United States Patent 8,461,315 (MICRORNAS AND USES THEREOF) - sequence listing, part 12

SEQ ID NO: 309368 - RNA, 64 nt, Homo Sapiens
gaccugcugacccagucugguuggugcagugugcuguccagagaugcguuuuuggugggcuuac

SEQ ID NO: 309369 - RNA, 64 nt, Homo Sapiens
gcaggaaggagaacggaugcccccugacgaagcuuguccagauggaccaccccagaucccacau

SEQ ID NO: 309370 - RNA, 64 nt, Homo Sapiens
aucccuguuuuugugaccaagcauugcccccgaauguccagauugcuuugcaauuccaggagcg

SEQ ID NO: 309371 - RNA, 64 nt, Homo Sapiens
caacuauuuccucuuuauuuucccucauugaaagaugcaaaacagcucucuauuguguacagaa

SEQ ID NO: 309372 - RNA, 64 nt, Homo Sapiens
aacagcucucuauuguguacagaaaggguaaauaaugcaaaauaccugguaguaaaauaaaugc

SEQ ID NO: 309373 - RNA, 64 nt, Homo Sapiens
gguuauuauuacauggugguggugguuuuauuauaugcaaaaucucugucuauuaugagauacu

SEQ ID NO: 309374 - RNA, 64 nt, Homo Sapiens
aagcacaguaauguguguuuuguucagcauuauuaugcaaaaauucacuaguugagaugguuug

SEQ ID NO: 309375 - RNA, 64 nt, Homo Sapiens
aaauauuggcaaacaauacaucaacagaugcaaaaugcaaaauauuuuuagaaggauuuuauuc

SEQ ID NO: 309376 - RNA, 64 nt, Homo Sapiens
caaaauaaaauauuggcaaauuuauucucaacagaugcaaaaugaaagacauuuuuagaaggau

SEQ ID NO: 309377 - RNA, 64 nt, Homo Sapiens
ccuauuuuaaaaucacugugcuuucaugcaaggcaugcaaaaagaacagguuuguauguagcac

SEQ ID NO: 309378 - RNA, 64 nt, Homo Sapiens
aauucaguuuauaagauaaaagccaauuauuuugaugcaaaagaugauacuuuuuuuuucuuaa

SEQ ID NO: 309379 - RNA, 64 nt, Homo Sapiens
gaaccaucagcaucacccgggaacuuuuuuagaaaugcaaaaucucuacugcuuuggauccugg

SEQ ID NO: 309380 - RNA, 64 nt, Homo Sapiens
ggauccugggucaaaaaaaagaaaaaaaaaagaaaugcaaaacuuuaggcccugccccagauuu

SEQ ID NO: 309381 - RNA, 50 nt, Homo Sapiens; identical to SEQ ID NO: 56892

SEQ ID NO: 309382 - RNA, 64 nt, Homo Sapiens
aguucccuaauauauucuuauauguagagcaauaaugcaaaagcuguucuauaugcaaacauga

SEQ ID NO: 309383 - RNA, 64 nt, Homo Sapiens
cuuuuuguaauguaguaucaaaguuuuuuagguaaugcaaaauuuuacaaaucauuuguggaau

SEQ ID NO: 309384 - RNA, 64 nt, Homo Sapiens
gaauuuuucaucaagaagguagcuugagccugaaaugcaaaacccauggaggaauucugaagcc

SEQ ID NO: 309385 - RNA, 64 nt, Homo Sapiens
acacuguuaucagaaauaggagaguggaugauagaugcaaaauaauaccuguccacaacaaacu

SEQ ID NO: 309386 - RNA, 64 nt, Homo Sapiens
aaaaauauacuuguauaugucacagagaaaaaaaaugcaaaauuuauaauagaguuacauuaac

SEQ ID NO: 309387 - RNA, 64 nt, Homo Sapiens
gaugcaacuuaaacuuuucuuugcaucaagguauaugcaaaacauuggugccgugcaucaccaa

SEQ ID NO: 309388 - RNA, 64 nt, Homo Sapiens
uuuucaacaaaauaguguuuauuuuucuuuuuaaaugcaaaaccuagugccuuggauuuuacau

SEQ ID NO: 309389 - RNA, 64 nt, Homo Sapiens
ccaaucuggcuucuagucucaacaagcauacacgaugcaaaauauucaggagcaaagauuuuca

SEQ ID NO: 309390 - RNA, 64 nt, Homo Sapiens
aaugagcuguaaccccuucacauugucacuguagaugcaaaacgguauguauugagugccuauu

SEQ ID NO: 309391 - RNA, 64 nt, Homo Sapiens
aaguauguauugagugccuauucauuuaucauucaugcaaaaaauggugguaauguaaaaucau

SEQ ID NO: 309392 - RNA, 64 nt, Homo Sapiens
gccacaaccacauacaacacaaagagaaaaagaaaugcaaaaaucucugcgugcagggacaaag

SEQ ID NO: 309393 - RNA, 64 nt, Homo Sapiens
gcaggagugagaggucucucuuccugauuuagauaugcaaaagcugguauguucaguaggaacu

SEQ ID NO: 309394 - RNA, 64 nt, Homo Sapiens
ccuaaggcaugugugaaacauacucauagauguuaugcaaaaaaaagucuauggccagguaugc

SEQ ID NO: 309395 - RNA, 64 nt, Homo Sapiens
guucuuguaagcuuuaacuauaucucucuuuaaaaugcaaaauaaugucuuaagauucaaaguc

SEQ ID NO: 309396 - RNA, 64 nt, Homo Sapiens
cuauaauucuaaauguuuaaaugcuuuucuaaaaaugcaaaacuaugauguuuaguugcuuuau

SEQ ID NO: 309397 - RNA, 64 nt, Homo Sapiens
aaagaauguagaaaagauacucagucuuaauccuaugcaaaaaaaaaaaucaaguaauuguuuu

SEQ ID NO: 309398 - RNA, 64 nt, Homo Sapiens
agcaggccauaacuuuauuugaguucucaagugaaugcaaaaggaacaaucuaaucaaaacugg

SEQ ID NO: 309399 - RNA, 64 nt, Homo Sapiens
aaaugcuuaaccaacacuacauauuaggauuaggaugcaaaaauguccuaaauucauagagugg

SEQ ID NO: 309400 - RNA, 64 nt, Homo Sapiens
guuuccccuuucacccaagugaugucacaguucgaugcaaaaucaaugauccagaaugaucgug

SEQ ID NO: 309401 - RNA, 64 nt, Homo Sapiens
aauaacucaaaguguuucuuaagggugaguuggcaugcaaaaaauuacauugauuacagugugu

SEQ ID NO: 309402 - RNA, 64 nt, Homo Sapiens
auucugauuacuuuagccuucaaaaucaguagcaaugcaaaaauauacucauuuuuaaauaauu

SEQ ID NO: 309403 - RNA, 64 nt, Homo Sapiens
uguauuuuccuguggcccauucugagcuccacaaaugcaaaagaacugucuccaacacauuguu

SEQ ID NO: 309404 - RNA, 64 nt, Homo Sapiens
gcuagcuugauuuuaaaaaauauaauguuuguauaugcaaaacugauucuuguauauuagcaau

SEQ ID NO: 309405 - RNA, 64 nt, Homo Sapiens
aaaagaaaagaaaaccacccgcaugauuuuuuuuaugcaaaaaggcugcuuccacacauuaaug

SEQ ID NO: 309406 - RNA, 64 nt, Homo Sapiens
uguagaaagaguuuaaaacccaaaaguauuuuuaaugcaaaaaacauaacuuuccucagauuuu

SEQ ID NO: 309407 - RNA, 64 nt, Homo Sapiens
uugucuauauauauuuguguaccuuuaaaaugguaugcaaaauuaauuauauuuccaaaaauga

SEQ ID NO: 309408 - RNA, 64 nt, Homo Sapiens
auucuuauggcggaguuuuuuuuuuuaaaaaaaaaugcaaaaaaagcgauguaagugucgaugu

SEQ ID NO: 309409 - RNA, 64 nt, Homo Sapiens
gcagcugaaauaauaccuuaguguguuugcagacaugcaaaacugugugugugugugugugugu

SEQ ID NO: 309410 - RNA, 64 nt, Homo Sapiens
aauggcacaggugaugccagaggugagacuguguaugcaaaaugaauuaguccgguaggauguc

SEQ ID NO: 309411 - RNA, 64 nt, Homo Sapiens
gcacacaucuguacucgucaaucaacaaaaccugaugcaaaaaacagaaaaggggugauguagg

SEQ ID NO: 309412 - RNA, 64 nt, Homo Sapiens
cugcacuaaagcuggcacucccccagccguucucaugcaaaauaccugugucagaauacuccuu

SEQ ID NO: 309413 - RNA, 64 nt, Homo Sapiens
uugcacuacaagaagaauguaguugugcaaaucuaugcaaaacugaugguggccugcuauuucc

SEQ ID NO: 309414 - RNA, 64 nt, Homo Sapiens
cauccagcugugugauauucugcugugcaaauccaugcaaaacugacugugguagugaaaaguc

SEQ ID NO: 309415 - RNA, 64 nt, Homo Sapiens
gacaucuuuaacauaguccuacuuuuuaugugcuaugcaaaauagaagaguaaacaggaaaccu

SEQ ID NO: 309416 - RNA, 64 nt, Homo Sapiens
aaccaaguccuccgaaggcaaauaaugagagcaaaugcaaaaauaacaucauuccaaaaagaac

SEQ ID NO: 309417 - RNA, 64 nt, Homo Sapiens
uuucaugguguuuucagggaacacagaaaugcggaugcaaaacaacuuuugacagaggcccauc

SEQ ID NO: 309418 - RNA, 64 nt, Homo Sapiens
gacaguuugcagaacacugauuugaaagcuuccuaugcaaaaugagaagggguucaaauauauu

SEQ ID NO: 309419 - RNA, 64 nt, Homo Sapiens
guuaaaaaaaaaaaaaaacaucaaagacccauuuaugcaaaaauuacaaaacugguuaccugua

SEQ ID NO: 309420 - RNA, 64 nt, Homo Sapiens
gguuuugugucauuaacugaugauaugucauaugaugcaaaaaaucaauaaguugauuuacuga

SEQ ID NO: 309421 - RNA, 64 nt, Homo Sapiens
uguaguuaaauuugaccucaguucaauguagacaaugcaaaauugaggcuuuuaagaaucaugu

SEQ ID NO: 309422 - RNA, 54 nt, Homo Sapiens; identical to SEQ ID NO: 56933

SEQ ID NO: 309423 - RNA, 64 nt, Homo Sapiens
uuaauuugucuuuauuuuuuaauuuuaaauuuuaaugcaaaauugccgaagaggaauaugguau

SEQ ID NO: 309424 - RNA, 64 nt, Homo Sapiens
gucuuuuccuagcuuccuggaaggaguuccacugaugcaaaagguaugacuuguggaaagcuuc

SEQ ID NO: 309425 - RNA, 64 nt, Homo Sapiens
gaaaaaaaaaaaaggugacaucaaaagguaggaaaugcaaaaaauauaaauauauauauauaug

SEQ ID NO: 309426 - RNA, 64 nt, Homo Sapiens
gaaaacacacacaaccaauauggacauauuucuuaugcaaaaaggcaagagccucuggacuaaa

SEQ ID NO: 309427 - RNA, 64 nt, Homo Sapiens
guuuuuuuuugaagugaauucuuuugaaaaaaaaaugcaaaacuagaaaacuuuauucauuuua

SEQ ID NO: 309428 - RNA, 64 nt, Homo Sapiens
aauuaacaucugcauaauuucacuuaaaauuauuaugcaaaaaugaauguuuuuucaaaaaaug

SEQ ID NO: 309429 - RNA, 64 nt, Homo Sapiens
uugguguggcugcaaauuuccugaauacuaccucaugcaaaauauccuuauuucuuauucagug

SEQ ID NO: 309430 - RNA, 64 nt, Homo Sapiens
ggauuuauuuucuuaaguuuguuagagcacuagaaugcaaaagacacagagagaaggccuagag

SEQ ID NO: 309431 - RNA, 64 nt, Homo Sapiens
aauuccuuuuagcaaccugaaaccaaaagaggaaauacuuuaaacucugaucagguacuacauc

SEQ ID NO: 309432 - RNA, 64 nt, Homo Sapiens
uuuguaacuuuaaggucuaaugccugagauagaaauacuuuauucuuuuaagaaauuaaauacu

SEQ ID NO: 309433 - RNA, 64 nt, Homo Sapiens
agccauaguacaugagcuuaugagaauuucacagauacuuuauauuugcagggaaucauggagc

SEQ ID NO: 309434 - RNA, 64 nt, Homo Sapiens
uuuucaguuuuuugcagggauaaagaaggugucuauacuuuagauuuuaucagugguucauugu

SEQ ID NO: 309435 - RNA, 64 nt, Homo Sapiens
guuucacaauuugacuagauggacuuuuugguaaauacuuuaguggcauuucacugucaaauau

SEQ ID NO: 309436 - RNA, 64 nt, Homo Sapiens
acuggcuuuaaaacuguaacacaucacauaaaagauacuuuaccagguauguauugcauuauau

SEQ ID NO: 309437 - RNA, 64 nt, Homo Sapiens
agauuggaagagggauaagaaaugaaagauccugauacuuuagguuuuucccuuuccucuauuu

SEQ ID NO: 309438 - RNA, 64 nt, Homo Sapiens
uuucagaagcauaauaaaguucacaauaaggauaauacuuuauauaauguauaaaguauauaua

SEQ ID NO: 309439 - RNA, 64 nt, Homo Sapiens
auaagaaauauaaccuuuuaaaguguauguuuuuauacuuuaaauauagauagguuuagccuuu

SEQ ID NO: 309440 - RNA, 64 nt, Homo Sapiens
aagcccacuaaagauaacuacugauuaguugucaauacuuuagcauaagaguauuuagaggaca

SEQ ID NO: 309441 - RNA, 64 nt, Homo Sapiens
uggauauucauguaauauauaauuuaaaaaaaaaauacuuuacuuauuauguuccuguguguug

SEQ ID NO: 309442 - RNA, 64 nt, Homo Sapiens
ugguugaagaugaaaucauuauggucuuaaaaagauacuuuauguugcaaugacaagagguuuc

SEQ ID NO: 309443 - RNA, 64 nt, Homo Sapiens
uuuuucagcagaaauuaugcuauagauacccauuauacuuuaaaugccuuaaguuauaguuaug

SEQ ID NO: 309444 - RNA, 64 nt, Homo Sapiens
gauguaugguuagaguccaacgaaaugugagacuauacuuuaaaaucucucuugggcuuccucc

SEQ ID NO: 309445 - RNA, 64 nt, Homo Sapiens
auuuagaccaauauucuagacacauauauuaagaauacuuuaugugaugaaauauuugaacugu

SEQ ID NO: 309446 - RNA, 64 nt, Homo Sapiens
gguuugugaauuuuauacaauccauggugucuuuauacuuuacuggggcagaguuaaccauuuc

SEQ ID NO: 309447 - RNA, 64 nt, Homo Sapiens
gauucauuauuacaaaaauaaaauacacauugaaauacuuuaauaauguugcgauggauugcca

SEQ ID NO: 309448 - RNA, 64 nt, Homo Sapiens
uggaagcacuggguugaacuugcuaaaguaaaucauacuuuagaaucucuucagggaaugugac

SEQ ID NO: 309449 - RNA, 64 nt, Homo Sapiens
augauagaaguccaaccguuuuugaaaauuuuauauacuuuauaaagcaaaauuguuccuuuuu

SEQ ID NO: 309450 - RNA, 64 nt, Homo Sapiens
cucucugaaauguaugacaccucugugagaauguauacuuuaugggcaacuuuugaacuccugu

SEQ ID NO: 309451 - RNA, 64 nt, Homo Sapiens
cugaaauuauaauuuuuuguuucuaugaguuugaauacuuuagauaccuuguugccaugguuug

SEQ ID NO: 309452 - RNA, 64 nt, Homo Sapiens
aauuuuuuaauuuuauauuauuauuauuauuauuauacuuuaagguuuaggguacaugugcaca

SEQ ID NO: 309453 - RNA, 64 nt, Homo Sapiens
ucgaucuuuaugcuguuauuacaggagaagugacauacuuuauauauguuuauauuagcaaggu

SEQ ID NO: 309454 - RNA, 64 nt, Homo Sapiens
uguuuauauuagcaaggucuguuuuuaauaccauauacuuuauauuucuauacauuuauauuuc

SEQ ID NO: 309455 - RNA, 64 nt, Homo Sapiens
uuaacuugaacauggcguguuuaaauuuucauacauacuuuacuugaauuauugcuguugucac

SEQ ID NO: 309456 - RNA, 64 nt, Homo Sapiens
acuggaaagauuuauuaaagaauuauauuuguguauacuuuauaaauuagucccucauuagauu

SEQ ID NO: 309457 - RNA, 64 nt, Homo Sapiens
aauaaaguuccaaguuacacggaaaauuuucagaauacuuuaaaagguggugguuaaaauucuu

SEQ ID NO: 309458 - RNA, 64 nt, Homo Sapiens
uuugacccaugccuuuuuaauaagugauacuacuauacuuuauuauucugagacuuuauuugcg

SEQ ID NO: 309459 - RNA, 64 nt, Homo Sapiens
aaccauuaccuguaccuggcugaaaggguuuguaauacuuuacauucuagacagaguugcuuaa

SEQ ID NO: 309460 - RNA, 64 nt, Homo Sapiens
gaaaggggacaccuguacauauaaacauauuuuuauacuuuauuuuauugugacuucacuguau

SEQ ID NO: 309461 - RNA, 64 nt, Homo Sapiens
gcuaaaaauacuaauaaugagaaauuauauaaaaauacuuuauugcuccauuauuuuuuaaaaa

SEQ ID NO: 309462 - RNA, 64 nt, Homo Sapiens
uuuaaaacacuugaugcuggaggaaacaaggcacauacuuuaauuguaaaaugguguuaugucu

SEQ ID NO: 309463 - RNA, 64 nt, Homo Sapiens
uacccauacguauauuuuauucuaguauguguguauacuuuauuaauuucuccauugaugaauc

SEQ ID NO: 309464 - RNA, 64 nt, Homo Sapiens
agcacacuggcucgcgguuuugugucuuugaugcauacuuuagaauuuuguauguuuuuuuaaa

SEQ ID NO: 309465 - RNA, 64 nt, Homo Sapiens
uucuaggcuauaacucagacuauuuuuacaauucauacuuuaauuacuucuguauacauuuaca

SEQ ID NO: 309466 - RNA, 64 nt, Homo Sapiens
aaacaguccuuauucagaaacauaaaaaguacuuauacuuuagagaauaggagacaguaguagc

SEQ ID NO: 309467 - RNA, 64 nt, Homo Sapiens
uuuugacuauccaauuuagauguguaauuucuauauacuuuaugcuguuuauauuucagucauu

SEQ ID NO: 309468 - RNA, 64 nt, Homo Sapiens
uuuaaagucagaauaguacagauugcugaguauuauacuuuaggcuagauuaauuaaaauugaa

SEQ ID NO: 309469 - RNA, 64 nt, Homo Sapiens; identical to SEQ ID NO: 70765

SEQ ID NO: 309470 - RNA, 64 nt, Homo Sapiens; identical to SEQ ID NO: 70766

SEQ ID NO: 309471 - RNA, 64 nt, Homo Sapiens; identical to SEQ ID NO: 70767

SEQ ID NO: 309472 - RNA, 64 nt, Homo Sapiens; identical to SEQ ID NO: 70768

SEQ ID NO: 309473 - RNA, 64 nt, Homo Sapiens; identical to SEQ ID NO: 70769

SEQ ID NO: 309474 - RNA, 64 nt, Homo Sapiens; identical to SEQ ID NO: 70770

SEQ ID NO: 309475 - RNA, 64 nt, Homo Sapiens; identical to SEQ ID NO: 70771

SEQ ID NO: 309476 - RNA, 64 nt, Homo Sapiens; identical to SEQ ID NO: 70772

SEQ ID NO: 309477 - RNA, 64 nt, Homo Sapiens; identical to SEQ ID NO: 70773

SEQ ID NO: 309478 - RNA, 64 nt, Homo Sapiens; identical to SEQ ID NO: 70774

SEQ ID NO: 309479 - RNA, 64 nt, Homo Sapiens; identical to SEQ ID NO: 70775

SEQ ID NO: 309480 - RNA, 64 nt, Homo Sapiens; identical to SEQ ID NO: 70776

SEQ ID NO: 309481 - RNA, 64 nt, Homo Sapiens; identical to SEQ ID NO: 70777

SEQ ID NO: 309482 - RNA, 64 nt, Homo Sapiens; identical to SEQ ID NO: 70778

SEQ ID NO: 309483 - RNA, 64 nt, Homo Sapiens; identical to SEQ ID NO: 70779

SEQ ID NO: 309484 - RNA, 64 nt, Homo Sapiens; identical to SEQ ID NO: 70780

SEQ ID NO: 309485 - RNA, 64 nt, Homo Sapiens; identical to SEQ ID NO: 70781

SEQ ID NO: 309486 - RNA, 64 nt, Homo Sapiens; identical to SEQ ID NO: 70782

SEQ ID NO: 309487 - RNA, 64 nt, Homo Sapiens; identical to SEQ ID NO: 70783

SEQ ID NO: 309488 - RNA, 64 nt, Homo Sapiens; identical to SEQ ID NO: 70784

SEQ ID NO: 309489 - RNA, 64 nt, Homo Sapiens; identical to SEQ ID NO: 70785

SEQ ID NO: 309490 - RNA, 64 nt, Homo Sapiens; identical to SEQ ID NO: 70786

SEQ ID NO: 309491 - RNA, 64 nt, Homo Sapiens; identical to SEQ ID NO: 70787

SEQ ID NO: 309492 - RNA, 64 nt, Homo Sapiens; identical to SEQ ID NO: 70788

SEQ ID NO: 309493 - RNA, 64 nt, Homo Sapiens; identical to SEQ ID NO: 70789

SEQ ID NO: 309494 - RNA, 64 nt, Homo Sapiens; identical to SEQ ID NO: 70790

SEQ ID NO: 309495 - RNA, 64 nt, Homo Sapiens; identical to SEQ ID NO: 70791

SEQ ID NO: 309496 - RNA, 64 nt, Homo Sapiens; identical to SEQ ID NO: 70792

SEQ ID NO: 309497 - RNA, 64 nt, Homo Sapiens; identical to SEQ ID NO: 70793

SEQ ID NO: 309498 - RNA, 64 nt, Homo Sapiens; identical to SEQ ID NO: 70794

SEQ ID NO: 309499 - RNA, 64 nt, Homo Sapiens; identical to SEQ ID NO: 70795

SEQ ID NO: 309500 - RNA, 64 nt, Homo Sapiens; identical to SEQ ID NO: 70796

SEQ ID NO: 309501 - RNA, 64 nt, Homo Sapiens; identical to SEQ ID NO: 70797

SEQ ID NO: 309502 - RNA, 64 nt, Homo Sapiens; identical to SEQ ID NO: 70798

SEQ ID NO: 309503 - RNA, 64 nt, Homo Sapiens; identical to SEQ ID NO: 70799

SEQ ID NO: 309504 - RNA, 64 nt, Homo Sapiens; identical to SEQ ID NO: 70800

SEQ ID NO: 309505 - RNA, 64 nt, Homo Sapiens; identical to SEQ ID NO: 70801

SEQ ID NO: 309506 - RNA, 64 nt, Homo Sapiens; identical to SEQ ID NO: 70802

SEQ ID NO: 309507 - RNA, 64 nt, Homo Sapiens; identical to SEQ ID NO: 70803

SEQ ID NO: 309508 - RNA, 64 nt, Homo Sapiens; identical to SEQ ID NO: 70804

SEQ ID NO: 309509 - RNA, 64 nt, Homo Sapiens; identical to SEQ ID NO: 70805

SEQ ID NO: 309510 - RNA, 64 nt, Homo Sapiens; identical to SEQ ID NO: 70806

SEQ ID NO: 309511 - RNA, 64 nt, Homo Sapiens; identical to SEQ ID NO: 70807

SEQ ID NO: 309512 - RNA, 64 nt, Homo Sapiens; identical to SEQ ID NO: 70808

SEQ ID NO: 309513 - RNA, 64 nt, Homo Sapiens; identical to SEQ ID NO: 70809

SEQ ID NO: 309514 - RNA, 64 nt, Homo Sapiens; identical to SEQ ID NO: 70810

SEQ ID NO: 309515 - RNA, 64 nt, Homo Sapiens; identical to SEQ ID NO: 70811

SEQ ID NO: 309516 - RNA, 64 nt, Homo Sapiens; identical to SEQ ID NO: 70812

SEQ ID NO: 309517 - RNA, 64 nt, Homo Sapiens; identical to SEQ ID NO: 70813

SEQ ID NO: 309518 - RNA, 64 nt, Homo Sapiens; identical to SEQ ID NO: 70814

SEQ ID NO: 309519 - RNA, 64 nt, Homo Sapiens; identical to SEQ ID NO: 70814

SEQ ID NO: 309520 - RNA, 64 nt, Homo Sapiens; identical to SEQ ID NO: 70816

SEQ ID NO: 309521 - RNA, 64 nt, Homo Sapiens; identical to SEQ ID NO: 70817

SEQ ID NO: 309522 - RNA, 64 nt, Homo Sapiens; identical to SEQ ID NO: 70818

SEQ ID NO: 309523 - RNA, 64 nt, Homo Sapiens; identical to SEQ ID NO: 70819

SEQ ID NO: 309524 - RNA, 64 nt, Homo Sapiens; identical to SEQ ID NO: 70820

SEQ ID NO: 309525 - RNA, 64 nt, Homo Sapiens; identical to SEQ ID NO: 70821

SEQ ID NO: 309526 - RNA, 64 nt, Homo Sapiens; identical to SEQ ID NO: 70822

SEQ ID NO: 309527 - RNA, 64 nt, Homo Sapiens; identical to SEQ ID NO: 70823

SEQ ID NO: 309528 - RNA, 64 nt, Homo Sapiens; identical to SEQ ID NO: 70824

SEQ ID NO: 309529 - RNA, 64 nt, Homo Sapiens; identical to SEQ ID NO: 70825

SEQ ID NO: 309530 - RNA, 64 nt, Homo Sapiens; identical to SEQ ID NO: 70826

SEQ ID NO: 309531 - RNA, 64 nt, Homo Sapiens; identical to SEQ ID NO: 70827

SEQ ID NO: 309532 - RNA, 64 nt, Homo Sapiens; identical to SEQ ID NO: 70828

SEQ ID NO: 309533 - RNA, 64 nt, Homo Sapiens; identical to SEQ ID NO: 70829

SEQ ID NO: 309534 - RNA, 64 nt, Homo Sapiens
agccauaaauguaugauauuagugcccaugaugcagcagcuaauuucaaaccuaccacugcaug

SEQ ID NO: 309535 - RNA, 64 nt, Homo Sapiens
acuuugguaacaauccaaagacccugagggucugagcagcuagaaguccuagacaaagaacuug

SEQ ID NO: 309536 - RNA, 64 nt, Homo Sapiens
acuaaaacuauuacucaucagucauucacugaucagcagcuaaaguccaugagaccaaaugguu

SEQ ID NO: 309537 - RNA, 64 nt, Homo Sapiens
guugcuucgaucuucagccacaugcuguccuugaagcagcuauuugaagauguguuuucugagg

SEQ ID NO: 309538 - RNA, 64 nt, Homo Sapiens
guuccaagauuucaaaguggugaaaugaaaauggagcagcuaguauguuuuauuauuuuauggg

SEQ ID NO: 309539 - RNA, 64 nt, Homo Sapiens
cuguugcuacacuauuauaggcauguuugauacuagcagcuaacacuggucacuccaaagcacu

SEQ ID NO: 309540 - RNA, 64 nt, Homo Sapiens
agcagaggcugaacaccugccuccgagguggagcagcagcuacaccggagcccccagcagggcc

SEQ ID NO: 309541 - RNA, 64 nt, Homo Sapiens
agcagaggcugaacaccugccuccgagguggaacagcagcuacaccggagcccccagcagggcc

SEQ ID NO: 309542 - RNA, 64 nt, Homo Sapiens; identical to SEQ ID NO: 249425

SEQ ID NO: 309543 - RNA, 64 nt, Homo Sapiens; identical to SEQ ID NO: 249426

SEQ ID NO: 309544 - RNA, 64 nt, Homo Sapiens; identical to SEQ ID NO: 249427

SEQ ID NO: 309545 - RNA, 64 nt, Homo Sapiens; identical to SEQ ID NO: 249428

SEQ ID NO: 309546 - RNA, 64 nt, Homo Sapiens; identical to SEQ ID NO: 249429

SEQ ID NO: 309547 - RNA, 64 nt, Homo Sapiens; identical to SEQ ID NO: 249430

SEQ ID NO: 309548 - RNA, 64 nt, Homo Sapiens; identical to SEQ ID NO: 249431

SEQ ID NO: 309549 - RNA, 64 nt, Homo Sapiens; identical to SEQ ID NO: 249432

SEQ ID NO: 309550 - RNA, 64 nt, Homo Sapiens; identical to SEQ ID NO: 249433

SEQ ID NO: 309551 - RNA, 64 nt, Homo Sapiens; identical to SEQ ID NO: 249434

SEQ ID NO: 309552 - RNA, 64 nt, Homo Sapiens; identical to SEQ ID NO: 249435

SEQ ID NO: 309553 - RNA, 64 nt, Homo Sapiens; identical to SEQ ID NO: 249436

SEQ ID NO: 309554 - RNA, 64 nt, Homo Sapiens; identical to SEQ ID NO: 249437

SEQ ID NO: 309555 - RNA, 64 nt, Homo Sapiens; identical to SEQ ID NO: 249438

SEQ ID NO: 309556 - RNA, 64 nt, Homo Sapiens; identical to SEQ ID NO: 249439

SEQ ID NO: 309557 - RNA, 64 nt, Homo Sapiens; identical to SEQ ID NO: 249440

SEQ ID NO: 309558 - RNA, 64 nt, Homo Sapiens; identical to SEQ ID NO: 249441

SEQ ID NO: 309559 - RNA, 64 nt, Homo Sapiens; identical to SEQ ID NO: 249442

SEQ ID NO: 309560 - RNA, 64 nt, Homo Sapiens; identical to SEQ ID NO: 249443

SEQ ID NO: 309561 - RNA, 64 nt, Homo Sapiens; identical to SEQ ID NO: 249444

SEQ ID NO: 309562 - RNA, 64 nt, Homo Sapiens; identical to SEQ ID NO: 249445

SEQ ID NO: 309563 - RNA, 64 nt, Homo Sapiens; identical to SEQ ID NO: 249446

SEQ ID NO: 309564 - RNA, 64 nt, Homo Sapiens; identical to SEQ ID NO: 249447

SEQ ID NO: 309565 - RNA, 64 nt, Homo Sapiens; identical to SEQ ID NO: 249448

SEQ ID NO: 309566 - RNA, 64 nt, Homo Sapiens; identical to SEQ ID NO: 249449

SEQ ID NO: 309567 - RNA, 64 nt, Homo Sapiens; identical to SEQ ID NO: 249450

SEQ ID NO: 309568 - RNA, 64 nt, Homo Sapiens; identical to SEQ ID NO: 249451

SEQ ID NO: 309569 - RNA, 64 nt, Homo Sapiens; identical to SEQ ID NO: 249452

SEQ ID NO: 309570 - RNA, 64 nt, Homo Sapiens; identical to SEQ ID NO: 249453

SEQ ID NO: 309571 - RNA, 64 nt, Homo Sapiens; identical to SEQ ID NO: 249454

SEQ ID NO: 309572 - RNA, 64 nt, Homo Sapiens; identical to SEQ ID NO: 249455

SEQ ID NO: 309573 - RNA, 64 nt, Homo Sapiens; identical to SEQ ID NO: 249456

SEQ ID NO: 309574 - RNA, 64 nt, Homo Sapiens; identical to SEQ ID NO: 249457

SEQ ID NO: 309575 - RNA, 64 nt, Homo Sapiens; identical to SEQ ID NO: 249458

SEQ ID NO: 309576 - RNA, 64 nt, Homo Sapiens; identical to SEQ ID NO: 249459

SEQ ID NO: 309577 - RNA, 64 nt, Homo Sapiens; identical to SEQ ID NO: 249460

SEQ ID NO: 309578 - RNA, 64 nt, Homo Sapiens; identical to SEQ ID NO: 249461

SEQ ID NO: 309579 - RNA, 64 nt, Homo Sapiens; identical to SEQ ID NO: 249462

SEQ ID NO: 309580 - RNA, 64 nt, Homo Sapiens; identical to SEQ ID NO: 249463

SEQ ID NO: 309581 - RNA, 64 nt, Homo Sapiens; identical to SEQ ID NO: 249464

SEQ ID NO: 309582 - RNA, 64 nt, Homo Sapiens; identical to SEQ ID NO: 249465

SEQ ID NO: 309583 - RNA, 64 nt, Homo Sapiens; identical to SEQ ID NO: 249466

SEQ ID NO: 309584 - RNA, 64 nt, Homo Sapiens; identical to SEQ ID NO: 249467

SEQ ID NO: 309585 - RNA, 64 nt, Homo Sapiens; identical to SEQ ID NO: 249468

SEQ ID NO: 309586 - RNA, 64 nt, Homo Sapiens; identical to SEQ ID NO: 249469

SEQ ID NO: 309587 - RNA, 64 nt, Homo Sapiens; identical to SEQ ID NO: 249470

SEQ ID NO: 309588 - RNA, 64 nt, Homo Sapiens; identical to SEQ ID NO: 249471

SEQ ID NO: 309589 - RNA, 64 nt, Homo Sapiens; identical to SEQ ID NO: 249472

SEQ ID NO: 309590 - RNA, 64 nt, Homo Sapiens; identical to SEQ ID NO: 249473

SEQ ID NO: 309591 - RNA, 64 nt, Homo Sapiens; identical to SEQ ID NO: 249474

SEQ ID NO: 309592 - RNA, 64 nt, Homo Sapiens; identical to SEQ ID NO: 249475

SEQ ID NO: 309593 - RNA, 64 nt, Homo Sapiens; identical to SEQ ID NO: 249476

SEQ ID NO: 309594 - RNA, 64 nt, Homo Sapiens; identical to SEQ ID NO: 249477

SEQ ID NO: 309595 - RNA, 64 nt, Homo Sapiens; identical to SEQ ID NO: 249478

SEQ ID NO: 309596 - RNA, 64 nt, Homo Sapiens; identical to SEQ ID NO: 249479

SEQ ID NO: 309597 - RNA, 64 nt, Homo Sapiens; identical to SEQ ID NO: 249480

SEQ ID NO: 309598 - RNA, 64 nt, Homo Sapiens; identical to SEQ ID NO: 249481

SEQ ID NO: 309599 - RNA, 64 nt, Homo Sapiens; identical to SEQ ID NO: 249482

SEQ ID NO: 309600 - RNA, 64 nt, Homo Sapiens; identical to SEQ ID NO: 249483

SEQ ID NO: 309601 - RNA, 64 nt, Homo Sapiens; identical to SEQ ID NO: 249484

SEQ ID NO: 309602 - RNA, 63 nt, Homo Sapiens
acuacacaaaauuuuauuuaaagagaacacuuagcagccuaugauaguuuucaauaaaauguu

SEQ ID NO: 309603 - RNA, 63 nt, Homo Sapiens
uugggucgcguaguugcugaaaccuaaguaccugcagccuacaggauaaggaaguucacagcc

SEQ ID NO: 309604 - RNA, 63 nt, Homo Sapiens
gggguuggccaguuggagccugggucagccucagcagccuauccccauguccucuaugccccu

SEQ ID NO: 309605 - RNA, 63 nt, Homo Sapiens
ggccccucgggggauuggggggacuggggaggcgcagccuagacccaauugcuugcccccaug

SEQ ID NO: 309606 - RNA, 63 nt, Homo Sapiens
aaggcuuucccaggaugcacguccucagagggagcagccuaucucccccaagcuggaggcggc

SEQ ID NO: 309607 - RNA, 63 nt, Homo Sapiens
auuuuuaagugugugaggagaugcucaguagcagcagccuauggcaagagcuuauaaaugauu

SEQ ID NO: 309608 - RNA, 64 nt, Homo Sapiens; identical to SEQ ID NO: 229370

SEQ ID NO: 309609 - RNA, 64 nt, Homo Sapiens; identical to SEQ ID NO: 229371

SEQ ID NO: 309610 - RNA, 64 nt, Homo Sapiens; identical to SEQ ID NO: 229372

SEQ ID NO: 309611 - RNA, 64 nt, Homo Sapiens; identical to SEQ ID NO: 229373

SEQ ID NO: 309612 - RNA, 64 nt, Homo Sapiens; identical to SEQ ID NO: 229374

SEQ ID NO: 309613 - RNA, 64 nt, Homo Sapiens; identical to SEQ ID NO: 229375

SEQ ID NO: 309614 - RNA, 64 nt, Homo Sapiens; identical to SEQ ID NO: 44480

SEQ ID NO: 309615 - RNA, 64 nt, Homo Sapiens; identical to SEQ ID NO: 44481

SEQ ID NO: 309616 - RNA, 64 nt, Homo Sapiens; identical to SEQ ID NO: 44482

SEQ ID NO: 309617 - RNA, 64 nt, Homo Sapiens; identical to SEQ ID NO: 44483

SEQ ID NO: 309618 - RNA, 64 nt, Homo Sapiens; identical to SEQ ID NO: 44484

SEQ ID NO: 309619 - RNA, 64 nt, Homo Sapiens; identical to SEQ ID NO: 44485

SEQ ID NO: 309620 - RNA, 64 nt, Homo Sapiens; identical to SEQ ID NO: 44486

SEQ ID NO: 309621 - RNA, 64 nt, Homo Sapiens; identical to SEQ ID NO: 44487

SEQ ID NO: 309622 - RNA, 64 nt, Homo Sapiens; identical to SEQ ID NO: 44488

SEQ ID NO: 309623 - RNA, 64 nt, Homo Sapiens; identical to SEQ ID NO: 44489

SEQ ID NO: 309624 - RNA, 64 nt, Homo Sapiens; identical to SEQ ID NO: 44490

SEQ ID NO: 309625 - RNA, 64 nt, Homo Sapiens; identical to SEQ ID NO: 44491

SEQ ID NO: 309626 - RNA, 64 nt, Homo Sapiens; identical to SEQ ID NO: 44492

SEQ ID NO: 309627 - RNA, 64 nt, Homo Sapiens; identical to SEQ ID NO: 44493

SEQ ID NO: 309628 - RNA, 64 nt, Homo Sapiens; identical to SEQ ID NO: 44494

SEQ ID NO: 309629 - RNA, 64 nt, Homo Sapiens; identical to SEQ ID NO: 44495

SEQ ID NO: 309630 - RNA, 64 nt, Homo Sapiens; identical to SEQ ID NO: 44496

SEQ ID NO: 309631 - RNA, 64 nt, Homo Sapiens; identical to SEQ ID NO: 44497

SEQ ID NO: 309632 - RNA, 64 nt, Homo Sapiens; identical to SEQ ID NO: 44498

SEQ ID NO: 309633 - RNA, 64 nt, Homo Sapiens; identical to SEQ ID NO: 44499

SEQ ID NO: 309634 - RNA, 64 nt, Homo Sapiens
ccacacccuuccuccuuccccugcccacagaggcagagggcacaggaaagaagccgggccaagc

SEQ ID NO: 309635 - RNA, 64 nt, Homo Sapiens
agagaagaggccccggcauggggaucuggguucuagagggcaugugaugacuguaaauguucac

SEQ ID NO: 309636 - RNA, 64 nt, Homo Sapiens
aaagauugugugucaccccuguuuauucuugaacagagggcaaagagggcacugggcacuucuc

SEQ ID NO: 309637 - RNA, 64 nt, Homo Sapiens
gugucaccccuguuuauucuugaacagagggcaaagagggcacugggcacuucucacaaacuuu

SEQ ID NO: 309638 - RNA, 64 nt, Homo Sapiens
gaagaggaggggugucuaggagagggcacaggagagagggcagaaaccaacaggggcugaggag

SEQ ID NO: 309639 - RNA, 64 nt, Homo Sapiens
ggagagagggcagagaagagcaggggcugaggagagagggcacagcaucucagccuggaaccaa

SEQ ID NO: 309640 - RNA, 64 nt, Homo Sapiens
cacccccaugcucuguggccuucuuacacuucucagagggcagaguggcagccgggcacccuac

SEQ ID NO: 309641 - RNA, 64 nt, Homo Sapiens
ggcagaguggcagccgggcacccuacagaaacucagagggcagaguggcagccaggcccacaug

SEQ ID NO: 309642 - RNA, 64 nt, Homo Sapiens
uggaggauggggaagguuugcagagagaggaagaagagggcaggguggggaggagcucugggcc

SEQ ID NO: 309643 - RNA, 64 nt, Homo Sapiens
gacaugggcccgggcccgguguggggguagacgcagagggcagaggguagcccuugguacugug

SEQ ID NO: 309644 - RNA, 64 nt, Homo Sapiens
ggcaguugaagggaacaugauggacugcugagugagagggcaggaaugaagggacaaagucaac

SEQ ID NO: 309645 - RNA, 64 nt, Homo Sapiens
ggaagacaauauagcagauuggaguccuugaagcagagggcacugagaaacaagcagaauucca

SEQ ID NO: 309646 - RNA, 64 nt, Homo Sapiens
guacagccuggcaaaaguuacuaguccuaccacuagagggcaugugcaccacaauugugauguc

SEQ ID NO: 309647 - RNA, 64 nt, Homo Sapiens
gaggugauagauggauauagagcauugggaagacagagggcaagaaggaagaccagaugggcuu

SEQ ID NO: 309648 - RNA, 64 nt, Homo Sapiens
aggaagcccacaggcggauguuccccacuugccuagagggcaucccucugggguagcgacagac

SEQ ID NO: 309649 - RNA, 64 nt, Homo Sapiens
aggugccugugggugaacugaggggaguagagggagagggcagguggaacuggggcagaaucua

SEQ ID NO: 309650 - RNA, 64 nt, Homo Sapiens
ugagaggacagaggcggugggacagccuggccacagagggcaaggacugugccggagucccugg

SEQ ID NO: 309651 - RNA, 64 nt, Homo Sapiens
ugaggacgggccacccuggcaccggaaggccagcagagggcacuguccgccagggcugggcagg

SEQ ID NO: 309652 - RNA, 64 nt, Homo Sapiens
gcuaaauaaauuaaucacuauuauuacuguggggagagggcaguggcauuauguacagugcuuu

SEQ ID NO: 309653 - RNA, 64 nt, Homo Sapiens
agaggacgaaaugccuuugggagcccacccgugcagagggcagagcggugggaagugaugcaga

SEQ ID NO: 309654 - RNA, 64 nt, Homo Sapiens
aagaggaaaguaucaggccuuugagaugugcuggagagggcagguugaaucuuauguaagaggc

SEQ ID NO: 309655 - RNA, 64 nt, Homo Sapiens
gggucaugaauccuuacccagguggaaguauuucagagggcauaccccuguguaaacaacucaa

SEQ ID NO: 309656 - RNA, 64 nt, Homo Sapiens
gcaagaacugcacugcaucuagagggcaagacggagagggcagaggccugugccagcaccaggc

SEQ ID NO: 309657 - RNA, 64 nt, Homo Sapiens
acggagagggcagagcaagaugccagcaccaggcagagggcaagcucccgccuggaagggccug

SEQ ID NO: 309658 - RNA, 64 nt, Homo Sapiens
cuacgguguaugguucugugccaauguauugauaagagggcacacacuguguacaguaaauggc

SEQ ID NO: 309659 - RNA, 64 nt, Homo Sapiens
ugauaagaccaccaccucagaguauggagcucagagagggcaggcaugaaguuuccuuggcugg

SEQ ID NO: 309660 - RNA, 64 nt, Homo Sapiens
ggaucugaggacaaggaaauggacagcaaugcagagagggcauaucuuuggaugcugucuucga

SEQ ID NO: 309661 - RNA, 64 nt, Homo Sapiens
gcacauggcccccagaggcuugagcagagauggcagagggcagagugugaacaugggggaacaa

SEQ ID NO: 309662 - RNA, 64 nt, Homo Sapiens
aggagagagcgccuccagucguauccccuggaguagagggcaagccugguuuuuuagggagaug

SEQ ID NO: 309663 - RNA, 64 nt, Homo Sapiens
gagaaggaaguacccugggggacccaggcugcuaagagggcaagaccuuggguaagucgcgccu

SEQ ID NO: 309664 - RNA, 64 nt, Homo Sapiens
ucugcacauaggcaguagccuccuccugggcuccagagggcacucagaaguugugcuaaaccaa

SEQ ID NO: 309665 - RNA, 64 nt, Homo Sapiens
cgugcagaaccagcacuaagguggacagcagacaagagggcaagccucuaguguaccaagugcu

SEQ ID NO: 309666 - RNA, 64 nt, Homo Sapiens
acccccucccccugggggcaaaucaggacacaacagagggcagaggccccauuagcuuuaaaau

SEQ ID NO: 309667 - RNA, 64 nt, Homo Sapiens
gucaccuccugacaugcgcucugggaaagguggcagagggcaggacaccaugagcucaggaucu

SEQ ID NO: 309668 - RNA, 64 nt, Homo Sapiens
ucucccaugcugggcauccuaggccacuuugcuuagagggcauuaaaggugccaugaaagguag

SEQ ID NO: 309669 - RNA, 64 nt, Homo Sapiens
cugaagaacauucccagugccccuggcuaggggcagagggcacugccaggcuguguucaguuag

SEQ ID NO: 309670 - RNA, 63 nt, Homo Sapiens
aguguuagagcggagcccaaaggaaggaugggagcccuggagugggcaagaccaggccaccug

SEQ ID NO: 309671 - RNA, 63 nt, Homo Sapiens
ccaggugccuccucucagucaggcuucagagcagcccuggagacaggagggccauguuaaaag

SEQ ID NO: 309672 - RNA, 63 nt, Homo Sapiens
ccuauagaaacaccaguaccugaaagcacuguagcccuggaccugccuccuucccucggggcc

SEQ ID NO: 309673 - RNA, 63 nt, Homo Sapiens
ugccuuugcuuaagccaucuuugugguagaggggcccuggaauugcagcuguacugaggauga

SEQ ID NO: 309674 - RNA, 63 nt, Homo Sapiens
gggccucaagccugcagccacuggcuugauugggcccuggacguugagcccagauguuggagc

SEQ ID NO: 309675 - RNA, 63 nt, Homo Sapiens
gacagugaccugaucuccuccucaugaccuucugcccuggacaagcccccugaacuggauuug

SEQ ID NO: 309676 - RNA, 63 nt, Homo Sapiens
uggugguuuucccuuggccaggugacggguguggcccuggaugugacugggaugagggugagg

SEQ ID NO: 309677 - RNA, 63 nt, Homo Sapiens
ccuguuacgagcacauccagcuuccugcucacagcccuggagucacacaggaggccuguauga

SEQ ID NO: 309678 - RNA, 63 nt, Homo Sapiens
aggaugaagacacagagacagcgcaagggccaggcccuggaggcugcugcgaguugccuuaga

SEQ ID NO: 309679 - RNA, 63 nt, Homo Sapiens
cggaacacaccugcagucccuaggcugagcuuggcccuggacuggugcacucucaccccacug

SEQ ID NO: 309680 - RNA, 63 nt, Homo Sapiens
ggccugacaguggguuccuuuuucaaaaugggugcccuggaggccaucgugguccauggagcc

SEQ ID NO: 309681 - RNA, 63 nt, Homo Sapiens
gaggauggaugguuccaugacgauuccaacccagcccuggacuagauaggccauugcuuucac

SEQ ID NO: 309682 - RNA, 63 nt, Homo Sapiens
ggaggguguguacagggcaaggcaugaaagggugcccuggauaccuucauuucuuaucuacuu

SEQ ID NO: 309683 - RNA, 63 nt, Homo Sapiens
cagcuguuccacuugcacacgccaggcacugaggcccuggagaagcagagaacaaggacagag

SEQ ID NO: 309684 - RNA, 63 nt, Homo Sapiens
gugugugcuaaggcuccguccugacugcccugugcccuggaaaagcagcaauagcauccgccc

SEQ ID NO: 309685 - RNA, 63 nt, Homo Sapiens
acuuaggugacaggaacuuccgcaccuccugaggcccuggaugauucuaauuguuagaaauuc

SEQ ID NO: 309686 - RNA, 63 nt, Homo Sapiens
ugccucaccuccagcugucagagggugagcagggcccuggaggcaggcacccccuccuccucc

SEQ ID NO: 309687 - RNA, 63 nt, Homo Sapiens
cugggaggugguguuggaggccccaugaagagcgcccuggacugcugagggugggccaacagc

SEQ ID NO: 309688 - RNA, 63 nt, Homo Sapiens
aaguugagcgugcgcacugcaugggaaauagcggcccuggaggauguuagacuugcucccucu

SEQ ID NO: 309689 - RNA, 63 nt, Homo Sapiens
cccugccugcagccagggcugggguugccagaggcccuggagggaaggacagucccugcuggg

SEQ ID NO: 309690 - RNA, 63 nt, Homo Sapiens
agccaccccaugcuggccuugcuaugcucaggggcccuggagcacccaagaugcaagaaggag

SEQ ID NO: 309691 - RNA, 63 nt, Homo Sapiens
ccccaccagccucaccagcgugagcagccuggagcccuggagaccuaaagggccauagcccag

SEQ ID NO: 309692 - RNA, 63 nt, Homo Sapiens
uaugaagcccuuggugaugaggacauagcaucugcccuggaaaucguuauuccaacauaauau

SEQ ID NO: 309693 - RNA, 63 nt, Homo Sapiens
ucguuauuccaacauaauauuauuuucuagaaugcccuggaaggacagaauauuuaaaaauau

SEQ ID NO: 309694 - RNA, 63 nt, Homo Sapiens
ugugcauaugugcaugugucggugucccugggagcccuggaaagguauguagggcccagggug

SEQ ID NO: 309695 - RNA, 63 nt, Homo Sapiens
cugugcaagggggacuggagaguucgacacgacgcccuggauccucaccuaagcugcacuuca

SEQ ID NO: 309696 - RNA, 63 nt, Homo Sapiens
agcacuggugucugcagcacgguguccuggccagcccuggagaucuucacuagccucucugaa

SEQ ID NO: 309697 - RNA, 63 nt, Homo Sapiens
cucacucaugugagaucuuggccagaggggaaggcccuggauuaggcccaggcuggggccagg

SEQ ID NO: 309698 - RNA, 63 nt, Homo Sapiens
gcagccccgaggcugagaccgcugcucagcacagcccuggauuggcauuucuccucuccucuu

SEQ ID NO: 309699 - RNA, 63 nt, Homo Sapiens
uguaccagcacagccuggggcggggagcaggaugcccuggacccugcaggaggaggccgccgg

SEQ ID NO: 309700 - RNA, 63 nt, Homo Sapiens
uggcuucagcugccauggccacgccuccuagcugcccuggaaggagauggcccgggacaagcc

SEQ ID NO: 309701 - RNA, 63 nt, Homo Sapiens
gcacauugguuuaagcccagagauccugcuugagcccuggacucaucuugggaagggccaugg

SEQ ID NO: 309702 - RNA, 63 nt, Homo Sapiens
ugcaccuggggaucccccuaaacugugaauucugcccuggacagggcuuugcccuuggaggau

SEQ ID NO: 309703 - RNA, 63 nt, Homo Sapiens
uguucucagagguaucaggaccagcccuggacugcccuggacucucuaggaauagccugugag

SEQ ID NO: 309704 - RNA, 63 nt, Homo Sapiens
gcccuggacuuguucucagaagccugugagccagcccuggacuuacucccuggcucuaggaau

SEQ ID NO: 309705 - RNA, 63 nt, Homo Sapiens
gcccccgcccacccuccugaccgcagcucccaggcccuggagaccuccaggcuuuccugcccu

SEQ ID NO: 309706 - RNA, 63 nt, Homo Sapiens
gcccgcagagcacagagcaggagaagggcuugggcccuggaggagaaagccauucuggacacc

SEQ ID NO: 309707 - RNA, 63 nt, Homo Sapiens
gccaggggugggagcaucggagggagucccagagcccuggaccuugggccuagaccgcgugau

SEQ ID NO: 309708 - RNA, 63 nt, Homo Sapiens
gggggggcccuuggcugcgggagaaggcccagagcccuggaggagccaccaccccgccggccc

SEQ ID NO: 309709 - RNA, 63 nt, Homo Sapiens
ugaugacgggggaggcccgucgggcuccguggggcccuggagccccacagcacccccugccgg

SEQ ID NO: 309710 - RNA, 63 nt, Homo Sapiens
ggguuuagcgggcuggguggccaccuggcuuaugcccuggagauggaggccgguggagaagcc

SEQ ID NO: 309711 - RNA, 63 nt, Homo Sapiens
uccaucuuucuucaucuuucgucgggagcccaugcccuggaaaugagcgaggggcagauucua

SEQ ID NO: 309712 - RNA, 63 nt, Homo Sapiens
ccccaaggcucuuccuccaggucacaugcuugugcccuggaagcgaguuuuguaggggucacu

SEQ ID NO: 309713 - RNA, 63 nt, Homo Sapiens
gucccgguuugucaguucuugccccacgcuguggcccuggagggagacagaagccuggacucu

SEQ ID NO: 309714 - RNA, 63 nt, Homo Sapiens
aauucagcucagcuucuuccggguuucaccugggcccuggaggagucucagaaacuccccugg

SEQ ID NO: 309715 - RNA, 63 nt, Homo Sapiens
cggcuccccucugcaggucuuggggacgcaguggcccuggacauucuaguagcuguugucugg

SEQ ID NO: 309716 - RNA, 63 nt, Homo Sapiens
aacaaggggcuggcuguccucccauagugggcagcccuggaggaguguguucccuguaacugc

SEQ ID NO: 309717 - RNA, 63 nt, Homo Sapiens
gggaauggcaagggcaagguagagugccuaggagcccuggacucaggcuggcagaggggcugg

SEQ ID NO: 309718 - RNA, 63 nt, Homo Sapiens
gagcccuggacucaggcuggcagaggggcuggugcccuggagaaaauaaagagaaggcuggag

SEQ ID NO: 309719 - RNA, 63 nt, Homo Sapiens
gcccugcagguauauugcaggggccugggggcggcccuggacuggcgggcgguuccccagugg

SEQ ID NO: 309720 - RNA, 63 nt, Homo Sapiens
gcccuggacuggcgggcgguuccccaguggggugcccuggaggcugccgggcagaguggagca

SEQ ID NO: 309721 - RNA, 63 nt, Homo Sapiens
cagccagugcauuuauuuuagccuguguguccagcccuggagcaagcgguacaagaguucugu

SEQ ID NO: 309722 - RNA, 63 nt, Homo Sapiens
ucgaggcuacagugagcuaucuugggaggcugagcccuggaggcgcgccuguagucccagcua

SEQ ID NO: 309723 - RNA, 63 nt, Homo Sapiens
ugcugggcccuccugggaugcuguguuuggucugcccuggagguauggguguccgguuggguc

SEQ ID NO: 309724 - RNA, 63 nt, Homo Sapiens
ggcccaugugggcugaaggagcgggaagggugggcccuggaggucuuacaguaacugagugug

SEQ ID NO: 309725 - RNA, 63 nt, Homo Sapiens
uggagaggacccucaggccucugagggcaccaggcccuggagaagaggugcaauucagggugu

SEQ ID NO: 309726 - RNA, 63 nt, Homo Sapiens
gggagggguugucaagcccacccgggaaacugagcccuggagaggggaagcagccagcccagg

SEQ ID NO: 309727 - RNA, 64 nt, Homo Sapiens
cuuccaaagcuucgucuuguuacucccuccaauucccccuuaaaugcuucucuuucccccaccc

SEQ ID NO: 309728 - RNA, 64 nt, Homo Sapiens
gaaaauugcaugaaacuagguuccuauuuucuaucccccuuaaaguuugauuuuuuuaaaguag

SEQ ID NO: 309729 - RNA, 64 nt, Homo Sapiens
gguucuuacacauaugcacacacgcauacacacaugcacgcacacacacauacacacaugcacg

SEQ ID NO: 309730 - RNA, 64 nt, Homo Sapiens
cauacacacaugcacgcacacacacauacacacaugcacgcacgcacgcaugcacaccaauuua

SEQ ID NO: 309731 - RNA, 64 nt, Homo Sapiens
ugugcuggcuuaaagguuguugugugugcacgcaugcacgcacauauaaaaaacgaguuacgug

SEQ ID NO: 309732 - RNA, 64 nt, Homo Sapiens
cacgcacaugugcuggcuuaguuacgugugugugugcacgcauguuguguauuauaaaaaacga

SEQ ID NO: 309733 - RNA, 64 nt, Homo Sapiens
gggcugggccaagcgacugacgcaugugugugugugcacgcacucgcaugugauugugugugca

SEQ ID NO: 309734 - RNA, 64 nt, Homo Sapiens
ugugugugugcacgcacuggcaugugauugugugugcacgcauggccagacauugggacgcacg

SEQ ID NO: 309735 - RNA, 64 nt, Homo Sapiens
cacacacagaugcacacacagauauacacauggaugcacgcacaugccaaugcacgcacacauc

SEQ ID NO: 309736 - RNA, 64 nt, Homo Sapiens
cacagauauacacauggaugcacgcacaugccaaugcacgcacacaucagugcacacggaugca

SEQ ID NO: 309737 - RNA, 64 nt, Homo Sapiens
cagggugccauccugcaggcagugacuacaacgugcagaccagcucgagcgccugcugcggcuc

SEQ ID NO: 309738 - RNA, 64 nt, Homo Sapiens
agaguccuuggacucccccuaaccaaacaacauugcagaccaccugaccccaccuagagcuuuu

SEQ ID NO: 309739 - RNA, 64 nt, Homo Sapiens
caggucugucuucgccccugugcucucugggauugcagaccauccuuugggacauggugccuca

SEQ ID NO: 309740 - RNA, 64 nt, Homo Sapiens
cuggccaacauggcaaaaccugaggcuaggaguugcagaccagcgcugaggcaggcagaucacc

SEQ ID NO: 309741 - RNA, 64 nt, Homo Sapiens
uucugcccccgugggccaggcgaucuacuggaccgcagaccaccccggccagccccgccccugc

SEQ ID NO: 309742 - RNA, 64 nt, Homo Sapiens
ggggaccuuuuaaggaaagauggccuccggcagugcagaccagagccccagcaccccucuccuu

SEQ ID NO: 309743 - RNA, 64 nt, Homo Sapiens
uccuugucaaaaugagauuccagguccugagagcugcuuugaggcaguuccaggaguacuuacu

SEQ ID NO: 309744 - RNA, 64 nt, Homo Sapiens
aaugauggcaccuacuuuugggaaucuguagcugugcuuugagaauugccaucggucauguguu

SEQ ID NO: 309745 - RNA, 64 nt, Homo Sapiens
ugaauaagcuuuguuacaaagcuuuucucaguugugcuuugaaguuugggcuuugucuggauuu

SEQ ID NO: 309746 - RNA, 64 nt, Homo Sapiens
cugauauguguguuucagagcuggaaggcugauuugcuuugaggugaaccagucuuaccugaga

SEQ ID NO: 309747 - RNA, 64 nt, Homo Sapiens
cugcaggucgucagcuuguucuggaaacucuuuaugcuuugacaucgaguacaaaaauaaucaa

SEQ ID NO: 309748 - RNA, 64 nt, Homo Sapiens
guacaaaaauaaucaaagaagcaauggcaaagggugcuuugaucuauuuacuggauauguucug

SEQ ID NO: 309749 - RNA, 64 nt, Homo Sapiens
cuuuccgauugcucauuaauuguggaguacaaaaugcuuugaguguuugugugaagaaaugaac

SEQ ID NO: 309750 - RNA, 56 nt, Homo Sapiens; identical to SEQ ID NO: 83586

SEQ ID NO: 309751 - RNA, 64 nt, Homo Sapiens
uugcuuucucaacauuauuguuuucauugaucuaugcuuugaguuuuauguccauuucucaauu

SEQ ID NO: 309752 - RNA, 64 nt, Homo Sapiens
cuacaucaaacggaauggaauacagcacuaaauaugcuuugaugaauccaucagaaucucagac

SEQ ID NO: 309753 - RNA, 64 nt, Homo Sapiens
ccaaauuagaaacacauuccagugggaaccagugugcuuugaaaaaugucaugaaagugguaaa

SEQ ID NO: 309754 - RNA, 64 nt, Homo Sapiens
ggguccauggcgaguguaucgcgagaaggaggagugcuuugagcucucuacaauacccggcggg

SEQ ID NO: 309755 - RNA, 64 nt, Homo Sapiens
uuuaguuugccugcaguuucuaggcauuucauuaugcuuugaacguuuaacaaaugacuguauc

SEQ ID NO: 309756 - RNA, 64 nt, Homo Sapiens
cauagcuacaauuuguuuuucuccuuaauuuaauugcuuugaaggggcccaaagaauuggaauc

SEQ ID NO: 309757 - RNA, 64 nt, Homo Sapiens
uggcagggucccuguucugacaggggaccgguccugcuuugagaccugcuuggcagugggacau

SEQ ID NO: 309758 - RNA, 64 nt, Homo Sapiens
uuuugugccugcuuuuugcuccccugacguuaugugcuuugagguuugccucugaaauucaugg

SEQ ID NO: 309759 - RNA, 64 nt, Homo Sapiens
uaaguucccacacugcuggaccuguggcaaagagugcuuugaauaagucagcuagggauucuug

SEQ ID NO: 309760 - RNA, 64 nt, Homo Sapiens
guuuuggaaggagaggucuuuaauagcuuugaaaugcuuugagaucauuggucaaauugcauuu

SEQ ID NO: 309761 - RNA, 64 nt, Homo Sapiens
caaaugaaaaaaauguuaacauuugguagacaugugcuuugacauagcgugagcagcacauuac

SEQ ID NO: 309762 - RNA, 64 nt, Homo Sapiens
ucuaaaaguuaugguuagaugcuauucuguggguugcuuugauaauucuuacuaacacagauua

SEQ ID NO: 309763 - RNA, 64 nt, Homo Sapiens
acaagaucuaugccuuaguguuguuuuuguugucugcuuugauguaaaagcaagaguauuugga

SEQ ID NO: 309764 - RNA, 64 nt, Homo Sapiens
ugaaaauauauauuuaucuuaacuguguuauuucugcuuugagaaugcuagcugcuuggacauu

SEQ ID NO: 309765 - RNA, 64 nt, Homo Sapiens
agcugcauuaagguguucagagauauaacccaggugcuuugagaaaauaugaguaauuucucua

SEQ ID NO: 309766 - RNA, 64 nt, Homo Sapiens
aaacauuucuuaaaacagugcuccauugaguacgugcuuugagauuauaucuaacuuuccuucc

SEQ ID NO: 309767 - RNA, 64 nt, Homo Sapiens
uuugaaguugggguaguaguuuguagaguuguacugcuuugauuaaacuugaaaaguuuauugc

SEQ ID NO: 309768 - RNA, 64 nt, Homo Sapiens
ccucauagacuuauauuuuauaaucagaauauguugcuuugaaaaagccucuaauggacugacc

SEQ ID NO: 309769 - RNA, 64 nt, Homo Sapiens
aaauguuaaugguuaauguucccaaaccagagaaugcuuugaaaauguaucauucaguguaaau

SEQ ID NO: 309770 - RNA, 64 nt, Homo Sapiens
uuggaauuacaggugugagccaccaugccuggccugcuuugacauauuuuauaguguguuaauu

SEQ ID NO: 309771 - RNA, 64 nt, Homo Sapiens
uuagaugggaauugcagaagcugcaucaaaaguaugcuuugagguauauauagugaaacagagc

SEQ ID NO: 309772 - RNA, 64 nt, Homo Sapiens
cugcuucguuccaccccgggcccuugucagggcuugcuuugaccggcuaagggggacagccuuc

SEQ ID NO: 309773 - RNA, 64 nt, Homo Sapiens
ggcgggguccgcauguacgucauuuccauaaacgugcuuugagagcgggccaccccacccuguu

SEQ ID NO: 309774 - RNA, 64 nt, Homo Sapiens
ugagagcaaaaugcauguaaucaacauggcuacuugcuuugaggcucaccagaauuauuuuuaa

SEQ ID NO: 309775 - RNA, 64 nt, Homo Sapiens
gucacuuuucacauccuugacuuuuuagaugugcugcuuugauauauaggacauugauuugauu

SEQ ID NO: 309776 - RNA, 64 nt, Homo Sapiens; identical to SEQ ID NO: 274997

SEQ ID NO: 309777 - RNA, 64 nt, Homo Sapiens; identical to SEQ ID NO: 274998

SEQ ID NO: 309778 - RNA, 64 nt, Homo Sapiens; identical to SEQ ID NO: 274999

SEQ ID NO: 309779 - RNA, 64 nt, Homo Sapiens; identical to SEQ ID NO: 275000

SEQ ID NO: 309780 - RNA, 64 nt, Homo Sapiens
aaacagaccaacacacacacauuaccuaaaaccaguccaaaauggaaagaaaaacuggcuaugc

SEQ ID NO: 309781 - RNA, 64 nt, Homo Sapiens
ggggucugcuccugcuaccuucauucauugguguguccaaaaauuucuaccacguguaggauaa

SEQ ID NO: 309782 - RNA, 64 nt, Homo Sapiens
acggggcuccugcucugccaaaguggcgguguuuguccaaaauaaaaaaugaagcugaaacuua

SEQ ID NO: 309783 - RNA, 64 nt, Homo Sapiens
gcggcuccaaguucccuucuccuagacuaggcauguccaaaauggugccaauaggaaaaagcua

SEQ ID NO: 309784 - RNA, 64 nt, Homo Sapiens
aaagaauaagaugcaucacucugaggguguuacuguccaaaagucaaaccaauaaaaauaccau

SEQ ID NO: 309785 - RNA, 64 nt, Homo Sapiens
guuagacccuugcauacagacauuuuuucuuucaguccaaaauauugacuggccauccaauuac

SEQ ID NO: 309786 - RNA, 64 nt, Homo Sapiens
aguuuuagcuacuuauuuuggagcacuaucagugguccaaaauuuauuucaaaaauagguauua

SEQ ID NO: 309787 - RNA, 64 nt, Homo Sapiens
ggaagaaguggaguaguuugaaccauguucuuaaguccaaaauauugaguucuaguuaaaucuu

SEQ ID NO: 309788 - RNA, 64 nt, Homo Sapiens
gugccuguagucccagcuacuugggaggcugaggcaggagaaucacuugaccccagguggugga

SEQ ID NO: 309789 - RNA, 64 nt, Homo Sapiens
auaacuauaaucccagcuacuugggaggcugaggcaggagaaucgcuugaacccgggaggcaca

SEQ ID NO: 309790 - RNA, 64 nt, Homo Sapiens
gcuccuguagucccagcuacuugggaggcugaggcaggagaaucgcuugaaccugggaggcaga

SEQ ID NO: 309791 - RNA, 64 nt, Homo Sapiens
acgccuguagucccaguuacuugggaggcugaggcaggagaauugcuugaaccugggaggugga

SEQ ID NO: 309792 - RNA, 64 nt, Homo Sapiens
cugccuguaaucccagcuacuugggaggcugaggcaggagaaucgcuugaacccgggaggcgga

SEQ ID NO: 309793 - RNA, 64 nt, Homo Sapiens
uuuugcggauugagagacuugguccaucuugucucaggagaagaaaccuuucuccaauguagca

SEQ ID NO: 309794 - RNA, 64 nt, Homo Sapiens
augccuguaaucccagcugcuugggaggcugaggcaggagaaucacuugaacacaggaggcaga

SEQ ID NO: 309795 - RNA, 64 nt, Homo Sapiens
gcuugaaccggggaggcagaucgggaggcugaggcaggagaauugagccuguagucccagcuac

SEQ ID NO: 309796 - RNA, 64 nt, Homo Sapiens
gcaugaaccugggaggcagauugggaggcugaggcaggagaauggcgccuguaaucccagcuac

SEQ ID NO: 309797 - RNA, 64 nt, Homo Sapiens
gcgugaauccgggaggcggaucagggggcugaggcaggagaauggcaccuguagucccagcuac

SEQ ID NO: 309798 - RNA, 64 nt, Homo Sapiens
gcuugagcccaagagguggauugggaggcugaggcaggagaauuacgccuguagucccagcuac

SEQ ID NO: 309799 - RNA, 64 nt, Homo Sapiens
gcuugaaccugggagguggauugggaggcugaggcaggagaaucguaccuauaaucccagcuac

SEQ ID NO: 309800 - RNA, 64 nt, Homo Sapiens
gauagaaaggaacuauguucgagagggaaggucucaggagaaggaagggauggauaggcacaua

SEQ ID NO: 309801 - RNA, 64 nt, Homo Sapiens
gcuugaaccugggaggcagaucaggaggcugaggcaggagaauugugccuauagucccagcuac

SEQ ID NO: 309802 - RNA, 64 nt, Homo Sapiens
gcuugaacccaggaggaagaucaggaggcugaggcaggagaauuacgccuguagucccagcuac

SEQ ID NO: 309803 - RNA, 64 nt, Homo Sapiens
gcuugaacccgggaggcggaucaggaggcugaggcaggagaaucgcgccuguaaucccagcuac

SEQ ID NO: 309804 - RNA, 64 nt, Homo Sapiens
gguggagccuggggcccugguccugcagagcagucaggagaaaucagaaaugagugagaggccu

SEQ ID NO: 309805 - RNA, 64 nt, Homo Sapiens
acuugaacccgggaggcagauugggaggcugaggcaggagaaucgcaccaguaaucccagcuac

SEQ ID NO: 309806 - RNA, 64 nt, Homo Sapiens
gcuugaaccugggaggcggaucaggaggcugaggcaggagaaucaugccuguaauccaagauac

SEQ ID NO: 309807 - RNA, 64 nt, Homo Sapiens
agaaagugcccacgaaaauugaguguaggcgcugcaggagaaaguacuaacauucacuguuaga

SEQ ID NO: 309808 - RNA, 64 nt, Homo Sapiens
uacuucagaagggcuguucuaaaaugaagugccccaggagaagaaguaacuuagaccaaaagga

SEQ ID NO: 309809 - RNA, 64 nt, Homo Sapiens
uuugaaggucaguucuaugacagugaauuuugcacaggagaagcagcuaccugauuucuuacuu

SEQ ID NO: 309810 - RNA, 64 nt, Homo Sapiens
gcgccuguagucccagcuacucaggaggcuaaggcaggagaaucucuugaacccgagaggugga

SEQ ID NO: 309811 - RNA, 64 nt, Homo Sapiens
acugcagcccaggaggcagagaauuacuugaacgcaggagaauccucagaaggccgaggcagga

SEQ ID NO: 309812 - RNA, 64 nt, Homo Sapiens
acuugaacgcaggagaaucaucagaaggccgaggcaggagaauuaugccuguaaucccaacuac

SEQ ID NO: 309813 - RNA, 64 nt, Homo Sapiens
gcucaaucuucaugagacaacaguuggcuggggacaggagaaguuccuaugccccuggacagga

SEQ ID NO: 309814 - RNA, 64 nt, Homo Sapiens
guaagauggaugguuccggcaaaagguuuagaugcaggagaacaggcagagggagaugguggca

SEQ ID NO: 309815 - RNA, 64 nt, Homo Sapiens
gcuugaacccaggaagcagaucaggaggcugaggcaggagaauugcacccguaaucccagcuac

SEQ ID NO: 309816 - RNA, 64 nt, Homo Sapiens
gcuugaaccugggagguggaucaggaggcugaggcaggagaaucuugccuguaauccuagcuac

SEQ ID NO: 309817 - RNA, 64 nt, Homo Sapiens
gcaccuguaaucccaguuacuugggaagcugaggcaggagaaucccuugaaccugggaggcaga

SEQ ID NO: 309818 - RNA, 64 nt, Homo Sapiens
guaccuguagucccagcuacccaggaagcuaaggcaggagaaucgcuugaauccaggaggcgga

SEQ ID NO: 309819 - RNA, 64 nt, Homo Sapiens
gcgccuguagucccagcuacuugggaggcugaggcaggagaauggcgugaacccgggaggcgga

SEQ ID NO: 309820 - RNA, 64 nt, Homo Sapiens
uagcucagauguggagauucauagaaugaggguccaggagaagaaaguuaggggaaaucucauu

SEQ ID NO: 309821 - RNA, 64 nt, Homo Sapiens
augccuauaaucccggcuacucgggaggcugaggcaggagaaucaccugaacccgggaggcaaa

SEQ ID NO: 309822 - RNA, 64 nt, Homo Sapiens
augccuguagucccaacuacuagggaggcugaggcaggagaaucacuugaacccaggaggugga

SEQ ID NO: 309823 - RNA, 64 nt, Homo Sapiens
gcuugaaccugggagacggauagggaggcugaggcaggagaauuaugccuguaaucccagcuac

SEQ ID NO: 309824 - RNA, 64 nt, Homo Sapiens
gcuugaaccugggaggcagauugagaggcugaggcaggagaaucgugccuguagucuuagcuac

SEQ ID NO: 309825 - RNA, 64 nt, Homo Sapiens
gcaccuguagucccagcuauuugggaggcugaugcaggagaauagcuuaagcccaggaauuuga

SEQ ID NO: 309826 - RNA, 64 nt, Homo Sapiens
acaccuauagucgcagcuacuugggaggcuggggcaggagaauugccugagccugggaagugga

SEQ ID NO: 309827 - RNA, 64 nt, Homo Sapiens
gggagcugaucccacgggcaggcucucccugcuccaggagaagacuaggaggaagaaugaggug

SEQ ID NO: 309828 - RNA, 64 nt, Homo Sapiens
gugccugcaaucccagcuacucaggaagcugaggcaggagaaucgcuugaaccugggaggugga

SEQ ID NO: 309829 - RNA, 64 nt, Homo Sapiens
gacguaaaccuaccccagcaccaugcaccaagagcaggagaaaaccaagcuugagagcucagca

SEQ ID NO: 309830 - RNA, 64 nt, Homo Sapiens
gcuugaaccuagaaggcggaucgggaggcugaggcaggagaaucgcaccuguaaucccagcuac

SEQ ID NO: 309831 - RNA, 64 nt, Homo Sapiens
cggggauuugaguuucucuguauaaaacaugccacaggagaauuaacagauuuuaaaugucuga

SEQ ID NO: 309832 - RNA, 64 nt, Homo Sapiens
aaugacuugcuuuucuaaaucacuaaaacagccucaggagaauacauucuugucacaaaagugc

SEQ ID NO: 309833 - RNA, 64 nt, Homo Sapiens
augccuguaauugcagcacuuuuagaggcugaggcaggagaauugguugaacccaggaggcgga

SEQ ID NO: 309834 - RNA, 64 nt, Homo Sapiens
augccuguaaucccagcuacucgggaggcugaggcaggagaauugcuugaacucgggaggugga

SEQ ID NO: 309835 - RNA, 64 nt, Homo Sapiens
acuugaacccgggggacagauggggaggcugaggcaggagaaucgcgccuauaaucccagcuac

SEQ ID NO: 309836 - RNA, 64 nt, Homo Sapiens
accugaaccccagaggcagaucaggaggcugagacaggagaaucgugcccguaaucccagcuac

SEQ ID NO: 309837 - RNA, 64 nt, Homo Sapiens
gcgugaacccgggaagcggauugggaggcugaggcaggagaauggcgccuguagucccagcuac

SEQ ID NO: 309838 - RNA, 64 nt, Homo Sapiens
auuaugaacauuuauuuagagcaaguggauuacacaggagaacccaccuaaauaaaaauugaaa

SEQ ID NO: 309839 - RNA, 64 nt, Homo Sapiens
acuugaacccaggagguggaucgggaggcugaggcaggagaaucggcgccuguaauccagcuac

SEQ ID NO: 309840 - RNA, 64 nt, Homo Sapiens
gcgggaaccugggaggcggauugggaggcugaggcaggagaauggcgccuguagucccagcuac

SEQ ID NO: 309841 - RNA, 64 nt, Homo Sapiens
uccgcuuguccaagacagggagggggggccgggccaggagaaucaaacagaacuccacugcaag

SEQ ID NO: 309842 - RNA, 64 nt, Homo Sapiens
gacaaccaggaugaggauguaagagcaaaccuaacaggagaaagucacugaauaucaacucuga

SEQ ID NO: 309843 - RNA, 64 nt, Homo Sapiens
uuuauuaccaagacauuaaaguagcauggcugcccaggagaaaagaagacauucuaauuccagu

SEQ ID NO: 309844 - RNA, 64 nt, Homo Sapiens
gcaccuguagucccagcuacucaggaggcugaggcaggagaauggugugaaccugggaggugga

SEQ ID NO: 309845 - RNA, 64 nt, Homo Sapiens
auaccuguagucccagcuacuugggaggcugaggcaggagaaucacuugaacucgggaggcgaa

SEQ ID NO: 309846 - RNA, 64 nt, Homo Sapiens
gugccuguagucucagcuacucaggaggcugaggcaggagaaucgccugaacccgggcggcgga

SEQ ID NO: 309847 - RNA, 64 nt, Homo Sapiens
aacgaugguuugaaaaggaaaccuaugauacaugcaggagaagcaaaacccaagugauugguga

SEQ ID NO: 309848 - RNA, 64 nt, Homo Sapiens
gcaccuguaaucccaguuaccugggaggcugaggcaggagaaucucuugagcccaggaggcgga

SEQ ID NO: 309849 - RNA, 64 nt, Homo Sapiens
gcgccuguaaucccagcuacucagaaggcugaggcaggagaaucacuugaaccuaggaggcgga

SEQ ID NO: 309850 - RNA, 64 nt, Homo Sapiens
augccuguaaucccagcuacucgggaggcugaggcaggagaaucgcuugaacccaggaggcgga

SEQ ID NO: 309851 - RNA, 64 nt, Homo Sapiens
gcgcuuguagucucagcuacuccggaggcugaggcaggagaauugcuugaaccuggaaggcaga

SEQ ID NO: 309852 - RNA, 64 nt, Homo Sapiens
gugucuguaaucccagcuauucgggaggcugaggcaggagaaucgcuugaacccaggaggugga

SEQ ID NO: 309853 - RNA, 64 nt, Homo Sapiens
cucacccccugcccccgcaccaaccacccauauucaggagaagaggacagacacggcaccucug

SEQ ID NO: 309854 - RNA, 64 nt, Homo Sapiens
augccuguaaucccagcuacucaggaggcuaaggcaggagaaucgcuugaacccgggaggugga

SEQ ID NO: 309855 - RNA, 64 nt, Homo Sapiens
aggagcugaggaggagaagccaaagaggaggaggcaggagaagcaggcagccugccccuucuac

SEQ ID NO: 309856 - RNA, 64 nt, Homo Sapiens
caugcccuuccccaacaucaggucugcagagcugcaggagaagauggccuacuuggaucaaacc

SEQ ID NO: 309857 - RNA, 64 nt, Homo Sapiens
gcccucacauccccuggccuggacccaggagacccaggagaaagcacccucccuuaggaaugag

SEQ ID NO: 309858 - RNA, 64 nt, Homo Sapiens
uugagccccgaaggagaucaggcagccccaccugcaggagaacgucagcccuccaggggaucag

SEQ ID NO: 309859 - RNA, 64 nt, Homo Sapiens
gcaccuguagucccagcuacucaggaggcugaggcaggagaauggcgugaacccggaaggcgga

SEQ ID NO: 309860 - RNA, 64 nt, Homo Sapiens
augcauguagucccagcuacuccugaggcucagucaggagaaucgcuugaacuugggaggcgga

SEQ ID NO: 309861 - RNA, 64 nt, Homo Sapiens
guuuaaacacaggagguggaucaggaggcugaagcaggagaaucgggccuguaauuccagcuac

SEQ ID NO: 309862 - RNA, 64 nt, Homo Sapiens
gcgugaacccgcgaggcggaacaggaggcugaggcaggagaauggcgugguggcgggugccugu

SEQ ID NO: 309863 - RNA, 64 nt, Homo Sapiens
cgccugaacccagaaggcaguugggaggcugaggcaggagaaaugcaccuguaaucccagcuac

SEQ ID NO: 309864 - RNA, 64 nt, Homo Sapiens
gcuugaaccugggaggcagauggggaggcugaggcaggagaaucaugccuguaaucccagcuac

SEQ ID NO: 309865 - RNA, 64 nt, Homo Sapiens
gcuugaacccuagaggcggaucaggaggcugagacaggagaaucgcaccuguaaucgcagccuu

SEQ ID NO: 309866 - RNA, 64 nt, Homo Sapiens
gcuagaaacugggagguggauugggaggcugaggcaggagaaucacgccuguaaucccaucuuc

SEQ ID NO: 309867 - RNA, 64 nt, Homo Sapiens
gcuugaacccgggagguggaucaggaggcugaggcaggagaaucacgccuguaguuccagcuac

SEQ ID NO: 309868 - RNA, 64 nt, Homo Sapiens
gcuugaaccugggaggcagaucaggaggcugaggcaggagaauccaagugccuuuaaucccacc

SEQ ID NO: 309869 - RNA, 64 nt, Homo Sapiens
gcuugaaccugggaggcggauugggaggcugaggcaggagaaucaugccuguaaucccagcuac

SEQ ID NO: 309870 - RNA, 64 nt, Homo Sapiens
uccuccuccccagaacucagaacccaagucugaucaggagaaaaacaucacacaaauuccaauu

SEQ ID NO: 309871 - RNA, 64 nt, Homo Sapiens
ugcaccugcagucccagcaacaugggaggcugaacaggagaaucgcuugaacccgcgacaggga

SEQ ID NO: 309872 - RNA, 64 nt, Homo Sapiens
gcuugaacccaggaggcggauugguaggcugaggcaggagaaucgcaccuauaaucccaccuac

SEQ ID NO: 309873 - RNA, 64 nt, Homo Sapiens
auugggaacagaauggaaaauccaucaaguauuacaggagaagggaucaguuugucuuuuugua

SEQ ID NO: 309874 - RNA, 64 nt, Homo Sapiens
acuugaacccuggagguagaucaggaggcugagacaggagaaucgugccuguagucucagcuac

SEQ ID NO: 309875 - RNA, 64 nt, Homo Sapiens
gcuugaacccgggaggcagaucaggaggcugaggcaggagaaucgcgccuguaaucccagcugc

SEQ ID NO: 309876 - RNA, 64 nt, Homo Sapiens
gaaagaaaagucuccauugauccucugcacuaaacaggagaauguaggaaggcaccaaagaacc

SEQ ID NO: 309877 - RNA, 64 nt, Homo Sapiens
auggaaggaagggaggaaggcgugaguuuacauacaggagaaugauccuuaaccaacuagguac

SEQ ID NO: 309878 - RNA, 64 nt, Homo Sapiens
ggugccuguaauccagcuacuugggagacugaggcaggagaauugcuugaacccaggaggcaga

SEQ ID NO: 309879 - RNA, 64 nt, Homo Sapiens
uccccuguagucccagcuacucgggaggcugaggcaggagaaucguuugaaccugggaggugga

SEQ ID NO: 309880 - RNA, 64 nt, Homo Sapiens
guaccuguaguccuagcuacuugggaggcugaggcaggagaauggcgugaaccugggaggugga

SEQ ID NO: 309881 - RNA, 64 nt, Homo Sapiens
uuagggccaaaauuuuaggaggagauguaggaugcaggagaaaauuaaaguguuuucuuuauau

SEQ ID NO: 309882 - RNA, 64 nt, Homo Sapiens
gggugaacccgggaggaagaucgggagguugaggcaggagaaugacgccuguauucacagcuac

SEQ ID NO: 309883 - RNA, 64 nt, Homo Sapiens
ucuugaacccaggaggcggauugggaggcugaggcaggagaaucgcaccuguaaucccagcuac

SEQ ID NO: 309884 - RNA, 64 nt, Homo Sapiens
gccugaacccaggaggcggaaaucguagcugaggcaggagaaucgcaugguggcacacaccugu

SEQ ID NO: 309885 - RNA, 64 nt, Homo Sapiens
gcuugaaccugggaggcaaaucaagaggcugaggcaggagaaucgcgccugaaaucccagcuac

SEQ ID NO: 309886 - RNA, 64 nt, Homo Sapiens
gcuugaacucaggagguggaucgggaggcugaggcaggagaauccaagggcccuccccagcuac

SEQ ID NO: 309887 - RNA, 64 nt, Homo Sapiens
gccugaacccgggaggcggauugggaggcugaggcaggagaauggcgccuguagucccagcuac

SEQ ID NO: 309888 - RNA, 64 nt, Homo Sapiens
aagcuaaaucugcauagauuuaggaaaaucugcucaggagaaaguaaugaaaacucagaggaaa

SEQ ID NO: 309889 - RNA, 64 nt, Homo Sapiens
ccagauggaguauguggaguaauguaccuguuggcaggagaaggaaaaaaaaaagaaaaaaaga

SEQ ID NO: 309890 - RNA, 64 nt, Homo Sapiens
gcaugaaccugggaggcagaacgggaggcugaggcaggagaauggcaccuguagucccagcuac

SEQ ID NO: 309891 - RNA, 64 nt, Homo Sapiens
uugguggaagauugcugaccgugccguuucugggcaggagaagacaucaugguguccagcaacu

SEQ ID NO: 309892 - RNA, 64 nt, Homo Sapiens
gucgugagguccuucugaauguaaaacuggagcccaggagaagcugucccaggagggcuguuaa

SEQ ID NO: 309893 - RNA, 64 nt, Homo Sapiens
ggccagggcccgcggggggcucaugcgggccccacaggagaagcucccaagcccgagcagaggg

SEQ ID NO: 309894 - RNA, 64 nt, Homo Sapiens
gcuugaacccgggagguggaucgggaggcugaggcaggagaaucgugccuauaaucccagcuac

SEQ ID NO: 309895 - RNA, 64 nt, Homo Sapiens
gcuugaacuugggagguggauugggaggcugaggcaggagaauugugccuguaauccuagcuac

SEQ ID NO: 309896 - RNA, 64 nt, Homo Sapiens
gcuugaacccaugagguggaucgggaggcugaggcaggagaauugcgcuuguaaucccagcuac

SEQ ID NO: 309897 - RNA, 64 nt, Homo Sapiens
gcgugaaccugggaggcggaucgggaggcugaggcaggagaauggugccuguagucccagcuac

SEQ ID NO: 309898 - RNA, 64 nt, Homo Sapiens
guuugaacacagggaugguguuaggagccugaggcaggagaauggcaucuguagucucagcaac

SEQ ID NO: 309899 - RNA, 64 nt, Homo Sapiens
agaaccgccuggaagaggaaggccaggguuuggccaggagaacuaagaaggucucaacuccagg

SEQ ID NO: 309900 - RNA, 64 nt, Homo Sapiens
gccuuagccucgucucgucccagaggcauuggaucaggagaaugggaauuuuuuuccucccacc

SEQ ID NO: 309901 - RNA, 64 nt, Homo Sapiens
cauuugcuguauagagcugccacccaacucuaagcaggagaaacuguacagaaagggcuuugcu

SEQ ID NO: 309902 - RNA, 64 nt, Homo Sapiens
augccuguauucccagcugcuugggaggcugaggcaggagaauggcuugaaccugggaggugga

SEQ ID NO: 309903 - RNA, 64 nt, Homo Sapiens
uaaagauucauuucucucccaagcuauucucuaacaggagaacaugugaaagcuggaaggaaaa

SEQ ID NO: 309904 - RNA, 64 nt, Homo Sapiens
ucaucuuaauagccuuuggcgccuagugagugagcaggagaacacacuucucgaguagaggucu

SEQ ID NO: 309905 - RNA, 64 nt, Homo Sapiens
acuuacauucuggugccuugagggauuuugggcccaggagaaacaaacgacgguacccaggaga

SEQ ID NO: 309906 - RNA, 64 nt, Homo Sapiens
gauuuugggcccaggagaaagaaacgacgguacccaggagaagguauggcugagccuggagcca

SEQ ID NO: 309907 - RNA, 64 nt, Homo Sapiens
gcgugaacccaggaggcggaucugaagacugaggcaggagaauggcgccuguagucccagcuac

SEQ ID NO: 309908 - RNA, 64 nt, Homo Sapiens
gcuugaacccgggaggcagaucaggaggcugaggcaggagaaucacgccuguagucucagcuac

SEQ ID NO: 309909 - RNA, 64 nt, Homo Sapiens
gcgccuguaguuccagcuaacugggcggcugaggcaggagaauggcgugaaccugggaggugga

SEQ ID NO: 309910 - RNA, 64 nt, Homo Sapiens
auggagaaagcccaagaguuagaacaguuggauacaggagaagaaacagcggcuccacuacaga

SEQ ID NO: 309911 - RNA, 64 nt, Homo Sapiens
aucaauagaauaaaagugacccgcauuauaaacacaggagaauaagaaacccccacccugccgc

SEQ ID NO: 309912 - RNA, 64 nt, Homo Sapiens
auuuuaaagaaacccccaccaggcucuuuaggcucaggagaagccagacaggggcugggugggg

SEQ ID NO: 309913 - RNA, 64 nt, Homo Sapiens
gcaccuguagucccagauacucgggaggcuaaggcaggagaaucgcuugacgggaagcggaggu

SEQ ID NO: 309914 - RNA, 64 nt, Homo Sapiens
gggccuguaauccuagcuacuuggggugcugaggcaggagaaucaacugaacccgggaggcgga

SEQ ID NO: 309915 - RNA, 64 nt, Homo Sapiens; identical to SEQ ID NO: 209315

SEQ ID NO: 309916 - RNA, 64 nt, Homo Sapiens; identical to SEQ ID NO: 209316

SEQ ID NO: 309917 - RNA, 64 nt, Homo Sapiens; identical to SEQ ID NO: 209317

SEQ ID NO: 309918 - RNA, 64 nt, Homo Sapiens; identical to SEQ ID NO: 209318

SEQ ID NO: 309919 - RNA, 64 nt, Homo Sapiens; identical to SEQ ID NO: 209319

SEQ ID NO: 309920 - RNA, 64 nt, Homo Sapiens; identical to SEQ ID NO: 209320

SEQ ID NO: 309921 - RNA, 64 nt, Homo Sapiens; identical to SEQ ID NO: 209321

SEQ ID NO: 309922 - RNA, 64 nt, Homo Sapiens; identical to SEQ ID NO: 209322

SEQ ID NO: 309923 - RNA, 64 nt, Homo Sapiens; identical to SEQ ID NO: 209323

SEQ ID NO: 309924 - RNA, 64 nt, Homo Sapiens; identical to SEQ ID NO: 209324

SEQ ID NO: 309925 - RNA, 64 nt, Homo Sapiens; identical to SEQ ID NO: 209325

SEQ ID NO: 309926 - RNA, 64 nt, Homo Sapiens; identical to SEQ ID NO: 209326

SEQ ID NO: 309927 - RNA, 64 nt, Homo Sapiens; identical to SEQ ID NO: 209327

SEQ ID NO: 309928 - RNA, 64 nt, Homo Sapiens; identical to SEQ ID NO: 209328

SEQ ID NO: 309929 - RNA, 64 nt, Homo Sapiens; identical to SEQ ID NO: 209329

SEQ ID NO: 309930 - RNA, 64 nt, Homo Sapiens; identical to SEQ ID NO: 209330

SEQ ID NO: 309931 - RNA, 64 nt, Homo Sapiens; identical to SEQ ID NO: 209331

SEQ ID NO: 309932 - RNA, 64 nt, Homo Sapiens; identical to SEQ ID NO: 209332

SEQ ID NO: 309933 - RNA, 64 nt, Homo Sapiens; identical to SEQ ID NO: 209333

SEQ ID NO: 309934 - RNA, 64 nt, Homo Sapiens; identical to SEQ ID NO: 209334

SEQ ID NO: 309935 - RNA, 64 nt, Homo Sapiens; identical to SEQ ID NO: 209335

SEQ ID NO: 309936 - RNA, 64 nt, Homo Sapiens; identical to SEQ ID NO: 209336

SEQ ID NO: 309937 - RNA, 64 nt, Homo Sapiens; identical to SEQ ID NO: 209337

SEQ ID NO: 309938 - RNA, 64 nt, Homo Sapiens; identical to SEQ ID NO: 209338

SEQ ID NO: 309939 - RNA, 64 nt, Homo Sapiens; identical to SEQ ID NO: 209339

SEQ ID NO: 309940 - RNA, 64 nt, Homo Sapiens; identical to SEQ ID NO: 209340

SEQ ID NO: 309941 - RNA, 64 nt, Homo Sapiens; identical to SEQ ID NO: 209341

SEQ ID NO: 309942 - RNA, 64 nt, Homo Sapiens; identical to SEQ ID NO: 209342

SEQ ID NO: 309943 - RNA, 64 nt, Homo Sapiens; identical to SEQ ID NO: 209343

SEQ ID NO: 309944 - RNA, 64 nt, Homo Sapiens; identical to SEQ ID NO: 209344

SEQ ID NO: 309945 - RNA, 64 nt, Homo Sapiens; identical to SEQ ID NO: 209345

SEQ ID NO: 309946 - RNA, 64 nt, Homo Sapiens; identical to SEQ ID NO: 209346

SEQ ID NO: 309947 - RNA, 64 nt, Homo Sapiens; identical to SEQ ID NO: 209347

SEQ ID NO: 309948 - RNA, 64 nt, Homo Sapiens; identical to SEQ ID NO: 209348

SEQ ID NO: 309949 - RNA, 64 nt, Homo Sapiens; identical to SEQ ID NO: 209349

SEQ ID NO: 309950 - RNA, 64 nt, Homo Sapiens; identical to SEQ ID NO: 209350

SEQ ID NO: 309951 - RNA, 64 nt, Homo Sapiens; identical to SEQ ID NO: 209351

SEQ ID NO: 309952 - RNA, 64 nt, Homo Sapiens; identical to SEQ ID NO: 209352

SEQ ID NO: 309953 - RNA, 64 nt, Homo Sapiens; identical to SEQ ID NO: 309788

SEQ ID NO: 309954 - RNA, 64 nt, Homo Sapiens; identical to SEQ ID NO: 309789

SEQ ID NO: 309955 - RNA, 64 nt, Homo Sapiens; identical to SEQ ID NO: 309790

SEQ ID NO: 309956 - RNA, 64 nt, Homo Sapiens; identical to SEQ ID NO: 309791

SEQ ID NO: 309957 - RNA, 64 nt, Homo Sapiens; identical to SEQ ID NO: 309792

SEQ ID NO: 309958 - RNA, 64 nt, Homo Sapiens; identical to SEQ ID NO: 309793

SEQ ID NO: 309959 - RNA, 64 nt, Homo Sapiens; identical to SEQ ID NO: 309794

SEQ ID NO: 309960 - RNA, 64 nt, Homo Sapiens; identical to SEQ ID NO: 309795

SEQ ID NO: 309961 - RNA, 64 nt, Homo Sapiens; identical to SEQ ID NO: 309796

SEQ ID NO: 309962 - RNA, 64 nt, Homo Sapiens; identical to SEQ ID NO: 309797

SEQ ID NO: 309963 - RNA, 64 nt, Homo Sapiens; identical to SEQ ID NO: 309798

SEQ ID NO: 309964 - RNA, 64 nt, Homo Sapiens; identical to SEQ ID NO: 309799

SEQ ID NO: 309965 - RNA, 64 nt, Homo Sapiens; identical to SEQ ID NO: 309800

SEQ ID NO: 309966 - RNA, 64 nt, Homo Sapiens; identical to SEQ ID NO: 309801

SEQ ID NO: 309967 - RNA, 64 nt, Homo Sapiens; identical to SEQ ID NO: 309802

SEQ ID NO: 309968 - RNA, 64 nt, Homo Sapiens; identical to SEQ ID NO: 309803

SEQ ID NO: 309969 - RNA, 64 nt, Homo Sapiens; identical to SEQ ID NO: 309804

SEQ ID NO: 309970 - RNA, 64 nt, Homo Sapiens; identical to SEQ ID NO: 309805

SEQ ID NO: 309971 - RNA, 64 nt, Homo Sapiens; identical to SEQ ID NO: 309806

SEQ ID NO: 309972 - RNA, 64 nt, Homo Sapiens; identical to SEQ ID NO: 309807

SEQ ID NO: 309973 - RNA, 64 nt, Homo Sapiens; identical to SEQ ID NO: 309808

SEQ ID NO: 309974 - RNA, 64 nt, Homo Sapiens; identical to SEQ ID NO: 309809

SEQ ID NO: 309975 - RNA, 64 nt, Homo Sapiens; identical to SEQ ID NO: 309810

SEQ ID NO: 309976 - RNA, 64 nt, Homo Sapiens; identical to SEQ ID NO: 309811

SEQ ID NO: 309977 - RNA, 64 nt, Homo Sapiens; identical to SEQ ID NO: 309812

SEQ ID NO: 309978 - RNA, 64 nt, Homo Sapiens; identical to SEQ ID NO: 309813

SEQ ID NO: 309979 - RNA, 64 nt, Homo Sapiens; identical to SEQ ID NO: 309814

SEQ ID NO: 309980 - RNA, 64 nt, Homo Sapiens; identical to SEQ ID NO: 309815

SEQ ID NO: 309981 - RNA, 64 nt, Homo Sapiens; identical to SEQ ID NO: 309816

SEQ ID NO: 309982 - RNA, 64 nt, Homo Sapiens; identical to SEQ ID NO: 309817

SEQ ID NO: 309983 - RNA, 64 nt, Homo Sapiens; identical to SEQ ID NO: 309818

SEQ ID NO: 309984 - RNA, 64 nt, Homo Sapiens; identical to SEQ ID NO: 309819

SEQ ID NO: 309985 - RNA, 64 nt, Homo Sapiens; identical to SEQ ID NO: 309820

SEQ ID NO: 309986 - RNA, 64 nt, Homo Sapiens; identical to SEQ ID NO: 309821

SEQ ID NO: 309987 - RNA, 64 nt, Homo Sapiens; identical to SEQ ID NO: 309822

SEQ ID NO: 309988 - RNA, 64 nt, Homo Sapiens; identical to SEQ ID NO: 309823

SEQ ID NO: 309989 - RNA, 64 nt, Homo Sapiens; identical to SEQ ID NO: 309824

SEQ ID NO: 309990 - RNA, 64 nt, Homo Sapiens; identical to SEQ ID NO: 309825

SEQ ID NO: 309991 - RNA, 64 nt, Homo Sapiens; identical to SEQ ID NO: 309826

SEQ ID NO: 309992 - RNA, 64 nt, Homo Sapiens; identical to SEQ ID NO: 309827

SEQ ID NO: 309993 - RNA, 64 nt, Homo Sapiens; identical to SEQ ID NO: 309828

SEQ ID NO: 309994 - RNA, 64 nt, Homo Sapiens; identical to SEQ ID NO: 309829

SEQ ID NO: 309995 - RNA, 64 nt, Homo Sapiens; identical to SEQ ID NO: 309830

SEQ ID NO: 309996 - RNA, 64 nt, Homo Sapiens; identical to SEQ ID NO: 309831

SEQ ID NO: 309997 - RNA, 64 nt, Homo Sapiens; identical to SEQ ID NO: 309832

SEQ ID NO: 309998 - RNA, 64 nt, Homo Sapiens; identical to SEQ ID NO: 309833

SEQ ID NO: 309999 - RNA, 64 nt, Homo Sapiens; identical to SEQ ID NO: 309834

SEQ ID NO: 310000 - RNA, 64 nt, Homo Sapiens; identical to SEQ ID NO: 309835

SEQ ID NO: 310001 - RNA, 64 nt, Homo Sapiens; identical to SEQ ID NO: 309836

SEQ ID NO: 310002 - RNA, 64 nt, Homo Sapiens; identical to SEQ ID NO: 309837

SEQ ID NO: 310003 - RNA, 64 nt, Homo Sapiens; identical to SEQ ID NO: 309838

SEQ ID NO: 310004 - RNA, 64 nt, Homo Sapiens; identical to SEQ ID NO: 309839

SEQ ID NO: 310005 - RNA, 64 nt, Homo Sapiens; identical to SEQ ID NO: 309840

SEQ ID NO: 310006 - RNA, 64 nt, Homo Sapiens; identical to SEQ ID NO: 309841

SEQ ID NO: 310007 - RNA, 64 nt, Homo Sapiens; identical to SEQ ID NO: 309842

SEQ ID NO: 310008 - RNA, 64 nt, Homo Sapiens; identical to SEQ ID NO: 309843

SEQ ID NO: 310009 - RNA, 64 nt, Homo Sapiens; identical to SEQ ID NO: 309844

SEQ ID NO: 310010 - RNA, 64 nt, Homo Sapiens; identical to SEQ ID NO: 309845

SEQ ID NO: 310011 - RNA, 64 nt, Homo Sapiens; identical to SEQ ID NO: 309846

SEQ ID NO: 310012 - RNA, 64 nt, Homo Sapiens; identical to SEQ ID NO: 309847

SEQ ID NO: 310013 - RNA, 64 nt, Homo Sapiens; identical to SEQ ID NO: 309848

SEQ ID NO: 310014 - RNA, 64 nt, Homo Sapiens; identical to SEQ ID NO: 309849

SEQ ID NO: 310015 - RNA, 64 nt, Homo Sapiens; identical to SEQ ID NO: 309850

SEQ ID NO: 310016 - RNA, 64 nt, Homo Sapiens; identical to SEQ ID NO: 309851

SEQ ID NO: 310017 - RNA, 64 nt, Homo Sapiens; identical to SEQ ID NO: 309852

SEQ ID NO: 310018 - RNA, 64 nt, Homo Sapiens; identical to SEQ ID NO: 309853

SEQ ID NO: 310019 - RNA, 64 nt, Homo Sapiens; identical to SEQ ID NO: 309854

SEQ ID NO: 310020 - RNA, 64 nt, Homo Sapiens; identical to SEQ ID NO: 309855

SEQ ID NO: 310021 - RNA, 64 nt, Homo Sapiens; identical to SEQ ID NO: 309856

SEQ ID NO: 310022 - RNA, 64 nt, Homo Sapiens; identical to SEQ ID NO: 309857

SEQ ID NO: 310023 - RNA, 64 nt, Homo Sapiens; identical to SEQ ID NO: 309858

SEQ ID NO: 310024 - RNA, 64 nt, Homo Sapiens; identical to SEQ ID NO: 309859

SEQ ID NO: 310025 - RNA, 64 nt, Homo Sapiens; identical to SEQ ID NO: 309860

SEQ ID NO: 310026 - RNA, 64 nt, Homo Sapiens; identical to SEQ ID NO: 309861

SEQ ID NO: 310027 - RNA, 64 nt, Homo Sapiens; identical to SEQ ID NO: 309862

SEQ ID NO: 310028 - RNA, 64 nt, Homo Sapiens; identical to SEQ ID NO: 309863

SEQ ID NO: 310029 - RNA, 64 nt, Homo Sapiens; identical to SEQ ID NO: 309864

SEQ ID NO: 310030 - RNA, 64 nt, Homo Sapiens; identical to SEQ ID NO: 309865

SEQ ID NO: 310031 - RNA, 64 nt, Homo Sapiens; identical to SEQ ID NO: 309866

SEQ ID NO: 310032 - RNA, 64 nt, Homo Sapiens; identical to SEQ ID NO: 309867

SEQ ID NO: 310033 - RNA, 64 nt, Homo Sapiens; identical to SEQ ID NO: 309868

SEQ ID NO: 310034 - RNA, 64 nt, Homo Sapiens; identical to SEQ ID NO: 309869

SEQ ID NO: 310035 - RNA, 64 nt, Homo Sapiens; identical to SEQ ID NO: 309870

SEQ ID NO: 310036 - RNA, 64 nt, Homo Sapiens; identical to SEQ ID NO: 309871

SEQ ID NO: 310037 - RNA, 64 nt, Homo Sapiens; identical to SEQ ID NO: 309872

SEQ ID NO: 310038 - RNA, 64 nt, Homo Sapiens; identical to SEQ ID NO: 309873

SEQ ID NO: 310039 - RNA, 64 nt, Homo Sapiens; identical to SEQ ID NO: 309874

SEQ ID NO: 310040 - RNA, 64 nt, Homo Sapiens; identical to SEQ ID NO: 309875

SEQ ID NO: 310041 - RNA, 64 nt, Homo Sapiens; identical to SEQ ID NO: 309876

SEQ ID NO: 310042 - RNA, 64 nt, Homo Sapiens; identical to SEQ ID NO: 309877

SEQ ID NO: 310043 - RNA, 64 nt, Homo Sapiens; identical to SEQ ID NO: 309878

SEQ ID NO: 310044 - RNA, 64 nt, Homo Sapiens; identical to SEQ ID NO: 309879

SEQ ID NO: 310045 - RNA, 64 nt, Homo Sapiens; identical to SEQ ID NO: 309880

SEQ ID NO: 310046 - RNA, 64 nt, Homo Sapiens; identical to SEQ ID NO: 309881

SEQ ID NO: 310047 - RNA, 64 nt, Homo Sapiens; identical to SEQ ID NO: 309882

SEQ ID NO: 310048 - RNA, 64 nt, Homo Sapiens; identical to SEQ ID NO: 309883

SEQ ID NO: 310049 - RNA, 64 nt, Homo Sapiens; identical to SEQ ID NO: 309884

SEQ ID NO: 310050 - RNA, 64 nt, Homo Sapiens; identical to SEQ ID NO: 309885

SEQ ID NO: 310051 - RNA, 64 nt, Homo Sapiens; identical to SEQ ID NO: 309886

SEQ ID NO: 310052 - RNA, 64 nt, Homo Sapiens; identical to SEQ ID NO: 309887

SEQ ID NO: 310053 - RNA, 64 nt, Homo Sapiens; identical to SEQ ID NO: 309888

SEQ ID NO: 310054 - RNA, 64 nt, Homo Sapiens; identical to SEQ ID NO: 309889

SEQ ID NO: 310055 - RNA, 64 nt, Homo Sapiens; identical to SEQ ID NO: 309890

SEQ ID NO: 310056 - RNA, 64 nt, Homo Sapiens; identical to SEQ ID NO: 309891

SEQ ID NO: 310057 - RNA, 64 nt, Homo Sapiens; identical to SEQ ID NO: 309892

SEQ ID NO: 310058 - RNA, 64 nt, Homo Sapiens; identical to SEQ ID NO: 309893

SEQ ID NO: 310059 - RNA, 64 nt, Homo Sapiens; identical to SEQ ID NO: 309894

SEQ ID NO: 310060 - RNA, 64 nt, Homo Sapiens; identical to SEQ ID NO: 309895

SEQ ID NO: 310061 - RNA, 64 nt, Homo Sapiens; identical to SEQ ID NO: 309896

SEQ ID NO: 310062 - RNA, 64 nt, Homo Sapiens; identical to SEQ ID NO: 309897

SEQ ID NO: 310063 - RNA, 64 nt, Homo Sapiens; identical to SEQ ID NO: 309898

SEQ ID NO: 310064 - RNA, 64 nt, Homo Sapiens; identical to SEQ ID NO: 309899

SEQ ID NO: 310065 - RNA, 64 nt, Homo Sapiens; identical to SEQ ID NO: 309900

SEQ ID NO: 310066 - RNA, 64 nt, Homo Sapiens; identical to SEQ ID NO: 309901

SEQ ID NO: 310067 - RNA, 64 nt, Homo Sapiens; identical to SEQ ID NO: 309902

SEQ ID NO: 310068 - RNA, 64 nt, Homo Sapiens; identical to SEQ ID NO: 309903

SEQ ID NO: 310069 - RNA, 64 nt, Homo Sapiens; identical to SEQ ID NO: 309904

SEQ ID NO: 310070 - RNA, 64 nt, Homo Sapiens; identical to SEQ ID NO: 309905

SEQ ID NO: 310071 - RNA, 64 nt, Homo Sapiens; identical to SEQ ID NO: 309906

SEQ ID NO: 310072 - RNA, 64 nt, Homo Sapiens; identical to SEQ ID NO: 309907

SEQ ID NO: 310073 - RNA, 64 nt, Homo Sapiens; identical to SEQ ID NO: 309908

SEQ ID NO: 310074 - RNA, 64 nt, Homo Sapiens; identical to SEQ ID NO: 309909

SEQ ID NO: 310075 - RNA, 64 nt, Homo Sapiens; identical to SEQ ID NO: 309910

SEQ ID NO: 310076 - RNA, 64 nt, Homo Sapiens; identical to SEQ ID NO: 309911

SEQ ID NO: 310077 - RNA, 64 nt, Homo Sapiens; identical to SEQ ID NO: 309912

SEQ ID NO: 310078 - RNA, 64 nt, Homo Sapiens; identical to SEQ ID NO: 309913

SEQ ID NO: 310079 - RNA, 64 nt, Homo Sapiens; identical to SEQ ID NO: 309914

SEQ ID NO: 310080 - RNA, 64 nt, Homo Sapiens; identical to SEQ ID NO: 209315

SEQ ID NO: 310081 - RNA, 64 nt, Homo Sapiens; identical to SEQ ID NO: 209316

SEQ ID NO: 310082 - RNA, 64 nt, Homo Sapiens; identical to SEQ ID NO: 209317

SEQ ID NO: 310083 - RNA, 64 nt, Homo Sapiens; identical to SEQ ID NO: 209318

SEQ ID NO: 310084 - RNA, 64 nt, Homo Sapiens; identical to SEQ ID NO: 209319

SEQ ID NO: 310085 - RNA, 64 nt, Homo Sapiens; identical to SEQ ID NO: 209320

SEQ ID NO: 310086 - RNA, 64 nt, Homo Sapiens; identical to SEQ ID NO: 209321

SEQ ID NO: 310087 - RNA, 64 nt, Homo Sapiens; identical to SEQ ID NO: 209322

SEQ ID NO: 310088 - RNA, 64 nt, Homo Sapiens; identical to SEQ ID NO: 209323

SEQ ID NO: 310089 - RNA, 64 nt, Homo Sapiens; identical to SEQ ID NO: 209324

SEQ ID NO: 310090 - RNA, 64 nt, Homo Sapiens; identical to SEQ ID NO: 209325

SEQ ID NO: 310091 - RNA, 64 nt, Homo Sapiens; identical to SEQ ID NO: 209326

SEQ ID NO: 310092 - RNA, 64 nt, Homo Sapiens; identical to SEQ ID NO: 209327

SEQ ID NO: 310093 - RNA, 64 nt, Homo Sapiens; identical to SEQ ID NO: 209328

SEQ ID NO: 310094 - RNA, 64 nt, Homo Sapiens; identical to SEQ ID NO: 209329

SEQ ID NO: 310095 - RNA, 64 nt, Homo Sapiens; identical to SEQ ID NO: 209330

SEQ ID NO: 310096 - RNA, 64 nt, Homo Sapiens; identical to SEQ ID NO: 209331

SEQ ID NO: 310097 - RNA, 64 nt, Homo Sapiens; identical to SEQ ID NO: 209332

SEQ ID NO: 310098 - RNA, 64 nt, Homo Sapiens; identical to SEQ ID NO: 209333

SEQ ID NO: 310099 - RNA, 64 nt, Homo Sapiens; identical to SEQ ID NO: 209334

SEQ ID NO: 310100 - RNA, 64 nt, Homo Sapiens; identical to SEQ ID NO: 209335

SEQ ID NO: 310101 - RNA, 64 nt, Homo Sapiens; identical to SEQ ID NO: 209336

SEQ ID NO: 310102 - RNA, 64 nt, Homo Sapiens; identical to SEQ ID NO: 209337

SEQ ID NO: 310103 - RNA, 64 nt, Homo Sapiens; identical to SEQ ID NO: 209338

SEQ ID NO: 310104 - RNA, 64 nt, Homo Sapiens; identical to SEQ ID NO: 209339

SEQ ID NO: 310105 - RNA, 64 nt, Homo Sapiens; identical to SEQ ID NO: 209340

SEQ ID NO: 310106 - RNA, 64 nt, Homo Sapiens; identical to SEQ ID NO: 209341

SEQ ID NO: 310107 - RNA, 64 nt, Homo Sapiens; identical to SEQ ID NO: 209342

SEQ ID NO: 310108 - RNA, 64 nt, Homo Sapiens; identical to SEQ ID NO: 209343

SEQ ID NO: 310109 - RNA, 64 nt, Homo Sapiens; identical to SEQ ID NO: 209344

SEQ ID NO: 310110 - RNA, 64 nt, Homo Sapiens; identical to SEQ ID NO: 209345

SEQ ID NO: 310111 - RNA, 64 nt, Homo Sapiens; identical to SEQ ID NO: 209346

SEQ ID NO: 310112 - RNA, 64 nt, Homo Sapiens; identical to SEQ ID NO: 209347

SEQ ID NO: 310113 - RNA, 64 nt, Homo Sapiens; identical to SEQ ID NO: 209348

SEQ ID NO: 310114 - RNA, 64 nt, Homo Sapiens; identical to SEQ ID NO: 209349

SEQ ID NO: 310115 - RNA, 64 nt, Homo Sapiens; identical to SEQ ID NO: 209350

SEQ ID NO: 310116 - RNA, 64 nt, Homo Sapiens; identical to SEQ ID NO: 209351

SEQ ID NO: 310117 - RNA, 64 nt, Homo Sapiens; identical to SEQ ID NO: 209352

SEQ ID NO: 310118 - RNA, 59 nt, Homo Sapiens
ucugcccuucacaaacaccucucucuccccugcacuagcugucccaagcuuacauacag

SEQ ID NO: 310119 - RNA, 59 nt, Homo Sapiens
ggcccgcggcucagccucggccgucugcccugcacuaccaaggccgaccacuagagguc

SEQ ID NO: 310120 - RNA, 59 nt, Homo Sapiens
cuugggucccacuuucuccaggaugccaacugcacuagcugugugcgaaugacguaucu

SEQ ID NO: 310121 - RNA, 59 nt, Homo Sapiens
ccuuaccccacccauccaugccagcacuucugcacuacggccauucuccucuugggcgc

SEQ ID NO: 310122 - RNA, 59 nt, Homo Sapiens
gcuaugacaugagcacacccaacgcaccccugcacuacuaugagaccguucgcauggca

SEQ ID NO: 310123 - RNA, 59 nt, Homo Sapiens
aauggaagacacaaaacugagagaucauucugcacuaaguuucgggaacuuauccccga

SEQ ID NO: 310124 - RNA, 59 nt, Homo Sapiens
gaacaucccccucccaacacuacccuucccugcacuaaagccagccugaccuuccuucc

SEQ ID NO: 310125 - RNA, 59 nt, Homo Sapiens
ugaacauccccucccaucauuacccuucccugcacuaaagccagccugaccuuccuucc

SEQ ID NO: 310126 - RNA, 59 nt, Homo Sapiens; identical to SEQ ID NO: 310125

SEQ ID NO: 310127 - RNA, 59 nt, Homo Sapiens
aaagucccccuccuaacgucuuccuuucccugcacuaacgccaaccugacugcuuuucc

SEQ ID NO: 310128 - RNA, 59 nt, Homo Sapiens
cugaaucugcuuauucuucagcuucaccucugcacuaaccccuuacccuuaugguacgu

SEQ ID NO: 310129 - RNA, 59 nt, Homo Sapiens
cucugucuuguggccaguuuggccuuucacugcacuauucugauggugccugacugaau

SEQ ID NO: 310130 - RNA, 59 nt, Homo Sapiens
accaaaacagcauguguaagaggcaguaucugcacuaauucucaacaugcuaaacauua

SEQ ID NO: 310131 - RNA, 59 nt, Homo Sapiens
gacauguggggccaggucacgauuaaccucugcacuacuuguguugucucuagagcagg

SEQ ID NO: 310132 - RNA, 59 nt, Homo Sapiens
agccuccaagcccccuggcagcuuggguucugcacuaaccaggggguagagagauuuca

SEQ ID NO: 310133 - RNA, 59 nt, Homo Sapiens
aacccaaauucugcaaaaaaugaaggaggcugcacuacauucuccuuguccuagucaga

SEQ ID NO: 310134 - RNA, 59 nt, Homo Sapiens
cuguucuguaguuauucugaaguuucacccugcacuacccuucuggaauauagagaaau

SEQ ID NO: 310135 - RNA, 59 nt, Homo Sapiens
cuuccugcuucccuaaggacugacagcugcugcacuagcucugccugugccuuuauccc

SEQ ID NO: 310136 - RNA, 59 nt, Homo Sapiens
uuacuguccuucugggaacucucuauucucugcacuaacauuuagcuauacuucaagua

SEQ ID NO: 310137 - RNA, 59 nt, Homo Sapiens
ucccuucuuuuuggagaacuuauauuacucugcacuauaauauauauguauaucaugua

SEQ ID NO: 310138 - RNA, 59 nt, Homo Sapiens
guauauaucagggacauuaauaaagcaaacugcacuagucagcuugaacaugcauuuuc

SEQ ID NO: 310139 - RNA, 59 nt, Homo Sapiens
uuuuucucaguuaccugcauaguugauuucugcacuaucaggaauaauuuuuuauuuaa

SEQ ID NO: 310140 - RNA, 59 nt, Homo Sapiens
uucuaagcacuuacaugugguauuauucacugcacuauaugcucaguuuucucuauucu

SEQ ID NO: 310141 - RNA, 59 nt, Homo Sapiens
agacacuuuguagaagaggaccuccugaacugcacuacauucacuuacaccugacugac

SEQ ID NO: 310142 - RNA, 59 nt, Homo Sapiens
augagggauggagguagcugugguuuggccugcacuacgauuguuaauuuuauaaaauu

SEQ ID NO: 310143 - RNA, 59 nt, Homo Sapiens
gucugguguagcuccucugcugcucccaucugcacuaauugacccaaaacguggguauu

SEQ ID NO: 310144 - RNA, 54 nt, Homo Sapiens
cccagcagcuggcacacugagcaccugcacuaaauuacucaaaaugugcuguaa

SEQ ID NO: 310145 - RNA, 59 nt, Homo Sapiens
gaaaauauggccauacugcuuuuuuaccccugcacuauuucagugcaccacagaauagg

SEQ ID NO: 310146 - RNA, 59 nt, Homo Sapiens
aguguagcugaggaggcaccuacacucaccugcacuaacagaguggccguccuaaccuc

SEQ ID NO: 310147 - RNA, 59 nt, Homo Sapiens
uggauucuguugaacuauggggucccacacugcacuauuaauuccacccacuguaaggg

SEQ ID NO: 310148 - RNA, 59 nt, Homo Sapiens
uguaugcauaagaccacuuuucccaaugacugcacuauauccagauuugauuguuuuac

SEQ ID NO: 310149 - RNA, 59 nt, Homo Sapiens
ccaaugucuuccauggagccgaugcugcacugcacuacuauugucugacccuagaggca

SEQ ID NO: 310150 - RNA, 59 nt, Homo Sapiens
acagauucuuaccgucuccauguauguagcugcacuacacaaaauugccugaauuguac

SEQ ID NO: 310151 - RNA, 59 nt, Homo Sapiens
cagcuuugaggauggcacugccuaccucccugcacuaacaaaacuggaaccaacucugc

SEQ ID NO: 310152 - RNA, 59 nt, Homo Sapiens
uuggaggacaaguagcacaaauuaggaaucugcacuauuuuuuugucccuggcggguaa

SEQ ID NO: 310153 - RNA, 59 nt, Homo Sapiens
cuuuucagagcacuucaucccuagagccgcugcacuaucgggcagaggaugcacggugg

SEQ ID NO: 310154 - RNA, 59 nt, Homo Sapiens
ugugaauggccuuccacuuccccuguggucugcacuacaauuacucuuuggccugggaa

SEQ ID NO: 310155 - RNA, 59 nt, Homo Sapiens
guacaauuuacaacaaugcugaaaaagaacugcacuacacauuuguaugguauuuuuau

SEQ ID NO: 310156 - RNA, 59 nt, Homo Sapiens
gcuauuacaaauauaacauguaauuccugcugcacuaaagcagacuagucuuauuuuuu

SEQ ID NO: 310157 - RNA, 59 nt, Homo Sapiens
ggcacguacugcagugugaaguuacacuccugcacuaaaucaagaggaauaccacuuau

SEQ ID NO: 310158 - RNA, 59 nt, Homo Sapiens
auguugcccaguaaaaguauacaaauucccugcacuagcagaagagaauucuguaucag

SEQ ID NO: 310159 - RNA, 59 nt, Homo Sapiens
ccuaguaguuccugaaacugugagcaccacugcacuaagccagugcggagcuguuaggg

SEQ ID NO: 310160 - RNA, 59 nt, Homo Sapiens
cuggagucauacccagccuaaguguugcccugcacuauggcuggaggacacauuuggua

SEQ ID NO: 310161 - RNA, 59 nt, Homo Sapiens
uggagagaaguggaauccuauauagaaugcugcacuaauugacaacacagccuauaggc

SEQ ID NO: 310162 - RNA, 59 nt, Homo Sapiens
uuucuguuuacugucaaaauauuucucaucugcacuauguuuccauuugugguccugaa

SEQ ID NO: 310163 - RNA, 59 nt, Homo Sapiens
agacuuugauuucuccaaguguguaucaucugcacuaggaacuuuguuuuuaagcaaua

SEQ ID NO: 310164 - RNA, 59 nt, Homo Sapiens
ccuggcuuuccuuggauacccacugucaccugcacuaugaagugcugcuggcugggcuu

SEQ ID NO: 310165 - RNA, 59 nt, Homo Sapiens
gucuuggaaggacuacuacucaauggccccugcacuacucuacuuccucuuaccuaugu

SEQ ID NO: 310166 - RNA, 59 nt, Homo Sapiens
ggagguuccagagagccaagaucgcaccacugcacuacagccugggcgacagaacgaga

SEQ ID NO: 310167 - RNA, 59 nt, Homo Sapiens
uagauccgaaugaaccuuauccuuuuucucugcacuauuuuauuuuugaagaagaauag

SEQ ID NO: 310168 - RNA, 59 nt, Homo Sapiens
auuccuuagaggaaacaguuaggguuaugcugcacuaguaaaauaaaugaaauuauuua

SEQ ID NO: 310169 - RNA, 59 nt, Homo Sapiens
uguuuuccucuguuuuacaauaauacagacugcacuaaaacagaaaaguuggaaaagga

SEQ ID NO: 310170 - RNA, 59 nt, Homo Sapiens
cggucaggauuccuugcugccagcccgggcugcacuauggaggcccagaugugggcagg

SEQ ID NO: 310171 - RNA, 59 nt, Homo Sapiens
cauucagacuucauugagcuggaagauaccugcacuaaugaaauauguaaagaaaaaca

SEQ ID NO: 310172 - RNA, 59 nt, Homo Sapiens
acaagauuauguuuucuuccaggauguuccugcacuauauucuaauccucauuuccugu

SEQ ID NO: 310173 - RNA, 59 nt, Homo Sapiens
ccaagaacuugcugccuugcuuucucccucugcacuagggacaguggagccaguuuggu

SEQ ID NO: 310174 - RNA, 59 nt, Homo Sapiens
cacuuuccaggcaggccuggcccugcccucugcacuaaggagaggccucccccaugccu

SEQ ID NO: 310175 - RNA, 59 nt, Homo Sapiens
acccacuaaaaagaugcgaacuugaaggacugcacuaaaaagggcaaucuaaauugugg

SEQ ID NO: 310176 - RNA, 59 nt, Homo Sapiens
aaugcucagucugaucaacaagugggcaccugcacuaccacuuuuuagaggaaauucac

SEQ ID NO: 310177 - RNA, 59 nt, Homo Sapiens
cccuuucucuuaaaaaccauggcauuagacugcacuaaauuaacaagcauguuaguugc

SEQ ID NO: 310178 - RNA, 59 nt, Homo Sapiens
uggauuaauuccuucuguucauuuuccaacugcacuaauugugcauauuacucugccua

SEQ ID NO: 310179 - RNA, 59 nt, Homo Sapiens
ccacacuaguucaugguaucgggagcuuucugcacuaggcucagaauuucaggccugcu

SEQ ID NO: 310180 - RNA, 59 nt, Homo Sapiens
gauuuuucuguuuuugaaaagguuucuuucugcacuagacaaaggaaucugcucuuuga

SEQ ID NO: 310181 - RNA, 59 nt, Homo Sapiens
ucaguauaacugcauuucuaucccacaaacugcacuacaggagaacaccauuccugauu

SEQ ID NO: 310182 - RNA, 59 nt, Homo Sapiens
ccuuuugagacauccuuuauaagcuaaaacugcacuaaguucuacuucugaaguuauua

SEQ ID NO: 310183 - RNA, 59 nt, Homo Sapiens
auggaugcuuuccacaaaaugucaccucgcugcacuaaaggaugaugaauccuaaucau

SEQ ID NO: 310184 - RNA, 59 nt, Homo Sapiens
uccagccucugggaaucagcccccccucucugcacuauccgauccucaucaacagaggg

SEQ ID NO: 310185 - RNA, 59 nt, Homo Sapiens
cauucauguaacaaaacccagcacauuaucugcacuauaagcucaaagaaugucacauc

SEQ ID NO: 310186 - RNA, 58 nt, Homo Sapiens
aaaagcaaauuuuccagucuucuaaagcucugcacuacauaaauaaaacugugcuugc

SEQ ID NO: 310187 - RNA, 59 nt, Homo Sapiens
aaagagaggcucuuuuuuuugguuuauaacugcacuaauccagaccugaaaggguaaag

SEQ ID NO: 310188 - RNA, 59 nt, Homo Sapiens
agaaaauugcacuaaaugaagggcuggcucugcacuaagaaagcauaacaccaauccca

SEQ ID NO: 310189 - RNA, 59 nt, Homo Sapiens
aagaaucacuuuaaaaagcaugagugucccugcacuaagguauaacaagcauagacaaa

SEQ ID NO: 310190 - RNA, 59 nt, Homo Sapiens
uuuuguuggacuuggcauguuuccaugaacugcacuauuauaaacuauuaaaaugauag

SEQ ID NO: 310191 - RNA, 59 nt, Homo Sapiens
aacauuuuucauauucgaagugguugucucugcacuauuuacugaaaaguucauccuuu

SEQ ID NO: 310192 - RNA, 59 nt, Homo Sapiens
uggaccuagcuugaggcaauuuuaauccccugcacuaggcagguaauaauaaagguuga

SEQ ID NO: 310193 - RNA, 59 nt, Homo Sapiens
aaacacaggccaucagggaaaacgaaaugcugcacuauuaaauuagagguuuuugaaaa

SEQ ID NO: 310194 - RNA, 59 nt, Homo Sapiens
agccggcugagugcaccgcccggcugcuucugcacuagcggguggggugguaugguggu

SEQ ID NO: 310195 - RNA, 59 nt, Homo Sapiens
gccaugcagcccucccugaggauugacuucugcacuaauccagugaaggaggcuguguc

SEQ ID NO: 310196 - RNA, 59 nt, Homo Sapiens
guacauagugcuaacaugaagaccuuuuucugcacuauaugcaaacaggguaacuaacu

SEQ ID NO: 310197 - RNA, 59 nt, Homo Sapiens
uggguuuaacugaccagagcgagagaacucugcacuaugaacccaaacccagcucaaaa

SEQ ID NO: 310198 - RNA, 59 nt, Homo Sapiens
aauaaauugcauguguuccucgcugauagcugcacuauuaguuauuuuuaccauccggg

SEQ ID NO: 310199 - RNA, 59 nt, Homo Sapiens
cuuuugcucuuacgaacauauuuggccuucugcacuacugaaacuuuaguacuuagaau

SEQ ID NO: 310200 - RNA, 59 nt, Homo Sapiens
auuucuguaaggaguaauuugaguaacaacugcacuaggccacaccaaaacgcugaaga

SEQ ID NO: 310201 - RNA, 59 nt, Homo Sapiens
gauguggagccuucauauguuaaauauuccugcacuagugauggucacuuagaauguuu

SEQ ID NO: 310202 - RNA, 59 nt, Homo Sapiens
uuauguuccucugugugcuaaacugaagucugcacuagaaguacagagagaauggccag

SEQ ID NO: 310203 - RNA, 59 nt, Homo Sapiens
cuagucuaucuuuucuaucuuggcacaugcugcacuaacuauguauucuucaaaacauu

SEQ ID NO: 310204 - RNA, 59 nt, Homo Sapiens
aggguuacugguuuauuuucaaaugguuacugcacuaccggaaguuuguccuguuaacc

SEQ ID NO: 310205 - RNA, 59 nt, Homo Sapiens
ugugcagaagagcagauaacaggaauucucugcacuagcauuaguaaggugaacuguuc

SEQ ID NO: 310206 - RNA, 59 nt, Homo Sapiens
gggacguagugugaacauccguaccguaacugcacuaaauugguuacuugcagccugaa

SEQ ID NO: 310207 - RNA, 59 nt, Homo Sapiens
uuucuacacuacaggaauuacagugaaggcugcacuaguccaccugagaugcugaccag

SEQ ID NO: 310208 - RNA, 59 nt, Homo Sapiens
ucaggccagguagcccuggcggcgcgccucugcacuaacagaugccccagccugcagag

SEQ ID NO: 310209 - RNA, 59 nt, Homo Sapiens
augauugcuaugaucuuugagaaauuuuucugcacuauuugcacugaaauguuuauuua

SEQ ID NO: 310210 - RNA, 59 nt, Homo Sapiens
acuucagccaacaggggugucugcuucugcugcacuacacaggccaggaguggcauucc

SEQ ID NO: 310211 - RNA, 59 nt, Homo Sapiens
ggauaaaacuuggccuagaaaaguuuggucugcacuauaaaacauuuuacuuauuuucc

SEQ ID NO: 310212 - RNA, 59 nt, Homo Sapiens
cucuucucuguuuccugccaagaccucaucugcacuaaugccuucucccugaccuugac

SEQ ID NO: 310213 - RNA, 59 nt, Homo Sapiens
acgagccuuuguuuuucuccggcacagagcugcacuauccaaaagggaggcucucugua

SEQ ID NO: 310214 - RNA, 59 nt, Homo Sapiens
guugaguuugauuuuuauuggucuaaggacugcacuauaaaagggugaaggaaauccuu

SEQ ID NO: 310215 - RNA, 59 nt, Homo Sapiens
acaggaaauaacauauguaagccccgaggcugcacuaccgcgauagggaacgcgcccuu

SEQ ID NO: 310216 - RNA, 59 nt, Homo Sapiens
auuaaaaguugugcaugggcuaucagacccugcacuaagauuuauuacuaugucuuauu

SEQ ID NO: 310217 - RNA, 59 nt, Homo Sapiens
uugguaauuuuuauuuuuuauuuuugggacugcacuauccuguucacgaagacauguga

SEQ ID NO: 310218 - RNA, 59 nt, Homo Sapiens
aaaucacccaaauuucaguucuuuaccuacugcacuaacaauggcaagggggguauucu

SEQ ID NO: 310219 - RNA, 59 nt, Homo Sapiens
aauauuguuuuucuagaggacauucauaucugcacuauuaucugaugacauguugguaa

SEQ ID NO: 310220 - RNA, 59 nt, Homo Sapiens
auguggaggcuugaugcugcgguugggggcugcacuaccugcguccguggaagccucug

SEQ ID NO: 310221 - RNA, 59 nt, Homo Sapiens
guuuccgaugagguguacggaugagugaccugcacuaagaagugaguugccacagugaa

SEQ ID NO: 310222 - RNA, 59 nt, Homo Sapiens
gaggucgggaggaaguuaauuauuucugucugcacuagagggguauggaauauggaauc

SEQ ID NO: 310223 - RNA, 59 nt, Homo Sapiens
auuaauuuguuuacaagaagagcacagaacugcacuaggacucauugcuaaaaaugugu

SEQ ID NO: 310224 - RNA, 59 nt, Homo Sapiens
auauuguucuuuuggggcucuaguucaugcugcacuaccgaaaauuagaaauugcaugu

SEQ ID NO: 310225 - RNA, 59 nt, Homo Sapiens
aacaagagauaaaauuguuagcccuuucucugcacuaccaguaauauuucugguuuuua

SEQ ID NO: 310226 - RNA, 59 nt, Homo Sapiens
gcaggaggguuggagggcugguuuuugcacugcacuaagugagauuuguguuugguuug

SEQ ID NO: 310227 - RNA, 59 nt, Homo Sapiens
aguuguuguuuuucucccuaaucuaucagcugcacuacuugagaaaauuuaaaguguuu

SEQ ID NO: 310228 - RNA, 59 nt, Homo Sapiens
uuauuauguuuuuuaaaaugugagaacuucugcacuacaaaauucccuucacagagaag

SEQ ID NO: 310229 - RNA, 59 nt, Homo Sapiens
uccaaauaaauaguacuggucauuucucucugcacuauuucugcgcgcugucuucugag

SEQ ID NO: 310230 - RNA, 59 nt, Homo Sapiens
caacacaaaaucucuguuuugugagaauacugcacuauggaauaauugacaaauugaaa

SEQ ID NO: 310231 - RNA, 59 nt, Homo Sapiens
agugaaaaagaaauuauauucagauaggacugcacuacauuauuugucacacauggauc

SEQ ID NO: 310232 - RNA, 59 nt, Homo Sapiens
guggccaaagcauggccuuaccagcuugucugcacuauuuucuuuuggguggugacugu

SEQ ID NO: 310233 - RNA, 59 nt, Homo Sapiens
auuuuaauuguccucacuuuuuuuugaaacugcacuaaauuuuucuuaacauuccaaga

SEQ ID NO: 310234 - RNA, 59 nt, Homo Sapiens
uugauguuuacagguggacagaauuuggccugcacuaauauugcuaugaaugauacccu

SEQ ID NO: 310235 - RNA, 59 nt, Homo Sapiens
aguacaaugcuuguuaaugguuacuuuagcugcacuaacgauauguuuuucugauauaa

SEQ ID NO: 310236 - RNA, 59 nt, Homo Sapiens
cugcggaccgcuuccuuccacagcgagaacugcacuaccuucuguuguacuuuaauuau

SEQ ID NO: 310237 - RNA, 59 nt, Homo Sapiens
aauaucuuuaaaggagagaugucaacuuucugcacuauucccagccucugcuccucccu

SEQ ID NO: 310238 - RNA, 59 nt, Homo Sapiens
ucauccugcuuaauccuuccagcaugucucugcacuaauaaacagcuaaauucacauaa

SEQ ID NO: 310239 - RNA, 59 nt, Homo Sapiens
gagauguuuuccaggaaggggcucagaagcugcacuaggccccgaguccccaugugucu

SEQ ID NO: 310240 - RNA, 59 nt, Homo Sapiens
agugggacuaguucuucacaguguggcagcugcacuaaucuguuugugagggaauaucc

SEQ ID NO: 310241 - RNA, 59 nt, Homo Sapiens
uuucuggcugaucccaaucacuucaccaucugcacuacaugcuuuauccccuucucuuc

SEQ ID NO: 310242 - RNA, 59 nt, Homo Sapiens
ucacuuuguguuuucugauuugagaaucacugcacuagaauucugauacacacuaaagu

SEQ ID NO: 310243 - RNA, 59 nt, Homo Sapiens
cuaaggagaagccagaugccaauccacagcugcacuaaguagagaggccacuuucccag

SEQ ID NO: 310244 - RNA, 59 nt, Homo Sapiens
ugcucccccugagccagcaccugcgggagcugcacuacagcccuggccuccacccccac

SEQ ID NO: 310245 - RNA, 59 nt, Homo Sapiens
aucugaaaugaucuuaauuacuagaagaucugcacuauuaacuuugugaagaguuucuc

SEQ ID NO: 310246 - RNA, 59 nt, Homo Sapiens
agccuaucaggacugcacucucuucucggcugcacuaaagcuggcacucccccagccgu

SEQ ID NO: 310247 - RNA, 59 nt, Homo Sapiens
acaauugugguuuauugaaugugauuuuucugcacuaauauaaauuagacuaaguguuu

SEQ ID NO: 310248 - RNA, 59 nt, Homo Sapiens
uuacucuagaauucuaauacagauacuuucugcacuaguaucacuuuuauuauugcagu

SEQ ID NO: 310249 - RNA, 59 nt, Homo Sapiens
ugcccguaucaucaugauugguacccugacugcacuacagugguuuaucuaugacuccg

SEQ ID NO: 310250 - RNA, 59 nt, Homo Sapiens
gcauaaucugagccagaguucagagccaucugcacuauuggguggguggcagaggggag

SEQ ID NO: 310251 - RNA, 59 nt, Homo Sapiens
ggccguggaagcuugaccagacccuuagccugcacuaaguuggagcaaaggcacaguuc

SEQ ID NO: 310252 - RNA, 59 nt, Homo Sapiens
ccagggaguaggggacccuugggcaaggacugcacuagucaucucuggucuggggcuga

SEQ ID NO: 310253 - RNA, 59 nt, Homo Sapiens
aauaaaccuuuuacucaacuugguguugacugcacuaauguguuguaugugcuguucca

SEQ ID NO: 310254 - RNA, 59 nt, Homo Sapiens
caauuaguauuuucauuuacugcugucaccugcacuauccaccuucacagcuuccucgc

SEQ ID NO: 310255 - RNA, 59 nt, Homo Sapiens
uaauauagaacuaugaauauuuuaguugacugcacuauaauggugucacuuagauugac

SEQ ID NO: 310256 - RNA, 59 nt, Homo Sapiens
gggaauggauuguggcugaaugccccaagcugcacuauuguauauugaacccuagcuag

SEQ ID NO: 310257 - RNA, 59 nt, Homo Sapiens
ggcucuugugccugcuguagacauuaggccugcacuagggccaugugcugucaagauuc

SEQ ID NO: 310258 - RNA, 59 nt, Homo Sapiens
uuugguagcucagugugcaugccguuuggcugcacuaacgcaacaggaaggggccuggg

SEQ ID NO: 310259 - RNA, 59 nt, Homo Sapiens
gacuuaggauccuuuuaucaccacuccugcugcacuaaggggcccugcaaccuucccag

SEQ ID NO: 310260 - RNA, 59 nt, Homo Sapiens
acccaccucuggaagacugguggaggucacugcacuacccuucucuccucagccuaggg

SEQ ID NO: 310261 - RNA, 59 nt, Homo Sapiens
aagaguauucuaguguucucuaaugaugccugcacuaucaagcuuuuucuuuuccuuuu

SEQ ID NO: 310262 - RNA, 59 nt, Homo Sapiens
uucucaauuuuaauauuaagaaguguggccugcacuauaacaauugauugaccacauga

SEQ ID NO: 310263 - RNA, 59 nt, Homo Sapiens
auuugcuuuaacuauuauggcaauacaaacugcacuaugaaaggaaaaauaaggaaauu

SEQ ID NO: 310264 - RNA, 59 nt, Homo Sapiens
uaauuaugguaccugcugccccuuuucagcugcacuauuagaaauguaccaacucaaug

SEQ ID NO: 310265 - RNA, 59 nt, Homo Sapiens
ugacgauagucccauuugggugguuucagcugcacuaucuguaugaaauggugucacca

SEQ ID NO: 310266 - RNA, 59 nt, Homo Sapiens
uaaugcaaauuaauaaaaugacacuuuuacugcacuauagaaauauucauguauguuaa

SEQ ID NO: 310267 - RNA, 59 nt, Homo Sapiens
gugcaccguuccccuccucggcuugaguccugcacuaccaaaauggccuggccauuuga

SEQ ID NO: 310268 - RNA, 59 nt, Homo Sapiens
caggagaauggaaagaaaaggaaccuccucugcacuaaaguuguuaggaaggcaccaaa

SEQ ID NO: 310269 - RNA, 59 nt, Homo Sapiens
aaguggaugcccagcggaagguaccugcccugcacuauggcaaggcucuggacuucuuu

SEQ ID NO: 310270 - RNA, 59 nt, Homo Sapiens
uaaugcacauugaguuuuguucuuuguuucugcacuaaucuuugcacuugcugaaucug

SEQ ID NO: 310271 - RNA, 59 nt, Homo Sapiens
agagguugcagugagccgagaucacgccacugcacuauagccuaggugacagagugaga

SEQ ID NO: 310272 - RNA, 59 nt, Homo Sapiens
cggaggggcgcgcuggggcuucgaccuggcugcacuaacccaggcuccuccucgccccg

SEQ ID NO: 310273 - RNA, 59 nt, Homo Sapiens
guccucacaucuuucacacuuccaccagccugcacuacucccucaaagcacacgucaug

SEQ ID NO: 310274 - RNA, 59 nt, Homo Sapiens
uauuuuugugagucuccguggcccccacccugcacuaccacguuuacacagggugggcu

SEQ ID NO: 310275 - RNA, 59 nt, Homo Sapiens
aacacuggacacccucgccagggccacuucugcacuagggcucugugcuggaacccagg

SEQ ID NO: 310276 - RNA, 59 nt, Homo Sapiens
cauucgcagugcccagugauggcauuacucugcacuauagccauuugccccaacuuaag

SEQ ID NO: 310277 - RNA, 59 nt, Homo Sapiens
ugguccaguaccuggcugagcugcugaagcugcacuacaugcaggaaucuccagggacc

SEQ ID NO: 310278 - RNA, 59 nt, Homo Sapiens
ccauccuuuccucucuccccguucaugcccugcacuacauagcacagccgggaugcuug

SEQ ID NO: 310279 - RNA, 59 nt, Homo Sapiens
gucuuaaaauugccaccugcacuuuguuucugcacuauuauguagugcauuuuaacuua

SEQ ID NO: 310280 - RNA, 59 nt, Homo Sapiens
guucguggggaacugcguggugcucuuugcugcacuauuugccgucaucgggaggagca

SEQ ID NO: 310281 - RNA, 59 nt, Homo Sapiens
acuugguaagaugacucugagccacccugcugcacuaggcugagccaagggagggaagg

SEQ ID NO: 310282 - RNA, 59 nt, Homo Sapiens
cuucuccacgggcacggagugaaccguuucugcacuaauugucccacaccugccauauu

SEQ ID NO: 310283 - RNA, 59 nt, Homo Sapiens
cgcggaacauugcacuaaacgucgucgagcugcacuaggccuggccugagccucugaaa

SEQ ID NO: 310284 - RNA, 59 nt, Homo Sapiens
uuuccuuguaaaugauuugagggugcuuucugcacuagugcugacaggcaacauuuuug

SEQ ID NO: 310285 - RNA, 59 nt, Homo Sapiens
aacugacagugcuacauuaaagcaagcuucugcacuaguauaaacaauuaauuuugccc

SEQ ID NO: 310286 - RNA, 59 nt, Homo Sapiens
aaauucauuugacuuuggagucaccccuacugcacuaccagcucauaaagaauugggac

SEQ ID NO: 310287 - RNA, 59 nt, Homo Sapiens
gacaaauagcacuagaggcugugucacaacugcacuaaaaaauuauggaucaugccgaa

SEQ ID NO: 310288 - RNA, 59 nt, Homo Sapiens
ggguguggucaaggggcacucagagacaccugcacuagaaauugcauugacauugugag

SEQ ID NO: 310289 - RNA, 59 nt, Homo Sapiens
cugggagcucuguuguguggcuucccggacugcacuaggcaagggacaguuccauggcc

SEQ ID NO: 310290 - RNA, 59 nt, Homo Sapiens
auuugguuugccaaaucagagagcgaacacugcacuaagguucuggguaaggggacgag

SEQ ID NO: 310291 - RNA, 59 nt, Homo Sapiens
uuggagaaguuagugucagauuguggagucugcacuaaccuaacuuggacugcacuaac

SEQ ID NO: 310292 - RNA, 59 nt, Homo Sapiens
uuguggagucugcacuaacuuaacuuggacugcacuaaccuaacuaacuugcacugcac

SEQ ID NO: 310293 - RNA, 59 nt, Homo Sapiens
uuggacugcacuaacuuguguaacuugcacugcacuaaccuaauuuagacugcacuaac

SEQ ID NO: 310294 - RNA, 59 nt, Homo Sapiens
uaacuugcacugcacuaacuuaauuuagacugcacuaacuuaacuuguggagucugcac

SEQ ID NO: 310295 - RNA, 59 nt, Homo Sapiens
uuagacugcacuaacuaacuuuguggagucugcacuaaucuuggacugagccccuuaac

SEQ ID NO: 310296 - RNA, 59 nt, Homo Sapiens
uggugauaauaaagaccuuacuaccuugccugcacuaacucacccuccacuggaaucac

SEQ ID NO: 310297 - RNA, 59 nt, Homo Sapiens
ccuguccuuuagggaagcuggagccaucucugcacuaacugcccucccaaauaucuugg

SEQ ID NO: 310298 - RNA, 59 nt, Homo Sapiens
guacuuuaaguuccagaaugaacauguagcugcacuaugccagaaauuaaugagggaag

SEQ ID NO: 310299 - RNA, 59 nt, Homo Sapiens
ccacucccaggaccaagauuggccugaggcugcacuaaaauucacuuagggucgagcau

SEQ ID NO: 310300 - RNA, 59 nt, Homo Sapiens
cucuuaaggaaaccacuguacaaaugacacugcacuaggauuauugggaaggaaucauu

SEQ ID NO: 310301 - RNA, 59 nt, Homo Sapiens
gagagccgggccccggacggacguugguucugcacuaaaacccaucuuccccggaugug

SEQ ID NO: 310302 - RNA, 59 nt, Homo Sapiens
uaaaauaagcaguuuagauuccgacgacacugcacuaauuggcaugucagccuccagcu

SEQ ID NO: 310303 - RNA, 59 nt, Homo Sapiens
cauuugucaugcuguaguugauuuuguaacugcacuaaagccaaggaaaguaaaaugug

SEQ ID NO: 310304 - RNA, 59 nt, Homo Sapiens
gccuggaccacagagcaggcauggaaccacugcacuauaagaagcugcagugagcucug

SEQ ID NO: 310305 - RNA, 59 nt, Homo Sapiens
gcuccugccccuucugcccugccuugccccugcacuaugcucuuggcuccuguggaagg

SEQ ID NO: 310306 - RNA, 59 nt, Homo Sapiens
cccaacuccccacuucugccgacuggcagcugcacuaucccugucucgggcuccccacc

SEQ ID NO: 310307 - RNA, 59 nt, Homo Sapiens
uuaggaccugcagcauguagugcuuggcacugcacuaguuggccacaggcccagugugc

SEQ ID NO: 310308 - RNA, 59 nt, Homo Sapiens
gguucuuaaguuuuuuaucuucacaaaugcugcacuauuguuuguuuugcgcucuccug

SEQ ID NO: 310309 - RNA, 59 nt, Homo Sapiens
uuaccugguuucguaggaaaaacagaaaucugcacuaauauuuuuuuuaagaauacaaa

SEQ ID NO: 310310 - RNA, 59 nt, Homo Sapiens
cuuucagaugucuucugccuguuauaacucugcacuacuccucugcagugccuugggga

SEQ ID NO: 310311 - RNA, 59 nt, Homo Sapiens
gaucuccaaacugaugucccugugaacaccugcacuaugagaagguuucccaacaagag

SEQ ID NO: 310312 - RNA, 59 nt, Homo Sapiens
gguccaucccgucuucaggaucaucuacacugcacuaggggagccccaggaaggcagca

SEQ ID NO: 310313 - RNA, 59 nt, Homo Sapiens
cugccucugcucucuugucucacauccaacugcacuaaagcgccuccaccccuaccccg

SEQ ID NO: 310314 - RNA, 59 nt, Homo Sapiens
aauucaaugcccuucauccaaucuuucgucugcacuaccucccucuccuugcuggcucc

SEQ ID NO: 310315 - RNA, 64 nt, Homo Sapiens
gggaaacaaacugccccguuaacuccagaucauugcacuggaauguaaucaagaaaguuaguca

SEQ ID NO: 310316 - RNA, 64 nt, Homo Sapiens
cugaguaccuacuagguaccaaguacucuuuuaggcacuggaaauacagugauggacaaaacag

SEQ ID NO: 310317 - RNA, 64 nt, Homo Sapiens
ucgagccuacaagccccgagagaaugaugaauuggcacuggagaaagccgacguggugauggug

SEQ ID NO: 310318 - RNA, 64 nt, Homo Sapiens
uuugugcuuggugggggggauuucgagggacuuugcacuggacucugggaaccuuucaucauua

SEQ ID NO: 310319 - RNA, 64 nt, Homo Sapiens
uaaaacaacauauuguguugggccaccuguacugaacgcugaaucguuuuuccucuuaaguuga

SEQ ID NO: 310320 - RNA, 64 nt, Homo Sapiens
cccugugugugaaaucuuaacgucucuacuugggaacgcugaucccauucauuuagaguugaug

SEQ ID NO: 310321 - RNA, 64 nt, Homo Sapiens; identical to SEQ ID NO: 250794

SEQ ID NO: 310322 - RNA, 64 nt, Homo Sapiens; identical to SEQ ID NO: 250795

SEQ ID NO: 310323 - RNA, 64 nt, Homo Sapiens; identical to SEQ ID NO: 250796

SEQ ID NO: 310324 - RNA, 64 nt, Homo Sapiens; identical to SEQ ID NO: 250797

SEQ ID NO: 310325 - RNA, 64 nt, Homo Sapiens; identical to SEQ ID NO: 250798

SEQ ID NO: 310326 - RNA, 64 nt, Homo Sapiens; identical to SEQ ID NO: 250799

SEQ ID NO: 310327 - RNA, 64 nt, Homo Sapiens; identical to SEQ ID NO: 250800

SEQ ID NO: 310328 - RNA, 64 nt, Homo Sapiens; identical to SEQ ID NO: 250801

SEQ ID NO: 310329 - RNA, 64 nt, Homo Sapiens; identical to SEQ ID NO: 250802

SEQ ID NO: 310330 - RNA, 64 nt, Homo Sapiens; identical to SEQ ID NO: 250803

SEQ ID NO: 310331 - RNA, 64 nt, Homo Sapiens; identical to SEQ ID NO: 250804

SEQ ID NO: 310332 - RNA, 64 nt, Homo Sapiens; identical to SEQ ID NO: 250805

SEQ ID NO: 310333 - RNA, 64 nt, Homo Sapiens; identical to SEQ ID NO: 250806

SEQ ID NO: 310334 - RNA, 64 nt, Homo Sapiens; identical to SEQ ID NO: 250807

SEQ ID NO: 310335 - RNA, 64 nt, Homo Sapiens; identical to SEQ ID NO: 250808

SEQ ID NO: 310336 - RNA, 64 nt, Homo Sapiens; identical to SEQ ID NO: 250809

SEQ ID NO: 310337 - RNA, 64 nt, Homo Sapiens; identical to SEQ ID NO: 250810

SEQ ID NO: 310338 - RNA, 64 nt, Homo Sapiens; identical to SEQ ID NO: 250811

SEQ ID NO: 310339 - RNA, 64 nt, Homo Sapiens; identical to SEQ ID NO: 250812

SEQ ID NO: 310340 - RNA, 64 nt, Homo Sapiens; identical to SEQ ID NO: 250813

SEQ ID NO: 310341 - RNA, 64 nt, Homo Sapiens; identical to SEQ ID NO: 250814

SEQ ID NO: 310342 - RNA, 64 nt, Homo Sapiens; identical to SEQ ID NO: 250815

SEQ ID NO: 310343 - RNA, 64 nt, Homo Sapiens; identical to SEQ ID NO: 250816

SEQ ID NO: 310344 - RNA, 64 nt, Homo Sapiens; identical to SEQ ID NO: 250817

SEQ ID NO: 310345 - RNA, 64 nt, Homo Sapiens; identical to SEQ ID NO: 250818

SEQ ID NO: 310346 - RNA, 64 nt, Homo Sapiens; identical to SEQ ID NO: 250819

SEQ ID NO: 310347 - RNA, 64 nt, Homo Sapiens; identical to SEQ ID NO: 250820

SEQ ID NO: 310348 - RNA, 64 nt, Homo Sapiens; identical to SEQ ID NO: 250821

SEQ ID NO: 310349 - RNA, 64 nt, Homo Sapiens; identical to SEQ ID NO: 250822

SEQ ID NO: 310350 - RNA, 64 nt, Homo Sapiens; identical to SEQ ID NO: 250823

SEQ ID NO: 310351 - RNA, 64 nt, Homo Sapiens; identical to SEQ ID NO: 250824

SEQ ID NO: 310352 - RNA, 64 nt, Homo Sapiens; identical to SEQ ID NO: 250825

SEQ ID NO: 310353 - RNA, 64 nt, Homo Sapiens; identical to SEQ ID NO: 250826

SEQ ID NO: 310354 - RNA, 64 nt, Homo Sapiens; identical to SEQ ID NO: 250827

SEQ ID NO: 310355 - RNA, 64 nt, Homo Sapiens; identical to SEQ ID NO: 250828

SEQ ID NO: 310356 - RNA, 64 nt, Homo Sapiens; identical to SEQ ID NO: 250829

SEQ ID NO: 310357 - RNA, 64 nt, Homo Sapiens; identical to SEQ ID NO: 250830

SEQ ID NO: 310358 - RNA, 64 nt, Homo Sapiens; identical to SEQ ID NO: 250831

SEQ ID NO: 310359 - RNA, 64 nt, Homo Sapiens; identical to SEQ ID NO: 250832

SEQ ID NO: 310360 - RNA, 64 nt, Homo Sapiens; identical to SEQ ID NO: 250833

SEQ ID NO: 310361 - RNA, 64 nt, Homo Sapiens; identical to SEQ ID NO: 250834

SEQ ID NO: 310362 - RNA, 64 nt, Homo Sapiens; identical to SEQ ID NO: 250835

SEQ ID NO: 310363 - RNA, 64 nt, Homo Sapiens; identical to SEQ ID NO: 250836

SEQ ID NO: 310364 - RNA, 64 nt, Homo Sapiens; identical to SEQ ID NO: 250837

SEQ ID NO: 310365 - RNA, 64 nt, Homo Sapiens; identical to SEQ ID NO: 250838

SEQ ID NO: 310366 - RNA, 64 nt, Homo Sapiens; identical to SEQ ID NO: 250839

SEQ ID NO: 310367 - RNA, 58 nt, Homo Sapiens; identical to SEQ ID NO: 250840

SEQ ID NO: 310368 - RNA, 64 nt, Homo Sapiens; identical to SEQ ID NO: 250841

SEQ ID NO: 310369 - RNA, 64 nt, Homo Sapiens; identical to SEQ ID NO: 250842

SEQ ID NO: 310370 - RNA, 64 nt, Homo Sapiens; identical to SEQ ID NO: 250843

SEQ ID NO: 310371 - RNA, 64 nt, Homo Sapiens; identical to SEQ ID NO: 250844

SEQ ID NO: 310372 - RNA, 64 nt, Homo Sapiens; identical to SEQ ID NO: 250845

SEQ ID NO: 310373 - RNA, 64 nt, Homo Sapiens; identical to SEQ ID NO: 250846

SEQ ID NO: 310374 - RNA, 64 nt, Homo Sapiens; identical to SEQ ID NO: 250847

SEQ ID NO: 310375 - RNA, 64 nt, Homo Sapiens; identical to SEQ ID NO: 250848

SEQ ID NO: 310376 - RNA, 64 nt, Homo Sapiens; identical to SEQ ID NO: 250849

SEQ ID NO: 310377 - RNA, 64 nt, Homo Sapiens; identical to SEQ ID NO: 250850

SEQ ID NO: 310378 - RNA, 64 nt, Homo Sapiens; identical to SEQ ID NO: 250851

SEQ ID NO: 310379 - RNA, 64 nt, Homo Sapiens; identical to SEQ ID NO: 250852

SEQ ID NO: 310380 - RNA, 64 nt, Homo Sapiens; identical to SEQ ID NO: 250853

SEQ ID NO: 310381 - RNA, 64 nt, Homo Sapiens; identical to SEQ ID NO: 250854

SEQ ID NO: 310382 - RNA, 64 nt, Homo Sapiens; identical to SEQ ID NO: 250855

SEQ ID NO: 310383 - RNA, 64 nt, Homo Sapiens; identical to SEQ ID NO: 250856

SEQ ID NO: 310384 - RNA, 64 nt, Homo Sapiens; identical to SEQ ID NO: 250857

SEQ ID NO: 310385 - RNA, 64 nt, Homo Sapiens; identical to SEQ ID NO: 250858

SEQ ID NO: 310386 - RNA, 64 nt, Homo Sapiens; identical to SEQ ID NO: 250859

SEQ ID NO: 310387 - RNA, 64 nt, Homo Sapiens; identical to SEQ ID NO: 250860

SEQ ID NO: 310388 - RNA, 63 nt, Homo Sapiens; identical to SEQ ID NO: 250861

SEQ ID NO: 310389 - RNA, 64 nt, Homo Sapiens; identical to SEQ ID NO: 250862

SEQ ID NO: 310390 - RNA, 64 nt, Homo Sapiens; identical to SEQ ID NO: 250863

SEQ ID NO: 310391 - RNA, 64 nt, Homo Sapiens; identical to SEQ ID NO: 250864

SEQ ID NO: 310392 - RNA, 64 nt, Homo Sapiens; identical to SEQ ID NO: 250865

SEQ ID NO: 310393 - RNA, 64 nt, Homo Sapiens; identical to SEQ ID NO: 250866

SEQ ID NO: 310394 - RNA, 64 nt, Homo Sapiens; identical to SEQ ID NO: 250867

SEQ ID NO: 310395 - RNA, 64 nt, Homo Sapiens; identical to SEQ ID NO: 250868

SEQ ID NO: 310396 - RNA, 64 nt, Homo Sapiens; identical to SEQ ID NO: 250869

SEQ ID NO: 310397 - RNA, 64 nt, Homo Sapiens; identical to SEQ ID NO: 250870

SEQ ID NO: 310398 - RNA, 64 nt, Homo Sapiens; identical to SEQ ID NO: 250871

SEQ ID NO: 310399 - RNA, 64 nt, Homo Sapiens; identical to SEQ ID NO: 250872

SEQ ID NO: 310400 - RNA, 64 nt, Homo Sapiens; identical to SEQ ID NO: 250873

SEQ ID NO: 310401 - RNA, 64 nt, Homo Sapiens; identical to SEQ ID NO: 250874

SEQ ID NO: 310402 - RNA, 64 nt, Homo Sapiens; identical to SEQ ID NO: 250875

SEQ ID NO: 310403 - RNA, 64 nt, Homo Sapiens; identical to SEQ ID NO: 250876

SEQ ID NO: 310404 - RNA, 64 nt, Homo Sapiens; identical to SEQ ID NO: 250877

SEQ ID NO: 310405 - RNA, 64 nt, Homo Sapiens; identical to SEQ ID NO: 250878

SEQ ID NO: 310406 - RNA, 64 nt, Homo Sapiens; identical to SEQ ID NO: 250879

SEQ ID NO: 310407 - RNA, 64 nt, Homo Sapiens; identical to SEQ ID NO: 250880

SEQ ID NO: 310408 - RNA, 64 nt, Homo Sapiens; identical to SEQ ID NO: 250881

SEQ ID NO: 310409 - RNA, 64 nt, Homo Sapiens; identical to SEQ ID NO: 250882

SEQ ID NO: 310410 - RNA, 64 nt, Homo Sapiens; identical to SEQ ID NO: 250883

SEQ ID NO: 310411 - RNA, 64 nt, Homo Sapiens; identical to SEQ ID NO: 250884

SEQ ID NO: 310412 - RNA, 64 nt, Homo Sapiens; identical to SEQ ID NO: 250885

SEQ ID NO: 310413 - RNA, 64 nt, Homo Sapiens; identical to SEQ ID NO: 250886

SEQ ID NO: 310414 - RNA, 64 nt, Homo Sapiens; identical to SEQ ID NO: 250887

SEQ ID NO: 310415 - RNA, 64 nt, Homo Sapiens; identical to SEQ ID NO: 250888

SEQ ID NO: 310416 - RNA, 64 nt, Homo Sapiens; identical to SEQ ID NO: 250889

SEQ ID NO: 310417 - RNA, 64 nt, Homo Sapiens; identical to SEQ ID NO: 250890

SEQ ID NO: 310418 - RNA, 64 nt, Homo Sapiens; identical to SEQ ID NO: 139090

SEQ ID NO: 310419 - RNA, 64 nt, Homo Sapiens; identical to SEQ ID NO: 139091

SEQ ID NO: 310420 - RNA, 64 nt, Homo Sapiens; identical to SEQ ID NO: 139092

SEQ ID NO: 310421 - RNA, 64 nt, Homo Sapiens; identical to SEQ ID NO: 139093

SEQ ID NO: 310422 - RNA, 64 nt, Homo Sapiens; identical to SEQ ID NO: 139094

SEQ ID NO: 310423 - RNA, 64 nt, Homo Sapiens; identical to SEQ ID NO: 139095

SEQ ID NO: 310424 - RNA, 64 nt, Homo Sapiens; identical to SEQ ID NO: 139096

SEQ ID NO: 310425 - RNA, 64 nt, Homo Sapiens; identical to SEQ ID NO: 139097

SEQ ID NO: 310426 - RNA, 64 nt, Homo Sapiens; identical to SEQ ID NO: 139098

SEQ ID NO: 310427 - RNA, 64 nt, Homo Sapiens; identical to SEQ ID NO: 139099

SEQ ID NO: 310428 - RNA, 64 nt, Homo Sapiens; identical to SEQ ID NO: 139100

SEQ ID NO: 310429 - RNA, 64 nt, Homo Sapiens; identical to SEQ ID NO: 139101

SEQ ID NO: 310430 - RNA, 64 nt, Homo Sapiens; identical to SEQ ID NO: 139102

SEQ ID NO: 310431 - RNA, 64 nt, Homo Sapiens; identical to SEQ ID NO: 139103

SEQ ID NO: 310432 - RNA, 64 nt, Homo Sapiens; identical to SEQ ID NO: 139104

SEQ ID NO: 310433 - RNA, 64 nt, Homo Sapiens; identical to SEQ ID NO: 139105

SEQ ID NO: 310434 - RNA, 64 nt, Homo Sapiens; identical to SEQ ID NO: 139106

SEQ ID NO: 310435 - RNA, 64 nt, Homo Sapiens; identical to SEQ ID NO: 139107

SEQ ID NO: 310436 - RNA, 64 nt, Homo Sapiens; identical to SEQ ID NO: 139108

SEQ ID NO: 310437 - RNA, 64 nt, Homo Sapiens; identical to SEQ ID NO: 139109

SEQ ID NO: 310438 - RNA, 64 nt, Homo Sapiens; identical to SEQ ID NO: 139110

SEQ ID NO: 310439 - RNA, 64 nt, Homo Sapiens; identical to SEQ ID NO: 139111

SEQ ID NO: 310440 - RNA, 64 nt, Homo Sapiens; identical to SEQ ID NO: 139112

SEQ ID NO: 310441 - RNA, 64 nt, Homo Sapiens; identical to SEQ ID NO: 139113

SEQ ID NO: 310442 - RNA, 64 nt, Homo Sapiens; identical to SEQ ID NO: 139114

SEQ ID NO: 310443 - RNA, 64 nt, Homo Sapiens; identical to SEQ ID NO: 139115

SEQ ID NO: 310444 - RNA, 52 nt, Homo Sapiens; identical to SEQ ID NO: 112167

SEQ ID NO: 310445 - RNA, 64 nt, Homo Sapiens; identical to SEQ ID NO: 139117

SEQ ID NO: 310446 - RNA, 64 nt, Homo Sapiens; identical to SEQ ID NO: 139118

SEQ ID NO: 310447 - RNA, 64 nt, Homo Sapiens; identical to SEQ ID NO: 139119

SEQ ID NO: 310448 - RNA, 64 nt, Homo Sapiens; identical to SEQ ID NO: 139120

SEQ ID NO: 310449 - RNA, 64 nt, Homo Sapiens; identical to SEQ ID NO: 139121

SEQ ID NO: 310450 - RNA, 64 nt, Homo Sapiens; identical to SEQ ID NO: 139122

SEQ ID NO: 310451 - RNA, 64 nt, Homo Sapiens; identical to SEQ ID NO: 139123

SEQ ID NO: 310452 - RNA, 64 nt, Homo Sapiens; identical to SEQ ID NO: 139124

SEQ ID NO: 310453 - RNA, 64 nt, Homo Sapiens; identical to SEQ ID NO: 139125

SEQ ID NO: 310454 - RNA, 64 nt, Homo Sapiens; identical to SEQ ID NO: 139126

SEQ ID NO: 310455 - RNA, 64 nt, Homo Sapiens; identical to SEQ ID NO: 139127

SEQ ID NO: 310456 - RNA, 64 nt, Homo Sapiens; identical to SEQ ID NO: 139128

SEQ ID NO: 310457 - RNA, 64 nt, Homo Sapiens; identical to SEQ ID NO: 139129

SEQ ID NO: 310458 - RNA, 64 nt, Homo Sapiens; identical to SEQ ID NO: 139130

SEQ ID NO: 310459 - RNA, 64 nt, Homo Sapiens; identical to SEQ ID NO: 139131

SEQ ID NO: 310460 - RNA, 64 nt, Homo Sapiens
gcgcuagaaucuuuuauuuuacuuuauuuuuuuugagguggaguuucgcucuuguugcccgggc

SEQ ID NO: 310461 - RNA, 64 nt, Homo Sapiens
gcucacgccuguaaucccaguauuuugggaggccgagguggaaagaucgcuugagcccaggagu

SEQ ID NO: 310462 - RNA, 64 nt, Homo Sapiens
ggagagugggcucggguacaacuugaggcccaaggagguggagucacuccugucaucccaggac

SEQ ID NO: 310463 - RNA, 64 nt, Homo Sapiens
cgggcugccccugggggccuccugcccaccuccggagguggaaccugugcccugggaugccuac

SEQ ID NO: 310464 - RNA, 64 nt, Homo Sapiens
cucugccagcaggugucuguucucuccuuguggggagguggaucggaggccgccagguguuugc

SEQ ID NO: 310465 - RNA, 64 nt, Homo Sapiens
uugcagucagccaagaucguucgcuugaacucgggagguggagggggaggcugaggcaggagaa

SEQ ID NO: 310466 - RNA, 64 nt, Homo Sapiens
ucaggcacgguggcucacgcaacccacaagggaagagguggaggggucugcagagggagaaaag

SEQ ID NO: 310467 - RNA, 64 nt, Homo Sapiens
uuacagugagcagagaucacuugcuugagcccaagagguggagggggaggcugaggcaggagaa

SEQ ID NO: 310468 - RNA, 64 nt, Homo Sapiens
uugcagugagcugagaucguucgcuugaaccugggagguggagggggaggcugaggcaggagaa

SEQ ID NO: 310469 - RNA, 64 nt, Homo Sapiens
uugcagugagcuaaaauuguuugcuugaaccugggagguggagggggaggcugaggcaggagaa

SEQ ID NO: 310470 - RNA, 64 nt, Homo Sapiens
aauaaucgugucaaucuggacccaaggcacugaagagguggaaagcugaauguauguugcguau

SEQ ID NO: 310471 - RNA, 64 nt, Homo Sapiens
gcgguggcucacaccuguaaucccagcacuuugggagguggaggcggguggaucacaaggucaa

SEQ ID NO: 310472 - RNA, 64 nt, Homo Sapiens
gggaggcugaggcaggagaaucacuugaacccaggagguggagguugcagugagccgagaucac

SEQ ID NO: 310473 - RNA, 64 nt, Homo Sapiens
uugcaguuagcugagauccuucgcuugaacccaggagguggagggggaggcugaggcgggagaa

SEQ ID NO: 310474 - RNA, 64 nt, Homo Sapiens
gaucauuugaggucaggagugacuuugggaagcugagguggacggcucaugccuauaaucccag

SEQ ID NO: 310475 - RNA, 64 nt, Homo Sapiens
uuuguuucuuuuuuuaaguucaggagacagggaagagguggaaaguugacaguaauaggaauaa

SEQ ID NO: 310476 - RNA, 64 nt, Homo Sapiens
uugcagugagcugugauuguucgcuugaaccugggagguggagggggaggcugaggcaggagaa

SEQ ID NO: 310477 - RNA, 64 nt, Homo Sapiens
cuguauagagcccggguccacuuccucuugccucgagguggaagcugcuugcugccucuccuuu

SEQ ID NO: 310478 - RNA, 64 nt, Homo Sapiens
ggacucuguugcuggucuucucaguucauuuccugagguggauuuacugagagaaggugaaaua

SEQ ID NO: 310479 - RNA, 64 nt, Homo Sapiens
ggcaggcugaggcaugagaaucgcuugaacccaggagguggagguuacagugagcugagagugc

SEQ ID NO: 310480 - RNA, 64 nt, Homo Sapiens
ccgggagagcuucgcuucagggaaacauuacugggagguggagguggaaaacgugauugagugg

SEQ ID NO: 310481 - RNA, 64 nt, Homo Sapiens
gagcuucgcuucagggaaacauuacugggagguggagguggaaaacgugauugaguggacugug

SEQ ID NO: 310482 - RNA, 64 nt, Homo Sapiens
agaaaagcugaauguuugggugugacguuugacugagguggauuggggcugccuguggacauua

SEQ ID NO: 310483 - RNA, 64 nt, Homo Sapiens
aaaaauuauugugaugauucauuuagcauaaagagagguggacggaaggguuuuccuauguauc

SEQ ID NO: 310484 - RNA, 64 nt, Homo Sapiens
ggccagcuuggugugugcuguuacaauaaaacaugagguggacauguaauuuauuuuaacauuu

SEQ ID NO: 310485 - RNA, 64 nt, Homo Sapiens
aggggacacugaggugagcacauguccccaagcagagguggagaaaggccaugaugucaagggc

SEQ ID NO: 310486 - RNA, 64 nt, Homo Sapiens
uauuuuaaaagauaaauauuaagagccugagagugagguggaaugaagcuucuggugaccuucc

SEQ ID NO: 310487 - RNA, 64 nt, Homo Sapiens
agggcugcaaauccuugugguuggagguagcuuugagguggaagaaugugaacagcggcuggac

SEQ ID NO: 310488 - RNA, 64 nt, Homo Sapiens
gcaggaguauaacuuccugaagauggagccucaggagguggagucccugggggagaccuaugac

SEQ ID NO: 310489 - RNA, 64 nt, Homo Sapiens
uaacaaagcgggcuuugccgucaacuuuuucaaagagguggacgagugcucucggcccaaccgc

SEQ ID NO: 310490 - RNA, 64 nt, Homo Sapiens
gggaggcugaggcaggagaaucacuugaacucgggagguggagguugcagugagccaagaucgc

SEQ ID NO: 310491 - RNA, 64 nt, Homo Sapiens
gcacaucccuauagucccagcuacuugggaggcugagguggaaggauugcuugagcgagggagg

SEQ ID NO: 310492 - RNA, 64 nt, Homo Sapiens
caagcagugacuccugagagucccaggaacagcagagguggaggggcugaaaugacacaccuac

SEQ ID NO: 310493 - RNA, 64 nt, Homo Sapiens
acccuggcugaaaugacacacccugagcgggcaggagguggaccaaagcuguuuccuccuggug

SEQ ID NO: 310494 - RNA, 64 nt, Homo Sapiens
gacccugguaugcccacgugggacagaggacacagagguggaagauugaucuugccaagaguga

SEQ ID NO: 310495 - RNA, 64 nt, Homo Sapiens
uucuacaguccccaacgugaacaguauuaagcaagagguggacucgagcaauccaggagcccag

SEQ ID NO: 310496 - RNA, 64 nt, Homo Sapiens
gggaggaugguugcacaacaaugagaaaguucuggagguggaugcaaaguuucugauuggggug

SEQ ID NO: 310497 - RNA, 64 nt, Homo Sapiens
aauuggaaguuugugcauugaaaucagcuauuuagagguggauaauucaaauuuuucuucuuaa

SEQ ID NO: 310498 - RNA, 64 nt, Homo Sapiens
uuguagugagccaagaucguucacuugagccugggagguggaggguaaggcugagguggaaggu

SEQ ID NO: 310499 - RNA, 64 nt, Homo Sapiens
guucacuugagccugggaggcuauugguaaggcugagguggaaggcccaugccuguaguaccug

SEQ ID NO: 310500 - RNA, 64 nt, Homo Sapiens
uugcagugagcugagaucguagaauugaacccaggagguggaggacucaggaggcugaggcaga

SEQ ID NO: 310501 - RNA, 64 nt, Homo Sapiens
acagaggcuucuucagaucagaaaggcguucuucgagguggaucaggugugcgggaccgguaca

SEQ ID NO: 310502 - RNA, 64 nt, Homo Sapiens
cccuccuuccacggauccaucuaagggguugguugagguggaagcacaguuccucgcccugggu

SEQ ID NO: 310503 - RNA, 64 nt, Homo Sapiens
ggggagugaaaucuccaugggggagugaaauugugagguggauguuucauugugagguggaugg

SEQ ID NO: 310504 - RNA, 64 nt, Homo Sapiens
ggggagugaaauugugagguauuaauuucauugugagguggaugccugguauaagaugugcuag

SEQ ID NO: 310505 - RNA, 64 nt, Homo Sapiens
gaagaauauuugaauugacuuuuuuugcuuuuaagagguggauuuuuaauuuuauuugagauuu

SEQ ID NO: 310506 - RNA, 64 nt, Homo Sapiens
auuccuuguauucuggcagcugggggugccaggugagguggagcagaaauguuccauugggggg

SEQ ID NO: 310507 - RNA, 64 nt, Homo Sapiens
uuacaguagccgagaucgcgucgcuagaaacugggagguggagggggaggcugaggcaggagaa

SEQ ID NO: 310508 - RNA, 64 nt, Homo Sapiens
uugcagugagcugagaucgcucgcuugaacccgggagguggaggaggaggcugaggcaggagaa

SEQ ID NO: 310509 - RNA, 64 nt, Homo Sapiens
gggagguuuaggcaggagaaucgcuugaacccuggagguggagguggagguugcagugagccga

SEQ ID NO: 310510 - RNA, 64 nt, Homo Sapiens
uuuaggcaggagaaucgcuugaacccuggagguggagguggagguugcagugagccgagaucgc

SEQ ID NO: 310511 - RNA, 64 nt, Homo Sapiens
ggggagggcaggcuuggggaaaauggccaugcaggagguggagaaaauuggaacucuacucaac

SEQ ID NO: 310512 - RNA, 64 nt, Homo Sapiens
cccaccuguuuucugaaacacacgagcaaacccagagguggauguuaugaacagcugugucugc

SEQ ID NO: 310513 - RNA, 64 nt, Homo Sapiens
agcagcuacaagcagaggcucagcagggcccuccgagguggagcaccccuacucccggagcccc

SEQ ID NO: 310514 - RNA, 64 nt, Homo Sapiens
agcagcuacaagcagaggcucagcagggcccuccgagguggaacgaaccccuacccggagcccc

SEQ ID NO: 310515 - RNA, 64 nt, Homo Sapiens
uuuguugauggaagaauucacaagcuggacaggagagguggauagagaaccugaagaucugagg

SEQ ID NO: 310516 - RNA, 64 nt, Homo Sapiens
auggaccugcgcagauggggcccugauugacuuggagguggacaaggcugcaugaagaccugcc

SEQ ID NO: 310517 - RNA, 64 nt, Homo Sapiens
acuucgaggcucgugggagcaaguggagcccagugagguggaaggcuggacuucggcgaggugg

SEQ ID NO: 310518 - RNA, 64 nt, Homo Sapiens
uggagcccagugagguggaacgcuggacuucggcgagguggaagcaguccucgccuggaggaga

SEQ ID NO: 310519 - RNA, 64 nt, Homo Sapiens
uccaaguggcuuagucugggggaucaggaggugggagguggaugguucuuauucuguggagaag

SEQ ID NO: 310520 - RNA, 64 nt, Homo Sapiens
gaggaagcuggaacuuacugacuguaagagguuagagguggaccgagaaggacuuuucccaguc

SEQ ID NO: 310521 - RNA, 64 nt, Homo Sapiens
uggagaacugcccuuauggagcuugcaguccagugagguggacagaccuguccccagacaguga

SEQ ID NO: 310522 - RNA, 64 nt, Homo Sapiens
gugcaugccugugauccuggcuacuucagaggcugagguggaaggaucacuugaggccaggagu

SEQ ID NO: 310523 - RNA, 64 nt, Homo Sapiens
gcgagcugggcaccugggagaugacagugaugaggagguggacaccaacagcaccagcacggcu

SEQ ID NO: 310524 - RNA, 64 nt, Homo Sapiens
ccauugcccuccagaacaaccggacgggggucccgagguggaaaaaaguuggccagguucauag

SEQ ID NO: 310525 - RNA, 64 nt, Homo Sapiens
uggucacgcugggcgcccagagcuuaagauccccgagguggagcggcugaguccaccgcugugc

SEQ ID NO: 310526 - RNA, 64 nt, Homo Sapiens
gugaggcucaugugggugucccugucugcagccagagguggaugagggaagcugguaacacuuc

SEQ ID NO: 310527 - RNA, 64 nt, Homo Sapiens
uccccaaggugucagagaugagguucgacucccagagguggagcgcccgaggcagcccuuccag

SEQ ID NO: 310528 - RNA, 64 nt, Homo Sapiens
cccggggagaggcaccugagccuugccgggugcagagguggagggacuguggggguggaccugg

SEQ ID NO: 310529 - RNA, 64 nt, Homo Sapiens
ccaagauuguaccacuguauuugcuugaacuugggagguggagggggaggcugaggcaggagaa

SEQ ID NO: 310530 - RNA, 64 nt, Homo Sapiens
uugcggugagccaagauggcuugcuugaacccaugagguggagggggaggcugaggcaggagaa

SEQ ID NO: 310531 - RNA, 64 nt, Homo Sapiens
cccagagagacagagacccacccagaaaaaggaagagguggaaacaaaaggauagagaaagaga

SEQ ID NO: 310532 - RNA, 64 nt, Homo Sapiens
cuccuccuguuuaccccacaggguaaauuaggaagagguggaugguguucauccagaggcgacu

SEQ ID NO: 310533 - RNA, 64 nt, Homo Sapiens
uugcagugagccaagacuacucgcuugagcccaggagguggagggggaggcugaggcggaagau

SEQ ID NO: 310534 - RNA, 64 nt, Homo Sapiens
uugcaguaagcugagaucgcucgcuugaaccugggagguggagguggaggcugaggccagagaa

SEQ ID NO: 310535 - RNA, 64 nt, Homo Sapiens
cugagagugauuuaacacugguuuugagacagacuuuauucagcuaucccucuauauaauaggu

SEQ ID NO: 310536 - RNA, 64 nt, Homo Sapiens
gagccaugaaguauaaauacugaaagaugucacuuuuauucaggaaauagggggagauucaagu

SEQ ID NO: 310537 - RNA, 64 nt, Homo Sapiens
auccuugugugauauuuuuuucuucgcuuguuuauuuauucauuuauuuaauuguauuuauuca

SEQ ID NO: 310538 - RNA, 64 nt, Homo Sapiens
uucgcuuguuuauuuauucauuuauuuaauuguauuuauucauuuacuaacuuuauguguuacc

SEQ ID NO: 310539 - RNA, 64 nt, Homo Sapiens
gcaaaaagauagaaucaaucauaaagugcacaccuuuauucagaacuuuaguauuaaaucaguu

SEQ ID NO: 310540 - RNA, 64 nt, Homo Sapiens
ucaauuucauuuuuuauguauuguuuuacuccuuuuuauucauacguaaaauuuuggauuaauu

SEQ ID NO: 310541 - RNA, 64 nt, Homo Sapiens
gcaaaaagauagaaucaaucauaaaaugcacaccuuuauucagaacuuuaguauuaaaucaguu

SEQ ID NO: 310542 - RNA, 64 nt, Homo Sapiens
cuuaauuucauuuuuaaguauuguuuuacuccuuuuuauucauacguaaaauuuuggauuaauu

SEQ ID NO: 310543 - RNA, 64 nt, Homo Sapiens
uuaauaucauacuaagugaaggacaggaaaggguuuuauucauaaauuaaaugucuacaugugc

SEQ ID NO: 310544 - RNA, 64 nt, Homo Sapiens
ggagacaacuuuuauagaaauacaaagccauuacuuuauucaauuucagacccucagaagcaau

SEQ ID NO: 310545 - RNA, 64 nt, Homo Sapiens
agaucuaccuaaaucaccccagagcuuuaugucuuuuauucauucuaauucuuauuaaccggaa

SEQ ID NO: 310546 - RNA, 64 nt, Homo Sapiens
uuaaguucguauuuuuuaaugcuaagguuaaaaauuuauucacuuuaccauuauuuauaccaua

SEQ ID NO: 310547 - RNA, 64 nt, Homo Sapiens
ugcaaagagccauguauucacugaaugcacuuguuuuauucaucucgcaaaauggaucucuaaa

SEQ ID NO: 310548 - RNA, 64 nt, Homo Sapiens
cuggucagauacaauaaaggccaggagauuucauuuuauucaccuaagaaauggacuugagguc

SEQ ID NO: 310549 - RNA, 64 nt, Homo Sapiens
auuucuccaaguugcuaucuucaaacugcucacauuuauucaguggacaaaugcauuacuguuu

SEQ ID NO: 310550 - RNA, 64 nt, Homo Sapiens
uaggaauguucguuuaaauucuaauccauauaaguuuauucauugccugaccaaauucuaaaac

SEQ ID NO: 310551 - RNA, 64 nt, Homo Sapiens
caugcaauacuaaagagaaaggaauaguuuaagcuuuauucauucuacuauguaacuuuuucag

SEQ ID NO: 310552 - RNA, 64 nt, Homo Sapiens
uuuuuuccuuacagugagacauuuaagcacacauuuuauucacauagauacuauguccuugaca

SEQ ID NO: 310553 - RNA, 64 nt, Homo Sapiens
uguucacgagaaacauaggcuuuucaaaaaaauuuuuauucaaggcaaagcaaggaacaucuug

SEQ ID NO: 310554 - RNA, 64 nt, Homo Sapiens
agguauuuaaauaauaaaauuucaagggauaguuuuuauucaauguauauaagacagguagugc

SEQ ID NO: 310555 - RNA, 64 nt, Homo Sapiens
uguagaguggugaaccuucuagaggaauauaugauuuauucacaguuccucaaggccuggggau

SEQ ID NO: 310556 - RNA, 64 nt, Homo Sapiens
ugaucuuacaaguuagauguuacuauaccuaccauuuauucagcuggauugcugaacacaguuc

SEQ ID NO: 310557 - RNA, 64 nt, Homo Sapiens
gauuuccacguuuuguguuuuauuggcccuuuucuuuauucagccccuuaaucuauuuucaguc

SEQ ID NO: 310558 - RNA, 64 nt, Homo Sapiens
cuacuggaaaguaacagagucaaaauuggaagguuuuauucauucuugaauuuuuccuuucuaa

SEQ ID NO: 310559 - RNA, 64 nt, Homo Sapiens
auuaaaagagguaaacaucaguuuccucaaacauuuuauucauguugaaugccuuuuugcaaug

SEQ ID NO: 310560 - RNA, 64 nt, Homo Sapiens
gggggcaagaaguagcagugauucauuggucuaauuuauucaaauuuauuuguuuguuuguuuu

SEQ ID NO: 310561 - RNA, 64 nt, Homo Sapiens
ggucuaauuuauucaaagggauuuguuuguuuguuuuauucauugcuucccuauuuauuuauuu

SEQ ID NO: 310562 - RNA, 64 nt, Homo Sapiens
uuuuguaguauuuacguaugcauagauguuuuuuuuuauucaacccucaauauaaccuuuuauu

SEQ ID NO: 310563 - RNA, 64 nt, Homo Sapiens
gauguuuuuuuuuauucaacccucaauauaaccuuuuauucauauuuucuaccaacuaugguug

SEQ ID NO: 310564 - RNA, 64 nt, Homo Sapiens
augcuaugucacuauuuuuguccccaauucauaguuuauucauaguucuagugcauuuccaugg

SEQ ID NO: 310565 - RNA, 64 nt, Homo Sapiens
cugucaauuuuugucuccuaucaucucuuuucccuuuauucaagcuaagccagaagcuguaaac

SEQ ID NO: 310566 - RNA, 64 nt, Homo Sapiens
cuuguuuccuuucuaguuaacaaauuaugguacuuuuauucagaucuguagauucugcuuagag

SEQ ID NO: 310567 - RNA, 64 nt, Homo Sapiens
uccugugcuuuaaauaaacauuuuuagguggcauuuuauucauuaauuuauucauugcagauac

SEQ ID NO: 310568 - RNA, 64 nt, Homo Sapiens
gcagauacuuuuuagguggcuucacuggaaauaauuuauucauuuguguguggaucugcagugc

SEQ ID NO: 310569 - RNA, 64 nt, Homo Sapiens
uaaccccuugaaacccugucggauauguuuuccuuuuauucacauuuaggguacuuuuauugau

SEQ ID NO: 310570 - RNA, 64 nt, Homo Sapiens
gcagcuguaauuuaguuaauuuguuaguuaaguuuuuauucaaaccuaugagacccuuacguga

SEQ ID NO: 310571 - RNA, 64 nt, Homo Sapiens
guaugaaaauuccugugauuuguauuguugugguuuuauucauuuuccaccugccaauucuaca

SEQ ID NO: 310572 - RNA, 64 nt, Homo Sapiens
ggugucagcuuugcuuuuccccaguaagcacauguuuauucaugggcaagagacagaaugauau

SEQ ID NO: 310573 - RNA, 64 nt, Homo Sapiens
aaaugggcuccugcccaguuggauuuccugggcuuuuauucacuuuggcuauuucucuuuucug

SEQ ID NO: 310574 - RNA, 64 nt, Homo Sapiens
accuaguaucugcaguccauaaauucagaauaauuuuauucaggauauaacucuuuuaaagaug

SEQ ID NO: 310575 - RNA, 64 nt, Homo Sapiens
uucaauuuaugguuuguaacgcucuuuuucauauuuuauucauauggagggcuuuaaaauuugu

SEQ ID NO: 310576 - RNA, 64 nt, Homo Sapiens
aaaaacuuagaauagugaaccuuaggauguguuuuuuauucaugaaccgcacagauuucaugaa

SEQ ID NO: 310577 - RNA, 64 nt, Homo Sapiens
ccaaggcagaggucgcauugcuguaucacaguauuuuauucagguuucugcaaaaaaauaaaaa

SEQ ID NO: 310578 - RNA, 64 nt, Homo Sapiens
ugaauagaauuuugcaaauuuaacguuuucaagauuuauucaaggaaacaaaaugccuauguuc

SEQ ID NO: 310579 - RNA, 64 nt, Homo Sapiens
cuucaucuuucuaagaauuaucuuggcuuuggacuuuauucauaaauguuuuauuucuguuagu

SEQ ID NO: 310580 - RNA, 64 nt, Homo Sapiens
aguuuuuuuuuaaacaaaaucguucuuguuggauuuuauucagcagcaucuaucauguagauaa

SEQ ID NO: 310581 - RNA, 64 nt, Homo Sapiens
ccaugucccuguagucgguagggggcagucuugcuuuauucauccuccaucucaaaaugaacuu

SEQ ID NO: 310582 - RNA, 64 nt, Homo Sapiens
uaauccauauuugcuguucaaguuaaucuagaaauuuauucaauucuguaugaacaccuggaag

SEQ ID NO: 310583 - RNA, 64 nt, Homo Sapiens
uuugcaaagugaacauguacauggucugcucucauuuauucauucuucucucaaaagucaaaug

SEQ ID NO: 310584 - RNA, 64 nt, Homo Sapiens
gguauguugaaguagugucuaaaaguaucuagucuuuauucacaguacauuauauugugugaug

SEQ ID NO: 310585 - RNA, 64 nt, Homo Sapiens
ucuuuuuaaaguaucuacugcauccaaccaucuauuuauucacuuaaauccaaaccuuuuuauu

SEQ ID NO: 310586 - RNA, 64 nt, Homo Sapiens
caaccaucuauuuauucacuuaaauccaaaccuuuuuauucaucccucuuuuuuuccccuucau

SEQ ID NO: 310587 - RNA, 64 nt, Homo Sapiens
gaauaccaucagcauucugcuuuaaagcucauguuuuauucaaagcacaaggacgguuauaacu

SEQ ID NO: 310588 - RNA, 64 nt, Homo Sapiens
cuuuugauguacuuucugauuccaggauuggauauuuauucaaggacuauuuuaaaaauagaaa

SEQ ID NO: 310589 - RNA, 64 nt, Homo Sapiens
uauacugucuuagacuuauuguacacacuuaguuuuuauucacuuguuuucacucugaauuuua

SEQ ID NO: 310590 - RNA, 64 nt, Homo Sapiens
aaugcauugccucaaaggugaugucaucuuaauuuuuauucacuuuaaauaacuacauuuuugu

SEQ ID NO: 310591 - RNA, 64 nt, Homo Sapiens
gcuaauuugaaagaaaauugaaacccaaagaaaguuuauucaauuuauuauaggaaaauaaauc

SEQ ID NO: 310592 - RNA, 64 nt, Homo Sapiens
uaagucaccaugcuucaaaaaagaaaaauuuaaguuuauucagaaacaaauacauaaauauuuu

SEQ ID NO: 310593 - RNA, 64 nt, Homo Sapiens
uguuucaaaauucaaagcauaagcauucaaacauuuuauucaagaagaggaggaauuuuauuca

SEQ ID NO: 310594 - RNA, 64 nt, Homo Sapiens
gcauucaaacauuuuauucagaaagaggaggaauuuuauucaaaacuaaaauaagguuuacucu

SEQ ID NO: 310595 - RNA, 64 nt, Homo Sapiens
aaguucucaaaucaugccuuccgcuuagucucauuuuauucauucagucgucaugaguugagug

SEQ ID NO: 310596 - RNA, 64 nt, Homo Sapiens
uaacauacugcauuucaaguacauguguguguguuuuauucagguuguguaaugcucccguaga

SEQ ID NO: 310597 - RNA, 64 nt, Homo Sapiens
auaaguuuugaaguuucuuagcaauuaaaguuuuuuuauucagugugaacugucaguaucuauu

SEQ ID NO: 310598 - RNA, 64 nt, Homo Sapiens
uuuuacuguaaugguaaggauuagaaggguggucuuuauucaggagugaaguuuuuuagaaccu

SEQ ID NO: 310599 - RNA, 64 nt, Homo Sapiens
gggcuuguucuuaucagcaagaaagccacauguguuuauucauuugguuguuaacggcauuccu

SEQ ID NO: 310600 - RNA, 64 nt, Homo Sapiens
uagguaaaauuauuguaccuaauuaugucuaaaguuuauucagggguaauuucccugaugucug

SEQ ID NO: 310601 - RNA, 64 nt, Homo Sapiens
gaguaacgucaguggcuuaggguuaaacggccauuuuauucaaaugcuugcuauacaaucugaa

SEQ ID NO: 310602 - RNA, 64 nt, Homo Sapiens
uaucuaguaucaccaaacaguaucgcuguucucuuuuauucauuugaaaugaauauaauuauau

SEQ ID NO: 310603 - RNA, 64 nt, Homo Sapiens
uuuauuagacuaguguugacuuuggggggggacauuuauucacaaaugagaaguaggcacaaag

SEQ ID NO: 310604 - RNA, 64 nt, Homo Sapiens
gggagagccagauuuucucugugcucuugaguuuuuuauucauucaagaaaccuugggccaccg

SEQ ID NO: 310605 - RNA, 64 nt, Homo Sapiens
auuuuaaagugacuuuuauuuugcacaaauaauuuuuauucagaauaauaaaucacucuuuauc

SEQ ID NO: 310606 - RNA, 64 nt, Homo Sapiens
acagauucucugcacaaaaccacccauucauucauuuauucauucacagcacuagcaagugcug

SEQ ID NO: 310607 - RNA, 64 nt, Homo Sapiens
gcaaguuuuuuggugcuguaauuucagucugacauuuauucaguaggaagucacagggaagcag

SEQ ID NO: 310608 - RNA, 64 nt, Homo Sapiens
auaauaaauguuaauaagguaaaguuuccauaguuuuauucaaaucguuaugcaugauuuaucc

SEQ ID NO: 310609 - RNA, 64 nt, Homo Sapiens
uacgguugggagaaugagacaggaggcuguggguuuuauucaaccucaggugccuuugaguucu

SEQ ID NO: 310610 - RNA, 64 nt, Homo Sapiens
cuugcauucuuuuggcaguuuagaagaacaacgguuuauucauaagcaucuaaagcagcagguc

SEQ ID NO: 310611 - RNA, 64 nt, Homo Sapiens
uaagaggaaagacaagugucguauuucgauccuguuuauucaaaugugugauuuugcugaaaug

SEQ ID NO: 310612 - RNA, 64 nt, Homo Sapiens
acugucuaaaaaauguacauuuguaauuagugccuuuauucauauuuugaaauaaguucuuagu

SEQ ID NO: 310613 - RNA, 64 nt, Homo Sapiens
uuauuaugaauuugguaauaguauagguuuauuauuuauucaucuaauuuuauaguacagguuu

SEQ ID NO: 310614 - RNA, 64 nt, Homo Sapiens
aauuuugauaaauuuuuuuuguaaacuaaguauguuuauucaagacauugaaacuacuuugcac

SEQ ID NO: 310615 - RNA, 64 nt, Homo Sapiens
uuccccuugaggaaagaauggcucaacguggauuuuuauucauuguggugcacguuucaaauuu

SEQ ID NO: 310616 - RNA, 64 nt, Homo Sapiens
aguuuguaaaggucuggaaucacaguuggcauccuuuauucaggucucuucucuccagcguaca

SEQ ID NO: 310617 - RNA, 64 nt, Homo Sapiens
uaaggcacaggcauauuaaacccacguaggagauuuuauucaaccagagcauuguuuucucccc

SEQ ID NO: 310618 - RNA, 64 nt, Homo Sapiens
cauucaacaaucauauacugaguucauuaauugguuuauucauuuuucuauugugaguuuguuu

SEQ ID NO: 310619 - RNA, 64 nt, Homo Sapiens
auauuuguagaaguauuagaaaaauauucuauuuuuuauucagugcugcguaauuacccauggu

SEQ ID NO: 310620 - RNA, 64 nt, Homo Sapiens
uauucauuaaagaacuuguaauaucaaauuacuauuuauucauaacaauugauuugaugcuaau

SEQ ID NO: 310621 - RNA, 64 nt, Homo Sapiens
caggcgugagccaccaugcccggcccaaauauuuuuuauucaggaugguauaaccuaacugaua

SEQ ID NO: 310622 - RNA, 64 nt, Homo Sapiens
ugcacuguccagcugguuguacccucuccaggcauuuauucaacaaaugugggugaagugccug

SEQ ID NO: 310623 - RNA, 63 nt, Homo Sapiens
gccuguccaauuucugcuguacauuauuaaaaguuuuauucacagagcugcucuggugccauc

SEQ ID NO: 310624 - RNA, 64 nt, Homo Sapiens
uauucauucauaaaaugagucauucauuuauucauuuauucauuuaugauauaauccauucaca

SEQ ID NO: 310625 - RNA, 64 nt, Homo Sapiens
uauucauuuauucauucauacauucacacauucauuuauucauuauuacacuuaugauauaauc

SEQ ID NO: 310626 - RNA, 64 nt, Homo Sapiens
ugauuuauguauuuaaacuaacucauucauguaguuuauucaaguacgaugcagcccaccauua

SEQ ID NO: 310627 - RNA, 64 nt, Homo Sapiens
cuuuuauuguggcugaauuuaauugauauauugcuuuauucacaccaauagauauauauccuac

SEQ ID NO: 310628 - RNA, 64 nt, Homo Sapiens
ugcaucugucuccaguguuguggguaaaacaggguuuauucagugagguaccaaauagugcaau

SEQ ID NO: 310629 - RNA, 64 nt, Homo Sapiens
agcaguuaucaauaaauuccuugcuuuuuugaacuuuauucagaacucuuuuacuuuuaagaaa

SEQ ID NO: 310630 - RNA, 64 nt, Homo Sapiens
guguaggugggaauaaaguaauacuuccagcauauuuauucaggaauucaugaccugaagcuga

SEQ ID NO: 310631 - RNA, 64 nt, Homo Sapiens
aguaacaaaguucuuguaagaaaaacaaacuuuuuuuauucaaagaaaaagagaaaaaaaucac

SEQ ID NO: 310632 - RNA, 64 nt, Homo Sapiens
gacaguuuaacaaagauaaaauucugaacugcguuuuauucauuuguguacuaugugauuuuuu

SEQ ID NO: 310633 - RNA, 64 nt, Homo Sapiens
aagauuuguugcucucagacuguguaaaacaaaauuuauucauguuuucugcauauuaaaaaau

SEQ ID NO: 310634 - RNA, 64 nt, Homo Sapiens
ugagguauagucugugaauuauguguuuuguauuuuuauucauuguguaauuuaguggugguga

SEQ ID NO: 310635 - RNA, 64 nt, Homo Sapiens
ugaucuaaauuauuguuuuaauuuuuaaaccuaauuuauucacucagugaacauucuuaccuaa

SEQ ID NO: 310636 - RNA, 64 nt, Homo Sapiens
agaauuuauuuucgaaggggaauaguuucaauguuuuauucacuugggcuuuuuuucuuccccc

SEQ ID NO: 310637 - RNA, 64 nt, Homo Sapiens
caaauacguauugucuaaaugcauuuaaaucuguuuuauucaaagaaaagcuaaagcaaaaaca

SEQ ID NO: 310638 - RNA, 64 nt, Homo Sapiens
gcauagcuuuaagccagugugauguaccgagcacuuuauucaguucauuccaggugaaaagcag

SEQ ID NO: 310639 - RNA, 64 nt, Homo Sapiens
gguuuuguuuucauucuggaacugcuuacccugauuuauucagugacaggaaggaguguuacac

SEQ ID NO: 310640 - RNA, 64 nt, Homo Sapiens
uuaauuggcuauuccaaagauucguguggauuuuuuuauucaacccugccccaaccaaaccgca

SEQ ID NO: 310641 - RNA, 64 nt, Homo Sapiens
ugucuuuagcuacaauugcuacacuugcaaacauuuuauucaguuuauauacauuuuccuuaaa

SEQ ID NO: 310642 - RNA, 64 nt, Homo Sapiens
acaaucuuuucauuuuuuaaguauacaguuuuccuuuauucagucuuuuuguagaacccauguu

SEQ ID NO: 310643 - RNA, 64 nt, Homo Sapiens
ugccuucuguauaaguuuauguuuauuccuacauuuuauucauuuuuaauguauggguaauugg

SEQ ID NO: 310644 - RNA, 64 nt, Homo Sapiens
gacuucgcugagucaguaaguauaaucacucuaguuuauucaaggauguguggcaacuuucaac

SEQ ID NO: 310645 - RNA, 64 nt, Homo Sapiens
cccagaacccuuccugagaccucgccggccuuguuuuauucaaagacagagaagaccaaagcau

SEQ ID NO: 310646 - RNA, 64 nt, Homo Sapiens
caaagcauugccugccagagcuuuguuuuauauauuuauucaucugggaggcagaacaggcuuc

SEQ ID NO: 310647 - RNA, 64 nt, Homo Sapiens
auccuuuuuuucuuuccugauuauccuaacaccauuuauucaauaaccuuguccauuuucauau

SEQ ID NO: 310648 - RNA, 64 nt, Homo Sapiens
uuuuuuuauugacuauuugaugguaaguuacauuuuuauucacauaaagcuuggauaucagguc

SEQ ID NO: 310649 - RNA, 64 nt, Homo Sapiens
ggaccuauuaucagaaggugacaaguacuggcucuuuauucauuaagcuuuuuuuuuuugaacc

SEQ ID NO: 310650 - RNA, 64 nt, Homo Sapiens
uggugaugggguaaucuauaacacaucauaagguuuuauucauauauauacaggguauuaagaa

SEQ ID NO: 310651 - RNA, 64 nt, Homo Sapiens
caauaaacauuuauugggaacacuccuucuuccauuuauucauuguuuuguucauuacuuuguu

SEQ ID NO: 310652 - RNA, 64 nt, Homo Sapiens
ucccugcucaggugucaccuguuccccgacucacuuuauucaagcucucccaaguauaugucug

SEQ ID NO: 310653 - RNA, 64 nt, Homo Sapiens
ggagauaauuuauuuuaaaggugauagugaauuauuuauucaugcuucugcucaucaaauugcu

SEQ ID NO: 310654 - RNA, 64 nt, Homo Sapiens
accuaaauguagguauuccccuaugggcucuuuuuuuauucauucuguuucuuuuuuguuuucu

SEQ ID NO: 310655 - RNA, 64 nt, Homo Sapiens
agaauuauugcuucuaguccacuuuucuuuacauuuuauucaauacgcuguccugaauccuauu

SEQ ID NO: 310656 - RNA, 64 nt, Homo Sapiens
uucagucauaaaagcuuuacuauuuauuuacauauuuauucauguucaugguacucuucuaaga

SEQ ID NO: 310657 - RNA, 64 nt, Homo Sapiens; identical to SEQ ID NO: 270569

SEQ ID NO: 310658 - RNA, 64 nt, Homo Sapiens; identical to SEQ ID NO: 270570

SEQ ID NO: 310659 - RNA, 64 nt, Homo Sapiens; identical to SEQ ID NO: 270571

SEQ ID NO: 310660 - RNA, 64 nt, Homo Sapiens; identical to SEQ ID NO: 270572

SEQ ID NO: 310661 - RNA, 64 nt, Homo Sapiens; identical to SEQ ID NO: 270573

SEQ ID NO: 310662 - RNA, 64 nt, Homo Sapiens; identical to SEQ ID NO: 270574

SEQ ID NO: 310663 - RNA, 64 nt, Homo Sapiens; identical to SEQ ID NO: 270575

SEQ ID NO: 310664 - RNA, 64 nt, Homo Sapiens; identical to SEQ ID NO: 270576

SEQ ID NO: 310665 - RNA, 64 nt, Homo Sapiens; identical to SEQ ID NO: 270577

SEQ ID NO: 310666 - RNA, 64 nt, Homo Sapiens; identical to SEQ ID NO: 270578

SEQ ID NO: 310667 - RNA, 64 nt, Homo Sapiens; identical to SEQ ID NO: 270579

SEQ ID NO: 310668 - RNA, 55 nt, Homo Sapiens; identical to SEQ ID NO: 270580

SEQ ID NO: 310669 - RNA, 64 nt, Homo Sapiens; identical to SEQ ID NO: 270581

SEQ ID NO: 310670 - RNA, 64 nt, Homo Sapiens; identical to SEQ ID NO: 270582

SEQ ID NO: 310671 - RNA, 64 nt, Homo Sapiens; identical to SEQ ID NO: 270583

SEQ ID NO: 310672 - RNA, 64 nt, Homo Sapiens; identical to SEQ ID NO: 270584

SEQ ID NO: 310673 - RNA, 64 nt, Homo Sapiens; identical to SEQ ID NO: 270585

SEQ ID NO: 310674 - RNA, 64 nt, Homo Sapiens; identical to SEQ ID NO: 270586

SEQ ID NO: 310675 - RNA, 64 nt, Homo Sapiens; identical to SEQ ID NO: 270587

SEQ ID NO: 310676 - RNA, 64 nt, Homo Sapiens; identical to SEQ ID NO: 270588

SEQ ID NO: 310677 - RNA, 64 nt, Homo Sapiens; identical to SEQ ID NO: 270589

SEQ ID NO: 310678 - RNA, 64 nt, Homo Sapiens; identical to SEQ ID NO: 270590

SEQ ID NO: 310679 - RNA, 64 nt, Homo Sapiens; identical to SEQ ID NO: 270591

SEQ ID NO: 310680 - RNA, 64 nt, Homo Sapiens; identical to SEQ ID NO: 270592

SEQ ID NO: 310681 - RNA, 64 nt, Homo Sapiens; identical to SEQ ID NO: 270593

SEQ ID NO: 310682 - RNA, 64 nt, Homo Sapiens; identical to SEQ ID NO: 270594

SEQ ID NO: 310683 - RNA, 64 nt, Homo Sapiens
aauaaagguuacaguuuugugguuaacguacuguuggaucaacaaguggggaugggguaaaagu

SEQ ID NO: 310684 - RNA, 64 nt, Homo Sapiens
ucuuuuucauagggguggaaaaaaccuggaacuuuggaucaauuaaauugacuagagacccaag

SEQ ID NO: 310685 - RNA, 64 nt, Homo Sapiens; identical to SEQ ID NO: 44100

SEQ ID NO: 310686 - RNA, 64 nt, Homo Sapiens; identical to SEQ ID NO: 44101

SEQ ID NO: 310687 - RNA, 64 nt, Homo Sapiens; identical to SEQ ID NO: 44102

SEQ ID NO: 310688 - RNA, 64 nt, Homo Sapiens; identical to SEQ ID NO: 44103

SEQ ID NO: 310689 - RNA, 64 nt, Homo Sapiens; identical to SEQ ID NO: 44104

SEQ ID NO: 310690 - RNA, 64 nt, Homo Sapiens; identical to SEQ ID NO: 44105

SEQ ID NO: 310691 - RNA, 64 nt, Homo Sapiens; identical to SEQ ID NO: 44106

SEQ ID NO: 310692 - RNA, 64 nt, Homo Sapiens; identical to SEQ ID NO: 44107

SEQ ID NO: 310693 - RNA, 64 nt, Homo Sapiens; identical to SEQ ID NO: 44108

SEQ ID NO: 310694 - RNA, 64 nt, Homo Sapiens; identical to SEQ ID NO: 44109

SEQ ID NO: 310695 - RNA, 64 nt, Homo Sapiens; identical to SEQ ID NO: 44110

SEQ ID NO: 310696 - RNA, 64 nt, Homo Sapiens; identical to SEQ ID NO: 44111

SEQ ID NO: 310697 - RNA, 64 nt, Homo Sapiens; identical to SEQ ID NO: 44112

SEQ ID NO: 310698 - RNA, 64 nt, Homo Sapiens; identical to SEQ ID NO: 44113

SEQ ID NO: 310699 - RNA, 64 nt, Homo Sapiens; identical to SEQ ID NO: 44114

SEQ ID NO: 310700 - RNA, 64 nt, Homo Sapiens; identical to SEQ ID NO: 44115

SEQ ID NO: 310701 - RNA, 64 nt, Homo Sapiens; identical to SEQ ID NO: 44116

SEQ ID NO: 310702 - RNA, 64 nt, Homo Sapiens; identical to SEQ ID NO: 44117

SEQ ID NO: 310703 - RNA, 64 nt, Homo Sapiens; identical to SEQ ID NO: 44118

SEQ ID NO: 310704 - RNA, 64 nt, Homo Sapiens; identical to SEQ ID NO: 44119

SEQ ID NO: 310705 - RNA, 64 nt, Homo Sapiens; identical to SEQ ID NO: 44120

SEQ ID NO: 310706 - RNA, 64 nt, Homo Sapiens; identical to SEQ ID NO: 44121

SEQ ID NO: 310707 - RNA, 64 nt, Homo Sapiens; identical to SEQ ID NO: 44122

SEQ ID NO: 310708 - RNA, 64 nt, Homo Sapiens; identical to SEQ ID NO: 44123

SEQ ID NO: 310709 - RNA, 64 nt, Homo Sapiens; identical to SEQ ID NO: 44124

SEQ ID NO: 310710 - RNA, 64 nt, Homo Sapiens; identical to SEQ ID NO: 44125

SEQ ID NO: 310711 - RNA, 64 nt, Homo Sapiens; identical to SEQ ID NO: 44126

SEQ ID NO: 310712 - RNA, 64 nt, Homo Sapiens; identical to SEQ ID NO: 44127

SEQ ID NO: 310713 - RNA, 64 nt, Homo Sapiens; identical to SEQ ID NO: 44128

SEQ ID NO: 310714 - RNA, 64 nt, Homo Sapiens; identical to SEQ ID NO: 44129

SEQ ID NO: 310715 - RNA, 64 nt, Homo Sapiens; identical to SEQ ID NO: 44130

SEQ ID NO: 310716 - RNA, 64 nt, Homo Sapiens; identical to SEQ ID NO: 44131

SEQ ID NO: 310717 - RNA, 64 nt, Homo Sapiens; identical to SEQ ID NO: 44132

SEQ ID NO: 310718 - RNA, 64 nt, Homo Sapiens; identical to SEQ ID NO: 44133

SEQ ID NO: 310719 - RNA, 64 nt, Homo Sapiens; identical to SEQ ID NO: 44134

SEQ ID NO: 310720 - RNA, 64 nt, Homo Sapiens; identical to SEQ ID NO: 44135

SEQ ID NO: 310721 - RNA, 64 nt, Homo Sapiens; identical to SEQ ID NO: 44136

SEQ ID NO: 310722 - RNA, 64 nt, Homo Sapiens; identical to SEQ ID NO: 44137

SEQ ID NO: 310723 - RNA, 64 nt, Homo Sapiens; identical to SEQ ID NO: 44138

SEQ ID NO: 310724 - RNA, 64 nt, Homo Sapiens; identical to SEQ ID NO: 44139

SEQ ID NO: 310725 - RNA, 64 nt, Homo Sapiens; identical to SEQ ID NO: 44140

SEQ ID NO: 310726 - RNA, 64 nt, Homo Sapiens; identical to SEQ ID NO: 44141

SEQ ID NO: 310727 - RNA, 64 nt, Homo Sapiens; identical to SEQ ID NO: 44142

SEQ ID NO: 310728 - RNA, 64 nt, Homo Sapiens; identical to SEQ ID NO: 44143

SEQ ID NO: 310729 - RNA, 64 nt, Homo Sapiens; identical to SEQ ID NO: 44144

SEQ ID NO: 310730 - RNA, 64 nt, Homo Sapiens; identical to SEQ ID NO: 44145

SEQ ID NO: 310731 - RNA, 64 nt, Homo Sapiens; identical to SEQ ID NO: 44146

SEQ ID NO: 310732 - RNA, 64 nt, Homo Sapiens; identical to SEQ ID NO: 44147

SEQ ID NO: 310733 - RNA, 64 nt, Homo Sapiens; identical to SEQ ID NO: 44148

SEQ ID NO: 310734 - RNA, 64 nt, Homo Sapiens; identical to SEQ ID NO: 44149

SEQ ID NO: 310735 - RNA, 64 nt, Homo Sapiens; identical to SEQ ID NO: 44150

SEQ ID NO: 310736 - RNA, 64 nt, Homo Sapiens; identical to SEQ ID NO: 44151

SEQ ID NO: 310737 - RNA, 64 nt, Homo Sapiens; identical to SEQ ID NO: 44152

SEQ ID NO: 310738 - RNA, 64 nt, Homo Sapiens; identical to SEQ ID NO: 44153

SEQ ID NO: 310739 - RNA, 64 nt, Homo Sapiens; identical to SEQ ID NO: 44154

SEQ ID NO: 310740 - RNA, 64 nt, Homo Sapiens; identical to SEQ ID NO: 44155

SEQ ID NO: 310741 - RNA, 64 nt, Homo Sapiens; identical to SEQ ID NO: 44156

SEQ ID NO: 310742 - RNA, 64 nt, Homo Sapiens; identical to SEQ ID NO: 44157

SEQ ID NO: 310743 - RNA, 64 nt, Homo Sapiens; identical to SEQ ID NO: 44158

SEQ ID NO: 310744 - RNA, 64 nt, Homo Sapiens; identical to SEQ ID NO: 44159

SEQ ID NO: 310745 - RNA, 64 nt, Homo Sapiens; identical to SEQ ID NO: 44160

SEQ ID NO: 310746 - RNA, 64 nt, Homo Sapiens; identical to SEQ ID NO: 44161

SEQ ID NO: 310747 - RNA, 64 nt, Homo Sapiens; identical to SEQ ID NO: 44162

SEQ ID NO: 310748 - RNA, 64 nt, Homo Sapiens; identical to SEQ ID NO: 44163

SEQ ID NO: 310749 - RNA, 64 nt, Homo Sapiens; identical to SEQ ID NO: 44164

SEQ ID NO: 310750 - RNA, 64 nt, Homo Sapiens; identical to SEQ ID NO: 44165

SEQ ID NO: 310751 - RNA, 64 nt, Homo Sapiens; identical to SEQ ID NO: 44166

SEQ ID NO: 310752 - RNA, 64 nt, Homo Sapiens; identical to SEQ ID NO: 44167

SEQ ID NO: 310753 - RNA, 64 nt, Homo Sapiens; identical to SEQ ID NO: 44168

SEQ ID NO: 310754 - RNA, 64 nt, Homo Sapiens; identical to SEQ ID NO: 44169

SEQ ID NO: 310755 - RNA, 64 nt, Homo Sapiens; identical to SEQ ID NO: 44170

SEQ ID NO: 310756 - RNA, 64 nt, Homo Sapiens; identical to SEQ ID NO: 44171

SEQ ID NO: 310757 - RNA, 64 nt, Homo Sapiens; identical to SEQ ID NO: 44172

SEQ ID NO: 310758 - RNA, 64 nt, Homo Sapiens; identical to SEQ ID NO: 44173

SEQ ID NO: 310759 - RNA, 64 nt, Homo Sapiens; identical to SEQ ID NO: 44174

SEQ ID NO: 310760 - RNA, 64 nt, Homo Sapiens; identical to SEQ ID NO: 44175

SEQ ID NO: 310761 - RNA, 64 nt, Homo Sapiens; identical to SEQ ID NO: 44176

SEQ ID NO: 310762 - RNA, 64 nt, Homo Sapiens; identical to SEQ ID NO: 44177

SEQ ID NO: 310763 - RNA, 64 nt, Homo Sapiens; identical to SEQ ID NO: 44178

SEQ ID NO: 310764 - RNA, 64 nt, Homo Sapiens; identical to SEQ ID NO: 44179

SEQ ID NO: 310765 - RNA, 64 nt, Homo Sapiens; identical to SEQ ID NO: 44180

SEQ ID NO: 310766 - RNA, 64 nt, Homo Sapiens; identical to SEQ ID NO: 44181

SEQ ID NO: 310767 - RNA, 64 nt, Homo Sapiens; identical to SEQ ID NO: 44182

SEQ ID NO: 310768 - RNA, 64 nt, Homo Sapiens; identical to SEQ ID NO: 44183

SEQ ID NO: 310769 - RNA, 64 nt, Homo Sapiens; identical to SEQ ID NO: 44184

SEQ ID NO: 310770 - RNA, 64 nt, Homo Sapiens; identical to SEQ ID NO: 44185

SEQ ID NO: 310771 - RNA, 64 nt, Homo Sapiens; identical to SEQ ID NO: 44186

SEQ ID NO: 310772 - RNA, 64 nt, Homo Sapiens; identical to SEQ ID NO: 44187

SEQ ID NO: 310773 - RNA, 64 nt, Homo Sapiens; identical to SEQ ID NO: 44188

SEQ ID NO: 310774 - RNA, 64 nt, Homo Sapiens; identical to SEQ ID NO: 44189

SEQ ID NO: 310775 - RNA, 64 nt, Homo Sapiens; identical to SEQ ID NO: 44190

SEQ ID NO: 310776 - RNA, 64 nt, Homo Sapiens; identical to SEQ ID NO: 44191

SEQ ID NO: 310777 - RNA, 64 nt, Homo Sapiens; identical to SEQ ID NO: 44192

SEQ ID NO: 310778 - RNA, 64 nt, Homo Sapiens; identical to SEQ ID NO: 44193

SEQ ID NO: 310779 - RNA, 64 nt, Homo Sapiens; identical to SEQ ID NO: 44194

SEQ ID NO: 310780 - RNA, 64 nt, Homo Sapiens; identical to SEQ ID NO: 44195

SEQ ID NO: 310781 - RNA, 64 nt, Homo Sapiens; identical to SEQ ID NO: 44196

SEQ ID NO: 310782 - RNA, 64 nt, Homo Sapiens; identical to SEQ ID NO: 44197

SEQ ID NO: 310783 - RNA, 64 nt, Homo Sapiens; identical to SEQ ID NO: 44198

SEQ ID NO: 310784 - RNA, 64 nt, Homo Sapiens; identical to SEQ ID NO: 44199

SEQ ID NO: 310785 - RNA, 64 nt, Homo Sapiens; identical to SEQ ID NO: 44200

SEQ ID NO: 310786 - RNA, 64 nt, Homo Sapiens; identical to SEQ ID NO: 44201

SEQ ID NO: 310787 - RNA, 64 nt, Homo Sapiens; identical to SEQ ID NO: 44202

SEQ ID NO: 310788 - RNA, 64 nt, Homo Sapiens; identical to SEQ ID NO: 44203

SEQ ID NO: 310789 - RNA, 64 nt, Homo Sapiens; identical to SEQ ID NO: 44204

SEQ ID NO: 310790 - RNA, 64 nt, Homo Sapiens; identical to SEQ ID NO: 44205

SEQ ID NO: 310791 - RNA, 64 nt, Homo Sapiens; identical to SEQ ID NO: 44206

SEQ ID NO: 310792 - RNA, 64 nt, Homo Sapiens; identical to SEQ ID NO: 44207

SEQ ID NO: 310793 - RNA, 64 nt, Homo Sapiens; identical to SEQ ID NO: 44208

SEQ ID NO: 310794 - RNA, 64 nt, Homo Sapiens; identical to SEQ ID NO: 44209

SEQ ID NO: 310795 - RNA, 64 nt, Homo Sapiens; identical to SEQ ID NO: 44210

SEQ ID NO: 310796 - RNA, 64 nt, Homo Sapiens; identical to SEQ ID NO: 44211

SEQ ID NO: 310797 - RNA, 64 nt, Homo Sapiens; identical to SEQ ID NO: 44212

SEQ ID NO: 310798 - RNA, 64 nt, Homo Sapiens; identical to SEQ ID NO: 44213

SEQ ID NO: 310799 - RNA, 64 nt, Homo Sapiens; identical to SEQ ID NO: 44214

SEQ ID NO: 310800 - RNA, 64 nt, Homo Sapiens; identical to SEQ ID NO: 44215

SEQ ID NO: 310801 - RNA, 64 nt, Homo Sapiens; identical to SEQ ID NO: 44216

SEQ ID NO: 310802 - RNA, 64 nt, Homo Sapiens; identical to SEQ ID NO: 44217

SEQ ID NO: 310803 - RNA, 64 nt, Homo Sapiens; identical to SEQ ID NO: 44218

SEQ ID NO: 310804 - RNA, 64 nt, Homo Sapiens; identical to SEQ ID NO: 44219

SEQ ID NO: 310805 - RNA, 64 nt, Homo Sapiens; identical to SEQ ID NO: 44220

SEQ ID NO: 310806 - RNA, 64 nt, Homo Sapiens; identical to SEQ ID NO: 44221

SEQ ID NO: 310807 - RNA, 64 nt, Homo Sapiens; identical to SEQ ID NO: 44222

SEQ ID NO: 310808 - RNA, 64 nt, Homo Sapiens; identical to SEQ ID NO: 44223

SEQ ID NO: 310809 - RNA, 64 nt, Homo Sapiens; identical to SEQ ID NO: 44224

SEQ ID NO: 310810 - RNA, 64 nt, Homo Sapiens; identical to SEQ ID NO: 44225

SEQ ID NO: 310811 - RNA, 64 nt, Homo Sapiens; identical to SEQ ID NO: 44226

SEQ ID NO: 310812 - RNA, 64 nt, Homo Sapiens; identical to SEQ ID NO: 44227

SEQ ID NO: 310813 - RNA, 64 nt, Homo Sapiens; identical to SEQ ID NO: 44228

SEQ ID NO: 310814 - RNA, 64 nt, Homo Sapiens; identical to SEQ ID NO: 44229

SEQ ID NO: 310815 - RNA, 64 nt, Homo Sapiens; identical to SEQ ID NO: 44230

SEQ ID NO: 310816 - RNA, 64 nt, Homo Sapiens; identical to SEQ ID NO: 44231

SEQ ID NO: 310817 - RNA, 64 nt, Homo Sapiens; identical to SEQ ID NO: 44232

SEQ ID NO: 310818 - RNA, 64 nt, Homo Sapiens; identical to SEQ ID NO: 44233

SEQ ID NO: 310819 - RNA, 64 nt, Homo Sapiens; identical to SEQ ID NO: 44234

SEQ ID NO: 310820 - RNA, 64 nt, Homo Sapiens; identical to SEQ ID NO: 44235

SEQ ID NO: 310821 - RNA, 64 nt, Homo Sapiens; identical to SEQ ID NO: 44236

SEQ ID NO: 310822 - RNA, 64 nt, Homo Sapiens; identical to SEQ ID NO: 44237

SEQ ID NO: 310823 - RNA, 64 nt, Homo Sapiens; identical to SEQ ID NO: 44238

SEQ ID NO: 310824 - RNA, 64 nt, Homo Sapiens; identical to SEQ ID NO: 44239

SEQ ID NO: 310825 - RNA, 64 nt, Homo Sapiens; identical to SEQ ID NO: 44240

SEQ ID NO: 310826 - RNA, 64 nt, Homo Sapiens; identical to SEQ ID NO: 44241

SEQ ID NO: 310827 - RNA, 64 nt, Homo Sapiens; identical to SEQ ID NO: 44242

SEQ ID NO: 310828 - RNA, 64 nt, Homo Sapiens; identical to SEQ ID NO: 44243

SEQ ID NO: 310829 - RNA, 64 nt, Homo Sapiens; identical to SEQ ID NO: 44244

SEQ ID NO: 310830 - RNA, 64 nt, Homo Sapiens; identical to SEQ ID NO: 44245

SEQ ID NO: 310831 - RNA, 64 nt, Homo Sapiens; identical to SEQ ID NO: 44246

SEQ ID NO: 310832 - RNA, 64 nt, Homo Sapiens; identical to SEQ ID NO: 44247

SEQ ID NO: 310833 - RNA, 64 nt, Homo Sapiens; identical to SEQ ID NO: 44248

SEQ ID NO: 310834 - RNA, 64 nt, Homo Sapiens; identical to SEQ ID NO: 44249

SEQ ID NO: 310835 - RNA, 64 nt, Homo Sapiens; identical to SEQ ID NO: 44250

SEQ ID NO: 310836 - RNA, 64 nt, Homo Sapiens; identical to SEQ ID NO: 44251

SEQ ID NO: 310837 - RNA, 64 nt, Homo Sapiens; identical to SEQ ID NO: 44252

SEQ ID NO: 310838 - RNA, 64 nt, Homo Sapiens; identical to SEQ ID NO: 44253

SEQ ID NO: 310839 - RNA, 64 nt, Homo Sapiens
gcccuggaucucccaauggccuuccaauccuuaaacugccaaucgccccacccguuccuaccug

SEQ ID NO: 310840 - RNA, 64 nt, Homo Sapiens
uuguaauccagucccuucuuggaaccuaaauugaacugccaaguacugcgcaugcaagagaccc

SEQ ID NO: 310841 - RNA, 64 nt, Homo Sapiens
guucaagguaauaugccaggcgcuguaugucuccacugccaaguagaagugacucaaaacccuc

SEQ ID NO: 310842 - RNA, 64 nt, Homo Sapiens
ccuuuacuaagcacaaguacuugccacugccaucacugccaaguaacuagaugucucuguuucc

SEQ ID NO: 310843 - RNA, 64 nt, Homo Sapiens
ucacaacccaggugacgaugcccucucagccaacacugccaaccugacccugucaucccgauug

SEQ ID NO: 310844 - RNA, 64 nt, Homo Sapiens
gaggaaucuuuucucugccuggucucagaaugggacugccaacuggcucauuggugggagacac

SEQ ID NO: 310845 - RNA, 64 nt, Homo Sapiens
gggggcuguagaaaagccuugugccccuaaugagacugccaagugagauuccuaugucucccua

SEQ ID NO: 310846 - RNA, 64 nt, Homo Sapiens
uagugccaagaggagguguguacuuccuuugcugacugccaacuaacuauuuuccccuccuauu

SEQ ID NO: 310847 - RNA, 64 nt, Homo Sapiens
gcucaggagccaggcuagugguacuaucccuguaacugccaagaauuguucuuggcauauuauu

SEQ ID NO: 310848 - RNA, 64 nt, Homo Sapiens
aucaaggcuuuugugauaugaguggugccaaaagacugccaagaacgagggcucuggagcugug

SEQ ID NO: 310849 - RNA, 64 nt, Homo Sapiens
ccuccagaauugacuuagcccuaguaauaaaagcacugccaaaacaucucagagacuucuuuua

SEQ ID NO: 310850 - RNA, 64 nt, Homo Sapiens
uuucugguaaagaucaugguuaaguauaaucauuacugccaaacuggaauuuucaaguuauuau

SEQ ID NO: 310851 - RNA, 64 nt, Homo Sapiens
ucugcaccauugugaauccaugucuguaagugaaacugccaaugucucugacccagcagaaaug

SEQ ID NO: 310852 - RNA, 64 nt, Homo Sapiens
gaugccaguggagagauuauccugggaaagaauuacugccaaagucuucuuuucuauuuuccag

SEQ ID NO: 310853 - RNA, 64 nt, Homo Sapiens
cgggugggcuaagccgccagcugccaaucaacacacugccaaugcucaucagcucaguaccuaa

SEQ ID NO: 310854 - RNA, 64 nt, Homo Sapiens
aacacacugccaaugcgggucagcucaguaccuaacugccaaucucuggaaaugcuaaacucau

SEQ ID NO: 310855 - RNA, 64 nt, Homo Sapiens
cuauguaauuuucuuuaauuugugcuuccggacaacugccaaaugggugcagugaaaugauuca

SEQ ID NO: 310856 - RNA, 64 nt, Homo Sapiens
caggcacaugcuuagcuguaaggaaugcugcugcacugccaacucucuggagagguagggccag

SEQ ID NO: 310857 - RNA, 64 nt, Homo Sapiens
uucucacagcaacaugugacaacaugcaagaaguacugccaauacugccaaccagagcagcuca

SEQ ID NO: 310858 - RNA, 64 nt, Homo Sapiens
caacaugugacaacaugcaagaaguacugccaauacugccaaccagagcagcucacucgagauc

SEQ ID NO: 310859 - RNA, 64 nt, Homo Sapiens
gcuccauauauugggugugauuuaaagcucauaaacugccaagagggauccagggacacuuuuu

SEQ ID NO: 310860 - RNA, 64 nt, Homo Sapiens
ugguacagcuucuggagcaguggggugagggaucacugccaaaagacaggcuaaaaugugaacg

SEQ ID NO: 310861 - RNA, 64 nt, Homo Sapiens
ucagcaagaagggacuguuucuaggugggcugggcgcgagcagggacugucccgagcgguauag

SEQ ID NO: 310862 - RNA, 64 nt, Homo Sapiens
ugcccgcccggggagcacaaacagagccacggagcgcgagcacacccccgcacgcugggcacca

SEQ ID NO: 310863 - RNA, 64 nt, Homo Sapiens
gcacccugacacuggcauuuagcagcaguggaaccgcgagcaagucccuuccuuuuagagcgug

SEQ ID NO: 310864 - RNA, 64 nt, Homo Sapiens
cugggaacugggucuuggguaaggacagcgcuuccgcgagcaccucuggcugcccguguuaaug

SEQ ID NO: 310865 - RNA, 64 nt, Homo Sapiens
gccccagcuuuccgccugcacccgcgaggacgcgcgcgagcacacgcggcgccccgccaggccu

SEQ ID NO: 310866 - RNA, 64 nt, Homo Sapiens
uguucauauagucaauguaaaacuuauuagcagucgcgagcacauuagagauuaaaccaauuau

SEQ ID NO: 310867 - RNA, 64 nt, Homo Sapiens
cccauguacccuggggcaccagagucucaggcaccgcgagcauucacuggggucucuccacccc

SEQ ID NO: 310868 - RNA, 64 nt, Homo Sapiens
uucuugggaccaaagucaauacucucccagcaaccgcgagcaauagccucagcccaccgccagu

SEQ ID NO: 310869 - RNA, 64 nt, Homo Sapiens
gaacguguguguuaggagaagcggagcuaggaggcgcgagcagagaggccaaguugcccacccu

SEQ ID NO: 310870 - RNA, 64 nt, Homo Sapiens
gcgccgggaccgggaucgugaccgugaccgugaccgcgagcacaaacggggggagcggggcagu

SEQ ID NO: 310871 - RNA, 64 nt, Homo Sapiens
ucagccucaacugcugagcgcccccacucccggccgcgagcaggcagggcuucggggacgcggg

SEQ ID NO: 310872 - RNA, 64 nt, Homo Sapiens
cagcggacgugagcuuccacugcggcugcagagacgcgagcaaccucuucucaucggcucuuau

SEQ ID NO: 310873 - RNA, 64 nt, Homo Sapiens; identical to SEQ ID NO: 220358

SEQ ID NO: 310874 - RNA, 64 nt, Homo Sapiens; identical to SEQ ID NO: 220359

SEQ ID NO: 310875 - RNA, 64 nt, Homo Sapiens; identical to SEQ ID NO: 220360

SEQ ID NO: 310876 - RNA, 64 nt, Homo Sapiens; identical to SEQ ID NO: 220361

SEQ ID NO: 310877 - RNA, 64 nt, Homo Sapiens
uuugauuuacugguacauuuuuaaaauaauaaaucugccauaaaaugcauuauaucuggagacu

SEQ ID NO: 310878 - RNA, 64 nt, Homo Sapiens
uaccucucuggugcuguuacaguacauucuguaccugccauacaggcucauuuucaugcaaauu

SEQ ID NO: 310879 - RNA, 64 nt, Homo Sapiens
uugagggcagggggaguuuuucccacaauccaagcugccauauuauuuauuguuucauuuuuuu

SEQ ID NO: 310880 - RNA, 64 nt, Homo Sapiens
augcauguuucuuccuguacucaggccuucaugucugccauaaccgaacauaggguuaacccuu

SEQ ID NO: 310881 - RNA, 64 nt, Homo Sapiens
ucuucacuagucaagaaugcaagaaugggccuuucugccauaauggaccauguuugagacucag

SEQ ID NO: 310882 - RNA, 64 nt, Homo Sapiens
agagauguuugaauuuauuacaaucugaugaacucugccauaaucucaacaauggaucccgcua

SEQ ID NO: 310883 - RNA, 64 nt, Homo Sapiens
uagcauuggaguccucugcagaaagggucuccagcugccauauguccguucugccaccugccuu

SEQ ID NO: 310884 - RNA, 64 nt, Homo Sapiens
guauugggauacuauagugaacucuggcagccuacugccauacagaagccacccagcuuaggau

SEQ ID NO: 310885 - RNA, 64 nt, Homo Sapiens; identical to SEQ ID NO: 250698

SEQ ID NO: 310886 - RNA, 64 nt, Homo Sapiens; identical to SEQ ID NO: 250699

SEQ ID NO: 310887 - RNA, 64 nt, Homo Sapiens; identical to SEQ ID NO: 250700

SEQ ID NO: 310888 - RNA, 64 nt, Homo Sapiens; identical to SEQ ID NO: 250701

SEQ ID NO: 310889 - RNA, 64 nt, Homo Sapiens; identical to SEQ ID NO: 250702

SEQ ID NO: 310890 - RNA, 64 nt, Homo Sapiens; identical to SEQ ID NO: 250703

SEQ ID NO: 310891 - RNA, 64 nt, Homo Sapiens; identical to SEQ ID NO: 250704

SEQ ID NO: 310892 - RNA, 64 nt, Homo Sapiens; identical to SEQ ID NO: 250705

SEQ ID NO: 310893 - RNA, 64 nt, Homo Sapiens; identical to SEQ ID NO: 250706

SEQ ID NO: 310894 - RNA, 64 nt, Homo Sapiens; identical to SEQ ID NO: 250707

SEQ ID NO: 310895 - RNA, 64 nt, Homo Sapiens; identical to SEQ ID NO: 250708

SEQ ID NO: 310896 - RNA, 64 nt, Homo Sapiens; identical to SEQ ID NO: 250709

SEQ ID NO: 310897 - RNA, 64 nt, Homo Sapiens; identical to SEQ ID NO: 250710

SEQ ID NO: 310898 - RNA, 64 nt, Homo Sapiens; identical to SEQ ID NO: 250711

SEQ ID NO: 310899 - RNA, 64 nt, Homo Sapiens; identical to SEQ ID NO: 250712

SEQ ID NO: 310900 - RNA, 64 nt, Homo Sapiens; identical to SEQ ID NO: 250713

SEQ ID NO: 310901 - RNA, 61 nt, Homo Sapiens; identical to SEQ ID NO: 250714

SEQ ID NO: 310902 - RNA, 64 nt, Homo Sapiens; identical to SEQ ID NO: 250715

SEQ ID NO: 310903 - RNA, 64 nt, Homo Sapiens; identical to SEQ ID NO: 250716

SEQ ID NO: 310904 - RNA, 64 nt, Homo Sapiens; identical to SEQ ID NO: 250717

SEQ ID NO: 310905 - RNA, 64 nt, Homo Sapiens; identical to SEQ ID NO: 250718

SEQ ID NO: 310906 - RNA, 64 nt, Homo Sapiens; identical to SEQ ID NO: 250719

SEQ ID NO: 310907 - RNA, 64 nt, Homo Sapiens; identical to SEQ ID NO: 250720

SEQ ID NO: 310908 - RNA, 64 nt, Homo Sapiens; identical to SEQ ID NO: 250721

SEQ ID NO: 310909 - RNA, 64 nt, Homo Sapiens; identical to SEQ ID NO: 250722

SEQ ID NO: 310910 - RNA, 64 nt, Homo Sapiens; identical to SEQ ID NO: 250723

SEQ ID NO: 310911 - RNA, 64 nt, Homo Sapiens; identical to SEQ ID NO: 250724

SEQ ID NO: 310912 - RNA, 64 nt, Homo Sapiens; identical to SEQ ID NO: 250725

SEQ ID NO: 310913 - RNA, 64 nt, Homo Sapiens; identical to SEQ ID NO: 250726

SEQ ID NO: 310914 - RNA, 64 nt, Homo Sapiens; identical to SEQ ID NO: 250727

SEQ ID NO: 310915 - RNA, 64 nt, Homo Sapiens; identical to SEQ ID NO: 250728

SEQ ID NO: 310916 - RNA, 64 nt, Homo Sapiens; identical to SEQ ID NO: 250729

SEQ ID NO: 310917 - RNA, 64 nt, Homo Sapiens; identical to SEQ ID NO: 250730

SEQ ID NO: 310918 - RNA, 64 nt, Homo Sapiens; identical to SEQ ID NO: 250731

SEQ ID NO: 310919 - RNA, 64 nt, Homo Sapiens; identical to SEQ ID NO: 250732

SEQ ID NO: 310920 - RNA, 64 nt, Homo Sapiens; identical to SEQ ID NO: 250733

SEQ ID NO: 310921 - RNA, 64 nt, Homo Sapiens; identical to SEQ ID NO: 250734

SEQ ID NO: 310922 - RNA, 64 nt, Homo Sapiens; identical to SEQ ID NO: 250735

SEQ ID NO: 310923 - RNA, 64 nt, Homo Sapiens; identical to SEQ ID NO: 250736

SEQ ID NO: 310924 - RNA, 64 nt, Homo Sapiens; identical to SEQ ID NO: 250737

SEQ ID NO: 310925 - RNA, 64 nt, Homo Sapiens; identical to SEQ ID NO: 250738

SEQ ID NO: 310926 - RNA, 64 nt, Homo Sapiens; identical to SEQ ID NO: 250739

SEQ ID NO: 310927 - RNA, 64 nt, Homo Sapiens; identical to SEQ ID NO: 250740

SEQ ID NO: 310928 - RNA, 64 nt, Homo Sapiens; identical to SEQ ID NO: 250741

SEQ ID NO: 310929 - RNA, 64 nt, Homo Sapiens; identical to SEQ ID NO: 250742

SEQ ID NO: 310930 - RNA, 64 nt, Homo Sapiens; identical to SEQ ID NO: 250743

SEQ ID NO: 310931 - RNA, 64 nt, Homo Sapiens; identical to SEQ ID NO: 250744

SEQ ID NO: 310932 - RNA, 64 nt, Homo Sapiens; identical to SEQ ID NO: 250745

SEQ ID NO: 310933 - RNA, 64 nt, Homo Sapiens; identical to SEQ ID NO: 250746

SEQ ID NO: 310934 - RNA, 64 nt, Homo Sapiens; identical to SEQ ID NO: 250747

SEQ ID NO: 310935 - RNA, 64 nt, Homo Sapiens; identical to SEQ ID NO: 250748

SEQ ID NO: 310936 - RNA, 64 nt, Homo Sapiens; identical to SEQ ID NO: 250749

SEQ ID NO: 310937 - RNA, 64 nt, Homo Sapiens; identical to SEQ ID NO: 250750

SEQ ID NO: 310938 - RNA, 64 nt, Homo Sapiens; identical to SEQ ID NO: 250751

SEQ ID NO: 310939 - RNA, 64 nt, Homo Sapiens; identical to SEQ ID NO: 250752

SEQ ID NO: 310940 - RNA, 64 nt, Homo Sapiens; identical to SEQ ID NO: 250753

SEQ ID NO: 310941 - RNA, 64 nt, Homo Sapiens; identical to SEQ ID NO: 146964

SEQ ID NO: 310942 - RNA, 64 nt, Homo Sapiens; identical to SEQ ID NO: 146965

SEQ ID NO: 310943 - RNA, 64 nt, Homo Sapiens; identical to SEQ ID NO: 146966

SEQ ID NO: 310944 - RNA, 64 nt, Homo Sapiens; identical to SEQ ID NO: 146967

SEQ ID NO: 310945 - RNA, 64 nt, Homo Sapiens; identical to SEQ ID NO: 146968

SEQ ID NO: 310946 - RNA, 64 nt, Homo Sapiens; identical to SEQ ID NO: 146969

SEQ ID NO: 310947 - RNA, 64 nt, Homo Sapiens; identical to SEQ ID NO: 146970

SEQ ID NO: 310948 - RNA, 64 nt, Homo Sapiens; identical to SEQ ID NO: 146971

SEQ ID NO: 310949 - RNA, 64 nt, Homo Sapiens; identical to SEQ ID NO: 146972

SEQ ID NO: 310950 - RNA, 64 nt, Homo Sapiens; identical to SEQ ID NO: 146973

SEQ ID NO: 310951 - RNA, 64 nt, Homo Sapiens; identical to SEQ ID NO: 146974

SEQ ID NO: 310952 - RNA, 64 nt, Homo Sapiens; identical to SEQ ID NO: 146975

SEQ ID NO: 310953 - RNA, 64 nt, Homo Sapiens; identical to SEQ ID NO: 146976

SEQ ID NO: 310954 - RNA, 64 nt, Homo Sapiens; identical to SEQ ID NO: 146977

SEQ ID NO: 310955 - RNA, 64 nt, Homo Sapiens; identical to SEQ ID NO: 146978

SEQ ID NO: 310956 - RNA, 64 nt, Homo Sapiens; identical to SEQ ID NO: 146979

SEQ ID NO: 310957 - RNA, 64 nt, Homo Sapiens; identical to SEQ ID NO: 146980

SEQ ID NO: 310958 - RNA, 64 nt, Homo Sapiens; identical to SEQ ID NO: 146981

SEQ ID NO: 310959 - RNA, 64 nt, Homo Sapiens; identical to SEQ ID NO: 284671

SEQ ID NO: 310960 - RNA, 64 nt, Homo Sapiens; identical to SEQ ID NO: 284672

SEQ ID NO: 310961 - RNA, 64 nt, Homo Sapiens; identical to SEQ ID NO: 284673

SEQ ID NO: 310962 - RNA, 64 nt, Homo Sapiens; identical to SEQ ID NO: 284674

SEQ ID NO: 310963 - RNA, 64 nt, Homo Sapiens; identical to SEQ ID NO: 284675

SEQ ID NO: 310964 - RNA, 64 nt, Homo Sapiens; identical to SEQ ID NO: 284676

SEQ ID NO: 310965 - RNA, 64 nt, Homo Sapiens; identical to SEQ ID NO: 284677

SEQ ID NO: 310966 - RNA, 64 nt, Homo Sapiens; identical to SEQ ID NO: 284678

SEQ ID NO: 310967 - RNA, 64 nt, Homo Sapiens; identical to SEQ ID NO: 284679

SEQ ID NO: 310968 - RNA, 64 nt, Homo Sapiens; identical to SEQ ID NO: 284680

SEQ ID NO: 310969 - RNA, 64 nt, Homo Sapiens; identical to SEQ ID NO: 284681

SEQ ID NO: 310970 - RNA, 64 nt, Homo Sapiens; identical to SEQ ID NO: 284682

SEQ ID NO: 310971 - RNA, 64 nt, Homo Sapiens
ggaccagaaugcaaccccagcuccacuccagccuggcguccagggccacagccauggccugggg

SEQ ID NO: 310972 - RNA, 64 nt, Homo Sapiens
cagaacagucucuccgugggaggagacauuauggggcguccaccaccaccccucccuggccauc

SEQ ID NO: 310973 - RNA, 64 nt, Homo Sapiens
acccugagggccauggccaagaucaccccggacgggcguccaggguauccucauaggaaacagu

SEQ ID NO: 310974 - RNA, 64 nt, Homo Sapiens
uccagcagacacaauggaggagaggaaagugagaggcguccauugacugauguuaagaguggcc

SEQ ID NO: 310975 - RNA, 64 nt, Homo Sapiens
gcggcugcaucgccuucuccccuccauccagccuggcguccagguugcccuguucaggggacag

SEQ ID NO: 310976 - RNA, 64 nt, Homo Sapiens
ugggggugugcaucuucgggaaaggugguggcggggcguccacuagguuuccuguccccugcug

SEQ ID NO: 310977 - RNA, 64 nt, Homo Sapiens
ucuugccuuagccucccgagcagcugggauuauaggcguccaccaccacgcccagcuaauuuuu

SEQ ID NO: 310978 - RNA, 64 nt, Homo Sapiens
ccuaagaacagcagcuccacucugagagcugggcggcguccacacuggguuuucuccgcacuga

SEQ ID NO: 310979 - RNA, 64 nt, Homo Sapiens
ggcagacacagggaggaaggacccagugcccucaggcguccaucugaugcaugggaccaacaua

SEQ ID NO: 310980 - RNA, 64 nt, Homo Sapiens
aaagaggggagaaaaggcgagugucaggugagaaggcguccacacaaucaucugugaaguggug

SEQ ID NO: 310981 - RNA, 64 nt, Homo Sapiens
agcaagaagagacugauugaggauacugaagacuggcguccaaggacuggaacaacucagucuc

SEQ ID NO: 310982 - RNA, 64 nt, Homo Sapiens
aaagcagcugcacucagacaacaggaacggcacaggcguccaggccaagcauaggauuuggaag

SEQ ID NO: 310983 - RNA, 53 nt, Homo Sapiens
uccuccugaagugcuuaugaaggggcguccauucuccuccauacauccccauc

SEQ ID NO: 310984 - RNA, 64 nt, Homo Sapiens
cggcguggguccuagccuggccagugaugcugcuggcguccagaccccagacucacuccaagca

SEQ ID NO: 310985 - RNA, 64 nt, Homo Sapiens
ccuuuggugagaagccaauucccacuugacagaaggcguccauccauucaucucauuggccaag

SEQ ID NO: 310986 - RNA, 64 nt, Homo Sapiens
cagaaugucacagaugaagaauauuaaaauuaggggcguccacuccaaaacauaucaccagagu

SEQ ID NO: 310987 - RNA, 64 nt, Homo Sapiens
aaugaaggcuggagaaugcacagagcacuggcuuggcguccagccagacucagccucuauuguc

SEQ ID NO: 310988 - RNA, 64 nt, Homo Sapiens
ucuguuccucaaugugugacucauuaggaaucuuggcguccacaugcugagcuguaccccacau

SEQ ID NO: 310989 - RNA, 64 nt, Homo Sapiens
aggagaugccugguucugccgggguuggcacuguggcguccaggcuccccacgggcuggaugac

SEQ ID NO: 310990 - RNA, 64 nt, Homo Sapiens
acuucugcacagaauuuggugggaaaauggaaauggcguccagucaaaagggauccccuucauu

SEQ ID NO: 310991 - RNA, 64 nt, Homo Sapiens
ccgaggccggcaacaaacgauggcccauggucggggcguccacggaggaggcagacgcccugcg

SEQ ID NO: 310992 - RNA, 64 nt, Homo Sapiens
cggcuguggcaggaggagcucugguucccaggguggcguccacuuagagcagacaggccuggcc

SEQ ID NO: 310993 - RNA, 64 nt, Homo Sapiens
auuuccuuagaucguggucagcuccgaggaauguggcguccaggcucuuugagagccaugggcu

SEQ ID NO: 310994 - RNA, 64 nt, Homo Sapiens
gcauuucccuaauaaauaguacucucccugccgaggcguccauacccauccccugcaccucccu

SEQ ID NO: 310995 - RNA, 63 nt, Homo Sapiens
gggugacccagacucguaaaccccggugcagcuggcguccaaaaggcccagacucguaaauga

SEQ ID NO: 310996 - RNA, 64 nt, Homo Sapiens
uguguccuccuggcagccccccacacccgaagcaggcguccauccucugcaccagccucucccu

SEQ ID NO: 310997 - RNA, 64 nt, Homo Sapiens
ccgcgcccuuuccccgacgccaaaaagcuccuggggcguccagggaaguugaacgagcauaguc

SEQ ID NO: 310998 - RNA, 64 nt, Homo Sapiens
uuuaauuuuugugguccuuccguuuauuauaauaggcguccaccaaugauuauccauauguguu

SEQ ID NO: 310999 - RNA, 64 nt, Homo Sapiens
ccaaggccccauaccugggcggagguggaggaagggcguccaugggcuuacucuuucucuugcu

SEQ ID NO: 311000 - RNA, 64 nt, Homo Sapiens
cccucagggaccaagaaguccaagaggggccgugggcguccagggcgcuaggaagccggguggg

SEQ ID NO: 311001 - RNA, 64 nt, Homo Sapiens
agguagcagcugccuccuucucuguggcugaucuggcguccacaccccagguguugcugacacu

SEQ ID NO: 311002 - RNA, 64 nt, Homo Sapiens
ucagcccuggccuggcuggggcccugggggucugggcguccagcgagggucccgguguauccug

SEQ ID NO: 311003 - RNA, 64 nt, Homo Sapiens
ucacagagcugcuuccccacgagcagcaggcaacggcguccaaggagacuaggaugaguucuug

SEQ ID NO: 311004 - RNA, 64 nt, Homo Sapiens
accugcgucuggggcuccagucgcugcucuugcuggcguccaucgccgccucggacggccgugc

SEQ ID NO: 311005 - RNA, 64 nt, Homo Sapiens
uuuauuguuuuuuaaagaauagguguuacuagaaggcguccaugcagauacacaaggacccuuc

SEQ ID NO: 311006 - RNA, 64 nt, Homo Sapiens
cagcccgcugggcccugcugcucccuccuggagcggcguccagcuuccuguccggccugagcgc

SEQ ID NO: 311007 - RNA, 64 nt, Homo Sapiens
gcaaacuacaguacgugaguacagggagggcccgggcguccaguucccccaagggggcuuuggg

SEQ ID NO: 311008 - RNA, 64 nt, Homo Sapiens
agcaauaccucucguuccagagaacugccugguuggcguccacaagaaccuaaacuauuccugc

SEQ ID NO: 311009 - RNA, 64 nt, Homo Sapiens
gagcugaagguggugaaauugucauucagaagaaggcguccaaguagacugugauuuugauagc

SEQ ID NO: 311010 - RNA, 64 nt, Homo Sapiens
uucuuuucggagaaauugaaauaagcucuuugcaggcguccaauccuagaaaccaauggucucc

SEQ ID NO: 311011 - RNA, 64 nt, Homo Sapiens
cuucugagugacaggugccaccugcgugugucuuggcguccacaucacaccugugacggaagca

SEQ ID NO: 311012 - RNA, 64 nt, Homo Sapiens
ccgagcuccugcaucccuugaguguugaucaggaggcguccacagcauuguucucgccucugaa

SEQ ID NO: 311013 - RNA, 64 nt, Homo Sapiens
cugcacagcaucacugaaucccguccggcagcuuggcguccacccucagugcucccuccagauc

SEQ ID NO: 311014 - RNA, 64 nt, Homo Sapiens
ucagcaccuuccuguagggccaggugguccugcgggcguccaggcccaagugggccugauuuag

SEQ ID NO: 311015 - RNA, 64 nt, Homo Sapiens
cagauuugcccuccuccugcucugcccaggagguggcguccagcaguccaggcagggcaugggg

SEQ ID NO: 311016 - RNA, 64 nt, Homo Sapiens
uuuugaauggugugccauuugaaccuuuuauguucccaaccacucagcaaaaggcuuuugugga

SEQ ID NO: 311017 - RNA, 64 nt, Homo Sapiens
aaaaguaucauucuuugcacguauuccuaguauucccaaccauguuaggccaagaagcaagaga

SEQ ID NO: 311018 - RNA, 64 nt, Homo Sapiens
uccuccauccccagaacaaaccgaaaucaggauacccaaccauacacacauacaaguccacaca

SEQ ID NO: 311019 - RNA, 64 nt, Homo Sapiens
aaaauaacaaauuaaccgcaaacuaucaacaacccccaaccaccaucuaccacuacggccaccc

SEQ ID NO: 311020 - RNA, 64 nt, Homo Sapiens
caggaggccuguaugacuucgugacaugauggaccccaaccacaagccgagauccaccugaucc

SEQ ID NO: 311021 - RNA, 64 nt, Homo Sapiens
cgcugggcugacucugaccggcuagaguccaagacccaaccaggaggcccagcugcagcccuca

SEQ ID NO: 311022 - RNA, 64 nt, Homo Sapiens
caaaaauuccuuuucccgaagugaccaaccuuuucccaaccauaaggacuuuauagaucagcca

SEQ ID NO: 311023 - RNA, 64 nt, Homo Sapiens
ucccacucacaacagcugccuacacagauguucacccaaccacaauuuuagcaauacccauguc

SEQ ID NO: 311024 - RNA, 64 nt, Homo Sapiens
cccuccaucuguggauuuuucagcauuggaaucccccaaccagagauguuaaagugagccuguc

SEQ ID NO: 311025 - RNA, 64 nt, Homo Sapiens
cuaaucacuguucccaaacauugacaaauccuaacccaaccaugguccagcaguuaccaguuua

SEQ ID NO: 311026 - RNA, 64 nt, Homo Sapiens
ggccccucugcugugccccuaugcccugugugggcccaaccaguggacaauggagucuggggga

SEQ ID NO: 311027 - RNA, 64 nt, Homo Sapiens
ucuccauccugcuuggaccaggguccugggucuucccaaccauaccccgagaucaggccccacc

SEQ ID NO: 311028 - RNA, 64 nt, Homo Sapiens
ggagcacggauucccuguacauggaucccaacaccccaaccacagaucccacacaaaucaguga

SEQ ID NO: 311029 - RNA, 64 nt, Homo Sapiens
gggucaugcgauccccaccccuagacuccuaugccccaaccacucagcauccagauccuggauc

SEQ ID NO: 311030 - RNA, 64 nt, Homo Sapiens
gggucaugggaucccagcaucuagacuccuaugccccaaccauucaguacccagauccuggauc

SEQ ID NO: 311031 - RNA, 64 nt, Homo Sapiens
aaagcgccccucagucuucaccuuccucccuuggcccaaccagcguuccuucugccaggcaggc

SEQ ID NO: 311032 - RNA, 64 nt, Homo Sapiens
aaggcuuucccaucuuggggcccccauucuaugccccaaccaccucuuggccggccccacugcc

SEQ ID NO: 311033 - RNA, 64 nt, Homo Sapiens
cuugucggcuccaguccccaaggcagccgcggugcccaaccacauaguucaucccuucucuucc

SEQ ID NO: 311034 - RNA, 64 nt, Homo Sapiens
uugggacagggaggugugagccaccucccccacucccaaccacguacagcucccccagcucccc

SEQ ID NO: 311035 - RNA, 64 nt, Homo Sapiens; identical to SEQ ID NO: 132800

SEQ ID NO: 311036 - RNA, 64 nt, Homo Sapiens; identical to SEQ ID NO: 132801

SEQ ID NO: 311037 - RNA, 64 nt, Homo Sapiens; identical to SEQ ID NO: 132802

SEQ ID NO: 311038 - RNA, 64 nt, Homo Sapiens; identical to SEQ ID NO: 132803

SEQ ID NO: 311039 - RNA, 64 nt, Homo Sapiens; identical to SEQ ID NO: 132804

SEQ ID NO: 311040 - RNA, 64 nt, Homo Sapiens; identical to SEQ ID NO: 132805

SEQ ID NO: 311041 - RNA, 64 nt, Homo Sapiens; identical to SEQ ID NO: 132806

SEQ ID NO: 311042 - RNA, 64 nt, Homo Sapiens; identical to SEQ ID NO: 132807

SEQ ID NO: 311043 - RNA, 64 nt, Homo Sapiens; identical to SEQ ID NO: 132808

SEQ ID NO: 311044 - RNA, 64 nt, Homo Sapiens; identical to SEQ ID NO: 132809

SEQ ID NO: 311045 - RNA, 64 nt, Homo Sapiens; identical to SEQ ID NO: 132810

SEQ ID NO: 311046 - RNA, 64 nt, Homo Sapiens; identical to SEQ ID NO: 132811

SEQ ID NO: 311047 - RNA, 64 nt, Homo Sapiens; identical to SEQ ID NO: 132812

SEQ ID NO: 311048 - RNA, 64 nt, Homo Sapiens; identical to SEQ ID NO: 132813

SEQ ID NO: 311049 - RNA, 64 nt, Homo Sapiens; identical to SEQ ID NO: 132814

SEQ ID NO: 311050 - RNA, 64 nt, Homo Sapiens; identical to SEQ ID NO: 132815

SEQ ID NO: 311051 - RNA, 64 nt, Homo Sapiens; identical to SEQ ID NO: 132816

SEQ ID NO: 311052 - RNA, 64 nt, Homo Sapiens; identical to SEQ ID NO: 132817

SEQ ID NO: 311053 - RNA, 64 nt, Homo Sapiens; identical to SEQ ID NO: 132818

SEQ ID NO: 311054 - RNA, 64 nt, Homo Sapiens; identical to SEQ ID NO: 132819

SEQ ID NO: 311055 - RNA, 64 nt, Homo Sapiens; identical to SEQ ID NO: 132820

SEQ ID NO: 311056 - RNA, 64 nt, Homo Sapiens; identical to SEQ ID NO: 132821

SEQ ID NO: 311057 - RNA, 64 nt, Homo Sapiens; identical to SEQ ID NO: 132822

SEQ ID NO: 311058 - RNA, 64 nt, Homo Sapiens; identical to SEQ ID NO: 132823

SEQ ID NO: 311059 - RNA, 64 nt, Homo Sapiens; identical to SEQ ID NO: 132824

SEQ ID NO: 311060 - RNA, 64 nt, Homo Sapiens; identical to SEQ ID NO: 132825

SEQ ID NO: 311061 - RNA, 64 nt, Homo Sapiens; identical to SEQ ID NO: 132826

SEQ ID NO: 311062 - RNA, 64 nt, Homo Sapiens; identical to SEQ ID NO: 132827

SEQ ID NO: 311063 - RNA, 64 nt, Homo Sapiens; identical to SEQ ID NO: 132828

SEQ ID NO: 311064 - RNA, 64 nt, Homo Sapiens; identical to SEQ ID NO: 132829

SEQ ID NO: 311065 - RNA, 64 nt, Homo Sapiens; identical to SEQ ID NO: 132830

SEQ ID NO: 311066 - RNA, 64 nt, Homo Sapiens; identical to SEQ ID NO: 132831

SEQ ID NO: 311067 - RNA, 64 nt, Homo Sapiens; identical to SEQ ID NO: 132832

SEQ ID NO: 311068 - RNA, 64 nt, Homo Sapiens; identical to SEQ ID NO: 132833

SEQ ID NO: 311069 - RNA, 64 nt, Homo Sapiens; identical to SEQ ID NO: 132834

SEQ ID NO: 311070 - RNA, 64 nt, Homo Sapiens; identical to SEQ ID NO: 132835

SEQ ID NO: 311071 - RNA, 64 nt, Homo Sapiens; identical to SEQ ID NO: 132836

SEQ ID NO: 311072 - RNA, 64 nt, Homo Sapiens; identical to SEQ ID NO: 132837

SEQ ID NO: 311073 - RNA, 64 nt, Homo Sapiens; identical to SEQ ID NO: 132838

SEQ ID NO: 311074 - RNA, 64 nt, Homo Sapiens; identical to SEQ ID NO: 132839

SEQ ID NO: 311075 - RNA, 64 nt, Homo Sapiens; identical to SEQ ID NO: 132840

SEQ ID NO: 311076 - RNA, 64 nt, Homo Sapiens; identical to SEQ ID NO: 132841

SEQ ID NO: 311077 - RNA, 64 nt, Homo Sapiens; identical to SEQ ID NO: 132842

SEQ ID NO: 311078 - RNA, 64 nt, Homo Sapiens; identical to SEQ ID NO: 132843

SEQ ID NO: 311079 - RNA, 64 nt, Homo Sapiens; identical to SEQ ID NO: 132844

SEQ ID NO: 311080 - RNA, 58 nt, Homo Sapiens; identical to SEQ ID NO: 132845

SEQ ID NO: 311081 - RNA, 64 nt, Homo Sapiens; identical to SEQ ID NO: 132846

SEQ ID NO: 311082 - RNA, 64 nt, Homo Sapiens; identical to SEQ ID NO: 132847

SEQ ID NO: 311083 - RNA, 64 nt, Homo Sapiens; identical to SEQ ID NO: 132848

SEQ ID NO: 311084 - RNA, 64 nt, Homo Sapiens; identical to SEQ ID NO: 132849

SEQ ID NO: 311085 - RNA, 64 nt, Homo Sapiens; identical to SEQ ID NO: 132850

SEQ ID NO: 311086 - RNA, 64 nt, Homo Sapiens; identical to SEQ ID NO: 132851

SEQ ID NO: 311087 - RNA, 64 nt, Homo Sapiens; identical to SEQ ID NO: 132852

SEQ ID NO: 311088 - RNA, 64 nt, Homo Sapiens; identical to SEQ ID NO: 132853

SEQ ID NO: 311089 - RNA, 64 nt, Homo Sapiens; identical to SEQ ID NO: 132854

SEQ ID NO: 311090 - RNA, 64 nt, Homo Sapiens; identical to SEQ ID NO: 132855

SEQ ID NO: 311091 - RNA, 64 nt, Homo Sapiens; identical to SEQ ID NO: 132856

SEQ ID NO: 311092 - RNA, 64 nt, Homo Sapiens; identical to SEQ ID NO: 132857

SEQ ID NO: 311093 - RNA, 64 nt, Homo Sapiens; identical to SEQ ID NO: 132858

SEQ ID NO: 311094 - RNA, 64 nt, Homo Sapiens; identical to SEQ ID NO: 132859

SEQ ID NO: 311095 - RNA, 64 nt, Homo Sapiens; identical to SEQ ID NO: 132860

SEQ ID NO: 311096 - RNA, 64 nt, Homo Sapiens; identical to SEQ ID NO: 132861

SEQ ID NO: 311097 - RNA, 64 nt, Homo Sapiens; identical to SEQ ID NO: 132862

SEQ ID NO: 311098 - RNA, 64 nt, Homo Sapiens; identical to SEQ ID NO: 132863

SEQ ID NO: 311099 - RNA, 64 nt, Homo Sapiens; identical to SEQ ID NO: 132864

SEQ ID NO: 311100 - RNA, 64 nt, Homo Sapiens; identical to SEQ ID NO: 132865

SEQ ID NO: 311101 - RNA, 64 nt, Homo Sapiens; identical to SEQ ID NO: 132866

SEQ ID NO: 311102 - RNA, 64 nt, Homo Sapiens; identical to SEQ ID NO: 132867

SEQ ID NO: 311103 - RNA, 64 nt, Homo Sapiens; identical to SEQ ID NO: 132868

SEQ ID NO: 311104 - RNA, 64 nt, Homo Sapiens; identical to SEQ ID NO: 132869

SEQ ID NO: 311105 - RNA, 64 nt, Homo Sapiens; identical to SEQ ID NO: 132870

SEQ ID NO: 311106 - RNA, 64 nt, Homo Sapiens; identical to SEQ ID NO: 132871

SEQ ID NO: 311107 - RNA, 64 nt, Homo Sapiens; identical to SEQ ID NO: 132872

SEQ ID NO: 311108 - RNA, 64 nt, Homo Sapiens; identical to SEQ ID NO: 132873

SEQ ID NO: 311109 - RNA, 64 nt, Homo Sapiens; identical to SEQ ID NO: 132874

SEQ ID NO: 311110 - RNA, 64 nt, Homo Sapiens; identical to SEQ ID NO: 132875

SEQ ID NO: 311111 - RNA, 64 nt, Homo Sapiens; identical to SEQ ID NO: 132876

SEQ ID NO: 311112 - RNA, 64 nt, Homo Sapiens; identical to SEQ ID NO: 132877

SEQ ID NO: 311113 - RNA, 64 nt, Homo Sapiens; identical to SEQ ID NO: 132878

SEQ ID NO: 311114 - RNA, 64 nt, Homo Sapiens; identical to SEQ ID NO: 132879

SEQ ID NO: 311115 - RNA, 64 nt, Homo Sapiens; identical to SEQ ID NO: 132880

SEQ ID NO: 311116 - RNA, 64 nt, Homo Sapiens; identical to SEQ ID NO: 132881

SEQ ID NO: 311117 - RNA, 64 nt, Homo Sapiens; identical to SEQ ID NO: 132882

SEQ ID NO: 311118 - RNA, 64 nt, Homo Sapiens; identical to SEQ ID NO: 132883

SEQ ID NO: 311119 - RNA, 64 nt, Homo Sapiens; identical to SEQ ID NO: 132884

SEQ ID NO: 311120 - RNA, 64 nt, Homo Sapiens; identical to SEQ ID NO: 132885

SEQ ID NO: 311121 - RNA, 64 nt, Homo Sapiens; identical to SEQ ID NO: 132886

SEQ ID NO: 311122 - RNA, 64 nt, Homo Sapiens; identical to SEQ ID NO: 132887

SEQ ID NO: 311123 - RNA, 64 nt, Homo Sapiens; identical to SEQ ID NO: 132888

SEQ ID NO: 311124 - RNA, 64 nt, Homo Sapiens; identical to SEQ ID NO: 132889

SEQ ID NO: 311125 - RNA, 52 nt, Homo Sapiens; identical to SEQ ID NO: 119717

SEQ ID NO: 311126 - RNA, 64 nt, Homo Sapiens; identical to SEQ ID NO: 119718

SEQ ID NO: 311127 - RNA, 64 nt, Homo Sapiens; identical to SEQ ID NO: 119719

SEQ ID NO: 311128 - RNA, 64 nt, Homo Sapiens; identical to SEQ ID NO: 119720

SEQ ID NO: 311129 - RNA, 64 nt, Homo Sapiens; identical to SEQ ID NO: 119721

SEQ ID NO: 311130 - RNA, 64 nt, Homo Sapiens; identical to SEQ ID NO: 119722

SEQ ID NO: 311131 - RNA, 64 nt, Homo Sapiens; identical to SEQ ID NO: 119723

SEQ ID NO: 311132 - RNA, 64 nt, Homo Sapiens; identical to SEQ ID NO: 119724

SEQ ID NO: 311133 - RNA, 64 nt, Homo Sapiens; identical to SEQ ID NO: 113812

SEQ ID NO: 311134 - RNA, 64 nt, Homo Sapiens; identical to SEQ ID NO: 113813

SEQ ID NO: 311135 - RNA, 64 nt, Homo Sapiens; identical to SEQ ID NO: 113814

SEQ ID NO: 311136 - RNA, 64 nt, Homo Sapiens; identical to SEQ ID NO: 113815

SEQ ID NO: 311137 - RNA, 64 nt, Homo Sapiens; identical to SEQ ID NO: 113816

SEQ ID NO: 311138 - RNA, 64 nt, Homo Sapiens; identical to SEQ ID NO: 113817

SEQ ID NO: 311139 - RNA, 64 nt, Homo Sapiens; identical to SEQ ID NO: 113818

SEQ ID NO: 311140 - RNA, 64 nt, Homo Sapiens; identical to SEQ ID NO: 113819

SEQ ID NO: 311141 - RNA, 64 nt, Homo Sapiens; identical to SEQ ID NO: 113820

SEQ ID NO: 311142 - RNA, 64 nt, Homo Sapiens; identical to SEQ ID NO: 113821

SEQ ID NO: 311143 - RNA, 64 nt, Homo Sapiens; identical to SEQ ID NO: 245760

SEQ ID NO: 311144 - RNA, 64 nt, Homo Sapiens; identical to SEQ ID NO: 245761

SEQ ID NO: 311145 - RNA, 64 nt, Homo Sapiens; identical to SEQ ID NO: 245762

SEQ ID NO: 311146 - RNA, 64 nt, Homo Sapiens; identical to SEQ ID NO: 245763

SEQ ID NO: 311147 - RNA, 64 nt, Homo Sapiens; identical to SEQ ID NO: 245764

SEQ ID NO: 311148 - RNA, 64 nt, Homo Sapiens; identical to SEQ ID NO: 245765

SEQ ID NO: 311149 - RNA, 64 nt, Homo Sapiens; identical to SEQ ID NO: 245766

SEQ ID NO: 311150 - RNA, 64 nt, Homo Sapiens; identical to SEQ ID NO: 245767

SEQ ID NO: 311151 - RNA, 64 nt, Homo Sapiens; identical to SEQ ID NO: 245768

SEQ ID NO: 311152 - RNA, 64 nt, Homo Sapiens; identical to SEQ ID NO: 245769

SEQ ID NO: 311153 - RNA, 64 nt, Homo Sapiens; identical to SEQ ID NO: 245770

SEQ ID NO: 311154 - RNA, 64 nt, Homo Sapiens; identical to SEQ ID NO: 245771

SEQ ID NO: 311155 - RNA, 64 nt, Homo Sapiens; identical to SEQ ID NO: 245772

SEQ ID NO: 311156 - RNA, 64 nt, Homo Sapiens; identical to SEQ ID NO: 245773

SEQ ID NO: 311157 - RNA, 64 nt, Homo Sapiens; identical to SEQ ID NO: 245774

SEQ ID NO: 311158 - RNA, 64 nt, Homo Sapiens; identical to SEQ ID NO: 245775

SEQ ID NO: 311159 - RNA, 64 nt, Homo Sapiens; identical to SEQ ID NO: 245776

SEQ ID NO: 311160 - RNA, 64 nt, Homo Sapiens; identical to SEQ ID NO: 245777

SEQ ID NO: 311161 - RNA, 64 nt, Homo Sapiens; identical to SEQ ID NO: 245778

SEQ ID NO: 311162 - RNA, 64 nt, Homo Sapiens; identical to SEQ ID NO: 245779

SEQ ID NO: 311163 - RNA, 64 nt, Homo Sapiens; identical to SEQ ID NO: 245780

SEQ ID NO: 311164 - RNA, 64 nt, Homo Sapiens; identical to SEQ ID NO: 245781

SEQ ID NO: 311165 - RNA, 64 nt, Homo Sapiens; identical to SEQ ID NO: 245782

SEQ ID NO: 311166 - RNA, 64 nt, Homo Sapiens; identical to SEQ ID NO: 245783

SEQ ID NO: 311167 - RNA, 64 nt, Homo Sapiens; identical to SEQ ID NO: 245784

SEQ ID NO: 311168 - RNA, 64 nt, Homo Sapiens; identical to SEQ ID NO: 245785

SEQ ID NO: 311169 - RNA, 64 nt, Homo Sapiens; identical to SEQ ID NO: 245786

SEQ ID NO: 311170 - RNA, 64 nt, Homo Sapiens; identical to SEQ ID NO: 245787

SEQ ID NO: 311171 - RNA, 64 nt, Homo Sapiens; identical to SEQ ID NO: 245788

SEQ ID NO: 311172 - RNA, 64 nt, Homo Sapiens; identical to SEQ ID NO: 245789

SEQ ID NO: 311173 - RNA, 64 nt, Homo Sapiens; identical to SEQ ID NO: 245790

SEQ ID NO: 311174 - RNA, 64 nt, Homo Sapiens; identical to SEQ ID NO: 245791

SEQ ID NO: 311175 - RNA, 64 nt, Homo Sapiens; identical to SEQ ID NO: 245792

SEQ ID NO: 311176 - RNA, 64 nt, Homo Sapiens; identical to SEQ ID NO: 245793

SEQ ID NO: 311177 - RNA, 64 nt, Homo Sapiens; identical to SEQ ID NO: 245794

SEQ ID NO: 311178 - RNA, 64 nt, Homo Sapiens; identical to SEQ ID NO: 245795

SEQ ID NO: 311179 - RNA, 64 nt, Homo Sapiens; identical to SEQ ID NO: 245796

SEQ ID NO: 311180 - RNA, 64 nt, Homo Sapiens; identical to SEQ ID NO: 245797

SEQ ID NO: 311181 - RNA, 64 nt, Homo Sapiens; identical to SEQ ID NO: 245798

SEQ ID NO: 311182 - RNA, 64 nt, Homo Sapiens; identical to SEQ ID NO: 245799

SEQ ID NO: 311183 - RNA, 64 nt, Homo Sapiens; identical to SEQ ID NO: 245800

SEQ ID NO: 311184 - RNA, 64 nt, Homo Sapiens; identical to SEQ ID NO: 245801

SEQ ID NO: 311185 - RNA, 64 nt, Homo Sapiens; identical to SEQ ID NO: 245802

SEQ ID NO: 311186 - RNA, 64 nt, Homo Sapiens; identical to SEQ ID NO: 245803

SEQ ID NO: 311187 - RNA, 64 nt, Homo Sapiens; identical to SEQ ID NO: 245804

SEQ ID NO: 311188 - RNA, 64 nt, Homo Sapiens; identical to SEQ ID NO: 83018

SEQ ID NO: 311189 - RNA, 64 nt, Homo Sapiens; identical to SEQ ID NO: 83019

SEQ ID NO: 311190 - RNA, 64 nt, Homo Sapiens; identical to SEQ ID NO: 83020

SEQ ID NO: 311191 - RNA, 64 nt, Homo Sapiens; identical to SEQ ID NO: 83021

SEQ ID NO: 311192 - RNA, 64 nt, Homo Sapiens; identical to SEQ ID NO: 83022

SEQ ID NO: 311193 - RNA, 64 nt, Homo Sapiens; identical to SEQ ID NO: 83023

SEQ ID NO: 311194 - RNA, 64 nt, Homo Sapiens; identical to SEQ ID NO: 83024

SEQ ID NO: 311195 - RNA, 64 nt, Homo Sapiens; identical to SEQ ID NO: 83025

SEQ ID NO: 311196 - RNA, 64 nt, Homo Sapiens; identical to SEQ ID NO: 83026

SEQ ID NO: 311197 - RNA, 64 nt, Homo Sapiens; identical to SEQ ID NO: 83027

SEQ ID NO: 311198 - RNA, 64 nt, Homo Sapiens; identical to SEQ ID NO: 83028

SEQ ID NO: 311199 - RNA, 64 nt, Homo Sapiens; identical to SEQ ID NO: 83029

SEQ ID NO: 311200 - RNA, 64 nt, Homo Sapiens; identical to SEQ ID NO: 83030

SEQ ID NO: 311201 - RNA, 64 nt, Homo Sapiens; identical to SEQ ID NO: 83031

SEQ ID NO: 311202 - RNA, 64 nt, Homo Sapiens; identical to SEQ ID NO: 83032

SEQ ID NO: 311203 - RNA, 64 nt, Homo Sapiens; identical to SEQ ID NO: 83033

SEQ ID NO: 311204 - RNA, 64 nt, Homo Sapiens; identical to SEQ ID NO: 83034

SEQ ID NO: 311205 - RNA, 64 nt, Homo Sapiens; identical to SEQ ID NO: 83035

SEQ ID NO: 311206 - RNA, 64 nt, Homo Sapiens
cccgccuuccccauauuuucgucuuaugugguucaacucccaccaguaaccugggcuaaaauag

SEQ ID NO: 311207 - RNA, 64 nt, Homo Sapiens
cugauacauccugaaguaacaugcuggagaccuuaacucccaucaaauuucacugauuuuaauc

SEQ ID NO: 311208 - RNA, 64 nt, Homo Sapiens
cuugauuguauauaagauaauucauacuggagaaaacucccagaaguggaguuuuccuuauugc

SEQ ID NO: 311209 - RNA, 64 nt, Homo Sapiens
acaggguuucuccauguuggucagucuggucucaaacucccaaccucaggugauaugcccgccu

SEQ ID NO: 311210 - RNA, 64 nt, Homo Sapiens
ggcaaccaaagaaaugaguuuuggggaggaacacaacucccaucccagucaguuuccuucccau

SEQ ID NO: 311211 - RNA, 64 nt, Homo Sapiens
uguagugguaugaucauagcucaccacaaccuugaacucccaggcucaagcgauccucccgccu

SEQ ID NO: 311212 - RNA, 64 nt, Homo Sapiens
ggugucagagguggcugugcagugucagagaugaaacucccagaccagagguacagcugccgaa

SEQ ID NO: 311213 - RNA, 64 nt, Homo Sapiens
ggugccagagauggcugugcagugucggagaugaaacucccaaaccagagguacagcugcugaa

SEQ ID NO: 311214 - RNA, 64 nt, Homo Sapiens
ggugccagagauggcugugcagugucagagaugaaacucccaaaccagagguagagcugcccaa

SEQ ID NO: 311215 - RNA, 64 nt, Homo Sapiens
ggugccagagauggcugugcggugucagagaugaaacucccaaaccagagguggagcuccccaa

SEQ ID NO: 311216 - RNA, 64 nt, Homo Sapiens
agcccaaucccugaucccugaaguccugcaaccaaacucccaucuuuccuuaugcuguaaaagc

SEQ ID NO: 311217 - RNA, 64 nt, Homo Sapiens
acccgagcugggaccaguaccgguaccaaugcagaacucccaagguagugcagcagggcaguag

SEQ ID NO: 311218 - RNA, 64 nt, Homo Sapiens
cuuuaggagagauaucauuaucgcuguuuuauaaauaagggaaacuuuagcuugaggguuuaag

SEQ ID NO: 311219 - RNA, 64 nt, Homo Sapiens
gaacugauguuuucagcauauuuucaaaauauugauaagggaaguuauuacuuuuauauaguau

SEQ ID NO: 311220 - RNA, 64 nt, Homo Sapiens
aaucaaguauuauaaacaaguguauauggugguaauaagggaaaaagaaaauacuuaaauguua

SEQ ID NO: 311221 - RNA, 64 nt, Homo Sapiens
gauguuugugcaguaacuugggcagaguuacuugauaagggacuaauacuagauuugggagaag

SEQ ID NO: 311222 - RNA, 64 nt, Homo Sapiens; identical to SEQ ID NO: 302048

SEQ ID NO: 311223 - RNA, 64 nt, Homo Sapiens; identical to SEQ ID NO: 302049

SEQ ID NO: 311224 - RNA, 64 nt, Homo Sapiens; identical to SEQ ID NO: 302050

SEQ ID NO: 311225 - RNA, 64 nt, Homo Sapiens; identical to SEQ ID NO: 302051

SEQ ID NO: 311226 - RNA, 64 nt, Homo Sapiens; identical to SEQ ID NO: 302052

SEQ ID NO: 311227 - RNA, 64 nt, Homo Sapiens; identical to SEQ ID NO: 302053

SEQ ID NO: 311228 - RNA, 64 nt, Homo Sapiens
ucauauucccaguggagaggggaacaaguggggcugggcauauaccuauuccggcuucuagugg

SEQ ID NO: 311229 - RNA, 64 nt, Homo Sapiens
gacccacgugggagccuggaucccuggacuguccugggcauagguuucaggggccuccuuuguu

SEQ ID NO: 311230 - RNA, 64 nt, Homo Sapiens
gugucuggacacugccacaugacgcugccacaucugggcauacaaucugggcauacagugucug

SEQ ID NO: 311231 - RNA, 64 nt, Homo Sapiens
gugucuggacgcugccacaugaugcugccacaucugggcauacaggcagccacacagcuggacg

SEQ ID NO: 311232 - RNA, 64 nt, Homo Sapiens
cauccucuuguuccagucucagcuggcugcuccgugggcauacuucauaccuuucaucacagag

SEQ ID NO: 311233 - RNA, 64 nt, Homo Sapiens
aaaccagcuuccuccucagcuccagcucuuuuaaugggcauaucaaaacugaugacuuuuuccu

SEQ ID NO: 311234 - RNA, 64 nt, Homo Sapiens
agaaguaucugacuguagacacaacuaggcuccgugggcauaucuggguggcaauuucagaggg

SEQ ID NO: 311235 - RNA, 64 nt, Homo Sapiens
ccaguaugaaauaagaauaagcagcccacacaacugggcauagugguucaugccuguaauccca

SEQ ID NO: 311236 - RNA, 64 nt, Homo Sapiens; identical to SEQ ID NO: 131192

SEQ ID NO: 311237 - RNA, 64 nt, Homo Sapiens; identical to SEQ ID NO: 131193

SEQ ID NO: 311238 - RNA, 64 nt, Homo Sapiens; identical to SEQ ID NO: 131194

SEQ ID NO: 311239 - RNA, 64 nt, Homo Sapiens; identical to SEQ ID NO: 131195

SEQ ID NO: 311240 - RNA, 64 nt, Homo Sapiens; identical to SEQ ID NO: 131196

SEQ ID NO: 311241 - RNA, 64 nt, Homo Sapiens; identical to SEQ ID NO: 131197

SEQ ID NO: 311242 - RNA, 64 nt, Homo Sapiens; identical to SEQ ID NO: 131198

SEQ ID NO: 311243 - RNA, 64 nt, Homo Sapiens; identical to SEQ ID NO: 131199

SEQ ID NO: 311244 - RNA, 64 nt, Homo Sapiens; identical to SEQ ID NO: 131200

SEQ ID NO: 311245 - RNA, 64 nt, Homo Sapiens; identical to SEQ ID NO: 131201

SEQ ID NO: 311246 - RNA, 64 nt, Homo Sapiens; identical to SEQ ID NO: 131202

SEQ ID NO: 311247 - RNA, 64 nt, Homo Sapiens; identical to SEQ ID NO: 131203

SEQ ID NO: 311248 - RNA, 64 nt, Homo Sapiens; identical to SEQ ID NO: 131204

SEQ ID NO: 311249 - RNA, 64 nt, Homo Sapiens; identical to SEQ ID NO: 131205

SEQ ID NO: 311250 - RNA, 64 nt, Homo Sapiens; identical to SEQ ID NO: 131206

SEQ ID NO: 311251 - RNA, 64 nt, Homo Sapiens; identical to SEQ ID NO: 131207

SEQ ID NO: 311252 - RNA, 64 nt, Homo Sapiens
aucuuuuaaauuuaccuagcaaaaaugaguuaaguaacaugauauuaaaagucacuugucauuc

SEQ ID NO: 311253 - RNA, 64 nt, Homo Sapiens
uauguguaaacugacaaaaaccuuggucuaauauuaacaugauguaugcacuaaacguuuugug

SEQ ID NO: 311254 - RNA, 64 nt, Homo Sapiens
caagugucuggcacuaagggccaccccaauuuuguaacaugaugccuuguaugauguaaguggc

SEQ ID NO: 311255 - RNA, 64 nt, Homo Sapiens
acagucaacucuccauuaucaagagcuaaagucauaacaugauuuugugaauuuuuucauguua

SEQ ID NO: 311256 - RNA, 64 nt, Homo Sapiens
guuuccauaacagagacagcucauaaccuuuucauaacaugauaaugauaguuuccuaaccuuu

SEQ ID NO: 311257 - RNA, 64 nt, Homo Sapiens
guuuccuaaccuuuucauaaauauuagcuuuucauaacaugauaaguuguuuuuaaaagauuca

SEQ ID NO: 311258 - RNA, 64 nt, Homo Sapiens
uacaacaaauaccauagacagguugguuuauaaauaacaugaauuuauuucucacaguucugga

SEQ ID NO: 311259 - RNA, 64 nt, Homo Sapiens
accucccaauaccaucacauuagggguuaggauuuaacaugaauuuuggggacauauaaacauu

SEQ ID NO: 311260 - RNA, 64 nt, Homo Sapiens
uugcuuuacacaucaucaacucuaaauccuauaguaacaugagaauucacuucuucuuguaaaa

SEQ ID NO: 311261 - RNA, 64 nt, Homo Sapiens
aggaauauugugacaauucauugcuaauaaaacauaacaugagucucuuuguacuguuuuuaau

SEQ ID NO: 311262 - RNA, 64 nt, Homo Sapiens
cugaagagaaaguucauucacagagacugccucuuaacaugaagaucauuggacaagccacacg

SEQ ID NO: 311263 - RNA, 64 nt, Homo Sapiens
auaccucuggugugggacggucuuuucuaaacuuuaacaugagacuuaaaagauauaauaaggg

SEQ ID NO: 311264 - RNA, 64 nt, Homo Sapiens
guuuauuacuuggcaauaccggauuuagaguugaauggcaaaauuuaaaacuaaugcuaauaag

SEQ ID NO: 311265 - RNA, 64 nt, Homo Sapiens
uaauguaaauaaguuacuauuaagaaguuuucuuauggcaaaaacuugagagcugacuguugcu

SEQ ID NO: 311266 - RNA, 64 nt, Homo Sapiens
uguaagcgugucauuuaaguauuuaauuuuagaaauggcaaauuggaugucuugaaacccgugc

SEQ ID NO: 311267 - RNA, 64 nt, Homo Sapiens
aaaugcagauuucccaguuaguuggguaacaaaaauggcaaaaggcacuuugcgcauuguguaa

SEQ ID NO: 311268 - RNA, 64 nt, Homo Sapiens
cagugguuaaagagguaaucacagucugagcaacauggcaaaacccugugucuacaaaaaauaa

SEQ ID NO: 311269 - RNA, 64 nt, Homo Sapiens
aaucaaaagcugguucuuugaaaagaucuacaaaauggcaaacauuuagcuagauugaccaccc

SEQ ID NO: 311270 - RNA, 64 nt, Homo Sapiens
caaaacauaauuuugugcaagugauaauauuuaaauggcaaaaagucuuucagaauaggauucu

SEQ ID NO: 311271 - RNA, 64 nt, Homo Sapiens
gccaucauuuacuuuuaaacuuuaucuuuuuaguauggcaaacuuccuauaauuuuagacauuc

SEQ ID NO: 311272 - RNA, 64 nt, Homo Sapiens
uaugcuauuccuggaaaaauuagacacaagaaagauggcaaauuaauucuaaaccccuuuucca

SEQ ID NO: 311273 - RNA, 64 nt, Homo Sapiens
agauagauguaguuccuuccggcccagggauacaauggcaaacauguauaacacauucugcuaa

SEQ ID NO: 311274 - RNA, 64 nt, Homo Sapiens
cccaucucuacuaaaaauacccagccuggccaacauggcaaaauuugaggccaggaguucaaga

SEQ ID NO: 311275 - RNA, 64 nt, Homo Sapiens
ccacuauuacuuuugcaccaauuuuuaauuuuuaauggcaaaagaacuaaucgugguuuuugcc

SEQ ID NO: 311276 - RNA, 64 nt, Homo Sapiens
ucucucagaaauuuauguguguggaugguaccuuauggcaaaaaaggaugugguuuacaguaag

SEQ ID NO: 311277 - RNA, 64 nt, Homo Sapiens
uaacaccccacugucaacauuaauaauaauaauaauggcaaacuagacuuagacucccacauag

SEQ ID NO: 311278 - RNA, 64 nt, Homo Sapiens
aaagacuguaggagagccaacaaagacaagggaaauggcaaacagaaagagcuguguuuugguu

SEQ ID NO: 311279 - RNA, 64 nt, Homo Sapiens
aguaaggauggggaccuucuuaggacccgugggaauggcaaaacgaucuuucucaaaggaagcu

SEQ ID NO: 311280 - RNA, 64 nt, Homo Sapiens
gcuugcagauauuuuuaaauauuucuuuauugauauggcaaauuucagacuugaaucuguagac

SEQ ID NO: 311281 - RNA, 64 nt, Homo Sapiens
ggagacccagagucacuugcucccaauucuacacauggcaaaaucccuagaggguagaaaguuu

SEQ ID NO: 311282 - RNA, 64 nt, Homo Sapiens
caaaauagcuccuacaauuucagggguuuucuuuauggcaaagccacaaacucaacacuaccau

SEQ ID NO: 311283 - RNA, 64 nt, Homo Sapiens
uuuuaauauuucuguuuucaguauauagccaugcauggcaaauacaguaaaacuauguauaaua

SEQ ID NO: 311284 - RNA, 64 nt, Homo Sapiens
guucacaggcuuucacagcaaggguaccuauuucauggcaaaauaggcaguuuuaaaagaauaa

SEQ ID NO: 311285 - RNA, 64 nt, Homo Sapiens
uugagcccaggaguuugagaccagccugggcaacauggcaaaaccccaucucuacaaaaaauac

SEQ ID NO: 311286 - RNA, 64 nt, Homo Sapiens
cugugucuguugugccuugcccggcgccucacggauggcaaagcucuccucacccaugggacug

SEQ ID NO: 311287 - RNA, 64 nt, Homo Sapiens
ucuaaaaccagugggaaaacugucugauuucuggauggcaaaggcuuucuaaacucaaaaguga

SEQ ID NO: 311288 - RNA, 64 nt, Homo Sapiens
uggacuugauucuacugguaauaguuauccacaaauggcaaaacacaugcuuuuguaucuuguc

SEQ ID NO: 311289 - RNA, 64 nt, Homo Sapiens
caugcuuuuguaucuugucaagccagggcuauuuauggcaaacaagugugagcgguuugcuguu

SEQ ID NO: 311290 - RNA, 55 nt, Homo Sapiens; identical to SEQ ID NO: 244290

SEQ ID NO: 311291 - RNA, 64 nt, Homo Sapiens
cauacuggugagaaauucuaaaaaugugaagacuauggcaaagucuuuaaaugguugucacacu

SEQ ID NO: 311292 - RNA, 64 nt, Homo Sapiens
uauacuguacaaaaaccccacaagugugaaaaacauggcaaagccuuuaagaagcccucaauuc

SEQ ID NO: 311293 - RNA, 64 nt, Homo Sapiens
cauacuggagaaaacgccuacaugugugaacaauauggcaaaacuuaaugcucacacuuuauug

SEQ ID NO: 311294 - RNA, 64 nt, Homo Sapiens
uugagcccaggaguuugaaaccagccuggguaacauggcaaaauccugucuuuacaaaaaauac

SEQ ID NO: 311295 - RNA, 64 nt, Homo Sapiens
cugaagucagaaguuugagaccagccuggcaaacauggcaaaacugucucuauuaaaaauacag

SEQ ID NO: 311296 - RNA, 64 nt, Homo Sapiens
ugccugcuguaugcuauuuuaaggagccuguagcauggcaaaucgcuggccuuccccagccugc

SEQ ID NO: 311297 - RNA, 64 nt, Homo Sapiens
aaugugaaaaggcauugggagauccauaugugcaauggcaaagaaaaggaaacucaggcaaagg

SEQ ID NO: 311298 - RNA, 64 nt, Homo Sapiens
uggaacgcaaagggccgaggagcaucugguuuucauggcaaagcucuacuccagagcuccuuua

SEQ ID NO: 311299 - RNA, 64 nt, Homo Sapiens
ucugcuaauuaagugcaauaaauuuuucuagaaaauggcaaagaugacuuccagguggauauug

SEQ ID NO: 311300 - RNA, 64 nt, Homo Sapiens
ucauuaacacaaaauuucauaagacaaacaaaacauggcaaauuugccaccuucgugguuguaa

SEQ ID NO: 311301 - RNA, 64 nt, Homo Sapiens
gcuuugagauauaauauugaaggaaggccuaagaauggcaaaucuuucucauauccaucgugau

SEQ ID NO: 311302 - RNA, 64 nt, Homo Sapiens; identical to SEQ ID NO: 165419

SEQ ID NO: 311303 - RNA, 64 nt, Homo Sapiens; identical to SEQ ID NO: 165420

SEQ ID NO: 311304 - RNA, 64 nt, Homo Sapiens; identical to SEQ ID NO: 165421

SEQ ID NO: 311305 - RNA, 64 nt, Homo Sapiens; identical to SEQ ID NO: 165422

SEQ ID NO: 311306 - RNA, 64 nt, Homo Sapiens; identical to SEQ ID NO: 165423

SEQ ID NO: 311307 - RNA, 64 nt, Homo Sapiens; identical to SEQ ID NO: 165424

SEQ ID NO: 311308 - RNA, 64 nt, Homo Sapiens; identical to SEQ ID NO: 165425

SEQ ID NO: 311309 - RNA, 64 nt, Homo Sapiens; identical to SEQ ID NO: 165426

SEQ ID NO: 311310 - RNA, 64 nt, Homo Sapiens; identical to SEQ ID NO: 165427

SEQ ID NO: 311311 - RNA, 64 nt, Homo Sapiens; identical to SEQ ID NO: 165428

SEQ ID NO: 311312 - RNA, 64 nt, Homo Sapiens; identical to SEQ ID NO: 165429

SEQ ID NO: 311313 - RNA, 64 nt, Homo Sapiens; identical to SEQ ID NO: 165430

SEQ ID NO: 311314 - RNA, 64 nt, Homo Sapiens; identical to SEQ ID NO: 165431

SEQ ID NO: 311315 - RNA, 64 nt, Homo Sapiens; identical to SEQ ID NO: 165432

SEQ ID NO: 311316 - RNA, 64 nt, Homo Sapiens; identical to SEQ ID NO: 165433

SEQ ID NO: 311317 - RNA, 64 nt, Homo Sapiens; identical to SEQ ID NO: 165434

SEQ ID NO: 311318 - RNA, 64 nt, Homo Sapiens; identical to SEQ ID NO: 165435

SEQ ID NO: 311319 - RNA, 64 nt, Homo Sapiens; identical to SEQ ID NO: 165436

SEQ ID NO: 311320 - RNA, 64 nt, Homo Sapiens; identical to SEQ ID NO: 165437

SEQ ID NO: 311321 - RNA, 64 nt, Homo Sapiens; identical to SEQ ID NO: 165438

SEQ ID NO: 311322 - RNA, 64 nt, Homo Sapiens; identical to SEQ ID NO: 165439

SEQ ID NO: 311323 - RNA, 64 nt, Homo Sapiens; identical to SEQ ID NO: 165440

SEQ ID NO: 311324 - RNA, 64 nt, Homo Sapiens; identical to SEQ ID NO: 165441

SEQ ID NO: 311325 - RNA, 64 nt, Homo Sapiens; identical to SEQ ID NO: 165442

SEQ ID NO: 311326 - RNA, 64 nt, Homo Sapiens; identical to SEQ ID NO: 165443

SEQ ID NO: 311327 - RNA, 64 nt, Homo Sapiens; identical to SEQ ID NO: 165444

SEQ ID NO: 311328 - RNA, 64 nt, Homo Sapiens; identical to SEQ ID NO: 165445

SEQ ID NO: 311329 - RNA, 64 nt, Homo Sapiens; identical to SEQ ID NO: 165446

SEQ ID NO: 311330 - RNA, 64 nt, Homo Sapiens; identical to SEQ ID NO: 165447

SEQ ID NO: 311331 - RNA, 64 nt, Homo Sapiens; identical to SEQ ID NO: 165448

SEQ ID NO: 311332 - RNA, 64 nt, Homo Sapiens; identical to SEQ ID NO: 165449

SEQ ID NO: 311333 - RNA, 64 nt, Homo Sapiens; identical to SEQ ID NO: 165450

SEQ ID NO: 311334 - RNA, 64 nt, Homo Sapiens; identical to SEQ ID NO: 165451

SEQ ID NO: 311335 - RNA, 64 nt, Homo Sapiens; identical to SEQ ID NO: 165452

SEQ ID NO: 311336 - RNA, 64 nt, Homo Sapiens; identical to SEQ ID NO: 165453

SEQ ID NO: 311337 - RNA, 64 nt, Homo Sapiens; identical to SEQ ID NO: 165454

SEQ ID NO: 311338 - RNA, 64 nt, Homo Sapiens; identical to SEQ ID NO: 165455

SEQ ID NO: 311339 - RNA, 64 nt, Homo Sapiens; identical to SEQ ID NO: 165456

SEQ ID NO: 311340 - RNA, 64 nt, Homo Sapiens; identical to SEQ ID NO: 165457

SEQ ID NO: 311341 - RNA, 64 nt, Homo Sapiens; identical to SEQ ID NO: 165458

SEQ ID NO: 311342 - RNA, 64 nt, Homo Sapiens; identical to SEQ ID NO: 165459

SEQ ID NO: 311343 - RNA, 64 nt, Homo Sapiens; identical to SEQ ID NO: 165460

SEQ ID NO: 311344 - RNA, 64 nt, Homo Sapiens; identical to SEQ ID NO: 165461

SEQ ID NO: 311345 - RNA, 64 nt, Homo Sapiens; identical to SEQ ID NO: 165462

SEQ ID NO: 311346 - RNA, 64 nt, Homo Sapiens; identical to SEQ ID NO: 165463

SEQ ID NO: 311347 - RNA, 64 nt, Homo Sapiens; identical to SEQ ID NO: 165464

SEQ ID NO: 311348 - RNA, 63 nt, Homo Sapiens; identical to SEQ ID NO: 165465

SEQ ID NO: 311349 - RNA, 64 nt, Homo Sapiens; identical to SEQ ID NO: 165466

SEQ ID NO: 311350 - RNA, 64 nt, Homo Sapiens; identical to SEQ ID NO: 165467

SEQ ID NO: 311351 - RNA, 64 nt, Homo Sapiens; identical to SEQ ID NO: 165468

SEQ ID NO: 311352 - RNA, 64 nt, Homo Sapiens; identical to SEQ ID NO: 165469

SEQ ID NO: 311353 - RNA, 64 nt, Homo Sapiens; identical to SEQ ID NO: 165470

SEQ ID NO: 311354 - RNA, 64 nt, Homo Sapiens; identical to SEQ ID NO: 165471

SEQ ID NO: 311355 - RNA, 64 nt, Homo Sapiens; identical to SEQ ID NO: 165472

SEQ ID NO: 311356 - RNA, 64 nt, Homo Sapiens; identical to SEQ ID NO: 165473

SEQ ID NO: 311357 - RNA, 64 nt, Homo Sapiens; identical to SEQ ID NO: 165474

SEQ ID NO: 311358 - RNA, 64 nt, Homo Sapiens; identical to SEQ ID NO: 165475

SEQ ID NO: 311359 - RNA, 64 nt, Homo Sapiens; identical to SEQ ID NO: 165476

SEQ ID NO: 311360 - RNA, 64 nt, Homo Sapiens; identical to SEQ ID NO: 165477

SEQ ID NO: 311361 - RNA, 64 nt, Homo Sapiens; identical to SEQ ID NO: 165478

SEQ ID NO: 311362 - RNA, 64 nt, Homo Sapiens; identical to SEQ ID NO: 165479

SEQ ID NO: 311363 - RNA, 64 nt, Homo Sapiens; identical to SEQ ID NO: 165480

SEQ ID NO: 311364 - RNA, 64 nt, Homo Sapiens; identical to SEQ ID NO: 165481

SEQ ID NO: 311365 - RNA, 64 nt, Homo Sapiens; identical to SEQ ID NO: 165482

SEQ ID NO: 311366 - RNA, 64 nt, Homo Sapiens; identical to SEQ ID NO: 165483

SEQ ID NO: 311367 - RNA, 64 nt, Homo Sapiens; identical to SEQ ID NO: 165484

SEQ ID NO: 311368 - RNA, 64 nt, Homo Sapiens; identical to SEQ ID NO: 165485

SEQ ID NO: 311369 - RNA, 61 nt, Homo Sapiens
agcuuccauagaaauacacuuuguaucuggaccucaaaauuaugggaacauuuacuuaaac

SEQ ID NO: 311370 - RNA, 61 nt, Homo Sapiens
uaugauaaaggacaaaauaagcuguuugccaccucaaaacuuuaugaacuucaccaccacu

SEQ ID NO: 311371 - RNA, 61 nt, Homo Sapiens
uaacgguugcaccuccaagucccugacugcuccucaaaagcagagagacugaagucacaac

SEQ ID NO: 311372 - RNA, 61 nt, Homo Sapiens
ugauucagaaacugacuuggucauuucuccuccucaaaaacgccuauaaaucuuggaggaa

SEQ ID NO: 311373 - RNA, 61 nt, Homo Sapiens
acccuugacgucaagucucccccgucauguuccucaaaagcaguuggggcaggcuggcugg

SEQ ID NO: 311374 - RNA, 61 nt, Homo Sapiens
aaaugagaucccgccucuucaacacccgacuccucaaaagcaacaugcgaccgugaccagg

SEQ ID NO: 311375 - RNA, 61 nt, Homo Sapiens
aauacuugucuuucucuccucucccuccaucccucaaaagaucuuuaugcauuucccacua

SEQ ID NO: 311376 - RNA, 61 nt, Homo Sapiens
ugaggggcauagugaaaaaggaacagccaugccucaaaaucaaaucauuugcauucccaca

SEQ ID NO: 311377 - RNA, 61 nt, Homo Sapiens
gguuguggcuccuguugaauuguugguuguuccucaaaacaacuuccaguaggcccacagu

SEQ ID NO: 311378 - RNA, 61 nt, Homo Sapiens
caugcccauugucuucagguuccuuuucacuccucaaaaugugccauggagcacuagaugg

SEQ ID NO: 311379 - RNA, 61 nt, Homo Sapiens
aaaaaaaaaagaguuaaucugugaaacuccaccucaaaaaacuccagccugggcgacaaga

SEQ ID NO: 311380 - RNA, 61 nt, Homo Sapiens
cagaacguggccgggcgugguguuucuggauccucaaaacuagugucgcuuuccagccuuu

SEQ ID NO: 311381 - RNA, 61 nt, Homo Sapiens
uggcacaugccuguauuacugaaagcuaaauccucaaaaccuaguaaggggacuaaugauu

SEQ ID NO: 311382 - RNA, 61 nt, Homo Sapiens
ugagcauguaauaauacaagaacuguuucccccucaaaaccugaaccugaauuauuuguaa

SEQ ID NO: 311383 - RNA, 61 nt, Homo Sapiens
aagaaauauauccuaugcagauuugacucugccucaaaaaauguacaauuuggggccucaa

SEQ ID NO: 311384 - RNA, 61 nt, Homo Sapiens
uucagcuccgugugugagaucacacacaaguccucaaaagugccucucacccacucccaga

SEQ ID NO: 311385 - RNA, 61 nt, Homo Sapiens
cugaguguuuagggaaauagcuucuuuaaaaccucaaaaccaugaccauccugucaaagac

SEQ ID NO: 311386 - RNA, 61 nt, Homo Sapiens
auuccagccugggugacagagugagacucccccucaaaaaaaaaaaaaaaaaaaaaaaaaa

SEQ ID NO: 311387 - RNA, 61 nt, Homo Sapiens
cauacacacacacacauacaguauauucuuuccucaaaaggguuaagaugucuaaaauagg

SEQ ID NO: 311388 - RNA, 61 nt, Homo Sapiens
ucuagaugcaaauacauugaguuuaaaagugccucaaaauaauugagaucacauuucagga

SEQ ID NO: 311389 - RNA, 64 nt, Homo Sapiens
aaaguaggucguuaccccuaaauuuuucuuuuuuuaacugcaaucuuauuucuuuucucaaaaa

SEQ ID NO: 311390 - RNA, 64 nt, Homo Sapiens
cuucauuccaggaaagcccugccggucucaaagauaacugcaucgaagggggugggcuaugaaa

SEQ ID NO: 311391 - RNA, 64 nt, Homo Sapiens
uaaugguacuuaugauuaaaaacgcauuuaauacuaacugcaguaguucuuucaagaaucuuua

SEQ ID NO: 311392 - RNA, 64 nt, Homo Sapiens
uaacuugcaccaagcaagaaaauauaaauacaguuaacugcauuaagauaaucacguuaaaauu

SEQ ID NO: 311393 - RNA, 64 nt, Homo Sapiens
uugugaauuucacugccuuacugcuuuuauauuuuaacugcagaagacuaugaacauagaauug

SEQ ID NO: 311394 - RNA, 64 nt, Homo Sapiens
uuucaaaccaaaguuuaaaaucauuuggguuuuguaacugcaauacuuuuuuguccguguccuc

SEQ ID NO: 311395 - RNA, 64 nt, Homo Sapiens
aauuaaaucuucuaucugaguaaacugacauggcuaacugcaagcacuuucugauuacucauga

SEQ ID NO: 311396 - RNA, 64 nt, Homo Sapiens
auauuuuccuuuuauacuacuuucaaauacgagauaacugcaaaaaguucucuauggcaaaguc

SEQ ID NO: 311397 - RNA, 64 nt, Homo Sapiens
acuugaacagcgaaagcagagcauguuauuuauauaacugcauuuaagcaguaccaagacugaa

SEQ ID NO: 311398 - RNA, 64 nt, Homo Sapiens
aaaucuuuguguuacuucacucaaagaacauaaguaacugcaauuaacauauaugaaauuuauu

SEQ ID NO: 311399 - RNA, 64 nt, Homo Sapiens
guaucuacuuaccauagauaccuuucauaacugguaacugcaaagccuuuugugcuggacccag

SEQ ID NO: 311400 - RNA, 64 nt, Homo Sapiens
uuaguuugucauauaaccagguuuauccuuagucuaacugcaagggauggaaccugccccaggu

SEQ ID NO: 311401 - RNA, 64 nt, Homo Sapiens
cucacuggcguuguguuuuucagguuguggugcaucagcccaaauuucugugucugaaaguuua

SEQ ID NO: 311402 - RNA, 64 nt, Homo Sapiens
uggggaggacauggcgcccgacugcccuguggacucagcccagcagacccaagguaguccuggc

SEQ ID NO: 311403 - RNA, 64 nt, Homo Sapiens
aagcaauggggcuuuagugaauuccccaucuuccucagcccagacagcccuccuaauaccucau

SEQ ID NO: 311404 - RNA, 64 nt, Homo Sapiens
gggccuccuuggcuggcaugauggauaggucaucucagcccaaacauggaggcaguggcgccuu

SEQ ID NO: 311405 - RNA, 64 nt, Homo Sapiens
gccuugccagucuugccaggcuucucuggcagacucagcccacuggcgggcagcagcuccccau

SEQ ID NO: 311406 - RNA, 64 nt, Homo Sapiens
ugccaugccccugggcgggccccuccugcccuucucagcccagacugcacauuguugucaccca

SEQ ID NO: 311407 - RNA, 64 nt, Homo Sapiens
agaacugucucauucauuuacauuucuguuacagucagcccaggagguuacagugagcucucca

SEQ ID NO: 311408 - RNA, 64 nt, Homo Sapiens
aauccaucacccuucgcugacucucuuuucggacucagcccaccugcacccaggugaaauaaac

SEQ ID NO: 311409 - RNA, 64 nt, Homo Sapiens
ccaccuggcaaaauccuccuuuugggguucaaagucagcccaucgcgguggaaaaacuugaggg

SEQ ID NO: 311410 - RNA, 64 nt, Homo Sapiens
cccuucccuucuccaggcccucacgauggcugugucagcccagcauuccucaugcugacccucc

SEQ ID NO: 311411 - RNA, 64 nt, Homo Sapiens
acauagauagcuuuuuuuuuucccuaaggaauauucagcccacugacaguacuuauuaauugag

SEQ ID NO: 311412 - RNA, 64 nt, Homo Sapiens
caacaagguaauugcgugccccauucacagguucucagcccaagguaaaaauaauacaugaauc

SEQ ID NO: 311413 - RNA, 64 nt, Homo Sapiens
ugcaccugccccccagccuucagacucugggcugucagcccaugaaggccacugcuacaucucc

SEQ ID NO: 311414 - RNA, 64 nt, Homo Sapiens
ccaccaacuucaucgccuuuccgcccagacuggcucagcccaggcuuccugcuucagggccgca

SEQ ID NO: 311415 - RNA, 64 nt, Homo Sapiens
acuaggcuggacccuucccacuacauaauagggcucagcccaggcagccagcuuugggcugagc

SEQ ID NO: 311416 - RNA, 64 nt, Homo Sapiens
ggagcuagggcagggaccaaaugaacagaaagucucagcccaggauggggcuucuucaacaggg

SEQ ID NO: 311417 - RNA, 64 nt, Homo Sapiens
ccggggaggcagggguccugcagguccuggugggucagcccagcaccugcucccagugggagcu

SEQ ID NO: 311418 - RNA, 64 nt, Homo Sapiens
ccaauagcucuacugcccuccccuuccccuuuacucagcccagcuggccaccuagaagucuccc

SEQ ID NO: 311419 - RNA, 64 nt, Homo Sapiens
aguuccagacugccuggcuagcagggggauuacuucagcccaggcagcacuuugggaggccaag

SEQ ID NO: 311420 - RNA, 64 nt, Homo Sapiens
cucagucagacauguucacucagagccaggucccucagcccagaaguaucuauuuuacaaaaug

SEQ ID NO: 311421 - RNA, 64 nt, Homo Sapiens
caggaugugaacuuccccaucgcaaaugcaguucucagcccacugcaguggauacaaggaaggg

SEQ ID NO: 311422 - RNA, 64 nt, Homo Sapiens
gccaggcugucuacccuauggccacagcaggaggucagcccagggccaggagacacauggcugg

SEQ ID NO: 311423 - RNA, 64 nt, Homo Sapiens
cuagcccagcucaggcaggcaggauccaagcagaucagcccagcgugcugugcuucucagaggc

SEQ ID NO: 311424 - RNA, 64 nt, Homo Sapiens
acccccaggggauucaugggacagcuggcaucaaucagcccaagcaaaaaguccagaagccuug

SEQ ID NO: 311425 - RNA, 64 nt, Homo Sapiens
caggucagagcccacccggcagguuucagaguggucagcccaguuuaagggugggagucuggag

SEQ ID NO: 311426 - RNA, 64 nt, Homo Sapiens
uagacaucugccaguaagccugcugagagaagccucagcccacucauaccuagagacgcugcug

SEQ ID NO: 311427 - RNA, 64 nt, Homo Sapiens
uuacgcccccucccuguuucuuaucaccagcccaucagcccacugacucccauaugguagaaaa

SEQ ID NO: 311428 - RNA, 64 nt, Homo Sapiens
ggaaugcucauggccccuguggucugcuuguccuucagcccaugcccagcagauaccucucuga

SEQ ID NO: 311429 - RNA, 64 nt, Homo Sapiens
agaaugaaucaacugcuauccuuccccucaccccucagcccaggagggaaagggcauuuucuuu

SEQ ID NO: 311430 - RNA, 64 nt, Homo Sapiens
agaacauuuuagccauugauguucacacguggcaucagcccaugcaagauagguuucuguauuu

SEQ ID NO: 311431 - RNA, 64 nt, Homo Sapiens
ccucauugugacuuaugaggagcuccucuuguccucagcccaccuggggcccugagauggcccc

SEQ ID NO: 311432 - RNA, 64 nt, Homo Sapiens
caccaggcgcuggucucacccccacuuggcccacucagcccauuaguaccagccccccagccca

SEQ ID NO: 311433 - RNA, 64 nt, Homo Sapiens; identical to SEQ ID NO: 155574

SEQ ID NO: 311434 - RNA, 64 nt, Homo Sapiens; identical to SEQ ID NO: 155575

SEQ ID NO: 311435 - RNA, 64 nt, Homo Sapiens; identical to SEQ ID NO: 155576

SEQ ID NO: 311436 - RNA, 64 nt, Homo Sapiens; identical to SEQ ID NO: 155577

SEQ ID NO: 311437 - RNA, 64 nt, Homo Sapiens; identical to SEQ ID NO: 155578

SEQ ID NO: 311438 - RNA, 64 nt, Homo Sapiens; identical to SEQ ID NO: 155579

SEQ ID NO: 311439 - RNA, 64 nt, Homo Sapiens; identical to SEQ ID NO: 155580

SEQ ID NO: 311440 - RNA, 64 nt, Homo Sapiens; identical to SEQ ID NO: 155581

SEQ ID NO: 311441 - RNA, 64 nt, Homo Sapiens; identical to SEQ ID NO: 155582

SEQ ID NO: 311442 - RNA, 64 nt, Homo Sapiens; identical to SEQ ID NO: 155583

SEQ ID NO: 311443 - RNA, 64 nt, Homo Sapiens; identical to SEQ ID NO: 155584

SEQ ID NO: 311444 - RNA, 64 nt, Homo Sapiens; identical to SEQ ID NO: 155585

SEQ ID NO: 311445 - RNA, 64 nt, Homo Sapiens; identical to SEQ ID NO: 155586

SEQ ID NO: 311446 - RNA, 64 nt, Homo Sapiens; identical to SEQ ID NO: 155587

SEQ ID NO: 311447 - RNA, 64 nt, Homo Sapiens; identical to SEQ ID NO: 155588

SEQ ID NO: 311448 - RNA, 64 nt, Homo Sapiens; identical to SEQ ID NO: 155589

SEQ ID NO: 311449 - RNA, 64 nt, Homo Sapiens; identical to SEQ ID NO: 155590

SEQ ID NO: 311450 - RNA, 64 nt, Homo Sapiens; identical to SEQ ID NO: 155591

SEQ ID NO: 311451 - RNA, 64 nt, Homo Sapiens; identical to SEQ ID NO: 155592

SEQ ID NO: 311452 - RNA, 64 nt, Homo Sapiens; identical to SEQ ID NO: 155593

SEQ ID NO: 311453 - RNA, 64 nt, Homo Sapiens; identical to SEQ ID NO: 155594

SEQ ID NO: 311454 - RNA, 64 nt, Homo Sapiens; identical to SEQ ID NO: 155595

SEQ ID NO: 311455 - RNA, 64 nt, Homo Sapiens; identical to SEQ ID NO: 305621

SEQ ID NO: 311456 - RNA, 64 nt, Homo Sapiens; identical to SEQ ID NO: 305622

SEQ ID NO: 311457 - RNA, 64 nt, Homo Sapiens; identical to SEQ ID NO: 305623

SEQ ID NO: 311458 - RNA, 64 nt, Homo Sapiens; identical to SEQ ID NO: 305624

SEQ ID NO: 311459 - RNA, 64 nt, Homo Sapiens; identical to SEQ ID NO: 305625

SEQ ID NO: 311460 - RNA, 64 nt, Homo Sapiens; identical to SEQ ID NO: 305626

SEQ ID NO: 311461 - RNA, 64 nt, Homo Sapiens; identical to SEQ ID NO: 305627

SEQ ID NO: 311462 - RNA, 64 nt, Homo Sapiens; identical to SEQ ID NO: 305628

SEQ ID NO: 311463 - RNA, 64 nt, Homo Sapiens; identical to SEQ ID NO: 305629

SEQ ID NO: 311464 - RNA, 64 nt, Homo Sapiens; identical to SEQ ID NO: 305630

SEQ ID NO: 311465 - RNA, 64 nt, Homo Sapiens; identical to SEQ ID NO: 305631

SEQ ID NO: 311466 - RNA, 64 nt, Homo Sapiens; identical to SEQ ID NO: 305632

SEQ ID NO: 311467 - RNA, 64 nt, Homo Sapiens; identical to SEQ ID NO: 305633

SEQ ID NO: 311468 - RNA, 64 nt, Homo Sapiens; identical to SEQ ID NO: 305634

SEQ ID NO: 311469 - RNA, 64 nt, Homo Sapiens; identical to SEQ ID NO: 305635

SEQ ID NO: 311470 - RNA, 64 nt, Homo Sapiens; identical to SEQ ID NO: 305636

SEQ ID NO: 311471 - RNA, 64 nt, Homo Sapiens; identical to SEQ ID NO: 305637

SEQ ID NO: 311472 - RNA, 64 nt, Homo Sapiens; identical to SEQ ID NO: 285749

SEQ ID NO: 311473 - RNA, 64 nt, Homo Sapiens; identical to SEQ ID NO: 285750

SEQ ID NO: 311474 - RNA, 64 nt, Homo Sapiens; identical to SEQ ID NO: 285751

SEQ ID NO: 311475 - RNA, 64 nt, Homo Sapiens; identical to SEQ ID NO: 285752

SEQ ID NO: 311476 - RNA, 64 nt, Homo Sapiens; identical to SEQ ID NO: 285753

SEQ ID NO: 311477 - RNA, 64 nt, Homo Sapiens; identical to SEQ ID NO: 285754

SEQ ID NO: 311478 - RNA, 64 nt, Homo Sapiens; identical to SEQ ID NO: 285755

SEQ ID NO: 311479 - RNA, 64 nt, Homo Sapiens; identical to SEQ ID NO: 285756

SEQ ID NO: 311480 - RNA, 58 nt, Homo Sapiens; identical to SEQ ID NO: 285757

SEQ ID NO: 311481 - RNA, 64 nt, Homo Sapiens; identical to SEQ ID NO: 285758

SEQ ID NO: 311482 - RNA, 64 nt, Homo Sapiens; identical to SEQ ID NO: 285759

SEQ ID NO: 311483 - RNA, 64 nt, Homo Sapiens; identical to SEQ ID NO: 285760

SEQ ID NO: 311484 - RNA, 64 nt, Homo Sapiens
guuucguagggauauauucauuuaagccuaugagaagauagacuuuuaauagccaugacuauaa

SEQ ID NO: 311485 - RNA, 64 nt, Homo Sapiens
cuuuuuucuuuuuugucauuuuauuauggugguaaagauagaauuucaucauauaucaucauca

SEQ ID NO: 311486 - RNA, 64 nt, Homo Sapiens
aauugugaggcuggauucacaaaaugccuauuguaagauagaauuaacuuuagauuugggauuu

SEQ ID NO: 311487 - RNA, 64 nt, Homo Sapiens
auacuuuuaagacaacuuggccuaaucuuuuuaaaagauagaaguuauucuaauguaucccaaa

SEQ ID NO: 311488 - RNA, 64 nt, Homo Sapiens
acuuggucuaucugcauuaggacccaugggccguggaggcuauggaggugguggcagugguggu

SEQ ID NO: 311489 - RNA, 64 nt, Homo Sapiens
ggguaacuacggggaugaucgucgugguggcagaggaggcuaugaucgaggcggcuaccggggc

SEQ ID NO: 311490 - RNA, 64 nt, Homo Sapiens
ugaguuccuccaguuaaauguggcuguagauguuggaggcuagggaggcuaguaaauaucaaaa

SEQ ID NO: 311491 - RNA, 64 nt, Homo Sapiens
ccaguuaaauguggcuguagauguuggaggcuagggaggcuaguaaauaucaaaaggaaaaggg

SEQ ID NO: 311492 - RNA, 64 nt, Homo Sapiens; identical to SEQ ID NO: 227821

SEQ ID NO: 311493 - RNA, 64 nt, Homo Sapiens; identical to SEQ ID NO: 227822

SEQ ID NO: 311494 - RNA, 64 nt, Homo Sapiens; identical to SEQ ID NO: 227823

SEQ ID NO: 311495 - RNA, 64 nt, Homo Sapiens; identical to SEQ ID NO: 227824

SEQ ID NO: 311496 - RNA, 64 nt, Homo Sapiens; identical to SEQ ID NO: 227825

SEQ ID NO: 311497 - RNA, 64 nt, Homo Sapiens; identical to SEQ ID NO: 227826

SEQ ID NO: 311498 - RNA, 64 nt, Homo Sapiens; identical to SEQ ID NO: 227827

SEQ ID NO: 311499 - RNA, 64 nt, Homo Sapiens; identical to SEQ ID NO: 227828

SEQ ID NO: 311500 - RNA, 64 nt, Homo Sapiens; identical to SEQ ID NO: 227829

SEQ ID NO: 311501 - RNA, 64 nt, Homo Sapiens; identical to SEQ ID NO: 227830

SEQ ID NO: 311502 - RNA, 64 nt, Homo Sapiens; identical to SEQ ID NO: 227831

SEQ ID NO: 311503 - RNA, 64 nt, Homo Sapiens; identical to SEQ ID NO: 227832

SEQ ID NO: 311504 - RNA, 64 nt, Homo Sapiens; identical to SEQ ID NO: 227833

SEQ ID NO: 311505 - RNA, 64 nt, Homo Sapiens; identical to SEQ ID NO: 227834

SEQ ID NO: 311506 - RNA, 64 nt, Homo Sapiens; identical to SEQ ID NO: 227835

SEQ ID NO: 311507 - RNA, 64 nt, Homo Sapiens; identical to SEQ ID NO: 227836

SEQ ID NO: 311508 - RNA, 64 nt, Homo Sapiens; identical to SEQ ID NO: 227837

SEQ ID NO: 311509 - RNA, 64 nt, Homo Sapiens; identical to SEQ ID NO: 227838

SEQ ID NO: 311510 - RNA, 64 nt, Homo Sapiens; identical to SEQ ID NO: 227839

SEQ ID NO: 311511 - RNA, 64 nt, Homo Sapiens; identical to SEQ ID NO: 227840

SEQ ID NO: 311512 - RNA, 64 nt, Homo Sapiens; identical to SEQ ID NO: 227841

SEQ ID NO: 311513 - RNA, 64 nt, Homo Sapiens; identical to SEQ ID NO: 227842

SEQ ID NO: 311514 - RNA, 64 nt, Homo Sapiens
aacuugacauucuggagagagacuaucuucuggaguugaguacaagcacagaaacaucuuuacg

SEQ ID NO: 311515 - RNA, 64 nt, Homo Sapiens
cagcaaaggucuauagaaaaaggcuugcguguucguugaguaaucauuguuucauuuucauuuu

SEQ ID NO: 311516 - RNA, 64 nt, Homo Sapiens
agcaacauaaaccacauuuuuguuuucaaaagcaguugaguaacauaaaacacuauaggacauu

SEQ ID NO: 311517 - RNA, 64 nt, Homo Sapiens
acaauuaaagauuaugcuccuguuguccugcuugguugaguaccgagguaaucuuucugcuguu

SEQ ID NO: 311518 - RNA, 64 nt, Homo Sapiens
ccaauagguuuuuauuccaacuccgagcacugugguugaguaacaucaccucaauuuuuuauua

SEQ ID NO: 311519 - RNA, 64 nt, Homo Sapiens
gauucccaccccaaauaguaauaaaauuacuucuguugaguaaacuuuuuaugucaucguaaaa

SEQ ID NO: 311520 - RNA, 64 nt, Homo Sapiens
gcagacaguggccuccccuuccccucccugccccaggacuuaaagagcaauaguuugccccuuu

SEQ ID NO: 311521 - RNA, 64 nt, Homo Sapiens
acagaagcuauuaauacacgacagcauguggggaaggacuuauggugggccagguggaccucau

SEQ ID NO: 311522 - RNA, 64 nt, Homo Sapiens
auuuauaauaaugauaggugauaggcccacaaggaggacuuacaauguggaacuuagucucuuu

SEQ ID NO: 311523 - RNA, 64 nt, Homo Sapiens
gggacucccuauggcugaaggccuuaugagucaaaggacuuauagccaauugauuguucuaggc

SEQ ID NO: 311524 - RNA, 64 nt, Homo Sapiens
acaggccucuuguuccuuccgacuuaacaucaacaggacuuaacuuaccuggugcucucaacag

SEQ ID NO: 311525 - RNA, 64 nt, Homo Sapiens
aucaacaggacuuaacacagcuggugcucucaacaggacuuaacaaggggugcagaguguuuac

SEQ ID NO: 311526 - RNA, 64 nt, Homo Sapiens
ucuuguuuuuuucccaguuucuauauucaccaaaaggacuuaauaugaacuaaacauugccuug

SEQ ID NO: 311527 - RNA, 64 nt, Homo Sapiens
ucuuguuuuuucccaguuuucuauauucaccaaaaggacuuacuaugaacuaaacauugccuug

SEQ ID NO: 311528 - RNA, 64 nt, Homo Sapiens
uuucacuacacuacaggauaacauauggcucuugaggacuuagcaaaaaacauuguguaucuau

SEQ ID NO: 311529 - RNA, 64 nt, Homo Sapiens
ugaacuuugaucucuguuuuuuguuaaugcaaacaggacuuaaauuuuuauuucauuuuuauuu

SEQ ID NO: 311530 - RNA, 64 nt, Homo Sapiens
caaaacuuuacugguuugagaagaauaaucaaaaaggacuuauaccaauaggacuuacuauugu

SEQ ID NO: 311531 - RNA, 64 nt, Homo Sapiens
uugagaagaauaaucaaaaaggacuuauaccaauaggacuuacuauuguuuuuuaaggaucucc

SEQ ID NO: 311532 - RNA, 64 nt, Homo Sapiens; identical to SEQ ID NO: 82704

SEQ ID NO: 311533 - RNA, 64 nt, Homo Sapiens; identical to SEQ ID NO: 82705

SEQ ID NO: 311534 - RNA, 64 nt, Homo Sapiens; identical to SEQ ID NO: 82706

SEQ ID NO: 311535 - RNA, 64 nt, Homo Sapiens; identical to SEQ ID NO: 82707

SEQ ID NO: 311536 - RNA, 64 nt, Homo Sapiens; identical to SEQ ID NO: 82708

SEQ ID NO: 311537 - RNA, 64 nt, Homo Sapiens; identical to SEQ ID NO: 82709

SEQ ID NO: 311538 - RNA, 64 nt, Homo Sapiens; identical to SEQ ID NO: 82710

SEQ ID NO: 311539 - RNA, 64 nt, Homo Sapiens; identical to SEQ ID NO: 82711

SEQ ID NO: 311540 - RNA, 64 nt, Homo Sapiens; identical to SEQ ID NO: 82712

SEQ ID NO: 311541 - RNA, 64 nt, Homo Sapiens; identical to SEQ ID NO: 82713

SEQ ID NO: 311542 - RNA, 64 nt, Homo Sapiens; identical to SEQ ID NO: 82714

SEQ ID NO: 311543 - RNA, 64 nt, Homo Sapiens; identical to SEQ ID NO: 82715

SEQ ID NO: 311544 - RNA, 64 nt, Homo Sapiens; identical to SEQ ID NO: 82716

SEQ ID NO: 311545 - RNA, 64 nt, Homo Sapiens; identical to SEQ ID NO: 82717

SEQ ID NO: 311546 - RNA, 64 nt, Homo Sapiens; identical to SEQ ID NO: 82718

SEQ ID NO: 311547 - RNA, 64 nt, Homo Sapiens; identical to SEQ ID NO: 82719

SEQ ID NO: 311548 - RNA, 64 nt, Homo Sapiens; identical to SEQ ID NO: 82720

SEQ ID NO: 311549 - RNA, 64 nt, Homo Sapiens; identical to SEQ ID NO: 82721

SEQ ID NO: 311550 - RNA, 64 nt, Homo Sapiens; identical to SEQ ID NO: 82722

SEQ ID NO: 311551 - RNA, 64 nt, Homo Sapiens; identical to SEQ ID NO: 82723

SEQ ID NO: 311552 - RNA, 64 nt, Homo Sapiens; identical to SEQ ID NO: 82724

SEQ ID NO: 311553 - RNA, 64 nt, Homo Sapiens; identical to SEQ ID NO: 82725

SEQ ID NO: 311554 - RNA, 64 nt, Homo Sapiens; identical to SEQ ID NO: 82726

SEQ ID NO: 311555 - RNA, 64 nt, Homo Sapiens; identical to SEQ ID NO: 82727

SEQ ID NO: 311556 - RNA, 64 nt, Homo Sapiens; identical to SEQ ID NO: 82728

SEQ ID NO: 311557 - RNA, 64 nt, Homo Sapiens; identical to SEQ ID NO: 82729

SEQ ID NO: 311558 - RNA, 64 nt, Homo Sapiens; identical to SEQ ID NO: 82730

SEQ ID NO: 311559 - RNA, 64 nt, Homo Sapiens; identical to SEQ ID NO: 82731

SEQ ID NO: 311560 - RNA, 64 nt, Homo Sapiens; identical to SEQ ID NO: 82732

SEQ ID NO: 311561 - RNA, 64 nt, Homo Sapiens; identical to SEQ ID NO: 82733

SEQ ID NO: 311562 - RNA, 64 nt, Homo Sapiens; identical to SEQ ID NO: 82734

SEQ ID NO: 311563 - RNA, 64 nt, Homo Sapiens; identical to SEQ ID NO: 82735

SEQ ID NO: 311564 - RNA, 64 nt, Homo Sapiens; identical to SEQ ID NO: 82736

SEQ ID NO: 311565 - RNA, 64 nt, Homo Sapiens; identical to SEQ ID NO: 82737

SEQ ID NO: 311566 - RNA, 64 nt, Homo Sapiens; identical to SEQ ID NO: 82738

SEQ ID NO: 311567 - RNA, 64 nt, Homo Sapiens; identical to SEQ ID NO: 82739

SEQ ID NO: 311568 - RNA, 64 nt, Homo Sapiens; identical to SEQ ID NO: 82740

SEQ ID NO: 311569 - RNA, 64 nt, Homo Sapiens; identical to SEQ ID NO: 82741

SEQ ID NO: 311570 - RNA, 64 nt, Homo Sapiens; identical to SEQ ID NO: 82742

SEQ ID NO: 311571 - RNA, 64 nt, Homo Sapiens; identical to SEQ ID NO: 82743

SEQ ID NO: 311572 - RNA, 64 nt, Homo Sapiens; identical to SEQ ID NO: 82744

SEQ ID NO: 311573 - RNA, 64 nt, Homo Sapiens; identical to SEQ ID NO: 82745

SEQ ID NO: 311574 - RNA, 64 nt, Homo Sapiens; identical to SEQ ID NO: 82746

SEQ ID NO: 311575 - RNA, 64 nt, Homo Sapiens; identical to SEQ ID NO: 82747

SEQ ID NO: 311576 - RNA, 64 nt, Homo Sapiens; identical to SEQ ID NO: 82748

SEQ ID NO: 311577 - RNA, 64 nt, Homo Sapiens; identical to SEQ ID NO: 82749

SEQ ID NO: 311578 - RNA, 64 nt, Homo Sapiens; identical to SEQ ID NO: 82750

SEQ ID NO: 311579 - RNA, 64 nt, Homo Sapiens; identical to SEQ ID NO: 82751

SEQ ID NO: 311580 - RNA, 64 nt, Homo Sapiens; identical to SEQ ID NO: 82752

SEQ ID NO: 311581 - RNA, 64 nt, Homo Sapiens; identical to SEQ ID NO: 82753

SEQ ID NO: 311582 - RNA, 64 nt, Homo Sapiens; identical to SEQ ID NO: 82754

SEQ ID NO: 311583 - RNA, 64 nt, Homo Sapiens; identical to SEQ ID NO: 82755

SEQ ID NO: 311584 - RNA, 64 nt, Homo Sapiens; identical to SEQ ID NO: 82756

SEQ ID NO: 311585 - RNA, 64 nt, Homo Sapiens; identical to SEQ ID NO: 82757

SEQ ID NO: 311586 - RNA, 64 nt, Homo Sapiens; identical to SEQ ID NO: 82758

SEQ ID NO: 311587 - RNA, 64 nt, Homo Sapiens; identical to SEQ ID NO: 82759

SEQ ID NO: 311588 - RNA, 64 nt, Homo Sapiens; identical to SEQ ID NO: 82760

SEQ ID NO: 311589 - RNA, 64 nt, Homo Sapiens; identical to SEQ ID NO: 82761

SEQ ID NO: 311590 - RNA, 64 nt, Homo Sapiens; identical to SEQ ID NO: 82762

SEQ ID NO: 311591 - RNA, 64 nt, Homo Sapiens; identical to SEQ ID NO: 82763

SEQ ID NO: 311592 - RNA, 64 nt, Homo Sapiens; identical to SEQ ID NO: 82764

SEQ ID NO: 311593 - RNA, 64 nt, Homo Sapiens; identical to SEQ ID NO: 82765

SEQ ID NO: 311594 - RNA, 64 nt, Homo Sapiens; identical to SEQ ID NO: 82766

SEQ ID NO: 311595 - RNA, 64 nt, Homo Sapiens; identical to SEQ ID NO: 82767

SEQ ID NO: 311596 - RNA, 64 nt, Homo Sapiens; identical to SEQ ID NO: 82768

SEQ ID NO: 311597 - RNA, 64 nt, Homo Sapiens; identical to SEQ ID NO: 82769

SEQ ID NO: 311598 - RNA, 64 nt, Homo Sapiens; identical to SEQ ID NO: 82770

SEQ ID NO: 311599 - RNA, 64 nt, Homo Sapiens; identical to SEQ ID NO: 82771

SEQ ID NO: 311600 - RNA, 64 nt, Homo Sapiens; identical to SEQ ID NO: 82772

SEQ ID NO: 311601 - RNA, 64 nt, Homo Sapiens; identical to SEQ ID NO: 82773

SEQ ID NO: 311602 - RNA, 64 nt, Homo Sapiens; identical to SEQ ID NO: 82774

SEQ ID NO: 311603 - RNA, 64 nt, Homo Sapiens; identical to SEQ ID NO: 82775

SEQ ID NO: 311604 - RNA, 64 nt, Homo Sapiens; identical to SEQ ID NO: 82776

SEQ ID NO: 311605 - RNA, 64 nt, Homo Sapiens; identical to SEQ ID NO: 82777

SEQ ID NO: 311606 - RNA, 64 nt, Homo Sapiens; identical to SEQ ID NO: 82778

SEQ ID NO: 311607 - RNA, 64 nt, Homo Sapiens; identical to SEQ ID NO: 82779

SEQ ID NO: 311608 - RNA, 64 nt, Homo Sapiens; identical to SEQ ID NO: 82780

SEQ ID NO: 311609 - RNA, 64 nt, Homo Sapiens; identical to SEQ ID NO: 82781

SEQ ID NO: 311610 - RNA, 64 nt, Homo Sapiens; identical to SEQ ID NO: 82782

SEQ ID NO: 311611 - RNA, 64 nt, Homo Sapiens; identical to SEQ ID NO: 82783

SEQ ID NO: 311612 - RNA, 64 nt, Homo Sapiens; identical to SEQ ID NO: 82784

SEQ ID NO: 311613 - RNA, 64 nt, Homo Sapiens; identical to SEQ ID NO: 82785

SEQ ID NO: 311614 - RNA, 64 nt, Homo Sapiens; identical to SEQ ID NO: 82786

SEQ ID NO: 311615 - RNA, 64 nt, Homo Sapiens; identical to SEQ ID NO: 82787

SEQ ID NO: 311616 - RNA, 64 nt, Homo Sapiens; identical to SEQ ID NO: 82788

SEQ ID NO: 311617 - RNA, 64 nt, Homo Sapiens; identical to SEQ ID NO: 82789

SEQ ID NO: 311618 - RNA, 64 nt, Homo Sapiens; identical to SEQ ID NO: 82790

SEQ ID NO: 311619 - RNA, 64 nt, Homo Sapiens; identical to SEQ ID NO: 97587

SEQ ID NO: 311620 - RNA, 64 nt, Homo Sapiens; identical to SEQ ID NO: 97588

SEQ ID NO: 311621 - RNA, 64 nt, Homo Sapiens; identical to SEQ ID NO: 97589

SEQ ID NO: 311622 - RNA, 64 nt, Homo Sapiens; identical to SEQ ID NO: 97590

SEQ ID NO: 311623 - RNA, 64 nt, Homo Sapiens; identical to SEQ ID NO: 97591

SEQ ID NO: 311624 - RNA, 64 nt, Homo Sapiens; identical to SEQ ID NO: 97592

SEQ ID NO: 311625 - RNA, 64 nt, Homo Sapiens; identical to SEQ ID NO: 97593

SEQ ID NO: 311626 - RNA, 61 nt, Homo Sapiens; identical to SEQ ID NO: 97594

SEQ ID NO: 311627 - RNA, 64 nt, Homo Sapiens; identical to SEQ ID NO: 97595

SEQ ID NO: 311628 - RNA, 64 nt, Homo Sapiens; identical to SEQ ID NO: 97596

SEQ ID NO: 311629 - RNA, 64 nt, Homo Sapiens; identical to SEQ ID NO: 97597

SEQ ID NO: 311630 - RNA, 64 nt, Homo Sapiens; identical to SEQ ID NO: 97598

SEQ ID NO: 311631 - RNA, 64 nt, Homo Sapiens; identical to SEQ ID NO: 97599

SEQ ID NO: 311632 - RNA, 64 nt, Homo Sapiens; identical to SEQ ID NO: 97600

SEQ ID NO: 311633 - RNA, 64 nt, Homo Sapiens; identical to SEQ ID NO: 97601

SEQ ID NO: 311634 - RNA, 64 nt, Homo Sapiens; identical to SEQ ID NO: 97602

SEQ ID NO: 311635 - RNA, 64 nt, Homo Sapiens; identical to SEQ ID NO: 97603

SEQ ID NO: 311636 - RNA, 64 nt, Homo Sapiens; identical to SEQ ID NO: 97604

SEQ ID NO: 311637 - RNA, 64 nt, Homo Sapiens; identical to SEQ ID NO: 97605

SEQ ID NO: 311638 - RNA, 64 nt, Homo Sapiens; identical to SEQ ID NO: 97606

SEQ ID NO: 311639 - RNA, 64 nt, Homo Sapiens; identical to SEQ ID NO: 97607

SEQ ID NO: 311640 - RNA, 64 nt, Homo Sapiens; identical to SEQ ID NO: 97608

SEQ ID NO: 311641 - RNA, 64 nt, Homo Sapiens; identical to SEQ ID NO: 97609

SEQ ID NO: 311642 - RNA, 64 nt, Homo Sapiens; identical to SEQ ID NO: 97610

SEQ ID NO: 311643 - RNA, 64 nt, Homo Sapiens; identical to SEQ ID NO: 97611

SEQ ID NO: 311644 - RNA, 64 nt, Homo Sapiens; identical to SEQ ID NO: 97612

SEQ ID NO: 311645 - RNA, 64 nt, Homo Sapiens; identical to SEQ ID NO: 97613

SEQ ID NO: 311646 - RNA, 64 nt, Homo Sapiens; identical to SEQ ID NO: 97614

SEQ ID NO: 311647 - RNA, 64 nt, Homo Sapiens; identical to SEQ ID NO: 97615

SEQ ID NO: 311648 - RNA, 64 nt, Homo Sapiens; identical to SEQ ID NO: 97616

SEQ ID NO: 311649 - RNA, 64 nt, Homo Sapiens; identical to SEQ ID NO: 97617

SEQ ID NO: 311650 - RNA, 64 nt, Homo Sapiens; identical to SEQ ID NO: 97618

SEQ ID NO: 311651 - RNA, 64 nt, Homo Sapiens; identical to SEQ ID NO: 97619

SEQ ID NO: 311652 - RNA, 64 nt, Homo Sapiens; identical to SEQ ID NO: 97620

SEQ ID NO: 311653 - RNA, 64 nt, Homo Sapiens; identical to SEQ ID NO: 97621

SEQ ID NO: 311654 - RNA, 64 nt, Homo Sapiens; identical to SEQ ID NO: 97622

SEQ ID NO: 311655 - RNA, 64 nt, Homo Sapiens; identical to SEQ ID NO: 97623

SEQ ID NO: 311656 - RNA, 64 nt, Homo Sapiens; identical to SEQ ID NO: 97624

SEQ ID NO: 311657 - RNA, 64 nt, Homo Sapiens; identical to SEQ ID NO: 97625

SEQ ID NO: 311658 - RNA, 64 nt, Homo Sapiens; identical to SEQ ID NO: 97626

SEQ ID NO: 311659 - RNA, 64 nt, Homo Sapiens; identical to SEQ ID NO: 97627

SEQ ID NO: 311660 - RNA, 64 nt, Homo Sapiens; identical to SEQ ID NO: 97628

SEQ ID NO: 311661 - RNA, 64 nt, Homo Sapiens; identical to SEQ ID NO: 97629

SEQ ID NO: 311662 - RNA, 64 nt, Homo Sapiens; identical to SEQ ID NO: 97630

SEQ ID NO: 311663 - RNA, 64 nt, Homo Sapiens; identical to SEQ ID NO: 97631

SEQ ID NO: 311664 - RNA, 64 nt, Homo Sapiens; identical to SEQ ID NO: 97632

SEQ ID NO: 311665 - RNA, 64 nt, Homo Sapiens; identical to SEQ ID NO: 97633

SEQ ID NO: 311666 - RNA, 64 nt, Homo Sapiens; identical to SEQ ID NO: 97634

SEQ ID NO: 311667 - RNA, 64 nt, Homo Sapiens; identical to SEQ ID NO: 97635

SEQ ID NO: 311668 - RNA, 64 nt, Homo Sapiens; identical to SEQ ID NO: 97636

SEQ ID NO: 311669 - RNA, 64 nt, Homo Sapiens; identical to SEQ ID NO: 97637

SEQ ID NO: 311670 - RNA, 64 nt, Homo Sapiens; identical to SEQ ID NO: 97638

SEQ ID NO: 311671 - RNA, 64 nt, Homo Sapiens; identical to SEQ ID NO: 97639

SEQ ID NO: 311672 - RNA, 64 nt, Homo Sapiens; identical to SEQ ID NO: 97640

SEQ ID NO: 311673 - RNA, 64 nt, Homo Sapiens; identical to SEQ ID NO: 97641

SEQ ID NO: 311674 - RNA, 64 nt, Homo Sapiens; identical to SEQ ID NO: 97642

SEQ ID NO: 311675 - RNA, 64 nt, Homo Sapiens; identical to SEQ ID NO: 97643

SEQ ID NO: 311676 - RNA, 64 nt, Homo Sapiens; identical to SEQ ID NO: 97644

SEQ ID NO: 311677 - RNA, 64 nt, Homo Sapiens; identical to SEQ ID NO: 97645

SEQ ID NO: 311678 - RNA, 64 nt, Homo Sapiens; identical to SEQ ID NO: 97646

SEQ ID NO: 311679 - RNA, 64 nt, Homo Sapiens; identical to SEQ ID NO: 97647

SEQ ID NO: 311680 - RNA, 64 nt, Homo Sapiens; identical to SEQ ID NO: 97648

SEQ ID NO: 311681 - RNA, 64 nt, Homo Sapiens; identical to SEQ ID NO: 97649

SEQ ID NO: 311682 - RNA, 64 nt, Homo Sapiens; identical to SEQ ID NO: 97650

SEQ ID NO: 311683 - RNA, 64 nt, Homo Sapiens; identical to SEQ ID NO: 97651

SEQ ID NO: 311684 - RNA, 64 nt, Homo Sapiens; identical to SEQ ID NO: 97652

SEQ ID NO: 311685 - RNA, 64 nt, Homo Sapiens; identical to SEQ ID NO: 97653

SEQ ID NO: 311686 - RNA, 64 nt, Homo Sapiens; identical to SEQ ID NO: 97654

SEQ ID NO: 311687 - RNA, 64 nt, Homo Sapiens; identical to SEQ ID NO: 97655

SEQ ID NO: 311688 - RNA, 64 nt, Homo Sapiens; identical to SEQ ID NO: 97656

SEQ ID NO: 311689 - RNA, 64 nt, Homo Sapiens; identical to SEQ ID NO: 97657

SEQ ID NO: 311690 - RNA, 64 nt, Homo Sapiens; identical to SEQ ID NO: 97658

SEQ ID NO: 311691 - RNA, 64 nt, Homo Sapiens; identical to SEQ ID NO: 97659

SEQ ID NO: 311692 - RNA, 58 nt, Homo Sapiens; identical to SEQ ID NO: 97660

SEQ ID NO: 311693 - RNA, 64 nt, Homo Sapiens; identical to SEQ ID NO: 97661

SEQ ID NO: 311694 - RNA, 64 nt, Homo Sapiens; identical to SEQ ID NO: 97662

SEQ ID NO: 311695 - RNA, 64 nt, Homo Sapiens; identical to SEQ ID NO: 97663

SEQ ID NO: 311696 - RNA, 64 nt, Homo Sapiens; identical to SEQ ID NO: 97664

SEQ ID NO: 311697 - RNA, 64 nt, Homo Sapiens; identical to SEQ ID NO: 97665

SEQ ID NO: 311698 - RNA, 64 nt, Homo Sapiens; identical to SEQ ID NO: 97666

SEQ ID NO: 311699 - RNA, 64 nt, Homo Sapiens; identical to SEQ ID NO: 97667

SEQ ID NO: 311700 - RNA, 64 nt, Homo Sapiens; identical to SEQ ID NO: 97668

SEQ ID NO: 311701 - RNA, 64 nt, Homo Sapiens; identical to SEQ ID NO: 97669

SEQ ID NO: 311702 - RNA, 64 nt, Homo Sapiens; identical to SEQ ID NO: 97670

SEQ ID NO: 311703 - RNA, 64 nt, Homo Sapiens
ugaugugaaugcgauucagaguguuauguaauaugccuagaaggagcaaccccaggauagcuaa

SEQ ID NO: 311704 - RNA, 64 nt, Homo Sapiens
aacggacuuuuuuuuucuauaaauacacauuuaugccuagaagguuuguuuacuaugaaauuuu

SEQ ID NO: 311705 - RNA, 64 nt, Homo Sapiens
acuccuaaaguauaggauuagaauaggaucaaaggccuagaaagccacaacagcucaaaucuca

SEQ ID NO: 311706 - RNA, 64 nt, Homo Sapiens
uuuugcuuugcuaguuaaagagucaagaacauuagccuagaaguggcuuaaauuuauuuuucaa

SEQ ID NO: 311707 - RNA, 64 nt, Homo Sapiens
cauguuauuuaaccugaguauaguauuuaacgaagccuagaagcacggcuguggguggugauuu

SEQ ID NO: 311708 - RNA, 64 nt, Homo Sapiens
gaagguuucauaauugguucuacgacccuuuugagccuagaauuauuguucuuauauaagauca

SEQ ID NO: 311709 - RNA, 64 nt, Homo Sapiens
cugcagacagaaaaugaaagaaaaaaauggacuugccuagaauaauauauugaaugccuuuuga

SEQ ID NO: 311710 - RNA, 64 nt, Homo Sapiens
caaaggaggcacucguucucuuuucuugcuguaugccuagaaagugguugaaggauucuugaug

SEQ ID NO: 311711 - RNA, 64 nt, Homo Sapiens
ggaaucagaaaaaccuguucccaucaccggccuagccuagaauccuagccuagaagcccucucu

SEQ ID NO: 311712 - RNA, 64 nt, Homo Sapiens
ccuguucccaucaccggccuagccuagaauccuagccuagaagcccucucucccucugggcugg

SEQ ID NO: 311713 - RNA, 64 nt, Homo Sapiens
ugauuguguggaaccaguauguagcaaauggaaagccuagaaauaucuuauuuucuaaguuuac

SEQ ID NO: 311714 - RNA, 64 nt, Homo Sapiens
uugggucuuuacuucugggaauuuguauguaacagccuagaaaauuaaaaggagguggaugcau

SEQ ID NO: 311715 - RNA, 64 nt, Homo Sapiens; identical to SEQ ID NO: 311713

SEQ ID NO: 311716 - RNA, 64 nt, Homo Sapiens; identical to SEQ ID NO: 311714

SEQ ID NO: 311717 - RNA, 64 nt, Homo Sapiens
uaaggccucacaggaugagucuccauucucuguaaaugcuuauuuuaucauagucuuuagccuc

SEQ ID NO: 311718 - RNA, 64 nt, Homo Sapiens
aaacucaaaucuggcacguaggugcuucuuaguaaaugcuuaaugaaugccaccaacucugcaa

SEQ ID NO: 311719 - RNA, 64 nt, Homo Sapiens
ucaauguggauuugucggcuuacagccagugcuuaaugcuuauauagaacuaaaaaucuuaaaa

SEQ ID NO: 311720 - RNA, 64 nt, Homo Sapiens
agaacuauucagauugucagcuuucuaacauaucaaugcuuagcacaguuugauuuuuacuuuu

SEQ ID NO: 311721 - RNA, 64 nt, Homo Sapiens
ccacaucuguggauucaaccaaccaaggacggaaaaugcuuaaaaaauaauacaacaacaacaa

SEQ ID NO: 311722 - RNA, 64 nt, Homo Sapiens
aaaacaagucauuuuuguauuuuucaucuuuaagaaugcuuaaaaaagcuaaucccuaaaauag

SEQ ID NO: 311723 - RNA, 64 nt, Homo Sapiens
agugcugggauuacagguacaaugauguauaauuaaugcuuagugaagcauaaaguuaccuaca

SEQ ID NO: 311724 - RNA, 64 nt, Homo Sapiens
guacagaaaacauguauaaauauaagucuauacuaaugcuuacaacuuucuaagaggguucuug

SEQ ID NO: 311725 - RNA, 64 nt, Homo Sapiens
gccuuugaaauuuuguaaucuuuauauucucuaaaaugcuuaauauguauguauacuggcguac

SEQ ID NO: 311726 - RNA, 64 nt, Homo Sapiens
gagaaaaaaaauuuuaaaaaguaugccuuuuaaaaaugcuuauaugauuaaacaccucuuuugg

SEQ ID NO: 311727 - RNA, 64 nt, Homo Sapiens
uuaaugugauuuuucuaaaacuucaaaaaaccaaaaugcuuauuccugucguuaaguguuguaa

SEQ ID NO: 311728 - RNA, 64 nt, Homo Sapiens
auagucucuagggugaugcauuuggaaggugccuaaugcuuaggcugaggauuugggcauauuu

SEQ ID NO: 311729 - RNA, 64 nt, Homo Sapiens
cuguuaauguaaacuuuugauguuaaaaggagcuaaugcuuauuuuaauuuaguugugugugug

SEQ ID NO: 311730 - RNA, 64 nt, Homo Sapiens
aaggaauuaaaaaaaaaaaguuaacacuugagcaaaugcuuaagcuaugguaaacuaagcuagu

SEQ ID NO: 311731 - RNA, 64 nt, Homo Sapiens
cucauugacuuauuucuuucggagaguuacuacaaaugcuuauuuagaguagaguuauuuucug

SEQ ID NO: 311732 - RNA, 64 nt, Homo Sapiens
gacaugcuaggggaaaaaaaaaagcuggggagaaaaugcuuaagccuuagaagaaagauuguga

SEQ ID NO: 311733 - RNA, 64 nt, Homo Sapiens
uaaaugguggcuguaacauaauaaauguuuaauaaaugcuuauaugaauggauuuuuagaauua

SEQ ID NO: 311734 - RNA, 64 nt, Homo Sapiens
aaacauaauuugaaugggucuaugaaggaaaaauaaugcuuagacuuugguguagguucuuccu

SEQ ID NO: 311735 - RNA, 64 nt, Homo Sapiens
cuugacauuggucuguuuugcugugaauauuggaaaugcuuaggaucuucagacccaauagcuc

SEQ ID NO: 311736 - RNA, 64 nt, Homo Sapiens
uaccuuauuuuuauauaugacaaacuacuucuauaaugcuuauuaugguaaaauaaaauuggaa

SEQ ID NO: 311737 - RNA, 64 nt, Homo Sapiens
ggaagaauauaaguaucuccaucuuuguauuuuuaaugcuuaggguccuaggaucuagaauuag

SEQ ID NO: 311738 - RNA, 64 nt, Homo Sapiens
caacacuacuacuguuagcaaggaugcaaaaauaaaugcuuaacauagaguggauauuaggauu

SEQ ID NO: 311739 - RNA, 64 nt, Homo Sapiens
augauccuacuaauuauccugcuguucuuuaauuaaugcuuaaugaauaauauggcacuguaaa

SEQ ID NO: 311740 - RNA, 64 nt, Homo Sapiens
cuuuuguuuuuccuuggaccuaaacagagaaaauaaugcuuauguaucugaagaaaaggucaga

SEQ ID NO: 311741 - RNA, 64 nt, Homo Sapiens
caagacaauauccacacuuucauauagaacaacaaaugcuuacaugucacccaucauuuugaag

SEQ ID NO: 311742 - RNA, 64 nt, Homo Sapiens
uggucuucuuccucugguauaauucugugcccuuaaugcuuaacaaaaaauaugagcaccauug

SEQ ID NO: 311743 - RNA, 64 nt, Homo Sapiens
gaaagagaagucacaacaaaaggaagacuggagaaaugcuuacuucuagagggagaagacugug

SEQ ID NO: 311744 - RNA, 64 nt, Homo Sapiens
uuuugaauucagaccuggaauguaaguaagugacaaugcuuauggaaagccaguuaguuagaau

SEQ ID NO: 311745 - RNA, 64 nt, Homo Sapiens
ucuuugcugucaggugcauugugggcauaaggaaaucuguuacaagcugccauauuggccugcu

SEQ ID NO: 311746 - RNA, 64 nt, Homo Sapiens
uuuuuguauuauugccaauuuguguuaccagacaaucuguuaauguaucuaauucgaaucagca

SEQ ID NO: 311747 - RNA, 64 nt, Homo Sapiens
uuaugacauucagaaaucaugaaacacaguagauaucuguuauaaugugguguaucacauggau

SEQ ID NO: 311748 - RNA, 64 nt, Homo Sapiens
uagauacuaagugaaacuuaguguaacaauuuugaucuguuaaauuggauuuuacauguacauu

SEQ ID NO: 311749 - RNA, 64 nt, Homo Sapiens
agucugggacauccgguauauuuuuuggaacucaaucuguuaacgacaguuuuuuuuuuuuuuu

SEQ ID NO: 311750 - RNA, 64 nt, Homo Sapiens
gccuccuuuuaucucucuucaauacagugugcuuaucuguuacggugcuaauucuuggaccuuu

SEQ ID NO: 311751 - RNA, 64 nt, Homo Sapiens
auauagugauaaaccaucugaaaguguaaaaaaaaucuguuacuuauuggauaugguaucuccu

SEQ ID NO: 311752 - RNA, 64 nt, Homo Sapiens
uucagguagugccauaaucuaacuucuuaaagagaucuguuauuucuacacuuaguuauugaua

SEQ ID NO: 311753 - RNA, 64 nt, Homo Sapiens
uaaaagcuuuuauccucuaauugucugagaaggaaucuguuaaagcuccagugcuugccauaau

SEQ ID NO: 311754 - RNA, 64 nt, Homo Sapiens
uggauauaugggccagccugaaagagagaaguguaucuguuacgauuacugaauuaacaaugag

SEQ ID NO: 311755 - RNA, 64 nt, Homo Sapiens
ccaaaaaaagcaaauggauagaaagugcuauucacccaguaaacaaaucagaugccuauguaag

SEQ ID NO: 311756 - RNA, 64 nt, Homo Sapiens
gaggcaagcaauucuaagauccuaucugguuuuucccaguaaauggugucccuaaagaccacuu

SEQ ID NO: 311757 - RNA, 64 nt, Homo Sapiens
gaauccauagacucaucuagauaaagacaucagucccaguaaauaaugggcugcaauuaggcag

SEQ ID NO: 311758 - RNA, 64 nt, Homo Sapiens
gugggagaaggggaucaauaagguaacaacccugcccaguaacuuagaggccucuugugacugg

SEQ ID NO: 311759 - RNA, 64 nt, Homo Sapiens
agucuccgguucagcuuccgacaccagaguggaacccaguaagcaccaucaggaaugaauuuca

SEQ ID NO: 311760 - RNA, 64 nt, Homo Sapiens
gcaagagaggcccaaucucaacuguagacugugucccaguaagagagucacagcuucagguguu

SEQ ID NO: 311761 - RNA, 64 nt, Homo Sapiens
cauuacacucacuccuguucccuuauucuucauucccaguaauucccuaccaaaugguggggac

SEQ ID NO: 311762 - RNA, 64 nt, Homo Sapiens
cccaguuacaucaaacagugacuuccaguuauuccccaguaagucugagugguuccuucaagcu

SEQ ID NO: 311763 - RNA, 64 nt, Homo Sapiens
gggguuuaggugugcagaagcuuuccuuucccuacccaguaaccaugugacuacuaacguggua

SEQ ID NO: 311764 - RNA, 64 nt, Homo Sapiens
agaaaacagggaccuuauuauucauuacugcauccccaguaaugaaaguacuuagaaaauaauu

SEQ ID NO: 311765 - RNA, 64 nt, Homo Sapiens
cugugcucuugaccugcuccgcccccuucccuggagggagcacccucuggacagacagaaccau

SEQ ID NO: 311766 - RNA, 64 nt, Homo Sapiens
caggucagcguggccugauugucccaggaccugaagggagcaaggauggccucagggccuggug

SEQ ID NO: 311767 - RNA, 64 nt, Homo Sapiens
aagagaugcugauaguuugagacccaggccgcagagggagcaggcggacacaaaguccauccag

SEQ ID NO: 311768 - RNA, 64 nt, Homo Sapiens
ggggcguuccacauggacagaucccuuuaauuaaagggagcaaaauaaaaaguuauauauaauu

SEQ ID NO: 311769 - RNA, 64 nt, Homo Sapiens
uccagcugccuggcagugcuguucugcccuccgcagggagcagcggguuggcuuggggugaaaa

SEQ ID NO: 311770 - RNA, 64 nt, Homo Sapiens
accaacuccagacuggcucccccacugucaacauagggagcaucgucagggagagaaacccaac

SEQ ID NO: 311771 - RNA, 64 nt, Homo Sapiens
aauuucuaauggaaguuuguugugaauguaaaggagggagcauucuuugcuuuuuaauauacaa

SEQ ID NO: 311772 - RNA, 64 nt, Homo Sapiens
agaugcccagggagacccaagaaagagucagguuagggagcagugaaagugaggagggaagaca

SEQ ID NO: 311773 - RNA, 64 nt, Homo Sapiens
ggaggccucugcaagauucuuggcccagggaaucagggagcacuugacuaggguccucaggcag

SEQ ID NO: 311774 - RNA, 64 nt, Homo Sapiens
acgccaaccccagcaguccuacggcugcaccugcagggagcagcaggggcagggccguagacuc

SEQ ID NO: 311775 - RNA, 64 nt, Homo Sapiens
accccuggaccccuccugcucaagggugccuggcagggagcacucccgcguagccaggugggcc

SEQ ID NO: 311776 - RNA, 64 nt, Homo Sapiens
cagagggugggggaccuggccccagagccaacagagggagcagguggggaggugcaguggcacc

SEQ ID NO: 311777 - RNA, 64 nt, Homo Sapiens
gguaugaagcugcgcuccuccaucggguuuggggagggagcacucugggacugugagacaagga

SEQ ID NO: 311778 - RNA, 64 nt, Homo Sapiens
gccaagcaaagagaagucucaguggagcaugaggagggagcaguccagaugccaacaaggaaau

SEQ ID NO: 311779 - RNA, 64 nt, Homo Sapiens
ggugggugcucugaaaacccugcugggcucaccgagggagcacuuucccuccacuuccaggugg

SEQ ID NO: 311780 - RNA, 64 nt, Homo Sapiens
gggaguuugagggaaucagagguggauaggugggagggagcaaguuuaaagcagagacuauuuu

SEQ ID NO: 311781 - RNA, 64 nt, Homo Sapiens
auaggaaggaaacuggaauucuuuguacuaauacagggagcacacuccuucaguucagcaagac

SEQ ID NO: 311782 - RNA, 64 nt, Homo Sapiens
uaugacucucugcuaucccacuguauagauccacagggagcaaacacuuagaaaugauagagaa

SEQ ID NO: 311783 - RNA, 64 nt, Homo Sapiens
ggaagguuguaugugucauuucaugcucauggggagggagcaggcugucugacuacaacaugca

SEQ ID NO: 311784 - RNA, 64 nt, Homo Sapiens
uuaaacuuaaugcagugggccugucuauauauauagggagcacuaguuucuuugcuuacuuuua

SEQ ID NO: 311785 - RNA, 64 nt, Homo Sapiens
ccugagggcuugagggaggcuggggaaaaccagcagggagcacuuggcuccuggcagagggaga

SEQ ID NO: 311786 - RNA, 64 nt, Homo Sapiens
uuccccugcaaggugcccaccugcccggagacagagggagcagcugaggccucucuccacuggc

SEQ ID NO: 311787 - RNA, 64 nt, Homo Sapiens
accaaaaccugcggggcugcuuggaguggaaagcagggagcaguguucagaggcaaagcagccu

SEQ ID NO: 311788 - RNA, 64 nt, Homo Sapiens
gcuucaccacccuggcuuauguggaacaccuaucagggagcagaaaaggggugcaguacacuaa

SEQ ID NO: 311789 - RNA, 64 nt, Homo Sapiens
gcucaggcccccaucucugggguguuugggggucagggagcagggagcacuggccguggucuac

SEQ ID NO: 311790 - RNA, 64 nt, Homo Sapiens
cccccaucucugggguguuugggggucagggagcagggagcacuggccguggucuacagcgugu

SEQ ID NO: 311791 - RNA, 64 nt, Homo Sapiens
gcauccgugagcagugugucuccugcaugcagaaagggagcagagaaggccaggggcuuuugcu

SEQ ID NO: 311792 - RNA, 64 nt, Homo Sapiens
guaucaaacagcucaggcuguuuuugggugcaagagggagcacgugacuguauuauacaugggu

SEQ ID NO: 311793 - RNA, 64 nt, Homo Sapiens
guccaauuuucacacacgugagaaucccuggcaaagggagcagaacugaaccggcuuuaccaaa

SEQ ID NO: 311794 - RNA, 64 nt, Homo Sapiens
ggagaaggaggggaaccagauguuagaucaggggagggagcaggagugucccucccgucagugc

SEQ ID NO: 311795 - RNA, 64 nt, Homo Sapiens
ugcggauccgggaggaggagcgcuacccaccuccagggagcacccugcccaccaagaagcacug

SEQ ID NO: 311796 - RNA, 64 nt, Homo Sapiens
ucacuggauugacuuugcugucaaaacuacugacagggagcagcccccgggccgcuggcuggug

SEQ ID NO: 311797 - RNA, 64 nt, Homo Sapiens
cuucccaggucugacuuugucacccugccguuucagggagcagaaguccuucuggacaguguga

SEQ ID NO: 311798 - RNA, 64 nt, Homo Sapiens
ugagaggguuucuuuuacuucaaaaucuuucuucagggagcaagacaugaacugacuaauuggu

SEQ ID NO: 311799 - RNA, 64 nt, Homo Sapiens
cggagcgagagagggagaaagggaaggaagagagagggagcagggaggagggaggaggaauaag

SEQ ID NO: 311800 - RNA, 64 nt, Homo Sapiens
agccugcagucacuggcuuguuccaggacagggaagggagcagggcgccuggccagagccgggg

SEQ ID NO: 311801 - RNA, 64 nt, Homo Sapiens
gguccgcugaggcagucuguuaaugaucgugggcagggagcagauugccggcauguuuuggggg

SEQ ID NO: 311802 - RNA, 64 nt, Homo Sapiens
gacuugccggcauguuuuggcccucugccgacgcagggagcagaauaagagagggcuuauaaau

SEQ ID NO: 311803 - RNA, 64 nt, Homo Sapiens
gaacauugcucuucauuuuggccuguacuucucccucagggacguagaacaauggaaugucagu

SEQ ID NO: 311804 - RNA, 64 nt, Homo Sapiens
cuuuuucuuuaaaauucaauuaagguacuucucccucagggacguagaacaauggaaugucagu

SEQ ID NO: 311805 - RNA, 64 nt, Homo Sapiens
aaauauuagccacagaccaccuacaucacaauaacucagggagcuuauagaagugaagauuccu

SEQ ID NO: 311806 - RNA, 64 nt, Homo Sapiens
cuguguaggaucucguuuguuaaaguccagcaugcucagggaccgucuuaucagacgcccgucu

SEQ ID NO: 311807 - RNA, 64 nt, Homo Sapiens
uagguuuucucagaggcucaccugccauccaccccucagggagcucagggguuggucugagagg

SEQ ID NO: 311808 - RNA, 64 nt, Homo Sapiens
uccagagacucaugcccauggaggcugggcuacccucagggagaaggccccugugcuccaggcc

SEQ ID NO: 311809 - RNA, 64 nt, Homo Sapiens
ggauuguccaguuacuuuagguuacuguaguggucucagggaaaagaaguugucugugggugau

SEQ ID NO: 311810 - RNA, 64 nt, Homo Sapiens
cccacgccuuuguuguuugaugccucccacccuucucagggaccagggcaggaggagggggccg

SEQ ID NO: 311811 - RNA, 64 nt, Homo Sapiens
ucagaccuagugcucccuucggggaagggccccacucagggauccuaaugaguggucggaccgu

SEQ ID NO: 311812 - RNA, 64 nt, Homo Sapiens
gaggccgaugcauaaagucagccuguucaaagugcucagggacuuagcaaaaugagaagaugug

SEQ ID NO: 311813 - RNA, 64 nt, Homo Sapiens
auacuguacuguguagugugucuccguaugucaucucagggagcuuaaaaugggcuugauuuaa

SEQ ID NO: 311814 - RNA, 64 nt, Homo Sapiens
ucuuuccucggccgagucaggcuuccuggugagccucagggagugcauggucucagaugccauc

SEQ ID NO: 311815 - RNA, 64 nt, Homo Sapiens
gcuccucuccagaguuuccggucaccuccguguucucagggagugcguggucuuggaugccauc

SEQ ID NO: 311816 - RNA, 64 nt, Homo Sapiens
cagucuccuuuugucuggugguuccaugcagucacucagggaccaaggguagggguauaagucu

SEQ ID NO: 311817 - RNA, 64 nt, Homo Sapiens
cagacuuacagaguggguagcuuuucugcagucacucagggaccugagcaggucagcaggaacc

SEQ ID NO: 311818 - RNA, 64 nt, Homo Sapiens
gucuuuuauaaacucaaugggugguuucucaggucucagggaaggaaaagagagaucuacuuug

SEQ ID NO: 311819 - RNA, 64 nt, Homo Sapiens
gcaauuguucuuaaagagcccucuuugccugccacucagggagucuuugggaagagcugcugag

SEQ ID NO: 311820 - RNA, 64 nt, Homo Sapiens
gcuggccacccuggccucagcucccucaggacgccucagggaucucgcugcgcgguccuauacg

SEQ ID NO: 311821 - RNA, 64 nt, Homo Sapiens
ccaauugauccucuacuuuccuucuuuagucccucucagggacgccuccauccccggcuccccu

SEQ ID NO: 311822 - RNA, 64 nt, Homo Sapiens
ccuaugcugcuggccuaaaacauuucuaaggagucucagggauggggcugggccugagauucug

SEQ ID NO: 311823 - RNA, 64 nt, Homo Sapiens
aggaagcuaaagugacgaguagugugacaucaaacucagggaagcuaaaaucugaguuuugccc

SEQ ID NO: 311824 - RNA, 64 nt, Homo Sapiens
aggaugacucagcacugccgcucaacagacaugacucagggauggcuuaguacugccccucagc

SEQ ID NO: 311825 - RNA, 64 nt, Homo Sapiens
aggaugacucagcacugccgcucaacagggaugacucagggauggcuuaguacugccccucaac

SEQ ID NO: 311826 - RNA, 64 nt, Homo Sapiens; identical to SEQ ID NO: 311824

SEQ ID NO: 311827 - RNA, 64 nt, Homo Sapiens; identical to SEQ ID NO: 311824

SEQ ID NO: 311828 - RNA, 64 nt, Homo Sapiens
agccccucagccauccagggcuacccacugcuuacucagggaccaggcagcccccauggcagua

SEQ ID NO: 311829 - RNA, 64 nt, Homo Sapiens
ccucccccuacuucuccccaagggccaagaacugcucagggacauuaaaggucaaaaguccagc

SEQ ID NO: 311830 - RNA, 64 nt, Homo Sapiens
cauaaggagcgugggauccgauggaaagguggagcucagggaaaauggggguccuugccucucg

SEQ ID NO: 311831 - RNA, 64 nt, Homo Sapiens
acucagaggggagggaagggcucaucagcacccgcucagggagccugucccuuuauguucccaa

SEQ ID NO: 311832 - RNA, 64 nt, Homo Sapiens
cacccccaggcuucaaaccaccuggaaugcacagcucagggaagcugguggaugccuagaggcu

SEQ ID NO: 311833 - RNA, 64 nt, Homo Sapiens
gaaggacagggaacucuccauuauuggggcaggacucagggaggacacuuggggccaugugucu

SEQ ID NO: 311834 - RNA, 64 nt, Homo Sapiens
gcccaucugucagcagcgucuucuagguccccagcucagggagccauccccagcuccaguuuuc

SEQ ID NO: 311835 - RNA, 64 nt, Homo Sapiens
acaucuuucuucuuaguuuacagugaaauauuaucucagggauauuuuuuuuuuuuuuuugaga

SEQ ID NO: 311836 - RNA, 64 nt, Homo Sapiens
gggauuacaggcgugagccaccgcgcccggccaucucagggauauuuaaacaaaggaagaggaa

SEQ ID NO: 311837 - RNA, 64 nt, Homo Sapiens
caauaccauaaucaugauaaauauauuauguacacucagggaacauauuugguaaguuuuguac

SEQ ID NO: 311838 - RNA, 64 nt, Homo Sapiens
gcagaccucuccucucucuuaccacuccacugugcucagggaaggcucuccaaagagugugucc

SEQ ID NO: 311839 - RNA, 64 nt, Homo Sapiens
gagaaccacaauagaaaaagcagaacaacagagucucagggaaacagacacccagaguuggaga

SEQ ID NO: 311840 - RNA, 64 nt, Homo Sapiens
gggagacaaugaccuggagggagagaaacagagacucagggagagagagacagagacccaaagg

SEQ ID NO: 311841 - RNA, 64 nt, Homo Sapiens
auuacauccucccauggaggaugagagacugaggcucagggagggcaaggaauaggcccaagau

SEQ ID NO: 311842 - RNA, 64 nt, Homo Sapiens
auggugguauggcugaacaaggagcggcagacaacucagggagaaacucaggagugcaguacca

SEQ ID NO: 311843 - RNA, 64 nt, Homo Sapiens
gaggcccuugggagcaggugcuugggcguuugaacucagggagggccaaucagaucaacucugu

SEQ ID NO: 311844 - RNA, 64 nt, Homo Sapiens
ggcacacuggccuccagaagggucuccucugcagcucagggacuacugcccccuccacuggagg

SEQ ID NO: 311845 - RNA, 64 nt, Homo Sapiens
aggugggaauugaguucaaacuugguagcauaagcucagggauauccaaacauuguaagaauug

SEQ ID NO: 311846 - RNA, 64 nt, Homo Sapiens
ccuccaggggucuucagacccccacgaaaagggucucagggacuaauaauuuuuaaucugcaga

SEQ ID NO: 311847 - RNA, 64 nt, Homo Sapiens
guuaucaaguguuucugcaugguaaugucauguaaaugcugauauugauuucacugguccaucu

SEQ ID NO: 311848 - RNA, 64 nt, Homo Sapiens
gaauggaauuuccuaugcacuacuguagcuaggaaaugcugaaaacaacuguguuuuuuaauua

SEQ ID NO: 311849 - RNA, 64 nt, Homo Sapiens
aaucuaggugaaaucacagaguacaaaacgugagaaugcugaauguguaaaguugcagagggau

SEQ ID NO: 311850 - RNA, 64 nt, Homo Sapiens
agugaacagagcugggauuccaugcgacagcuugaaugcugaccuucagacaugagacauaggg

SEQ ID NO: 311851 - RNA, 64 nt, Homo Sapiens
augcccugaccuccaauaaaaaccucuuuaaaacaaugcugauuuuugaauucaugauuaguuu

SEQ ID NO: 311852 - RNA, 64 nt, Homo Sapiens
gaauuacccugucaugaagcguuuaaauuguuaaaaugcugauuuucuuauuaguuuguuaauu

SEQ ID NO: 311853 - RNA, 64 nt, Homo Sapiens
ucauauguaauugaaauacuucagaucacaugaaaaugcugauuuaacauuuaaguaucacagc

SEQ ID NO: 311854 - RNA, 64 nt, Homo Sapiens
ccagaucugugaaugauagagauuaugcuaaauuaaugcugauucuuugugugugugggaaauc

SEQ ID NO: 311855 - RNA, 64 nt, Homo Sapiens
auuuguuuauuaaaauguguaauggauuguguaaaaugcugaucgcucuagauuuucugaagaa

SEQ ID NO: 311856 - RNA, 64 nt, Homo Sapiens
uguuaugcaaauaaugaaguuguuuucaaacugcaaugcugaaaacuucaucugaaaguucagc

SEQ ID NO: 311857 - RNA, 64 nt, Homo Sapiens
auuuuaacagucuucuuaaauaagagaucauugaaaugcugaaaauggugcuaaaccugacaaa

SEQ ID NO: 311858 - RNA, 64 nt, Homo Sapiens
ucgccucuuccugcuguauguuuucuguaaaugaaaugcugacuuugucuccaccagauaguau

SEQ ID NO: 311859 - RNA, 64 nt, Homo Sapiens
ugauaguaaaucaauuucaguugcuggucccuuuaaugcugauuauaaauaaaagucagaaucu

SEQ ID NO: 311860 - RNA, 64 nt, Homo Sapiens
uuacaggugugagccaccauccuccaccucccaaaaugcugagagggcucaagccaucugccug

SEQ ID NO: 311861 - RNA, 64 nt, Homo Sapiens
ucuaaaacuaaauaaauagaaccaaguauaguaaaaugcugacauguuauucugaagugagagg

SEQ ID NO: 311862 - RNA, 64 nt, Homo Sapiens
uuuuacauaaaaucaaggagaauucccaucaggaaaugcugaccgagaaugaagacuacuuagu

SEQ ID NO: 311863 - RNA, 64 nt, Homo Sapiens
auuacuuauuaucuuggauuuaugguguuauuaaaaugcugaccauauuuccuucauccucuug

SEQ ID NO: 311864 - RNA, 64 nt, Homo Sapiens
aaacaaugaaaacucaauucuauuuacaaguauaaaugcugaguaugucuguugaagacgagca

SEQ ID NO: 311865 - RNA, 64 nt, Homo Sapiens
guaacggaguuaauuuuauuaauuggaggaaaugaaugcugauuuaggguuuaugcuuaauuuu

SEQ ID NO: 311866 - RNA, 64 nt, Homo Sapiens
augagagcggcggagacaagccuucucugaaaacaaugcugagaaaaacaacccagcgaaggcg

SEQ ID NO: 311867 - RNA, 64 nt, Homo Sapiens
auuauuuuggaugcuagcugaugaacaauagaaaaaugcugaacacuaaaguugaauaaaaugc

SEQ ID NO: 311868 - RNA, 64 nt, Homo Sapiens
guaagauggucccauuucaagggacuuaggagaaaaugcugaaucuauuacagagcuauguaaa

SEQ ID NO: 311869 - RNA, 64 nt, Homo Sapiens
aaacaccuagcuuuauucuuuccagaaaugucuaaaugcugaaagcauguaccauuugcauggc

SEQ ID NO: 311870 - RNA, 64 nt, Homo Sapiens
caaaaggauuuuucaacacauuauaugcugcauaaaugcugaugguuggaugagaguaaaaaaa

SEQ ID NO: 311871 - RNA, 64 nt, Homo Sapiens
acugcaaaaucuuggacauaagucguuacaucagaaugcugaugucuuccuuugaccagaugga

SEQ ID NO: 311872 - RNA, 64 nt, Homo Sapiens
ggucugaugugccuaauuuaucuguggaaaauuuaaugcugaauuacauuugguugggaaaugu

SEQ ID NO: 311873 - RNA, 64 nt, Homo Sapiens
uauaaaaguaucuauauaauaucuauaaacuguuaaugcugagguauagucugugaauuaugug

SEQ ID NO: 311874 - RNA, 64 nt, Homo Sapiens
accccaaagaucucauguuauuaaagugucuaauaaugcugaagagaagagaaacuagaaacag

SEQ ID NO: 311875 - RNA, 64 nt, Homo Sapiens
cccugugugagagaaaagaaaaaagguagaucugaaugcugaucgcggacucccagcacagaaa

SEQ ID NO: 311876 - RNA, 64 nt, Homo Sapiens; identical to SEQ ID NO: 276332

SEQ ID NO: 311877 - RNA, 64 nt, Homo Sapiens; identical to SEQ ID NO: 276333

SEQ ID NO: 311878 - RNA, 64 nt, Homo Sapiens; identical to SEQ ID NO: 276334

SEQ ID NO: 311879 - RNA, 64 nt, Homo Sapiens; identical to SEQ ID NO: 276335

SEQ ID NO: 311880 - RNA, 64 nt, Homo Sapiens; identical to SEQ ID NO: 276336

SEQ ID NO: 311881 - RNA, 64 nt, Homo Sapiens; identical to SEQ ID NO: 276337

SEQ ID NO: 311882 - RNA, 64 nt, Homo Sapiens; identical to SEQ ID NO: 276338

SEQ ID NO: 311883 - RNA, 64 nt, Homo Sapiens; identical to SEQ ID NO: 276339

SEQ ID NO: 311884 - RNA, 64 nt, Homo Sapiens; identical to SEQ ID NO: 276340

SEQ ID NO: 311885 - RNA, 64 nt, Homo Sapiens; identical to SEQ ID NO: 276341

SEQ ID NO: 311886 - RNA, 64 nt, Homo Sapiens; identical to SEQ ID NO: 276342

SEQ ID NO: 311887 - RNA, 64 nt, Homo Sapiens; identical to SEQ ID NO: 276343

SEQ ID NO: 311888 - RNA, 64 nt, Homo Sapiens; identical to SEQ ID NO: 276344

SEQ ID NO: 311889 - RNA, 64 nt, Homo Sapiens; identical to SEQ ID NO: 276345

SEQ ID NO: 311890 - RNA, 64 nt, Homo Sapiens; identical to SEQ ID NO: 276346

SEQ ID NO: 311891 - RNA, 64 nt, Homo Sapiens; identical to SEQ ID NO: 276347

SEQ ID NO: 311892 - RNA, 64 nt, Homo Sapiens; identical to SEQ ID NO: 276348

SEQ ID NO: 311893 - RNA, 64 nt, Homo Sapiens; identical to SEQ ID NO: 276349

SEQ ID NO: 311894 - RNA, 64 nt, Homo Sapiens; identical to SEQ ID NO: 276350

SEQ ID NO: 311895 - RNA, 64 nt, Homo Sapiens; identical to SEQ ID NO: 276351

SEQ ID NO: 311896 - RNA, 64 nt, Homo Sapiens; identical to SEQ ID NO: 276352

SEQ ID NO: 311897 - RNA, 64 nt, Homo Sapiens; identical to SEQ ID NO: 276353

SEQ ID NO: 311898 - RNA, 64 nt, Homo Sapiens; identical to SEQ ID NO: 276354

SEQ ID NO: 311899 - RNA, 64 nt, Homo Sapiens; identical to SEQ ID NO: 276355

SEQ ID NO: 311900 - RNA, 64 nt, Homo Sapiens; identical to SEQ ID NO: 276356

SEQ ID NO: 311901 - RNA, 64 nt, Homo Sapiens; identical to SEQ ID NO: 276357

SEQ ID NO: 311902 - RNA, 64 nt, Homo Sapiens; identical to SEQ ID NO: 276358

SEQ ID NO: 311903 - RNA, 64 nt, Homo Sapiens; identical to SEQ ID NO: 276359

SEQ ID NO: 311904 - RNA, 64 nt, Homo Sapiens
gaugaaguuuuauacacacagcaguaaauuugcuagcaguaaaacauuucuuuucuggccaaaa

SEQ ID NO: 311905 - RNA, 64 nt, Homo Sapiens
uugcuagcaguaaaagaugacuuuucuggccaaaagcaguaaauaccccauguccucagcauuu

SEQ ID NO: 311906 - RNA, 64 nt, Homo Sapiens
aacggccaaaucacacagucuagugacaugauugagcaguaaaggauuucuuuccuaaaguccc

SEQ ID NO: 311907 - RNA, 64 nt, Homo Sapiens
agggagcugagagccugguugagcucccacagccagcaguaaucaucugucacugaaggaggug

SEQ ID NO: 311908 - RNA, 64 nt, Homo Sapiens
ucacaaguucuuuccaguuuccaagucuuuuccuagcaguaauuuaggggagacagaggaguuu

SEQ ID NO: 311909 - RNA, 64 nt, Homo Sapiens
gcuuccuuacagucuggaacugacaauaugcaggagcaguaaacuggcagaaaaccaggaauca

SEQ ID NO: 311910 - RNA, 64 nt, Homo Sapiens; identical to SEQ ID NO: 289244

SEQ ID NO: 311911 - RNA, 64 nt, Homo Sapiens; identical to SEQ ID NO: 289245

SEQ ID NO: 311912 - RNA, 64 nt, Homo Sapiens; identical to SEQ ID NO: 289246

SEQ ID NO: 311913 - RNA, 64 nt, Homo Sapiens; identical to SEQ ID NO: 289247

SEQ ID NO: 311914 - RNA, 64 nt, Homo Sapiens; identical to SEQ ID NO: 289248

SEQ ID NO: 311915 - RNA, 64 nt, Homo Sapiens; identical to SEQ ID NO: 289249

SEQ ID NO: 311916 - RNA, 64 nt, Homo Sapiens; identical to SEQ ID NO: 289250

SEQ ID NO: 311917 - RNA, 64 nt, Homo Sapiens; identical to SEQ ID NO: 289251

SEQ ID NO: 311918 - RNA, 64 nt, Homo Sapiens; identical to SEQ ID NO: 289252

SEQ ID NO: 311919 - RNA, 64 nt, Homo Sapiens; identical to SEQ ID NO: 289253

SEQ ID NO: 311920 - RNA, 64 nt, Homo Sapiens; identical to SEQ ID NO: 289254

SEQ ID NO: 311921 - RNA, 64 nt, Homo Sapiens; identical to SEQ ID NO: 289255

SEQ ID NO: 311922 - RNA, 64 nt, Homo Sapiens; identical to SEQ ID NO: 289256

SEQ ID NO: 311923 - RNA, 64 nt, Homo Sapiens; identical to SEQ ID NO: 289257

SEQ ID NO: 311924 - RNA, 64 nt, Homo Sapiens; identical to SEQ ID NO: 289258

SEQ ID NO: 311925 - RNA, 64 nt, Homo Sapiens; identical to SEQ ID NO: 289259

SEQ ID NO: 311926 - RNA, 64 nt, Homo Sapiens; identical to SEQ ID NO: 289260

SEQ ID NO: 311927 - RNA, 64 nt, Homo Sapiens; identical to SEQ ID NO: 289261

SEQ ID NO: 311928 - RNA, 64 nt, Homo Sapiens; identical to SEQ ID NO: 289262

SEQ ID NO: 311929 - RNA, 64 nt, Homo Sapiens; identical to SEQ ID NO: 289263

SEQ ID NO: 311930 - RNA, 64 nt, Homo Sapiens
uaaaccuuuugggagaaaacauuuuguacuuuaaaugugacaaauaucuggaucuguguauuug

SEQ ID NO: 311931 - RNA, 64 nt, Homo Sapiens
gaguacauuuuguguugcugccuuuccuauggaaaugugacauuaguguauaguguauauauaa

SEQ ID NO: 311932 - RNA, 64 nt, Homo Sapiens
cuaacucuaagccuauuuuauuuuuuauaaaacuaugugacauuuugguugagcagaauguacg

SEQ ID NO: 311933 - RNA, 64 nt, Homo Sapiens
auuuggugccugugagcucugauuguaggaaugcaugugacagucccaguccuaugguaaugac

SEQ ID NO: 311934 - RNA, 64 nt, Homo Sapiens
gguuuucaacaacaugcuuagaaggauccuaaggaugugacacugggagaguggccaguuggaa

SEQ ID NO: 311935 - RNA, 64 nt, Homo Sapiens
uuucccuuucccauuguugcucuuucaaacuuucaugugacauaauagcucauuuuauucuagg

SEQ ID NO: 311936 - RNA, 64 nt, Homo Sapiens
cuaaaguuaauacaugaagcucacaugaauaguaaugugacaaaucauuuauuuuguaccucau

SEQ ID NO: 311937 - RNA, 64 nt, Homo Sapiens
acugucauuauaccaguguugucauauuggcuuuaugugacauaguauauucauucauuuaguu

SEQ ID NO: 311938 - RNA, 64 nt, Homo Sapiens
auuauuuauuaccuuuccauuuguucgccugaugaugugacaaugcauggucuuugugcaugcu

SEQ ID NO: 311939 - RNA, 64 nt, Homo Sapiens
uauguacuucuggcaauucuaucuguauuuaaagaugugacaaucuugacaccaauuuuaagaa

SEQ ID NO: 311940 - RNA, 64 nt, Homo Sapiens
guugauuucccucauuguguaaacauugacagguaugugacaaaugggaaaaaaaauccaaaua

SEQ ID NO: 311941 - RNA, 64 nt, Homo Sapiens
guuggggaaacaguccaaacgugagccaaagcuuaugugacaugggcgagaggugagcuacuuu

SEQ ID NO: 311942 - RNA, 64 nt, Homo Sapiens
gcagcagaaaggcucugaagucaugucagcuuauaugugacacuugugugcauacgccucuugu

SEQ ID NO: 311943 - RNA, 64 nt, Homo Sapiens
gcgagcagcugcacugcucaugcaguuagcuagcaugugacaucaugugacaaaguucauguaa

SEQ ID NO: 311944 - RNA, 64 nt, Homo Sapiens
gcacugcucaugcaguuagcuagcaugugacaucaugugacaaaguucauguaauuagauggaa

SEQ ID NO: 311945 - RNA, 64 nt, Homo Sapiens
augucaagaagauaggagaaguuauguucuugugaugugacaaacaacgaaagcuacucucuua

SEQ ID NO: 311946 - RNA, 64 nt, Homo Sapiens
ucauaaaagugagcuuugaauaaaauggugauggaugugacaccuuucaugauuuuauaucucu

SEQ ID NO: 311947 - RNA, 64 nt, Homo Sapiens
uucauacugaaaagaaacucuacaaacuugaaagaugugacagugcuuuugacaacaccuaaaa

SEQ ID NO: 311948 - RNA, 64 nt, Homo Sapiens
aucauacuggugagaaauccuagaaauguaaagaaugugacaaggccuuuaaaugguugucaca

SEQ ID NO: 311949 - RNA, 64 nt, Homo Sapiens
uucauaccauagagaaauccuacaaauaugaagaaugugacaaagcuuuuaaccacuucucaac

SEQ ID NO: 311950 - RNA, 64 nt, Homo Sapiens
uucauacaggagagaaacccuacaaaugugaagaaugugacaaagccuuuaaccaguccucaau

SEQ ID NO: 311951 - RNA, 64 nt, Homo Sapiens
uucuuacugcagagaaacucuacaaaccaguaagaugugacagugcuucugacaacaucucaaa

SEQ ID NO: 311952 - RNA, 64 nt, Homo Sapiens
gccuuuaaauggcugucacauagaaaugugaagaaugugacaaaaucauaugaaugagaaaucc

SEQ ID NO: 311953 - RNA, 64 nt, Homo Sapiens
gcuuuuggcaacaccucagauacaaaccugaaagaugugacaauaauucauacaugagagacuc

SEQ ID NO: 311954 - RNA, 64 nt, Homo Sapiens
ggcuucaaccgguccucaaauacaaacgugaagaaugugacaaauucaugcuggagagaaacac

SEQ ID NO: 311955 - RNA, 64 nt, Homo Sapiens
uuuuucagauaucguucauauacaaguguaauaaaugugacagagaauccauaaugagagaucu

SEQ ID NO: 311956 - RNA, 64 nt, Homo Sapiens
guuuucgguugcaaaucaaauacaaauaggaagaaugugacaaauucauacugcagagaaacuu

SEQ ID NO: 311957 - RNA, 64 nt, Homo Sapiens
guuuucauucacaaauccaguacaaacgugaacaaugugacaaauucauacugcauagaaaucu

SEQ ID NO: 311958 - RNA, 64 nt, Homo Sapiens
guuuuuaaucaacaaucacauacaagcacaaugaaugugacauguucauaguggagagaaaccu

SEQ ID NO: 311959 - RNA, 64 nt, Homo Sapiens
aguuuucaguuguaaaucaauacaaaugggaggaaugugacaaauucauacuggagagaaaccu

SEQ ID NO: 311960 - RNA, 64 nt, Homo Sapiens
acuaugaugucauuuggaaggugaguugcuuucaaugugacaaccccuuuccucacugaaggcu

SEQ ID NO: 311961 - RNA, 64 nt, Homo Sapiens
acacgcacaaacgccuucacaguucagggggaaaaugugacagcugucucaugaaggaucacag

SEQ ID NO: 311962 - RNA, 64 nt, Homo Sapiens
cacuacccuuccaugccccagaccucugucuugcaugugacaauugacaaucuggacuacccca

SEQ ID NO: 311963 - RNA, 64 nt, Homo Sapiens
aaaagcaaaacaaaauggaaaguaggggagguggaugugacaacaacuuccaaauuggcucuuu

SEQ ID NO: 311964 - RNA, 64 nt, Homo Sapiens; identical to SEQ ID NO: 255986

SEQ ID NO: 311965 - RNA, 64 nt, Homo Sapiens; identical to SEQ ID NO: 255987

SEQ ID NO: 311966 - RNA, 64 nt, Homo Sapiens; identical to SEQ ID NO: 255988

SEQ ID NO: 311967 - RNA, 64 nt, Homo Sapiens; identical to SEQ ID NO: 255989

SEQ ID NO: 311968 - RNA, 64 nt, Homo Sapiens; identical to SEQ ID NO: 255990

SEQ ID NO: 311969 - RNA, 64 nt, Homo Sapiens; identical to SEQ ID NO: 255991

SEQ ID NO: 311970 - RNA, 64 nt, Homo Sapiens; identical to SEQ ID NO: 255992

SEQ ID NO: 311971 - RNA, 64 nt, Homo Sapiens; identical to SEQ ID NO: 255993

SEQ ID NO: 311972 - RNA, 64 nt, Homo Sapiens; identical to SEQ ID NO: 255994

SEQ ID NO: 311973 - RNA, 64 nt, Homo Sapiens; identical to SEQ ID NO: 255995

SEQ ID NO: 311974 - RNA, 64 nt, Homo Sapiens; identical to SEQ ID NO: 266128

SEQ ID NO: 311975 - RNA, 64 nt, Homo Sapiens; identical to SEQ ID NO: 266129

SEQ ID NO: 311976 - RNA, 64 nt, Homo Sapiens; identical to SEQ ID NO: 266130

SEQ ID NO: 311977 - RNA, 64 nt, Homo Sapiens; identical to SEQ ID NO: 266131

SEQ ID NO: 311978 - RNA, 64 nt, Homo Sapiens; identical to SEQ ID NO: 266132

SEQ ID NO: 311979 - RNA, 64 nt, Homo Sapiens; identical to SEQ ID NO: 266133

SEQ ID NO: 311980 - RNA, 64 nt, Homo Sapiens; identical to SEQ ID NO: 266134

SEQ ID NO: 311981 - RNA, 64 nt, Homo Sapiens
ucucccguaugagauuucagguccccauguuuucaccaagcaaucugcuaugucagccaaccca

SEQ ID NO: 311982 - RNA, 64 nt, Homo Sapiens
aauaaaaggaagccauagaauugcucuggucaaaaccaagcacaccauagccuuaacugaauau

SEQ ID NO: 311983 - RNA, 64 nt, Homo Sapiens
ucuugucauuuggagucaguggaaaauccagcacaccaagcaccagucuucuucugaggcaaaa

SEQ ID NO: 311984 - RNA, 64 nt, Homo Sapiens
gccaugaaagguaaacacauugugaacugaacuuaccaagcagauucugugagaaagcacuggu

SEQ ID NO: 311985 - RNA, 64 nt, Homo Sapiens
uacuuaauucaacuuaacuaucaucuuauucagcaccaagcaugucccaggcacuguacuaacc

SEQ ID NO: 311986 - RNA, 64 nt, Homo Sapiens
cugauguacucuaaauacugagaaaaccuguucuaccaagcaacaacuccgcaggcaguuacca

SEQ ID NO: 311987 - RNA, 64 nt, Homo Sapiens
acuuugugaaacuggauggaacaaacuuuaacuuaccaagcaccaagugugaaagugacuuuca

SEQ ID NO: 311988 - RNA, 64 nt, Homo Sapiens
uuaauauagguuuucuuucuguauuauaaaaugcaccaagcaauuaugguggaccuauuacccu

SEQ ID NO: 311989 - RNA, 64 nt, Homo Sapiens
guggacccaguucuauuguuggcuucagcgguggaccaagcacugguguuggcuucugcagugg

SEQ ID NO: 311990 - RNA, 64 nt, Homo Sapiens
guggaccaagcacugguguuggcuucugcaguggaccaagcaccaguggcuucagcgguggacc

SEQ ID NO: 311991 - RNA, 64 nt, Homo Sapiens
caccugccucuugagguugcuccauagcuuacugcuugugcagugaaauccuuuuaauuuuuaa

SEQ ID NO: 311992 - RNA, 64 nt, Homo Sapiens
cgacaaugugcuaaccugcuuuuucuuaacuguucuugugcaaucacuguugcuuaccugcuga

SEQ ID NO: 311993 - RNA, 64 nt, Homo Sapiens
uuuaaaauuuccaccuuuuggucuuguuuuuaaucuugugcaugauaccccauguaaaauccac

SEQ ID NO: 311994 - RNA, 64 nt, Homo Sapiens
uaaucuugugcaugauaccccauguaaaauccaccuugugcaagauuucuuggacagaugugug

SEQ ID NO: 311995 - RNA, 64 nt, Homo Sapiens
cacauugaaauugguggcuucauucuagauguagcuugugcagauguagcaggaaaauaggaaa

SEQ ID NO: 311996 - RNA, 64 nt, Homo Sapiens
gccaugaggucuucaauacuguuuuaccccaucccuugugcauauuuccagggagaaggaaagc

SEQ ID NO: 311997 - RNA, 64 nt, Homo Sapiens; identical to SEQ ID NO: 53673

SEQ ID NO: 311998 - RNA, 64 nt, Homo Sapiens; identical to SEQ ID NO: 53674

SEQ ID NO: 311999 - RNA, 64 nt, Homo Sapiens; identical to SEQ ID NO: 53675

SEQ ID NO: 312000 - RNA, 64 nt, Homo Sapiens; identical to SEQ ID NO: 53676

SEQ ID NO: 312001 - RNA, 64 nt, Homo Sapiens; identical to SEQ ID NO: 53677

SEQ ID NO: 312002 - RNA, 64 nt, Homo Sapiens; identical to SEQ ID NO: 53678

SEQ ID NO: 312003 - RNA, 64 nt, Homo Sapiens; identical to SEQ ID NO: 53679

SEQ ID NO: 312004 - RNA, 64 nt, Homo Sapiens; identical to SEQ ID NO: 53680

SEQ ID NO: 312005 - RNA, 64 nt, Homo Sapiens; identical to SEQ ID NO: 53681

SEQ ID NO: 312006 - RNA, 64 nt, Homo Sapiens; identical to SEQ ID NO: 53682

SEQ ID NO: 312007 - RNA, 64 nt, Homo Sapiens; identical to SEQ ID NO: 53683

SEQ ID NO: 312008 - RNA, 64 nt, Homo Sapiens; identical to SEQ ID NO: 53684

SEQ ID NO: 312009 - RNA, 64 nt, Homo Sapiens
caagaaaaaccccaccauaacccaaggcaaacaauguauugacaggauuccaauaauuaagaau

SEQ ID NO: 312010 - RNA, 64 nt, Homo Sapiens
uaccuuucacuugaaaaagaaguauaaaaacaacuguauugaguugaggcuguggagaaauaag

SEQ ID NO: 312011 - RNA, 64 nt, Homo Sapiens
gcaguccacucuguuuucuauugucccuaacuuguguauugauguaaaguguaagugcuuucuu

SEQ ID NO: 312012 - RNA, 64 nt, Homo Sapiens
ugggguuugcuuauuuguuaugucauugauguacuguauugacuuauucauaauguuauuuaag

SEQ ID NO: 312013 - RNA, 64 nt, Homo Sapiens
uuuuacaguauucauuuuucugcuuuggaggauuuguauugagcaaaagauuuagaagugcaug

SEQ ID NO: 312014 - RNA, 64 nt, Homo Sapiens
uuucuaaucuuuagagaccuaacugugagugaacuguauugauuaguuuagugaugucuuggug

SEQ ID NO: 312015 - RNA, 64 nt, Homo Sapiens
auggaugcccuccuuaauagcauuguauuuagucuguauugaucuaaacuggacuagaauagug

SEQ ID NO: 312016 - RNA, 64 nt, Homo Sapiens
cauauuuaacucgcccucuaccugcugaaagcaguguauugacggauagggacugaauauggac

SEQ ID NO: 312017 - RNA, 64 nt, Homo Sapiens
aucugugaaaugcuaagugcgaccuaccucaaaauguauugaggaaaauacauaauuaauauuu

SEQ ID NO: 312018 - RNA, 64 nt, Homo Sapiens
ucuucuguauuuaccuuuugaauauaaucucuauuguauugauuuuuguauguuacucuuauuu

SEQ ID NO: 312019 - RNA, 64 nt, Homo Sapiens
acucaugcgugagauggguguuuacuaacuaaauaccauucacugauagaggauagggagaaua

SEQ ID NO: 312020 - RNA, 64 nt, Homo Sapiens
uaguggucauaaaauagaaugucucaugucaaugaccauucaaucauuuguaaguguaaaaaau

SEQ ID NO: 312021 - RNA, 64 nt, Homo Sapiens
uauugcaaggacagcaucaaagagauggugcuaaaccauucaugaugaacucacccccaugauc

SEQ ID NO: 312022 - RNA, 64 nt, Homo Sapiens
cucccaccaggcuccaccucgaauacuggggauuaccauucagcaugagauuugggcaggaaca

SEQ ID NO: 312023 - RNA, 64 nt, Homo Sapiens
uaaagugcccucacacugcugugcagccaucaccaccauucaucuccagaauuuguucucaguc

SEQ ID NO: 312024 - RNA, 64 nt, Homo Sapiens
ccagaauuuguucucagucccaaacugaaacuauaccauucaaacaacagcgcuccccauuucc

SEQ ID NO: 312025 - RNA, 64 nt, Homo Sapiens
uuugagaagaaaagaacauucucucacuagaguuaccauucauaccuaagccuguucaaguagg

SEQ ID NO: 312026 - RNA, 64 nt, Homo Sapiens
gaggucccuggaaaaaaauaaagagugugcuaacaccauucacacugaucaucgauaagcauuu

SEQ ID NO: 312027 - RNA, 64 nt, Homo Sapiens
uucguuugccccucugacuguuggaaucccacgcaccauucaguaggauucaauucaaugugga

SEQ ID NO: 312028 - RNA, 64 nt, Homo Sapiens
acgcaccauucaguaggauucaauucaauguggaaccauucaacauucaccucauuaaccuaaa

SEQ ID NO: 312029 - RNA, 64 nt, Homo Sapiens
uuuaaacaaaauuuaguaucuuuuggucuuucacaccauucauauguuaaguggcagaauagcc

SEQ ID NO: 312030 - RNA, 64 nt, Homo Sapiens
auuauauuuaguaggggaaaaauugggcucaagaaccauucaucaguacgugagacaagcaguu

SEQ ID NO: 312031 - RNA, 64 nt, Homo Sapiens
ccagcaaucucauuacugggauaaagacagagauaccauucaacuuguggaagacagugugggg

SEQ ID NO: 312032 - RNA, 64 nt, Homo Sapiens
acauaggcacaggcaaagauacaacccaggcaguaccauucaggaacaguaaaaauccuggaag

SEQ ID NO: 312033 - RNA, 64 nt, Homo Sapiens
uacccaaaucaagaaagacaaaauaacaauagaaaccauucacacacuccguucaugcauggac

SEQ ID NO: 312034 - RNA, 64 nt, Homo Sapiens
cuccacuggccgccagccucccuagcacaaggggaccauucagcaaugaguguuuacucauguu

SEQ ID NO: 312035 - RNA, 64 nt, Homo Sapiens
uagauguguguaaugauaccuauuuuuuaucuuaaccauucacaccagcauuugguauuacuac

SEQ ID NO: 312036 - RNA, 64 nt, Homo Sapiens
cacuaaaggacauaagaguuccacaguuugcuuaaccauucaccuauuccaugguauggaugua

SEQ ID NO: 312037 - RNA, 64 nt, Homo Sapiens
cccggagcccccagcagggcuccuuucucagcugaaccccuacuagcagaagcggaaggccgcu

SEQ ID NO: 312038 - RNA, 64 nt, Homo Sapiens
cggagcccccagcagggcccuccuuucucagcugaaccccuaccagcagaagcggaaggccgcu

SEQ ID NO: 312039 - RNA, 64 nt, Homo Sapiens
aucauuuucuuauuguacauaaacaaaaccaaccaaccccuaaaaaaauuaaggggagagagga

SEQ ID NO: 312040 - RNA, 64 nt, Homo Sapiens
ggggaggggcagcuguccauccccuccuccccacaaccccuaguucaggagccaguuucuccag

SEQ ID NO: 312041 - RNA, 64 nt, Homo Sapiens
uaaaggauaaauucaaaaaauagccucaugagacuuggcauacacacucgugggauuccaguua

SEQ ID NO: 312042 - RNA, 64 nt, Homo Sapiens
uaaaaaacaaaacaacaacaauaauuuaucaaaauuggcauauuuaaagccuaacauucuaaua

SEQ ID NO: 312043 - RNA, 64 nt, Homo Sapiens
gcauuuucuaacuuaggaaguuccauuuaaaauuuuggcauauguuagaaaaaaauguagugug

SEQ ID NO: 312044 - RNA, 64 nt, Homo Sapiens
acuuuugguacauuguggcucaaguuauaaguguuuggcauaguggggauguggaauuuuuaua

SEQ ID NO: 312045 - RNA, 64 nt, Homo Sapiens
uguaaaaacaaauacauaaggaggauucugauauuuggcauacuugguacucuuggcauaaagc

SEQ ID NO: 312046 - RNA, 64 nt, Homo Sapiens
gcgaggauucugauauuuggagaugaugguacucuuggcauaaauuaacuaaaccagucuuguu

SEQ ID NO: 312047 - RNA, 64 nt, Homo Sapiens
cuauggagaagugcagaaacuacauaauguuuuauuggcauagucacuguaaaaauaguaugug

SEQ ID NO: 312048 - RNA, 64 nt, Homo Sapiens
cugcaaaccaauuugggcucgcuugcuggaggcuuuggcauagguuguagucuacuagcacagu

SEQ ID NO: 312049 - RNA, 64 nt, Homo Sapiens
uguucgaucaggagccuguuuauuuggaggcuuuuuggcauaguuugauacguguuaguccugu

SEQ ID NO: 312050 - RNA, 64 nt, Homo Sapiens
auuagagaaaccauuuguaaacacauaaaugauuuuggcauaccaguaaagcuaucuggagaga

SEQ ID NO: 312051 - RNA, 64 nt, Homo Sapiens
gaaaauuuuugucuuucauggaaugcaauuugacuuggcauaauugugaguuaauuugauaaag

SEQ ID NO: 312052 - RNA, 64 nt, Homo Sapiens
auuacaguucacacugcagagcuagguuguccuauuggcauaaaacaaaccagcaacuuuucuc

SEQ ID NO: 312053 - RNA, 64 nt, Homo Sapiens
guugcaugauauguaagauuagaaaguuggguucuuggcauagacuucauaucuguugcaugga

SEQ ID NO: 312054 - RNA, 64 nt, Homo Sapiens
gcaacuuuaugauuucugaaauguacucuuuucuuuggcauaguucuaucuacgcuugauucac

SEQ ID NO: 312055 - RNA, 64 nt, Homo Sapiens
acacacacacacacacacacacauacacagacaaaaacacaaaaacucugaggggaucugguga

SEQ ID NO: 312056 - RNA, 64 nt, Homo Sapiens
ggauuaaaacuaaccgugaccacuacuccaaacaaaacacaauaugccuaggggcacggaugaa

SEQ ID NO: 312057 - RNA, 64 nt, Homo Sapiens
cuauuuucucuacggcuuaggcuaugugagggcaaaacacaaaucccuuugcuaaaaagaacca

SEQ ID NO: 312058 - RNA, 64 nt, Homo Sapiens
agugaaauuaucuugagucuacacauuauuuuuaaaacacaaaaauuguucggcuggaacugac

SEQ ID NO: 312059 - RNA, 64 nt, Homo Sapiens
uagccuugacaaauuuuaccuuaaaaccaaaaugaaacacaaaaauuaauccuuaauaaugaua

SEQ ID NO: 312060 - RNA, 64 nt, Homo Sapiens
auguuucucuaagauuuccuuugguuguauuuagaaacacaaauaguuuuauaaucaggauugc

SEQ ID NO: 312061 - RNA, 64 nt, Homo Sapiens
agaaagcaaaguaauaaaaucacaaauguuuggaaaacacaaaaguaacuuguuuaucucaguc

SEQ ID NO: 312062 - RNA, 64 nt, Homo Sapiens
cccuggccagcuuaaccuggucugaggugagacuaaacacaaaaacaguagauaaaucucuccc

SEQ ID NO: 312063 - RNA, 64 nt, Homo Sapiens
caccuuaucuauuagucaccaacaggaaauagcuaaacacaacaggaacccauuacuaauaccu

SEQ ID NO: 312064 - RNA, 64 nt, Homo Sapiens
gguuuuuccuaauuccagagugacuccuguucuuaaacacaaguuguuuccuuaaaaauugauu

SEQ ID NO: 312065 - RNA, 64 nt, Homo Sapiens
cugccaaaaucuuacucugccaguuauguuaccgaaacacaaaauagguguucaucuaagguua

SEQ ID NO: 312066 - RNA, 64 nt, Homo Sapiens
acacuuuaauuuuucguuaaaaccuauucuucauaaacacaagacaucuuaugccugacuauua

SEQ ID NO: 312067 - RNA, 64 nt, Homo Sapiens
uacuuuuuuuaagugauuuuuuuguccuucagccaaacacaauaugggcucaagucacuuuuau

SEQ ID NO: 312068 - RNA, 64 nt, Homo Sapiens
auuaguauuuuccacgucacuguuuauuuuuuuaaaacacaaauucuaaagcuacaacaaauac

SEQ ID NO: 312069 - RNA, 64 nt, Homo Sapiens
cauuauuuccacuugcaggccagcuuaaccucugaaacacaaaugaucuugagaccacuuuagu

SEQ ID NO: 312070 - RNA, 64 nt, Homo Sapiens
uuucauuuuucucuuccugggauucauuuuuucaaaacacaaugcuggaaaaaaaagauuuguu

SEQ ID NO: 312071 - RNA, 62 nt, Homo Sapiens
uuucugguuacuaugaauaaaaauaaaaagcauaaaacacaaaauugcaucuucauuaggaa

SEQ ID NO: 312072 - RNA, 64 nt, Homo Sapiens
agaaugauuuaaauaggauuucuuuuuauuuuuaaaacacaaguacuuucuaaaacuaaaagag

SEQ ID NO: 312073 - RNA, 64 nt, Homo Sapiens
uggcacuuacaauuuuaaagaacuuugaaacacaaaacacaaguuuuuuuguuuuugcuucugg

SEQ ID NO: 312074 - RNA, 64 nt, Homo Sapiens
cacaaguuggcacuuacaaucuucuggaacuuugaaacacaaaaccgaacuuuuuuuguuuuug

SEQ ID NO: 312075 - RNA, 64 nt, Homo Sapiens
accaaaaaggaaaaaaaauccaccaaaccaugauaaacacaaaaugcagcuuccugaugcuuag

SEQ ID NO: 312076 - RNA, 64 nt, Homo Sapiens
uuugaccuuaucuuaauggaaaacgguuaacuccaaacacaaaagacucuacuggaaaguguag

SEQ ID NO: 312077 - RNA, 64 nt, Homo Sapiens
cuacacugggucucaauauccuauuguuuuuccaaaacacaaauucaauuaaugcuaaauaaag

SEQ ID NO: 312078 - RNA, 64 nt, Homo Sapiens
ucaccucuuggagcugcuucaaaacagaaaagagaaacacaagcaagaugaccacaaggggccc

SEQ ID NO: 312079 - RNA, 64 nt, Homo Sapiens
uuuuuuaaaucgugauuucgguuccagaguacuuaaacacaacacgauuuccucugaacacagg

SEQ ID NO: 312080 - RNA, 64 nt, Homo Sapiens
gccgaaaacgccgguaaguuuuucuuuucucaugaaacacaagaggagaugaaggaggacgacg

SEQ ID NO: 312081 - RNA, 64 nt, Homo Sapiens
aucagaagccuucagauagauugaggcucaaaaaaaacacaaagccucuguucuuucaacuccu

SEQ ID NO: 312082 - RNA, 64 nt, Homo Sapiens
ggacaguucuguguugaaaccaggugagcccugaaaacacaaaaacaguucaauaaugaggaaa

SEQ ID NO: 312083 - RNA, 64 nt, Homo Sapiens
uuuuaauacagauugaaaggaacuauuuugaagaaaacacaacaaaaaaucaaaaggcacugug

SEQ ID NO: 312084 - RNA, 64 nt, Homo Sapiens
uguguuuauggcauuuaguagaaaacuugcugaaaaacacaacuacagggaaaacagcuagcuu

SEQ ID NO: 312085 - RNA, 64 nt, Homo Sapiens
cauauauuuuguguucauucuacugagaggaccuaaacacaaugacaccucaguaacaguaagc

SEQ ID NO: 312086 - RNA, 64 nt, Homo Sapiens
uccagaaaacuuuaacauucuucaaagaaauagaaaacacaauccuaaaauuuauaugggaacc

SEQ ID NO: 312087 - RNA, 64 nt, Homo Sapiens
uaaguauuaauacaggauggcaucauggcaauggaaacacaauucagcucuaucuuuguguuua

SEQ ID NO: 312088 - RNA, 64 nt, Homo Sapiens
ugcuggaacucauccucaacgacacuugggaggcaaacacaagcuagaaacuguggagcuuugu

SEQ ID NO: 312089 - RNA, 64 nt, Homo Sapiens
auacuuggacuuauuuauuuagguuuauacacauaaacacaacaacacuuuugugugugugcgc

SEQ ID NO: 312090 - RNA, 64 nt, Homo Sapiens
gucgccucgcaguguuucguuucugucaaucuacaaacacaaguucuuuaacuccaccuccaau

SEQ ID NO: 312091 - RNA, 64 nt, Homo Sapiens
uuuaauuaugguuuucuugaaacguguaaauuaaaaacacaaucaguguucaggcuucaguuau

SEQ ID NO: 312092 - RNA, 64 nt, Homo Sapiens
ugauacccuacacuuucaggggaccgagucugacaaacacaauacauuuaucugugaccuauau

SEQ ID NO: 312093 - RNA, 64 nt, Homo Sapiens
cuuuuacuugaaauguaaaugaaauaaagaaauaaaacacaauaucauacauauaaaugguggu

SEQ ID NO: 312094 - RNA, 64 nt, Homo Sapiens
aauuggccacugguaaaacucuguucuuuaaaugaaacacaagaaauaaagccccuuugugaaa

SEQ ID NO: 312095 - RNA, 64 nt, Homo Sapiens
aucuacacacaucuacacccagcuugggcccugcaaacacaaccuccacacuguguaugugaac

SEQ ID NO: 312096 - RNA, 64 nt, Homo Sapiens
uucaauuccucggcugaacuaauaaaauagaaugaaacacaaaaaggugacuaaauuaaacuaa

SEQ ID NO: 312097 - RNA, 64 nt, Homo Sapiens
uaggcuuugccuuuaaugaucucuuacgguuagaaaacacaauaaaaacaaacuguucggcuac

SEQ ID NO: 312098 - RNA, 64 nt, Homo Sapiens
aaccucuugcuugugugcaaaaguuccuaaaaggaaacacaaguaaugccuauccauuacuagc

SEQ ID NO: 312099 - RNA, 64 nt, Homo Sapiens
auuuugcaaauguaaagaauaugacaaggucuucaaacacaaguuuuucuaauaacucauuaga

SEQ ID NO: 312100 - RNA, 64 nt, Homo Sapiens
aaaaaauuucacaccuugcaaaaggagaucuaaaaaacacaaucagaaaugacaaaggggacau

SEQ ID NO: 312101 - RNA, 64 nt, Homo Sapiens
cucagcccagccaggcccccgacuucuuuuucuaaaacacaaaacacccccaagacugggaggg

SEQ ID NO: 312102 - RNA, 64 nt, Homo Sapiens
agaagaggaaaaaaaagcaaaaaaagcgacaaaaaaacacaaacaacaaaaaagaaaaaaauca

SEQ ID NO: 312103 - RNA, 64 nt, Homo Sapiens
accacccaggaacacgcagaaccaggucacggagaaacacaaacuuuggacaucaaauuuggac

SEQ ID NO: 312104 - RNA, 64 nt, Homo Sapiens
aaagacaaaaaaaaaaaaagaacuugaaaaaaaaaaacacaaaaauuuuuacuggggauucuug

SEQ ID NO: 312105 - RNA, 64 nt, Homo Sapiens
cuuugacuugacuugcgaagggauugaaaaacagaaacacaaaaccagugccaugacugcccgc

SEQ ID NO: 312106 - RNA, 64 nt, Homo Sapiens
cccuccgcccgaguaaauucuauagcgaagcaaaaaacacaagagccccaggcucguuuuccuu

SEQ ID NO: 312107 - RNA, 64 nt, Homo Sapiens
agcugaaacaaacuugacaaguggaaaaguaaagaaacacaaauaacuuauccaaaaauuuuau

SEQ ID NO: 312108 - RNA, 64 nt, Homo Sapiens
augaguuaggucuuuaucaagaaaaccuaagaauaaacacaacaaauuagaaaauguguugaua

SEQ ID NO: 312109 - RNA, 64 nt, Homo Sapiens
ugcuaggaacuugggaaaggaaccagcuucugauaaacacaaucggguuauagcuucaggaggg

SEQ ID NO: 312110 - RNA, 64 nt, Homo Sapiens
aaaucaaauauauaaccaauugugugaacucaccaaacacaagacuccuauuucuccaaagccu

SEQ ID NO: 312111 - RNA, 64 nt, Homo Sapiens
uugauuuuacauuuccuauaucacuaaaauacuuaaacacaaaaauaaaauuccacuccuuuau

SEQ ID NO: 312112 - RNA, 64 nt, Homo Sapiens
uagucuagguaaagaaaaaaaaaaaaaggucaugaaacacaaauguccucaacugucaucauuc

SEQ ID NO: 312113 - RNA, 54 nt, Homo Sapiens
uguguguucuggaucugugaaaguaaacacaaaauauagaaaaaaagaaaagaa

SEQ ID NO: 312114 - RNA, 64 nt, Homo Sapiens
ccugccuugaaugcaugggguugcagcucuguucaaacacaauucuaucagcuccaaaaugugu

SEQ ID NO: 312115 - RNA, 64 nt, Homo Sapiens
ccaaaguagaaaaugguagaagguaguggguagaagucacuauauaaggaaggggaugggauuu

SEQ ID NO: 312116 - RNA, 64 nt, Homo Sapiens
uaaaaguuuuggagagggaaauccaggcuauuaaagucacuaaauuucuaaguauguccauuuc

SEQ ID NO: 312117 - RNA, 64 nt, Homo Sapiens
auauauaagguaugugcuauucucauaucaugguagucacuaacgagcacuuguccacgucuuu

SEQ ID NO: 312118 - RNA, 64 nt, Homo Sapiens
ugcuuucugguuugaaagaucuuacuguugcuuuagucacuaauguacuucagugcaccuacug

SEQ ID NO: 312119 - RNA, 64 nt, Homo Sapiens
gagugguucuugaugcucaccugaagccccuagacgcugcuaggagggggggcccuccugggcc

SEQ ID NO: 312120 - RNA, 64 nt, Homo Sapiens
ggcccuccugggcccccaauaccccuccgcuugccgcugcuagcgcaccccugcaguccagcgu

SEQ ID NO: 312121 - RNA, 64 nt, Homo Sapiens
uagguaguacagguaagggggaaauuguaaagaauuagcagaauuaggcauauguacaaaacca

SEQ ID NO: 312122 - RNA, 64 nt, Homo Sapiens
ucuaacauuugguaaaaggaaguauacuggucuguuagcagagacaaacuuuuuuuagaauuga

SEQ ID NO: 312123 - RNA, 64 nt, Homo Sapiens
uucucaucuuaaaacccuuuauguucaaaauacauuagcagaggccaugaaagugaaaaaaaau

SEQ ID NO: 312124 - RNA, 64 nt, Homo Sapiens
acagcuaccccaucaaagcugaacuugaaacguuuuagcagaauuuuaaauaugugaaaguuca

SEQ ID NO: 312125 - RNA, 64 nt, Homo Sapiens
aggcagagucaggagagguggucuuugaaguaaguuagcagaaaucaaggggacccccgccucc

SEQ ID NO: 312126 - RNA, 64 nt, Homo Sapiens
uuuugguuugaagccacagguguggcuucuggccuuagcagaugguaugcuugcggaccgcagc

SEQ ID NO: 312127 - RNA, 64 nt, Homo Sapiens
ugggcgcauaaccugcgcugaccaguuuaggggcuuagcagaugccugccagcugaccucguug

SEQ ID NO: 312128 - RNA, 64 nt, Homo Sapiens
accucguuggcaggaggguuggguggagauguuuuuagcagagcuuccauuaguguagaccugu

SEQ ID NO: 312129 - RNA, 64 nt, Homo Sapiens
ugcagcccacaggcuuuuuucccgcucuagacuuuuagcagaucgggcuguuuuuccuuguugc

SEQ ID NO: 312130 - RNA, 64 nt, Homo Sapiens
caccucguuaagcuccgggagccuggagugcuuuuuagcagagacucugggcagaucuccaagc

SEQ ID NO: 312131 - RNA, 64 nt, Homo Sapiens
gucaccaaggcuccuccaacaugcgggaggaggcuuagcagacuugcgcugcaccagcgaaucu

SEQ ID NO: 312132 - RNA, 64 nt, Homo Sapiens
acugcuggcuucagccccuugagcagcccauggcuuagcagacccccagauguaggucaguggc

SEQ ID NO: 312133 - RNA, 64 nt, Homo Sapiens; identical to SEQ ID NO: 296379

SEQ ID NO: 312134 - RNA, 64 nt, Homo Sapiens; identical to SEQ ID NO: 296380

SEQ ID NO: 312135 - RNA, 64 nt, Homo Sapiens; identical to SEQ ID NO: 296381

SEQ ID NO: 312136 - RNA, 64 nt, Homo Sapiens; identical to SEQ ID NO: 296382

SEQ ID NO: 312137 - RNA, 64 nt, Homo Sapiens; identical to SEQ ID NO: 296383

SEQ ID NO: 312138 - RNA, 64 nt, Homo Sapiens; identical to SEQ ID NO: 296384

SEQ ID NO: 312139 - RNA, 64 nt, Homo Sapiens; identical to SEQ ID NO: 296385

SEQ ID NO: 312140 - RNA, 64 nt, Homo Sapiens; identical to SEQ ID NO: 296386

SEQ ID NO: 312141 - RNA, 64 nt, Homo Sapiens; identical to SEQ ID NO: 296387

SEQ ID NO: 312142 - RNA, 64 nt, Homo Sapiens; identical to SEQ ID NO: 296388

SEQ ID NO: 312143 - RNA, 64 nt, Homo Sapiens; identical to SEQ ID NO: 296389

SEQ ID NO: 312144 - RNA, 64 nt, Homo Sapiens; identical to SEQ ID NO: 296390

SEQ ID NO: 312145 - RNA, 64 nt, Homo Sapiens; identical to SEQ ID NO: 296391

SEQ ID NO: 312146 - RNA, 64 nt, Homo Sapiens; identical to SEQ ID NO: 296392

SEQ ID NO: 312147 - RNA, 64 nt, Homo Sapiens; identical to SEQ ID NO: 296393

SEQ ID NO: 312148 - RNA, 64 nt, Homo Sapiens; identical to SEQ ID NO: 296394

SEQ ID NO: 312149 - RNA, 64 nt, Homo Sapiens; identical to SEQ ID NO: 296395

SEQ ID NO: 312150 - RNA, 64 nt, Homo Sapiens; identical to SEQ ID NO: 296396

SEQ ID NO: 312151 - RNA, 64 nt, Homo Sapiens; identical to SEQ ID NO: 296397

SEQ ID NO: 312152 - RNA, 64 nt, Homo Sapiens; identical to SEQ ID NO: 296398

SEQ ID NO: 312153 - RNA, 64 nt, Homo Sapiens; identical to SEQ ID NO: 296399

SEQ ID NO: 312154 - RNA, 64 nt, Homo Sapiens; identical to SEQ ID NO: 296400

SEQ ID NO: 312155 - RNA, 64 nt, Homo Sapiens; identical to SEQ ID NO: 296401

SEQ ID NO: 312156 - RNA, 64 nt, Homo Sapiens; identical to SEQ ID NO: 296402

SEQ ID NO: 312157 - RNA, 64 nt, Homo Sapiens; identical to SEQ ID NO: 296403

SEQ ID NO: 312158 - RNA, 64 nt, Homo Sapiens; identical to SEQ ID NO: 296404

SEQ ID NO: 312159 - RNA, 64 nt, Homo Sapiens; identical to SEQ ID NO: 296405

SEQ ID NO: 312160 - RNA, 64 nt, Homo Sapiens; identical to SEQ ID NO: 296406

SEQ ID NO: 312161 - RNA, 64 nt, Homo Sapiens; identical to SEQ ID NO: 296407

SEQ ID NO: 312162 - RNA, 64 nt, Homo Sapiens; identical to SEQ ID NO: 296408

SEQ ID NO: 312163 - RNA, 64 nt, Homo Sapiens; identical to SEQ ID NO: 296409

SEQ ID NO: 312164 - RNA, 64 nt, Homo Sapiens; identical to SEQ ID NO: 296410

SEQ ID NO: 312165 - RNA, 64 nt, Homo Sapiens; identical to SEQ ID NO: 296402

SEQ ID NO: 312166 - RNA, 64 nt, Homo Sapiens; identical to SEQ ID NO: 296403

SEQ ID NO: 312167 - RNA, 64 nt, Homo Sapiens; identical to SEQ ID NO: 296404

SEQ ID NO: 312168 - RNA, 64 nt, Homo Sapiens; identical to SEQ ID NO: 296414

SEQ ID NO: 312169 - RNA, 64 nt, Homo Sapiens; identical to SEQ ID NO: 296415

SEQ ID NO: 312170 - RNA, 64 nt, Homo Sapiens; identical to SEQ ID NO: 296416

SEQ ID NO: 312171 - RNA, 64 nt, Homo Sapiens; identical to SEQ ID NO: 296417

SEQ ID NO: 312172 - RNA, 64 nt, Homo Sapiens; identical to SEQ ID NO: 296418

SEQ ID NO: 312173 - RNA, 64 nt, Homo Sapiens; identical to SEQ ID NO: 296419

SEQ ID NO: 312174 - RNA, 64 nt, Homo Sapiens; identical to SEQ ID NO: 296420

SEQ ID NO: 312175 - RNA, 64 nt, Homo Sapiens; identical to SEQ ID NO: 296421

SEQ ID NO: 312176 - RNA, 64 nt, Homo Sapiens; identical to SEQ ID NO: 296422

SEQ ID NO: 312177 - RNA, 64 nt, Homo Sapiens; identical to SEQ ID NO: 296423

SEQ ID NO: 312178 - RNA, 64 nt, Homo Sapiens; identical to SEQ ID NO: 296424

SEQ ID NO: 312179 - RNA, 64 nt, Homo Sapiens; identical to SEQ ID NO: 296425

SEQ ID NO: 312180 - RNA, 64 nt, Homo Sapiens; identical to SEQ ID NO: 296426

SEQ ID NO: 312181 - RNA, 64 nt, Homo Sapiens; identical to SEQ ID NO: 296427

SEQ ID NO: 312182 - RNA, 64 nt, Homo Sapiens; identical to SEQ ID NO: 296428

SEQ ID NO: 312183 - RNA, 64 nt, Homo Sapiens; identical to SEQ ID NO: 296429

SEQ ID NO: 312184 - RNA, 64 nt, Homo Sapiens; identical to SEQ ID NO: 296430

SEQ ID NO: 312185 - RNA, 64 nt, Homo Sapiens; identical to SEQ ID NO: 296431

SEQ ID NO: 312186 - RNA, 64 nt, Homo Sapiens; identical to SEQ ID NO: 142221

SEQ ID NO: 312187 - RNA, 64 nt, Homo Sapiens; identical to SEQ ID NO: 142222

SEQ ID NO: 312188 - RNA, 64 nt, Homo Sapiens; identical to SEQ ID NO: 142223

SEQ ID NO: 312189 - RNA, 64 nt, Homo Sapiens; identical to SEQ ID NO: 142224

SEQ ID NO: 312190 - RNA, 64 nt, Homo Sapiens; identical to SEQ ID NO: 142225

SEQ ID NO: 312191 - RNA, 64 nt, Homo Sapiens; identical to SEQ ID NO: 142226

SEQ ID NO: 312192 - RNA, 64 nt, Homo Sapiens; identical to SEQ ID NO: 142227

SEQ ID NO: 312193 - RNA, 64 nt, Homo Sapiens; identical to SEQ ID NO: 142228

SEQ ID NO: 312194 - RNA, 64 nt, Homo Sapiens; identical to SEQ ID NO: 142229

SEQ ID NO: 312195 - RNA, 64 nt, Homo Sapiens; identical to SEQ ID NO: 142230

SEQ ID NO: 312196 - RNA, 64 nt, Homo Sapiens; identical to SEQ ID NO: 142231

SEQ ID NO: 312197 - RNA, 64 nt, Homo Sapiens; identical to SEQ ID NO: 142232

SEQ ID NO: 312198 - RNA, 64 nt, Homo Sapiens; identical to SEQ ID NO: 142233

SEQ ID NO: 312199 - RNA, 64 nt, Homo Sapiens; identical to SEQ ID NO: 142234

SEQ ID NO: 312200 - RNA, 64 nt, Homo Sapiens; identical to SEQ ID NO: 142235

SEQ ID NO: 312201 - RNA, 64 nt, Homo Sapiens; identical to SEQ ID NO: 142236

SEQ ID NO: 312202 - RNA, 64 nt, Homo Sapiens; identical to SEQ ID NO: 142237

SEQ ID NO: 312203 - RNA, 64 nt, Homo Sapiens; identical to SEQ ID NO: 142238

SEQ ID NO: 312204 - RNA, 64 nt, Homo Sapiens; identical to SEQ ID NO: 142239

SEQ ID NO: 312205 - RNA, 64 nt, Homo Sapiens; identical to SEQ ID NO: 142240

SEQ ID NO: 312206 - RNA, 64 nt, Homo Sapiens; identical to SEQ ID NO: 142241

SEQ ID NO: 312207 - RNA, 64 nt, Homo Sapiens; identical to SEQ ID NO: 142242

SEQ ID NO: 312208 - RNA, 64 nt, Homo Sapiens; identical to SEQ ID NO: 142243

SEQ ID NO: 312209 - RNA, 64 nt, Homo Sapiens; identical to SEQ ID NO: 142244

SEQ ID NO: 312210 - RNA, 64 nt, Homo Sapiens; identical to SEQ ID NO: 142245

SEQ ID NO: 312211 - RNA, 64 nt, Homo Sapiens; identical to SEQ ID NO: 142246

SEQ ID NO: 312212 - RNA, 64 nt, Homo Sapiens; identical to SEQ ID NO: 142247

SEQ ID NO: 312213 - RNA, 64 nt, Homo Sapiens; identical to SEQ ID NO: 142248

SEQ ID NO: 312214 - RNA, 64 nt, Homo Sapiens; identical to SEQ ID NO: 142249

SEQ ID NO: 312215 - RNA, 64 nt, Homo Sapiens; identical to SEQ ID NO: 142250

SEQ ID NO: 312216 - RNA, 64 nt, Homo Sapiens; identical to SEQ ID NO: 142251

SEQ ID NO: 312217 - RNA, 64 nt, Homo Sapiens; identical to SEQ ID NO: 142252

SEQ ID NO: 312218 - RNA, 64 nt, Homo Sapiens; identical to SEQ ID NO: 142253

SEQ ID NO: 312219 - RNA, 64 nt, Homo Sapiens; identical to SEQ ID NO: 142254

SEQ ID NO: 312220 - RNA, 64 nt, Homo Sapiens; identical to SEQ ID NO: 142255

SEQ ID NO: 312221 - RNA, 64 nt, Homo Sapiens; identical to SEQ ID NO: 142256

SEQ ID NO: 312222 - RNA, 64 nt, Homo Sapiens; identical to SEQ ID NO: 142257

SEQ ID NO: 312223 - RNA, 64 nt, Homo Sapiens; identical to SEQ ID NO: 142258

SEQ ID NO: 312224 - RNA, 64 nt, Homo Sapiens; identical to SEQ ID NO: 142259

SEQ ID NO: 312225 - RNA, 64 nt, Homo Sapiens; identical to SEQ ID NO: 142260

SEQ ID NO: 312226 - RNA, 64 nt, Homo Sapiens; identical to SEQ ID NO: 142261

SEQ ID NO: 312227 - RNA, 64 nt, Homo Sapiens; identical to SEQ ID NO: 142262

SEQ ID NO: 312228 - RNA, 64 nt, Homo Sapiens; identical to SEQ ID NO: 142263

SEQ ID NO: 312229 - RNA, 64 nt, Homo Sapiens; identical to SEQ ID NO: 142264

SEQ ID NO: 312230 - RNA, 64 nt, Homo Sapiens; identical to SEQ ID NO: 142265

SEQ ID NO: 312231 - RNA, 64 nt, Homo Sapiens; identical to SEQ ID NO: 142266

SEQ ID NO: 312232 - RNA, 64 nt, Homo Sapiens; identical to SEQ ID NO: 142267

SEQ ID NO: 312233 - RNA, 64 nt, Homo Sapiens; identical to SEQ ID NO: 142268

SEQ ID NO: 312234 - RNA, 64 nt, Homo Sapiens
cuccccaaauuuuaagcucugaagcaguagauacacuccuuaucgauuggggaaaggggagaga

SEQ ID NO: 312235 - RNA, 64 nt, Homo Sapiens
ugggguaggugggugagauucucuuaaaccuggaacuccuuaaagggugccaccuguuuuuaaa

SEQ ID NO: 312236 - RNA, 64 nt, Homo Sapiens
gugcuuauagaacuagucucguauuaggacuggcacuccuuacgaagggauggaugaaguucau

SEQ ID NO: 312237 - RNA, 64 nt, Homo Sapiens
aggcuuagcccuugucuuacaugcaguaggagagacuccuuaugccaagcuuggggcaagcuug

SEQ ID NO: 312238 - RNA, 64 nt, Homo Sapiens
cugaugucuguauauguugcugcuuuuuuuuagaacuccuuacucuuuauuauaauaaaccuga

SEQ ID NO: 312239 - RNA, 64 nt, Homo Sapiens
ugaggaaaugcuacuaauaugaaauaauauauaaacuccuuauguuuggaaacagaguaaugaa

SEQ ID NO: 312240 - RNA, 64 nt, Homo Sapiens
auugagguuaagauauagcuagugucugaacgacacuccuuaaaguaaguuccaaauguaaaac

SEQ ID NO: 312241 - RNA, 64 nt, Homo Sapiens
cgacacuccuuaaaguaaguuccaaauguaaaacacuccuuaaguuccaaauguuuuccgcuaa

SEQ ID NO: 312242 - RNA, 64 nt, Homo Sapiens
auuucauagaaaaaugacugguaagcacuccuuaacuccuuaguccucuaauaguaaugguuca

SEQ ID NO: 312243 - RNA, 64 nt, Homo Sapiens
uccuuaguauuucauagaaaaugguucaguaagcacuccuuaaccuucccucccucuaauagua

SEQ ID NO: 312244 - RNA, 64 nt, Homo Sapiens
aaggaccugugacaugcccaaauagggaccugugacuccuuaauuggaauaugucacacuccuu

SEQ ID NO: 312245 - RNA, 64 nt, Homo Sapiens
agggaccugugacuccuuaaauggaauaugucacacuccuuaaucaauucuaccaagacacuca

SEQ ID NO: 312246 - RNA, 64 nt, Homo Sapiens
cggccuccugucugcaugcccccuguggccaccaggcuccgaggggccguggugacucuugauc

SEQ ID NO: 312247 - RNA, 64 nt, Homo Sapiens
ggggcagcucaguacccucccugaggcucacgguggcuccgagcaugagguccgccuccugggc

SEQ ID NO: 312248 - RNA, 64 nt, Homo Sapiens
cugacucuuuuucuuguuuugucugccauucuugaaagugcaucuugagagcccccauuuguug

SEQ ID NO: 312249 - RNA, 64 nt, Homo Sapiens
uuuugugauccuuuaauauuauccaugcuuuuauaaagugcaguacacauuuugacauugccac

SEQ ID NO: 312250 - RNA, 64 nt, Homo Sapiens
uacaaaaggauuguuuuaauccccauuauucuggaaagugcauccuagucucccagucuauaac

SEQ ID NO: 312251 - RNA, 64 nt, Homo Sapiens
gcaagugcccuugagaacuuguagagggaguaaaaaagugcauggauaaaugacugcagcaaau

SEQ ID NO: 312252 - RNA, 64 nt, Homo Sapiens
cuuauauuugagaauuaaugagaacuacaacacaaaagugcagaauuugguauucacaucucag

SEQ ID NO: 312253 - RNA, 64 nt, Homo Sapiens
gauagggaccuuugucucuuugugucaccaacaaaaagugcauuuugauuccuaagguuuccag

SEQ ID NO: 312254 - RNA, 64 nt, Homo Sapiens
auuaaauguuugcuuuauagaauguuagcaaaacaaagugcaauuuaggaaaaguaaaauccaa

SEQ ID NO: 312255 - RNA, 64 nt, Homo Sapiens
uauuuuuauacagaguuacuggggaaaggagggaaaagugcauuauggaaguuuuccauucacu

SEQ ID NO: 312256 - RNA, 64 nt, Homo Sapiens
caagacggaaaaggacuuucuucuguuuucuuccaaagugcaaccacaguggagagcccacggu

SEQ ID NO: 312257 - RNA, 64 nt, Homo Sapiens
auuucucuucuuugaccgugcuaggaauuccaggaaagugcauuccugcccuggugaccuuuuc

SEQ ID NO: 312258 - RNA, 64 nt, Homo Sapiens
ucacugaaauaaugagauuuaugguuugaaacuuaaagugcacaacuuuuuccuuuuuucucac

SEQ ID NO: 312259 - RNA, 64 nt, Homo Sapiens
gaagaucauuuauuacuuuuuggucaugcaucuaaaagugcaugaucaaaucaguaacugguca

SEQ ID NO: 312260 - RNA, 64 nt, Homo Sapiens
agaaccguuguuaauuuuaaaacuagcaaucuauaaagugcaccaggucaacuugaauaaaaac

SEQ ID NO: 312261 - RNA, 64 nt, Homo Sapiens
aucaagagcaaaacugcacaaacuugcacauuggaaagugcaacaaguucccgugauugcagua

SEQ ID NO: 312262 - RNA, 64 nt, Homo Sapiens
agaaaaaccuaccaauuaacauguaucuuaaugaaaagugcaaaugucuaccugcucguuccca

SEQ ID NO: 312263 - RNA, 64 nt, Homo Sapiens
gaacuucaaaacaaaacaaaucuuacuguaaaaaaaagugcacuauguuccuaaauuuuuguaa

SEQ ID NO: 312264 - RNA, 64 nt, Homo Sapiens
uaagauagaguuuuuauuaaacaaaaagcaugugaaagugcacuuuguuguuuguuuauuauaa

SEQ ID NO: 312265 - RNA, 64 nt, Homo Sapiens
uggccaaaugaaaugguaguuaaguuuacuggggaaagugcauuuguuguucucguuguuguuu

SEQ ID NO: 312266 - RNA, 64 nt, Homo Sapiens
cugaggugugacauggcccccaagcagagcggguaaagugcaauggguaagggagggaagggga

SEQ ID NO: 312267 - RNA, 64 nt, Homo Sapiens
aaaccagcagggaguuagcacugaacugcuuuuaaaagugcacauuaaaaaggaaaguuugcca

SEQ ID NO: 312268 - RNA, 64 nt, Homo Sapiens; identical to SEQ ID NO: 217813

SEQ ID NO: 312269 - RNA, 64 nt, Homo Sapiens; identical to SEQ ID NO: 217814

SEQ ID NO: 312270 - RNA, 64 nt, Homo Sapiens; identical to SEQ ID NO: 217815

SEQ ID NO: 312271 - RNA, 64 nt, Homo Sapiens; identical to SEQ ID NO: 217816

SEQ ID NO: 312272 - RNA, 64 nt, Homo Sapiens; identical to SEQ ID NO: 217817

SEQ ID NO: 312273 - RNA, 64 nt, Homo Sapiens; identical to SEQ ID NO: 217818

SEQ ID NO: 312274 - RNA, 64 nt, Homo Sapiens; identical to SEQ ID NO: 217819

SEQ ID NO: 312275 - RNA, 64 nt, Homo Sapiens; identical to SEQ ID NO: 217820

SEQ ID NO: 312276 - RNA, 64 nt, Homo Sapiens; identical to SEQ ID NO: 217821

SEQ ID NO: 312277 - RNA, 64 nt, Homo Sapiens; identical to SEQ ID NO: 217822

SEQ ID NO: 312278 - RNA, 64 nt, Homo Sapiens; identical to SEQ ID NO: 217823

SEQ ID NO: 312279 - RNA, 64 nt, Homo Sapiens; identical to SEQ ID NO: 217824

SEQ ID NO: 312280 - RNA, 64 nt, Homo Sapiens; identical to SEQ ID NO: 217825

SEQ ID NO: 312281 - RNA, 64 nt, Homo Sapiens; identical to SEQ ID NO: 217826

SEQ ID NO: 312282 - RNA, 64 nt, Homo Sapiens; identical to SEQ ID NO: 217827

SEQ ID NO: 312283 - RNA, 64 nt, Homo Sapiens; identical to SEQ ID NO: 217828

SEQ ID NO: 312284 - RNA, 64 nt, Homo Sapiens; identical to SEQ ID NO: 217829

SEQ ID NO: 312285 - RNA, 64 nt, Homo Sapiens; identical to SEQ ID NO: 217830

SEQ ID NO: 312286 - RNA, 64 nt, Homo Sapiens; identical to SEQ ID NO: 217831

SEQ ID NO: 312287 - RNA, 64 nt, Homo Sapiens; identical to SEQ ID NO: 217832

SEQ ID NO: 312288 - RNA, 64 nt, Homo Sapiens; identical to SEQ ID NO: 217833

SEQ ID NO: 312289 - RNA, 64 nt, Homo Sapiens; identical to SEQ ID NO: 217834

SEQ ID NO: 312290 - RNA, 64 nt, Homo Sapiens; identical to SEQ ID NO: 217835

SEQ ID NO: 312291 - RNA, 64 nt, Homo Sapiens; identical to SEQ ID NO: 217836

SEQ ID NO: 312292 - RNA, 64 nt, Homo Sapiens; identical to SEQ ID NO: 217837

SEQ ID NO: 312293 - RNA, 64 nt, Homo Sapiens; identical to SEQ ID NO: 217838

SEQ ID NO: 312294 - RNA, 64 nt, Homo Sapiens; identical to SEQ ID NO: 217839

SEQ ID NO: 312295 - RNA, 64 nt, Homo Sapiens; identical to SEQ ID NO: 217840

SEQ ID NO: 312296 - RNA, 64 nt, Homo Sapiens; identical to SEQ ID NO: 217841

SEQ ID NO: 312297 - RNA, 63 nt, Homo Sapiens; identical to SEQ ID NO: 217842

SEQ ID NO: 312298 - RNA, 64 nt, Homo Sapiens; identical to SEQ ID NO: 217843

SEQ ID NO: 312299 - RNA, 64 nt, Homo Sapiens; identical to SEQ ID NO: 217844

SEQ ID NO: 312300 - RNA, 64 nt, Homo Sapiens; identical to SEQ ID NO: 217845

SEQ ID NO: 312301 - RNA, 64 nt, Homo Sapiens; identical to SEQ ID NO: 217846

SEQ ID NO: 312302 - RNA, 64 nt, Homo Sapiens; identical to SEQ ID NO: 217847

SEQ ID NO: 312303 - RNA, 64 nt, Homo Sapiens; identical to SEQ ID NO: 217848

SEQ ID NO: 312304 - RNA, 64 nt, Homo Sapiens; identical to SEQ ID NO: 217849

SEQ ID NO: 312305 - RNA, 64 nt, Homo Sapiens; identical to SEQ ID NO: 217850

SEQ ID NO: 312306 - RNA, 64 nt, Homo Sapiens; identical to SEQ ID NO: 217851

SEQ ID NO: 312307 - RNA, 64 nt, Homo Sapiens; identical to SEQ ID NO: 217852

SEQ ID NO: 312308 - RNA, 64 nt, Homo Sapiens; identical to SEQ ID NO: 217853

SEQ ID NO: 312309 - RNA, 64 nt, Homo Sapiens; identical to SEQ ID NO: 217854

SEQ ID NO: 312310 - RNA, 64 nt, Homo Sapiens; identical to SEQ ID NO: 217855

SEQ ID NO: 312311 - RNA, 64 nt, Homo Sapiens; identical to SEQ ID NO: 217856

SEQ ID NO: 312312 - RNA, 64 nt, Homo Sapiens; identical to SEQ ID NO: 217857

SEQ ID NO: 312313 - RNA, 64 nt, Homo Sapiens; identical to SEQ ID NO: 217858

SEQ ID NO: 312314 - RNA, 64 nt, Homo Sapiens; identical to SEQ ID NO: 217859

SEQ ID NO: 312315 - RNA, 64 nt, Homo Sapiens; identical to SEQ ID NO: 217860

SEQ ID NO: 312316 - RNA, 64 nt, Homo Sapiens; identical to SEQ ID NO: 217861

SEQ ID NO: 312317 - RNA, 64 nt, Homo Sapiens; identical to SEQ ID NO: 217862

SEQ ID NO: 312318 - RNA, 64 nt, Homo Sapiens; identical to SEQ ID NO: 217863

SEQ ID NO: 312319 - RNA, 64 nt, Homo Sapiens; identical to SEQ ID NO: 217864

SEQ ID NO: 312320 - RNA, 64 nt, Homo Sapiens; identical to SEQ ID NO: 217865

SEQ ID NO: 312321 - RNA, 64 nt, Homo Sapiens
gaaacuugcuguaguaacuuuuugaacgcuguaagcuguguacuguuauaagugugcuuccuau

SEQ ID NO: 312322 - RNA, 64 nt, Homo Sapiens
uugcuggaaaugccugaccucucagucuggcucugcuguguaguccauagcccagccagaugag

SEQ ID NO: 312323 - RNA, 64 nt, Homo Sapiens
gcucuucgaguuuguggggaagaugcuggggaaggcuguguaugagguaggaacguuaagaaac

SEQ ID NO: 312324 - RNA, 64 nt, Homo Sapiens
uugggagucugucuuuccuuagccgucugagugagcuguguaugaacaagucccaggaguucca

SEQ ID NO: 312325 - RNA, 64 nt, Homo Sapiens
cucccauugacuagauggacuuuauuuuggaguggcuguguacucccuuaugauuacuaaauau

SEQ ID NO: 312326 - RNA, 64 nt, Homo Sapiens
agaaaugcccauacgacagcagcauacgcucuuugcuguguagagcgucugcagccacccaggu

SEQ ID NO: 312327 - RNA, 64 nt, Homo Sapiens
uuuggugcucuauugauuggaagaauauagguuugcuguguaggacuuuucuuguugacaaagc

SEQ ID NO: 312328 - RNA, 64 nt, Homo Sapiens
gaauaguauuccccgcuacaugcaguaauccauggcuguguacuccgucucucugcccuuccuu

SEQ ID NO: 312329 - RNA, 64 nt, Homo Sapiens
cgacaagccacaaggaccaauguagguauucuccccgccccaucuucaaggcucagcgacugag

SEQ ID NO: 312330 - RNA, 64 nt, Homo Sapiens
agcaauuguucccucuggagggguccaggugcccccgccccacaaggccgcggagccucagcag

SEQ ID NO: 312331 - RNA, 64 nt, Homo Sapiens
aaaacaguucuuuuguuaagauacuccuccugccccgccccauuuaacuucaguguuuucuaca

SEQ ID NO: 312332 - RNA, 64 nt, Homo Sapiens
ccucaccagagaaaagaaucggcccucagucaccccgccccauugugaccuggagcagucagag

SEQ ID NO: 312333 - RNA, 64 nt, Homo Sapiens
ucccuuccagcaaacucaaccgggccccccgacgccgccccauucgacuggcagccaggccugu

SEQ ID NO: 312334 - RNA, 64 nt, Homo Sapiens
ccgagucgcuaaggggcugccguucgugacucagccgccccaucgccgcaccugcccgccucgg

SEQ ID NO: 312335 - RNA, 64 nt, Homo Sapiens
acccggccuuggucccuggcgggcaguccccuguccgccccaaacuccuccuugccgcugugug

SEQ ID NO: 312336 - RNA, 64 nt, Homo Sapiens
cacgcacgcacacucggggaggcggcgggugggcccgccccacgagccccgccccgggcagggg

SEQ ID NO: 312337 - RNA, 64 nt, Homo Sapiens
cccgcccccagcccugcaugcaggugcccucgcuccgccccaucaguuccugccccugccccuc

SEQ ID NO: 312338 - RNA, 64 nt, Homo Sapiens
gcacgcacgcacgcacacggccccgcacacagccccgccccaccccgcaaccagcccugucgac

SEQ ID NO: 312339 - RNA, 61 nt, Homo Sapiens
cgccgccugccgcccgcugagcaccgaggacccgccccaagcagagccgccccugggcccg

SEQ ID NO: 312340 - RNA, 64 nt, Homo Sapiens
aaccucggccgugacauucggggccgggcgggacccgccccacagacuccaacuuccccuccaa

SEQ ID NO: 312341 - RNA, 64 nt, Homo Sapiens
acugagagggggaagaagcggggaggaagaaaucccgccccaaacguccgcuuuccuuuucucu

SEQ ID NO: 312342 - RNA, 64 nt, Homo Sapiens
gggagcccucgcccccgacucucggucggccuccccgccccaggcgucacucagugaucacggg

SEQ ID NO: 312343 - RNA, 64 nt, Homo Sapiens
gcauccuucucggagcuggugcagguuccccaccccgccccacccccagagcugggcccccugg

SEQ ID NO: 312344 - RNA, 64 nt, Homo Sapiens
gcugggcccccugggcaggugaggcgcccccgccccgccccagacccggaccgcgggccggaag

SEQ ID NO: 312345 - RNA, 64 nt, Homo Sapiens
cuuaguccccagggccaagcgauuuuggcugaagccgccccagccauucauuugggggguggga

SEQ ID NO: 312346 - RNA, 64 nt, Homo Sapiens
aaucccauugcauagguuuacccgugaccgccccccgccccaucacugugaauccugugcucug

SEQ ID NO: 312347 - RNA, 64 nt, Homo Sapiens
aggaagggcgaacuuucuagcucuuacguacaacugacagcaaauccuuaauguggacgaauuu

SEQ ID NO: 312348 - RNA, 64 nt, Homo Sapiens
caaacucuggggugcaugugugugauuggacaguugacagcaccgcugaggcucucccuuucuc

SEQ ID NO: 312349 - RNA, 64 nt, Homo Sapiens
gaaauaggugaggcaggguuuccuccuuagacacugacagcauucucuguaccccuucaaaucc

SEQ ID NO: 312350 - RNA, 64 nt, Homo Sapiens
gggcauuuaguccuacccagccaucggcugcguaugacagcaggauggcacuucccauuucucu

SEQ ID NO: 312351 - RNA, 64 nt, Homo Sapiens
ucuacaaagcuguaguucacauuaauguuaauuaugacagcagaaauuucaguguagcuucaag

SEQ ID NO: 312352 - RNA, 64 nt, Homo Sapiens
gaaccuauuccuguuguugcaguacagucuuaagugacagcacugggcguauuucgaaaaccag

SEQ ID NO: 312353 - RNA, 64 nt, Homo Sapiens
gcuguggggguggcccacugccuucccccugugcugacagcauugaacauggcccaggcccuuu

SEQ ID NO: 312354 - RNA, 64 nt, Homo Sapiens
agccggcuguuugggggaugccugugggaggggcugacagcagcucaacaaagcaaacagagag

SEQ ID NO: 312355 - RNA, 64 nt, Homo Sapiens
agucugaguugcuguuugguucuauuuccagaagugacagcacagugcucuuugaaugcagacu

SEQ ID NO: 312356 - RNA, 64 nt, Homo Sapiens
agacuggcggcauggugcuugcccagcagcccauugacagcauuuagggugguuucccucucag

SEQ ID NO: 312357 - RNA, 64 nt, Homo Sapiens
ccuggcuguguugccccucucucaucccucuuugugacagcagaaaaaugucaucuccccccac

SEQ ID NO: 312358 - RNA, 64 nt, Homo Sapiens
uagauuugggcagugaacagaugcugccaucuggugacagcauggcauccaggaaaagugggga

SEQ ID NO: 312359 - RNA, 64 nt, Homo Sapiens
ccuggggguggcagggguggggcagagagaauacugacagcagaggucuuggugggcugcacgu

SEQ ID NO: 312360 - RNA, 64 nt, Homo Sapiens
gggguaucaucugcucgguggggccacccacaggugacagcauggacccucaggcuggcugccc

SEQ ID NO: 312361 - RNA, 64 nt, Homo Sapiens
aagagcagggcccaugaccgucuuuggacuaggcugacagcaggcuaagcaguucccucauugc

SEQ ID NO: 312362 - RNA, 64 nt, Homo Sapiens
caccccuguguggcccccaggaugggcuuguaccugacagcacccaagguuauuugcaggcagg

SEQ ID NO: 312363 - RNA, 64 nt, Homo Sapiens
aggaauaaaccguuuguuucucaguuguuuguguugacagcauucuucgugcuggcuuagacuc

SEQ ID NO: 312364 - RNA, 64 nt, Homo Sapiens
cucagcauuaaaacuggugauggaugcccuuggaugacagcaucuaaucugcuuuuccaagcac

SEQ ID NO: 312365 - RNA, 64 nt, Homo Sapiens
ugcauggucacuugagcccaucuuaggaaggaggugacagcacugacuugggagaaggaugggg

SEQ ID NO: 312366 - RNA, 64 nt, Homo Sapiens
cccaguaggguaggauuguggauuucacuaauuuugacagcaccccugcccaucaacuguaucu

SEQ ID NO: 312367 - RNA, 64 nt, Homo Sapiens
agaaaugaagagaaccuucuuuuucucuugacuuugacagcacaugcuaaaaaucucuuccaag

SEQ ID NO: 312368 - RNA, 64 nt, Homo Sapiens
gcuaugagcuccagugcuuuugccaaaauucucuugacagcacaccuccucucuuuccauguua

SEQ ID NO: 312369 - RNA, 62 nt, Homo Sapiens
cugaaacagcuaaaaaaaugaauuugaauugcgccagauaggucaauaccaagcuucugauu

SEQ ID NO: 312370 - RNA, 62 nt, Homo Sapiens
ugcuguuucuaauauaauuauuuucuaagauagccagauaguuagaaaaagauuuucauuga

SEQ ID NO: 312371 - RNA, 62 nt, Homo Sapiens
uuguugauaaagagauguuaaauaauugugaagccagauaugcaauguguaucugaaaagca

SEQ ID NO: 312372 - RNA, 62 nt, Homo Sapiens
cagauccuguauuaauuacucuuaguggagaugccagauaucccauacagaauuagcagaga

SEQ ID NO: 312373 - RNA, 64 nt, Homo Sapiens; identical to SEQ ID NO: 50556

SEQ ID NO: 312374 - RNA, 64 nt, Homo Sapiens; identical to SEQ ID NO: 50557

SEQ ID NO: 312375 - RNA, 64 nt, Homo Sapiens; identical to SEQ ID NO: 50558

SEQ ID NO: 312376 - RNA, 64 nt, Homo Sapiens; identical to SEQ ID NO: 50559

SEQ ID NO: 312377 - RNA, 64 nt, Homo Sapiens; identical to SEQ ID NO: 50560

SEQ ID NO: 312378 - RNA, 64 nt, Homo Sapiens; identical to SEQ ID NO: 50561

SEQ ID NO: 312379 - RNA, 64 nt, Homo Sapiens; identical to SEQ ID NO: 50562

SEQ ID NO: 312380 - RNA, 64 nt, Homo Sapiens; identical to SEQ ID NO: 50563

SEQ ID NO: 312381 - RNA, 64 nt, Homo Sapiens; identical to SEQ ID NO: 50564

SEQ ID NO: 312382 - RNA, 64 nt, Homo Sapiens; identical to SEQ ID NO: 50565

SEQ ID NO: 312383 - RNA, 64 nt, Homo Sapiens; identical to SEQ ID NO: 50566

SEQ ID NO: 312384 - RNA, 64 nt, Homo Sapiens; identical to SEQ ID NO: 50567

SEQ ID NO: 312385 - RNA, 64 nt, Homo Sapiens; identical to SEQ ID NO: 50568

SEQ ID NO: 312386 - RNA, 64 nt, Homo Sapiens; identical to SEQ ID NO: 50569

SEQ ID NO: 312387 - RNA, 64 nt, Homo Sapiens; identical to SEQ ID NO: 50570

SEQ ID NO: 312388 - RNA, 64 nt, Homo Sapiens; identical to SEQ ID NO: 50571

SEQ ID NO: 312389 - RNA, 64 nt, Homo Sapiens; identical to SEQ ID NO: 50572

SEQ ID NO: 312390 - RNA, 64 nt, Homo Sapiens; identical to SEQ ID NO: 50573

SEQ ID NO: 312391 - RNA, 64 nt, Homo Sapiens; identical to SEQ ID NO: 50574

SEQ ID NO: 312392 - RNA, 64 nt, Homo Sapiens; identical to SEQ ID NO: 50575

SEQ ID NO: 312393 - RNA, 64 nt, Homo Sapiens; identical to SEQ ID NO: 50576

SEQ ID NO: 312394 - RNA, 64 nt, Homo Sapiens; identical to SEQ ID NO: 50577

SEQ ID NO: 312395 - RNA, 64 nt, Homo Sapiens; identical to SEQ ID NO: 50578

SEQ ID NO: 312396 - RNA, 64 nt, Homo Sapiens; identical to SEQ ID NO: 50579

SEQ ID NO: 312397 - RNA, 64 nt, Homo Sapiens; identical to SEQ ID NO: 50580

SEQ ID NO: 312398 - RNA, 64 nt, Homo Sapiens; identical to SEQ ID NO: 50581

SEQ ID NO: 312399 - RNA, 64 nt, Homo Sapiens; identical to SEQ ID NO: 50582

SEQ ID NO: 312400 - RNA, 64 nt, Homo Sapiens; identical to SEQ ID NO: 50583

SEQ ID NO: 312401 - RNA, 64 nt, Homo Sapiens; identical to SEQ ID NO: 50584

SEQ ID NO: 312402 - RNA, 64 nt, Homo Sapiens; identical to SEQ ID NO: 50585

SEQ ID NO: 312403 - RNA, 64 nt, Homo Sapiens; identical to SEQ ID NO: 50586

SEQ ID NO: 312404 - RNA, 64 nt, Homo Sapiens; identical to SEQ ID NO: 50587

SEQ ID NO: 312405 - RNA, 64 nt, Homo Sapiens; identical to SEQ ID NO: 50588

SEQ ID NO: 312406 - RNA, 64 nt, Homo Sapiens; identical to SEQ ID NO: 50589

SEQ ID NO: 312407 - RNA, 64 nt, Homo Sapiens; identical to SEQ ID NO: 50590

SEQ ID NO: 312408 - RNA, 64 nt, Homo Sapiens; identical to SEQ ID NO: 50591

SEQ ID NO: 312409 - RNA, 64 nt, Homo Sapiens; identical to SEQ ID NO: 50592

SEQ ID NO: 312410 - RNA, 64 nt, Homo Sapiens; identical to SEQ ID NO: 50593

SEQ ID NO: 312411 - RNA, 64 nt, Homo Sapiens; identical to SEQ ID NO: 50594

SEQ ID NO: 312412 - RNA, 64 nt, Homo Sapiens; identical to SEQ ID NO: 50595

SEQ ID NO: 312413 - RNA, 64 nt, Homo Sapiens; identical to SEQ ID NO: 50596

SEQ ID NO: 312414 - RNA, 64 nt, Homo Sapiens; identical to SEQ ID NO: 50597

SEQ ID NO: 312415 - RNA, 64 nt, Homo Sapiens; identical to SEQ ID NO: 50598

SEQ ID NO: 312416 - RNA, 64 nt, Homo Sapiens; identical to SEQ ID NO: 50599

SEQ ID NO: 312417 - RNA, 64 nt, Homo Sapiens; identical to SEQ ID NO: 50600

SEQ ID NO: 312418 - RNA, 64 nt, Homo Sapiens; identical to SEQ ID NO: 50601

SEQ ID NO: 312419 - RNA, 64 nt, Homo Sapiens; identical to SEQ ID NO: 50602

SEQ ID NO: 312420 - RNA, 64 nt, Homo Sapiens; identical to SEQ ID NO: 50603

SEQ ID NO: 312421 - RNA, 64 nt, Homo Sapiens; identical to SEQ ID NO: 50604

SEQ ID NO: 312422 - RNA, 64 nt, Homo Sapiens; identical to SEQ ID NO: 50605

SEQ ID NO: 312423 - RNA, 64 nt, Homo Sapiens; identical to SEQ ID NO: 50606

SEQ ID NO: 312424 - RNA, 64 nt, Homo Sapiens; identical to SEQ ID NO: 50607

SEQ ID NO: 312425 - RNA, 64 nt, Homo Sapiens; identical to SEQ ID NO: 50608

SEQ ID NO: 312426 - RNA, 64 nt, Homo Sapiens; identical to SEQ ID NO: 50609

SEQ ID NO: 312427 - RNA, 64 nt, Homo Sapiens; identical to SEQ ID NO: 50610

SEQ ID NO: 312428 - RNA, 64 nt, Homo Sapiens; identical to SEQ ID NO: 50611

SEQ ID NO: 312429 - RNA, 64 nt, Homo Sapiens; identical to SEQ ID NO: 50612

SEQ ID NO: 312430 - RNA, 64 nt, Homo Sapiens; identical to SEQ ID NO: 50613

SEQ ID NO: 312431 - RNA, 64 nt, Homo Sapiens; identical to SEQ ID NO: 50614

SEQ ID NO: 312432 - RNA, 64 nt, Homo Sapiens; identical to SEQ ID NO: 50615

SEQ ID NO: 312433 - RNA, 64 nt, Homo Sapiens; identical to SEQ ID NO: 50616

SEQ ID NO: 312434 - RNA, 64 nt, Homo Sapiens; identical to SEQ ID NO: 50617

SEQ ID NO: 312435 - RNA, 64 nt, Homo Sapiens; identical to SEQ ID NO: 50618

SEQ ID NO: 312436 - RNA, 64 nt, Homo Sapiens; identical to SEQ ID NO: 50619

SEQ ID NO: 312437 - RNA, 64 nt, Homo Sapiens; identical to SEQ ID NO: 50620

SEQ ID NO: 312438 - RNA, 64 nt, Homo Sapiens; identical to SEQ ID NO: 50621

SEQ ID NO: 312439 - RNA, 64 nt, Homo Sapiens; identical to SEQ ID NO: 50622

SEQ ID NO: 312440 - RNA, 64 nt, Homo Sapiens; identical to SEQ ID NO: 50623

SEQ ID NO: 312441 - RNA, 64 nt, Homo Sapiens; identical to SEQ ID NO: 50624

SEQ ID NO: 312442 - RNA, 64 nt, Homo Sapiens; identical to SEQ ID NO: 50625

SEQ ID NO: 312443 - RNA, 64 nt, Homo Sapiens; identical to SEQ ID NO: 50626

SEQ ID NO: 312444 - RNA, 64 nt, Homo Sapiens; identical to SEQ ID NO: 50627

SEQ ID NO: 312445 - RNA, 64 nt, Homo Sapiens; identical to SEQ ID NO: 50628

SEQ ID NO: 312446 - RNA, 64 nt, Homo Sapiens; identical to SEQ ID NO: 50629

SEQ ID NO: 312447 - RNA, 64 nt, Homo Sapiens; identical to SEQ ID NO: 50630

SEQ ID NO: 312448 - RNA, 64 nt, Homo Sapiens; identical to SEQ ID NO: 50631

SEQ ID NO: 312449 - RNA, 64 nt, Homo Sapiens; identical to SEQ ID NO: 50632

SEQ ID NO: 312450 - RNA, 64 nt, Homo Sapiens; identical to SEQ ID NO: 50633

SEQ ID NO: 312451 - RNA, 64 nt, Homo Sapiens; identical to SEQ ID NO: 50634

SEQ ID NO: 312452 - RNA, 64 nt, Homo Sapiens; identical to SEQ ID NO: 50635

SEQ ID NO: 312453 - RNA, 64 nt, Homo Sapiens; identical to SEQ ID NO: 50636

SEQ ID NO: 312454 - RNA, 64 nt, Homo Sapiens; identical to SEQ ID NO: 50637

SEQ ID NO: 312455 - RNA, 64 nt, Homo Sapiens; identical to SEQ ID NO: 50638

SEQ ID NO: 312456 - RNA, 64 nt, Homo Sapiens; identical to SEQ ID NO: 50639

SEQ ID NO: 312457 - RNA, 64 nt, Homo Sapiens; identical to SEQ ID NO: 50640

SEQ ID NO: 312458 - RNA, 64 nt, Homo Sapiens; identical to SEQ ID NO: 50641

SEQ ID NO: 312459 - RNA, 64 nt, Homo Sapiens; identical to SEQ ID NO: 50642

SEQ ID NO: 312460 - RNA, 64 nt, Homo Sapiens; identical to SEQ ID NO: 50643

SEQ ID NO: 312461 - RNA, 64 nt, Homo Sapiens; identical to SEQ ID NO: 50644

SEQ ID NO: 312462 - RNA, 64 nt, Homo Sapiens; identical to SEQ ID NO: 53253

SEQ ID NO: 312463 - RNA, 64 nt, Homo Sapiens; identical to SEQ ID NO: 53254

SEQ ID NO: 312464 - RNA, 64 nt, Homo Sapiens
aagccauuuauuuauuccaucuagaaaggaaacccuguuucaguccccucucucuggcuguucu

SEQ ID NO: 312465 - RNA, 64 nt, Homo Sapiens
uuaccuguaagacuuuuaaagauuuuccucccuccuguuucaggugggucacauucugaugaau

SEQ ID NO: 312466 - RNA, 64 nt, Homo Sapiens
ugauugcaucugaagaaaggaucccugagagucucuguuucaucaggacauucugaaauuuacc

SEQ ID NO: 312467 - RNA, 64 nt, Homo Sapiens
aaauguuugagccuguuccauuuucccguggaaccuguuucacucaaugccaggcagugcagca

SEQ ID NO: 312468 - RNA, 64 nt, Homo Sapiens
uauaaaagguccaguuuuuaauaggugaucggaucuguuucauuuuuggaauuugagagaaggu

SEQ ID NO: 312469 - RNA, 64 nt, Homo Sapiens
aguuuuugaauucagugcaugguccaaaaaaugccuguuucagacuuuuuaguauuuuauaaau

SEQ ID NO: 312470 - RNA, 64 nt, Homo Sapiens
aaucccauucaggcuacaagugacgacaaagauucuguuucaaauauagccacagaaauaaagg

SEQ ID NO: 312471 - RNA, 64 nt, Homo Sapiens
aaucccauucaggcuacaagugacgagaaagauucuguuucaaauauagccacagaaauaaaga

SEQ ID NO: 312472 - RNA, 64 nt, Homo Sapiens
aagucaguucugugaucugggucucuaaucugugcuguuucaaaguucucuguggcaaagcagc

SEQ ID NO: 312473 - RNA, 64 nt, Homo Sapiens
cagaacugaacugagguucauggauuuuccaggacuguuucaaacaugcccauuacuaacggca

SEQ ID NO: 312474 - RNA, 64 nt, Homo Sapiens
gaugggagauugaagauuucuguugaaacuuacacuguuucaucucagcuuuugaugguacuga

SEQ ID NO: 312475 - RNA, 64 nt, Homo Sapiens
ugguccuaccaauggauucauggaguagccuggacuguuucauaguuuucuaaauguacaaauu

SEQ ID NO: 312476 - RNA, 64 nt, Homo Sapiens
aaaacuugcauagaauucugauuaaauagugggucuguuucacaugugcaguuugaaguauuua

SEQ ID NO: 312477 - RNA, 64 nt, Homo Sapiens
cauuguauauuuugcaaaaacaagauguuuguagcuguuucagagagaguacgguauauuuaug

SEQ ID NO: 312478 - RNA, 64 nt, Homo Sapiens
cuuauaauuaaauguaaaauugaaaauucauuugcuguuucaaagugugauaucuuucacaaua

SEQ ID NO: 312479 - RNA, 64 nt, Homo Sapiens
agagcugucuuagcucaaauuccucccucuauuacuguuucaccacaugaauaccucguguucc

SEQ ID NO: 312480 - RNA, 64 nt, Homo Sapiens
caugauaguugauaugagacauuuugccuguuuucuguuucaaaucauuuuauuuuagccaaac

SEQ ID NO: 312481 - RNA, 64 nt, Homo Sapiens
guauuguaaacugaggcuaaauuuuuuuuuaaaccuguuucauguguuauaaaggccagcuugu

SEQ ID NO: 312482 - RNA, 64 nt, Homo Sapiens
uuuccuacucauagccaaccaauaaauucaguaucuguuucaaauauuuuagaaguguaguuug

SEQ ID NO: 312483 - RNA, 64 nt, Homo Sapiens
ugaaugaagggaguaugucuucguuccaauaauccuguuucacuccagguuacagaccugccua

SEQ ID NO: 312484 - RNA, 64 nt, Homo Sapiens
ugugggacuuacaagcacuuugggguuggagcaucuguuucaaaauaaacuccugaccuccugg

SEQ ID NO: 312485 - RNA, 64 nt, Homo Sapiens
aguauuauuugccuucauaauagaacccaagagucuguuucaauuuaugaauucaguauuugca

SEQ ID NO: 312486 - RNA, 64 nt, Homo Sapiens
gaacaaaauuuaguauucaagcugagugagaauacuguuucaaugagcaugucccuaagauaaa

SEQ ID NO: 312487 - RNA, 64 nt, Homo Sapiens
ggauccugacacuggagggcgaucuuuugauaugcuguuucacaguaaauuauaagaagcuggc

SEQ ID NO: 312488 - RNA, 64 nt, Homo Sapiens
uaagcuauuaguaauaaaaggaaugaauagauggcuguuucaguugcugcuauuccugcuggag

SEQ ID NO: 312489 - RNA, 64 nt, Homo Sapiens
uuuuauuaauaacacauaauuaguaaccacucuacuguuucaaguuaaucuaguaauagagcuu

SEQ ID NO: 312490 - RNA, 64 nt, Homo Sapiens
cuccagagucugugcccuuuaccaccgugcccaacuguuucacaugcuguguuugguaguuuuu

SEQ ID NO: 312491 - RNA, 64 nt, Homo Sapiens
uuuaagaaaacaaguauauaauuuacuuuguagacuguuucacauugcacucaucauauuuugu

SEQ ID NO: 312492 - RNA, 64 nt, Homo Sapiens
gaggcccaaagcacuugcuuacauccucugauagcuguuucaaaugugcauuuuguggaauuuu

SEQ ID NO: 312493 - RNA, 64 nt, Homo Sapiens
uaaagaaauaaguauccuacucaaaaaaggaagucuguuucagaacuuuagggccuuugaaaua

SEQ ID NO: 312494 - RNA, 64 nt, Homo Sapiens
uuguccaagaucuuugcaccuuaauauuaauggacuguuucagguaaaagagaaugaauguaug

SEQ ID NO: 312495 - RNA, 64 nt, Homo Sapiens
caagaggcaggugacauuguguccauauuucuuccuguuucagaacuucuguuucacaacaauu

SEQ ID NO: 312496 - RNA, 64 nt, Homo Sapiens
cauuguguccauauuucuuccuguuucagaacuucuguuucacaacaauuucucucucgcuaca

SEQ ID NO: 312497 - RNA, 64 nt, Homo Sapiens
aggagacucuuuuccuauacuucuaaaaugcaaacuguuucagauucugagcaccucauuguaa

SEQ ID NO: 312498 - RNA, 64 nt, Homo Sapiens
ugauggugccagggaauccguggcuugguacacacuguuucauccaguggccacguggaagcuu

SEQ ID NO: 312499 - RNA, 64 nt, Homo Sapiens
agaaugccuuuuaaaacauuguauauaaucuucacuguuucaccaucuagcuugcuaagucaaa

SEQ ID NO: 312500 - RNA, 64 nt, Homo Sapiens
aauauuuaaaauuagauaugauucacacuauauucuguuucauaugcagauuuuauucucaccu

SEQ ID NO: 312501 - RNA, 64 nt, Homo Sapiens
gcaaccgcgguacagacguguaaaagccuauuaacuguuucagguuguuauaucugagaggcuu

SEQ ID NO: 312502 - RNA, 64 nt, Homo Sapiens
gugaauagugaauguaaaggaaaaaaacaugcaccuguuucacuaaaaaaaaaaaaaaaagaaa

SEQ ID NO: 312503 - RNA, 64 nt, Homo Sapiens
uccaugcugcuagguggcgggggucgggggucuucuguuucacuaacaggaacaaagacagaaa

SEQ ID NO: 312504 - RNA, 64 nt, Homo Sapiens
uucugggggugagaugaccauucugggucuaagacuguuucaaagaagagcucauagacugacu

SEQ ID NO: 312505 - RNA, 64 nt, Homo Sapiens
ugaguccaaguuguuuacucugugccuuaucucacuguuucagcauggccaccuccccauuuuc

SEQ ID NO: 312506 - RNA, 64 nt, Homo Sapiens
uagauccuuacagcuggcagacaugucccaccagcuguuucagaugggacucuaucagcuuuac

SEQ ID NO: 312507 - RNA, 64 nt, Homo Sapiens
aucaauccaacuuaaaagcaagaugaaauuuuagcuguuucagcuugcuuuuugaugguggaua

SEQ ID NO: 312508 - RNA, 64 nt, Homo Sapiens
ugaggauuucaguucugaagacagaaguguucaccuguuucauccuucugagauguagcagguc

SEQ ID NO: 312509 - RNA, 64 nt, Homo Sapiens
uuagcaagccuaaguccccucauguucagugagccuguuucauuugcuauauagaaaaagaaac

SEQ ID NO: 312510 - RNA, 64 nt, Homo Sapiens
aaugggugcuuuuaacuagcuucuacauggcaagcuguuucaguuugcaaaaucacugcccagc

SEQ ID NO: 312511 - RNA, 64 nt, Homo Sapiens
uugacccuuucuugggaaggaccauaaacgcacacuguuucaucgcucacuuaacucucgcaau

SEQ ID NO: 312512 - RNA, 64 nt, Homo Sapiens
gucuuuuaguugaagcacucaugaaaaucccgcucuguuucaggagaaguaacucggggaaaag

SEQ ID NO: 312513 - RNA, 63 nt, Homo Sapiens
ugaaccguguggcaaagccuuuaaaugguccucaacccuuaaugaacguaagugaauucaugc

SEQ ID NO: 312514 - RNA, 63 nt, Homo Sapiens
uaaagaauguggcaaagccuucaauagguucucaacccuuacugugcacaagauaauucauuc

SEQ ID NO: 312515 - RNA, 63 nt, Homo Sapiens
aacagcuuuucccaggagacuucaaaaauguuaaacccuuaccgaagauauacaaaaacauac

SEQ ID NO: 312516 - RNA, 63 nt, Homo Sapiens
aaugcacaccucaugagucuccugaccucaacuaacccuuaaaguucgacgccccgaaccuca

SEQ ID NO: 312517 - RNA, 63 nt, Homo Sapiens
aaacauaagaugauucauaccuaaccauuucucaacccuuacuugaagaauguggcaaaacuu

SEQ ID NO: 312518 - RNA, 55 nt, Homo Sapiens
ggacauaagagaauucauacucuucaacccuuauuguggcaaagccuuuaaccga

SEQ ID NO: 312519 - RNA, 63 nt, Homo Sapiens
acugccuguaccaggcugccuggcaaaggccaaaacccuuacucacaugaggauggaggaaca

SEQ ID NO: 312520 - RNA, 63 nt, Homo Sapiens
aagauaccuucuauauguaaugaucacagaacuaacccuuauaauauaguuuuacuuauuuug

SEQ ID NO: 312521 - RNA, 64 nt, Homo Sapiens
ggccgcccuuggcuccugucccugcugcuccucuaggccucacucaacaaccaagcgccuggag

SEQ ID NO: 312522 - RNA, 64 nt, Homo Sapiens
ucauugacacucuucccuccucccaccugccaccaggccucaccaaagcccacugccauggggc

SEQ ID NO: 312523 - RNA, 64 nt, Homo Sapiens
uucuccaucagcuuaugggacguuuaguuucuagaggccucaguacccugggugccauucccag

SEQ ID NO: 312524 - RNA, 64 nt, Homo Sapiens
ccucggaagccgucugacucgaguuacuugucugaggccucaucacugaaaacauuucaaagcu

SEQ ID NO: 312525 - RNA, 64 nt, Homo Sapiens
aucauggugggaggcaaaagccacauggcuggggaggccucagaguuuaauuggacuuaaaguu

SEQ ID NO: 312526 - RNA, 64 nt, Homo Sapiens
aucauggcgggaggugaaagccacauggcuggggaggccucagaguuuacuuggacuuacaguu

SEQ ID NO: 312527 - RNA, 64 nt, Homo Sapiens
agggauuuguccauucugcucuuggccucuccugaggccucauaaugggagaccaaaucaaaaa

SEQ ID NO: 312528 - RNA, 64 nt, Homo Sapiens
caccugagcagaugcugaggcaguucauuaaaccaggccucagcuucagugccucaucuugcca

SEQ ID NO: 312529 - RNA, 64 nt, Homo Sapiens
caacaccaguggaacuggagcccacccucucacuaggccucaccagauucaacaaggcccucug

SEQ ID NO: 312530 - RNA, 64 nt, Homo Sapiens
cgucugcuccuaggaccuccugccguguccagggaggccucauggcgcaggucuccuuggggcc

SEQ ID NO: 312531 - RNA, 64 nt, Homo Sapiens
cuugcccucaaugcacgaaaaucugggcugguacaggccucagccugugcuuagaaguccuuua

SEQ ID NO: 312532 - RNA, 64 nt, Homo Sapiens
uggacaacggugcuuccccacagcuuccggcccgaggccucaccccaagcccccugaacaaaca

SEQ ID NO: 312533 - RNA, 64 nt, Homo Sapiens
uccuugcagaggugagggguagccgcaacccuacaggccucaguugccgccuguagccagugac

SEQ ID NO: 312534 - RNA, 64 nt, Homo Sapiens
ggcucccgcccuucuuccucccaacaugaagucuaggccucagggccacuucccaccaggaccc

SEQ ID NO: 312535 - RNA, 64 nt, Homo Sapiens
caaggccaaggcuggcaucaggacaggccgggacaggccucacccccugccccaggccacagca

SEQ ID NO: 312536 - RNA, 64 nt, Homo Sapiens
uuaugucauaugggcugacugguguagguuugguaggccucacugcucuccagaggcuaguguu

SEQ ID NO: 312537 - RNA, 64 nt, Homo Sapiens
cacaagagauuuggccuccuuggaacauguaggaaggccucaaggauguaauucuagcccaggg

SEQ ID NO: 312538 - RNA, 64 nt, Homo Sapiens
cuccuucaaucuccaugaaaccaucguaacauggaggccucagcugcucugaggagagaaauca

SEQ ID NO: 312539 - RNA, 64 nt, Homo Sapiens
uccugcauuuuuagauuccuuuuaguucuaauugaggccucacuagaugcucuucaguucugug

SEQ ID NO: 312540 - RNA, 64 nt, Homo Sapiens
gaguacguguucaguaugcuaguuauuaugaaaaaggccucaagcagagagcuggcuugagagu

SEQ ID NO: 312541 - RNA, 64 nt, Homo Sapiens
acugccagggaauaaaaccaugggucccugugccaggccucaaugccugcagcauacaguaaga

SEQ ID NO: 312542 - RNA, 64 nt, Homo Sapiens
cugcucuucccagguggggacaguggcccaagcaaggccucacucgcagccacuucuucaagag

SEQ ID NO: 312543 - RNA, 64 nt, Homo Sapiens
ugcucuugagaauaguuucucgugucccccucgcaggccucauucuuugaacaucgacucugaa

SEQ ID NO: 312544 - RNA, 64 nt, Homo Sapiens
guuuaauuggacuuacaguuccacaugacuggggaggccucagaaucauggugggaggcaaaaa

SEQ ID NO: 312545 - RNA, 64 nt, Homo Sapiens
guuuaauuggacuuacaguuccacauggccggggaggccucagaaucauggcgggaggugaaaa

SEQ ID NO: 312546 - RNA, 64 nt, Homo Sapiens
cuccuggacccagcaggggcaacugguccaggccaggccucaucguuucagguggaacaggagg

SEQ ID NO: 312547 - RNA, 64 nt, Homo Sapiens
ccucccaaauaugccccuccuagaggcuauuccuaggccucagggugugggucagggagggguc

SEQ ID NO: 312548 - RNA, 64 nt, Homo Sapiens
uagaaagaaaauccccucagccuaccuguuccugaggccucauuugcuauucuauucugcugcc

SEQ ID NO: 312549 - RNA, 64 nt, Homo Sapiens
cccaucagaacccugccugcagccccugcuuuuuaggccucacuucccugcugcaucugcauga

SEQ ID NO: 312550 - RNA, 64 nt, Homo Sapiens
guuagacacuagggaugcaaagaugaaugagauaaggccucaggccucauggaaggugagacag

SEQ ID NO: 312551 - RNA, 64 nt, Homo Sapiens
acuagggaugcaaagaugaaugagauaaggccucaggccucauggaaggugagacaguaaagac

SEQ ID NO: 312552 - RNA, 64 nt, Homo Sapiens
gccccucucuucccagcacuucccugccucccccaggccucaggcccagcacccaguuccuccu

SEQ ID NO: 312553 - RNA, 64 nt, Homo Sapiens
gcccucauugugguccgaggacagccuuuuccccaggccucagagcauugcucauccgugccaa

SEQ ID NO: 312554 - RNA, 64 nt, Homo Sapiens
acucgagcccacccagcauccggcgggugcucugaggccucacugcccccgcccgcacagcucc

SEQ ID NO: 312555 - RNA, 64 nt, Homo Sapiens
aucuccacucugcguaacagggcccggugaccgcaggccucagcgacuaggggaggggguccug

SEQ ID NO: 312556 - RNA, 64 nt, Homo Sapiens
ugaguuuuuaguacuguguugucaggcucuucccaggccucagguguugucuuuugugcugugu

SEQ ID NO: 312557 - RNA, 64 nt, Homo Sapiens
cugaaguacucauguuuuaauagugccucuccaaaggccucaccuuggacagaggucaauccuu

SEQ ID NO: 312558 - RNA, 64 nt, Homo Sapiens
auagguccuccccucaccccaacucuagguuuccaggccucacagccaagcugaagcuuggaga

SEQ ID NO: 312559 - RNA, 64 nt, Homo Sapiens
caaaggcagcugcccucccugacccuauagccccaggccucaugggggguauguggggaaggga

SEQ ID NO: 312560 - RNA, 64 nt, Homo Sapiens
ucuccugugggcuuuuuaccugaguaucucugggaggccucaugcagagucacuagaaguuacc

SEQ ID NO: 312561 - RNA, 64 nt, Homo Sapiens
cacccugccuguggccccgccuuugagccagggcaggccucagacaaauucaaggacaaccugu

SEQ ID NO: 312562 - RNA, 64 nt, Homo Sapiens
ggucaaggagcucagaggagccacacuacucucuaggccucagguucugugagacuggggccag

SEQ ID NO: 312563 - RNA, 64 nt, Homo Sapiens
cuccaacugguguuaucccacuucucaagaucauaggccucagaacccucccaaaggauacugc

SEQ ID NO: 312564 - RNA, 64 nt, Homo Sapiens
gcagggucaucagacagucaccuuuggccucaagaggccucagaacugcaaacuccugcgucgg

SEQ ID NO: 312565 - RNA, 64 nt, Homo Sapiens
cagcaggacuuaugguucugggucucagagcuucaggccucacuguccuucugccacggaugcu

SEQ ID NO: 312566 - RNA, 64 nt, Homo Sapiens
gaccagaauguuccgggaggcugccugaccuaugaggccucaauucccaggacagggguaaguu

SEQ ID NO: 312567 - RNA, 64 nt, Homo Sapiens
aagaagugccggaccagccccugcccuuuggcaaaggccucaucaguuguacugcuuccaguuc

SEQ ID NO: 312568 - RNA, 64 nt, Homo Sapiens
aaccugcucuuccgcugcucugggucugcagcggaggccucagccgggcugagcgcgccuggug

SEQ ID NO: 312569 - RNA, 64 nt, Homo Sapiens; identical to SEQ ID NO: 73772

SEQ ID NO: 312570 - RNA, 64 nt, Homo Sapiens; identical to SEQ ID NO: 73773

SEQ ID NO: 312571 - RNA, 64 nt, Homo Sapiens; identical to SEQ ID NO: 73774

SEQ ID NO: 312572 - RNA, 64 nt, Homo Sapiens; identical to SEQ ID NO: 73775

SEQ ID NO: 312573 - RNA, 64 nt, Homo Sapiens; identical to SEQ ID NO: 73776

SEQ ID NO: 312574 - RNA, 64 nt, Homo Sapiens; identical to SEQ ID NO: 73777

SEQ ID NO: 312575 - RNA, 64 nt, Homo Sapiens; identical to SEQ ID NO: 73778

SEQ ID NO: 312576 - RNA, 64 nt, Homo Sapiens; identical to SEQ ID NO: 73779

SEQ ID NO: 312577 - RNA, 64 nt, Homo Sapiens; identical to SEQ ID NO: 73780

SEQ ID NO: 312578 - RNA, 64 nt, Homo Sapiens; identical to SEQ ID NO: 73781

SEQ ID NO: 312579 - RNA, 64 nt, Homo Sapiens; identical to SEQ ID NO: 73782

SEQ ID NO: 312580 - RNA, 64 nt, Homo Sapiens; identical to SEQ ID NO: 73783

SEQ ID NO: 312581 - RNA, 64 nt, Homo Sapiens; identical to SEQ ID NO: 73784

SEQ ID NO: 312582 - RNA, 64 nt, Homo Sapiens; identical to SEQ ID NO: 73785

SEQ ID NO: 312583 - RNA, 64 nt, Homo Sapiens; identical to SEQ ID NO: 73786

SEQ ID NO: 312584 - RNA, 64 nt, Homo Sapiens; identical to SEQ ID NO: 73787

SEQ ID NO: 312585 - RNA, 64 nt, Homo Sapiens; identical to SEQ ID NO: 73788

SEQ ID NO: 312586 - RNA, 64 nt, Homo Sapiens; identical to SEQ ID NO: 73789

SEQ ID NO: 312587 - RNA, 64 nt, Homo Sapiens; identical to SEQ ID NO: 73790

SEQ ID NO: 312588 - RNA, 64 nt, Homo Sapiens; identical to SEQ ID NO: 73791

SEQ ID NO: 312589 - RNA, 64 nt, Homo Sapiens; identical to SEQ ID NO: 73792

SEQ ID NO: 312590 - RNA, 64 nt, Homo Sapiens; identical to SEQ ID NO: 73793

SEQ ID NO: 312591 - RNA, 64 nt, Homo Sapiens; identical to SEQ ID NO: 73794

SEQ ID NO: 312592 - RNA, 64 nt, Homo Sapiens; identical to SEQ ID NO: 73795

SEQ ID NO: 312593 - RNA, 64 nt, Homo Sapiens; identical to SEQ ID NO: 73796

SEQ ID NO: 312594 - RNA, 64 nt, Homo Sapiens; identical to SEQ ID NO: 73797

SEQ ID NO: 312595 - RNA, 64 nt, Homo Sapiens; identical to SEQ ID NO: 73798

SEQ ID NO: 312596 - RNA, 64 nt, Homo Sapiens; identical to SEQ ID NO: 73799

SEQ ID NO: 312597 - RNA, 64 nt, Homo Sapiens; identical to SEQ ID NO: 73800

SEQ ID NO: 312598 - RNA, 64 nt, Homo Sapiens; identical to SEQ ID NO: 73801

SEQ ID NO: 312599 - RNA, 64 nt, Homo Sapiens; identical to SEQ ID NO: 73802

SEQ ID NO: 312600 - RNA, 64 nt, Homo Sapiens; identical to SEQ ID NO: 73803

SEQ ID NO: 312601 - RNA, 64 nt, Homo Sapiens; identical to SEQ ID NO: 73804

SEQ ID NO: 312602 - RNA, 64 nt, Homo Sapiens; identical to SEQ ID NO: 73805

SEQ ID NO: 312603 - RNA, 64 nt, Homo Sapiens; identical to SEQ ID NO: 73806

SEQ ID NO: 312604 - RNA, 64 nt, Homo Sapiens; identical to SEQ ID NO: 73807

SEQ ID NO: 312605 - RNA, 64 nt, Homo Sapiens; identical to SEQ ID NO: 73808

SEQ ID NO: 312606 - RNA, 64 nt, Homo Sapiens; identical to SEQ ID NO: 73809

SEQ ID NO: 312607 - RNA, 64 nt, Homo Sapiens; identical to SEQ ID NO: 73810

SEQ ID NO: 312608 - RNA, 64 nt, Homo Sapiens; identical to SEQ ID NO: 73811

SEQ ID NO: 312609 - RNA, 64 nt, Homo Sapiens; identical to SEQ ID NO: 73812

SEQ ID NO: 312610 - RNA, 64 nt, Homo Sapiens; identical to SEQ ID NO: 73813

SEQ ID NO: 312611 - RNA, 64 nt, Homo Sapiens; identical to SEQ ID NO: 73814

SEQ ID NO: 312612 - RNA, 64 nt, Homo Sapiens; identical to SEQ ID NO: 73815

SEQ ID NO: 312613 - RNA, 64 nt, Homo Sapiens; identical to SEQ ID NO: 73816

SEQ ID NO: 312614 - RNA, 64 nt, Homo Sapiens; identical to SEQ ID NO: 73817

SEQ ID NO: 312615 - RNA, 64 nt, Homo Sapiens; identical to SEQ ID NO: 73818

SEQ ID NO: 312616 - RNA, 64 nt, Homo Sapiens; identical to SEQ ID NO: 73819

SEQ ID NO: 312617 - RNA, 64 nt, Homo Sapiens; identical to SEQ ID NO: 73820

SEQ ID NO: 312618 - RNA, 64 nt, Homo Sapiens; identical to SEQ ID NO: 73821

SEQ ID NO: 312619 - RNA, 64 nt, Homo Sapiens; identical to SEQ ID NO: 73822

SEQ ID NO: 312620 - RNA, 64 nt, Homo Sapiens; identical to SEQ ID NO: 73823

SEQ ID NO: 312621 - RNA, 64 nt, Homo Sapiens; identical to SEQ ID NO: 73824

SEQ ID NO: 312622 - RNA, 64 nt, Homo Sapiens; identical to SEQ ID NO: 73825

SEQ ID NO: 312623 - RNA, 64 nt, Homo Sapiens; identical to SEQ ID NO: 73826

SEQ ID NO: 312624 - RNA, 64 nt, Homo Sapiens; identical to SEQ ID NO: 73827

SEQ ID NO: 312625 - RNA, 64 nt, Homo Sapiens; identical to SEQ ID NO: 73828

SEQ ID NO: 312626 - RNA, 64 nt, Homo Sapiens; identical to SEQ ID NO: 73829

SEQ ID NO: 312627 - RNA, 64 nt, Homo Sapiens; identical to SEQ ID NO: 73830

SEQ ID NO: 312628 - RNA, 64 nt, Homo Sapiens; identical to SEQ ID NO: 105402

SEQ ID NO: 312629 - RNA, 64 nt, Homo Sapiens; identical to SEQ ID NO: 105403

SEQ ID NO: 312630 - RNA, 64 nt, Homo Sapiens
ugccuaaaaagaucuuuguuaaaaggaauguuucugaaugcaaguguuauaagugcuuauuuau

SEQ ID NO: 312631 - RNA, 64 nt, Homo Sapiens
ccuaauauaugauauagucuccaaaugguccauuugaaugcaucaguucaguugacuuucccca

SEQ ID NO: 312632 - RNA, 64 nt, Homo Sapiens
ccauauaguuucuugcacaaucuguucacuccacugaaugcaacauuucauacaacugaguuac

SEQ ID NO: 312633 - RNA, 64 nt, Homo Sapiens
aacugauuucauacaacugaugggccacugacauugaaugcaacuuauuuuaccccaaguuuuu

SEQ ID NO: 312634 - RNA, 64 nt, Homo Sapiens
gaccuuggaaaucuguaugugguggagaaguauuugaaugcauuuaggcuuaauuucuucgccu

SEQ ID NO: 312635 - RNA, 64 nt, Homo Sapiens
gccugaggguccccacgguuccuuucugcuuuucugaaugcaucaaggguacgagaacuugcca

SEQ ID NO: 312636 - RNA, 64 nt, Homo Sapiens
guuuaguuauagcaaaaauauggauaauuucuagugaaugcauaaauuagguugcguuucuuau

SEQ ID NO: 312637 - RNA, 64 nt, Homo Sapiens
gauguuuugaaaaaagcuaggagaugacuuugaaugaaugcaagguuagugagauccuaagcuc

SEQ ID NO: 312638 - RNA, 64 nt, Homo Sapiens
cuucuauuuccagaagugacauugccgugcucuuugaaugcagaagaauccaaaaguauuuucc

SEQ ID NO: 312639 - RNA, 64 nt, Homo Sapiens
uccagaguggccaugccuagcccaacuuuaauuuugaaugcauucaaaguaacccugacuaggg

SEQ ID NO: 312640 - RNA, 64 nt, Homo Sapiens
acgguuuuuggaucuggcauuuuggacagcugacugaaugcagauggaaaugggacggaggucc

SEQ ID NO: 312641 - RNA, 64 nt, Homo Sapiens
uuucaaagcuuuccuguuuccagaacaggaggugugaaugcacguaacuugcauauuguuggca

SEQ ID NO: 312642 - RNA, 64 nt, Homo Sapiens
acugucuuauuuuaaucuuauccacaggaaaacuugaaugcacauugcaaugaagaugagcaga

SEQ ID NO: 312643 - RNA, 64 nt, Homo Sapiens
auuguccccuacugggaauaaauuggugcaguuuugaaugcaacucuggccagggacgugcugc

SEQ ID NO: 312644 - RNA, 64 nt, Homo Sapiens
agcaaauauugucugcccuguaauugaauaagugugaaugcagacaucauuuuuuuaaaaaaug

SEQ ID NO: 312645 - RNA, 64 nt, Homo Sapiens
uugccuuuauuauaaauuuggguagaguucauuuugaaugcaagcccuuuuaauaaaauauaag

SEQ ID NO: 312646 - RNA, 64 nt, Homo Sapiens
uauuaaucguuuuaguugcuuaaaaaguucucauugaaugcaccuguuuuguggauaauugaaa

SEQ ID NO: 312647 - RNA, 64 nt, Homo Sapiens
uuugcucauggugaauauagccagaucagggacuugaaugcacugccacaaauagaaaauauga

SEQ ID NO: 312648 - RNA, 64 nt, Homo Sapiens
cacaucagaaaauucacacuggagagaaaccuuaugaaugcagugaaugugggaaagcuuuuau

SEQ ID NO: 312649 - RNA, 64 nt, Homo Sapiens
auuauaaaaaccucaauucugaaaaucuauagacugaaugcaguuccaaacaaaaucaacuaag

SEQ ID NO: 312650 - RNA, 64 nt, Homo Sapiens
gacaucagagaguucacucuggagagaggccuuaugaaugcagugaauguggcaaauucuuugu

SEQ ID NO: 312651 - RNA, 64 nt, Homo Sapiens
gucaucagagaguucacacuggagaaagaccuuuugaaugcagcauuugugggaaauccuuuag

SEQ ID NO: 312652 - RNA, 64 nt, Homo Sapiens
cuuugccagucuagccccagcagggcaccguguaugaaugcaguuuggugcuguuuuagaguau

SEQ ID NO: 312653 - RNA, 64 nt, Homo Sapiens
cccccuagauccauguggcuuuaugugaggggacugaaugcagacacaccauagcccccuucua

SEQ ID NO: 312654 - RNA, 64 nt, Homo Sapiens
gucugagcaaaccugggugugaauucggugguuuugaaugcauaaagugccuuguggacacggg

SEQ ID NO: 312655 - RNA, 64 nt, Homo Sapiens
ucagugggagccaggaagccucaggcuucacgacugaaugcacccaauauccgaccuggcugcg

SEQ ID NO: 312656 - RNA, 64 nt, Homo Sapiens; identical to SEQ ID NO: 288178

SEQ ID NO: 312657 - RNA, 64 nt, Homo Sapiens; identical to SEQ ID NO: 288179

SEQ ID NO: 312658 - RNA, 64 nt, Homo Sapiens; identical to SEQ ID NO: 288180

SEQ ID NO: 312659 - RNA, 64 nt, Homo Sapiens; identical to SEQ ID NO: 288181

SEQ ID NO: 312660 - RNA, 64 nt, Homo Sapiens; identical to SEQ ID NO: 288182

SEQ ID NO: 312661 - RNA, 64 nt, Homo Sapiens; identical to SEQ ID NO: 288183

SEQ ID NO: 312662 - RNA, 64 nt, Homo Sapiens; identical to SEQ ID NO: 288184

SEQ ID NO: 312663 - RNA, 64 nt, Homo Sapiens; identical to SEQ ID NO: 288185

SEQ ID NO: 312664 - RNA, 64 nt, Homo Sapiens; identical to SEQ ID NO: 288186

SEQ ID NO: 312665 - RNA, 64 nt, Homo Sapiens; identical to SEQ ID NO: 288187

SEQ ID NO: 312666 - RNA, 64 nt, Homo Sapiens; identical to SEQ ID NO: 288188

SEQ ID NO: 312667 - RNA, 64 nt, Homo Sapiens; identical to SEQ ID NO: 288189

SEQ ID NO: 312668 - RNA, 64 nt, Homo Sapiens; identical to SEQ ID NO: 288190

SEQ ID NO: 312669 - RNA, 64 nt, Homo Sapiens; identical to SEQ ID NO: 288191

SEQ ID NO: 312670 - RNA, 64 nt, Homo Sapiens; identical to SEQ ID NO: 288192

SEQ ID NO: 312671 - RNA, 64 nt, Homo Sapiens; identical to SEQ ID NO: 288193

SEQ ID NO: 312672 - RNA, 64 nt, Homo Sapiens; identical to SEQ ID NO: 288194

SEQ ID NO: 312673 - RNA, 64 nt, Homo Sapiens; identical to SEQ ID NO: 288195

SEQ ID NO: 312674 - RNA, 64 nt, Homo Sapiens
accagccugggcaacauaguaucaguugaggccaggaguuuaagucagaggcugaggugagagg

SEQ ID NO: 312675 - RNA, 64 nt, Homo Sapiens
gugauaaaggcaguauuucaccuguguacacaugggaguuuaguaaccggaguucggaaaccgu

SEQ ID NO: 312676 - RNA, 64 nt, Homo Sapiens
uuaaaagacaacacuagauagcagugaggaauggggaguuuaguccaagaggucacgagauugg

SEQ ID NO: 312677 - RNA, 64 nt, Homo Sapiens
uggcuucuguuuuucaaaaggaaacguauggguaggaguuuaggagagcuugggaguaccacug

SEQ ID NO: 312678 - RNA, 64 nt, Homo Sapiens
uuaaaaagcaaguugcgaugguuuuguauagccaggaguuuauugugauuaaacaucaaagaaa

SEQ ID NO: 312679 - RNA, 64 nt, Homo Sapiens
ugggaggucgaggcaagcugaucgcuugagcccaggaguuuaagaccggccugaguagcauagc

SEQ ID NO: 312680 - RNA, 64 nt, Homo Sapiens
ucuaauuucuguuacaguucugcaaagguaaccuggaguuuagaaguuaaaaaaaagcauggga

SEQ ID NO: 312681 - RNA, 64 nt, Homo Sapiens
gggccacugcacaggccaccugcuuggguuccucggaguuuaauuugaaagucugggugucuua

SEQ ID NO: 312682 - RNA, 64 nt, Homo Sapiens; identical to SEQ ID NO: 175198

SEQ ID NO: 312683 - RNA, 64 nt, Homo Sapiens; identical to SEQ ID NO: 175199

SEQ ID NO: 312684 - RNA, 64 nt, Homo Sapiens; identical to SEQ ID NO: 175200

SEQ ID NO: 312685 - RNA, 64 nt, Homo Sapiens; identical to SEQ ID NO: 175201

SEQ ID NO: 312686 - RNA, 64 nt, Homo Sapiens; identical to SEQ ID NO: 175202

SEQ ID NO: 312687 - RNA, 64 nt, Homo Sapiens; identical to SEQ ID NO: 175203

SEQ ID NO: 312688 - RNA, 64 nt, Homo Sapiens; identical to SEQ ID NO: 175204

SEQ ID NO: 312689 - RNA, 64 nt, Homo Sapiens; identical to SEQ ID NO: 175205

SEQ ID NO: 312690 - RNA, 64 nt, Homo Sapiens; identical to SEQ ID NO: 175206

SEQ ID NO: 312691 - RNA, 64 nt, Homo Sapiens; identical to SEQ ID NO: 175207

SEQ ID NO: 312692 - RNA, 64 nt, Homo Sapiens; identical to SEQ ID NO: 175208

SEQ ID NO: 312693 - RNA, 64 nt, Homo Sapiens; identical to SEQ ID NO: 175209

SEQ ID NO: 312694 - RNA, 64 nt, Homo Sapiens; identical to SEQ ID NO: 175210

SEQ ID NO: 312695 - RNA, 64 nt, Homo Sapiens; identical to SEQ ID NO: 175211

SEQ ID NO: 312696 - RNA, 64 nt, Homo Sapiens
gagaaauauuaacuuuuuuaagcugugaguugguaacuagcaggccccugcagggugggauuug

SEQ ID NO: 312697 - RNA, 64 nt, Homo Sapiens
aauuaagugacccccgucaaucucaguuugaacaaacuagcaacuaaaaguuuuaugcagugaa

SEQ ID NO: 312698 - RNA, 64 nt, Homo Sapiens
ccccucccugcccuucagagcucaagacaaguaauacacccaggucuugacugcauuugucuug

SEQ ID NO: 312699 - RNA, 64 nt, Homo Sapiens
guauguuaacuuaacuuuaauuuccuguguaguuuacacccagagcagauacucauaaaguaua

SEQ ID NO: 312700 - RNA, 64 nt, Homo Sapiens
uaaugugaguccugggccuuucugccuccugauguacacccaucgccaucauagcaagagugcu

SEQ ID NO: 312701 - RNA, 64 nt, Homo Sapiens
cucucugguccuuguugcucuaacaguccagauguacacccagccucagggggaaggcagcucu

SEQ ID NO: 312702 - RNA, 64 nt, Homo Sapiens
auugugcaugagcucaaagggggaacaaaauagauacacccaucauggucaucuaucaucaaga

SEQ ID NO: 312703 - RNA, 64 nt, Homo Sapiens
ugaauauagaugagcguagcauccucaguuaaccuacacccaccuuaccugggggugcugaugc

SEQ ID NO: 312704 - RNA, 64 nt, Homo Sapiens
accaguuaauuuuuuguauuggacuacaggugcuuacacccaagcucaaccccccacauagcug

SEQ ID NO: 312705 - RNA, 64 nt, Homo Sapiens
ugccucucuggcuccagaagcucuucucauaguguacacccacccuuaaagguacggguuucug

SEQ ID NO: 312706 - RNA, 64 nt, Homo Sapiens
acugaggaccaaugacgucaucauccucugcccuuacacccaugcuuuguuuguuuaccugugc

SEQ ID NO: 312707 - RNA, 64 nt, Homo Sapiens
uucucaagggcagauucucugugugaugagcacuuacacccacgcucgagaaacagugccgccg

SEQ ID NO: 312708 - RNA, 64 nt, Homo Sapiens
ugagaggauauagccaauuaaguguguuauggaguacacccauuuugacacacuuguaauaaga

SEQ ID NO: 312709 - RNA, 64 nt, Homo Sapiens
cugcccggcagcccccaucuucaagggcugcuucuacacccaccccaccgaggugcugaagccu

SEQ ID NO: 312710 - RNA, 64 nt, Homo Sapiens
cugcucagacagauuuagggcccgccagcuaggcuacacccaucaugcgccgcccuccuccauc

SEQ ID NO: 312711 - RNA, 64 nt, Homo Sapiens
uuuuguacguuuccauguaagaauaguuuuugaauacacccacacuuuaaagauaguaccugca

SEQ ID NO: 312712 - RNA, 64 nt, Homo Sapiens
ucccagcaaaugccacucaugaccuuaucaacuuuacacccauaaauaucuguugaaccuucau

SEQ ID NO: 312713 - RNA, 64 nt, Homo Sapiens
cacuuacaccaaacuacugacacauauagacacauacacccaaacauucuuuggaguuaaaaug

SEQ ID NO: 312714 - RNA, 64 nt, Homo Sapiens
uugucccuuuauugaaaaaacauuaaccuguucauacacccauuguuuuuuuggcaguugucug

SEQ ID NO: 312715 - RNA, 64 nt, Homo Sapiens
uggccugaagcaacugaagagugcccugcacguauacacccagagcuaagccaucauauccccu

SEQ ID NO: 312716 - RNA, 64 nt, Homo Sapiens
guaucaggacgagaaugagggaaaaacauccagauacacccaaagaagaguggguuucacaagu

SEQ ID NO: 312717 - RNA, 64 nt, Homo Sapiens
caguuaugcagcuacuuuuuuuuaauguauuaaauacacccagcagaauaagacuuauccauuu

SEQ ID NO: 312718 - RNA, 64 nt, Homo Sapiens
ccaguaaacgcaggauggaauuuuccugggacucuacacccaucuuaaggugguauaccuucca

SEQ ID NO: 312719 - RNA, 64 nt, Homo Sapiens
aagagauuccugagccagugucaggaggaaggcuuacacccacaguggaaagacagcuucucau

SEQ ID NO: 312720 - RNA, 64 nt, Homo Sapiens
uuuacaacucacuggugguuuuccgcauucuuuguacacccaugaaagaaaacuuuuaugcaag

SEQ ID NO: 312721 - RNA, 64 nt, Homo Sapiens
cuguauuuuucaaguuuucuauaaggaauacacauacacccacaugcacacaccauaguuuuua

SEQ ID NO: 312722 - RNA, 64 nt, Homo Sapiens
cuguaaauugauauaaauuaguuuucucucgaguuacacccaaguaaugaagacuuaagagaac

SEQ ID NO: 312723 - RNA, 64 nt, Homo Sapiens
cucccaaguagcugggacuacaggcguucacuacuacacccagcuaauuuuuaaguuuuuuaua

SEQ ID NO: 312724 - RNA, 64 nt, Homo Sapiens
cacaccagucuuguaucucuuaccugcgaagcaauacacccagaaauuuaggcaacacucaauu

SEQ ID NO: 312725 - RNA, 64 nt, Homo Sapiens
gggagggaccuaguuaaguccgcgaaaagguaaauacacccaaaugcccucuccucuggucccc

SEQ ID NO: 312726 - RNA, 64 nt, Homo Sapiens
cuuuucaugugcagccgacuuaaucaccucuugcuacacccauuuacuuuuuagcaaauuuuuu

SEQ ID NO: 312727 - RNA, 64 nt, Homo Sapiens
caauacaacaccaaaaugaaauaaaaagaaaagcuacacccaaaugcauacuucugacaacuug

SEQ ID NO: 312728 - RNA, 64 nt, Homo Sapiens
auuuaugcagacauguaaaaaaucagaagcaaaguacacccauucucuccuuaaaaugcauuuc

SEQ ID NO: 312729 - RNA, 64 nt, Homo Sapiens
ugaugcagauacuuguauacaguuucugggaggguacacccaaaugucccucagacuuggaugg

SEQ ID NO: 312730 - RNA, 64 nt, Homo Sapiens
uaguuugugguagcaaagugagcacucaaaaauguacacccauuaaaccuuugaguaauaaauc

SEQ ID NO: 312731 - RNA, 64 nt, Homo Sapiens
ugggagguaagcaucuuccaaagccgcagggagauacacccaaccaaagccucggcgcucaccu

SEQ ID NO: 312732 - RNA, 64 nt, Homo Sapiens
ucucuuugcuucacagguuugccugucuagcucauacacccauugaaacucugucacuccucau

SEQ ID NO: 312733 - RNA, 64 nt, Homo Sapiens
auugauuuauuuuucuguuuuccuauuaaaaccuuacacccauuaauucugauaauuugcuucu

SEQ ID NO: 312734 - RNA, 64 nt, Homo Sapiens
gcuccccacguugggcaacuccagccaagauuccuacacccaaaugugaccguguugcucacga

SEQ ID NO: 312735 - RNA, 64 nt, Homo Sapiens
ugcaagcaacuuucuaaaguuguguacaugaacauacacccacauccagacuacagugauuuag

SEQ ID NO: 312736 - RNA, 64 nt, Homo Sapiens
ugagagacaccaauaaaagagaauuuucuacuucuacacccauuaccuuuccaccauaagaaau

SEQ ID NO: 312737 - RNA, 64 nt, Homo Sapiens
gucagcuccuucuacuuauuagcuucuuuguuaauacacccaugguaaauauuuccaggcuguc

SEQ ID NO: 312738 - RNA, 64 nt, Homo Sapiens
cuugauaucucgaacuuucaaaauauauuuucaguacacccaguugccaaaguuuugcugucuc

SEQ ID NO: 312739 - RNA, 64 nt, Homo Sapiens
ccuugcaaagcgcuggauuacaggcaugagccacuacacccagccgauuuuuccuuuuugauua

SEQ ID NO: 312740 - RNA, 64 nt, Homo Sapiens
gugacagggcugccaucgcucaccuguaccuauuuacacccagaacuuuccagcucccccucau

SEQ ID NO: 312741 - RNA, 64 nt, Homo Sapiens
uggagaaaagaacccgacgucccacagccagauauacacccagcuccaugccagcccuucaugu

SEQ ID NO: 312742 - RNA, 64 nt, Homo Sapiens
agcccaagguggagggugcgacaccaugugccuauacacccagcuuccauaccaaagacuuauc

SEQ ID NO: 312743 - RNA, 64 nt, Homo Sapiens
gcuccuacuuguuacuauuagauggucaugauaguacacccauuaugcaccagucaucauaaaa

SEQ ID NO: 312744 - RNA, 64 nt, Homo Sapiens
ccccaggcuggacaugcugaagaagggauaacccuacacccagacgagaugggaaggcacaggg

SEQ ID NO: 312745 - RNA, 64 nt, Homo Sapiens
ggacaguuccccuucagucccaucccccuacacauacacccagccggggccaaauuuauacuua

SEQ ID NO: 312746 - RNA, 64 nt, Homo Sapiens
gaggcacugaugcuuguaacucuggaaagaggccuacacccaagggcuaggaauuuuauuuuuc

SEQ ID NO: 312747 - RNA, 64 nt, Homo Sapiens
cuaagcugguuggaguaggagcgauaccaaaggguacacccaucugugagucacaucuugaaaa

SEQ ID NO: 312748 - RNA, 64 nt, Homo Sapiens
aauccuauauagucuuauucaccaauauauccaauacacccacagcaaugguaccuuuuuaaga

SEQ ID NO: 312749 - RNA, 64 nt, Homo Sapiens
gcuuguuucuuccccuguaacuuuccugcucccauacacccaaguucuccagucugucacccuc

SEQ ID NO: 312750 - RNA, 64 nt, Homo Sapiens
uuguugaagaacugcggguucaucacuguuggucuacacccagucgucucccucuuuuuguacc

SEQ ID NO: 312751 - RNA, 64 nt, Homo Sapiens
uauuuucuucaagucuuugucaucucacuuuuaauacacccagaaaugaguuacgugaaaagag

SEQ ID NO: 312752 - RNA, 64 nt, Homo Sapiens
ccucaucucaauuaaugcuauuguagcaggaaauuacacccagccuuccuucccaauuucuccu

SEQ ID NO: 312753 - RNA, 64 nt, Homo Sapiens
ccccacccccacagggucagcaacugcuuccgguuacacccaggacuaccccugcccgacccug

SEQ ID NO: 312754 - RNA, 64 nt, Homo Sapiens
cuucgcuuaaagggaacaccaggcccggcuuuccuacacccagcucucuuuuucuaauguaaau

SEQ ID NO: 312755 - RNA, 64 nt, Homo Sapiens
gcaaggcuggucuugaacuccugaccucaggugauacacccaucucggccucccaaagugcugg

SEQ ID NO: 312756 - RNA, 64 nt, Homo Sapiens
acauuuuggaguguccuggcuaccagcucucaccuacacccacgcacccccccacacacuaugc

SEQ ID NO: 312757 - RNA, 64 nt, Homo Sapiens
guagcccuaacacaugggaugaacguuuuacugcuacacccagauuuguguugaacgaaaacau

SEQ ID NO: 312758 - RNA, 64 nt, Homo Sapiens
accuggacauuuguaagaauauauuuaauauauguacacccauuauguuuucagguaacaggag

SEQ ID NO: 312759 - RNA, 64 nt, Homo Sapiens
ugggcauaaaauguucaccuuuuugccagaugaguacacccagaaugcuaauuuuucuguccau

SEQ ID NO: 312760 - RNA, 64 nt, Homo Sapiens
uaaagaaaaaugccugucucuagcuguucuggacuacacccaagccugauccagccuuuccaag

SEQ ID NO: 312761 - RNA, 64 nt, Homo Sapiens
ccaaaugcaguuuauuuuuaaauagguuggcucuuacacccauucucuucuguacuuugauugu

SEQ ID NO: 312762 - RNA, 64 nt, Homo Sapiens
gauucuguucugcaacuccauuuuggaugaguuguacacccaaguuuuccagcacuuuguauga

SEQ ID NO: 312763 - RNA, 64 nt, Homo Sapiens
agagugaugugugaguuuguuauuugaccggaucuacacccaccguggauggcacccgaggcau

SEQ ID NO: 312764 - RNA, 64 nt, Homo Sapiens
cacaucucccugcugcacccgccagauggacagguacacccaagaccugagugugccccugccu

SEQ ID NO: 312765 - RNA, 64 nt, Homo Sapiens
uuuaaaaaauaacauauucucuuaggccagucaguacacccaauugaaaagaagaaagucuaug

SEQ ID NO: 312766 - RNA, 64 nt, Homo Sapiens
ggguuuccagaguuuggucaccaaaaauacaaaauacacccaaugaauuggacgcagcaaucug

SEQ ID NO: 312767 - RNA, 64 nt, Homo Sapiens
agagcccuagagaaaugcuguuacuuuuuauuuuuacacccaucagauuuaaggaaaagacuuu

SEQ ID NO: 312768 - RNA, 64 nt, Homo Sapiens
gggccaggcuggguguccucacaggagugagggcuacacccaauuccaaaagccugagaagaga

SEQ ID NO: 312769 - RNA, 64 nt, Homo Sapiens
aggcuguucagaccgacguugccaucaaaacacauacacccagaaagaaacaacagaaaccaaa

SEQ ID NO: 312770 - RNA, 64 nt, Homo Sapiens
uucugguagccucucugcuucuuucagucuggucuacacccacuaaggaggagaaugcugccuc

SEQ ID NO: 312771 - RNA, 64 nt, Homo Sapiens
gaggaaaaaaaggagcgcuuuaccccaaaaugauuacacccaggaaucccagaaagcuuaauga

SEQ ID NO: 312772 - RNA, 64 nt, Homo Sapiens
cuaaaauuaacuggacauuaacuuaguucuuagcuacacccacucugguugcuuuugaacacuu

SEQ ID NO: 312773 - RNA, 64 nt, Homo Sapiens
uguuuuccaguguucuucucucauugacaacaccuacacccaccacaaaggauaaucuuucuuu

SEQ ID NO: 312774 - RNA, 64 nt, Homo Sapiens
cggcgcccagcuggcugcagacuuaaaaugacacuacacccagaucccucaucccaccccaaau

SEQ ID NO: 312775 - RNA, 64 nt, Homo Sapiens
aggcggcugagggaacugagcagccccugaguccuacacccagagugacuuugggugagccuua

SEQ ID NO: 312776 - RNA, 64 nt, Homo Sapiens
acuuugcgaccugcggcccaccuccgugucgggguacacccagcuuggagagagcacccugggg

SEQ ID NO: 312777 - RNA, 64 nt, Homo Sapiens
agggcccaggcuuggggaacagagagagcagguguacacccaaccaaagugauugugcccuugg

SEQ ID NO: 312778 - RNA, 64 nt, Homo Sapiens
ugcaaaacucuuucaucuugcaaaacugaaacucuacacccauuaaaaaauaacucgccauuuc

SEQ ID NO: 312779 - RNA, 64 nt, Homo Sapiens
gauaaacaaauggaaaaagaagaugucccuaaccuacacccauagauuaccaagguuucagugu

SEQ ID NO: 312780 - RNA, 64 nt, Homo Sapiens
ugaggccaccaggcucaagccacugcuguugcauuacacccaucccuuugcaaaaucccuaugg

SEQ ID NO: 312781 - RNA, 64 nt, Homo Sapiens
uagaggagcacacuccauuuugagagguguuuucuacacccagccagauaaaacugcccaauac

SEQ ID NO: 312782 - RNA, 64 nt, Homo Sapiens
gccaggggcaguuggcaaaaguccaaguagagauuacacccagaacaccauuccuuccaggagc

SEQ ID NO: 312783 - RNA, 64 nt, Homo Sapiens
uugggugcccaggauacuggugccuggccccacguacacccacauacuucucagauggcuccca

SEQ ID NO: 312784 - RNA, 64 nt, Homo Sapiens
aguucacaaguagauguaauuuacuaaagaaugauacacccauaugcuauauacagcuuaacuc

SEQ ID NO: 312785 - RNA, 64 nt, Homo Sapiens
aaaggcagcuguucuagaguuucagucaccuaaguacacccacaaaacaauaugaauauggaga

SEQ ID NO: 312786 - RNA, 64 nt, Homo Sapiens
auaaugggcauuacugaauuuuuaaaaugccgauuacacccaaauauugugcacauuuaauaau

SEQ ID NO: 312787 - RNA, 64 nt, Homo Sapiens
uugaguagugagaguuuuagaccuuugucuuuaguacacccaaggaucaacugcuccugaagca

SEQ ID NO: 312788 - RNA, 64 nt, Homo Sapiens
uuccaaugugaacucuugccucuugagaugcaauuacacccaaucuaagcucugcuuaugccua

SEQ ID NO: 312789 - RNA, 64 nt, Homo Sapiens
augugagcaaacacacacaccacacagacacacauacacccaugcauacacaccccugaacaca

SEQ ID NO: 312790 - RNA, 64 nt, Homo Sapiens
cuacugaacaucguagcuuagaaaaugcauugaauacacccaacaguccaaaauauuggaaguu

SEQ ID NO: 312791 - RNA, 64 nt, Homo Sapiens
cucuagcuucaguugacuucuugacucucuccccuacacccacuaccuggcauccaggaccaaa

SEQ ID NO: 312792 - RNA, 64 nt, Homo Sapiens
gagugacgguugaagaaucaagcucauaauaugauacacccagacagacccagaaaucuuuuga

SEQ ID NO: 312793 - RNA, 64 nt, Homo Sapiens
gucgcugcaaccuacccucucucugccucagccuuacacccaagcaguaggucugugcucuccc

SEQ ID NO: 312794 - RNA, 64 nt, Homo Sapiens
acaaaacacaaacccugaaggaaaaccuuuuccauacacccaggcuaugcauugaagaguuuuc

SEQ ID NO: 312795 - RNA, 64 nt, Homo Sapiens
gcugcggcuacacauuccacaaagugcuggcacuuacacccacaacccggaaggcuguggaccg

SEQ ID NO: 312796 - RNA, 64 nt, Homo Sapiens
ugaguaaaauugugcuaaccaguuaaaaguacuguacacccaugcucaauauauaguccuggaa

SEQ ID NO: 312797 - RNA, 64 nt, Homo Sapiens
uggcgugcugucugucugcacguaagcauguuccuacacccacaagcagagacacgcacaugca

SEQ ID NO: 312798 - RNA, 64 nt, Homo Sapiens
uacaguacaaaagauuauuauuacuucuguuuuuuacacccacaaaaguuguacauacauguga

SEQ ID NO: 312799 - RNA, 64 nt, Homo Sapiens
uuauugcauuaagaauccuguagacagacacacauacacccaaauuguuccauggguguacacg

SEQ ID NO: 312800 - RNA, 64 nt, Homo Sapiens
agagucccggugcccucuguugaaugugaagcacuacacccagcgcaaagcauccaggcgguuc

SEQ ID NO: 312801 - RNA, 64 nt, Homo Sapiens
uccugugcaggcugccgggcacucccugccgugcuacacccagagcccuccucucaccgccccc

SEQ ID NO: 312802 - RNA, 64 nt, Homo Sapiens
gugugggagcguguugaagauuuuaaguggucucuacacccaaauagugguauucuaaucccgu

SEQ ID NO: 312803 - RNA, 64 nt, Homo Sapiens
aaaugauuuuccauacauuguacugaucaaguuauacacccagggguauauacacuuucuucau

SEQ ID NO: 312804 - RNA, 64 nt, Homo Sapiens
uuuguacaugcuuuuaggacagaauggagacuuauacacccaaaguuuaucuguguuuguuugu

SEQ ID NO: 312805 - RNA, 64 nt, Homo Sapiens
ucuguaauacaauuuuguccuaauuugccuaauuuacacccacauuuuuuccaagauucagcuc

SEQ ID NO: 312806 - RNA, 64 nt, Homo Sapiens
ucaauucccucuccaggacuccgcaccacuccccuacacccagagcauucucuuccccucaucu

SEQ ID NO: 312807 - RNA, 64 nt, Homo Sapiens
acagcagggacaagauacauaugaggacaagguauacacccaguucugaauaacuugaagaaca

SEQ ID NO: 312808 - RNA, 64 nt, Homo Sapiens
uuggcacccugauuauucauucuucacagacacauacacccaucgcagauguagcccuugccca

SEQ ID NO: 312809 - RNA, 64 nt, Homo Sapiens
gcucugcccuuuucccuuucuccucugcagucuuuacacccacaaaggaggagagaaaagcugg

SEQ ID NO: 312810 - RNA, 64 nt, Homo Sapiens
aagucaaugagggacuucuucaugggguaccaccuacacccaacucucuuuuggugugggagga

SEQ ID NO: 312811 - RNA, 64 nt, Homo Sapiens
ucaaaaaacaccacccaccaaauugcacaauagauacacccacaaaguugagauucagcguugu

SEQ ID NO: 312812 - RNA, 64 nt, Homo Sapiens
ugucuuuccagaaguucaucucaagccaauuuacuacacccaguauucuuucaauuccugcucu

SEQ ID NO: 312813 - RNA, 64 nt, Homo Sapiens
aacccgccuuggcccacaggugcccaggucaccuuacacccagcuuaaucccauguugacagga

SEQ ID NO: 312814 - RNA, 64 nt, Homo Sapiens
auccuuuuguguuuuuuuguucuacugagauuguuacacccagaaaccagagucacccgcuggc

SEQ ID NO: 312815 - RNA, 64 nt, Homo Sapiens
aauagagacgggacugcggacagaccauggacacuacacccagcccucaccccccagaugaggc

SEQ ID NO: 312816 - RNA, 64 nt, Homo Sapiens
uaauuuuuaaacuauaauuucaggcacgcgccacuacacccagccuugugaauaccugggacuu

SEQ ID NO: 312817 - RNA, 64 nt, Homo Sapiens
gccucugacucuguccccaucgcucgcucuuuuuuacacccaguaauggaccaaaugugccaca

SEQ ID NO: 312818 - RNA, 64 nt, Homo Sapiens
augggcaucuuuuguauuaaaaaauauauguauauacacccaaggucaacaguaaaccacugaa

SEQ ID NO: 312819 - RNA, 64 nt, Homo Sapiens
cuggcccagggccggcuuuguggcgcccuggcccuacacccagcccgcugaccuccgcuccucg

SEQ ID NO: 312820 - RNA, 64 nt, Homo Sapiens
cugggcccuacagccuggagaaccuggagaauccuacacccacagaacccggcuuuguccccaa

SEQ ID NO: 312821 - RNA, 64 nt, Homo Sapiens
aagcccucgugcacacacacaaauuauucagauguacacccacccacauaucuuacagccagag

SEQ ID NO: 312822 - RNA, 64 nt, Homo Sapiens
gaaaaauaaucuuagaacagauggcugugaaaauuacacccaugcacagaacaagccacaggaa

SEQ ID NO: 312823 - RNA, 64 nt, Homo Sapiens
cagaauaauagagcagauaauauauagaguuccauacacccacugcaccccauacccucauucc

SEQ ID NO: 312824 - RNA, 64 nt, Homo Sapiens
gaauuugaauggguuugauuugcaaauuuggauuuacacccauuguuuuggaagcacaucagcu

SEQ ID NO: 312825 - RNA, 64 nt, Homo Sapiens
aucuggugccaagaucuacauuucaacccugccuuacacccagagcguccagaucugccacaua

SEQ ID NO: 312826 - RNA, 64 nt, Homo Sapiens
cauggcuugacuuccuucauuucccuaacugaaauacacccacucucuuggaauaaugacguac

SEQ ID NO: 312827 - RNA, 64 nt, Homo Sapiens
gcggucugugguagagaacuccggacccaguggcuacacccacaacaacccguuugcugcagag

SEQ ID NO: 312828 - RNA, 64 nt, Homo Sapiens
uggggcccgcuuugccacgacucugacacacaaguacacccaucgcucccagccccucuuggca

SEQ ID NO: 312829 - RNA, 64 nt, Homo Sapiens
caaaagucacccagggacacgccuguuucuucucuacacccaccuagccccucacuuccagcuu

SEQ ID NO: 312830 - RNA, 64 nt, Homo Sapiens
auucuauuuggcuaauuaagaaugauauacuauguacacccaauaagcuguacuagaaugaaua

SEQ ID NO: 312831 - RNA, 64 nt, Homo Sapiens
accagggauuucaagagucaaggugcaaguugccuacacccaauucuccugcggacuucauugc

SEQ ID NO: 312832 - RNA, 64 nt, Homo Sapiens
agggugacuauuuccccugacaucugaagagcuguacacccacagccugcauucuagugcaaaa

SEQ ID NO: 312833 - RNA, 64 nt, Homo Sapiens
gguaauaaacguguacaaguucuuagauuccccauacacccaagaguauggauuucagaggugc

SEQ ID NO: 312834 - RNA, 64 nt, Homo Sapiens
aggauuucaggcugagugugguggcucacgccuauacacccagcacuuuggaaggcugaggaag

SEQ ID NO: 312835 - RNA, 64 nt, Homo Sapiens
accacugcgaggccugcgggaaggacuuccucuuuacacccacagaggugcugcgccaccggaa

SEQ ID NO: 312836 - RNA, 64 nt, Homo Sapiens
ggaaaggagagagauucuguuuccugaggcuuaauacacccaacauuauaacaaaggacuguag

SEQ ID NO: 312837 - RNA, 64 nt, Homo Sapiens
cccacccggcccgucgugacauuugguguuaacauacacccaagauuuuuuucuuuuuucuccu

SEQ ID NO: 312838 - RNA, 64 nt, Homo Sapiens
ggggccaguucagagacccaccauaagagauggcuacacccagguuucaccccugcagucucga

SEQ ID NO: 312839 - RNA, 64 nt, Homo Sapiens
auaaaaaccugaaaaccaaccccgcugccagaaauacacccacagacugccucaccaccccugu

SEQ ID NO: 312840 - RNA, 64 nt, Homo Sapiens
aguggcauagccccuuuuccgguauggggucuccuacacccacgcgcaccaccucuccggucgc

SEQ ID NO: 312841 - RNA, 64 nt, Homo Sapiens
ccaaguaaacucacuccuuuucccccacagggguuacacccaucugguugucccacccacucuu

SEQ ID NO: 312842 - RNA, 64 nt, Homo Sapiens
aaaaaaaaaaaaaaaaaagaauaagaggugauauuacacccaugaaacaagaauaagaugcuau

SEQ ID NO: 312843 - RNA, 64 nt, Homo Sapiens
gagguauuuaucuuuacuuuacugucauagaaauuacacccaaauauuaaauugauguugcugg

SEQ ID NO: 312844 - RNA, 64 nt, Homo Sapiens
cguguguaccgggggugaauaugugcaugcagccuacacccacaaaggagucuguguggugugu

SEQ ID NO: 312845 - RNA, 64 nt, Homo Sapiens
agcaaggccuuggauuucugggcccaagcagaaguacacccacaccuaaccagccacagccaag

SEQ ID NO: 312846 - RNA, 64 nt, Homo Sapiens
gguggagcagguggcuuaggagagcucacucuuuuacacccagaacucgguucuccaacagccc

SEQ ID NO: 312847 - RNA, 64 nt, Homo Sapiens
auauuucuaauaauauaugguauguugcauuauauacacccaugcagucaaagcuggacauuuu

SEQ ID NO: 312848 - RNA, 64 nt, Homo Sapiens
aagccaauggaacccuugauuuccuaccucaguguacacccaacuauugguuguaucaguuugu

SEQ ID NO: 312849 - RNA, 64 nt, Homo Sapiens
agaggacuccagccuucucgcugcagggcagcuguacacccagcucauagacgcuucacagagc

SEQ ID NO: 312850 - RNA, 64 nt, Homo Sapiens
ucuucaggaacucuuccccuccauguggcuaaaauacacccauuugcugcuuccaaguuugagu

SEQ ID NO: 312851 - RNA, 64 nt, Homo Sapiens
gaucuacacaaacuacaaaaguuaauuuucuuguuacacccacugcacucugcaaccaguguug

SEQ ID NO: 312852 - RNA, 64 nt, Homo Sapiens
cuucauggccacgcccgaguuucugaucaaugacuacacccacaacaucccgcucauugacgac

SEQ ID NO: 312853 - RNA, 64 nt, Homo Sapiens
guugucagcuuuggauugcuccaccccucauaccuacacccaagagacacuccccccuccauuc

SEQ ID NO: 312854 - RNA, 64 nt, Homo Sapiens
cuuuccuucuucuauggacuucagacagccagugucuggggacucugccacucuacccccagcc

SEQ ID NO: 312855 - RNA, 64 nt, Homo Sapiens
ggcugagccugggcgugguggguggggugauggcucuggggagcggcugccauccuacaagcca

SEQ ID NO: 312856 - RNA, 64 nt, Homo Sapiens
cggcucuggcucuugccuucuccucccagcaugcucuggggaggagaggcggcucuggugcccc

SEQ ID NO: 312857 - RNA, 64 nt, Homo Sapiens
cggcucuggugcccauccucuccucccagcacgcucuggggaggagaggcggcucuggugccca

SEQ ID NO: 312858 - RNA, 64 nt, Homo Sapiens
uggauguaggcuuuuucuaacacacguguacagaucuggggauucuggagccuccauccgcagu

SEQ ID NO: 312859 - RNA, 64 nt, Homo Sapiens
ugggguuuggcuuuagcaacaguuuugucuggaaucuggggacagauguggacuggagcagggg

SEQ ID NO: 312860 - RNA, 64 nt, Homo Sapiens
auccuggccucuggcauauucaucaaguaugaguucuggggaugagucacuguaaugaugugag

SEQ ID NO: 312861 - RNA, 64 nt, Homo Sapiens
ccagagcaauuuauacuuuacccucaggcuguccucuggggagaaggugccauggucuuaggug

SEQ ID NO: 312862 - RNA, 64 nt, Homo Sapiens
auuuauaaauuauuaugacaccuuuggguugcaaucuggggauacuggcaaagcagaaaauugu

SEQ ID NO: 312863 - RNA, 64 nt, Homo Sapiens
aauucucuguuugucuguuguggaaauaaaaccuucuggggaugaaucaaaacuaucugacaau

SEQ ID NO: 312864 - RNA, 64 nt, Homo Sapiens
agcaggccaccaagagcacaaccccagggcgaggucuggggaggccucccagcccgccucuguu

SEQ ID NO: 312865 - RNA, 64 nt, Homo Sapiens
uccuuccuggcccuugcauggaugcaguugugacucuggggacaaugcagccagaagcugaggg

SEQ ID NO: 312866 - RNA, 64 nt, Homo Sapiens
aggaggcuggaggccaggaccuuggaaaagguuuucuggggaggaaaugaugacugagaacagg

SEQ ID NO: 312867 - RNA, 64 nt, Homo Sapiens
ugcugggcauucacucuauugggaaagaggugcuucuggggaagugcuccuaggaccucccuug

SEQ ID NO: 312868 - RNA, 64 nt, Homo Sapiens
aggggccucuggccuggcugaguucacagcccagucuggggacagcuggguaugaggugcuuac

SEQ ID NO: 312869 - RNA, 64 nt, Homo Sapiens
agaagguccugcagcccccuuccccuggguguguucuggggaccugugguuugcuggcggaaac

SEQ ID NO: 312870 - RNA, 64 nt, Homo Sapiens
cagcuuccuugucggaggggaaaaggacaggugaucuggggaaaacgcagcuacaccuggagca

SEQ ID NO: 312871 - RNA, 64 nt, Homo Sapiens
uaaccugaaacauguuacugggacucgacauuuuucuggggauugaaaucuuuaguccuuggag

SEQ ID NO: 312872 - RNA, 64 nt, Homo Sapiens
ggcuccguguagcaacccagcuuccccaucgccuucuggggagggcagucagcacagagagcgg

SEQ ID NO: 312873 - RNA, 64 nt, Homo Sapiens
gacacagaggacagcuuccccuuccccauugccuucuggggagggcagucagcacagagagcgg

SEQ ID NO: 312874 - RNA, 64 nt, Homo Sapiens
gacacagaggacggcuuccccuuccccauugccuucuggggagggcaguuagcacagaggaugg

SEQ ID NO: 312875 - RNA, 64 nt, Homo Sapiens
ugguuugaauggagauucuggugcuugcagaucaucuggggaccagugcuucuccaacacugaa

SEQ ID NO: 312876 - RNA, 64 nt, Homo Sapiens
gagugugggagugcagagaagaaauucauguggaucuggggacuagcaaggauaucagagcugg

SEQ ID NO: 312877 - RNA, 64 nt, Homo Sapiens
agcaccccugcccccgguggagggguuguugcuuucuggggaggaggacgguugacggcccugc

SEQ ID NO: 312878 - RNA, 64 nt, Homo Sapiens
cugccgaugcuccguucacauaagccagugugguucuggggaccugaggagcccuguggcaccc

SEQ ID NO: 312879 - RNA, 64 nt, Homo Sapiens
aggcagccagcaucugggcccccaggaagucucaucuggggagccauggugcugggagaggcag

SEQ ID NO: 312880 - RNA, 64 nt, Homo Sapiens
gggucugcucccaaggggccuugccaggugacugucuggggagcgucaugaggagauucugccu

SEQ ID NO: 312881 - RNA, 64 nt, Homo Sapiens
cgggcugggguuuauuuaaacuguucugugugggucuggggagggagagcaccuuaauauuauu

SEQ ID NO: 312882 - RNA, 64 nt, Homo Sapiens
aguucucacugucuccuggucugugcugcccugcucuggggaugcacggcggcaggguggggga

SEQ ID NO: 312883 - RNA, 64 nt, Homo Sapiens
ugucuguguuccacaccuugccccuccucccccaucuggggauguuguacccguguccuugucu

SEQ ID NO: 312884 - RNA, 64 nt, Homo Sapiens
gcauuuugguuuuuuauucccagguuagggccacucuggggaagccacuggugggugccaggga

SEQ ID NO: 312885 - RNA, 64 nt, Homo Sapiens
aagagcaaguagaaaagugguccuuagacucacgucuggggaggaaaggagugagcacuuuggg

SEQ ID NO: 312886 - RNA, 64 nt, Homo Sapiens
agaccuagaaacaagcuuucucauguccugggauucuggggaagccuccugaccccucucuccc

SEQ ID NO: 312887 - RNA, 64 nt, Homo Sapiens
cucuuuaagaaaaagaauucgaaggucauacaauucuggggacuacaggaguggauccaggccu

SEQ ID NO: 312888 - RNA, 64 nt, Homo Sapiens
cauuuuuuauguguuaucuuagacaggaagaugcucuggggacaaguuguagcagagggaaaug

SEQ ID NO: 312889 - RNA, 64 nt, Homo Sapiens
auacugugugcucuccccauagcuccuuaaacccucuggggagcugaacccucccaacuguggg

SEQ ID NO: 312890 - RNA, 64 nt, Homo Sapiens
cuuggcucugagccucuagcuucccagcuccuugucuggggagcgaucuaccugcccaggccca

SEQ ID NO: 312891 - RNA, 64 nt, Homo Sapiens
cuagguaggugauuguacguggaacuuacaugggucuggggaggccuguauucccuguuucuca

SEQ ID NO: 312892 - RNA, 64 nt, Homo Sapiens
accccaagggccggagacccuggcagaagaguccucuggggaggaagaaugcacucugcaggcc

SEQ ID NO: 312893 - RNA, 64 nt, Homo Sapiens
ggacuggcaaaacauuccagaaugaagagagcugucuggggagagcccuucuucccuucuccac

SEQ ID NO: 312894 - RNA, 64 nt, Homo Sapiens
augauuucguuaguuuuauuaucuguuuacuuccucuggggaaggcagacugauaaaauuauau

SEQ ID NO: 312895 - RNA, 64 nt, Homo Sapiens
accuuucucagcuggcuguggggaccugucagagucuggggacucggcgugcagggcgggcucc

SEQ ID NO: 312896 - RNA, 64 nt, Homo Sapiens
aggaaggcggccgcuggggcuccugggcauccucucuggggagcugcuggccgcuuagcguugu

SEQ ID NO: 312897 - RNA, 64 nt, Homo Sapiens
caguggaugaagacgucccuucagccauguggccucuggggaaugugaauucacaucuaggacc

SEQ ID NO: 312898 - RNA, 64 nt, Homo Sapiens
auacuuauggucggaagucggugucaauggaggaucuggggaaagcuguuuguagguggcuaca

SEQ ID NO: 312899 - RNA, 64 nt, Homo Sapiens
ucguguuuccgguacuggguaaaaugauucuaccucuggggauaaggauucacauucgcucuag

SEQ ID NO: 312900 - RNA, 64 nt, Homo Sapiens
agaaagagagggcagugagggugaggagaggggaucuggggacuugggugugacaccugcuuga

SEQ ID NO: 312901 - RNA, 64 nt, Homo Sapiens
ccccaaauguccaucuuucucagacggggcucugucuggggagcacccacaggcugccuuuggg

SEQ ID NO: 312902 - RNA, 64 nt, Homo Sapiens
gccaguccuguccuccuuucccuguucugcccacucuggggaauagggaggggaggagaggaga

SEQ ID NO: 312903 - RNA, 64 nt, Homo Sapiens
uguccccagugguauguauguaugugcuaggcagucuggggacccccugugucucugaccaccc

SEQ ID NO: 312904 - RNA, 64 nt, Homo Sapiens
aguauggcagauggcacagagaaagggaaggggcucuggggacuucuccuucuaugaaagccuc

SEQ ID NO: 312905 - RNA, 64 nt, Homo Sapiens
gcuuccucacaccccuguccacuccccagggagcucuggggacaguuggcuuugcccaccccuc

SEQ ID NO: 312906 - RNA, 64 nt, Homo Sapiens
cagguccaccgagccccugagaguggcuugagcuucuggggauggguggugggcaggugacacg

SEQ ID NO: 312907 - RNA, 64 nt, Homo Sapiens
aacugccuuccucccccugaccccgccccggccuucuggggaaggaacaaaguccccaaacaaa

SEQ ID NO: 312908 - RNA, 64 nt, Homo Sapiens
aaaaauucuauuuuuguuguaauguccucgcggcucuggggacgcuaaaagaaccgggccugcc

SEQ ID NO: 312909 - RNA, 64 nt, Homo Sapiens
ugaugcuccuccgggucugcgucgggcgugggucucuggggacccuccagagguggaggugggc

SEQ ID NO: 312910 - RNA, 64 nt, Homo Sapiens
ugauuuuuuuucuugguuucuggauaaaccacccucuggggacaggauaauaaaacauguaaua

SEQ ID NO: 312911 - RNA, 64 nt, Homo Sapiens
cucgccggggaagauggggcuucuuguauauugcucuggggacucugucccuuugaguuccugc

SEQ ID NO: 312912 - RNA, 64 nt, Homo Sapiens
agauuuugggucuggaucucugugggcucggcuaucuggggagcauuugggcaguucccagucc

SEQ ID NO: 312913 - RNA, 64 nt, Homo Sapiens
ggcugaggacaaauaccugcacacucccagggacucuggggagauucccuccacaauaacagaa

SEQ ID NO: 312914 - RNA, 64 nt, Homo Sapiens
caggggccccagcacccuccgucugccugcacacucuggggagcgaugagcuagggcucugggg

SEQ ID NO: 312915 - RNA, 64 nt, Homo Sapiens
ggggcccacccccuucgugcgcaugcuuaaugcuucuggggaggagggggcuggucccagcgga

SEQ ID NO: 312916 - RNA, 64 nt, Homo Sapiens
agaaaacuaaaaaccaaggcaccuuaccagucugucuggggacaggaucccugcugcaccuucc

SEQ ID NO: 312917 - RNA, 64 nt, Homo Sapiens
gaaggagaagcugguggccacagcagaguccugcucuggggacgccugcuucauuuacaagccu

SEQ ID NO: 312918 - RNA, 64 nt, Homo Sapiens
ugucucgcaacagagccugggcugcuccuccugcucuggggagucuaggccguggggacuguuc

SEQ ID NO: 312919 - RNA, 64 nt, Homo Sapiens
uccugcucuggggagucuaggccguggggacuguucuggggaggcucaugcugucuccaugacg

SEQ ID NO: 312920 - RNA, 64 nt, Homo Sapiens
uagagcaaaggagggaccucgagcccucagcaggucuggggagccacggaagccccaggcuuua

SEQ ID NO: 312921 - RNA, 64 nt, Homo Sapiens
cccugcuucuaucuuggcugcggggaccuggcauucuggggagaaggaaggccagggagguccc

SEQ ID NO: 312922 - RNA, 64 nt, Homo Sapiens
cagccuucgacagggacaucggcaccuuuggaucucuggggacacaccugccaacaggccuugc

SEQ ID NO: 312923 - RNA, 64 nt, Homo Sapiens
cugagagugccuaguccccaugcuccaccaaggcucuggggaacuggggccuuucuugaucucc

SEQ ID NO: 312924 - RNA, 64 nt, Homo Sapiens; identical to SEQ ID NO: 110917

SEQ ID NO: 312925 - RNA, 64 nt, Homo Sapiens; identical to SEQ ID NO: 110918

SEQ ID NO: 312926 - RNA, 64 nt, Homo Sapiens; identical to SEQ ID NO: 110919

SEQ ID NO: 312927 - RNA, 64 nt, Homo Sapiens; identical to SEQ ID NO: 110920

SEQ ID NO: 312928 - RNA, 64 nt, Homo Sapiens; identical to SEQ ID NO: 110921

SEQ ID NO: 312929 - RNA, 64 nt, Homo Sapiens; identical to SEQ ID NO: 110922

SEQ ID NO: 312930 - RNA, 64 nt, Homo Sapiens; identical to SEQ ID NO: 110923

SEQ ID NO: 312931 - RNA, 64 nt, Homo Sapiens; identical to SEQ ID NO: 110924

SEQ ID NO: 312932 - RNA, 64 nt, Homo Sapiens; identical to SEQ ID NO: 110925

SEQ ID NO: 312933 - RNA, 64 nt, Homo Sapiens; identical to SEQ ID NO: 110926

SEQ ID NO: 312934 - RNA, 64 nt, Homo Sapiens; identical to SEQ ID NO: 110927

SEQ ID NO: 312935 - RNA, 64 nt, Homo Sapiens; identical to SEQ ID NO: 110928

SEQ ID NO: 312936 - RNA, 61 nt, Homo Sapiens; identical to SEQ ID NO: 110929

SEQ ID NO: 312937 - RNA, 64 nt, Homo Sapiens; identical to SEQ ID NO: 110930

SEQ ID NO: 312938 - RNA, 64 nt, Homo Sapiens; identical to SEQ ID NO: 110931

SEQ ID NO: 312939 - RNA, 64 nt, Homo Sapiens; identical to SEQ ID NO: 110932

SEQ ID NO: 312940 - RNA, 64 nt, Homo Sapiens; identical to SEQ ID NO: 110933

SEQ ID NO: 312941 - RNA, 64 nt, Homo Sapiens; identical to SEQ ID NO: 110934

SEQ ID NO: 312942 - RNA, 64 nt, Homo Sapiens; identical to SEQ ID NO: 110935

SEQ ID NO: 312943 - RNA, 64 nt, Homo Sapiens; identical to SEQ ID NO: 110936

SEQ ID NO: 312944 - RNA, 64 nt, Homo Sapiens; identical to SEQ ID NO: 110937

SEQ ID NO: 312945 - RNA, 64 nt, Homo Sapiens; identical to SEQ ID NO: 110938

SEQ ID NO: 312946 - RNA, 64 nt, Homo Sapiens; identical to SEQ ID NO: 110939

SEQ ID NO: 312947 - RNA, 64 nt, Homo Sapiens; identical to SEQ ID NO: 110940

SEQ ID NO: 312948 - RNA, 64 nt, Homo Sapiens; identical to SEQ ID NO: 110941

SEQ ID NO: 312949 - RNA, 64 nt, Homo Sapiens; identical to SEQ ID NO: 110942

SEQ ID NO: 312950 - RNA, 64 nt, Homo Sapiens; identical to SEQ ID NO: 110943

SEQ ID NO: 312951 - RNA, 64 nt, Homo Sapiens; identical to SEQ ID NO: 110944

SEQ ID NO: 312952 - RNA, 64 nt, Homo Sapiens; identical to SEQ ID NO: 110945

SEQ ID NO: 312953 - RNA, 64 nt, Homo Sapiens; identical to SEQ ID NO: 110946

SEQ ID NO: 312954 - RNA, 64 nt, Homo Sapiens; identical to SEQ ID NO: 110947

SEQ ID NO: 312955 - RNA, 64 nt, Homo Sapiens; identical to SEQ ID NO: 110948

SEQ ID NO: 312956 - RNA, 64 nt, Homo Sapiens; identical to SEQ ID NO: 110949

SEQ ID NO: 312957 - RNA, 64 nt, Homo Sapiens; identical to SEQ ID NO: 110950

SEQ ID NO: 312958 - RNA, 64 nt, Homo Sapiens; identical to SEQ ID NO: 110951

SEQ ID NO: 312959 - RNA, 64 nt, Homo Sapiens; identical to SEQ ID NO: 110952

SEQ ID NO: 312960 - RNA, 64 nt, Homo Sapiens; identical to SEQ ID NO: 110953

SEQ ID NO: 312961 - RNA, 64 nt, Homo Sapiens; identical to SEQ ID NO: 110954

SEQ ID NO: 312962 - RNA, 64 nt, Homo Sapiens; identical to SEQ ID NO: 110955

SEQ ID NO: 312963 - RNA, 64 nt, Homo Sapiens; identical to SEQ ID NO: 110956

SEQ ID NO: 312964 - RNA, 64 nt, Homo Sapiens; identical to SEQ ID NO: 110957

SEQ ID NO: 312965 - RNA, 64 nt, Homo Sapiens; identical to SEQ ID NO: 110958

SEQ ID NO: 312966 - RNA, 64 nt, Homo Sapiens; identical to SEQ ID NO: 72205

SEQ ID NO: 312967 - RNA, 64 nt, Homo Sapiens; identical to SEQ ID NO: 72206

SEQ ID NO: 312968 - RNA, 64 nt, Homo Sapiens; identical to SEQ ID NO: 72207

SEQ ID NO: 312969 - RNA, 64 nt, Homo Sapiens; identical to SEQ ID NO: 72208

SEQ ID NO: 312970 - RNA, 64 nt, Homo Sapiens; identical to SEQ ID NO: 72209

SEQ ID NO: 312971 - RNA, 64 nt, Homo Sapiens; identical to SEQ ID NO: 72210

SEQ ID NO: 312972 - RNA, 64 nt, Homo Sapiens; identical to SEQ ID NO: 72211

SEQ ID NO: 312973 - RNA, 64 nt, Homo Sapiens; identical to SEQ ID NO: 72212

SEQ ID NO: 312974 - RNA, 64 nt, Homo Sapiens; identical to SEQ ID NO: 72213

SEQ ID NO: 312975 - RNA, 64 nt, Homo Sapiens; identical to SEQ ID NO: 72214

SEQ ID NO: 312976 - RNA, 64 nt, Homo Sapiens; identical to SEQ ID NO: 72215

SEQ ID NO: 312977 - RNA, 64 nt, Homo Sapiens; identical to SEQ ID NO: 72216

SEQ ID NO: 312978 - RNA, 64 nt, Homo Sapiens; identical to SEQ ID NO: 72217

SEQ ID NO: 312979 - RNA, 64 nt, Homo Sapiens; identical to SEQ ID NO: 72218

SEQ ID NO: 312980 - RNA, 64 nt, Homo Sapiens; identical to SEQ ID NO: 72219

SEQ ID NO: 312981 - RNA, 64 nt, Homo Sapiens; identical to SEQ ID NO: 72220

SEQ ID NO: 312982 - RNA, 64 nt, Homo Sapiens; identical to SEQ ID NO: 72221

SEQ ID NO: 312983 - RNA, 64 nt, Homo Sapiens; identical to SEQ ID NO: 72222

SEQ ID NO: 312984 - RNA, 64 nt, Homo Sapiens; identical to SEQ ID NO: 72223

SEQ ID NO: 312985 - RNA, 64 nt, Homo Sapiens; identical to SEQ ID NO: 72224

SEQ ID NO: 312986 - RNA, 64 nt, Homo Sapiens; identical to SEQ ID NO: 72225

SEQ ID NO: 312987 - RNA, 64 nt, Homo Sapiens; identical to SEQ ID NO: 72226

SEQ ID NO: 312988 - RNA, 64 nt, Homo Sapiens; identical to SEQ ID NO: 72227

SEQ ID NO: 312989 - RNA, 64 nt, Homo Sapiens; identical to SEQ ID NO: 72228

SEQ ID NO: 312990 - RNA, 64 nt, Homo Sapiens; identical to SEQ ID NO: 72229

SEQ ID NO: 312991 - RNA, 64 nt, Homo Sapiens; identical to SEQ ID NO: 72230

SEQ ID NO: 312992 - RNA, 64 nt, Homo Sapiens; identical to SEQ ID NO: 72231

SEQ ID NO: 312993 - RNA, 64 nt, Homo Sapiens; identical to SEQ ID NO: 72232

SEQ ID NO: 312994 - RNA, 64 nt, Homo Sapiens; identical to SEQ ID NO: 72233

SEQ ID NO: 312995 - RNA, 64 nt, Homo Sapiens; identical to SEQ ID NO: 72234

SEQ ID NO: 312996 - RNA, 64 nt, Homo Sapiens; identical to SEQ ID NO: 72235

SEQ ID NO: 312997 - RNA, 64 nt, Homo Sapiens; identical to SEQ ID NO: 72236

SEQ ID NO: 312998 - RNA, 64 nt, Homo Sapiens; identical to SEQ ID NO: 72237

SEQ ID NO: 312999 - RNA, 64 nt, Homo Sapiens; identical to SEQ ID NO: 72238

SEQ ID NO: 313000 - RNA, 64 nt, Homo Sapiens; identical to SEQ ID NO: 72239

SEQ ID NO: 313001 - RNA, 64 nt, Homo Sapiens; identical to SEQ ID NO: 72240

SEQ ID NO: 313002 - RNA, 64 nt, Homo Sapiens; identical to SEQ ID NO: 72241

SEQ ID NO: 313003 - RNA, 64 nt, Homo Sapiens; identical to SEQ ID NO: 72242

SEQ ID NO: 313004 - RNA, 64 nt, Homo Sapiens; identical to SEQ ID NO: 72243

SEQ ID NO: 313005 - RNA, 64 nt, Homo Sapiens; identical to SEQ ID NO: 72244

SEQ ID NO: 313006 - RNA, 64 nt, Homo Sapiens; identical to SEQ ID NO: 72245

SEQ ID NO: 313007 - RNA, 64 nt, Homo Sapiens; identical to SEQ ID NO: 72246

SEQ ID NO: 313008 - RNA, 64 nt, Homo Sapiens; identical to SEQ ID NO: 72247

SEQ ID NO: 313009 - RNA, 64 nt, Homo Sapiens; identical to SEQ ID NO: 72248

SEQ ID NO: 313010 - RNA, 64 nt, Homo Sapiens; identical to SEQ ID NO: 72249

SEQ ID NO: 313011 - RNA, 64 nt, Homo Sapiens; identical to SEQ ID NO: 72250

SEQ ID NO: 313012 - RNA, 64 nt, Homo Sapiens; identical to SEQ ID NO: 72251

SEQ ID NO: 313013 - RNA, 64 nt, Homo Sapiens; identical to SEQ ID NO: 72252

SEQ ID NO: 313014 - RNA, 64 nt, Homo Sapiens; identical to SEQ ID NO: 72253

SEQ ID NO: 313015 - RNA, 64 nt, Homo Sapiens; identical to SEQ ID NO: 72254

SEQ ID NO: 313016 - RNA, 64 nt, Homo Sapiens; identical to SEQ ID NO: 72255

SEQ ID NO: 313017 - RNA, 64 nt, Homo Sapiens; identical to SEQ ID NO: 72256

SEQ ID NO: 313018 - RNA, 64 nt, Homo Sapiens; identical to SEQ ID NO: 72257

SEQ ID NO: 313019 - RNA, 64 nt, Homo Sapiens; identical to SEQ ID NO: 72258

SEQ ID NO: 313020 - RNA, 64 nt, Homo Sapiens; identical to SEQ ID NO: 72259

SEQ ID NO: 313021 - RNA, 64 nt, Homo Sapiens; identical to SEQ ID NO: 72260

SEQ ID NO: 313022 - RNA, 64 nt, Homo Sapiens; identical to SEQ ID NO: 72261

SEQ ID NO: 313023 - RNA, 64 nt, Homo Sapiens; identical to SEQ ID NO: 72262

SEQ ID NO: 313024 - RNA, 64 nt, Homo Sapiens; identical to SEQ ID NO: 72263

SEQ ID NO: 313025 - RNA, 64 nt, Homo Sapiens; identical to SEQ ID NO: 72264

SEQ ID NO: 313026 - RNA, 64 nt, Homo Sapiens; identical to SEQ ID NO: 72265

SEQ ID NO: 313027 - RNA, 64 nt, Homo Sapiens; identical to SEQ ID NO: 72266

SEQ ID NO: 313028 - RNA, 64 nt, Homo Sapiens; identical to SEQ ID NO: 72267

SEQ ID NO: 313029 - RNA, 64 nt, Homo Sapiens; identical to SEQ ID NO: 72268

SEQ ID NO: 313030 - RNA, 64 nt, Homo Sapiens; identical to SEQ ID NO: 72269

SEQ ID NO: 313031 - RNA, 64 nt, Homo Sapiens; identical to SEQ ID NO: 72270

SEQ ID NO: 313032 - RNA, 64 nt, Homo Sapiens; identical to SEQ ID NO: 72271

SEQ ID NO: 313033 - RNA, 64 nt, Homo Sapiens; identical to SEQ ID NO: 72272

SEQ ID NO: 313034 - RNA, 64 nt, Homo Sapiens; identical to SEQ ID NO: 72273

SEQ ID NO: 313035 - RNA, 64 nt, Homo Sapiens; identical to SEQ ID NO: 95053

SEQ ID NO: 313036 - RNA, 64 nt, Homo Sapiens; identical to SEQ ID NO: 95054

SEQ ID NO: 313037 - RNA, 64 nt, Homo Sapiens; identical to SEQ ID NO: 95055

SEQ ID NO: 313038 - RNA, 64 nt, Homo Sapiens; identical to SEQ ID NO: 95056

SEQ ID NO: 313039 - RNA, 64 nt, Homo Sapiens; identical to SEQ ID NO: 95057

SEQ ID NO: 313040 - RNA, 64 nt, Homo Sapiens; identical to SEQ ID NO: 95058

SEQ ID NO: 313041 - RNA, 64 nt, Homo Sapiens; identical to SEQ ID NO: 95059

SEQ ID NO: 313042 - RNA, 64 nt, Homo Sapiens; identical to SEQ ID NO: 95060

SEQ ID NO: 313043 - RNA, 64 nt, Homo Sapiens; identical to SEQ ID NO: 95061

SEQ ID NO: 313044 - RNA, 64 nt, Homo Sapiens; identical to SEQ ID NO: 95062

SEQ ID NO: 313045 - RNA, 64 nt, Homo Sapiens; identical to SEQ ID NO: 95063

SEQ ID NO: 313046 - RNA, 64 nt, Homo Sapiens; identical to SEQ ID NO: 95064

SEQ ID NO: 313047 - RNA, 64 nt, Homo Sapiens; identical to SEQ ID NO: 95065

SEQ ID NO: 313048 - RNA, 64 nt, Homo Sapiens; identical to SEQ ID NO: 95066

SEQ ID NO: 313049 - RNA, 64 nt, Homo Sapiens; identical to SEQ ID NO: 95067

SEQ ID NO: 313050 - RNA, 64 nt, Homo Sapiens; identical to SEQ ID NO: 95068

SEQ ID NO: 313051 - RNA, 64 nt, Homo Sapiens; identical to SEQ ID NO: 95069

SEQ ID NO: 313052 - RNA, 64 nt, Homo Sapiens; identical to SEQ ID NO: 95070

SEQ ID NO: 313053 - RNA, 64 nt, Homo Sapiens; identical to SEQ ID NO: 95071

SEQ ID NO: 313054 - RNA, 64 nt, Homo Sapiens; identical to SEQ ID NO: 95072

SEQ ID NO: 313055 - RNA, 64 nt, Homo Sapiens; identical to SEQ ID NO: 95073

SEQ ID NO: 313056 - RNA, 64 nt, Homo Sapiens; identical to SEQ ID NO: 95074

SEQ ID NO: 313057 - RNA, 64 nt, Homo Sapiens; identical to SEQ ID NO: 95075

SEQ ID NO: 313058 - RNA, 64 nt, Homo Sapiens; identical to SEQ ID NO: 95076

SEQ ID NO: 313059 - RNA, 64 nt, Homo Sapiens; identical to SEQ ID NO: 95077

SEQ ID NO: 313060 - RNA, 64 nt, Homo Sapiens; identical to SEQ ID NO: 95078

SEQ ID NO: 313061 - RNA, 64 nt, Homo Sapiens; identical to SEQ ID NO: 95079

SEQ ID NO: 313062 - RNA, 64 nt, Homo Sapiens; identical to SEQ ID NO: 64767

SEQ ID NO: 313063 - RNA, 64 nt, Homo Sapiens; identical to SEQ ID NO: 64768

SEQ ID NO: 313064 - RNA, 64 nt, Homo Sapiens; identical to SEQ ID NO: 64769

SEQ ID NO: 313065 - RNA, 64 nt, Homo Sapiens; identical to SEQ ID NO: 64770

SEQ ID NO: 313066 - RNA, 64 nt, Homo Sapiens; identical to SEQ ID NO: 64771

SEQ ID NO: 313067 - RNA, 64 nt, Homo Sapiens; identical to SEQ ID NO: 64772

SEQ ID NO: 313068 - RNA, 64 nt, Homo Sapiens; identical to SEQ ID NO: 64773

SEQ ID NO: 313069 - RNA, 64 nt, Homo Sapiens; identical to SEQ ID NO: 64774

SEQ ID NO: 313070 - RNA, 64 nt, Homo Sapiens; identical to SEQ ID NO: 64775

SEQ ID NO: 313071 - RNA, 64 nt, Homo Sapiens; identical to SEQ ID NO: 64776

SEQ ID NO: 313072 - RNA, 64 nt, Homo Sapiens; identical to SEQ ID NO: 64777

SEQ ID NO: 313073 - RNA, 64 nt, Homo Sapiens; identical to SEQ ID NO: 64778

SEQ ID NO: 313074 - RNA, 64 nt, Homo Sapiens; identical to SEQ ID NO: 64779

SEQ ID NO: 313075 - RNA, 64 nt, Homo Sapiens; identical to SEQ ID NO: 64780

SEQ ID NO: 313076 - RNA, 64 nt, Homo Sapiens; identical to SEQ ID NO: 64781

SEQ ID NO: 313077 - RNA, 64 nt, Homo Sapiens; identical to SEQ ID NO: 64782

SEQ ID NO: 313078 - RNA, 64 nt, Homo Sapiens; identical to SEQ ID NO: 64783

SEQ ID NO: 313079 - RNA, 64 nt, Homo Sapiens; identical to SEQ ID NO: 64784

SEQ ID NO: 313080 - RNA, 64 nt, Homo Sapiens; identical to SEQ ID NO: 64785

SEQ ID NO: 313081 - RNA, 64 nt, Homo Sapiens; identical to SEQ ID NO: 64786

SEQ ID NO: 313082 - RNA, 64 nt, Homo Sapiens; identical to SEQ ID NO: 64787

SEQ ID NO: 313083 - RNA, 64 nt, Homo Sapiens; identical to SEQ ID NO: 64788

SEQ ID NO: 313084 - RNA, 64 nt, Homo Sapiens; identical to SEQ ID NO: 64789

SEQ ID NO: 313085 - RNA, 64 nt, Homo Sapiens; identical to SEQ ID NO: 64790

SEQ ID NO: 313086 - RNA, 64 nt, Homo Sapiens; identical to SEQ ID NO: 64791

SEQ ID NO: 313087 - RNA, 64 nt, Homo Sapiens; identical to SEQ ID NO: 64792

SEQ ID NO: 313088 - RNA, 64 nt, Homo Sapiens; identical to SEQ ID NO: 64793

SEQ ID NO: 313089 - RNA, 64 nt, Homo Sapiens; identical to SEQ ID NO: 64794

SEQ ID NO: 313090 - RNA, 64 nt, Homo Sapiens; identical to SEQ ID NO: 64795

SEQ ID NO: 313091 - RNA, 64 nt, Homo Sapiens; identical to SEQ ID NO: 64796

SEQ ID NO: 313092 - RNA, 64 nt, Homo Sapiens; identical to SEQ ID NO: 64797

SEQ ID NO: 313093 - RNA, 64 nt, Homo Sapiens; identical to SEQ ID NO: 64798

SEQ ID NO: 313094 - RNA, 64 nt, Homo Sapiens; identical to SEQ ID NO: 64799

SEQ ID NO: 313095 - RNA, 64 nt, Homo Sapiens; identical to SEQ ID NO: 64800

SEQ ID NO: 313096 - RNA, 64 nt, Homo Sapiens; identical to SEQ ID NO: 64801

SEQ ID NO: 313097 - RNA, 64 nt, Homo Sapiens; identical to SEQ ID NO: 64802

SEQ ID NO: 313098 - RNA, 64 nt, Homo Sapiens; identical to SEQ ID NO: 64803

SEQ ID NO: 313099 - RNA, 64 nt, Homo Sapiens
uuuuugugguggcuuauccaugucuugucaguaagugaaacauugguagcucuaucuggugaag

SEQ ID NO: 313100 - RNA, 64 nt, Homo Sapiens
aaagaugguugaagauugugagcaucaaaugccugugaaacagcgcauuccacaucagauuuaa

SEQ ID NO: 313101 - RNA, 64 nt, Homo Sapiens
auaucuuuaaaaguuaaaacgacguauuacuguggugaaacaaauauuaugccuuauuauggcu

SEQ ID NO: 313102 - RNA, 64 nt, Homo Sapiens
aauuauguaauuagagucgguguauaagguggaugugaaacauguaaauuacuuucaggcuaua

SEQ ID NO: 313103 - RNA, 64 nt, Homo Sapiens
uucgggcuucugacugcuccauagguuuugacuggugaaacaggggcccagaugacaaccucuc

SEQ ID NO: 313104 - RNA, 64 nt, Homo Sapiens
agagggccucacgccaaacaaacggccuuuucgugugaaacaucuucagggcgggaaaggggcc

SEQ ID NO: 313105 - RNA, 64 nt, Homo Sapiens
uccccacccccuuuauuuugguccucucguaguugugaaacacuugcagagcaaacaaagcaga

SEQ ID NO: 313106 - RNA, 64 nt, Homo Sapiens
ccuagaccgcgaggaaguggaaucuuccuuaaaggugaaacauaaguugagaaguagugcuugg

SEQ ID NO: 313107 - RNA, 64 nt, Homo Sapiens
uacuuugagcuuauuguuuuuggugucuauuauagugaaacaugcaaacccagguucaugaaua

SEQ ID NO: 313108 - RNA, 64 nt, Homo Sapiens
cguuuucauuguucacuucucuaggauauugaaugugaaacaucuuaacauagguuuuuaaaga

SEQ ID NO: 313109 - RNA, 64 nt, Homo Sapiens
ucgcuguuuccagaacggggaggaguaucucauugugaaacagacucuagagugguucuauuug

SEQ ID NO: 313110 - RNA, 64 nt, Homo Sapiens
acugauauuucauuauaauuaguucaccuucccugugaaacaagagaauuguaaaauguugugg

SEQ ID NO: 313111 - RNA, 64 nt, Homo Sapiens
gaagucucaacagcagaaaagguagauggugugugugaaacaguuuguauauuaaaggucuugg

SEQ ID NO: 313112 - RNA, 64 nt, Homo Sapiens
gaucuuggaagaaauuuugauagcuuaagaagaagugaaacauguuaaacagcucaggaagaaa

SEQ ID NO: 313113 - RNA, 64 nt, Homo Sapiens
agguuaagaaauguggauaauccugucccauuuagugaaacaaauggauacaagaguuaaaacu

SEQ ID NO: 313114 - RNA, 64 nt, Homo Sapiens
uaagaugucaccguagcuuguagauugcugggcagugaaacaguuccccaagugacaauacgua

SEQ ID NO: 313115 - RNA, 64 nt, Homo Sapiens
guuugcugccagcccagaaggaugaaggaaagaagcaccucacagcuccuuucuagguccuucu

SEQ ID NO: 313116 - RNA, 64 nt, Homo Sapiens
uuccucauuggaagcaaagaccuagccaacaacagcaccucaaucugauacacucccgaugcca

SEQ ID NO: 313117 - RNA, 64 nt, Homo Sapiens
caccagacucagcacuagcacuccaucagcacuagcaccucacuccaucagcacuagcaccuca

SEQ ID NO: 313118 - RNA, 64 nt, Homo Sapiens
ccaucagcacuagcaccucacuccaucagcacuagcaccucacuccaucggccccggcacccug

SEQ ID NO: 313119 - RNA, 64 nt, Homo Sapiens
gaccuggugucccugcaugaccuguacugggcgugcaccucaaggcugcgcggguuuccggcug

SEQ ID NO: 313120 - RNA, 64 nt, Homo Sapiens
uaccuggaguuccgguccuuggggagcuggcucagcaccucaccuuuucgaccacuuggagacg

SEQ ID NO: 313121 - RNA, 64 nt, Homo Sapiens
ugcuuaggaaagagggccggagaauaagaagccagcaccucaucagucagcccugcaaugugag

SEQ ID NO: 313122 - RNA, 64 nt, Homo Sapiens
uuucccuuuacucgcuggcagccauugucugugggcaccucauguuuuuccacacucuacuggg

SEQ ID NO: 313123 - RNA, 64 nt, Homo Sapiens
aacccgugccccccgcccgggcgggguacugccugcaccucagaccucugccugggggcucccu

SEQ ID NO: 313124 - RNA, 64 nt, Homo Sapiens
cagggcgcguuuccacuuaaggugugucugucacgcaccucauucuccccagacagucuuugag

SEQ ID NO: 313125 - RNA, 64 nt, Homo Sapiens
ugcauguuaugagcgugugcuuauccguuaaggcuggaggcacaugugggugaugguggaugau

SEQ ID NO: 313126 - RNA, 64 nt, Homo Sapiens
caggguucccggucaguccggcuggccgccuucauggaggcaucauggcagagcacaugagaug

SEQ ID NO: 313127 - RNA, 64 nt, Homo Sapiens
uacccaauuucugggcucuggauccucacagucauggaggcaccgugggccuggcacuugcaaa

SEQ ID NO: 313128 - RNA, 64 nt, Homo Sapiens
aggcucaaaagaggaaauuucaguucugagaagguggaggcaccaacaaagcucacgcccuaug

SEQ ID NO: 313129 - RNA, 64 nt, Homo Sapiens
ugucaucacuacagauaugcgcagaggacaaggcuggaggcauuaugcagcccagugcagccuu

SEQ ID NO: 313130 - RNA, 64 nt, Homo Sapiens
aaggagaggcagggcaggaccauccagcgcugccuggaggcaggugcagaagcaccugcuccgg

SEQ ID NO: 313131 - RNA, 64 nt, Homo Sapiens
ggaccaagaugcagcaaggaccaugggugaccucuggaggcaguagccagguggccugugcucc

SEQ ID NO: 313132 - RNA, 64 nt, Homo Sapiens
agucuagaugcccagagagcugcccggaggggucuggaggcauaaaaaacugacacauggccag

SEQ ID NO: 313133 - RNA, 64 nt, Homo Sapiens
guuacagguugacucaauagaugcugucaguagauggaggcaaguaugggggagaaaagggaaa

SEQ ID NO: 313134 - RNA, 64 nt, Homo Sapiens
agcauuucaagauguaccuucaccucucccugcauggaggcaacccacccaguccauucacccu

SEQ ID NO: 313135 - RNA, 64 nt, Homo Sapiens
ggagcagaggcucaggcacaauugcuggugcugguggaggcagcccugaugcaguuucugugcc

SEQ ID NO: 313136 - RNA, 51 nt, Homo Sapiens
ggucacacgagccagugugaguggaggcagaggagugaggcccacgggcag

SEQ ID NO: 313137 - RNA, 64 nt, Homo Sapiens
gcgaccccccgacauagcaaaagguggcaacccauggaggcagaaagaaggacgccagccugac

SEQ ID NO: 313138 - RNA, 64 nt, Homo Sapiens
cggccaaggccucuagggaaucagcccccugaccuggaggcagcuugagucuuuggaugccaac

SEQ ID NO: 313139 - RNA, 64 nt, Homo Sapiens
cuuagccacuucauuccccuguggcuauuagagcuggaggcaccccuuucaacagaauucacuu

SEQ ID NO: 313140 - RNA, 64 nt, Homo Sapiens
ggcuuccuggugcuggagguucaucauggccagcuggaggcaggucauuuagccuguccuguca

SEQ ID NO: 313141 - RNA, 64 nt, Homo Sapiens
ugguggccaugcuccucuucgccuggucucacccuggaggcaccuuagagccagggggagcugg

SEQ ID NO: 313142 - RNA, 64 nt, Homo Sapiens
aggaagaccuggcuuucuugcuggaccugacccauggaggcagggggggagcccuggugaaggg

SEQ ID NO: 313143 - RNA, 64 nt, Homo Sapiens
uucuugggcugcuacuccagaaaccaguaccuuguggaggcaggaauggaugcuuucuguugag

SEQ ID NO: 313144 - RNA, 64 nt, Homo Sapiens
uucaugugaaucccagggggcagagaggaggcucuggaggcacacaggaugcagccuucccccu

SEQ ID NO: 313145 - RNA, 64 nt, Homo Sapiens
uagcuggcuaucucuggccuuacuaacaccccccuggaggcaugccccuuuucuccagcacaca

SEQ ID NO: 313146 - RNA, 64 nt, Homo Sapiens
cgcugcccgcucagcccagcuguugggaacagcauggaggcagauguggggcugagcuggggaa

SEQ ID NO: 313147 - RNA, 64 nt, Homo Sapiens
agccggcuaugaaagggagcgagccccucggcucuggaggcaaucaagcagacauagaagagcc

SEQ ID NO: 313148 - RNA, 64 nt, Homo Sapiens
gcauuguucuugauuaguuuggcacuccauuacguggaggcagcacagugcagacagaccuaau

SEQ ID NO: 313149 - RNA, 64 nt, Homo Sapiens
aagcagcagaacugacauugggacccagguccauuggaggcaucuuuuaguuaugcgcuugaga

SEQ ID NO: 313150 - RNA, 64 nt, Homo Sapiens
cagccacaacccugccaccuuggggaauccagccuggaggcauccccuaagcagccagccaugg

SEQ ID NO: 313151 - RNA, 64 nt, Homo Sapiens
gaggcauccccuaagcagccagccauggccuggguggaggcaccugaagacgucugucccaaac

SEQ ID NO: 313152 - RNA, 64 nt, Homo Sapiens
uucuauuaguccccacccaaacuuuauugauucaccuccuaaaacaacagauguacgacuugca

SEQ ID NO: 313153 - RNA, 64 nt, Homo Sapiens
uaagacuuaaugagacuuuaaaagcauuuuuuaaccuccuaaguaucaaguauagaaaaucuuc

SEQ ID NO: 313154 - RNA, 64 nt, Homo Sapiens
uggaacugguuguccauuguaugcguccgugaugccuccuaaugucaaucauguuuccucucag

SEQ ID NO: 313155 - RNA, 64 nt, Homo Sapiens
agccuuuccugugagucuuuuuugucucuaguguccuccuaaaccuguauuuauuuucccugug

SEQ ID NO: 313156 - RNA, 64 nt, Homo Sapiens
agccagaaggugcaggggccaggggugggagcaucggagggagucccagagcccuggaccuugg

SEQ ID NO: 313157 - RNA, 64 nt, Homo Sapiens
ugaagagacaggcaccccucccagccguggucaacggagggaguggcacuucugccuugagucc

SEQ ID NO: 313158 - RNA, 64 nt, Homo Sapiens
agguggucuuggggcauggugcagagcaggugaccggagggaaucggugacggagcggggccaa

SEQ ID NO: 313159 - RNA, 64 nt, Homo Sapiens
gaaucggugacggagcggggccaagggagggguccggagggagucagggauggagggcagaggg

SEQ ID NO: 313160 - RNA, 64 nt, Homo Sapiens
uuuguuuuguuuuguuuuuuuuucuauucuuaaaccuuaccauuuguaugaaauaaccacuccg

SEQ ID NO: 313161 - RNA, 64 nt, Homo Sapiens
ggagccgaaucuggucccugggccaccuggggcaccuuaccaccgaagauaaccucuccuccug

SEQ ID NO: 313162 - RNA, 64 nt, Homo Sapiens
uauaugcaaaugacugucaguccuuccaugguuuccuuaccauugcucgcuagcugaucucauu

SEQ ID NO: 313163 - RNA, 64 nt, Homo Sapiens
uacuguccuauagcucauucaaaaauuauuagguccuuaccaguuaaaauacguacauuaaaaa

SEQ ID NO: 313164 - RNA, 64 nt, Homo Sapiens
cacauuuguggacugguggcucuguuacuagaucccuuaccaguuauucugcccaacuccaucc

SEQ ID NO: 313165 - RNA, 64 nt, Homo Sapiens
uuccacgcccuugcagugggucacagcuggguauccuuaccauguguugccuugccacguccug

SEQ ID NO: 313166 - RNA, 64 nt, Homo Sapiens
aaagcgaauaggcaguuagcacagcacagcuaccccuuaccaagcagucuauggaaacaacccc

SEQ ID NO: 313167 - RNA, 64 nt, Homo Sapiens
uguuucuccuucuccccgcuucccugggguuuuuccuuaccauaaguauucugguccgaggguu

SEQ ID NO: 313168 - RNA, 64 nt, Homo Sapiens
ugcagaagcuuuucuguucgccuuuugggcaauuccuuaccaaaaugaaaguauaaccaagcau

SEQ ID NO: 313169 - RNA, 64 nt, Homo Sapiens
agaaagcaaugcaaacugagaccaccucucccgcccuuaccagccuccuguggcggucaccacc

SEQ ID NO: 313170 - RNA, 64 nt, Homo Sapiens
ugaagcuaaagagauguguagcucacaggggcuaccuuaccaguauaaagagcugauaacagua

SEQ ID NO: 313171 - RNA, 64 nt, Homo Sapiens
cucaguccaccaacaacaaacguguuugaauucaccuuaccaauauuaaucccagcguguguaa

SEQ ID NO: 313172 - RNA, 64 nt, Homo Sapiens
ucugaggcuuuaugauaauagauucucuuguauaagauccuagauccuaagggucgaaagcucu

SEQ ID NO: 313173 - RNA, 64 nt, Homo Sapiens
cuuuaugauaauagauucucuuguauaagauccuagauccuaagggucgaaagcucuagaaucu

SEQ ID NO: 313174 - RNA, 64 nt, Homo Sapiens
auugggguuagggagguggggaagagauaaucuuucugauuaccuguuuugucuggauggcugg

SEQ ID NO: 313175 - RNA, 64 nt, Homo Sapiens
aguaucuuggauuaacugaugccugcuagugcuuucugauuacucgcauucuguuucuugcuuu

SEQ ID NO: 313176 - RNA, 64 nt, Homo Sapiens
ccuugguaaauuauauaaaccuaacuugagcagaucugauuauucuuggauaguauucaagugg

SEQ ID NO: 313177 - RNA, 64 nt, Homo Sapiens
uugucaagacuuggcuaaccagugagcuuguagcucugauuaucuagcauuuuuagggucauuc

SEQ ID NO: 313178 - RNA, 64 nt, Homo Sapiens
aaaaagugcuuauuaugugcaacauuaugauuaaucugauuauacaccauuuuugagcagaucu

SEQ ID NO: 313179 - RNA, 64 nt, Homo Sapiens
cuagagaaucaaguuuauuuuauguauauauuuuucugauuauaagaguaauauauguucauug

SEQ ID NO: 313180 - RNA, 64 nt, Homo Sapiens
uucugucuucccuuaggaagaacguuaucucucuucugauuaggaaggacuucccuuuugagua

SEQ ID NO: 313181 - RNA, 64 nt, Homo Sapiens
caauugguucaguaugugaaaccaccauuuccccucugauuaguaaugcuauuuuuauagaaua

SEQ ID NO: 313182 - RNA, 64 nt, Homo Sapiens
agugaaauagcagugauuucaugucccuguauguucugauuaagucuuauaugcagagaggaca

SEQ ID NO: 313183 - RNA, 64 nt, Homo Sapiens
agccuuuggggguugauucacagcauuuaagcuuucugauuauaccucucaaacauucuucugu

SEQ ID NO: 313184 - RNA, 64 nt, Homo Sapiens
aaggaaaugaaugguuccacauaaacagaaaugcucugauuagaugccuuggguuucugugcag

SEQ ID NO: 313185 - RNA, 64 nt, Homo Sapiens
uaaucuuuuacauugaaccuaaccagccucaugcucugauuagacugaagauauuccaacucaa

SEQ ID NO: 313186 - RNA, 64 nt, Homo Sapiens
ucauuucucaguuuauuaauguaaguggcaaauaucugauuaaauaaggucagccucccuuuuu

SEQ ID NO: 313187 - RNA, 64 nt, Homo Sapiens
uggacugcauuaauuggucaauuaauagaacuauucugauuauuauuuugacaguuuaggcuuc

SEQ ID NO: 313188 - RNA, 64 nt, Homo Sapiens
gcuccuguuuagcuuuuauuucaguucuaaccucaguccagaaacauaugugagguuguuuccc

SEQ ID NO: 313189 - RNA, 64 nt, Homo Sapiens
uuagcucuugcuuuaaguguuuguuuguuaucucaguccagaaccaauauuaucguaauuaauu

SEQ ID NO: 313190 - RNA, 64 nt, Homo Sapiens
uuuagucuggcugcaccuaaaagggcuucauuuuaguccagauuuuugcagcaauuacucacua

SEQ ID NO: 313191 - RNA, 64 nt, Homo Sapiens
ccuccuguuggccuuggaaucugaauuaaacuuaaguccagaagcaggaugaggaugucaccaa

SEQ ID NO: 313192 - RNA, 64 nt, Homo Sapiens
acagaugcugcugugcugcagacagauacaugcuaguccagagagccgccccugagauggcugu

SEQ ID NO: 313193 - RNA, 64 nt, Homo Sapiens
aguggaaaauaugaaaagaccacacaggcccagcaguccagaaacugggcaaaaauauucugca

SEQ ID NO: 313194 - RNA, 64 nt, Homo Sapiens
ggccacagagaacucaaacgcugaaggaaggaagaguccagaagaccucauucuucccuuauca

SEQ ID NO: 313195 - RNA, 64 nt, Homo Sapiens
aggccagaaagugaauccagaaugauggaagaagaguccagaacagcucuagagugggagaaag

SEQ ID NO: 313196 - RNA, 64 nt, Homo Sapiens
ccugauucuguuuggacuggggaguguugcucccaguccagaggcugaaucuuugcgggugaag

SEQ ID NO: 313197 - RNA, 64 nt, Homo Sapiens
auuagggucccagaagggggagcccauuucucaaaguccagaaauuggaggcacccccaggggc

SEQ ID NO: 313198 - RNA, 64 nt, Homo Sapiens
ccuuccugucuuucuggcccggacacacagucucaguccagaugggcugcucauuccuucugga

SEQ ID NO: 313199 - RNA, 64 nt, Homo Sapiens
cggggcacuuucagaguuuggaauggggcgaucaaguccagagcaaaccacguggugucccugc

SEQ ID NO: 313200 - RNA, 64 nt, Homo Sapiens
ccccagccccuccucccucacccucagacccaggaguccagaccccaggaguccagccccuccu

SEQ ID NO: 313201 - RNA, 64 nt, Homo Sapiens
ccccagccccuccucccucacccucagacccaggaguccagaccacagauccccagccccuccu

SEQ ID NO: 313202 - RNA, 64 nt, Homo Sapiens
agguuuuguuuuuuuuuuaaaggaaaugcagccuagucuugagaacauaauuuuauauaaucaa

SEQ ID NO: 313203 - RNA, 64 nt, Homo Sapiens
auaucuaauaagaguucaaagaguuaugaguugaagucuugaaugcaggaaacuaucugauagu

SEQ ID NO: 313204 - RNA, 64 nt, Homo Sapiens
aaagugaggccaguguuauuucccgggaguguucagucuugacccuagucacugauuuuuucua

SEQ ID NO: 313205 - RNA, 64 nt, Homo Sapiens
aaaagccaaacuccaagaccaaguaaguuagaggagucuugauuuuuuagacuucacugcggag

SEQ ID NO: 313206 - RNA, 64 nt, Homo Sapiens
aacaggucaaggacagcuuccccagcagaauuccagucuugagauacaagcaugcaccacggca

SEQ ID NO: 313207 - RNA, 64 nt, Homo Sapiens
ucauggccucaagucauccuuugugcggcaagcuagucuugaacagagacagaaucuugcuaug

SEQ ID NO: 313208 - RNA, 64 nt, Homo Sapiens; identical to SEQ ID NO: 103765

SEQ ID NO: 313209 - RNA, 64 nt, Homo Sapiens; identical to SEQ ID NO: 103766

SEQ ID NO: 313210 - RNA, 53 nt, Homo Sapiens; identical to SEQ ID NO: 103767

SEQ ID NO: 313211 - RNA, 64 nt, Homo Sapiens; identical to SEQ ID NO: 103768

SEQ ID NO: 313212 - RNA, 64 nt, Homo Sapiens; identical to SEQ ID NO: 103769

SEQ ID NO: 313213 - RNA, 64 nt, Homo Sapiens; identical to SEQ ID NO: 103770

SEQ ID NO: 313214 - RNA, 53 nt, Homo Sapiens; identical to SEQ ID NO: 103771

SEQ ID NO: 313215 - RNA, 64 nt, Homo Sapiens; identical to SEQ ID NO: 103772

SEQ ID NO: 313216 - RNA, 64 nt, Homo Sapiens; identical to SEQ ID NO: 103773

SEQ ID NO: 313217 - RNA, 64 nt, Homo Sapiens; identical to SEQ ID NO: 103774

SEQ ID NO: 313218 - RNA, 64 nt, Homo Sapiens; identical to SEQ ID NO: 103775

SEQ ID NO: 313219 - RNA, 64 nt, Homo Sapiens; identical to SEQ ID NO: 103776

SEQ ID NO: 313220 - RNA, 64 nt, Homo Sapiens
cucugaaugaugacccuuccuuaauacugggugaugugugaauauuuguuuguuggcagacagg

SEQ ID NO: 313221 - RNA, 64 nt, Homo Sapiens
gauuacaggcauaagccacugcgccuggccuugaugugugaauauuugagaggucauaagcagu

SEQ ID NO: 313222 - RNA, 64 nt, Homo Sapiens
uucacuuuggaugcucugaaacauuuguugauuuugugugaauguuuauaucaaaauguuugcc

SEQ ID NO: 313223 - RNA, 64 nt, Homo Sapiens
gaguaaaauaauuuaauuaauagcucauauuuuaugugugaaaacauguuagugaacauauaua

SEQ ID NO: 313224 - RNA, 64 nt, Homo Sapiens
ucuuaaaaucuaucacuuuucaccuuacacuugaugugugaaaacuauaaaaacaaugugugaa

SEQ ID NO: 313225 - RNA, 64 nt, Homo Sapiens
ccuuacacuugaugugugaaaacuauaaaaacaaugugugaaacccagggguucuaaaauacaa

SEQ ID NO: 313226 - RNA, 64 nt, Homo Sapiens
acauuguaugaaauaaaccuuagaaaaugaaaaaugugugaauauuuguauauuauguauaaau

SEQ ID NO: 313227 - RNA, 64 nt, Homo Sapiens
aucaaaacacaacucaacuaaaagaauuuuuuugugugugaauuaagauaauuuaaccauguga

SEQ ID NO: 313228 - RNA, 64 nt, Homo Sapiens
ccugcauaacuuucgaacuuagccauuccguacaugugugaagucgcauaauauucugugauac

SEQ ID NO: 313229 - RNA, 64 nt, Homo Sapiens
cauacuuuuucaggauucuuuucaaugcugcugcugugugaagcgaaaaaucgauaguguuuuc

SEQ ID NO: 313230 - RNA, 64 nt, Homo Sapiens
aauacauaaagauugguacaacauuuuuaucaaaugugugaauaugauuucacuccuaacugug

SEQ ID NO: 313231 - RNA, 64 nt, Homo Sapiens
cauagauguaaucuugucucaucuacagacaagcugugugaaugcacucccuuggagcucucag

SEQ ID NO: 313232 - RNA, 64 nt, Homo Sapiens
aaauaugaugcaauaaauuguuuugaaaaacaguugugugaauauuucaacuaaucuguguugg

SEQ ID NO: 313233 - RNA, 64 nt, Homo Sapiens
uggaggagguaccagccauauaauaggggguguaugugugaauuuuguuuaaacucuacuguau

SEQ ID NO: 313234 - RNA, 64 nt, Homo Sapiens
ccuacccugguggauuuuauuccuagauuuggguugugugaaucagauuugggcaucuguuuuu

SEQ ID NO: 313235 - RNA, 64 nt, Homo Sapiens
uauucugaauaauugccauucagaaugcuauuuuugugugaaaucaaaauaucauugggccaug

SEQ ID NO: 313236 - RNA, 64 nt, Homo Sapiens
uguuucaaaaauaaaagaacacauuagauguuacugugugaagaauaaugccuuguaugguguu

SEQ ID NO: 313237 - RNA, 64 nt, Homo Sapiens
ugugaagaauaaugccuuguaugguguugauacgugugugaaguauucuuauuuuauuugucug

SEQ ID NO: 313238 - RNA, 64 nt, Homo Sapiens
cugaguucugguuuugauucugccacgagccagcugugugaauuuggucaagggaccuaacucu

SEQ ID NO: 313239 - RNA, 64 nt, Homo Sapiens
auguaagaagauagcacagauaucgggauauuauugugugaaaaugcugcuuuuacuuugaugu

SEQ ID NO: 313240 - RNA, 64 nt, Homo Sapiens
agaucccuucaucugcacaagcccuggcuagauaugugugaauguguggcaucauuucacuuca

SEQ ID NO: 313241 - RNA, 64 nt, Homo Sapiens
aaauugguaacucuauuguaaaacaugucaauggugugugaagaaaaaucaaccaaucuguagg

SEQ ID NO: 313242 - RNA, 64 nt, Homo Sapiens
ucccucuucaccuccccaccgugggagaaaagcuugugugaaauuguuuuuuuagagcuugauu

SEQ ID NO: 313243 - RNA, 64 nt, Homo Sapiens
cugaaucacaggaaugguguaaacucaguaugcaugugugaaugagaacagacuaguuuugagu

SEQ ID NO: 313244 - RNA, 64 nt, Homo Sapiens
ucuagggacauucaaucuagauguagucuuugaaugugugaaaaccauuccaucucuugaaaaa

SEQ ID NO: 313245 - RNA, 64 nt, Homo Sapiens
caucucauggucuuggugacuaggccaagccuauugugugaaacagcugcuuccccuccucuca

SEQ ID NO: 313246 - RNA, 64 nt, Homo Sapiens
uaaaaacaaagaauuucauuauuguauuuuaaacugugugaaauauacuguagccugauuucau

SEQ ID NO: 313247 - RNA, 64 nt, Homo Sapiens
uuguguguguguguguguguugaaugugugcaugugugugaaugacuggcaaaaggugugugug

SEQ ID NO: 313248 - RNA, 64 nt, Homo Sapiens
ugugcaugugugugaauguuuggcaaaaggugugugugugaaugaugugauuuuuguugggcac

SEQ ID NO: 313249 - RNA, 64 nt, Homo Sapiens
ucaucuacaauuaaaaaaaaacaggggaauuaugugugugaaugcaauuaaugcugauuugggu

SEQ ID NO: 313250 - RNA, 64 nt, Homo Sapiens
auuucucauuugauauaauuuuucucuguuucacugugugaaaaaaagaagauauuucccauaa

SEQ ID NO: 313251 - RNA, 64 nt, Homo Sapiens
ucuguaauguccccuucuuucuaggcucuguugcugugugaauccauuagauuuacaguaucgu

SEQ ID NO: 313252 - RNA, 64 nt, Homo Sapiens
aauugcauccucagaugauuauugacugugugugugugugaaaacagacauuccagugccaccc

SEQ ID NO: 313253 - RNA, 64 nt, Homo Sapiens
gugcccugcucucccguucgccucuuucuguuucugugugaacuuucccgguaauaucacucgu

SEQ ID NO: 313254 - RNA, 64 nt, Homo Sapiens
agugaagucucaacagcagaugggguagauggugugugugaaacuucuuguauauuaaaggucu

SEQ ID NO: 313255 - RNA, 64 nt, Homo Sapiens
uccauguguuugcugaggugguucaucagagcagugugugaaauaagugagugcucgucacugg

SEQ ID NO: 313256 - RNA, 64 nt, Homo Sapiens
cgugugugugugugcacaucuaugugugcuugagugugugaacaaaccuucaaaacaagacaug

SEQ ID NO: 313257 - RNA, 64 nt, Homo Sapiens
acuguguacuggagccugcaugacuguaugugugugugugaaccuguguguguguucaagugcg

SEQ ID NO: 313258 - RNA, 64 nt, Homo Sapiens
cauuuucuaauugcaucuccaugggcugugagacugugugaagccguuuguguggucuccaugu

SEQ ID NO: 313259 - RNA, 64 nt, Homo Sapiens
gcagaggggucucgccaaagcgcaugugugugcaugugugaacguguguguccuuugcaugguu

SEQ ID NO: 313260 - RNA, 64 nt, Homo Sapiens
acuuuauuccgacuaauacuuacugugaauaaugugugugaaggcuagguguugggggggaaag

SEQ ID NO: 313261 - RNA, 64 nt, Homo Sapiens
uauuuuccuuauaaaagaugaauugcagaaguaaugugugaauaaucuuuguaucauaucuuuu

SEQ ID NO: 313262 - RNA, 64 nt, Homo Sapiens
ugggcagucugugguguggagagacucuaggugaugugugaagcggcaaaacuuccuuggccac

SEQ ID NO: 313263 - RNA, 64 nt, Homo Sapiens
ggagaugaugcacuguguuuuguuuccuaaaggaugugugaacgugcagaaaguuccaucaggc

SEQ ID NO: 313264 - RNA, 64 nt, Homo Sapiens
aaguaacugacauuguuguguugcauaugcuaagugugugaauguuucuuuugguugauuaaaa

SEQ ID NO: 313265 - RNA, 64 nt, Homo Sapiens
uguuugguggaacccaugcaacuuuggagcacucugugugaagcggguugguuuaugggcuuuu

SEQ ID NO: 313266 - RNA, 65 nt, Homo Sapiens
auguuaauauaaguaucuggugaaggaccaaaaccgugugauaagguugugugucgugugggagu

SEQ ID NO: 313267 - RNA, 65 nt, Homo Sapiens
auuucugaagcguuuguguguguguugaucagguugugugauauuuuugcuugauagagaaucaa

SEQ ID NO: 313268 - RNA, 65 nt, Homo Sapiens
auuauauaguaaagcugguagccuugaaaaugucagugugauaucuauuauguagauaaauauau

SEQ ID NO: 313269 - RNA, 65 nt, Homo Sapiens
gagagauggacaaugaaauaucaguugguggauaugugugauagcugauuucaauauugaaguau

SEQ ID NO: 313270 - RNA, 65 nt, Homo Sapiens
ucccccccgguggaggggcaaauggcugaauccuugugugauauuuuuuucuucgcuuguuuauu

SEQ ID NO: 313271 - RNA, 65 nt, Homo Sapiens
cugaguucuggggugggaguuuugcucucugucaggugugauaaaauguugaacccuccccacca

SEQ ID NO: 313272 - RNA, 65 nt, Homo Sapiens
agaggaaccuugugccggccaggcccaguuuccuugugugauacacuaauguauuugcuuuuuuu

SEQ ID NO: 313273 - RNA, 65 nt, Homo Sapiens
aucugauuugacugggauguuuuaugagaauguaagugugauauuauacugucugccuugcugga

SEQ ID NO: 313274 - RNA, 65 nt, Homo Sapiens
cauacuugcuguccagaggguuguucuagucuucugugugauacuaaagcugcaugagcuagaau

SEQ ID NO: 313275 - RNA, 65 nt, Homo Sapiens
gaggaaugacuuaauuaugauggacuaagugcugggugugauaaagccuccuacaugggcagcag

SEQ ID NO: 313276 - RNA, 65 nt, Homo Sapiens
cuuccaaauguaguuaccaaguuuuaagaagcuuugugugauauuaucucaaaauguuuaccaau

SEQ ID NO: 313277 - RNA, 65 nt, Homo Sapiens
cagugcuggcuggcugucuuucaggguccccgugugugugauaagcuugggauggagucaguugu

SEQ ID NO: 313278 - RNA, 65 nt, Homo Sapiens
uuaaguucuuauuuuggauuucuagaugaugcuuugugugauacaaauugaaaacacacuuccag

SEQ ID NO: 313279 - RNA, 65 nt, Homo Sapiens
ggcaguauuucagacuggugacacaugggaguuuagugugauaaaguucggaaaccguccugugu

SEQ ID NO: 313280 - RNA, 65 nt, Homo Sapiens
uuaaacauauuuaaacaaaaugaggagugccagcagugugauaauggugcagaauuucaugcaaa

SEQ ID NO: 313281 - RNA, 65 nt, Homo Sapiens
uacccuaaacugccuuuuuuggggaaccauuuuuggugugauaaagucuuuuucucaggccugag

SEQ ID NO: 313282 - RNA, 65 nt, Homo Sapiens
ggugaacccagccccugaccucuuccuacaaugcugugugauaugacucaaaugguuacccugcu

SEQ ID NO: 313283 - RNA, 65 nt, Homo Sapiens
aaggaaggccacuguuaggucagucccaggggagggugugauagucacacauaggaugguaaugc

SEQ ID NO: 313284 - RNA, 65 nt, Homo Sapiens
ucgaaauuaacauauuuuugaaccaaagugaucuagugugauagacuuaguggucacagucaucu

SEQ ID NO: 313285 - RNA, 65 nt, Homo Sapiens
gaaaggguuguugugucuggggggcugaggccccugugugauauucccuggcugugcaaauaaau

SEQ ID NO: 313286 - RNA, 65 nt, Homo Sapiens
uuuuuagagauuacagaauuuuuaaacagggagacgugugauauacucccucccuucccuacuau

SEQ ID NO: 313287 - RNA, 65 nt, Homo Sapiens
agugauguguguauauuauucaaaaaaauguacuggugugauaucuuguaugaaugaucauuuaa

SEQ ID NO: 313288 - RNA, 65 nt, Homo Sapiens
aacaugaaaucuuauaagguuucaguuugacagaagugugauauauguaacuugugccauggacc

SEQ ID NO: 313289 - RNA, 65 nt, Homo Sapiens
uuauaauuuuuucaacuccuauuguguuucuuugugugugauauuuuaaucaaaagugguugagu

SEQ ID NO: 313290 - RNA, 65 nt, Homo Sapiens
uuugauagugaaucaugacccuaagggagagauuugugugauaaaaguauuguauauaauagauc

SEQ ID NO: 313291 - RNA, 65 nt, Homo Sapiens
auucuucaggucucuaagccccuggaagcagcauugugugauauucucagaggcaggggaaaaua

SEQ ID NO: 313292 - RNA, 65 nt, Homo Sapiens
uuguugaaguuauuuguaauucagaaaccuugcuugugugauacauagucucuucauuuauuacu

SEQ ID NO: 313293 - RNA, 65 nt, Homo Sapiens
aaaguaguguaucauguucuuaacuuaauaaauuugugugauauacccauauaauugguaaugga

SEQ ID NO: 313294 - RNA, 65 nt, Homo Sapiens
uuccgaguaagaccuuaaggcccaaagguagguuggugugauagugugucuacugauaaaauuau

SEQ ID NO: 313295 - RNA, 65 nt, Homo Sapiens
gcauuuagucagucccccaacuuguaaaugcagaugugugauaaacugugauuaacagugaagac

SEQ ID NO: 313296 - RNA, 65 nt, Homo Sapiens
cacuaagcagucaguccccucacuaauauagcauugugugauaaggcauuuaucuuuuaaaacuu

SEQ ID NO: 313297 - RNA, 65 nt, Homo Sapiens
ugagcggucgcauggcagagcccaacagcagugcagugugauaacgaccuguacuccacaugcaa

SEQ ID NO: 313298 - RNA, 65 nt, Homo Sapiens
cuugagguuuuguucaugcccccuuugacugaucagugugauaaggacuuuaggaaaaaaagcau

SEQ ID NO: 313299 - RNA, 65 nt, Homo Sapiens
acugguugcuagucaauguucuauauuuaaugaaugugugauaaaucauccuguaaucaguaugg

SEQ ID NO: 313300 - RNA, 65 nt, Homo Sapiens
uuucucuguauuccgauacaaaguguuguaucaaagugugauauacaaaguguaccaacauaagu

SEQ ID NO: 313301 - RNA, 65 nt, Homo Sapiens
acguuaguuauaaucaccuuguaucucuaaauauggugugauaugaaccaguccauucacauugg

SEQ ID NO: 313302 - RNA, 65 nt, Homo Sapiens
aaauguaaaauugaaaauucauuugcuguuucaaagugugauaucuuucacaauagccuuuuuau

SEQ ID NO: 313303 - RNA, 65 nt, Homo Sapiens
uuuggguuugaauuccagcucuacuauuuuugguugugugauagaguuauuuaaccucucugagc

SEQ ID NO: 313304 - RNA, 65 nt, Homo Sapiens
guguuagauuuuuuugauguaggaauaauauuuaggugugauauaugcaaacaggaucuaagcuu

SEQ ID NO: 313305 - RNA, 65 nt, Homo Sapiens
caccaugccaugcagggauacaggcccuccagugugugugauagucucugcagagggggucauuc

SEQ ID NO: 313306 - RNA, 65 nt, Homo Sapiens
uacugaggauaauaaaauccacagcaauagcucaagugugauaacauggcaguuucagcguucaa

SEQ ID NO: 313307 - RNA, 65 nt, Homo Sapiens
ugggaguauuaaaauagcuuauaaagguagaguaagugugauauaugcuuguauguaaaacccaa

SEQ ID NO: 313308 - RNA, 65 nt, Homo Sapiens
ccccuuccuguguccacgugaccacaguccccagagugugauauucucccccaucccccgacccc

SEQ ID NO: 313309 - RNA, 65 nt, Homo Sapiens
uuaucgguuaggucauuuguuaguaaaagcaccuagugugauagaaaaaaaaaaaaaacucaaga

SEQ ID NO: 313310 - RNA, 65 nt, Homo Sapiens
guucucaaugcagaucucccuucuacuguuugggugugugauagguccucauuaaaaacaaauac

SEQ ID NO: 313311 - RNA, 65 nt, Homo Sapiens
gacagguaagcaacagugcuggguuugagacuuacgugugauacuccuaccugugugauucagua

SEQ ID NO: 313312 - RNA, 65 nt, Homo Sapiens
agugacauuucuaucacaaucauuuuauggaagaugugugauaaucuguuuuuacugguauuaau

SEQ ID NO: 313313 - RNA, 59 nt, Homo Sapiens
cuaacagcagugagauuuaaaaagagcuagugugauaauccuaacucuacuacgcauua

SEQ ID NO: 313314 - RNA, 65 nt, Homo Sapiens
gcuaagguauaaggagaaaggagauugguaaggaagugugauacauauugaaucaggugucaagg

SEQ ID NO: 313315 - RNA, 65 nt, Homo Sapiens
ggauuuuccucccacuuagacucaaacacauuuuagugugauauuucauuuauuauagguaguau

SEQ ID NO: 313316 - RNA, 65 nt, Homo Sapiens
uuuuucuagacugucucuguggaauauauuugugugugugauauaugcaugugugugaugguaug

SEQ ID NO: 313317 - RNA, 65 nt, Homo Sapiens
uuugaugaugaaagguggaaaacaaaauaaauuuugugugauaauucuuuuugcauugugaaaaa

SEQ ID NO: 313318 - RNA, 65 nt, Homo Sapiens
caaguaaauguuuucuauuuugacuuuuuauuauugugugauaaccgaacuaauaaaaaucuaua

SEQ ID NO: 313319 - RNA, 65 nt, Homo Sapiens
guagauuucuucuuagcagaauagcauccugagcugugugauacaguguaauaucuuauguguau

SEQ ID NO: 313320 - RNA, 65 nt, Homo Sapiens
uaccaugaagaagaauaaaugaggguaaggggcuagugugauagggagaggggugggaugccauc

SEQ ID NO: 313321 - RNA, 65 nt, Homo Sapiens
gugugaaggauuuccuaacagcuuuagaaaucuuagugugauacaucucucauacaguuuggggu

SEQ ID NO: 313322 - RNA, 65 nt, Homo Sapiens
guguuuuuauguggcugcccaacguggagcgggcagugugauaggcugggugggcuaagcagccu

SEQ ID NO: 313323 - RNA, 65 nt, Homo Sapiens
caaccugguauacagacauuaugugauguuaguaggugugauauguuaaaaaaacaaaaauguac

SEQ ID NO: 313324 - RNA, 65 nt, Homo Sapiens
uaaagguguaauuaagacaguggcauuugucucuagugugauauagaauguuucugcagaucuug

SEQ ID NO: 313325 - RNA, 65 nt, Homo Sapiens
uguucuuugaagguuuuuuauuuuaaaaauugaaugugugauaugaauagagcuuuuauauaaag

SEQ ID NO: 313326 - RNA, 65 nt, Homo Sapiens
uuauuuauaaagacuuuggaugugugcaugugugugugugauaggggucuucaaaguagccugac

SEQ ID NO: 313327 - RNA, 65 nt, Homo Sapiens
gagggauguuagcuuuguggcagaauucccugcaugugugauaacugaucuuguuuuauuuuuug

SEQ ID NO: 313328 - RNA, 65 nt, Homo Sapiens
uaaauucuguuuaauuacaucuguaaauauuaugugugugauaguauucaauaaaguaaaaucaa

SEQ ID NO: 313329 - RNA, 65 nt, Homo Sapiens
ggaguggagugucuccuggagagagugaggagagugugugauagcuagaaagagagagagacaga

SEQ ID NO: 313330 - RNA, 65 nt, Homo Sapiens
uaacuguauaaagaaucuaugacuuuuugagggaagugugauauauuaacaaauauaaccaauuc

SEQ ID NO: 313331 - RNA, 65 nt, Homo Sapiens
ccccuggaggaaauaauauuuucaaacugucguuggugugauacuuuggcucaaaggaucuuugc

SEQ ID NO: 313332 - RNA, 65 nt, Homo Sapiens
ccugcaguuuuuauccaauauugaguuuauaacuugugugauauuaaccuugcgauuugcacaua

SEQ ID NO: 313333 - RNA, 65 nt, Homo Sapiens
acauguguauaguauuuaagcucccccucccccuugugugauaccguuauguuucuguuuguucc

SEQ ID NO: 313334 - RNA, 65 nt, Homo Sapiens
auuuauguaggaagaaacuuccucacccagcccaugugugauaggaauuccauuaauuaccaagc

SEQ ID NO: 313335 - RNA, 65 nt, Homo Sapiens
accagauaauaaggaaaacaucuguuacaagcguagugugauaauauuaucuuuucuucuguauc

SEQ ID NO: 313336 - RNA, 65 nt, Homo Sapiens
auuuugcuugccuauaggagucccacuuauauauugugugauaugaauguuuagcaguauccccu

SEQ ID NO: 313337 - RNA, 65 nt, Homo Sapiens
uuguguuugcuuacauuggcucaagaauagauuuggugugauaccuugaaauaggaaugguuuuc

SEQ ID NO: 313338 - RNA, 65 nt, Homo Sapiens
cugauuuugguuugcaauaacacaacuuuuuuugugugugauaaaauccuucccucaucccauca

SEQ ID NO: 313339 - RNA, 65 nt, Homo Sapiens
gucugcugauaaaauauuuaacuccuuucucaagugugugauaagcauuuuuuguucuuuucuug

SEQ ID NO: 313340 - RNA, 65 nt, Homo Sapiens
agagucagcaucauuaaaggacuucaugcuggccugugugauacacuguaaagucugaguaagaa

SEQ ID NO: 313341 - RNA, 65 nt, Homo Sapiens
cuugagcaugcauuucucacaauaauuauuaagcugugugauaauuucugcuuucaggacacuca

SEQ ID NO: 313342 - RNA, 65 nt, Homo Sapiens
acucauucagacugacuucuacaggacuucuacgugugugauaaaagccugugaaucgugagucc

SEQ ID NO: 313343 - RNA, 65 nt, Homo Sapiens
aagugaaacugcuaaauauguauagagagguugacgugugauacgugggacaguucacauagaca

SEQ ID NO: 313344 - RNA, 65 nt, Homo Sapiens
auccacgccaaguggaagccacuggaccacaggaggugugauagagccuuugaucuucaggaugc

SEQ ID NO: 313345 - RNA, 65 nt, Homo Sapiens
auccacauggcugucaagaauguaaauuauaaagggugugauagacuuuaaccacugaagauugc

SEQ ID NO: 313346 - RNA, 65 nt, Homo Sapiens
acaggaggccagagagaggcugaccacuacccugggugugauaucgucccugagaacacagacaa

SEQ ID NO: 313347 - RNA, 65 nt, Homo Sapiens
uaacauuaauauuuuauuuguauuuucacgggagcgugugauauugguuaauuaagaauguuggu

SEQ ID NO: 313348 - RNA, 65 nt, Homo Sapiens
auacugcacuuggcugggcauauuaauuuuuaaaggugugauaagaacuauaggaugauuggaau

SEQ ID NO: 313349 - RNA, 65 nt, Homo Sapiens
uaggaaucauuauucagaauuuuugaaaauuaccagugugauacauuuaaauacuuaaccacuaa

SEQ ID NO: 313350 - RNA, 65 nt, Homo Sapiens
uggguuugcuaaugugcugucaccucugaacaugugugugauaaauuuuuucuucccaggcaaua

SEQ ID NO: 313351 - RNA, 65 nt, Homo Sapiens
cuucucaucccugcauagauugugagugugugggugugugauaaggcucccaagggcugacaugg

SEQ ID NO: 313352 - RNA, 65 nt, Homo Sapiens
cagcuuacauuuuguuauuucuauuuuuauaaauugugugauaauuagagguaagaauaacaagu

SEQ ID NO: 313353 - RNA, 65 nt, Homo Sapiens
auuaugauuccuguauuauuucagugagagcuacagugugauauuucagagucuauuaaauaaaa

SEQ ID NO: 313354 - RNA, 65 nt, Homo Sapiens
cggcagcucacuaggauuuugcugaacauuaaaaagugugauagcgauauuagugccaaucaaau

SEQ ID NO: 313355 - RNA, 65 nt, Homo Sapiens
caaacgggagaaauuuauauuuuaugaaauacugcgugugauaaguuaacgcacuuggaguaauu

SEQ ID NO: 313356 - RNA, 65 nt, Homo Sapiens
gccuacuauacauuaggaagcuuggaccacuuacagugugauaagaaaaagagcaucccuauggg

SEQ ID NO: 313357 - RNA, 65 nt, Homo Sapiens
acacaugcauuuaugugcguuccaugcauauaugugugugauaauuauaauugcauacacaugcc

SEQ ID NO: 313358 - RNA, 65 nt, Homo Sapiens
aagguuugacugcuauaauuuaauauauuaaguaugugugauacuauuuuauuauuguguauauc

SEQ ID NO: 313359 - RNA, 65 nt, Homo Sapiens
uauuuuuaaauaaaaacuuacccuugcacaaaaaagugugauaaaaaccaaagaaaucaauggaa

SEQ ID NO: 313360 - RNA, 65 nt, Homo Sapiens
uugauggauucuuccauccugccggaugagugugggugugauacagccuacauaaagacuguuau

SEQ ID NO: 313361 - RNA, 65 nt, Homo Sapiens
aagauaguggcuacugauguucaagugggauugaagugugauaaauggauauauuuuguuguuug

SEQ ID NO: 313362 - RNA, 65 nt, Homo Sapiens
ucauugcuaauuuuucauucuuuuuccacuggaaagugugauagcauuuuucuaauuaguggauc

SEQ ID NO: 313363 - RNA, 65 nt, Homo Sapiens
acucuuuagauugugcuuucaagaagcuguucacggugugauaauaauauuugcucugggucagg

SEQ ID NO: 313364 - RNA, 65 nt, Homo Sapiens
aggggaacagauuuuucauuguaauaguggaaguugugugauaguuaggagauaucaacaugcau

SEQ ID NO: 313365 - RNA, 65 nt, Homo Sapiens
guguguacguauguguguguucuacaagaacggaagugugauauguuuaaagaugaucagagaaa

SEQ ID NO: 313366 - RNA, 65 nt, Homo Sapiens
uaacagaaauaagaagaaaacaggugaaaaagacagugugauaaggccauggugguggauugugg

SEQ ID NO: 313367 - RNA, 65 nt, Homo Sapiens
aaacaaaugccuuacagaugaagcuagaaugggcugugugauaggcaucucaguugguggguguu

SEQ ID NO: 313368 - RNA, 65 nt, Homo Sapiens
agcucaccuugaccuccuagggcuggagugugguggugugauaauagggucucuauugucaccca

SEQ ID NO: 313369 - RNA, 65 nt, Homo Sapiens
gcuuuuuuuuuuuuuuuuuuacaaaaugaugauuagugugauaaugugcugcaaaaaauauccaa

SEQ ID NO: 313370 - RNA, 65 nt, Homo Sapiens
ugauuaacuuaugaaaaaauuauuuggggacaggagugugauaccuuccuugguuuuuuuuugca

SEQ ID NO: 313371 - RNA, 65 nt, Homo Sapiens
uguucaccaaugaaugagucccuuucuauaucaucgugugauaaugaagaaaagcuuuucaacag

SEQ ID NO: 313372 - RNA, 65 nt, Homo Sapiens
aguuugaucccaggaacuugagccuucuccagccugugugauacaggaggacucaguuucuccac

SEQ ID NO: 313373 - RNA, 65 nt, Homo Sapiens
uacuuagugaauucauggguuggauccugacaggugugugauaaucuugguccucagcaacuguc

SEQ ID NO: 313374 - RNA, 65 nt, Homo Sapiens
aucucgcuuuauccaccauaacguaaagaacugcggugugauaacagccuucacggggccacggu

SEQ ID NO: 313375 - RNA, 65 nt, Homo Sapiens
auccauaaaaauuuaaagugagaggcaugguuagugugugauacaauaaaaaguaauuguuuggu

SEQ ID NO: 313376 - RNA, 65 nt, Homo Sapiens
ucgcuccccuuuuuuuaaaaaggacuguuuugcuagugugauaaugaauagguaagauaugagau

SEQ ID NO: 313377 - RNA, 65 nt, Homo Sapiens
aacucaaucacucagccccuccaaagauaguugaugugugauaaucucauaauguugagaacccu

SEQ ID NO: 313378 - RNA, 65 nt, Homo Sapiens
cuaaaggguagaccuggaccugccaccuaugaguugugugauauagaaaaaaaucucuuagcucu

SEQ ID NO: 313379 - RNA, 65 nt, Homo Sapiens
uguucuguaaauaaaaucuuugaucacaccacucagugugauaauugugucuacagcuaaaaugg

SEQ ID NO: 313380 - RNA, 65 nt, Homo Sapiens
caucaagaugaaacaggacaggagagaacuguucagugugauacagagcugccauuuccaaagua

SEQ ID NO: 313381 - RNA, 65 nt, Homo Sapiens
uucaucuuguaaaucugcuucauaauaaacuucuggugugauacugucaacauaugugauuguuc

SEQ ID NO: 313382 - RNA, 65 nt, Homo Sapiens
cucuauagccacuacagggcgccagcaggcguggggugugauacuaaagaggccggucaccagaa

SEQ ID NO: 313383 - RNA, 65 nt, Homo Sapiens
ugugaacccaacaaauucaagcagcaacaugagaagugugauacaacuguauccaucuauacuug

SEQ ID NO: 313384 - RNA, 65 nt, Homo Sapiens
auaaaaauauguuaccugcaccacuggucaguuuugugugauagaauucauaaauucaagcacua

SEQ ID NO: 313385 - RNA, 65 nt, Homo Sapiens
agauccuugucaagcuuucuucuguggucugauuagugugauaccggggcaccuccucugguacu

SEQ ID NO: 313386 - RNA, 65 nt, Homo Sapiens
augaguaugcagaggaguuuucaagaggcuaucuggugugauauuguaauaggcugaaugcaaaa

SEQ ID NO: 313387 - RNA, 65 nt, Homo Sapiens
guucuaugguuaguuuugcagguuugcauccagcugugugauauucugcugugcaaauccaugca

SEQ ID NO: 313388 - RNA, 65 nt, Homo Sapiens
gagauacacuagcaauuuuuuuaaaaacuggaacagugugauaggaagccugcuggaugauuucu

SEQ ID NO: 313389 - RNA, 65 nt, Homo Sapiens
cauaucaugaacagcguaaguuccuacacacggacgugugauacacacaugcauguacagguaag

SEQ ID NO: 313390 - RNA, 65 nt, Homo Sapiens
uuaggaauacagaagauuuaugaagcaagggcgcagugugauauuaaccagucuaucagggaggc

SEQ ID NO: 313391 - RNA, 65 nt, Homo Sapiens
ucagucaagcuguugaagucugggccacuuggagugugugauaaacuucuggccguccuugucuc

SEQ ID NO: 313392 - RNA, 65 nt, Homo Sapiens
guuuguuacuuuuaaguacacuucuaagccuaagugugugauacaagaaaaaacuugaaagaaca

SEQ ID NO: 313393 - RNA, 65 nt, Homo Sapiens
uuccagauuuguuggaucuauuguacagcauucaugugugauauuuggucauuugagaauuuuuu

SEQ ID NO: 313394 - RNA, 65 nt, Homo Sapiens
auuuugaaucugagacgaauuaagauaaaucaccugugugauaauucaguacucacauggauuuu

SEQ ID NO: 313395 - RNA, 65 nt, Homo Sapiens
ucuucauuauguccugcgcuuuacuuuaaaugugugugugauacucagugugaauguaucauguu

SEQ ID NO: 313396 - RNA, 65 nt, Homo Sapiens
uauaagaaguuaauuuuugaaaaugacauauuuuugugugauagaaagaauggagcaaguugugc

SEQ ID NO: 313397 - RNA, 65 nt, Homo Sapiens
aacauaacaaaacccaguagucaccaaggcagguagugugauaaaugaacacaccacucugaggc

SEQ ID NO: 313398 - RNA, 65 nt, Homo Sapiens
caguuuuacuuuuguauauaaaucuaagacugccugugugauaaaacacuuguuuaaaaaaaaaa

SEQ ID NO: 313399 - RNA, 65 nt, Homo Sapiens
gguucugucaucaucauucaucuauuuuuguuuaugugugauaguuguggacacgcuugguuugc

SEQ ID NO: 313400 - RNA, 65 nt, Homo Sapiens
ugcaugucaccuugaugggggcugugaguggggcagugugauacccagugacuagacgcacucug

SEQ ID NO: 313401 - RNA, 65 nt, Homo Sapiens
acucuagguugaugcauuuuguacuuagcuguacugugugauauuuuucauuauuuuaggacgcc

SEQ ID NO: 313402 - RNA, 65 nt, Homo Sapiens
guccuugguggguuuagucauggccaagacaagcagugugauagagcacauccacggugggugag

SEQ ID NO: 313403 - RNA, 65 nt, Homo Sapiens
guuuaaauggcaaaaacaaauuucagaauaggauugugugauaauguuuuuaaugaacauuuguc

SEQ ID NO: 313404 - RNA, 65 nt, Homo Sapiens
uaugcucuaaaucacuacacgauaaauuuuucacugugugauauuuguuacuguauuuaguuugu

SEQ ID NO: 313405 - RNA, 65 nt, Homo Sapiens
cuuuucacguuuuauagagcuuucuauauuauccagugugauaauacuuaggaacccuggcaucu

SEQ ID NO: 313406 - RNA, 65 nt, Homo Sapiens
uggccaagaauaccacuuuugaaguuaauccuuuugugugauacaggaugaacuugggauguuug

SEQ ID NO: 313407 - RNA, 65 nt, Homo Sapiens
acucuccauauauuuauuuguuuggaaucacucuugugugauauaaaggcguguauauuaucuuu

SEQ ID NO: 313408 - RNA, 65 nt, Homo Sapiens
agcagguuggagugacuggugggccuagaucacuggugugauaaaccccaauuuucaccccgggg

SEQ ID NO: 313409 - RNA, 65 nt, Homo Sapiens
guaccuacguacuuauaucagcaccauguauguaggugugauaguacuuucaaacagcgccucca

SEQ ID NO: 313410 - RNA, 65 nt, Homo Sapiens
ucccauuucaaaugauuccacgauuaaggaccauggugugauagaccugcggcaauagacuggaa

SEQ ID NO: 313411 - RNA, 65 nt, Homo Sapiens
uuuuuauagacauauauaaagauaguccugaucaagugugauaaagucaagugaaaggguagggg

SEQ ID NO: 313412 - RNA, 65 nt, Homo Sapiens
aucccagcccagauugcucaucaauuaaaaaugcugugugauaaagaagagagaaggaaauuuua

SEQ ID NO: 313413 - RNA, 65 nt, Homo Sapiens
ccauuuucaaaagacaguguugaauaaacauaccugugugauaaaacacagaauuuacauauaca

SEQ ID NO: 313414 - RNA, 65 nt, Homo Sapiens
uccugcugaauuaaauuauaguguuuucccuccaagugugauauuguuuuuuuuuuuuuuagugu

SEQ ID NO: 313415 - RNA, 65 nt, Homo Sapiens
uaacaugguaagccuuagcagucaucuuuucagccgugugauaaucaauacagucugauuuagaa

SEQ ID NO: 313416 - RNA, 65 nt, Homo Sapiens
gaaaaauaaugccucuccugagguagaagauacaugugugauauaaauauuuaaauuggucaguc

SEQ ID NO: 313417 - RNA, 65 nt, Homo Sapiens
ggaauuuaaagacucauccccagccuccaccuccugugugauacuugggggcuagcuuuuuucuu

SEQ ID NO: 313418 - RNA, 65 nt, Homo Sapiens
cacuguaugauauaaaguuauagucauuuaaaaaugugugauauuaguacauuaguagguaaaug

SEQ ID NO: 313419 - RNA, 65 nt, Homo Sapiens
cuuaucaucauugccuuuccacuacucuacuaucugugugauauuagacaaaauauuugcuucuu

SEQ ID NO: 313420 - RNA, 65 nt, Homo Sapiens
ugacacguaaguguuguacauauuuaugggguacagugugauauuuaaauauauguauaugaugu

SEQ ID NO: 313421 - RNA, 65 nt, Homo Sapiens
ugacacauaacuguuguacucauuuaugggguacagugugauaguuaaugcaaguauacaaugug

SEQ ID NO: 313422 - RNA, 65 nt, Homo Sapiens
guccaugauggugaugaaucuauuaaucaugaugagugugauaggggugcucuucaagacuuaga

SEQ ID NO: 313423 - RNA, 65 nt, Homo Sapiens
ggcuguagcuuuguaggauauuuggggauuccauagugugauauccccuucuucccuuugcucaa

SEQ ID NO: 313424 - RNA, 65 nt, Homo Sapiens
gccagguaagaacaguaauuggcccagacagguaggugugauaaacagaguagaaaagauugugg

SEQ ID NO: 313425 - RNA, 65 nt, Homo Sapiens
agcauugugguuauguaaaaaagaaacuuuguuaugugugauaauugacaauauuagauaauauu

SEQ ID NO: 313426 - RNA, 65 nt, Homo Sapiens
uagguuagcacuucaguuacagggaacaccuggacgugugauaaaauuuucuagucugcauagga

SEQ ID NO: 313427 - RNA, 65 nt, Homo Sapiens
uguauauauugcauuuuguuccagggcccaggucugugugauaucugggccugacccuuccuguc

SEQ ID NO: 313428 - RNA, 65 nt, Homo Sapiens
aacuuuaauugcauccuaucagauuguugaggugggugugauagucuucaggugcagugcguuca

SEQ ID NO: 313429 - RNA, 65 nt, Homo Sapiens
gaauuuccucuuccugugcaaauuccucuagucaagugugauauaucaagaaaucugaggaggau

SEQ ID NO: 313430 - RNA, 65 nt, Homo Sapiens
ucagaucccauuuccgucugcccccucgucaccaggugugauagccccagccaggucacaccugg

SEQ ID NO: 313431 - RNA, 65 nt, Homo Sapiens
gagcgcacaccacuggcgugagacagcgcuugguggugugauacuuuuggugcuguguauaguau

SEQ ID NO: 313432 - RNA, 65 nt, Homo Sapiens
gccaaagaacuguauacuguuucaaucaacgguuagugugauacugaaaacucuaaaguucugac

SEQ ID NO: 313433 - RNA, 65 nt, Homo Sapiens
gaaaucucuucagaaauaagaagcuauuucauuaagugugauauaaaccuccucaaacauuuuac

SEQ ID NO: 313434 - RNA, 65 nt, Homo Sapiens
ugugacaaaggguaucauacuagcaagaugcuagugugugauacguuuagacaaucgggagaaga

SEQ ID NO: 313435 - RNA, 65 nt, Homo Sapiens
caaauauuuauugaucaucucuucuccauaagauagugugauaaacacagucaugaauaaaguua

SEQ ID NO: 313436 - RNA, 65 nt, Homo Sapiens
gcagauuuauaugcacugaugaggaaagacauacugugugauagggagaaaaagcagcuuauaaa

SEQ ID NO: 313437 - RNA, 65 nt, Homo Sapiens
cauuaguuugcuguuaauuuaugcauuugaagccagugugauacagccaucuguaccuacuggag

SEQ ID NO: 313438 - RNA, 65 nt, Homo Sapiens
cggcagguagcagggggagugcuggucacaccccugugugauaugugaugcccucggcaaagaau

SEQ ID NO: 313439 - RNA, 65 nt, Homo Sapiens
cugaacuugggcuaaaaucaaaccuuggcacacaggugugauacaacuuaacaggaaucaucgau

SEQ ID NO: 313440 - RNA, 65 nt, Homo Sapiens
acaucaccauuucaaggcccuccaaucgauguuuagugugauaggugcuuuaagaucucuaccac

SEQ ID NO: 313441 - RNA, 65 nt, Homo Sapiens
cugugguguucuguucauguuuucucagauauuuugugugauacuugcaccuguagauaucaucu

SEQ ID NO: 313442 - RNA, 65 nt, Homo Sapiens
agcagucuucagcuccuuacaguuugccaugggaugugugauaucguuuagaagaaaucuuacgg

SEQ ID NO: 313443 - RNA, 65 nt, Homo Sapiens
ccccuuccuguguccaugugaccacaguccccagagugugauauucuccccccucccccgacccc

SEQ ID NO: 313444 - RNA, 65 nt, Homo Sapiens
aaauucaccccucugaacuguuugcuauugauguagugugauagaggaaaauugauuccucugac

SEQ ID NO: 313445 - RNA, 65 nt, Homo Sapiens
ucagaaauacagauaaaugaaguagagguauaauugugugauauuuuuauucuuuuuuucucuag

SEQ ID NO: 313446 - RNA, 65 nt, Homo Sapiens
ggccccccgccagacaauaggggcuugggcuguuugugugauaccucauugaguauuugugccua

SEQ ID NO: 313447 - RNA, 65 nt, Homo Sapiens
aggcccauucuucacucuuuaguuuccacugccucgugugauaugcuuccaaggccccauccauu

SEQ ID NO: 313448 - RNA, 65 nt, Homo Sapiens
aggcccauuccugccucuuuagcuuccacugccucgugugauaugcuuccagggccccauccauu

SEQ ID NO: 313449 - RNA, 64 nt, Homo Sapiens; identical to SEQ ID NO: 139090

SEQ ID NO: 313450 - RNA, 64 nt, Homo Sapiens; identical to SEQ ID NO: 139091

SEQ ID NO: 313451 - RNA, 64 nt, Homo Sapiens; identical to SEQ ID NO: 139092

SEQ ID NO: 313452 - RNA, 64 nt, Homo Sapiens; identical to SEQ ID NO: 139093

SEQ ID NO: 313453 - RNA, 64 nt, Homo Sapiens; identical to SEQ ID NO: 139094

SEQ ID NO: 313454 - RNA, 64 nt, Homo Sapiens; identical to SEQ ID NO: 139095

SEQ ID NO: 313455 - RNA, 64 nt, Homo Sapiens; identical to SEQ ID NO: 139096

SEQ ID NO: 313456 - RNA, 64 nt, Homo Sapiens; identical to SEQ ID NO: 139097

SEQ ID NO: 313457 - RNA, 64 nt, Homo Sapiens; identical to SEQ ID NO: 139098

SEQ ID NO: 313458 - RNA, 64 nt, Homo Sapiens; identical to SEQ ID NO: 139099

SEQ ID NO: 313459 - RNA, 64 nt, Homo Sapiens; identical to SEQ ID NO: 139100

SEQ ID NO: 313460 - RNA, 64 nt, Homo Sapiens; identical to SEQ ID NO: 139101

SEQ ID NO: 313461 - RNA, 64 nt, Homo Sapiens; identical to SEQ ID NO: 139102

SEQ ID NO: 313462 - RNA, 64 nt, Homo Sapiens; identical to SEQ ID NO: 139103

SEQ ID NO: 313463 - RNA, 64 nt, Homo Sapiens; identical to SEQ ID NO: 139104

SEQ ID NO: 313464 - RNA, 64 nt, Homo Sapiens; identical to SEQ ID NO: 139105

SEQ ID NO: 313465 - RNA, 64 nt, Homo Sapiens; identical to SEQ ID NO: 139106

SEQ ID NO: 313466 - RNA, 64 nt, Homo Sapiens; identical to SEQ ID NO: 139107

SEQ ID NO: 313467 - RNA, 64 nt, Homo Sapiens; identical to SEQ ID NO: 139108

SEQ ID NO: 313468 - RNA, 64 nt, Homo Sapiens; identical to SEQ ID NO: 139109

SEQ ID NO: 313469 - RNA, 64 nt, Homo Sapiens; identical to SEQ ID NO: 139110

SEQ ID NO: 313470 - RNA, 64 nt, Homo Sapiens; identical to SEQ ID NO: 139111

SEQ ID NO: 313471 - RNA, 64 nt, Homo Sapiens; identical to SEQ ID NO: 139112

SEQ ID NO: 313472 - RNA, 64 nt, Homo Sapiens; identical to SEQ ID NO: 139113

SEQ ID NO: 313473 - RNA, 64 nt, Homo Sapiens; identical to SEQ ID NO: 139114

SEQ ID NO: 313474 - RNA, 64 nt, Homo Sapiens; identical to SEQ ID NO: 139115

SEQ ID NO: 313475 - RNA, 52 nt, Homo Sapiens; identical to SEQ ID NO: 112167

SEQ ID NO: 313476 - RNA, 64 nt, Homo Sapiens; identical to SEQ ID NO: 139117

SEQ ID NO: 313477 - RNA, 64 nt, Homo Sapiens; identical to SEQ ID NO: 139118

SEQ ID NO: 313478 - RNA, 64 nt, Homo Sapiens; identical to SEQ ID NO: 139119

SEQ ID NO: 313479 - RNA, 64 nt, Homo Sapiens; identical to SEQ ID NO: 139120

SEQ ID NO: 313480 - RNA, 64 nt, Homo Sapiens; identical to SEQ ID NO: 139121

SEQ ID NO: 313481 - RNA, 64 nt, Homo Sapiens; identical to SEQ ID NO: 139122

SEQ ID NO: 313482 - RNA, 64 nt, Homo Sapiens; identical to SEQ ID NO: 139123

SEQ ID NO: 313483 - RNA, 64 nt, Homo Sapiens; identical to SEQ ID NO: 139124

SEQ ID NO: 313484 - RNA, 64 nt, Homo Sapiens; identical to SEQ ID NO: 139125

SEQ ID NO: 313485 - RNA, 64 nt, Homo Sapiens; identical to SEQ ID NO: 139126

SEQ ID NO: 313486 - RNA, 64 nt, Homo Sapiens; identical to SEQ ID NO: 139127

SEQ ID NO: 313487 - RNA, 64 nt, Homo Sapiens; identical to SEQ ID NO: 139128

SEQ ID NO: 313488 - RNA, 64 nt, Homo Sapiens; identical to SEQ ID NO: 139129

SEQ ID NO: 313489 - RNA, 64 nt, Homo Sapiens; identical to SEQ ID NO: 139130

SEQ ID NO: 313490 - RNA, 64 nt, Homo Sapiens; identical to SEQ ID NO: 139131

SEQ ID NO: 313491 - RNA, 64 nt, Homo Sapiens
ggaccagauuuggaaguuccagcgccaugaccugaucgaggaguaccacggccgccccgccgcg

SEQ ID NO: 313492 - RNA, 64 nt, Homo Sapiens
acaguuccagcaaaagcagcggcccgagcagaagaucgaggacaucagcaauaaguaugggggc

SEQ ID NO: 313493 - RNA, 64 nt, Homo Sapiens
uuacagagcaucuagcugguagaggggaaaauggggccuagaaggauccaacccucuuauuuuc

SEQ ID NO: 313494 - RNA, 64 nt, Homo Sapiens
acugacuguuaacacaaacgaucaaucaaucaauggccuagagcagucacuucugauucugaca

SEQ ID NO: 313495 - RNA, 64 nt, Homo Sapiens
uuaccugcugagccccgcaggccgcugaaccaaaggccuagauggggaggacuaggagagcgag

SEQ ID NO: 313496 - RNA, 64 nt, Homo Sapiens
auuuucuggugagguggguuugggaggaaagagaggccuagaggaggaguugaaagcucugcug

SEQ ID NO: 313497 - RNA, 64 nt, Homo Sapiens
cuccaucaauccaguccaagaggaggaggacgaaggccuagacucagcugaaggaucuucaaag

SEQ ID NO: 313498 - RNA, 64 nt, Homo Sapiens
uucaaagcaggaugaagaccuagacuuaccugaaggccuagacucagcugaaggaucuucaaag

SEQ ID NO: 313499 - RNA, 64 nt, Homo Sapiens
ugccaacuucacuuaccuuuccauuuccagaaguggccuagaaaccuuccugccccacuguggg

SEQ ID NO: 313500 - RNA, 64 nt, Homo Sapiens
cuccuuccugccccacuguggaaaugaagaggaaggccuagagccucuugccaaaugcuucaug

SEQ ID NO: 313501 - RNA, 50 nt, Homo Sapiens
gagguuucuuccaggggugaaggguggagccagguagaugcagcgguagc

SEQ ID NO: 313502 - RNA, 61 nt, Homo Sapiens
cccaucggcuuccauaucuuccaggucccagaggguggaaggagccaggacgcacccccac

SEQ ID NO: 313503 - RNA, 61 nt, Homo Sapiens
gaggagugucauuucuauguagcucuuggcgaggguggagguguggggccuugcgguucag

SEQ ID NO: 313504 - RNA, 61 nt, Homo Sapiens
ggaggcaggggccgagggggaaugcaggagaaggguggagauaaaaauaaauaucgcuuag

SEQ ID NO: 313505 - RNA, 61 nt, Homo Sapiens
gccagaccagcagagcagggagccacuugccaggguggaggaggagcauuguccaggcaug

SEQ ID NO: 313506 - RNA, 61 nt, Homo Sapiens
agcugagacaggaguccggacagaggugggcaggguggauggcuucgggcagggaaggcgg

SEQ ID NO: 313507 - RNA, 61 nt, Homo Sapiens
gacaaguguuuuggaaagagcacccucgagaaggguggaugacagggcagagcaggaagga

SEQ ID NO: 313508 - RNA, 61 nt, Homo Sapiens
gauggcagcuggggcuaggggaagggcuuugaggguggaaggaugggauggguuccagagg

SEQ ID NO: 313509 - RNA, 61 nt, Homo Sapiens
gaagucaggucauaaguuucugcaggcaugaaggguggagugggacguguuucugucauaa

SEQ ID NO: 313510 - RNA, 61 nt, Homo Sapiens
uggguagggcugggaggagguuuugggaaguaggguggaugaagugggggcuucuacaggc

SEQ ID NO: 313511 - RNA, 61 nt, Homo Sapiens
ccaggccucuaaggcuucucucccuggagugaggguggaggugagggagagcuggcacaag

SEQ ID NO: 313512 - RNA, 61 nt, Homo Sapiens
ucuucagcaccaccucuaagaucucugagagaggguggaucagccucuguguaaacaaaaa

SEQ ID NO: 313513 - RNA, 61 nt, Homo Sapiens
gagacuguuggcuccaccuccaagcugagcuaggguggagggcagggugggcaggaaguga

SEQ ID NO: 313514 - RNA, 61 nt, Homo Sapiens
uggcacaguguuauguggacugggccacgauaggguggagugagcuagugaagaaggcaga

SEQ ID NO: 313515 - RNA, 61 nt, Homo Sapiens
ucacagccugcugggcugggucgcguagcccaggguggaggcagaacgaugcugcuguggu

SEQ ID NO: 313516 - RNA, 61 nt, Homo Sapiens
uacaacuaggccagggauuagccacugugggaggguggacaggcaaugguucaguggccug

SEQ ID NO: 313517 - RNA, 61 nt, Homo Sapiens
uugucaccaucaggccuuucuggcuccugauaggguggagcaaaaguggaaaggaaaggaa

SEQ ID NO: 313518 - RNA, 61 nt, Homo Sapiens
ggggcccugccagaguuaaagcagugacuggaggguggacugggggguugcagcaucuuua

SEQ ID NO: 313519 - RNA, 61 nt, Homo Sapiens
gagcuugccucuuugagaaaaccagccgggcaggguggaagugcaugucgggcuuaagguc

SEQ ID NO: 313520 - RNA, 61 nt, Homo Sapiens
aaucccagugaguaaauuaugagaaggggccaggguggaacggcaauugucagucuuuuua

SEQ ID NO: 313521 - RNA, 61 nt, Homo Sapiens
cagacccaagagcuuggcacauuuccggguuaggguggaaugggcuuugcagggaagaggg

SEQ ID NO: 313522 - RNA, 61 nt, Homo Sapiens
caguucucagucagacgugcagcauggcugcaggguggaccagcugccuggcauucaggcc

SEQ ID NO: 313523 - RNA, 64 nt, Homo Sapiens
cucuuuuuguaaauguauuuauugugaaggaacaccaugguagauuaaaagaccuuaagcuggc

SEQ ID NO: 313524 - RNA, 64 nt, Homo Sapiens
ccaucucuccuaagaccuuuguggcuucauuuguccaugguagcuuagauuuaacagauagagu

SEQ ID NO: 313525 - RNA, 63 nt, Homo Sapiens
aaguucguauuugcugaugccaguuuaaaauucccagguuacgucugaggaucaguuggugua

SEQ ID NO: 313526 - RNA, 63 nt, Homo Sapiens
aaccucgggaacgagcuauccuagcuucugaauccagguuaggauuauacuugaaugauggau

SEQ ID NO: 313527 - RNA, 63 nt, Homo Sapiens
aguuucauuuguucuugcccacaagcuugaaauccagguuaagguauccagccuuuaucauau

SEQ ID NO: 313528 - RNA, 63 nt, Homo Sapiens
agauguauagcuuucccaagaugaugguaaaacccagguuagucaucaguaaccuucucuauu

SEQ ID NO: 313529 - RNA, 63 nt, Homo Sapiens
cagaaagagguaaagagucugaaucaaaaaggaccagguuauugcuguugcuguuuuguggug

SEQ ID NO: 313530 - RNA, 63 nt, Homo Sapiens
gaggccccuggcuucaugagaacaaaggcaggcccagguuauaauuacagcuuucuccugccc

SEQ ID NO: 313531 - RNA, 63 nt, Homo Sapiens
ugccagcccuugcuugaugcuuacuggaaaucuccagguuaauuucuaucucugaucccuccc

SEQ ID NO: 313532 - RNA, 63 nt, Homo Sapiens
cuuuggugaccuacauugucaaaacuaccaauuccagguuaacuuuguuggagaauuuccccc

SEQ ID NO: 313533 - RNA, 63 nt, Homo Sapiens
cuuuuucacucugcagugugauuggacugccagccagguuaauaaacugaaaaaugugauugg

SEQ ID NO: 313534 - RNA, 63 nt, Homo Sapiens
uuaagugcugguaagaauauuucucuguuguugccagguuaccuucugcuuuuaaauugccau

SEQ ID NO: 313535 - RNA, 63 nt, Homo Sapiens
acccuacguacuggcauauuugaaacucuuuuuccagguuagguccuuuucuuucucauugaa

SEQ ID NO: 313536 - RNA, 63 nt, Homo Sapiens
uucuaaaaauucuuaacuuugcucccuuuuaagccagguuacaacaccuucugccuuuguccu

SEQ ID NO: 313537 - RNA, 63 nt, Homo Sapiens
aauaguggugggaggaagggccccugccaggccccagguuaggccuuagaucacaucacucca

SEQ ID NO: 313538 - RNA, 63 nt, Homo Sapiens
aaggccaugugccccuuugacucaccucauucuccagguuacaaagggaaacacagcucuaac

SEQ ID NO: 313539 - RNA, 63 nt, Homo Sapiens
ugacaacguaggguaacuacaguucauucuguuccagguuauauaaaacugcauuuccugaau

SEQ ID NO: 313540 - RNA, 63 nt, Homo Sapiens
uuuucuauuuuucuaagauaaaguaaaugaauuccagguuaaauguucacuuuaagguaauaa

SEQ ID NO: 313541 - RNA, 63 nt, Homo Sapiens
cagguugacuaguaucuguggguaccucccugcccagguuauucacucacaagccaccgggcc

SEQ ID NO: 313542 - RNA, 63 nt, Homo Sapiens
cuuuaggugccuccugucuuauggcguugcaggccagguuaugccucaugcugacuugcagag

SEQ ID NO: 313543 - RNA, 63 nt, Homo Sapiens
uuuucuguagaguguuguuugaauuuugagccuccagguuagaggcuccaagcagacaaagaa

SEQ ID NO: 313544 - RNA, 63 nt, Homo Sapiens
aaauguaauuuuaauucaaugaagauaucauuaccagguuacucuugagauuuuucaacggug

SEQ ID NO: 313545 - RNA, 63 nt, Homo Sapiens
gggcugguccuaagagggggcagaaaugaaugaccagguuaaaucccucuacaugugguuucu

SEQ ID NO: 313546 - RNA, 63 nt, Homo Sapiens
gcaauaaaguauaauguuuacagaaguuuuacuccagguuauuuugcugacaaccauuaaagu

SEQ ID NO: 313547 - RNA, 63 nt, Homo Sapiens
gauaacaaacggcuccuguguacaaauaaagucccagguuaaauuauacaaaugucuuaguug

SEQ ID NO: 313548 - RNA, 63 nt, Homo Sapiens
gggcuugccuugcucucuccguguccacuugucccagguuagggcugggucugggaguccuca

SEQ ID NO: 313549 - RNA, 63 nt, Homo Sapiens
aucggagccuucuuguguccucuaccuagguugccagguuauccgcucacacuuggcuggguu

SEQ ID NO: 313550 - RNA, 63 nt, Homo Sapiens
aggaugggaagagaaaaggaaagcagagagaacccagguuagaauuuacuucugguaagcaua

SEQ ID NO: 313551 - RNA, 63 nt, Homo Sapiens
aguggggggacuuaauucuagacugcucaguggccagguuaucgcagaugaugggauaacaug

SEQ ID NO: 313552 - RNA, 63 nt, Homo Sapiens
cccuagagagagugaggugcagggacccgagggccagguuagcacagcgcuggccccagcaug

SEQ ID NO: 313553 - RNA, 63 nt, Homo Sapiens
uguugucauccucaugacauuccugaggauucaccagguuagaagugaggacguuuaucuuug

SEQ ID NO: 313554 - RNA, 63 nt, Homo Sapiens
agagcaaaaagcuguguguuuuagaaaaaaaagccagguuacgcaacaggcauucugucaugu

SEQ ID NO: 313555 - RNA, 63 nt, Homo Sapiens
guuuuaaauauaugcuauagggacguuccaugcccagguuaacaaagaacugugauauauaga

SEQ ID NO: 313556 - RNA, 63 nt, Homo Sapiens
ccaugcaggccuauguggauugcugguuacccaccagguuaucaaugccccgcaucaucccuu

SEQ ID NO: 313557 - RNA, 63 nt, Homo Sapiens
cauagaguuccuuugucauaccuaugaggaaagccagguuauaaaacaugugacuauaccuuu

SEQ ID NO: 313558 - RNA, 63 nt, Homo Sapiens
ugcaucgagaaccugaauaacguuuagucaccuccagguuauaaggaccauguuauagaucag

SEQ ID NO: 313559 - RNA, 63 nt, Homo Sapiens
uuuucuauacuuugguccauuuccugggaguagccagguuaaacuaauaauaugaacuuauau

SEQ ID NO: 313560 - RNA, 63 nt, Homo Sapiens
acagguuuuuauuuuuccuaaugagaccaaaguccagguuagcauuccagaaccaaaucuuaa

SEQ ID NO: 313561 - RNA, 63 nt, Homo Sapiens
ugacgacaccugucuguuccagguccccaaagaccagguuaagaccugucggucuugauguca

SEQ ID NO: 313562 - RNA, 63 nt, Homo Sapiens
aaaaaaaaaauuauuuuuccagucuaccgugguccagguuaucagcucuuuaagagcucuauu

SEQ ID NO: 313563 - RNA, 63 nt, Homo Sapiens
caacccuaagguccaccacuccauccugaugccccagguuauccacagccuccuucccgacca

SEQ ID NO: 313564 - RNA, 63 nt, Homo Sapiens
agugccagcuuauuugugaugccccuucccagaccagguuaggauuccugggaaggccgcgga

SEQ ID NO: 313565 - RNA, 63 nt, Homo Sapiens
ccaccacugcccaaagcaaauugcacuguggcuccagguuauaauuggagcuucaggaccggc

SEQ ID NO: 313566 - RNA, 63 nt, Homo Sapiens
gccuugugagaaaagcuggagaagugagggcagccagguuauucucuggagguugguggauga

SEQ ID NO: 313567 - RNA, 63 nt, Homo Sapiens
cagagaccaagaggguuggagacacuaguuuuaccagguuacaggaggguucaagacagaagg

SEQ ID NO: 313568 - RNA, 63 nt, Homo Sapiens
aaaacagguuagcuuuucuuugcugcagaagaaccagguuaaauugauagacucugaagaguc

SEQ ID NO: 313569 - RNA, 63 nt, Homo Sapiens
guugauucagcuuuaagaugauauguuagcccuccagguuaaaugggaugcaaguauugcuaa

SEQ ID NO: 313570 - RNA, 63 nt, Homo Sapiens
gaccugccuaucguuccaaucagcuccuuguucccagguuacaguagcuuuauuggucugaac

SEQ ID NO: 313571 - RNA, 63 nt, Homo Sapiens
aaggcagcauuccaugaccaaagaagcuucaugccagguuagggugcccugcaaauauuagca

SEQ ID NO: 313572 - RNA, 63 nt, Homo Sapiens
gaaacagcucucagauuuauaaauuggaaaucaccagguuacuugccaauauauagucauauu

SEQ ID NO: 313573 - RNA, 63 nt, Homo Sapiens
guauucuccguuuuccuuucucguauaccugccccagguuaucccauuucuguuguuaccuuu

SEQ ID NO: 313574 - RNA, 63 nt, Homo Sapiens
uuuuggguuucauuauaaacucuuagccucaguccagguuaaucugaaguuugaaagcucaga

SEQ ID NO: 313575 - RNA, 63 nt, Homo Sapiens
cuacccauaacucccugcuaggcuaaguagaaaccagguuauuucucccugcuuauggcuccc

SEQ ID NO: 313576 - RNA, 63 nt, Homo Sapiens
uucuuaucucuuucacuuuuuaaauaucuuucaccagguuauauuuugguauuauuuuuccaa

SEQ ID NO: 313577 - RNA, 63 nt, Homo Sapiens
acacauaagauugaacaaagcauuuagauuauuccagguuauaucauuuuuuuaaagauuuuc

SEQ ID NO: 313578 - RNA, 63 nt, Homo Sapiens
cuguguaguucguguuaucaaucugaucugcagccagguuauuuacuucugaagcauuggagu

SEQ ID NO: 313579 - RNA, 63 nt, Homo Sapiens
cuugauauacacagagauggcagaaauauucauccagguuaacugccuaccccaugccugcug

SEQ ID NO: 313580 - RNA, 63 nt, Homo Sapiens
cuguugaguuguggcuucaacucucaggugaguccagguuaaagcuucacaugcaggaggccu

SEQ ID NO: 313581 - RNA, 63 nt, Homo Sapiens
uauacauuuauguggagguggucaggugucaugccagguuaugauuugucugucauuuacccu

SEQ ID NO: 313582 - RNA, 63 nt, Homo Sapiens
uuuucauaguguuucuuucaugucaggcuccucccagguuauggauagaacaaugaugccagu

SEQ ID NO: 313583 - RNA, 63 nt, Homo Sapiens
uuuaaacuauacauauacauaauuuauggaugcccagguuacaaguuuaacaaguuccauagu

SEQ ID NO: 313584 - RNA, 63 nt, Homo Sapiens
ugguaaaauaauccaggcguaaucacuguguaaccagguuaagucugacagaaaaaaaaaaaa

SEQ ID NO: 313585 - RNA, 63 nt, Homo Sapiens
aaggagagaagcuacuauugauuagagccuaacccagguuaacugcaagaagaggcgggauac

SEQ ID NO: 313586 - RNA, 63 nt, Homo Sapiens
ucauuaccccauuggguggcaccuuuuaaaaauccagguuauuaaaggauucacacuuuauua

SEQ ID NO: 313587 - RNA, 63 nt, Homo Sapiens
cuguaucaauuacaguaguucuaccagaaucucccagguuauaauuuaugaggguagagaaau

SEQ ID NO: 313588 - RNA, 63 nt, Homo Sapiens
gcaaugguguugcccugaguggaucuccaaggaccagguuauuuuaaaaagauuuguuuuguc

SEQ ID NO: 313589 - RNA, 63 nt, Homo Sapiens
agacagcaggaagccauagaugcuggcuggguuccagguuauggggagaagaaauacagucaa

SEQ ID NO: 313590 - RNA, 63 nt, Homo Sapiens
gcacaaauuagcacccuauaccacgacaugagaccagguuauaauguugcaacugggaauaua

SEQ ID NO: 313591 - RNA, 63 nt, Homo Sapiens
ccaggagcaugaacugauccaugaaugccuuuuccagguuaaaauuuggucacugaugccuau

SEQ ID NO: 313592 - RNA, 63 nt, Homo Sapiens
ucacacaugguauauuauugacccaauaacucgccagguuacaugggucuugagagagaauuu

SEQ ID NO: 313593 - RNA, 63 nt, Homo Sapiens
cucccaguuuaaaggaugggaagaccccaaucaccagguuauuggaucuguccagugagagau

SEQ ID NO: 313594 - RNA, 63 nt, Homo Sapiens
gauuacaauuaaucuuuuaccuaccaauggaagccagguuaauuuauccggcaagagugaauu

SEQ ID NO: 313595 - RNA, 63 nt, Homo Sapiens
auuuuaauuucuacaaaauaaacuuauuuuucaccagguuaaauuuauuauaccacuuauauc

SEQ ID NO: 313596 - RNA, 63 nt, Homo Sapiens
ucccuggugaaacugaggagaaaaguuaaucaaccagguuacucccacaguuugcccgugugu

SEQ ID NO: 313597 - RNA, 63 nt, Homo Sapiens
uggaagaaacuuugagaggucagagucucagagccagguuaaguuuucucauuuccaaagacc

SEQ ID NO: 313598 - RNA, 63 nt, Homo Sapiens
auggccuuuauccuaguuccccugauguuuuucccagguuacaccgcuaauucauaccucccu

SEQ ID NO: 313599 - RNA, 63 nt, Homo Sapiens
caccaguccuugcacuguucaaagguuaagaggccagguuaccuguauguugcuugcuauuaa

SEQ ID NO: 313600 - RNA, 63 nt, Homo Sapiens
ugguguaaagguuuguuauauuucuuuagcaaaccagguuaugaagcaguacuuuaccuguuu

SEQ ID NO: 313601 - RNA, 63 nt, Homo Sapiens
ccuacacuuccuucugugcccugccagugacccccagguuauucuaaagcagaguccuucccu

SEQ ID NO: 313602 - RNA, 63 nt, Homo Sapiens
uccuguuuuuucagcacuuuaacagaugccauuccagguuaaacuggguugucuguacuaaau

SEQ ID NO: 313603 - RNA, 63 nt, Homo Sapiens
aaaaggauaagugaacacccaugaaccuacuacccagguuaagaaaauaaaugucaccaggua

SEQ ID NO: 313604 - RNA, 63 nt, Homo Sapiens
uaaguccgcucugaugaaacauucuaagaucaaccagguuacuaugaugauuuugcugugaca

SEQ ID NO: 313605 - RNA, 63 nt, Homo Sapiens
gcuccaaguuccacaggucuuugcucaggcauaccagguuauaagggccuggacagauuauga

SEQ ID NO: 313606 - RNA, 63 nt, Homo Sapiens
acauuuuaaaauccugauuuuggagacuuaaaaccagguuaauggcuaagaauggguaacaug

SEQ ID NO: 313607 - RNA, 63 nt, Homo Sapiens
aguucucaaauauuggguugggcacggcuuauaccagguuaccucacuuuuaauuagugaugc

SEQ ID NO: 313608 - RNA, 63 nt, Homo Sapiens
ggagggagaaaagagguggguaggguuacagauccagguuauaacuacucuggcccauaccuu

SEQ ID NO: 313609 - RNA, 63 nt, Homo Sapiens
ggccuccugcgcccucaccugccacagagcaacccagguuaaauacagcccaugcacaaagcc

SEQ ID NO: 313610 - RNA, 63 nt, Homo Sapiens
cacgcccuccauagaccuucagagaaggugaaaccagguuaucugggaaucuuuccagcccgc

SEQ ID NO: 313611 - RNA, 63 nt, Homo Sapiens
uuccagaauucuugcaagacccugauacaacugccagguuaauuguuccguccccuuaccacc

SEQ ID NO: 313612 - RNA, 63 nt, Homo Sapiens
gggcccccaagaagagcuuuggagucuggggaaccagguuagucuguccacgugggguuguuu

SEQ ID NO: 313613 - RNA, 63 nt, Homo Sapiens
ugguaagaggauuuuuuugguuuuuguccauauccagguuagcccuuuacagcaaucaagaua

SEQ ID NO: 313614 - RNA, 63 nt, Homo Sapiens
cucuccccucuuggccuccuaaucagugaccggccagguuagcagagcuacagcgugugaugg

SEQ ID NO: 313615 - RNA, 63 nt, Homo Sapiens
ugcuucuaggacucuuggcccaccuucuccuccccagguuacugaacccaggcgcugccccag

SEQ ID NO: 313616 - RNA, 63 nt, Homo Sapiens
aaagcacugacuuguuucucagcugccccuuugccagguuaauaggggcugcucaggccgccu

SEQ ID NO: 313617 - RNA, 63 nt, Homo Sapiens
acaaaccagccuaaggcagacacucuccacuguccagguuauaaccugguaccagcagacuuu

SEQ ID NO: 313618 - RNA, 63 nt, Homo Sapiens
auuuuuuguauuuuuaguagagacgggguuucaccagguuagccaggauggucucgaucuccu

SEQ ID NO: 313619 - RNA, 63 nt, Homo Sapiens
agaguuuguaacaaaauauuuuauuauauaaaaccagguuagaaggaaugcaggauauuuuua

SEQ ID NO: 313620 - RNA, 63 nt, Homo Sapiens
auggaagcugcuaagguucgaauucaaacccagccagguuaugccaacacuuugagggaugca

SEQ ID NO: 313621 - RNA, 63 nt, Homo Sapiens
uuaagaauugguuuugggagggcgaggacugggccagguuagaggcagauggcacaggggcgu

SEQ ID NO: 313622 - RNA, 63 nt, Homo Sapiens
gcaacccuaacucacucuaggggauugcucacuccagguuacucacaucaccaccuggaauca

SEQ ID NO: 313623 - RNA, 63 nt, Homo Sapiens
uuauacaucucaaugcugagaguuaaaauauucccagguuaaaauuuuuuuaaaguaccaaua

SEQ ID NO: 313624 - RNA, 63 nt, Homo Sapiens
aaaucugagaucugccaggccccucuucuaacaccagguuaggcaugcuugguuauuuccagu

SEQ ID NO: 313625 - RNA, 63 nt, Homo Sapiens
gggggcaaucugagaauauuccucaaaagguguccagguuaaauagacauguuacuggcugca

SEQ ID NO: 313626 - RNA, 63 nt, Homo Sapiens
uuacuccugaccacuaauaguucaugagccuguccagguuagugaugcauccagggguucauu

SEQ ID NO: 313627 - RNA, 63 nt, Homo Sapiens
accuuuagccaagaggagcugcagggaccauggccagguuaccaaaaugcccugcucugaagc

SEQ ID NO: 313628 - RNA, 63 nt, Homo Sapiens
ccuuacugggcuaaucagcacuugaucggaaguccagguuaguaugugaagccaggaguacua

SEQ ID NO: 313629 - RNA, 63 nt, Homo Sapiens
aaaugggucaaccagagcaacacuuuuuuucuuccagguuauuugagaccagacauggagcaa

SEQ ID NO: 313630 - RNA, 63 nt, Homo Sapiens
aauauauauguugcuguugcugaauacaggagaccagguuaggaauauaguuucauaauaaua

SEQ ID NO: 313631 - RNA, 63 nt, Homo Sapiens
ucuccagggagagaggguggucgucugugcauuccagguuacugcacuugucugaugugacgu

SEQ ID NO: 313632 - RNA, 63 nt, Homo Sapiens
ccaggucuucuuaaaacaaagucaucagcuuugccagguuacauacuuuauuuaaaaguauag

SEQ ID NO: 313633 - RNA, 63 nt, Homo Sapiens
caaagcaagugauugggacagagguuaucugucccagguuaucugggcauagaugcaggugag

SEQ ID NO: 313634 - RNA, 63 nt, Homo Sapiens
ggcuagaguugucuuuaaggguuaggguuaggaccagguuaggucaggguuggauuggguuua

SEQ ID NO: 313635 - RNA, 63 nt, Homo Sapiens
gugagccaagaucgugccacgagcccaugaggcccagguuacauugaggugggaggaucgcuu

SEQ ID NO: 313636 - RNA, 63 nt, Homo Sapiens
cucagcuccuaucucuguauggccugguuuuucccagguuaugauuauagagcgaggauuauu

SEQ ID NO: 313637 - RNA, 63 nt, Homo Sapiens
cuuggaaaugggccccacguuucgaauucaucuccagguuaagaagcugccagaccuugccag

SEQ ID NO: 313638 - RNA, 63 nt, Homo Sapiens
cuuaccuguccgcccaccugucuggaacaagggccagguuaagaccacaugccucauguccaa

SEQ ID NO: 313639 - RNA, 63 nt, Homo Sapiens
uuuuuguaagauuucuccuugcaagcacaacauccagguuaaucuaagugacuuaaccuuaga

SEQ ID NO: 313640 - RNA, 63 nt, Homo Sapiens
ucuucccugcccagagccagauuaaacaaaaccccagguuauuguuuuuuaagaacagggaaa

SEQ ID NO: 313641 - RNA, 63 nt, Homo Sapiens
ucagacaccacuaguagauaaacacuggagagcccagguuauagagauugggaagcccacugu

SEQ ID NO: 313642 - RNA, 63 nt, Homo Sapiens
uauuguuuuugagacaaggucccuuucugucacccagguuagaguagauuucaguggcacaau

SEQ ID NO: 313643 - RNA, 63 nt, Homo Sapiens
uuuaugucugagcuuauuguguuugagcuaacaccagguuacucaguaaccaugaccugcucc

SEQ ID NO: 313644 - RNA, 63 nt, Homo Sapiens
gacuagaagcuucuguuccugacaccaaaugugccagguuagcaaaugagcacaagauguggc

SEQ ID NO: 313645 - RNA, 63 nt, Homo Sapiens
aggagccggugcucuggaagaccugaaagaagcccagguuacaaagacaugggggccuugugg

SEQ ID NO: 313646 - RNA, 63 nt, Homo Sapiens
uucuagauguccggguucccugcacaccugucgccagguuaaacaaccaucgagcauguguca

SEQ ID NO: 313647 - RNA, 63 nt, Homo Sapiens
agccgcugaccaaaguccaaagcacagcagcguccagguuaaagcccugagcugugagagacc

SEQ ID NO: 313648 - RNA, 63 nt, Homo Sapiens
ccgcauaaaaaauaaagugaucuuacgaaaaacccagguuagaaauauaagaaauaaaggagc

SEQ ID NO: 313649 - RNA, 63 nt, Homo Sapiens
aagggguucccuuuuugguaccccauuugacacccagguuaaagcuuacccuugauuuuuucu

SEQ ID NO: 313650 - RNA, 63 nt, Homo Sapiens
gcaaaaaugagguuuugcuugagggucuccagaccagguuacucagagacuagauguaucuga

SEQ ID NO: 313651 - RNA, 63 nt, Homo Sapiens
cacgacccaggcugagaaggugggauuugagacccagguuaggacuccagggugaaggcagag

SEQ ID NO: 313652 - RNA, 63 nt, Homo Sapiens
aaaaugaaaggaacuugacuguacaguuuguagccagguuaagcauuugguauuguuucauuu

SEQ ID NO: 313653 - RNA, 63 nt, Homo Sapiens
caccaugucccuugcccccauguagcccauuucccagguuaugcucuuuucuuucucaggguc

SEQ ID NO: 313654 - RNA, 63 nt, Homo Sapiens
uuacguauugaauauagaaaucauucuaacaacccagguuauuuucaaucagaccaggcauuc

SEQ ID NO: 313655 - RNA, 63 nt, Homo Sapiens
guuuaccucuucuaugcaagccuugcuagacagccagguuagccuuugcccugucacccccga

SEQ ID NO: 313656 - RNA, 63 nt, Homo Sapiens
auagccuaaaaaccuagccucuaacaccuuguuccagguuaccuuccaaaguuucuaucuugu

SEQ ID NO: 313657 - RNA, 63 nt, Homo Sapiens
gcugaagccugccccgcugaggggugcacagcgccagguuaacgcuggaccaacgcggguucu

SEQ ID NO: 313658 - RNA, 63 nt, Homo Sapiens
ccagaaaugacccaacucucgacccaccccucuccagguuauccuccucccuggagcuccaga

SEQ ID NO: 313659 - RNA, 63 nt, Homo Sapiens
aauucuccugccucagccuccaaccuccgccacccagguuaaaggugcaaucuuggcucacug

SEQ ID NO: 313660 - RNA, 63 nt, Homo Sapiens
aauugggaauggcugggaggccgccccuuccccccagguuagccgcgagacuuucgguccccc

SEQ ID NO: 313661 - RNA, 63 nt, Homo Sapiens
ugugaagagacucugggauccagaagacacucaccagguuaucgaugccuauccacccucugg

SEQ ID NO: 313662 - RNA, 63 nt, Homo Sapiens
ucggggcauagcccagggaugcccccaggcggcccagguuagaugcgucccuuuggcuuguca

SEQ ID NO: 313663 - RNA, 63 nt, Homo Sapiens
aggcccaguggggaagaaugaacauggcuucauccagguuaacugaugcugccauuugcccag

SEQ ID NO: 313664 - RNA, 63 nt, Homo Sapiens
aggccaagggguaggccugagcgccagagucgcccagguuagcccacaggauuccuuugugug

SEQ ID NO: 313665 - RNA, 63 nt, Homo Sapiens
ucaugcacacgcugacacgcgguugcauggaguccagguuacucaggccggcacuucugagug

SEQ ID NO: 313666 - RNA, 63 nt, Homo Sapiens
accuguggauuguuucaauuuuuccuaguauuuccagguuagagauuaaugcauccagauugu

SEQ ID NO: 313667 - RNA, 63 nt, Homo Sapiens
uagguagaguuagugcuccauguagggcguaguccagguuagcucuuuaccuagucccugcug

SEQ ID NO: 313668 - RNA, 63 nt, Homo Sapiens
ggcagaucagaagggcugcgggcccagcugaacccagguuaggcacucugcuccuuacaucua

SEQ ID NO: 313669 - RNA, 63 nt, Homo Sapiens
uguuuaauccauguauugguacuuuacugaaaaccagguuauauucuaaagaagaaagaaggc

SEQ ID NO: 313670 - RNA, 63 nt, Homo Sapiens
aaaugaccuaucaaaaauuaucuuaauugugaaccagguuagcucauucaccagauauuuugu

SEQ ID NO: 313671 - RNA, 63 nt, Homo Sapiens
ucauuggggugguugucaugugauggguccccuccagguuacuaaagggugcauguccccugc

SEQ ID NO: 313672 - RNA, 63 nt, Homo Sapiens
aaagggugcauguccccugcugacggguccccuccagguuacuugguuggggugguugucaug

SEQ ID NO: 313673 - RNA, 63 nt, Homo Sapiens
aucugugagugacugagggagacaggaggaauaccagguuauucauggaauaaagucuuucca

SEQ ID NO: 313674 - RNA, 63 nt, Homo Sapiens
gccaagcacugugcagaggguacacaguuccugccagguuaacacccucccuucaggccuccc

SEQ ID NO: 313675 - RNA, 63 nt, Homo Sapiens
aaaggauucagcacuacagcaagauucucagauccagguuaggggaaaauaauuuuuuccucc

SEQ ID NO: 313676 - RNA, 64 nt, Homo Sapiens
aaaguucguauuugcugaugccaguuuaaaauucccagguuacgucugaggaucaguuggugua

SEQ ID NO: 313677 - RNA, 64 nt, Homo Sapiens
gaaccucgggaacgagcuauccuagcuucugaauccagguuaggauuauacuugaaugauggau

SEQ ID NO: 313678 - RNA, 64 nt, Homo Sapiens
uaguuucauuuguucuugcccacaagcuugaaauccagguuaagguauccagccuuuaucauau

SEQ ID NO: 313679 - RNA, 64 nt, Homo Sapiens
aagauguauagcuuucccaagaugaugguaaaacccagguuagucaucaguaaccuucucuauu

SEQ ID NO: 313680 - RNA, 64 nt, Homo Sapiens
acagaaagagguaaagagucugaaucaaaaaggaccagguuauugcuguugcuguuuuguggug

SEQ ID NO: 313681 - RNA, 64 nt, Homo Sapiens
agaggccccuggcuucaugagaacaaaggcaggcccagguuauaauuacagcuuucuccugccc

SEQ ID NO: 313682 - RNA, 64 nt, Homo Sapiens
uugccagcccuugcuugaugcuuacuggaaaucuccagguuaauuucuaucucugaucccuccc

SEQ ID NO: 313683 - RNA, 64 nt, Homo Sapiens
ucuuuggugaccuacauugucaaaacuaccaauuccagguuaacuuuguuggagaauuuccccc

SEQ ID NO: 313684 - RNA, 64 nt, Homo Sapiens
ccuuuuucacucugcagugugauuggacugccagccagguuaauaaacugaaaaaugugauugg

SEQ ID NO: 313685 - RNA, 64 nt, Homo Sapiens
auuaagugcugguaagaauauuucucuguuguugccagguuaccuucugcuuuuaaauugccau

SEQ ID NO: 313686 - RNA, 64 nt, Homo Sapiens
uacccuacguacuggcauauuugaaacucuuuuuccagguuagguccuuuucuuucucauugaa

SEQ ID NO: 313687 - RNA, 64 nt, Homo Sapiens
uucuaaaaauucuuaacuuuugcucccuuuuaagccagguuacacacaccuucugccuuugucc

SEQ ID NO: 313688 - RNA, 64 nt, Homo Sapiens
aauaguggugggaggaagggaccccugccaggccccagguuaggcccuuagaucacaucacucc

SEQ ID NO: 313689 - RNA, 64 nt, Homo Sapiens
aaggccaugugccccuuugaccucaccucauucuccagguuacauaagggaaacacagcucuaa

SEQ ID NO: 313690 - RNA, 64 nt, Homo Sapiens
augacaacguaggguaacuacaguucauucuguuccagguuauauaaaacugcauuuccugaau

SEQ ID NO: 313691 - RNA, 64 nt, Homo Sapiens
auuuucuauuuuucuaagauaaaguaaaugaauuccagguuaaauguucacuuuaagguaauaa

SEQ ID NO: 313692 - RNA, 64 nt, Homo Sapiens
acagguugacuaguaucuguggguaccucccugcccagguuauucacucacaagccaccgggcc

SEQ ID NO: 313693 - RNA, 64 nt, Homo Sapiens
ucuuuaggugccuccugucuuauggcguugcaggccagguuaugccucaugcugacuugcagag

SEQ ID NO: 313694 - RNA, 64 nt, Homo Sapiens
uuuuucuguagaguguuguuugaauuuugagccuccagguuagaggcuccaagcagacaaagaa

SEQ ID NO: 313695 - RNA, 64 nt, Homo Sapiens
aaaauguaauuuuaauucaaugaagauaucauuaccagguuacucuugagauuuuucaacggug

SEQ ID NO: 313696 - RNA, 64 nt, Homo Sapiens
agggcugguccuaagagggggcagaaaugaaugaccagguuaaaucccucuacaugugguuucu

SEQ ID NO: 313697 - RNA, 64 nt, Homo Sapiens
gcaauaaaguauaauguuuaucagaaguuuuacuccagguuauuuuugcugacaaccauuaaag

SEQ ID NO: 313698 - RNA, 64 nt, Homo Sapiens
gauaacaaacggcuccugugguacaaauaaagucccagguuaaauuuauacaaaugucuuaguu

SEQ ID NO: 313699 - RNA, 64 nt, Homo Sapiens
gggcuugccuugcucucuccaguguccacuugucccagguuaggggcugggucugggaguccuc

SEQ ID NO: 313700 - RNA, 64 nt, Homo Sapiens
aucggagccuucuuguguccuucuaccuagguugccagguuaucacgcucacacuuggcugggu

SEQ ID NO: 313701 - RNA, 64 nt, Homo Sapiens
aggaugggaagagaaaaggaaaagcagagagaacccagguuagacauuuacuucugguaagcau

SEQ ID NO: 313702 - RNA, 64 nt, Homo Sapiens
aguggggggacuuaauucuaggacugcucaguggccagguuaucagcagaugaugggauaacau

SEQ ID NO: 313703 - RNA, 64 nt, Homo Sapiens
ccccuagagagagugaggugcagggacccgagggccagguuagcacagcgcuggccccagcaug

SEQ ID NO: 313704 - RNA, 64 nt, Homo Sapiens
guguugucauccucaugacauuccugaggauucaccagguuagaagugaggacguuuaucuuug

SEQ ID NO: 313705 - RNA, 64 nt, Homo Sapiens
aagagcaaaaagcuguguguuuuagaaaaaaaagccagguuacgcaacaggcauucugucaugu

SEQ ID NO: 313706 - RNA, 64 nt, Homo Sapiens
gguuuuaaauauaugcuauagggacguuccaugcccagguuaacaaagaacugugauauauaga

SEQ ID NO: 313707 - RNA, 64 nt, Homo Sapiens
ccaugcaggccuauguggauuugcugguuacccaccagguuaucuaaugccccgcaucaucccu

SEQ ID NO: 313708 - RNA, 64 nt, Homo Sapiens
cauagaguuccuuugucauauccuaugaggaaagccagguuauagaaacaugugacuauaccuu

SEQ ID NO: 313709 - RNA, 64 nt, Homo Sapiens
ugcaucgagaaccugaauaagcguuuagucaccuccagguuauauaggaccauguuauagauca

SEQ ID NO: 313710 - RNA, 64 nt, Homo Sapiens
uuuucuauacuuugguccauuuuccugggaguagccagguuaaaacuaauaauaugaacuuaua

SEQ ID NO: 313711 - RNA, 64 nt, Homo Sapiens
acagguuuuuauuuuuccuaaaugagaccaaaguccagguuagccauuccagaaccaaaucuua

SEQ ID NO: 313712 - RNA, 64 nt, Homo Sapiens
ugacgacaccugucuguuccaagguccccaaagaccagguuaaggaccugucggucuugauguc

SEQ ID NO: 313713 - RNA, 64 nt, Homo Sapiens
caaaaaaaaaauuauuuuuccagucuaccgugguccagguuaucagcucuuuaagagcucuauu

SEQ ID NO: 313714 - RNA, 64 nt, Homo Sapiens
ucaacccuaagguccaccacuccauccugaugccccagguuauccacagccuccuucccgacca

SEQ ID NO: 313715 - RNA, 64 nt, Homo Sapiens
gagugccagcuuauuugugaugccccuucccagaccagguuaggauuccugggaaggccgcgga

SEQ ID NO: 313716 - RNA, 64 nt, Homo Sapiens
ccaccacugcccaaagcaaacuugcacuguggcuccagguuauaaauuggagcuucaggaccgg

SEQ ID NO: 313717 - RNA, 64 nt, Homo Sapiens
ugccuugugagaaaagcuggagaagugagggcagccagguuauucucuggagguugguggauga

SEQ ID NO: 313718 - RNA, 64 nt, Homo Sapiens
gcagagaccaagaggguuggagacacuaguuuuaccagguuacaggaggguucaagacagaagg

SEQ ID NO: 313719 - RNA, 64 nt, Homo Sapiens
aaaacagguuagcuuuucuucugcugcagaagaaccagguuaaacuugauagacucugaagagu

SEQ ID NO: 313720 - RNA, 64 nt, Homo Sapiens
guugauucagcuuuaagaugaauauguuagcccuccagguuaaacugggaugcaaguauugcua

SEQ ID NO: 313721 - RNA, 64 nt, Homo Sapiens
gaccugccuaucguuccaauccagcuccuuguucccagguuacacguagcuuuauuggucugaa

SEQ ID NO: 313722 - RNA, 64 nt, Homo Sapiens
aaggcagcauuccaugaccaaaagaagcuucaugccagguuaggugugcccugcaaauauuagc

SEQ ID NO: 313723 - RNA, 64 nt, Homo Sapiens
ggaaacagcucucagauuuauaaauuggaaaucaccagguuacuugccaauauauagucauauu

SEQ ID NO: 313724 - RNA, 64 nt, Homo Sapiens
aguauucuccguuuuccuuucucguauaccugccccagguuaucccauuucuguuguuaccuuu

SEQ ID NO: 313725 - RNA, 64 nt, Homo Sapiens
guuuuggguuucauuauaaacucuuagccucaguccagguuaaucugaaguuugaaagcucaga

SEQ ID NO: 313726 - RNA, 64 nt, Homo Sapiens
ccuacccauaacucccugcuaggcuaaguagaaaccagguuauuucucccugcuuauggcuccc

SEQ ID NO: 313727 - RNA, 64 nt, Homo Sapiens
uuucuuaucucuuucacuuuuuaaauaucuuucaccagguuauauuuugguauuauuuuuccaa

SEQ ID NO: 313728 - RNA, 64 nt, Homo Sapiens
aacacauaagauugaacaaagcauuuagauuauuccagguuauaucauuuuuuuaaagauuuuc

SEQ ID NO: 313729 - RNA, 64 nt, Homo Sapiens
ucuguguaguucguguuaucaaucugaucugcagccagguuauuuacuucugaagcauuggagu

SEQ ID NO: 313730 - RNA, 64 nt, Homo Sapiens
cuugauauacacagagaugggcagaaauauucauccagguuaaccugccuaccccaugccugcu

SEQ ID NO: 313731 - RNA, 64 nt, Homo Sapiens
cuguugaguuguggcuucaaucucucaggugaguccagguuaaaggcuucacaugcaggaggcc

SEQ ID NO: 313732 - RNA, 64 nt, Homo Sapiens
uauacauuuauguggaggugugucaggugucaugccagguuauguauuugucugucauuuaccc

SEQ ID NO: 313733 - RNA, 64 nt, Homo Sapiens
uuuucauaguguuucuuucauugucaggcuccucccagguuaugagauagaacaaugaugccag

SEQ ID NO: 313734 - RNA, 64 nt, Homo Sapiens
uuuaaacuauacauauacauuaauuuauggaugcccagguuacauaguuuaacaaguuccauag

SEQ ID NO: 313735 - RNA, 64 nt, Homo Sapiens
ugguaaaauaauccaggcguaaaucacuguguaaccagguuaagaucugacagaaaaaaaaaaa

SEQ ID NO: 313736 - RNA, 64 nt, Homo Sapiens
uaaggagagaagcuacuauugauuagagccuaacccagguuaacugcaagaagaggcgggauac

SEQ ID NO: 313737 - RNA, 64 nt, Homo Sapiens
uucauuaccccauuggguggcaccuuuuaaaaauccagguuauuaaaggauucacacuuuauua

SEQ ID NO: 313738 - RNA, 64 nt, Homo Sapiens
ucuguaucaauuacaguaguucuaccagaaucucccagguuauaauuuaugaggguagagaaau

SEQ ID NO: 313739 - RNA, 64 nt, Homo Sapiens
ugcaaugguguugcccugaguggaucuccaaggaccagguuauuuuaaaaagauuuguuuuguc

SEQ ID NO: 313740 - RNA, 64 nt, Homo Sapiens
cagacagcaggaagccauagaugcuggcuggguuccagguuauggggagaagaaauacagucaa

SEQ ID NO: 313741 - RNA, 64 nt, Homo Sapiens
gcacaaauuagcacccuauaaccacgacaugagaccagguuauaaauguugcaacugggaauau

SEQ ID NO: 313742 - RNA, 64 nt, Homo Sapiens
cccaggagcaugaacugauccaugaaugccuuuuccagguuaaaauuuggucacugaugccuau

SEQ ID NO: 313743 - RNA, 64 nt, Homo Sapiens
uucacacaugguauauuauugacccaauaacucgccagguuacaugggucuugagagagaauuu

SEQ ID NO: 313744 - RNA, 64 nt, Homo Sapiens
ccucccaguuuaaaggaugggaagaccccaaucaccagguuauuggaucuguccagugagagau

SEQ ID NO: 313745 - RNA, 64 nt, Homo Sapiens
gauuacaauuaaucuuuuacucuaccaauggaagccagguuaauguuauccggcaagagugaau

SEQ ID NO: 313746 - RNA, 64 nt, Homo Sapiens
auuuuaauuucuacaaaauacaacuuauuuuucaccagguuaaaguuuauuauaccacuuauau

SEQ ID NO: 313747 - RNA, 64 nt, Homo Sapiens
uucccuggugaaacugaggagaaaaguuaaucaaccagguuacucccacaguuugcccgugugu

SEQ ID NO: 313748 - RNA, 64 nt, Homo Sapiens
uggaagaaacuuugagagguccagagucucagagccagguuaagauuuucucauuuccaaagac

SEQ ID NO: 313749 - RNA, 64 nt, Homo Sapiens
auggccuuuauccuaguuccuccugauguuuuucccagguuacacccgcuaauucauaccuccc

SEQ ID NO: 313750 - RNA, 64 nt, Homo Sapiens
caccaguccuugcacuguucaaaagguuaagaggccagguuacccuguauguugcuugcuauua

SEQ ID NO: 313751 - RNA, 64 nt, Homo Sapiens
ugguguaaagguuuguuauauuuucuuuagcaaaccagguuauguaagcaguacuuuaccuguu

SEQ ID NO: 313752 - RNA, 64 nt, Homo Sapiens
accuacacuuccuucugugcccugccagugacccccagguuauucuaaagcagaguccuucccu

SEQ ID NO: 313753 - RNA, 64 nt, Homo Sapiens
uuccuguuuuuucagcacuuuaacagaugccauuccagguuaaacuggguugucuguacuaaau

SEQ ID NO: 313754 - RNA, 64 nt, Homo Sapiens
aaaaaggauaagugaacacccaugaaccuacuacccagguuaagaaaauaaaugucaccaggua

SEQ ID NO: 313755 - RNA, 64 nt, Homo Sapiens
uaaguccgcucugaugaaacaauucuaagaucaaccagguuacucaugaugauuuugcugugac

SEQ ID NO: 313756 - RNA, 64 nt, Homo Sapiens
gcuccaaguuccacaggucuauugcucaggcauaccagguuauaaagggccuggacagauuaug

SEQ ID NO: 313757 - RNA, 64 nt, Homo Sapiens
uacauuuuaaaauccugauuuuggagacuuaaaaccagguuaauggcuaagaauggguaacaug

SEQ ID NO: 313758 - RNA, 64 nt, Homo Sapiens
aaguucucaaauauuggguugggcacggcuuauaccagguuaccucacuuuuaauuagugaugc

SEQ ID NO: 313759 - RNA, 64 nt, Homo Sapiens
gggagggagaaaagagguggguaggguuacagauccagguuauaacuacucuggcccauaccuu

SEQ ID NO: 313760 - RNA, 64 nt, Homo Sapiens
gggccuccugcgcccucaccugccacagagcaacccagguuaaauacagcccaugcacaaagcc

SEQ ID NO: 313761 - RNA, 64 nt, Homo Sapiens
ccacgcccuccauagaccuucagagaaggugaaaccagguuaucugggaaucuuuccagcccgc

SEQ ID NO: 313762 - RNA, 64 nt, Homo Sapiens
uuccagaauucuugcaagaccccugauacaacugccagguuaaucuguuccguccccuuaccac

SEQ ID NO: 313763 - RNA, 64 nt, Homo Sapiens
gggcccccaagaagagcuuuuggagucuggggaaccagguuagugcuguccacgugggguuguu

SEQ ID NO: 313764 - RNA, 64 nt, Homo Sapiens
ugguaagaggauuuuuuuggauuuuuguccauauccagguuagcaccuuuacagcaaucaagau

SEQ ID NO: 313765 - RNA, 64 nt, Homo Sapiens
cucuccccucuuggccuccugaaucagugaccggccagguuagcgagagcuacagcgugugaug

SEQ ID NO: 313766 - RNA, 64 nt, Homo Sapiens
ugcuucuaggacucuuggccgcaccuucuccuccccagguuacuagaacccaggcgcugcccca

SEQ ID NO: 313767 - RNA, 64 nt, Homo Sapiens
aaagcacugacuuguuucucuagcugccccuuugccagguuaaucaggggcugcucaggccgcc

SEQ ID NO: 313768 - RNA, 64 nt, Homo Sapiens
cacaaaccagccuaaggcagacacucuccacuguccagguuauaaccugguaccagcagacuuu

SEQ ID NO: 313769 - RNA, 64 nt, Homo Sapiens
aauuuuuuguauuuuuaguagagacgggguuucaccagguuagccaggauggucucgaucuccu

SEQ ID NO: 313770 - RNA, 64 nt, Homo Sapiens
uagaguuuguaacaaaauauuuuauuauauaaaaccagguuagaaggaaugcaggauauuuuua

SEQ ID NO: 313771 - RNA, 64 nt, Homo Sapiens
uauggaagcugcuaagguucgaauucaaacccagccagguuaugccaacacuuugagggaugca

SEQ ID NO: 313772 - RNA, 64 nt, Homo Sapiens
uuuaagaauugguuuugggagggcgaggacugggccagguuagaggcagauggcacaggggcgu

SEQ ID NO: 313773 - RNA, 64 nt, Homo Sapiens
gcaacccuaacucacucuagagggauugcucacuccagguuacuccacaucaccaccuggaauc

SEQ ID NO: 313774 - RNA, 64 nt, Homo Sapiens
cuuauacaucucaaugcugagaguuaaaauauucccagguuaaaauuuuuuuaaaguaccaaua

SEQ ID NO: 313775 - RNA, 64 nt, Homo Sapiens
aaaaucugagaucugccaggccccucuucuaacaccagguuaggcaugcuugguuauuuccagu

SEQ ID NO: 313776 - RNA, 64 nt, Homo Sapiens
ugggggcaaucugagaauauuccucaaaagguguccagguuaaauagacauguuacuggcugca

SEQ ID NO: 313777 - RNA, 64 nt, Homo Sapiens
uuacuccugaccacuaauaguuucaugagccuguccagguuaguggaugcauccagggguucau

SEQ ID NO: 313778 - RNA, 64 nt, Homo Sapiens
gaccuuuagccaagaggagcugcagggaccauggccagguuaccaaaaugcccugcucugaagc

SEQ ID NO: 313779 - RNA, 64 nt, Homo Sapiens
cccuuacugggcuaaucagcacuugaucggaaguccagguuaguaugugaagccaggaguacua

SEQ ID NO: 313780 - RNA, 64 nt, Homo Sapiens
aaaugggucaaccagagcaaacacuuuuuuucuuccagguuauuuugagaccagacauggagca

SEQ ID NO: 313781 - RNA, 64 nt, Homo Sapiens
aaauauauauguugcuguugcugaauacaggagaccagguuaggaauauaguuucauaauaaua

SEQ ID NO: 313782 - RNA, 64 nt, Homo Sapiens; identical to SEQ ID NO: 144801

SEQ ID NO: 313783 - RNA, 64 nt, Homo Sapiens; identical to SEQ ID NO: 144802

SEQ ID NO: 313784 - RNA, 64 nt, Homo Sapiens
gcaaagcaagugauugggacagagguuaucugucccagguuaucugggcauagaugcaggugag

SEQ ID NO: 313785 - RNA, 64 nt, Homo Sapiens
aggcuagaguugucuuuaaggguuaggguuaggaccagguuaggucaggguuggauuggguuua

SEQ ID NO: 313786 - RNA, 64 nt, Homo Sapiens
gugagccaagaucgugccacugagcccaugaggcccagguuacaguugaggugggaggaucgcu

SEQ ID NO: 313787 - RNA, 64 nt, Homo Sapiens
ccucagcuccuaucucuguauggccugguuuuucccagguuaugauuauagagcgaggauuauu

SEQ ID NO: 313788 - RNA, 64 nt, Homo Sapiens
ucuuggaaaugggccccacguuucgaauucaucuccagguuaagaagcugccagaccuugccag

SEQ ID NO: 313789 - RNA, 64 nt, Homo Sapiens
gcuuaccuguccgcccaccugucuggaacaagggccagguuaagaccacaugccucauguccaa

SEQ ID NO: 313790 - RNA, 64 nt, Homo Sapiens
uuuuuguaagauuucuccuuagcaagcacaacauccagguuaauccuaagugacuuaaccuuag

SEQ ID NO: 313791 - RNA, 64 nt, Homo Sapiens
ucuucccugcccagagccagaauuaaacaaaaccccagguuauuuguuuuuuaagaacagggaa

SEQ ID NO: 313792 - RNA, 64 nt, Homo Sapiens
ucagacaccacuaguagauauaacacuggagagcccagguuauaugagauugggaagcccacug

SEQ ID NO: 313793 - RNA, 64 nt, Homo Sapiens
uuauuguuuuugagacaaggucccuuucugucacccagguuagaguagauuucaguggcacaau

SEQ ID NO: 313794 - RNA, 64 nt, Homo Sapiens
guuuaugucugagcuuauuguguuugagcuaacaccagguuacucaguaaccaugaccugcucc

SEQ ID NO: 313795 - RNA, 64 nt, Homo Sapiens
ugacuagaagcuucuguuccugacaccaaaugugccagguuagcaaaugagcacaagauguggc

SEQ ID NO: 313796 - RNA, 64 nt, Homo Sapiens
gaggagccggugcucuggaagaccugaaagaagcccagguuacaaagacaugggggccuugugg

SEQ ID NO: 313797 - RNA, 64 nt, Homo Sapiens
auucuagauguccggguucccugcacaccugucgccagguuaaacaaccaucgagcauguguca

SEQ ID NO: 313798 - RNA, 64 nt, Homo Sapiens
agccgcugaccaaaguccaacagcacagcagcguccagguuaaaggcccugagcugugagagac

SEQ ID NO: 313799 - RNA, 64 nt, Homo Sapiens
ccgcauaaaaaauaaagugacucuuacgaaaaacccagguuagaaaauauaagaaauaaaggag

SEQ ID NO: 313800 - RNA, 64 nt, Homo Sapiens
aagggguucccuuuuugguauccccauuugacacccagguuaaaugcuuacccuugauuuuuuc

SEQ ID NO: 313801 - RNA, 64 nt, Homo Sapiens
gcaaaaaugagguuuugcuuagagggucuccagaccagguuacuucagagacuagauguaucug

SEQ ID NO: 313802 - RNA, 64 nt, Homo Sapiens
cacgacccaggcugagaagggugggauuugagacccagguuagguacuccagggugaaggcaga

SEQ ID NO: 313803 - RNA, 64 nt, Homo Sapiens
uaaaaugaaaggaacuugacuguacaguuuguagccagguuaagcauuugguauuguuucauuu

SEQ ID NO: 313804 - RNA, 64 nt, Homo Sapiens
ucaccaugucccuugcccccauguagcccauuucccagguuaugcucuuuucuuucucaggguc

SEQ ID NO: 313805 - RNA, 64 nt, Homo Sapiens
guuacguauugaauauagaaaucauucuaacaacccagguuauuuucaaucagaccaggcauuc

SEQ ID NO: 313806 - RNA, 64 nt, Homo Sapiens
uguuuaccucuucuaugcaagccuugcuagacagccagguuagccuuugcccugucacccccga

SEQ ID NO: 313807 - RNA, 64 nt, Homo Sapiens
aauagccuaaaaaccuagccucuaacaccuuguuccagguuaccuuccaaaguuucuaucuugu

SEQ ID NO: 313808 - RNA, 64 nt, Homo Sapiens
gcugaagccugccccgcugauggggugcacagcgccagguuaacugcuggaccaacgcggguuc

SEQ ID NO: 313809 - RNA, 64 nt, Homo Sapiens
ccagaaaugacccaacucucagacccaccccucuccagguuaucccuccucccuggagcuccag

SEQ ID NO: 313810 - RNA, 64 nt, Homo Sapiens
aauucuccugccucagccucgcaaccuccgccacccagguuaaauggugcaaucuuggcucacu

SEQ ID NO: 313811 - RNA, 64 nt, Homo Sapiens
aauugggaauggcugggaggcccgccccuuccccccagguuagcucgcgagacuuucggucccc

SEQ ID NO: 313812 - RNA, 64 nt, Homo Sapiens
ugugaagagacucugggaucgcagaagacacucaccagguuaucggaugccuauccacccucug

SEQ ID NO: 313813 - RNA, 64 nt, Homo Sapiens
aucggggcauagcccagggaugcccccaggcggcccagguuagaugcgucccuuuggcuuguca

SEQ ID NO: 313814 - RNA, 64 nt, Homo Sapiens
gaggcccaguggggaagaaugaacauggcuucauccagguuaacugaugcugccauuugcccag

SEQ ID NO: 313815 - RNA, 64 nt, Homo Sapiens
gaggccaagggguaggccugagcgccagagucgcccagguuagcccacaggauuccuuugugug

SEQ ID NO: 313816 - RNA, 64 nt, Homo Sapiens
cucaugcacacgcugacacgcgguugcauggaguccagguuacucaggccggcacuucugagug

SEQ ID NO: 313817 - RNA, 64 nt, Homo Sapiens
accuguggauuguuucaauuuuuuccuaguauuuccagguuagaugauuaaugcauccagauug

SEQ ID NO: 313818 - RNA, 64 nt, Homo Sapiens
uagguagaguuagugcuccaguguagggcguaguccagguuagccucuuuaccuagucccugcu

SEQ ID NO: 313819 - RNA, 64 nt, Homo Sapiens
ggcagaucagaagggcugcgaggcccagcugaacccagguuaggacacucugcuccuuacaucu

SEQ ID NO: 313820 - RNA, 64 nt, Homo Sapiens
auguuuaauccauguauugguacuuuacugaaaaccagguuauauucuaaagaagaaagaaggc

SEQ ID NO: 313821 - RNA, 64 nt, Homo Sapiens
aaaugaccuaucaaaaauuauucuuaauugugaaccagguuagcuucauucaccagauauuuug

SEQ ID NO: 313822 - RNA, 64 nt, Homo Sapiens
gucauuggggugguugucaugugauggguccccuccagguuacuaaagggugcauguccccugc

SEQ ID NO: 313823 - RNA, 64 nt, Homo Sapiens
aaagggugcauguccccugcgugacggguccccuccagguuacugugguuggggugguugucau

SEQ ID NO: 313824 - RNA, 64 nt, Homo Sapiens
caucugugagugacugagggagacaggaggaauaccagguuauucauggaauaaagucuuucca

SEQ ID NO: 313825 - RNA, 64 nt, Homo Sapiens
ugccaagcacugugcagaggguacacaguuccugccagguuaacacccucccuucaggccuccc

SEQ ID NO: 313826 - RNA, 64 nt, Homo Sapiens
aaaggauucagcacuacagccaagauucucagauccagguuagggggaaaauaauuuuuuccuc

SEQ ID NO: 313827 - RNA, 64 nt, Homo Sapiens
gaugcuucaugcccuguuccucaaaacuagaagugcgcaugaaguggaagagaccauaaaggcu

SEQ ID NO: 313828 - RNA, 64 nt, Homo Sapiens
aagagagcaccgugaaucuaaaaacacauuuugugcgcaugaugugauaauaugguguuauggg

SEQ ID NO: 313829 - RNA, 64 nt, Homo Sapiens
agauccggaacgucagccagcucccagccacauggcgcaugaaggagagcccagucucccucca

SEQ ID NO: 313830 - RNA, 64 nt, Homo Sapiens
gcuuugugggcuccaggccuguacucaucggcaggcgcaugaguaucugugggaguccucuaga

SEQ ID NO: 313831 - RNA, 64 nt, Homo Sapiens
uauuaaagcgagcaaagucugcauuuuaccuggugcgcaugaguggggucuuuaagaguuuugg

SEQ ID NO: 313832 - RNA, 64 nt, Homo Sapiens
cuacauaugagaauucuuuaucaguuuuaaaagugcgcaugauugaugaaauuuuaaaggaguu

SEQ ID NO: 313833 - RNA, 64 nt, Homo Sapiens
gacuggcguauuuagcccgucaugugucccugcggcgcaugagucugggcacgccagucugcac

SEQ ID NO: 313834 - RNA, 64 nt, Homo Sapiens
guuuuuauaccaagaacauugacgacaauguguagcgcaugauugguguuuggugaugguuauu

SEQ ID NO: 313835 - RNA, 64 nt, Homo Sapiens
uugugaagguggaaauaaaccauaauggucagaggcgcaugaauauuuaauucauguugccuug

SEQ ID NO: 313836 - RNA, 64 nt, Homo Sapiens
ucucuucuaacauuuaaggaauagagccuaauuagcgcaugaauacguguugaacugugaauga

SEQ ID NO: 313837 - RNA, 64 nt, Homo Sapiens
ccucuaaguuggaaauugaaacaacuuaaaugcugcgcaugaaauguuuguugcuuacaguuug

SEQ ID NO: 313838 - RNA, 64 nt, Homo Sapiens
ucugcuaggacuuaccccagccacugaguggcaggcgcaugagauuuguggcuguuccugaugc

SEQ ID NO: 313839 - RNA, 64 nt, Homo Sapiens
ccagaaagaaacaacagaaaccaaaacucacaaggcgcaugauuacuuguuuuauauuucaugu

SEQ ID NO: 313840 - RNA, 64 nt, Homo Sapiens
cacugagcaaacagcacuuuggugcucugugguggcgcaugauuucuugagcagguggagccau

SEQ ID NO: 313841 - RNA, 64 nt, Homo Sapiens
acugucugccuuugagggcuugugugcuggugcugcgcaugaggcccuggucuuguuaccugug

SEQ ID NO: 313842 - RNA, 64 nt, Homo Sapiens
auaacucagaggaacagacacucaaacucccaaagcgcaugauugcugggaaacaguagaaacc

SEQ ID NO: 313843 - RNA, 64 nt, Homo Sapiens
gcuggagcuuauuccgccgccaguccugugaguggcgcaugaacguaagugcaguggggguaag

SEQ ID NO: 313844 - RNA, 64 nt, Homo Sapiens
aaagagacguggggcuauuuguggugcagggcaagcgcaugaguucuuccuccucuacuacaug

SEQ ID NO: 313845 - RNA, 64 nt, Homo Sapiens
auccccaggaccccauccuguucucggggacccugcgcaugaaccuggaccccuucggcagcua

SEQ ID NO: 313846 - RNA, 64 nt, Homo Sapiens
cccccgcccucgcgcugccuucccgggggggcgagcgcaugacccgacaagcuggacccccugc

SEQ ID NO: 313847 - RNA, 64 nt, Homo Sapiens
uuuagucugacuugacuauuguuuuuccuuucuggcgcaugaauccauacaucauuccuggaag

SEQ ID NO: 313848 - RNA, 64 nt, Homo Sapiens
gggucagucaggguucgggggcugcagcagccaagcgcaugagagguguuuccuuggccuucca

SEQ ID NO: 313849 - RNA, 64 nt, Homo Sapiens
gugugugcucacaaccacucucaccuguucgugagcgcaugaggcgaaguuaucuuauauuucc

SEQ ID NO: 313850 - RNA, 64 nt, Homo Sapiens
ccuggcgacaguugagaccuccuggugugaagaugaauguaaacgaagaugaaugaauguaacu

SEQ ID NO: 313851 - RNA, 64 nt, Homo Sapiens
ccuggugugaagaugaauguaugugaagaugaaugaauguaacucacggcagagagcagcgccg

SEQ ID NO: 313852 - RNA, 64 nt, Homo Sapiens
auagcuuucaggaaagauaaagagaacaugcuuagaauguaagcuaaacagauuuuuucuguug

SEQ ID NO: 313853 - RNA, 64 nt, Homo Sapiens
ggggcuaacuucgggaucccugcacuuuauguaagaauguaaaccuggagucucauuuaagaau

SEQ ID NO: 313854 - RNA, 64 nt, Homo Sapiens
uacauagcacuugauacguguuaaaugaacauaugaauguaauuuauauauuccuagaauuuaa

SEQ ID NO: 313855 - RNA, 64 nt, Homo Sapiens
agcagcucaauuuguacuacuucagccaaucugugaauguaaaaacuacacuguugccuugcua

SEQ ID NO: 313856 - RNA, 64 nt, Homo Sapiens
aggaaucauuggugaacuuuccaagguuauuucugaauguaacaauuuccuuaaaaaugacuua

SEQ ID NO: 313857 - RNA, 64 nt, Homo Sapiens
caaacugccccguuaacuccagaucauugcacuggaauguaaucaagaaaguuagucauguuuu

SEQ ID NO: 313858 - RNA, 64 nt, Homo Sapiens
agaugaauauauuccuuacaucaaccaagauuuugaauguaauaaacuuuauaaucgucauugu

SEQ ID NO: 313859 - RNA, 64 nt, Homo Sapiens
auuuucuaaacacuuuacuaacacugcccacaaugaauguaacugcaaauaagaauguuugagc

SEQ ID NO: 313860 - RNA, 64 nt, Homo Sapiens
auaaugaccaaagugcauucugaguuuuuucaaggaauguaauacuggagcuuuaagaacauac

SEQ ID NO: 313861 - RNA, 64 nt, Homo Sapiens
gaaaaauugacauugcugccuuuaagaauaccaugaauguaagaaauugaaagaaauuguaaaa

SEQ ID NO: 313862 - RNA, 64 nt, Homo Sapiens
acacuuaaaucuaacagaggauuuucagaguagugaauguaaggaaagcuuaauggaucucucc

SEQ ID NO: 313863 - RNA, 64 nt, Homo Sapiens
gcaucaaagaauucacacaggagagaaagcacaugaauguaaugaauguggaaaagcuuucagu

SEQ ID NO: 313864 - RNA, 64 nt, Homo Sapiens
gcaucacaaaaugcauaggaaagagaaaucguaugaauguaaugaguaugagggcaguuucagu

SEQ ID NO: 313865 - RNA, 64 nt, Homo Sapiens
caacaucagagcauucauaccaaagagaacucaugaauguaaugaagaugggaagauauuuauc

SEQ ID NO: 313866 - RNA, 64 nt, Homo Sapiens
gggacagcucaggguuguuuuauuuaauugacaugaauguaaagacauuugacuuuuauuuuug

SEQ ID NO: 313867 - RNA, 64 nt, Homo Sapiens
cgccuccacguggcggcagaagugaauuguuggagaauguaaacuuuuguauuuucccugccga

SEQ ID NO: 313868 - RNA, 64 nt, Homo Sapiens
accuguguuaccacgaaugaguuaaaugccauuugaauguaaucggcaguuuggugcaauuuau

SEQ ID NO: 313869 - RNA, 64 nt, Homo Sapiens
gauuucuccagcagugugcaacuccugauuugcagaauguaaguaagaaguggauuucucuuuu

SEQ ID NO: 313870 - RNA, 64 nt, Homo Sapiens
uauagaugcguguauauguagagaacucuccauagaauguaauuccaaagauaggaggaagaaa

SEQ ID NO: 313871 - RNA, 64 nt, Homo Sapiens
cucgcagcagauaucagugguggcaacgaaaguagaauguaaaacuccuaggauacagaaacca

SEQ ID NO: 313872 - RNA, 64 nt, Homo Sapiens
aucuguugucauguuaguaaaugauuugaaaacugaauguaauacuugaguagauuuuuuuuuc

SEQ ID NO: 313873 - RNA, 64 nt, Homo Sapiens
acauagaguaaacaucuuaguaauauauuaaagugaauguaaauggugguuaaaauuacauuac

SEQ ID NO: 313874 - RNA, 64 nt, Homo Sapiens
auuuccaaacuaaauuacucaauauuuugacuaagaauguaaauaaccuuuagacucugaaagu

SEQ ID NO: 313875 - RNA, 64 nt, Homo Sapiens
uuggucaaguuauuaugaugauggcucagcugaggaauguaacuaugacugaaugaaugaauga

SEQ ID NO: 313876 - RNA, 64 nt, Homo Sapiens
guccaaguaaaaugagguaugacuuaauauuaaagaauguaaagcacaaaacauuuaagugcca

SEQ ID NO: 313877 - RNA, 64 nt, Homo Sapiens
guaucuauauacaaaaggcuaaagucagccuaaagaauguaaagugaaaaaagaugacaauuua

SEQ ID NO: 313878 - RNA, 64 nt, Homo Sapiens
caaaaaggaacuaguuagagugacaaugguuugagaauguaaaaucagagauauuuagaauauu

SEQ ID NO: 313879 - RNA, 64 nt, Homo Sapiens
gaucuuaacaauuccaauagaagagaagacauaugaauguaaggaaugugggaaaaucuuggcu

SEQ ID NO: 313880 - RNA, 64 nt, Homo Sapiens
ucagcugugaucucacaagugugaaaaaucuuaugaauguaaaauguguggagauucuucuuug

SEQ ID NO: 313881 - RNA, 64 nt, Homo Sapiens
ucauaaaaggacacacacuggagagaaacccugugaauguaagaaauguagaaaagcauuccau

SEQ ID NO: 313882 - RNA, 64 nt, Homo Sapiens
acaugaaaggaugcacagaggagagaagcucugugaauguaagcauugugggaaagcauucaua

SEQ ID NO: 313883 - RNA, 64 nt, Homo Sapiens
acaugcaagaacacacaauggagagaaacccuaugaauguaaagaaugcagaaaagcauucagc

SEQ ID NO: 313884 - RNA, 64 nt, Homo Sapiens
gcauggaaggacucacacuggagaaaaacccuaugaauguaagcaguaugggaaagcguucaga

SEQ ID NO: 313885 - RNA, 64 nt, Homo Sapiens
ucagaccugacaagauucuuugaauacagauaaugaauguaaacaauuaacuguuuauaauaac

SEQ ID NO: 313886 - RNA, 64 nt, Homo Sapiens
uuaugaaaggacacacacuggagagaaacccuaugaauguaagaaauguggaaaagcguuccau

SEQ ID NO: 313887 - RNA, 64 nt, Homo Sapiens
uacaugaaaguugcacagaggagaggcgcccuaagaauguaagcauugugggaaagcauucaua

SEQ ID NO: 313888 - RNA, 64 nt, Homo Sapiens
auacaugcaaaacacacacuggagagaaaccuaugaauguaaggaaugcaaacaagcauucaau

SEQ ID NO: 313889 - RNA, 64 nt, Homo Sapiens
acaugaaaggacucauacgagagagaauccguaugaauguaaggauugugggaaagcauucagc

SEQ ID NO: 313890 - RNA, 64 nt, Homo Sapiens
agacauguaaagacacaccagaaggaaacccuaugaauguaagcaauguggcaaaagcuuucac

SEQ ID NO: 313891 - RNA, 64 nt, Homo Sapiens
gcauggaagcacucacacuuggcagaaacucuaugaauguaagcaguaugggaaagccuucaga

SEQ ID NO: 313892 - RNA, 64 nt, Homo Sapiens
ucagaucggcuaggauucuuugaauacaaauaaugaauguaaacaauuaacuguuuauaauaac

SEQ ID NO: 313893 - RNA, 60 nt, Homo Sapiens
augcgaaaucauacagcugagaaacccuaugaauguaaggaauguggaaaagccuucagc

SEQ ID NO: 313894 - RNA, 64 nt, Homo Sapiens
ucaugugagaagucacacaggggagaaacccuaugaauguaauaaaugugggaaagccuuuucu

SEQ ID NO: 313895 - RNA, 64 nt, Homo Sapiens
acauaugagaagucauacuggugagaaacccuuugaauguaaugaaugugggaaagcauucucu

SEQ ID NO: 313896 - RNA, 64 nt, Homo Sapiens
aauguggaaaacccuucagugagagaaacccuaugaauguaaagacaugaacgaauucauacug

SEQ ID NO: 313897 - RNA, 64 nt, Homo Sapiens
agugugguaaagccuucagugagagaaaccuuaugaauguaaacacaugaaagaacccacacug

SEQ ID NO: 313898 - RNA, 64 nt, Homo Sapiens
aaugugggaaaacauacauucaaagaaacaguaugaauguaaaaacaugaaaggaugcacacug

SEQ ID NO: 313899 - RNA, 64 nt, Homo Sapiens
ugugugggaaaacuuacuugcacagaaacacuaugaauguaaacacaugagaggaaucacacug

SEQ ID NO: 313900 - RNA, 64 nt, Homo Sapiens
aaugugggaaaguguucguagagaaaaacccuaugaauguaaaaacaugaaagaacucacacug

SEQ ID NO: 313901 - RNA, 64 nt, Homo Sapiens
aauguggaaaaaccuacauauacagaaacgcuaugaauguaaacacaugaaaggaaucacacug

SEQ ID NO: 313902 - RNA, 64 nt, Homo Sapiens
acauaguaaagccuuaauuugagauaaacccuaugaauguaaacgauagaaauaauucucauug

SEQ ID NO: 313903 - RNA, 64 nt, Homo Sapiens
aauguagaaaagcauugagugagagaagucauaugaauguaagaacaugaaaggauucacucug

SEQ ID NO: 313904 - RNA, 64 nt, Homo Sapiens
cauguggugaaggcuuaagugaaauaaacucuaugaauguaaacaaaauaaaaaaaaagaaaaa

SEQ ID NO: 313905 - RNA, 64 nt, Homo Sapiens
aauguggaaaagcauugagucaaagaagcuaugugaauguaaggacaugaaagaacucauaccg

SEQ ID NO: 313906 - RNA, 64 nt, Homo Sapiens
aaugcaggaaagcauucucugagagaagccguaugaauguaaggacaugaaaggauucacacug

SEQ ID NO: 313907 - RNA, 64 nt, Homo Sapiens
aaugugggaaagcauuuggugagagaagccauaugaauguaaauucaugagacaacucauaugg

SEQ ID NO: 313908 - RNA, 64 nt, Homo Sapiens
aaugugggaaagcauuugaucagagaaaccccaugaauguaagcacgugaaaccacucacagug

SEQ ID NO: 313909 - RNA, 64 nt, Homo Sapiens
aguguucuaaagccuucccugggagaaacuguaugaauguaagcacaugaaagaacacguacug

SEQ ID NO: 313910 - RNA, 64 nt, Homo Sapiens
aguguucuaaagccuuucaugagagaaacuauaugaauguaagcgcaugaaagaacucacucug

SEQ ID NO: 313911 - RNA, 64 nt, Homo Sapiens
aaugugagaaggccucuucugugagaaacccuaugaauguaaugacaucaaagaauuccuacug

SEQ ID NO: 313912 - RNA, 64 nt, Homo Sapiens
auuguaaaaaagcuuuucuugugacaaacccuaugaauguaaagacaucagacaauucacacug

SEQ ID NO: 313913 - RNA, 64 nt, Homo Sapiens
aauguguaaagaccuuuacugugugaaacccuaugaauguaaggacaucaaagaauucauacca

SEQ ID NO: 313914 - RNA, 64 nt, Homo Sapiens
aaugugggaaugccuucauugggagaaacccuaugaauguaaugacaucagagaauucacagug

SEQ ID NO: 313915 - RNA, 64 nt, Homo Sapiens
aaccaccagcccauccugaggaaagccuccuauggaauguaaagugcaaucauuucuucagaua

SEQ ID NO: 313916 - RNA, 64 nt, Homo Sapiens
uuucaaaccauuuaccaucugaaaguuuugauuugaauguaaaacaggaaauuggaauuccuuu

SEQ ID NO: 313917 - RNA, 64 nt, Homo Sapiens
guucagaaaaggucuguuuugauagauagcucaggaauguaaaggagacuuaugaaggcauuag

SEQ ID NO: 313918 - RNA, 64 nt, Homo Sapiens
cuuccaaaauguacauaucuguggaacagcuguugaauguaauaguccuaaaaauggccagauu

SEQ ID NO: 313919 - RNA, 64 nt, Homo Sapiens; identical to SEQ ID NO: 280098

SEQ ID NO: 313920 - RNA, 64 nt, Homo Sapiens; identical to SEQ ID NO: 280099

SEQ ID NO: 313921 - RNA, 64 nt, Homo Sapiens; identical to SEQ ID NO: 280100

SEQ ID NO: 313922 - RNA, 64 nt, Homo Sapiens; identical to SEQ ID NO: 280101

SEQ ID NO: 313923 - RNA, 64 nt, Homo Sapiens; identical to SEQ ID NO: 280102

SEQ ID NO: 313924 - RNA, 64 nt, Homo Sapiens; identical to SEQ ID NO: 280103

SEQ ID NO: 313925 - RNA, 64 nt, Homo Sapiens; identical to SEQ ID NO: 280104

SEQ ID NO: 313926 - RNA, 64 nt, Homo Sapiens; identical to SEQ ID NO: 280105

SEQ ID NO: 313927 - RNA, 64 nt, Homo Sapiens; identical to SEQ ID NO: 280106

SEQ ID NO: 313928 - RNA, 64 nt, Homo Sapiens; identical to SEQ ID NO: 280107

SEQ ID NO: 313929 - RNA, 64 nt, Homo Sapiens; identical to SEQ ID NO: 280108

SEQ ID NO: 313930 - RNA, 64 nt, Homo Sapiens; identical to SEQ ID NO: 280109

SEQ ID NO: 313931 - RNA, 64 nt, Homo Sapiens; identical to SEQ ID NO: 280110

SEQ ID NO: 313932 - RNA, 64 nt, Homo Sapiens; identical to SEQ ID NO: 280111

SEQ ID NO: 313933 - RNA, 64 nt, Homo Sapiens; identical to SEQ ID NO: 280112

SEQ ID NO: 313934 - RNA, 64 nt, Homo Sapiens; identical to SEQ ID NO: 280113

SEQ ID NO: 313935 - RNA, 64 nt, Homo Sapiens; identical to SEQ ID NO: 280114

SEQ ID NO: 313936 - RNA, 64 nt, Homo Sapiens; identical to SEQ ID NO: 280115

SEQ ID NO: 313937 - RNA, 64 nt, Homo Sapiens; identical to SEQ ID NO: 280116

SEQ ID NO: 313938 - RNA, 64 nt, Homo Sapiens; identical to SEQ ID NO: 280117

SEQ ID NO: 313939 - RNA, 64 nt, Homo Sapiens; identical to SEQ ID NO: 280118

SEQ ID NO: 313940 - RNA, 64 nt, Homo Sapiens; identical to SEQ ID NO: 280119

SEQ ID NO: 313941 - RNA, 64 nt, Homo Sapiens; identical to SEQ ID NO: 280120

SEQ ID NO: 313942 - RNA, 64 nt, Homo Sapiens; identical to SEQ ID NO: 280121

SEQ ID NO: 313943 - RNA, 64 nt, Homo Sapiens; identical to SEQ ID NO: 280122

SEQ ID NO: 313944 - RNA, 64 nt, Homo Sapiens; identical to SEQ ID NO: 280123

SEQ ID NO: 313945 - RNA, 64 nt, Homo Sapiens; identical to SEQ ID NO: 280124

SEQ ID NO: 313946 - RNA, 64 nt, Homo Sapiens; identical to SEQ ID NO: 280125

SEQ ID NO: 313947 - RNA, 64 nt, Homo Sapiens; identical to SEQ ID NO: 280126

SEQ ID NO: 313948 - RNA, 64 nt, Homo Sapiens; identical to SEQ ID NO: 280127

SEQ ID NO: 313949 - RNA, 64 nt, Homo Sapiens; identical to SEQ ID NO: 280128

SEQ ID NO: 313950 - RNA, 64 nt, Homo Sapiens; identical to SEQ ID NO: 280129

SEQ ID NO: 313951 - RNA, 64 nt, Homo Sapiens; identical to SEQ ID NO: 280130

SEQ ID NO: 313952 - RNA, 64 nt, Homo Sapiens; identical to SEQ ID NO: 280131

SEQ ID NO: 313953 - RNA, 64 nt, Homo Sapiens; identical to SEQ ID NO: 280132

SEQ ID NO: 313954 - RNA, 64 nt, Homo Sapiens; identical to SEQ ID NO: 280133

SEQ ID NO: 313955 - RNA, 64 nt, Homo Sapiens; identical to SEQ ID NO: 280134

SEQ ID NO: 313956 - RNA, 64 nt, Homo Sapiens; identical to SEQ ID NO: 280135

SEQ ID NO: 313957 - RNA, 64 nt, Homo Sapiens; identical to SEQ ID NO: 280136

SEQ ID NO: 313958 - RNA, 64 nt, Homo Sapiens; identical to SEQ ID NO: 280137

SEQ ID NO: 313959 - RNA, 64 nt, Homo Sapiens; identical to SEQ ID NO: 280138

SEQ ID NO: 313960 - RNA, 64 nt, Homo Sapiens; identical to SEQ ID NO: 280139

SEQ ID NO: 313961 - RNA, 64 nt, Homo Sapiens; identical to SEQ ID NO: 280140

SEQ ID NO: 313962 - RNA, 64 nt, Homo Sapiens; identical to SEQ ID NO: 280141

SEQ ID NO: 313963 - RNA, 64 nt, Homo Sapiens; identical to SEQ ID NO: 280142

SEQ ID NO: 313964 - RNA, 64 nt, Homo Sapiens; identical to SEQ ID NO: 280143

SEQ ID NO: 313965 - RNA, 64 nt, Homo Sapiens; identical to SEQ ID NO: 280144

SEQ ID NO: 313966 - RNA, 64 nt, Homo Sapiens; identical to SEQ ID NO: 280145

SEQ ID NO: 313967 - RNA, 64 nt, Homo Sapiens; identical to SEQ ID NO: 280146

SEQ ID NO: 313968 - RNA, 64 nt, Homo Sapiens; identical to SEQ ID NO: 280147

SEQ ID NO: 313969 - RNA, 64 nt, Homo Sapiens; identical to SEQ ID NO: 280148

SEQ ID NO: 313970 - RNA, 64 nt, Homo Sapiens; identical to SEQ ID NO: 280149

SEQ ID NO: 313971 - RNA, 64 nt, Homo Sapiens; identical to SEQ ID NO: 280150

SEQ ID NO: 313972 - RNA, 64 nt, Homo Sapiens; identical to SEQ ID NO: 280151

SEQ ID NO: 313973 - RNA, 64 nt, Homo Sapiens; identical to SEQ ID NO: 280152

SEQ ID NO: 313974 - RNA, 64 nt, Homo Sapiens; identical to SEQ ID NO: 280153

SEQ ID NO: 313975 - RNA, 64 nt, Homo Sapiens; identical to SEQ ID NO: 280154

SEQ ID NO: 313976 - RNA, 64 nt, Homo Sapiens; identical to SEQ ID NO: 280155

SEQ ID NO: 313977 - RNA, 64 nt, Homo Sapiens; identical to SEQ ID NO: 280156

SEQ ID NO: 313978 - RNA, 64 nt, Homo Sapiens; identical to SEQ ID NO: 280157

SEQ ID NO: 313979 - RNA, 64 nt, Homo Sapiens; identical to SEQ ID NO: 280158

SEQ ID NO: 313980 - RNA, 64 nt, Homo Sapiens; identical to SEQ ID NO: 280159

SEQ ID NO: 313981 - RNA, 64 nt, Homo Sapiens; identical to SEQ ID NO: 280160

SEQ ID NO: 313982 - RNA, 64 nt, Homo Sapiens; identical to SEQ ID NO: 280161

SEQ ID NO: 313983 - RNA, 64 nt, Homo Sapiens; identical to SEQ ID NO: 280162

SEQ ID NO: 313984 - RNA, 64 nt, Homo Sapiens; identical to SEQ ID NO: 280163

SEQ ID NO: 313985 - RNA, 64 nt, Homo Sapiens; identical to SEQ ID NO: 280164

SEQ ID NO: 313986 - RNA, 64 nt, Homo Sapiens; identical to SEQ ID NO: 280165

SEQ ID NO: 313987 - RNA, 54 nt, Homo Sapiens; identical to SEQ ID NO: 280166

SEQ ID NO: 313988 - RNA, 64 nt, Homo Sapiens; identical to SEQ ID NO: 280167

SEQ ID NO: 313989 - RNA, 64 nt, Homo Sapiens; identical to SEQ ID NO: 280168

SEQ ID NO: 313990 - RNA, 64 nt, Homo Sapiens; identical to SEQ ID NO: 280169

SEQ ID NO: 313991 - RNA, 64 nt, Homo Sapiens; identical to SEQ ID NO: 280170

SEQ ID NO: 313992 - RNA, 64 nt, Homo Sapiens; identical to SEQ ID NO: 280171

SEQ ID NO: 313993 - RNA, 64 nt, Homo Sapiens; identical to SEQ ID NO: 280172

SEQ ID NO: 313994 - RNA, 64 nt, Homo Sapiens; identical to SEQ ID NO: 280173

SEQ ID NO: 313995 - RNA, 64 nt, Homo Sapiens; identical to SEQ ID NO: 280174

SEQ ID NO: 313996 - RNA, 64 nt, Homo Sapiens; identical to SEQ ID NO: 280175

SEQ ID NO: 313997 - RNA, 64 nt, Homo Sapiens; identical to SEQ ID NO: 280176

SEQ ID NO: 313998 - RNA, 64 nt, Homo Sapiens; identical to SEQ ID NO: 280177

SEQ ID NO: 313999 - RNA, 64 nt, Homo Sapiens; identical to SEQ ID NO: 280178

SEQ ID NO: 314000 - RNA, 64 nt, Homo Sapiens; identical to SEQ ID NO: 280179

SEQ ID NO: 314001 - RNA, 64 nt, Homo Sapiens; identical to SEQ ID NO: 280180

SEQ ID NO: 314002 - RNA, 64 nt, Homo Sapiens; identical to SEQ ID NO: 280181

SEQ ID NO: 314003 - RNA, 64 nt, Homo Sapiens; identical to SEQ ID NO: 280182

SEQ ID NO: 314004 - RNA, 64 nt, Homo Sapiens; identical to SEQ ID NO: 280183

SEQ ID NO: 314005 - RNA, 64 nt, Homo Sapiens; identical to SEQ ID NO: 280184

SEQ ID NO: 314006 - RNA, 64 nt, Homo Sapiens; identical to SEQ ID NO: 280185

SEQ ID NO: 314007 - RNA, 64 nt, Homo Sapiens; identical to SEQ ID NO: 280186

SEQ ID NO: 314008 - RNA, 64 nt, Homo Sapiens; identical to SEQ ID NO: 280187

SEQ ID NO: 314009 - RNA, 64 nt, Homo Sapiens; identical to SEQ ID NO: 280188

SEQ ID NO: 314010 - RNA, 64 nt, Homo Sapiens; identical to SEQ ID NO: 280189

SEQ ID NO: 314011 - RNA, 64 nt, Homo Sapiens; identical to SEQ ID NO: 280190

SEQ ID NO: 314012 - RNA, 64 nt, Homo Sapiens; identical to SEQ ID NO: 280191

SEQ ID NO: 314013 - RNA, 64 nt, Homo Sapiens; identical to SEQ ID NO: 280192

SEQ ID NO: 314014 - RNA, 64 nt, Homo Sapiens; identical to SEQ ID NO: 280193

SEQ ID NO: 314015 - RNA, 64 nt, Homo Sapiens; identical to SEQ ID NO: 280194

SEQ ID NO: 314016 - RNA, 64 nt, Homo Sapiens; identical to SEQ ID NO: 280195

SEQ ID NO: 314017 - RNA, 64 nt, Homo Sapiens; identical to SEQ ID NO: 280196

SEQ ID NO: 314018 - RNA, 64 nt, Homo Sapiens; identical to SEQ ID NO: 280197

SEQ ID NO: 314019 - RNA, 64 nt, Homo Sapiens; identical to SEQ ID NO: 280198

SEQ ID NO: 314020 - RNA, 64 nt, Homo Sapiens; identical to SEQ ID NO: 280199

SEQ ID NO: 314021 - RNA, 64 nt, Homo Sapiens; identical to SEQ ID NO: 280200

SEQ ID NO: 314022 - RNA, 64 nt, Homo Sapiens; identical to SEQ ID NO: 280201

SEQ ID NO: 314023 - RNA, 64 nt, Homo Sapiens; identical to SEQ ID NO: 280202

SEQ ID NO: 314024 - RNA, 64 nt, Homo Sapiens; identical to SEQ ID NO: 280203

SEQ ID NO: 314025 - RNA, 64 nt, Homo Sapiens; identical to SEQ ID NO: 280204

SEQ ID NO: 314026 - RNA, 64 nt, Homo Sapiens; identical to SEQ ID NO: 280205

SEQ ID NO: 314027 - RNA, 64 nt, Homo Sapiens; identical to SEQ ID NO: 280206

SEQ ID NO: 314028 - RNA, 64 nt, Homo Sapiens; identical to SEQ ID NO: 280207

SEQ ID NO: 314029 - RNA, 64 nt, Homo Sapiens; identical to SEQ ID NO: 280208

SEQ ID NO: 314030 - RNA, 64 nt, Homo Sapiens; identical to SEQ ID NO: 280209

SEQ ID NO: 314031 - RNA, 64 nt, Homo Sapiens; identical to SEQ ID NO: 280210

SEQ ID NO: 314032 - RNA, 64 nt, Homo Sapiens; identical to SEQ ID NO: 280211

SEQ ID NO: 314033 - RNA, 64 nt, Homo Sapiens; identical to SEQ ID NO: 280212

SEQ ID NO: 314034 - RNA, 64 nt, Homo Sapiens; identical to SEQ ID NO: 280213

SEQ ID NO: 314035 - RNA, 64 nt, Homo Sapiens; identical to SEQ ID NO: 280214

SEQ ID NO: 314036 - RNA, 64 nt, Homo Sapiens; identical to SEQ ID NO: 280215

SEQ ID NO: 314037 - RNA, 64 nt, Homo Sapiens; identical to SEQ ID NO: 280216

SEQ ID NO: 314038 - RNA, 64 nt, Homo Sapiens; identical to SEQ ID NO: 280217

SEQ ID NO: 314039 - RNA, 64 nt, Homo Sapiens; identical to SEQ ID NO: 280218

SEQ ID NO: 314040 - RNA, 64 nt, Homo Sapiens; identical to SEQ ID NO: 280219

SEQ ID NO: 314041 - RNA, 64 nt, Homo Sapiens; identical to SEQ ID NO: 280220

SEQ ID NO: 314042 - RNA, 64 nt, Homo Sapiens; identical to SEQ ID NO: 280221

SEQ ID NO: 314043 - RNA, 64 nt, Homo Sapiens; identical to SEQ ID NO: 280222

SEQ ID NO: 314044 - RNA, 64 nt, Homo Sapiens; identical to SEQ ID NO: 280223

SEQ ID NO: 314045 - RNA, 64 nt, Homo Sapiens; identical to SEQ ID NO: 280224

SEQ ID NO: 314046 - RNA, 64 nt, Homo Sapiens; identical to SEQ ID NO: 280225

SEQ ID NO: 314047 - RNA, 64 nt, Homo Sapiens; identical to SEQ ID NO: 280226

SEQ ID NO: 314048 - RNA, 64 nt, Homo Sapiens; identical to SEQ ID NO: 280227

SEQ ID NO: 314049 - RNA, 64 nt, Homo Sapiens; identical to SEQ ID NO: 280228

SEQ ID NO: 314050 - RNA, 64 nt, Homo Sapiens; identical to SEQ ID NO: 280229

SEQ ID NO: 314051 - RNA, 64 nt, Homo Sapiens; identical to SEQ ID NO: 280230

SEQ ID NO: 314052 - RNA, 64 nt, Homo Sapiens; identical to SEQ ID NO: 280231

SEQ ID NO: 314053 - RNA, 64 nt, Homo Sapiens; identical to SEQ ID NO: 280232

SEQ ID NO: 314054 - RNA, 64 nt, Homo Sapiens; identical to SEQ ID NO: 280233

SEQ ID NO: 314055 - RNA, 64 nt, Homo Sapiens; identical to SEQ ID NO: 280234

SEQ ID NO: 314056 - RNA, 64 nt, Homo Sapiens; identical to SEQ ID NO: 280235

SEQ ID NO: 314057 - RNA, 64 nt, Homo Sapiens; identical to SEQ ID NO: 280236

SEQ ID NO: 314058 - RNA, 64 nt, Homo Sapiens; identical to SEQ ID NO: 280237

SEQ ID NO: 314059 - RNA, 64 nt, Homo Sapiens; identical to SEQ ID NO: 280238

SEQ ID NO: 314060 - RNA, 64 nt, Homo Sapiens; identical to SEQ ID NO: 280239

SEQ ID NO: 314061 - RNA, 64 nt, Homo Sapiens; identical to SEQ ID NO: 280240

SEQ ID NO: 314062 - RNA, 64 nt, Homo Sapiens; identical to SEQ ID NO: 280241

SEQ ID NO: 314063 - RNA, 64 nt, Homo Sapiens; identical to SEQ ID NO: 280242

SEQ ID NO: 314064 - RNA, 64 nt, Homo Sapiens; identical to SEQ ID NO: 280243

SEQ ID NO: 314065 - RNA, 64 nt, Homo Sapiens; identical to SEQ ID NO: 280244

SEQ ID NO: 314066 - RNA, 64 nt, Homo Sapiens; identical to SEQ ID NO: 280245

SEQ ID NO: 314067 - RNA, 64 nt, Homo Sapiens; identical to SEQ ID NO: 280246

SEQ ID NO: 314068 - RNA, 64 nt, Homo Sapiens; identical to SEQ ID NO: 280247

SEQ ID NO: 314069 - RNA, 64 nt, Homo Sapiens; identical to SEQ ID NO: 280248

SEQ ID NO: 314070 - RNA, 64 nt, Homo Sapiens; identical to SEQ ID NO: 280249

SEQ ID NO: 314071 - RNA, 64 nt, Homo Sapiens; identical to SEQ ID NO: 280250

SEQ ID NO: 314072 - RNA, 64 nt, Homo Sapiens; identical to SEQ ID NO: 280251

SEQ ID NO: 314073 - RNA, 64 nt, Homo Sapiens; identical to SEQ ID NO: 280252

SEQ ID NO: 314074 - RNA, 64 nt, Homo Sapiens; identical to SEQ ID NO: 280253

SEQ ID NO: 314075 - RNA, 64 nt, Homo Sapiens; identical to SEQ ID NO: 280254

SEQ ID NO: 314076 - RNA, 64 nt, Homo Sapiens; identical to SEQ ID NO: 280255

SEQ ID NO: 314077 - RNA, 64 nt, Homo Sapiens; identical to SEQ ID NO: 280256

SEQ ID NO: 314078 - RNA, 64 nt, Homo Sapiens; identical to SEQ ID NO: 280257

SEQ ID NO: 314079 - RNA, 64 nt, Homo Sapiens; identical to SEQ ID NO: 280258

SEQ ID NO: 314080 - RNA, 64 nt, Homo Sapiens; identical to SEQ ID NO: 280259

SEQ ID NO: 314081 - RNA, 64 nt, Homo Sapiens; identical to SEQ ID NO: 280260

SEQ ID NO: 314082 - RNA, 64 nt, Homo Sapiens; identical to SEQ ID NO: 280261

SEQ ID NO: 314083 - RNA, 64 nt, Homo Sapiens; identical to SEQ ID NO: 280262

SEQ ID NO: 314084 - RNA, 64 nt, Homo Sapiens; identical to SEQ ID NO: 280263

SEQ ID NO: 314085 - RNA, 64 nt, Homo Sapiens; identical to SEQ ID NO: 280264

SEQ ID NO: 314086 - RNA, 64 nt, Homo Sapiens; identical to SEQ ID NO: 280265

SEQ ID NO: 314087 - RNA, 64 nt, Homo Sapiens; identical to SEQ ID NO: 280266

SEQ ID NO: 314088 - RNA, 64 nt, Homo Sapiens; identical to SEQ ID NO: 280267

SEQ ID NO: 314089 - RNA, 64 nt, Homo Sapiens; identical to SEQ ID NO: 280268

SEQ ID NO: 314090 - RNA, 64 nt, Homo Sapiens; identical to SEQ ID NO: 280269

SEQ ID NO: 314091 - RNA, 64 nt, Homo Sapiens; identical to SEQ ID NO: 280270

SEQ ID NO: 314092 - RNA, 64 nt, Homo Sapiens; identical to SEQ ID NO: 280271

SEQ ID NO: 314093 - RNA, 64 nt, Homo Sapiens; identical to SEQ ID NO: 280272

SEQ ID NO: 314094 - RNA, 64 nt, Homo Sapiens; identical to SEQ ID NO: 280273

SEQ ID NO: 314095 - RNA, 64 nt, Homo Sapiens; identical to SEQ ID NO: 280274

SEQ ID NO: 314096 - RNA, 64 nt, Homo Sapiens; identical to SEQ ID NO: 280275

SEQ ID NO: 314097 - RNA, 64 nt, Homo Sapiens; identical to SEQ ID NO: 280276

SEQ ID NO: 314098 - RNA, 64 nt, Homo Sapiens; identical to SEQ ID NO: 280277

SEQ ID NO: 314099 - RNA, 64 nt, Homo Sapiens; identical to SEQ ID NO: 280278

SEQ ID NO: 314100 - RNA, 64 nt, Homo Sapiens; identical to SEQ ID NO: 280279

SEQ ID NO: 314101 - RNA, 64 nt, Homo Sapiens; identical to SEQ ID NO: 280280

SEQ ID NO: 314102 - RNA, 57 nt, Homo Sapiens; identical to SEQ ID NO: 280281

SEQ ID NO: 314103 - RNA, 64 nt, Homo Sapiens; identical to SEQ ID NO: 280282

SEQ ID NO: 314104 - RNA, 64 nt, Homo Sapiens; identical to SEQ ID NO: 280283

SEQ ID NO: 314105 - RNA, 64 nt, Homo Sapiens; identical to SEQ ID NO: 280284

SEQ ID NO: 314106 - RNA, 64 nt, Homo Sapiens; identical to SEQ ID NO: 280285

SEQ ID NO: 314107 - RNA, 64 nt, Homo Sapiens; identical to SEQ ID NO: 280286

SEQ ID NO: 314108 - RNA, 64 nt, Homo Sapiens; identical to SEQ ID NO: 280287

SEQ ID NO: 314109 - RNA, 64 nt, Homo Sapiens; identical to SEQ ID NO: 280288

SEQ ID NO: 314110 - RNA, 64 nt, Homo Sapiens; identical to SEQ ID NO: 280289

SEQ ID NO: 314111 - RNA, 64 nt, Homo Sapiens; identical to SEQ ID NO: 280290

SEQ ID NO: 314112 - RNA, 64 nt, Homo Sapiens; identical to SEQ ID NO: 280291

SEQ ID NO: 314113 - RNA, 64 nt, Homo Sapiens; identical to SEQ ID NO: 280292

SEQ ID NO: 314114 - RNA, 64 nt, Homo Sapiens; identical to SEQ ID NO: 280293

SEQ ID NO: 314115 - RNA, 64 nt, Homo Sapiens; identical to SEQ ID NO: 280294

SEQ ID NO: 314116 - RNA, 64 nt, Homo Sapiens; identical to SEQ ID NO: 280295

SEQ ID NO: 314117 - RNA, 64 nt, Homo Sapiens; identical to SEQ ID NO: 280296

SEQ ID NO: 314118 - RNA, 64 nt, Homo Sapiens; identical to SEQ ID NO: 280297

SEQ ID NO: 314119 - RNA, 64 nt, Homo Sapiens; identical to SEQ ID NO: 280298

SEQ ID NO: 314120 - RNA, 64 nt, Homo Sapiens; identical to SEQ ID NO: 280299

SEQ ID NO: 314121 - RNA, 64 nt, Homo Sapiens; identical to SEQ ID NO: 280300

SEQ ID NO: 314122 - RNA, 64 nt, Homo Sapiens; identical to SEQ ID NO: 280301

SEQ ID NO: 314123 - RNA, 64 nt, Homo Sapiens; identical to SEQ ID NO: 280302

SEQ ID NO: 314124 - RNA, 64 nt, Homo Sapiens; identical to SEQ ID NO: 280303

SEQ ID NO: 314125 - RNA, 64 nt, Homo Sapiens; identical to SEQ ID NO: 280304

SEQ ID NO: 314126 - RNA, 64 nt, Homo Sapiens; identical to SEQ ID NO: 280305

SEQ ID NO: 314127 - RNA, 64 nt, Homo Sapiens; identical to SEQ ID NO: 280306

SEQ ID NO: 314128 - RNA, 64 nt, Homo Sapiens; identical to SEQ ID NO: 280307

SEQ ID NO: 314129 - RNA, 64 nt, Homo Sapiens; identical to SEQ ID NO: 280308

SEQ ID NO: 314130 - RNA, 64 nt, Homo Sapiens; identical to SEQ ID NO: 280309

SEQ ID NO: 314131 - RNA, 64 nt, Homo Sapiens; identical to SEQ ID NO: 280310

SEQ ID NO: 314132 - RNA, 64 nt, Homo Sapiens; identical to SEQ ID NO: 280311

SEQ ID NO: 314133 - RNA, 64 nt, Homo Sapiens; identical to SEQ ID NO: 280312

SEQ ID NO: 314134 - RNA, 64 nt, Homo Sapiens; identical to SEQ ID NO: 280313

SEQ ID NO: 314135 - RNA, 64 nt, Homo Sapiens; identical to SEQ ID NO: 280314

SEQ ID NO: 314136 - RNA, 64 nt, Homo Sapiens; identical to SEQ ID NO: 280315

SEQ ID NO: 314137 - RNA, 64 nt, Homo Sapiens; identical to SEQ ID NO: 280316

SEQ ID NO: 314138 - RNA, 64 nt, Homo Sapiens; identical to SEQ ID NO: 280317

SEQ ID NO: 314139 - RNA, 64 nt, Homo Sapiens; identical to SEQ ID NO: 280318

SEQ ID NO: 314140 - RNA, 64 nt, Homo Sapiens; identical to SEQ ID NO: 280319

SEQ ID NO: 314141 - RNA, 64 nt, Homo Sapiens; identical to SEQ ID NO: 280320

SEQ ID NO: 314142 - RNA, 64 nt, Homo Sapiens; identical to SEQ ID NO: 280321

SEQ ID NO: 314143 - RNA, 64 nt, Homo Sapiens; identical to SEQ ID NO: 280322

SEQ ID NO: 314144 - RNA, 64 nt, Homo Sapiens; identical to SEQ ID NO: 280323

SEQ ID NO: 314145 - RNA, 64 nt, Homo Sapiens; identical to SEQ ID NO: 280324

SEQ ID NO: 314146 - RNA, 64 nt, Homo Sapiens; identical to SEQ ID NO: 280325

SEQ ID NO: 314147 - RNA, 64 nt, Homo Sapiens; identical to SEQ ID NO: 280326

SEQ ID NO: 314148 - RNA, 64 nt, Homo Sapiens; identical to SEQ ID NO: 280327

SEQ ID NO: 314149 - RNA, 64 nt, Homo Sapiens; identical to SEQ ID NO: 280328

SEQ ID NO: 314150 - RNA, 64 nt, Homo Sapiens; identical to SEQ ID NO: 280329

SEQ ID NO: 314151 - RNA, 64 nt, Homo Sapiens; identical to SEQ ID NO: 280330

SEQ ID NO: 314152 - RNA, 64 nt, Homo Sapiens; identical to SEQ ID NO: 280331

SEQ ID NO: 314153 - RNA, 64 nt, Homo Sapiens; identical to SEQ ID NO: 280332

SEQ ID NO: 314154 - RNA, 64 nt, Homo Sapiens; identical to SEQ ID NO: 280333

SEQ ID NO: 314155 - RNA, 64 nt, Homo Sapiens; identical to SEQ ID NO: 280334

SEQ ID NO: 314156 - RNA, 64 nt, Homo Sapiens; identical to SEQ ID NO: 280335

SEQ ID NO: 314157 - RNA, 64 nt, Homo Sapiens; identical to SEQ ID NO: 280336

SEQ ID NO: 314158 - RNA, 64 nt, Homo Sapiens; identical to SEQ ID NO: 280337

SEQ ID NO: 314159 - RNA, 64 nt, Homo Sapiens; identical to SEQ ID NO: 280338

SEQ ID NO: 314160 - RNA, 64 nt, Homo Sapiens; identical to SEQ ID NO: 280339

SEQ ID NO: 314161 - RNA, 64 nt, Homo Sapiens; identical to SEQ ID NO: 280340

SEQ ID NO: 314162 - RNA, 64 nt, Homo Sapiens; identical to SEQ ID NO: 280341

SEQ ID NO: 314163 - RNA, 64 nt, Homo Sapiens; identical to SEQ ID NO: 280342

SEQ ID NO: 314164 - RNA, 64 nt, Homo Sapiens; identical to SEQ ID NO: 280343

SEQ ID NO: 314165 - RNA, 64 nt, Homo Sapiens; identical to SEQ ID NO: 280344

SEQ ID NO: 314166 - RNA, 64 nt, Homo Sapiens; identical to SEQ ID NO: 280345

SEQ ID NO: 314167 - RNA, 64 nt, Homo Sapiens; identical to SEQ ID NO: 280346

SEQ ID NO: 314168 - RNA, 64 nt, Homo Sapiens; identical to SEQ ID NO: 280347

SEQ ID NO: 314169 - RNA, 64 nt, Homo Sapiens; identical to SEQ ID NO: 280348

SEQ ID NO: 314170 - RNA, 64 nt, Homo Sapiens; identical to SEQ ID NO: 280349

SEQ ID NO: 314171 - RNA, 64 nt, Homo Sapiens; identical to SEQ ID NO: 280350

SEQ ID NO: 314172 - RNA, 64 nt, Homo Sapiens; identical to SEQ ID NO: 280351

SEQ ID NO: 314173 - RNA, 64 nt, Homo Sapiens; identical to SEQ ID NO: 280352

SEQ ID NO: 314174 - RNA, 64 nt, Homo Sapiens; identical to SEQ ID NO: 280353

SEQ ID NO: 314175 - RNA, 64 nt, Homo Sapiens; identical to SEQ ID NO: 280354

SEQ ID NO: 314176 - RNA, 64 nt, Homo Sapiens; identical to SEQ ID NO: 280355

SEQ ID NO: 314177 - RNA, 64 nt, Homo Sapiens; identical to SEQ ID NO: 280356

SEQ ID NO: 314178 - RNA, 64 nt, Homo Sapiens; identical to SEQ ID NO: 280357

SEQ ID NO: 314179 - RNA, 64 nt, Homo Sapiens; identical to SEQ ID NO: 280358

SEQ ID NO: 314180 - RNA, 64 nt, Homo Sapiens; identical to SEQ ID NO: 280359

SEQ ID NO: 314181 - RNA, 64 nt, Homo Sapiens; identical to SEQ ID NO: 280360

SEQ ID NO: 314182 - RNA, 64 nt, Homo Sapiens; identical to SEQ ID NO: 280361

SEQ ID NO: 314183 - RNA, 64 nt, Homo Sapiens; identical to SEQ ID NO: 280362

SEQ ID NO: 314184 - RNA, 64 nt, Homo Sapiens; identical to SEQ ID NO: 280363

SEQ ID NO: 314185 - RNA, 64 nt, Homo Sapiens; identical to SEQ ID NO: 280364

SEQ ID NO: 314186 - RNA, 64 nt, Homo Sapiens; identical to SEQ ID NO: 280365

SEQ ID NO: 314187 - RNA, 64 nt, Homo Sapiens; identical to SEQ ID NO: 280366

SEQ ID NO: 314188 - RNA, 64 nt, Homo Sapiens; identical to SEQ ID NO: 280367

SEQ ID NO: 314189 - RNA, 64 nt, Homo Sapiens; identical to SEQ ID NO: 280368

SEQ ID NO: 314190 - RNA, 64 nt, Homo Sapiens; identical to SEQ ID NO: 280369

SEQ ID NO: 314191 - RNA, 64 nt, Homo Sapiens; identical to SEQ ID NO: 280370

SEQ ID NO: 314192 - RNA, 64 nt, Homo Sapiens; identical to SEQ ID NO: 280371

SEQ ID NO: 314193 - RNA, 64 nt, Homo Sapiens; identical to SEQ ID NO: 280372

SEQ ID NO: 314194 - RNA, 64 nt, Homo Sapiens; identical to SEQ ID NO: 280373

SEQ ID NO: 314195 - RNA, 64 nt, Homo Sapiens; identical to SEQ ID NO: 280374

SEQ ID NO: 314196 - RNA, 64 nt, Homo Sapiens; identical to SEQ ID NO: 280375

SEQ ID NO: 314197 - RNA, 64 nt, Homo Sapiens; identical to SEQ ID NO: 280376

SEQ ID NO: 314198 - RNA, 64 nt, Homo Sapiens; identical to SEQ ID NO: 280377

SEQ ID NO: 314199 - RNA, 64 nt, Homo Sapiens; identical to SEQ ID NO: 280378

SEQ ID NO: 314200 - RNA, 64 nt, Homo Sapiens; identical to SEQ ID NO: 280379

SEQ ID NO: 314201 - RNA, 64 nt, Homo Sapiens; identical to SEQ ID NO: 280380

SEQ ID NO: 314202 - RNA, 64 nt, Homo Sapiens; identical to SEQ ID NO: 280381

SEQ ID NO: 314203 - RNA, 64 nt, Homo Sapiens; identical to SEQ ID NO: 280382

SEQ ID NO: 314204 - RNA, 64 nt, Homo Sapiens; identical to SEQ ID NO: 280383

SEQ ID NO: 314205 - RNA, 64 nt, Homo Sapiens; identical to SEQ ID NO: 280384

SEQ ID NO: 314206 - RNA, 64 nt, Homo Sapiens; identical to SEQ ID NO: 280385

SEQ ID NO: 314207 - RNA, 64 nt, Homo Sapiens; identical to SEQ ID NO: 280386

SEQ ID NO: 314208 - RNA, 64 nt, Homo Sapiens; identical to SEQ ID NO: 280387

SEQ ID NO: 314209 - RNA, 64 nt, Homo Sapiens; identical to SEQ ID NO: 280388

SEQ ID NO: 314210 - RNA, 64 nt, Homo Sapiens; identical to SEQ ID NO: 280389

SEQ ID NO: 314211 - RNA, 64 nt, Homo Sapiens; identical to SEQ ID NO: 280390

SEQ ID NO: 314212 - RNA, 64 nt, Homo Sapiens; identical to SEQ ID NO: 280391

SEQ ID NO: 314213 - RNA, 64 nt, Homo Sapiens; identical to SEQ ID NO: 280392

SEQ ID NO: 314214 - RNA, 64 nt, Homo Sapiens; identical to SEQ ID NO: 280393

SEQ ID NO: 314215 - RNA, 64 nt, Homo Sapiens; identical to SEQ ID NO: 280394

SEQ ID NO: 314216 - RNA, 64 nt, Homo Sapiens; identical to SEQ ID NO: 280395

SEQ ID NO: 314217 - RNA, 64 nt, Homo Sapiens; identical to SEQ ID NO: 280396

SEQ ID NO: 314218 - RNA, 64 nt, Homo Sapiens; identical to SEQ ID NO: 280397

SEQ ID NO: 314219 - RNA, 64 nt, Homo Sapiens; identical to SEQ ID NO: 280398

SEQ ID NO: 314220 - RNA, 64 nt, Homo Sapiens; identical to SEQ ID NO: 280399

SEQ ID NO: 314221 - RNA, 64 nt, Homo Sapiens; identical to SEQ ID NO: 280400

SEQ ID NO: 314222 - RNA, 64 nt, Homo Sapiens; identical to SEQ ID NO: 280401

SEQ ID NO: 314223 - RNA, 64 nt, Homo Sapiens; identical to SEQ ID NO: 280402

SEQ ID NO: 314224 - RNA, 64 nt, Homo Sapiens; identical to SEQ ID NO: 280403

SEQ ID NO: 314225 - RNA, 64 nt, Homo Sapiens; identical to SEQ ID NO: 280404

SEQ ID NO: 314226 - RNA, 64 nt, Homo Sapiens; identical to SEQ ID NO: 280405

SEQ ID NO: 314227 - RNA, 64 nt, Homo Sapiens; identical to SEQ ID NO: 280406

SEQ ID NO: 314228 - RNA, 64 nt, Homo Sapiens; identical to SEQ ID NO: 280407

SEQ ID NO: 314229 - RNA, 64 nt, Homo Sapiens; identical to SEQ ID NO: 280408

SEQ ID NO: 314230 - RNA, 64 nt, Homo Sapiens; identical to SEQ ID NO: 280409

SEQ ID NO: 314231 - RNA, 64 nt, Homo Sapiens; identical to SEQ ID NO: 280410

SEQ ID NO: 314232 - RNA, 64 nt, Homo Sapiens; identical to SEQ ID NO: 280411

SEQ ID NO: 314233 - RNA, 64 nt, Homo Sapiens; identical to SEQ ID NO: 280412

SEQ ID NO: 314234 - RNA, 64 nt, Homo Sapiens; identical to SEQ ID NO: 280413

SEQ ID NO: 314235 - RNA, 64 nt, Homo Sapiens; identical to SEQ ID NO: 280414

SEQ ID NO: 314236 - RNA, 64 nt, Homo Sapiens; identical to SEQ ID NO: 280415

SEQ ID NO: 314237 - RNA, 64 nt, Homo Sapiens; identical to SEQ ID NO: 280416

SEQ ID NO: 314238 - RNA, 64 nt, Homo Sapiens; identical to SEQ ID NO: 280417

SEQ ID NO: 314239 - RNA, 64 nt, Homo Sapiens; identical to SEQ ID NO: 280418

SEQ ID NO: 314240 - RNA, 64 nt, Homo Sapiens; identical to SEQ ID NO: 280419

SEQ ID NO: 314241 - RNA, 64 nt, Homo Sapiens; identical to SEQ ID NO: 280420

SEQ ID NO: 314242 - RNA, 64 nt, Homo Sapiens; identical to SEQ ID NO: 280421

SEQ ID NO: 314243 - RNA, 64 nt, Homo Sapiens; identical to SEQ ID NO: 280422

SEQ ID NO: 314244 - RNA, 64 nt, Homo Sapiens; identical to SEQ ID NO: 280423

SEQ ID NO: 314245 - RNA, 64 nt, Homo Sapiens; identical to SEQ ID NO: 280424

SEQ ID NO: 314246 - RNA, 64 nt, Homo Sapiens; identical to SEQ ID NO: 280425

SEQ ID NO: 314247 - RNA, 64 nt, Homo Sapiens; identical to SEQ ID NO: 280426

SEQ ID NO: 314248 - RNA, 64 nt, Homo Sapiens; identical to SEQ ID NO: 280427

SEQ ID NO: 314249 - RNA, 64 nt, Homo Sapiens; identical to SEQ ID NO: 280428

SEQ ID NO: 314250 - RNA, 64 nt, Homo Sapiens; identical to SEQ ID NO: 280429

SEQ ID NO: 314251 - RNA, 64 nt, Homo Sapiens; identical to SEQ ID NO: 280430

SEQ ID NO: 314252 - RNA, 64 nt, Homo Sapiens; identical to SEQ ID NO: 280431

SEQ ID NO: 314253 - RNA, 64 nt, Homo Sapiens; identical to SEQ ID NO: 280432

SEQ ID NO: 314254 - RNA, 64 nt, Homo Sapiens; identical to SEQ ID NO: 280433

SEQ ID NO: 314255 - RNA, 64 nt, Homo Sapiens; identical to SEQ ID NO: 280434

SEQ ID NO: 314256 - RNA, 64 nt, Homo Sapiens; identical to SEQ ID NO: 280435

SEQ ID NO: 314257 - RNA, 64 nt, Homo Sapiens; identical to SEQ ID NO: 280436

SEQ ID NO: 314258 - RNA, 64 nt, Homo Sapiens; identical to SEQ ID NO: 280437

SEQ ID NO: 314259 - RNA, 64 nt, Homo Sapiens; identical to SEQ ID NO: 280438

SEQ ID NO: 314260 - RNA, 64 nt, Homo Sapiens; identical to SEQ ID NO: 280439

SEQ ID NO: 314261 - RNA, 64 nt, Homo Sapiens; identical to SEQ ID NO: 280440

SEQ ID NO: 314262 - RNA, 64 nt, Homo Sapiens; identical to SEQ ID NO: 280441

SEQ ID NO: 314263 - RNA, 64 nt, Homo Sapiens; identical to SEQ ID NO: 280442

SEQ ID NO: 314264 - RNA, 64 nt, Homo Sapiens; identical to SEQ ID NO: 280443

SEQ ID NO: 314265 - RNA, 64 nt, Homo Sapiens; identical to SEQ ID NO: 280444

SEQ ID NO: 314266 - RNA, 64 nt, Homo Sapiens; identical to SEQ ID NO: 280445

SEQ ID NO: 314267 - RNA, 64 nt, Homo Sapiens; identical to SEQ ID NO: 280446

SEQ ID NO: 314268 - RNA, 64 nt, Homo Sapiens; identical to SEQ ID NO: 280447

SEQ ID NO: 314269 - RNA, 64 nt, Homo Sapiens; identical to SEQ ID NO: 280448

SEQ ID NO: 314270 - RNA, 64 nt, Homo Sapiens; identical to SEQ ID NO: 280449

SEQ ID NO: 314271 - RNA, 64 nt, Homo Sapiens; identical to SEQ ID NO: 280450

SEQ ID NO: 314272 - RNA, 64 nt, Homo Sapiens; identical to SEQ ID NO: 280451

SEQ ID NO: 314273 - RNA, 64 nt, Homo Sapiens; identical to SEQ ID NO: 280452

SEQ ID NO: 314274 - RNA, 64 nt, Homo Sapiens; identical to SEQ ID NO: 280453

SEQ ID NO: 314275 - RNA, 64 nt, Homo Sapiens; identical to SEQ ID NO: 280454

SEQ ID NO: 314276 - RNA, 64 nt, Homo Sapiens; identical to SEQ ID NO: 280455

SEQ ID NO: 314277 - RNA, 64 nt, Homo Sapiens; identical to SEQ ID NO: 280456

SEQ ID NO: 314278 - RNA, 64 nt, Homo Sapiens; identical to SEQ ID NO: 280457

SEQ ID NO: 314279 - RNA, 64 nt, Homo Sapiens; identical to SEQ ID NO: 280458

SEQ ID NO: 314280 - RNA, 64 nt, Homo Sapiens; identical to SEQ ID NO: 280459

SEQ ID NO: 314281 - RNA, 64 nt, Homo Sapiens; identical to SEQ ID NO: 280460

SEQ ID NO: 314282 - RNA, 64 nt, Homo Sapiens; identical to SEQ ID NO: 280461

SEQ ID NO: 314283 - RNA, 64 nt, Homo Sapiens; identical to SEQ ID NO: 280462

SEQ ID NO: 314284 - RNA, 64 nt, Homo Sapiens; identical to SEQ ID NO: 280463

SEQ ID NO: 314285 - RNA, 64 nt, Homo Sapiens; identical to SEQ ID NO: 280464

SEQ ID NO: 314286 - RNA, 64 nt, Homo Sapiens; identical to SEQ ID NO: 280465

SEQ ID NO: 314287 - RNA, 64 nt, Homo Sapiens; identical to SEQ ID NO: 280466

SEQ ID NO: 314288 - RNA, 64 nt, Homo Sapiens; identical to SEQ ID NO: 280467

SEQ ID NO: 314289 - RNA, 64 nt, Homo Sapiens; identical to SEQ ID NO: 280468

SEQ ID NO: 314290 - RNA, 64 nt, Homo Sapiens; identical to SEQ ID NO: 280469

SEQ ID NO: 314291 - RNA, 64 nt, Homo Sapiens; identical to SEQ ID NO: 280470

SEQ ID NO: 314292 - RNA, 64 nt, Homo Sapiens; identical to SEQ ID NO: 280471

SEQ ID NO: 314293 - RNA, 64 nt, Homo Sapiens; identical to SEQ ID NO: 280472

SEQ ID NO: 314294 - RNA, 64 nt, Homo Sapiens; identical to SEQ ID NO: 280473

SEQ ID NO: 314295 - RNA, 64 nt, Homo Sapiens; identical to SEQ ID NO: 280474

SEQ ID NO: 314296 - RNA, 64 nt, Homo Sapiens; identical to SEQ ID NO: 280475

SEQ ID NO: 314297 - RNA, 64 nt, Homo Sapiens; identical to SEQ ID NO: 280476

SEQ ID NO: 314298 - RNA, 64 nt, Homo Sapiens; identical to SEQ ID NO: 280477

SEQ ID NO: 314299 - RNA, 64 nt, Homo Sapiens; identical to SEQ ID NO: 280478

SEQ ID NO: 314300 - RNA, 64 nt, Homo Sapiens; identical to SEQ ID NO: 280479

SEQ ID NO: 314301 - RNA, 64 nt, Homo Sapiens; identical to SEQ ID NO: 280480

SEQ ID NO: 314302 - RNA, 64 nt, Homo Sapiens; identical to SEQ ID NO: 280481

SEQ ID NO: 314303 - RNA, 64 nt, Homo Sapiens; identical to SEQ ID NO: 280482

SEQ ID NO: 314304 - RNA, 64 nt, Homo Sapiens; identical to SEQ ID NO: 280483

SEQ ID NO: 314305 - RNA, 54 nt, Homo Sapiens; identical to SEQ ID NO: 280484

SEQ ID NO: 314306 - RNA, 64 nt, Homo Sapiens; identical to SEQ ID NO: 280485

SEQ ID NO: 314307 - RNA, 64 nt, Homo Sapiens; identical to SEQ ID NO: 280486

SEQ ID NO: 314308 - RNA, 64 nt, Homo Sapiens; identical to SEQ ID NO: 280487

SEQ ID NO: 314309 - RNA, 64 nt, Homo Sapiens; identical to SEQ ID NO: 280488

SEQ ID NO: 314310 - RNA, 64 nt, Homo Sapiens; identical to SEQ ID NO: 280489

SEQ ID NO: 314311 - RNA, 64 nt, Homo Sapiens; identical to SEQ ID NO: 280490

SEQ ID NO: 314312 - RNA, 64 nt, Homo Sapiens; identical to SEQ ID NO: 280491

SEQ ID NO: 314313 - RNA, 64 nt, Homo Sapiens; identical to SEQ ID NO: 280492

SEQ ID NO: 314314 - RNA, 64 nt, Homo Sapiens; identical to SEQ ID NO: 280493

SEQ ID NO: 314315 - RNA, 64 nt, Homo Sapiens; identical to SEQ ID NO: 280494

SEQ ID NO: 314316 - RNA, 64 nt, Homo Sapiens; identical to SEQ ID NO: 280495

SEQ ID NO: 314317 - RNA, 64 nt, Homo Sapiens; identical to SEQ ID NO: 280496

SEQ ID NO: 314318 - RNA, 64 nt, Homo Sapiens; identical to SEQ ID NO: 280497

SEQ ID NO: 314319 - RNA, 64 nt, Homo Sapiens; identical to SEQ ID NO: 280498

SEQ ID NO: 314320 - RNA, 64 nt, Homo Sapiens; identical to SEQ ID NO: 280499

SEQ ID NO: 314321 - RNA, 64 nt, Homo Sapiens; identical to SEQ ID NO: 280500

SEQ ID NO: 314322 - RNA, 64 nt, Homo Sapiens; identical to SEQ ID NO: 280501

SEQ ID NO: 314323 - RNA, 64 nt, Homo Sapiens; identical to SEQ ID NO: 280502

SEQ ID NO: 314324 - RNA, 64 nt, Homo Sapiens; identical to SEQ ID NO: 280503

SEQ ID NO: 314325 - RNA, 64 nt, Homo Sapiens; identical to SEQ ID NO: 280504

SEQ ID NO: 314326 - RNA, 64 nt, Homo Sapiens; identical to SEQ ID NO: 280505

SEQ ID NO: 314327 - RNA, 64 nt, Homo Sapiens; identical to SEQ ID NO: 280506

SEQ ID NO: 314328 - RNA, 64 nt, Homo Sapiens; identical to SEQ ID NO: 280507

SEQ ID NO: 314329 - RNA, 64 nt, Homo Sapiens; identical to SEQ ID NO: 280508

SEQ ID NO: 314330 - RNA, 64 nt, Homo Sapiens; identical to SEQ ID NO: 280509

SEQ ID NO: 314331 - RNA, 64 nt, Homo Sapiens; identical to SEQ ID NO: 280510

SEQ ID NO: 314332 - RNA, 64 nt, Homo Sapiens; identical to SEQ ID NO: 280511

SEQ ID NO: 314333 - RNA, 64 nt, Homo Sapiens; identical to SEQ ID NO: 280512

SEQ ID NO: 314334 - RNA, 64 nt, Homo Sapiens; identical to SEQ ID NO: 280513

SEQ ID NO: 314335 - RNA, 64 nt, Homo Sapiens; identical to SEQ ID NO: 280514

SEQ ID NO: 314336 - RNA, 64 nt, Homo Sapiens; identical to SEQ ID NO: 280515

SEQ ID NO: 314337 - RNA, 64 nt, Homo Sapiens; identical to SEQ ID NO: 280516

SEQ ID NO: 314338 - RNA, 64 nt, Homo Sapiens; identical to SEQ ID NO: 280517

SEQ ID NO: 314339 - RNA, 64 nt, Homo Sapiens; identical to SEQ ID NO: 280518

SEQ ID NO: 314340 - RNA, 64 nt, Homo Sapiens; identical to SEQ ID NO: 280519

SEQ ID NO: 314341 - RNA, 64 nt, Homo Sapiens; identical to SEQ ID NO: 280520

SEQ ID NO: 314342 - RNA, 64 nt, Homo Sapiens; identical to SEQ ID NO: 280521

SEQ ID NO: 314343 - RNA, 64 nt, Homo Sapiens; identical to SEQ ID NO: 280522

SEQ ID NO: 314344 - RNA, 64 nt, Homo Sapiens; identical to SEQ ID NO: 280523

SEQ ID NO: 314345 - RNA, 64 nt, Homo Sapiens; identical to SEQ ID NO: 280524

SEQ ID NO: 314346 - RNA, 64 nt, Homo Sapiens; identical to SEQ ID NO: 280525

SEQ ID NO: 314347 - RNA, 64 nt, Homo Sapiens; identical to SEQ ID NO: 280526

SEQ ID NO: 314348 - RNA, 64 nt, Homo Sapiens; identical to SEQ ID NO: 280527

SEQ ID NO: 314349 - RNA, 64 nt, Homo Sapiens; identical to SEQ ID NO: 280528

SEQ ID NO: 314350 - RNA, 64 nt, Homo Sapiens; identical to SEQ ID NO: 280529

SEQ ID NO: 314351 - RNA, 64 nt, Homo Sapiens; identical to SEQ ID NO: 280530

SEQ ID NO: 314352 - RNA, 64 nt, Homo Sapiens; identical to SEQ ID NO: 280531

SEQ ID NO: 314353 - RNA, 64 nt, Homo Sapiens; identical to SEQ ID NO: 280532

SEQ ID NO: 314354 - RNA, 64 nt, Homo Sapiens; identical to SEQ ID NO: 280533

SEQ ID NO: 314355 - RNA, 64 nt, Homo Sapiens; identical to SEQ ID NO: 280534

SEQ ID NO: 314356 - RNA, 64 nt, Homo Sapiens; identical to SEQ ID NO: 280535

SEQ ID NO: 314357 - RNA, 64 nt, Homo Sapiens; identical to SEQ ID NO: 280536

SEQ ID NO: 314358 - RNA, 64 nt, Homo Sapiens; identical to SEQ ID NO: 280537

SEQ ID NO: 314359 - RNA, 64 nt, Homo Sapiens; identical to SEQ ID NO: 280538

SEQ ID NO: 314360 - RNA, 64 nt, Homo Sapiens; identical to SEQ ID NO: 280539

SEQ ID NO: 314361 - RNA, 64 nt, Homo Sapiens; identical to SEQ ID NO: 280540

SEQ ID NO: 314362 - RNA, 64 nt, Homo Sapiens; identical to SEQ ID NO: 280541

SEQ ID NO: 314363 - RNA, 64 nt, Homo Sapiens; identical to SEQ ID NO: 280542

SEQ ID NO: 314364 - RNA, 64 nt, Homo Sapiens; identical to SEQ ID NO: 280543

SEQ ID NO: 314365 - RNA, 64 nt, Homo Sapiens; identical to SEQ ID NO: 280544

SEQ ID NO: 314366 - RNA, 64 nt, Homo Sapiens; identical to SEQ ID NO: 280545

SEQ ID NO: 314367 - RNA, 64 nt, Homo Sapiens; identical to SEQ ID NO: 280546

SEQ ID NO: 314368 - RNA, 64 nt, Homo Sapiens; identical to SEQ ID NO: 280547

SEQ ID NO: 314369 - RNA, 64 nt, Homo Sapiens; identical to SEQ ID NO: 280548

SEQ ID NO: 314370 - RNA, 64 nt, Homo Sapiens; identical to SEQ ID NO: 280549

SEQ ID NO: 314371 - RNA, 64 nt, Homo Sapiens; identical to SEQ ID NO: 280550

SEQ ID NO: 314372 - RNA, 64 nt, Homo Sapiens; identical to SEQ ID NO: 280551

SEQ ID NO: 314373 - RNA, 64 nt, Homo Sapiens; identical to SEQ ID NO: 280552

SEQ ID NO: 314374 - RNA, 64 nt, Homo Sapiens; identical to SEQ ID NO: 280553

SEQ ID NO: 314375 - RNA, 64 nt, Homo Sapiens; identical to SEQ ID NO: 280554

SEQ ID NO: 314376 - RNA, 64 nt, Homo Sapiens; identical to SEQ ID NO: 280555

SEQ ID NO: 314377 - RNA, 64 nt, Homo Sapiens; identical to SEQ ID NO: 280556

SEQ ID NO: 314378 - RNA, 64 nt, Homo Sapiens; identical to SEQ ID NO: 280557

SEQ ID NO: 314379 - RNA, 64 nt, Homo Sapiens; identical to SEQ ID NO: 280558

SEQ ID NO: 314380 - RNA, 64 nt, Homo Sapiens; identical to SEQ ID NO: 280559

SEQ ID NO: 314381 - RNA, 60 nt, Homo Sapiens; identical to SEQ ID NO: 280560

SEQ ID NO: 314382 - RNA, 64 nt, Homo Sapiens; identical to SEQ ID NO: 280561

SEQ ID NO: 314383 - RNA, 64 nt, Homo Sapiens; identical to SEQ ID NO: 280562

SEQ ID NO: 314384 - RNA, 64 nt, Homo Sapiens; identical to SEQ ID NO: 280563

SEQ ID NO: 314385 - RNA, 64 nt, Homo Sapiens; identical to SEQ ID NO: 280564

SEQ ID NO: 314386 - RNA, 64 nt, Homo Sapiens; identical to SEQ ID NO: 280565

SEQ ID NO: 314387 - RNA, 64 nt, Homo Sapiens; identical to SEQ ID NO: 280566

SEQ ID NO: 314388 - RNA, 64 nt, Homo Sapiens; identical to SEQ ID NO: 280567

SEQ ID NO: 314389 - RNA, 64 nt, Homo Sapiens; identical to SEQ ID NO: 280568

SEQ ID NO: 314390 - RNA, 64 nt, Homo Sapiens; identical to SEQ ID NO: 280569

SEQ ID NO: 314391 - RNA, 64 nt, Homo Sapiens; identical to SEQ ID NO: 280570

SEQ ID NO: 314392 - RNA, 64 nt, Homo Sapiens; identical to SEQ ID NO: 280571

SEQ ID NO: 314393 - RNA, 64 nt, Homo Sapiens; identical to SEQ ID NO: 280572

SEQ ID NO: 314394 - RNA, 64 nt, Homo Sapiens; identical to SEQ ID NO: 280573

SEQ ID NO: 314395 - RNA, 64 nt, Homo Sapiens; identical to SEQ ID NO: 280574

SEQ ID NO: 314396 - RNA, 64 nt, Homo Sapiens; identical to SEQ ID NO: 280575

SEQ ID NO: 314397 - RNA, 64 nt, Homo Sapiens; identical to SEQ ID NO: 280576

SEQ ID NO: 314398 - RNA, 64 nt, Homo Sapiens; identical to SEQ ID NO: 280577

SEQ ID NO: 314399 - RNA, 64 nt, Homo Sapiens; identical to SEQ ID NO: 280578

SEQ ID NO: 314400 - RNA, 64 nt, Homo Sapiens; identical to SEQ ID NO: 280579

SEQ ID NO: 314401 - RNA, 64 nt, Homo Sapiens; identical to SEQ ID NO: 280580

SEQ ID NO: 314402 - RNA, 64 nt, Homo Sapiens; identical to SEQ ID NO: 280581

SEQ ID NO: 314403 - RNA, 64 nt, Homo Sapiens; identical to SEQ ID NO: 280582

SEQ ID NO: 314404 - RNA, 64 nt, Homo Sapiens; identical to SEQ ID NO: 280583

SEQ ID NO: 314405 - RNA, 64 nt, Homo Sapiens; identical to SEQ ID NO: 280584

SEQ ID NO: 314406 - RNA, 64 nt, Homo Sapiens; identical to SEQ ID NO: 280585

SEQ ID NO: 314407 - RNA, 64 nt, Homo Sapiens; identical to SEQ ID NO: 280586

SEQ ID NO: 314408 - RNA, 64 nt, Homo Sapiens; identical to SEQ ID NO: 280587

SEQ ID NO: 314409 - RNA, 64 nt, Homo Sapiens; identical to SEQ ID NO: 280588

SEQ ID NO: 314410 - RNA, 64 nt, Homo Sapiens; identical to SEQ ID NO: 280589

SEQ ID NO: 314411 - RNA, 64 nt, Homo Sapiens; identical to SEQ ID NO: 280590

SEQ ID NO: 314412 - RNA, 64 nt, Homo Sapiens; identical to SEQ ID NO: 280591

SEQ ID NO: 314413 - RNA, 64 nt, Homo Sapiens; identical to SEQ ID NO: 280592

SEQ ID NO: 314414 - RNA, 64 nt, Homo Sapiens; identical to SEQ ID NO: 280593

SEQ ID NO: 314415 - RNA, 64 nt, Homo Sapiens; identical to SEQ ID NO: 280594

SEQ ID NO: 314416 - RNA, 64 nt, Homo Sapiens; identical to SEQ ID NO: 280595

SEQ ID NO: 314417 - RNA, 64 nt, Homo Sapiens; identical to SEQ ID NO: 280596

SEQ ID NO: 314418 - RNA, 64 nt, Homo Sapiens; identical to SEQ ID NO: 280597

SEQ ID NO: 314419 - RNA, 64 nt, Homo Sapiens; identical to SEQ ID NO: 280598

SEQ ID NO: 314420 - RNA, 64 nt, Homo Sapiens; identical to SEQ ID NO: 280599

SEQ ID NO: 314421 - RNA, 64 nt, Homo Sapiens; identical to SEQ ID NO: 280600

SEQ ID NO: 314422 - RNA, 64 nt, Homo Sapiens; identical to SEQ ID NO: 280601

SEQ ID NO: 314423 - RNA, 64 nt, Homo Sapiens; identical to SEQ ID NO: 280602

SEQ ID NO: 314424 - RNA, 64 nt, Homo Sapiens; identical to SEQ ID NO: 280603

SEQ ID NO: 314425 - RNA, 64 nt, Homo Sapiens; identical to SEQ ID NO: 280604

SEQ ID NO: 314426 - RNA, 64 nt, Homo Sapiens; identical to SEQ ID NO: 280605

SEQ ID NO: 314427 - RNA, 64 nt, Homo Sapiens; identical to SEQ ID NO: 280606

SEQ ID NO: 314428 - RNA, 64 nt, Homo Sapiens; identical to SEQ ID NO: 280607

SEQ ID NO: 314429 - RNA, 64 nt, Homo Sapiens; identical to SEQ ID NO: 280608

SEQ ID NO: 314430 - RNA, 64 nt, Homo Sapiens; identical to SEQ ID NO: 280609

SEQ ID NO: 314431 - RNA, 64 nt, Homo Sapiens; identical to SEQ ID NO: 280610

SEQ ID NO: 314432 - RNA, 64 nt, Homo Sapiens; identical to SEQ ID NO: 280611

SEQ ID NO: 314433 - RNA, 64 nt, Homo Sapiens; identical to SEQ ID NO: 280612

SEQ ID NO: 314434 - RNA, 64 nt, Homo Sapiens; identical to SEQ ID NO: 280613

SEQ ID NO: 314435 - RNA, 64 nt, Homo Sapiens; identical to SEQ ID NO: 280614

SEQ ID NO: 314436 - RNA, 64 nt, Homo Sapiens; identical to SEQ ID NO: 280615

SEQ ID NO: 314437 - RNA, 64 nt, Homo Sapiens; identical to SEQ ID NO: 280616

SEQ ID NO: 314438 - RNA, 64 nt, Homo Sapiens; identical to SEQ ID NO: 280617

SEQ ID NO: 314439 - RNA, 64 nt, Homo Sapiens; identical to SEQ ID NO: 280618

SEQ ID NO: 314440 - RNA, 64 nt, Homo Sapiens; identical to SEQ ID NO: 280619

SEQ ID NO: 314441 - RNA, 64 nt, Homo Sapiens; identical to SEQ ID NO: 280620

SEQ ID NO: 314442 - RNA, 64 nt, Homo Sapiens; identical to SEQ ID NO: 280621

SEQ ID NO: 314443 - RNA, 64 nt, Homo Sapiens; identical to SEQ ID NO: 280622

SEQ ID NO: 314444 - RNA, 64 nt, Homo Sapiens; identical to SEQ ID NO: 280623

SEQ ID NO: 314445 - RNA, 64 nt, Homo Sapiens; identical to SEQ ID NO: 280624

SEQ ID NO: 314446 - RNA, 64 nt, Homo Sapiens; identical to SEQ ID NO: 280625

SEQ ID NO: 314447 - RNA, 64 nt, Homo Sapiens; identical to SEQ ID NO: 280626

SEQ ID NO: 314448 - RNA, 64 nt, Homo Sapiens; identical to SEQ ID NO: 280627

SEQ ID NO: 314449 - RNA, 64 nt, Homo Sapiens; identical to SEQ ID NO: 280628

SEQ ID NO: 314450 - RNA, 64 nt, Homo Sapiens; identical to SEQ ID NO: 280629

SEQ ID NO: 314451 - RNA, 64 nt, Homo Sapiens; identical to SEQ ID NO: 280630

SEQ ID NO: 314452 - RNA, 64 nt, Homo Sapiens; identical to SEQ ID NO: 280631

SEQ ID NO: 314453 - RNA, 64 nt, Homo Sapiens; identical to SEQ ID NO: 280632

SEQ ID NO: 314454 - RNA, 64 nt, Homo Sapiens; identical to SEQ ID NO: 280633

SEQ ID NO: 314455 - RNA, 64 nt, Homo Sapiens; identical to SEQ ID NO: 280634

SEQ ID NO: 314456 - RNA, 64 nt, Homo Sapiens; identical to SEQ ID NO: 280635

SEQ ID NO: 314457 - RNA, 64 nt, Homo Sapiens; identical to SEQ ID NO: 280636

SEQ ID NO: 314458 - RNA, 64 nt, Homo Sapiens; identical to SEQ ID NO: 280637

SEQ ID NO: 314459 - RNA, 64 nt, Homo Sapiens; identical to SEQ ID NO: 280638

SEQ ID NO: 314460 - RNA, 64 nt, Homo Sapiens; identical to SEQ ID NO: 280639

SEQ ID NO: 314461 - RNA, 64 nt, Homo Sapiens; identical to SEQ ID NO: 280640

SEQ ID NO: 314462 - RNA, 64 nt, Homo Sapiens; identical to SEQ ID NO: 280641

SEQ ID NO: 314463 - RNA, 64 nt, Homo Sapiens; identical to SEQ ID NO: 280642

SEQ ID NO: 314464 - RNA, 64 nt, Homo Sapiens; identical to SEQ ID NO: 280643

SEQ ID NO: 314465 - RNA, 64 nt, Homo Sapiens; identical to SEQ ID NO: 280644

SEQ ID NO: 314466 - RNA, 64 nt, Homo Sapiens; identical to SEQ ID NO: 280645

SEQ ID NO: 314467 - RNA, 64 nt, Homo Sapiens; identical to SEQ ID NO: 280646

SEQ ID NO: 314468 - RNA, 64 nt, Homo Sapiens; identical to SEQ ID NO: 280647

SEQ ID NO: 314469 - RNA, 64 nt, Homo Sapiens; identical to SEQ ID NO: 280648

SEQ ID NO: 314470 - RNA, 64 nt, Homo Sapiens; identical to SEQ ID NO: 280649

SEQ ID NO: 314471 - RNA, 64 nt, Homo Sapiens; identical to SEQ ID NO: 280650

SEQ ID NO: 314472 - RNA, 64 nt, Homo Sapiens; identical to SEQ ID NO: 280651

SEQ ID NO: 314473 - RNA, 64 nt, Homo Sapiens; identical to SEQ ID NO: 280652

SEQ ID NO: 314474 - RNA, 64 nt, Homo Sapiens; identical to SEQ ID NO: 280653

SEQ ID NO: 314475 - RNA, 64 nt, Homo Sapiens; identical to SEQ ID NO: 280654

SEQ ID NO: 314476 - RNA, 64 nt, Homo Sapiens; identical to SEQ ID NO: 280655

SEQ ID NO: 314477 - RNA, 64 nt, Homo Sapiens; identical to SEQ ID NO: 280656

SEQ ID NO: 314478 - RNA, 64 nt, Homo Sapiens; identical to SEQ ID NO: 280657

SEQ ID NO: 314479 - RNA, 64 nt, Homo Sapiens; identical to SEQ ID NO: 280658

SEQ ID NO: 314480 - RNA, 64 nt, Homo Sapiens; identical to SEQ ID NO: 280659

SEQ ID NO: 314481 - RNA, 64 nt, Homo Sapiens; identical to SEQ ID NO: 280660

SEQ ID NO: 314482 - RNA, 64 nt, Homo Sapiens; identical to SEQ ID NO: 280661

SEQ ID NO: 314483 - RNA, 64 nt, Homo Sapiens; identical to SEQ ID NO: 280662

SEQ ID NO: 314484 - RNA, 64 nt, Homo Sapiens; identical to SEQ ID NO: 280663

SEQ ID NO: 314485 - RNA, 64 nt, Homo Sapiens; identical to SEQ ID NO: 280664

SEQ ID NO: 314486 - RNA, 64 nt, Homo Sapiens; identical to SEQ ID NO: 280665

SEQ ID NO: 314487 - RNA, 64 nt, Homo Sapiens; identical to SEQ ID NO: 280666

SEQ ID NO: 314488 - RNA, 64 nt, Homo Sapiens; identical to SEQ ID NO: 280667

SEQ ID NO: 314489 - RNA, 64 nt, Homo Sapiens; identical to SEQ ID NO: 280668

SEQ ID NO: 314490 - RNA, 64 nt, Homo Sapiens; identical to SEQ ID NO: 280669

SEQ ID NO: 314491 - RNA, 64 nt, Homo Sapiens; identical to SEQ ID NO: 280670

SEQ ID NO: 314492 - RNA, 64 nt, Homo Sapiens; identical to SEQ ID NO: 280671

SEQ ID NO: 314493 - RNA, 64 nt, Homo Sapiens; identical to SEQ ID NO: 280672

SEQ ID NO: 314494 - RNA, 64 nt, Homo Sapiens; identical to SEQ ID NO: 280673

SEQ ID NO: 314495 - RNA, 64 nt, Homo Sapiens; identical to SEQ ID NO: 280674

SEQ ID NO: 314496 - RNA, 64 nt, Homo Sapiens; identical to SEQ ID NO: 280675

SEQ ID NO: 314497 - RNA, 64 nt, Homo Sapiens; identical to SEQ ID NO: 280676

SEQ ID NO: 314498 - RNA, 64 nt, Homo Sapiens; identical to SEQ ID NO: 280677

SEQ ID NO: 314499 - RNA, 64 nt, Homo Sapiens; identical to SEQ ID NO: 280678

SEQ ID NO: 314500 - RNA, 64 nt, Homo Sapiens; identical to SEQ ID NO: 280679

SEQ ID NO: 314501 - RNA, 64 nt, Homo Sapiens; identical to SEQ ID NO: 280680

SEQ ID NO: 314502 - RNA, 64 nt, Homo Sapiens; identical to SEQ ID NO: 280681

SEQ ID NO: 314503 - RNA, 64 nt, Homo Sapiens; identical to SEQ ID NO: 280682

SEQ ID NO: 314504 - RNA, 64 nt, Homo Sapiens; identical to SEQ ID NO: 280683

SEQ ID NO: 314505 - RNA, 64 nt, Homo Sapiens; identical to SEQ ID NO: 280684

SEQ ID NO: 314506 - RNA, 64 nt, Homo Sapiens; identical to SEQ ID NO: 280685

SEQ ID NO: 314507 - RNA, 64 nt, Homo Sapiens; identical to SEQ ID NO: 280686

SEQ ID NO: 314508 - RNA, 64 nt, Homo Sapiens; identical to SEQ ID NO: 280687

SEQ ID NO: 314509 - RNA, 64 nt, Homo Sapiens; identical to SEQ ID NO: 280688

SEQ ID NO: 314510 - RNA, 64 nt, Homo Sapiens; identical to SEQ ID NO: 280689

SEQ ID NO: 314511 - RNA, 64 nt, Homo Sapiens; identical to SEQ ID NO: 280690

SEQ ID NO: 314512 - RNA, 64 nt, Homo Sapiens; identical to SEQ ID NO: 280691

SEQ ID NO: 314513 - RNA, 64 nt, Homo Sapiens; identical to SEQ ID NO: 280692

SEQ ID NO: 314514 - RNA, 64 nt, Homo Sapiens; identical to SEQ ID NO: 280693

SEQ ID NO: 314515 - RNA, 64 nt, Homo Sapiens; identical to SEQ ID NO: 280694

SEQ ID NO: 314516 - RNA, 64 nt, Homo Sapiens; identical to SEQ ID NO: 280695

SEQ ID NO: 314517 - RNA, 64 nt, Homo Sapiens; identical to SEQ ID NO: 280696

SEQ ID NO: 314518 - RNA, 64 nt, Homo Sapiens; identical to SEQ ID NO: 280697

SEQ ID NO: 314519 - RNA, 64 nt, Homo Sapiens; identical to SEQ ID NO: 280698

SEQ ID NO: 314520 - RNA, 64 nt, Homo Sapiens; identical to SEQ ID NO: 280699

SEQ ID NO: 314521 - RNA, 64 nt, Homo Sapiens; identical to SEQ ID NO: 280700

SEQ ID NO: 314522 - RNA, 64 nt, Homo Sapiens; identical to SEQ ID NO: 280701

SEQ ID NO: 314523 - RNA, 64 nt, Homo Sapiens; identical to SEQ ID NO: 280702

SEQ ID NO: 314524 - RNA, 64 nt, Homo Sapiens; identical to SEQ ID NO: 280703

SEQ ID NO: 314525 - RNA, 64 nt, Homo Sapiens; identical to SEQ ID NO: 280704

SEQ ID NO: 314526 - RNA, 64 nt, Homo Sapiens; identical to SEQ ID NO: 280705

SEQ ID NO: 314527 - RNA, 64 nt, Homo Sapiens; identical to SEQ ID NO: 280706

SEQ ID NO: 314528 - RNA, 64 nt, Homo Sapiens; identical to SEQ ID NO: 280707

SEQ ID NO: 314529 - RNA, 64 nt, Homo Sapiens; identical to SEQ ID NO: 280708

SEQ ID NO: 314530 - RNA, 64 nt, Homo Sapiens; identical to SEQ ID NO: 280709

SEQ ID NO: 314531 - RNA, 64 nt, Homo Sapiens; identical to SEQ ID NO: 280710

SEQ ID NO: 314532 - RNA, 64 nt, Homo Sapiens; identical to SEQ ID NO: 280711

SEQ ID NO: 314533 - RNA, 64 nt, Homo Sapiens; identical to SEQ ID NO: 280712

SEQ ID NO: 314534 - RNA, 64 nt, Homo Sapiens; identical to SEQ ID NO: 280713

SEQ ID NO: 314535 - RNA, 64 nt, Homo Sapiens; identical to SEQ ID NO: 280714

SEQ ID NO: 314536 - RNA, 64 nt, Homo Sapiens; identical to SEQ ID NO: 280715

SEQ ID NO: 314537 - RNA, 64 nt, Homo Sapiens; identical to SEQ ID NO: 280716

SEQ ID NO: 314538 - RNA, 64 nt, Homo Sapiens; identical to SEQ ID NO: 280717

SEQ ID NO: 314539 - RNA, 64 nt, Homo Sapiens; identical to SEQ ID NO: 280718

SEQ ID NO: 314540 - RNA, 64 nt, Homo Sapiens; identical to SEQ ID NO: 280719

SEQ ID NO: 314541 - RNA, 64 nt, Homo Sapiens; identical to SEQ ID NO: 280720

SEQ ID NO: 314542 - RNA, 64 nt, Homo Sapiens; identical to SEQ ID NO: 280721

SEQ ID NO: 314543 - RNA, 64 nt, Homo Sapiens; identical to SEQ ID NO: 280722

SEQ ID NO: 314544 - RNA, 64 nt, Homo Sapiens; identical to SEQ ID NO: 280723

SEQ ID NO: 314545 - RNA, 64 nt, Homo Sapiens; identical to SEQ ID NO: 280724

SEQ ID NO: 314546 - RNA, 64 nt, Homo Sapiens; identical to SEQ ID NO: 280725

SEQ ID NO: 314547 - RNA, 64 nt, Homo Sapiens; identical to SEQ ID NO: 280726

SEQ ID NO: 314548 - RNA, 64 nt, Homo Sapiens; identical to SEQ ID NO: 280727

SEQ ID NO: 314549 - RNA, 64 nt, Homo Sapiens; identical to SEQ ID NO: 280728

SEQ ID NO: 314550 - RNA, 64 nt, Homo Sapiens; identical to SEQ ID NO: 280729

SEQ ID NO: 314551 - RNA, 64 nt, Homo Sapiens; identical to SEQ ID NO: 280730

SEQ ID NO: 314552 - RNA, 64 nt, Homo Sapiens; identical to SEQ ID NO: 280731

SEQ ID NO: 314553 - RNA, 64 nt, Homo Sapiens; identical to SEQ ID NO: 280732

SEQ ID NO: 314554 - RNA, 64 nt, Homo Sapiens; identical to SEQ ID NO: 280733

SEQ ID NO: 314555 - RNA, 64 nt, Homo Sapiens; identical to SEQ ID NO: 280734

SEQ ID NO: 314556 - RNA, 64 nt, Homo Sapiens; identical to SEQ ID NO: 280735

SEQ ID NO: 314557 - RNA, 64 nt, Homo Sapiens; identical to SEQ ID NO: 280736

SEQ ID NO: 314558 - RNA, 64 nt, Homo Sapiens; identical to SEQ ID NO: 280737

SEQ ID NO: 314559 - RNA, 64 nt, Homo Sapiens; identical to SEQ ID NO: 280738

SEQ ID NO: 314560 - RNA, 64 nt, Homo Sapiens; identical to SEQ ID NO: 280739

SEQ ID NO: 314561 - RNA, 64 nt, Homo Sapiens; identical to SEQ ID NO: 280740

SEQ ID NO: 314562 - RNA, 64 nt, Homo Sapiens; identical to SEQ ID NO: 280741

SEQ ID NO: 314563 - RNA, 64 nt, Homo Sapiens; identical to SEQ ID NO: 280742

SEQ ID NO: 314564 - RNA, 64 nt, Homo Sapiens; identical to SEQ ID NO: 280743

SEQ ID NO: 314565 - RNA, 64 nt, Homo Sapiens; identical to SEQ ID NO: 280744

SEQ ID NO: 314566 - RNA, 64 nt, Homo Sapiens; identical to SEQ ID NO: 280745

SEQ ID NO: 314567 - RNA, 64 nt, Homo Sapiens; identical to SEQ ID NO: 280746

SEQ ID NO: 314568 - RNA, 64 nt, Homo Sapiens; identical to SEQ ID NO: 280747

SEQ ID NO: 314569 - RNA, 64 nt, Homo Sapiens; identical to SEQ ID NO: 280748

SEQ ID NO: 314570 - RNA, 64 nt, Homo Sapiens; identical to SEQ ID NO: 280749

SEQ ID NO: 314571 - RNA, 64 nt, Homo Sapiens; identical to SEQ ID NO: 280750

SEQ ID NO: 314572 - RNA, 64 nt, Homo Sapiens; identical to SEQ ID NO: 280751

SEQ ID NO: 314573 - RNA, 64 nt, Homo Sapiens; identical to SEQ ID NO: 280752

SEQ ID NO: 314574 - RNA, 64 nt, Homo Sapiens; identical to SEQ ID NO: 280753

SEQ ID NO: 314575 - RNA, 64 nt, Homo Sapiens; identical to SEQ ID NO: 280754

SEQ ID NO: 314576 - RNA, 64 nt, Homo Sapiens; identical to SEQ ID NO: 280755

SEQ ID NO: 314577 - RNA, 64 nt, Homo Sapiens; identical to SEQ ID NO: 280756

SEQ ID NO: 314578 - RNA, 64 nt, Homo Sapiens; identical to SEQ ID NO: 280757

SEQ ID NO: 314579 - RNA, 64 nt, Homo Sapiens; identical to SEQ ID NO: 280758

SEQ ID NO: 314580 - RNA, 64 nt, Homo Sapiens; identical to SEQ ID NO: 280759

SEQ ID NO: 314581 - RNA, 64 nt, Homo Sapiens; identical to SEQ ID NO: 280760

SEQ ID NO: 314582 - RNA, 64 nt, Homo Sapiens; identical to SEQ ID NO: 280761

SEQ ID NO: 314583 - RNA, 64 nt, Homo Sapiens; identical to SEQ ID NO: 280762

SEQ ID NO: 314584 - RNA, 64 nt, Homo Sapiens; identical to SEQ ID NO: 280763

SEQ ID NO: 314585 - RNA, 64 nt, Homo Sapiens; identical to SEQ ID NO: 280764

SEQ ID NO: 314586 - RNA, 64 nt, Homo Sapiens; identical to SEQ ID NO: 280765

SEQ ID NO: 314587 - RNA, 64 nt, Homo Sapiens; identical to SEQ ID NO: 280766

SEQ ID NO: 314588 - RNA, 64 nt, Homo Sapiens; identical to SEQ ID NO: 280767

SEQ ID NO: 314589 - RNA, 64 nt, Homo Sapiens; identical to SEQ ID NO: 280768

SEQ ID NO: 314590 - RNA, 64 nt, Homo Sapiens; identical to SEQ ID NO: 280769

SEQ ID NO: 314591 - RNA, 64 nt, Homo Sapiens; identical to SEQ ID NO: 280770

SEQ ID NO: 314592 - RNA, 64 nt, Homo Sapiens; identical to SEQ ID NO: 280771

SEQ ID NO: 314593 - RNA, 64 nt, Homo Sapiens; identical to SEQ ID NO: 280772

SEQ ID NO: 314594 - RNA, 64 nt, Homo Sapiens; identical to SEQ ID NO: 280773

SEQ ID NO: 314595 - RNA, 64 nt, Homo Sapiens; identical to SEQ ID NO: 280774

SEQ ID NO: 314596 - RNA, 64 nt, Homo Sapiens; identical to SEQ ID NO: 280775

SEQ ID NO: 314597 - RNA, 64 nt, Homo Sapiens; identical to SEQ ID NO: 280776

SEQ ID NO: 314598 - RNA, 64 nt, Homo Sapiens; identical to SEQ ID NO: 280777

SEQ ID NO: 314599 - RNA, 64 nt, Homo Sapiens; identical to SEQ ID NO: 280778

SEQ ID NO: 314600 - RNA, 64 nt, Homo Sapiens; identical to SEQ ID NO: 280779

SEQ ID NO: 314601 - RNA, 64 nt, Homo Sapiens; identical to SEQ ID NO: 280780

SEQ ID NO: 314602 - RNA, 64 nt, Homo Sapiens; identical to SEQ ID NO: 280781

SEQ ID NO: 314603 - RNA, 64 nt, Homo Sapiens; identical to SEQ ID NO: 280782

SEQ ID NO: 314604 - RNA, 64 nt, Homo Sapiens; identical to SEQ ID NO: 280783

SEQ ID NO: 314605 - RNA, 64 nt, Homo Sapiens; identical to SEQ ID NO: 280784

SEQ ID NO: 314606 - RNA, 64 nt, Homo Sapiens; identical to SEQ ID NO: 280785

SEQ ID NO: 314607 - RNA, 64 nt, Homo Sapiens; identical to SEQ ID NO: 280786

SEQ ID NO: 314608 - RNA, 64 nt, Homo Sapiens; identical to SEQ ID NO: 280787

SEQ ID NO: 314609 - RNA, 64 nt, Homo Sapiens; identical to SEQ ID NO: 280788

SEQ ID NO: 314610 - RNA, 64 nt, Homo Sapiens; identical to SEQ ID NO: 280789

SEQ ID NO: 314611 - RNA, 64 nt, Homo Sapiens; identical to SEQ ID NO: 280790

SEQ ID NO: 314612 - RNA, 64 nt, Homo Sapiens; identical to SEQ ID NO: 280791

SEQ ID NO: 314613 - RNA, 64 nt, Homo Sapiens; identical to SEQ ID NO: 280792

SEQ ID NO: 314614 - RNA, 64 nt, Homo Sapiens; identical to SEQ ID NO: 280793

SEQ ID NO: 314615 - RNA, 64 nt, Homo Sapiens; identical to SEQ ID NO: 280794

SEQ ID NO: 314616 - RNA, 64 nt, Homo Sapiens; identical to SEQ ID NO: 280795

SEQ ID NO: 314617 - RNA, 64 nt, Homo Sapiens; identical to SEQ ID NO: 280796

SEQ ID NO: 314618 - RNA, 64 nt, Homo Sapiens; identical to SEQ ID NO: 280797

SEQ ID NO: 314619 - RNA, 64 nt, Homo Sapiens; identical to SEQ ID NO: 280798

SEQ ID NO: 314620 - RNA, 64 nt, Homo Sapiens; identical to SEQ ID NO: 280799

SEQ ID NO: 314621 - RNA, 64 nt, Homo Sapiens; identical to SEQ ID NO: 280800

SEQ ID NO: 314622 - RNA, 64 nt, Homo Sapiens; identical to SEQ ID NO: 280801

SEQ ID NO: 314623 - RNA, 64 nt, Homo Sapiens; identical to SEQ ID NO: 280802

SEQ ID NO: 314624 - RNA, 64 nt, Homo Sapiens; identical to SEQ ID NO: 280803

SEQ ID NO: 314625 - RNA, 64 nt, Homo Sapiens; identical to SEQ ID NO: 280804

SEQ ID NO: 314626 - RNA, 64 nt, Homo Sapiens; identical to SEQ ID NO: 280805

SEQ ID NO: 314627 - RNA, 64 nt, Homo Sapiens; identical to SEQ ID NO: 280806

SEQ ID NO: 314628 - RNA, 64 nt, Homo Sapiens; identical to SEQ ID NO: 280807

SEQ ID NO: 314629 - RNA, 64 nt, Homo Sapiens; identical to SEQ ID NO: 280808

SEQ ID NO: 314630 - RNA, 64 nt, Homo Sapiens; identical to SEQ ID NO: 280809

SEQ ID NO: 314631 - RNA, 64 nt, Homo Sapiens; identical to SEQ ID NO: 280810

SEQ ID NO: 314632 - RNA, 64 nt, Homo Sapiens; identical to SEQ ID NO: 280811

SEQ ID NO: 314633 - RNA, 64 nt, Homo Sapiens; identical to SEQ ID NO: 280812

SEQ ID NO: 314634 - RNA, 64 nt, Homo Sapiens; identical to SEQ ID NO: 280813

SEQ ID NO: 314635 - RNA, 64 nt, Homo Sapiens; identical to SEQ ID NO: 280814

SEQ ID NO: 314636 - RNA, 64 nt, Homo Sapiens; identical to SEQ ID NO: 280815

SEQ ID NO: 314637 - RNA, 64 nt, Homo Sapiens; identical to SEQ ID NO: 280816

SEQ ID NO: 314638 - RNA, 64 nt, Homo Sapiens; identical to SEQ ID NO: 280817

SEQ ID NO: 314639 - RNA, 64 nt, Homo Sapiens; identical to SEQ ID NO: 280818

SEQ ID NO: 314640 - RNA, 64 nt, Homo Sapiens; identical to SEQ ID NO: 280819

SEQ ID NO: 314641 - RNA, 64 nt, Homo Sapiens; identical to SEQ ID NO: 280820

SEQ ID NO: 314642 - RNA, 64 nt, Homo Sapiens; identical to SEQ ID NO: 280821

SEQ ID NO: 314643 - RNA, 64 nt, Homo Sapiens; identical to SEQ ID NO: 280822

SEQ ID NO: 314644 - RNA, 64 nt, Homo Sapiens; identical to SEQ ID NO: 280823

SEQ ID NO: 314645 - RNA, 64 nt, Homo Sapiens; identical to SEQ ID NO: 280824

SEQ ID NO: 314646 - RNA, 64 nt, Homo Sapiens; identical to SEQ ID NO: 280825

SEQ ID NO: 314647 - RNA, 64 nt, Homo Sapiens; identical to SEQ ID NO: 280826

SEQ ID NO: 314648 - RNA, 64 nt, Homo Sapiens; identical to SEQ ID NO: 280827

SEQ ID NO: 314649 - RNA, 64 nt, Homo Sapiens; identical to SEQ ID NO: 280828

SEQ ID NO: 314650 - RNA, 64 nt, Homo Sapiens; identical to SEQ ID NO: 280829

SEQ ID NO: 314651 - RNA, 64 nt, Homo Sapiens; identical to SEQ ID NO: 280830

SEQ ID NO: 314652 - RNA, 64 nt, Homo Sapiens; identical to SEQ ID NO: 280831

SEQ ID NO: 314653 - RNA, 64 nt, Homo Sapiens; identical to SEQ ID NO: 280832

SEQ ID NO: 314654 - RNA, 64 nt, Homo Sapiens; identical to SEQ ID NO: 280833

SEQ ID NO: 314655 - RNA, 64 nt, Homo Sapiens; identical to SEQ ID NO: 280834

SEQ ID NO: 314656 - RNA, 64 nt, Homo Sapiens; identical to SEQ ID NO: 280835

SEQ ID NO: 314657 - RNA, 64 nt, Homo Sapiens; identical to SEQ ID NO: 280836

SEQ ID NO: 314658 - RNA, 64 nt, Homo Sapiens; identical to SEQ ID NO: 280837

SEQ ID NO: 314659 - RNA, 64 nt, Homo Sapiens; identical to SEQ ID NO: 280838

SEQ ID NO: 314660 - RNA, 64 nt, Homo Sapiens; identical to SEQ ID NO: 280839

SEQ ID NO: 314661 - RNA, 64 nt, Homo Sapiens; identical to SEQ ID NO: 280840

SEQ ID NO: 314662 - RNA, 64 nt, Homo Sapiens; identical to SEQ ID NO: 280841

SEQ ID NO: 314663 - RNA, 58 nt, Homo Sapiens; identical to SEQ ID NO: 280842

SEQ ID NO: 314664 - RNA, 53 nt, Homo Sapiens; identical to SEQ ID NO: 280843

SEQ ID NO: 314665 - RNA, 64 nt, Homo Sapiens; identical to SEQ ID NO: 280844

SEQ ID NO: 314666 - RNA, 64 nt, Homo Sapiens; identical to SEQ ID NO: 280845

SEQ ID NO: 314667 - RNA, 64 nt, Homo Sapiens; identical to SEQ ID NO: 280846

SEQ ID NO: 314668 - RNA, 64 nt, Homo Sapiens; identical to SEQ ID NO: 280847

SEQ ID NO: 314669 - RNA, 64 nt, Homo Sapiens; identical to SEQ ID NO: 280848

SEQ ID NO: 314670 - RNA, 64 nt, Homo Sapiens; identical to SEQ ID NO: 280849

SEQ ID NO: 314671 - RNA, 64 nt, Homo Sapiens; identical to SEQ ID NO: 280850

SEQ ID NO: 314672 - RNA, 64 nt, Homo Sapiens; identical to SEQ ID NO: 280851

SEQ ID NO: 314673 - RNA, 64 nt, Homo Sapiens; identical to SEQ ID NO: 280852

SEQ ID NO: 314674 - RNA, 64 nt, Homo Sapiens; identical to SEQ ID NO: 280853

SEQ ID NO: 314675 - RNA, 64 nt, Homo Sapiens; identical to SEQ ID NO: 280854

SEQ ID NO: 314676 - RNA, 64 nt, Homo Sapiens; identical to SEQ ID NO: 280855

SEQ ID NO: 314677 - RNA, 64 nt, Homo Sapiens; identical to SEQ ID NO: 280856

SEQ ID NO: 314678 - RNA, 64 nt, Homo Sapiens; identical to SEQ ID NO: 280857

SEQ ID NO: 314679 - RNA, 64 nt, Homo Sapiens; identical to SEQ ID NO: 280858

SEQ ID NO: 314680 - RNA, 64 nt, Homo Sapiens; identical to SEQ ID NO: 280859

SEQ ID NO: 314681 - RNA, 64 nt, Homo Sapiens; identical to SEQ ID NO: 280860

SEQ ID NO: 314682 - RNA, 64 nt, Homo Sapiens; identical to SEQ ID NO: 280861

SEQ ID NO: 314683 - RNA, 64 nt, Homo Sapiens; identical to SEQ ID NO: 280862

SEQ ID NO: 314684 - RNA, 64 nt, Homo Sapiens; identical to SEQ ID NO: 280863

SEQ ID NO: 314685 - RNA, 64 nt, Homo Sapiens; identical to SEQ ID NO: 280864

SEQ ID NO: 314686 - RNA, 64 nt, Homo Sapiens; identical to SEQ ID NO: 280865

SEQ ID NO: 314687 - RNA, 64 nt, Homo Sapiens; identical to SEQ ID NO: 280866

SEQ ID NO: 314688 - RNA, 64 nt, Homo Sapiens; identical to SEQ ID NO: 280867

SEQ ID NO: 314689 - RNA, 64 nt, Homo Sapiens; identical to SEQ ID NO: 280868

SEQ ID NO: 314690 - RNA, 64 nt, Homo Sapiens; identical to SEQ ID NO: 280869

SEQ ID NO: 314691 - RNA, 64 nt, Homo Sapiens; identical to SEQ ID NO: 280870

SEQ ID NO: 314692 - RNA, 64 nt, Homo Sapiens; identical to SEQ ID NO: 280871

SEQ ID NO: 314693 - RNA, 64 nt, Homo Sapiens; identical to SEQ ID NO: 280872

SEQ ID NO: 314694 - RNA, 64 nt, Homo Sapiens; identical to SEQ ID NO: 280873

SEQ ID NO: 314695 - RNA, 64 nt, Homo Sapiens; identical to SEQ ID NO: 280874

SEQ ID NO: 314696 - RNA, 64 nt, Homo Sapiens; identical to SEQ ID NO: 280875

SEQ ID NO: 314697 - RNA, 64 nt, Homo Sapiens; identical to SEQ ID NO: 280876

SEQ ID NO: 314698 - RNA, 64 nt, Homo Sapiens; identical to SEQ ID NO: 280877

SEQ ID NO: 314699 - RNA, 64 nt, Homo Sapiens; identical to SEQ ID NO: 280878

SEQ ID NO: 314700 - RNA, 64 nt, Homo Sapiens; identical to SEQ ID NO: 280879

SEQ ID NO: 314701 - RNA, 60 nt, Homo Sapiens; identical to SEQ ID NO: 280880

SEQ ID NO: 314702 - RNA, 64 nt, Homo Sapiens; identical to SEQ ID NO: 280881

SEQ ID NO: 314703 - RNA, 64 nt, Homo Sapiens; identical to SEQ ID NO: 280882

SEQ ID NO: 314704 - RNA, 64 nt, Homo Sapiens; identical to SEQ ID NO: 280883

SEQ ID NO: 314705 - RNA, 64 nt, Homo Sapiens; identical to SEQ ID NO: 280884

SEQ ID NO: 314706 - RNA, 64 nt, Homo Sapiens; identical to SEQ ID NO: 280885

SEQ ID NO: 314707 - RNA, 64 nt, Homo Sapiens; identical to SEQ ID NO: 280886

SEQ ID NO: 314708 - RNA, 64 nt, Homo Sapiens; identical to SEQ ID NO: 280887

SEQ ID NO: 314709 - RNA, 64 nt, Homo Sapiens; identical to SEQ ID NO: 280888

SEQ ID NO: 314710 - RNA, 64 nt, Homo Sapiens; identical to SEQ ID NO: 280889

SEQ ID NO: 314711 - RNA, 64 nt, Homo Sapiens; identical to SEQ ID NO: 280890

SEQ ID NO: 314712 - RNA, 64 nt, Homo Sapiens; identical to SEQ ID NO: 280891

SEQ ID NO: 314713 - RNA, 64 nt, Homo Sapiens; identical to SEQ ID NO: 280892

SEQ ID NO: 314714 - RNA, 64 nt, Homo Sapiens; identical to SEQ ID NO: 280893

SEQ ID NO: 314715 - RNA, 64 nt, Homo Sapiens; identical to SEQ ID NO: 280894

SEQ ID NO: 314716 - RNA, 64 nt, Homo Sapiens; identical to SEQ ID NO: 280895

SEQ ID NO: 314717 - RNA, 64 nt, Homo Sapiens; identical to SEQ ID NO: 280896

SEQ ID NO: 314718 - RNA, 64 nt, Homo Sapiens; identical to SEQ ID NO: 280897

SEQ ID NO: 314719 - RNA, 64 nt, Homo Sapiens; identical to SEQ ID NO: 280898

SEQ ID NO: 314720 - RNA, 64 nt, Homo Sapiens; identical to SEQ ID NO: 280899

SEQ ID NO: 314721 - RNA, 64 nt, Homo Sapiens; identical to SEQ ID NO: 280900

SEQ ID NO: 314722 - RNA, 64 nt, Homo Sapiens; identical to SEQ ID NO: 280901

SEQ ID NO: 314723 - RNA, 64 nt, Homo Sapiens; identical to SEQ ID NO: 280902

SEQ ID NO: 314724 - RNA, 64 nt, Homo Sapiens; identical to SEQ ID NO: 280903

SEQ ID NO: 314725 - RNA, 64 nt, Homo Sapiens; identical to SEQ ID NO: 280904

SEQ ID NO: 314726 - RNA, 64 nt, Homo Sapiens; identical to SEQ ID NO: 280905

SEQ ID NO: 314727 - RNA, 64 nt, Homo Sapiens; identical to SEQ ID NO: 280906

SEQ ID NO: 314728 - RNA, 64 nt, Homo Sapiens; identical to SEQ ID NO: 280907

SEQ ID NO: 314729 - RNA, 64 nt, Homo Sapiens; identical to SEQ ID NO: 280908

SEQ ID NO: 314730 - RNA, 64 nt, Homo Sapiens; identical to SEQ ID NO: 280909

SEQ ID NO: 314731 - RNA, 64 nt, Homo Sapiens; identical to SEQ ID NO: 280910

SEQ ID NO: 314732 - RNA, 64 nt, Homo Sapiens; identical to SEQ ID NO: 280911

SEQ ID NO: 314733 - RNA, 64 nt, Homo Sapiens; identical to SEQ ID NO: 280912

SEQ ID NO: 314734 - RNA, 64 nt, Homo Sapiens; identical to SEQ ID NO: 280913

SEQ ID NO: 314735 - RNA, 64 nt, Homo Sapiens; identical to SEQ ID NO: 280914

SEQ ID NO: 314736 - RNA, 64 nt, Homo Sapiens; identical to SEQ ID NO: 280915

SEQ ID NO: 314737 - RNA, 64 nt, Homo Sapiens; identical to SEQ ID NO: 280916

SEQ ID NO: 314738 - RNA, 64 nt, Homo Sapiens; identical to SEQ ID NO: 280917

SEQ ID NO: 314739 - RNA, 64 nt, Homo Sapiens; identical to SEQ ID NO: 280918

SEQ ID NO: 314740 - RNA, 64 nt, Homo Sapiens; identical to SEQ ID NO: 280919

SEQ ID NO: 314741 - RNA, 64 nt, Homo Sapiens; identical to SEQ ID NO: 280920

SEQ ID NO: 314742 - RNA, 64 nt, Homo Sapiens; identical to SEQ ID NO: 280921

SEQ ID NO: 314743 - RNA, 64 nt, Homo Sapiens; identical to SEQ ID NO: 280922

SEQ ID NO: 314744 - RNA, 64 nt, Homo Sapiens; identical to SEQ ID NO: 280923

SEQ ID NO: 314745 - RNA, 64 nt, Homo Sapiens; identical to SEQ ID NO: 280924

SEQ ID NO: 314746 - RNA, 64 nt, Homo Sapiens; identical to SEQ ID NO: 280925

SEQ ID NO: 314747 - RNA, 64 nt, Homo Sapiens; identical to SEQ ID NO: 280926

SEQ ID NO: 314748 - RNA, 64 nt, Homo Sapiens; identical to SEQ ID NO: 280927

SEQ ID NO: 314749 - RNA, 64 nt, Homo Sapiens; identical to SEQ ID NO: 280928

SEQ ID NO: 314750 - RNA, 64 nt, Homo Sapiens; identical to SEQ ID NO: 280929

SEQ ID NO: 314751 - RNA, 64 nt, Homo Sapiens; identical to SEQ ID NO: 280930

SEQ ID NO: 314752 - RNA, 64 nt, Homo Sapiens; identical to SEQ ID NO: 280931

SEQ ID NO: 314753 - RNA, 64 nt, Homo Sapiens; identical to SEQ ID NO: 280932

SEQ ID NO: 314754 - RNA, 64 nt, Homo Sapiens; identical to SEQ ID NO: 280933

SEQ ID NO: 314755 - RNA, 64 nt, Homo Sapiens; identical to SEQ ID NO: 280934

SEQ ID NO: 314756 - RNA, 64 nt, Homo Sapiens; identical to SEQ ID NO: 280935

SEQ ID NO: 314757 - RNA, 64 nt, Homo Sapiens; identical to SEQ ID NO: 280936

SEQ ID NO: 314758 - RNA, 64 nt, Homo Sapiens; identical to SEQ ID NO: 280937

SEQ ID NO: 314759 - RNA, 64 nt, Homo Sapiens; identical to SEQ ID NO: 280938

SEQ ID NO: 314760 - RNA, 64 nt, Homo Sapiens; identical to SEQ ID NO: 280939

SEQ ID NO: 314761 - RNA, 64 nt, Homo Sapiens; identical to SEQ ID NO: 280940

SEQ ID NO: 314762 - RNA, 64 nt, Homo Sapiens; identical to SEQ ID NO: 280941

SEQ ID NO: 314763 - RNA, 64 nt, Homo Sapiens; identical to SEQ ID NO: 280942

SEQ ID NO: 314764 - RNA, 64 nt, Homo Sapiens; identical to SEQ ID NO: 280943

SEQ ID NO: 314765 - RNA, 64 nt, Homo Sapiens; identical to SEQ ID NO: 280944

SEQ ID NO: 314766 - RNA, 64 nt, Homo Sapiens; identical to SEQ ID NO: 280945

SEQ ID NO: 314767 - RNA, 64 nt, Homo Sapiens; identical to SEQ ID NO: 280946

SEQ ID NO: 314768 - RNA, 64 nt, Homo Sapiens; identical to SEQ ID NO: 280947

SEQ ID NO: 314769 - RNA, 64 nt, Homo Sapiens; identical to SEQ ID NO: 280948

SEQ ID NO: 314770 - RNA, 64 nt, Homo Sapiens; identical to SEQ ID NO: 280949

SEQ ID NO: 314771 - RNA, 64 nt, Homo Sapiens; identical to SEQ ID NO: 280950

SEQ ID NO: 314772 - RNA, 64 nt, Homo Sapiens; identical to SEQ ID NO: 280951

SEQ ID NO: 314773 - RNA, 64 nt, Homo Sapiens; identical to SEQ ID NO: 280952

SEQ ID NO: 314774 - RNA, 64 nt, Homo Sapiens; identical to SEQ ID NO: 280953

SEQ ID NO: 314775 - RNA, 64 nt, Homo Sapiens; identical to SEQ ID NO: 280954

SEQ ID NO: 314776 - RNA, 64 nt, Homo Sapiens; identical to SEQ ID NO: 280955

SEQ ID NO: 314777 - RNA, 64 nt, Homo Sapiens; identical to SEQ ID NO: 280956

SEQ ID NO: 314778 - RNA, 64 nt, Homo Sapiens; identical to SEQ ID NO: 280957

SEQ ID NO: 314779 - RNA, 64 nt, Homo Sapiens; identical to SEQ ID NO: 280958

SEQ ID NO: 314780 - RNA, 64 nt, Homo Sapiens; identical to SEQ ID NO: 280959

SEQ ID NO: 314781 - RNA, 64 nt, Homo Sapiens; identical to SEQ ID NO: 280960

SEQ ID NO: 314782 - RNA, 64 nt, Homo Sapiens; identical to SEQ ID NO: 280961

SEQ ID NO: 314783 - RNA, 64 nt, Homo Sapiens; identical to SEQ ID NO: 280962

SEQ ID NO: 314784 - RNA, 64 nt, Homo Sapiens; identical to SEQ ID NO: 280963

SEQ ID NO: 314785 - RNA, 64 nt, Homo Sapiens; identical to SEQ ID NO: 280964

SEQ ID NO: 314786 - RNA, 64 nt, Homo Sapiens; identical to SEQ ID NO: 280965

SEQ ID NO: 314787 - RNA, 64 nt, Homo Sapiens; identical to SEQ ID NO: 280966

SEQ ID NO: 314788 - RNA, 64 nt, Homo Sapiens; identical to SEQ ID NO: 280967

SEQ ID NO: 314789 - RNA, 64 nt, Homo Sapiens; identical to SEQ ID NO: 280968

SEQ ID NO: 314790 - RNA, 64 nt, Homo Sapiens; identical to SEQ ID NO: 280969

SEQ ID NO: 314791 - RNA, 64 nt, Homo Sapiens; identical to SEQ ID NO: 280970

SEQ ID NO: 314792 - RNA, 64 nt, Homo Sapiens; identical to SEQ ID NO: 280971

SEQ ID NO: 314793 - RNA, 64 nt, Homo Sapiens; identical to SEQ ID NO: 280972

SEQ ID NO: 314794 - RNA, 64 nt, Homo Sapiens; identical to SEQ ID NO: 280973

SEQ ID NO: 314795 - RNA, 64 nt, Homo Sapiens; identical to SEQ ID NO: 280974

SEQ ID NO: 314796 - RNA, 64 nt, Homo Sapiens; identical to SEQ ID NO: 280975

SEQ ID NO: 314797 - RNA, 64 nt, Homo Sapiens; identical to SEQ ID NO: 280976

SEQ ID NO: 314798 - RNA, 64 nt, Homo Sapiens; identical to SEQ ID NO: 280977

SEQ ID NO: 314799 - RNA, 64 nt, Homo Sapiens; identical to SEQ ID NO: 280978

SEQ ID NO: 314800 - RNA, 64 nt, Homo Sapiens; identical to SEQ ID NO: 280979

SEQ ID NO: 314801 - RNA, 64 nt, Homo Sapiens; identical to SEQ ID NO: 280980

SEQ ID NO: 314802 - RNA, 64 nt, Homo Sapiens; identical to SEQ ID NO: 280981

SEQ ID NO: 314803 - RNA, 64 nt, Homo Sapiens; identical to SEQ ID NO: 280982

SEQ ID NO: 314804 - RNA, 64 nt, Homo Sapiens; identical to SEQ ID NO: 280983

SEQ ID NO: 314805 - RNA, 64 nt, Homo Sapiens; identical to SEQ ID NO: 280984

SEQ ID NO: 314806 - RNA, 64 nt, Homo Sapiens; identical to SEQ ID NO: 280985

SEQ ID NO: 314807 - RNA, 64 nt, Homo Sapiens; identical to SEQ ID NO: 280986

SEQ ID NO: 314808 - RNA, 64 nt, Homo Sapiens; identical to SEQ ID NO: 280987

SEQ ID NO: 314809 - RNA, 64 nt, Homo Sapiens; identical to SEQ ID NO: 280988

SEQ ID NO: 314810 - RNA, 64 nt, Homo Sapiens; identical to SEQ ID NO: 280989

SEQ ID NO: 314811 - RNA, 64 nt, Homo Sapiens; identical to SEQ ID NO: 280990

SEQ ID NO: 314812 - RNA, 64 nt, Homo Sapiens; identical to SEQ ID NO: 280991

SEQ ID NO: 314813 - RNA, 64 nt, Homo Sapiens; identical to SEQ ID NO: 280992

SEQ ID NO: 314814 - RNA, 64 nt, Homo Sapiens; identical to SEQ ID NO: 280993

SEQ ID NO: 314815 - RNA, 64 nt, Homo Sapiens; identical to SEQ ID NO: 280994

SEQ ID NO: 314816 - RNA, 64 nt, Homo Sapiens; identical to SEQ ID NO: 280995

SEQ ID NO: 314817 - RNA, 64 nt, Homo Sapiens; identical to SEQ ID NO: 280996

SEQ ID NO: 314818 - RNA, 64 nt, Homo Sapiens; identical to SEQ ID NO: 280997

SEQ ID NO: 314819 - RNA, 64 nt, Homo Sapiens; identical to SEQ ID NO: 280998

SEQ ID NO: 314820 - RNA, 64 nt, Homo Sapiens; identical to SEQ ID NO: 280999

SEQ ID NO: 314821 - RNA, 64 nt, Homo Sapiens; identical to SEQ ID NO: 281000

SEQ ID NO: 314822 - RNA, 64 nt, Homo Sapiens; identical to SEQ ID NO: 281001

SEQ ID NO: 314823 - RNA, 64 nt, Homo Sapiens; identical to SEQ ID NO: 281002

SEQ ID NO: 314824 - RNA, 64 nt, Homo Sapiens; identical to SEQ ID NO: 281003

SEQ ID NO: 314825 - RNA, 64 nt, Homo Sapiens; identical to SEQ ID NO: 281004

SEQ ID NO: 314826 - RNA, 64 nt, Homo Sapiens; identical to SEQ ID NO: 281005

SEQ ID NO: 314827 - RNA, 64 nt, Homo Sapiens; identical to SEQ ID NO: 281006

SEQ ID NO: 314828 - RNA, 64 nt, Homo Sapiens; identical to SEQ ID NO: 281007

SEQ ID NO: 314829 - RNA, 64 nt, Homo Sapiens; identical to SEQ ID NO: 281008

SEQ ID NO: 314830 - RNA, 64 nt, Homo Sapiens; identical to SEQ ID NO: 281009

SEQ ID NO: 314831 - RNA, 64 nt, Homo Sapiens; identical to SEQ ID NO: 281010

SEQ ID NO: 314832 - RNA, 64 nt, Homo Sapiens; identical to SEQ ID NO: 281011

SEQ ID NO: 314833 - RNA, 64 nt, Homo Sapiens; identical to SEQ ID NO: 281012

SEQ ID NO: 314834 - RNA, 64 nt, Homo Sapiens; identical to SEQ ID NO: 281013

SEQ ID NO: 314835 - RNA, 64 nt, Homo Sapiens; identical to SEQ ID NO: 281014

SEQ ID NO: 314836 - RNA, 64 nt, Homo Sapiens; identical to SEQ ID NO: 281015

SEQ ID NO: 314837 - RNA, 64 nt, Homo Sapiens; identical to SEQ ID NO: 281016

SEQ ID NO: 314838 - RNA, 64 nt, Homo Sapiens; identical to SEQ ID NO: 281017

SEQ ID NO: 314839 - RNA, 64 nt, Homo Sapiens; identical to SEQ ID NO: 281018

SEQ ID NO: 314840 - RNA, 64 nt, Homo Sapiens; identical to SEQ ID NO: 281019

SEQ ID NO: 314841 - RNA, 64 nt, Homo Sapiens; identical to SEQ ID NO: 281020

SEQ ID NO: 314842 - RNA, 64 nt, Homo Sapiens; identical to SEQ ID NO: 281021

SEQ ID NO: 314843 - RNA, 64 nt, Homo Sapiens; identical to SEQ ID NO: 281022

SEQ ID NO: 314844 - RNA, 64 nt, Homo Sapiens; identical to SEQ ID NO: 281023

SEQ ID NO: 314845 - RNA, 64 nt, Homo Sapiens; identical to SEQ ID NO: 281024

SEQ ID NO: 314846 - RNA, 64 nt, Homo Sapiens; identical to SEQ ID NO: 281025

SEQ ID NO: 314847 - RNA, 64 nt, Homo Sapiens; identical to SEQ ID NO: 281026

SEQ ID NO: 314848 - RNA, 64 nt, Homo Sapiens; identical to SEQ ID NO: 281027

SEQ ID NO: 314849 - RNA, 64 nt, Homo Sapiens; identical to SEQ ID NO: 281028

SEQ ID NO: 314850 - RNA, 64 nt, Homo Sapiens; identical to SEQ ID NO: 281029

SEQ ID NO: 314851 - RNA, 64 nt, Homo Sapiens; identical to SEQ ID NO: 281030

SEQ ID NO: 314852 - RNA, 64 nt, Homo Sapiens; identical to SEQ ID NO: 281031

SEQ ID NO: 314853 - RNA, 64 nt, Homo Sapiens; identical to SEQ ID NO: 281032

SEQ ID NO: 314854 - RNA, 64 nt, Homo Sapiens; identical to SEQ ID NO: 281033

SEQ ID NO: 314855 - RNA, 64 nt, Homo Sapiens; identical to SEQ ID NO: 281034

SEQ ID NO: 314856 - RNA, 64 nt, Homo Sapiens; identical to SEQ ID NO: 281035

SEQ ID NO: 314857 - RNA, 64 nt, Homo Sapiens; identical to SEQ ID NO: 281036

SEQ ID NO: 314858 - RNA, 64 nt, Homo Sapiens; identical to SEQ ID NO: 281037

SEQ ID NO: 314859 - RNA, 64 nt, Homo Sapiens; identical to SEQ ID NO: 281038

SEQ ID NO: 314860 - RNA, 64 nt, Homo Sapiens; identical to SEQ ID NO: 281039

SEQ ID NO: 314861 - RNA, 64 nt, Homo Sapiens; identical to SEQ ID NO: 281040

SEQ ID NO: 314862 - RNA, 64 nt, Homo Sapiens; identical to SEQ ID NO: 281041

SEQ ID NO: 314863 - RNA, 64 nt, Homo Sapiens; identical to SEQ ID NO: 281042

SEQ ID NO: 314864 - RNA, 64 nt, Homo Sapiens; identical to SEQ ID NO: 281043

SEQ ID NO: 314865 - RNA, 64 nt, Homo Sapiens; identical to SEQ ID NO: 281044

SEQ ID NO: 314866 - RNA, 64 nt, Homo Sapiens; identical to SEQ ID NO: 281045

SEQ ID NO: 314867 - RNA, 64 nt, Homo Sapiens; identical to SEQ ID NO: 281046

SEQ ID NO: 314868 - RNA, 64 nt, Homo Sapiens; identical to SEQ ID NO: 281047

SEQ ID NO: 314869 - RNA, 64 nt, Homo Sapiens; identical to SEQ ID NO: 281048

SEQ ID NO: 314870 - RNA, 64 nt, Homo Sapiens; identical to SEQ ID NO: 281049

SEQ ID NO: 314871 - RNA, 64 nt, Homo Sapiens; identical to SEQ ID NO: 281050

SEQ ID NO: 314872 - RNA, 64 nt, Homo Sapiens; identical to SEQ ID NO: 281051

SEQ ID NO: 314873 - RNA, 64 nt, Homo Sapiens; identical to SEQ ID NO: 281052

SEQ ID NO: 314874 - RNA, 64 nt, Homo Sapiens; identical to SEQ ID NO: 281053

SEQ ID NO: 314875 - RNA, 64 nt, Homo Sapiens; identical to SEQ ID NO: 281054

SEQ ID NO: 314876 - RNA, 64 nt, Homo Sapiens; identical to SEQ ID NO: 281055

SEQ ID NO: 314877 - RNA, 64 nt, Homo Sapiens; identical to SEQ ID NO: 281056

SEQ ID NO: 314878 - RNA, 64 nt, Homo Sapiens; identical to SEQ ID NO: 281057

SEQ ID NO: 314879 - RNA, 64 nt, Homo Sapiens; identical to SEQ ID NO: 281058

SEQ ID NO: 314880 - RNA, 64 nt, Homo Sapiens; identical to SEQ ID NO: 281059

SEQ ID NO: 314881 - RNA, 64 nt, Homo Sapiens; identical to SEQ ID NO: 281060

SEQ ID NO: 314882 - RNA, 64 nt, Homo Sapiens; identical to SEQ ID NO: 281061

SEQ ID NO: 314883 - RNA, 64 nt, Homo Sapiens; identical to SEQ ID NO: 281062

SEQ ID NO: 314884 - RNA, 64 nt, Homo Sapiens; identical to SEQ ID NO: 281063

SEQ ID NO: 314885 - RNA, 64 nt, Homo Sapiens; identical to SEQ ID NO: 281064

SEQ ID NO: 314886 - RNA, 64 nt, Homo Sapiens; identical to SEQ ID NO: 281065

SEQ ID NO: 314887 - RNA, 64 nt, Homo Sapiens; identical to SEQ ID NO: 281066

SEQ ID NO: 314888 - RNA, 64 nt, Homo Sapiens; identical to SEQ ID NO: 281067

SEQ ID NO: 314889 - RNA, 64 nt, Homo Sapiens; identical to SEQ ID NO: 281068

SEQ ID NO: 314890 - RNA, 64 nt, Homo Sapiens; identical to SEQ ID NO: 281069

SEQ ID NO: 314891 - RNA, 64 nt, Homo Sapiens; identical to SEQ ID NO: 281070

SEQ ID NO: 314892 - RNA, 64 nt, Homo Sapiens; identical to SEQ ID NO: 281071

SEQ ID NO: 314893 - RNA, 64 nt, Homo Sapiens; identical to SEQ ID NO: 281072

SEQ ID NO: 314894 - RNA, 64 nt, Homo Sapiens; identical to SEQ ID NO: 281073

SEQ ID NO: 314895 - RNA, 64 nt, Homo Sapiens; identical to SEQ ID NO: 281074

SEQ ID NO: 314896 - RNA, 64 nt, Homo Sapiens; identical to SEQ ID NO: 281075

SEQ ID NO: 314897 - RNA, 64 nt, Homo Sapiens; identical to SEQ ID NO: 281076

SEQ ID NO: 314898 - RNA, 64 nt, Homo Sapiens; identical to SEQ ID NO: 281077

SEQ ID NO: 314899 - RNA, 64 nt, Homo Sapiens; identical to SEQ ID NO: 281078

SEQ ID NO: 314900 - RNA, 64 nt, Homo Sapiens; identical to SEQ ID NO: 281079

SEQ ID NO: 314901 - RNA, 64 nt, Homo Sapiens; identical to SEQ ID NO: 281080

SEQ ID NO: 314902 - RNA, 64 nt, Homo Sapiens; identical to SEQ ID NO: 281081

SEQ ID NO: 314903 - RNA, 64 nt, Homo Sapiens; identical to SEQ ID NO: 281082

SEQ ID NO: 314904 - RNA, 64 nt, Homo Sapiens; identical to SEQ ID NO: 281083

SEQ ID NO: 314905 - RNA, 64 nt, Homo Sapiens; identical to SEQ ID NO: 281084

SEQ ID NO: 314906 - RNA, 64 nt, Homo Sapiens; identical to SEQ ID NO: 281085

SEQ ID NO: 314907 - RNA, 64 nt, Homo Sapiens; identical to SEQ ID NO: 281086

SEQ ID NO: 314908 - RNA, 64 nt, Homo Sapiens; identical to SEQ ID NO: 281087

SEQ ID NO: 314909 - RNA, 64 nt, Homo Sapiens; identical to SEQ ID NO: 281088

SEQ ID NO: 314910 - RNA, 64 nt, Homo Sapiens; identical to SEQ ID NO: 281089

SEQ ID NO: 314911 - RNA, 64 nt, Homo Sapiens; identical to SEQ ID NO: 281090

SEQ ID NO: 314912 - RNA, 64 nt, Homo Sapiens; identical to SEQ ID NO: 281091

SEQ ID NO: 314913 - RNA, 64 nt, Homo Sapiens; identical to SEQ ID NO: 281092

SEQ ID NO: 314914 - RNA, 64 nt, Homo Sapiens; identical to SEQ ID NO: 281093

SEQ ID NO: 314915 - RNA, 64 nt, Homo Sapiens; identical to SEQ ID NO: 281094

SEQ ID NO: 314916 - RNA, 64 nt, Homo Sapiens; identical to SEQ ID NO: 281095

SEQ ID NO: 314917 - RNA, 64 nt, Homo Sapiens; identical to SEQ ID NO: 281096

SEQ ID NO: 314918 - RNA, 64 nt, Homo Sapiens; identical to SEQ ID NO: 281097

SEQ ID NO: 314919 - RNA, 64 nt, Homo Sapiens; identical to SEQ ID NO: 281098

SEQ ID NO: 314920 - RNA, 64 nt, Homo Sapiens; identical to SEQ ID NO: 281099

SEQ ID NO: 314921 - RNA, 64 nt, Homo Sapiens; identical to SEQ ID NO: 281100

SEQ ID NO: 314922 - RNA, 64 nt, Homo Sapiens; identical to SEQ ID NO: 281101

SEQ ID NO: 314923 - RNA, 64 nt, Homo Sapiens; identical to SEQ ID NO: 281102

SEQ ID NO: 314924 - RNA, 64 nt, Homo Sapiens; identical to SEQ ID NO: 281103

SEQ ID NO: 314925 - RNA, 64 nt, Homo Sapiens; identical to SEQ ID NO: 46940

SEQ ID NO: 314926 - RNA, 64 nt, Homo Sapiens; identical to SEQ ID NO: 46941

SEQ ID NO: 314927 - RNA, 64 nt, Homo Sapiens; identical to SEQ ID NO: 46942

SEQ ID NO: 314928 - RNA, 64 nt, Homo Sapiens; identical to SEQ ID NO: 46943

SEQ ID NO: 314929 - RNA, 64 nt, Homo Sapiens; identical to SEQ ID NO: 46944

SEQ ID NO: 314930 - RNA, 64 nt, Homo Sapiens; identical to SEQ ID NO: 46945

SEQ ID NO: 314931 - RNA, 64 nt, Homo Sapiens; identical to SEQ ID NO: 46946

SEQ ID NO: 314932 - RNA, 64 nt, Homo Sapiens; identical to SEQ ID NO: 46947

SEQ ID NO: 314933 - RNA, 64 nt, Homo Sapiens; identical to SEQ ID NO: 46948

SEQ ID NO: 314934 - RNA, 64 nt, Homo Sapiens; identical to SEQ ID NO: 46949

SEQ ID NO: 314935 - RNA, 64 nt, Homo Sapiens; identical to SEQ ID NO: 46950

SEQ ID NO: 314936 - RNA, 64 nt, Homo Sapiens; identical to SEQ ID NO: 46951

SEQ ID NO: 314937 - RNA, 64 nt, Homo Sapiens; identical to SEQ ID NO: 46952

SEQ ID NO: 314938 - RNA, 64 nt, Homo Sapiens; identical to SEQ ID NO: 46953

SEQ ID NO: 314939 - RNA, 64 nt, Homo Sapiens; identical to SEQ ID NO: 46954

SEQ ID NO: 314940 - RNA, 64 nt, Homo Sapiens; identical to SEQ ID NO: 46955

SEQ ID NO: 314941 - RNA, 64 nt, Homo Sapiens; identical to SEQ ID NO: 46956

SEQ ID NO: 314942 - RNA, 64 nt, Homo Sapiens; identical to SEQ ID NO: 46957

SEQ ID NO: 314943 - RNA, 64 nt, Homo Sapiens; identical to SEQ ID NO: 46958

SEQ ID NO: 314944 - RNA, 60 nt, Homo Sapiens; identical to SEQ ID NO: 46959

SEQ ID NO: 314945 - RNA, 64 nt, Homo Sapiens; identical to SEQ ID NO: 46960

SEQ ID NO: 314946 - RNA, 64 nt, Homo Sapiens; identical to SEQ ID NO: 46961

SEQ ID NO: 314947 - RNA, 64 nt, Homo Sapiens; identical to SEQ ID NO: 46962

SEQ ID NO: 314948 - RNA, 64 nt, Homo Sapiens; identical to SEQ ID NO: 46963

SEQ ID NO: 314949 - RNA, 64 nt, Homo Sapiens; identical to SEQ ID NO: 46964

SEQ ID NO: 314950 - RNA, 64 nt, Homo Sapiens; identical to SEQ ID NO: 46965

SEQ ID NO: 314951 - RNA, 64 nt, Homo Sapiens; identical to SEQ ID NO: 46966

SEQ ID NO: 314952 - RNA, 64 nt, Homo Sapiens; identical to SEQ ID NO: 46967

SEQ ID NO: 314953 - RNA, 64 nt, Homo Sapiens; identical to SEQ ID NO: 46968

SEQ ID NO: 314954 - RNA, 64 nt, Homo Sapiens; identical to SEQ ID NO: 46969

SEQ ID NO: 314955 - RNA, 64 nt, Homo Sapiens; identical to SEQ ID NO: 46970

SEQ ID NO: 314956 - RNA, 64 nt, Homo Sapiens; identical to SEQ ID NO: 46971

SEQ ID NO: 314957 - RNA, 64 nt, Homo Sapiens; identical to SEQ ID NO: 46972

SEQ ID NO: 314958 - RNA, 64 nt, Homo Sapiens; identical to SEQ ID NO: 46973

SEQ ID NO: 314959 - RNA, 64 nt, Homo Sapiens; identical to SEQ ID NO: 46974

SEQ ID NO: 314960 - RNA, 64 nt, Homo Sapiens; identical to SEQ ID NO: 46975

SEQ ID NO: 314961 - RNA, 64 nt, Homo Sapiens; identical to SEQ ID NO: 46976

SEQ ID NO: 314962 - RNA, 64 nt, Homo Sapiens; identical to SEQ ID NO: 46977

SEQ ID NO: 314963 - RNA, 64 nt, Homo Sapiens; identical to SEQ ID NO: 46978

SEQ ID NO: 314964 - RNA, 64 nt, Homo Sapiens; identical to SEQ ID NO: 46979

SEQ ID NO: 314965 - RNA, 64 nt, Homo Sapiens; identical to SEQ ID NO: 46980

SEQ ID NO: 314966 - RNA, 64 nt, Homo Sapiens; identical to SEQ ID NO: 46981

SEQ ID NO: 314967 - RNA, 64 nt, Homo Sapiens; identical to SEQ ID NO: 46982

SEQ ID NO: 314968 - RNA, 64 nt, Homo Sapiens; identical to SEQ ID NO: 46983

SEQ ID NO: 314969 - RNA, 64 nt, Homo Sapiens; identical to SEQ ID NO: 46984

SEQ ID NO: 314970 - RNA, 64 nt, Homo Sapiens; identical to SEQ ID NO: 46985

SEQ ID NO: 314971 - RNA, 64 nt, Homo Sapiens; identical to SEQ ID NO: 46986

SEQ ID NO: 314972 - RNA, 64 nt, Homo Sapiens; identical to SEQ ID NO: 46987

SEQ ID NO: 314973 - RNA, 64 nt, Homo Sapiens; identical to SEQ ID NO: 46988

SEQ ID NO: 314974 - RNA, 64 nt, Homo Sapiens; identical to SEQ ID NO: 46989

SEQ ID NO: 314975 - RNA, 64 nt, Homo Sapiens; identical to SEQ ID NO: 46990

SEQ ID NO: 314976 - RNA, 64 nt, Homo Sapiens; identical to SEQ ID NO: 46991

SEQ ID NO: 314977 - RNA, 64 nt, Homo Sapiens; identical to SEQ ID NO: 46992

SEQ ID NO: 314978 - RNA, 64 nt, Homo Sapiens; identical to SEQ ID NO: 46993

SEQ ID NO: 314979 - RNA, 64 nt, Homo Sapiens; identical to SEQ ID NO: 46994

SEQ ID NO: 314980 - RNA, 64 nt, Homo Sapiens; identical to SEQ ID NO: 46995

SEQ ID NO: 314981 - RNA, 64 nt, Homo Sapiens; identical to SEQ ID NO: 46996

SEQ ID NO: 314982 - RNA, 64 nt, Homo Sapiens; identical to SEQ ID NO: 46997

SEQ ID NO: 314983 - RNA, 64 nt, Homo Sapiens; identical to SEQ ID NO: 46998

SEQ ID NO: 314984 - RNA, 64 nt, Homo Sapiens; identical to SEQ ID NO: 46999

SEQ ID NO: 314985 - RNA, 64 nt, Homo Sapiens; identical to SEQ ID NO: 47000

SEQ ID NO: 314986 - RNA, 64 nt, Homo Sapiens; identical to SEQ ID NO: 81713

SEQ ID NO: 314987 - RNA, 64 nt, Homo Sapiens; identical to SEQ ID NO: 81714

SEQ ID NO: 314988 - RNA, 64 nt, Homo Sapiens; identical to SEQ ID NO: 81715

SEQ ID NO: 314989 - RNA, 64 nt, Homo Sapiens; identical to SEQ ID NO: 81716

SEQ ID NO: 314990 - RNA, 64 nt, Homo Sapiens; identical to SEQ ID NO: 81717

SEQ ID NO: 314991 - RNA, 64 nt, Homo Sapiens; identical to SEQ ID NO: 81718

SEQ ID NO: 314992 - RNA, 64 nt, Homo Sapiens
gauauauguuauuucuugcgaacaacuuuuuaaaugaacugauuuuucaucuugguaauaucaa

SEQ ID NO: 314993 - RNA, 64 nt, Homo Sapiens
gucacacccuguacuucauugcauuuguaugaagugaacugagcauuuuacugagaaaugaccu

SEQ ID NO: 314994 - RNA, 64 nt, Homo Sapiens
guuucuccuaacuuucugcucacuaugaacuuuuugaacugacauaggcaggagugccaaagga

SEQ ID NO: 314995 - RNA, 64 nt, Homo Sapiens
ugccuucccccgucgcauaaaugguuuugaaaaaugaacugagcugcucaguggacuucuauag

SEQ ID NO: 314996 - RNA, 64 nt, Homo Sapiens
ugcuaaaugacuccacacucagccuucucuacccugaacugaauuaucacccuuuucuccaugu

SEQ ID NO: 314997 - RNA, 64 nt, Homo Sapiens
auauuuacaaaguccuucuacccacuaucaaaaaugaacugaucugcauucagcaggaaaaggg

SEQ ID NO: 314998 - RNA, 64 nt, Homo Sapiens
acacuagcuuuguauuuuuuuuucuguaaaacugugaacugauauauuuuccuuuaucacuuua

SEQ ID NO: 314999 - RNA, 64 nt, Homo Sapiens
agaaucgcuugaaccugggagguggaaguuguagugaacugagaucgcaccacugcacuccagc

SEQ ID NO: 315000 - RNA, 64 nt, Homo Sapiens
cagaccaacuggaaucccaggacugugacccucuugaacugaauaauggaaaaagcuuucuucu

SEQ ID NO: 315001 - RNA, 64 nt, Homo Sapiens
ggacacccgaggcugccacugaaaccagaauaugugaacugaguugaagacagcuugggcaggu

SEQ ID NO: 315002 - RNA, 64 nt, Homo Sapiens
agaauguuccuuaaaucaugaauaauauaaaguuugaacugauugaauuuauuucauauaaaau

SEQ ID NO: 315003 - RNA, 64 nt, Homo Sapiens
aaggagcucugaauuuauuuuacagaaaaaaaucugaacugagaucauuuaucaaaccuuuuau

SEQ ID NO: 315004 - RNA, 64 nt, Homo Sapiens
agugaauuugaaaauuugucuguauuuaauggccugaacugagaguugauauggccaaagggag

SEQ ID NO: 315005 - RNA, 64 nt, Homo Sapiens
aggaucacuugagccugggagguugaggcugcagugaacugagaucacgacacugcacuccagc

SEQ ID NO: 315006 - RNA, 64 nt, Homo Sapiens
agccacagaacuucaguugaugccaugaaacauuugaacugauguuucacuuaaagaaaaaaaa

SEQ ID NO: 315007 - RNA, 64 nt, Homo Sapiens
acaaaacucaggaauuggugugagucucuuucuaugaacugaacuuauuaugcuuuuaguugua

SEQ ID NO: 315008 - RNA, 64 nt, Homo Sapiens
guuauuuauaugcccaacaaauuucauagccugcugaacugaacugagugugucagaagugcug

SEQ ID NO: 315009 - RNA, 64 nt, Homo Sapiens
uuauaugcccaacaaauuucauagccugcugaacugaacugagugugucagaagugcugguuaa

SEQ ID NO: 315010 - RNA, 64 nt, Homo Sapiens
uuucugaaaacguaauguagaggccuuaacuuacugaacugaacaucagugcuuuuagaaaugc

SEQ ID NO: 315011 - RNA, 64 nt, Homo Sapiens
gcagcaacaacauuauuuuuuugucagugauuugugaacugagaguguacaugaugaucauggg

SEQ ID NO: 315012 - RNA, 64 nt, Homo Sapiens
ggcccuccgaggugggucuggggccugaccuaccugaacugacuugucgggagggaagagaacu

SEQ ID NO: 315013 - RNA, 64 nt, Homo Sapiens
agagacuggcagagucccgacauagacgccuuugugaacugaaaccagugugcacccagcgcuc

SEQ ID NO: 315014 - RNA, 64 nt, Homo Sapiens
gaggaacaugcugucuccuguuugucacucccagugaacugaaugccuugagaacaaagucacc

SEQ ID NO: 315015 - RNA, 64 nt, Homo Sapiens
ucugaacagcaucugucaaaugcagaaaguggccugaacugaccugccuguugguccaggaccc

SEQ ID NO: 315016 - RNA, 64 nt, Homo Sapiens
gugaugaacuggcagggauaaaucuggcaauggaugaacugaaaccuuggccagcaaguuagag

SEQ ID NO: 315017 - RNA, 64 nt, Homo Sapiens
gccacuugaguuggggccaucaggggucuuaccuugaacugaaguuggggcuaaagacugaucu

SEQ ID NO: 315018 - RNA, 64 nt, Homo Sapiens
aucuucucuauauucauuucgcauuaacuacaagugaacugaucccacuuuggaucaguucaca

SEQ ID NO: 315019 - RNA, 64 nt, Homo Sapiens
aguaagagaaauaaauagaacaugcucuccuacuugaacugaaacaguucuuuuauuuccaaaa

SEQ ID NO: 315020 - RNA, 64 nt, Homo Sapiens; identical to SEQ ID NO: 175595

SEQ ID NO: 315021 - RNA, 64 nt, Homo Sapiens; identical to SEQ ID NO: 175596

SEQ ID NO: 315022 - RNA, 64 nt, Homo Sapiens; identical to SEQ ID NO: 175597

SEQ ID NO: 315023 - RNA, 64 nt, Homo Sapiens; identical to SEQ ID NO: 175598

SEQ ID NO: 315024 - RNA, 64 nt, Homo Sapiens; identical to SEQ ID NO: 175599

SEQ ID NO: 315025 - RNA, 64 nt, Homo Sapiens; identical to SEQ ID NO: 175600

SEQ ID NO: 315026 - RNA, 64 nt, Homo Sapiens; identical to SEQ ID NO: 175601

SEQ ID NO: 315027 - RNA, 64 nt, Homo Sapiens; identical to SEQ ID NO: 175602

SEQ ID NO: 315028 - RNA, 64 nt, Homo Sapiens; identical to SEQ ID NO: 175603

SEQ ID NO: 315029 - RNA, 64 nt, Homo Sapiens; identical to SEQ ID NO: 175604

SEQ ID NO: 315030 - RNA, 64 nt, Homo Sapiens; identical to SEQ ID NO: 175605

SEQ ID NO: 315031 - RNA, 64 nt, Homo Sapiens; identical to SEQ ID NO: 175606

SEQ ID NO: 315032 - RNA, 64 nt, Homo Sapiens; identical to SEQ ID NO: 175607

SEQ ID NO: 315033 - RNA, 64 nt, Homo Sapiens; identical to SEQ ID NO: 175608

SEQ ID NO: 315034 - RNA, 64 nt, Homo Sapiens; identical to SEQ ID NO: 175609

SEQ ID NO: 315035 - RNA, 64 nt, Homo Sapiens; identical to SEQ ID NO: 175610

SEQ ID NO: 315036 - RNA, 64 nt, Homo Sapiens; identical to SEQ ID NO: 175611

SEQ ID NO: 315037 - RNA, 64 nt, Homo Sapiens; identical to SEQ ID NO: 175612

SEQ ID NO: 315038 - RNA, 64 nt, Homo Sapiens; identical to SEQ ID NO: 175613

SEQ ID NO: 315039 - RNA, 64 nt, Homo Sapiens; identical to SEQ ID NO: 175614

SEQ ID NO: 315040 - RNA, 64 nt, Homo Sapiens; identical to SEQ ID NO: 175615

SEQ ID NO: 315041 - RNA, 64 nt, Homo Sapiens; identical to SEQ ID NO: 175616

SEQ ID NO: 315042 - RNA, 64 nt, Homo Sapiens; identical to SEQ ID NO: 175617

SEQ ID NO: 315043 - RNA, 64 nt, Homo Sapiens; identical to SEQ ID NO: 175618

SEQ ID NO: 315044 - RNA, 64 nt, Homo Sapiens
ggaaguggcuguucccagacugacuucugagcuaagccugcaaguuuucagggcagugggaugg

SEQ ID NO: 315045 - RNA, 64 nt, Homo Sapiens
cccuccucuggaacugggaucacuucuucccuccagccugcaugaucccuucccaccucucccc

SEQ ID NO: 315046 - RNA, 64 nt, Homo Sapiens
ugauguguguuuguggauaccugggcaucgacccagccugcaggugagcucugggccauguugc

SEQ ID NO: 315047 - RNA, 64 nt, Homo Sapiens
acagucuaagacuucagggccgggaccuuuguccagccugcacaguagagugaggcugccucuc

SEQ ID NO: 315048 - RNA, 64 nt, Homo Sapiens
gugaggggcgcauuccuccagcgccaagcgucagagccugcagacaacggagggcagcgccccc

SEQ ID NO: 315049 - RNA, 64 nt, Homo Sapiens
gggaagcuucuccuccccaaggcggccauggggcagccugcagaggacaguggacguggagcug

SEQ ID NO: 315050 - RNA, 64 nt, Homo Sapiens
gcacgggugccuccagccugagacaucaggggagagccugcagcugaguucagcagaaaggagg

SEQ ID NO: 315051 - RNA, 64 nt, Homo Sapiens
cugggcuccucagagccugaagcaagcuuuuggaagccugcaguccucccagcuccagugcaga

SEQ ID NO: 315052 - RNA, 64 nt, Homo Sapiens
ggccaggcuggaccccggcuccacacccacauccagccugcaggccucucugcaguccucucac

SEQ ID NO: 315053 - RNA, 64 nt, Homo Sapiens
uggccccugacaccucccccagccccagcacaccagccugcaccucuuaucccguguuaagucc

SEQ ID NO: 315054 - RNA, 64 nt, Homo Sapiens
ucacgagacccgcccuccccagaaguucaagaccagccugcacaagggaggacugcuugaagcc

SEQ ID NO: 315055 - RNA, 64 nt, Homo Sapiens
aacuggaacaaggccccaccccuucaggaauggcagccugcagcagaggcagcuugucccccga

SEQ ID NO: 315056 - RNA, 64 nt, Homo Sapiens
cccguacuccuccacccagaugagggcccuccagagccugcaggcaucuguggggaaucccagc

SEQ ID NO: 315057 - RNA, 64 nt, Homo Sapiens
ccuccagagccugcaggcaucuguggggaaucccagccugcagguucuuggagaagcaggugaa

SEQ ID NO: 315058 - RNA, 64 nt, Homo Sapiens
uggaagcccuuuguuccuucccggguuuguccugagccugcacuguccucgccugcagccucag

SEQ ID NO: 315059 - RNA, 64 nt, Homo Sapiens
ccauguuaacgugagcaaauuccucucaugaaauagccugcagcuauuaagaagcacgugugug

SEQ ID NO: 315060 - RNA, 64 nt, Homo Sapiens
ccuucacugaucccagccaccccagaaaagcugcagccugcaggcaccagccgggccauaugcc

SEQ ID NO: 315061 - RNA, 64 nt, Homo Sapiens
gccugaaugucaugcucccuggggcaggaccuugagccugcagcacacacuaggccaccugcag

SEQ ID NO: 315062 - RNA, 64 nt, Homo Sapiens
gucuuacugauuuacaaacucugcacugauuuguagccugcacuuuugaaucucagucuucagc

SEQ ID NO: 315063 - RNA, 64 nt, Homo Sapiens
gauuuguagccugcacugucgaaucucagucuucagccugcacuuuuuaaguggaagaucauuu

SEQ ID NO: 315064 - RNA, 64 nt, Homo Sapiens
ccccaguuuagguucugagcaguauuggacuuguagccugcaguugucuuuugacuugcaggcc

SEQ ID NO: 315065 - RNA, 64 nt, Homo Sapiens
gagcauuggaauccucuucuuccagggaggaauuagccugcaagguuaggacuugaagagggaa

SEQ ID NO: 315066 - RNA, 64 nt, Homo Sapiens
ugccugugggguggggaggccuugcuuucccuggagccugcaugggagaggcaccugccaacua

SEQ ID NO: 315067 - RNA, 64 nt, Homo Sapiens
aagggcuuuaccccaaccugucaaaacauguuacagccugcauccagaaccaauaacuucugca

SEQ ID NO: 315068 - RNA, 57 nt, Homo Sapiens
ugcccagcgacaaucacugaacgccgaagccugcagccaugcgaccccacgccaccc

SEQ ID NO: 315069 - RNA, 64 nt, Homo Sapiens
accccacgccaccccgugccuccugccuccgcgcagccugcagcgggagacccuguccccgccc

SEQ ID NO: 315070 - RNA, 64 nt, Homo Sapiens
cggcaguucuuuguuaaagaugggguuggucugaagccugcacgcucaugccagcggcuuuggc

SEQ ID NO: 315071 - RNA, 64 nt, Homo Sapiens
cuggcugcccagcuucggacggggcccggggccaagccugcauuaauccaggcgucgaccuggu

SEQ ID NO: 315072 - RNA, 64 nt, Homo Sapiens
cgggcuuggguggguuccuuacagcccugcagcaagccugcacauagcacuuuaaacgccgaag

SEQ ID NO: 315073 - RNA, 64 nt, Homo Sapiens
gggcaaggcccccgcggaauacgaagaccaaagcagccugcacaugccccaaaccggccuagac

SEQ ID NO: 315074 - RNA, 64 nt, Homo Sapiens
cuagacaaauguuuucaaauaaauuucacugcccagccugcacagauuuccauuugaaguacuu

SEQ ID NO: 315075 - RNA, 64 nt, Homo Sapiens
uggcuggguuuuuuaaaaauagaaucucacugauagccugcaagaaacagaugcagugccugcu

SEQ ID NO: 315076 - RNA, 64 nt, Homo Sapiens
caugucaaaaaaaacaaagucuauauacuacuuugagaaguaaaacauuaauugcaagaaauaa

SEQ ID NO: 315077 - RNA, 64 nt, Homo Sapiens
uacauuggagggccaauggcugauaaugugaaaugagaaguauuaguaaacugcacuguuucug

SEQ ID NO: 315078 - RNA, 64 nt, Homo Sapiens
uugugcugaucgccuuauuuguugucauguguaugagaaguacuuauguacaguucauaaauuu

SEQ ID NO: 315079 - RNA, 64 nt, Homo Sapiens
cagaguucuuugcaagcuuacuaggucuugguuagagaaguaagccuuuaacuaucagagggau

SEQ ID NO: 315080 - RNA, 64 nt, Homo Sapiens
uugcagagcaaacaaagcagaggcaagaacugaggagaaguaucagagacaaacgggacuuuua

SEQ ID NO: 315081 - RNA, 64 nt, Homo Sapiens
aaguggaaucuuccuuaaaggugaaacauaaguugagaaguagugcuugguuauuaagccugga

SEQ ID NO: 315082 - RNA, 64 nt, Homo Sapiens
agggcacagugugagaggcgagaacgaucugggagagaaguaucuuuaacagaguugaaaggcc

SEQ ID NO: 315083 - RNA, 64 nt, Homo Sapiens
aggggagcgagacgaaaggaagaaucagacaggcgagaaguacgccaccaagaaaugaacuuag

SEQ ID NO: 315084 - RNA, 64 nt, Homo Sapiens; identical to SEQ ID NO: 249571

SEQ ID NO: 315085 - RNA, 64 nt, Homo Sapiens; identical to SEQ ID NO: 249572

SEQ ID NO: 315086 - RNA, 64 nt, Homo Sapiens; identical to SEQ ID NO: 249573

SEQ ID NO: 315087 - RNA, 64 nt, Homo Sapiens; identical to SEQ ID NO: 249574

SEQ ID NO: 315088 - RNA, 64 nt, Homo Sapiens; identical to SEQ ID NO: 249575

SEQ ID NO: 315089 - RNA, 64 nt, Homo Sapiens; identical to SEQ ID NO: 249576

SEQ ID NO: 315090 - RNA, 64 nt, Homo Sapiens; identical to SEQ ID NO: 249577

SEQ ID NO: 315091 - RNA, 64 nt, Homo Sapiens; identical to SEQ ID NO: 249578

SEQ ID NO: 315092 - RNA, 64 nt, Homo Sapiens; identical to SEQ ID NO: 249579

SEQ ID NO: 315093 - RNA, 64 nt, Homo Sapiens; identical to SEQ ID NO: 249580

SEQ ID NO: 315094 - RNA, 64 nt, Homo Sapiens; identical to SEQ ID NO: 249581

SEQ ID NO: 315095 - RNA, 64 nt, Homo Sapiens; identical to SEQ ID NO: 249582

SEQ ID NO: 315096 - RNA, 64 nt, Homo Sapiens; identical to SEQ ID NO: 249583

SEQ ID NO: 315097 - RNA, 64 nt, Homo Sapiens; identical to SEQ ID NO: 249584

SEQ ID NO: 315098 - RNA, 64 nt, Homo Sapiens; identical to SEQ ID NO: 249585

SEQ ID NO: 315099 - RNA, 64 nt, Homo Sapiens; identical to SEQ ID NO: 249586

SEQ ID NO: 315100 - RNA, 64 nt, Homo Sapiens; identical to SEQ ID NO: 249587

SEQ ID NO: 315101 - RNA, 64 nt, Homo Sapiens; identical to SEQ ID NO: 249588

SEQ ID NO: 315102 - RNA, 64 nt, Homo Sapiens; identical to SEQ ID NO: 249589

SEQ ID NO: 315103 - RNA, 64 nt, Homo Sapiens; identical to SEQ ID NO: 249590

SEQ ID NO: 315104 - RNA, 64 nt, Homo Sapiens; identical to SEQ ID NO: 249591

SEQ ID NO: 315105 - RNA, 64 nt, Homo Sapiens; identical to SEQ ID NO: 249592

SEQ ID NO: 315106 - RNA, 64 nt, Homo Sapiens; identical to SEQ ID NO: 249593

SEQ ID NO: 315107 - RNA, 64 nt, Homo Sapiens; identical to SEQ ID NO: 249594

SEQ ID NO: 315108 - RNA, 64 nt, Homo Sapiens; identical to SEQ ID NO: 249595

SEQ ID NO: 315109 - RNA, 64 nt, Homo Sapiens; identical to SEQ ID NO: 249596

SEQ ID NO: 315110 - RNA, 64 nt, Homo Sapiens; identical to SEQ ID NO: 249597

SEQ ID NO: 315111 - RNA, 64 nt, Homo Sapiens; identical to SEQ ID NO: 249598

SEQ ID NO: 315112 - RNA, 64 nt, Homo Sapiens; identical to SEQ ID NO: 249599

SEQ ID NO: 315113 - RNA, 64 nt, Homo Sapiens; identical to SEQ ID NO: 249600

SEQ ID NO: 315114 - RNA, 64 nt, Homo Sapiens; identical to SEQ ID NO: 249601

SEQ ID NO: 315115 - RNA, 64 nt, Homo Sapiens; identical to SEQ ID NO: 249602

SEQ ID NO: 315116 - RNA, 64 nt, Homo Sapiens; identical to SEQ ID NO: 249603

SEQ ID NO: 315117 - RNA, 64 nt, Homo Sapiens; identical to SEQ ID NO: 249604

SEQ ID NO: 315118 - RNA, 64 nt, Homo Sapiens; identical to SEQ ID NO: 249605

SEQ ID NO: 315119 - RNA, 64 nt, Homo Sapiens; identical to SEQ ID NO: 249606

SEQ ID NO: 315120 - RNA, 55 nt, Homo Sapiens
ccaggguggcucugauauagcagcccugguguauuuucgauauuucaggaagacu

SEQ ID NO: 315121 - RNA, 64 nt, Homo Sapiens
acccuccuaauagucauacuaguagucauacucccugguguaguguauucucuaaaagcuuuaa

SEQ ID NO: 315122 - RNA, 64 nt, Homo Sapiens; identical to SEQ ID NO: 164717

SEQ ID NO: 315123 - RNA, 64 nt, Homo Sapiens; identical to SEQ ID NO: 164718

SEQ ID NO: 315124 - RNA, 64 nt, Homo Sapiens; identical to SEQ ID NO: 164719

SEQ ID NO: 315125 - RNA, 64 nt, Homo Sapiens; identical to SEQ ID NO: 164720

SEQ ID NO: 315126 - RNA, 64 nt, Homo Sapiens; identical to SEQ ID NO: 164721

SEQ ID NO: 315127 - RNA, 64 nt, Homo Sapiens; identical to SEQ ID NO: 164722

SEQ ID NO: 315128 - RNA, 64 nt, Homo Sapiens; identical to SEQ ID NO: 164723

SEQ ID NO: 315129 - RNA, 64 nt, Homo Sapiens; identical to SEQ ID NO: 164724

SEQ ID NO: 315130 - RNA, 64 nt, Homo Sapiens; identical to SEQ ID NO: 164725

SEQ ID NO: 315131 - RNA, 64 nt, Homo Sapiens; identical to SEQ ID NO: 164726

SEQ ID NO: 315132 - RNA, 65 nt, Homo Sapiens
gcuugcuggaacauucuaacauuuacacuuuuguuauaagcuauuuaaaaccaguaaggagacuu

SEQ ID NO: 315133 - RNA, 65 nt, Homo Sapiens
ucuaucuauuuaauuggauauuggacucugcucauauaagcuacagacaaaagccaaaagacucu

SEQ ID NO: 315134 - RNA, 65 nt, Homo Sapiens
uauucacaguugguguccugucacuuuguuuuaaaauaagcuagaaccaggaugcuuccuuauug

SEQ ID NO: 315135 - RNA, 64 nt, Homo Sapiens
ccauucacacagauauuuugggauaauaaaggaaaauaagcuacaauugcuugucgucuuuuuu

SEQ ID NO: 315136 - RNA, 65 nt, Homo Sapiens
aguuauugcccuuuuauauugugaauguaaugugcauaagcuauauccguagauguuauuguuuu

SEQ ID NO: 315137 - RNA, 65 nt, Homo Sapiens
auuugcacagggagaauugaaacugaguauaaucaauaagcuagauacgaaaucaguuucucaaa

SEQ ID NO: 315138 - RNA, 65 nt, Homo Sapiens
auauguaaaauuucucaccauuuuggugggguaagauaagcuauuauuaagauuuaauccuuaua

SEQ ID NO: 315139 - RNA, 65 nt, Homo Sapiens
aaaaaucacuauaaggcagcucuaaauuugccuugauaagcuaaauaaauuacuuuuauaacuua

SEQ ID NO: 315140 - RNA, 65 nt, Homo Sapiens
cagagaagggaaaugacaaaggggcagcuggccagauaagcuaggaugagagcagagacucagug

SEQ ID NO: 315141 - RNA, 65 nt, Homo Sapiens
agcccccagcccugggaaccacucccaccacaggcauaagcuaucaccuagcagccucaaaacgg

SEQ ID NO: 315142 - RNA, 65 nt, Homo Sapiens
uaagggauggaaaaggaagacuagaggcuugcauaauaagcuaaagaggcugaaagaggccaaug

SEQ ID NO: 315143 - RNA, 65 nt, Homo Sapiens
aauucuggauuuuguccuacaagucugugccauuuauaagcuaaguugaggguucagagggagac

SEQ ID NO: 315144 - RNA, 65 nt, Homo Sapiens
auaggcuuauuccauggaacaagaauuaaaaaugaauaagcuaucaauauauaauuuaaguacaa

SEQ ID NO: 315145 - RNA, 65 nt, Homo Sapiens
uucuaauaugcugccagguagguuuuuguuguaacauaagcuauuugggaugaauguuuuuauag

SEQ ID NO: 315146 - RNA, 65 nt, Homo Sapiens
gaguggaacauggagcugaucuuuucuuggggcauauaagcuacuaccccaggucugucucuugc

SEQ ID NO: 315147 - RNA, 65 nt, Homo Sapiens
aacuuugauguacacuauaacaaaauugcaaauaaauaagcuaugcuucauuaguuuacgaacca

SEQ ID NO: 315148 - RNA, 65 nt, Homo Sapiens
uauauaucaaacauuucauuaacucuaugaaacauauaagcuaacuuaauaauacuuauguuaau

SEQ ID NO: 315149 - RNA, 65 nt, Homo Sapiens
ugcaguagaccgaaaccauccaggcuguagauuugauaagcuagaaaguccuguuccagaaguac

SEQ ID NO: 315150 - RNA, 65 nt, Homo Sapiens
ucuugauccauuuaaaaggagacucguucauguauauaagcuauuugccgagauguuauaacaag

SEQ ID NO: 315151 - RNA, 65 nt, Homo Sapiens
accauggucgccacuguuuuuggugacuucugaccauaagcuagacugugaagcuugauuucugc

SEQ ID NO: 315152 - RNA, 65 nt, Homo Sapiens
guagaaaaguuuagacuuauuagccugccuuacauauaagcuaauagaaaucauacauaaaaaug

SEQ ID NO: 315153 - RNA, 65 nt, Homo Sapiens
cugccuucucuuuaauuagaauucuugugaaauaaauaagcuagaaugcauaacacugaguguua

SEQ ID NO: 315154 - RNA, 65 nt, Homo Sapiens
aauugaaaaugguuuuuacagcuuacaggaggaagauaagcuacuucaacuucaaaucugugauu

SEQ ID NO: 315155 - RNA, 65 nt, Homo Sapiens
uagcacugagacccccaugguaauguaacuuaauuauaagcuaugucacuacccuccuguaaaau

SEQ ID NO: 315156 - RNA, 65 nt, Homo Sapiens
augcgauucuucuguuguaaaaaaauauauguacuauaagcuacauaaaauauuuucuauuuuuu

SEQ ID NO: 315157 - RNA, 65 nt, Homo Sapiens
gacgguuaacauuuagcagaaaaacaaaccauugaauaagcuacuaggugaaaugcaaaacaacc

SEQ ID NO: 315158 - RNA, 65 nt, Homo Sapiens
agaguuaaugaacagucuaauauugacuuaucagaauaagcuaacucuaaauuuaaugcucuaca

SEQ ID NO: 315159 - RNA, 65 nt, Homo Sapiens
ugaaaaaucccaguaauggaaugaagguaauauugauaagcuauugucuguaauaguuuuauauu

SEQ ID NO: 315160 - RNA, 65 nt, Homo Sapiens
uuacauguuuuccaacauauccuaaaaacugugauauaagcuaacauauaauuugccuuacguca

SEQ ID NO: 315161 - RNA, 65 nt, Homo Sapiens
augaguuggcaugcauacaagauuuacuaagugggauaagcuaauuauacuuuuuguuguggaua

SEQ ID NO: 315162 - RNA, 65 nt, Homo Sapiens
cuaaaucuauacauauuacuuguaucuagugcagaauaagcuauaacaucccauugaggaaucuu

SEQ ID NO: 315163 - RNA, 65 nt, Homo Sapiens
ccagguagagagaccacaagcaggcucaacauaacauaagcuagaaaaauuagaugacugaauuu

SEQ ID NO: 315164 - RNA, 65 nt, Homo Sapiens
gugaaggaaaaggggacaggaacaaaggaccaaaaauaagcuacauguuuuauuucuucaucgug

SEQ ID NO: 315165 - RNA, 65 nt, Homo Sapiens
guuuucuguguuuagcuauuuaauacuaauuuuccauaagcuauuuugguuuagugcaaaguaua

SEQ ID NO: 315166 - RNA, 65 nt, Homo Sapiens
agaagaaauauuucuaggagguaguuccaaagcacauaagcuagacagucauugguuauacaugu

SEQ ID NO: 315167 - RNA, 65 nt, Homo Sapiens
auugauacaaugaugauuaaaacuagaacagguauauaagcuaauugguacuauuugccauuuaa

SEQ ID NO: 315168 - RNA, 65 nt, Homo Sapiens
ugaguuggguuuucgaaccucuacauuauaaauuuauaagcuaagcagaccauugucuugcagga

SEQ ID NO: 315169 - RNA, 65 nt, Homo Sapiens
cauguguuugugauaagaguaauguguucuccgugauaagcuauccucacuuugcuggccuuuga

SEQ ID NO: 315170 - RNA, 65 nt, Homo Sapiens
uuuuccuaaggauaaaguacaaaacauccagauauauaagcuauuacaaaauaucuuuaaaaguu

SEQ ID NO: 315171 - RNA, 65 nt, Homo Sapiens
uguaauaaguguggauuauaagguaaaaugcuaaaauaagcuacccauagaccaguauuucugac

SEQ ID NO: 315172 - RNA, 65 nt, Homo Sapiens
guauguaaacuaaaaggggguacagucacuuaagcauaagcuacagcuauaggccuagaguaugc

SEQ ID NO: 315173 - RNA, 65 nt, Homo Sapiens
aauaacagucuguguuuucugaagguuaguuuaagauaagcuaaccauugugaaaauucugaguu

SEQ ID NO: 315174 - RNA, 65 nt, Homo Sapiens
acaucaaaucagggaaaaauaccguggccauuuauauaagcuauaccuaagcugugguugcagaa

SEQ ID NO: 315175 - RNA, 65 nt, Homo Sapiens
uaauauuuuuuuccuauuuuauacucauggaagagauaagcuaaagaggggacaauaaugagaaa

SEQ ID NO: 315176 - RNA, 65 nt, Homo Sapiens
aaucaaguauuggcaaagauguggggaaaauucucauaagcuacugaugagaauuuauaaauuau

SEQ ID NO: 315177 - RNA, 65 nt, Homo Sapiens
uuuauuccugccuuuaauauggggaggaagguuccauaagcuacauguuuccuaguuaagcucuu

SEQ ID NO: 315178 - RNA, 65 nt, Homo Sapiens
ccacacaucuuuggacuuuucuuaaaaguucaguaauaagcuaacuguguuuauaaaauguaagu

SEQ ID NO: 315179 - RNA, 65 nt, Homo Sapiens
gagagagcuacacggcaggggcagacacugugaguauaagcuacuuuccucccuggagugcucua

SEQ ID NO: 315180 - RNA, 65 nt, Homo Sapiens
acaggaaaauaaguuuugauugcauuguuuuuaaaauaagcuaguuuucugagguguuuucacac

SEQ ID NO: 315181 - RNA, 65 nt, Homo Sapiens
uccuguuucuuucauguacucauuuacuuucaaaaauaagcuagaauauauuaaagaaaauagaa

SEQ ID NO: 315182 - RNA, 65 nt, Homo Sapiens
gagcucuauuuccccaccccacuauccucacucccauaagcuaagccuuaugugagccccuucag

SEQ ID NO: 315183 - RNA, 65 nt, Homo Sapiens
guuuuucauucacuuuaauagaagggcaaauauuuauaagcuauuucuguaccaaaguguuugug

SEQ ID NO: 315184 - RNA, 65 nt, Homo Sapiens
aucaugggacccucucuaauccuuccaccaaucaaauaagcuauugcuauugguuuggaguugag

SEQ ID NO: 315185 - RNA, 65 nt, Homo Sapiens
cccaaaauucauaaagaaauucuuuacagaaauugauaagcuaguuaugaaaaucauagcuggcu

SEQ ID NO: 315186 - RNA, 65 nt, Homo Sapiens
caacaaagaacauauuaaaaugacugaaauguaaaauaagcuauucaccugugaaauaacuauuu

SEQ ID NO: 315187 - RNA, 65 nt, Homo Sapiens
cuuguuuguaaaaaaaaaaauauagagaauuugcuauaagcuaguauuuuaaauugacccuuagc

SEQ ID NO: 315188 - RNA, 65 nt, Homo Sapiens
aauguuuguacuuaugcauuuuuaauaaauguuaaauaagcuaacuaguauaaagagucuguauu

SEQ ID NO: 315189 - RNA, 65 nt, Homo Sapiens
ucucccagacccaccacugggcuuggcugccugacauaagcuaaaggugagagcguuggacccag

SEQ ID NO: 315190 - RNA, 65 nt, Homo Sapiens
auccugaggcugaggguuuuuaaauauacuuuugaauaagcuacucuauuuuacccugugacauu

SEQ ID NO: 315191 - RNA, 65 nt, Homo Sapiens
guuggggaaauuuguggguuaagaagugcuaacagauaagcuauaaaagaauagucagacugaua

SEQ ID NO: 315192 - RNA, 65 nt, Homo Sapiens
guaagaaacuuaucauaagggcuauuuguuguuguauaagcuacugaauccaguaguuuuucuau

SEQ ID NO: 315193 - RNA, 65 nt, Homo Sapiens
uuaagugugcuguaaggaaaagucuuagaaacauaauaagcuaaaaucccauucacacauggcca

SEQ ID NO: 315194 - RNA, 65 nt, Homo Sapiens
uagcuugcuuucaagcuucaccccuugcacuuaacauaagcuauuuuuggcauuguguuaucauc

SEQ ID NO: 315195 - RNA, 65 nt, Homo Sapiens
guuauauucuuuucucauuucuuccccacccaaaaauaagcuaccauauagcuuauaagucucaa

SEQ ID NO: 315196 - RNA, 65 nt, Homo Sapiens
aauaacugugcauggucugagauuuuacccuacuuauaagcuaacaaguuagccuguuacuguuu

SEQ ID NO: 315197 - RNA, 65 nt, Homo Sapiens
uugguuuuuuaaaaagcaacuguuuaauugcuuaaauaagcuauguauuaaaucugucuccaguu

SEQ ID NO: 315198 - RNA, 56 nt, Homo Sapiens
cucagaaacuuuccuacuguuuugcaauaagcuaaggaacauuugacuggcacuga

SEQ ID NO: 315199 - RNA, 65 nt, Homo Sapiens
uggauaguguagcuuuaaugauuuaugcagaauuaauaagcuauuuugacacauugcuugaccug

SEQ ID NO: 315200 - RNA, 65 nt, Homo Sapiens
ggcuuguuuguguaaagcuuauuuucuuucuugaaauaagcuaauaggccuuagacuaauuuucg

SEQ ID NO: 315201 - RNA, 65 nt, Homo Sapiens
acuuugccaaauagugaaaaguagagcaaucguguauaagcuaauguuuaaaagcaaaacugcaa

SEQ ID NO: 315202 - RNA, 65 nt, Homo Sapiens
cugagaauuuuuuaacauaugcaagucagccaaacauaagcuaccaaaauaaagagcaauguguu

SEQ ID NO: 315203 - RNA, 65 nt, Homo Sapiens
uuguuucuuuuuuuuuaacuggucagucauucacaauaagcuaugaggguaaauaaauauguguu

SEQ ID NO: 315204 - RNA, 65 nt, Homo Sapiens
auguuuguacuacuuuuuagaugcuuaaacuauacauaagcuauuaucuauuguuccuaguaauc

SEQ ID NO: 315205 - RNA, 65 nt, Homo Sapiens
ggaggagaaaugagagggcuuaaaugaaauuuaaaauaagcuauauuauacaaauacuaucucug

SEQ ID NO: 315206 - RNA, 65 nt, Homo Sapiens
ucucaaaaucugggccaagaaugauugcuagguccauaagcuaauuugucuggccuugccauuua

SEQ ID NO: 315207 - RNA, 65 nt, Homo Sapiens
uuuucauguaucauuauuuuuacaaggaacuauauauaagcuagcacauaauuauccuucuguuc

SEQ ID NO: 315208 - RNA, 65 nt, Homo Sapiens
uaaagcccuugcacagcuggagaaauggcaucauuauaagcuaugaguugaaauguucugucaaa

SEQ ID NO: 315209 - RNA, 65 nt, Homo Sapiens
cuaguagccuuuaguuuaaagacuacuugcaaaugauaagcuauuauuuauaaaaucuaaauuug

SEQ ID NO: 315210 - RNA, 65 nt, Homo Sapiens
gcuggcaaguucagauacuaguaacaagcucugguauaagcuaaggagguuuuaggauuuucaug

SEQ ID NO: 315211 - RNA, 65 nt, Homo Sapiens
gguaggucuauuuucagagcagagucuuuauguccauaagcuacgaguugaggagguuucugcau

SEQ ID NO: 315212 - RNA, 65 nt, Homo Sapiens
auuuuuauaaaggaaaacuuaagaauuauauaugaauaagcuauuugccucuaacuuugugguau

SEQ ID NO: 315213 - RNA, 65 nt, Homo Sapiens
guccgccacugauuuucauucuucaguaccagucuauaagcuacucucugaaguucccccauuuc

SEQ ID NO: 315214 - RNA, 65 nt, Homo Sapiens
cacuuaucugauacuuauuuaauaggauacaauguauaagcuacucaggcacugagaaugauagu

SEQ ID NO: 315215 - RNA, 65 nt, Homo Sapiens
agcuuucuggguaauucaccaauuuccuuuaaaacauaagcuaccugaauggagaauacaucuug

SEQ ID NO: 315216 - RNA, 65 nt, Homo Sapiens
aaaugugagcucuccugguaaauaguauacauuuuauaagcuauauuuuaaaggccuaagaacau

SEQ ID NO: 315217 - RNA, 65 nt, Homo Sapiens
uauauauauauauauauauauauaugguauaggagauaagcuauuucuuuccaaaaucuauaaau

SEQ ID NO: 315218 - RNA, 65 nt, Homo Sapiens
ucaagucuauguuaaaguugcuuuccugcuguuaaauaagcuaugauauuaagauauucugacuu

SEQ ID NO: 315219 - RNA, 65 nt, Homo Sapiens
cacugaccuguccccaguguuuggggaaagcugguauaagcuacacuugguugcuggaaaaaucu

SEQ ID NO: 315220 - RNA, 65 nt, Homo Sapiens
uuacucucugcagccgucuaaaggugguuuucaccauaagcuaauuuuaaagaauuauauuggau

SEQ ID NO: 315221 - RNA, 65 nt, Homo Sapiens
auuaaguaaagugaaguccauacaaaguuaaauuuauaagcuagcacacauuuccacuauaauuu

SEQ ID NO: 315222 - RNA, 65 nt, Homo Sapiens
gaaauuaagccaucguguuguguuuuugguagaaaauaagcuagacuuuuuuccccucauaaccu

SEQ ID NO: 315223 - RNA, 65 nt, Homo Sapiens
gauuaacuaaucggaacaugggcauagcaaaugacauaagcuaccggagagauuagaagacaaca

SEQ ID NO: 315224 - RNA, 65 nt, Homo Sapiens
ugacuuauuugguggucugucaagaagaaaguuguauaagcuauugauaaggguguguaucuuaa

SEQ ID NO: 315225 - RNA, 65 nt, Homo Sapiens
aguuuauuaugcaacucuggagguauagagggcauauaagcuaugggacauaugcugaucacagg

SEQ ID NO: 315226 - RNA, 65 nt, Homo Sapiens
ucaaacccucaugacaaaguaggcacaagucuacaauaagcuaaaucagaauuuacaaauacaag

SEQ ID NO: 315227 - RNA, 65 nt, Homo Sapiens
caggugggauauguccucagccuuugggggccuggauaagcuauugcagcacuuucugaggcuuu

SEQ ID NO: 315228 - RNA, 65 nt, Homo Sapiens
guuaaguacuacaauguaaucuguuucccagggaaauaagcuauugguaguuguaggaaaucuua

SEQ ID NO: 315229 - RNA, 65 nt, Homo Sapiens
uagucuugucuaauagaugggccccauaaccaaacauaagcuagcaaucucucccccacucccuu

SEQ ID NO: 315230 - RNA, 65 nt, Homo Sapiens
uguuggcaaaaguaauuuauaggagcaaagaaugcauaagcuauguuugaaaauccuccaaaaaa

SEQ ID NO: 315231 - RNA, 65 nt, Homo Sapiens
aacuacaguuuuuccaaacuaugaaugugcuauucauaagcuagaauagaugaagagccaacuug

SEQ ID NO: 315232 - RNA, 65 nt, Homo Sapiens
cuaauuuuugagagaaacacuuauauaauauccucauaagcuauuguguaauauaccaauuaguu

SEQ ID NO: 315233 - RNA, 65 nt, Homo Sapiens
uaccuauggccgugcaaacauggcaagcaguaaaaauaagcuaucggcuucaggaucaauuuugu

SEQ ID NO: 315234 - RNA, 65 nt, Homo Sapiens
uaaccccaaacauuuggauuauucucucuuaaaagauaagcuauugaaguaaccucagcacuacu

SEQ ID NO: 315235 - RNA, 65 nt, Homo Sapiens
uagagugaggcuggagguggauaacuugauuuuguauaagcuauugauuuguguuagcuauggga

SEQ ID NO: 315236 - RNA, 65 nt, Homo Sapiens
ugcugaaaauggcuuccauagauuaaguguauauuauaagcuauaaagaaugcacauauguagac

SEQ ID NO: 315237 - RNA, 65 nt, Homo Sapiens
cugcuuaggauucuguucccugggcugaaacugaaauaagcuaauuuuuugggucacgguggcag

SEQ ID NO: 315238 - RNA, 65 nt, Homo Sapiens
uuacuguaauugccagaggcagaaauggucuggguauaagcuauuucauaaaagcagcuuuaaau

SEQ ID NO: 315239 - RNA, 65 nt, Homo Sapiens
cagaauucuaagaugaauuuaccaggugagaaugaauaagcuaugcaagguauuuuguaauauac

SEQ ID NO: 315240 - RNA, 65 nt, Homo Sapiens
gaaaccagguaagcccuuuauuuuuaaaaaauaauauaagcuacauacucccuauuuucauuccu

SEQ ID NO: 315241 - RNA, 65 nt, Homo Sapiens
ucacuacaaggagcuguuaugauaccauaaagcacauaagcuagauuauacucuccuuuugaaaa

SEQ ID NO: 315242 - RNA, 65 nt, Homo Sapiens
aaagacaaaaaaaacaaaaaguuuuucuaccaacaauaagcuagauuuauucaaaguguuagccu

SEQ ID NO: 315243 - RNA, 65 nt, Homo Sapiens
aaauugaauacuuugaauguguuucacaguuugaaauaagcuauuugauguaauacuucuugugu

SEQ ID NO: 315244 - RNA, 65 nt, Homo Sapiens
guucauaguaacauuauacuucauagccagaaaguauaagcuaauacccaucaggcugggugugg

SEQ ID NO: 315245 - RNA, 65 nt, Homo Sapiens
uauauauccaguuuucauuuuuuuacgucuugccuauaagcuaauaucauaaauaagguuguuua

SEQ ID NO: 315246 - RNA, 65 nt, Homo Sapiens
ggauccaccacaccccaccgagcacuagaagcugcauaagcuacacaggaugugcuucugcagcc

SEQ ID NO: 315247 - RNA, 65 nt, Homo Sapiens
uuuauugguuuaguauucuucuuaauauuugcaugauaagcuaguuuaacugacuuucuagaugc

SEQ ID NO: 315248 - RNA, 65 nt, Homo Sapiens
uaugucuaggagcuuuaucuaauagauucuuaaagauaagcuagcguugugaaaauuucagaaac

SEQ ID NO: 315249 - RNA, 65 nt, Homo Sapiens
aucagcaacaacacaaugacgaacacaaauuuaaaauaagcuauaggguagauuuucaagagugu

SEQ ID NO: 315250 - RNA, 65 nt, Homo Sapiens
agaaucccuuuggacagucuuucuggaaauguguuauaagcuagguuuuuuuuuuuugagaguua

SEQ ID NO: 315251 - RNA, 65 nt, Homo Sapiens
ucauauuaguauuaauacuauugauuuuuuuaaacauaagcuaaaaagacaaaauuuuucuuuuc

SEQ ID NO: 315252 - RNA, 65 nt, Homo Sapiens
agguucagaaucagaauuuuauaguuggcaccauuauaagcuauaauuagauuuucccauuucua

SEQ ID NO: 315253 - RNA, 65 nt, Homo Sapiens
caccuuauuugcuuaucauaaguagauccuugggcauaagcuaagacugcccagcauacuuaaaa

SEQ ID NO: 315254 - RNA, 65 nt, Homo Sapiens
ccauaucaugaaaaauucuacuuagcuauauuauuauaagcuacauuugcccugaauuugaacac

SEQ ID NO: 315255 - RNA, 65 nt, Homo Sapiens
augauuagagacaucaccgcuaaaaaacuacauuuauaagcuaggauuuguuauaugcaaauauu

SEQ ID NO: 315256 - RNA, 65 nt, Homo Sapiens
cagaaaaguaaccucuucuuaaguggaauauucuaauaagcuaccuuuuguaagugccauguuua

SEQ ID NO: 315257 - RNA, 65 nt, Homo Sapiens
uuauuacacguuccaguuugucucgcuguguaggcauaagcuaaugguuuauuuucagaaagcug

SEQ ID NO: 315258 - RNA, 65 nt, Homo Sapiens
augcauaaagaaugcaccacucaacuuuuuuauucauaagcuaauauuuuuuuaaaguuacauua

SEQ ID NO: 315259 - RNA, 65 nt, Homo Sapiens
ggcuuuucauacacaggacacuccaauuuguuccaauaagcuaagugacuuugcuaauggcuauu

SEQ ID NO: 315260 - RNA, 65 nt, Homo Sapiens
aaacaauagauaugaguguuaagcuauaccuaauuauaagcuauaggacaaggaguucuggugac

SEQ ID NO: 315261 - RNA, 65 nt, Homo Sapiens
agguauagaaaaacauuuuauuauaccaauaauuaauaagcuauuauauagguaaauauagugau

SEQ ID NO: 315262 - RNA, 65 nt, Homo Sapiens
gaaacacuaacccaaaaacuuucuccauugcagaaauaagcuagguuuuugguaugaaauugucu

SEQ ID NO: 315263 - RNA, 65 nt, Homo Sapiens
ggagccggugccgccugaauggcuacuuguguggcauaagcuagaagcggugcaguggcaagggg

SEQ ID NO: 315264 - RNA, 65 nt, Homo Sapiens
aaaauacucauuuuuuaaaaaaauuaagaaucuauauaagcuauaaaaacguucccacaaugcac

SEQ ID NO: 315265 - RNA, 65 nt, Homo Sapiens
auagcuuguuuuguugaaauagguauaagcagaagauaagcuaauuuaacauuugaguuuguuua

SEQ ID NO: 315266 - RNA, 65 nt, Homo Sapiens
cuuugucacuugaaaggaaugaaacugaaugcaaaauaagcuaauuccauauuugcugugcauca

SEQ ID NO: 315267 - RNA, 65 nt, Homo Sapiens
gagugauggggcacucaagaaaguucagaggaggcauaagcuauggagguuggaaaggaagaaag

SEQ ID NO: 315268 - RNA, 65 nt, Homo Sapiens
aaaggaacaaaacgagcaugaauuaacucuucaauauaagcuaugaaguaauaguugguugugaa

SEQ ID NO: 315269 - RNA, 65 nt, Homo Sapiens
uagaaaaucugugcuagaaccugugucuuauuccuauaagcuauguguucagacugaaacuggag

SEQ ID NO: 315270 - RNA, 65 nt, Homo Sapiens
aggaggcuggcuuguccccuccucacucccuucccauaagcuauagacccgaggaaacucagagu

SEQ ID NO: 315271 - RNA, 65 nt, Homo Sapiens
auauauugcaaaaacauaguuuguaaaggcauucuauaagcuauuuauguaaaaucaauaaaagu

SEQ ID NO: 315272 - RNA, 65 nt, Homo Sapiens
uucuguucuguaaagugauacuuccagaaaaauacauaagcuaguucaggggaguaggagaaugu

SEQ ID NO: 315273 - RNA, 65 nt, Homo Sapiens
caugauguaaaaaccuuacuuaugcagauuaauauauaagcuacaacaguuacaauaaauaacuu

SEQ ID NO: 315274 - RNA, 65 nt, Homo Sapiens
uucuuauuucuuucagaagacauuucugaaaucuuauaagcuacuuaagcuacguugucaguuuu

SEQ ID NO: 315275 - RNA, 65 nt, Homo Sapiens
ccagccacuucugaauacaauauguagcugauuuaauaagcuaguuagugaauggaaaauaagug

SEQ ID NO: 315276 - RNA, 65 nt, Homo Sapiens
gcuccuucuccaagacucaggccugugggcacucuauaagcuaguugaucuuggcucuccugaua

SEQ ID NO: 315277 - RNA, 65 nt, Homo Sapiens
aggguaagggaauagaucacucagauguauuuuagauaagcuauuuagccuuugauggaaucaua

SEQ ID NO: 315278 - RNA, 65 nt, Homo Sapiens
gcuugauucacagauggaugugaccuaaaggauaaauaagcuauuacuuaugugcugaucucuug

SEQ ID NO: 315279 - RNA, 65 nt, Homo Sapiens
ugcuguauuuuccccccacuucucuauguaacgauauaagcuaucggagggugguaccgaucagg

SEQ ID NO: 315280 - RNA, 65 nt, Homo Sapiens
gguaaaauaaugccaguaaucaacaagagauugaaauaagcuaugcaagcaaacaacaauaucaa

SEQ ID NO: 315281 - RNA, 65 nt, Homo Sapiens
uagaacuuugaagggcauuaacaugaucacacuguauaagcuacugcuggucgacuuuuuaaaaa

SEQ ID NO: 315282 - RNA, 65 nt, Homo Sapiens
agcaaaauaaaacauagcaaugcauguuauguuuaauaagcuacuuauguuucucuuugauuauu

SEQ ID NO: 315283 - RNA, 65 nt, Homo Sapiens
aauuauaugguccuugucuaaaaguggacacuuaaauaagcuauaaagaauaggaugggauaaag

SEQ ID NO: 315284 - RNA, 65 nt, Homo Sapiens
accacuguagggauuuuguuucuuuguuccuuuucauaagcuaauacauuuguuacccauggugu

SEQ ID NO: 315285 - RNA, 65 nt, Homo Sapiens
gauaguuacaaaauacaaaaguucaaccucuuacaauaagcuaaacgcaaugucauuuuuaaaaa

SEQ ID NO: 315286 - RNA, 65 nt, Homo Sapiens
guauacuaguuuuucuuucugauugucagugauuuauaagcuauaaaugaccaagguccucagac

SEQ ID NO: 315287 - RNA, 65 nt, Homo Sapiens
guucccuuugaaauaacgcuugccacaaguauauaauaagcuauauuaauuguguuuugcauaaa

SEQ ID NO: 315288 - RNA, 65 nt, Homo Sapiens
aacaguauuucguugauaucauuuugaaaauauauauaagcuaaauguuuugugagguaauacug

SEQ ID NO: 315289 - RNA, 65 nt, Homo Sapiens
aauguuguuuucugucaauaggccacauguuggaaauaagcuaguguuuuucuuuuaauaggcug

SEQ ID NO: 315290 - RNA, 65 nt, Homo Sapiens
gcaacacagacacuccuaggugacccauguauugcauaagcuaaaguaugagauacagaacuugg

SEQ ID NO: 315291 - RNA, 65 nt, Homo Sapiens
gagauaauugucuaguuagggggcagcuggagaaaauaagcuaaguuugcaauaacagaguacac

SEQ ID NO: 315292 - RNA, 63 nt, Homo Sapiens
cccccagaacugugagaaauaaauuucuguuguuuauaagcuacccaguuuaugccauuuugu

SEQ ID NO: 315293 - RNA, 65 nt, Homo Sapiens
acagcauuguacaauuagcuuaguaacacuauggaauaagcuaaaacauaucacaguuuuuacau

SEQ ID NO: 315294 - RNA, 65 nt, Homo Sapiens
gagagaauuuaucacaccacguccuuauuggaauaauaagcuacuugccuugaguuuauaauuca

SEQ ID NO: 315295 - RNA, 65 nt, Homo Sapiens
gacguaguaguuuguaaaaacguuuucuaugacgcauaagcuagcaugccuaugauuuauuuccu

SEQ ID NO: 315296 - RNA, 65 nt, Homo Sapiens
ugaaugccuugaaaguauuaagaauacugcaaaggauaagcuaauaucgucaaugugaauagcuu

SEQ ID NO: 315297 - RNA, 65 nt, Homo Sapiens
uugacaguugccaguggaaaaacagugcucaugucauaagcuaugaaaaaaauaauuaaaaaaga

SEQ ID NO: 315298 - RNA, 65 nt, Homo Sapiens
auaaaacaaaacaaaacaaaaaaaacuugugccugauaagcuaaggcucauuuauuuuuaaaagg

SEQ ID NO: 315299 - RNA, 65 nt, Homo Sapiens
uacauguucagguuuuuuuuuuuuuuuuuuuuucaauaagcuauuuuuuuucuuuucuuauuuua

SEQ ID NO: 315300 - RNA, 65 nt, Homo Sapiens
ggucuugaucaaaucaaacuaagaagaccuuagaaauaagcuaccauuuugccacagagcagcuu

SEQ ID NO: 315301 - RNA, 65 nt, Homo Sapiens
ucaacuuagaaucugugauugcuuacaggaagaagauaagcuacuaauagaaaauguuuuuaccu

SEQ ID NO: 315302 - RNA, 65 nt, Homo Sapiens
uggaucaguggcuuaaauaauaauacuauuuagaaauaagcuaauugcuuaacugucuucacuau

SEQ ID NO: 315303 - RNA, 65 nt, Homo Sapiens
uguccaggguauugcuccccguucacuaaugugaaauaagcuauguuuauaaaaaucuugaguuu

SEQ ID NO: 315304 - RNA, 65 nt, Homo Sapiens
uguucuaauuuuuaccgaugcuguguaggcauuuuauaagcuacauuggauuuauucugccaaac

SEQ ID NO: 315305 - RNA, 65 nt, Homo Sapiens
uaaaugaggcuagagaggcagaggaaggcuagucaauaagcuaaggaggcuccuugccugagucc

SEQ ID NO: 315306 - RNA, 65 nt, Homo Sapiens
ggaacaaagagauugugguggugcuaaaggaggccauaagcuacacagaggccuuggguguucca

SEQ ID NO: 315307 - RNA, 65 nt, Homo Sapiens
aagaguauuaauuuauugggccgcacccccagaauauaagcuaucgucagggccccccugcccca

SEQ ID NO: 315308 - RNA, 65 nt, Homo Sapiens
ugggaaaaauuauaguguaugaauaaagaaauccuauaagcuauuauacauugguguuuugauug

SEQ ID NO: 315309 - RNA, 65 nt, Homo Sapiens
augcugggccugaacauaaugcugggauugcaggcauaagcuacccugccuuggccucccgaagu

SEQ ID NO: 315310 - RNA, 65 nt, Homo Sapiens
acucacugucaguauuaaggcccagcagccuguugauaagcuacccugucucaccaugugcuggu

SEQ ID NO: 315311 - RNA, 65 nt, Homo Sapiens
gcaacccugggggccaguucaggugguccccaaccauaagcuaggucugaaaguuacacagccaa

SEQ ID NO: 315312 - RNA, 65 nt, Homo Sapiens
gccuugaauugauuuuuuucucauaaaauagucugauaagcuaauuuuuaaaaagaaaugccauu

SEQ ID NO: 315313 - RNA, 65 nt, Homo Sapiens
cagccccaucugcgggggcagugcucacccacaccauaagcuacugccauccuggcccagggcau

SEQ ID NO: 315314 - RNA, 65 nt, Homo Sapiens
uguuguugguauuaugcugcagaguugugugcuacauaagcuauuauuaaaugugagugggcauu

SEQ ID NO: 315315 - RNA, 65 nt, Homo Sapiens
uuguugcacuuuaaacauuuaucugcuuggucuugauaagcuaugcuuuugcuaggucacagagg

SEQ ID NO: 315316 - RNA, 65 nt, Homo Sapiens
accagacagacaacacugggaaaaagacagggcugauaagcuaacgcuaccucaaccaaugccaa

SEQ ID NO: 315317 - RNA, 65 nt, Homo Sapiens
gggaguuugguaacguaacuugguuucgcuaccuuauaagcuaugcuuuuguucccauaccaguu

SEQ ID NO: 315318 - RNA, 65 nt, Homo Sapiens
aggaauucaagguugguucaacaucuaaaaaucaaauaagcuaauauacagucaguucucauuau

SEQ ID NO: 315319 - RNA, 65 nt, Homo Sapiens
aggaauucaagguuuguucaacaucuaaaaaucaaauaagcuaauaaagaaaagagguuuauacu

SEQ ID NO: 315320 - RNA, 65 nt, Homo Sapiens
aacuuauauuaauaguaauuuguaaaguugguuggauaagcuauccguguugcagguucauggau

SEQ ID NO: 315321 - RNA, 65 nt, Homo Sapiens
uuucuaacuacaaagguuuauguuuagacuuuaacauaagcuauuuguucuuagcucaaugagca

SEQ ID NO: 315322 - RNA, 65 nt, Homo Sapiens
auauuuuuuucauauguguaggugaaaugguaugaauaagcuaacaggaauaguaucuaaaaaca

SEQ ID NO: 315323 - RNA, 65 nt, Homo Sapiens
cauuuuaacaauguuaauucuugcagaccaugaacauaagcuaccuucccauuuauaugcgucuu

SEQ ID NO: 315324 - RNA, 65 nt, Homo Sapiens
uuuauucuuauuugauguggcacuaugcccggccaauaagcuauaggacuacaggcaugcgcagc

SEQ ID NO: 315325 - RNA, 65 nt, Homo Sapiens
gcgguuccuggacuaaguccggcucguucaagaacauaagcuaccaccuucucccuccccacccc

SEQ ID NO: 315326 - RNA, 65 nt, Homo Sapiens
ugaauacuugaaccauaaaauuagggaguauucuaauaagcuaguuuuuuuuuaaucuacugcau

SEQ ID NO: 315327 - RNA, 65 nt, Homo Sapiens
aaaaaaaaguucuguguuugaauauucucgauuuaauaagcuaaaauagcggaugccuccucagg

SEQ ID NO: 315328 - RNA, 65 nt, Homo Sapiens
ucagcagaaugagauauuaagcuauuuaugauucuauaagcuauuauuacaggaacugugcauca

SEQ ID NO: 315329 - RNA, 65 nt, Homo Sapiens
uuuguauacacauuugcauauacccacauggggacauaagcuaauuuuuuuacaggacacagaau

SEQ ID NO: 315330 - RNA, 65 nt, Homo Sapiens
gcaaagcgaugucagagggcgguuuugagcuuucuauaagcuauagcuuuguuuauuucacccgu

SEQ ID NO: 315331 - RNA, 65 nt, Homo Sapiens
ugugcccagcagcucuuggucaaagcacuguugcuauaagcuaucucugggaugccucuaggccc

SEQ ID NO: 315332 - RNA, 65 nt, Homo Sapiens
cauacaaaucuuuuagguaguagaguuuaacguguauaagcuaaaagugaaaguaacugaguguu

SEQ ID NO: 315333 - RNA, 65 nt, Homo Sapiens
cuuaaaaacaaacaaacaaaaaaaaaaucuguuagauaagcuaucaaaaugcagcuguuguuuug

SEQ ID NO: 315334 - RNA, 65 nt, Homo Sapiens
aaaacagagucucaagacccccgcucuggacugucauaagcuagcacccgugguaagcgggacga

SEQ ID NO: 315335 - RNA, 65 nt, Homo Sapiens
gugaguguguguguacgcacacacacuggggauagauaagcuaccugguaaaggguuugaacauu

SEQ ID NO: 315336 - RNA, 65 nt, Homo Sapiens
auaaauagagaaaaagugugugugagcaauaaugcauaagcuacugauaacuugcuuacagcaga

SEQ ID NO: 315337 - RNA, 65 nt, Homo Sapiens
uuuuuccucaaagcucaauuagaauagcaaaauuuauaagcuaguaaacuuauacuauagcaagu

SEQ ID NO: 315338 - RNA, 65 nt, Homo Sapiens
accuugugacuuuuagguaagaaauaggcaugaugauaagcuaugcagauuauuaaaaagcuuga

SEQ ID NO: 315339 - RNA, 65 nt, Homo Sapiens
acuucauuuguuugcuguucaucuuuugggagggaauaagcuagagccaucaauacaauuccgcu

SEQ ID NO: 315340 - RNA, 65 nt, Homo Sapiens
accuaaacugacaaugaauugguuauacaucaugcauaagcuacacuuuuauauuaguuuauauu

SEQ ID NO: 315341 - RNA, 65 nt, Homo Sapiens
ugaauaaacguaaaggacaaguaaacaauuugaugauaagcuacaguuuuucuuagaaaguaaau

SEQ ID NO: 315342 - RNA, 65 nt, Homo Sapiens
ucacugaccagcauggacucaggcaacugguaaugauaagcuaugagcuccagugcuuuugccaa

SEQ ID NO: 315343 - RNA, 65 nt, Homo Sapiens
uauuugaccccaaaaccuuuuucauauacccaauaauaagcuacagaacuaauauucugcaaaug

SEQ ID NO: 315344 - RNA, 65 nt, Homo Sapiens
aaauuuaaaaacuugugauuuaagaagaggaaaagauaagcuacagauugagaugaauuugcaaa

SEQ ID NO: 315345 - RNA, 65 nt, Homo Sapiens
cacgacucaaaauauucuaaaacaccacugaaaucauaagcuauuagcaaucaauuauacccacc

SEQ ID NO: 315346 - RNA, 65 nt, Homo Sapiens
agaaucaguuauaaaaguauuuugauguaauguuuauaagcuauguuguuauuacuuuguguaac

SEQ ID NO: 315347 - RNA, 65 nt, Homo Sapiens
uucuagugacccaugugucaaugccuuuguuguauauaagcuaaaguuggugaguuuaguugugc

SEQ ID NO: 315348 - RNA, 65 nt, Homo Sapiens
uaagggcgaugauuauuauuaacaucuggagaagcauaagcuaaucaacucauuuuauucucggc

SEQ ID NO: 315349 - RNA, 65 nt, Homo Sapiens
cacagaaaauaaaauguuugcuauaauacagugcuauaagcuauguugcuuauacacucugauuc

SEQ ID NO: 315350 - RNA, 65 nt, Homo Sapiens
aucacuauagguccauuucuaaugaguugaauuacauaagcuaaggacugcagacuacugcuuug

SEQ ID NO: 315351 - RNA, 65 nt, Homo Sapiens
cagaugucugcaguuauaaacuggaaugcauacauauaagcuaaauuugcccuuugcuugaauuc

SEQ ID NO: 315352 - RNA, 64 nt, Homo Sapiens; identical to SEQ ID NO: 125643

SEQ ID NO: 315353 - RNA, 64 nt, Homo Sapiens; identical to SEQ ID NO: 125644

SEQ ID NO: 315354 - RNA, 64 nt, Homo Sapiens; identical to SEQ ID NO: 125645

SEQ ID NO: 315355 - RNA, 64 nt, Homo Sapiens; identical to SEQ ID NO: 125646

SEQ ID NO: 315356 - RNA, 64 nt, Homo Sapiens; identical to SEQ ID NO: 125647

SEQ ID NO: 315357 - RNA, 64 nt, Homo Sapiens; identical to SEQ ID NO: 125648

SEQ ID NO: 315358 - RNA, 64 nt, Homo Sapiens; identical to SEQ ID NO: 125649

SEQ ID NO: 315359 - RNA, 64 nt, Homo Sapiens; identical to SEQ ID NO: 125650

SEQ ID NO: 315360 - RNA, 64 nt, Homo Sapiens; identical to SEQ ID NO: 125651

SEQ ID NO: 315361 - RNA, 64 nt, Homo Sapiens; identical to SEQ ID NO: 125652

SEQ ID NO: 315362 - RNA, 64 nt, Homo Sapiens; identical to SEQ ID NO: 125653

SEQ ID NO: 315363 - RNA, 64 nt, Homo Sapiens; identical to SEQ ID NO: 125654

SEQ ID NO: 315364 - RNA, 64 nt, Homo Sapiens; identical to SEQ ID NO: 125655

SEQ ID NO: 315365 - RNA, 64 nt, Homo Sapiens; identical to SEQ ID NO: 125656

SEQ ID NO: 315366 - RNA, 62 nt, Homo Sapiens
aguuaagugauuucugaagcguuuguguguguguugaucagguugugugauauuuuugcuug

SEQ ID NO: 315367 - RNA, 62 nt, Homo Sapiens
uaaauacauugaaguuuacauuuccaugugcuguugaucaacggcgccaccuguguuugcug

SEQ ID NO: 315368 - RNA, 62 nt, Homo Sapiens
cuuuuaaauaacugguugugacaaagcuuguuguugaucagauucacuguuucaucauauuu

SEQ ID NO: 315369 - RNA, 62 nt, Homo Sapiens
agacuuaauuaacuaauauaguauuuucuaagguugaucaucuuauaccacgaaucguuaau

SEQ ID NO: 315370 - RNA, 62 nt, Homo Sapiens
ugagggaaguaaagacagugaagggguggaggguugaucagggcacaguggacagggagacc

SEQ ID NO: 315371 - RNA, 62 nt, Homo Sapiens
acuguuucacagcacaaacucaucuuuacaguguugaucaaugcaucaguuaagaaauaaug

SEQ ID NO: 315372 - RNA, 62 nt, Homo Sapiens
aaccuacugggcuacuaauacuucucucagcaguugaucaaauacaauagaccauguaagcu

SEQ ID NO: 315373 - RNA, 62 nt, Homo Sapiens
aggggugugggagcagagaaaaaaaugaauauguugaucauugcgugacauauacuaaauaa

SEQ ID NO: 315374 - RNA, 62 nt, Homo Sapiens
uacuuuuuaguaauuucuuuacuguaaaucauguugaucauggcauacuucuaggauagcua

SEQ ID NO: 315375 - RNA, 62 nt, Homo Sapiens
aaauuuaagagaagaccuagacuacugcuaauguugaucagcaauaauuuauuauuaaggua

SEQ ID NO: 315376 - RNA, 62 nt, Homo Sapiens
ggcaaugaaaaauucucagucuccaguuuucaguugaucacuuuuaacaauuccaaaggaau

SEQ ID NO: 315377 - RNA, 62 nt, Homo Sapiens
gaugaguugggcuuaaugcaagcaugaaauauguugaucaguaauuuugcuaaaugcuuauc

SEQ ID NO: 315378 - RNA, 62 nt, Homo Sapiens
cgaggucaggaguucaagacaggccaaggcggguugaucaccuguaaucccagcacuuuggg

SEQ ID NO: 315379 - RNA, 62 nt, Homo Sapiens
aucucagucuucaaaagauaccacuugauuuaguugaucaccccauccagaaaauuacaacu

SEQ ID NO: 315380 - RNA, 62 nt, Homo Sapiens
gcugagagagaaucuuggaaacacacauaccuguugaucaugggcccugcagaauuggcccu

SEQ ID NO: 315381 - RNA, 62 nt, Homo Sapiens
accuuuagaugaauucccugugagugagagaaguugaucaccccaggaauuagucacuaaga

SEQ ID NO: 315382 - RNA, 62 nt, Homo Sapiens
gugauucuucagaugcccuucccaacugguuaguugaucaagaauuuuggggguggggguug

SEQ ID NO: 315383 - RNA, 62 nt, Homo Sapiens
cugugguugaggaagugguguuuagaaugucaguugaucagcuagauuuguguccacacuac

SEQ ID NO: 315384 - RNA, 62 nt, Homo Sapiens
accauaauuuugcucauugaaggcuaucuccaguugaucauugggaugagcaucuuugugca

SEQ ID NO: 315385 - RNA, 62 nt, Homo Sapiens
ggcaaguguggauccuuuggggccugaaucugguugaucagauccucccucuucuaagccuu

SEQ ID NO: 315386 - RNA, 62 nt, Homo Sapiens
uuuuuuuggaagaugcaauucguacauuuccuguugaucaaugucuccuuguuuuucuaggu

SEQ ID NO: 315387 - RNA, 62 nt, Homo Sapiens
ucacucucuggccuaaaaccaugcauugcauaguugaucaaggccagagcuaucuuccuaaa

SEQ ID NO: 315388 - RNA, 62 nt, Homo Sapiens
augugcaaagacugacuacuuuucuugguaauguugaucauuugcuggauguaaauuguucu

SEQ ID NO: 315389 - RNA, 62 nt, Homo Sapiens
ugggcaaauuuuacguaaagaaggaacaugacguugaucauuauagauauauuuuaguaaaa

SEQ ID NO: 315390 - RNA, 62 nt, Homo Sapiens
cugaaaaacgguuuuuagucgguguagcagcaguugaucagauuaaauuuggcucuaaaguu

SEQ ID NO: 315391 - RNA, 62 nt, Homo Sapiens
ccagguugaauauuugccauucuuugagcaguguugaucaagcauuuuguauaauuuuuuuu

SEQ ID NO: 315392 - RNA, 62 nt, Homo Sapiens
aauguggaccuuagaauacaguuuugaguagaguugaucaaaaucaauuaaaauagucucuu

SEQ ID NO: 315393 - RNA, 62 nt, Homo Sapiens
agucagguucggggugcaugggcuguggugguguugaucaguugcuccaguguuugaaauaa

SEQ ID NO: 315394 - RNA, 62 nt, Homo Sapiens
agcaguuucagagaacuuuuugcaugcuuaugguugaucaguuaaaaaagaauguuacagua

SEQ ID NO: 315395 - RNA, 62 nt, Homo Sapiens
ucucguucuguuguccaggauggagugcagugguugaucauagcucccgggcuguagucucc

SEQ ID NO: 315396 - RNA, 62 nt, Homo Sapiens
ggaggcugagaccaugaugcagaaggucagccguugaucaauuucaccaugccccagacgcc

SEQ ID NO: 315397 - RNA, 62 nt, Homo Sapiens
acugaucuuauuggucugaucagccaggaccaguugaucagagaucuuugcaacacuccaac

SEQ ID NO: 315398 - RNA, 62 nt, Homo Sapiens
ggaggcaaaagaauuuagaguauccucuuauuguugaucaaacuuuaucugaugaagccaaa

SEQ ID NO: 315399 - RNA, 62 nt, Homo Sapiens
guauggguucuccauauagcacaaaaaaucaaguugaucagaugguagaucaagcauuacac

SEQ ID NO: 315400 - RNA, 62 nt, Homo Sapiens
aucauuggaacauggggacgcugaauaaagcaguugaucagcgcaagaagaaagaugggaaa

SEQ ID NO: 315401 - RNA, 62 nt, Homo Sapiens
uuucauacauuuuugcuuaucccauaaguacaguugaucaaagucauaguagguaaaugcuu

SEQ ID NO: 315402 - RNA, 62 nt, Homo Sapiens
uuguaaacuuuuauuuuuacucuuuacguugaguugaucaauuuuccauacuaagauuuuca

SEQ ID NO: 315403 - RNA, 62 nt, Homo Sapiens
agcaagauuccguaagcugagaacucuggacaguugaucagcuuuaccuauggugcuuugcc

SEQ ID NO: 315404 - RNA, 62 nt, Homo Sapiens
gucucagauacuugggaggcugaggugggaggguugaucacuugaggcugagaggucaaggu

SEQ ID NO: 315405 - RNA, 62 nt, Homo Sapiens
gaagagagaacuuucugugaguagccauguguguugaucagauacaguuuuucugagaucuu

SEQ ID NO: 315406 - RNA, 62 nt, Homo Sapiens
gcuuuuugucaaguagcaugagaagaaaaaaaguugaucauacuucaacguuauauauguac

SEQ ID NO: 315407 - RNA, 62 nt, Homo Sapiens
ugacuguccccguaaaaagucagaaucuguuuguugaucaagcauugccaguuuucuucauu

SEQ ID NO: 315408 - RNA, 62 nt, Homo Sapiens
cagcuucaaucacaauaugcggucauuaagauguugaucacaguuaugagaggauuuaguua

SEQ ID NO: 315409 - RNA, 62 nt, Homo Sapiens
uuaccgaauaagguaccaagaucacaaauaguguugaucagaucuuacaaguuuauguggca

SEQ ID NO: 315410 - RNA, 62 nt, Homo Sapiens
gguugcgaagagauucuuaaaaguaucuguguguugaucaucaguuuuacaaaaacaccuau

SEQ ID NO: 315411 - RNA, 62 nt, Homo Sapiens
cucacucugucacccaggcuggaguacaguggguugaucauggcucacugcauccuugacuu

SEQ ID NO: 315412 - RNA, 62 nt, Homo Sapiens
gcuguaguacugagguuugaggaaaaauaaauguugaucagcagaccacguauuuaaaauuc

SEQ ID NO: 315413 - RNA, 62 nt, Homo Sapiens
aacuacuucagcuacuugcauguuugccaucuguugaucaggagcacugcaugugugauggu

SEQ ID NO: 315414 - RNA, 62 nt, Homo Sapiens
ugugacacuuacugguuaaacuuuuaaguacuguugaucagugugugauuuuuguuuguuuc

SEQ ID NO: 315415 - RNA, 62 nt, Homo Sapiens
uucaguaaaguugaucuguaauggaaugauagguugaucagaguaaaguucuuguacaaaaa

SEQ ID NO: 315416 - RNA, 62 nt, Homo Sapiens
aggaaagugguuuauaggccauucauacuuaaguugaucacuugcccaugguggacauuuuu

SEQ ID NO: 315417 - RNA, 62 nt, Homo Sapiens
auucucuuaaaguugauaucuuaauauuuuguguugaucauuauuuccauucuuaaugugaa

SEQ ID NO: 315418 - RNA, 62 nt, Homo Sapiens
acguuauuaaaauuguaauaccuagguaguugguugaucacaguuuguuaauuguauaaaaa

SEQ ID NO: 315419 - RNA, 62 nt, Homo Sapiens
cuuuacugugcuuauuuuuuuaagaaaaaaguguugaucaaccauucgaccuauaagaagcc

SEQ ID NO: 315420 - RNA, 62 nt, Homo Sapiens
guugcuaguagcuuggcagcaaugaggucacuguugaucagugcuuaagauuuugaugcaua

SEQ ID NO: 315421 - RNA, 62 nt, Homo Sapiens
aacucacccuaaaucugaacggagacugauagguugaucagaaguagggccucuguaaaauu

SEQ ID NO: 315422 - RNA, 62 nt, Homo Sapiens
uuacuguagauuuuuacugaaaggauuuuuugguugaucaggaauguaauuucacaacaccu

SEQ ID NO: 315423 - RNA, 62 nt, Homo Sapiens
gcacagaacagguucaaauagacugagagacuguugaucaaaacauaaaaugacagcaaaga

SEQ ID NO: 315424 - RNA, 62 nt, Homo Sapiens
uggcagaaaagcaguuagacugaauucaaccaguugaucaaaguaacccaaugguagauaaa

SEQ ID NO: 315425 - RNA, 62 nt, Homo Sapiens
uuguauaaaaugaaguuuuuaaauugucaggaguugaucaugaggacaguagcauuaaauaa

SEQ ID NO: 315426 - RNA, 62 nt, Homo Sapiens
uggaaaggcagcucuaaaugucaaucagccuaguugaucagcuuauugucuagugaaacucg

SEQ ID NO: 315427 - RNA, 62 nt, Homo Sapiens
gguccuuggugugacccucugaaugguccaggguugaucacacucuggguuuauuacauggc

SEQ ID NO: 315428 - RNA, 62 nt, Homo Sapiens
aaauuaucuuuccuccaauaaauaaaaacggaguugaucaagguaucgucagacaugagaau

SEQ ID NO: 315429 - RNA, 62 nt, Homo Sapiens
ggcauccgagugguguccugugugggcugauaguugaucacacauugugcuuuugauuuuug

SEQ ID NO: 315430 - RNA, 62 nt, Homo Sapiens
aauaaaaucagugcuguaggaagauggacuguguugaucauggguguaagcaacccaguuua

SEQ ID NO: 315431 - RNA, 62 nt, Homo Sapiens
accuguggaaaaccucuggcagcaacaacucuguugaucagacuuaggccugaaggacaaga

SEQ ID NO: 315432 - RNA, 62 nt, Homo Sapiens
uguacuuaaaacaucugauaauuauuuguacuguugaucacaacuaagguuugacugcuaua

SEQ ID NO: 315433 - RNA, 62 nt, Homo Sapiens
uaugaaauguuacuucguucaagauauuuacuguugaucaguggcuaggaagugaaaggauc

SEQ ID NO: 315434 - RNA, 62 nt, Homo Sapiens
aaaaauaaaggggcuacagauucuaacaaacuguugaucagcuaacauaccugcagcugcuu

SEQ ID NO: 315435 - RNA, 62 nt, Homo Sapiens
gaugccaccugguuagcaccaagaggggcgacguugaucauauucagagcccuuuguuaaau

SEQ ID NO: 315436 - RNA, 62 nt, Homo Sapiens
gaaagggaaacuuacuccuaagucaaucuugaguugaucagauggauuuuucauaccuauaa

SEQ ID NO: 315437 - RNA, 62 nt, Homo Sapiens
uagguuuuuuuuuaaaccacaaagcaacaucuguugaucauuagaacaaaggaaaaauauag

SEQ ID NO: 315438 - RNA, 62 nt, Homo Sapiens
aguuuugcguggguucugcucuuccucccuauguugaucagugucaugugagcauaagccaa

SEQ ID NO: 315439 - RNA, 62 nt, Homo Sapiens
ccucuugcauugauucaguuauugagauauucguugaucaccuccuauuucccaggcacugu

SEQ ID NO: 315440 - RNA, 62 nt, Homo Sapiens
ugugacauugcacaucuaaauaccacauuuaaguugaucauuaauaugcaaugguagaucag

SEQ ID NO: 315441 - RNA, 62 nt, Homo Sapiens
cugaaaggauucacuuuugacuuuauaugacaguugaucaagaacagguacuaccccuuuuu

SEQ ID NO: 315442 - RNA, 62 nt, Homo Sapiens
auaccucacuaucauuucaaaagguuaaaugaguugaucacuaucucugcucugugcuccuc

SEQ ID NO: 315443 - RNA, 62 nt, Homo Sapiens
uggggcucagcuuccaaggugcucaccugguuguugaucagagagcguguccguugugaucc

SEQ ID NO: 315444 - RNA, 62 nt, Homo Sapiens
ugaggucaggaguuugagacaggccgaggcagguugaucaccuguauucucagcacuuuggg

SEQ ID NO: 315445 - RNA, 62 nt, Homo Sapiens
gucuucaaguugaacaucaaggcaaaccucuuguugaucauaugcuuuucuuauuuuagucg

SEQ ID NO: 315446 - RNA, 62 nt, Homo Sapiens
uguaaaugugaccuuguacacuaugcuauauuguugaucaaguugguaaaaaauaaaaaauu

SEQ ID NO: 315447 - RNA, 62 nt, Homo Sapiens
cagagccucaguucuguacucuugggccgauuguugaucaucgauacuuauaggugucagcc

SEQ ID NO: 315448 - RNA, 62 nt, Homo Sapiens
acauggaguugauuuuaugauaaaauaaaaauguugaucaaguucuacuucaccuaaaaaaa

SEQ ID NO: 315449 - RNA, 62 nt, Homo Sapiens
ugguagcaaacugguucuuucggagccauccuguugaucaugcagcuccaccaaaccuuagg

SEQ ID NO: 315450 - RNA, 62 nt, Homo Sapiens
gcaaucacuguguuguauauaauaguucauagguugaucacucauaauaauugacucuaagg

SEQ ID NO: 315451 - RNA, 62 nt, Homo Sapiens
uucuauaagcuauuuauguaaaaucaauaaaaguugaucauaauuaaacuguaucaguugag

SEQ ID NO: 315452 - RNA, 62 nt, Homo Sapiens
ucugcuuuucaaaguuuaucaagcaaaaugaaguugaucaaaagauaaaucacuucaaaacc

SEQ ID NO: 315453 - RNA, 62 nt, Homo Sapiens
uuuccacaaagaauuagguggugaaauggcuaguugaucauuguacuuuuguucuauagccu

SEQ ID NO: 315454 - RNA, 62 nt, Homo Sapiens
cccacugcgaccuuccuuucagaaacgaaguuguugaucaggauuaacagaacaggaauauc

SEQ ID NO: 315455 - RNA, 62 nt, Homo Sapiens
uuagcagguugcagcuuggaaaaaaucaaaacguugaucacuuagaggcuuucaaagcugug

SEQ ID NO: 315456 - RNA, 62 nt, Homo Sapiens
aaugaucuuucuccauacugacuuuuaacaauguugaucauugaggcuaaauuaauauauau

SEQ ID NO: 315457 - RNA, 62 nt, Homo Sapiens
aaaaaugcauuugaccaggauaaaugagguauguugaucauggcuuugcuuuauaucuugau

SEQ ID NO: 315458 - RNA, 62 nt, Homo Sapiens
acauucagcagggacucgugaaacagcaggauguugaucagauguuuugggagguuaugcag

SEQ ID NO: 315459 - RNA, 62 nt, Homo Sapiens
uagaucaaagcaaauguggacugaaucugcuuguugaucaguguugaagaaagugcaaaagg

SEQ ID NO: 315460 - RNA, 62 nt, Homo Sapiens
ggggaugggguuggggagacguuuacaaagagguugaucauuuaauaaccucucaguuuggg

SEQ ID NO: 315461 - RNA, 62 nt, Homo Sapiens
caaauggggucauucuugucugaucuguacaaguugaucaaaaaagaaaauuaaacuuucuu

SEQ ID NO: 315462 - RNA, 62 nt, Homo Sapiens
ugagauucagcaauucacaaauguuuaauuggguugaucaaauaauuggcugcaauuauuua

SEQ ID NO: 315463 - RNA, 62 nt, Homo Sapiens
uacauccaaaaguauaguuuaacaacuguugaguugaucacaugauguucgguuguguuguc

SEQ ID NO: 315464 - RNA, 62 nt, Homo Sapiens
aguuucuagaauuuuauaucauuggaugauauguugaucagccuuauguggaagaacuguga

SEQ ID NO: 315465 - RNA, 62 nt, Homo Sapiens
ggaucuuuaggaggaacccacacacccuacaaguugaucaugcaggaacugaaaaccagucu

SEQ ID NO: 315466 - RNA, 62 nt, Homo Sapiens
cuguugccuuggaacccacggaagaacucauuguugaucacaaagccaaaaacagagacagg

SEQ ID NO: 315467 - RNA, 62 nt, Homo Sapiens
ccguuauguugccucaaauauuguacauuucuguugaucacgauauaggaacuaaguuaaac

SEQ ID NO: 315468 - RNA, 62 nt, Homo Sapiens
uccucucaugguacucugcugagcuuuccagaguugaucauuuuucaucauugucuucagga

SEQ ID NO: 315469 - RNA, 62 nt, Homo Sapiens
cauguagaguagguauuuuuuauagauugaagguugaucaauuuuuuaauacuuucaagaga

SEQ ID NO: 315470 - RNA, 62 nt, Homo Sapiens
uagaggagcucuggcuaaggcuccagacauggguugaucaccuguccuggaggaagagcuag

SEQ ID NO: 315471 - RNA, 62 nt, Homo Sapiens
cccauucacaacuacuuucucgcucccagaagguugaucagauauucuacaaucacagagua

SEQ ID NO: 315472 - RNA, 62 nt, Homo Sapiens
aaaucuucaggggugcuaauccuguugcaucaguugaucauacuaacgagaacgguaaugcg

SEQ ID NO: 315473 - RNA, 62 nt, Homo Sapiens
ucugacaugauuccuuccugcaagaaugggagguugaucagauucuugugccucuaauagcc

SEQ ID NO: 315474 - RNA, 62 nt, Homo Sapiens
ccccugcccaccgcccaggcccuucugauacaguugaucagaucaauggcgacuuuccgugu

SEQ ID NO: 315475 - RNA, 62 nt, Homo Sapiens
aauaacacaggugaaaagaaccguaccagccuguugaucaucggacaacuuccccaggaacc

SEQ ID NO: 315476 - RNA, 62 nt, Homo Sapiens
cccugccugcccugccuagggguccaagcagaguugaucaguucuccuggcgcugagaggug

SEQ ID NO: 315477 - RNA, 62 nt, Homo Sapiens
uuuaugcuuagaugugaaaauaaauguuauuuguugaucauuucuauaauccagagcuuuag

SEQ ID NO: 315478 - RNA, 59 nt, Homo Sapiens
uuaagucuucugaagaaugaagauaaaauguugaucauguauauauauccauagugaau

SEQ ID NO: 315479 - RNA, 62 nt, Homo Sapiens
cuaagcauuucuacugggcaguuucauuuuuaguugaucagguuuuaaguuuuugaacuaaa

SEQ ID NO: 315480 - RNA, 62 nt, Homo Sapiens
ggagcggguuugaacaggacccuggcuuagggguugaucacuuuccuagcaaaggggagacc

SEQ ID NO: 315481 - RNA, 62 nt, Homo Sapiens
uaaaugugguauuugagaagauaaaugauguaguugaucaguauuccuccucuaucaccuuu

SEQ ID NO: 315482 - RNA, 62 nt, Homo Sapiens
cgaauuggaucaaucuugaaacaugugugaaaguugaucauauuuuaauguaaucauuuuga

SEQ ID NO: 315483 - RNA, 62 nt, Homo Sapiens
guggagcuguccacauucggauguuaacauuuguugaucaaugucaaugaaagagauugaga

SEQ ID NO: 315484 - RNA, 62 nt, Homo Sapiens
accuguaaaugaaagaccuuuauuuuugucuuguugaucauuuuuauaauuagucauuuaca

SEQ ID NO: 315485 - RNA, 62 nt, Homo Sapiens
auuguccacuuugacgaucagucauucgguccguugaucaauaauccuucgaucuugucucc

SEQ ID NO: 315486 - RNA, 62 nt, Homo Sapiens
gacauuuucuucuagaggaaaacucugaagcaguugaucaaacuuuguucaacaucagggaa

SEQ ID NO: 315487 - RNA, 62 nt, Homo Sapiens
cugcccuugcccccuuccccagaacaaaacauguugaucaugugcaauauuucuuacugugc

SEQ ID NO: 315488 - RNA, 62 nt, Homo Sapiens
auuaguuuagccucagauucugcagcugagaaguugaucagccaccucugaaggacaugcag

SEQ ID NO: 315489 - RNA, 62 nt, Homo Sapiens
cugguggcuugguuacugugccgugcccggauguugaucaugaaaccucacugaaaccugcu

SEQ ID NO: 315490 - RNA, 62 nt, Homo Sapiens
ccguccucaccgagcuccugcaucccuugaguguugaucaggaggcguccacagcauuguuc

SEQ ID NO: 315491 - RNA, 62 nt, Homo Sapiens
cuagucuugaacucccgaccggguuucuccauguugaucagauuguauuuuuaguagagaug

SEQ ID NO: 315492 - RNA, 62 nt, Homo Sapiens
gaucauacuccccuuguuuccuuuagcauguuguugaucauguguaccauuuucuuguuuaa

SEQ ID NO: 315493 - RNA, 62 nt, Homo Sapiens
gaauaaauaaacgagccuaucaagaagugccaguugaucaaucuuggcacacagcaggcuuu

SEQ ID NO: 315494 - RNA, 62 nt, Homo Sapiens
augauaaaguaaugauggcuguggucuuuccuguugaucauggaggggauugggugaggaca

SEQ ID NO: 315495 - RNA, 62 nt, Homo Sapiens
uauguguauucauauagcuguauacauauucaguugaucauuuuauaaacauaugaaggcau

SEQ ID NO: 315496 - RNA, 62 nt, Homo Sapiens
gagcucaggagagagcuuccugccaagggcagguugaucaguuuucugguagguucugucug

SEQ ID NO: 315497 - RNA, 62 nt, Homo Sapiens
ggugugauuuauguguuaaccucagucacgagguugaucagcuaauugugggaccaaaaugu

SEQ ID NO: 315498 - RNA, 62 nt, Homo Sapiens
cgugccaggaccaccugcaaaagccagggugcguugaucauucucagaucauugauuggccu

SEQ ID NO: 315499 - RNA, 62 nt, Homo Sapiens
aagggggugucaaacagaggcaucagccugcuguugaucacagagagaaauugaguagaaag

SEQ ID NO: 315500 - RNA, 62 nt, Homo Sapiens
agcuuggcuagaaccgguaagauggugacauuguugaucaagacugggaauauaagagagaa

SEQ ID NO: 315501 - RNA, 62 nt, Homo Sapiens
cucucagugggguucuguguugugcaaucuaaguugaucagucugucucauaaagacaggau

SEQ ID NO: 315502 - RNA, 62 nt, Homo Sapiens
augguggcgugcucauuuccaaaggagccaaaguugaucagaaguguaugcuuccugaauaa

SEQ ID NO: 315503 - RNA, 62 nt, Homo Sapiens
cuauuaaaauguguauuucaauaaauuaaaaaguugaucaacaaucgaacccaugagugaac

SEQ ID NO: 315504 - RNA, 62 nt, Homo Sapiens
gagggagccugaguacaggcacagucuucucuguugaucacaggacuucccuccccaaaugg

SEQ ID NO: 315505 - RNA, 64 nt, Homo Sapiens
caagaucgugccacugcacacgggagguggagguugcagucagcgcaggagaaucgcuugaacu

SEQ ID NO: 315506 - RNA, 64 nt, Homo Sapiens
ggcagggaggggaggaaugaacugccauguacacugcagucaagaaaccaagucagaugagaug

SEQ ID NO: 315507 - RNA, 64 nt, Homo Sapiens
acagcaccacuuagguguagcauggauuuuaaacugcagucaguaucagauccuguuugauaaa

SEQ ID NO: 315508 - RNA, 64 nt, Homo Sapiens
uaaaugaacccacugccuuaaaugucuugaauguugcagucaagugucugucauguguugauau

SEQ ID NO: 315509 - RNA, 64 nt, Homo Sapiens
ugggacuuucaaaaaaaaaagaucaggcugaaacugcagucagauuuaugacagcugacaguuu

SEQ ID NO: 315510 - RNA, 64 nt, Homo Sapiens
gaguggguugcuuucucacaaagaugggguucugugcagucacaggucacuuccuugacaacac

SEQ ID NO: 315511 - RNA, 64 nt, Homo Sapiens
acagagagcggcuuccccaucgccuucuggcugcugcagucagcacagaggacagcuuccccau

SEQ ID NO: 315512 - RNA, 64 nt, Homo Sapiens
acagagagcggcuuccccaucgccuucuggccgcugcagucagcacagaggacggcuuccccau

SEQ ID NO: 315513 - RNA, 64 nt, Homo Sapiens
ugauauagcacuagcaaagcaauauuauaagcauugcagucagaaggaggcccaggauccccaa

SEQ ID NO: 315514 - RNA, 64 nt, Homo Sapiens
uuuuaucuccucugcuugaccugaagaaaaucucugcagucaauccacagaacuuuggcacauu

SEQ ID NO: 315515 - RNA, 64 nt, Homo Sapiens
aacacugcacuuuggugcugauuuuuaccugauuugcagucauacucaaaguacuguauuuuuu

SEQ ID NO: 315516 - RNA, 64 nt, Homo Sapiens
aaguaguuuguaauugauauuugggguugaguaaugcagucagacccugaaaccaggugcuucc

SEQ ID NO: 315517 - RNA, 64 nt, Homo Sapiens
ugggaguagacaccugaaacagagacauggagacugcagucacuucucuugagagcaugaauua

SEQ ID NO: 315518 - RNA, 64 nt, Homo Sapiens
cagggacccagucuccuuuuauaagucuguuccaugcagucacuaugugacuaaggguaggggu

SEQ ID NO: 315519 - RNA, 64 nt, Homo Sapiens
cagggacccagacuuacagacaggaacccuuuucugcagucacucuuugcugugagcaggucag

SEQ ID NO: 315520 - RNA, 64 nt, Homo Sapiens
ugguaggaucugaguugacccugcaguucgguuaugcagucaauuauuucuuuuuaagaggagg

SEQ ID NO: 315521 - RNA, 64 nt, Homo Sapiens
ugugcagcacucaaucccacuggaagccuaaugcugcagucagaagcaaugccuggcuggggca

SEQ ID NO: 315522 - RNA, 64 nt, Homo Sapiens
gucagcacggcgcucccagacgagagcccuagcgugcagucagcaaacccuguccacccaaccc

SEQ ID NO: 315523 - RNA, 64 nt, Homo Sapiens
gcagcuugccaggcugucauacaggguagcugugugcagucacucacccacacaaguggagcuc

SEQ ID NO: 315524 - RNA, 64 nt, Homo Sapiens
aauguagcccauuaccacauguagccuuggagacccaggcaaggacaaguacacguguacucac

SEQ ID NO: 315525 - RNA, 64 nt, Homo Sapiens
agagaauccucaccaguucucaccaaccuuccccccaggcaagggcagcugccagcauggugcu

SEQ ID NO: 315526 - RNA, 64 nt, Homo Sapiens
aaacucaaaucuuugucacgcaaacccaaguuguccaggcaaauaaaagaaaacaaaagccaga

SEQ ID NO: 315527 - RNA, 64 nt, Homo Sapiens
caaaacuccuuuauucaaaaagaaauucauauauccaggcaacaaaccaacagaaguuauuuac

SEQ ID NO: 315528 - RNA, 64 nt, Homo Sapiens
ggucccuaugggcuuccgcacaugccgcgggcggccaggcaacgugcgugucucugccaugugg

SEQ ID NO: 315529 - RNA, 64 nt, Homo Sapiens
gcaggggcucugcuuccucagcccuagaggcgagccaggcaagguuggcgacugucauguggcu

SEQ ID NO: 315530 - RNA, 64 nt, Homo Sapiens
ucuuuucaaguuggucaggcuccugcuuguguauccaggcaaccuccccuuggaucugccuuug

SEQ ID NO: 315531 - RNA, 64 nt, Homo Sapiens
aaagacagcagugaugacacgugcuaccccuugcccaggcaaggugauaguuaccuucacaaug

SEQ ID NO: 315532 - RNA, 64 nt, Homo Sapiens
gccaucucuggaugccugauugccaagcucaggaccaggcaaugugacuuugcaucagcaacaa

SEQ ID NO: 315533 - RNA, 64 nt, Homo Sapiens
gugggccugggguaccaagagacuccuugagagaccaggcaaagcaagugauugggacagaggu

SEQ ID NO: 315534 - RNA, 64 nt, Homo Sapiens
gccucuccuucucagugcagggacgucaccccugccaggcaagcccagggcacagaugccagga

SEQ ID NO: 315535 - RNA, 64 nt, Homo Sapiens
ggcuucucccucucagugcgaggcuucaccccugccaggcaagcccagggcauagaugcugaga

SEQ ID NO: 315536 - RNA, 64 nt, Homo Sapiens
gccucucccucucagugcagggacgucaccccugccaggcaagcccagggcacagaggccggga

SEQ ID NO: 315537 - RNA, 64 nt, Homo Sapiens
gccccucccucucagugcgggaacgucaccccugccaggcaagcccagggcacagaugcugcga

SEQ ID NO: 315538 - RNA, 64 nt, Homo Sapiens
agcugugugaccauccagggguggagggggaaaaccaggcaauuucguuccuggaaucaaccaa

SEQ ID NO: 315539 - RNA, 64 nt, Homo Sapiens
ccauggcagggguggauucgggagcugggaguaaccaggcaaagucaaccagaugccuagcucc

SEQ ID NO: 315540 - RNA, 64 nt, Homo Sapiens; identical to SEQ ID NO: 283773

SEQ ID NO: 315541 - RNA, 64 nt, Homo Sapiens; identical to SEQ ID NO: 283774

SEQ ID NO: 315542 - RNA, 64 nt, Homo Sapiens; identical to SEQ ID NO: 283775

SEQ ID NO: 315543 - RNA, 64 nt, Homo Sapiens; identical to SEQ ID NO: 283776

SEQ ID NO: 315544 - RNA, 64 nt, Homo Sapiens; identical to SEQ ID NO: 283777

SEQ ID NO: 315545 - RNA, 64 nt, Homo Sapiens; identical to SEQ ID NO: 283778

SEQ ID NO: 315546 - RNA, 64 nt, Homo Sapiens; identical to SEQ ID NO: 283779

SEQ ID NO: 315547 - RNA, 64 nt, Homo Sapiens; identical to SEQ ID NO: 283780

SEQ ID NO: 315548 - RNA, 64 nt, Homo Sapiens; identical to SEQ ID NO: 283781

SEQ ID NO: 315549 - RNA, 64 nt, Homo Sapiens; identical to SEQ ID NO: 283782

SEQ ID NO: 315550 - RNA, 64 nt, Homo Sapiens; identical to SEQ ID NO: 283783

SEQ ID NO: 315551 - RNA, 64 nt, Homo Sapiens; identical to SEQ ID NO: 283784

SEQ ID NO: 315552 - RNA, 64 nt, Homo Sapiens; identical to SEQ ID NO: 283785

SEQ ID NO: 315553 - RNA, 64 nt, Homo Sapiens; identical to SEQ ID NO: 283786

SEQ ID NO: 315554 - RNA, 64 nt, Homo Sapiens; identical to SEQ ID NO: 283787

SEQ ID NO: 315555 - RNA, 64 nt, Homo Sapiens; identical to SEQ ID NO: 283788

SEQ ID NO: 315556 - RNA, 64 nt, Homo Sapiens; identical to SEQ ID NO: 283789

SEQ ID NO: 315557 - RNA, 64 nt, Homo Sapiens; identical to SEQ ID NO: 283790

SEQ ID NO: 315558 - RNA, 64 nt, Homo Sapiens; identical to SEQ ID NO: 283791

SEQ ID NO: 315559 - RNA, 64 nt, Homo Sapiens; identical to SEQ ID NO: 283792

SEQ ID NO: 315560 - RNA, 64 nt, Homo Sapiens; identical to SEQ ID NO: 283793

SEQ ID NO: 315561 - RNA, 64 nt, Homo Sapiens; identical to SEQ ID NO: 283794

SEQ ID NO: 315562 - RNA, 64 nt, Homo Sapiens; identical to SEQ ID NO: 283795

SEQ ID NO: 315563 - RNA, 64 nt, Homo Sapiens; identical to SEQ ID NO: 283796

SEQ ID NO: 315564 - RNA, 64 nt, Homo Sapiens; identical to SEQ ID NO: 283797

SEQ ID NO: 315565 - RNA, 64 nt, Homo Sapiens; identical to SEQ ID NO: 283798

SEQ ID NO: 315566 - RNA, 64 nt, Homo Sapiens; identical to SEQ ID NO: 283799

SEQ ID NO: 315567 - RNA, 64 nt, Homo Sapiens; identical to SEQ ID NO: 283800

SEQ ID NO: 315568 - RNA, 64 nt, Homo Sapiens; identical to SEQ ID NO: 283801

SEQ ID NO: 315569 - RNA, 64 nt, Homo Sapiens; identical to SEQ ID NO: 283802

SEQ ID NO: 315570 - RNA, 64 nt, Homo Sapiens; identical to SEQ ID NO: 283803

SEQ ID NO: 315571 - RNA, 64 nt, Homo Sapiens; identical to SEQ ID NO: 283804

SEQ ID NO: 315572 - RNA, 64 nt, Homo Sapiens; identical to SEQ ID NO: 283805

SEQ ID NO: 315573 - RNA, 64 nt, Homo Sapiens; identical to SEQ ID NO: 283806

SEQ ID NO: 315574 - RNA, 64 nt, Homo Sapiens; identical to SEQ ID NO: 283807

SEQ ID NO: 315575 - RNA, 64 nt, Homo Sapiens; identical to SEQ ID NO: 283808

SEQ ID NO: 315576 - RNA, 64 nt, Homo Sapiens; identical to SEQ ID NO: 210960

SEQ ID NO: 315577 - RNA, 64 nt, Homo Sapiens; identical to SEQ ID NO: 210961

SEQ ID NO: 315578 - RNA, 64 nt, Homo Sapiens; identical to SEQ ID NO: 210962

SEQ ID NO: 315579 - RNA, 64 nt, Homo Sapiens; identical to SEQ ID NO: 210963

SEQ ID NO: 315580 - RNA, 64 nt, Homo Sapiens; identical to SEQ ID NO: 210964

SEQ ID NO: 315581 - RNA, 64 nt, Homo Sapiens; identical to SEQ ID NO: 210965

SEQ ID NO: 315582 - RNA, 64 nt, Homo Sapiens
uccucguuccucuccuggaugggacagaauguggcguggagaaggucagagccaagagugaaug

SEQ ID NO: 315583 - RNA, 64 nt, Homo Sapiens
gugccgggccauuggcgagagcuucaucaugaagcguggagacagcuuccucgaugggacccgg

SEQ ID NO: 315584 - RNA, 64 nt, Homo Sapiens
acgguggccccugcagaaugcacgaagggagcaccguggagaaggcuacagcugccaggucaug

SEQ ID NO: 315585 - RNA, 64 nt, Homo Sapiens
accacgcccuccaaacagagcccaucacccagggcguggagaugccuggaaggcagaugguacc

SEQ ID NO: 315586 - RNA, 64 nt, Homo Sapiens
uaguuagacaauguccuguugggugguccuguugcguggagaucuccucugguccuuucaaagg

SEQ ID NO: 315587 - RNA, 64 nt, Homo Sapiens
cucgauccuagccugugucagcuggauguguuuacguggagaggcguggccacuuuuuagguca

SEQ ID NO: 315588 - RNA, 60 nt, Homo Sapiens
gagucuaagauucuguaucccugaguucagccuagccacauagccacagagucugagauu

SEQ ID NO: 315589 - RNA, 60 nt, Homo Sapiens
gagucugagauucugaguucagaaugucagccuagccacauauuucaaagccacagcaua

SEQ ID NO: 315590 - RNA, 60 nt, Homo Sapiens
gccuccuacagcccaccugggcccugaguuccuagccaccccacccaccacacugaucca

SEQ ID NO: 315591 - RNA, 60 nt, Homo Sapiens
caccacacugauccagcccuuuccacuccuccuagccaccuccagguggcaucagugucu

SEQ ID NO: 315592 - RNA, 60 nt, Homo Sapiens
ccaaguauaugagaaagguacacccaguguccuagccaggccccucagaaggcugucugg

SEQ ID NO: 315593 - RNA, 60 nt, Homo Sapiens
gucuguucuuguggaccagacucggccaaaccuagccaggcacuugccccagagaagcua

SEQ ID NO: 315594 - RNA, 60 nt, Homo Sapiens
gucucaaaccuguggggaaguuccucaccaccuagccauagcuggggugcugagccugcc

SEQ ID NO: 315595 - RNA, 64 nt, Homo Sapiens
acuagauaggagagacuaauacaagcugggcaaacugacagaauuuagaagcaaaauuaaaagu

SEQ ID NO: 315596 - RNA, 64 nt, Homo Sapiens
ucuucccucuucccuccccaguucgaagguaauacugacagauuuuuuuuuuaaacauuucuga

SEQ ID NO: 315597 - RNA, 64 nt, Homo Sapiens
cuuuugcuaauaccaaaauuuaauugaggaaaaacugacagauguaggcaagaagaggugugag

SEQ ID NO: 315598 - RNA, 64 nt, Homo Sapiens
uagaaccugaggucucauucguguaaaucccagacugacagacuuagccuacagacauggaaca

SEQ ID NO: 315599 - RNA, 64 nt, Homo Sapiens
uuuccauuguuuccugucuuuaaucagucccucacugacagacguggauaaaccauaauuuauu

SEQ ID NO: 315600 - RNA, 64 nt, Homo Sapiens
uacauauugaagaggacaauuacucucauaacagcugacagaaggcaagcaugugggaaauagg

SEQ ID NO: 315601 - RNA, 64 nt, Homo Sapiens
cuggggagggggccaucugcugcgcccggccccacugacagaucugaagagcacaguaggaagg

SEQ ID NO: 315602 - RNA, 64 nt, Homo Sapiens
auuucacaguagugggugggccuguuuuaaggcucugacagauaccacgaaacaugaagcacgu

SEQ ID NO: 315603 - RNA, 64 nt, Homo Sapiens
cacagagaagagaucagagaccaggagaccacugcugacagauaugaagugcauagugcugcuc

SEQ ID NO: 315604 - RNA, 64 nt, Homo Sapiens
ucaaagacacgucuaucagcugguuaagucuugccugacagaacuuuaaccgugugucaagauu

SEQ ID NO: 315605 - RNA, 64 nt, Homo Sapiens
caccaguggugacauccuucagucccucacaucucugacagagcgggacagaauggauauuugg

SEQ ID NO: 315606 - RNA, 64 nt, Homo Sapiens
gucugugccugugauuccagucacccuguaguuacugacagaaauugacuggacugucauugug

SEQ ID NO: 315607 - RNA, 64 nt, Homo Sapiens
cuugaccagaaaaagauuuguuuaccuaccauuucauugguaguauggcccacggugaccauuu

SEQ ID NO: 315608 - RNA, 64 nt, Homo Sapiens
uugguuauaguguuuaggcuagaaaugccucccacauugguaauaaacauuacaaaauacaaug

SEQ ID NO: 315609 - RNA, 64 nt, Homo Sapiens
cuaaacagagaugaggugguaucuucacguagaacauugguauucgcuugagaaaaaaagaaua

SEQ ID NO: 315610 - RNA, 64 nt, Homo Sapiens
cauaaaugauuaauuaaauagcuuuugugucuuacauugguagccagccagccaaggcucuguu

SEQ ID NO: 315611 - RNA, 64 nt, Homo Sapiens; identical to SEQ ID NO: 163826

SEQ ID NO: 315612 - RNA, 64 nt, Homo Sapiens; identical to SEQ ID NO: 163827

SEQ ID NO: 315613 - RNA, 64 nt, Homo Sapiens; identical to SEQ ID NO: 163828

SEQ ID NO: 315614 - RNA, 64 nt, Homo Sapiens; identical to SEQ ID NO: 163829

SEQ ID NO: 315615 - RNA, 64 nt, Homo Sapiens; identical to SEQ ID NO: 163830

SEQ ID NO: 315616 - RNA, 64 nt, Homo Sapiens; identical to SEQ ID NO: 163831

SEQ ID NO: 315617 - RNA, 64 nt, Homo Sapiens; identical to SEQ ID NO: 163832

SEQ ID NO: 315618 - RNA, 64 nt, Homo Sapiens; identical to SEQ ID NO: 163833

SEQ ID NO: 315619 - RNA, 64 nt, Homo Sapiens; identical to SEQ ID NO: 163834

SEQ ID NO: 315620 - RNA, 64 nt, Homo Sapiens; identical to SEQ ID NO: 163835

SEQ ID NO: 315621 - RNA, 64 nt, Homo Sapiens; identical to SEQ ID NO: 163836

SEQ ID NO: 315622 - RNA, 64 nt, Homo Sapiens; identical to SEQ ID NO: 163837

SEQ ID NO: 315623 - RNA, 64 nt, Homo Sapiens; identical to SEQ ID NO: 163838

SEQ ID NO: 315624 - RNA, 64 nt, Homo Sapiens; identical to SEQ ID NO: 163839

SEQ ID NO: 315625 - RNA, 64 nt, Homo Sapiens; identical to SEQ ID NO: 163840

SEQ ID NO: 315626 - RNA, 64 nt, Homo Sapiens; identical to SEQ ID NO: 163841

SEQ ID NO: 315627 - RNA, 64 nt, Homo Sapiens; identical to SEQ ID NO: 163842

SEQ ID NO: 315628 - RNA, 64 nt, Homo Sapiens; identical to SEQ ID NO: 163843

SEQ ID NO: 315629 - RNA, 64 nt, Homo Sapiens; identical to SEQ ID NO: 163844

SEQ ID NO: 315630 - RNA, 64 nt, Homo Sapiens; identical to SEQ ID NO: 163845

SEQ ID NO: 315631 - RNA, 64 nt, Homo Sapiens; identical to SEQ ID NO: 163846

SEQ ID NO: 315632 - RNA, 64 nt, Homo Sapiens; identical to SEQ ID NO: 163847

SEQ ID NO: 315633 - RNA, 64 nt, Homo Sapiens; identical to SEQ ID NO: 163848

SEQ ID NO: 315634 - RNA, 64 nt, Homo Sapiens; identical to SEQ ID NO: 163849

SEQ ID NO: 315635 - RNA, 64 nt, Homo Sapiens; identical to SEQ ID NO: 163850

SEQ ID NO: 315636 - RNA, 64 nt, Homo Sapiens; identical to SEQ ID NO: 163851

SEQ ID NO: 315637 - RNA, 64 nt, Homo Sapiens; identical to SEQ ID NO: 163852

SEQ ID NO: 315638 - RNA, 64 nt, Homo Sapiens; identical to SEQ ID NO: 163853

SEQ ID NO: 315639 - RNA, 64 nt, Homo Sapiens; identical to SEQ ID NO: 163854

SEQ ID NO: 315640 - RNA, 64 nt, Homo Sapiens; identical to SEQ ID NO: 163855

SEQ ID NO: 315641 - RNA, 64 nt, Homo Sapiens; identical to SEQ ID NO: 163856

SEQ ID NO: 315642 - RNA, 64 nt, Homo Sapiens; identical to SEQ ID NO: 163857

SEQ ID NO: 315643 - RNA, 64 nt, Homo Sapiens; identical to SEQ ID NO: 163858

SEQ ID NO: 315644 - RNA, 64 nt, Homo Sapiens; identical to SEQ ID NO: 163859

SEQ ID NO: 315645 - RNA, 64 nt, Homo Sapiens; identical to SEQ ID NO: 163860

SEQ ID NO: 315646 - RNA, 64 nt, Homo Sapiens; identical to SEQ ID NO: 163861

SEQ ID NO: 315647 - RNA, 64 nt, Homo Sapiens; identical to SEQ ID NO: 163862

SEQ ID NO: 315648 - RNA, 64 nt, Homo Sapiens; identical to SEQ ID NO: 163863

SEQ ID NO: 315649 - RNA, 64 nt, Homo Sapiens; identical to SEQ ID NO: 163864

SEQ ID NO: 315650 - RNA, 64 nt, Homo Sapiens; identical to SEQ ID NO: 163865

SEQ ID NO: 315651 - RNA, 64 nt, Homo Sapiens; identical to SEQ ID NO: 163866

SEQ ID NO: 315652 - RNA, 64 nt, Homo Sapiens; identical to SEQ ID NO: 163867

SEQ ID NO: 315653 - RNA, 64 nt, Homo Sapiens; identical to SEQ ID NO: 163868

SEQ ID NO: 315654 - RNA, 64 nt, Homo Sapiens; identical to SEQ ID NO: 163869

SEQ ID NO: 315655 - RNA, 64 nt, Homo Sapiens; identical to SEQ ID NO: 163870

SEQ ID NO: 315656 - RNA, 64 nt, Homo Sapiens; identical to SEQ ID NO: 163871

SEQ ID NO: 315657 - RNA, 64 nt, Homo Sapiens; identical to SEQ ID NO: 163872

SEQ ID NO: 315658 - RNA, 64 nt, Homo Sapiens; identical to SEQ ID NO: 163873

SEQ ID NO: 315659 - RNA, 64 nt, Homo Sapiens; identical to SEQ ID NO: 163874

SEQ ID NO: 315660 - RNA, 64 nt, Homo Sapiens; identical to SEQ ID NO: 163875

SEQ ID NO: 315661 - RNA, 64 nt, Homo Sapiens; identical to SEQ ID NO: 163876

SEQ ID NO: 315662 - RNA, 64 nt, Homo Sapiens; identical to SEQ ID NO: 163877

SEQ ID NO: 315663 - RNA, 64 nt, Homo Sapiens; identical to SEQ ID NO: 163878

SEQ ID NO: 315664 - RNA, 64 nt, Homo Sapiens; identical to SEQ ID NO: 163879

SEQ ID NO: 315665 - RNA, 64 nt, Homo Sapiens; identical to SEQ ID NO: 163880

SEQ ID NO: 315666 - RNA, 64 nt, Homo Sapiens; identical to SEQ ID NO: 163881

SEQ ID NO: 315667 - RNA, 64 nt, Homo Sapiens; identical to SEQ ID NO: 163882

SEQ ID NO: 315668 - RNA, 64 nt, Homo Sapiens; identical to SEQ ID NO: 163883

SEQ ID NO: 315669 - RNA, 64 nt, Homo Sapiens; identical to SEQ ID NO: 163884

SEQ ID NO: 315670 - RNA, 64 nt, Homo Sapiens; identical to SEQ ID NO: 163885

SEQ ID NO: 315671 - RNA, 64 nt, Homo Sapiens; identical to SEQ ID NO: 163886

SEQ ID NO: 315672 - RNA, 64 nt, Homo Sapiens; identical to SEQ ID NO: 163887

SEQ ID NO: 315673 - RNA, 64 nt, Homo Sapiens; identical to SEQ ID NO: 163888

SEQ ID NO: 315674 - RNA, 64 nt, Homo Sapiens; identical to SEQ ID NO: 163889

SEQ ID NO: 315675 - RNA, 64 nt, Homo Sapiens; identical to SEQ ID NO: 163890

SEQ ID NO: 315676 - RNA, 64 nt, Homo Sapiens; identical to SEQ ID NO: 163891

SEQ ID NO: 315677 - RNA, 64 nt, Homo Sapiens; identical to SEQ ID NO: 163892

SEQ ID NO: 315678 - RNA, 64 nt, Homo Sapiens; identical to SEQ ID NO: 163893

SEQ ID NO: 315679 - RNA, 64 nt, Homo Sapiens; identical to SEQ ID NO: 163894

SEQ ID NO: 315680 - RNA, 64 nt, Homo Sapiens; identical to SEQ ID NO: 163895

SEQ ID NO: 315681 - RNA, 64 nt, Homo Sapiens; identical to SEQ ID NO: 163896

SEQ ID NO: 315682 - RNA, 64 nt, Homo Sapiens; identical to SEQ ID NO: 163897

SEQ ID NO: 315683 - RNA, 64 nt, Homo Sapiens; identical to SEQ ID NO: 163898

SEQ ID NO: 315684 - RNA, 64 nt, Homo Sapiens; identical to SEQ ID NO: 163899

SEQ ID NO: 315685 - RNA, 64 nt, Homo Sapiens; identical to SEQ ID NO: 163900

SEQ ID NO: 315686 - RNA, 64 nt, Homo Sapiens; identical to SEQ ID NO: 163901

SEQ ID NO: 315687 - RNA, 64 nt, Homo Sapiens; identical to SEQ ID NO: 163902

SEQ ID NO: 315688 - RNA, 64 nt, Homo Sapiens; identical to SEQ ID NO: 163903

SEQ ID NO: 315689 - RNA, 64 nt, Homo Sapiens; identical to SEQ ID NO: 163904

SEQ ID NO: 315690 - RNA, 64 nt, Homo Sapiens; identical to SEQ ID NO: 163905

SEQ ID NO: 315691 - RNA, 64 nt, Homo Sapiens; identical to SEQ ID NO: 163906

SEQ ID NO: 315692 - RNA, 64 nt, Homo Sapiens; identical to SEQ ID NO: 163907

SEQ ID NO: 315693 - RNA, 64 nt, Homo Sapiens; identical to SEQ ID NO: 163908

SEQ ID NO: 315694 - RNA, 64 nt, Homo Sapiens; identical to SEQ ID NO: 163909

SEQ ID NO: 315695 - RNA, 64 nt, Homo Sapiens; identical to SEQ ID NO: 163910

SEQ ID NO: 315696 - RNA, 64 nt, Homo Sapiens; identical to SEQ ID NO: 163911

SEQ ID NO: 315697 - RNA, 64 nt, Homo Sapiens; identical to SEQ ID NO: 163912

SEQ ID NO: 315698 - RNA, 64 nt, Homo Sapiens; identical to SEQ ID NO: 163913

SEQ ID NO: 315699 - RNA, 64 nt, Homo Sapiens; identical to SEQ ID NO: 163914

SEQ ID NO: 315700 - RNA, 64 nt, Homo Sapiens; identical to SEQ ID NO: 163915

SEQ ID NO: 315701 - RNA, 64 nt, Homo Sapiens; identical to SEQ ID NO: 163916

SEQ ID NO: 315702 - RNA, 64 nt, Homo Sapiens; identical to SEQ ID NO: 163917

SEQ ID NO: 315703 - RNA, 64 nt, Homo Sapiens; identical to SEQ ID NO: 163918

SEQ ID NO: 315704 - RNA, 64 nt, Homo Sapiens; identical to SEQ ID NO: 163919

SEQ ID NO: 315705 - RNA, 64 nt, Homo Sapiens; identical to SEQ ID NO: 163920

SEQ ID NO: 315706 - RNA, 64 nt, Homo Sapiens; identical to SEQ ID NO: 163921

SEQ ID NO: 315707 - RNA, 64 nt, Homo Sapiens; identical to SEQ ID NO: 163922

SEQ ID NO: 315708 - RNA, 64 nt, Homo Sapiens; identical to SEQ ID NO: 163923

SEQ ID NO: 315709 - RNA, 64 nt, Homo Sapiens; identical to SEQ ID NO: 163924

SEQ ID NO: 315710 - RNA, 64 nt, Homo Sapiens; identical to SEQ ID NO: 163925

SEQ ID NO: 315711 - RNA, 64 nt, Homo Sapiens; identical to SEQ ID NO: 163926

SEQ ID NO: 315712 - RNA, 64 nt, Homo Sapiens; identical to SEQ ID NO: 163927

SEQ ID NO: 315713 - RNA, 64 nt, Homo Sapiens; identical to SEQ ID NO: 163928

SEQ ID NO: 315714 - RNA, 64 nt, Homo Sapiens; identical to SEQ ID NO: 163929

SEQ ID NO: 315715 - RNA, 64 nt, Homo Sapiens; identical to SEQ ID NO: 163930

SEQ ID NO: 315716 - RNA, 64 nt, Homo Sapiens; identical to SEQ ID NO: 163931

SEQ ID NO: 315717 - RNA, 64 nt, Homo Sapiens; identical to SEQ ID NO: 163932

SEQ ID NO: 315718 - RNA, 64 nt, Homo Sapiens; identical to SEQ ID NO: 163933

SEQ ID NO: 315719 - RNA, 64 nt, Homo Sapiens; identical to SEQ ID NO: 163934

SEQ ID NO: 315720 - RNA, 64 nt, Homo Sapiens; identical to SEQ ID NO: 163935

SEQ ID NO: 315721 - RNA, 64 nt, Homo Sapiens; identical to SEQ ID NO: 163936

SEQ ID NO: 315722 - RNA, 64 nt, Homo Sapiens; identical to SEQ ID NO: 163937

SEQ ID NO: 315723 - RNA, 64 nt, Homo Sapiens; identical to SEQ ID NO: 163938

SEQ ID NO: 315724 - RNA, 64 nt, Homo Sapiens; identical to SEQ ID NO: 163939

SEQ ID NO: 315725 - RNA, 64 nt, Homo Sapiens; identical to SEQ ID NO: 163940

SEQ ID NO: 315726 - RNA, 64 nt, Homo Sapiens
auaauccaacucaguaugaacagccuuaagccucagcaaagagcugaggagagucaaaaacaug

SEQ ID NO: 315727 - RNA, 64 nt, Homo Sapiens
aaaaccuccgaggaagagaaacugaagggaaaggagcaaagagacaauaucccagaugguaaag

SEQ ID NO: 315728 - RNA, 64 nt, Homo Sapiens
uauucagaaaagagguaaggaacuagcaaagaaaagcaaagaagagaagcagacaccuccagug

SEQ ID NO: 315729 - RNA, 64 nt, Homo Sapiens
agcaaagaaguauucagaaaaccuccagugaacuagcaaagaaaccaagacagcagaagcagac

SEQ ID NO: 315730 - RNA, 64 nt, Homo Sapiens
guagauugagcugaauaaccaugggaagugaccaagcaaagacacucgauuggagucaguugaa

SEQ ID NO: 315731 - RNA, 64 nt, Homo Sapiens
gcaguugugaaaauugcuaauggugccaaggccaagcaaagaguuucagaaaaugacugagaag

SEQ ID NO: 315732 - RNA, 64 nt, Homo Sapiens
aagcacuuuuuaaauggcucuaagaauaagccacagcaaagaauuuaaaguggcuccuuuaauu

SEQ ID NO: 315733 - RNA, 64 nt, Homo Sapiens
auuguuggauacugaaugacagacaaucuuauguagcaaagauuaugccugaaaaggaaaauua

SEQ ID NO: 315734 - RNA, 64 nt, Homo Sapiens
uaaauuuuugaagggcaguuaauguuuagaauugagcaaagauguugggaagcuaauuuuguug

SEQ ID NO: 315735 - RNA, 64 nt, Homo Sapiens
uuggguaucauuuuuguuucguuacuucuagaaaagcaaagaaaaauacaugaacaaauggaaa

SEQ ID NO: 315736 - RNA, 64 nt, Homo Sapiens
gaagacugugaugugugguccccauauguggcucagcaaagacucgagagaucaucccuuuguc

SEQ ID NO: 315737 - RNA, 64 nt, Homo Sapiens
ggguccauguacucagauaaacaugaagaaaauaagcaaagaaaaauggagacugggaaagcaa

SEQ ID NO: 315738 - RNA, 64 nt, Homo Sapiens
uaagcuagaugaugacagugaugaugaugaagaaagcaaagaaggccaagaaaguucuaguagu

SEQ ID NO: 315739 - RNA, 64 nt, Homo Sapiens
agaaguuaaaccacccgauaggccuucgagcaaaagcaaagauccaccgagagaagaagagaaa

SEQ ID NO: 315740 - RNA, 64 nt, Homo Sapiens
guaccgcugcacuccagccucggagguaguggugagcaaagaucaauugcuugaacccaggagg

SEQ ID NO: 315741 - RNA, 64 nt, Homo Sapiens
gaaggcaacaaaggaaacagaccuagagaaagccagcaaagaaugguggccaucuuuuccuacu

SEQ ID NO: 315742 - RNA, 64 nt, Homo Sapiens
uauuucauuguccccagguagacuucuagggaauagcaaagaccauguccuaaagcauuuuggu

SEQ ID NO: 315743 - RNA, 64 nt, Homo Sapiens
uguggacugccgugguccuaguggcauuuguaaaagcaaagagcgcaacccagccagggucuug

SEQ ID NO: 315744 - RNA, 64 nt, Homo Sapiens
auuuuuccuuacucuuugcaaugaugucuuugagagcaaagacugugucugccuucauuagacu

SEQ ID NO: 315745 - RNA, 55 nt, Homo Sapiens
uucaguauugugcugaaagaugaacagcaaagauguguugguuuguuuuuccaga

SEQ ID NO: 315746 - RNA, 64 nt, Homo Sapiens
gaaaccuauuggcagcuucaugagcagcucgcucacucccuaaaguccaggaugucugcacaac

SEQ ID NO: 315747 - RNA, 64 nt, Homo Sapiens
ugacuuugaucaggucacuaucaguccccugcccacucccuacgacagaccuggguucaagucc

SEQ ID NO: 315748 - RNA, 64 nt, Homo Sapiens
ucagaaugcaucccgcaucccugcgcggucccccacucccuacaccagcgguggcuucuugaug

SEQ ID NO: 315749 - RNA, 64 nt, Homo Sapiens
ucagaacgcaucccucaucucugcgccgucccccacucccuacauuucagugcaagucuugaug

SEQ ID NO: 315750 - RNA, 64 nt, Homo Sapiens
cccacucuuccccgccucacuucaugcccaggcagccacagaaaaugggguuaggcuucaugcc

SEQ ID NO: 315751 - RNA, 64 nt, Homo Sapiens
augggguuaggcuucaugcccagggcugguccaggccacagaggcacgaaguuggagaaccuga

SEQ ID NO: 315752 - RNA, 64 nt, Homo Sapiens
uacaagugacgacaaagauucuguuucaaauauagccacagaaauaaaggagggaccaauaucu

SEQ ID NO: 315753 - RNA, 64 nt, Homo Sapiens
uacaagugacgagaaagauucuguuucaaauauagccacagaaauaaagaagggacaacaaucu

SEQ ID NO: 315754 - RNA, 64 nt, Homo Sapiens
uacaacugacgaggaagacucuguuucgaauauagccacagaaauaaaggauggagaaaaaucu

SEQ ID NO: 315755 - RNA, 64 nt, Homo Sapiens
uacaacugaugagaaagauucuguuucgaacauagccacagaaauaaaggauggagaaaaaucu

SEQ ID NO: 315756 - RNA, 64 nt, Homo Sapiens
cuaagauucuguauccucugcugaguucagccuagccacagaguuagccacagagucugagauu

SEQ ID NO: 315757 - RNA, 64 nt, Homo Sapiens
cugagauucugaguucagccagaaugucagccuagccacagaguuauuucaaagccacagcaua

SEQ ID NO: 315758 - RNA, 64 nt, Homo Sapiens
uaagugaccucagguaacauccacagaguugaaagccacagagugaaagccacagaguugaaag

SEQ ID NO: 315759 - RNA, 64 nt, Homo Sapiens
ugaaagccacagaguuaaguccacagaguugaaagccacagaguaccgccaucuuacacgaaag

SEQ ID NO: 315760 - RNA, 64 nt, Homo Sapiens
ugaaagccacagaguugaaacaucuuacacgaaagccacagaguuguccauggcccuauaccgc

SEQ ID NO: 315761 - RNA, 64 nt, Homo Sapiens
gucaccucuuuuacaguuagaaacaccagccgaggccacagaaucccaucccuuuccugaguca

SEQ ID NO: 315762 - RNA, 64 nt, Homo Sapiens
accauugucucaauucaaauccauagauuucgaagccacagagucucucccuggagcagcagac

SEQ ID NO: 315763 - RNA, 64 nt, Homo Sapiens
caccucaggauauucuuuucuacugaauacccuggccacagagcuccagaauggagcuuagugc

SEQ ID NO: 315764 - RNA, 64 nt, Homo Sapiens
uaucaaaaauggugacaucaaugaguauugagaagccacagaaagaauaauuuacaaaaaucaa

SEQ ID NO: 315765 - RNA, 64 nt, Homo Sapiens
cagaagagacaguagucugcauacaucgcugcaggccacagagcagcuuggguuggaagagaga

SEQ ID NO: 315766 - RNA, 64 nt, Homo Sapiens
aauacuagugaaucacccacaaggaaaagccacugccacagaggaggcggguccccuugugcgg

SEQ ID NO: 315767 - RNA, 64 nt, Homo Sapiens
aggaaucaccccucugccccugcagcuggaaugugccacagaggccccaccugaaggguggaug

SEQ ID NO: 315768 - RNA, 64 nt, Homo Sapiens
ucacugggccagucaacggggggcuccugcccaggccacagagaaccugaguucccgggagcug

SEQ ID NO: 315769 - RNA, 64 nt, Homo Sapiens
aagaaagcauuugaucugacaaggugacuucugggccacagauccuuugggagguguuaacuca

SEQ ID NO: 315770 - RNA, 64 nt, Homo Sapiens
gcucaagaauccagcccuaaccuucuuaauauccgccacagaagugaaagcaagcacaacuaaa

SEQ ID NO: 315771 - RNA, 64 nt, Homo Sapiens
cacaccauuacauacacagacgcagccccuccccgccacagagacacacagacacacaaucaca

SEQ ID NO: 315772 - RNA, 64 nt, Homo Sapiens
cacaccauuacacacacauagauacgcccuuccggccacagaaauacacagacacgcaaucgca

SEQ ID NO: 315773 - RNA, 64 nt, Homo Sapiens
cacaccauuacauacacagacacacacccuccccgccacagagagacacagacacaaaaucaca

SEQ ID NO: 315774 - RNA, 64 nt, Homo Sapiens
caccauuacauacacagacacacacacccuccccgccacagagacacacagacacaaaaucaca

SEQ ID NO: 315775 - RNA, 64 nt, Homo Sapiens
cagagacacggucacugauucacacccagucccugccacagaccgucucagacacgcacagugg

SEQ ID NO: 315776 - RNA, 64 nt, Homo Sapiens
agugggccugcugcaugauucacacccagucccugccacagaccgucucagacacgcacagugg

SEQ ID NO: 315777 - RNA, 64 nt, Homo Sapiens; identical to SEQ ID NO: 315776

SEQ ID NO: 315778 - RNA, 64 nt, Homo Sapiens
gaaccuuugaggccuguaaauccaugggcuuugggccacagaaucaccuuuagaucccuucccc

SEQ ID NO: 315779 - RNA, 64 nt, Homo Sapiens
gggggaugauugaauuguucauugggggaguguggccacagaccugguacuucaguuuggaucu

SEQ ID NO: 315780 - RNA, 60 nt, Homo Sapiens
ccuacuacccaucugggugacccggggcaggccacagaggccaggccagggcuggaagga

SEQ ID NO: 315781 - RNA, 64 nt, Homo Sapiens
cucucugugcagccucacagggcuuugccacggagccacagagagaugcuggguccccgaggcc

SEQ ID NO: 315782 - RNA, 64 nt, Homo Sapiens
ccugccccgaguggacucugagggcagguuccaagccacagacgaaccccccagugccuuggcg

SEQ ID NO: 315783 - RNA, 64 nt, Homo Sapiens
cucaccgugccugaguggcaaugcggcugguggugccacagagcgcgccacucucugcccugcc

SEQ ID NO: 315784 - RNA, 64 nt, Homo Sapiens
gcugcccccaccacacacacgagggacagcacaggccacagagggucaggaagccaggcaagga

SEQ ID NO: 315785 - RNA, 64 nt, Homo Sapiens
cccuuccuuacuuguuggggcccccauccccagggccacagaucccagauucucugagcacuuu

SEQ ID NO: 315786 - RNA, 64 nt, Homo Sapiens
ugcacagguagccccgacccucucaggcauuccagccacagaacaucaaagugagcgaguacug

SEQ ID NO: 315787 - RNA, 64 nt, Homo Sapiens
aagcaccuccgguuggaggcacccaggcuugccagccacagagcgccccaaagucaccgucauc

SEQ ID NO: 315788 - RNA, 64 nt, Homo Sapiens; identical to SEQ ID NO: 311016

SEQ ID NO: 315789 - RNA, 64 nt, Homo Sapiens; identical to SEQ ID NO: 311017

SEQ ID NO: 315790 - RNA, 64 nt, Homo Sapiens; identical to SEQ ID NO: 311018

SEQ ID NO: 315791 - RNA, 64 nt, Homo Sapiens; identical to SEQ ID NO: 311019

SEQ ID NO: 315792 - RNA, 64 nt, Homo Sapiens; identical to SEQ ID NO: 311020

SEQ ID NO: 315793 - RNA, 64 nt, Homo Sapiens; identical to SEQ ID NO: 311021

SEQ ID NO: 315794 - RNA, 64 nt, Homo Sapiens; identical to SEQ ID NO: 311022

SEQ ID NO: 315795 - RNA, 64 nt, Homo Sapiens; identical to SEQ ID NO: 311023

SEQ ID NO: 315796 - RNA, 64 nt, Homo Sapiens; identical to SEQ ID NO: 311024

SEQ ID NO: 315797 - RNA, 64 nt, Homo Sapiens; identical to SEQ ID NO: 311025

SEQ ID NO: 315798 - RNA, 64 nt, Homo Sapiens; identical to SEQ ID NO: 311026

SEQ ID NO: 315799 - RNA, 64 nt, Homo Sapiens; identical to SEQ ID NO: 311027

SEQ ID NO: 315800 - RNA, 64 nt, Homo Sapiens; identical to SEQ ID NO: 311028

SEQ ID NO: 315801 - RNA, 64 nt, Homo Sapiens; identical to SEQ ID NO: 311029

SEQ ID NO: 315802 - RNA, 64 nt, Homo Sapiens; identical to SEQ ID NO: 311030

SEQ ID NO: 315803 - RNA, 64 nt, Homo Sapiens; identical to SEQ ID NO: 311031

SEQ ID NO: 315804 - RNA, 64 nt, Homo Sapiens; identical to SEQ ID NO: 311032

SEQ ID NO: 315805 - RNA, 64 nt, Homo Sapiens; identical to SEQ ID NO: 311033

SEQ ID NO: 315806 - RNA, 64 nt, Homo Sapiens; identical to SEQ ID NO: 311034

SEQ ID NO: 315807 - RNA, 64 nt, Homo Sapiens; identical to SEQ ID NO: 250930

SEQ ID NO: 315808 - RNA, 64 nt, Homo Sapiens; identical to SEQ ID NO: 250931

SEQ ID NO: 315809 - RNA, 64 nt, Homo Sapiens; identical to SEQ ID NO: 250932

SEQ ID NO: 315810 - RNA, 64 nt, Homo Sapiens; identical to SEQ ID NO: 250933

SEQ ID NO: 315811 - RNA, 64 nt, Homo Sapiens; identical to SEQ ID NO: 250934

SEQ ID NO: 315812 - RNA, 64 nt, Homo Sapiens; identical to SEQ ID NO: 250935

SEQ ID NO: 315813 - RNA, 64 nt, Homo Sapiens
cagugugcacaucaugugcagacaccuuggaaaccuuucccaagccuuccuggcccacaguggc

SEQ ID NO: 315814 - RNA, 64 nt, Homo Sapiens
cugcccuccagcaauacaugugcagggguugcugcuuucccagugccaggagaacccccgcucc

SEQ ID NO: 315815 - RNA, 64 nt, Homo Sapiens
agcucccuuggauacuauauuguaugauuucuuccuuucccacuaauaugcacauccagaaaaa

SEQ ID NO: 315816 - RNA, 64 nt, Homo Sapiens
agucaacaagcuuaggcagcauugauuuaggucacuuucccagugaggaaaauuucuguguuuu

SEQ ID NO: 315817 - RNA, 64 nt, Homo Sapiens
gugaugcaagcaugccgcaggaagagugggcugucuuucccaggcuggggaagggugcaggcgg

SEQ ID NO: 315818 - RNA, 64 nt, Homo Sapiens
cuacagaacaauggccauucaggguugggugguucuuucccagccgggugugcccagaggcaag

SEQ ID NO: 315819 - RNA, 64 nt, Homo Sapiens
ccagaccagcccucucaccacacccagaagaggccuuucccaucuggagagaagcuuccagacc

SEQ ID NO: 315820 - RNA, 64 nt, Homo Sapiens
gaccagcccuucacacaccacagccaggaggggccuuucccaccuggagagaaacuuccagacc

SEQ ID NO: 315821 - RNA, 64 nt, Homo Sapiens
cagaccauccccucucaccacagccaggagaggccuuucccaccgguagagaaacuuccagacc

SEQ ID NO: 315822 - RNA, 64 nt, Homo Sapiens
gacaagccucucacacaccacagccaggagaggccuuucccaccuggacagaaacuuccagacc

SEQ ID NO: 315823 - RNA, 64 nt, Homo Sapiens
cagaccagccccucacaccacagccaggagaggccuuucccaccuggagagaaacuuccagacc

SEQ ID NO: 315824 - RNA, 64 nt, Homo Sapiens
cagaccagccccucacaccaccgccaggagaggccuuucccaccgggagagaaacuuccagacc

SEQ ID NO: 315825 - RNA, 64 nt, Homo Sapiens
cagaccagccccucacaccacagccaggagaggccuuucccaccgggagagaaacuuccagacc

SEQ ID NO: 315826 - RNA, 64 nt, Homo Sapiens
ccagaccagcccucucacuacagccagaagaggccuuucccaccgggagaggaacuuccagacc

SEQ ID NO: 315827 - RNA, 64 nt, Homo Sapiens
cagaccagcccuucacaccacagccaggagaggccuuucccaccuggagagaaacuuccagacc

SEQ ID NO: 315828 - RNA, 64 nt, Homo Sapiens
uuuuuugaccuuccacuagaaaguucuaucuucccuuucccaccccucuuucacagcccuuuua

SEQ ID NO: 315829 - RNA, 64 nt, Homo Sapiens
guggucguagugguggaguuaagaggcucaaugacuuucccaaggaugaggaaacugaagcuca

SEQ ID NO: 315830 - RNA, 64 nt, Homo Sapiens
ccugcgguaaacacuaaucuaguucccaccucugcuuucccaagccccauacccaugagcaguc

SEQ ID NO: 315831 - RNA, 64 nt, Homo Sapiens
ugugacuuuccuggugcaucugugagagaguguccuuucccaucggugacuggagcaaagcugc

SEQ ID NO: 315832 - RNA, 64 nt, Homo Sapiens
aaaaauugcugcuguagaagggagaugagcuguucuuucccacuuuuaaucuuucacaugaggg

SEQ ID NO: 315833 - RNA, 64 nt, Homo Sapiens
cagggcucaugucugauucuucuggauaguucuucuuucccaacguuaagcccugggaagacgu

SEQ ID NO: 315834 - RNA, 64 nt, Homo Sapiens
ugcuacacccuuuuccagcuugggaguugaucgccuuucccaggaucaccgugggcucccugac

SEQ ID NO: 315835 - RNA, 64 nt, Homo Sapiens
ucacaucuaaccucaucuucuggacaugaagauucuuucccaauguccacaaaauaaccaaucc

SEQ ID NO: 315836 - RNA, 64 nt, Homo Sapiens
cauguggaacuguaaguccaccaugauucugaggcuuucccagcgaagugccuuuugccuccca

SEQ ID NO: 315837 - RNA, 64 nt, Homo Sapiens
gauaaacuggcacccuucuuucuuuaacuucuuucuuucccauuauuaaaguauauuauguaug

SEQ ID NO: 315838 - RNA, 64 nt, Homo Sapiens
uccacagaaauaaguugccauccucagguuggcccuuucccaagcacuguaagugaguggguca

SEQ ID NO: 315839 - RNA, 64 nt, Homo Sapiens
ccuuuucuuccuuuccccugucuucaugccacugcuuucccaugcuucuuucggguuguagggg

SEQ ID NO: 315840 - RNA, 64 nt, Homo Sapiens
gugccaugauacagucugcauuugcacauggugacuuucccacugaggcaggcaagccguggau

SEQ ID NO: 315841 - RNA, 64 nt, Homo Sapiens
aggccaaaaaaaugcugcgccaccauuagaugggcuuucccaauaguagauacagucuucagga

SEQ ID NO: 315842 - RNA, 64 nt, Homo Sapiens
cgggcagaucaucagccuucccccucuuggccuccuuucccacagaccggccagguuagccucu

SEQ ID NO: 315843 - RNA, 64 nt, Homo Sapiens
ugauacugccccuggggugucauccugggucagccuuucccaaguuucugccuccucuuccaca

SEQ ID NO: 315844 - RNA, 64 nt, Homo Sapiens
aucauaaaauuuuuaaaaaucugaauguguauugcuuucccaucuaugcgaaguaugguuucua

SEQ ID NO: 315845 - RNA, 64 nt, Homo Sapiens
gguguccaccagaagaguugagaaacagggguaccuuucccagguuuagauuguaaugauuaac

SEQ ID NO: 315846 - RNA, 64 nt, Homo Sapiens
uauaaaaccuaaaauuaagauaauagagucacagcuuucccagguaggaaaagauucaaagcuc

SEQ ID NO: 315847 - RNA, 64 nt, Homo Sapiens
ggucugcaugucuuuuaucaacugcauuuggggccuuucccauugacugucccauucuccacuc

SEQ ID NO: 315848 - RNA, 64 nt, Homo Sapiens
agaagaaagagaagaaaugaagugaccauccagccuuucccaauuagacuuccucuccuuccac

SEQ ID NO: 315849 - RNA, 64 nt, Homo Sapiens
gggaccagcagagggcgccaacuucaggaguccgcuuucccaccaggcuucauucacccagugg

SEQ ID NO: 315850 - RNA, 64 nt, Homo Sapiens
uuucugcuuugccuucacaaaaguaauguguucccuuucccaccccuugccugacccucaggga

SEQ ID NO: 315851 - RNA, 64 nt, Homo Sapiens
aaggaggucaggcaaaagggaggaguuuucuguccuuucccagguuucacacucaauuugauau

SEQ ID NO: 315852 - RNA, 64 nt, Homo Sapiens
cccauggcccugaaacacacacauuucccccuuccuuucccagaagccacuggccccccauagc

SEQ ID NO: 315853 - RNA, 64 nt, Homo Sapiens
cuuaugguauguagccagcugugcacuuucuucucuuucccaaccccaggaaagguuuuccuua

SEQ ID NO: 315854 - RNA, 64 nt, Homo Sapiens
ccaaccccaggaaagguuuuccuuauuuugugugcuuucccagucccauuccucagcuucuuca

SEQ ID NO: 315855 - RNA, 64 nt, Homo Sapiens
gcuacagcccuuuugacuucgcccgaugaccucccuuucccacuguugguuaauuagaucuggg

SEQ ID NO: 315856 - RNA, 64 nt, Homo Sapiens
gucacuucugcaguccuccuugucaccugcugagcuuucccaguccucuccagacuaauguucc

SEQ ID NO: 315857 - RNA, 64 nt, Homo Sapiens
ccuuuguuccucaauagcuguuccauguucugcccuuucccacaucccugccccuggcuuccuc

SEQ ID NO: 315858 - RNA, 64 nt, Homo Sapiens
uguuggaggcuuuuccaacguuccauguucugcccuuucccacaucccugccccuggcuuccuc

SEQ ID NO: 315859 - RNA, 64 nt, Homo Sapiens
aagaauccaucuuagcgccuugugugccucauuccuuucccaccagucuuucccacgguuuaug

SEQ ID NO: 315860 - RNA, 64 nt, Homo Sapiens
guuuaugugugugccucauuccugacaccuaagucuuucccacgaucccucuucuggcuugggc

SEQ ID NO: 315861 - RNA, 64 nt, Homo Sapiens
cugcugaagaaccagaaaaaagaaagcacaacaccuuucccaugccuccucuggagccuucgcc

SEQ ID NO: 315862 - RNA, 64 nt, Homo Sapiens
ucuucucaauagcccauugacuuagaaacuguuacuuucccauuuuacacacagugaaacugag

SEQ ID NO: 315863 - RNA, 64 nt, Homo Sapiens
ccacagggcuugaagugaagacguguuccgaccccuuucccagcucugggcaccauugcuccag

SEQ ID NO: 315864 - RNA, 64 nt, Homo Sapiens
uccagccuggagggaaggggucuccaggacauuccuuucccagccuggcccagccccaccucag

SEQ ID NO: 315865 - RNA, 64 nt, Homo Sapiens
aauucacgcuuaaacaaccacagcuucagagcugcuuucccagaaacuuugaugauucuauguc

SEQ ID NO: 315866 - RNA, 64 nt, Homo Sapiens
agcuccccuguuccaguucugcccaucugcuacucuuucccaccaggugugacauggucagggg

SEQ ID NO: 315867 - RNA, 64 nt, Homo Sapiens
gcaguaugagguggggcugcaauagaggcugagccggagccaggagccuggguccccuccuccc

SEQ ID NO: 315868 - RNA, 64 nt, Homo Sapiens
ucccaggggcccagagccccgcuuugcaaggauccggagccagcgccccagagaugaaggggca

SEQ ID NO: 315869 - RNA, 62 nt, Homo Sapiens
uaaguguacagugggcuugcauuggggauggggguguguacagaugaagucaguggcuuguc

SEQ ID NO: 315870 - RNA, 62 nt, Homo Sapiens
ugcuagagauaaacuuuccaauuuuuaagcuugguguguacccagggaaguuaucuugguau

SEQ ID NO: 315871 - RNA, 62 nt, Homo Sapiens
gugugaggaugaaauaaugaccuugauuuuuggguguguauugcagaagccucgucgcuuuc

SEQ ID NO: 315872 - RNA, 62 nt, Homo Sapiens
acaagaaagcaaguacaguguggauuucaaaugguguguaacuucagcuccagcugguuuuu

SEQ ID NO: 315873 - RNA, 62 nt, Homo Sapiens
guuauaugggaauuaaaauauguuuaggcagggguguguaaaaagguuaaguuuuuguuucu

SEQ ID NO: 315874 - RNA, 62 nt, Homo Sapiens
ggcauccagcagccacuaacaaacacacaacugguguguaaaaggcaggccuuacauuagaa

SEQ ID NO: 315875 - RNA, 62 nt, Homo Sapiens
acaagauauuuggggaauaaaaauaacagcuugguguguagcaucugcagccacuuggcaaa

SEQ ID NO: 315876 - RNA, 62 nt, Homo Sapiens
uguaugggugugugugggugggugugaguguggguguguacguaccaauaaacaaccugguu

SEQ ID NO: 315877 - RNA, 62 nt, Homo Sapiens
uucccuccaugcugucgucaucgacauauacagguguguacguagguguauguguguacucu

SEQ ID NO: 315878 - RNA, 62 nt, Homo Sapiens
acccuaggcuccccgcccacgucgcugugcuugguguguagggaccccuccccgccacgauc

SEQ ID NO: 315879 - RNA, 62 nt, Homo Sapiens
gggggagaggguagcaaggucccacugggccugguguguagagcauagggaccagucuacua

SEQ ID NO: 315880 - RNA, 62 nt, Homo Sapiens
caacccagugcuuccuaagauacuccccuuaggguguguaucgaaggguuccuaacccaacc

SEQ ID NO: 315881 - RNA, 62 nt, Homo Sapiens
ugccuuucuccugacuggccguggggggaugagguguguauaauagacuugcugaugugcau

SEQ ID NO: 315882 - RNA, 62 nt, Homo Sapiens
augcugucauaucagagucagacuguguccgugguguguauugugacuguccguggaggggu

SEQ ID NO: 315883 - RNA, 62 nt, Homo Sapiens
uaguaagauuacccugagcuuggaccaccccugguguguagcaugcagccuaaaguacagcc

SEQ ID NO: 315884 - RNA, 62 nt, Homo Sapiens
ggggaaagggucuuuccuggugugcaugugcugguguguaagggagggugugggugugcgug

SEQ ID NO: 315885 - RNA, 62 nt, Homo Sapiens
gaccccacccugagguccugcauuucucagucgguguguaaucacguuccagggcccaaagc

SEQ ID NO: 315886 - RNA, 62 nt, Homo Sapiens
auugugcagaauauucuaagaggucagaaauugguguguauaacuacauuuuuagugaugca

SEQ ID NO: 315887 - RNA, 62 nt, Homo Sapiens
ccugcugccucugacuacucagccuuguuuucgguguguaggccccagcugcccacuggaac

SEQ ID NO: 315888 - RNA, 62 nt, Homo Sapiens
aagcacguggagccacaagaaagcuggggggugguguguaagagcuggcugaggcaucgcuc

SEQ ID NO: 315889 - RNA, 62 nt, Homo Sapiens
uguauguggggaguagguguugugagccaugggguguguauucuuucacuuucauuugcugg

SEQ ID NO: 315890 - RNA, 62 nt, Homo Sapiens
auaguugaaacuguagaaagggucagguuggagguguguaauaaaaaagaauuaccuagguu

SEQ ID NO: 315891 - RNA, 62 nt, Homo Sapiens
gucuuccacuucaaugcacauggugcaguuuugguguguaacuuagaaggauugaacuucuu

SEQ ID NO: 315892 - RNA, 62 nt, Homo Sapiens
uuuuaaaucuuuuuuuaacuaauaagauuuacgguguguauuuuauacagaaaugcauuaua

SEQ ID NO: 315893 - RNA, 62 nt, Homo Sapiens
augauuuugcgggggagugguuaugggcuugggguguguagagcaauugccugccuuguacu

SEQ ID NO: 315894 - RNA, 62 nt, Homo Sapiens
caucuggcugucuguccauuagaguauccuaggguguguaucguuguggccccugcaggggc

SEQ ID NO: 315895 - RNA, 62 nt, Homo Sapiens
ucucucacuaccuuucucauugccuuagagcagguguguacauguggaaacccuucucccug

SEQ ID NO: 315896 - RNA, 62 nt, Homo Sapiens
uguguguguguaugcauauaguaguauucugugguguguaugcauuauuuuuuuuuggcuga

SEQ ID NO: 315897 - RNA, 62 nt, Homo Sapiens
aaauuauuuuugaauugaacuuaaugcaggcagguguguaauuuuuauagaaguuugaaaau

SEQ ID NO: 315898 - RNA, 62 nt, Homo Sapiens
gaaauaauauggaauuagcacuaaauuuucaagguguguagaagaaggguaccaguaauaca

SEQ ID NO: 315899 - RNA, 62 nt, Homo Sapiens
uuugaaaguuuacauuuuuuaugcuuuguguugguguguaauuuuuguacucuugguggcua

SEQ ID NO: 315900 - RNA, 62 nt, Homo Sapiens
agucguaggccuuaugauaauuaccccgcggugguguguagaaaaguauguaaauuugcucu

SEQ ID NO: 315901 - RNA, 62 nt, Homo Sapiens
uauuuucuuuaguuuaaucuuggucauguuuugguguguauuuuuaauuuuuuucuuaaauu

SEQ ID NO: 315902 - RNA, 62 nt, Homo Sapiens
uacuaaaaauacaaaaauuagcuggguguggugguguguaccuguagucccagcuacccagg

SEQ ID NO: 315903 - RNA, 62 nt, Homo Sapiens
ccccucccuguuugacuucacgacagacagaugguguguaugaggugagccgaagaucaauu

SEQ ID NO: 315904 - RNA, 62 nt, Homo Sapiens
auacacagacuaucacuaaacuuuguggcacugguguguaaauaaaauuuguaagguugccc

SEQ ID NO: 315905 - RNA, 62 nt, Homo Sapiens
uuucauugcgauuuccuguuuagacugugcaugguguguauaacuggauucccacaguaaua

SEQ ID NO: 315906 - RNA, 62 nt, Homo Sapiens
uguauaugugugcguguggugucucugccauagguguguauguggucaauucagaagaaagu

SEQ ID NO: 315907 - RNA, 62 nt, Homo Sapiens
gugccuaagccuccugaguagcugggaucacagguguguaccaccacgcccagcugauuuuu

SEQ ID NO: 315908 - RNA, 62 nt, Homo Sapiens
uacuuuuagcuucauucucccauauuuugaaggguguguaacuucagcucugcaggauugca

SEQ ID NO: 315909 - RNA, 62 nt, Homo Sapiens
cuugagcagauccagggaucagugagaggagugguguguaccccuaaauccucccaccccag

SEQ ID NO: 315910 - RNA, 62 nt, Homo Sapiens
uauaaggaaaaaaaauagccugccuugggacagguguguaauguuagugugcaugacuaaug

SEQ ID NO: 315911 - RNA, 62 nt, Homo Sapiens
cauacucuguacauuuuucugagagaaugaaugguguguauauauauuuggaaacucuuggu

SEQ ID NO: 315912 - RNA, 62 nt, Homo Sapiens
aacucaccugaaugggacuuucgcugcuugaugguguguacaaacccuaauugaugagaggc

SEQ ID NO: 315913 - RNA, 62 nt, Homo Sapiens
ggccaaguuuugcuuguugugugcauuugauugguguguauuagcucccagggaaaaacgaa

SEQ ID NO: 315914 - RNA, 62 nt, Homo Sapiens
uagacugauuacacugaggugaggcuacaagggguguguaaccguguaacacgugaaggcaa

SEQ ID NO: 315915 - RNA, 62 nt, Homo Sapiens
cuggccccuuugguuuccgugucauccuuuuugguguguaggacaaggagccagggaauugg

SEQ ID NO: 315916 - RNA, 62 nt, Homo Sapiens
ugagguuagggugaggggucaggguuuaggaggguguguauguugggaggacaggcuaguug

SEQ ID NO: 315917 - RNA, 62 nt, Homo Sapiens
auaguaaaacuagccuuucacauuaagguuuugguguguauuuuguuaaauaacuaacaugc

SEQ ID NO: 315918 - RNA, 62 nt, Homo Sapiens
cuacagcagaaguucugagccugaccacagaugguguguaaucuaucaaacacaccccuggc

SEQ ID NO: 315919 - RNA, 62 nt, Homo Sapiens
uacacacccagagauggagcacaaaggugacggguguguagguuauaccugagcccaguaca

SEQ ID NO: 315920 - RNA, 62 nt, Homo Sapiens
uuguaaguacuuuugugcauggguggggguuggguguguaauuuuucuucuguuuuuauuga

SEQ ID NO: 315921 - RNA, 62 nt, Homo Sapiens
gggcaaaaugccaaaaagcaccuggauaggaggguguguacauacuuggcaugaaagggugc

SEQ ID NO: 315922 - RNA, 62 nt, Homo Sapiens
ucauuaaaaaauauaaauaugugcuuuuuuuugguguguauuuuugugaauuaucugcaugu

SEQ ID NO: 315923 - RNA, 62 nt, Homo Sapiens
gaggggaugaaucggaacgacuguuggacagugguguguauuagaggaugcucacuguaaga

SEQ ID NO: 315924 - RNA, 62 nt, Homo Sapiens
uuacacuuucugcacaucuccuuucgaaaucugguguguauuauucucuuuuucauacuaag

SEQ ID NO: 315925 - RNA, 62 nt, Homo Sapiens
uguaccuuucagcauccuagcaugacucuuuagguguguaugagaaagcuguuuaagaaggc

SEQ ID NO: 315926 - RNA, 62 nt, Homo Sapiens
cuucuucaaaauuguacacagucuuccagcacgguguguacauuuugaccuguucagugucu

SEQ ID NO: 315927 - RNA, 62 nt, Homo Sapiens
cauggauuaguuuuccugacaaagcauguuuugguguguagucuuacuuuuuagaaauagcu

SEQ ID NO: 315928 - RNA, 62 nt, Homo Sapiens
gucaaagauguguucaggcauuccagguaacagguguguauguaaaguuaaaaauaggcuuu

SEQ ID NO: 315929 - RNA, 62 nt, Homo Sapiens
ucaagaagaaaguuguauaagcuauugauaaggguguguaucuuaauguuguugaguuuugu

SEQ ID NO: 315930 - RNA, 62 nt, Homo Sapiens
agcccuucuuuccacagaagcuccagguagaggguguguaaguagauaggccaugggcacug

SEQ ID NO: 315931 - RNA, 62 nt, Homo Sapiens
cagcaguugaaggaagagagugcauggcaccugguguguaacgacacaaucagcacaacugg

SEQ ID NO: 315932 - RNA, 62 nt, Homo Sapiens
acacuggacaggguucucuaagcagugaggcugguguguaugauugucuuaaaauuuuuuaa

SEQ ID NO: 315933 - RNA, 62 nt, Homo Sapiens
aggcuaugauuucucuugcagaucggggaagggguguguaccacacauccccaggcaggaca

SEQ ID NO: 315934 - RNA, 62 nt, Homo Sapiens
auaccaauuaguuuuauauaguacuuauguuugguguguaauuauuacauuguacagaaucu

SEQ ID NO: 315935 - RNA, 62 nt, Homo Sapiens
uguagucacagguacuuggggccgggugaggugguguguaccaaaaaaagaaaaaagaaaaa

SEQ ID NO: 315936 - RNA, 62 nt, Homo Sapiens
uuacaaauuauaauuuauguccuuguuaaaaugguguguacccugcaccaacacugucguau

SEQ ID NO: 315937 - RNA, 62 nt, Homo Sapiens
gcagggagcugcgccuuccuggggugcccggugguguguagagaaaagcugcuuguuuacuc

SEQ ID NO: 315938 - RNA, 62 nt, Homo Sapiens
aaaucuucuauuguguggaaaauguugugaaggguguguaggugugguacauguguauguca

SEQ ID NO: 315939 - RNA, 62 nt, Homo Sapiens
uuacgagaaaaagaaggggaaugguggggaaugguguguaccgauauauaguauuucuuuag

SEQ ID NO: 315940 - RNA, 62 nt, Homo Sapiens
uaaagagauaggggagaaaaguucuuauuuaugguguguaugccagggacauggacuugggu

SEQ ID NO: 315941 - RNA, 62 nt, Homo Sapiens
aaaguccacauguaaauuuaggcugcaucccagguguguagccaauggaacaaaacucaucu

SEQ ID NO: 315942 - RNA, 62 nt, Homo Sapiens
ccaagguuaccaacuaccuaaaggaugucccggguguguacaggggccugggcuguggacag

SEQ ID NO: 315943 - RNA, 62 nt, Homo Sapiens
caaauaauacuugaccagcuuuuaccaaauaugguguguauuaaagguaauauaauuuuagg

SEQ ID NO: 315944 - RNA, 62 nt, Homo Sapiens
gauguuucauuuugguuuuaaccauuccaaucgguguguagugucaguauuuuuccuuuuua

SEQ ID NO: 315945 - RNA, 62 nt, Homo Sapiens
uuuuauacgauguuuguuauaguuuccaugaagguguguaugccagaguugggagauaagau

SEQ ID NO: 315946 - RNA, 62 nt, Homo Sapiens
aggagucccuaacuuucuuaucccaugagagagguguguaaaggagaaagcuagaggugaac

SEQ ID NO: 315947 - RNA, 62 nt, Homo Sapiens
aaaauauucuuuguaugauugauuuuucauuugguguguaaggaaaucuuuauuaauguuua

SEQ ID NO: 315948 - RNA, 62 nt, Homo Sapiens
auuacuguaauacuucugcauuggcauucuuugguguguagagauaguugacuuucuaucuu

SEQ ID NO: 315949 - RNA, 62 nt, Homo Sapiens
uuucaggggcuucacauggaggaaaguuccaggguguguauguccaucugugcauaaggaga

SEQ ID NO: 315950 - RNA, 62 nt, Homo Sapiens
ugaaaguggggugagguuccaaagaaacguaggguguguaugcaggauaauagguuuuucau

SEQ ID NO: 315951 - RNA, 62 nt, Homo Sapiens
ccaaggcccccuggcugugcccagggaaggaggguguguacccagaggaggugcuggcggcc

SEQ ID NO: 315952 - RNA, 62 nt, Homo Sapiens
ugguaaaaccuguucuccauugaccacaggcugguguguaggcuugaaugcugguacuauug

SEQ ID NO: 315953 - RNA, 62 nt, Homo Sapiens
guuagccuugcuggggccauaauaugcuucaggguguguaaaagaagaaaucucuuuguggc

SEQ ID NO: 315954 - RNA, 62 nt, Homo Sapiens; identical to SEQ ID NO: 315953

SEQ ID NO: 315955 - RNA, 62 nt, Homo Sapiens
gcauuuuguuaaugcacauucuguuuguuuaagguguguaagauacacacccuucuagauga

SEQ ID NO: 315956 - RNA, 62 nt, Homo Sapiens
uugcugauugcauuuccucucauuaacaauuggguguguaauaaaaagcauuguacuucauc

SEQ ID NO: 315957 - RNA, 62 nt, Homo Sapiens
cagcccauuagguuaaacaccaaagaaagacugguguguacugaauaggaaagggaaguuuu

SEQ ID NO: 315958 - RNA, 62 nt, Homo Sapiens
ucuaguuugcacauccagaacggcgaaggcuggguguguauuccacuaacugaaauauggca

SEQ ID NO: 315959 - RNA, 62 nt, Homo Sapiens
uaguggauccuggauggaacuguuguaacauagguguguagaagauaccagauuugauauaa

SEQ ID NO: 315960 - RNA, 62 nt, Homo Sapiens
cuuuugugugugugcgcaggagaaaccagcaggguguguacaaaacuuaacauucuuguaau

SEQ ID NO: 315961 - RNA, 62 nt, Homo Sapiens
uauacacacacacacauguaguuacagcuggagguguguauagccugcugagcucugguuag

SEQ ID NO: 315962 - RNA, 62 nt, Homo Sapiens
aguaauuacacgaggcaaacaaaauuugcucggguguguagcgccuuuaaagauacagugug

SEQ ID NO: 315963 - RNA, 62 nt, Homo Sapiens
uugaucugcauugacaccagcucgccuggauggguguguauuggacaggugaauaccugcuc

SEQ ID NO: 315964 - RNA, 62 nt, Homo Sapiens
ggggaaaauagcuaaaagucaaauauuaguuugguguguauuuguaaaacuugaagccauaa

SEQ ID NO: 315965 - RNA, 62 nt, Homo Sapiens
uguagccugaagaacuggaguuggaaggaugugguguguaccgccuguguugugcaaaagaa

SEQ ID NO: 315966 - RNA, 62 nt, Homo Sapiens
uuuuguaaguuguaacuugauacuuaaccuaugguguguacuucuuccuaauaucaggcgcc

SEQ ID NO: 315967 - RNA, 62 nt, Homo Sapiens
gcaggugggcuggacuucuaccugcccucaaggguguguauauuguauaggggcaacuguau

SEQ ID NO: 315968 - RNA, 62 nt, Homo Sapiens
gcgccugcugcugugacccguuuuggaaaacugguguguaccgaggcgcugacugcacggcu

SEQ ID NO: 315969 - RNA, 62 nt, Homo Sapiens
augacagcuuuccuucacacacuauuuuuguggguguguauauaucugauuugggaagaauu

SEQ ID NO: 315970 - RNA, 62 nt, Homo Sapiens
uggaggccaguguuggggagccuguggaggcagguguguagaauuguguucgggaggugggg

SEQ ID NO: 315971 - RNA, 62 nt, Homo Sapiens
ucacuagggcaguggggagaugcucuccuguugguguguauggauucugugccaucugaaca

SEQ ID NO: 315972 - RNA, 62 nt, Homo Sapiens
cuuguauaacuuuguaaauacauagaaaauuggguguguauacucuguggcaaagcgugucc

SEQ ID NO: 315973 - RNA, 62 nt, Homo Sapiens
uuugcaaauuguuuccuuuaaugguuuugucagguguguaaagcauacauauguguguauau

SEQ ID NO: 315974 - RNA, 62 nt, Homo Sapiens
gauguguaauccaguaaaaucucccuuuuucggguguguaugugggcaugugcccauuucua

SEQ ID NO: 315975 - RNA, 62 nt, Homo Sapiens
uuauucugaagaauaaaccuagcuggcaugcugguguguaccuguaguccuagcuauuuggg

SEQ ID NO: 315976 - RNA, 62 nt, Homo Sapiens
gcauaaugaauauaauuuacccaguggacaaagguguguaccaagugaauuuaaauaauugg

SEQ ID NO: 315977 - RNA, 62 nt, Homo Sapiens
ugugacgucgggcauucauauaggaagaacgcgguguguaacacuguguacaccucaaauac

SEQ ID NO: 315978 - RNA, 62 nt, Homo Sapiens
uacugcgucuguccacacucgauugggccccagguguguaugaggcgcucugguaaggugcu

SEQ ID NO: 315979 - RNA, 62 nt, Homo Sapiens
ggaggggggagaacuaaaugcacaauguauuugguguguagguaugucuuuauuccuuauuu

SEQ ID NO: 315980 - RNA, 62 nt, Homo Sapiens
gguaacauggggaaaaugcuguccacauuuaugguguguauagaacaaaaaugggaggaggu

SEQ ID NO: 315981 - RNA, 62 nt, Homo Sapiens
cucaugugguuugcacagccaaaaagcaaacugguguguauugccccuaugugggauuuuuu

SEQ ID NO: 315982 - RNA, 62 nt, Homo Sapiens
ggccucccgggagccacugucugaggacaguggguguguacucuuguguuguguguuucugu

SEQ ID NO: 315983 - RNA, 62 nt, Homo Sapiens
ggacaucucuuccagaguuaucccacuggcuugguguguauacauuaggggaggauaaucug

SEQ ID NO: 315984 - RNA, 62 nt, Homo Sapiens
guccuguguauguguggguguguguguauuuggguguguaaauguugguucuuccacuacug

SEQ ID NO: 315985 - RNA, 62 nt, Homo Sapiens
uagauuccauauuaaugaggagaaagaguguugguguguagggguagggggcacagaacacc

SEQ ID NO: 315986 - RNA, 62 nt, Homo Sapiens
uugagucuuuaacaaagugauacccaaaugcagguguguaggagcccuuuccccuagacauc

SEQ ID NO: 315987 - RNA, 62 nt, Homo Sapiens
aacugugauaacuguugccccaggacaugaaagguguguauggcugugaggagugagugaga

SEQ ID NO: 315988 - RNA, 62 nt, Homo Sapiens
uggcaaagagcucuucaaauauucuuucaaacgguguguauuaucuuccaaggaaaaacaua

SEQ ID NO: 315989 - RNA, 62 nt, Homo Sapiens
cuguugguuugaaguguuagacuauagccccugguguguaaauaauguacauagagugagaa

SEQ ID NO: 315990 - RNA, 62 nt, Homo Sapiens
ucuagcugugucuaccauguauucuuagaagggguguguaugauauugaugauaguugaaau

SEQ ID NO: 315991 - RNA, 62 nt, Homo Sapiens
acuuaacaccuggacuuuuaguguagcauggggguguguacaagaaggagaugaaggagugu

SEQ ID NO: 315992 - RNA, 62 nt, Homo Sapiens
gcgugcuguaguggaaguuugcuuggaacacagguguguacacacuggggggguuggggugg

SEQ ID NO: 315993 - RNA, 62 nt, Homo Sapiens
uguccauguguggauguuggggcuugggggaagguguguaucgcuuucaagcaaaaugccug

SEQ ID NO: 315994 - RNA, 62 nt, Homo Sapiens
uuuguaaauguuaugcacucacgacugcugcugguguguauuagaauuaauagcccuuagca

SEQ ID NO: 315995 - RNA, 62 nt, Homo Sapiens
ugacacaaaaguuauuuacagcacacuuuuuggguguguaaacugccagccucucacaucuu

SEQ ID NO: 315996 - RNA, 62 nt, Homo Sapiens
uaccaaaaauacaaaauguauccagacauggugguguguaccuguagucccagcuacucagg

SEQ ID NO: 315997 - RNA, 62 nt, Homo Sapiens
acagcuugugcugcuugcacaacugagcugcugguguguaccccuuagcagggugucugggg

SEQ ID NO: 315998 - RNA, 62 nt, Homo Sapiens
augauuugucugcuaagaaguucuauucucaggguguguaccuuaccucuucuuggucagaa

SEQ ID NO: 315999 - RNA, 62 nt, Homo Sapiens
cagagaccgagagcaugaguaggggggguguggguguguaacgggcaucugaauacaggagu

SEQ ID NO: 316000 - RNA, 62 nt, Homo Sapiens
aagugcucccuucccagaggaggggccccaucgguguguaagguggccuauuccucugugug

SEQ ID NO: 316001 - RNA, 62 nt, Homo Sapiens
caccuggggggcccuuccccagcauaccugcugguguguaaguguggacuaacccgccgcca

SEQ ID NO: 316002 - RNA, 62 nt, Homo Sapiens
gugguggccuguuugaaaguaaaaaccugcuugguguguagguuccguaucucccuggagaa

SEQ ID NO: 316003 - RNA, 62 nt, Homo Sapiens
uacgcagccuccagggcaccgugaauucuuaggguguguacgaaucuucugcuaauggugau

SEQ ID NO: 316004 - RNA, 62 nt, Homo Sapiens
gcugcuguguaucaaaagacggggggcacagugguguguagucagacagagugaagcuggcu

SEQ ID NO: 316005 - RNA, 62 nt, Homo Sapiens
gggaugguggagugagagccuuugccuuuagggguguguauucacauaguccucagggcuca

SEQ ID NO: 316006 - RNA, 62 nt, Homo Sapiens
auagugucgggcuuccggggaaagcaaucauugguguguauguguaugugcaugcacacacg

SEQ ID NO: 316007 - RNA, 62 nt, Homo Sapiens
ccaccucagccgccgaaguagcugggacuauagguguguaccaucacaccuggcuaauuuuu

SEQ ID NO: 316008 - RNA, 62 nt, Homo Sapiens
ucagacugauggugcccaugaguggagucuccgguguguaccgaagugagcgcugggaacag

SEQ ID NO: 316009 - RNA, 62 nt, Homo Sapiens
aaggggggugacaaggucccaguagaaccagggguguguaugaggcacggggaagguuuugg

SEQ ID NO: 316010 - RNA, 62 nt, Homo Sapiens
agggucauacccccucccucagcuaguggagggguguguaacgguaccccccaaccuccagg

SEQ ID NO: 316011 - RNA, 62 nt, Homo Sapiens
ugaagugguucucaguccccaggaccaaagaagguguguaagguugaccucugguucagcca

SEQ ID NO: 316012 - RNA, 62 nt, Homo Sapiens
uaacuuaucacuggaccacuuauucaaaguaggguguguauguucuccaauuuggcugggau

SEQ ID NO: 316013 - RNA, 62 nt, Homo Sapiens
cagggcauucuguuggccuacgcaugugguaagguguguacuaguguguggaugcgugugaa

SEQ ID NO: 316014 - RNA, 62 nt, Homo Sapiens
acuacauccagcuaaaggagacugggacuacagguguguaccuccuccucucagccugagua

SEQ ID NO: 316015 - RNA, 62 nt, Homo Sapiens
ccuggcaucuguggcauguguguugggugugggguguguacaaaggggguguguguagugug

SEQ ID NO: 316016 - RNA, 62 nt, Homo Sapiens
auaccugcugggccagucccgccuguguccuggguguguaccuaaugccuguccugccucug

SEQ ID NO: 316017 - RNA, 62 nt, Homo Sapiens
aagcaguacuagaaacuuuccaaggagucuuggguguguagccaagaggagccaugagcuau

SEQ ID NO: 316018 - RNA, 62 nt, Homo Sapiens
ccugugugcucacccacagagcaugggguaaugguguguagacacaggcccucugcagaagc

SEQ ID NO: 316019 - RNA, 62 nt, Homo Sapiens
gguugaauaguucuauacaaaugaaguauggagguguguauguuuauauguauauaacaaaa

SEQ ID NO: 316020 - RNA, 62 nt, Homo Sapiens
uuggggaagucaaauggccaugaacuguaguagguguguaguucugugaaagcaacaugaaa

SEQ ID NO: 316021 - RNA, 62 nt, Homo Sapiens
uuuuaacugucaugaaauacaaacaggugguagguguguaauuuuuuuagcaagauugacca

SEQ ID NO: 316022 - RNA, 62 nt, Homo Sapiens
gcauaugccaaggaaaugucugagaguugauggguguguaaucaacauuauuaagacacagc

SEQ ID NO: 316023 - RNA, 62 nt, Homo Sapiens
acgcuaauaaaauguguugcgaggcugacgcugguguguaugcgagcgcccgccucccagcc

SEQ ID NO: 316024 - RNA, 62 nt, Homo Sapiens
acugcuuuucucagccccaagccucuagucuggguguguacggagggucuagccugggugug

SEQ ID NO: 316025 - RNA, 62 nt, Homo Sapiens
cuagucuggguguguacggagggucuagccuggguguguacggagggucuagccugggugag

SEQ ID NO: 316026 - RNA, 62 nt, Homo Sapiens
cuagccugggugaguacggagggucuagccuggguguguauggaggaucuagccugggugag

SEQ ID NO: 316027 - RNA, 62 nt, Homo Sapiens
cuagccugggugaguauggagggucuagccuggguguguauggagggucuagccugggugag

SEQ ID NO: 316028 - RNA, 62 nt, Homo Sapiens; identical to SEQ ID NO: 316027

SEQ ID NO: 316029 - RNA, 62 nt, Homo Sapiens
cuagccugggugaguauggagggucuagccuggguguguacggagggucuagucugagugcg

SEQ ID NO: 316030 - RNA, 62 nt, Homo Sapiens
gggcuggggggcaggcugaauguguguguguggguguguauguguggagugugugugugugu

SEQ ID NO: 316031 - RNA, 62 nt, Homo Sapiens
cuugaaaaagaaacuuuagagaaagcaucagggguguguacucaguauuucaaaucagaaca

SEQ ID NO: 316032 - RNA, 62 nt, Homo Sapiens
gagauggagguguaggcuggagagacauuguggguguguaucuucuuaucucauuucacaag

SEQ ID NO: 316033 - RNA, 62 nt, Homo Sapiens
cagagccuugacuggauggagguggggagugugguguguaaagucucuggccucauaaaagg

SEQ ID NO: 316034 - RNA, 62 nt, Homo Sapiens
cauuuucuauaauuuuauaaaugaaaccauaugguguguacuuuuuaggggguggggcucug

SEQ ID NO: 316035 - RNA, 62 nt, Homo Sapiens
accacaccgggcuaauuuuuuuugaaacuacagguguguaccccucagucccccuccaggua

SEQ ID NO: 316036 - RNA, 62 nt, Homo Sapiens
cugcuacaaggaguuguugguauuuucccacugguguguagcaugcaaacaugagcagaaaa

SEQ ID NO: 316037 - RNA, 62 nt, Homo Sapiens
agcaugcauuuguaggcaccaauggaugucuugguguguaggaagcauggcuuuauuuucuu

SEQ ID NO: 316038 - RNA, 62 nt, Homo Sapiens
agaaacuuccaaacgcagugcccuguucugccgguguguacagccucagcgcaccaggagac

SEQ ID NO: 316039 - RNA, 62 nt, Homo Sapiens
acgaggaaacauuauucauuggaaaagugcaugguguguauuuuagggauuaugagcuucuu

SEQ ID NO: 316040 - RNA, 62 nt, Homo Sapiens
uuuuaaguccuguauauguauguaguaguuuggguguguauauauaguagcauuucaaaaug

SEQ ID NO: 316041 - RNA, 62 nt, Homo Sapiens
aaccuguaagcccagcauuugagagaagguaggguguguauauauaaaagguuguguacaac

SEQ ID NO: 316042 - RNA, 62 nt, Homo Sapiens
uguaggccuagcugcucagggcugggcguggugguguguaccacagaaaaauuuuaaaauua

SEQ ID NO: 316043 - RNA, 62 nt, Homo Sapiens
ugcaugcagccuacacccacaggagucugugugguguguaugcugagcaagccaggaaggga

SEQ ID NO: 316044 - RNA, 62 nt, Homo Sapiens
auguaucagggaccauggcccuacuaaguacagguguguauaucacauaaauauagcgagcu

SEQ ID NO: 316045 - RNA, 62 nt, Homo Sapiens
ggaaucccucccccucuuacgcggggggcggggguguguaugucagcauggcggggcggggg

SEQ ID NO: 316046 - RNA, 62 nt, Homo Sapiens
acagggucccacagguuugggaacaaaaaugagguguguagaacaaggaggaugaaacgccg

SEQ ID NO: 316047 - RNA, 62 nt, Homo Sapiens
acccacagaggcuccggguguguucugggcaugguguguaagacaucugcuauuuccugugg

SEQ ID NO: 316048 - RNA, 62 nt, Homo Sapiens
agccuaacauuguucaggcgcauggccccugcgguguguacacgaacucggcuucuuuuguc

SEQ ID NO: 316049 - RNA, 62 nt, Homo Sapiens
cgggcaugagcagaggugagcgugagcgagcggguguguauguacgagugugcacgugugug

SEQ ID NO: 316050 - RNA, 62 nt, Homo Sapiens
cuugaauuccuuccguaugguacccuaaggcagguguguaugcccuagccuuuguccucacc

SEQ ID NO: 316051 - RNA, 62 nt, Homo Sapiens
gcacaaggacauuguaugcaaagguugugcaggguguguacucccagccacgacugccaugu

SEQ ID NO: 316052 - RNA, 62 nt, Homo Sapiens
augccggcuggaagaagaaccucgcaucuuuugguguguaugcaccuuggcagccagcagga

SEQ ID NO: 316053 - RNA, 62 nt, Homo Sapiens
ucucuaagggcuuuacaaggaucaaauaagaugguguguauguaagaaauuuguaaaaugug

SEQ ID NO: 316054 - RNA, 62 nt, Homo Sapiens
auguguguguguguguguguguguguguguaugguguguauuccauaucuauucccauguaa

SEQ ID NO: 316055 - RNA, 62 nt, Homo Sapiens
uuuguuuguuucuuuuucaugguauuacugaagguguguauacucccuaauacacauuuaug

SEQ ID NO: 316056 - RNA, 62 nt, Homo Sapiens
augaauucuuugaacucuuaaauuauccacaugguguguauuccauggguuuuuuaacccca

SEQ ID NO: 316057 - RNA, 62 nt, Homo Sapiens
cuguagaguuuccacauuucgagagaagcugugguguguaugaagucaguuaugauugucug

SEQ ID NO: 316058 - RNA, 62 nt, Homo Sapiens
uaauuuguucaaaagaaaaaaagaagauuguugguguguaaucuggguucauguuguaauaa

SEQ ID NO: 316059 - RNA, 62 nt, Homo Sapiens
uacuuuagaaaaaaugaaaauuggguggggcagguguguauuauguaaucagauuuauuuaa

SEQ ID NO: 316060 - RNA, 62 nt, Homo Sapiens
uugaaguuuuggacugaaaucaaacauauuuggguguguaauccaaguauagauuaaggcaa

SEQ ID NO: 316061 - RNA, 62 nt, Homo Sapiens
cuaguauguaugugcuuugcaccuuaccaagugguguguaaauuccccaguacuuuuagcca

SEQ ID NO: 316062 - RNA, 60 nt, Homo Sapiens
cguggugcggugugugacugaaaaguugucaugguguguagaguuucucuugagggcaau

SEQ ID NO: 316063 - RNA, 62 nt, Homo Sapiens
guaaauuguggacucaggauuuuuugaaacuugguguguaacucuaaaucuuguauaugcau

SEQ ID NO: 316064 - RNA, 62 nt, Homo Sapiens; identical to SEQ ID NO: 316055

SEQ ID NO: 316065 - RNA, 62 nt, Homo Sapiens
cuacuggcaucuguuaucuaguaugcauuucugguguguaucugaaaggaagacauuuucua

SEQ ID NO: 316066 - RNA, 63 nt, Homo Sapiens
guaaguguacagugggcuugcauuggggauggggguguguacagaugaagucaguggcuuguc

SEQ ID NO: 316067 - RNA, 63 nt, Homo Sapiens
augcuagagauaaacuuuccaauuuuuaagcuugguguguacccagggaaguuaucuugguau

SEQ ID NO: 316068 - RNA, 63 nt, Homo Sapiens
ggugugaggaugaaauaaugaccuugauuuuuggguguguauugcagaagccucgucgcuuuc

SEQ ID NO: 316069 - RNA, 63 nt, Homo Sapiens
cacaagaaagcaaguacaguguggauuucaaaugguguguaacuucagcuccagcugguuuuu

SEQ ID NO: 316070 - RNA, 63 nt, Homo Sapiens
uguuauaugggaauuaaaauauguuuaggcagggguguguaaaaagguuaaguuuuuguuucu

SEQ ID NO: 316071 - RNA, 63 nt, Homo Sapiens
uggcauccagcagccacuaacaaacacacaacugguguguaaaaggcaggccuuacauuagaa

SEQ ID NO: 316072 - RNA, 63 nt, Homo Sapiens
cacaagauauuuggggaauaaaaauaacagcuugguguguagcaucugcagccacuuggcaaa

SEQ ID NO: 316073 - RNA, 63 nt, Homo Sapiens
guguaugggugugugugggugggugugaguguggguguguacguaccaauaaacaaccugguu

SEQ ID NO: 316074 - RNA, 63 nt, Homo Sapiens
auucccuccaugcugucgucaucgacauauacagguguguacguagguguauguguguacucu

SEQ ID NO: 316075 - RNA, 63 nt, Homo Sapiens
acccuaggcuccccgcccaccgucgcugugcuugguguguaggagaccccuccccgccacgau

SEQ ID NO: 316076 - RNA, 63 nt, Homo Sapiens
gggggagaggguagcaagguacccacugggccugguguguagaggcauagggaccagucuacu

SEQ ID NO: 316077 - RNA, 63 nt, Homo Sapiens
caacccagugcuuccuaagacuacuccccuuaggguguguaucggaaggguuccuaacccaac

SEQ ID NO: 316078 - RNA, 63 nt, Homo Sapiens
ugccuuucuccugacuggccuguggggggaugagguguguauagauagacuugcugaugugca

SEQ ID NO: 316079 - RNA, 63 nt, Homo Sapiens
augcugucauaucagagucaugacuguguccgugguguguauuggugacuguccguggagggg

SEQ ID NO: 316080 - RNA, 63 nt, Homo Sapiens
uaguaagauuacccugagcucuggaccaccccugguguguagccaugcagccuaaaguacagc

SEQ ID NO: 316081 - RNA, 63 nt, Homo Sapiens
ggggaaagggucuuuccugggugugcaugugcugguguguaaggggagggugugggugugcgu

SEQ ID NO: 316082 - RNA, 63 nt, Homo Sapiens
agaccccacccugagguccugcauuucucagucgguguguaaucacguuccagggcccaaagc

SEQ ID NO: 316083 - RNA, 63 nt, Homo Sapiens
gauugugcagaauauucuaagaggucagaaauugguguguauaacuacauuuuuagugaugca

SEQ ID NO: 316084 - RNA, 63 nt, Homo Sapiens
uccugcugccucugacuacucagccuuguuuucgguguguaggccccagcugcccacuggaac

SEQ ID NO: 316085 - RNA, 63 nt, Homo Sapiens
aagcacguggagccacaagacaagcuggggggugguguguaaggagcuggcugaggcaucgcu

SEQ ID NO: 316086 - RNA, 63 nt, Homo Sapiens
uguauguggggaguaggugugugugagccaugggguguguauuucuuucacuuucauuugcug

SEQ ID NO: 316087 - RNA, 63 nt, Homo Sapiens
uauaguugaaacuguagaaagggucagguuggagguguguaauaaaaaagaauuaccuagguu

SEQ ID NO: 316088 - RNA, 63 nt, Homo Sapiens
agucuuccacuucaaugcacauggugcaguuuugguguguaacuuagaaggauugaacuucuu

SEQ ID NO: 316089 - RNA, 63 nt, Homo Sapiens
uuuuuaaaucuuuuuuuaacuaauaagauuuacgguguguauuuuauacagaaaugcauuaua

SEQ ID NO: 316090 - RNA, 63 nt, Homo Sapiens
augauuuugcgggggagugguuuaugggcuugggguguguagaagcaauugccugccuuguac

SEQ ID NO: 316091 - RNA, 63 nt, Homo Sapiens
caucuggcugucuguccauucagaguauccuaggguguguaucgguuguggccccugcagggg

SEQ ID NO: 316092 - RNA, 63 nt, Homo Sapiens
ucucucacuaccuuucucaugugccuuagagcagguguguacacuguggaaacccuucucccu

SEQ ID NO: 316093 - RNA, 63 nt, Homo Sapiens
uguguguguguaugcauauaaguaguauucugugguguguaugucauuauuuuuuuuuggcug

SEQ ID NO: 316094 - RNA, 63 nt, Homo Sapiens
aaauuauuuuugaauugaacuuuaaugcaggcagguguguaauuuuuuauagaaguuugaaaa

SEQ ID NO: 316095 - RNA, 63 nt, Homo Sapiens
gaaauaauauggaauuagcaacuaaauuuucaagguguguagacagaaggguaccaguaauac

SEQ ID NO: 316096 - RNA, 63 nt, Homo Sapiens
auuugaaaguuuacauuuuuuaugcuuuguguugguguguaauuuuuguacucuugguggcua

SEQ ID NO: 316097 - RNA, 63 nt, Homo Sapiens
uagucguaggccuuaugauaauuaccccgcggugguguguagaaaaguauguaaauuugcucu

SEQ ID NO: 316098 - RNA, 63 nt, Homo Sapiens
uuauuuucuuuaguuuaaucuuggucauguuuugguguguauuuuuaauuuuuuucuuaaauu

SEQ ID NO: 316099 - RNA, 63 nt, Homo Sapiens
cuacuaaaaauacaaaaauuagcuggguguggugguguguaccuguagucccagcuacccagg

SEQ ID NO: 316100 - RNA, 63 nt, Homo Sapiens
ccccucccuguuugacuucaucgacagacagaugguguguauggaggugagccgaagaucaau

SEQ ID NO: 316101 - RNA, 63 nt, Homo Sapiens
auacacagacuaucacuaaaccuuuguggcacugguguguaaaauaaaauuuguaagguugcc

SEQ ID NO: 316102 - RNA, 63 nt, Homo Sapiens
uuucauugcgauuuccuguuauagacugugcaugguguguauauacuggauucccacaguaau

SEQ ID NO: 316103 - RNA, 63 nt, Homo Sapiens
uguauaugugugcgugugguugucucugccauagguguguaugauggucaauucagaagaaag

SEQ ID NO: 316104 - RNA, 63 nt, Homo Sapiens
ugugccuaagccuccugaguagcugggaucacagguguguaccaccacgcccagcugauuuuu

SEQ ID NO: 316105 - RNA, 63 nt, Homo Sapiens
cuacuuuuagcuucauucucccauauuuugaaggguguguaacuucagcucugcaggauugca

SEQ ID NO: 316106 - RNA, 63 nt, Homo Sapiens
ccuugagcagauccagggaucagugagaggagugguguguaccccuaaauccucccaccccag

SEQ ID NO: 316107 - RNA, 63 nt, Homo Sapiens
auauaaggaaaaaaaauagccugccuugggacagguguguaauguuagugugcaugacuaaug

SEQ ID NO: 316108 - RNA, 63 nt, Homo Sapiens
cauacucuguacauuuuucuugagagaaugaaugguguguauaauauauuuggaaacucuugg

SEQ ID NO: 316109 - RNA, 63 nt, Homo Sapiens
aacucaccugaaugggacuucucgcugcuugaugguguguacauaacccuaauugaugagagg

SEQ ID NO: 316110 - RNA, 63 nt, Homo Sapiens
ggccaaguuuugcuuguuguagugcauuugauugguguguauugagcucccagggaaaaacga

SEQ ID NO: 316111 - RNA, 63 nt, Homo Sapiens
guagacugauuacacugaggugaggcuacaagggguguguaaccguguaacacgugaaggcaa

SEQ ID NO: 316112 - RNA, 63 nt, Homo Sapiens
ucuggccccuuugguuuccgugucauccuuuuugguguguaggacaaggagccagggaauugg

SEQ ID NO: 316113 - RNA, 63 nt, Homo Sapiens
uugagguuagggugaggggucaggguuuaggaggguguguauguugggaggacaggcuaguug

SEQ ID NO: 316114 - RNA, 63 nt, Homo Sapiens
uauaguaaaacuagccuuucacauuaagguuuugguguguauuuuguuaaauaacuaacaugc

SEQ ID NO: 316115 - RNA, 63 nt, Homo Sapiens
ccuacagcagaaguucugagccugaccacagaugguguguaaucuaucaaacacaccccuggc

SEQ ID NO: 316116 - RNA, 63 nt, Homo Sapiens
uacacacccagagauggagcaacaaaggugacggguguguaggcuuauaccugagcccaguac

SEQ ID NO: 316117 - RNA, 63 nt, Homo Sapiens
uuguaaguacuuuugugcauaggguggggguuggguguguaauuuuuucuucuguuuuuauug

SEQ ID NO: 316118 - RNA, 63 nt, Homo Sapiens
gggcaaaaugccaaaaagcacccuggauaggaggguguguacacuacuuggcaugaaagggug

SEQ ID NO: 316119 - RNA, 63 nt, Homo Sapiens
ucauuaaaaaauauaaauauugugcuuuuuuuugguguguauuguuugugaauuaucugcaug

SEQ ID NO: 316120 - RNA, 63 nt, Homo Sapiens
gaggggaugaaucggaacgaacuguuggacagugguguguauugagaggaugcucacuguaag

SEQ ID NO: 316121 - RNA, 63 nt, Homo Sapiens
uuacacuuucugcacaucucgcuuucgaaaucugguguguauucauucucuuuuucauacuaa

SEQ ID NO: 316122 - RNA, 63 nt, Homo Sapiens
uguaccuuucagcauccuagccaugacucuuuagguguguaugaagaaagcuguuuaagaagg

SEQ ID NO: 316123 - RNA, 63 nt, Homo Sapiens
cuucuucaaaauuguacacaugucuuccagcacgguguguacaauuuugaccuguucaguguc

SEQ ID NO: 316124 - RNA, 63 nt, Homo Sapiens
gcauggauuaguuuuccugacaaagcauguuuugguguguagucuuacuuuuuagaaauagcu

SEQ ID NO: 316125 - RNA, 63 nt, Homo Sapiens
ggucaaagauguguucaggcauuccagguaacagguguguauguaaaguuaaaaauaggcuuu

SEQ ID NO: 316126 - RNA, 63 nt, Homo Sapiens
gucaagaagaaaguuguauaagcuauugauaaggguguguaucuuaauguuguugaguuuugu

SEQ ID NO: 316127 - RNA, 63 nt, Homo Sapiens
cagcccuucuuuccacagaagcuccagguagaggguguguaaguagauaggccaugggcacug

SEQ ID NO: 316128 - RNA, 63 nt, Homo Sapiens
ccagcaguugaaggaagagagugcauggcaccugguguguaacgacacaaucagcacaacugg

SEQ ID NO: 316129 - RNA, 63 nt, Homo Sapiens
cacacuggacaggguucucuaagcagugaggcugguguguaugauugucuuaaaauuuuuuaa

SEQ ID NO: 316130 - RNA, 63 nt, Homo Sapiens
aggcuaugauuucucuugcaagaucggggaagggguguguaccaacacauccccaggcaggac

SEQ ID NO: 316131 - RNA, 63 nt, Homo Sapiens
auaccaauuaguuuuauauauguacuuauguuugguguguaaucuauuacauuguacagaauc

SEQ ID NO: 316132 - RNA, 63 nt, Homo Sapiens
uguagucacagguacuugggagccgggugaggugguguguaccaaaaaaaagaaaaaagaaaa

SEQ ID NO: 316133 - RNA, 63 nt, Homo Sapiens
uuacaaauuauaauuuauguuccuuguuaaaaugguguguaccacugcaccaacacugucgua

SEQ ID NO: 316134 - RNA, 63 nt, Homo Sapiens
agcagggagcugcgccuuccuggggugcccggugguguguagagaaaagcugcuuguuuacuc

SEQ ID NO: 316135 - RNA, 63 nt, Homo Sapiens
caaaucuucuauuguguggaaaauguugugaaggguguguaggugugguacauguguauguca

SEQ ID NO: 316136 - RNA, 63 nt, Homo Sapiens
uuuacgagaaaaagaaggggaaugguggggaaugguguguaccgauauauaguauuucuuuag

SEQ ID NO: 316137 - RNA, 63 nt, Homo Sapiens
uaaagagauaggggagaaaauguucuuauuuaugguguguaugcccagggacauggacuuggg

SEQ ID NO: 316138 - RNA, 63 nt, Homo Sapiens
aaaguccacauguaaauuuauggcugcaucccagguguguagcgcaauggaacaaaacucauc

SEQ ID NO: 316139 - RNA, 63 nt, Homo Sapiens
ccaagguuaccaacuaccuagaaggaugucccggguguguacauggggccugggcuguggaca

SEQ ID NO: 316140 - RNA, 63 nt, Homo Sapiens
caaauaauacuugaccagcuguuuaccaaauaugguguguauuaaaagguaauauaauuuuag

SEQ ID NO: 316141 - RNA, 63 nt, Homo Sapiens
gauguuucauuuugguuuuaaaccauuccaaucgguguguaguugucaguauuuuuccuuuuu

SEQ ID NO: 316142 - RNA, 63 nt, Homo Sapiens
uuuuauacgauguuuguuauuaguuuccaugaagguguguaugaccagaguugggagauaaga

SEQ ID NO: 316143 - RNA, 63 nt, Homo Sapiens
aaggagucccuaacuuucuuaucccaugagagagguguguaaaggagaaagcuagaggugaac

SEQ ID NO: 316144 - RNA, 63 nt, Homo Sapiens
aaaauauucuuuguaugauuagauuuuucauuugguguguaagagaaaucuuuauuaauguuu

SEQ ID NO: 316145 - RNA, 63 nt, Homo Sapiens
auuacuguaauacuucugcauuuggcauucuuugguguguagaagauaguugacuuucuaucu

SEQ ID NO: 316146 - RNA, 63 nt, Homo Sapiens
uuucaggggcuucacauggaaggaaaguuccaggguguguaugguccaucugugcauaaggag

SEQ ID NO: 316147 - RNA, 63 nt, Homo Sapiens
ugaaaguggggugagguuccuaaagaaacguaggguguguaugacaggauaauagguuuuuca

SEQ ID NO: 316148 - RNA, 63 nt, Homo Sapiens
ccaaggcccccuggcugugccccagggaaggaggguguguaccgcagaggaggugcuggcggc

SEQ ID NO: 316149 - RNA, 63 nt, Homo Sapiens
ugguaaaaccuguucuccaugugaccacaggcugguguguagggcuugaaugcugguacuauu

SEQ ID NO: 316150 - RNA, 63 nt, Homo Sapiens
aguuagccuugcuggggccauaauaugcuucaggguguguaaaagaagaaaucucuuuguggc

SEQ ID NO: 316151 - RNA, 63 nt, Homo Sapiens; identical to SEQ ID NO: 316150

SEQ ID NO: 316152 - RNA, 63 nt, Homo Sapiens
ugcauuuuguuaaugcacauucuguuuguuuaagguguguaagauacacacccuucuagauga

SEQ ID NO: 316153 - RNA, 63 nt, Homo Sapiens
guugcugauugcauuuccucucauuaacaauuggguguguaauaaaaagcauuguacuucauc

SEQ ID NO: 316154 - RNA, 63 nt, Homo Sapiens
ucagcccauuagguuaaacaccaaagaaagacugguguguacugaauaggaaagggaaguuuu

SEQ ID NO: 316155 - RNA, 63 nt, Homo Sapiens
uucuaguuugcacauccagaacggcgaaggcuggguguguauuccacuaacugaaauauggca

SEQ ID NO: 316156 - RNA, 63 nt, Homo Sapiens
uaguggauccuggauggaacauguuguaacauagguguguagacagauaccagauuugauaua

SEQ ID NO: 316157 - RNA, 63 nt, Homo Sapiens
cuuuugugugugugcgcagguagaaaccagcaggguguguacacaaacuuaacauucuuguaa

SEQ ID NO: 316158 - RNA, 63 nt, Homo Sapiens
uauacacacacacacauguagguuacagcuggagguguguauaggccugcugagcucugguua

SEQ ID NO: 316159 - RNA, 63 nt, Homo Sapiens
aguaauuacacgaggcaaacgaaaauuugcucggguguguagcugccuuuaaagauacagugu

SEQ ID NO: 316160 - RNA, 63 nt, Homo Sapiens
uugaucugcauugacaccagccucgccuggauggguguguauugggacaggugaauaccugcu

SEQ ID NO: 316161 - RNA, 63 nt, Homo Sapiens
ggggaaaauagcuaaaagucaaaauauuaguuugguguguauuuuguaaaacuugaagccaua

SEQ ID NO: 316162 - RNA, 63 nt, Homo Sapiens
uguagccugaagaacuggagauuggaaggaugugguguguaccagccuguguugugcaaaaga

SEQ ID NO: 316163 - RNA, 63 nt, Homo Sapiens
uuuuguaaguuguaacuugacuacuuaaccuaugguguguacuaucuuccuaauaucaggcgc

SEQ ID NO: 316164 - RNA, 63 nt, Homo Sapiens
cgcaggugggcuggacuucuaccugcccucaaggguguguauauuguauaggggcaacuguau

SEQ ID NO: 316165 - RNA, 63 nt, Homo Sapiens
cgcgccugcugcugugacccguuuuggaaaacugguguguaccgaggcgcugacugcacggcu

SEQ ID NO: 316166 - RNA, 63 nt, Homo Sapiens
uaugacagcuuuccuucacacacuauuuuuguggguguguauauaucugauuugggaagaauu

SEQ ID NO: 316167 - RNA, 63 nt, Homo Sapiens
auggaggccaguguuggggagccuguggaggcagguguguagaauuguguucgggaggugggg

SEQ ID NO: 316168 - RNA, 63 nt, Homo Sapiens
ucacuagggcaguggggagaaugcucuccuguugguguguaugggauucugugccaucugaac

SEQ ID NO: 316169 - RNA, 63 nt, Homo Sapiens
cuuguauaacuuuguaaauaccauagaaaauuggguguguauaccucuguggcaaagcguguc

SEQ ID NO: 316170 - RNA, 63 nt, Homo Sapiens
uuugcaaauuguuuccuuuauaugguuuugucagguguguaaaugcauacauauguguguaua

SEQ ID NO: 316171 - RNA, 63 nt, Homo Sapiens
ugauguguaauccaguaaaaucucccuuuuucggguguguaugugggcaugugcccauuucua

SEQ ID NO: 316172 - RNA, 63 nt, Homo Sapiens
uuuauucugaagaauaaaccuagcuggcaugcugguguguaccuguaguccuagcuauuuggg

SEQ ID NO: 316173 - RNA, 63 nt, Homo Sapiens
ggcauaaugaauauaauuuacccaguggacaaagguguguaccaagugaauuuaaauaauugg

SEQ ID NO: 316174 - RNA, 63 nt, Homo Sapiens
uugugacgucgggcauucauauaggaagaacgcgguguguaacacuguguacaccucaaauac

SEQ ID NO: 316175 - RNA, 63 nt, Homo Sapiens
guacugcgucuguccacacucgauugggccccagguguguaugaggcgcucugguaaggugcu

SEQ ID NO: 316176 - RNA, 63 nt, Homo Sapiens
ggaggggggagaacuaaaugucacaauguauuugguguguagguuaugucuuuauuccuuauu

SEQ ID NO: 316177 - RNA, 63 nt, Homo Sapiens
gguaacauggggaaaaugcuuguccacauuuaugguguguauaagaacaaaaaugggaggagg

SEQ ID NO: 316178 - RNA, 63 nt, Homo Sapiens
cucaugugguuugcacagccuaaaaagcaaacugguguguauuggccccuaugugggauuuuu

SEQ ID NO: 316179 - RNA, 63 nt, Homo Sapiens
ggccucccgggagccacuguucugaggacaguggguguguacuccuuguguuguguguuucug

SEQ ID NO: 316180 - RNA, 63 nt, Homo Sapiens
uggacaucucuuccagaguuaucccacuggcuugguguguauacauuaggggaggauaaucug

SEQ ID NO: 316181 - RNA, 63 nt, Homo Sapiens
uguccuguguauguguggguguguguguauuuggguguguaaauguugguucuuccacuacug

SEQ ID NO: 316182 - RNA, 63 nt, Homo Sapiens
uagauuccauauuaaugaggcagaaagaguguugguguguaggggguagggggcacagaacac

SEQ ID NO: 316183 - RNA, 63 nt, Homo Sapiens
uugagucuuuaacaaagugacuacccaaaugcagguguguaggcagcccuuuccccuagacau

SEQ ID NO: 316184 - RNA, 63 nt, Homo Sapiens
aacugugauaacuguugcccacaggacaugaaagguguguaugggcugugaggagugagugag

SEQ ID NO: 316185 - RNA, 63 nt, Homo Sapiens
uggcaaagagcucuucaaauaauucuuucaaacgguguguauugaucuuccaaggaaaaacau

SEQ ID NO: 316186 - RNA, 63 nt, Homo Sapiens
ccuguugguuugaaguguuagacuauagccccugguguguaaauaauguacauagagugagaa

SEQ ID NO: 316187 - RNA, 63 nt, Homo Sapiens
ucuagcugugucuaccauguuauucuuagaagggguguguauggauauugaugauaguugaaa

SEQ ID NO: 316188 - RNA, 63 nt, Homo Sapiens
acuuaacaccuggacuuuuauguguagcauggggguguguacagagaaggagaugaaggagug

SEQ ID NO: 316189 - RNA, 63 nt, Homo Sapiens
gcgugcuguaguggaaguuuggcuuggaacacagguguguacagcacuggggggguuggggug

SEQ ID NO: 316190 - RNA, 63 nt, Homo Sapiens
uguccauguguggauguugggggcuugggggaagguguguaucugcuuucaagcaaaaugccu

SEQ ID NO: 316191 - RNA, 63 nt, Homo Sapiens
uuuguaaauguuaugcacucaacgacugcugcugguguguauucagaauuaauagcccuuagc

SEQ ID NO: 316192 - RNA, 63 nt, Homo Sapiens
ugacacaaaaguuauuuacaugcacacuuuuuggguguguaaagcugccagccucucacaucu

SEQ ID NO: 316193 - RNA, 63 nt, Homo Sapiens
cuaccaaaaauacaaaauguauccagacauggugguguguaccuguagucccagcuacucagg

SEQ ID NO: 316194 - RNA, 63 nt, Homo Sapiens
gacagcuugugcugcuugcacaacugagcugcugguguguaccccuuagcagggugucugggg

SEQ ID NO: 316195 - RNA, 63 nt, Homo Sapiens
augauuugucugcuaagaagauucuauucucaggguguguaccauuaccucuucuuggucaga

SEQ ID NO: 316196 - RNA, 63 nt, Homo Sapiens
cagagaccgagagcaugaguuaggggggguguggguguguaacagggcaucugaauacaggag

SEQ ID NO: 316197 - RNA, 63 nt, Homo Sapiens
aaagugcucccuucccagaggaggggccccaucgguguguaagguggccuauuccucugugug

SEQ ID NO: 316198 - RNA, 63 nt, Homo Sapiens
ccaccuggggggcccuuccccagcauaccugcugguguguaaguguggacuaacccgccgcca

SEQ ID NO: 316199 - RNA, 63 nt, Homo Sapiens
ggugguggccuguuugaaaguaaaaaccugcuugguguguagguuccguaucucccuggagaa

SEQ ID NO: 316200 - RNA, 63 nt, Homo Sapiens
uacgcagccuccagggcaccugugaauucuuaggguguguacguaaucuucugcuaaugguga

SEQ ID NO: 316201 - RNA, 63 nt, Homo Sapiens
gcugcuguguaucaaaagacuggggggcacagugguguguagugcagacagagugaagcuggc

SEQ ID NO: 316202 - RNA, 63 nt, Homo Sapiens
agggaugguggagugagagccuuugccuuuagggguguguauucacauaguccucagggcuca

SEQ ID NO: 316203 - RNA, 63 nt, Homo Sapiens
uauagugucgggcuuccggggaaagcaaucauugguguguauguguaugugcaugcacacacg

SEQ ID NO: 316204 - RNA, 63 nt, Homo Sapiens
cccaccucagccgccgaaguagcugggacuauagguguguaccaucacaccuggcuaauuuuu

SEQ ID NO: 316205 - RNA, 63 nt, Homo Sapiens
ucagacugauggugcccauggaguggagucuccgguguguaccagaagugagcgcugggaaca

SEQ ID NO: 316206 - RNA, 63 nt, Homo Sapiens
aaggggggugacaaggucccgaguagaaccagggguguguauggaggcacggggaagguuuug

SEQ ID NO: 316207 - RNA, 63 nt, Homo Sapiens
agggucauacccccucccucgagcuaguggagggguguguaacggguaccccccaaccuccag

SEQ ID NO: 316208 - RNA, 63 nt, Homo Sapiens
ugaagugguucucaguccccaaggaccaaagaagguguguaagaguugaccucugguucagcc

SEQ ID NO: 316209 - RNA, 63 nt, Homo Sapiens
uaacuuaucacuggaccacuuuauucaaaguaggguguguauguuucuccaauuuggcuggga

SEQ ID NO: 316210 - RNA, 63 nt, Homo Sapiens
cagggcauucuguuggccuaacgcaugugguaagguguguacugaguguguggaugcguguga

SEQ ID NO: 316211 - RNA, 63 nt, Homo Sapiens
acuacauccagcuaaaggagaacugggacuacagguguguaccauccuccucucagccugagu

SEQ ID NO: 316212 - RNA, 63 nt, Homo Sapiens
ccuggcaucuguggcaugugguguugggugugggguguguacauaaggggguguguguagugu

SEQ ID NO: 316213 - RNA, 63 nt, Homo Sapiens
auaccugcugggccagucccggccuguguccuggguguguacccuaaugccuguccugccucu

SEQ ID NO: 316214 - RNA, 63 nt, Homo Sapiens
gaagcaguacuagaaacuuuccaaggagucuuggguguguagccaagaggagccaugagcuau

SEQ ID NO: 316215 - RNA, 63 nt, Homo Sapiens
accugugugcucacccacagagcaugggguaaugguguguagacacaggcccucugcagaagc

SEQ ID NO: 316216 - RNA, 63 nt, Homo Sapiens
ugguugaauaguucuauacaaaugaaguauggagguguguauguuuauauguauauaacaaaa

SEQ ID NO: 316217 - RNA, 63 nt, Homo Sapiens
uuggggaagucaaauggccaaugaacuguaguagguguguagucucugugaaagcaacaugaa

SEQ ID NO: 316218 - RNA, 63 nt, Homo Sapiens
uuuuaacugucaugaaauacaaaacaggugguagguguguaaucuuuuuuagcaagauugacc

SEQ ID NO: 316219 - RNA, 63 nt, Homo Sapiens
gcauaugccaaggaaauguccugagaguugauggguguguaauacaacauuauuaagacacag

SEQ ID NO: 316220 - RNA, 63 nt, Homo Sapiens
cacgcuaauaaaauguguugcgaggcugacgcugguguguaugcgagcgcccgccucccagcc

SEQ ID NO: 316221 - RNA, 63 nt, Homo Sapiens
gacugcuuuucucagccccaagccucuagucuggguguguacggagggucuagccugggugug

SEQ ID NO: 316222 - RNA, 63 nt, Homo Sapiens
ucuagucuggguguguacggagggucuagccuggguguguacggagggucuagccugggugag

SEQ ID NO: 316223 - RNA, 63 nt, Homo Sapiens
ucuagccugggugaguacggagggucuagccuggguguguauggaggaucuagccugggugag

SEQ ID NO: 316224 - RNA, 63 nt, Homo Sapiens
ucuagccugggugaguauggagggucuagccuggguguguauggagggucuagccugggugag

SEQ ID NO: 316225 - RNA, 63 nt, Homo Sapiens; identical to SEQ ID NO: 316224

SEQ ID NO: 316226 - RNA, 63 nt, Homo Sapiens
ucuagccugggugaguauggagggucuagccuggguguguacggagggucuagucugagugcg

SEQ ID NO: 316227 - RNA, 63 nt, Homo Sapiens
ggggcuggggggcaggcugaauguguguguguggguguguauguguggagugugugugugugu

SEQ ID NO: 316228 - RNA, 63 nt, Homo Sapiens
ucuugaaaaagaaacuuuagagaaagcaucagggguguguacucaguauuucaaaucagaaca

SEQ ID NO: 316229 - RNA, 63 nt, Homo Sapiens
ggagauggagguguaggcuggagagacauuguggguguguaucuucuuaucucauuucacaag

SEQ ID NO: 316230 - RNA, 63 nt, Homo Sapiens
gcagagccuugacuggauggagguggggagugugguguguaaagucucuggccucauaaaagg

SEQ ID NO: 316231 - RNA, 63 nt, Homo Sapiens
gcauuuucuauaauuuuauaaaugaaaccauaugguguguacuuuuuaggggguggggcucug

SEQ ID NO: 316232 - RNA, 63 nt, Homo Sapiens
accacaccgggcuaauuuuuauuugaaacuacagguguguaccgccucagucccccuccaggu

SEQ ID NO: 316233 - RNA, 63 nt, Homo Sapiens
cugcuacaaggaguuguuggauauuuucccacugguguguagcaaugcaaacaugagcagaaa

SEQ ID NO: 316234 - RNA, 63 nt, Homo Sapiens
agcaugcauuuguaggcaccuaauggaugucuugguguguaggaaagcauggcuuuauuuucu

SEQ ID NO: 316235 - RNA, 63 nt, Homo Sapiens
cagaaacuuccaaacgcagugcccuguucugccgguguguacagccucagcgcaccaggagac

SEQ ID NO: 316236 - RNA, 63 nt, Homo Sapiens
cacgaggaaacauuauucauuggaaaagugcaugguguguauuuuagggauuaugagcuucuu

SEQ ID NO: 316237 - RNA, 63 nt, Homo Sapiens
uuuuuaaguccuguauauguauguaguaguuuggguguguauauauaguagcauuucaaaaug

SEQ ID NO: 316238 - RNA, 63 nt, Homo Sapiens
aaaccuguaagcccagcauuugagagaagguaggguguguauauauaaaagguuguguacaac

SEQ ID NO: 316239 - RNA, 63 nt, Homo Sapiens
uguaggccuagcugcucaggagcugggcguggugguguguaccuacagaaaaauuuuaaaauu

SEQ ID NO: 316240 - RNA, 63 nt, Homo Sapiens
ugcaugcagccuacacccacaaggagucugugugguguguauggcugagcaagccaggaaggg

SEQ ID NO: 316241 - RNA, 63 nt, Homo Sapiens
auguaucagggaccauggccucuacuaaguacagguguguauaaucacauaaauauagcgagc

SEQ ID NO: 316242 - RNA, 63 nt, Homo Sapiens
ggaaucccucccccucuuacggcggggggcggggguguguaugaucagcauggcggggcgggg

SEQ ID NO: 316243 - RNA, 63 nt, Homo Sapiens
acagggucccacagguuuggggaacaaaaaugagguguguagacacaaggaggaugaaacgcc

SEQ ID NO: 316244 - RNA, 63 nt, Homo Sapiens
acccacagaggcuccgggugguguucugggcaugguguguaagcacaucugcuauuuccugug

SEQ ID NO: 316245 - RNA, 63 nt, Homo Sapiens
cagccuaacauuguucaggcgcauggccccugcgguguguacacgaacucggcuucuuuuguc

SEQ ID NO: 316246 - RNA, 63 nt, Homo Sapiens
acgggcaugagcagaggugagcgugagcgagcggguguguauguacgagugugcacgugugug

SEQ ID NO: 316247 - RNA, 63 nt, Homo Sapiens
cuugaauuccuuccguauggcuacccuaaggcagguguguaugccccuagccuuuguccucac

SEQ ID NO: 316248 - RNA, 63 nt, Homo Sapiens
gcacaaggacauuguaugcauaagguugugcaggguguguacuacccagccacgacugccaug

SEQ ID NO: 316249 - RNA, 63 nt, Homo Sapiens
caugccggcuggaagaagaaccucgcaucuuuugguguguaugcaccuuggcagccagcagga

SEQ ID NO: 316250 - RNA, 63 nt, Homo Sapiens
uucucuaagggcuuuacaaggaucaaauaagaugguguguauguaagaaauuuguaaaaugug

SEQ ID NO: 316251 - RNA, 63 nt, Homo Sapiens
uauguguguguguguguguguguguguguguaugguguguauuccauaucuauucccauguaa

SEQ ID NO: 316252 - RNA, 63 nt, Homo Sapiens
uuuuguuuguuucuuuuucaugguauuacugaagguguguauacucccuaauacacauuuaug

SEQ ID NO: 316253 - RNA, 63 nt, Homo Sapiens
augaauucuuugaacucuuaaaauuauccacaugguguguauugccauggguuuuuuaacccc

SEQ ID NO: 316254 - RNA, 63 nt, Homo Sapiens
cuguagaguuuccacauuucggagagaagcugugguguguaugaaagucaguuaugauugucu

SEQ ID NO: 316255 - RNA, 63 nt, Homo Sapiens
uaauuuguucaaaagaaaaaaaagaagauuguugguguguaauccuggguucauguuguaaua

SEQ ID NO: 316256 - RNA, 63 nt, Homo Sapiens
uacuuuagaaaaaaugaaaaauuggguggggcagguguguauucauguaaucagauuuauuua

SEQ ID NO: 316257 - RNA, 63 nt, Homo Sapiens
uugaaguuuuggacugaaauacaaacauauuuggguguguaauuccaaguauagauuaaggca

SEQ ID NO: 316258 - RNA, 63 nt, Homo Sapiens
cuaguauguaugugcuuugcaaccuuaccaagugguguguaaauuuccccaguacuuuuagcc

SEQ ID NO: 316259 - RNA, 61 nt, Homo Sapiens
cguggugcggugugugacuguaaaaguugucaugguguguaggaguuucucuugagggcaa

SEQ ID NO: 316260 - RNA, 63 nt, Homo Sapiens
gguaaauuguggacucaggauuuuuugaaacuugguguguaacucuaaaucuuguauaugcau

SEQ ID NO: 316261 - RNA, 63 nt, Homo Sapiens; identical to SEQ ID NO: 316252

SEQ ID NO: 316262 - RNA, 63 nt, Homo Sapiens
gcuacuggcaucuguuaucuaguaugcauuucugguguguaucugaaaggaagacauuuucua

SEQ ID NO: 316263 - RNA, 64 nt, Homo Sapiens
uguaaguguacagugggcuugcauuggggauggggguguguacagaugaagucaguggcuuguc

SEQ ID NO: 316264 - RNA, 64 nt, Homo Sapiens
uaugcuagagauaaacuuuccaauuuuuaagcuugguguguacccagggaaguuaucuugguau

SEQ ID NO: 316265 - RNA, 64 nt, Homo Sapiens
aggugugaggaugaaauaaugaccuugauuuuuggguguguauugcagaagccucgucgcuuuc

SEQ ID NO: 316266 - RNA, 64 nt, Homo Sapiens
ucacaagaaagcaaguacaguguggauuucaaaugguguguaacuucagcuccagcugguuuuu

SEQ ID NO: 316267 - RNA, 64 nt, Homo Sapiens
cuguuauaugggaauuaaaauauguuuaggcagggguguguaaaaagguuaaguuuuuguuucu

SEQ ID NO: 316268 - RNA, 64 nt, Homo Sapiens
cuggcauccagcagccacuaacaaacacacaacugguguguaaaaggcaggccuuacauuagaa

SEQ ID NO: 316269 - RNA, 64 nt, Homo Sapiens
ccacaagauauuuggggaauaaaaauaacagcuugguguguagcaucugcagccacuuggcaaa

SEQ ID NO: 316270 - RNA, 64 nt, Homo Sapiens
gguguaugggugugugugggugggugugaguguggguguguacguaccaauaaacaaccugguu

SEQ ID NO: 316271 - RNA, 64 nt, Homo Sapiens
cauucccuccaugcugucgucaucgacauauacagguguguacguagguguauguguguacucu

SEQ ID NO: 316272 - RNA, 64 nt, Homo Sapiens
acccuaggcuccccgcccacucgucgcugugcuugguguguaggcagaccccuccccgccacga

SEQ ID NO: 316273 - RNA, 64 nt, Homo Sapiens
gggggagaggguagcaagguuacccacugggccugguguguagauggcauagggaccagucuac

SEQ ID NO: 316274 - RNA, 64 nt, Homo Sapiens
caacccagugcuuccuaagaccuacuccccuuaggguguguaucuggaaggguuccuaacccaa

SEQ ID NO: 316275 - RNA, 64 nt, Homo Sapiens
ugccuuucuccugacuggccauguggggggaugagguguguauaugauagacuugcugaugugc

SEQ ID NO: 316276 - RNA, 64 nt, Homo Sapiens
augcugucauaucagagucagugacuguguccgugguguguauugggugacuguccguggaggg

SEQ ID NO: 316277 - RNA, 64 nt, Homo Sapiens
uaguaagauuacccugagcuccuggaccaccccugguguguagcucaugcagccuaaaguacag

SEQ ID NO: 316278 - RNA, 64 nt, Homo Sapiens
ggggaaagggucuuuccuggugugugcaugugcugguguguaagagggagggugugggugugcg

SEQ ID NO: 316279 - RNA, 64 nt, Homo Sapiens
uagaccccacccugagguccugcauuucucagucgguguguaaucacguuccagggcccaaagc

SEQ ID NO: 316280 - RNA, 64 nt, Homo Sapiens
ugauugugcagaauauucuaagaggucagaaauugguguguauaacuacauuuuuagugaugca

SEQ ID NO: 316281 - RNA, 64 nt, Homo Sapiens
uuccugcugccucugacuacucagccuuguuuucgguguguaggccccagcugcccacuggaac

SEQ ID NO: 316282 - RNA, 64 nt, Homo Sapiens
aagcacguggagccacaagaucaagcuggggggugguguguaagugagcuggcugaggcaucgc

SEQ ID NO: 316283 - RNA, 64 nt, Homo Sapiens
uguauguggggaguagguguggugugagccaugggguguguauucucuuucacuuucauuugcu

SEQ ID NO: 316284 - RNA, 64 nt, Homo Sapiens
uuauaguugaaacuguagaaagggucagguuggagguguguaauaaaaaagaauuaccuagguu

SEQ ID NO: 316285 - RNA, 64 nt, Homo Sapiens
gagucuuccacuucaaugcacauggugcaguuuugguguguaacuuagaaggauugaacuucuu

SEQ ID NO: 316286 - RNA, 64 nt, Homo Sapiens
guuuuuaaaucuuuuuuuaacuaauaagauuuacgguguguauuuuauacagaaaugcauuaua

SEQ ID NO: 316287 - RNA, 64 nt, Homo Sapiens
augauuuugcgggggaguggcuuuaugggcuugggguguguagaaagcaauugccugccuugua

SEQ ID NO: 316288 - RNA, 64 nt, Homo Sapiens
caucuggcugucuguccauugcagaguauccuaggguguguaucagguuguggccccugcaggg

SEQ ID NO: 316289 - RNA, 64 nt, Homo Sapiens
ucucucacuaccuuucucauugugccuuagagcagguguguacaccuguggaaacccuucuccc

SEQ ID NO: 316290 - RNA, 64 nt, Homo Sapiens
uguguguguguaugcauauagaguaguauucugugguguguauguucauuauuuuuuuuuggcu

SEQ ID NO: 316291 - RNA, 64 nt, Homo Sapiens
aaauuauuuuugaauugaacauuuaaugcaggcagguguguaauauuuuuauagaaguuugaaa

SEQ ID NO: 316292 - RNA, 64 nt, Homo Sapiens
gaaauaauauggaauuagcacacuaaauuuucaagguguguagaacagaaggguaccaguaaua

SEQ ID NO: 316293 - RNA, 64 nt, Homo Sapiens
aauuugaaaguuuacauuuuuuaugcuuuguguugguguguaauuuuuguacucuugguggcua

SEQ ID NO: 316294 - RNA, 64 nt, Homo Sapiens
uuagucguaggccuuaugauaauuaccccgcggugguguguagaaaaguauguaaauuugcucu

SEQ ID NO: 316295 - RNA, 64 nt, Homo Sapiens
auuauuuucuuuaguuuaaucuuggucauguuuugguguguauuuuuaauuuuuuucuuaaauu

SEQ ID NO: 316296 - RNA, 64 nt, Homo Sapiens
ucuacuaaaaauacaaaaauuagcuggguguggugguguguaccuguagucccagcuacccagg

SEQ ID NO: 316297 - RNA, 64 nt, Homo Sapiens
ccccucccuguuugacuucauucgacagacagaugguguguaugagaggugagccgaagaucaa

SEQ ID NO: 316298 - RNA, 64 nt, Homo Sapiens
auacacagacuaucacuaaacccuuuguggcacugguguguaaagauaaaauuuguaagguugc

SEQ ID NO: 316299 - RNA, 64 nt, Homo Sapiens
uuucauugcgauuuccuguuuauagacugugcaugguguguauauuacuggauucccacaguaa

SEQ ID NO: 316300 - RNA, 64 nt, Homo Sapiens
uguauaugugugcguguggugugucucugccauagguguguaugaauggucaauucagaagaaa

SEQ ID NO: 316301 - RNA, 64 nt, Homo Sapiens
augugccuaagccuccugaguagcugggaucacagguguguaccaccacgcccagcugauuuuu

SEQ ID NO: 316302 - RNA, 64 nt, Homo Sapiens
ucuacuuuuagcuucauucucccauauuuugaaggguguguaacuucagcucugcaggauugca

SEQ ID NO: 316303 - RNA, 64 nt, Homo Sapiens
accuugagcagauccagggaucagugagaggagugguguguaccccuaaauccucccaccccag

SEQ ID NO: 316304 - RNA, 64 nt, Homo Sapiens
uauauaaggaaaaaaaauagccugccuugggacagguguguaauguuagugugcaugacuaaug

SEQ ID NO: 316305 - RNA, 64 nt, Homo Sapiens
cauacucuguacauuuuucugugagagaaugaaugguguguauagauauauuuggaaacucuug

SEQ ID NO: 316306 - RNA, 64 nt, Homo Sapiens
aacucaccugaaugggacuugcucgcugcuugaugguguguacacuaacccuaauugaugagag

SEQ ID NO: 316307 - RNA, 64 nt, Homo Sapiens
ggccaaguuuugcuuguuguaagugcauuugauugguguguauuggagcucccagggaaaaacg

SEQ ID NO: 316308 - RNA, 64 nt, Homo Sapiens
aguagacugauuacacugaggugaggcuacaagggguguguaaccguguaacacgugaaggcaa

SEQ ID NO: 316309 - RNA, 64 nt, Homo Sapiens
gucuggccccuuugguuuccgugucauccuuuuugguguguaggacaaggagccagggaauugg

SEQ ID NO: 316310 - RNA, 64 nt, Homo Sapiens
auugagguuagggugaggggucaggguuuaggaggguguguauguugggaggacaggcuaguug

SEQ ID NO: 316311 - RNA, 64 nt, Homo Sapiens
uuauaguaaaacuagccuuucacauuaagguuuugguguguauuuuguuaaauaacuaacaugc

SEQ ID NO: 316312 - RNA, 64 nt, Homo Sapiens
uccuacagcagaaguucugagccugaccacagaugguguguaaucuaucaaacacaccccuggc

SEQ ID NO: 316313 - RNA, 64 nt, Homo Sapiens
uacacacccagagauggagccaacaaaggugacggguguguaggacuuauaccugagcccagua

SEQ ID NO: 316314 - RNA, 64 nt, Homo Sapiens
uuguaaguacuuuugugcaugaggguggggguuggguguguaaucuuuuucuucuguuuuuauu

SEQ ID NO: 316315 - RNA, 64 nt, Homo Sapiens
gggcaaaaugccaaaaagcagcccuggauaggaggguguguacaucuacuuggcaugaaagggu

SEQ ID NO: 316316 - RNA, 64 nt, Homo Sapiens
ucauuaaaaaauauaaauaugugugcuuuuuuuugguguguauuuguuugugaauuaucugcau

SEQ ID NO: 316317 - RNA, 64 nt, Homo Sapiens
gaggggaugaaucggaacgagacuguuggacagugguguguauuugagaggaugcucacuguaa

SEQ ID NO: 316318 - RNA, 64 nt, Homo Sapiens
uuacacuuucugcacaucucagcuuucgaaaucugguguguauuacauucucuuuuucauacua

SEQ ID NO: 316319 - RNA, 64 nt, Homo Sapiens
uguaccuuucagcauccuaggccaugacucuuuagguguguauguaagaaagcuguuuaagaag

SEQ ID NO: 316320 - RNA, 64 nt, Homo Sapiens
cuucuucaaaauuguacacacugucuuccagcacgguguguacacauuuugaccuguucagugu

SEQ ID NO: 316321 - RNA, 64 nt, Homo Sapiens
ugcauggauuaguuuuccugacaaagcauguuuugguguguagucuuacuuuuuagaaauagcu

SEQ ID NO: 316322 - RNA, 64 nt, Homo Sapiens
aggucaaagauguguucaggcauuccagguaacagguguguauguaaaguuaaaaauaggcuuu

SEQ ID NO: 316323 - RNA, 64 nt, Homo Sapiens
ugucaagaagaaaguuguauaagcuauugauaaggguguguaucuuaauguuguugaguuuugu

SEQ ID NO: 316324 - RNA, 64 nt, Homo Sapiens
acagcccuucuuuccacagaagcuccagguagaggguguguaaguagauaggccaugggcacug

SEQ ID NO: 316325 - RNA, 64 nt, Homo Sapiens
accagcaguugaaggaagagagugcauggcaccugguguguaacgacacaaucagcacaacugg

SEQ ID NO: 316326 - RNA, 64 nt, Homo Sapiens
gcacacuggacaggguucucuaagcagugaggcugguguguaugauugucuuaaaauuuuuuaa

SEQ ID NO: 316327 - RNA, 64 nt, Homo Sapiens
aggcuaugauuucucuugcacagaucggggaagggguguguaccaaacacauccccaggcagga

SEQ ID NO: 316328 - RNA, 64 nt, Homo Sapiens
auaccaauuaguuuuauauacuguacuuauguuugguguguaauacuauuacauuguacagaau

SEQ ID NO: 316329 - RNA, 64 nt, Homo Sapiens
uguagucacagguacuugggaagccgggugaggugguguguaccaaaaaaaaagaaaaaagaaa

SEQ ID NO: 316330 - RNA, 64 nt, Homo Sapiens
uuacaaauuauaauuuauguauccuuguuaaaaugguguguacccacugcaccaacacugucgu

SEQ ID NO: 316331 - RNA, 64 nt, Homo Sapiens
gagcagggagcugcgccuuccuggggugcccggugguguguagagaaaagcugcuuguuuacuc

SEQ ID NO: 316332 - RNA, 64 nt, Homo Sapiens
acaaaucuucuauuguguggaaaauguugugaaggguguguaggugugguacauguguauguca

SEQ ID NO: 316333 - RNA, 64 nt, Homo Sapiens
uuuuacgagaaaaagaaggggaaugguggggaaugguguguaccgauauauaguauuucuuuag

SEQ ID NO: 316334 - RNA, 64 nt, Homo Sapiens
uaaagagauaggggagaaaaguguucuuauuuaugguguguaugacccagggacauggacuugg

SEQ ID NO: 316335 - RNA, 64 nt, Homo Sapiens
aaaguccacauguaaauuuacuggcugcaucccagguguguagcugcaauggaacaaaacucau

SEQ ID NO: 316336 - RNA, 64 nt, Homo Sapiens
ccaagguuaccaacuaccuaagaaggaugucccggguguguacacuggggccugggcuguggac

SEQ ID NO: 316337 - RNA, 64 nt, Homo Sapiens
caaauaauacuugaccagcugguuuaccaaauaugguguguauugaaaagguaauauaauuuua

SEQ ID NO: 316338 - RNA, 64 nt, Homo Sapiens
gauguuucauuuugguuuuauaaccauuccaaucgguguguaguuugucaguauuuuuccuuuu

SEQ ID NO: 316339 - RNA, 64 nt, Homo Sapiens
uuuuauacgauguuuguuauauaguuuccaugaagguguguauguaccagaguugggagauaag

SEQ ID NO: 316340 - RNA, 64 nt, Homo Sapiens
caaggagucccuaacuuucuuaucccaugagagagguguguaaaggagaaagcuagaggugaac

SEQ ID NO: 316341 - RNA, 64 nt, Homo Sapiens
aaaauauucuuuguaugauuuagauuuuucauuugguguguaagaagaaaucuuuauuaauguu

SEQ ID NO: 316342 - RNA, 64 nt, Homo Sapiens
auuacuguaauacuucugcauuuuggcauucuuugguguguagacagauaguugacuuucuauc

SEQ ID NO: 316343 - RNA, 64 nt, Homo Sapiens
uuucaggggcuucacauggagaggaaaguuccaggguguguauguguccaucugugcauaagga

SEQ ID NO: 316344 - RNA, 64 nt, Homo Sapiens
ugaaaguggggugagguuccauaaagaaacguaggguguguaugcacaggauaauagguuuuuc

SEQ ID NO: 316345 - RNA, 64 nt, Homo Sapiens
ccaaggcccccuggcugugcccccagggaaggaggguguguaccggcagaggaggugcuggcgg

SEQ ID NO: 316346 - RNA, 64 nt, Homo Sapiens
ugguaaaaccuguucuccauugugaccacaggcugguguguaggugcuugaaugcugguacuau

SEQ ID NO: 316347 - RNA, 64 nt, Homo Sapiens
uaguuagccuugcuggggccauaauaugcuucaggguguguaaaagaagaaaucucuuuguggc

SEQ ID NO: 316348 - RNA, 64 nt, Homo Sapiens; identical to SEQ ID NO: 316347

SEQ ID NO: 316349 - RNA, 64 nt, Homo Sapiens
augcauuuuguuaaugcacauucuguuuguuuaagguguguaagauacacacccuucuagauga

SEQ ID NO: 316350 - RNA, 64 nt, Homo Sapiens
aguugcugauugcauuuccucucauuaacaauuggguguguaauaaaaagcauuguacuucauc

SEQ ID NO: 316351 - RNA, 64 nt, Homo Sapiens
cucagcccauuagguuaaacaccaaagaaagacugguguguacugaauaggaaagggaaguuuu

SEQ ID NO: 316352 - RNA, 64 nt, Homo Sapiens
uuucuaguuugcacauccagaacggcgaaggcuggguguguauuccacuaacugaaauauggca

SEQ ID NO: 316353 - RNA, 64 nt, Homo Sapiens
uaguggauccuggauggaacaauguuguaacauagguguguagaucagauaccagauuugauau

SEQ ID NO: 316354 - RNA, 64 nt, Homo Sapiens
cuuuugugugugugcgcaggauagaaaccagcaggguguguacaccaaacuuaacauucuugua

SEQ ID NO: 316355 - RNA, 64 nt, Homo Sapiens
uauacacacacacacauguaagguuacagcuggagguguguauagggccugcugagcucugguu

SEQ ID NO: 316356 - RNA, 64 nt, Homo Sapiens
aguaauuacacgaggcaaacugaaaauuugcucggguguguagcuugccuuuaaagauacagug

SEQ ID NO: 316357 - RNA, 64 nt, Homo Sapiens
uugaucugcauugacaccaguccucgccuggauggguguguauuggggacaggugaauaccugc

SEQ ID NO: 316358 - RNA, 64 nt, Homo Sapiens
ggggaaaauagcuaaaagucaaaaauauuaguuugguguguauuuuuguaaaacuugaagccau

SEQ ID NO: 316359 - RNA, 64 nt, Homo Sapiens
uguagccugaagaacuggagaauuggaaggaugugguguguaccuagccuguguugugcaaaag

SEQ ID NO: 316360 - RNA, 64 nt, Homo Sapiens
uuuuguaaguuguaacuugaccuacuuaaccuaugguguguacugaucuuccuaauaucaggcg

SEQ ID NO: 316361 - RNA, 64 nt, Homo Sapiens
gcgcaggugggcuggacuucuaccugcccucaaggguguguauauuguauaggggcaacuguau

SEQ ID NO: 316362 - RNA, 64 nt, Homo Sapiens
ucgcgccugcugcugugacccguuuuggaaaacugguguguaccgaggcgcugacugcacggcu

SEQ ID NO: 316363 - RNA, 64 nt, Homo Sapiens
guaugacagcuuuccuucacacacuauuuuuguggguguguauauaucugauuugggaagaauu

SEQ ID NO: 316364 - RNA, 64 nt, Homo Sapiens
cauggaggccaguguuggggagccuguggaggcagguguguagaauuguguucgggaggugggg

SEQ ID NO: 316365 - RNA, 64 nt, Homo Sapiens
ucacuagggcaguggggagacaugcucuccuguugguguguauguggauucugugccaucugaa

SEQ ID NO: 316366 - RNA, 64 nt, Homo Sapiens
cuuguauaacuuuguaaauacccauagaaaauuggguguguauauccucuguggcaaagcgugu

SEQ ID NO: 316367 - RNA, 64 nt, Homo Sapiens
uuugcaaauuguuuccuuuaauaugguuuugucagguguguaaaaugcauacauauguguguau

SEQ ID NO: 316368 - RNA, 64 nt, Homo Sapiens
cugauguguaauccaguaaaaucucccuuuuucggguguguaugugggcaugugcccauuucua

SEQ ID NO: 316369 - RNA, 64 nt, Homo Sapiens
cuuuauucugaagaauaaaccuagcuggcaugcugguguguaccuguaguccuagcuauuuggg

SEQ ID NO: 316370 - RNA, 64 nt, Homo Sapiens
gggcauaaugaauauaauuuacccaguggacaaagguguguaccaagugaauuuaaauaauugg

SEQ ID NO: 316371 - RNA, 64 nt, Homo Sapiens
cuugugacgucgggcauucauauaggaagaacgcgguguguaacacuguguacaccucaaauac

SEQ ID NO: 316372 - RNA, 64 nt, Homo Sapiens
uguacugcgucuguccacacucgauugggccccagguguguaugaggcgcucugguaaggugcu

SEQ ID NO: 316373 - RNA, 64 nt, Homo Sapiens
ggaggggggagaacuaaauguucacaauguauuugguguguaggauuaugucuuuauuccuuau

SEQ ID NO: 316374 - RNA, 64 nt, Homo Sapiens
gguaacauggggaaaaugcuguguccacauuuaugguguguauaaagaacaaaaaugggaggag

SEQ ID NO: 316375 - RNA, 64 nt, Homo Sapiens
cucaugugguuugcacagccuuaaaaagcaaacugguguguauugggccccuaugugggauuuu

SEQ ID NO: 316376 - RNA, 64 nt, Homo Sapiens
ggccucccgggagccacugugucugaggacaguggguguguacucccuuguguuguguguuucu

SEQ ID NO: 316377 - RNA, 64 nt, Homo Sapiens
cuggacaucucuuccagaguuaucccacuggcuugguguguauacauuaggggaggauaaucug

SEQ ID NO: 316378 - RNA, 64 nt, Homo Sapiens
guguccuguguauguguggguguguguguauuuggguguguaaauguugguucuuccacuacug

SEQ ID NO: 316379 - RNA, 64 nt, Homo Sapiens
uagauuccauauuaaugaggccagaaagaguguugguguguagggggguagggggcacagaaca

SEQ ID NO: 316380 - RNA, 64 nt, Homo Sapiens
uugagucuuuaacaaagugaucuacccaaaugcagguguguagggcagcccuuuccccuagaca

SEQ ID NO: 316381 - RNA, 64 nt, Homo Sapiens
aacugugauaacuguugcccgacaggacaugaaagguguguauguggcugugaggagugaguga

SEQ ID NO: 316382 - RNA, 64 nt, Homo Sapiens
uggcaaagagcucuucaaauuaauucuuucaaacgguguguauuagaucuuccaaggaaaaaca

SEQ ID NO: 316383 - RNA, 64 nt, Homo Sapiens
cccuguugguuugaaguguuagacuauagccccugguguguaaauaauguacauagagugagaa

SEQ ID NO: 316384 - RNA, 64 nt, Homo Sapiens
ucuagcugugucuaccauguauauucuuagaagggguguguaugagauauugaugauaguugaa

SEQ ID NO: 316385 - RNA, 64 nt, Homo Sapiens
acuuaacaccuggacuuuuaguguguagcauggggguguguacaugagaaggagaugaaggagu

SEQ ID NO: 316386 - RNA, 64 nt, Homo Sapiens
gcgugcuguaguggaaguuugggcuuggaacacagguguguacaagcacuggggggguuggggu

SEQ ID NO: 316387 - RNA, 64 nt, Homo Sapiens
uguccauguguggauguuggugggcuugggggaagguguguaucuugcuuucaagcaaaaugcc

SEQ ID NO: 316388 - RNA, 64 nt, Homo Sapiens
uuuguaaauguuaugcacuccaacgacugcugcugguguguauuacagaauuaauagcccuuag

SEQ ID NO: 316389 - RNA, 64 nt, Homo Sapiens
ugacacaaaaguuauuuacauugcacacuuuuuggguguguaaaggcugccagccucucacauc

SEQ ID NO: 316390 - RNA, 64 nt, Homo Sapiens
ucuaccaaaaauacaaaauguauccagacauggugguguguaccuguagucccagcuacucagg

SEQ ID NO: 316391 - RNA, 64 nt, Homo Sapiens
agacagcuugugcugcuugcacaacugagcugcugguguguaccccuuagcagggugucugggg

SEQ ID NO: 316392 - RNA, 64 nt, Homo Sapiens
augauuugucugcuaagaagaauucuauucucaggguguguaccuauuaccucuucuuggucag

SEQ ID NO: 316393 - RNA, 64 nt, Homo Sapiens
cagagaccgagagcaugaguguaggggggguguggguguguaacgagggcaucugaauacagga

SEQ ID NO: 316394 - RNA, 64 nt, Homo Sapiens
caaagugcucccuucccagaggaggggccccaucgguguguaagguggccuauuccucugugug

SEQ ID NO: 316395 - RNA, 64 nt, Homo Sapiens
uccaccuggggggcccuuccccagcauaccugcugguguguaaguguggacuaacccgccgcca

SEQ ID NO: 316396 - RNA, 64 nt, Homo Sapiens
uggugguggccuguuugaaaguaaaaaccugcuugguguguagguuccguaucucccuggagaa

SEQ ID NO: 316397 - RNA, 64 nt, Homo Sapiens
uacgcagccuccagggcaccaugugaauucuuaggguguguacgcuaaucuucugcuaauggug

SEQ ID NO: 316398 - RNA, 64 nt, Homo Sapiens
gcugcuguguaucaaaagaccuggggggcacagugguguguaguagcagacagagugaagcugg

SEQ ID NO: 316399 - RNA, 64 nt, Homo Sapiens
aagggaugguggagugagagccuuugccuuuagggguguguauucacauaguccucagggcuca

SEQ ID NO: 316400 - RNA, 64 nt, Homo Sapiens
uuauagugucgggcuuccggggaaagcaaucauugguguguauguguaugugcaugcacacacg

SEQ ID NO: 316401 - RNA, 64 nt, Homo Sapiens
ucccaccucagccgccgaaguagcugggacuauagguguguaccaucacaccuggcuaauuuuu

SEQ ID NO: 316402 - RNA, 64 nt, Homo Sapiens
ucagacugauggugcccaugagaguggagucuccgguguguacccagaagugagcgcugggaac

SEQ ID NO: 316403 - RNA, 64 nt, Homo Sapiens
aaggggggugacaaggucccggaguagaaccagggguguguaugggaggcacggggaagguuuu

SEQ ID NO: 316404 - RNA, 64 nt, Homo Sapiens
agggucauacccccucccucggagcuaguggagggguguguaacuggguaccccccaaccucca

SEQ ID NO: 316405 - RNA, 64 nt, Homo Sapiens
ugaagugguucucagucccccaaggaccaaagaagguguguaaggaguugaccucugguucagc

SEQ ID NO: 316406 - RNA, 64 nt, Homo Sapiens
uaacuuaucacuggaccacuauuauucaaaguaggguguguauguuuucuccaauuuggcuggg

SEQ ID NO: 316407 - RNA, 64 nt, Homo Sapiens
cagggcauucuguuggccuaaacgcaugugguaagguguguacuugaguguguggaugcgugug

SEQ ID NO: 316408 - RNA, 64 nt, Homo Sapiens
acuacauccagcuaaaggaguaacugggacuacagguguguaccaauccuccucucagccugag

SEQ ID NO: 316409 - RNA, 64 nt, Homo Sapiens
ccuggcaucuguggcauguguguguugggugugggguguguacaauaaggggguguguguagug

SEQ ID NO: 316410 - RNA, 64 nt, Homo Sapiens
auaccugcugggccagucccuggccuguguccuggguguguaccacuaaugccuguccugccuc

SEQ ID NO: 316411 - RNA, 64 nt, Homo Sapiens
agaagcaguacuagaaacuuuccaaggagucuuggguguguagccaagaggagccaugagcuau

SEQ ID NO: 316412 - RNA, 64 nt, Homo Sapiens
aaccugugugcucacccacagagcaugggguaaugguguguagacacaggcccucugcagaagc

SEQ ID NO: 316413 - RNA, 64 nt, Homo Sapiens
uugguugaauaguucuauacaaaugaaguauggagguguguauguuuauauguauauaacaaaa

SEQ ID NO: 316414 - RNA, 64 nt, Homo Sapiens
uuggggaagucaaauggccaaaugaacuguaguagguguguaguucucugugaaagcaacauga

SEQ ID NO: 316415 - RNA, 64 nt, Homo Sapiens
uuuuaacugucaugaaauaccaaaacaggugguagguguguaauucuuuuuuagcaagauugac

SEQ ID NO: 316416 - RNA, 64 nt, Homo Sapiens
gcauaugccaaggaaaugucgcugagaguugauggguguguaauuacaacauuauuaagacaca

SEQ ID NO: 316417 - RNA, 64 nt, Homo Sapiens
ccacgcuaauaaaauguguugcgaggcugacgcugguguguaugcgagcgcccgccucccagcc

SEQ ID NO: 316418 - RNA, 64 nt, Homo Sapiens
ugacugcuuuucucagccccaagccucuagucuggguguguacggagggucuagccugggugug

SEQ ID NO: 316419 - RNA, 64 nt, Homo Sapiens
cucuagucuggguguguacggagggucuagccuggguguguacggagggucuagccugggugag

SEQ ID NO: 316420 - RNA, 64 nt, Homo Sapiens
gucuagccugggugaguacggagggucuagccuggguguguauggaggaucuagccugggugag

SEQ ID NO: 316421 - RNA, 64 nt, Homo Sapiens
gucuagccugggugaguauggagggucuagccuggguguguauggagggucuagccugggugag

SEQ ID NO: 316422 - RNA, 64 nt, Homo Sapiens; identical to SEQ ID NO: 316421

SEQ ID NO: 316423 - RNA, 64 nt, Homo Sapiens
gucuagccugggugaguauggagggucuagccuggguguguacggagggucuagucugagugcg

SEQ ID NO: 316424 - RNA, 64 nt, Homo Sapiens
gggggcuggggggcaggcugaauguguguguguggguguguauguguggagugugugugugugu

SEQ ID NO: 316425 - RNA, 64 nt, Homo Sapiens
aucuugaaaaagaaacuuuagagaaagcaucagggguguguacucaguauuucaaaucagaaca

SEQ ID NO: 316426 - RNA, 64 nt, Homo Sapiens
cggagauggagguguaggcuggagagacauuguggguguguaucuucuuaucucauuucacaag

SEQ ID NO: 316427 - RNA, 64 nt, Homo Sapiens
ggcagagccuugacuggauggagguggggagugugguguguaaagucucuggccucauaaaagg

SEQ ID NO: 316428 - RNA, 64 nt, Homo Sapiens
agcauuuucuauaauuuuauaaaugaaaccauaugguguguacuuuuuaggggguggggcucug

SEQ ID NO: 316429 - RNA, 64 nt, Homo Sapiens
accacaccgggcuaauuuuuuauuugaaacuacagguguguaccugccucagucccccuccagg

SEQ ID NO: 316430 - RNA, 64 nt, Homo Sapiens
cugcuacaaggaguuguuggaauauuuucccacugguguguagcaaaugcaaacaugagcagaa

SEQ ID NO: 316431 - RNA, 64 nt, Homo Sapiens
agcaugcauuuguaggcaccuuaauggaugucuugguguguagggaaagcauggcuuuauuuuc

SEQ ID NO: 316432 - RNA, 64 nt, Homo Sapiens
ucagaaacuuccaaacgcagugcccuguucugccgguguguacagccucagcgcaccaggagac

SEQ ID NO: 316433 - RNA, 64 nt, Homo Sapiens
acacgaggaaacauuauucauuggaaaagugcaugguguguauuuuagggauuaugagcuucuu

SEQ ID NO: 316434 - RNA, 64 nt, Homo Sapiens
guuuuuaaguccuguauauguauguaguaguuuggguguguauauauaguagcauuucaaaaug

SEQ ID NO: 316435 - RNA, 64 nt, Homo Sapiens
uaaaccuguaagcccagcauuugagagaagguaggguguguauauauaaaagguuguguacaac

SEQ ID NO: 316436 - RNA, 64 nt, Homo Sapiens
uguaggccuagcugcucagguagcugggcguggugguguguacccuacagaaaaauuuuaaaau

SEQ ID NO: 316437 - RNA, 64 nt, Homo Sapiens
ugcaugcagccuacacccacgaaggagucugugugguguguaugggcugagcaagccaggaagg

SEQ ID NO: 316438 - RNA, 64 nt, Homo Sapiens
auguaucagggaccauggcccucuacuaaguacagguguguauaaaucacauaaauauagcgag

SEQ ID NO: 316439 - RNA, 64 nt, Homo Sapiens
ggaaucccucccccucuuacgggcggggggcggggguguguaugcaucagcauggcggggcggg

SEQ ID NO: 316440 - RNA, 64 nt, Homo Sapiens
acagggucccacagguuuggcggaacaaaaaugagguguguagaacacaaggaggaugaaacgc

SEQ ID NO: 316441 - RNA, 64 nt, Homo Sapiens
acccacagaggcuccggguggguguucugggcaugguguguaagacacaucugcuauuuccugu

SEQ ID NO: 316442 - RNA, 64 nt, Homo Sapiens
gcagccuaacauuguucaggcgcauggccccugcgguguguacacgaacucggcuucuuuuguc

SEQ ID NO: 316443 - RNA, 64 nt, Homo Sapiens
aacgggcaugagcagaggugagcgugagcgagcggguguguauguacgagugugcacgugugug

SEQ ID NO: 316444 - RNA, 64 nt, Homo Sapiens
cuugaauuccuuccguauggccuacccuaaggcagguguguauguccccuagccuuuguccuca

SEQ ID NO: 316445 - RNA, 64 nt, Homo Sapiens
gcacaaggacauuguaugcaguaagguugugcaggguguguacuaacccagccacgacugccau

SEQ ID NO: 316446 - RNA, 64 nt, Homo Sapiens
ccaugccggcuggaagaagaaccucgcaucuuuugguguguaugcaccuuggcagccagcagga

SEQ ID NO: 316447 - RNA, 64 nt, Homo Sapiens
cuucucuaagggcuuuacaaggaucaaauaagaugguguguauguaagaaauuuguaaaaugug

SEQ ID NO: 316448 - RNA, 64 nt, Homo Sapiens
uuauguguguguguguguguguguguguguguaugguguguauuccauaucuauucccauguaa

SEQ ID NO: 316449 - RNA, 64 nt, Homo Sapiens
uuuuuguuuguuucuuuuucaugguauuacugaagguguguauacucccuaauacacauuuaug

SEQ ID NO: 316450 - RNA, 64 nt, Homo Sapiens
augaauucuuugaacucuuacaaauuauccacaugguguguauuagccauggguuuuuuaaccc

SEQ ID NO: 316451 - RNA, 64 nt, Homo Sapiens
cuguagaguuuccacauuucuggagagaagcugugguguguaugaaaagucaguuaugauuguc

SEQ ID NO: 316452 - RNA, 64 nt, Homo Sapiens
uaauuuguucaaaagaaaaaaaaagaagauuguugguguguaauuccuggguucauguuguaau

SEQ ID NO: 316453 - RNA, 64 nt, Homo Sapiens
uacuuuagaaaaaaugaaaaaauuggguggggcagguguguauuccauguaaucagauuuauuu

SEQ ID NO: 316454 - RNA, 64 nt, Homo Sapiens
uugaaguuuuggacugaaauaacaaacauauuuggguguguaauguccaaguauagauuaaggc

SEQ ID NO: 316455 - RNA, 64 nt, Homo Sapiens
cuaguauguaugugcuuugccaaccuuaccaagugguguguaaaauuuccccaguacuuuuagc

SEQ ID NO: 316456 - RNA, 62 nt, Homo Sapiens
cguggugcggugugugacugauaaaaguugucaugguguguauggaguuucucuugagggca

SEQ ID NO: 316457 - RNA, 64 nt, Homo Sapiens
agguaaauuguggacucaggauuuuuugaaacuugguguguaacucuaaaucuuguauaugcau

SEQ ID NO: 316458 - RNA, 64 nt, Homo Sapiens; identical to SEQ ID NO: 316449

SEQ ID NO: 316459 - RNA, 64 nt, Homo Sapiens
cgcuacuggcaucuguuaucuaguaugcauuucugguguguaucugaaaggaagacauuuucua

SEQ ID NO: 316460 - RNA, 61 nt, Homo Sapiens
ccaccucagccucccaaagugcugggaugacaggugugagccacugcgcccagccugaauc

SEQ ID NO: 316461 - RNA, 61 nt, Homo Sapiens
ccaucucagccucccagagugcugggauuacaggugugagcuacugcgcccagccccagaa

SEQ ID NO: 316462 - RNA, 61 nt, Homo Sapiens
gacauucggauaauucgggcuauuuguauucaggugugagcuggcaaauccgagaccuguu

SEQ ID NO: 316463 - RNA, 61 nt, Homo Sapiens
gugcucagucugaagacguuggacccaaguuaggugugacacguucacacgacuauguagc

SEQ ID NO: 316464 - RNA, 61 nt, Homo Sapiens
cugccucggccucccaaagugcugggauuacaggugugagccaccgugcccagccuauacu

SEQ ID NO: 316465 - RNA, 61 nt, Homo Sapiens
auacagcuuggcacuuuaaagcauuaacagcaggugugacccugagggcuccuccauggug

SEQ ID NO: 316466 - RNA, 61 nt, Homo Sapiens
caaaauaguagaacucgugguugcuuuggacaggugugauuugugcaagccagguucaacc

SEQ ID NO: 316467 - RNA, 61 nt, Homo Sapiens
uuuuuguuuuguuuuguuuucuuucuaaucgaggugugaaaaaguucuagguucaguugaa

SEQ ID NO: 316468 - RNA, 61 nt, Homo Sapiens
ccaucuucgccucccaaaguucugagauagcaggugugagucaucaugcccagccuccuug

SEQ ID NO: 316469 - RNA, 61 nt, Homo Sapiens
ccaccuuggccucccaaagugcugggauuacaggugugagccaccacgcccggccgauuug

SEQ ID NO: 316470 - RNA, 61 nt, Homo Sapiens
guauugauuucaaauaggaaguugguagacuaggugugaggaugaaauaaugaccuugauu

SEQ ID NO: 316471 - RNA, 61 nt, Homo Sapiens
cugccucugccucccaaagugcugggauuacaggugugacccacugcgcacagccccagcu

SEQ ID NO: 316472 - RNA, 61 nt, Homo Sapiens
caacuagugaaaggcuuugccuccggggggcaggugugacuuccauuucaucagugccugc

SEQ ID NO: 316473 - RNA, 61 nt, Homo Sapiens
guuucacaguauuucaugaauuuacccacacaggugugauccuccuugagcauugaggagg

SEQ ID NO: 316474 - RNA, 61 nt, Homo Sapiens
gcacgaucuguauauaguacaucaaacuuagaggugugaccuuaaauuuaacuuuuuuuaa

SEQ ID NO: 316475 - RNA, 55 nt, Homo Sapiens
uuuacccuaagucgaacugaguauaaggugugacuauuggauucuugaacuaaaa

SEQ ID NO: 316476 - RNA, 61 nt, Homo Sapiens
ccaccucagccucccaaagugcugggauuacaggugugagccaccacgcccggcuauguuu

SEQ ID NO: 316477 - RNA, 61 nt, Homo Sapiens
cugccucggccucccaaagugcugagacuacaggugugagccaccgugcucagccacuagc

SEQ ID NO: 316478 - RNA, 61 nt, Homo Sapiens
ugauuuucgagcuucuguaugcuaagaaaauaggugugaaaaacugguguucugaaauagc

SEQ ID NO: 316479 - RNA, 61 nt, Homo Sapiens
ccgccucggccucccaaagugccgagauuacaggugugagccaccgcgcucggccagagcu

SEQ ID NO: 316480 - RNA, 61 nt, Homo Sapiens
gaguucuggggugggaguuuugcucucugucaggugugauaaaauguugaacccuccccac

SEQ ID NO: 316481 - RNA, 61 nt, Homo Sapiens
accaggaugaaggcgugcaaggggcucagcaaggugugaaugaccuuaguccgcaaguuca

SEQ ID NO: 316482 - RNA, 61 nt, Homo Sapiens
aggcuucccuuggcucccaaggagguguagcaggugugagcaauauuagugccaugugccu

SEQ ID NO: 316483 - RNA, 61 nt, Homo Sapiens
uuaggacuuuuuuugaaguuccuuuuuacuuaggugugaaagaugguucuuuguugaaaua

SEQ ID NO: 316484 - RNA, 61 nt, Homo Sapiens
gaucuuauaagaaaugcaagaggauauugauaggugugaacuaguucaucaaguagcccaa

SEQ ID NO: 316485 - RNA, 61 nt, Homo Sapiens
uuuucccauuauguucccuuuuauaccauuuaggugugaguuccuuagcuucugccuauag

SEQ ID NO: 316486 - RNA, 61 nt, Homo Sapiens
ggaaugugauauacagcacccugauccuaacaggugugauuguuacguaagacgcugauac

SEQ ID NO: 316487 - RNA, 61 nt, Homo Sapiens
cugccuuggccucccaaagugcugggauuacaggugugagcugccacgcccagccccagua

SEQ ID NO: 316488 - RNA, 61 nt, Homo Sapiens
aggggcuguuauauacauauauacacaaccaaggugugaucugaauuuaauccacauuugg

SEQ ID NO: 316489 - RNA, 61 nt, Homo Sapiens
ccauuuucugucuuuaauuaaccaagguguuaggugugacugucacaacuguuauguuuuc

SEQ ID NO: 316490 - RNA, 61 nt, Homo Sapiens
gaguaucauuugccaaccaaaaggcuuucagaggugugaauggaucuccaaggauaagugu

SEQ ID NO: 316491 - RNA, 61 nt, Homo Sapiens
ccaccucggcuucccaaagugcugagauuacaggugugagccaccgcacccggccaacuuu

SEQ ID NO: 316492 - RNA, 61 nt, Homo Sapiens
ugaccucuaaagcagcgugacugaacacagaaggugugaacucagaauuccagccgcucau

SEQ ID NO: 316493 - RNA, 61 nt, Homo Sapiens
ucagaaacaaugacauccagccugucuaggaaggugugaugcagauccuuuuccagaaaua

SEQ ID NO: 316494 - RNA, 61 nt, Homo Sapiens
guuuggacccaggccucaucaaaagcaacugaggugugacuaguugggaggcauguuucug

SEQ ID NO: 316495 - RNA, 61 nt, Homo Sapiens
ccugcugcacucaucugauguugucaugcugaggugugacauaccaaucuuuugugacaua

SEQ ID NO: 316496 - RNA, 61 nt, Homo Sapiens
cgugaucacauuuucuauuuuguaaauuucuaggugugagcguugaagucugagcacuuua

SEQ ID NO: 316497 - RNA, 61 nt, Homo Sapiens
cauggcacccggucuugguugcugggauuauaggugugagccugccuuggucuccuaaagu

SEQ ID NO: 316498 - RNA, 61 nt, Homo Sapiens
caccacaccuggcuaauuuugggaggaccacaggugugagcucaccucagccucccgagua

SEQ ID NO: 316499 - RNA, 61 nt, Homo Sapiens
caccgcacccggcuggccaagcugggauuacaggugugagcccaccucagccucccaaagu

SEQ ID NO: 316500 - RNA, 61 nt, Homo Sapiens
gcccacauugucuguagccaaaagcuagucuaggugugagagcccaagcccuuccaccaga

SEQ ID NO: 316501 - RNA, 61 nt, Homo Sapiens
aguguguaccaguuuaaagcacuugaaauauaggugugaacuugcaaauaugcauuuccaa

SEQ ID NO: 316502 - RNA, 61 nt, Homo Sapiens
cacagcgccuggcccagugugcugggauuacaggugugagcccaccucggccucccaaagu

SEQ ID NO: 316503 - RNA, 61 nt, Homo Sapiens
cacugcacccagccuaccuugcugggauuacaggugugagcccgccucagccucccaaagu

SEQ ID NO: 316504 - RNA, 61 nt, Homo Sapiens
acuuguaacuguaaucccagauaaaucagccaggugugaugaauuuuaaaaucaggaaaga

SEQ ID NO: 316505 - RNA, 61 nt, Homo Sapiens
uacaggucucuguguaaugucaucaauaaccaggugugagcgcagaggccuccaccaaggc

SEQ ID NO: 316506 - RNA, 61 nt, Homo Sapiens
uaacaauucaaucucuucuuuuucuguuuuaaggugugaggaauagugggucugcugcuac

SEQ ID NO: 316507 - RNA, 61 nt, Homo Sapiens
acuagguuuuucuucuuccuuaccucccuggaggugugaagggagagugcagagaaauauc

SEQ ID NO: 316508 - RNA, 61 nt, Homo Sapiens
cguucacauaacugugcagcggacccacguuaggugugacagugcucagucugaagacaau

SEQ ID NO: 316509 - RNA, 61 nt, Homo Sapiens
gaguaaagugugggauuguuucuuggauuccaggugugaugugucuuuggacuuguagacc

SEQ ID NO: 316510 - RNA, 61 nt, Homo Sapiens
acagcuauggaggcccccaggugccaagaggaggugugaugcuuugcugacugccaacuua

SEQ ID NO: 316511 - RNA, 61 nt, Homo Sapiens
uuuguuaccacccauuucucccuggugguacaggugugacaaaugcucaagaugugauggg

SEQ ID NO: 316512 - RNA, 61 nt, Homo Sapiens
caccacgcccgguacauauugcugggauuacaggugugagccugccucggccucccaaagu

SEQ ID NO: 316513 - RNA, 61 nt, Homo Sapiens
ucugugagucacugcuaagagaacccaccgcaggugugagucgcuccaccccuuagccugg

SEQ ID NO: 316514 - RNA, 61 nt, Homo Sapiens
ugugggacugucugggccuguggaggguggaaggugugauccaagagaagcuaagcggaaa

SEQ ID NO: 316515 - RNA, 61 nt, Homo Sapiens
gaccacauccggucaaguucucugggauuacaggugugagcccaccucggccucccaaagu

SEQ ID NO: 316516 - RNA, 61 nt, Homo Sapiens
agggcucaguagcuucucugauuaggaaaccaggugugaaaugaaauucucugaaaauccc

SEQ ID NO: 316517 - RNA, 61 nt, Homo Sapiens
caccgcaccuggccuaaaccgcugggauuacaggugugagccugccucggacucccaaagu

SEQ ID NO: 316518 - RNA, 61 nt, Homo Sapiens
gcugaggaauauguguuccuugugucuucaaaggugugagacauuuauauugcccaucucc

SEQ ID NO: 316519 - RNA, 61 nt, Homo Sapiens
ugacaugagggccggaggcgcaacucuggucaggugugauuccaaaacaggacugugguga

SEQ ID NO: 316520 - RNA, 61 nt, Homo Sapiens
ccugagguccauggaggugcgugcucaggccaggugugaauggcugcauuuagaucaccgu

SEQ ID NO: 316521 - RNA, 61 nt, Homo Sapiens
acccaccuuagccucccaaagugcugggauuaggugugagccaccgcaccuggccgauauu

SEQ ID NO: 316522 - RNA, 61 nt, Homo Sapiens
ugucggcuuuuugccaucugugauaugccauaggugugacaauccgagcaguggagucauu

SEQ ID NO: 316523 - RNA, 61 nt, Homo Sapiens
aaaggccagagaugggccuccuucccuggggaggugugauguaguuaucacauucaggacc

SEQ ID NO: 316524 - RNA, 61 nt, Homo Sapiens
caauagacuggccccaacucaggcuggacuaaggugugauuaauucuuuguuuuuugugug

SEQ ID NO: 316525 - RNA, 61 nt, Homo Sapiens
uugcgcgcggugccggcugggucuguaccaaaggugugaaggaaagaagacaccgaccacg

SEQ ID NO: 316526 - RNA, 61 nt, Homo Sapiens
uuauccucucaacuagauuguaagcacuuggaggugugacuuacaggucuuuguaucucac

SEQ ID NO: 316527 - RNA, 61 nt, Homo Sapiens
cugcucaagagaaacccugagaaaccccaguaggugugagcuccuggguguucauucauuu

SEQ ID NO: 316528 - RNA, 61 nt, Homo Sapiens
ccaccucggccuccgaaagugcuaggauuacaggugugagccacugugccuggccuccggu

SEQ ID NO: 316529 - RNA, 61 nt, Homo Sapiens
acuuuaaucugcuuuuauguuuucaggcugaaggugugaaaauccuaagaggauuucauau

SEQ ID NO: 316530 - RNA, 61 nt, Homo Sapiens
cugccucagccucccaaagugcugagauuacaggugugagccaccaggcucagcccccuaa

SEQ ID NO: 316531 - RNA, 61 nt, Homo Sapiens
aauaugugacuuuuuaaaaaagcugucaaauaggugugacccuacuaauaauuauuagaaa

SEQ ID NO: 316532 - RNA, 61 nt, Homo Sapiens
cugccuuggccuuccagagugcugggauuacaggugugagccaccacgcccagccuugcau

SEQ ID NO: 316533 - RNA, 61 nt, Homo Sapiens
ccgccuuggccucccaaagugcugggauuacaggugugagccacuauacccgaccagauca

SEQ ID NO: 316534 - RNA, 61 nt, Homo Sapiens
caaguucucccugaaagagggcagucacaagaggugugaagaguagcagccgaugcucucu

SEQ ID NO: 316535 - RNA, 61 nt, Homo Sapiens
ugggcuuccccuuacccagggcugcacagccaggugugagggucaccggcaggugggcugg

SEQ ID NO: 316536 - RNA, 61 nt, Homo Sapiens
uagaaagucacauauauacaacuuguaugaaaggugugaauuguugcaauuaaguuuuagu

SEQ ID NO: 316537 - RNA, 61 nt, Homo Sapiens
agaauuuacgugguugugauugugggagcagaggugugaagcuuucccugcaguccuucca

SEQ ID NO: 316538 - RNA, 61 nt, Homo Sapiens
ggagagaccucuucugcaccucacugcacgcaggugugagacacaggagguccugauguca

SEQ ID NO: 316539 - RNA, 61 nt, Homo Sapiens
gugucuguaugcgugccuguuguguguacauaggugugagugagcugacuaucucuuuuga

SEQ ID NO: 316540 - RNA, 61 nt, Homo Sapiens
caccaggcccagccuauaucgcugggauuacaggugugagcccgccucagccucccaaagu

SEQ ID NO: 316541 - RNA, 61 nt, Homo Sapiens
agcagggcucagcagcaaguuaaaggcaagcaggugugaagugaaauaaauacuagcugag

SEQ ID NO: 316542 - RNA, 61 nt, Homo Sapiens
cuguuuaaggcucuucauccugguuagcaaaaggugugaauguaaugugauggaauuuaaa

SEQ ID NO: 316543 - RNA, 61 nt, Homo Sapiens
auuuuagcaaggggagguaggaguggaagagaggugugaagaaaccucuccgaacaaauga

SEQ ID NO: 316544 - RNA, 61 nt, Homo Sapiens
gggagugagucacaggagccugucccccaacaggugugacugcucugacaaccuguggcau

SEQ ID NO: 316545 - RNA, 61 nt, Homo Sapiens
ccgccuuggccucccaaagugcugggauuacaggugugagccaccaugccuggcccuaauu

SEQ ID NO: 316546 - RNA, 61 nt, Homo Sapiens
cugccucagccucccaaagugcugggauuacaggugugagucaccacaucuggucggauuu

SEQ ID NO: 316547 - RNA, 61 nt, Homo Sapiens
ucagcuugaacugccagugcaccagcaguuuaggugugaugagagaauucagauauacuuu

SEQ ID NO: 316548 - RNA, 61 nt, Homo Sapiens
ugggggcugaagaccauccucuugaccacagaggugugacugugggaauuccucccaauuu

SEQ ID NO: 316549 - RNA, 61 nt, Homo Sapiens
aggagaguaccugcugcaggaccuggaggucaggugugaaugcuguauuggcacagggaau

SEQ ID NO: 316550 - RNA, 61 nt, Homo Sapiens
ucccugcauuuuuuuuuuuuuuuugagagagaggugugaugagggaugugugugugcagcu

SEQ ID NO: 316551 - RNA, 61 nt, Homo Sapiens
ccgucucagccucccaaagggcugagauuacaggugugagcuaccucaccuggccaaaaca

SEQ ID NO: 316552 - RNA, 61 nt, Homo Sapiens
ccaccucagccucccaaacugcugggauuacaggugugagccaccgugaccagccaaugug

SEQ ID NO: 316553 - RNA, 61 nt, Homo Sapiens
cugccucagucucucaaagugcugggauuacaggugugagccacugugcccagccuaauug

SEQ ID NO: 316554 - RNA, 61 nt, Homo Sapiens
aaguggguugggguacagacgaaacaggaguaggugugaguugauaauguugaaguugagu

SEQ ID NO: 316555 - RNA, 61 nt, Homo Sapiens
ccucauaccuugcccauucccucugaauauuaggugugaugucaacagcauguuagaagga

SEQ ID NO: 316556 - RNA, 61 nt, Homo Sapiens
agaaccuuggagaucagaacugauucucaccaggugugagaggugugguagcagauugcaa

SEQ ID NO: 316557 - RNA, 61 nt, Homo Sapiens
uaguguuagauuuuuuugaugaauaauauuuaggugugauacaaacaggaucuaagcuuag

SEQ ID NO: 316558 - RNA, 61 nt, Homo Sapiens
uauuuuagcuuuuuugucuuccaggauuaggaggugugagaugaggaaaaaagauugcacu

SEQ ID NO: 316559 - RNA, 61 nt, Homo Sapiens
cacugugcccggccaaaagagcugggauuacaggugugagcccgccucggccucccaaaau

SEQ ID NO: 316560 - RNA, 61 nt, Homo Sapiens
cacugugccuggccagauaugcugggauuacaggugugagaccgccuuggccacccaaagu

SEQ ID NO: 316561 - RNA, 61 nt, Homo Sapiens
caccacgcauggcccugaacgcugggauuacaggugugagccccaccuugccucccaaagu

SEQ ID NO: 316562 - RNA, 61 nt, Homo Sapiens
ccagggcccgccaaccgcugugaagccugggaggugugaacaauguuaccagcccaccuuc

SEQ ID NO: 316563 - RNA, 61 nt, Homo Sapiens
ucagaaucaugagcaccaugcaucaacaugaaggugugacauugcugggugaucauacaua

SEQ ID NO: 316564 - RNA, 61 nt, Homo Sapiens
cacugggcccggucuuuuuugcugggauuacaggugugagcccgccucggccucccgaagu

SEQ ID NO: 316565 - RNA, 61 nt, Homo Sapiens
ccuccccagccucccaaagugcugggauuacaggugugagccaccacagccagccaguaug

SEQ ID NO: 316566 - RNA, 61 nt, Homo Sapiens
ccuccacagccucccaaacugcugggauuacaggugugagccaccgcacguagcauuuaca

SEQ ID NO: 316567 - RNA, 61 nt, Homo Sapiens
ccgccucagcuucccaaagugcugggauuacaggugugagucacugcacccagccgaguug

SEQ ID NO: 316568 - RNA, 61 nt, Homo Sapiens
aaguuaacaaaucaacuuccauuuggauuguaggugugaaggcacaacucuaauugcuauu

SEQ ID NO: 316569 - RNA, 61 nt, Homo Sapiens
ccaccucagccucccaaagugcugggauuacaggugugagccaccacacuuggccaguaua

SEQ ID NO: 316570 - RNA, 61 nt, Homo Sapiens
gucuuaugaaccuuaugagaaaacuccgaagaggugugagcaggauucuucugaaugacug

SEQ ID NO: 316571 - RNA, 61 nt, Homo Sapiens
ccaccucggccucccaaagugcugggauuacaggugugagccacugugccuggccccccac

SEQ ID NO: 316572 - RNA, 61 nt, Homo Sapiens
caccacgccuggcccaugaagcugggauuacaggugugagcccgucucggccucccaaagu

SEQ ID NO: 316573 - RNA, 61 nt, Homo Sapiens
caccacgccuggccggcuuagcugggauuacaggugugagccugccuuggccucccaaagu

SEQ ID NO: 316574 - RNA, 61 nt, Homo Sapiens
accuuuccugaaauucugaccucuuccuuacaggugugagcaugcugcaugaaagcguuau

SEQ ID NO: 316575 - RNA, 61 nt, Homo Sapiens
cuguuacugauacuauaaguuacugaaaaacaggugugaucagauguauucauccuggugu

SEQ ID NO: 316576 - RNA, 61 nt, Homo Sapiens
cagacuugacuugcuguugcucagcgugaugaggugugagaaagagaggcagaucaggaug

SEQ ID NO: 316577 - RNA, 61 nt, Homo Sapiens
gagcuuauugucaaagccaaugauuuacugaaggugugauguccuucauucagacgggcuc

SEQ ID NO: 316578 - RNA, 61 nt, Homo Sapiens
ugcuguaucauuugaaccaaagugaggaaugaggugugauucugaguguguccagauacca

SEQ ID NO: 316579 - RNA, 61 nt, Homo Sapiens
caccgugcccggccaaguaagcugggauuacaggugugagcccgccuuggccucccaaagu

SEQ ID NO: 316580 - RNA, 61 nt, Homo Sapiens
ugugucaacuuugauccuuugucucccaggaaggugugaccucuccuuugccugcauaccu

SEQ ID NO: 316581 - RNA, 61 nt, Homo Sapiens
ccagccucggccuucugaagugcugggauucaggugugagccacugugcccagcagggaug

SEQ ID NO: 316582 - RNA, 61 nt, Homo Sapiens
cugccucugccucccgaagugcuuggauuacaggugugagccacuguguccagccuguaac

SEQ ID NO: 316583 - RNA, 61 nt, Homo Sapiens
guuuugagaaggcccaacaggaguuugcaacaggugugauguccaacaaaacuguccagac

SEQ ID NO: 316584 - RNA, 61 nt, Homo Sapiens
ccgccucagccucccaaaguguugggauuacaggugugagccacugcgccuggccuaaaca

SEQ ID NO: 316585 - RNA, 61 nt, Homo Sapiens
gugugacaagccaguucuacaggcauuaccuaggugugagacuaaaagcuuuucuuauuga

SEQ ID NO: 316586 - RNA, 61 nt, Homo Sapiens
uuucuuauugacuuaaauuuggauaacagcaaggugugaggggggugguggguauggugug

SEQ ID NO: 316587 - RNA, 61 nt, Homo Sapiens
ccacuucagacccccaaagugcugggauuccaggugugagccgcugcggccgaccacauuu

SEQ ID NO: 316588 - RNA, 61 nt, Homo Sapiens
uuguggagcagaagaaggagucccucacccuaggugugagaugggauucuggaagcuuccu

SEQ ID NO: 316589 - RNA, 61 nt, Homo Sapiens
ugugcuaucgugcuguuccuacucaguaaacaggugugaugaguuaacaagaaauaacacu

SEQ ID NO: 316590 - RNA, 61 nt, Homo Sapiens
ucaagggccuagccccaaaaguccccuggggaggugugaacaaucccucuccuuccgcugg

SEQ ID NO: 316591 - RNA, 61 nt, Homo Sapiens
ugcaaccugguauacagacagugauguuaguaggugugauaaaaaaaacaaaaauguacau

SEQ ID NO: 316592 - RNA, 61 nt, Homo Sapiens
caacuuaagaauauguaaauaaaagccugcuaggugugaguaagguggcuagcuaagugaa

SEQ ID NO: 316593 - RNA, 61 nt, Homo Sapiens
cacugugcccggcaaauuuuacugggauuacaggugugagcccacuucagcuucccaaagc

SEQ ID NO: 316594 - RNA, 61 nt, Homo Sapiens
caccaugccuggccuaaacugcugagauuacaggugugagccugccuccaccucccaaaau

SEQ ID NO: 316595 - RNA, 61 nt, Homo Sapiens
caccgcagccggaccauuuugcugggauuacaggugugagcccaccucagccucccaaagu

SEQ ID NO: 316596 - RNA, 61 nt, Homo Sapiens
uguuucagugaaccaaaguuucagguguuuuaggugugagauagcaaggugccuuuguacc

SEQ ID NO: 316597 - RNA, 61 nt, Homo Sapiens
gacaaaaugcaaaccuauuugagagagagagaggugugagggcauuuaauaaaaaaaaaga

SEQ ID NO: 316598 - RNA, 61 nt, Homo Sapiens
aagggagaguaggagagacccaagaugucacaggugugaugacacaaucaaauauaaauug

SEQ ID NO: 316599 - RNA, 61 nt, Homo Sapiens
gugggugccuguaaucccagaaaaauuagccaggugugaugccugucucuacuaaaaauac

SEQ ID NO: 316600 - RNA, 61 nt, Homo Sapiens
cgcuguacccgaacuuuuuugcugggauuacaggugugagccaguuuccaucucccuaaga

SEQ ID NO: 316601 - RNA, 61 nt, Homo Sapiens
cugccucagccucccugguagcugggauuacaggugugagccacugcacccacccaagaca

SEQ ID NO: 316602 - RNA, 61 nt, Homo Sapiens
ccucccaaaaugcugggagccaccaggcaccaggugugaucuaccacaccugucuaaaaag

SEQ ID NO: 316603 - RNA, 61 nt, Homo Sapiens
cugccucggccucccaaagugcugagauuacaggugugagccacccugcccagccgucaaa

SEQ ID NO: 316604 - RNA, 61 nt, Homo Sapiens
cugccuuggccucccaaaaugcugagauuacaggugugagccacugcaccucgccagaugu

SEQ ID NO: 316605 - RNA, 61 nt, Homo Sapiens
cugccuuggcacccaaaguguugagauuuacaggugugagccaccacaccaggccagagcu

SEQ ID NO: 316606 - RNA, 61 nt, Homo Sapiens
ggaucugagcaagugcaagccuggcugacacaggugugaagaggccauccuggaacccagg

SEQ ID NO: 316607 - RNA, 61 nt, Homo Sapiens
gguuggggacccagggaacaucggucuacucaggugugagggggcaggucugaccugcccc

SEQ ID NO: 316608 - RNA, 61 nt, Homo Sapiens
acagcaccuuguugccagagauucuacacaaaggugugauggacacugaugcucuauuaag

SEQ ID NO: 316609 - RNA, 61 nt, Homo Sapiens
gagcgaguauugugauuuugcugaaaagacaaggugugaaggagcaacuucaguugacaca

SEQ ID NO: 316610 - RNA, 61 nt, Homo Sapiens
ccgccucagccucccaaagugcugggauuacaggugugagccaccgcaccuggccucuguc

SEQ ID NO: 316611 - RNA, 61 nt, Homo Sapiens
uucacugcuacauaggauuuugucaaauugaaggugugacaagaugguguucugcuaaugu

SEQ ID NO: 316612 - RNA, 61 nt, Homo Sapiens
acccagacaggacugcagagugcuuugacuuaggugugaagucuaacgcaaaaauagcucu

SEQ ID NO: 316613 - RNA, 61 nt, Homo Sapiens
cacagugcccagcuuuuuuugcagggcuuacaggugugagccugccucggccucccaaagu

SEQ ID NO: 316614 - RNA, 61 nt, Homo Sapiens
agcugaagauucuaccacugagaacugccuaaggugugaaaaaacagaaauagauggugga

SEQ ID NO: 316615 - RNA, 61 nt, Homo Sapiens
cuauacaaagugauggaagcgggcucaauacaggugugaauuauauaugcuuaauggccug

SEQ ID NO: 316616 - RNA, 61 nt, Homo Sapiens
ugacugguuuuauuuuucucauuuuagagaaaggugugauuccauauuuuuuuaaugggac

SEQ ID NO: 316617 - RNA, 61 nt, Homo Sapiens
caccgcacccaguugggaacgcugggauuauaggugugagccugucucggccucccgaagu

SEQ ID NO: 316618 - RNA, 61 nt, Homo Sapiens
cacugcacccggccugaaaugcugugauuacaggugugagcccgccucgaccucccaaagu

SEQ ID NO: 316619 - RNA, 61 nt, Homo Sapiens
ccaggcagacacaccccgcugugccuuaggaaggugugagaccggcuucccccauccccac

SEQ ID NO: 316620 - RNA, 61 nt, Homo Sapiens
cuacuucuuccucccaaaguguugggauuauaggugugagccacugcacccagccuacuuc

SEQ ID NO: 316621 - RNA, 61 nt, Homo Sapiens
ccaccucgaccucccaaagugcugggauuacaggugugagccaccucgccugggcccccuu

SEQ ID NO: 316622 - RNA, 61 nt, Homo Sapiens
ccuucuuugguuuaauuuucuaugugcuuuuaggugugaauccagauaugcggucuuaauu

SEQ ID NO: 316623 - RNA, 61 nt, Homo Sapiens
cccgccuuggccuccaaagugcugggauuacaggugugagcuaccgcgcccggccuauuau

SEQ ID NO: 316624 - RNA, 61 nt, Homo Sapiens
cucagaaguaggacugaauucuacuauugcuaggugugagaaagugguggugagaaccuua

SEQ ID NO: 316625 - RNA, 61 nt, Homo Sapiens
auguggucucugugugugcgugugugggcacaggugugagugugugagugacaguuacccc

SEQ ID NO: 316626 - RNA, 61 nt, Homo Sapiens
aaaaagaaaagaaaaagccuguuuaaugcacaggugugaguggauugcuuauggcuaugag

SEQ ID NO: 316627 - RNA, 61 nt, Homo Sapiens
ccuccuuggccucccagagugcugggauuacaggugugagccacugugccgggcccguccc

SEQ ID NO: 316628 - RNA, 61 nt, Homo Sapiens
ccacgccaaguggaagccacuggaccacaggaggugugauagagccuuugaucuucaggau

SEQ ID NO: 316629 - RNA, 61 nt, Homo Sapiens
uggggaugcagagcuuucugcugaccaacccaggugugaccggacaagcuguuuccuucuu

SEQ ID NO: 316630 - RNA, 61 nt, Homo Sapiens
caccacguccggccaauuuuucuaggauuacaggugugagcccaccuuggccucccaaagu

SEQ ID NO: 316631 - RNA, 61 nt, Homo Sapiens
uguuaguuuuucuuacuugcaccuugaugguaggugugacauuaauucuuaagauguguag

SEQ ID NO: 316632 - RNA, 58 nt, Homo Sapiens
cucuuccaccuagagcauucggcaucccaggugugacagucaugugcaggagcacuga

SEQ ID NO: 316633 - RNA, 61 nt, Homo Sapiens
acgugcucucgcucccuuucuuccccugcccaggugugagcuguaguacaagauuaucuua

SEQ ID NO: 316634 - RNA, 61 nt, Homo Sapiens
uuuacacaagguaaacguggacucauuggccaggugugauuccugcaaacgugcuuuuuga

SEQ ID NO: 316635 - RNA, 61 nt, Homo Sapiens
uaguauuagauucacagaaccagaaauagcaaggugugaucuuuaucaggacuaacauuuu

SEQ ID NO: 316636 - RNA, 61 nt, Homo Sapiens
guggccauuuccuuaccuuugcuuagugaucaggugugagacccuuugccacguccccuua

SEQ ID NO: 316637 - RNA, 61 nt, Homo Sapiens
cuagcaaggcucaucuuucuaucagaacuucaggugugacuacaaagagaugcuuggagca

SEQ ID NO: 316638 - RNA, 61 nt, Homo Sapiens
aauugaggaaaaacugacaguaggcaagaagaggugugagucuuuguuucuuuguuuuauu

SEQ ID NO: 316639 - RNA, 61 nt, Homo Sapiens
ucaucaaaaagaaaaaucaaacuucuaaauaaggugugaaaggaaaaauuugaaguauuag

SEQ ID NO: 316640 - RNA, 61 nt, Homo Sapiens
agauacugcacuuggcuggguuaauuuuuaaaggugugauacuauaggaugauuggaauua

SEQ ID NO: 316641 - RNA, 61 nt, Homo Sapiens
ggcucuagucuccucccuguauaaaaaccagaggugugacaaaggauuuugacaggugacc

SEQ ID NO: 316642 - RNA, 61 nt, Homo Sapiens
uugagcacaguccagaaaugcaugucauacaaggugugaaucaggccagcuccucugccca

SEQ ID NO: 316643 - RNA, 61 nt, Homo Sapiens
guguugagauuuuuuacuguuaaccagaaucaggugugaauacacaaguaauacuacuggg

SEQ ID NO: 316644 - RNA, 61 nt, Homo Sapiens
augcuguguucacccuucuugguagaagcuaaggugugagcugggagguugcuggacagga

SEQ ID NO: 316645 - RNA, 61 nt, Homo Sapiens
auuugacauuauuuuagaucccagagaaaucaggugugauuaguucuccaggcaugaaugc

SEQ ID NO: 316646 - RNA, 61 nt, Homo Sapiens
ccaccuccaccucccaaacugcugggauuacaggugugagccaccaugcccaacacccacu

SEQ ID NO: 316647 - RNA, 61 nt, Homo Sapiens
cuaguuggaaucguuuacucugcuagaauuuaggugugagauuuuuuguuucccagguaua

SEQ ID NO: 316648 - RNA, 61 nt, Homo Sapiens
ucacaguagggugaguuaaguaugugcccucaggugugaaggagcacaggugagggggugc

SEQ ID NO: 316649 - RNA, 61 nt, Homo Sapiens
caccaugccugggcuaaacugcugggauuacaggugugagcucaccucggccucccaaagu

SEQ ID NO: 316650 - RNA, 61 nt, Homo Sapiens
caauggcauucaaagugucugacaguauuaaaggugugaaaaagagcaauagaaccuuuaa

SEQ ID NO: 316651 - RNA, 61 nt, Homo Sapiens
uaugugacacuuaagaacagcaggguaccagaggugugaaaauguaauacaagcguuucua

SEQ ID NO: 316652 - RNA, 61 nt, Homo Sapiens
cacagcacucggccuaaauagcugggauuacaggugugagccuuccucauccuucuaaagu

SEQ ID NO: 316653 - RNA, 61 nt, Homo Sapiens
cucuuggccuuuccccuugcagggguugugcaggugugaauaaagagaauaaggaaguucu

SEQ ID NO: 316654 - RNA, 61 nt, Homo Sapiens
uugauuuggauccacaggcagagccaagggaaggugugauucucugaggaaagagugauuc

SEQ ID NO: 316655 - RNA, 61 nt, Homo Sapiens
uagggguuuacucauuuuucuucccugagccaggugugacaagccaacucugucaccauuc

SEQ ID NO: 316656 - RNA, 61 nt, Homo Sapiens
ugagcacagggaugggcaccugcaccccagaaggugugagcugucucucugccaggagcua

SEQ ID NO: 316657 - RNA, 61 nt, Homo Sapiens
uaaucuguuguaguggugagcugauacauucaggugugaccguuggugaaaacuugugccc

SEQ ID NO: 316658 - RNA, 61 nt, Homo Sapiens
caaacaaggucagucuaaaguggcagguccuaggugugaccugauaccaccacccuuugug

SEQ ID NO: 316659 - RNA, 61 nt, Homo Sapiens
ccaccucggccucccaaagugcugggauuauaggugugagccaccgcgccgggccgguugc

SEQ ID NO: 316660 - RNA, 61 nt, Homo Sapiens
guauguauuauuagaguccgcucagaagauaaggugugaaugaaccucccccauuuaaaua

SEQ ID NO: 316661 - RNA, 61 nt, Homo Sapiens
agcagauuugauuuuucaguaugaagagccaaggugugaaacagcagacagcuacuugggc

SEQ ID NO: 316662 - RNA, 61 nt, Homo Sapiens
ggaugcuguguuugggggguaaguggguggcaggugugaggucccacagcagccgguaagg

SEQ ID NO: 316663 - RNA, 61 nt, Homo Sapiens
uaccgcaccccgccgagguugcugagauuacaggugugagcccgccucagccucccaaagu

SEQ ID NO: 316664 - RNA, 61 nt, Homo Sapiens
gcacguuucaaagcuuuccucacagaacaggaggugugaauguuaacuugcauauuguugg

SEQ ID NO: 316665 - RNA, 61 nt, Homo Sapiens
ucugcagaaagucucuucuuacuugaugagaaggugugaaccuaucuugugugugcguuag

SEQ ID NO: 316666 - RNA, 61 nt, Homo Sapiens
augugaaugcaaccagcaaauuuauccuugaaggugugaugguagaaauaggaaaacaaca

SEQ ID NO: 316667 - RNA, 61 nt, Homo Sapiens
cucauguccaccugccugccagccaggcuacaggugugacuuccuucucuaaacuguuaca

SEQ ID NO: 316668 - RNA, 61 nt, Homo Sapiens
caccaugcccgggcugaaaugcugggauuaaaggugugauccugucucggccucccaaagu

SEQ ID NO: 316669 - RNA, 61 nt, Homo Sapiens
caccagccucugagacaccagggauugcgguaggugugacccccugagacuuggugauggg

SEQ ID NO: 316670 - RNA, 61 nt, Homo Sapiens
caccaugcucugccaauuaugcugggauuacaggugugagcccacccuggccucccagagu

SEQ ID NO: 316671 - RNA, 61 nt, Homo Sapiens
guguccucauaugaaucaggucuuccaaucuaggugugaucuguugcugguaguaugugaa

SEQ ID NO: 316672 - RNA, 61 nt, Homo Sapiens
auaccacauucacuucugaagcuaucuucacaggugugauccagacugucuguauucaaug

SEQ ID NO: 316673 - RNA, 61 nt, Homo Sapiens
cauaaaugcuuccuucuacgggcacuuuggaaggugugagggaagaguggcucuuagcaga

SEQ ID NO: 316674 - RNA, 59 nt, Homo Sapiens
ugccaccucagagagagugaacccagcagaggugugacgggaggcuggggagagacccc

SEQ ID NO: 316675 - RNA, 61 nt, Homo Sapiens
uagcagccccagggaggaugcugccuccaagaggugugagcccucugucucggggaugaac

SEQ ID NO: 316676 - RNA, 61 nt, Homo Sapiens
ggcugacgugugagggaggacaggcgggaggaggugugaggaggaggcucccgaggggaag

SEQ ID NO: 316677 - RNA, 61 nt, Homo Sapiens
cugccucggccucucagagagcugggauuacaggugugagccgccgugcccagccauugca

SEQ ID NO: 316678 - RNA, 61 nt, Homo Sapiens
uagacucuguugaaaagaaagaagcuaagcuaggugugaagaauggaauuggaagcccacu

SEQ ID NO: 316679 - RNA, 61 nt, Homo Sapiens
auguggaauuuuccagcaaaauguuuaacucaggugugauuuuugaaaaugucucuguaau

SEQ ID NO: 316680 - RNA, 61 nt, Homo Sapiens
ccaccucagcgucccgaagugcugggauuacaggugugagccaccgcgccuggccugggcu

SEQ ID NO: 316681 - RNA, 61 nt, Homo Sapiens
cugccccugucucccaaagugcuaggauuacaggugugagccaccacaccuggcccauagu

SEQ ID NO: 316682 - RNA, 61 nt, Homo Sapiens
cacugugcccggccuguguaguugggauuacaggugugaacccgccucagccucccaaagu

SEQ ID NO: 316683 - RNA, 61 nt, Homo Sapiens
ugaacuagauugcaugcuucaagagugaaguaggugugacuccacuugaaggaagaagucu

SEQ ID NO: 316684 - RNA, 61 nt, Homo Sapiens
caccacuguauuuuuugcaggcugggacuacaggugugaguucucagccugccuccgagua

SEQ ID NO: 316685 - RNA, 61 nt, Homo Sapiens
gcccagggcuccagagcucgcuuagggccugaggugugaaacguggccgccacgcagugug

SEQ ID NO: 316686 - RNA, 61 nt, Homo Sapiens
cugggaaggcuugggauuugaauggguggaaaggugugagaaauucguguguuuuuuuaug

SEQ ID NO: 316687 - RNA, 61 nt, Homo Sapiens
cacuguaccaggcuauauaugcugggacuauaggugugagcccaccuugaccucccaaagu

SEQ ID NO: 316688 - RNA, 61 nt, Homo Sapiens
gggcuugcuugguaugcuuauuucagacaaaaggugugaggcugcaaagaagucaagcuuu

SEQ ID NO: 316689 - RNA, 61 nt, Homo Sapiens
ccaccucagccuuucaaagugcuggaauuacaggugugagccacucugccuggccuaccac

SEQ ID NO: 316690 - RNA, 61 nt, Homo Sapiens
agaaaaaaagcugcaaaaauuauauauugcaaggugugauggucuggcuugggugaauuuc

SEQ ID NO: 316691 - RNA, 61 nt, Homo Sapiens
ccuaucaccuccagcacaaucccagugaaaaaggugugaagcacccaccauguucuugaac

SEQ ID NO: 316692 - RNA, 61 nt, Homo Sapiens
aucccaaaugcagcaguggguucugaguuguaggugugacucccacuugcuggugaauaau

SEQ ID NO: 316693 - RNA, 61 nt, Homo Sapiens
cugccucggccucccaaagugcugggauuacaggugugagccacccugcucaaccagguuu

SEQ ID NO: 316694 - RNA, 61 nt, Homo Sapiens
uguccuccugcaaggacgcaacugugagcugaggugugagccuaggagcccaggaccccug

SEQ ID NO: 316695 - RNA, 61 nt, Homo Sapiens
uguaacccaccuugaccauauuccccauuucaggugugagaucaaacgcaacuguuucuac

SEQ ID NO: 316696 - RNA, 61 nt, Homo Sapiens
aacacuuuucuucuccauucuggugagggcuaggugugaucccucuucauucccccuccug

SEQ ID NO: 316697 - RNA, 61 nt, Homo Sapiens
ucuccaauuuacccucuuuguaacauuugaaaggugugauuugcuguuuacagugucagau

SEQ ID NO: 316698 - RNA, 61 nt, Homo Sapiens
gggcccuccggcuggauguuaaggcugagugaggugugauucaggcagcugccacaggccu

SEQ ID NO: 316699 - RNA, 61 nt, Homo Sapiens
cuucgaugcaaggaguccaguguuguccucaaggugugaugccaaccccauuuccucuccc

SEQ ID NO: 316700 - RNA, 61 nt, Homo Sapiens
auuuuaauauggaggugggaggagagauaauaggugugauuacuggcagaguaagagaagg

SEQ ID NO: 316701 - RNA, 61 nt, Homo Sapiens
cagcaaucuuuuaggaagagccuaaauugcuaggugugaccauucuuuauugacuuuuugc

SEQ ID NO: 316702 - RNA, 61 nt, Homo Sapiens
caccacaccuggcugcauaggcugggauuacaggugugaguccaccuuggccucccaaagu

SEQ ID NO: 316703 - RNA, 61 nt, Homo Sapiens
auaaaaucaugaagcagguaugauaauacuuaggugugauuuagugccuuuacuucaggcu

SEQ ID NO: 316704 - RNA, 61 nt, Homo Sapiens
gcaggaauccuggaggaauagacugguugcaaggugugaccacgguggcagaugaguggga

SEQ ID NO: 316705 - RNA, 61 nt, Homo Sapiens
gcaggaauccuggaggaacagacugguugcaaggugugaccacuguggcagaugaguggga

SEQ ID NO: 316706 - RNA, 61 nt, Homo Sapiens
gucguuaugaagcauucaacugugcucugugaggugugaaauuaaaaacauuauguuucac

SEQ ID NO: 316707 - RNA, 61 nt, Homo Sapiens
gaagugugaguuaaaaauauugaauauuggcaggugugaaaacaagugucaaaauuccuca

SEQ ID NO: 316708 - RNA, 61 nt, Homo Sapiens
agcagccuuccuaaacucagaguuuuaauaaaggugugaggaggcuggggccaguugacac

SEQ ID NO: 316709 - RNA, 61 nt, Homo Sapiens
uuuuauaaaacuacaaacugaggcucagagaaggugugaccucuuguugcuugaggcacag

SEQ ID NO: 316710 - RNA, 61 nt, Homo Sapiens
cugccucggccucccaaagugcugggauuacaggugugagccaccgugcccagccaaagac

SEQ ID NO: 316711 - RNA, 61 nt, Homo Sapiens
auuuauauccuacugcucaaggucaucgccaaggugugauuggaaaaauucaaaaaauugc

SEQ ID NO: 316712 - RNA, 61 nt, Homo Sapiens
ugccgcacccggccguucccgcugggauuacaggugugagcccgccucagccucccaaagu

SEQ ID NO: 316713 - RNA, 61 nt, Homo Sapiens
caccgcaccuggcccuaacugcugggauuacaggugugaucccacauuggccucccaaagu

SEQ ID NO: 316714 - RNA, 61 nt, Homo Sapiens
augcccugaugccuaaccaaugcuaacaccaaggugugaacguaagcugugcagaaccugc

SEQ ID NO: 316715 - RNA, 61 nt, Homo Sapiens
aacagaguuauuaaguaaguccucauccuaaaggugugagagauguaguuauuguuauaau

SEQ ID NO: 316716 - RNA, 61 nt, Homo Sapiens
ugccagauccucuucucaaagcugggauuacaggugugagcauagugagaccuuggcgcua

SEQ ID NO: 316717 - RNA, 61 nt, Homo Sapiens
cuaccucggcuucccaaagugcucggauuacaggugugagccacugugccuagccuauaau

SEQ ID NO: 316718 - RNA, 61 nt, Homo Sapiens
caugagucuaaguauagccacugauggugacaggugugagucuggcuggaacacuuucagu

SEQ ID NO: 316719 - RNA, 61 nt, Homo Sapiens
cugccucagccucccaaaguacugggauuauaggugugagcuacuguacccagccuuaacc

SEQ ID NO: 316720 - RNA, 61 nt, Homo Sapiens
ccgccucggccucccaaaaugcugggauuagaggugugagccacugugcccagcccaucaa

SEQ ID NO: 316721 - RNA, 61 nt, Homo Sapiens
gucuccaggggaucccuguuucccaacugaaaggugugaacggacacacacacagccugga

SEQ ID NO: 316722 - RNA, 61 nt, Homo Sapiens
ggugcucaggcuuugcccaggugccaggagaaggugugagcaugagccuauuggacacacc

SEQ ID NO: 316723 - RNA, 61 nt, Homo Sapiens
caccgugccuggccuaaauaugcuggauuacaggugugagccccaccuuggccucccaaag

SEQ ID NO: 316724 - RNA, 61 nt, Homo Sapiens
auugugugugugaaaaagcucaaaauaaaacaggugugagauagaacacaauagagaacuu

SEQ ID NO: 316725 - RNA, 61 nt, Homo Sapiens
ccuuauauguggcccucguggugaagguuacaggugugagcccaucucggcuucccaaugu

SEQ ID NO: 316726 - RNA, 61 nt, Homo Sapiens
aguccuuagcacuuuuucucucgauugauagaggugugacuaccaaaacugaucaucugag

SEQ ID NO: 316727 - RNA, 61 nt, Homo Sapiens
uucuaaaauaaaggaaugcuuauaaaauuauaggugugaacaguaacauuuucacgauugu

SEQ ID NO: 316728 - RNA, 61 nt, Homo Sapiens
uguacguacaggcuuuuuaugcgcuucacugaggugugaauccagccucaaggcaaggagg

SEQ ID NO: 316729 - RNA, 61 nt, Homo Sapiens
cagccacagcagaggcaaggguuggcaggacaggugugacauguccacgcccagaacaaca

SEQ ID NO: 316730 - RNA, 61 nt, Homo Sapiens
aagugcuaaguuuauaauucagguuugaucaaggugugaauaacugaagaaaauaacuugc

SEQ ID NO: 316731 - RNA, 61 nt, Homo Sapiens
aguagaguagcgcuguuggccaggaggugucaggugugaguguauucugccagcuuuucau

SEQ ID NO: 316732 - RNA, 61 nt, Homo Sapiens
cugccucagccucccaaagugcugggauuacaggugugagccaccacgccuggccccaguc

SEQ ID NO: 316733 - RNA, 61 nt, Homo Sapiens
aagaggguaugggggaaagguucauagacuuaggugugagaaugaggugggaggugucugg

SEQ ID NO: 316734 - RNA, 61 nt, Homo Sapiens
cugccuuggcuucccaaaguccugggauuacaggugugagccaccacauccagccuaacuu

SEQ ID NO: 316735 - RNA, 61 nt, Homo Sapiens
gccucgaccucucucaaagugcuggcauuacaggugugagccacggugcccggcccacaau

SEQ ID NO: 316736 - RNA, 61 nt, Homo Sapiens
gagcuaaaguaaaauaucuaacaggugaaaaaggugugaggauugaacucaauaaaccuuc

SEQ ID NO: 316737 - RNA, 61 nt, Homo Sapiens
uaucucuguaggacuuaagagaauagcuaaaaggugugacuugccuuauugaaaugauacu

SEQ ID NO: 316738 - RNA, 61 nt, Homo Sapiens
ggcacaggcugcugcccuucuccguggaaacaggugugaugaggugugcacggacaccugg

SEQ ID NO: 316739 - RNA, 61 nt, Homo Sapiens
augggggaacaaugagcagauuaaugcaggcaggugugaacaaaugugugacugcucaugg

SEQ ID NO: 316740 - RNA, 61 nt, Homo Sapiens
gaauuucuuuugccguuauuuguuaaucauuaggugugacugauaauacaccacuacauuc

SEQ ID NO: 316741 - RNA, 61 nt, Homo Sapiens
ucuuccuccuaaaccugaugaucucuuugaaaggugugagagcagauaggagccaggcugc

SEQ ID NO: 316742 - RNA, 61 nt, Homo Sapiens
acaagaaugcaaauggcucugacaaguacucaggugugagguggccaguguuuuaacuugu

SEQ ID NO: 316743 - RNA, 61 nt, Homo Sapiens
uuggucugucacacuguacaauaacugcugcaggugugauuccuucugaaccucuacacca

SEQ ID NO: 316744 - RNA, 61 nt, Homo Sapiens
acuuuguggguuuguguuauacauuguuuacaggugugaaaagagaaauaaaacauuuggc

SEQ ID NO: 316745 - RNA, 61 nt, Homo Sapiens
caccgugcccggccaccagagcuggcauuacaggugugagcccgccuuggccucccaaagu

SEQ ID NO: 316746 - RNA, 61 nt, Homo Sapiens
ucugagcacuuaccgggcgugaccguuucuuaggugugagaggggcuguggcuuuugugca

SEQ ID NO: 316747 - RNA, 61 nt, Homo Sapiens
caauucaagcaggcgccaagugcuaugacagaggugugaauaaaagcaucaggaaaucgga

SEQ ID NO: 316748 - RNA, 61 nt, Homo Sapiens
ccaccucagccucccgaauagcugggacuacaggugugagucaccaagcccaguuaaucuu

SEQ ID NO: 316749 - RNA, 61 nt, Homo Sapiens
cugccucagccucccaaagugcugggauuacaggugugaaccaccacacccagcccacuuc

SEQ ID NO: 316750 - RNA, 61 nt, Homo Sapiens
ccguuucgacuucccaaagugcugggauuacaggugugagccacuucaccaggcccauuuu

SEQ ID NO: 316751 - RNA, 61 nt, Homo Sapiens
ccaccucagccuccuaaagcacugggauuacaggugugaaccaccguacccagccuaucuu

SEQ ID NO: 316752 - RNA, 61 nt, Homo Sapiens
aucaccuugaucuugggcuuucagcccccaaaggugugagaaaauaaacuucgguugauaa

SEQ ID NO: 316753 - RNA, 61 nt, Homo Sapiens
cccaucucuacuaaaaauacaaaaauuagccaggugugauggugcaugccuguaaucccag

SEQ ID NO: 316754 - RNA, 61 nt, Homo Sapiens
augcaaccagaguagaggggaccugcucagcaggugugaccaggguucucugaaucuguua

SEQ ID NO: 316755 - RNA, 61 nt, Homo Sapiens
gcagccccuguccucaccaugggccugggccaggugugacagaguagagguagcacagggg

SEQ ID NO: 316756 - RNA, 61 nt, Homo Sapiens
agcccgccagcggaaaguguucauucugcauaggugugaggcuuuaucugcacacaggaca

SEQ ID NO: 316757 - RNA, 61 nt, Homo Sapiens
uuauaaagacaucuccagcuacagucuguaaaggugugacucacuccacucgcacgugauu

SEQ ID NO: 316758 - RNA, 61 nt, Homo Sapiens
gucaguuugcuggucuuccagguuuccugucaggugugacuccuccccccauuagcuguaa

SEQ ID NO: 316759 - RNA, 61 nt, Homo Sapiens
agcugcggcccacgcuguucucguguaugagaggugugaaaccaagcucugcucuuucagg

SEQ ID NO: 316760 - RNA, 61 nt, Homo Sapiens
cagcagccauaccccucuucguugggauuauaggugugagcccgccuuggccucccuaagu

SEQ ID NO: 316761 - RNA, 61 nt, Homo Sapiens
cuucgagucugcggcucuguggacacaauaaaggugugaagcugaggccccggacgccccc

SEQ ID NO: 316762 - RNA, 61 nt, Homo Sapiens
gcgccacugcauuccagcuuaggcugcagugaggugugauuuccuugagcccaggagguug

SEQ ID NO: 316763 - RNA, 61 nt, Homo Sapiens
cuaccugccuuggagagggccagagaagguaaggugugaacuuauuccugguuuaauucag

SEQ ID NO: 316764 - RNA, 61 nt, Homo Sapiens
cacugugcccagcugaguaagcuggaauuacaggugugagcccgccuuggccucccaaagu

SEQ ID NO: 316765 - RNA, 61 nt, Homo Sapiens
uguacuccuuguuugucccaugcuaguuuaaaggugugauugggaggggauucuuuccucu

SEQ ID NO: 316766 - RNA, 61 nt, Homo Sapiens
ggcacaguacgcagagcaagucaggcagcgcaggugugauggucaggaagaggcgaacagc

SEQ ID NO: 316767 - RNA, 61 nt, Homo Sapiens
ucagugacuauggcccccacguucaggaggaaggugugaugccgucauacaguuacaggaa

SEQ ID NO: 316768 - RNA, 61 nt, Homo Sapiens
ccaccucagccucccaaggugcugggauuacaggugugagccaccacaccuggccaagaau

SEQ ID NO: 316769 - RNA, 61 nt, Homo Sapiens
ccaccuuggccucccaaagugcugggauuacaggugugagccaccacacugggccaaugcu

SEQ ID NO: 316770 - RNA, 61 nt, Homo Sapiens
agggggugccuaacugagcaguagggauagaaggugugaaccugggagugcuuuuauaaau

SEQ ID NO: 316771 - RNA, 50 nt, Homo Sapiens
aucuccaaugugccgcauaaaggugugagggcauaggagaaacacuaggc

SEQ ID NO: 316772 - RNA, 61 nt, Homo Sapiens
ucaucaucuuugccucuagccaccguagauaaggugugaagggacugcuguuugcaauggg

SEQ ID NO: 316773 - RNA, 61 nt, Homo Sapiens
accuacguacuuauaucagcaccauguauguaggugugauaguacuuucaaacagcgccuc

SEQ ID NO: 316774 - RNA, 61 nt, Homo Sapiens
caccgcacccaauccuauuagcugggauuacaggugugagcccgccucggccucccaaagu

SEQ ID NO: 316775 - RNA, 61 nt, Homo Sapiens
accccugccccacugguaccugccucaccccaggugugaaggucuccccuuccccgagucu

SEQ ID NO: 316776 - RNA, 61 nt, Homo Sapiens
cgcugcgcucggccuucuuugcugggauuacaggugugagcccgccuuggccucccaaagu

SEQ ID NO: 316777 - RNA, 61 nt, Homo Sapiens
cuccacaccuggcuguuuucgcugggauuacaggugugagcccaccucggccucccaaagu

SEQ ID NO: 316778 - RNA, 61 nt, Homo Sapiens
aucucucgugccugccaccuuggcugcaggcaggugugaccguuggugcagguugaugugc

SEQ ID NO: 316779 - RNA, 61 nt, Homo Sapiens
caccaugccuggcccuaugugcugggauuaaaggugugagcccacccaggccucccaaagu

SEQ ID NO: 316780 - RNA, 61 nt, Homo Sapiens
cacugcaguggaccaauuuugcuaggauuacaggugugagcccaccucagccuuccaaagu

SEQ ID NO: 316781 - RNA, 61 nt, Homo Sapiens
aaugcuguggagaggcaucuagugugaaggaaggugugaugcuuaaggacuuuucccuuca

SEQ ID NO: 316782 - RNA, 61 nt, Homo Sapiens
auccuggcucgcuggauuugguaugccuggcaggugugagccuauugaagaagcauuaggg

SEQ ID NO: 316783 - RNA, 61 nt, Homo Sapiens
caccacacccggccuuaucugcugggauuacaggugugagccugccuuggccucccaaagu

SEQ ID NO: 316784 - RNA, 61 nt, Homo Sapiens
cacugccuggccuggccguagcugggauuacaggugugagccugccccagcauuccaaagu

SEQ ID NO: 316785 - RNA, 61 nt, Homo Sapiens
guaaguucauguaggagaguagcgagugcgcaggugugagucuguccucugacccaccggc

SEQ ID NO: 316786 - RNA, 61 nt, Homo Sapiens
cacagugccuggcccauucugcugggauuacaggugugagccuucucugccucccuaaguu

SEQ ID NO: 316787 - RNA, 61 nt, Homo Sapiens
gugcuguccuucugaucucuuguucaugugcaggugugaguauuuccugacauagauggug

SEQ ID NO: 316788 - RNA, 61 nt, Homo Sapiens
auggcucagccgccugaguagcugggauuacaggugugagccaacaagcccggcuaauuuu

SEQ ID NO: 316789 - RNA, 61 nt, Homo Sapiens
cugccucggccucccaaagugcugggauuacaggugugagcugccgcacccagccaagaaa

SEQ ID NO: 316790 - RNA, 61 nt, Homo Sapiens
aucgaucuuccugccaagguuuuggaauuacaggugugagccaccaugccuggccugcuuu

SEQ ID NO: 316791 - RNA, 61 nt, Homo Sapiens
uuuaacaaaaauguucugugugucaggaaagaggugugagagugguaggcagccugccgca

SEQ ID NO: 316792 - RNA, 61 nt, Homo Sapiens
ucuuuaaaaaagggaagucuugagguuuuagaggugugaauuauguuucaucaaugugcag

SEQ ID NO: 316793 - RNA, 61 nt, Homo Sapiens
caccacgucuugucccccgcgcugggauuacaggugugagccuaccuuagucucccaaagu

SEQ ID NO: 316794 - RNA, 61 nt, Homo Sapiens
auaggaaaauacagugcaaagaguaaaaauuaggugugaaauuuaaguauaaauccuacua

SEQ ID NO: 316795 - RNA, 61 nt, Homo Sapiens
agcuuuguauguuuaugaaguacagacugaaaggugugaaccuguguuucaaauggacugu

SEQ ID NO: 316796 - RNA, 61 nt, Homo Sapiens
uuggccaggcuggucucgaacuccuggccucaggugugauccgcccgccuccgccucccca

SEQ ID NO: 316797 - RNA, 61 nt, Homo Sapiens
ccgccuccgccuccccaagcgcugagauuacaggugugagccaccgugcccagccccucag

SEQ ID NO: 316798 - RNA, 61 nt, Homo Sapiens
acuccccuagucugcagauugaguugguaggaggugugauuuguuuacaugcaccuuuguu

SEQ ID NO: 316799 - RNA, 61 nt, Homo Sapiens
cguuguauauucagagagagagagggagucaaggugugaccgucgaccacagccaguguca

SEQ ID NO: 316800 - RNA, 61 nt, Homo Sapiens
cagacuuuagagcuuguggcuugaauguuaaaggugugaccaccgacaccacucaugucaa

SEQ ID NO: 316801 - RNA, 61 nt, Homo Sapiens
uuuaauacuaucucucauuguuuuggaaacaaggugugauuaugcuauacuauaaccagcc

SEQ ID NO: 316802 - RNA, 61 nt, Homo Sapiens
cugcuuuggccucccaaagcgcuaggauuccaggugugagcuacugugcccagcuaaaaua

SEQ ID NO: 316803 - RNA, 61 nt, Homo Sapiens
guaaaaagaggggguugcuagaaggaaaaacaggugugaccugauccugccccuuccuucu

SEQ ID NO: 316804 - RNA, 61 nt, Homo Sapiens
gccugccucagccucccagugcugggauuauaggugugagccacugcgccuggcuaaguua

SEQ ID NO: 316805 - RNA, 61 nt, Homo Sapiens
cugccuugaccucccaaagugcuaggauaacaggugugagccaccgcacccugccaaguua

SEQ ID NO: 316806 - RNA, 61 nt, Homo Sapiens
ccguguaucugggauauuuccauauggcaauaggugugaacagggaacucagaauacagac

SEQ ID NO: 316807 - RNA, 61 nt, Homo Sapiens
cugccccagccucccaaguagcugggaggacaggugugagcugccgcacccagccuguuuc

SEQ ID NO: 316808 - RNA, 61 nt, Homo Sapiens
cacucucuagaccaacugaugcagaaacaggaggugugagccagcaaucagauggagauuc

SEQ ID NO: 316809 - RNA, 61 nt, Homo Sapiens
ccgccucggccccccaaagugcugggguuacaggugugagccacugcacccggccacaaga

SEQ ID NO: 316810 - RNA, 61 nt, Homo Sapiens
cagguaagaacaguaauuggcccagacagguaggugugauaaacagaguagaaaagauugu

SEQ ID NO: 316811 - RNA, 61 nt, Homo Sapiens
accucaagugaucugccugccucagcuucucaggugugaccuacugugcuuggccuaaugu

SEQ ID NO: 316812 - RNA, 61 nt, Homo Sapiens
uccugcauguguugaugccaccuguaugugcaggugugaccucaggugugugaguaucccu

SEQ ID NO: 316813 - RNA, 61 nt, Homo Sapiens
caccaugcccggcuaacuuugcuggaacuccaggugugaauccaccucagccuccacagca

SEQ ID NO: 316814 - RNA, 61 nt, Homo Sapiens
caccgcgccuggccuauuaugcugggauuacaggugugagccgccucggccucccaaaauu

SEQ ID NO: 316815 - RNA, 61 nt, Homo Sapiens
caccgcgccuggccuuuuuugcugggauuacaggugugaguccgccuuggccucccaaagu

SEQ ID NO: 316816 - RNA, 61 nt, Homo Sapiens
cacagcacccaaccuuuuuugcugggauuacaggugugagccugccucggccucccaaagu

SEQ ID NO: 316817 - RNA, 61 nt, Homo Sapiens
agcaggaugcugaggaaccagccccucccagaggugugaucagguccucuucaauccagca

SEQ ID NO: 316818 - RNA, 61 nt, Homo Sapiens
cacuguggccgaccuacuaugcugggauuacaggugugagcccaccucagccucucaaagu

SEQ ID NO: 316819 - RNA, 61 nt, Homo Sapiens
caccacgccuggcuaauuuugcuaggauuacaggugugagccugcuucggccucccaaagu

SEQ ID NO: 316820 - RNA, 61 nt, Homo Sapiens
gggucccgcagaagaaaacaagaguggaagcaggugugagaaugaguuagauguggagguc

SEQ ID NO: 316821 - RNA, 61 nt, Homo Sapiens
caccgcgcccagcccguuuuucugggauuacaggugugagccugccucagccucccaaagu

SEQ ID NO: 316822 - RNA, 61 nt, Homo Sapiens
caccacaccugacccauagggcugggauuacaggugugagccugccucggccucccaaagu

SEQ ID NO: 316823 - RNA, 61 nt, Homo Sapiens
ccuucaguucuguuccuauuuugggagcuggaggugugacaggugggggcgagaggaggac

SEQ ID NO: 316824 - RNA, 61 nt, Homo Sapiens
cacagcaccuggccaaccaaguugggauuacaggugugagcccgccucagccucccaaagu

SEQ ID NO: 316825 - RNA, 61 nt, Homo Sapiens
cugccucggccucccaaagugcugggauuacaggugugagccaccacgcccugccuacucu

SEQ ID NO: 316826 - RNA, 61 nt, Homo Sapiens
acugggguguguggcagagccaggacccaggaggugugauuccugaaggcauccccaggcc

SEQ ID NO: 316827 - RNA, 61 nt, Homo Sapiens
uaaaaugccuagauuuccauugccuaaaguaaggugugaccagugaaacaacagcagagaa

SEQ ID NO: 316828 - RNA, 61 nt, Homo Sapiens
acagcuguguuaaccaaugaggucugcugccaggugugaacaagcaugucucuacgaauga

SEQ ID NO: 316829 - RNA, 61 nt, Homo Sapiens
gggcauggucguacacugcucauugugccacaggugugacuggaaagcaugauauucuagg

SEQ ID NO: 316830 - RNA, 61 nt, Homo Sapiens
uuuccggauccagagccacagaaagaaauguaggugugaaguauuaggcugcugucaggga

SEQ ID NO: 316831 - RNA, 61 nt, Homo Sapiens
agaucccauuuccgucugcccccucgucaccaggugugauagccccagccaggucacaccu

SEQ ID NO: 316832 - RNA, 61 nt, Homo Sapiens
cccacaaggaacccucaggccacccuccacgaggugugacuaacuaugcaauaauccaccc

SEQ ID NO: 316833 - RNA, 61 nt, Homo Sapiens
cuugauccucccgagcugugagcgcagucugaggugugaggacacggccuccuguuggagu

SEQ ID NO: 316834 - RNA, 61 nt, Homo Sapiens
acuuuuuugcucguagauauauccgggaagcaggugugauuuggcauuuucuuaauugaaa

SEQ ID NO: 316835 - RNA, 61 nt, Homo Sapiens
cacggcacccagccuagcucgcugggauuacaggugugagcccaccuuggccucccaaagu

SEQ ID NO: 316836 - RNA, 61 nt, Homo Sapiens
ucagggagaaacaaacuugcguaggaauuuaaggugugacuggcuuuuaucauuuuaaaug

SEQ ID NO: 316837 - RNA, 61 nt, Homo Sapiens
aagacugaaaaggagguccgggcccucaaaaaggugugaacagauagccagagagagaccu

SEQ ID NO: 316838 - RNA, 61 nt, Homo Sapiens
caccgcgcccagccaagaaugcugggauuacaggugugagcccgccucggccucccaaagu

SEQ ID NO: 316839 - RNA, 61 nt, Homo Sapiens
caccaugccuggccgugguugcugggauuacaggugugagcccaccucagccucccaaagu

SEQ ID NO: 316840 - RNA, 61 nt, Homo Sapiens
guauuaggaaacaugagcagcccaacuuuaaaggugugagagagaccuuccccucccuauc

SEQ ID NO: 316841 - RNA, 61 nt, Homo Sapiens
ugcuccucaacacgauggauuuuagcauuuaaggugugaaaccuaaagcaaguuagaaguu

SEQ ID NO: 316842 - RNA, 61 nt, Homo Sapiens
ccaccugcucuuuccucccucuccccugccgaggugugaccguggccccaccuguucuuuc

SEQ ID NO: 316843 - RNA, 61 nt, Homo Sapiens
ccgccugcucuuuccuccccugucccccugcaggugugaccuggagggaggcugugcugug

SEQ ID NO: 316844 - RNA, 61 nt, Homo Sapiens
uggccuggagucuucaacuuuugaccggugcaggugugaccagagaccaccucuguggcca

SEQ ID NO: 316845 - RNA, 61 nt, Homo Sapiens
ccgcuucggccucccaaaguucugggauuacaggugugagccaccgugcacggccggccug

SEQ ID NO: 316846 - RNA, 61 nt, Homo Sapiens
ccguuucuucauauaauccgaccacagugggaggugugauuuacccauuacacaaugagaa

SEQ ID NO: 316847 - RNA, 61 nt, Homo Sapiens
cugccucagccucccaaagugcugggauuacaggugugagccaccgcgcccggccgagaau

SEQ ID NO: 316848 - RNA, 61 nt, Homo Sapiens
caaggacaaaaauaaguguguuuguuuuuacaggugugaaagucacagcuuguaaauaagu

SEQ ID NO: 316849 - RNA, 61 nt, Homo Sapiens
gugccggagaugaaugagccccagcaguccaaggugugaugugggaagacaccgcagagcu

SEQ ID NO: 316850 - RNA, 61 nt, Homo Sapiens
uccuaauaugaucuaaaaccauauuaaaaauaggugugauuaagugguuucuaagauuuuu

SEQ ID NO: 316851 - RNA, 61 nt, Homo Sapiens
cacugugcccagcaguuuccgcugagauuacaggugugagccugucuuggccucccaaagu

SEQ ID NO: 316852 - RNA, 61 nt, Homo Sapiens
caccacacccagccucuguagcugggauuacaggugugagcccgccuuggccucccaaagu

SEQ ID NO: 316853 - RNA, 61 nt, Homo Sapiens
aguugcauaggauguguggaggugcuuauccaggugugauuuauguguuaaccucagucac

SEQ ID NO: 316854 - RNA, 61 nt, Homo Sapiens
gugauuuaagggcccaggucgugguucuaaaaggugugaagggagucaaaaagaaccacuu

SEQ ID NO: 316855 - RNA, 61 nt, Homo Sapiens
ccucuguuugcacuggacauugucuaugcacaggugugagucgacaaucaauggauggugc

SEQ ID NO: 316856 - RNA, 61 nt, Homo Sapiens
ccucuguuugcacuggacauugucuaugcacaggugugagucgacaaucaguggauggugc

SEQ ID NO: 316857 - RNA, 61 nt, Homo Sapiens
cgaggcaguuccugcguucuaucagcgagaaaggugugagcaaagcagguggcaugaauug

SEQ ID NO: 316858 - RNA, 61 nt, Homo Sapiens
caccgugccuggccaauuccgcugggauuacaggugugagcccgccucggccucucaaaau

SEQ ID NO: 316859 - RNA, 61 nt, Homo Sapiens
agcccugcugaggucacugucagcacuaggcaggugugagggaauucaagacagggcagug

SEQ ID NO: 316860 - RNA, 61 nt, Homo Sapiens
gaaaccccaucucuuaaagaaaaaguuagccaggugugaugaugugcaccuauagucccag

SEQ ID NO: 316861 - RNA, 61 nt, Homo Sapiens
gaacuugggcuaaaaucaaaccuuggcacacaggugugauacaacuuaacaggaaucaucg

SEQ ID NO: 316862 - RNA, 61 nt, Homo Sapiens
ccaccucagccucccaaagagcugggauuacaggugugagcuaccgcgccuggccaugaug

SEQ ID NO: 316863 - RNA, 61 nt, Homo Sapiens
cccuggagcccccuuuggggcggaguggggaaggugugagucagcgccccuggacgggccg

SEQ ID NO: 316864 - RNA, 61 nt, Homo Sapiens
cugaaagagaggacugguucugaggccagaaaggugugaggagagaggaggaaaagucuuc

SEQ ID NO: 316865 - RNA, 61 nt, Homo Sapiens
ccgccuuggccucccaaagugcugggauuacaggugugagccuccaugcccagccuaaauu

SEQ ID NO: 316866 - RNA, 61 nt, Homo Sapiens
cuaccucggccuccuaaagugcugagauuacaggugugagccaccgugcccggcccauucu

SEQ ID NO: 316867 - RNA, 61 nt, Homo Sapiens
cauauuaaaugaaagaauaucuaauugggggaggugugaagggaaagaaauucuuuucaaa

SEQ ID NO: 316868 - RNA, 61 nt, Homo Sapiens
cugccuuggccucccaaagcgcuaggauuagaggugugagccgcugcacccugccccagua

SEQ ID NO: 316869 - RNA, 61 nt, Homo Sapiens
cucccaaaggcauaggcuugcaaagagcagaaggugugaaaucacacucuuccucugggca

SEQ ID NO: 316870 - RNA, 61 nt, Homo Sapiens
caccgugcccggcccagauagcugggauuacaggugugagccugccucagccucccaaagu

SEQ ID NO: 316871 - RNA, 61 nt, Homo Sapiens
gaaucaguaggaccaggccaacagguauuucaggugugaaacccuauaggaacagcccagc

SEQ ID NO: 316872 - RNA, 61 nt, Homo Sapiens
uuuccaaaauacuuaaaaauaaaaugagaacaggugugaguauuguuauuauuaagguuua

SEQ ID NO: 316873 - RNA, 61 nt, Homo Sapiens
ccaguuugcuccagaaaguuaggguaguuugaggugugacagcugcaacuggcaaaggaga

SEQ ID NO: 316874 - RNA, 61 nt, Homo Sapiens
uggucagggggcccaucugcaucuuugccagaggugugacauccccccugucuucccccac

SEQ ID NO: 316875 - RNA, 61 nt, Homo Sapiens
cacugcacccgaccgauacugcugggauuacaggugugagcccgccucguccucccaaagu

SEQ ID NO: 316876 - RNA, 61 nt, Homo Sapiens
uguaaacugucuaguguuugugcuuguguccaggugugacuucccuguacaucuguucacg

SEQ ID NO: 316877 - RNA, 61 nt, Homo Sapiens
ucugccacgaggggccugcucagggcaggagaggugugaaagaggaaaagcuggggccagc

SEQ ID NO: 316878 - RNA, 61 nt, Homo Sapiens
caggagagacaguuggauucuugggacagggaggugugaggcucccccacucccaaccacg

SEQ ID NO: 316879 - RNA, 64 nt, Homo Sapiens; identical to SEQ ID NO: 235822

SEQ ID NO: 316880 - RNA, 64 nt, Homo Sapiens; identical to SEQ ID NO: 235823

SEQ ID NO: 316881 - RNA, 64 nt, Homo Sapiens; identical to SEQ ID NO: 235824

SEQ ID NO: 316882 - RNA, 64 nt, Homo Sapiens; identical to SEQ ID NO: 235825

SEQ ID NO: 316883 - RNA, 64 nt, Homo Sapiens; identical to SEQ ID NO: 235826

SEQ ID NO: 316884 - RNA, 64 nt, Homo Sapiens; identical to SEQ ID NO: 235827

SEQ ID NO: 316885 - RNA, 64 nt, Homo Sapiens; identical to SEQ ID NO: 235828

SEQ ID NO: 316886 - RNA, 64 nt, Homo Sapiens; identical to SEQ ID NO: 235829

SEQ ID NO: 316887 - RNA, 64 nt, Homo Sapiens; identical to SEQ ID NO: 235830

SEQ ID NO: 316888 - RNA, 64 nt, Homo Sapiens; identical to SEQ ID NO: 235831

SEQ ID NO: 316889 - RNA, 64 nt, Homo Sapiens; identical to SEQ ID NO: 235832

SEQ ID NO: 316890 - RNA, 64 nt, Homo Sapiens; identical to SEQ ID NO: 235833

SEQ ID NO: 316891 - RNA, 64 nt, Homo Sapiens; identical to SEQ ID NO: 235834

SEQ ID NO: 316892 - RNA, 64 nt, Homo Sapiens; identical to SEQ ID NO: 235835

SEQ ID NO: 316893 - RNA, 64 nt, Homo Sapiens; identical to SEQ ID NO: 235836

SEQ ID NO: 316894 - RNA, 64 nt, Homo Sapiens; identical to SEQ ID NO: 235837

SEQ ID NO: 316895 - RNA, 64 nt, Homo Sapiens; identical to SEQ ID NO: 235838

SEQ ID NO: 316896 - RNA, 64 nt, Homo Sapiens; identical to SEQ ID NO: 235839

SEQ ID NO: 316897 - RNA, 64 nt, Homo Sapiens; identical to SEQ ID NO: 235840

SEQ ID NO: 316898 - RNA, 64 nt, Homo Sapiens; identical to SEQ ID NO: 235841

SEQ ID NO: 316899 - RNA, 64 nt, Homo Sapiens; identical to SEQ ID NO: 235842

SEQ ID NO: 316900 - RNA, 64 nt, Homo Sapiens; identical to SEQ ID NO: 235843

SEQ ID NO: 316901 - RNA, 64 nt, Homo Sapiens; identical to SEQ ID NO: 235844

SEQ ID NO: 316902 - RNA, 64 nt, Homo Sapiens; identical to SEQ ID NO: 235845

SEQ ID NO: 316903 - RNA, 55 nt, Homo Sapiens; identical to SEQ ID NO: 235846

SEQ ID NO: 316904 - RNA, 64 nt, Homo Sapiens; identical to SEQ ID NO: 235847

SEQ ID NO: 316905 - RNA, 64 nt, Homo Sapiens; identical to SEQ ID NO: 235848

SEQ ID NO: 316906 - RNA, 64 nt, Homo Sapiens; identical to SEQ ID NO: 235849

SEQ ID NO: 316907 - RNA, 64 nt, Homo Sapiens; identical to SEQ ID NO: 235850

SEQ ID NO: 316908 - RNA, 64 nt, Homo Sapiens; identical to SEQ ID NO: 235851

SEQ ID NO: 316909 - RNA, 64 nt, Homo Sapiens; identical to SEQ ID NO: 235852

SEQ ID NO: 316910 - RNA, 64 nt, Homo Sapiens; identical to SEQ ID NO: 235853

SEQ ID NO: 316911 - RNA, 64 nt, Homo Sapiens; identical to SEQ ID NO: 235854

SEQ ID NO: 316912 - RNA, 64 nt, Homo Sapiens; identical to SEQ ID NO: 235855

SEQ ID NO: 316913 - RNA, 64 nt, Homo Sapiens; identical to SEQ ID NO: 235856

SEQ ID NO: 316914 - RNA, 64 nt, Homo Sapiens; identical to SEQ ID NO: 235857

SEQ ID NO: 316915 - RNA, 64 nt, Homo Sapiens; identical to SEQ ID NO: 235858

SEQ ID NO: 316916 - RNA, 64 nt, Homo Sapiens; identical to SEQ ID NO: 235859

SEQ ID NO: 316917 - RNA, 64 nt, Homo Sapiens; identical to SEQ ID NO: 235860

SEQ ID NO: 316918 - RNA, 64 nt, Homo Sapiens; identical to SEQ ID NO: 235861

SEQ ID NO: 316919 - RNA, 64 nt, Homo Sapiens; identical to SEQ ID NO: 235862

SEQ ID NO: 316920 - RNA, 64 nt, Homo Sapiens; identical to SEQ ID NO: 235863

SEQ ID NO: 316921 - RNA, 64 nt, Homo Sapiens; identical to SEQ ID NO: 235864

SEQ ID NO: 316922 - RNA, 64 nt, Homo Sapiens; identical to SEQ ID NO: 235865

SEQ ID NO: 316923 - RNA, 64 nt, Homo Sapiens; identical to SEQ ID NO: 235866

SEQ ID NO: 316924 - RNA, 64 nt, Homo Sapiens; identical to SEQ ID NO: 235867

SEQ ID NO: 316925 - RNA, 64 nt, Homo Sapiens; identical to SEQ ID NO: 235868

SEQ ID NO: 316926 - RNA, 64 nt, Homo Sapiens; identical to SEQ ID NO: 235869

SEQ ID NO: 316927 - RNA, 64 nt, Homo Sapiens; identical to SEQ ID NO: 235870

SEQ ID NO: 316928 - RNA, 64 nt, Homo Sapiens; identical to SEQ ID NO: 235871

SEQ ID NO: 316929 - RNA, 64 nt, Homo Sapiens; identical to SEQ ID NO: 235872

SEQ ID NO: 316930 - RNA, 64 nt, Homo Sapiens; identical to SEQ ID NO: 235873

SEQ ID NO: 316931 - RNA, 64 nt, Homo Sapiens; identical to SEQ ID NO: 235874

SEQ ID NO: 316932 - RNA, 64 nt, Homo Sapiens; identical to SEQ ID NO: 235875

SEQ ID NO: 316933 - RNA, 64 nt, Homo Sapiens; identical to SEQ ID NO: 235876

SEQ ID NO: 316934 - RNA, 64 nt, Homo Sapiens; identical to SEQ ID NO: 235877

SEQ ID NO: 316935 - RNA, 64 nt, Homo Sapiens; identical to SEQ ID NO: 235878

SEQ ID NO: 316936 - RNA, 64 nt, Homo Sapiens; identical to SEQ ID NO: 235879

SEQ ID NO: 316937 - RNA, 64 nt, Homo Sapiens; identical to SEQ ID NO: 235880

SEQ ID NO: 316938 - RNA, 64 nt, Homo Sapiens; identical to SEQ ID NO: 235881

SEQ ID NO: 316939 - RNA, 64 nt, Homo Sapiens; identical to SEQ ID NO: 235882

SEQ ID NO: 316940 - RNA, 64 nt, Homo Sapiens; identical to SEQ ID NO: 235883

SEQ ID NO: 316941 - RNA, 64 nt, Homo Sapiens; identical to SEQ ID NO: 235884

SEQ ID NO: 316942 - RNA, 64 nt, Homo Sapiens; identical to SEQ ID NO: 235885

SEQ ID NO: 316943 - RNA, 64 nt, Homo Sapiens; identical to SEQ ID NO: 235886

SEQ ID NO: 316944 - RNA, 64 nt, Homo Sapiens
aaagagagcauguuuaaauuaauuuccaaaagaccaucaauaaacaauguuguguucacagucu

SEQ ID NO: 316945 - RNA, 64 nt, Homo Sapiens
agaguaaucuucaaggucugaauucauuauuuaacaucaauauccauugauacucauuaaugca

SEQ ID NO: 316946 - RNA, 64 nt, Homo Sapiens
uuccuguuuagauuuuugcaagcagaaccaucugcaucaauauacaucauauuaaauaaaaugu

SEQ ID NO: 316947 - RNA, 64 nt, Homo Sapiens
uuauguuucuuggcauuguuuuagaaaacuguugcaucaauauaggcucauuuuuauguuuauu

SEQ ID NO: 316948 - RNA, 64 nt, Homo Sapiens
uuuuuaggcugaauuaauuuacgcaauaaaauaacaucaauagauuaccuacuccuuauuuacg

SEQ ID NO: 316949 - RNA, 64 nt, Homo Sapiens
uauucaaauauacaggugcauguauggccccuuucaucaauaucuggugcacuacucugaggcc

SEQ ID NO: 316950 - RNA, 64 nt, Homo Sapiens
cauuuauugcguaccuccuauuucucaucuucaccaucaauaaaaagaucagcagaaauagggu

SEQ ID NO: 316951 - RNA, 64 nt, Homo Sapiens
uguauuuugagugccuaagauucauucuuucauucaucaauaaaaaaagucagaacuagaauug

SEQ ID NO: 316952 - RNA, 64 nt, Homo Sapiens; identical to SEQ ID NO: 220958

SEQ ID NO: 316953 - RNA, 64 nt, Homo Sapiens; identical to SEQ ID NO: 220959

SEQ ID NO: 316954 - RNA, 55 nt, Homo Sapiens
ucaucaacaagguggugugauggcuccugcacaggcccugcacauaggaugaggg

SEQ ID NO: 316955 - RNA, 64 nt, Homo Sapiens
aucaacaagguggugugauggcuccugcacaggcccugcacauaggaugagggcaucugcuccc

SEQ ID NO: 316956 - RNA, 64 nt, Homo Sapiens
ucuccuucaccccuauggugcucagcccugagauccugcacaagguggaguguacuggcuacgc

SEQ ID NO: 316957 - RNA, 64 nt, Homo Sapiens
accccugaaacuggaccugcauagcuacgugaggccugcacagcuaaguguggagcuggacuac

SEQ ID NO: 316958 - RNA, 64 nt, Homo Sapiens
uugugccagcaguggcuccucucugccuuugagcccugcacagcuggacccauccuaagugcca

SEQ ID NO: 316959 - RNA, 64 nt, Homo Sapiens
agucuaagacuucagggccgggaccuuuguccagccugcacaguagagugaggcugccucuccc

SEQ ID NO: 316960 - RNA, 64 nt, Homo Sapiens
uacccuggaacuuaauaaaaacaaaccugcacauccugcacauggguacauguuuaccuaugua

SEQ ID NO: 316961 - RNA, 64 nt, Homo Sapiens
cugcacauguacccuggaacaccuauguaacaaaccugcacaucaagcaccaugguacauguuu

SEQ ID NO: 316962 - RNA, 64 nt, Homo Sapiens
cugccacuuucugucggugcuaauggauggaacuccugcacaaguuuuaacugaacaagaaauc

SEQ ID NO: 316963 - RNA, 64 nt, Homo Sapiens
uaguaaauaaaauaauagagagcccagaaaucaaccugcacaccuaccgccaucuaaucuucaa

SEQ ID NO: 316964 - RNA, 64 nt, Homo Sapiens
ugcaaaccugcuguccucugcccugcacaacacuccugcacacgggucuccccagggcuccucc

SEQ ID NO: 316965 - RNA, 64 nt, Homo Sapiens
acuccugcacacgugcaaacccagggcuccucccccugcacaacgccaccaggguagggucucc

SEQ ID NO: 316966 - RNA, 64 nt, Homo Sapiens
cccgugcacaggcacacgugcuggucugcacacaccugcacacaccugcacacucgcuaugcca

SEQ ID NO: 316967 - RNA, 64 nt, Homo Sapiens
ggcacacgugcuggucugcacacaccugcacacaccugcacacucgcuaugccaggccuccugg

SEQ ID NO: 316968 - RNA, 64 nt, Homo Sapiens
cuaccaaguauacuggugaagauuggagcacauuccugcacaaaaacaaggguggguuugcaca

SEQ ID NO: 316969 - RNA, 64 nt, Homo Sapiens
aaaggaugggguugggggggcuuuggagcagaauccugcacauucuuuagcuggucacuuggaa

SEQ ID NO: 316970 - RNA, 64 nt, Homo Sapiens
cagaacugccuuuggcccuaccuaacccagggacccugcacagcaccccagccucuguccacuu

SEQ ID NO: 316971 - RNA, 64 nt, Homo Sapiens
gcacuacccagacugccagagagguguccaccucccugcacaugccaggagucgccauaccugu

SEQ ID NO: 316972 - RNA, 64 nt, Homo Sapiens
gcaaccgccaaauuguuucaaucugaugcucaggccugcacaaaggaggggggagcugaaagga

SEQ ID NO: 316973 - RNA, 64 nt, Homo Sapiens
uggguguugcagggacccgcuccuucuuguagcgccugcacaccgcgggggcagcggccccggc

SEQ ID NO: 316974 - RNA, 64 nt, Homo Sapiens
auauguacauguacccaccacaaacgugcaagcuccugcacacaugcaugcacacaaacgugua

SEQ ID NO: 316975 - RNA, 64 nt, Homo Sapiens
acgcacacguacauucacuacaaacgugcagccuccugcacacgugcacauucauguguacacc

SEQ ID NO: 316976 - RNA, 64 nt, Homo Sapiens
auaugcccagugccagcuagggcccaccgcccauccugcacacggggccgcugggcaggugccc

SEQ ID NO: 316977 - RNA, 64 nt, Homo Sapiens
acuggcaagagucccaggcuccaaggacacccucccugcacaugauuggguguuaaugguggcc

SEQ ID NO: 316978 - RNA, 64 nt, Homo Sapiens
cagcaguggacagcaugguccucacacccagcucccugcacacccaggccagccaccccucccg

SEQ ID NO: 316979 - RNA, 64 nt, Homo Sapiens
cacaugcugucacgcauacacacacgcacauacuccugcacauguucccaugcaugugugugca

SEQ ID NO: 316980 - RNA, 64 nt, Homo Sapiens
ucaugaacauuaaaugugaugaugauuucuuuucccugcacacaucuuuccggugcaauaucua

SEQ ID NO: 316981 - RNA, 64 nt, Homo Sapiens
cuauugagcugguaguggcagaggacugaggguaccugcacaguuugauucuuuuccacgugua

SEQ ID NO: 316982 - RNA, 64 nt, Homo Sapiens
gucccucuccccggacaagccaccccugcacacaccugcacaccugcacgugcacacaccugca

SEQ ID NO: 316983 - RNA, 64 nt, Homo Sapiens
ccugcacaccgucccucucccacaccugcacaccccugcacacaaguuugccucugcacgugca

SEQ ID NO: 316984 - RNA, 64 nt, Homo Sapiens
ccugcacacaccugcacaccugcacgugcacacaccugcacacccugcccuagcaguuugccuc

SEQ ID NO: 316985 - RNA, 64 nt, Homo Sapiens
ucucagcggccuguggccuugguggggagagcuuccugcacagcuugauaccacgcagaccuug

SEQ ID NO: 316986 - RNA, 64 nt, Homo Sapiens
ugggccguggugggccugucgggagcuggcucauccugcacagcugggcaggccuuuccaccug

SEQ ID NO: 316987 - RNA, 64 nt, Homo Sapiens
uugcaaacagcuuuuaccuggcaucugccgagacccugcacaguaagagcuaaagauucucagg

SEQ ID NO: 316988 - RNA, 64 nt, Homo Sapiens
ggcuuggguggguuccuuugagcccugcagcaagccugcacacggcacuuuaaacgccgaagac

SEQ ID NO: 316989 - RNA, 64 nt, Homo Sapiens
gcaaggcccccgcggaauccgaagaccaaagcagccugcacaggccccaaaccggccuagacac

SEQ ID NO: 316990 - RNA, 64 nt, Homo Sapiens
ugcuaacuggggccugcguggaaggccuccgcucccugcacacacacggacaggaauuuccgug

SEQ ID NO: 316991 - RNA, 64 nt, Homo Sapiens
caagucuagcauguuccugucuccaacaccgccuccugcacaugcagagcagacagaaauaccc

SEQ ID NO: 316992 - RNA, 64 nt, Homo Sapiens
gucaggacuauuccuucuggacucugugccuuugccugcacagcuaguguugauggcuuguuug

SEQ ID NO: 316993 - RNA, 64 nt, Homo Sapiens
uaccccggaacuuacuuaaaacaaaccugcacauccugcacaugggcacacguucaccuaugua

SEQ ID NO: 316994 - RNA, 64 nt, Homo Sapiens
cugcacauguaccccggaacaccuauguaacaaaccugcacaucaaccaccauggcacacguuc

SEQ ID NO: 316995 - RNA, 64 nt, Homo Sapiens
ccaggugcaguccccgccccgccuaguccucggcgucacgcaaugcucaccucgccucuucccc

SEQ ID NO: 316996 - RNA, 64 nt, Homo Sapiens
uuaaagagaucugggccucauguagcucaccccggucacgcaugaaggcaaaagcaggucagaa

SEQ ID NO: 316997 - RNA, 64 nt, Homo Sapiens
cauucuugucaaguugcccagcuuggaguugucugucacgcacauguguccugugguuauagcu

SEQ ID NO: 316998 - RNA, 64 nt, Homo Sapiens
cugaggcccagaggcggagggcagucugcucaaggucacgcagcuggugacugguuggggcaga

SEQ ID NO: 316999 - RNA, 64 nt, Homo Sapiens
guccagcccucaggugggagguggcgccgcaggggucacgcaugguagagcacccucaggagaa

SEQ ID NO: 317000 - RNA, 64 nt, Homo Sapiens
gccaacgggucuucaguacuuuuauuaaaaaauagucacgcagacagugcccugguggcucugc

SEQ ID NO: 317001 - RNA, 64 nt, Homo Sapiens
cuacucuccaguaugucuuauuacucuccaguaugucacgcaucuuuaacuuuucacguccuau

SEQ ID NO: 317002 - RNA, 64 nt, Homo Sapiens
acagaacccaguuagcagcacagcaccauuccuggucacgcaaacagccacugagcugucgugc

SEQ ID NO: 317003 - RNA, 64 nt, Homo Sapiens
ucauguacuggaaugaucugggaaaggaaagggggucacgcacauggcugugugacacacguaa

SEQ ID NO: 317004 - RNA, 60 nt, Homo Sapiens
ggcccagagagaugaaguagcuugucuagggucacgcagcuuguaaguggcagagcuggc

SEQ ID NO: 317005 - RNA, 64 nt, Homo Sapiens
agggcacgugaagucauugacaccugcaugugcugucacgcacaugcccaaggaugcugucaag

SEQ ID NO: 317006 - RNA, 64 nt, Homo Sapiens
acuuuaaaaaaaaaaaaaaaaagggcagucuguggucacgcaaguucacucugcuuucuguaua

SEQ ID NO: 317007 - RNA, 64 nt, Homo Sapiens
ugacugguuuucggccuuucggagaagacaaagugucacgcaguaggacacgaaaggcauagaa

SEQ ID NO: 317008 - RNA, 64 nt, Homo Sapiens
ugacuuuggaccauaucuaguauauaauauuuuugucacgcaccugcugcauugcucuaacuua

SEQ ID NO: 317009 - RNA, 64 nt, Homo Sapiens
agauuuucagaaaauguucguuacguuuguuuaagucacgcaaaacauugauauuuggaauuaa

SEQ ID NO: 317010 - RNA, 64 nt, Homo Sapiens
uggacccccuucuccuuuccuuucuuuccuucaggucacgcagcccuguacuguauccagcacc

SEQ ID NO: 317011 - RNA, 64 nt, Homo Sapiens
ucgugugcucaucucacacacaccccccucccgggucacgcagacaccccccaaccacacacau

SEQ ID NO: 317012 - RNA, 64 nt, Homo Sapiens
uacucgucaucgcaucacuuccuuucccuccagagucacgcacaaagcagagacagauguagac

SEQ ID NO: 317013 - RNA, 64 nt, Homo Sapiens
ugccuguucaaguucucauuuucauuuuaguuuggucacgcauuucuuaauaucagcacagcaa

SEQ ID NO: 317014 - RNA, 64 nt, Homo Sapiens
cuaguucccaugacuccugguauauggacacacagucacgcaaguuuuccaacacaucuauaua

SEQ ID NO: 317015 - RNA, 64 nt, Homo Sapiens
cggcuuucaggaggugccagcaggccaugcagcagucacgcaguaagcccuccagccucuaggu

SEQ ID NO: 317016 - RNA, 64 nt, Homo Sapiens
aggacugacuugacagacgauggugcacccaucagucacgcaggugcaacgggugaccuaagcg

SEQ ID NO: 317017 - RNA, 64 nt, Homo Sapiens
uggaagcuaaauugccuccucuaucccauccccugucacgcauccuaaaguugcuucuccuacc

SEQ ID NO: 317018 - RNA, 64 nt, Homo Sapiens
uuauuuuuuuaauacucgugaagacaaaauaaaugucacgcaaccuacagauauuaauguuaac

SEQ ID NO: 317019 - RNA, 64 nt, Homo Sapiens
uuguuaccggagccacgggaagaaagcagccggagucacgcacgugcagagcugggcaugggag

SEQ ID NO: 317020 - RNA, 64 nt, Homo Sapiens
cagaaaacgcuuuauuagugaaccuugggaccaugucacgcaagagauucagcacugggaaaga

SEQ ID NO: 317021 - RNA, 64 nt, Homo Sapiens
uucauucauugcuacauaauaaugcacaaauucugucacgcauguuuuucugccagcuauguug

SEQ ID NO: 317022 - RNA, 62 nt, Homo Sapiens
ugugaucccagcuacuuagggccacgcauagugucacgcaccucaaaguaaaaagaauuuga

SEQ ID NO: 317023 - RNA, 64 nt, Homo Sapiens
guucugguccuggauuccagaugauuaugcaugagucacgcaaucacugugucuggccuagugu

SEQ ID NO: 317024 - RNA, 64 nt, Homo Sapiens
uggguguuacaaaguuguaucccuuuuauagauggucacgcaccggauagagguuggguuuccc

SEQ ID NO: 317025 - RNA, 64 nt, Homo Sapiens
uagucuaggaaauugagauuuugauacaccuaaggucacgcagcuggguagauauacagcuguc

SEQ ID NO: 317026 - RNA, 64 nt, Homo Sapiens
cugcagaugaggaaaccgagagaaguggcccaaggucacgcaacucugagaugccacauuucau

SEQ ID NO: 317027 - RNA, 64 nt, Homo Sapiens
uguucacacaugcacacucacgcucacacaugcugucacgcauacacacacgcacauacuccug

SEQ ID NO: 317028 - RNA, 64 nt, Homo Sapiens
uugcucgcuucuguguugacuuagaucaagacacgucacgcauccuuucugggguaguaccugu

SEQ ID NO: 317029 - RNA, 64 nt, Homo Sapiens
aauggggcuauuccuacgcuuggaggaacuuagugucacgcacaccacgcucaguuuggaccau

SEQ ID NO: 317030 - RNA, 53 nt, Homo Sapiens
acagauaccgcuccacacucgacgucacgcaggcugagccaacuccgauguga

SEQ ID NO: 317031 - RNA, 54 nt, Homo Sapiens
cagcacugucaacacugggcggacgucacgcagaccgcuuccggggagaaguga

SEQ ID NO: 317032 - RNA, 64 nt, Homo Sapiens
acucggacacugcccuggaauugacccccacagggucacgcaggugaccgaaugcucauagagg

SEQ ID NO: 317033 - RNA, 64 nt, Homo Sapiens
ugcucccucggaccccccaagccacugcugaaaagucacgcagcaggccucaggagugaccaua

SEQ ID NO: 317034 - RNA, 64 nt, Homo Sapiens
acuuaaugacagagauauguaaggagcaaauagagucacgcaucacaauguaauguuagagaua

SEQ ID NO: 317035 - RNA, 64 nt, Homo Sapiens
gaaggugacguucccaggagagggcaccuacacagucacgcaaacacacacuaauuccuggcag

SEQ ID NO: 317036 - RNA, 64 nt, Homo Sapiens
uuuuaaugcaaagcgccuuuuuugagcagguagagucacgcauccggcaggcggggcgagcucc

SEQ ID NO: 317037 - RNA, 64 nt, Homo Sapiens
caacggcgcugacgucacaugccgcggagaugacgucacgcaagucccucacccagagcacacg

SEQ ID NO: 317038 - RNA, 64 nt, Homo Sapiens
cccuucacaugacgcuaugugagauucugcacgagucacgcaccgguuuucucacuauuuuugg

SEQ ID NO: 317039 - RNA, 64 nt, Homo Sapiens
ucuaggacauucuccccucuccuaggagacggaugucacgcacaaauggggagagaaguguuua

SEQ ID NO: 317040 - RNA, 64 nt, Homo Sapiens
ugcguggcagccucuuccaguugagguguuuuaugucacgcacacuccaucccaguguacaaaa

SEQ ID NO: 317041 - RNA, 64 nt, Homo Sapiens
cugagugcacuggcaggaucguuuuccaaacugugucacgcagguacauacauagagagagaca

SEQ ID NO: 317042 - RNA, 64 nt, Homo Sapiens
gguagcagggcgcguuuccacuuaaggugugucugucacgcaccucauucuccccagacagucu

SEQ ID NO: 317043 - RNA, 64 nt, Homo Sapiens
uuaaagaaauaacgugcaugcuuuaaaaaacacagucacgcaccaagcaggcaaauagcuuuag

SEQ ID NO: 317044 - RNA, 64 nt, Homo Sapiens
ucuucuuuuacucuuugaaaccaugucuucaauugucacgcauuagagacaaaccaauuuaauu

SEQ ID NO: 317045 - RNA, 64 nt, Homo Sapiens
aaaaacugagcagcgccaacagcgagagcagcaggucacgcagaccagggaggccaagcagccg

SEQ ID NO: 317046 - RNA, 64 nt, Homo Sapiens
ccgccucuuccccuuucugucccgggauaccuggcggcaagagacuucuuggcuauuguccaug

SEQ ID NO: 317047 - RNA, 64 nt, Homo Sapiens
cuaugggcucccuggccucccaggccaccaaggacggcaagaaggacaagaaggaggaagacaa

SEQ ID NO: 317048 - RNA, 64 nt, Homo Sapiens
uuaucuccucucauacaucaagccccagaggaggcggcaagaggaacagccacaaacaaguacu

SEQ ID NO: 317049 - RNA, 64 nt, Homo Sapiens
cggcaaggcacggacgacugugcagacacagcagcggcaagaagcgagaacugcccucccccuc

SEQ ID NO: 317050 - RNA, 64 nt, Homo Sapiens
cccacccuguccggaggcgguggggcacggccgccggcaagaaagcaggugcaucgcgucgagg

SEQ ID NO: 317051 - RNA, 64 nt, Homo Sapiens
gcacaggcaaggccgaugacucccccccgguugccggcaagaccuagacuccugagcugcagag

SEQ ID NO: 317052 - RNA, 64 nt, Homo Sapiens
gugccuauacugccucuacaguucacaagaacaacggcaagacaaagggauagaaaggaacuau

SEQ ID NO: 317053 - RNA, 64 nt, Homo Sapiens
aacagaguuugcuccaagugggcugagaauaugacggcaagagggcuuggaggaccgaccccau

SEQ ID NO: 317054 - RNA, 64 nt, Homo Sapiens
gaaccaauuccuuuccccuuggcagggcuggcuacggcaagagguugggagaggcauguucuug

SEQ ID NO: 317055 - RNA, 64 nt, Homo Sapiens
agcuuuuccagcgcgcucgucugagcuuccucuucggcaagagggcuccuccaccagcuccacc

SEQ ID NO: 317056 - RNA, 64 nt, Homo Sapiens
cugggaaccccgcagcgcgaggcugccucaucaacggcaagaggaaaggaggggucucgggaca

SEQ ID NO: 317057 - RNA, 64 nt, Homo Sapiens
gcagaggguacggagucuucaaaggagacucccucggcaagaugaacccuuugauuguuuucua

SEQ ID NO: 317058 - RNA, 64 nt, Homo Sapiens
acccggguucugaaaaugugcuguguuccuaccucggcaagaucaccagcacugaggggcccag

SEQ ID NO: 317059 - RNA, 64 nt, Homo Sapiens
cucccaggcucaaucaagguagcacccccugccccggcaagaaaccugggagguggcagacaga

SEQ ID NO: 317060 - RNA, 64 nt, Homo Sapiens
gugaaaggccucagcucugacggccugaccacugcggcaagaggaccccagcuggggugcuuac

SEQ ID NO: 317061 - RNA, 64 nt, Homo Sapiens
ccuauugaucagugacacugccagaggcccauaccggcaagaggaagaggacgucauuuuguaa

SEQ ID NO: 317062 - RNA, 64 nt, Homo Sapiens
cccgugugucaccagugccagggggcagcaacaacggcaagacucugccggaggggugccagga

SEQ ID NO: 317063 - RNA, 64 nt, Homo Sapiens
uccacacccuagguugccuggcagagcagugguccggcaagaagggagacacagcugcccuggg

SEQ ID NO: 317064 - RNA, 64 nt, Homo Sapiens
gaauucuaccaauggaagccccucacauguuauccggcaagaguaggcuccgaaucaccaucuc

SEQ ID NO: 317065 - RNA, 55 nt, Homo Sapiens
agcuccaagacucaaaguagcccggcggcaagaggcccauguuccggagagaagc

SEQ ID NO: 317066 - RNA, 64 nt, Homo Sapiens
caacuggcuccacagccugguggugaaucacaugcggcaagaggagggugcaugcgucuccugc

SEQ ID NO: 317067 - RNA, 63 nt, Homo Sapiens
uucagcgccacuggcuggaaccaucggcagcgccggcaagacccaugugggaacggacccuga

SEQ ID NO: 317068 - RNA, 64 nt, Homo Sapiens
ccaucucaaaaaaaaaagaacagccugggcgagacggcaagacuaagaucacaccacuacacuc

SEQ ID NO: 317069 - RNA, 64 nt, Homo Sapiens
uuuauauuuauucucaagcaacccagcauuuuaacggcaagaacacaauucaacuacauguucu

SEQ ID NO: 317070 - RNA, 64 nt, Homo Sapiens
agaggaaaggagccacaggagcgggugcuacacccggcaagacagagcgucuccaucuaaaauu

SEQ ID NO: 317071 - RNA, 64 nt, Homo Sapiens
accuuguaaccagugcagaaaugaaauagcuuagcggcaagaagccguugaggcgguuuccuga

SEQ ID NO: 317072 - RNA, 64 nt, Homo Sapiens
ggaauggacccugugugugggcacagcuggggaacggcaagaaagcacaggauguggggcgagg

SEQ ID NO: 317073 - RNA, 64 nt, Homo Sapiens
ccccucucuuccccacuggggggccuggacuucacggcaagaccacguccauccugggacagac

SEQ ID NO: 317074 - RNA, 64 nt, Homo Sapiens
cucccggugcccccagaccccgcagcucugugcccggcaagaagcagcuagacacacgccaggg

SEQ ID NO: 317075 - RNA, 64 nt, Homo Sapiens
cucaggaccuucaagauuccaucugugggcuggccggcaagauggcaccaguggggacccacac

SEQ ID NO: 317076 - RNA, 64 nt, Homo Sapiens
ugaaggagagauacuuaggaaauccuaaaagaggcggcaagaagguaccucccuguguaacuca

SEQ ID NO: 317077 - RNA, 64 nt, Homo Sapiens
accaaaaaccaaaacaaacaacaguuuugcaccacggcaagaaacagugaauaagcaacuuucu

SEQ ID NO: 317078 - RNA, 64 nt, Homo Sapiens
uugugaugaagaaaagugggccagugugggaaugcggcaagaaggaauugacuucgacugugac

SEQ ID NO: 317079 - RNA, 64 nt, Homo Sapiens
agcacccaggagagccuugcugugucugucugcccggcaagaguccauucucacugcugggaca

SEQ ID NO: 317080 - RNA, 64 nt, Homo Sapiens
ucuuaagaaugugacacauucgcucuugcuacuucggcaagacacugcucacacagucacccuc

SEQ ID NO: 317081 - RNA, 64 nt, Homo Sapiens
augcuauugaaaaaguucagagcaguuauaaagacggcaagaccacuauacaaauuaaguggua

SEQ ID NO: 317082 - RNA, 64 nt, Homo Sapiens
uauuuauaauauuuagcgaacgggggcaggaggacggcaagaccccacugacugugccgagggg

SEQ ID NO: 317083 - RNA, 64 nt, Homo Sapiens
aguuuugagcguuguauuccgcagaaggcaagagcggcaagaugcuggcuaugaaaccuuguga

SEQ ID NO: 317084 - RNA, 64 nt, Homo Sapiens
caaagaguccccacuuaacaauaccccccccccacggcaagaaugcccaaauccgaaugacccc

SEQ ID NO: 317085 - RNA, 64 nt, Homo Sapiens
ggggcaagucuggggcuccacaagaagcauuucccggcaagagaguugaagacaagcugcuugu

SEQ ID NO: 317086 - RNA, 64 nt, Homo Sapiens
gagcugagauugcgccacugcacuccagucuggucggcaagagugagacuccgucucaaaaaca

SEQ ID NO: 317087 - RNA, 64 nt, Homo Sapiens
acaaccaccugcgacgccacgaacugcgccugcgcggcaagaaugucuagccugcccgcccgca

SEQ ID NO: 317088 - RNA, 64 nt, Homo Sapiens
gcauuuuuuuuuuuuaaaggugcauugagacuuacggcaagaagccuaacuguuuuguauaugc

SEQ ID NO: 317089 - RNA, 64 nt, Homo Sapiens
uggagaaaaggaaagcuccauuccucaggaaauucggcaagacuccgggagaacaucaaugcuu

SEQ ID NO: 317090 - RNA, 64 nt, Homo Sapiens
aaauaguugaaucagugaucuaguauuuuccuuucggcaagauuuguuagguuuuuaccccuuc

SEQ ID NO: 317091 - RNA, 64 nt, Homo Sapiens; identical to SEQ ID NO: 316995

SEQ ID NO: 317092 - RNA, 64 nt, Homo Sapiens; identical to SEQ ID NO: 316996

SEQ ID NO: 317093 - RNA, 64 nt, Homo Sapiens; identical to SEQ ID NO: 316997

SEQ ID NO: 317094 - RNA, 64 nt, Homo Sapiens; identical to SEQ ID NO: 316998

SEQ ID NO: 317095 - RNA, 64 nt, Homo Sapiens; identical to SEQ ID NO: 316999

SEQ ID NO: 317096 - RNA, 64 nt, Homo Sapiens; identical to SEQ ID NO: 317000

SEQ ID NO: 317097 - RNA, 64 nt, Homo Sapiens; identical to SEQ ID NO: 317001

SEQ ID NO: 317098 - RNA, 64 nt, Homo Sapiens; identical to SEQ ID NO: 317002

SEQ ID NO: 317099 - RNA, 64 nt, Homo Sapiens; identical to SEQ ID NO: 317003

SEQ ID NO: 317100 - RNA, 60 nt, Homo Sapiens; identical to SEQ ID NO: 317004

SEQ ID NO: 317101 - RNA, 64 nt, Homo Sapiens; identical to SEQ ID NO: 317005

SEQ ID NO: 317102 - RNA, 64 nt, Homo Sapiens; identical to SEQ ID NO: 317006

SEQ ID NO: 317103 - RNA, 64 nt, Homo Sapiens; identical to SEQ ID NO: 317007

SEQ ID NO: 317104 - RNA, 64 nt, Homo Sapiens; identical to SEQ ID NO: 317008

SEQ ID NO: 317105 - RNA, 64 nt, Homo Sapiens; identical to SEQ ID NO: 317009

SEQ ID NO: 317106 - RNA, 64 nt, Homo Sapiens; identical to SEQ ID NO: 317010

SEQ ID NO: 317107 - RNA, 64 nt, Homo Sapiens; identical to SEQ ID NO: 317011

SEQ ID NO: 317108 - RNA, 64 nt, Homo Sapiens; identical to SEQ ID NO: 317012

SEQ ID NO: 317109 - RNA, 64 nt, Homo Sapiens; identical to SEQ ID NO: 317013

SEQ ID NO: 317110 - RNA, 64 nt, Homo Sapiens; identical to SEQ ID NO: 317014

SEQ ID NO: 317111 - RNA, 64 nt, Homo Sapiens; identical to SEQ ID NO: 317015

SEQ ID NO: 317112 - RNA, 64 nt, Homo Sapiens; identical to SEQ ID NO: 317016

SEQ ID NO: 317113 - RNA, 64 nt, Homo Sapiens; identical to SEQ ID NO: 317017

SEQ ID NO: 317114 - RNA, 64 nt, Homo Sapiens; identical to SEQ ID NO: 317018

SEQ ID NO: 317115 - RNA, 64 nt, Homo Sapiens; identical to SEQ ID NO: 317019

SEQ ID NO: 317116 - RNA, 64 nt, Homo Sapiens; identical to SEQ ID NO: 317020

SEQ ID NO: 317117 - RNA, 64 nt, Homo Sapiens; identical to SEQ ID NO: 317021

SEQ ID NO: 317118 - RNA, 62 nt, Homo Sapiens; identical to SEQ ID NO: 317022

SEQ ID NO: 317119 - RNA, 64 nt, Homo Sapiens; identical to SEQ ID NO: 317023

SEQ ID NO: 317120 - RNA, 64 nt, Homo Sapiens; identical to SEQ ID NO: 317024

SEQ ID NO: 317121 - RNA, 64 nt, Homo Sapiens; identical to SEQ ID NO: 317025

SEQ ID NO: 317122 - RNA, 64 nt, Homo Sapiens; identical to SEQ ID NO: 317026

SEQ ID NO: 317123 - RNA, 64 nt, Homo Sapiens; identical to SEQ ID NO: 317027

SEQ ID NO: 317124 - RNA, 64 nt, Homo Sapiens; identical to SEQ ID NO: 317028

SEQ ID NO: 317125 - RNA, 64 nt, Homo Sapiens; identical to SEQ ID NO: 317029

SEQ ID NO: 317126 - RNA, 53 nt, Homo Sapiens; identical to SEQ ID NO: 317030

SEQ ID NO: 317127 - RNA, 54 nt, Homo Sapiens; identical to SEQ ID NO: 317031

SEQ ID NO: 317128 - RNA, 64 nt, Homo Sapiens; identical to SEQ ID NO: 317032

SEQ ID NO: 317129 - RNA, 64 nt, Homo Sapiens; identical to SEQ ID NO: 317033

SEQ ID NO: 317130 - RNA, 64 nt, Homo Sapiens; identical to SEQ ID NO: 317034

SEQ ID NO: 317131 - RNA, 64 nt, Homo Sapiens; identical to SEQ ID NO: 317035

SEQ ID NO: 317132 - RNA, 64 nt, Homo Sapiens; identical to SEQ ID NO: 317036

SEQ ID NO: 317133 - RNA, 64 nt, Homo Sapiens; identical to SEQ ID NO: 317037

SEQ ID NO: 317134 - RNA, 64 nt, Homo Sapiens; identical to SEQ ID NO: 317038

SEQ ID NO: 317135 - RNA, 64 nt, Homo Sapiens; identical to SEQ ID NO: 317039

SEQ ID NO: 317136 - RNA, 64 nt, Homo Sapiens; identical to SEQ ID NO: 317040

SEQ ID NO: 317137 - RNA, 64 nt, Homo Sapiens; identical to SEQ ID NO: 317041

SEQ ID NO: 317138 - RNA, 64 nt, Homo Sapiens; identical to SEQ ID NO: 317042

SEQ ID NO: 317139 - RNA, 64 nt, Homo Sapiens; identical to SEQ ID NO: 317043

SEQ ID NO: 317140 - RNA, 64 nt, Homo Sapiens; identical to SEQ ID NO: 317044

SEQ ID NO: 317141 - RNA, 64 nt, Homo Sapiens; identical to SEQ ID NO: 317045

SEQ ID NO: 317142 - RNA, 64 nt, Homo Sapiens; identical to SEQ ID NO: 317046

SEQ ID NO: 317143 - RNA, 64 nt, Homo Sapiens; identical to SEQ ID NO: 317047

SEQ ID NO: 317144 - RNA, 64 nt, Homo Sapiens; identical to SEQ ID NO: 317048

SEQ ID NO: 317145 - RNA, 64 nt, Homo Sapiens; identical to SEQ ID NO: 317049

SEQ ID NO: 317146 - RNA, 64 nt, Homo Sapiens; identical to SEQ ID NO: 317050

SEQ ID NO: 317147 - RNA, 64 nt, Homo Sapiens; identical to SEQ ID NO: 317051

SEQ ID NO: 317148 - RNA, 64 nt, Homo Sapiens; identical to SEQ ID NO: 317052

SEQ ID NO: 317149 - RNA, 64 nt, Homo Sapiens; identical to SEQ ID NO: 317053

SEQ ID NO: 317150 - RNA, 64 nt, Homo Sapiens; identical to SEQ ID NO: 317054

SEQ ID NO: 317151 - RNA, 64 nt, Homo Sapiens; identical to SEQ ID NO: 317055

SEQ ID NO: 317152 - RNA, 64 nt, Homo Sapiens; identical to SEQ ID NO: 317056

SEQ ID NO: 317153 - RNA, 64 nt, Homo Sapiens; identical to SEQ ID NO: 317057

SEQ ID NO: 317154 - RNA, 64 nt, Homo Sapiens; identical to SEQ ID NO: 317058

SEQ ID NO: 317155 - RNA, 64 nt, Homo Sapiens; identical to SEQ ID NO: 317059

SEQ ID NO: 317156 - RNA, 64 nt, Homo Sapiens; identical to SEQ ID NO: 317060

SEQ ID NO: 317157 - RNA, 64 nt, Homo Sapiens; identical to SEQ ID NO: 317061

SEQ ID NO: 317158 - RNA, 64 nt, Homo Sapiens; identical to SEQ ID NO: 317062

SEQ ID NO: 317159 - RNA, 64 nt, Homo Sapiens; identical to SEQ ID NO: 317063

SEQ ID NO: 317160 - RNA, 64 nt, Homo Sapiens; identical to SEQ ID NO: 317064

SEQ ID NO: 317161 - RNA, 55 nt, Homo Sapiens; identical to SEQ ID NO: 317065

SEQ ID NO: 317162 - RNA, 64 nt, Homo Sapiens; identical to SEQ ID NO: 317066

SEQ ID NO: 317163 - RNA, 63 nt, Homo Sapiens; identical to SEQ ID NO: 317067

SEQ ID NO: 317164 - RNA, 64 nt, Homo Sapiens; identical to SEQ ID NO: 317068

SEQ ID NO: 317165 - RNA, 64 nt, Homo Sapiens; identical to SEQ ID NO: 317069

SEQ ID NO: 317166 - RNA, 64 nt, Homo Sapiens; identical to SEQ ID NO: 317070

SEQ ID NO: 317167 - RNA, 64 nt, Homo Sapiens; identical to SEQ ID NO: 317071

SEQ ID NO: 317168 - RNA, 64 nt, Homo Sapiens; identical to SEQ ID NO: 317072

SEQ ID NO: 317169 - RNA, 64 nt, Homo Sapiens; identical to SEQ ID NO: 317073

SEQ ID NO: 317170 - RNA, 64 nt, Homo Sapiens; identical to SEQ ID NO: 317074

SEQ ID NO: 317171 - RNA, 64 nt, Homo Sapiens; identical to SEQ ID NO: 317075

SEQ ID NO: 317172 - RNA, 64 nt, Homo Sapiens; identical to SEQ ID NO: 317076

SEQ ID NO: 317173 - RNA, 64 nt, Homo Sapiens; identical to SEQ ID NO: 317077

SEQ ID NO: 317174 - RNA, 64 nt, Homo Sapiens; identical to SEQ ID NO: 317078

SEQ ID NO: 317175 - RNA, 64 nt, Homo Sapiens; identical to SEQ ID NO: 317079

SEQ ID NO: 317176 - RNA, 64 nt, Homo Sapiens; identical to SEQ ID NO: 317080

SEQ ID NO: 317177 - RNA, 64 nt, Homo Sapiens; identical to SEQ ID NO: 317081

SEQ ID NO: 317178 - RNA, 64 nt, Homo Sapiens; identical to SEQ ID NO: 317082

SEQ ID NO: 317179 - RNA, 64 nt, Homo Sapiens; identical to SEQ ID NO: 317083

SEQ ID NO: 317180 - RNA, 64 nt, Homo Sapiens; identical to SEQ ID NO: 317084

SEQ ID NO: 317181 - RNA, 64 nt, Homo Sapiens; identical to SEQ ID NO: 317085

SEQ ID NO: 317182 - RNA, 64 nt, Homo Sapiens; identical to SEQ ID NO: 317086

SEQ ID NO: 317183 - RNA, 64 nt, Homo Sapiens; identical to SEQ ID NO: 317087

SEQ ID NO: 317184 - RNA, 64 nt, Homo Sapiens; identical to SEQ ID NO: 317088

SEQ ID NO: 317185 - RNA, 64 nt, Homo Sapiens; identical to SEQ ID NO: 317089

SEQ ID NO: 317186 - RNA, 64 nt, Homo Sapiens; identical to SEQ ID NO: 317090

SEQ ID NO: 317187 - RNA, 64 nt, Homo Sapiens
ccuggcgccuggcggucaccuggugccuacuguccgacaggaugccuugauccucgugcgaccc

SEQ ID NO: 317188 - RNA, 64 nt, Homo Sapiens
cagcggguuacauccacacugcugaucacaccaacgacaggagcugauaagcaagaaagcguca

SEQ ID NO: 317189 - RNA, 64 nt, Homo Sapiens
agcuaaucuucagagagcucggcaguugcuguggcgacaggaagacggaugcccacagggccug

SEQ ID NO: 317190 - RNA, 64 nt, Homo Sapiens
aaauaacggugcuugugucacuagcauagaauagcgacaggaauagaugugguccuuaggagac

SEQ ID NO: 317191 - RNA, 64 nt, Homo Sapiens
aggaggccugcagauccagccuuccugucaacagcgacaggaaaucucuagguuggugagugcu

SEQ ID NO: 317192 - RNA, 64 nt, Homo Sapiens
uaguugucacuuuauuuuggaccugcugugaucucgacaggaaacgugccacagagcaguagug

SEQ ID NO: 317193 - RNA, 64 nt, Homo Sapiens
gaaggugaggucugggaugcugcgugcggcgcgacgacaggagguaugaccuggguggggucag

SEQ ID NO: 317194 - RNA, 64 nt, Homo Sapiens
aaacuuuggaauaaggaagaucuggaacugaaaccgacaggaagccauuguuguuuacuuuagu

SEQ ID NO: 317195 - RNA, 64 nt, Homo Sapiens
uuuccuugcucucacccacggauaaaaccagaagcgacaggaggccagcuccugggguuccugg

SEQ ID NO: 317196 - RNA, 64 nt, Homo Sapiens
ggcccucugcuuuucuucccaaagaugaugcaagcgacaggaaacaagauaaaaccagagcagg

SEQ ID NO: 317197 - RNA, 64 nt, Homo Sapiens
acugcaugucagagcacuuugcucaucacccuuccgacaggagcgaggaacucuccuguggccu

SEQ ID NO: 317198 - RNA, 64 nt, Homo Sapiens
ccaugcccaccgccccuggaguugcccuccaggccgacaggagggucuguccacguggagagaa

SEQ ID NO: 317199 - RNA, 64 nt, Homo Sapiens
gcaggacgguuuguuuucagugggugggggcccucgacaggacaugucccauggcuacauccug

SEQ ID NO: 317200 - RNA, 64 nt, Homo Sapiens
cugcugggugggggugggggggcuucagucuguccgacaggaaguaccgucacuagcccagcca

SEQ ID NO: 317201 - RNA, 64 nt, Homo Sapiens
aagguuggagcagugcuuuuagcacuguggaucacgacaggaaacuuuaauguugcccacauua

SEQ ID NO: 317202 - RNA, 64 nt, Homo Sapiens
cuacaaguuccacacuuuaauuugcaagcuucuucgacaggaaauugcuaggauggaauugcaa

SEQ ID NO: 317203 - RNA, 64 nt, Homo Sapiens
uugugucccugaaguucccuguugcaugagccugcgacaggaccucacccccaccaccaggcuu

SEQ ID NO: 317204 - RNA, 64 nt, Homo Sapiens
cccaccaaucuggugaggauaaugguggcuccagcgacaggaggccaacccuggagaccaagaa

SEQ ID NO: 317205 - RNA, 64 nt, Homo Sapiens
agcuaguugggcgccccccacccucccccggacucgacaggagccuggaccuccggcuucauuu

SEQ ID NO: 317206 - RNA, 64 nt, Homo Sapiens
aggcugcuggacacgucggacagcgaaguauccccgacaggacgggcuugggcuuccauuugug

SEQ ID NO: 317207 - RNA, 64 nt, Homo Sapiens
cccagcaccagagcacaaugagaaacggcagcgccgacaggagcggcggcagaugaagcgguua

SEQ ID NO: 317208 - RNA, 64 nt, Homo Sapiens
caggcagcucccugaccauuuggacacauugccacgacaggagccuccaaguaugugggagggg

SEQ ID NO: 317209 - RNA, 64 nt, Homo Sapiens
ccaggggaaaaaccccugcuggaccacgcaguugcgacaggaggugggcuccugggcugaacau

SEQ ID NO: 317210 - RNA, 64 nt, Homo Sapiens
ucagccugcuuugagccucagugagaaguccuuccgacaggagcugacucaugucaggauggca

SEQ ID NO: 317211 - RNA, 64 nt, Homo Sapiens
cucagaaguugcugccaccaacucuuuaagaaggcgacaggaucaguccuucucucggguucug

SEQ ID NO: 317212 - RNA, 64 nt, Homo Sapiens
gaggccaccuccaagccgcgggugcccccuagggcgacaggagccagcgggacgccgcacgcgg

SEQ ID NO: 317213 - RNA, 64 nt, Homo Sapiens
auaaaggaaagguacuggcuugaagucacaaccacgacaggaguaaggauuuggaauaaggauu

SEQ ID NO: 317214 - RNA, 64 nt, Homo Sapiens
ccaagggcugaauccaguggagcugggccaaguacgacaggaguccagauaaagguguaggggc

SEQ ID NO: 317215 - RNA, 64 nt, Homo Sapiens
ccgaacacacgcugugagccaccaagaccuggggcgacaggagaaccgguccucucucugacgg

SEQ ID NO: 317216 - RNA, 64 nt, Homo Sapiens
ucuuacaggugguugucugggguggguggaguggcgacaggauagagcugaaggacuaugcaaa

SEQ ID NO: 317217 - RNA, 64 nt, Homo Sapiens
cacaccagagugugcaggcuagagguccagauugcgacaggagcacaacacucuagaacuggag

SEQ ID NO: 317218 - RNA, 64 nt, Homo Sapiens
gggacagcaggccccuugacaucuuugaggacugcgacaggaccuagaggacugucacucuagc

SEQ ID NO: 317219 - RNA, 64 nt, Homo Sapiens
cagaaaaucagggacauggcgcccugucuucgggcgacaggagcaagcugacccugugaucucu

SEQ ID NO: 317220 - RNA, 64 nt, Homo Sapiens
cuuugaggugucucaaucugaucugagugagaggcgacaggaguauuuuuuuuuuuuuacagcu

SEQ ID NO: 317221 - RNA, 64 nt, Homo Sapiens
ccguugcuccagugcauguccauuguucuucaggcgacaggagagggggaagaacuaggggcuc

SEQ ID NO: 317222 - RNA, 51 nt, Homo Sapiens
gcgaggccccugggacggacccgacaggaggaggaccacgagcggaaguag

SEQ ID NO: 317223 - RNA, 64 nt, Homo Sapiens
agaaccggcgcugggcaacacgggccugcaaacucgacaggacccugcccgaggggcccucgcg

SEQ ID NO: 317224 - RNA, 64 nt, Homo Sapiens
aacccggcagacgggugcaggcccggccuuuccccacgcggacuccgcgcgaccccggcccucu

SEQ ID NO: 317225 - RNA, 64 nt, Homo Sapiens
gguggcgggugcacagagacggucuggaaggaaacacgcggaucugaacagcaguaauccuggg

SEQ ID NO: 317226 - RNA, 64 nt, Homo Sapiens
ccaagggcaucaugcagcugugucauucagcgcacacgcggacgcaagaugcagguggaguaca

SEQ ID NO: 317227 - RNA, 64 nt, Homo Sapiens
cucagcccuagacucccucccgaagcgacagggccacgcggagcgcgguaccugcagaugaagg

SEQ ID NO: 317228 - RNA, 64 nt, Homo Sapiens
cagcucagagugcccgucagggccugugcauccgcacgcggagccgucuguuaggagcuuccag

SEQ ID NO: 317229 - RNA, 64 nt, Homo Sapiens
ccaagcacacucuggcgggucgcagacacacggacacgcggaagcgggacagacgccggcgacg

SEQ ID NO: 317230 - RNA, 64 nt, Homo Sapiens
ccgggguucggaucgcuccggggucccccuccugcacgcggacugggcgagggcggcggggccu

SEQ ID NO: 317231 - RNA, 64 nt, Homo Sapiens
ucacacugaccaagauacuuaagugcugcaauugcacgcggagugaguuuuuuagugcgugcag

SEQ ID NO: 317232 - RNA, 64 nt, Homo Sapiens
ccccgccuggccuggaccccaaucggagggcgcgcacgcggaucaccgacgcuuacugugcgag

SEQ ID NO: 317233 - RNA, 64 nt, Homo Sapiens
gcagauagaaacugggacggauucaagucacaugcacgcggauagcaguaagccacacaccugc

SEQ ID NO: 317234 - RNA, 64 nt, Homo Sapiens
gaaguuuauacuuagaacugaccaccuccccggccacgcggagagcuguacaguguguaaaucu

SEQ ID NO: 317235 - RNA, 64 nt, Homo Sapiens
ucacuugaccaauacugacccucuuuaccucgcccacgcggacacacgccuccuguagucgcuu

SEQ ID NO: 317236 - RNA, 64 nt, Homo Sapiens
gaaacaguuugaaagggacugcuccaaaaaucugcacgcggagccgcgucaggaggaaagaauu

SEQ ID NO: 317237 - RNA, 64 nt, Homo Sapiens
cuacuacugcagucuuuauugggaacuggcagcgcacgcggaugggcaacaauuaaggccccag

SEQ ID NO: 317238 - RNA, 64 nt, Homo Sapiens
ccaucaaaccuugacaccgggugcucugcacacccacgcggauguugcaccucauucucccgau

SEQ ID NO: 317239 - RNA, 64 nt, Homo Sapiens
aauuugcaucugaaauaggauggcucaccuuccgcacgcggauugaggcaaacggaggcaaagc

SEQ ID NO: 317240 - RNA, 64 nt, Homo Sapiens
uaacugcgauauuggaacacuuuaauggaguguccacgcggagaguguucacacgcggggucgg

SEQ ID NO: 317241 - RNA, 64 nt, Homo Sapiens
agugggaggucaucugaaggagcccuggccgagucacgcggaggggcccggcgucuguggcggg

SEQ ID NO: 317242 - RNA, 64 nt, Homo Sapiens
cuguguccccaucucggccggcccggagcucgcccacgcggacccccgcccugccccagcucag

SEQ ID NO: 317243 - RNA, 64 nt, Homo Sapiens
cucgcugggcugcacucagcggaagccccccgaccacgcggacgagccucuuuccacagacuua

SEQ ID NO: 317244 - RNA, 57 nt, Homo Sapiens
ccgccucaagggucuucaggguccagccacgcggauggcuaccgcguccagguguga

SEQ ID NO: 317245 - RNA, 64 nt, Homo Sapiens
gaugggcuaugaguuuggcaaggguuugggccgacacgcggaaggccggguggagcccauccau

SEQ ID NO: 317246 - RNA, 64 nt, Homo Sapiens
agcagagccggcccugaggacaguccugcccauccacgcggagauguggcugccgcguuugcau

SEQ ID NO: 317247 - RNA, 64 nt, Homo Sapiens
ccucgggugcgaaaucagacccaccugacaccaucacgcggaggcccagcagcaccugcaccca

SEQ ID NO: 317248 - RNA, 64 nt, Homo Sapiens
uucccuagucaaugcucugauacagggcucuaguuaugguuacuugugaugaaaaacuuggccu

SEQ ID NO: 317249 - RNA, 64 nt, Homo Sapiens
uuccuugugaugaaaaacuuuaaaaggcucuaauuaugguuacuaacaaauuuucucacuguca

SEQ ID NO: 317250 - RNA, 64 nt, Homo Sapiens; identical to SEQ ID NO: 180837

SEQ ID NO: 317251 - RNA, 64 nt, Homo Sapiens; identical to SEQ ID NO: 180838

SEQ ID NO: 317252 - RNA, 64 nt, Homo Sapiens; identical to SEQ ID NO: 180839

SEQ ID NO: 317253 - RNA, 64 nt, Homo Sapiens; identical to SEQ ID NO: 180840

SEQ ID NO: 317254 - RNA, 64 nt, Homo Sapiens; identical to SEQ ID NO: 180841

SEQ ID NO: 317255 - RNA, 64 nt, Homo Sapiens; identical to SEQ ID NO: 180842

SEQ ID NO: 317256 - RNA, 64 nt, Homo Sapiens; identical to SEQ ID NO: 180843

SEQ ID NO: 317257 - RNA, 64 nt, Homo Sapiens; identical to SEQ ID NO: 180844

SEQ ID NO: 317258 - RNA, 64 nt, Homo Sapiens; identical to SEQ ID NO: 180845

SEQ ID NO: 317259 - RNA, 64 nt, Homo Sapiens; identical to SEQ ID NO: 180846

SEQ ID NO: 317260 - RNA, 64 nt, Homo Sapiens; identical to SEQ ID NO: 180847

SEQ ID NO: 317261 - RNA, 64 nt, Homo Sapiens; identical to SEQ ID NO: 180848

SEQ ID NO: 317262 - RNA, 64 nt, Homo Sapiens; identical to SEQ ID NO: 180849

SEQ ID NO: 317263 - RNA, 64 nt, Homo Sapiens; identical to SEQ ID NO: 180850

SEQ ID NO: 317264 - RNA, 64 nt, Homo Sapiens; identical to SEQ ID NO: 180851

SEQ ID NO: 317265 - RNA, 64 nt, Homo Sapiens; identical to SEQ ID NO: 180852

SEQ ID NO: 317266 - RNA, 63 nt, Homo Sapiens; identical to SEQ ID NO: 102980

SEQ ID NO: 317267 - RNA, 63 nt, Homo Sapiens; identical to SEQ ID NO: 102981

SEQ ID NO: 317268 - RNA, 63 nt, Homo Sapiens; identical to SEQ ID NO: 102982

SEQ ID NO: 317269 - RNA, 63 nt, Homo Sapiens; identical to SEQ ID NO: 102983

SEQ ID NO: 317270 - RNA, 63 nt, Homo Sapiens; identical to SEQ ID NO: 102984

SEQ ID NO: 317271 - RNA, 63 nt, Homo Sapiens; identical to SEQ ID NO: 102985

SEQ ID NO: 317272 - RNA, 63 nt, Homo Sapiens; identical to SEQ ID NO: 102986

SEQ ID NO: 317273 - RNA, 63 nt, Homo Sapiens; identical to SEQ ID NO: 102987

SEQ ID NO: 317274 - RNA, 63 nt, Homo Sapiens; identical to SEQ ID NO: 102988

SEQ ID NO: 317275 - RNA, 63 nt, Homo Sapiens; identical to SEQ ID NO: 102989

SEQ ID NO: 317276 - RNA, 63 nt, Homo Sapiens; identical to SEQ ID NO: 102990

SEQ ID NO: 317277 - RNA, 58 nt, Homo Sapiens; identical to SEQ ID NO: 102991

SEQ ID NO: 317278 - RNA, 63 nt, Homo Sapiens; identical to SEQ ID NO: 102992

SEQ ID NO: 317279 - RNA, 63 nt, Homo Sapiens; identical to SEQ ID NO: 102993

SEQ ID NO: 317280 - RNA, 63 nt, Homo Sapiens; identical to SEQ ID NO: 102994

SEQ ID NO: 317281 - RNA, 63 nt, Homo Sapiens; identical to SEQ ID NO: 102995

SEQ ID NO: 317282 - RNA, 63 nt, Homo Sapiens; identical to SEQ ID NO: 102996

SEQ ID NO: 317283 - RNA, 63 nt, Homo Sapiens; identical to SEQ ID NO: 102997

SEQ ID NO: 317284 - RNA, 63 nt, Homo Sapiens; identical to SEQ ID NO: 102998

SEQ ID NO: 317285 - RNA, 63 nt, Homo Sapiens; identical to SEQ ID NO: 102999

SEQ ID NO: 317286 - RNA, 63 nt, Homo Sapiens; identical to SEQ ID NO: 103000

SEQ ID NO: 317287 - RNA, 63 nt, Homo Sapiens; identical to SEQ ID NO: 103001

SEQ ID NO: 317288 - RNA, 63 nt, Homo Sapiens; identical to SEQ ID NO: 103002

SEQ ID NO: 317289 - RNA, 63 nt, Homo Sapiens; identical to SEQ ID NO: 103003

SEQ ID NO: 317290 - RNA, 63 nt, Homo Sapiens; identical to SEQ ID NO: 103004

SEQ ID NO: 317291 - RNA, 63 nt, Homo Sapiens; identical to SEQ ID NO: 103005

SEQ ID NO: 317292 - RNA, 63 nt, Homo Sapiens; identical to SEQ ID NO: 103006

SEQ ID NO: 317293 - RNA, 63 nt, Homo Sapiens; identical to SEQ ID NO: 103007

SEQ ID NO: 317294 - RNA, 63 nt, Homo Sapiens; identical to SEQ ID NO: 103008

SEQ ID NO: 317295 - RNA, 63 nt, Homo Sapiens; identical to SEQ ID NO: 103009

SEQ ID NO: 317296 - RNA, 63 nt, Homo Sapiens; identical to SEQ ID NO: 103010

SEQ ID NO: 317297 - RNA, 63 nt, Homo Sapiens; identical to SEQ ID NO: 103011

SEQ ID NO: 317298 - RNA, 63 nt, Homo Sapiens; identical to SEQ ID NO: 103012

SEQ ID NO: 317299 - RNA, 63 nt, Homo Sapiens; identical to SEQ ID NO: 103013

SEQ ID NO: 317300 - RNA, 53 nt, Homo Sapiens; identical to SEQ ID NO: 103014

SEQ ID NO: 317301 - RNA, 63 nt, Homo Sapiens; identical to SEQ ID NO: 103015

SEQ ID NO: 317302 - RNA, 63 nt, Homo Sapiens; identical to SEQ ID NO: 103016

SEQ ID NO: 317303 - RNA, 63 nt, Homo Sapiens; identical to SEQ ID NO: 103017

SEQ ID NO: 317304 - RNA, 63 nt, Homo Sapiens; identical to SEQ ID NO: 103018

SEQ ID NO: 317305 - RNA, 63 nt, Homo Sapiens; identical to SEQ ID NO: 103019

SEQ ID NO: 317306 - RNA, 63 nt, Homo Sapiens; identical to SEQ ID NO: 103020

SEQ ID NO: 317307 - RNA, 63 nt, Homo Sapiens; identical to SEQ ID NO: 103021

SEQ ID NO: 317308 - RNA, 63 nt, Homo Sapiens; identical to SEQ ID NO: 103022

SEQ ID NO: 317309 - RNA, 63 nt, Homo Sapiens; identical to SEQ ID NO: 103023

SEQ ID NO: 317310 - RNA, 63 nt, Homo Sapiens; identical to SEQ ID NO: 103024

SEQ ID NO: 317311 - RNA, 63 nt, Homo Sapiens; identical to SEQ ID NO: 103025

SEQ ID NO: 317312 - RNA, 63 nt, Homo Sapiens; identical to SEQ ID NO: 103026

SEQ ID NO: 317313 - RNA, 63 nt, Homo Sapiens; identical to SEQ ID NO: 103027

SEQ ID NO: 317314 - RNA, 63 nt, Homo Sapiens; identical to SEQ ID NO: 103028

SEQ ID NO: 317315 - RNA, 63 nt, Homo Sapiens; identical to SEQ ID NO: 103029

SEQ ID NO: 317316 - RNA, 63 nt, Homo Sapiens; identical to SEQ ID NO: 103030

SEQ ID NO: 317317 - RNA, 63 nt, Homo Sapiens; identical to SEQ ID NO: 103031

SEQ ID NO: 317318 - RNA, 63 nt, Homo Sapiens; identical to SEQ ID NO: 103032

SEQ ID NO: 317319 - RNA, 63 nt, Homo Sapiens; identical to SEQ ID NO: 103033

SEQ ID NO: 317320 - RNA, 63 nt, Homo Sapiens; identical to SEQ ID NO: 103034

SEQ ID NO: 317321 - RNA, 63 nt, Homo Sapiens; identical to SEQ ID NO: 103035

SEQ ID NO: 317322 - RNA, 63 nt, Homo Sapiens; identical to SEQ ID NO: 103036

SEQ ID NO: 317323 - RNA, 63 nt, Homo Sapiens; identical to SEQ ID NO: 103037

SEQ ID NO: 317324 - RNA, 63 nt, Homo Sapiens; identical to SEQ ID NO: 103038

SEQ ID NO: 317325 - RNA, 63 nt, Homo Sapiens; identical to SEQ ID NO: 103039

SEQ ID NO: 317326 - RNA, 63 nt, Homo Sapiens; identical to SEQ ID NO: 103040

SEQ ID NO: 317327 - RNA, 63 nt, Homo Sapiens; identical to SEQ ID NO: 103041

SEQ ID NO: 317328 - RNA, 63 nt, Homo Sapiens; identical to SEQ ID NO: 103042

SEQ ID NO: 317329 - RNA, 63 nt, Homo Sapiens; identical to SEQ ID NO: 103043

SEQ ID NO: 317330 - RNA, 63 nt, Homo Sapiens; identical to SEQ ID NO: 103044

SEQ ID NO: 317331 - RNA, 63 nt, Homo Sapiens; identical to SEQ ID NO: 103045

SEQ ID NO: 317332 - RNA, 63 nt, Homo Sapiens; identical to SEQ ID NO: 103046

SEQ ID NO: 317333 - RNA, 63 nt, Homo Sapiens; identical to SEQ ID NO: 103047

SEQ ID NO: 317334 - RNA, 63 nt, Homo Sapiens; identical to SEQ ID NO: 103048

SEQ ID NO: 317335 - RNA, 63 nt, Homo Sapiens; identical to SEQ ID NO: 103049

SEQ ID NO: 317336 - RNA, 63 nt, Homo Sapiens; identical to SEQ ID NO: 103050

SEQ ID NO: 317337 - RNA, 63 nt, Homo Sapiens; identical to SEQ ID NO: 103051

SEQ ID NO: 317338 - RNA, 63 nt, Homo Sapiens; identical to SEQ ID NO: 103052

SEQ ID NO: 317339 - RNA, 63 nt, Homo Sapiens; identical to SEQ ID NO: 103053

SEQ ID NO: 317340 - RNA, 63 nt, Homo Sapiens; identical to SEQ ID NO: 103054

SEQ ID NO: 317341 - RNA, 63 nt, Homo Sapiens; identical to SEQ ID NO: 103055

SEQ ID NO: 317342 - RNA, 63 nt, Homo Sapiens; identical to SEQ ID NO: 103056

SEQ ID NO: 317343 - RNA, 63 nt, Homo Sapiens; identical to SEQ ID NO: 103057

SEQ ID NO: 317344 - RNA, 63 nt, Homo Sapiens; identical to SEQ ID NO: 103058

SEQ ID NO: 317345 - RNA, 63 nt, Homo Sapiens; identical to SEQ ID NO: 103059

SEQ ID NO: 317346 - RNA, 63 nt, Homo Sapiens; identical to SEQ ID NO: 103060

SEQ ID NO: 317347 - RNA, 63 nt, Homo Sapiens; identical to SEQ ID NO: 103061

SEQ ID NO: 317348 - RNA, 63 nt, Homo Sapiens; identical to SEQ ID NO: 103062

SEQ ID NO: 317349 - RNA, 63 nt, Homo Sapiens; identical to SEQ ID NO: 103063

SEQ ID NO: 317350 - RNA, 63 nt, Homo Sapiens; identical to SEQ ID NO: 103064

SEQ ID NO: 317351 - RNA, 63 nt, Homo Sapiens; identical to SEQ ID NO: 103065

SEQ ID NO: 317352 - RNA, 63 nt, Homo Sapiens; identical to SEQ ID NO: 103066

SEQ ID NO: 317353 - RNA, 63 nt, Homo Sapiens; identical to SEQ ID NO: 103067

SEQ ID NO: 317354 - RNA, 63 nt, Homo Sapiens; identical to SEQ ID NO: 103068

SEQ ID NO: 317355 - RNA, 63 nt, Homo Sapiens; identical to SEQ ID NO: 103069

SEQ ID NO: 317356 - RNA, 63 nt, Homo Sapiens; identical to SEQ ID NO: 103070

SEQ ID NO: 317357 - RNA, 63 nt, Homo Sapiens; identical to SEQ ID NO: 103071

SEQ ID NO: 317358 - RNA, 63 nt, Homo Sapiens; identical to SEQ ID NO: 103072

SEQ ID NO: 317359 - RNA, 63 nt, Homo Sapiens; identical to SEQ ID NO: 103073

SEQ ID NO: 317360 - RNA, 63 nt, Homo Sapiens; identical to SEQ ID NO: 103074

SEQ ID NO: 317361 - RNA, 63 nt, Homo Sapiens; identical to SEQ ID NO: 103075

SEQ ID NO: 317362 - RNA, 63 nt, Homo Sapiens; identical to SEQ ID NO: 103076

SEQ ID NO: 317363 - RNA, 63 nt, Homo Sapiens; identical to SEQ ID NO: 103077

SEQ ID NO: 317364 - RNA, 63 nt, Homo Sapiens; identical to SEQ ID NO: 103078

SEQ ID NO: 317365 - RNA, 63 nt, Homo Sapiens; identical to SEQ ID NO: 103079

SEQ ID NO: 317366 - RNA, 63 nt, Homo Sapiens; identical to SEQ ID NO: 103080

SEQ ID NO: 317367 - RNA, 63 nt, Homo Sapiens; identical to SEQ ID NO: 103081

SEQ ID NO: 317368 - RNA, 63 nt, Homo Sapiens; identical to SEQ ID NO: 103082

SEQ ID NO: 317369 - RNA, 63 nt, Homo Sapiens; identical to SEQ ID NO: 103083

SEQ ID NO: 317370 - RNA, 63 nt, Homo Sapiens; identical to SEQ ID NO: 103084

SEQ ID NO: 317371 - RNA, 63 nt, Homo Sapiens; identical to SEQ ID NO: 103085

SEQ ID NO: 317372 - RNA, 63 nt, Homo Sapiens; identical to SEQ ID NO: 103086

SEQ ID NO: 317373 - RNA, 63 nt, Homo Sapiens; identical to SEQ ID NO: 103087

SEQ ID NO: 317374 - RNA, 63 nt, Homo Sapiens; identical to SEQ ID NO: 103088

SEQ ID NO: 317375 - RNA, 63 nt, Homo Sapiens; identical to SEQ ID NO: 103089

SEQ ID NO: 317376 - RNA, 63 nt, Homo Sapiens; identical to SEQ ID NO: 103090

SEQ ID NO: 317377 - RNA, 63 nt, Homo Sapiens; identical to SEQ ID NO: 103091

SEQ ID NO: 317378 - RNA, 63 nt, Homo Sapiens; identical to SEQ ID NO: 103092

SEQ ID NO: 317379 - RNA, 63 nt, Homo Sapiens; identical to SEQ ID NO: 103093

SEQ ID NO: 317380 - RNA, 63 nt, Homo Sapiens; identical to SEQ ID NO: 103094

SEQ ID NO: 317381 - RNA, 63 nt, Homo Sapiens; identical to SEQ ID NO: 103095

SEQ ID NO: 317382 - RNA, 63 nt, Homo Sapiens; identical to SEQ ID NO: 103096

SEQ ID NO: 317383 - RNA, 63 nt, Homo Sapiens; identical to SEQ ID NO: 103097

SEQ ID NO: 317384 - RNA, 60 nt, Homo Sapiens; identical to SEQ ID NO: 103098

SEQ ID NO: 317385 - RNA, 63 nt, Homo Sapiens; identical to SEQ ID NO: 103099

SEQ ID NO: 317386 - RNA, 63 nt, Homo Sapiens; identical to SEQ ID NO: 103100

SEQ ID NO: 317387 - RNA, 63 nt, Homo Sapiens; identical to SEQ ID NO: 103101

SEQ ID NO: 317388 - RNA, 63 nt, Homo Sapiens; identical to SEQ ID NO: 103102

SEQ ID NO: 317389 - RNA, 63 nt, Homo Sapiens; identical to SEQ ID NO: 103103

SEQ ID NO: 317390 - RNA, 63 nt, Homo Sapiens; identical to SEQ ID NO: 103104

SEQ ID NO: 317391 - RNA, 63 nt, Homo Sapiens; identical to SEQ ID NO: 103105

SEQ ID NO: 317392 - RNA, 63 nt, Homo Sapiens; identical to SEQ ID NO: 103106

SEQ ID NO: 317393 - RNA, 63 nt, Homo Sapiens; identical to SEQ ID NO: 103107

SEQ ID NO: 317394 - RNA, 63 nt, Homo Sapiens; identical to SEQ ID NO: 103108

SEQ ID NO: 317395 - RNA, 63 nt, Homo Sapiens; identical to SEQ ID NO: 103109

SEQ ID NO: 317396 - RNA, 63 nt, Homo Sapiens; identical to SEQ ID NO: 103110

SEQ ID NO: 317397 - RNA, 63 nt, Homo Sapiens; identical to SEQ ID NO: 103111

SEQ ID NO: 317398 - RNA, 63 nt, Homo Sapiens; identical to SEQ ID NO: 103112

SEQ ID NO: 317399 - RNA, 63 nt, Homo Sapiens; identical to SEQ ID NO: 103113

SEQ ID NO: 317400 - RNA, 63 nt, Homo Sapiens; identical to SEQ ID NO: 103114

SEQ ID NO: 317401 - RNA, 63 nt, Homo Sapiens; identical to SEQ ID NO: 103115

SEQ ID NO: 317402 - RNA, 63 nt, Homo Sapiens; identical to SEQ ID NO: 103116

SEQ ID NO: 317403 - RNA, 63 nt, Homo Sapiens; identical to SEQ ID NO: 103117

SEQ ID NO: 317404 - RNA, 63 nt, Homo Sapiens; identical to SEQ ID NO: 103118

SEQ ID NO: 317405 - RNA, 63 nt, Homo Sapiens; identical to SEQ ID NO: 103119

SEQ ID NO: 317406 - RNA, 63 nt, Homo Sapiens; identical to SEQ ID NO: 103120

SEQ ID NO: 317407 - RNA, 63 nt, Homo Sapiens; identical to SEQ ID NO: 103121

SEQ ID NO: 317408 - RNA, 63 nt, Homo Sapiens; identical to SEQ ID NO: 103122

SEQ ID NO: 317409 - RNA, 63 nt, Homo Sapiens; identical to SEQ ID NO: 103123

SEQ ID NO: 317410 - RNA, 63 nt, Homo Sapiens; identical to SEQ ID NO: 103124

SEQ ID NO: 317411 - RNA, 63 nt, Homo Sapiens; identical to SEQ ID NO: 103125

SEQ ID NO: 317412 - RNA, 63 nt, Homo Sapiens; identical to SEQ ID NO: 103126

SEQ ID NO: 317413 - RNA, 63 nt, Homo Sapiens; identical to SEQ ID NO: 103127

SEQ ID NO: 317414 - RNA, 63 nt, Homo Sapiens; identical to SEQ ID NO: 103128

SEQ ID NO: 317415 - RNA, 63 nt, Homo Sapiens; identical to SEQ ID NO: 103129

SEQ ID NO: 317416 - RNA, 63 nt, Homo Sapiens; identical to SEQ ID NO: 103130

SEQ ID NO: 317417 - RNA, 63 nt, Homo Sapiens; identical to SEQ ID NO: 103131

SEQ ID NO: 317418 - RNA, 63 nt, Homo Sapiens; identical to SEQ ID NO: 103132

SEQ ID NO: 317419 - RNA, 63 nt, Homo Sapiens; identical to SEQ ID NO: 103133

SEQ ID NO: 317420 - RNA, 63 nt, Homo Sapiens; identical to SEQ ID NO: 103134

SEQ ID NO: 317421 - RNA, 63 nt, Homo Sapiens; identical to SEQ ID NO: 103135

SEQ ID NO: 317422 - RNA, 63 nt, Homo Sapiens; identical to SEQ ID NO: 103136

SEQ ID NO: 317423 - RNA, 63 nt, Homo Sapiens; identical to SEQ ID NO: 103137

SEQ ID NO: 317424 - RNA, 63 nt, Homo Sapiens; identical to SEQ ID NO: 103138

SEQ ID NO: 317425 - RNA, 63 nt, Homo Sapiens; identical to SEQ ID NO: 103139

SEQ ID NO: 317426 - RNA, 63 nt, Homo Sapiens; identical to SEQ ID NO: 103140

SEQ ID NO: 317427 - RNA, 63 nt, Homo Sapiens; identical to SEQ ID NO: 103141

SEQ ID NO: 317428 - RNA, 63 nt, Homo Sapiens; identical to SEQ ID NO: 103142

SEQ ID NO: 317429 - RNA, 63 nt, Homo Sapiens; identical to SEQ ID NO: 103143

SEQ ID NO: 317430 - RNA, 63 nt, Homo Sapiens; identical to SEQ ID NO: 103144

SEQ ID NO: 317431 - RNA, 63 nt, Homo Sapiens; identical to SEQ ID NO: 103145

SEQ ID NO: 317432 - RNA, 63 nt, Homo Sapiens; identical to SEQ ID NO: 103146

SEQ ID NO: 317433 - RNA, 63 nt, Homo Sapiens; identical to SEQ ID NO: 103147

SEQ ID NO: 317434 - RNA, 63 nt, Homo Sapiens; identical to SEQ ID NO: 103148

SEQ ID NO: 317435 - RNA, 63 nt, Homo Sapiens; identical to SEQ ID NO: 103149

SEQ ID NO: 317436 - RNA, 63 nt, Homo Sapiens; identical to SEQ ID NO: 103150

SEQ ID NO: 317437 - RNA, 63 nt, Homo Sapiens; identical to SEQ ID NO: 103151

SEQ ID NO: 317438 - RNA, 63 nt, Homo Sapiens; identical to SEQ ID NO: 103152

SEQ ID NO: 317439 - RNA, 63 nt, Homo Sapiens; identical to SEQ ID NO: 103153

SEQ ID NO: 317440 - RNA, 63 nt, Homo Sapiens; identical to SEQ ID NO: 103154

SEQ ID NO: 317441 - RNA, 63 nt, Homo Sapiens; identical to SEQ ID NO: 103155

SEQ ID NO: 317442 - RNA, 63 nt, Homo Sapiens; identical to SEQ ID NO: 103156

SEQ ID NO: 317443 - RNA, 63 nt, Homo Sapiens; identical to SEQ ID NO: 103157

SEQ ID NO: 317444 - RNA, 63 nt, Homo Sapiens; identical to SEQ ID NO: 103158

SEQ ID NO: 317445 - RNA, 63 nt, Homo Sapiens; identical to SEQ ID NO: 103159

SEQ ID NO: 317446 - RNA, 63 nt, Homo Sapiens; identical to SEQ ID NO: 103160

SEQ ID NO: 317447 - RNA, 63 nt, Homo Sapiens; identical to SEQ ID NO: 103161

SEQ ID NO: 317448 - RNA, 63 nt, Homo Sapiens; identical to SEQ ID NO: 103162

SEQ ID NO: 317449 - RNA, 63 nt, Homo Sapiens; identical to SEQ ID NO: 103163

SEQ ID NO: 317450 - RNA, 63 nt, Homo Sapiens; identical to SEQ ID NO: 103164

SEQ ID NO: 317451 - RNA, 63 nt, Homo Sapiens; identical to SEQ ID NO: 103165

SEQ ID NO: 317452 - RNA, 63 nt, Homo Sapiens; identical to SEQ ID NO: 103166

SEQ ID NO: 317453 - RNA, 63 nt, Homo Sapiens; identical to SEQ ID NO: 103167

SEQ ID NO: 317454 - RNA, 63 nt, Homo Sapiens; identical to SEQ ID NO: 103168

SEQ ID NO: 317455 - RNA, 63 nt, Homo Sapiens; identical to SEQ ID NO: 103169

SEQ ID NO: 317456 - RNA, 63 nt, Homo Sapiens; identical to SEQ ID NO: 103170

SEQ ID NO: 317457 - RNA, 63 nt, Homo Sapiens; identical to SEQ ID NO: 103171

SEQ ID NO: 317458 - RNA, 63 nt, Homo Sapiens; identical to SEQ ID NO: 103172

SEQ ID NO: 317459 - RNA, 63 nt, Homo Sapiens; identical to SEQ ID NO: 103173

SEQ ID NO: 317460 - RNA, 63 nt, Homo Sapiens; identical to SEQ ID NO: 103174

SEQ ID NO: 317461 - RNA, 63 nt, Homo Sapiens; identical to SEQ ID NO: 103175

SEQ ID NO: 317462 - RNA, 63 nt, Homo Sapiens; identical to SEQ ID NO: 103176

SEQ ID NO: 317463 - RNA, 63 nt, Homo Sapiens; identical to SEQ ID NO: 103177

SEQ ID NO: 317464 - RNA, 63 nt, Homo Sapiens; identical to SEQ ID NO: 103178

SEQ ID NO: 317465 - RNA, 63 nt, Homo Sapiens; identical to SEQ ID NO: 103179

SEQ ID NO: 317466 - RNA, 63 nt, Homo Sapiens; identical to SEQ ID NO: 103180

SEQ ID NO: 317467 - RNA, 63 nt, Homo Sapiens; identical to SEQ ID NO: 103181

SEQ ID NO: 317468 - RNA, 63 nt, Homo Sapiens; identical to SEQ ID NO: 103182

SEQ ID NO: 317469 - RNA, 63 nt, Homo Sapiens; identical to SEQ ID NO: 103183

SEQ ID NO: 317470 - RNA, 63 nt, Homo Sapiens; identical to SEQ ID NO: 103184

SEQ ID NO: 317471 - RNA, 63 nt, Homo Sapiens; identical to SEQ ID NO: 103185

SEQ ID NO: 317472 - RNA, 63 nt, Homo Sapiens; identical to SEQ ID NO: 103186

SEQ ID NO: 317473 - RNA, 63 nt, Homo Sapiens; identical to SEQ ID NO: 103187

SEQ ID NO: 317474 - RNA, 63 nt, Homo Sapiens; identical to SEQ ID NO: 103188

SEQ ID NO: 317475 - RNA, 63 nt, Homo Sapiens; identical to SEQ ID NO: 103189

SEQ ID NO: 317476 - RNA, 63 nt, Homo Sapiens; identical to SEQ ID NO: 103190

SEQ ID NO: 317477 - RNA, 63 nt, Homo Sapiens; identical to SEQ ID NO: 103191

SEQ ID NO: 317478 - RNA, 63 nt, Homo Sapiens; identical to SEQ ID NO: 103192

SEQ ID NO: 317479 - RNA, 63 nt, Homo Sapiens; identical to SEQ ID NO: 103193

SEQ ID NO: 317480 - RNA, 63 nt, Homo Sapiens; identical to SEQ ID NO: 103194

SEQ ID NO: 317481 - RNA, 63 nt, Homo Sapiens; identical to SEQ ID NO: 103195

SEQ ID NO: 317482 - RNA, 51 nt, Homo Sapiens; identical to SEQ ID NO: 103196

SEQ ID NO: 317483 - RNA, 63 nt, Homo Sapiens; identical to SEQ ID NO: 103197

SEQ ID NO: 317484 - RNA, 63 nt, Homo Sapiens; identical to SEQ ID NO: 103198

SEQ ID NO: 317485 - RNA, 63 nt, Homo Sapiens; identical to SEQ ID NO: 103199

SEQ ID NO: 317486 - RNA, 63 nt, Homo Sapiens; identical to SEQ ID NO: 103200

SEQ ID NO: 317487 - RNA, 63 nt, Homo Sapiens; identical to SEQ ID NO: 103201

SEQ ID NO: 317488 - RNA, 63 nt, Homo Sapiens; identical to SEQ ID NO: 103202

SEQ ID NO: 317489 - RNA, 63 nt, Homo Sapiens; identical to SEQ ID NO: 103203

SEQ ID NO: 317490 - RNA, 63 nt, Homo Sapiens; identical to SEQ ID NO: 103204

SEQ ID NO: 317491 - RNA, 63 nt, Homo Sapiens; identical to SEQ ID NO: 103205

SEQ ID NO: 317492 - RNA, 63 nt, Homo Sapiens; identical to SEQ ID NO: 103206

SEQ ID NO: 317493 - RNA, 63 nt, Homo Sapiens; identical to SEQ ID NO: 103207

SEQ ID NO: 317494 - RNA, 63 nt, Homo Sapiens; identical to SEQ ID NO: 103208

SEQ ID NO: 317495 - RNA, 63 nt, Homo Sapiens; identical to SEQ ID NO: 103209

SEQ ID NO: 317496 - RNA, 63 nt, Homo Sapiens; identical to SEQ ID NO: 103210

SEQ ID NO: 317497 - RNA, 63 nt, Homo Sapiens; identical to SEQ ID NO: 103211

SEQ ID NO: 317498 - RNA, 63 nt, Homo Sapiens; identical to SEQ ID NO: 103212

SEQ ID NO: 317499 - RNA, 63 nt, Homo Sapiens; identical to SEQ ID NO: 103213

SEQ ID NO: 317500 - RNA, 63 nt, Homo Sapiens; identical to SEQ ID NO: 103214

SEQ ID NO: 317501 - RNA, 63 nt, Homo Sapiens; identical to SEQ ID NO: 103215

SEQ ID NO: 317502 - RNA, 63 nt, Homo Sapiens; identical to SEQ ID NO: 103216

SEQ ID NO: 317503 - RNA, 63 nt, Homo Sapiens; identical to SEQ ID NO: 103217

SEQ ID NO: 317504 - RNA, 63 nt, Homo Sapiens; identical to SEQ ID NO: 103218

SEQ ID NO: 317505 - RNA, 63 nt, Homo Sapiens; identical to SEQ ID NO: 103219

SEQ ID NO: 317506 - RNA, 63 nt, Homo Sapiens; identical to SEQ ID NO: 103220

SEQ ID NO: 317507 - RNA, 63 nt, Homo Sapiens; identical to SEQ ID NO: 103221

SEQ ID NO: 317508 - RNA, 63 nt, Homo Sapiens; identical to SEQ ID NO: 103222

SEQ ID NO: 317509 - RNA, 63 nt, Homo Sapiens; identical to SEQ ID NO: 103223

SEQ ID NO: 317510 - RNA, 63 nt, Homo Sapiens; identical to SEQ ID NO: 103224

SEQ ID NO: 317511 - RNA, 63 nt, Homo Sapiens; identical to SEQ ID NO: 103225

SEQ ID NO: 317512 - RNA, 63 nt, Homo Sapiens; identical to SEQ ID NO: 103226

SEQ ID NO: 317513 - RNA, 63 nt, Homo Sapiens; identical to SEQ ID NO: 103227

SEQ ID NO: 317514 - RNA, 63 nt, Homo Sapiens; identical to SEQ ID NO: 103228

SEQ ID NO: 317515 - RNA, 63 nt, Homo Sapiens; identical to SEQ ID NO: 103229

SEQ ID NO: 317516 - RNA, 63 nt, Homo Sapiens; identical to SEQ ID NO: 103230

SEQ ID NO: 317517 - RNA, 63 nt, Homo Sapiens; identical to SEQ ID NO: 103231

SEQ ID NO: 317518 - RNA, 63 nt, Homo Sapiens; identical to SEQ ID NO: 103232

SEQ ID NO: 317519 - RNA, 63 nt, Homo Sapiens; identical to SEQ ID NO: 103233

SEQ ID NO: 317520 - RNA, 63 nt, Homo Sapiens; identical to SEQ ID NO: 103234

SEQ ID NO: 317521 - RNA, 63 nt, Homo Sapiens; identical to SEQ ID NO: 103235

SEQ ID NO: 317522 - RNA, 63 nt, Homo Sapiens; identical to SEQ ID NO: 103236

SEQ ID NO: 317523 - RNA, 63 nt, Homo Sapiens; identical to SEQ ID NO: 103237

SEQ ID NO: 317524 - RNA, 63 nt, Homo Sapiens; identical to SEQ ID NO: 103238

SEQ ID NO: 317525 - RNA, 63 nt, Homo Sapiens; identical to SEQ ID NO: 103239

SEQ ID NO: 317526 - RNA, 63 nt, Homo Sapiens; identical to SEQ ID NO: 103240

SEQ ID NO: 317527 - RNA, 63 nt, Homo Sapiens; identical to SEQ ID NO: 103241

SEQ ID NO: 317528 - RNA, 63 nt, Homo Sapiens; identical to SEQ ID NO: 103242

SEQ ID NO: 317529 - RNA, 63 nt, Homo Sapiens; identical to SEQ ID NO: 103243

SEQ ID NO: 317530 - RNA, 63 nt, Homo Sapiens; identical to SEQ ID NO: 103244

SEQ ID NO: 317531 - RNA, 63 nt, Homo Sapiens; identical to SEQ ID NO: 103245

SEQ ID NO: 317532 - RNA, 63 nt, Homo Sapiens; identical to SEQ ID NO: 103246

SEQ ID NO: 317533 - RNA, 63 nt, Homo Sapiens; identical to SEQ ID NO: 103247

SEQ ID NO: 317534 - RNA, 63 nt, Homo Sapiens; identical to SEQ ID NO: 103248

SEQ ID NO: 317535 - RNA, 63 nt, Homo Sapiens; identical to SEQ ID NO: 103249

SEQ ID NO: 317536 - RNA, 63 nt, Homo Sapiens; identical to SEQ ID NO: 103250

SEQ ID NO: 317537 - RNA, 63 nt, Homo Sapiens; identical to SEQ ID NO: 103251

SEQ ID NO: 317538 - RNA, 63 nt, Homo Sapiens; identical to SEQ ID NO: 103252

SEQ ID NO: 317539 - RNA, 63 nt, Homo Sapiens; identical to SEQ ID NO: 103253

SEQ ID NO: 317540 - RNA, 63 nt, Homo Sapiens; identical to SEQ ID NO: 103254

SEQ ID NO: 317541 - RNA, 63 nt, Homo Sapiens; identical to SEQ ID NO: 103255

SEQ ID NO: 317542 - RNA, 63 nt, Homo Sapiens; identical to SEQ ID NO: 103256

SEQ ID NO: 317543 - RNA, 63 nt, Homo Sapiens; identical to SEQ ID NO: 103257

SEQ ID NO: 317544 - RNA, 63 nt, Homo Sapiens; identical to SEQ ID NO: 103258

SEQ ID NO: 317545 - RNA, 63 nt, Homo Sapiens; identical to SEQ ID NO: 103259

SEQ ID NO: 317546 - RNA, 63 nt, Homo Sapiens; identical to SEQ ID NO: 103260

SEQ ID NO: 317547 - RNA, 63 nt, Homo Sapiens; identical to SEQ ID NO: 103261

SEQ ID NO: 317548 - RNA, 63 nt, Homo Sapiens; identical to SEQ ID NO: 103262

SEQ ID NO: 317549 - RNA, 63 nt, Homo Sapiens; identical to SEQ ID NO: 103263

SEQ ID NO: 317550 - RNA, 63 nt, Homo Sapiens; identical to SEQ ID NO: 103264

SEQ ID NO: 317551 - RNA, 63 nt, Homo Sapiens; identical to SEQ ID NO: 103265

SEQ ID NO: 317552 - RNA, 63 nt, Homo Sapiens; identical to SEQ ID NO: 103266

SEQ ID NO: 317553 - RNA, 63 nt, Homo Sapiens; identical to SEQ ID NO: 103267

SEQ ID NO: 317554 - RNA, 63 nt, Homo Sapiens; identical to SEQ ID NO: 103268

SEQ ID NO: 317555 - RNA, 63 nt, Homo Sapiens; identical to SEQ ID NO: 103269

SEQ ID NO: 317556 - RNA, 63 nt, Homo Sapiens; identical to SEQ ID NO: 103270

SEQ ID NO: 317557 - RNA, 63 nt, Homo Sapiens; identical to SEQ ID NO: 103271

SEQ ID NO: 317558 - RNA, 63 nt, Homo Sapiens; identical to SEQ ID NO: 103272

SEQ ID NO: 317559 - RNA, 63 nt, Homo Sapiens; identical to SEQ ID NO: 103273

SEQ ID NO: 317560 - RNA, 63 nt, Homo Sapiens; identical to SEQ ID NO: 103274

SEQ ID NO: 317561 - RNA, 63 nt, Homo Sapiens; identical to SEQ ID NO: 103275

SEQ ID NO: 317562 - RNA, 63 nt, Homo Sapiens; identical to SEQ ID NO: 103276

SEQ ID NO: 317563 - RNA, 63 nt, Homo Sapiens; identical to SEQ ID NO: 103277

SEQ ID NO: 317564 - RNA, 63 nt, Homo Sapiens; identical to SEQ ID NO: 103278

SEQ ID NO: 317565 - RNA, 63 nt, Homo Sapiens; identical to SEQ ID NO: 103279

SEQ ID NO: 317566 - RNA, 63 nt, Homo Sapiens; identical to SEQ ID NO: 103280

SEQ ID NO: 317567 - RNA, 63 nt, Homo Sapiens; identical to SEQ ID NO: 103281

SEQ ID NO: 317568 - RNA, 63 nt, Homo Sapiens; identical to SEQ ID NO: 103282

SEQ ID NO: 317569 - RNA, 63 nt, Homo Sapiens; identical to SEQ ID NO: 103283

SEQ ID NO: 317570 - RNA, 63 nt, Homo Sapiens; identical to SEQ ID NO: 103284

SEQ ID NO: 317571 - RNA, 63 nt, Homo Sapiens; identical to SEQ ID NO: 103285

SEQ ID NO: 317572 - RNA, 63 nt, Homo Sapiens; identical to SEQ ID NO: 103286

SEQ ID NO: 317573 - RNA, 63 nt, Homo Sapiens; identical to SEQ ID NO: 103287

SEQ ID NO: 317574 - RNA, 63 nt, Homo Sapiens; identical to SEQ ID NO: 103288

SEQ ID NO: 317575 - RNA, 62 nt, Homo Sapiens; identical to SEQ ID NO: 103289

SEQ ID NO: 317576 - RNA, 62 nt, Homo Sapiens; identical to SEQ ID NO: 103290

SEQ ID NO: 317577 - RNA, 62 nt, Homo Sapiens; identical to SEQ ID NO: 103291

SEQ ID NO: 317578 - RNA, 62 nt, Homo Sapiens; identical to SEQ ID NO: 103292

SEQ ID NO: 317579 - RNA, 62 nt, Homo Sapiens; identical to SEQ ID NO: 103293

SEQ ID NO: 317580 - RNA, 62 nt, Homo Sapiens; identical to SEQ ID NO: 103294

SEQ ID NO: 317581 - RNA, 62 nt, Homo Sapiens; identical to SEQ ID NO: 103295

SEQ ID NO: 317582 - RNA, 62 nt, Homo Sapiens; identical to SEQ ID NO: 103296

SEQ ID NO: 317583 - RNA, 62 nt, Homo Sapiens; identical to SEQ ID NO: 103297

SEQ ID NO: 317584 - RNA, 62 nt, Homo Sapiens; identical to SEQ ID NO: 103298

SEQ ID NO: 317585 - RNA, 62 nt, Homo Sapiens; identical to SEQ ID NO: 103299

SEQ ID NO: 317586 - RNA, 57 nt, Homo Sapiens; identical to SEQ ID NO: 103300

SEQ ID NO: 317587 - RNA, 62 nt, Homo Sapiens; identical to SEQ ID NO: 103301

SEQ ID NO: 317588 - RNA, 62 nt, Homo Sapiens; identical to SEQ ID NO: 103302

SEQ ID NO: 317589 - RNA, 62 nt, Homo Sapiens; identical to SEQ ID NO: 103303

SEQ ID NO: 317590 - RNA, 62 nt, Homo Sapiens; identical to SEQ ID NO: 103304

SEQ ID NO: 317591 - RNA, 62 nt, Homo Sapiens; identical to SEQ ID NO: 103305

SEQ ID NO: 317592 - RNA, 62 nt, Homo Sapiens; identical to SEQ ID NO: 103306

SEQ ID NO: 317593 - RNA, 62 nt, Homo Sapiens; identical to SEQ ID NO: 103307

SEQ ID NO: 317594 - RNA, 62 nt, Homo Sapiens; identical to SEQ ID NO: 103308

SEQ ID NO: 317595 - RNA, 62 nt, Homo Sapiens; identical to SEQ ID NO: 103309

SEQ ID NO: 317596 - RNA, 62 nt, Homo Sapiens; identical to SEQ ID NO: 103310

SEQ ID NO: 317597 - RNA, 62 nt, Homo Sapiens; identical to SEQ ID NO: 103311

SEQ ID NO: 317598 - RNA, 62 nt, Homo Sapiens; identical to SEQ ID NO: 103312

SEQ ID NO: 317599 - RNA, 62 nt, Homo Sapiens; identical to SEQ ID NO: 103313

SEQ ID NO: 317600 - RNA, 62 nt, Homo Sapiens; identical to SEQ ID NO: 103314

SEQ ID NO: 317601 - RNA, 62 nt, Homo Sapiens; identical to SEQ ID NO: 103315

SEQ ID NO: 317602 - RNA, 62 nt, Homo Sapiens; identical to SEQ ID NO: 103316

SEQ ID NO: 317603 - RNA, 62 nt, Homo Sapiens; identical to SEQ ID NO: 103317

SEQ ID NO: 317604 - RNA, 62 nt, Homo Sapiens; identical to SEQ ID NO: 103318

SEQ ID NO: 317605 - RNA, 62 nt, Homo Sapiens; identical to SEQ ID NO: 103319

SEQ ID NO: 317606 - RNA, 62 nt, Homo Sapiens; identical to SEQ ID NO: 103320

SEQ ID NO: 317607 - RNA, 62 nt, Homo Sapiens; identical to SEQ ID NO: 103321

SEQ ID NO: 317608 - RNA, 62 nt, Homo Sapiens; identical to SEQ ID NO: 103322

SEQ ID NO: 317609 - RNA, 62 nt, Homo Sapiens; identical to SEQ ID NO: 103323

SEQ ID NO: 317610 - RNA, 62 nt, Homo Sapiens; identical to SEQ ID NO: 103324

SEQ ID NO: 317611 - RNA, 62 nt, Homo Sapiens; identical to SEQ ID NO: 103325

SEQ ID NO: 317612 - RNA, 62 nt, Homo Sapiens; identical to SEQ ID NO: 103326

SEQ ID NO: 317613 - RNA, 62 nt, Homo Sapiens; identical to SEQ ID NO: 103327

SEQ ID NO: 317614 - RNA, 62 nt, Homo Sapiens; identical to SEQ ID NO: 103328

SEQ ID NO: 317615 - RNA, 62 nt, Homo Sapiens; identical to SEQ ID NO: 103329

SEQ ID NO: 317616 - RNA, 62 nt, Homo Sapiens; identical to SEQ ID NO: 103330

SEQ ID NO: 317617 - RNA, 62 nt, Homo Sapiens; identical to SEQ ID NO: 103331

SEQ ID NO: 317618 - RNA, 62 nt, Homo Sapiens; identical to SEQ ID NO: 103332

SEQ ID NO: 317619 - RNA, 62 nt, Homo Sapiens; identical to SEQ ID NO: 103333

SEQ ID NO: 317620 - RNA, 62 nt, Homo Sapiens; identical to SEQ ID NO: 103334

SEQ ID NO: 317621 - RNA, 62 nt, Homo Sapiens; identical to SEQ ID NO: 103335

SEQ ID NO: 317622 - RNA, 62 nt, Homo Sapiens; identical to SEQ ID NO: 103336

SEQ ID NO: 317623 - RNA, 62 nt, Homo Sapiens; identical to SEQ ID NO: 103337

SEQ ID NO: 317624 - RNA, 62 nt, Homo Sapiens; identical to SEQ ID NO: 103338

SEQ ID NO: 317625 - RNA, 62 nt, Homo Sapiens; identical to SEQ ID NO: 103339

SEQ ID NO: 317626 - RNA, 62 nt, Homo Sapiens; identical to SEQ ID NO: 103340

SEQ ID NO: 317627 - RNA, 62 nt, Homo Sapiens; identical to SEQ ID NO: 103341

SEQ ID NO: 317628 - RNA, 62 nt, Homo Sapiens; identical to SEQ ID NO: 103342

SEQ ID NO: 317629 - RNA, 62 nt, Homo Sapiens; identical to SEQ ID NO: 103343

SEQ ID NO: 317630 - RNA, 62 nt, Homo Sapiens; identical to SEQ ID NO: 103344

SEQ ID NO: 317631 - RNA, 62 nt, Homo Sapiens; identical to SEQ ID NO: 103345

SEQ ID NO: 317632 - RNA, 62 nt, Homo Sapiens; identical to SEQ ID NO: 103346

SEQ ID NO: 317633 - RNA, 62 nt, Homo Sapiens; identical to SEQ ID NO: 103347

SEQ ID NO: 317634 - RNA, 62 nt, Homo Sapiens; identical to SEQ ID NO: 103348

SEQ ID NO: 317635 - RNA, 62 nt, Homo Sapiens; identical to SEQ ID NO: 103349

SEQ ID NO: 317636 - RNA, 62 nt, Homo Sapiens; identical to SEQ ID NO: 103350

SEQ ID NO: 317637 - RNA, 62 nt, Homo Sapiens; identical to SEQ ID NO: 103351

SEQ ID NO: 317638 - RNA, 62 nt, Homo Sapiens; identical to SEQ ID NO: 103352

SEQ ID NO: 317639 - RNA, 62 nt, Homo Sapiens; identical to SEQ ID NO: 103353

SEQ ID NO: 317640 - RNA, 62 nt, Homo Sapiens; identical to SEQ ID NO: 103354

SEQ ID NO: 317641 - RNA, 62 nt, Homo Sapiens; identical to SEQ ID NO: 103355

SEQ ID NO: 317642 - RNA, 62 nt, Homo Sapiens; identical to SEQ ID NO: 103356

SEQ ID NO: 317643 - RNA, 62 nt, Homo Sapiens; identical to SEQ ID NO: 103357

SEQ ID NO: 317644 - RNA, 62 nt, Homo Sapiens; identical to SEQ ID NO: 103358

SEQ ID NO: 317645 - RNA, 62 nt, Homo Sapiens; identical to SEQ ID NO: 103359

SEQ ID NO: 317646 - RNA, 62 nt, Homo Sapiens; identical to SEQ ID NO: 103360

SEQ ID NO: 317647 - RNA, 62 nt, Homo Sapiens; identical to SEQ ID NO: 103361

SEQ ID NO: 317648 - RNA, 62 nt, Homo Sapiens; identical to SEQ ID NO: 103362

SEQ ID NO: 317649 - RNA, 62 nt, Homo Sapiens; identical to SEQ ID NO: 103363

SEQ ID NO: 317650 - RNA, 62 nt, Homo Sapiens; identical to SEQ ID NO: 103364

SEQ ID NO: 317651 - RNA, 62 nt, Homo Sapiens; identical to SEQ ID NO: 103365

SEQ ID NO: 317652 - RNA, 62 nt, Homo Sapiens; identical to SEQ ID NO: 103366

SEQ ID NO: 317653 - RNA, 62 nt, Homo Sapiens; identical to SEQ ID NO: 103367

SEQ ID NO: 317654 - RNA, 62 nt, Homo Sapiens; identical to SEQ ID NO: 103368

SEQ ID NO: 317655 - RNA, 62 nt, Homo Sapiens; identical to SEQ ID NO: 103369

SEQ ID NO: 317656 - RNA, 62 nt, Homo Sapiens; identical to SEQ ID NO: 103370

SEQ ID NO: 317657 - RNA, 62 nt, Homo Sapiens; identical to SEQ ID NO: 103371

SEQ ID NO: 317658 - RNA, 59 nt, Homo Sapiens; identical to SEQ ID NO: 103372

SEQ ID NO: 317659 - RNA, 62 nt, Homo Sapiens; identical to SEQ ID NO: 103373

SEQ ID NO: 317660 - RNA, 62 nt, Homo Sapiens; identical to SEQ ID NO: 103374

SEQ ID NO: 317661 - RNA, 62 nt, Homo Sapiens; identical to SEQ ID NO: 103375

SEQ ID NO: 317662 - RNA, 62 nt, Homo Sapiens; identical to SEQ ID NO: 103376

SEQ ID NO: 317663 - RNA, 62 nt, Homo Sapiens; identical to SEQ ID NO: 103377

SEQ ID NO: 317664 - RNA, 62 nt, Homo Sapiens; identical to SEQ ID NO: 103378

SEQ ID NO: 317665 - RNA, 62 nt, Homo Sapiens; identical to SEQ ID NO: 103379

SEQ ID NO: 317666 - RNA, 62 nt, Homo Sapiens; identical to SEQ ID NO: 103380

SEQ ID NO: 317667 - RNA, 62 nt, Homo Sapiens; identical to SEQ ID NO: 103381

SEQ ID NO: 317668 - RNA, 62 nt, Homo Sapiens; identical to SEQ ID NO: 103382

SEQ ID NO: 317669 - RNA, 62 nt, Homo Sapiens; identical to SEQ ID NO: 103383

SEQ ID NO: 317670 - RNA, 62 nt, Homo Sapiens; identical to SEQ ID NO: 103384

SEQ ID NO: 317671 - RNA, 62 nt, Homo Sapiens; identical to SEQ ID NO: 103385

SEQ ID NO: 317672 - RNA, 62 nt, Homo Sapiens; identical to SEQ ID NO: 103386

SEQ ID NO: 317673 - RNA, 62 nt, Homo Sapiens; identical to SEQ ID NO: 103387

SEQ ID NO: 317674 - RNA, 62 nt, Homo Sapiens; identical to SEQ ID NO: 103388

SEQ ID NO: 317675 - RNA, 62 nt, Homo Sapiens; identical to SEQ ID NO: 103389

SEQ ID NO: 317676 - RNA, 62 nt, Homo Sapiens; identical to SEQ ID NO: 103390

SEQ ID NO: 317677 - RNA, 62 nt, Homo Sapiens; identical to SEQ ID NO: 103391

SEQ ID NO: 317678 - RNA, 62 nt, Homo Sapiens; identical to SEQ ID NO: 103392

SEQ ID NO: 317679 - RNA, 60 nt, Homo Sapiens; identical to SEQ ID NO: 103393

SEQ ID NO: 317680 - RNA, 62 nt, Homo Sapiens; identical to SEQ ID NO: 103394

SEQ ID NO: 317681 - RNA, 62 nt, Homo Sapiens; identical to SEQ ID NO: 103395

SEQ ID NO: 317682 - RNA, 62 nt, Homo Sapiens; identical to SEQ ID NO: 103396

SEQ ID NO: 317683 - RNA, 62 nt, Homo Sapiens; identical to SEQ ID NO: 103397

SEQ ID NO: 317684 - RNA, 62 nt, Homo Sapiens; identical to SEQ ID NO: 103398

SEQ ID NO: 317685 - RNA, 62 nt, Homo Sapiens; identical to SEQ ID NO: 103399

SEQ ID NO: 317686 - RNA, 62 nt, Homo Sapiens; identical to SEQ ID NO: 103400

SEQ ID NO: 317687 - RNA, 62 nt, Homo Sapiens; identical to SEQ ID NO: 103401

SEQ ID NO: 317688 - RNA, 62 nt, Homo Sapiens; identical to SEQ ID NO: 103402

SEQ ID NO: 317689 - RNA, 62 nt, Homo Sapiens; identical to SEQ ID NO: 103403

SEQ ID NO: 317690 - RNA, 62 nt, Homo Sapiens; identical to SEQ ID NO: 103404

SEQ ID NO: 317691 - RNA, 62 nt, Homo Sapiens; identical to SEQ ID NO: 103405

SEQ ID NO: 317692 - RNA, 62 nt, Homo Sapiens; identical to SEQ ID NO: 103406

SEQ ID NO: 317693 - RNA, 62 nt, Homo Sapiens; identical to SEQ ID NO: 103407

SEQ ID NO: 317694 - RNA, 62 nt, Homo Sapiens; identical to SEQ ID NO: 103408

SEQ ID NO: 317695 - RNA, 62 nt, Homo Sapiens; identical to SEQ ID NO: 103409

SEQ ID NO: 317696 - RNA, 62 nt, Homo Sapiens; identical to SEQ ID NO: 103410

SEQ ID NO: 317697 - RNA, 62 nt, Homo Sapiens; identical to SEQ ID NO: 103411

SEQ ID NO: 317698 - RNA, 62 nt, Homo Sapiens; identical to SEQ ID NO: 103412

SEQ ID NO: 317699 - RNA, 62 nt, Homo Sapiens; identical to SEQ ID NO: 103413

SEQ ID NO: 317700 - RNA, 62 nt, Homo Sapiens; identical to SEQ ID NO: 103414

SEQ ID NO: 317701 - RNA, 62 nt, Homo Sapiens; identical to SEQ ID NO: 103415

SEQ ID NO: 317702 - RNA, 62 nt, Homo Sapiens; identical to SEQ ID NO: 103416

SEQ ID NO: 317703 - RNA, 62 nt, Homo Sapiens; identical to SEQ ID NO: 103417

SEQ ID NO: 317704 - RNA, 62 nt, Homo Sapiens; identical to SEQ ID NO: 103418

SEQ ID NO: 317705 - RNA, 62 nt, Homo Sapiens; identical to SEQ ID NO: 103419

SEQ ID NO: 317706 - RNA, 62 nt, Homo Sapiens; identical to SEQ ID NO: 103420

SEQ ID NO: 317707 - RNA, 62 nt, Homo Sapiens; identical to SEQ ID NO: 103421

SEQ ID NO: 317708 - RNA, 62 nt, Homo Sapiens; identical to SEQ ID NO: 103422

SEQ ID NO: 317709 - RNA, 62 nt, Homo Sapiens; identical to SEQ ID NO: 103423

SEQ ID NO: 317710 - RNA, 62 nt, Homo Sapiens; identical to SEQ ID NO: 103424

SEQ ID NO: 317711 - RNA, 62 nt, Homo Sapiens; identical to SEQ ID NO: 103425

SEQ ID NO: 317712 - RNA, 62 nt, Homo Sapiens; identical to SEQ ID NO: 103426

SEQ ID NO: 317713 - RNA, 62 nt, Homo Sapiens; identical to SEQ ID NO: 103427

SEQ ID NO: 317714 - RNA, 62 nt, Homo Sapiens; identical to SEQ ID NO: 103428

SEQ ID NO: 317715 - RNA, 62 nt, Homo Sapiens; identical to SEQ ID NO: 103429

SEQ ID NO: 317716 - RNA, 62 nt, Homo Sapiens; identical to SEQ ID NO: 103430

SEQ ID NO: 317717 - RNA, 62 nt, Homo Sapiens; identical to SEQ ID NO: 103431

SEQ ID NO: 317718 - RNA, 62 nt, Homo Sapiens; identical to SEQ ID NO: 103432

SEQ ID NO: 317719 - RNA, 62 nt, Homo Sapiens; identical to SEQ ID NO: 103433

SEQ ID NO: 317720 - RNA, 62 nt, Homo Sapiens; identical to SEQ ID NO: 103434

SEQ ID NO: 317721 - RNA, 62 nt, Homo Sapiens; identical to SEQ ID NO: 103435

SEQ ID NO: 317722 - RNA, 62 nt, Homo Sapiens; identical to SEQ ID NO: 103436

SEQ ID NO: 317723 - RNA, 62 nt, Homo Sapiens; identical to SEQ ID NO: 103437

SEQ ID NO: 317724 - RNA, 62 nt, Homo Sapiens; identical to SEQ ID NO: 103438

SEQ ID NO: 317725 - RNA, 62 nt, Homo Sapiens; identical to SEQ ID NO: 103439

SEQ ID NO: 317726 - RNA, 62 nt, Homo Sapiens; identical to SEQ ID NO: 103440

SEQ ID NO: 317727 - RNA, 62 nt, Homo Sapiens; identical to SEQ ID NO: 103441

SEQ ID NO: 317728 - RNA, 62 nt, Homo Sapiens; identical to SEQ ID NO: 103442

SEQ ID NO: 317729 - RNA, 62 nt, Homo Sapiens; identical to SEQ ID NO: 103443

SEQ ID NO: 317730 - RNA, 62 nt, Homo Sapiens; identical to SEQ ID NO: 103444

SEQ ID NO: 317731 - RNA, 62 nt, Homo Sapiens; identical to SEQ ID NO: 103445

SEQ ID NO: 317732 - RNA, 62 nt, Homo Sapiens; identical to SEQ ID NO: 103446

SEQ ID NO: 317733 - RNA, 62 nt, Homo Sapiens; identical to SEQ ID NO: 103447

SEQ ID NO: 317734 - RNA, 62 nt, Homo Sapiens; identical to SEQ ID NO: 103448

SEQ ID NO: 317735 - RNA, 62 nt, Homo Sapiens; identical to SEQ ID NO: 103449

SEQ ID NO: 317736 - RNA, 62 nt, Homo Sapiens; identical to SEQ ID NO: 103450

SEQ ID NO: 317737 - RNA, 62 nt, Homo Sapiens; identical to SEQ ID NO: 103451

SEQ ID NO: 317738 - RNA, 62 nt, Homo Sapiens; identical to SEQ ID NO: 103452

SEQ ID NO: 317739 - RNA, 62 nt, Homo Sapiens; identical to SEQ ID NO: 103453

SEQ ID NO: 317740 - RNA, 62 nt, Homo Sapiens; identical to SEQ ID NO: 103454

SEQ ID NO: 317741 - RNA, 62 nt, Homo Sapiens; identical to SEQ ID NO: 103455

SEQ ID NO: 317742 - RNA, 62 nt, Homo Sapiens; identical to SEQ ID NO: 103456

SEQ ID NO: 317743 - RNA, 62 nt, Homo Sapiens; identical to SEQ ID NO: 103457

SEQ ID NO: 317744 - RNA, 62 nt, Homo Sapiens; identical to SEQ ID NO: 103458

SEQ ID NO: 317745 - RNA, 62 nt, Homo Sapiens; identical to SEQ ID NO: 103459

SEQ ID NO: 317746 - RNA, 62 nt, Homo Sapiens; identical to SEQ ID NO: 103460

SEQ ID NO: 317747 - RNA, 62 nt, Homo Sapiens; identical to SEQ ID NO: 103461

SEQ ID NO: 317748 - RNA, 62 nt, Homo Sapiens; identical to SEQ ID NO: 103462

SEQ ID NO: 317749 - RNA, 62 nt, Homo Sapiens; identical to SEQ ID NO: 103463

SEQ ID NO: 317750 - RNA, 62 nt, Homo Sapiens; identical to SEQ ID NO: 103464

SEQ ID NO: 317751 - RNA, 62 nt, Homo Sapiens; identical to SEQ ID NO: 103465

SEQ ID NO: 317752 - RNA, 62 nt, Homo Sapiens; identical to SEQ ID NO: 103466

SEQ ID NO: 317753 - RNA, 62 nt, Homo Sapiens; identical to SEQ ID NO: 103467

SEQ ID NO: 317754 - RNA, 62 nt, Homo Sapiens; identical to SEQ ID NO: 103468

SEQ ID NO: 317755 - RNA, 62 nt, Homo Sapiens; identical to SEQ ID NO: 103469

SEQ ID NO: 317756 - RNA, 62 nt, Homo Sapiens; identical to SEQ ID NO: 103470

SEQ ID NO: 317757 - RNA, 62 nt, Homo Sapiens; identical to SEQ ID NO: 103471

SEQ ID NO: 317758 - RNA, 62 nt, Homo Sapiens; identical to SEQ ID NO: 103472

SEQ ID NO: 317759 - RNA, 62 nt, Homo Sapiens; identical to SEQ ID NO: 103473

SEQ ID NO: 317760 - RNA, 62 nt, Homo Sapiens; identical to SEQ ID NO: 103474

SEQ ID NO: 317761 - RNA, 62 nt, Homo Sapiens; identical to SEQ ID NO: 103475

SEQ ID NO: 317762 - RNA, 62 nt, Homo Sapiens; identical to SEQ ID NO: 103476

SEQ ID NO: 317763 - RNA, 62 nt, Homo Sapiens; identical to SEQ ID NO: 103477

SEQ ID NO: 317764 - RNA, 62 nt, Homo Sapiens; identical to SEQ ID NO: 103478

SEQ ID NO: 317765 - RNA, 62 nt, Homo Sapiens; identical to SEQ ID NO: 103479

SEQ ID NO: 317766 - RNA, 62 nt, Homo Sapiens; identical to SEQ ID NO: 103480

SEQ ID NO: 317767 - RNA, 62 nt, Homo Sapiens; identical to SEQ ID NO: 103481

SEQ ID NO: 317768 - RNA, 62 nt, Homo Sapiens; identical to SEQ ID NO: 103482

SEQ ID NO: 317769 - RNA, 62 nt, Homo Sapiens; identical to SEQ ID NO: 103483

SEQ ID NO: 317770 - RNA, 62 nt, Homo Sapiens; identical to SEQ ID NO: 103484

SEQ ID NO: 317771 - RNA, 62 nt, Homo Sapiens; identical to SEQ ID NO: 103485

SEQ ID NO: 317772 - RNA, 62 nt, Homo Sapiens; identical to SEQ ID NO: 103486

SEQ ID NO: 317773 - RNA, 62 nt, Homo Sapiens; identical to SEQ ID NO: 103487

SEQ ID NO: 317774 - RNA, 62 nt, Homo Sapiens; identical to SEQ ID NO: 103488

SEQ ID NO: 317775 - RNA, 62 nt, Homo Sapiens; identical to SEQ ID NO: 103489

SEQ ID NO: 317776 - RNA, 62 nt, Homo Sapiens; identical to SEQ ID NO: 103490

SEQ ID NO: 317777 - RNA, 62 nt, Homo Sapiens; identical to SEQ ID NO: 103491

SEQ ID NO: 317778 - RNA, 62 nt, Homo Sapiens; identical to SEQ ID NO: 103492

SEQ ID NO: 317779 - RNA, 62 nt, Homo Sapiens; identical to SEQ ID NO: 103493

SEQ ID NO: 317780 - RNA, 62 nt, Homo Sapiens; identical to SEQ ID NO: 103494

SEQ ID NO: 317781 - RNA, 62 nt, Homo Sapiens; identical to SEQ ID NO: 103495

SEQ ID NO: 317782 - RNA, 62 nt, Homo Sapiens; identical to SEQ ID NO: 103496

SEQ ID NO: 317783 - RNA, 62 nt, Homo Sapiens; identical to SEQ ID NO: 103497

SEQ ID NO: 317784 - RNA, 62 nt, Homo Sapiens; identical to SEQ ID NO: 103498

SEQ ID NO: 317785 - RNA, 62 nt, Homo Sapiens; identical to SEQ ID NO: 103499

SEQ ID NO: 317786 - RNA, 62 nt, Homo Sapiens; identical to SEQ ID NO: 103500

SEQ ID NO: 317787 - RNA, 62 nt, Homo Sapiens; identical to SEQ ID NO: 103501

SEQ ID NO: 317788 - RNA, 62 nt, Homo Sapiens; identical to SEQ ID NO: 103502

SEQ ID NO: 317789 - RNA, 62 nt, Homo Sapiens; identical to SEQ ID NO: 103503

SEQ ID NO: 317790 - RNA, 62 nt, Homo Sapiens; identical to SEQ ID NO: 103504

SEQ ID NO: 317791 - RNA, 62 nt, Homo Sapiens; identical to SEQ ID NO: 103505

SEQ ID NO: 317792 - RNA, 62 nt, Homo Sapiens; identical to SEQ ID NO: 103506

SEQ ID NO: 317793 - RNA, 62 nt, Homo Sapiens; identical to SEQ ID NO: 103507

SEQ ID NO: 317794 - RNA, 63 nt, Homo Sapiens; identical to SEQ ID NO: 103508

SEQ ID NO: 317795 - RNA, 63 nt, Homo Sapiens; identical to SEQ ID NO: 103509

SEQ ID NO: 317796 - RNA, 63 nt, Homo Sapiens; identical to SEQ ID NO: 103510

SEQ ID NO: 317797 - RNA, 63 nt, Homo Sapiens; identical to SEQ ID NO: 103511

SEQ ID NO: 317798 - RNA, 63 nt, Homo Sapiens; identical to SEQ ID NO: 103512

SEQ ID NO: 317799 - RNA, 63 nt, Homo Sapiens; identical to SEQ ID NO: 103513

SEQ ID NO: 317800 - RNA, 63 nt, Homo Sapiens; identical to SEQ ID NO: 103514

SEQ ID NO: 317801 - RNA, 63 nt, Homo Sapiens; identical to SEQ ID NO: 103515

SEQ ID NO: 317802 - RNA, 63 nt, Homo Sapiens; identical to SEQ ID NO: 103516

SEQ ID NO: 317803 - RNA, 63 nt, Homo Sapiens; identical to SEQ ID NO: 103517

SEQ ID NO: 317804 - RNA, 63 nt, Homo Sapiens; identical to SEQ ID NO: 103518

SEQ ID NO: 317805 - RNA, 57 nt, Homo Sapiens; identical to SEQ ID NO: 103300

SEQ ID NO: 317806 - RNA, 63 nt, Homo Sapiens; identical to SEQ ID NO: 103520

SEQ ID NO: 317807 - RNA, 63 nt, Homo Sapiens; identical to SEQ ID NO: 103521

SEQ ID NO: 317808 - RNA, 63 nt, Homo Sapiens; identical to SEQ ID NO: 103522

SEQ ID NO: 317809 - RNA, 63 nt, Homo Sapiens; identical to SEQ ID NO: 103523

SEQ ID NO: 317810 - RNA, 63 nt, Homo Sapiens; identical to SEQ ID NO: 103524

SEQ ID NO: 317811 - RNA, 63 nt, Homo Sapiens; identical to SEQ ID NO: 103525

SEQ ID NO: 317812 - RNA, 63 nt, Homo Sapiens; identical to SEQ ID NO: 103526

SEQ ID NO: 317813 - RNA, 63 nt, Homo Sapiens; identical to SEQ ID NO: 103527

SEQ ID NO: 317814 - RNA, 63 nt, Homo Sapiens; identical to SEQ ID NO: 103528

SEQ ID NO: 317815 - RNA, 63 nt, Homo Sapiens; identical to SEQ ID NO: 103529

SEQ ID NO: 317816 - RNA, 63 nt, Homo Sapiens; identical to SEQ ID NO: 103530

SEQ ID NO: 317817 - RNA, 63 nt, Homo Sapiens; identical to SEQ ID NO: 103531

SEQ ID NO: 317818 - RNA, 63 nt, Homo Sapiens; identical to SEQ ID NO: 103532

SEQ ID NO: 317819 - RNA, 63 nt, Homo Sapiens; identical to SEQ ID NO: 103533

SEQ ID NO: 317820 - RNA, 63 nt, Homo Sapiens; identical to SEQ ID NO: 103534

SEQ ID NO: 317821 - RNA, 63 nt, Homo Sapiens; identical to SEQ ID NO: 103535

SEQ ID NO: 317822 - RNA, 63 nt, Homo Sapiens; identical to SEQ ID NO: 103536

SEQ ID NO: 317823 - RNA, 63 nt, Homo Sapiens; identical to SEQ ID NO: 103537

SEQ ID NO: 317824 - RNA, 63 nt, Homo Sapiens; identical to SEQ ID NO: 103538

SEQ ID NO: 317825 - RNA, 63 nt, Homo Sapiens; identical to SEQ ID NO: 103539

SEQ ID NO: 317826 - RNA, 63 nt, Homo Sapiens; identical to SEQ ID NO: 103540

SEQ ID NO: 317827 - RNA, 63 nt, Homo Sapiens; identical to SEQ ID NO: 103541

SEQ ID NO: 317828 - RNA, 63 nt, Homo Sapiens; identical to SEQ ID NO: 103542

SEQ ID NO: 317829 - RNA, 63 nt, Homo Sapiens; identical to SEQ ID NO: 103543

SEQ ID NO: 317830 - RNA, 63 nt, Homo Sapiens; identical to SEQ ID NO: 103544

SEQ ID NO: 317831 - RNA, 63 nt, Homo Sapiens; identical to SEQ ID NO: 103545

SEQ ID NO: 317832 - RNA, 63 nt, Homo Sapiens; identical to SEQ ID NO: 103546

SEQ ID NO: 317833 - RNA, 63 nt, Homo Sapiens; identical to SEQ ID NO: 103547

SEQ ID NO: 317834 - RNA, 63 nt, Homo Sapiens; identical to SEQ ID NO: 103548

SEQ ID NO: 317835 - RNA, 63 nt, Homo Sapiens; identical to SEQ ID NO: 103549

SEQ ID NO: 317836 - RNA, 63 nt, Homo Sapiens; identical to SEQ ID NO: 103550

SEQ ID NO: 317837 - RNA, 63 nt, Homo Sapiens; identical to SEQ ID NO: 103551

SEQ ID NO: 317838 - RNA, 63 nt, Homo Sapiens; identical to SEQ ID NO: 103552

SEQ ID NO: 317839 - RNA, 63 nt, Homo Sapiens; identical to SEQ ID NO: 103553

SEQ ID NO: 317840 - RNA, 63 nt, Homo Sapiens; identical to SEQ ID NO: 103554

SEQ ID NO: 317841 - RNA, 63 nt, Homo Sapiens; identical to SEQ ID NO: 103555

SEQ ID NO: 317842 - RNA, 63 nt, Homo Sapiens; identical to SEQ ID NO: 103556

SEQ ID NO: 317843 - RNA, 63 nt, Homo Sapiens; identical to SEQ ID NO: 103557

SEQ ID NO: 317844 - RNA, 63 nt, Homo Sapiens; identical to SEQ ID NO: 103558

SEQ ID NO: 317845 - RNA, 63 nt, Homo Sapiens; identical to SEQ ID NO: 103559

SEQ ID NO: 317846 - RNA, 63 nt, Homo Sapiens; identical to SEQ ID NO: 103560

SEQ ID NO: 317847 - RNA, 63 nt, Homo Sapiens; identical to SEQ ID NO: 103561

SEQ ID NO: 317848 - RNA, 63 nt, Homo Sapiens; identical to SEQ ID NO: 103562

SEQ ID NO: 317849 - RNA, 63 nt, Homo Sapiens; identical to SEQ ID NO: 103563

SEQ ID NO: 317850 - RNA, 63 nt, Homo Sapiens; identical to SEQ ID NO: 103564

SEQ ID NO: 317851 - RNA, 63 nt, Homo Sapiens; identical to SEQ ID NO: 103565

SEQ ID NO: 317852 - RNA, 63 nt, Homo Sapiens; identical to SEQ ID NO: 103566

SEQ ID NO: 317853 - RNA, 63 nt, Homo Sapiens; identical to SEQ ID NO: 103567

SEQ ID NO: 317854 - RNA, 63 nt, Homo Sapiens; identical to SEQ ID NO: 103568

SEQ ID NO: 317855 - RNA, 63 nt, Homo Sapiens; identical to SEQ ID NO: 103569

SEQ ID NO: 317856 - RNA, 63 nt, Homo Sapiens; identical to SEQ ID NO: 103570

SEQ ID NO: 317857 - RNA, 63 nt, Homo Sapiens; identical to SEQ ID NO: 103571

SEQ ID NO: 317858 - RNA, 63 nt, Homo Sapiens; identical to SEQ ID NO: 103572

SEQ ID NO: 317859 - RNA, 63 nt, Homo Sapiens; identical to SEQ ID NO: 103573

SEQ ID NO: 317860 - RNA, 63 nt, Homo Sapiens; identical to SEQ ID NO: 103574

SEQ ID NO: 317861 - RNA, 63 nt, Homo Sapiens; identical to SEQ ID NO: 103575

SEQ ID NO: 317862 - RNA, 63 nt, Homo Sapiens; identical to SEQ ID NO: 103576

SEQ ID NO: 317863 - RNA, 63 nt, Homo Sapiens; identical to SEQ ID NO: 103577

SEQ ID NO: 317864 - RNA, 63 nt, Homo Sapiens; identical to SEQ ID NO: 103578

SEQ ID NO: 317865 - RNA, 63 nt, Homo Sapiens; identical to SEQ ID NO: 103579

SEQ ID NO: 317866 - RNA, 63 nt, Homo Sapiens; identical to SEQ ID NO: 103580

SEQ ID NO: 317867 - RNA, 63 nt, Homo Sapiens; identical to SEQ ID NO: 103581

SEQ ID NO: 317868 - RNA, 63 nt, Homo Sapiens; identical to SEQ ID NO: 103582

SEQ ID NO: 317869 - RNA, 63 nt, Homo Sapiens; identical to SEQ ID NO: 103583

SEQ ID NO: 317870 - RNA, 63 nt, Homo Sapiens; identical to SEQ ID NO: 103584

SEQ ID NO: 317871 - RNA, 63 nt, Homo Sapiens; identical to SEQ ID NO: 103585

SEQ ID NO: 317872 - RNA, 63 nt, Homo Sapiens; identical to SEQ ID NO: 103586

SEQ ID NO: 317873 - RNA, 63 nt, Homo Sapiens; identical to SEQ ID NO: 103587

SEQ ID NO: 317874 - RNA, 63 nt, Homo Sapiens; identical to SEQ ID NO: 103588

SEQ ID NO: 317875 - RNA, 63 nt, Homo Sapiens; identical to SEQ ID NO: 103589

SEQ ID NO: 317876 - RNA, 63 nt, Homo Sapiens; identical to SEQ ID NO: 103590

SEQ ID NO: 317877 - RNA, 59 nt, Homo Sapiens; identical to SEQ ID NO: 103372

SEQ ID NO: 317878 - RNA, 63 nt, Homo Sapiens; identical to SEQ ID NO: 103592

SEQ ID NO: 317879 - RNA, 63 nt, Homo Sapiens; identical to SEQ ID NO: 103593

SEQ ID NO: 317880 - RNA, 63 nt, Homo Sapiens; identical to SEQ ID NO: 103594

SEQ ID NO: 317881 - RNA, 63 nt, Homo Sapiens; identical to SEQ ID NO: 103595

SEQ ID NO: 317882 - RNA, 63 nt, Homo Sapiens; identical to SEQ ID NO: 103596

SEQ ID NO: 317883 - RNA, 63 nt, Homo Sapiens; identical to SEQ ID NO: 103597

SEQ ID NO: 317884 - RNA, 63 nt, Homo Sapiens; identical to SEQ ID NO: 103598

SEQ ID NO: 317885 - RNA, 63 nt, Homo Sapiens; identical to SEQ ID NO: 103599

SEQ ID NO: 317886 - RNA, 63 nt, Homo Sapiens; identical to SEQ ID NO: 103600

SEQ ID NO: 317887 - RNA, 63 nt, Homo Sapiens; identical to SEQ ID NO: 103601

SEQ ID NO: 317888 - RNA, 63 nt, Homo Sapiens; identical to SEQ ID NO: 103602

SEQ ID NO: 317889 - RNA, 63 nt, Homo Sapiens; identical to SEQ ID NO: 103603

SEQ ID NO: 317890 - RNA, 63 nt, Homo Sapiens; identical to SEQ ID NO: 103604

SEQ ID NO: 317891 - RNA, 63 nt, Homo Sapiens; identical to SEQ ID NO: 103605

SEQ ID NO: 317892 - RNA, 63 nt, Homo Sapiens; identical to SEQ ID NO: 103606

SEQ ID NO: 317893 - RNA, 63 nt, Homo Sapiens; identical to SEQ ID NO: 103607

SEQ ID NO: 317894 - RNA, 63 nt, Homo Sapiens; identical to SEQ ID NO: 103608

SEQ ID NO: 317895 - RNA, 63 nt, Homo Sapiens; identical to SEQ ID NO: 103609

SEQ ID NO: 317896 - RNA, 63 nt, Homo Sapiens; identical to SEQ ID NO: 103610

SEQ ID NO: 317897 - RNA, 63 nt, Homo Sapiens; identical to SEQ ID NO: 103611

SEQ ID NO: 317898 - RNA, 61 nt, Homo Sapiens; identical to SEQ ID NO: 103612

SEQ ID NO: 317899 - RNA, 63 nt, Homo Sapiens; identical to SEQ ID NO: 103613

SEQ ID NO: 317900 - RNA, 63 nt, Homo Sapiens; identical to SEQ ID NO: 103614

SEQ ID NO: 317901 - RNA, 63 nt, Homo Sapiens; identical to SEQ ID NO: 103615

SEQ ID NO: 317902 - RNA, 63 nt, Homo Sapiens; identical to SEQ ID NO: 103616

SEQ ID NO: 317903 - RNA, 63 nt, Homo Sapiens; identical to SEQ ID NO: 103617

SEQ ID NO: 317904 - RNA, 63 nt, Homo Sapiens; identical to SEQ ID NO: 103618

SEQ ID NO: 317905 - RNA, 63 nt, Homo Sapiens; identical to SEQ ID NO: 103619

SEQ ID NO: 317906 - RNA, 63 nt, Homo Sapiens; identical to SEQ ID NO: 103620

SEQ ID NO: 317907 - RNA, 63 nt, Homo Sapiens; identical to SEQ ID NO: 103621

SEQ ID NO: 317908 - RNA, 63 nt, Homo Sapiens; identical to SEQ ID NO: 103622

SEQ ID NO: 317909 - RNA, 63 nt, Homo Sapiens; identical to SEQ ID NO: 103623

SEQ ID NO: 317910 - RNA, 63 nt, Homo Sapiens; identical to SEQ ID NO: 103624

SEQ ID NO: 317911 - RNA, 63 nt, Homo Sapiens; identical to SEQ ID NO: 103625

SEQ ID NO: 317912 - RNA, 63 nt, Homo Sapiens; identical to SEQ ID NO: 103626

SEQ ID NO: 317913 - RNA, 63 nt, Homo Sapiens; identical to SEQ ID NO: 103627

SEQ ID NO: 317914 - RNA, 63 nt, Homo Sapiens; identical to SEQ ID NO: 103628

SEQ ID NO: 317915 - RNA, 63 nt, Homo Sapiens; identical to SEQ ID NO: 103629

SEQ ID NO: 317916 - RNA, 63 nt, Homo Sapiens; identical to SEQ ID NO: 103630

SEQ ID NO: 317917 - RNA, 63 nt, Homo Sapiens; identical to SEQ ID NO: 103631

SEQ ID NO: 317918 - RNA, 63 nt, Homo Sapiens; identical to SEQ ID NO: 103632

SEQ ID NO: 317919 - RNA, 63 nt, Homo Sapiens; identical to SEQ ID NO: 103633

SEQ ID NO: 317920 - RNA, 63 nt, Homo Sapiens; identical to SEQ ID NO: 103634

SEQ ID NO: 317921 - RNA, 63 nt, Homo Sapiens; identical to SEQ ID NO: 103635

SEQ ID NO: 317922 - RNA, 63 nt, Homo Sapiens; identical to SEQ ID NO: 103636

SEQ ID NO: 317923 - RNA, 63 nt, Homo Sapiens; identical to SEQ ID NO: 103637

SEQ ID NO: 317924 - RNA, 63 nt, Homo Sapiens; identical to SEQ ID NO: 103638

SEQ ID NO: 317925 - RNA, 63 nt, Homo Sapiens; identical to SEQ ID NO: 103639

SEQ ID NO: 317926 - RNA, 63 nt, Homo Sapiens; identical to SEQ ID NO: 103640

SEQ ID NO: 317927 - RNA, 63 nt, Homo Sapiens; identical to SEQ ID NO: 103641

SEQ ID NO: 317928 - RNA, 63 nt, Homo Sapiens; identical to SEQ ID NO: 103642

SEQ ID NO: 317929 - RNA, 63 nt, Homo Sapiens; identical to SEQ ID NO: 103643

SEQ ID NO: 317930 - RNA, 63 nt, Homo Sapiens; identical to SEQ ID NO: 103644

SEQ ID NO: 317931 - RNA, 63 nt, Homo Sapiens; identical to SEQ ID NO: 103645

SEQ ID NO: 317932 - RNA, 63 nt, Homo Sapiens; identical to SEQ ID NO: 103646

SEQ ID NO: 317933 - RNA, 63 nt, Homo Sapiens; identical to SEQ ID NO: 103647

SEQ ID NO: 317934 - RNA, 63 nt, Homo Sapiens; identical to SEQ ID NO: 103648

SEQ ID NO: 317935 - RNA, 63 nt, Homo Sapiens; identical to SEQ ID NO: 103649

SEQ ID NO: 317936 - RNA, 63 nt, Homo Sapiens; identical to SEQ ID NO: 103650

SEQ ID NO: 317937 - RNA, 63 nt, Homo Sapiens; identical to SEQ ID NO: 103651

SEQ ID NO: 317938 - RNA, 63 nt, Homo Sapiens; identical to SEQ ID NO: 103652

SEQ ID NO: 317939 - RNA, 63 nt, Homo Sapiens; identical to SEQ ID NO: 103653

SEQ ID NO: 317940 - RNA, 63 nt, Homo Sapiens; identical to SEQ ID NO: 103654

SEQ ID NO: 317941 - RNA, 63 nt, Homo Sapiens; identical to SEQ ID NO: 103655

SEQ ID NO: 317942 - RNA, 63 nt, Homo Sapiens; identical to SEQ ID NO: 103656

SEQ ID NO: 317943 - RNA, 63 nt, Homo Sapiens; identical to SEQ ID NO: 103657

SEQ ID NO: 317944 - RNA, 63 nt, Homo Sapiens; identical to SEQ ID NO: 103658

SEQ ID NO: 317945 - RNA, 63 nt, Homo Sapiens; identical to SEQ ID NO: 103659

SEQ ID NO: 317946 - RNA, 63 nt, Homo Sapiens; identical to SEQ ID NO: 103660

SEQ ID NO: 317947 - RNA, 63 nt, Homo Sapiens; identical to SEQ ID NO: 103661

SEQ ID NO: 317948 - RNA, 63 nt, Homo Sapiens; identical to SEQ ID NO: 103662

SEQ ID NO: 317949 - RNA, 63 nt, Homo Sapiens; identical to SEQ ID NO: 103663

SEQ ID NO: 317950 - RNA, 63 nt, Homo Sapiens; identical to SEQ ID NO: 103664

SEQ ID NO: 317951 - RNA, 63 nt, Homo Sapiens; identical to SEQ ID NO: 103665

SEQ ID NO: 317952 - RNA, 63 nt, Homo Sapiens; identical to SEQ ID NO: 103666

SEQ ID NO: 317953 - RNA, 63 nt, Homo Sapiens; identical to SEQ ID NO: 103667

SEQ ID NO: 317954 - RNA, 63 nt, Homo Sapiens; identical to SEQ ID NO: 103668

SEQ ID NO: 317955 - RNA, 63 nt, Homo Sapiens; identical to SEQ ID NO: 103669

SEQ ID NO: 317956 - RNA, 63 nt, Homo Sapiens; identical to SEQ ID NO: 103670

SEQ ID NO: 317957 - RNA, 63 nt, Homo Sapiens; identical to SEQ ID NO: 103671

SEQ ID NO: 317958 - RNA, 63 nt, Homo Sapiens; identical to SEQ ID NO: 103672

SEQ ID NO: 317959 - RNA, 63 nt, Homo Sapiens; identical to SEQ ID NO: 103673

SEQ ID NO: 317960 - RNA, 63 nt, Homo Sapiens; identical to SEQ ID NO: 103674

SEQ ID NO: 317961 - RNA, 63 nt, Homo Sapiens; identical to SEQ ID NO: 103675

SEQ ID NO: 317962 - RNA, 63 nt, Homo Sapiens; identical to SEQ ID NO: 103676

SEQ ID NO: 317963 - RNA, 63 nt, Homo Sapiens; identical to SEQ ID NO: 103677

SEQ ID NO: 317964 - RNA, 63 nt, Homo Sapiens; identical to SEQ ID NO: 103678

SEQ ID NO: 317965 - RNA, 63 nt, Homo Sapiens; identical to SEQ ID NO: 103679

SEQ ID NO: 317966 - RNA, 63 nt, Homo Sapiens; identical to SEQ ID NO: 103680

SEQ ID NO: 317967 - RNA, 63 nt, Homo Sapiens; identical to SEQ ID NO: 103681

SEQ ID NO: 317968 - RNA, 63 nt, Homo Sapiens; identical to SEQ ID NO: 103682

SEQ ID NO: 317969 - RNA, 63 nt, Homo Sapiens; identical to SEQ ID NO: 103683

SEQ ID NO: 317970 - RNA, 63 nt, Homo Sapiens; identical to SEQ ID NO: 103684

SEQ ID NO: 317971 - RNA, 63 nt, Homo Sapiens; identical to SEQ ID NO: 103685

SEQ ID NO: 317972 - RNA, 63 nt, Homo Sapiens; identical to SEQ ID NO: 103686

SEQ ID NO: 317973 - RNA, 63 nt, Homo Sapiens; identical to SEQ ID NO: 103687

SEQ ID NO: 317974 - RNA, 63 nt, Homo Sapiens; identical to SEQ ID NO: 103688

SEQ ID NO: 317975 - RNA, 63 nt, Homo Sapiens; identical to SEQ ID NO: 103689

SEQ ID NO: 317976 - RNA, 63 nt, Homo Sapiens; identical to SEQ ID NO: 103690

SEQ ID NO: 317977 - RNA, 63 nt, Homo Sapiens; identical to SEQ ID NO: 103691

SEQ ID NO: 317978 - RNA, 63 nt, Homo Sapiens; identical to SEQ ID NO: 103692

SEQ ID NO: 317979 - RNA, 63 nt, Homo Sapiens; identical to SEQ ID NO: 103693

SEQ ID NO: 317980 - RNA, 63 nt, Homo Sapiens; identical to SEQ ID NO: 103694

SEQ ID NO: 317981 - RNA, 63 nt, Homo Sapiens; identical to SEQ ID NO: 103695

SEQ ID NO: 317982 - RNA, 63 nt, Homo Sapiens; identical to SEQ ID NO: 103696

SEQ ID NO: 317983 - RNA, 63 nt, Homo Sapiens; identical to SEQ ID NO: 103697

SEQ ID NO: 317984 - RNA, 63 nt, Homo Sapiens; identical to SEQ ID NO: 103698

SEQ ID NO: 317985 - RNA, 63 nt, Homo Sapiens; identical to SEQ ID NO: 103699

SEQ ID NO: 317986 - RNA, 63 nt, Homo Sapiens; identical to SEQ ID NO: 103700

SEQ ID NO: 317987 - RNA, 63 nt, Homo Sapiens; identical to SEQ ID NO: 103701

SEQ ID NO: 317988 - RNA, 63 nt, Homo Sapiens; identical to SEQ ID NO: 103702

SEQ ID NO: 317989 - RNA, 63 nt, Homo Sapiens; identical to SEQ ID NO: 103703

SEQ ID NO: 317990 - RNA, 63 nt, Homo Sapiens; identical to SEQ ID NO: 103704

SEQ ID NO: 317991 - RNA, 63 nt, Homo Sapiens; identical to SEQ ID NO: 103705

SEQ ID NO: 317992 - RNA, 63 nt, Homo Sapiens; identical to SEQ ID NO: 103706

SEQ ID NO: 317993 - RNA, 63 nt, Homo Sapiens; identical to SEQ ID NO: 103707

SEQ ID NO: 317994 - RNA, 63 nt, Homo Sapiens; identical to SEQ ID NO: 103708

SEQ ID NO: 317995 - RNA, 63 nt, Homo Sapiens; identical to SEQ ID NO: 103709

SEQ ID NO: 317996 - RNA, 63 nt, Homo Sapiens; identical to SEQ ID NO: 103710

SEQ ID NO: 317997 - RNA, 63 nt, Homo Sapiens; identical to SEQ ID NO: 103711

SEQ ID NO: 317998 - RNA, 63 nt, Homo Sapiens; identical to SEQ ID NO: 103712

SEQ ID NO: 317999 - RNA, 63 nt, Homo Sapiens; identical to SEQ ID NO: 103713

SEQ ID NO: 318000 - RNA, 63 nt, Homo Sapiens; identical to SEQ ID NO: 103714

SEQ ID NO: 318001 - RNA, 63 nt, Homo Sapiens; identical to SEQ ID NO: 103715

SEQ ID NO: 318002 - RNA, 63 nt, Homo Sapiens; identical to SEQ ID NO: 103716

SEQ ID NO: 318003 - RNA, 63 nt, Homo Sapiens; identical to SEQ ID NO: 103717

SEQ ID NO: 318004 - RNA, 63 nt, Homo Sapiens; identical to SEQ ID NO: 103718

SEQ ID NO: 318005 - RNA, 63 nt, Homo Sapiens; identical to SEQ ID NO: 103719

SEQ ID NO: 318006 - RNA, 63 nt, Homo Sapiens; identical to SEQ ID NO: 103720

SEQ ID NO: 318007 - RNA, 63 nt, Homo Sapiens; identical to SEQ ID NO: 103721

SEQ ID NO: 318008 - RNA, 63 nt, Homo Sapiens; identical to SEQ ID NO: 103722

SEQ ID NO: 318009 - RNA, 63 nt, Homo Sapiens; identical to SEQ ID NO: 103723

SEQ ID NO: 318010 - RNA, 63 nt, Homo Sapiens; identical to SEQ ID NO: 103724

SEQ ID NO: 318011 - RNA, 63 nt, Homo Sapiens; identical to SEQ ID NO: 103725

SEQ ID NO: 318012 - RNA, 63 nt, Homo Sapiens; identical to SEQ ID NO: 103726

SEQ ID NO: 318013 - RNA, 64 nt, Homo Sapiens
aguccuguggugcaguuacugaaaggacguguggagacagcagcagguggacagcccagacccu

SEQ ID NO: 318014 - RNA, 64 nt, Homo Sapiens
gccuucuagggucaccuuaauuucagccuccagaagacagcagauaguuaugcuaaaguggagg

SEQ ID NO: 318015 - RNA, 64 nt, Homo Sapiens
cccgccucccccgcagguuaugucagcagcucugagacagcaguaucacaggccagauguuguu

SEQ ID NO: 318016 - RNA, 64 nt, Homo Sapiens
agaugagccccacguggagcucgggacggauaguagacagcaauaacucgguguguggccgccu

SEQ ID NO: 318017 - RNA, 64 nt, Homo Sapiens
agauaaaaaagggaaaacuauagcuuugaguggcagacagcacacaucacaugcaucaacucac

SEQ ID NO: 318018 - RNA, 64 nt, Homo Sapiens
cagcuuucuccuacagggcuuuuccugaguccccagacagcagaguaugaacugcugacaccca

SEQ ID NO: 318019 - RNA, 64 nt, Homo Sapiens
cuuaacaggcuuuccaauuagucuuucuuaaucuagacagcaaaugugaaugaaugaaaguuga

SEQ ID NO: 318020 - RNA, 64 nt, Homo Sapiens
uucucuauuggccucucaggcauuagaaaaauucagacagcaucuacaaagacaaguacaacuc

SEQ ID NO: 318021 - RNA, 64 nt, Homo Sapiens
gugaagcugucagcuuaauaacaagaauggccuaagacagcaaagacagcacuguuccugggcu

SEQ ID NO: 318022 - RNA, 64 nt, Homo Sapiens
ucagcuuaauaacaagaauggccuaagacagcaaagacagcacuguuccugggcugggacgcaa

SEQ ID NO: 318023 - RNA, 64 nt, Homo Sapiens
gugaaaaaagaaacaugccacuugauuaggagagagacagcaguguuugaacuacagcaucuuu

SEQ ID NO: 318024 - RNA, 64 nt, Homo Sapiens
uuuggaggucagagucugcuuucguaggcucuuuagacagcaccuaccacuugguucuccagcg

SEQ ID NO: 318025 - RNA, 64 nt, Homo Sapiens
cacggcccgcagccuggcauccgaguacaaggacagacagcagguaaagaaauucaugcuugca

SEQ ID NO: 318026 - RNA, 64 nt, Homo Sapiens
gcagaugccgcaggcgcggccucgacugagcuuuagacagcagacuucaagcauccucagaagc

SEQ ID NO: 318027 - RNA, 64 nt, Homo Sapiens
ccuagccaggccccagggagccuccgcugggcccagacagcagcguuugguuuuauccacuuuu

SEQ ID NO: 318028 - RNA, 64 nt, Homo Sapiens
ugucucaaaaaaaaaaaaaaaaacaauggaaggcagacagcaagucccugaggacacaucacac

SEQ ID NO: 318029 - RNA, 64 nt, Homo Sapiens; identical to SEQ ID NO: 98595

SEQ ID NO: 318030 - RNA, 64 nt, Homo Sapiens; identical to SEQ ID NO: 98596

SEQ ID NO: 318031 - RNA, 64 nt, Homo Sapiens; identical to SEQ ID NO: 98597

SEQ ID NO: 318032 - RNA, 64 nt, Homo Sapiens; identical to SEQ ID NO: 98598

SEQ ID NO: 318033 - RNA, 64 nt, Homo Sapiens; identical to SEQ ID NO: 98599

SEQ ID NO: 318034 - RNA, 64 nt, Homo Sapiens; identical to SEQ ID NO: 98600

SEQ ID NO: 318035 - RNA, 64 nt, Homo Sapiens; identical to SEQ ID NO: 98601

SEQ ID NO: 318036 - RNA, 64 nt, Homo Sapiens; identical to SEQ ID NO: 98602

SEQ ID NO: 318037 - RNA, 64 nt, Homo Sapiens; identical to SEQ ID NO: 98603

SEQ ID NO: 318038 - RNA, 64 nt, Homo Sapiens; identical to SEQ ID NO: 98604

SEQ ID NO: 318039 - RNA, 64 nt, Homo Sapiens; identical to SEQ ID NO: 98605

SEQ ID NO: 318040 - RNA, 64 nt, Homo Sapiens; identical to SEQ ID NO: 98606

SEQ ID NO: 318041 - RNA, 64 nt, Homo Sapiens; identical to SEQ ID NO: 98607

SEQ ID NO: 318042 - RNA, 64 nt, Homo Sapiens; identical to SEQ ID NO: 98608

SEQ ID NO: 318043 - RNA, 64 nt, Homo Sapiens; identical to SEQ ID NO: 98609

SEQ ID NO: 318044 - RNA, 64 nt, Homo Sapiens; identical to SEQ ID NO: 98610

SEQ ID NO: 318045 - RNA, 64 nt, Homo Sapiens; identical to SEQ ID NO: 98611

SEQ ID NO: 318046 - RNA, 64 nt, Homo Sapiens; identical to SEQ ID NO: 98612

SEQ ID NO: 318047 - RNA, 64 nt, Homo Sapiens; identical to SEQ ID NO: 98613

SEQ ID NO: 318048 - RNA, 64 nt, Homo Sapiens; identical to SEQ ID NO: 98614

SEQ ID NO: 318049 - RNA, 64 nt, Homo Sapiens; identical to SEQ ID NO: 98615

SEQ ID NO: 318050 - RNA, 57 nt, Homo Sapiens; identical to SEQ ID NO: 98616

SEQ ID NO: 318051 - RNA, 64 nt, Homo Sapiens; identical to SEQ ID NO: 98617

SEQ ID NO: 318052 - RNA, 64 nt, Homo Sapiens; identical to SEQ ID NO: 98618

SEQ ID NO: 318053 - RNA, 64 nt, Homo Sapiens; identical to SEQ ID NO: 98619

SEQ ID NO: 318054 - RNA, 64 nt, Homo Sapiens; identical to SEQ ID NO: 98620

SEQ ID NO: 318055 - RNA, 64 nt, Homo Sapiens; identical to SEQ ID NO: 98621

SEQ ID NO: 318056 - RNA, 64 nt, Homo Sapiens; identical to SEQ ID NO: 98622

SEQ ID NO: 318057 - RNA, 64 nt, Homo Sapiens; identical to SEQ ID NO: 98623

SEQ ID NO: 318058 - RNA, 64 nt, Homo Sapiens; identical to SEQ ID NO: 98624

SEQ ID NO: 318059 - RNA, 64 nt, Homo Sapiens; identical to SEQ ID NO: 98625

SEQ ID NO: 318060 - RNA, 64 nt, Homo Sapiens; identical to SEQ ID NO: 98626

SEQ ID NO: 318061 - RNA, 64 nt, Homo Sapiens; identical to SEQ ID NO: 98627

SEQ ID NO: 318062 - RNA, 64 nt, Homo Sapiens; identical to SEQ ID NO: 98628

SEQ ID NO: 318063 - RNA, 64 nt, Homo Sapiens; identical to SEQ ID NO: 98629

SEQ ID NO: 318064 - RNA, 64 nt, Homo Sapiens; identical to SEQ ID NO: 98630

SEQ ID NO: 318065 - RNA, 64 nt, Homo Sapiens; identical to SEQ ID NO: 98631

SEQ ID NO: 318066 - RNA, 64 nt, Homo Sapiens; identical to SEQ ID NO: 98632

SEQ ID NO: 318067 - RNA, 64 nt, Homo Sapiens; identical to SEQ ID NO: 98633

SEQ ID NO: 318068 - RNA, 64 nt, Homo Sapiens; identical to SEQ ID NO: 98634

SEQ ID NO: 318069 - RNA, 64 nt, Homo Sapiens; identical to SEQ ID NO: 98635

SEQ ID NO: 318070 - RNA, 64 nt, Homo Sapiens; identical to SEQ ID NO: 98636

SEQ ID NO: 318071 - RNA, 64 nt, Homo Sapiens; identical to SEQ ID NO: 98637

SEQ ID NO: 318072 - RNA, 64 nt, Homo Sapiens; identical to SEQ ID NO: 98638

SEQ ID NO: 318073 - RNA, 64 nt, Homo Sapiens; identical to SEQ ID NO: 98639

SEQ ID NO: 318074 - RNA, 64 nt, Homo Sapiens; identical to SEQ ID NO: 98640

SEQ ID NO: 318075 - RNA, 64 nt, Homo Sapiens; identical to SEQ ID NO: 98641

SEQ ID NO: 318076 - RNA, 64 nt, Homo Sapiens; identical to SEQ ID NO: 98642

SEQ ID NO: 318077 - RNA, 64 nt, Homo Sapiens; identical to SEQ ID NO: 98643

SEQ ID NO: 318078 - RNA, 64 nt, Homo Sapiens; identical to SEQ ID NO: 98644

SEQ ID NO: 318079 - RNA, 64 nt, Homo Sapiens; identical to SEQ ID NO: 98645

SEQ ID NO: 318080 - RNA, 64 nt, Homo Sapiens; identical to SEQ ID NO: 98646

SEQ ID NO: 318081 - RNA, 64 nt, Homo Sapiens; identical to SEQ ID NO: 98647

SEQ ID NO: 318082 - RNA, 64 nt, Homo Sapiens; identical to SEQ ID NO: 98648

SEQ ID NO: 318083 - RNA, 64 nt, Homo Sapiens; identical to SEQ ID NO: 98649

SEQ ID NO: 318084 - RNA, 64 nt, Homo Sapiens; identical to SEQ ID NO: 98650

SEQ ID NO: 318085 - RNA, 64 nt, Homo Sapiens; identical to SEQ ID NO: 98651

SEQ ID NO: 318086 - RNA, 64 nt, Homo Sapiens; identical to SEQ ID NO: 98652

SEQ ID NO: 318087 - RNA, 64 nt, Homo Sapiens; identical to SEQ ID NO: 98653

SEQ ID NO: 318088 - RNA, 64 nt, Homo Sapiens; identical to SEQ ID NO: 98654

SEQ ID NO: 318089 - RNA, 64 nt, Homo Sapiens; identical to SEQ ID NO: 98655

SEQ ID NO: 318090 - RNA, 64 nt, Homo Sapiens; identical to SEQ ID NO: 98656

SEQ ID NO: 318091 - RNA, 64 nt, Homo Sapiens; identical to SEQ ID NO: 98657

SEQ ID NO: 318092 - RNA, 64 nt, Homo Sapiens; identical to SEQ ID NO: 98658

SEQ ID NO: 318093 - RNA, 64 nt, Homo Sapiens; identical to SEQ ID NO: 98659

SEQ ID NO: 318094 - RNA, 64 nt, Homo Sapiens; identical to SEQ ID NO: 98660

SEQ ID NO: 318095 - RNA, 64 nt, Homo Sapiens; identical to SEQ ID NO: 98661

SEQ ID NO: 318096 - RNA, 64 nt, Homo Sapiens; identical to SEQ ID NO: 98662

SEQ ID NO: 318097 - RNA, 64 nt, Homo Sapiens; identical to SEQ ID NO: 98663

SEQ ID NO: 318098 - RNA, 64 nt, Homo Sapiens; identical to SEQ ID NO: 98664

SEQ ID NO: 318099 - RNA, 64 nt, Homo Sapiens; identical to SEQ ID NO: 98665

SEQ ID NO: 318100 - RNA, 64 nt, Homo Sapiens; identical to SEQ ID NO: 98666

SEQ ID NO: 318101 - RNA, 64 nt, Homo Sapiens; identical to SEQ ID NO: 98667

SEQ ID NO: 318102 - RNA, 64 nt, Homo Sapiens; identical to SEQ ID NO: 98668

SEQ ID NO: 318103 - RNA, 64 nt, Homo Sapiens; identical to SEQ ID NO: 98669

SEQ ID NO: 318104 - RNA, 64 nt, Homo Sapiens; identical to SEQ ID NO: 98670

SEQ ID NO: 318105 - RNA, 64 nt, Homo Sapiens; identical to SEQ ID NO: 98671

SEQ ID NO: 318106 - RNA, 64 nt, Homo Sapiens; identical to SEQ ID NO: 312698

SEQ ID NO: 318107 - RNA, 64 nt, Homo Sapiens; identical to SEQ ID NO: 312699

SEQ ID NO: 318108 - RNA, 64 nt, Homo Sapiens; identical to SEQ ID NO: 312700

SEQ ID NO: 318109 - RNA, 64 nt, Homo Sapiens; identical to SEQ ID NO: 312701

SEQ ID NO: 318110 - RNA, 64 nt, Homo Sapiens; identical to SEQ ID NO: 312702

SEQ ID NO: 318111 - RNA, 64 nt, Homo Sapiens; identical to SEQ ID NO: 312703

SEQ ID NO: 318112 - RNA, 64 nt, Homo Sapiens; identical to SEQ ID NO: 312704

SEQ ID NO: 318113 - RNA, 64 nt, Homo Sapiens; identical to SEQ ID NO: 312705

SEQ ID NO: 318114 - RNA, 64 nt, Homo Sapiens; identical to SEQ ID NO: 312706

SEQ ID NO: 318115 - RNA, 64 nt, Homo Sapiens; identical to SEQ ID NO: 312707

SEQ ID NO: 318116 - RNA, 64 nt, Homo Sapiens; identical to SEQ ID NO: 312708

SEQ ID NO: 318117 - RNA, 64 nt, Homo Sapiens; identical to SEQ ID NO: 312709

SEQ ID NO: 318118 - RNA, 64 nt, Homo Sapiens; identical to SEQ ID NO: 312710

SEQ ID NO: 318119 - RNA, 64 nt, Homo Sapiens; identical to SEQ ID NO: 312711

SEQ ID NO: 318120 - RNA, 64 nt, Homo Sapiens; identical to SEQ ID NO: 312712

SEQ ID NO: 318121 - RNA, 64 nt, Homo Sapiens; identical to SEQ ID NO: 312713

SEQ ID NO: 318122 - RNA, 64 nt, Homo Sapiens; identical to SEQ ID NO: 312714

SEQ ID NO: 318123 - RNA, 64 nt, Homo Sapiens; identical to SEQ ID NO: 312715

SEQ ID NO: 318124 - RNA, 64 nt, Homo Sapiens; identical to SEQ ID NO: 312716

SEQ ID NO: 318125 - RNA, 64 nt, Homo Sapiens; identical to SEQ ID NO: 312717

SEQ ID NO: 318126 - RNA, 64 nt, Homo Sapiens; identical to SEQ ID NO: 312718

SEQ ID NO: 318127 - RNA, 64 nt, Homo Sapiens; identical to SEQ ID NO: 312719

SEQ ID NO: 318128 - RNA, 64 nt, Homo Sapiens; identical to SEQ ID NO: 312720

SEQ ID NO: 318129 - RNA, 64 nt, Homo Sapiens; identical to SEQ ID NO: 312721

SEQ ID NO: 318130 - RNA, 64 nt, Homo Sapiens; identical to SEQ ID NO: 312722

SEQ ID NO: 318131 - RNA, 64 nt, Homo Sapiens; identical to SEQ ID NO: 312723

SEQ ID NO: 318132 - RNA, 64 nt, Homo Sapiens; identical to SEQ ID NO: 312724

SEQ ID NO: 318133 - RNA, 64 nt, Homo Sapiens; identical to SEQ ID NO: 312725

SEQ ID NO: 318134 - RNA, 64 nt, Homo Sapiens; identical to SEQ ID NO: 312726

SEQ ID NO: 318135 - RNA, 64 nt, Homo Sapiens; identical to SEQ ID NO: 312727

SEQ ID NO: 318136 - RNA, 64 nt, Homo Sapiens; identical to SEQ ID NO: 312728

SEQ ID NO: 318137 - RNA, 64 nt, Homo Sapiens; identical to SEQ ID NO: 312729

SEQ ID NO: 318138 - RNA, 64 nt, Homo Sapiens; identical to SEQ ID NO: 312730

SEQ ID NO: 318139 - RNA, 64 nt, Homo Sapiens; identical to SEQ ID NO: 312731

SEQ ID NO: 318140 - RNA, 64 nt, Homo Sapiens; identical to SEQ ID NO: 312732

SEQ ID NO: 318141 - RNA, 64 nt, Homo Sapiens; identical to SEQ ID NO: 312733

SEQ ID NO: 318142 - RNA, 64 nt, Homo Sapiens; identical to SEQ ID NO: 312734

SEQ ID NO: 318143 - RNA, 64 nt, Homo Sapiens; identical to SEQ ID NO: 312735

SEQ ID NO: 318144 - RNA, 64 nt, Homo Sapiens; identical to SEQ ID NO: 312736

SEQ ID NO: 318145 - RNA, 64 nt, Homo Sapiens; identical to SEQ ID NO: 312737

SEQ ID NO: 318146 - RNA, 64 nt, Homo Sapiens; identical to SEQ ID NO: 312738

SEQ ID NO: 318147 - RNA, 64 nt, Homo Sapiens; identical to SEQ ID NO: 312739

SEQ ID NO: 318148 - RNA, 64 nt, Homo Sapiens; identical to SEQ ID NO: 312740

SEQ ID NO: 318149 - RNA, 64 nt, Homo Sapiens; identical to SEQ ID NO: 312741

SEQ ID NO: 318150 - RNA, 64 nt, Homo Sapiens; identical to SEQ ID NO: 312742

SEQ ID NO: 318151 - RNA, 64 nt, Homo Sapiens; identical to SEQ ID NO: 312743

SEQ ID NO: 318152 - RNA, 64 nt, Homo Sapiens; identical to SEQ ID NO: 312744

SEQ ID NO: 318153 - RNA, 64 nt, Homo Sapiens; identical to SEQ ID NO: 312745

SEQ ID NO: 318154 - RNA, 64 nt, Homo Sapiens; identical to SEQ ID NO: 312746

SEQ ID NO: 318155 - RNA, 64 nt, Homo Sapiens; identical to SEQ ID NO: 312747

SEQ ID NO: 318156 - RNA, 64 nt, Homo Sapiens; identical to SEQ ID NO: 312748

SEQ ID NO: 318157 - RNA, 64 nt, Homo Sapiens; identical to SEQ ID NO: 312749

SEQ ID NO: 318158 - RNA, 64 nt, Homo Sapiens; identical to SEQ ID NO: 312750

SEQ ID NO: 318159 - RNA, 64 nt, Homo Sapiens; identical to SEQ ID NO: 312751

SEQ ID NO: 318160 - RNA, 64 nt, Homo Sapiens; identical to SEQ ID NO: 312752

SEQ ID NO: 318161 - RNA, 64 nt, Homo Sapiens; identical to SEQ ID NO: 312753

SEQ ID NO: 318162 - RNA, 64 nt, Homo Sapiens; identical to SEQ ID NO: 312754

SEQ ID NO: 318163 - RNA, 64 nt, Homo Sapiens; identical to SEQ ID NO: 312755

SEQ ID NO: 318164 - RNA, 64 nt, Homo Sapiens; identical to SEQ ID NO: 312756

SEQ ID NO: 318165 - RNA, 64 nt, Homo Sapiens; identical to SEQ ID NO: 312757

SEQ ID NO: 318166 - RNA, 64 nt, Homo Sapiens; identical to SEQ ID NO: 312758

SEQ ID NO: 318167 - RNA, 64 nt, Homo Sapiens; identical to SEQ ID NO: 312759

SEQ ID NO: 318168 - RNA, 64 nt, Homo Sapiens; identical to SEQ ID NO: 312760

SEQ ID NO: 318169 - RNA, 64 nt, Homo Sapiens; identical to SEQ ID NO: 312761

SEQ ID NO: 318170 - RNA, 64 nt, Homo Sapiens; identical to SEQ ID NO: 312762

SEQ ID NO: 318171 - RNA, 64 nt, Homo Sapiens; identical to SEQ ID NO: 312763

SEQ ID NO: 318172 - RNA, 64 nt, Homo Sapiens; identical to SEQ ID NO: 312764

SEQ ID NO: 318173 - RNA, 64 nt, Homo Sapiens; identical to SEQ ID NO: 312765

SEQ ID NO: 318174 - RNA, 64 nt, Homo Sapiens; identical to SEQ ID NO: 312766

SEQ ID NO: 318175 - RNA, 64 nt, Homo Sapiens; identical to SEQ ID NO: 312767

SEQ ID NO: 318176 - RNA, 64 nt, Homo Sapiens; identical to SEQ ID NO: 312768

SEQ ID NO: 318177 - RNA, 64 nt, Homo Sapiens; identical to SEQ ID NO: 312769

SEQ ID NO: 318178 - RNA, 64 nt, Homo Sapiens; identical to SEQ ID NO: 312770

SEQ ID NO: 318179 - RNA, 64 nt, Homo Sapiens; identical to SEQ ID NO: 312771

SEQ ID NO: 318180 - RNA, 64 nt, Homo Sapiens; identical to SEQ ID NO: 312772

SEQ ID NO: 318181 - RNA, 64 nt, Homo Sapiens; identical to SEQ ID NO: 312773

SEQ ID NO: 318182 - RNA, 64 nt, Homo Sapiens; identical to SEQ ID NO: 312774

SEQ ID NO: 318183 - RNA, 64 nt, Homo Sapiens; identical to SEQ ID NO: 312775

SEQ ID NO: 318184 - RNA, 64 nt, Homo Sapiens; identical to SEQ ID NO: 312776

SEQ ID NO: 318185 - RNA, 64 nt, Homo Sapiens; identical to SEQ ID NO: 312777

SEQ ID NO: 318186 - RNA, 64 nt, Homo Sapiens; identical to SEQ ID NO: 312778

SEQ ID NO: 318187 - RNA, 64 nt, Homo Sapiens; identical to SEQ ID NO: 312779

SEQ ID NO: 318188 - RNA, 64 nt, Homo Sapiens; identical to SEQ ID NO: 312780

SEQ ID NO: 318189 - RNA, 64 nt, Homo Sapiens; identical to SEQ ID NO: 312781

SEQ ID NO: 318190 - RNA, 64 nt, Homo Sapiens; identical to SEQ ID NO: 312782

SEQ ID NO: 318191 - RNA, 64 nt, Homo Sapiens; identical to SEQ ID NO: 312783

SEQ ID NO: 318192 - RNA, 64 nt, Homo Sapiens; identical to SEQ ID NO: 312784

SEQ ID NO: 318193 - RNA, 64 nt, Homo Sapiens; identical to SEQ ID NO: 312785

SEQ ID NO: 318194 - RNA, 64 nt, Homo Sapiens; identical to SEQ ID NO: 312786

SEQ ID NO: 318195 - RNA, 64 nt, Homo Sapiens; identical to SEQ ID NO: 312787

SEQ ID NO: 318196 - RNA, 64 nt, Homo Sapiens; identical to SEQ ID NO: 312788

SEQ ID NO: 318197 - RNA, 64 nt, Homo Sapiens; identical to SEQ ID NO: 312789

SEQ ID NO: 318198 - RNA, 64 nt, Homo Sapiens; identical to SEQ ID NO: 312790

SEQ ID NO: 318199 - RNA, 64 nt, Homo Sapiens; identical to SEQ ID NO: 312791

SEQ ID NO: 318200 - RNA, 64 nt, Homo Sapiens; identical to SEQ ID NO: 312792

SEQ ID NO: 318201 - RNA, 64 nt, Homo Sapiens; identical to SEQ ID NO: 312793

SEQ ID NO: 318202 - RNA, 64 nt, Homo Sapiens; identical to SEQ ID NO: 312794

SEQ ID NO: 318203 - RNA, 64 nt, Homo Sapiens; identical to SEQ ID NO: 312795

SEQ ID NO: 318204 - RNA, 64 nt, Homo Sapiens; identical to SEQ ID NO: 312796

SEQ ID NO: 318205 - RNA, 64 nt, Homo Sapiens; identical to SEQ ID NO: 312797

SEQ ID NO: 318206 - RNA, 64 nt, Homo Sapiens; identical to SEQ ID NO: 312798

SEQ ID NO: 318207 - RNA, 64 nt, Homo Sapiens; identical to SEQ ID NO: 312799

SEQ ID NO: 318208 - RNA, 64 nt, Homo Sapiens; identical to SEQ ID NO: 312800

SEQ ID NO: 318209 - RNA, 64 nt, Homo Sapiens; identical to SEQ ID NO: 312801

SEQ ID NO: 318210 - RNA, 64 nt, Homo Sapiens; identical to SEQ ID NO: 312802

SEQ ID NO: 318211 - RNA, 64 nt, Homo Sapiens; identical to SEQ ID NO: 312803

SEQ ID NO: 318212 - RNA, 64 nt, Homo Sapiens; identical to SEQ ID NO: 312804

SEQ ID NO: 318213 - RNA, 64 nt, Homo Sapiens; identical to SEQ ID NO: 312805

SEQ ID NO: 318214 - RNA, 64 nt, Homo Sapiens; identical to SEQ ID NO: 312806

SEQ ID NO: 318215 - RNA, 64 nt, Homo Sapiens; identical to SEQ ID NO: 312807

SEQ ID NO: 318216 - RNA, 64 nt, Homo Sapiens; identical to SEQ ID NO: 312808

SEQ ID NO: 318217 - RNA, 64 nt, Homo Sapiens; identical to SEQ ID NO: 312809

SEQ ID NO: 318218 - RNA, 64 nt, Homo Sapiens; identical to SEQ ID NO: 312810

SEQ ID NO: 318219 - RNA, 64 nt, Homo Sapiens; identical to SEQ ID NO: 312811

SEQ ID NO: 318220 - RNA, 64 nt, Homo Sapiens; identical to SEQ ID NO: 312812

SEQ ID NO: 318221 - RNA, 64 nt, Homo Sapiens; identical to SEQ ID NO: 312813

SEQ ID NO: 318222 - RNA, 64 nt, Homo Sapiens; identical to SEQ ID NO: 312814

SEQ ID NO: 318223 - RNA, 64 nt, Homo Sapiens; identical to SEQ ID NO: 312815

SEQ ID NO: 318224 - RNA, 64 nt, Homo Sapiens; identical to SEQ ID NO: 312816

SEQ ID NO: 318225 - RNA, 64 nt, Homo Sapiens; identical to SEQ ID NO: 312817

SEQ ID NO: 318226 - RNA, 64 nt, Homo Sapiens; identical to SEQ ID NO: 312818

SEQ ID NO: 318227 - RNA, 64 nt, Homo Sapiens; identical to SEQ ID NO: 312819

SEQ ID NO: 318228 - RNA, 64 nt, Homo Sapiens; identical to SEQ ID NO: 312820

SEQ ID NO: 318229 - RNA, 64 nt, Homo Sapiens; identical to SEQ ID NO: 312821

SEQ ID NO: 318230 - RNA, 64 nt, Homo Sapiens; identical to SEQ ID NO: 312822

SEQ ID NO: 318231 - RNA, 64 nt, Homo Sapiens; identical to SEQ ID NO: 312823

SEQ ID NO: 318232 - RNA, 64 nt, Homo Sapiens; identical to SEQ ID NO: 312824

SEQ ID NO: 318233 - RNA, 64 nt, Homo Sapiens; identical to SEQ ID NO: 312825

SEQ ID NO: 318234 - RNA, 64 nt, Homo Sapiens; identical to SEQ ID NO: 312826

SEQ ID NO: 318235 - RNA, 64 nt, Homo Sapiens; identical to SEQ ID NO: 312827

SEQ ID NO: 318236 - RNA, 64 nt, Homo Sapiens; identical to SEQ ID NO: 312828

SEQ ID NO: 318237 - RNA, 64 nt, Homo Sapiens; identical to SEQ ID NO: 312829

SEQ ID NO: 318238 - RNA, 64 nt, Homo Sapiens; identical to SEQ ID NO: 312830

SEQ ID NO: 318239 - RNA, 64 nt, Homo Sapiens; identical to SEQ ID NO: 312831

SEQ ID NO: 318240 - RNA, 64 nt, Homo Sapiens; identical to SEQ ID NO: 312832

SEQ ID NO: 318241 - RNA, 64 nt, Homo Sapiens; identical to SEQ ID NO: 312833

SEQ ID NO: 318242 - RNA, 64 nt, Homo Sapiens; identical to SEQ ID NO: 312834

SEQ ID NO: 318243 - RNA, 64 nt, Homo Sapiens; identical to SEQ ID NO: 312835

SEQ ID NO: 318244 - RNA, 64 nt, Homo Sapiens; identical to SEQ ID NO: 312836

SEQ ID NO: 318245 - RNA, 64 nt, Homo Sapiens; identical to SEQ ID NO: 312837

SEQ ID NO: 318246 - RNA, 64 nt, Homo Sapiens; identical to SEQ ID NO: 312838

SEQ ID NO: 318247 - RNA, 64 nt, Homo Sapiens; identical to SEQ ID NO: 312839

SEQ ID NO: 318248 - RNA, 64 nt, Homo Sapiens; identical to SEQ ID NO: 312840

SEQ ID NO: 318249 - RNA, 64 nt, Homo Sapiens; identical to SEQ ID NO: 312841

SEQ ID NO: 318250 - RNA, 64 nt, Homo Sapiens; identical to SEQ ID NO: 312842

SEQ ID NO: 318251 - RNA, 64 nt, Homo Sapiens; identical to SEQ ID NO: 312843

SEQ ID NO: 318252 - RNA, 64 nt, Homo Sapiens; identical to SEQ ID NO: 312844

SEQ ID NO: 318253 - RNA, 64 nt, Homo Sapiens; identical to SEQ ID NO: 312845

SEQ ID NO: 318254 - RNA, 64 nt, Homo Sapiens; identical to SEQ ID NO: 312846

SEQ ID NO: 318255 - RNA, 64 nt, Homo Sapiens; identical to SEQ ID NO: 312847

SEQ ID NO: 318256 - RNA, 64 nt, Homo Sapiens; identical to SEQ ID NO: 312848

SEQ ID NO: 318257 - RNA, 64 nt, Homo Sapiens; identical to SEQ ID NO: 312849

SEQ ID NO: 318258 - RNA, 64 nt, Homo Sapiens; identical to SEQ ID NO: 312850

SEQ ID NO: 318259 - RNA, 64 nt, Homo Sapiens; identical to SEQ ID NO: 312851

SEQ ID NO: 318260 - RNA, 64 nt, Homo Sapiens; identical to SEQ ID NO: 312852

SEQ ID NO: 318261 - RNA, 64 nt, Homo Sapiens; identical to SEQ ID NO: 312853

SEQ ID NO: 318262 - RNA, 64 nt, Homo Sapiens
gcccaccacaucgcagcacuuuuaccacguuuuguccucagaccccgcccaugcuguguggucu

SEQ ID NO: 318263 - RNA, 64 nt, Homo Sapiens
gagggccuccccugcugguggcccuguccugggauccucagaagccugacuguccuaugggcuu

SEQ ID NO: 318264 - RNA, 60 nt, Homo Sapiens
cuguuaagaccuccuauugaguuuuccagguccucagaugggaauugcacaguaggaugu

SEQ ID NO: 318265 - RNA, 64 nt, Homo Sapiens
uaaaauagucgugaaucuuguucaaaaugcagauuccucagauucaauaaugagagcucagacu

SEQ ID NO: 318266 - RNA, 64 nt, Homo Sapiens
ucagaaggaccauucaagguucacuguuguuuuguccucagaaccaggagcuucagauccuaag

SEQ ID NO: 318267 - RNA, 64 nt, Homo Sapiens
ucauuagugaauagaugauguuggaagucauggguccucagagugggggcuccuuaagccucca

SEQ ID NO: 318268 - RNA, 64 nt, Homo Sapiens
ggugaugcggucacccugcaaaagacuugcacuuuccucagaaccaacaugacgcagcucaaua

SEQ ID NO: 318269 - RNA, 64 nt, Homo Sapiens
cccuaagauuucugguaaaccugaaggguggcccuccucagacaauuuaucucccagcaaugac

SEQ ID NO: 318270 - RNA, 64 nt, Homo Sapiens
gaaaaaucuugagaccagauucucuacagcuguuuccucagaggcaaaguugaacugggcuacc

SEQ ID NO: 318271 - RNA, 64 nt, Homo Sapiens
gaaaagcuuaugaggauuucccuucucaggauuuuccucagauuuagguggugcuuacuaauua

SEQ ID NO: 318272 - RNA, 64 nt, Homo Sapiens
cggagcccccgcauaucagcaguucacccaguacuccucagagacugguuucccucuaaaccca

SEQ ID NO: 318273 - RNA, 64 nt, Homo Sapiens
gaugcgucccagccagccccgucgcucucguccauccucagagacaaagaagagggcagggagu

SEQ ID NO: 318274 - RNA, 64 nt, Homo Sapiens
gcgcgcugcuuuggugagacacccccaugcaagguccucagaguagccggguucuaccacaaac

SEQ ID NO: 318275 - RNA, 64 nt, Homo Sapiens
aagagaguguuuugccagggacacagucuguuccuccucagaaaacaccccccaaaugcuaaca

SEQ ID NO: 318276 - RNA, 64 nt, Homo Sapiens
aggugauauuuucaggaaaaauaaauacaggaaauccucagagagccugccaacuuguaacuua

SEQ ID NO: 318277 - RNA, 64 nt, Homo Sapiens
ggaagaggugaccccacccaguuggccuuaccuguccucagaaaucagcgggaccccuucaucu

SEQ ID NO: 318278 - RNA, 64 nt, Homo Sapiens
gauuuguaaauagcuacugguaaaugguuauuuuuccucagaauccuaauaugaucuaaaaccc

SEQ ID NO: 318279 - RNA, 64 nt, Homo Sapiens
augagacuguaaaacaaaaaaugacuuaugacuuuccucagaacguuucuuguguuugagaacc

SEQ ID NO: 318280 - RNA, 64 nt, Homo Sapiens
cucaucacuuuuuuuuaaauaucauuuugggaagggaagacaggguuaaggaacuuuauuuaaa

SEQ ID NO: 318281 - RNA, 64 nt, Homo Sapiens
ccagagccugccaguggaggcuuaucuguugggaggaagacagcucuucacagaagcaaagaac

SEQ ID NO: 318282 - RNA, 64 nt, Homo Sapiens
uuuucaaaagcaauucagaaaggaugcacagucaggaagacacacuggaugugauuauuaauau

SEQ ID NO: 318283 - RNA, 64 nt, Homo Sapiens
guuuaaauuugagaaucaaacauucuauguguuuggaagacaacucugcuugcucauccaagga

SEQ ID NO: 318284 - RNA, 64 nt, Homo Sapiens
ccaccgcgcccagcccuggagugauacuuuuuauggaagacaaaagccccccaaaucuguguaa

SEQ ID NO: 318285 - RNA, 64 nt, Homo Sapiens
gacaaguccuuacuauauugcccugucucucaagggaagacaucaagacuggacuugaacuccu

SEQ ID NO: 318286 - RNA, 64 nt, Homo Sapiens
ccauaggcaaacucuguuuuuuacuuuccccauaggaagacagaauaacccugagguuuuguac

SEQ ID NO: 318287 - RNA, 64 nt, Homo Sapiens
ugcuuguucccagaggauucccgaccuaagguuuggaagacaacuccauuguugcucucuauac

SEQ ID NO: 318288 - RNA, 64 nt, Homo Sapiens
gcgcucuuuaauuuguuguagauuaggucuugcuggaagacagagaaaacuugccuuucaguau

SEQ ID NO: 318289 - RNA, 64 nt, Homo Sapiens
auguauuaauguauguaggagcugcaguucuuguggaagacacuugcugagugaaggaaaugaa

SEQ ID NO: 318290 - RNA, 64 nt, Homo Sapiens
ucuacagaaaaacaaugguagucagucacuaaaaggaagacagucaccgaauauugagcaauau

SEQ ID NO: 318291 - RNA, 64 nt, Homo Sapiens
uuaucuucuggacuauagcuccugcauuuucauaggaagacacaauacuuaaaaauuuauuagc

SEQ ID NO: 318292 - RNA, 64 nt, Homo Sapiens
guggggauaaagacagagauaguucagccauuguggaagacaguguggaaauguaaauuaaauu

SEQ ID NO: 318293 - RNA, 64 nt, Homo Sapiens
ccaggcaguaccauucaggaacaguaaaaauccuggaagacaacgacuuaauguaaaacccaaa

SEQ ID NO: 318294 - RNA, 64 nt, Homo Sapiens
auacuuaguuguuccaggcaccuaaaaucaauuaggaagacauaguucccuucuuuuuugggua

SEQ ID NO: 318295 - RNA, 64 nt, Homo Sapiens
ugggguuauugagacauuggaugugaaauaccuaggaagacauguauggagaaugcuuaacaaa

SEQ ID NO: 318296 - RNA, 64 nt, Homo Sapiens
acagcucuuggguuuuuaguccugcuguguguugggaagacaucaggccugaaagcugagggca

SEQ ID NO: 318297 - RNA, 64 nt, Homo Sapiens
aauugucacuuuccaguuuguuuuucucuauuaaggaagacauuuucuaauugcaucuccaugg

SEQ ID NO: 318298 - RNA, 64 nt, Homo Sapiens
ugagcccaugagccccaccacuacacuccagccuggaagacaccaugacacacagugaggccug

SEQ ID NO: 318299 - RNA, 64 nt, Homo Sapiens
uacacaaacuaaugcucguguuucccaagcaccuggaagacaugccagauccaugugcaguaau

SEQ ID NO: 318300 - RNA, 64 nt, Homo Sapiens
agcuccugaacugguggccagcccacgggguacuggaagacagugguucugauggguucagccc

SEQ ID NO: 318301 - RNA, 64 nt, Homo Sapiens
auauauaaaauauauaaaugcauaaaaaaauccuggaagacacagcaaaauguuaacagugguc

SEQ ID NO: 318302 - RNA, 64 nt, Homo Sapiens
uuccuguuugacacaggguaucuaggaggggcggggaagacauggauaguauaggaagacauua

SEQ ID NO: 318303 - RNA, 64 nt, Homo Sapiens
aucuaggaggggcggggaagacauggauaguauaggaagacauuaauccuagcauugucauuua

SEQ ID NO: 318304 - RNA, 64 nt, Homo Sapiens
agugagccgagaucgugccuuugcacuccagcguggaagacagugagacuccgucucaaaaaaa

SEQ ID NO: 318305 - RNA, 64 nt, Homo Sapiens
agugggccgggaucguacuacugcacuccagcauggaagacagcgagacuccgucuccaaaaaa

SEQ ID NO: 318306 - RNA, 64 nt, Homo Sapiens
gggggaugacagugugggagcugugggguacugaggaagacaccauuccuugacggugucuaag

SEQ ID NO: 318307 - RNA, 64 nt, Homo Sapiens
uugcagcugaggugggaguggagaaugguucccaggaagacaguuccaccucuaagguccgaaa

SEQ ID NO: 318308 - RNA, 64 nt, Homo Sapiens
gauugucuggaagauguggagacauggauuguccggaagacaugagacuuggagcuucuuggaa

SEQ ID NO: 318309 - RNA, 64 nt, Homo Sapiens
gauuguccggaagacauggaacuuggagcuucuuggaagacaugaagacuugauuuacuggaag

SEQ ID NO: 318310 - RNA, 64 nt, Homo Sapiens
gauuuccuggaagacguggaaccuugaaauuauuggaagacaugagaucuguauuugauggaag

SEQ ID NO: 318311 - RNA, 64 nt, Homo Sapiens
gauuagcuggaagaucuguaacacagauuuuucuggaagacaugagacuuggauuugguggaag

SEQ ID NO: 318312 - RNA, 64 nt, Homo Sapiens
gauuuuucuggaagacaugggacuuggauuugguggaagacacaaagaacuagauuuacuggaa

SEQ ID NO: 318313 - RNA, 64 nt, Homo Sapiens; identical to SEQ ID NO: 247878

SEQ ID NO: 318314 - RNA, 64 nt, Homo Sapiens; identical to SEQ ID NO: 247879

SEQ ID NO: 318315 - RNA, 64 nt, Homo Sapiens; identical to SEQ ID NO: 247880

SEQ ID NO: 318316 - RNA, 64 nt, Homo Sapiens; identical to SEQ ID NO: 247881

SEQ ID NO: 318317 - RNA, 64 nt, Homo Sapiens
cugcuucaagguuucuuuuguauauaauucuuagaaugcucauuucuuuuaaaugguuuaauuu

SEQ ID NO: 318318 - RNA, 64 nt, Homo Sapiens
auuaccuaauacugaguuuuugcaaaaaacaaugaaugcucauauguaauugaaauacuucaga

SEQ ID NO: 318319 - RNA, 64 nt, Homo Sapiens
acauuuuauuuuuucuugcaaauaccuccucccuaaugcucaccuuuaucaccucauucugaac

SEQ ID NO: 318320 - RNA, 64 nt, Homo Sapiens
cuuggcuuguuauugccucuacuuugauucugauaaugcucacuugguccuaccuauuauccuu

SEQ ID NO: 318321 - RNA, 64 nt, Homo Sapiens
aucugucuagaauccugcuuuacaggaucauguaaaugcucaaagauguaauguaguucuuugu

SEQ ID NO: 318322 - RNA, 64 nt, Homo Sapiens
gccaggauuuuguauugccaucgggugccaaauaaaugcucauauuuauuacugaugugugcuc

SEQ ID NO: 318323 - RNA, 64 nt, Homo Sapiens
aauauuauuuuuucuauuugguaaaacuuuugacaaugcucauucgugauuuucucaaaauauu

SEQ ID NO: 318324 - RNA, 51 nt, Homo Sapiens
cauaaaguugugguccaaugcaaugcucaacauaguuauguuuuguuuuaa

SEQ ID NO: 318325 - RNA, 64 nt, Homo Sapiens
uugaaaccuaaaucuuuucuucuacagcuaguaaaaugcucagagauaaguagaccagucaagg

SEQ ID NO: 318326 - RNA, 64 nt, Homo Sapiens
aaacaaauucccugcaguugaaaguguuaacauuaaugcucaauguaagugaauacuuaauuua

SEQ ID NO: 318327 - RNA, 64 nt, Homo Sapiens
cccugaguugccgccgagaaacuccccuacaucaaaugcucaagcaccgagugaggccauagca

SEQ ID NO: 318328 - RNA, 64 nt, Homo Sapiens
cccccagcuggaaguuaagaauuccccuacaucaaaugcucaagcaccaagugaggccauagca

SEQ ID NO: 318329 - RNA, 64 nt, Homo Sapiens
auuauauuucaugacaauggaguaaaucucuuauuuuagcaaauauaagcacucuaauuuuuaa

SEQ ID NO: 318330 - RNA, 64 nt, Homo Sapiens
acauggucaaaaaggcaaucuguuuguuuugcuauuuagcaauaauuuuuguuguuuuuguuuu

SEQ ID NO: 318331 - RNA, 64 nt, Homo Sapiens
aacugagauuuaagucucuccucaaaauacccaguuuagcaagcguagccucuuucaucccaua

SEQ ID NO: 318332 - RNA, 64 nt, Homo Sapiens
uugagcauaggcucuuuuuggguauauauggggcuuuagcaagugaggaccaugaaacauugua

SEQ ID NO: 318333 - RNA, 64 nt, Homo Sapiens
uuaggagagaauagucaugacuuuuuccugggaguuuagcaaguucccuagcaggccauuuucc

SEQ ID NO: 318334 - RNA, 64 nt, Homo Sapiens
ccaguauuccuucacuauuuaaaaaaaguaaucuuuuagcaaccugcauuuugcaaaaaaaaaa

SEQ ID NO: 318335 - RNA, 64 nt, Homo Sapiens
augcagccuccgcaagaugacauuuauucguucauuuagcaaauacccacaaacauucaccaau

SEQ ID NO: 318336 - RNA, 64 nt, Homo Sapiens
ugucuuggcccuaaugagaaacaugggguuuggcuuuagcaaccguuuugucuggaaucugggg

SEQ ID NO: 318337 - RNA, 64 nt, Homo Sapiens
uucuuucacuuggaacucuagcuaacuuccuacuuuuagcaaaaaucuugguaucucuuccucu

SEQ ID NO: 318338 - RNA, 64 nt, Homo Sapiens
ucuacuauuucuguauucacugagaccaaggcaauuuagcaaauuuaaaucacaaauggauaag

SEQ ID NO: 318339 - RNA, 64 nt, Homo Sapiens
acuugucauuuggacuuuuuuuuaaauggaguucuuuagcaacaaaguauagaaacauguucau

SEQ ID NO: 318340 - RNA, 64 nt, Homo Sapiens
uggcauugucaucgacacucaauuucaugugaauuuuagcaaaacaggaaacaaagauaaugac

SEQ ID NO: 318341 - RNA, 64 nt, Homo Sapiens
gacuggaauuuuauccuuucuacagauacauccuuuuagcaaaauuuacuucauuguuuuguac

SEQ ID NO: 318342 - RNA, 64 nt, Homo Sapiens
auaugguuuacuucauuguucuguccucuccaccuuuagcaaacuguuccauauuaaccacaga

SEQ ID NO: 318343 - RNA, 64 nt, Homo Sapiens
uuuuugaaaauuuuuuugguugugacaggcucuuuuuagcaaaauauuuuuaugcuguagcaaa

SEQ ID NO: 318344 - RNA, 64 nt, Homo Sapiens
ugcucuacauaaaaucacuaguaguuucucaaauuuuagcaauaguagacaucacuacaccgau

SEQ ID NO: 318345 - RNA, 64 nt, Homo Sapiens
ugaucauauaaaaagggaggguuacugaaagaauuuuagcaauauauugauucaggaaaaggag

SEQ ID NO: 318346 - RNA, 64 nt, Homo Sapiens
gagucuuuguaucuacuuuuuuauuaaagugaaauuuagcaauaguuaauauuaggugacauaa

SEQ ID NO: 318347 - RNA, 64 nt, Homo Sapiens
uuauuuacuauuuacugugucaaaugucuggccauuuagcaaagcaacuguguuuucauuuuuu

SEQ ID NO: 318348 - RNA, 64 nt, Homo Sapiens
acagucaguacaucaaagacacacuucauucuucuuuagcaaguaugaguuugggaaaugcuga

SEQ ID NO: 318349 - RNA, 64 nt, Homo Sapiens
uuuguaaaacuguguagcauugcaaaaaaaauuuuuuagcaauuuaaaaauuuaaaaauugaag

SEQ ID NO: 318350 - RNA, 64 nt, Homo Sapiens
aauaaccggagaacuaacauuggcucuuaaacaguuuagcaacucgaggcuuccagcugcccag

SEQ ID NO: 318351 - RNA, 64 nt, Homo Sapiens
uuaagagaucuauccaauuuugaggaaguaaggguuuagcaagguauuaucucuauuuuucaga

SEQ ID NO: 318352 - RNA, 64 nt, Homo Sapiens
cuguaaaauaaguauuaucuuaucucauucaguauuuagcaauuuaagaggaaaacaguauaag

SEQ ID NO: 318353 - RNA, 64 nt, Homo Sapiens
gaggguugcagagcagcuuauaauguaucuaacuuuuagcaaagaaucucuugcuggaguggug

SEQ ID NO: 318354 - RNA, 64 nt, Homo Sapiens
aauacuugacuauauaaacauucucauuuucuuuuuuagcaaaaaauuuuucacagcacagguc

SEQ ID NO: 318355 - RNA, 64 nt, Homo Sapiens
ugcagcccuuugagauuucuaaauacugacaguguuuagcaacagucuaaauggugcauauagg

SEQ ID NO: 318356 - RNA, 64 nt, Homo Sapiens
cgcuguaagcaggauuucacuaccucucuuaagguuuagcaaacuucuaaauagcccauuuuaa

SEQ ID NO: 318357 - RNA, 64 nt, Homo Sapiens
ugcauucaaaguggcuuuauaaaagaagauuuucuuuagcaagaauaaugaggucaugucauuu

SEQ ID NO: 318358 - RNA, 64 nt, Homo Sapiens
gaagaaaucucucccaauacccauuuauccuauuuuuagcaauaauucguuaaugauuccacuu

SEQ ID NO: 318359 - RNA, 64 nt, Homo Sapiens
uuucagaugcucauaaaaguuacuuagcuaaaauuuuagcaauuuauugcauuuugaaauaauc

SEQ ID NO: 318360 - RNA, 64 nt, Homo Sapiens
uauuaacuguucaugguguuagaguugcaaacuuuuuagcaagaaaauauggauuuccucauuu

SEQ ID NO: 318361 - RNA, 64 nt, Homo Sapiens
aaagccauauaaauguagugagugugggaaagcuuuuagcaaaggcucgaaucuuacugcccau

SEQ ID NO: 318362 - RNA, 64 nt, Homo Sapiens
aaaaguuguaugaagguggugaacaugggagacuuuuagcaaugaugcagauuuuuuuauuaga

SEQ ID NO: 318363 - RNA, 64 nt, Homo Sapiens
gaaaguguuuuuuuaauuuucuuacuuuaaguucuuuagcaaauucauuuauuccuaaguauuu

SEQ ID NO: 318364 - RNA, 64 nt, Homo Sapiens
uuauuccauucaauauggcuuucaguuauaaucauuuagcaauauguguugaaucuacaucaca

SEQ ID NO: 318365 - RNA, 64 nt, Homo Sapiens; identical to SEQ ID NO: 110836

SEQ ID NO: 318366 - RNA, 64 nt, Homo Sapiens; identical to SEQ ID NO: 110837

SEQ ID NO: 318367 - RNA, 64 nt, Homo Sapiens; identical to SEQ ID NO: 110838

SEQ ID NO: 318368 - RNA, 64 nt, Homo Sapiens; identical to SEQ ID NO: 110839

SEQ ID NO: 318369 - RNA, 64 nt, Homo Sapiens; identical to SEQ ID NO: 110840

SEQ ID NO: 318370 - RNA, 64 nt, Homo Sapiens; identical to SEQ ID NO: 110841

SEQ ID NO: 318371 - RNA, 64 nt, Homo Sapiens; identical to SEQ ID NO: 110842

SEQ ID NO: 318372 - RNA, 64 nt, Homo Sapiens; identical to SEQ ID NO: 110843

SEQ ID NO: 318373 - RNA, 64 nt, Homo Sapiens; identical to SEQ ID NO: 110844

SEQ ID NO: 318374 - RNA, 64 nt, Homo Sapiens; identical to SEQ ID NO: 110845

SEQ ID NO: 318375 - RNA, 64 nt, Homo Sapiens; identical to SEQ ID NO: 110846

SEQ ID NO: 318376 - RNA, 64 nt, Homo Sapiens; identical to SEQ ID NO: 110847

SEQ ID NO: 318377 - RNA, 64 nt, Homo Sapiens; identical to SEQ ID NO: 110848

SEQ ID NO: 318378 - RNA, 64 nt, Homo Sapiens; identical to SEQ ID NO: 110849

SEQ ID NO: 318379 - RNA, 64 nt, Homo Sapiens; identical to SEQ ID NO: 110850

SEQ ID NO: 318380 - RNA, 64 nt, Homo Sapiens; identical to SEQ ID NO: 110851

SEQ ID NO: 318381 - RNA, 64 nt, Homo Sapiens; identical to SEQ ID NO: 110852

SEQ ID NO: 318382 - RNA, 64 nt, Homo Sapiens; identical to SEQ ID NO: 110853

SEQ ID NO: 318383 - RNA, 64 nt, Homo Sapiens; identical to SEQ ID NO: 110854

SEQ ID NO: 318384 - RNA, 64 nt, Homo Sapiens; identical to SEQ ID NO: 110855

SEQ ID NO: 318385 - RNA, 64 nt, Homo Sapiens; identical to SEQ ID NO: 110856

SEQ ID NO: 318386 - RNA, 64 nt, Homo Sapiens; identical to SEQ ID NO: 110857

SEQ ID NO: 318387 - RNA, 50 nt, Homo Sapiens; identical to SEQ ID NO: 110858

SEQ ID NO: 318388 - RNA, 64 nt, Homo Sapiens; identical to SEQ ID NO: 110859

SEQ ID NO: 318389 - RNA, 64 nt, Homo Sapiens; identical to SEQ ID NO: 110860

SEQ ID NO: 318390 - RNA, 64 nt, Homo Sapiens; identical to SEQ ID NO: 110861

SEQ ID NO: 318391 - RNA, 64 nt, Homo Sapiens; identical to SEQ ID NO: 110862

SEQ ID NO: 318392 - RNA, 64 nt, Homo Sapiens; identical to SEQ ID NO: 110863

SEQ ID NO: 318393 - RNA, 64 nt, Homo Sapiens; identical to SEQ ID NO: 110864

SEQ ID NO: 318394 - RNA, 64 nt, Homo Sapiens; identical to SEQ ID NO: 110865

SEQ ID NO: 318395 - RNA, 64 nt, Homo Sapiens; identical to SEQ ID NO: 110866

SEQ ID NO: 318396 - RNA, 64 nt, Homo Sapiens; identical to SEQ ID NO: 110867

SEQ ID NO: 318397 - RNA, 61 nt, Homo Sapiens; identical to SEQ ID NO: 110868

SEQ ID NO: 318398 - RNA, 64 nt, Homo Sapiens; identical to SEQ ID NO: 110869

SEQ ID NO: 318399 - RNA, 64 nt, Homo Sapiens; identical to SEQ ID NO: 110870

SEQ ID NO: 318400 - RNA, 64 nt, Homo Sapiens; identical to SEQ ID NO: 110871

SEQ ID NO: 318401 - RNA, 64 nt, Homo Sapiens; identical to SEQ ID NO: 110872

SEQ ID NO: 318402 - RNA, 64 nt, Homo Sapiens; identical to SEQ ID NO: 110873

SEQ ID NO: 318403 - RNA, 64 nt, Homo Sapiens; identical to SEQ ID NO: 110874

SEQ ID NO: 318404 - RNA, 64 nt, Homo Sapiens; identical to SEQ ID NO: 110875

SEQ ID NO: 318405 - RNA, 64 nt, Homo Sapiens; identical to SEQ ID NO: 110876

SEQ ID NO: 318406 - RNA, 64 nt, Homo Sapiens; identical to SEQ ID NO: 110877

SEQ ID NO: 318407 - RNA, 64 nt, Homo Sapiens; identical to SEQ ID NO: 110878

SEQ ID NO: 318408 - RNA, 64 nt, Homo Sapiens; identical to SEQ ID NO: 110879

SEQ ID NO: 318409 - RNA, 64 nt, Homo Sapiens; identical to SEQ ID NO: 110880

SEQ ID NO: 318410 - RNA, 64 nt, Homo Sapiens; identical to SEQ ID NO: 110881

SEQ ID NO: 318411 - RNA, 55 nt, Homo Sapiens; identical to SEQ ID NO: 110882

SEQ ID NO: 318412 - RNA, 64 nt, Homo Sapiens; identical to SEQ ID NO: 110883

SEQ ID NO: 318413 - RNA, 64 nt, Homo Sapiens; identical to SEQ ID NO: 110884

SEQ ID NO: 318414 - RNA, 64 nt, Homo Sapiens; identical to SEQ ID NO: 110885

SEQ ID NO: 318415 - RNA, 64 nt, Homo Sapiens; identical to SEQ ID NO: 110886

SEQ ID NO: 318416 - RNA, 64 nt, Homo Sapiens; identical to SEQ ID NO: 110887

SEQ ID NO: 318417 - RNA, 64 nt, Homo Sapiens; identical to SEQ ID NO: 110888

SEQ ID NO: 318418 - RNA, 64 nt, Homo Sapiens; identical to SEQ ID NO: 110889

SEQ ID NO: 318419 - RNA, 64 nt, Homo Sapiens; identical to SEQ ID NO: 110890

SEQ ID NO: 318420 - RNA, 61 nt, Homo Sapiens; identical to SEQ ID NO: 110891

SEQ ID NO: 318421 - RNA, 64 nt, Homo Sapiens; identical to SEQ ID NO: 110892

SEQ ID NO: 318422 - RNA, 64 nt, Homo Sapiens; identical to SEQ ID NO: 110893

SEQ ID NO: 318423 - RNA, 64 nt, Homo Sapiens; identical to SEQ ID NO: 110894

SEQ ID NO: 318424 - RNA, 64 nt, Homo Sapiens; identical to SEQ ID NO: 110895

SEQ ID NO: 318425 - RNA, 64 nt, Homo Sapiens; identical to SEQ ID NO: 110896

SEQ ID NO: 318426 - RNA, 64 nt, Homo Sapiens; identical to SEQ ID NO: 110897

SEQ ID NO: 318427 - RNA, 64 nt, Homo Sapiens; identical to SEQ ID NO: 110898

SEQ ID NO: 318428 - RNA, 64 nt, Homo Sapiens; identical to SEQ ID NO: 110899

SEQ ID NO: 318429 - RNA, 64 nt, Homo Sapiens; identical to SEQ ID NO: 110900

SEQ ID NO: 318430 - RNA, 64 nt, Homo Sapiens; identical to SEQ ID NO: 110901

SEQ ID NO: 318431 - RNA, 64 nt, Homo Sapiens; identical to SEQ ID NO: 110902

SEQ ID NO: 318432 - RNA, 64 nt, Homo Sapiens; identical to SEQ ID NO: 110903

SEQ ID NO: 318433 - RNA, 64 nt, Homo Sapiens; identical to SEQ ID NO: 110904

SEQ ID NO: 318434 - RNA, 64 nt, Homo Sapiens; identical to SEQ ID NO: 110905

SEQ ID NO: 318435 - RNA, 64 nt, Homo Sapiens; identical to SEQ ID NO: 110906

SEQ ID NO: 318436 - RNA, 64 nt, Homo Sapiens; identical to SEQ ID NO: 110907

SEQ ID NO: 318437 - RNA, 64 nt, Homo Sapiens; identical to SEQ ID NO: 110908

SEQ ID NO: 318438 - RNA, 64 nt, Homo Sapiens; identical to SEQ ID NO: 110909

SEQ ID NO: 318439 - RNA, 64 nt, Homo Sapiens; identical to SEQ ID NO: 110910

SEQ ID NO: 318440 - RNA, 64 nt, Homo Sapiens; identical to SEQ ID NO: 110911

SEQ ID NO: 318441 - RNA, 64 nt, Homo Sapiens; identical to SEQ ID NO: 110912

SEQ ID NO: 318442 - RNA, 64 nt, Homo Sapiens; identical to SEQ ID NO: 110913

SEQ ID NO: 318443 - RNA, 64 nt, Homo Sapiens; identical to SEQ ID NO: 110914

SEQ ID NO: 318444 - RNA, 64 nt, Homo Sapiens; identical to SEQ ID NO: 110915

SEQ ID NO: 318445 - RNA, 64 nt, Homo Sapiens; identical to SEQ ID NO: 110916

SEQ ID NO: 318446 - RNA, 62 nt, Homo Sapiens
uguuaaauuauuuuuucuauagaaauauugugcuuacucaagguagaagucugucuuucuau

SEQ ID NO: 318447 - RNA, 62 nt, Homo Sapiens
acuaccaccuuuuccuuauauucuaauaacugcuuacucaacauagaggccaagguauucua

SEQ ID NO: 318448 - RNA, 62 nt, Homo Sapiens
uugauaaagaacuacuacaaaauacaggagaacuuacucaauaaaccucucaacacagaagg

SEQ ID NO: 318449 - RNA, 62 nt, Homo Sapiens
uuuugcuaugguuugcgugcaguagaugcagacuuacucagagaaaucgauguuaccuugcu

SEQ ID NO: 318450 - RNA, 62 nt, Homo Sapiens
gguguacguaaaacaugguaaaccuauuccaccuuacucaagguuauuaugccacagacauu

SEQ ID NO: 318451 - RNA, 62 nt, Homo Sapiens
aucagagaguucauacucaaacaugcucacaucuuacucaacacugugaaaaagccauuaau

SEQ ID NO: 318452 - RNA, 62 nt, Homo Sapiens
aucaaagaauuccuacuggucagagggcgcaucuuacucaacaauguaggaaggccuuuagg

SEQ ID NO: 318453 - RNA, 62 nt, Homo Sapiens
aucaaagaauucauaccaguaauuauccaacucuuacucaacaaugugggaagguuuuuaau

SEQ ID NO: 318454 - RNA, 64 nt, Homo Sapiens; identical to SEQ ID NO: 270805

SEQ ID NO: 318455 - RNA, 64 nt, Homo Sapiens; identical to SEQ ID NO: 270806

SEQ ID NO: 318456 - RNA, 64 nt, Homo Sapiens; identical to SEQ ID NO: 270807

SEQ ID NO: 318457 - RNA, 64 nt, Homo Sapiens; identical to SEQ ID NO: 270808

SEQ ID NO: 318458 - RNA, 64 nt, Homo Sapiens; identical to SEQ ID NO: 270809

SEQ ID NO: 318459 - RNA, 64 nt, Homo Sapiens; identical to SEQ ID NO: 270810

SEQ ID NO: 318460 - RNA, 64 nt, Homo Sapiens; identical to SEQ ID NO: 270811

SEQ ID NO: 318461 - RNA, 64 nt, Homo Sapiens; identical to SEQ ID NO: 270812

SEQ ID NO: 318462 - RNA, 64 nt, Homo Sapiens; identical to SEQ ID NO: 270813

SEQ ID NO: 318463 - RNA, 64 nt, Homo Sapiens; identical to SEQ ID NO: 270814

SEQ ID NO: 318464 - RNA, 64 nt, Homo Sapiens; identical to SEQ ID NO: 270815

SEQ ID NO: 318465 - RNA, 64 nt, Homo Sapiens; identical to SEQ ID NO: 270816

SEQ ID NO: 318466 - RNA, 64 nt, Homo Sapiens; identical to SEQ ID NO: 234057

SEQ ID NO: 318467 - RNA, 64 nt, Homo Sapiens; identical to SEQ ID NO: 234058

SEQ ID NO: 318468 - RNA, 64 nt, Homo Sapiens; identical to SEQ ID NO: 234059

SEQ ID NO: 318469 - RNA, 64 nt, Homo Sapiens; identical to SEQ ID NO: 234060

SEQ ID NO: 318470 - RNA, 64 nt, Homo Sapiens; identical to SEQ ID NO: 119680

SEQ ID NO: 318471 - RNA, 64 nt, Homo Sapiens; identical to SEQ ID NO: 119681

SEQ ID NO: 318472 - RNA, 64 nt, Homo Sapiens; identical to SEQ ID NO: 119682

SEQ ID NO: 318473 - RNA, 64 nt, Homo Sapiens; identical to SEQ ID NO: 119683

SEQ ID NO: 318474 - RNA, 64 nt, Homo Sapiens; identical to SEQ ID NO: 119684

SEQ ID NO: 318475 - RNA, 64 nt, Homo Sapiens; identical to SEQ ID NO: 119685

SEQ ID NO: 318476 - RNA, 64 nt, Homo Sapiens; identical to SEQ ID NO: 119686

SEQ ID NO: 318477 - RNA, 64 nt, Homo Sapiens; identical to SEQ ID NO: 119687

SEQ ID NO: 318478 - RNA, 64 nt, Homo Sapiens; identical to SEQ ID NO: 119688

SEQ ID NO: 318479 - RNA, 64 nt, Homo Sapiens; identical to SEQ ID NO: 119689

SEQ ID NO: 318480 - RNA, 64 nt, Homo Sapiens; identical to SEQ ID NO: 119690

SEQ ID NO: 318481 - RNA, 64 nt, Homo Sapiens; identical to SEQ ID NO: 119691

SEQ ID NO: 318482 - RNA, 64 nt, Homo Sapiens; identical to SEQ ID NO: 119692

SEQ ID NO: 318483 - RNA, 64 nt, Homo Sapiens; identical to SEQ ID NO: 119693

SEQ ID NO: 318484 - RNA, 64 nt, Homo Sapiens; identical to SEQ ID NO: 119694

SEQ ID NO: 318485 - RNA, 64 nt, Homo Sapiens; identical to SEQ ID NO: 119695

SEQ ID NO: 318486 - RNA, 64 nt, Homo Sapiens; identical to SEQ ID NO: 119696

SEQ ID NO: 318487 - RNA, 64 nt, Homo Sapiens; identical to SEQ ID NO: 119697

SEQ ID NO: 318488 - RNA, 64 nt, Homo Sapiens; identical to SEQ ID NO: 119698

SEQ ID NO: 318489 - RNA, 64 nt, Homo Sapiens; identical to SEQ ID NO: 119699

SEQ ID NO: 318490 - RNA, 64 nt, Homo Sapiens; identical to SEQ ID NO: 119700

SEQ ID NO: 318491 - RNA, 64 nt, Homo Sapiens; identical to SEQ ID NO: 119701

SEQ ID NO: 318492 - RNA, 64 nt, Homo Sapiens; identical to SEQ ID NO: 119702

SEQ ID NO: 318493 - RNA, 64 nt, Homo Sapiens; identical to SEQ ID NO: 119703

SEQ ID NO: 318494 - RNA, 64 nt, Homo Sapiens; identical to SEQ ID NO: 119704

SEQ ID NO: 318495 - RNA, 64 nt, Homo Sapiens; identical to SEQ ID NO: 119705

SEQ ID NO: 318496 - RNA, 64 nt, Homo Sapiens; identical to SEQ ID NO: 119706

SEQ ID NO: 318497 - RNA, 64 nt, Homo Sapiens; identical to SEQ ID NO: 119707

SEQ ID NO: 318498 - RNA, 64 nt, Homo Sapiens; identical to SEQ ID NO: 119708

SEQ ID NO: 318499 - RNA, 64 nt, Homo Sapiens; identical to SEQ ID NO: 119709

SEQ ID NO: 318500 - RNA, 64 nt, Homo Sapiens; identical to SEQ ID NO: 119710

SEQ ID NO: 318501 - RNA, 64 nt, Homo Sapiens; identical to SEQ ID NO: 119711

SEQ ID NO: 318502 - RNA, 64 nt, Homo Sapiens; identical to SEQ ID NO: 119712

SEQ ID NO: 318503 - RNA, 64 nt, Homo Sapiens; identical to SEQ ID NO: 119713

SEQ ID NO: 318504 - RNA, 64 nt, Homo Sapiens; identical to SEQ ID NO: 119714

SEQ ID NO: 318505 - RNA, 64 nt, Homo Sapiens; identical to SEQ ID NO: 119715

SEQ ID NO: 318506 - RNA, 64 nt, Homo Sapiens; identical to SEQ ID NO: 119716

SEQ ID NO: 318507 - RNA, 64 nt, Homo Sapiens
cguggaaccaagccagggauaagacagggccccggcuggacacaagcagccaacccugaucugg

SEQ ID NO: 318508 - RNA, 64 nt, Homo Sapiens
uggcggaagcagagguucccggcguaggaaugaggcuggacagacauccaagagacuuugcaga

SEQ ID NO: 318509 - RNA, 64 nt, Homo Sapiens
ccuacguuugugccucugcuuuuaaaggugcugugcuggacaguuggcaugccaggguucgaga

SEQ ID NO: 318510 - RNA, 64 nt, Homo Sapiens
ggagaugcuggugucuggguagucauggauuucugcuggacauuugaaugugauaaacaaucca

SEQ ID NO: 318511 - RNA, 64 nt, Homo Sapiens
accaccuucuucccugaagaguuguccaggcugugcuggacagcgccuggagccaagggaugag

SEQ ID NO: 318512 - RNA, 64 nt, Homo Sapiens
ccgcaccgugagucuggcucaucucccgcgcggugcuggacaacugcaggagcuggagccgguc

SEQ ID NO: 318513 - RNA, 64 nt, Homo Sapiens
uggcuuccugcuccccaggcaugggggcugcccagcuggacagacggggcugcaccagggaccc

SEQ ID NO: 318514 - RNA, 64 nt, Homo Sapiens
uggccggggcugcaccagggauggaguauggggcgcuggacacaauggggugcagaccccccuc

SEQ ID NO: 318515 - RNA, 64 nt, Homo Sapiens
cagagaccaugagaaggagagcccaggccagccugcuggacaagccgccucugcccgggagaaa

SEQ ID NO: 318516 - RNA, 64 nt, Homo Sapiens
ccuggaaggaggcaauaaguccagaguuuaucaugcuggacaagggaggcugugaaugcugaga

SEQ ID NO: 318517 - RNA, 64 nt, Homo Sapiens
gaggacagcaggcaaguuccacguacuggggccugcuggacagcggcuggagggugagaucaac

SEQ ID NO: 318518 - RNA, 64 nt, Homo Sapiens
gcccccacccuugaccucaacgccucaguguggagcuggacacuuucgugaacagcuuggcgac

SEQ ID NO: 318519 - RNA, 64 nt, Homo Sapiens
cauugacccaugccuacuccaugccaggcccagugcuggacacagagacaugaagcucugucug

SEQ ID NO: 318520 - RNA, 64 nt, Homo Sapiens
gucaagugucaugagcaggagaaaaggcaugggagcuggacagauuauagugguugaagucugu

SEQ ID NO: 318521 - RNA, 64 nt, Homo Sapiens
guugacaggucagaagaucaggaaagaggucggggcuggacagauggggagagcgcagauagau

SEQ ID NO: 318522 - RNA, 64 nt, Homo Sapiens
gaggcaaggccaggagugccagauagugucucgagcuggacaguagcugaggccgaugcuaagg

SEQ ID NO: 318523 - RNA, 57 nt, Homo Sapiens
ggacccuaccagccugcgggcccuggggcuggacaguccugguggaccagcaacuag

SEQ ID NO: 318524 - RNA, 64 nt, Homo Sapiens
cuacagaugucuuugauguugacaauaacaagaggcuggacacccgggggugagauucaaguag

SEQ ID NO: 318525 - RNA, 64 nt, Homo Sapiens
gggaggcgacaguccuaucuauauaccuccagcagcuggacaugcaucuguagcuacauaaccu

SEQ ID NO: 318526 - RNA, 64 nt, Homo Sapiens; identical to SEQ ID NO: 82791

SEQ ID NO: 318527 - RNA, 64 nt, Homo Sapiens; identical to SEQ ID NO: 82792

SEQ ID NO: 318528 - RNA, 64 nt, Homo Sapiens; identical to SEQ ID NO: 82793

SEQ ID NO: 318529 - RNA, 64 nt, Homo Sapiens; identical to SEQ ID NO: 82794

SEQ ID NO: 318530 - RNA, 64 nt, Homo Sapiens; identical to SEQ ID NO: 82795

SEQ ID NO: 318531 - RNA, 64 nt, Homo Sapiens; identical to SEQ ID NO: 82796

SEQ ID NO: 318532 - RNA, 64 nt, Homo Sapiens; identical to SEQ ID NO: 82797

SEQ ID NO: 318533 - RNA, 64 nt, Homo Sapiens; identical to SEQ ID NO: 82798

SEQ ID NO: 318534 - RNA, 64 nt, Homo Sapiens; identical to SEQ ID NO: 82799

SEQ ID NO: 318535 - RNA, 64 nt, Homo Sapiens; identical to SEQ ID NO: 82800

SEQ ID NO: 318536 - RNA, 64 nt, Homo Sapiens; identical to SEQ ID NO: 82801

SEQ ID NO: 318537 - RNA, 64 nt, Homo Sapiens; identical to SEQ ID NO: 82802

SEQ ID NO: 318538 - RNA, 64 nt, Homo Sapiens; identical to SEQ ID NO: 82803

SEQ ID NO: 318539 - RNA, 64 nt, Homo Sapiens; identical to SEQ ID NO: 82804

SEQ ID NO: 318540 - RNA, 64 nt, Homo Sapiens; identical to SEQ ID NO: 82805

SEQ ID NO: 318541 - RNA, 64 nt, Homo Sapiens; identical to SEQ ID NO: 82806

SEQ ID NO: 318542 - RNA, 64 nt, Homo Sapiens; identical to SEQ ID NO: 82807

SEQ ID NO: 318543 - RNA, 64 nt, Homo Sapiens; identical to SEQ ID NO: 82808

SEQ ID NO: 318544 - RNA, 64 nt, Homo Sapiens; identical to SEQ ID NO: 82809

SEQ ID NO: 318545 - RNA, 64 nt, Homo Sapiens; identical to SEQ ID NO: 82810

SEQ ID NO: 318546 - RNA, 61 nt, Homo Sapiens; identical to SEQ ID NO: 82811

SEQ ID NO: 318547 - RNA, 64 nt, Homo Sapiens; identical to SEQ ID NO: 82812

SEQ ID NO: 318548 - RNA, 64 nt, Homo Sapiens; identical to SEQ ID NO: 82813

SEQ ID NO: 318549 - RNA, 64 nt, Homo Sapiens; identical to SEQ ID NO: 82814

SEQ ID NO: 318550 - RNA, 64 nt, Homo Sapiens; identical to SEQ ID NO: 82815

SEQ ID NO: 318551 - RNA, 64 nt, Homo Sapiens; identical to SEQ ID NO: 82816

SEQ ID NO: 318552 - RNA, 64 nt, Homo Sapiens; identical to SEQ ID NO: 82817

SEQ ID NO: 318553 - RNA, 64 nt, Homo Sapiens; identical to SEQ ID NO: 82818

SEQ ID NO: 318554 - RNA, 64 nt, Homo Sapiens; identical to SEQ ID NO: 82819

SEQ ID NO: 318555 - RNA, 64 nt, Homo Sapiens; identical to SEQ ID NO: 82820

SEQ ID NO: 318556 - RNA, 64 nt, Homo Sapiens; identical to SEQ ID NO: 82821

SEQ ID NO: 318557 - RNA, 64 nt, Homo Sapiens; identical to SEQ ID NO: 82822

SEQ ID NO: 318558 - RNA, 64 nt, Homo Sapiens; identical to SEQ ID NO: 82823

SEQ ID NO: 318559 - RNA, 64 nt, Homo Sapiens; identical to SEQ ID NO: 82824

SEQ ID NO: 318560 - RNA, 64 nt, Homo Sapiens; identical to SEQ ID NO: 82825

SEQ ID NO: 318561 - RNA, 64 nt, Homo Sapiens; identical to SEQ ID NO: 82826

SEQ ID NO: 318562 - RNA, 64 nt, Homo Sapiens; identical to SEQ ID NO: 82827

SEQ ID NO: 318563 - RNA, 64 nt, Homo Sapiens; identical to SEQ ID NO: 82828

SEQ ID NO: 318564 - RNA, 64 nt, Homo Sapiens; identical to SEQ ID NO: 82829

SEQ ID NO: 318565 - RNA, 64 nt, Homo Sapiens; identical to SEQ ID NO: 82830

SEQ ID NO: 318566 - RNA, 64 nt, Homo Sapiens; identical to SEQ ID NO: 82831

SEQ ID NO: 318567 - RNA, 64 nt, Homo Sapiens; identical to SEQ ID NO: 82832

SEQ ID NO: 318568 - RNA, 64 nt, Homo Sapiens; identical to SEQ ID NO: 82833

SEQ ID NO: 318569 - RNA, 64 nt, Homo Sapiens; identical to SEQ ID NO: 82834

SEQ ID NO: 318570 - RNA, 64 nt, Homo Sapiens; identical to SEQ ID NO: 82835

SEQ ID NO: 318571 - RNA, 64 nt, Homo Sapiens; identical to SEQ ID NO: 82836

SEQ ID NO: 318572 - RNA, 64 nt, Homo Sapiens; identical to SEQ ID NO: 82837

SEQ ID NO: 318573 - RNA, 64 nt, Homo Sapiens; identical to SEQ ID NO: 82838

SEQ ID NO: 318574 - RNA, 64 nt, Homo Sapiens; identical to SEQ ID NO: 82839

SEQ ID NO: 318575 - RNA, 64 nt, Homo Sapiens; identical to SEQ ID NO: 82840

SEQ ID NO: 318576 - RNA, 64 nt, Homo Sapiens
gcuuccucaccuugagaguaaagugcugcccucugcccccaacacacacacauaucaauuccug

SEQ ID NO: 318577 - RNA, 64 nt, Homo Sapiens
uccugcuggccuugggcuggagccuaggaaaguggcccccaaauccuuagugagcuaaagcugg

SEQ ID NO: 318578 - RNA, 64 nt, Homo Sapiens
aaagaccugucuauggcucugguuccccagauaggcccccaaauaaaagagcccuggagcauca

SEQ ID NO: 318579 - RNA, 64 nt, Homo Sapiens
accuccguugaacauucugucugacaucuccacugcccccaaaggaggagaucagaaaaucccu

SEQ ID NO: 318580 - RNA, 64 nt, Homo Sapiens
gucgaagaauuuucuucuugccaaaugucgaccagcccccaaauuuucaguggaacccuugccc

SEQ ID NO: 318581 - RNA, 64 nt, Homo Sapiens
gucgaccagcccccaaauguucaguggaacccuugcccccaaaugcgugaauuugggggauuuu

SEQ ID NO: 318582 - RNA, 64 nt, Homo Sapiens
gcgucuggcuccccuacuaagccccugcccugcugcccccaacacccccaacuccccgggcccg

SEQ ID NO: 318583 - RNA, 64 nt, Homo Sapiens
ccccgggcccggccccugccacccgcuacugccugcccccaacuccuccccugcagcgacucgg

SEQ ID NO: 318584 - RNA, 64 nt, Homo Sapiens
cuguggcgcauccagauuguuucccccaccccaugcccccaauucaguguccccugccccccuc

SEQ ID NO: 318585 - RNA, 64 nt, Homo Sapiens
uuucuuccccccacacuucuugccacgggagggggcccccaaacgaggguacagucccuuaacc

SEQ ID NO: 318586 - RNA, 64 nt, Homo Sapiens
gccccuccgcagccccuucccuugcucggggaaagcccccaauucugcccacacccauuuauuu

SEQ ID NO: 318587 - RNA, 64 nt, Homo Sapiens
cuuuucuuuccuuccuuccuucuuuuuuguuuuugcccccaauucugcccauacccauuucuuu

SEQ ID NO: 318588 - RNA, 64 nt, Homo Sapiens
ccuccuuccccagacccagaacucagagguccaggcccccaacccccaaccccuccucccucag

SEQ ID NO: 318589 - RNA, 64 nt, Homo Sapiens
ccuccucccucagacucagaacccagggguccaggcccccaacccccagccccuccucccucag

SEQ ID NO: 318590 - RNA, 64 nt, Homo Sapiens
acaaguuccagcuggucuuuugggaguggccccugcccccaaagguggucugcuuuugcugggg

SEQ ID NO: 318591 - RNA, 64 nt, Homo Sapiens
gucauccaugcgugcacauaugggugcuggcagagcccccaaggacucuggccucucgaguucu

SEQ ID NO: 318592 - RNA, 64 nt, Homo Sapiens
gaaacugagguucaggagacggcgacugggcugagcccccaaguaacaacgagcagaaggcccu

SEQ ID NO: 318593 - RNA, 64 nt, Homo Sapiens
ggccucccugagaugaaccucagauccaggaccugcccccaacuugggcuucagguaccuaaaa

SEQ ID NO: 318594 - RNA, 64 nt, Homo Sapiens
cccugccccuggcaagcccugaagucgggagaggugaccacaggucugaaaaucagccagugcc

SEQ ID NO: 318595 - RNA, 64 nt, Homo Sapiens
caacugagcccacauagcgcauucauaguuucccugaccacagccuugggaagacgguggaaac

SEQ ID NO: 318596 - RNA, 64 nt, Homo Sapiens
accacauccacucucaaccccguccccuucgcacugaccacacccaccccguucggccccgccc

SEQ ID NO: 318597 - RNA, 64 nt, Homo Sapiens
acccucaacccauugcgcccaguccccaccacagugaccacacccucacuggcucggcccugcc

SEQ ID NO: 318598 - RNA, 64 nt, Homo Sapiens
cuuucuuaguaauuuggcuucaaagacaaauuuuugaccacaccuccguuuucuccgucagacu

SEQ ID NO: 318599 - RNA, 64 nt, Homo Sapiens
ccccuuccccauuaaugugaguaaugaauuagccugaccacagguggucacuguaggcuaaugg

SEQ ID NO: 318600 - RNA, 64 nt, Homo Sapiens; identical to SEQ ID NO: 228081

SEQ ID NO: 318601 - RNA, 64 nt, Homo Sapiens; identical to SEQ ID NO: 228082

SEQ ID NO: 318602 - RNA, 64 nt, Homo Sapiens; identical to SEQ ID NO: 228083

SEQ ID NO: 318603 - RNA, 64 nt, Homo Sapiens; identical to SEQ ID NO: 228084

SEQ ID NO: 318604 - RNA, 64 nt, Homo Sapiens; identical to SEQ ID NO: 228085

SEQ ID NO: 318605 - RNA, 64 nt, Homo Sapiens; identical to SEQ ID NO: 228086

SEQ ID NO: 318606 - RNA, 64 nt, Homo Sapiens; identical to SEQ ID NO: 228087

SEQ ID NO: 318607 - RNA, 64 nt, Homo Sapiens; identical to SEQ ID NO: 228088

SEQ ID NO: 318608 - RNA, 64 nt, Homo Sapiens; identical to SEQ ID NO: 228089

SEQ ID NO: 318609 - RNA, 64 nt, Homo Sapiens; identical to SEQ ID NO: 228090

SEQ ID NO: 318610 - RNA, 64 nt, Homo Sapiens; identical to SEQ ID NO: 228091

SEQ ID NO: 318611 - RNA, 64 nt, Homo Sapiens; identical to SEQ ID NO: 228092

SEQ ID NO: 318612 - RNA, 64 nt, Homo Sapiens; identical to SEQ ID NO: 228093

SEQ ID NO: 318613 - RNA, 64 nt, Homo Sapiens; identical to SEQ ID NO: 228094

SEQ ID NO: 318614 - RNA, 64 nt, Homo Sapiens; identical to SEQ ID NO: 228095

SEQ ID NO: 318615 - RNA, 64 nt, Homo Sapiens; identical to SEQ ID NO: 228096

SEQ ID NO: 318616 - RNA, 64 nt, Homo Sapiens; identical to SEQ ID NO: 228097

SEQ ID NO: 318617 - RNA, 64 nt, Homo Sapiens; identical to SEQ ID NO: 228098

SEQ ID NO: 318618 - RNA, 64 nt, Homo Sapiens; identical to SEQ ID NO: 228099

SEQ ID NO: 318619 - RNA, 64 nt, Homo Sapiens; identical to SEQ ID NO: 228100

SEQ ID NO: 318620 - RNA, 64 nt, Homo Sapiens; identical to SEQ ID NO: 228101

SEQ ID NO: 318621 - RNA, 64 nt, Homo Sapiens; identical to SEQ ID NO: 228102

SEQ ID NO: 318622 - RNA, 64 nt, Homo Sapiens; identical to SEQ ID NO: 228103

SEQ ID NO: 318623 - RNA, 64 nt, Homo Sapiens; identical to SEQ ID NO: 228104

SEQ ID NO: 318624 - RNA, 64 nt, Homo Sapiens; identical to SEQ ID NO: 228105

SEQ ID NO: 318625 - RNA, 64 nt, Homo Sapiens; identical to SEQ ID NO: 228106

SEQ ID NO: 318626 - RNA, 64 nt, Homo Sapiens; identical to SEQ ID NO: 228107

SEQ ID NO: 318627 - RNA, 64 nt, Homo Sapiens; identical to SEQ ID NO: 228108

SEQ ID NO: 318628 - RNA, 64 nt, Homo Sapiens; identical to SEQ ID NO: 228109

SEQ ID NO: 318629 - RNA, 64 nt, Homo Sapiens; identical to SEQ ID NO: 228110

SEQ ID NO: 318630 - RNA, 64 nt, Homo Sapiens; identical to SEQ ID NO: 228111

SEQ ID NO: 318631 - RNA, 64 nt, Homo Sapiens; identical to SEQ ID NO: 228112

SEQ ID NO: 318632 - RNA, 64 nt, Homo Sapiens; identical to SEQ ID NO: 228113

SEQ ID NO: 318633 - RNA, 64 nt, Homo Sapiens; identical to SEQ ID NO: 228114

SEQ ID NO: 318634 - RNA, 64 nt, Homo Sapiens; identical to SEQ ID NO: 228115

SEQ ID NO: 318635 - RNA, 64 nt, Homo Sapiens; identical to SEQ ID NO: 228116

SEQ ID NO: 318636 - RNA, 64 nt, Homo Sapiens; identical to SEQ ID NO: 228117

SEQ ID NO: 318637 - RNA, 64 nt, Homo Sapiens; identical to SEQ ID NO: 228118

SEQ ID NO: 318638 - RNA, 64 nt, Homo Sapiens; identical to SEQ ID NO: 228119

SEQ ID NO: 318639 - RNA, 64 nt, Homo Sapiens; identical to SEQ ID NO: 228120

SEQ ID NO: 318640 - RNA, 64 nt, Homo Sapiens; identical to SEQ ID NO: 228121

SEQ ID NO: 318641 - RNA, 64 nt, Homo Sapiens; identical to SEQ ID NO: 228122

SEQ ID NO: 318642 - RNA, 64 nt, Homo Sapiens; identical to SEQ ID NO: 228123

SEQ ID NO: 318643 - RNA, 64 nt, Homo Sapiens; identical to SEQ ID NO: 228124

SEQ ID NO: 318644 - RNA, 64 nt, Homo Sapiens; identical to SEQ ID NO: 228125

SEQ ID NO: 318645 - RNA, 64 nt, Homo Sapiens; identical to SEQ ID NO: 228126

SEQ ID NO: 318646 - RNA, 64 nt, Homo Sapiens; identical to SEQ ID NO: 228127

SEQ ID NO: 318647 - RNA, 64 nt, Homo Sapiens; identical to SEQ ID NO: 228128

SEQ ID NO: 318648 - RNA, 64 nt, Homo Sapiens; identical to SEQ ID NO: 228129

SEQ ID NO: 318649 - RNA, 64 nt, Homo Sapiens; identical to SEQ ID NO: 228130

SEQ ID NO: 318650 - RNA, 64 nt, Homo Sapiens; identical to SEQ ID NO: 228131

SEQ ID NO: 318651 - RNA, 64 nt, Homo Sapiens; identical to SEQ ID NO: 228132

SEQ ID NO: 318652 - RNA, 64 nt, Homo Sapiens; identical to SEQ ID NO: 228133

SEQ ID NO: 318653 - RNA, 64 nt, Homo Sapiens; identical to SEQ ID NO: 228134

SEQ ID NO: 318654 - RNA, 64 nt, Homo Sapiens; identical to SEQ ID NO: 228135

SEQ ID NO: 318655 - RNA, 64 nt, Homo Sapiens; identical to SEQ ID NO: 228136

SEQ ID NO: 318656 - RNA, 64 nt, Homo Sapiens; identical to SEQ ID NO: 228137

SEQ ID NO: 318657 - RNA, 64 nt, Homo Sapiens; identical to SEQ ID NO: 228138

SEQ ID NO: 318658 - RNA, 64 nt, Homo Sapiens; identical to SEQ ID NO: 228139

SEQ ID NO: 318659 - RNA, 64 nt, Homo Sapiens; identical to SEQ ID NO: 228140

SEQ ID NO: 318660 - RNA, 64 nt, Homo Sapiens; identical to SEQ ID NO: 228141

SEQ ID NO: 318661 - RNA, 64 nt, Homo Sapiens; identical to SEQ ID NO: 228142

SEQ ID NO: 318662 - RNA, 64 nt, Homo Sapiens; identical to SEQ ID NO: 228143

SEQ ID NO: 318663 - RNA, 64 nt, Homo Sapiens; identical to SEQ ID NO: 228144

SEQ ID NO: 318664 - RNA, 64 nt, Homo Sapiens; identical to SEQ ID NO: 228145

SEQ ID NO: 318665 - RNA, 64 nt, Homo Sapiens; identical to SEQ ID NO: 228146

SEQ ID NO: 318666 - RNA, 64 nt, Homo Sapiens; identical to SEQ ID NO: 228147

SEQ ID NO: 318667 - RNA, 64 nt, Homo Sapiens; identical to SEQ ID NO: 228148

SEQ ID NO: 318668 - RNA, 64 nt, Homo Sapiens; identical to SEQ ID NO: 228149

SEQ ID NO: 318669 - RNA, 64 nt, Homo Sapiens; identical to SEQ ID NO: 228150

SEQ ID NO: 318670 - RNA, 64 nt, Homo Sapiens; identical to SEQ ID NO: 228151

SEQ ID NO: 318671 - RNA, 64 nt, Homo Sapiens; identical to SEQ ID NO: 228152

SEQ ID NO: 318672 - RNA, 64 nt, Homo Sapiens; identical to SEQ ID NO: 228153

SEQ ID NO: 318673 - RNA, 64 nt, Homo Sapiens; identical to SEQ ID NO: 228154

SEQ ID NO: 318674 - RNA, 64 nt, Homo Sapiens; identical to SEQ ID NO: 228155

SEQ ID NO: 318675 - RNA, 64 nt, Homo Sapiens; identical to SEQ ID NO: 228156

SEQ ID NO: 318676 - RNA, 64 nt, Homo Sapiens; identical to SEQ ID NO: 228157

SEQ ID NO: 318677 - RNA, 64 nt, Homo Sapiens; identical to SEQ ID NO: 228158

SEQ ID NO: 318678 - RNA, 64 nt, Homo Sapiens; identical to SEQ ID NO: 228159

SEQ ID NO: 318679 - RNA, 64 nt, Homo Sapiens; identical to SEQ ID NO: 228160

SEQ ID NO: 318680 - RNA, 64 nt, Homo Sapiens; identical to SEQ ID NO: 228161

SEQ ID NO: 318681 - RNA, 64 nt, Homo Sapiens; identical to SEQ ID NO: 228162

SEQ ID NO: 318682 - RNA, 64 nt, Homo Sapiens; identical to SEQ ID NO: 228163

SEQ ID NO: 318683 - RNA, 64 nt, Homo Sapiens; identical to SEQ ID NO: 228164

SEQ ID NO: 318684 - RNA, 64 nt, Homo Sapiens; identical to SEQ ID NO: 228165

SEQ ID NO: 318685 - RNA, 64 nt, Homo Sapiens; identical to SEQ ID NO: 228166

SEQ ID NO: 318686 - RNA, 64 nt, Homo Sapiens; identical to SEQ ID NO: 228167

SEQ ID NO: 318687 - RNA, 64 nt, Homo Sapiens; identical to SEQ ID NO: 228168

SEQ ID NO: 318688 - RNA, 52 nt, Homo Sapiens; identical to SEQ ID NO: 228169

SEQ ID NO: 318689 - RNA, 64 nt, Homo Sapiens; identical to SEQ ID NO: 228170

SEQ ID NO: 318690 - RNA, 64 nt, Homo Sapiens; identical to SEQ ID NO: 228171

SEQ ID NO: 318691 - RNA, 64 nt, Homo Sapiens; identical to SEQ ID NO: 228172

SEQ ID NO: 318692 - RNA, 64 nt, Homo Sapiens; identical to SEQ ID NO: 228173

SEQ ID NO: 318693 - RNA, 64 nt, Homo Sapiens; identical to SEQ ID NO: 228174

SEQ ID NO: 318694 - RNA, 64 nt, Homo Sapiens; identical to SEQ ID NO: 228175

SEQ ID NO: 318695 - RNA, 64 nt, Homo Sapiens; identical to SEQ ID NO: 228176

SEQ ID NO: 318696 - RNA, 64 nt, Homo Sapiens; identical to SEQ ID NO: 228177

SEQ ID NO: 318697 - RNA, 64 nt, Homo Sapiens; identical to SEQ ID NO: 228178

SEQ ID NO: 318698 - RNA, 64 nt, Homo Sapiens; identical to SEQ ID NO: 228179

SEQ ID NO: 318699 - RNA, 64 nt, Homo Sapiens; identical to SEQ ID NO: 228180

SEQ ID NO: 318700 - RNA, 64 nt, Homo Sapiens; identical to SEQ ID NO: 228181

SEQ ID NO: 318701 - RNA, 64 nt, Homo Sapiens; identical to SEQ ID NO: 228182

SEQ ID NO: 318702 - RNA, 64 nt, Homo Sapiens; identical to SEQ ID NO: 228183

SEQ ID NO: 318703 - RNA, 64 nt, Homo Sapiens; identical to SEQ ID NO: 228184

SEQ ID NO: 318704 - RNA, 64 nt, Homo Sapiens; identical to SEQ ID NO: 228185

SEQ ID NO: 318705 - RNA, 64 nt, Homo Sapiens; identical to SEQ ID NO: 228186

SEQ ID NO: 318706 - RNA, 64 nt, Homo Sapiens; identical to SEQ ID NO: 228187

SEQ ID NO: 318707 - RNA, 64 nt, Homo Sapiens; identical to SEQ ID NO: 228188

SEQ ID NO: 318708 - RNA, 64 nt, Homo Sapiens; identical to SEQ ID NO: 228189

SEQ ID NO: 318709 - RNA, 64 nt, Homo Sapiens; identical to SEQ ID NO: 228190

SEQ ID NO: 318710 - RNA, 64 nt, Homo Sapiens; identical to SEQ ID NO: 228191

SEQ ID NO: 318711 - RNA, 64 nt, Homo Sapiens; identical to SEQ ID NO: 228192

SEQ ID NO: 318712 - RNA, 64 nt, Homo Sapiens; identical to SEQ ID NO: 228193

SEQ ID NO: 318713 - RNA, 64 nt, Homo Sapiens; identical to SEQ ID NO: 228194

SEQ ID NO: 318714 - RNA, 64 nt, Homo Sapiens; identical to SEQ ID NO: 228195

SEQ ID NO: 318715 - RNA, 64 nt, Homo Sapiens; identical to SEQ ID NO: 228196

SEQ ID NO: 318716 - RNA, 64 nt, Homo Sapiens; identical to SEQ ID NO: 228197

SEQ ID NO: 318717 - RNA, 64 nt, Homo Sapiens; identical to SEQ ID NO: 228198

SEQ ID NO: 318718 - RNA, 64 nt, Homo Sapiens; identical to SEQ ID NO: 228199

SEQ ID NO: 318719 - RNA, 64 nt, Homo Sapiens; identical to SEQ ID NO: 228200

SEQ ID NO: 318720 - RNA, 64 nt, Homo Sapiens; identical to SEQ ID NO: 228201

SEQ ID NO: 318721 - RNA, 64 nt, Homo Sapiens; identical to SEQ ID NO: 228202

SEQ ID NO: 318722 - RNA, 64 nt, Homo Sapiens; identical to SEQ ID NO: 228203

SEQ ID NO: 318723 - RNA, 64 nt, Homo Sapiens; identical to SEQ ID NO: 228204

SEQ ID NO: 318724 - RNA, 64 nt, Homo Sapiens; identical to SEQ ID NO: 228205

SEQ ID NO: 318725 - RNA, 64 nt, Homo Sapiens; identical to SEQ ID NO: 228206

SEQ ID NO: 318726 - RNA, 64 nt, Homo Sapiens; identical to SEQ ID NO: 228207

SEQ ID NO: 318727 - RNA, 64 nt, Homo Sapiens; identical to SEQ ID NO: 228208

SEQ ID NO: 318728 - RNA, 64 nt, Homo Sapiens; identical to SEQ ID NO: 228209

SEQ ID NO: 318729 - RNA, 64 nt, Homo Sapiens; identical to SEQ ID NO: 228210

SEQ ID NO: 318730 - RNA, 64 nt, Homo Sapiens; identical to SEQ ID NO: 228211

SEQ ID NO: 318731 - RNA, 64 nt, Homo Sapiens; identical to SEQ ID NO: 228212

SEQ ID NO: 318732 - RNA, 64 nt, Homo Sapiens; identical to SEQ ID NO: 228213

SEQ ID NO: 318733 - RNA, 64 nt, Homo Sapiens; identical to SEQ ID NO: 228214

SEQ ID NO: 318734 - RNA, 64 nt, Homo Sapiens; identical to SEQ ID NO: 228215

SEQ ID NO: 318735 - RNA, 64 nt, Homo Sapiens; identical to SEQ ID NO: 228216

SEQ ID NO: 318736 - RNA, 64 nt, Homo Sapiens; identical to SEQ ID NO: 228217

SEQ ID NO: 318737 - RNA, 64 nt, Homo Sapiens; identical to SEQ ID NO: 228218

SEQ ID NO: 318738 - RNA, 64 nt, Homo Sapiens; identical to SEQ ID NO: 228219

SEQ ID NO: 318739 - RNA, 64 nt, Homo Sapiens; identical to SEQ ID NO: 49894

SEQ ID NO: 318740 - RNA, 64 nt, Homo Sapiens; identical to SEQ ID NO: 49895

SEQ ID NO: 318741 - RNA, 64 nt, Homo Sapiens; identical to SEQ ID NO: 49896

SEQ ID NO: 318742 - RNA, 64 nt, Homo Sapiens; identical to SEQ ID NO: 49897

SEQ ID NO: 318743 - RNA, 64 nt, Homo Sapiens; identical to SEQ ID NO: 49898

SEQ ID NO: 318744 - RNA, 64 nt, Homo Sapiens; identical to SEQ ID NO: 49899

SEQ ID NO: 318745 - RNA, 64 nt, Homo Sapiens; identical to SEQ ID NO: 49900

SEQ ID NO: 318746 - RNA, 64 nt, Homo Sapiens; identical to SEQ ID NO: 49901

SEQ ID NO: 318747 - RNA, 64 nt, Homo Sapiens; identical to SEQ ID NO: 49902

SEQ ID NO: 318748 - RNA, 64 nt, Homo Sapiens; identical to SEQ ID NO: 49903

SEQ ID NO: 318749 - RNA, 64 nt, Homo Sapiens; identical to SEQ ID NO: 49904

SEQ ID NO: 318750 - RNA, 64 nt, Homo Sapiens; identical to SEQ ID NO: 49905

SEQ ID NO: 318751 - RNA, 64 nt, Homo Sapiens; identical to SEQ ID NO: 49906

SEQ ID NO: 318752 - RNA, 64 nt, Homo Sapiens; identical to SEQ ID NO: 49907

SEQ ID NO: 318753 - RNA, 64 nt, Homo Sapiens; identical to SEQ ID NO: 49908

SEQ ID NO: 318754 - RNA, 64 nt, Homo Sapiens; identical to SEQ ID NO: 49909

SEQ ID NO: 318755 - RNA, 64 nt, Homo Sapiens; identical to SEQ ID NO: 49910

SEQ ID NO: 318756 - RNA, 64 nt, Homo Sapiens; identical to SEQ ID NO: 49911

SEQ ID NO: 318757 - RNA, 64 nt, Homo Sapiens; identical to SEQ ID NO: 49912

SEQ ID NO: 318758 - RNA, 64 nt, Homo Sapiens; identical to SEQ ID NO: 49913

SEQ ID NO: 318759 - RNA, 64 nt, Homo Sapiens; identical to SEQ ID NO: 49914

SEQ ID NO: 318760 - RNA, 64 nt, Homo Sapiens; identical to SEQ ID NO: 49915

SEQ ID NO: 318761 - RNA, 64 nt, Homo Sapiens; identical to SEQ ID NO: 49916

SEQ ID NO: 318762 - RNA, 64 nt, Homo Sapiens; identical to SEQ ID NO: 49917

SEQ ID NO: 318763 - RNA, 64 nt, Homo Sapiens; identical to SEQ ID NO: 49918

SEQ ID NO: 318764 - RNA, 64 nt, Homo Sapiens; identical to SEQ ID NO: 49919

SEQ ID NO: 318765 - RNA, 64 nt, Homo Sapiens; identical to SEQ ID NO: 49920

SEQ ID NO: 318766 - RNA, 64 nt, Homo Sapiens; identical to SEQ ID NO: 49921

SEQ ID NO: 318767 - RNA, 52 nt, Homo Sapiens; identical to SEQ ID NO: 49922

SEQ ID NO: 318768 - RNA, 64 nt, Homo Sapiens; identical to SEQ ID NO: 49923

SEQ ID NO: 318769 - RNA, 64 nt, Homo Sapiens; identical to SEQ ID NO: 49924

SEQ ID NO: 318770 - RNA, 64 nt, Homo Sapiens; identical to SEQ ID NO: 49925

SEQ ID NO: 318771 - RNA, 64 nt, Homo Sapiens; identical to SEQ ID NO: 49926

SEQ ID NO: 318772 - RNA, 64 nt, Homo Sapiens; identical to SEQ ID NO: 49927

SEQ ID NO: 318773 - RNA, 64 nt, Homo Sapiens; identical to SEQ ID NO: 49928

SEQ ID NO: 318774 - RNA, 64 nt, Homo Sapiens; identical to SEQ ID NO: 49929

SEQ ID NO: 318775 - RNA, 64 nt, Homo Sapiens; identical to SEQ ID NO: 49930

SEQ ID NO: 318776 - RNA, 64 nt, Homo Sapiens; identical to SEQ ID NO: 49931

SEQ ID NO: 318777 - RNA, 64 nt, Homo Sapiens; identical to SEQ ID NO: 49932

SEQ ID NO: 318778 - RNA, 64 nt, Homo Sapiens; identical to SEQ ID NO: 49933

SEQ ID NO: 318779 - RNA, 64 nt, Homo Sapiens; identical to SEQ ID NO: 49934

SEQ ID NO: 318780 - RNA, 64 nt, Homo Sapiens; identical to SEQ ID NO: 146929

SEQ ID NO: 318781 - RNA, 64 nt, Homo Sapiens; identical to SEQ ID NO: 146930

SEQ ID NO: 318782 - RNA, 64 nt, Homo Sapiens; identical to SEQ ID NO: 146931

SEQ ID NO: 318783 - RNA, 64 nt, Homo Sapiens; identical to SEQ ID NO: 146932

SEQ ID NO: 318784 - RNA, 64 nt, Homo Sapiens; identical to SEQ ID NO: 146933

SEQ ID NO: 318785 - RNA, 64 nt, Homo Sapiens; identical to SEQ ID NO: 146934

SEQ ID NO: 318786 - RNA, 64 nt, Homo Sapiens
ccccgccuaggacagggucaaucgaggaaugccagaugugcacgguuuuuggcaaaguaggggg

SEQ ID NO: 318787 - RNA, 64 nt, Homo Sapiens
ucugccaucgaucgcagauuucuguagaaacacggaugugcaugugcagauucccuuuugcagg

SEQ ID NO: 318788 - RNA, 64 nt, Homo Sapiens
ugagaaaacuagaggacugaaaaaucaaguagcugaugugcaguccaaacacauauucauaaaa

SEQ ID NO: 318789 - RNA, 64 nt, Homo Sapiens
gggcauaaaagcaaaucaacuguucuaccugcaagaugugcagaacuuucccucagcugacugg

SEQ ID NO: 318790 - RNA, 64 nt, Homo Sapiens
guguguguguguggugugucugguguuuguguaugaugugcagucugagugguggguggugggg

SEQ ID NO: 318791 - RNA, 64 nt, Homo Sapiens
aaguuuuuaugcaauaagccauuuuggaccucuggaugugcagcguuuuuuaagugccggguga

SEQ ID NO: 318792 - RNA, 64 nt, Homo Sapiens
ugcauguccucugcuugcccggcugcagagcagagaugugcagcccucuggucagcugguccag

SEQ ID NO: 318793 - RNA, 64 nt, Homo Sapiens
ccaccuggcugacaggaagaauuucugagagcuggaugugcaugcccuguggacgaagguacag

SEQ ID NO: 318794 - RNA, 64 nt, Homo Sapiens
cagugagagaaggcuugauguguauaaaagacgugaugugcaccaccucgaucucgguguuuca

SEQ ID NO: 318795 - RNA, 64 nt, Homo Sapiens
gguggcugugaggugaccccagacacugcagaacgaugugcacccucugcguuuuggauguccu

SEQ ID NO: 318796 - RNA, 64 nt, Homo Sapiens
uccccgaggugcagcugccgagauggcugugcccgaugugcaccaaaacuccccaaggugccug

SEQ ID NO: 318797 - RNA, 64 nt, Homo Sapiens
ucccagaggugcagcugcccaaauggccgugcccgaugugcaccgaaacuccccaaggugccug

SEQ ID NO: 318798 - RNA, 64 nt, Homo Sapiens
ucccggaagugcagcucccgagauggcugugcccgaugugcaccgaaacucccgaaggugcccg

SEQ ID NO: 318799 - RNA, 64 nt, Homo Sapiens
ucccagaagugcagcuuccaagauggccgugcccgaugugcaccgcaacucccgaaggugcccg

SEQ ID NO: 318800 - RNA, 64 nt, Homo Sapiens; identical to SEQ ID NO: 227757

SEQ ID NO: 318801 - RNA, 64 nt, Homo Sapiens; identical to SEQ ID NO: 227758

SEQ ID NO: 318802 - RNA, 64 nt, Homo Sapiens; identical to SEQ ID NO: 227759

SEQ ID NO: 318803 - RNA, 64 nt, Homo Sapiens; identical to SEQ ID NO: 227760

SEQ ID NO: 318804 - RNA, 64 nt, Homo Sapiens; identical to SEQ ID NO: 227761

SEQ ID NO: 318805 - RNA, 64 nt, Homo Sapiens; identical to SEQ ID NO: 227762

SEQ ID NO: 318806 - RNA, 64 nt, Homo Sapiens; identical to SEQ ID NO: 227763

SEQ ID NO: 318807 - RNA, 64 nt, Homo Sapiens; identical to SEQ ID NO: 227764

SEQ ID NO: 318808 - RNA, 64 nt, Homo Sapiens; identical to SEQ ID NO: 227765

SEQ ID NO: 318809 - RNA, 64 nt, Homo Sapiens; identical to SEQ ID NO: 227766

SEQ ID NO: 318810 - RNA, 64 nt, Homo Sapiens; identical to SEQ ID NO: 318786

SEQ ID NO: 318811 - RNA, 64 nt, Homo Sapiens; identical to SEQ ID NO: 318787

SEQ ID NO: 318812 - RNA, 64 nt, Homo Sapiens; identical to SEQ ID NO: 318788

SEQ ID NO: 318813 - RNA, 64 nt, Homo Sapiens; identical to SEQ ID NO: 318789

SEQ ID NO: 318814 - RNA, 64 nt, Homo Sapiens; identical to SEQ ID NO: 318790

SEQ ID NO: 318815 - RNA, 64 nt, Homo Sapiens; identical to SEQ ID NO: 318791

SEQ ID NO: 318816 - RNA, 64 nt, Homo Sapiens; identical to SEQ ID NO: 318792

SEQ ID NO: 318817 - RNA, 64 nt, Homo Sapiens; identical to SEQ ID NO: 318793

SEQ ID NO: 318818 - RNA, 64 nt, Homo Sapiens; identical to SEQ ID NO: 318794

SEQ ID NO: 318819 - RNA, 64 nt, Homo Sapiens; identical to SEQ ID NO: 318795

SEQ ID NO: 318820 - RNA, 64 nt, Homo Sapiens; identical to SEQ ID NO: 318796

SEQ ID NO: 318821 - RNA, 64 nt, Homo Sapiens; identical to SEQ ID NO: 318797

SEQ ID NO: 318822 - RNA, 64 nt, Homo Sapiens; identical to SEQ ID NO: 318798

SEQ ID NO: 318823 - RNA, 64 nt, Homo Sapiens; identical to SEQ ID NO: 318799

SEQ ID NO: 318824 - RNA, 64 nt, Homo Sapiens; identical to SEQ ID NO: 227757

SEQ ID NO: 318825 - RNA, 64 nt, Homo Sapiens; identical to SEQ ID NO: 227758

SEQ ID NO: 318826 - RNA, 64 nt, Homo Sapiens; identical to SEQ ID NO: 227759

SEQ ID NO: 318827 - RNA, 64 nt, Homo Sapiens; identical to SEQ ID NO: 227760

SEQ ID NO: 318828 - RNA, 64 nt, Homo Sapiens; identical to SEQ ID NO: 227761

SEQ ID NO: 318829 - RNA, 64 nt, Homo Sapiens; identical to SEQ ID NO: 227762

SEQ ID NO: 318830 - RNA, 64 nt, Homo Sapiens; identical to SEQ ID NO: 227763

SEQ ID NO: 318831 - RNA, 64 nt, Homo Sapiens; identical to SEQ ID NO: 227764

SEQ ID NO: 318832 - RNA, 64 nt, Homo Sapiens; identical to SEQ ID NO: 227765

SEQ ID NO: 318833 - RNA, 64 nt, Homo Sapiens; identical to SEQ ID NO: 227766

SEQ ID NO: 318834 - RNA, 64 nt, Homo Sapiens
uuuggaaaaaaaucucugggcuucgacugcugccagggaggagcugcugcaagccagagggagg

SEQ ID NO: 318835 - RNA, 64 nt, Homo Sapiens
cgacugcugccagggaggagcugcugcaagccagagggaggaagggggagaauacgaacagccu

SEQ ID NO: 318836 - RNA, 62 nt, Homo Sapiens
gccaguauuccuacuuauaguuggugagcaugagggaggaggaaucauggcuaccuucuccu

SEQ ID NO: 318837 - RNA, 64 nt, Homo Sapiens
gucccugggguuagcccuguuggcccugacaggaagggaggaagccuggugaauuuagugagca

SEQ ID NO: 318838 - RNA, 64 nt, Homo Sapiens
agagccggauggggagagucaacaggaaaaaaggagggaggaggaaaagccacaagagacauuc

SEQ ID NO: 318839 - RNA, 64 nt, Homo Sapiens
ccaggagcccucagguggcuggagcuggaauagcagggaggacuggguguaccuaggcaguauu

SEQ ID NO: 318840 - RNA, 64 nt, Homo Sapiens
ggguccugcggcccccuugcccaaccucggguuuagggaggaggguucacaguguuuuuguggg

SEQ ID NO: 318841 - RNA, 64 nt, Homo Sapiens
cauuuccacccucgggaggcggcuccugagaaacagggaggaaggggcggagcaccuggacguc

SEQ ID NO: 318842 - RNA, 64 nt, Homo Sapiens
gccagcccgcugcgaacccuccaccagcuaccggagggaggagggaggaugcgcugugggguug

SEQ ID NO: 318843 - RNA, 64 nt, Homo Sapiens
cgcugcgaacccuccaccagcuaccggagggaggagggaggaugcgcugugggguuguuuuugc

SEQ ID NO: 318844 - RNA, 64 nt, Homo Sapiens
gagcuaggagaucugagggcaggcgggcagcugcagggaggagaggugagaaaggaagcgucuu

SEQ ID NO: 318845 - RNA, 64 nt, Homo Sapiens
caggcccccugcagccucccaggacaggcuggcaagggaggagggccggccagcauuugguggc

SEQ ID NO: 318846 - RNA, 64 nt, Homo Sapiens
ggagccggagaagccggagcgcagaagccacggcagggaggaaaugaaagaaaggaggggagca

SEQ ID NO: 318847 - RNA, 64 nt, Homo Sapiens
gcaaauggagccauucugauaacacgagaguucuagggaggacaggaaaagcccagguucuuaa

SEQ ID NO: 318848 - RNA, 64 nt, Homo Sapiens
gugugugccccagggggucggggguaggggaugcagggaggaucuuagcauuuguuguuuucua

SEQ ID NO: 318849 - RNA, 64 nt, Homo Sapiens
augugugucagagaaagagagagagagagagagaagggaggaugagaacgaauggggggaagag

SEQ ID NO: 318850 - RNA, 64 nt, Homo Sapiens
guugcccuccagggucuagcccagccuauuuguuagggaggauagagaaacagagcacccccug

SEQ ID NO: 318851 - RNA, 64 nt, Homo Sapiens
uagaggguaugaccugggguugcuggccagagccagggaggagccuuaagaagugaaaucuagg

SEQ ID NO: 318852 - RNA, 64 nt, Homo Sapiens
gguggguggaaacggcucuuguuugaaagaacuuagggaggaccauuggcuugccaagaguaca

SEQ ID NO: 318853 - RNA, 64 nt, Homo Sapiens
gagacguuaagagcugagcacaccacaggaaaggagggaggaugcugugugagagccaugcugu

SEQ ID NO: 318854 - RNA, 64 nt, Homo Sapiens
ggacaaguguaauaaaucaauuauuacugaggaaagggaggagauuauuagaauauaaaaaaug

SEQ ID NO: 318855 - RNA, 64 nt, Homo Sapiens
gggauggcccauuaagaguucucucuugacaucaagggaggaagcacaguagcacacgugcuuc

SEQ ID NO: 318856 - RNA, 64 nt, Homo Sapiens
uccaccugcaccccacucccaaguagcuugaaaaagggaggacagucuuuccccagcagggguc

SEQ ID NO: 318857 - RNA, 64 nt, Homo Sapiens
uguguggggauggugagggaagaggggucacaugagggaggaaacuguauccaugcaugcauga

SEQ ID NO: 318858 - RNA, 64 nt, Homo Sapiens
caucccagguguguguaagagagagagagagaacagggaggauacagaaguauugcagcccaga

SEQ ID NO: 318859 - RNA, 64 nt, Homo Sapiens
ccccaccuccagcccccgcccauugguugggggaagggaggaaagguuggguggggaggggaau

SEQ ID NO: 318860 - RNA, 64 nt, Homo Sapiens
gucauuucuauguguaauuucuuggcgaggguggagggaggagugggccuugcgguucagagcu

SEQ ID NO: 318861 - RNA, 64 nt, Homo Sapiens
uaaaaggcagggaguuaauaugugccaagggaggagggaggaggagccacauccaucuggcagu

SEQ ID NO: 318862 - RNA, 64 nt, Homo Sapiens
gaggagguaaaaggcagggauggcaguugugccaagggaggagggacuuccagccacauccauc

SEQ ID NO: 318863 - RNA, 64 nt, Homo Sapiens
gcgcgcucugcuccuucccaugugcagacagaucagggaggaaccuccaaugggugggggacag

SEQ ID NO: 318864 - RNA, 64 nt, Homo Sapiens
ggagggcaucugucugugggagcccagaggcugcagggaggaggaggagggagguaucuggugu

SEQ ID NO: 318865 - RNA, 64 nt, Homo Sapiens
gcucauuugagggguggcuacuuggcuaugggauagggaggagggaauuacuagggaggagaga

SEQ ID NO: 318866 - RNA, 64 nt, Homo Sapiens
uacuuggcuaugggauagggaggagggaauuacuagggaggagagaaagggacaaaagcacccu

SEQ ID NO: 318867 - RNA, 64 nt, Homo Sapiens
ugagccaggccaacauuggugucccuguccccagagggaggagcaggcaggagagagaggggaa

SEQ ID NO: 318868 - RNA, 64 nt, Homo Sapiens
cacccccaggaggccaagccugaaaacagaggggagggaggaaggaaggagucccagcaggagc

SEQ ID NO: 318869 - RNA, 64 nt, Homo Sapiens
cugcggcuccuuagucaccucugauagcagauugagggaggaaaacagguaaggcaugaggaaa

SEQ ID NO: 318870 - RNA, 64 nt, Homo Sapiens
ccacaguucuacaagacugcaggaauucuccuuaagggaggagagcaagcagguguggccccag

SEQ ID NO: 318871 - RNA, 64 nt, Homo Sapiens
ggucaguugggugccuguuuaguucuagaucgucagggaggaagaaggcagcacguaaugugua

SEQ ID NO: 318872 - RNA, 64 nt, Homo Sapiens
ggucaguugggugcuuguuugguuauagaucgucagggaggagggaggcagcacggaacaugua

SEQ ID NO: 318873 - RNA, 64 nt, Homo Sapiens
gccgugcaguggcaggcggguguccuguagauagagggaggaaaccccucucccguguuuuguu

SEQ ID NO: 318874 - RNA, 64 nt, Homo Sapiens
ugaucauccaagaaauacuuaggaggcuggaguaagggaggacuccaccuggggagcugagaag

SEQ ID NO: 318875 - RNA, 64 nt, Homo Sapiens
gaggguggccaggcugacagggguuucugcagucagggaggagguuugcaguguagugacacug

SEQ ID NO: 318876 - RNA, 64 nt, Homo Sapiens
ccaggggcgaggcaggccgcugagggcaggagcaagggaggaagacgguucugagacugaacac

SEQ ID NO: 318877 - RNA, 64 nt, Homo Sapiens
aggacuuccaggaggaccccaacccggcccggagagggaggaggaggccuccaggggcgcggag

SEQ ID NO: 318878 - RNA, 64 nt, Homo Sapiens
gcucccggccagccgccggcccgcaggcagcgcgagggaggagcugcgccgccggcuccgccca

SEQ ID NO: 318879 - RNA, 64 nt, Homo Sapiens
uggggcugagaacugcagcccugggucuucccuuagggaggaagggcagaugaacccagcaggc

SEQ ID NO: 318880 - RNA, 64 nt, Homo Sapiens
ccugguuucccagaucuguauuucaguguuuacaagggaggaaggaccuuuccucaccucccuu

SEQ ID NO: 318881 - RNA, 64 nt, Homo Sapiens
cugcagccauugccauccaguggggagauggguuagggaggaggacgggcugacuccucuccug

SEQ ID NO: 318882 - RNA, 64 nt, Homo Sapiens
aaagaaaguuguggggcauaagacaccgggaaugagggaggaggaagacaguuguguuuucucu

SEQ ID NO: 318883 - RNA, 64 nt, Homo Sapiens
aggugcaggggcuucuguuuggcaggccccugccagggaggaccugguggccuccucauucucu

SEQ ID NO: 318884 - RNA, 64 nt, Homo Sapiens
guucugucucaggcuucuguggcaggacuggcccagggaggaggaagccagcagcacaccuggg

SEQ ID NO: 318885 - RNA, 64 nt, Homo Sapiens
acaagcuaauagcaaauauuacccauugcuaucaagggaggaggggguagucuguagaacccau

SEQ ID NO: 318886 - RNA, 64 nt, Homo Sapiens
aauucuauaacaguaaaccccauacgcaggugggagggaggaacaccggugccucggucacucu

SEQ ID NO: 318887 - RNA, 64 nt, Homo Sapiens
ugggggaggcuguuucuucucaggauuccuugccagggaggaaggggagggaacaggguggguu

SEQ ID NO: 318888 - RNA, 64 nt, Homo Sapiens
aggccuguaauuccagcacuuugggaggccgaggagggaggaucaccugaggucaggaguuuga

SEQ ID NO: 318889 - RNA, 64 nt, Homo Sapiens
agaggcuccugaagaugcugggcgguccuggcacagggaggagcagcucuguaaaucugugcac

SEQ ID NO: 318890 - RNA, 64 nt, Homo Sapiens
cagaucuacacacagaaaccacggcugggaugugagggaggacuaugccgaugcggcuuguggc

SEQ ID NO: 318891 - RNA, 64 nt, Homo Sapiens
ucuguugcucagagagguugcacucucauucaacagggaggaugagguggcagggcagagaugu

SEQ ID NO: 318892 - RNA, 64 nt, Homo Sapiens
ccccggcccucccuggcccggccacuccgaaggcagggaggaggacuuggcaacuggcuuuucu

SEQ ID NO: 318893 - RNA, 64 nt, Homo Sapiens
ccagagaggacagacacagauuuccugcugggggagggaggaguccacgcauccugaugcugcc

SEQ ID NO: 318894 - RNA, 64 nt, Homo Sapiens
gggacuuuagagagggaugaaaaugagcccugggagggaggaagggacgaggagggguggcugc

SEQ ID NO: 318895 - RNA, 64 nt, Homo Sapiens
uaccucuccccacguggaggguggagcaguuaugagggaggaagucaacugcuguucagccuca

SEQ ID NO: 318896 - RNA, 64 nt, Homo Sapiens
ugagaaucuccaagagaaaaauauuuggggaaggagggaggaaauaugucccuugcacaccacc

SEQ ID NO: 318897 - RNA, 64 nt, Homo Sapiens
gaagccaccucccaucacaccccugagcagaguuagggaggaauucuacuucccauaaaaggac

SEQ ID NO: 318898 - RNA, 64 nt, Homo Sapiens
auaguuaaaaagcauuauacuguggguaaugaaaagggaggaaaaaaaaagaaggaaaaggaau

SEQ ID NO: 318899 - RNA, 64 nt, Homo Sapiens
uuuaugcucaggagcauuggaauccucuucuuccagggaggaauuagccugcaagguuaggacu

SEQ ID NO: 318900 - RNA, 64 nt, Homo Sapiens
cgaggggaaaggccugugggggugcuggaaagggagggaggacgagaaaaacaggccgagugaa

SEQ ID NO: 318901 - RNA, 64 nt, Homo Sapiens
aauaaggggaaggaagagaggugguagucagaggagggaggagggaugaggcaccaggaaaggg

SEQ ID NO: 318902 - RNA, 64 nt, Homo Sapiens
ggaggacgagguaacucagcgcagggccugcaccagggaggaguguugcaggaggaggagcugg

SEQ ID NO: 318903 - RNA, 64 nt, Homo Sapiens
acaugguggagaccagggacaccuguuucuucuaagggaggaggcagcuugcucccugccccag

SEQ ID NO: 318904 - RNA, 64 nt, Homo Sapiens
aagucccugcgcuccagcuggacggcccuguuccagggaggaggugcucgguugacaccaucag

SEQ ID NO: 318905 - RNA, 64 nt, Homo Sapiens
aggagggcagggcgugcagggccuugugggccucagggaggacuugggcaccuacgccgaggga

SEQ ID NO: 318906 - RNA, 64 nt, Homo Sapiens
agagcagcccuucucagcuccacccugcccggggagggaggaggagcucugguuucagagcagu

SEQ ID NO: 318907 - RNA, 64 nt, Homo Sapiens
gggcagggccuugcaggggauugguacugaucccagggaggaaguguuggggcuucaugaacua

SEQ ID NO: 318908 - RNA, 64 nt, Homo Sapiens
aggucaggaggggggcccuccuucggaugaggugagggaggagcacacagcugaccgaauccgg

SEQ ID NO: 318909 - RNA, 64 nt, Homo Sapiens
uacacagcugaccgaauccggccagcuacgugggagggaggaauaucucuggcagcccacuugg

SEQ ID NO: 318910 - RNA, 64 nt, Homo Sapiens
gagugggacucaaauccagagguugagggggguuagggaggaguuccggaagucgcugugcccu

SEQ ID NO: 318911 - RNA, 64 nt, Homo Sapiens
accaggaguccugagcacacugaacacaccucagagggaggauccuuguuguggauuuugcacc

SEQ ID NO: 318912 - RNA, 64 nt, Homo Sapiens
accucccuucuacggagaugcaggcagugccacgagggaggaggggaccugcaaagcuagaauc

SEQ ID NO: 318913 - RNA, 64 nt, Homo Sapiens
ugugugugugcccgcauaugcaccaucaguucagagggaggaugaaaauguuaucgauacuaaa

SEQ ID NO: 318914 - RNA, 64 nt, Homo Sapiens
uggagcuuuuaagccaguuuucauaccacauacaagggaggauuagcuggagaugaaggcacac

SEQ ID NO: 318915 - RNA, 64 nt, Homo Sapiens
uucuuuggaaguucagcagaugaaagcccaggccagggaggagaaggcuagaaagcaggugagc

SEQ ID NO: 318916 - RNA, 64 nt, Homo Sapiens
ggagcggcagcgccucgcucgagagaagcagaugagggaggaggcugaacgcacgagggaugag

SEQ ID NO: 318917 - RNA, 58 nt, Homo Sapiens
gccugacacgggaagagugacaguagggagggaggacagaccuccaccacacugacau

SEQ ID NO: 318918 - RNA, 64 nt, Homo Sapiens
ucccaagcucccaucuauggggcuuagcaaaaaaagggaggaagugggggcuggauaugcccac

SEQ ID NO: 318919 - RNA, 64 nt, Homo Sapiens
gggggacauaaagccuguccucccuggaguugggagggaggaauuacaaaggacccuuucaaug

SEQ ID NO: 318920 - RNA, 64 nt, Homo Sapiens
gucccuuuuguucuucccccccaacuuuuuggccagggaggaauagacagcuuauccuuuucaa

SEQ ID NO: 318921 - RNA, 61 nt, Homo Sapiens
auuguccacauaacugaucacccauggcugccucuccuauuaucuauuaucacugaaacuu

SEQ ID NO: 318922 - RNA, 61 nt, Homo Sapiens
cuuauuauuggccauugaucuugaauuugcccucuccuagugcugcagucccacuucaaag

SEQ ID NO: 318923 - RNA, 61 nt, Homo Sapiens
ucucccuuuucccccgauccuuuuuuccuuccucuccuacaggugguauauuuuuccccuc

SEQ ID NO: 318924 - RNA, 61 nt, Homo Sapiens
gauuggaacaaaagcaaacacuccucaaccacucuccuaauaaguagugauggauucagua

SEQ ID NO: 318925 - RNA, 61 nt, Homo Sapiens
aaucuccugagaaaugaaccaaugaauaaaacucuccuaagcuguaaauacuggaucaaug

SEQ ID NO: 318926 - RNA, 61 nt, Homo Sapiens
agcuguccuggugggcccaggacuaugcuuucucuccuaggguugacauaaguuccuaccu

SEQ ID NO: 318927 - RNA, 61 nt, Homo Sapiens
uaucucucucucuaucuccucucucucucuccucuccuaucucuccucucucucucuccua

SEQ ID NO: 318928 - RNA, 61 nt, Homo Sapiens
cucucucuccucuccuaucucuccucucucucucuccuauacuaacuuguuucaaauugga

SEQ ID NO: 318929 - RNA, 61 nt, Homo Sapiens
guacugggaccacuguaaacuuuauuuaauucucuccuacaauuaucuacagcuauuuuau

SEQ ID NO: 318930 - RNA, 61 nt, Homo Sapiens
ggaagaauaucacaggcuaaaaucuugacaucucuccuagggcuaugauagaaucucaucu

SEQ ID NO: 318931 - RNA, 61 nt, Homo Sapiens
cuuuccagccuguuuccccaauuccucugugcucuccuagagcucugucugaauccucgca

SEQ ID NO: 318932 - RNA, 61 nt, Homo Sapiens
uuggauuaggagaacagguguuccuccuccccucuccuagcagcccuaaugucugaccuag

SEQ ID NO: 318933 - RNA, 61 nt, Homo Sapiens
cugacacaucugggucucaaauuaguuaaaacucuccuagggcagcagcaguggcucuucg

SEQ ID NO: 318934 - RNA, 61 nt, Homo Sapiens
aggcauuuaauuaaggcucuauaaauuccaacucuccuaagauuugcuuuucaaaauggaa

SEQ ID NO: 318935 - RNA, 61 nt, Homo Sapiens
ucucugucagaauugagcuugaaagaggucucucuccuaaggcauaauuggugauccugaa

SEQ ID NO: 318936 - RNA, 61 nt, Homo Sapiens
uugcucacugccuuaaucagcuguuucagagcucuccuaccuguacuucguuaacacgaau

SEQ ID NO: 318937 - RNA, 64 nt, Homo Sapiens
uauuaauugucuagaaugaagcuuauugccuuucccuauauaaauuaaugacuggaaaaaacuu

SEQ ID NO: 318938 - RNA, 64 nt, Homo Sapiens
auguucucuccuccaaaguuaauaauaauaaaaaccuauauaguguaacccaaauucauaaagc

SEQ ID NO: 318939 - RNA, 64 nt, Homo Sapiens
caaaaguaaugucuacauucgcaauuucuauuguccuauauauuuuaggcagcauugcuuugau

SEQ ID NO: 318940 - RNA, 64 nt, Homo Sapiens
agcauuucuguuaauucauuaaucucugcaaccuccuauauaaacuagacauugacugcaagag

SEQ ID NO: 318941 - RNA, 64 nt, Homo Sapiens
cuauuuaauacuugguuuauauauuuuuuccuuaccuauauauuaaaaauguaacugcuuuaua

SEQ ID NO: 318942 - RNA, 64 nt, Homo Sapiens
gaccugccuguccacgaauaugaaauaaccuacuccuauauacucuuagugcacaacacauuug

SEQ ID NO: 318943 - RNA, 64 nt, Homo Sapiens
uauauaacuuuguaauauaauaaaagcuuugcaaccuauauauuugacauuuuaaucauuauuu

SEQ ID NO: 318944 - RNA, 64 nt, Homo Sapiens
uguauauguuuuauauaugugacaaauauuguuuccuauauauaguggcccaauucuuuaaugg

SEQ ID NO: 318945 - RNA, 64 nt, Homo Sapiens
ugguguauaaacagggcauuacagaaugguacacccuauauauuucuguucaguauccauucac

SEQ ID NO: 318946 - RNA, 64 nt, Homo Sapiens
ucuccucuguucuacuuggcaccacaagcuauguccuauauauguauuucugacuuggcaggau

SEQ ID NO: 318947 - RNA, 64 nt, Homo Sapiens
gauaucuagaaaacuugguugauuaaaaauauauccuauauauauuuucaagaguaaaauuuaa

SEQ ID NO: 318948 - RNA, 64 nt, Homo Sapiens
uaauaccuccaaagauauuuucuauccucaugggccuauauauuacauuuuuaaguuacucagc

SEQ ID NO: 318949 - RNA, 64 nt, Homo Sapiens
aaccaaaauuauaggauuuuuuuuuuaguaaaaaccuauauaaaaaaauuauaggauuuuuuuc

SEQ ID NO: 318950 - RNA, 64 nt, Homo Sapiens
aaccaaaauuauaggauuuucuggugaguaaaaaccuauauaaauuucggggguaauagagcca

SEQ ID NO: 318951 - RNA, 64 nt, Homo Sapiens
uuuacuuaggugugaaagaugguucuuuguugaaauaauauagugguuuaguguuuucaaauca

SEQ ID NO: 318952 - RNA, 64 nt, Homo Sapiens
aauuaagcuuuauaaugacauuucaaccaucaacauaauauagugaggaguagcauaauauuuu

SEQ ID NO: 318953 - RNA, 64 nt, Homo Sapiens
ccaucacuuagaacgaaccccaaacaaaaaugccauaauauaaaugugugaaucagggcuguga

SEQ ID NO: 318954 - RNA, 64 nt, Homo Sapiens
uaaaaugggguuugcaggcuuuuuauggugaagaauaauauaucucugucuauagcuuucccau

SEQ ID NO: 318955 - RNA, 64 nt, Homo Sapiens
uaucucugaaucugaugugcuucuuucuaauaaaauaauauauaggcugcugcaauugaaaacu

SEQ ID NO: 318956 - RNA, 64 nt, Homo Sapiens
cuuauuuacuuuccuuuuuaauuuuaucugagacauaauauaaacuuguauagaaauagucuuc

SEQ ID NO: 318957 - RNA, 64 nt, Homo Sapiens
agcuguaacauuuccuuuaaaaauaccaaaucaaauaauauaaauuguacuuauaacuguuauu

SEQ ID NO: 318958 - RNA, 64 nt, Homo Sapiens
ccuugauguacauguugagaaaggagcccauuuuauaauauaaauaagucuugaaugaauacaa

SEQ ID NO: 318959 - RNA, 64 nt, Homo Sapiens
gccuuucaaauuaguuaccacugauacacuuuugauaauauaauagugaguugagggagcuaau

SEQ ID NO: 318960 - RNA, 64 nt, Homo Sapiens
uacauuuuaauuauuuguacguguagauuucuauauaauauaaauuuuaguaguaucuuccauu

SEQ ID NO: 318961 - RNA, 64 nt, Homo Sapiens
cauuuugccuauguuucuacuuuucauuuugguuauaauauaguuuuuuuaaauugaacaguau

SEQ ID NO: 318962 - RNA, 64 nt, Homo Sapiens
agcacacaaauuggugacagcugaacacuaaagaauaauauauaacccaaccccuuacacuaca

SEQ ID NO: 318963 - RNA, 64 nt, Homo Sapiens
uuaugacaaaaguuaucugaaggacuugcuguuuauaauauaagcaacauuuagcuaguuguuu

SEQ ID NO: 318964 - RNA, 64 nt, Homo Sapiens
caaauuugcuauaguuugucauuuuugcuuacaaauaauauaacuuuucaaccuucuaguuaua

SEQ ID NO: 318965 - RNA, 64 nt, Homo Sapiens
agugguauuaauuguuuuaaucugcaguucaccaauaauauaugaauuuagcaucuuuucauau

SEQ ID NO: 318966 - RNA, 64 nt, Homo Sapiens
uuuuucuuuuuucuuuuuuuaaagaaaugguagcauaauauacacaguuguccauuuuuuaaag

SEQ ID NO: 318967 - RNA, 64 nt, Homo Sapiens
uuaaguguacaucguaauuugaccuaauuuaaaaauaauauauuuucgaaguaguagauucuca

SEQ ID NO: 318968 - RNA, 64 nt, Homo Sapiens
cauuuaauaaaaauaaaugauuuugaaauuaaauauaauauagaauucacauuuuauauagcuc

SEQ ID NO: 318969 - RNA, 64 nt, Homo Sapiens
aaggauaauacuuuauauaauguauaaaguauauauaauauaauauauauguuauauaaacugc

SEQ ID NO: 318970 - RNA, 64 nt, Homo Sapiens
uaauacuuuauauaauguauaaaguauauauaauauaauauauauguuauauaaacugcacauu

SEQ ID NO: 318971 - RNA, 64 nt, Homo Sapiens
auacaaggagcuauuucuaaaauuuggcuuauguauaauauauuuaaauggggaauuucaucua

SEQ ID NO: 318972 - RNA, 64 nt, Homo Sapiens
acccaggcacucaauauucauccugaaauuuuuuauaauauauguaauuugucuagucuuaaag

SEQ ID NO: 318973 - RNA, 64 nt, Homo Sapiens
uucaaaccauauggccuagguaacuuuaauugaaauaauauagauuuaguugaauacuauucag

SEQ ID NO: 318974 - RNA, 64 nt, Homo Sapiens
uggcugcgguagccuaguaggaauggacuauauaauaauauagcaggugcucaauaacuguuug

SEQ ID NO: 318975 - RNA, 64 nt, Homo Sapiens
gggcaacagagcaagacccugucucaaaauaauaauaauauauaauuuuacaccaaaaguuuca

SEQ ID NO: 318976 - RNA, 64 nt, Homo Sapiens
aguacuuugauacucaaguuguuucacaagauuuauaauauagaugguuuuguuugacuaaaga

SEQ ID NO: 318977 - RNA, 64 nt, Homo Sapiens
agaagagaauauacacaacucagagaugcaauggauaauauaaaaagaguaccugagauguauu

SEQ ID NO: 318978 - RNA, 64 nt, Homo Sapiens
uaacuuaacuauaguauaaugaaaagaaugaccuauaauauagguguuuuguagauucuugugu

SEQ ID NO: 318979 - RNA, 64 nt, Homo Sapiens
agaguauuuuggguuuuuaauuaaauuauuguuaauaauauaacauauaagaauacuuuuauua

SEQ ID NO: 318980 - RNA, 64 nt, Homo Sapiens
cucuccuuuccccuucuggucccugcgcuuugguauaauauauauacuucuccauacacagacc

SEQ ID NO: 318981 - RNA, 64 nt, Homo Sapiens
gauauauauguccaccaguaauaucuauauacaaauaauauauauugguacaaauaaaaacugu

SEQ ID NO: 318982 - RNA, 64 nt, Homo Sapiens
ccuucuuuauaaugcuaaauuuuaaauguuuuaaauaauauauuaaaaauguccauaugcacua

SEQ ID NO: 318983 - RNA, 64 nt, Homo Sapiens
cagucuguuuggccauuacuacacuuuuuacuuuauaauauaaaagcaaaguuuuugucauuaa

SEQ ID NO: 318984 - RNA, 64 nt, Homo Sapiens
aaugcaauaaaguaauaaucucacuuuuauaugaauaauauauuucacaucuuuauuauugcag

SEQ ID NO: 318985 - RNA, 64 nt, Homo Sapiens
aucugaaggcauuuucagcucuagcaauuuauuuauaauauauaaguucauauauuuuuuaauc

SEQ ID NO: 318986 - RNA, 64 nt, Homo Sapiens
acaugcaauggaauauagauauguauauacacauauaauauauaugcuaaaguauaaagaguaa

SEQ ID NO: 318987 - RNA, 64 nt, Homo Sapiens
uaauaaaaauuuaugaauauuaaaauuaucauuaauaauauaaaacacuuauuugagauuaaau

SEQ ID NO: 318988 - RNA, 64 nt, Homo Sapiens
auauuuguuauucuaacucuauuuuuuaaaguuaauaauauaaaguggccauguaaaauauuuu

SEQ ID NO: 318989 - RNA, 64 nt, Homo Sapiens
gaauauuugaauugaaacaauagaaauuuuucucauaauauauaccuaugugaaaccaacuuau

SEQ ID NO: 318990 - RNA, 64 nt, Homo Sapiens
caccuaaauugaaagcuaagaaggaaauguaaauauaauauauauuuauauuugauguaauaug

SEQ ID NO: 318991 - RNA, 64 nt, Homo Sapiens
agcucauacuuuauggugguucuucuccuccgaaauaauauacugcagaaaucccagacagagc

SEQ ID NO: 318992 - RNA, 64 nt, Homo Sapiens
uggaauauauauauuauauaauauuuuuauauauauaauauauaauggaauauguauauuauau

SEQ ID NO: 318993 - RNA, 64 nt, Homo Sapiens
uggaauauguauauuauauaauacccuuccauauauaauauauagaaagggaaaccuaaaacaa

SEQ ID NO: 318994 - RNA, 64 nt, Homo Sapiens
cuuaguucaguaacuauuauugguacauagcgaaauaauauaaucauguggaauccauccauaa

SEQ ID NO: 318995 - RNA, 64 nt, Homo Sapiens
uggcagaagucaugcaaauuuuucuaaauauuagauaauauagaauuuuaucauauuuuaggcu

SEQ ID NO: 318996 - RNA, 64 nt, Homo Sapiens
uuuacccuuguauguuauccucagagggaagaugauaauauauaaauaauauaaugaacacacc

SEQ ID NO: 318997 - RNA, 64 nt, Homo Sapiens
auguuauccucagagggaagaugauaauauauaaauaauauaaugaacacacccuuaguuucuc

SEQ ID NO: 318998 - RNA, 64 nt, Homo Sapiens
auggauauucauuuauacugacuuuuacuuaaacauaauauauaaguacagugcaaguuuuuuc

SEQ ID NO: 318999 - RNA, 64 nt, Homo Sapiens
uaaccagugguaaaucaugacuuugaacacacacauaauauauacaucauugcugcauuuugua

SEQ ID NO: 319000 - RNA, 64 nt, Homo Sapiens
uugacaaauuuuacuaccauugcuuugaguuuguauaauauaucgacugaugcuuuaucuaaaa

SEQ ID NO: 319001 - RNA, 64 nt, Homo Sapiens
agacugaugcuuuaucuaaauacuccaucaaucuauaauauauugacuauaugucauuuuauua

SEQ ID NO: 319002 - RNA, 64 nt, Homo Sapiens
aagucagcagggacuccccugcaucuuuuuugguauaauauauaagacuucuaaguguccauau

SEQ ID NO: 319003 - RNA, 64 nt, Homo Sapiens
uauaaaauauauauauauauuauauauuauauauauaauauauaauauaauauaauauauuaua

SEQ ID NO: 319004 - RNA, 64 nt, Homo Sapiens
auauauauauuauauauauaauauaauauauaauauaauauauuuguguauauauauauuauau

SEQ ID NO: 319005 - RNA, 64 nt, Homo Sapiens
auauuauauauauauuauauuauauauauaauauauaauauaauauauauguguauauauauau

SEQ ID NO: 319006 - RNA, 64 nt, Homo Sapiens
auauaauauauuauauauauuauauauuauauauauaauauauauaauauaauauauguguaua

SEQ ID NO: 319007 - RNA, 64 nt, Homo Sapiens
uguauauauauauuauauauuguauauauauaauauaauauaugauauauauauuauauaugug

SEQ ID NO: 319008 - RNA, 64 nt, Homo Sapiens
auauguguauauauauauuaauguguguauauauauaauauaauucuccauauauauauuauau

SEQ ID NO: 319009 - RNA, 64 nt, Homo Sapiens
guagaacucauuuugcuggcugaaagaguauggaauaauauaucucaugucauuuuuuagaaga

SEQ ID NO: 319010 - RNA, 64 nt, Homo Sapiens
augcuuuaauguuaucuuugagaaaucuauguaaauaauauagucuacaacauagagacuguau

SEQ ID NO: 319011 - RNA, 64 nt, Homo Sapiens
guaaacaaaacacagcucuuuggcuugaagcaauauaauauauuaauguaugaacuuuuugcau

SEQ ID NO: 319012 - RNA, 64 nt, Homo Sapiens
cuaaacacaaugaaauagggggcauuuaaacaauauaauauauuaaaaauuacacugugguagu

SEQ ID NO: 319013 - RNA, 64 nt, Homo Sapiens
ugggcaacauagcgagacccuaucuaaaauaacaauaauauauggccaggcgggauggcucacg

SEQ ID NO: 319014 - RNA, 64 nt, Homo Sapiens
cgggagugagacaccaucucaaaaaauacauauaauaauauaaauaaaaauaucuuuuuugaaa

SEQ ID NO: 319015 - RNA, 64 nt, Homo Sapiens
ugccaaccucacugacacagggucauaguguauaauaauauacuguacuauauaauauaucauc

SEQ ID NO: 319016 - RNA, 64 nt, Homo Sapiens
cagggucauaguguauaauaauauacuguacuauauaauauaucaucuuuagagguaugauuuu

SEQ ID NO: 319017 - RNA, 64 nt, Homo Sapiens
gcaaugcuaguaacaggaugggaacaugggaaugauaauauauauuuuuucuuuuaauauuuua

SEQ ID NO: 319018 - RNA, 64 nt, Homo Sapiens
ggcuuucaguuaaaguuuugacuucuuauuauaaauaauauaaagaaugucucaguaauuagaa

SEQ ID NO: 319019 - RNA, 64 nt, Homo Sapiens
uaaguguuuuuuuaaacuauauauuauauauaaaauaauauaccugcaauuauauaucugauau

SEQ ID NO: 319020 - RNA, 64 nt, Homo Sapiens
uaagguacauaauaugcaaugauucaacuuauauauaauauauauuggagaguuuuguauuaug

SEQ ID NO: 319021 - RNA, 64 nt, Homo Sapiens
ggcuggaccacucaguuauuauugcuauuagaaaauaauauaucauguuuacuuuuguucuuca

SEQ ID NO: 319022 - RNA, 64 nt, Homo Sapiens
auagaaaaauaauuaucuguaaaaaaugaaggggauaauauaugauaaauuauguucugauauc

SEQ ID NO: 319023 - RNA, 64 nt, Homo Sapiens
uuauauuuuuugaaaucacauauaauuagacuuuauaauauauauacuuuuucauauauaauua

SEQ ID NO: 319024 - RNA, 64 nt, Homo Sapiens
auccauuuaggauuugugauuuaugucuugaguaauaauauaaagucaacuccagacugauagg

SEQ ID NO: 319025 - RNA, 64 nt, Homo Sapiens
uauauauauauaaaauaacuacuuuuuuuuauacauaauauauauuccacuugauguaaacaaa

SEQ ID NO: 319026 - RNA, 64 nt, Homo Sapiens
caaauauauauauauacauaaguagaaucacaggauaauauauaaacgcagcagaggaaccaua

SEQ ID NO: 319027 - RNA, 64 nt, Homo Sapiens
cacagacauggagagaauuagaucauauuauuaaauaauauauguuggaucacauacauuuaag

SEQ ID NO: 319028 - RNA, 64 nt, Homo Sapiens
aguuuuauaagaagauguuuaaaagcaauacuuaauaauauaacguacuaaagacuaaaaugca

SEQ ID NO: 319029 - RNA, 64 nt, Homo Sapiens
auauuuuucuuaugaauucuuaauaucucccaucauaauauaaaugacucuucauauggaaaaa

SEQ ID NO: 319030 - RNA, 64 nt, Homo Sapiens
cuacaaccagccaaaugcacuguuuccccaccuaauaauauauccagagagaaaagugggguuu

SEQ ID NO: 319031 - RNA, 64 nt, Homo Sapiens
uaugcuaucuugauucaugauuuaauugguuuauauaauauauguguguuugaacucugucgug

SEQ ID NO: 319032 - RNA, 64 nt, Homo Sapiens
cuuguaauuuuaaauuucagcuucacgauauaaaauaauauaagaacuucugguuuacaaaaug

SEQ ID NO: 319033 - RNA, 64 nt, Homo Sapiens
gaagcagaaaaacauugauuuuuuuauaucuuucauaauauaauuuucuaacaaugcaauaaaa

SEQ ID NO: 319034 - RNA, 64 nt, Homo Sapiens
aaagaaugaggaaccuguauuccucuucuucgugauaauauaaucucuauuuuuuuaggaaaac

SEQ ID NO: 319035 - RNA, 64 nt, Homo Sapiens
guuguguuuuuuuuuuuuuuuuugaaauaaaacuauaauauaaauucuccuauuaaauaaaauu

SEQ ID NO: 319036 - RNA, 64 nt, Homo Sapiens
uaugaauuauuaagcauaugugcuuucgcagcugauaauauaaaaggaaaucccacagucuaga

SEQ ID NO: 319037 - RNA, 64 nt, Homo Sapiens
uguauacauaugccaaaauaucauuuuguaugccauaauauauaugauuuaugaauuauaguaa

SEQ ID NO: 319038 - RNA, 64 nt, Homo Sapiens
aaccuauguaaugugauuaaaucaaauuaaauacauaauauauauuuacaaaauaauauaauua

SEQ ID NO: 319039 - RNA, 64 nt, Homo Sapiens
aaaucaaauuaaauacauaauauauauuuacaaaauaauauaauuaauaaacuuccuacaucua

SEQ ID NO: 319040 - RNA, 64 nt, Homo Sapiens
aguuucuuucagagaguuaaguuauuuuauauauauaauauauauauaaaauauauaauauaca

SEQ ID NO: 319041 - RNA, 64 nt, Homo Sapiens
guuauuuuauauauauaauauauauauaaaauauauaauauacaauauaaauauauagugugug

SEQ ID NO: 319042 - RNA, 64 nt, Homo Sapiens
uuuauaauguauaauuuuuauauauaggccauauauaauauauacguuacaucaaauucaguuu

SEQ ID NO: 319043 - RNA, 64 nt, Homo Sapiens
auacaacucuugcuugguauucccucuuggcucuauaauauaagcaauguccaaucuaaaaacg

SEQ ID NO: 319044 - RNA, 64 nt, Homo Sapiens
gggaaguuuuauuagcuuagugcacacauuacaaauaauauaagaacaaaaguguacuauguua

SEQ ID NO: 319045 - RNA, 64 nt, Homo Sapiens
cagucuguauuugcuuuucaauaacagcuaguauauaauauauaaaauacaauugaagcaaaaa

SEQ ID NO: 319046 - RNA, 64 nt, Homo Sapiens
ggaaaugaagccauguuaauuuacacacuaaacuauaauauaaagugcagagugguaaccaugc

SEQ ID NO: 319047 - RNA, 64 nt, Homo Sapiens
ugauggaugccuauaaauguucagaauugccuuuauaauauauuaauugaggccaaagggcuga

SEQ ID NO: 319048 - RNA, 64 nt, Homo Sapiens; identical to SEQ ID NO: 39347

SEQ ID NO: 319049 - RNA, 64 nt, Homo Sapiens; identical to SEQ ID NO: 39348

SEQ ID NO: 319050 - RNA, 64 nt, Homo Sapiens; identical to SEQ ID NO: 39349

SEQ ID NO: 319051 - RNA, 64 nt, Homo Sapiens; identical to SEQ ID NO: 39350

SEQ ID NO: 319052 - RNA, 64 nt, Homo Sapiens; identical to SEQ ID NO: 39351

SEQ ID NO: 319053 - RNA, 64 nt, Homo Sapiens; identical to SEQ ID NO: 39352

SEQ ID NO: 319054 - RNA, 64 nt, Homo Sapiens; identical to SEQ ID NO: 39353

SEQ ID NO: 319055 - RNA, 64 nt, Homo Sapiens; identical to SEQ ID NO: 39354

SEQ ID NO: 319056 - RNA, 64 nt, Homo Sapiens; identical to SEQ ID NO: 39355

SEQ ID NO: 319057 - RNA, 64 nt, Homo Sapiens; identical to SEQ ID NO: 39356

SEQ ID NO: 319058 - RNA, 64 nt, Homo Sapiens; identical to SEQ ID NO: 39357

SEQ ID NO: 319059 - RNA, 64 nt, Homo Sapiens; identical to SEQ ID NO: 39358

SEQ ID NO: 319060 - RNA, 64 nt, Homo Sapiens; identical to SEQ ID NO: 39359

SEQ ID NO: 319061 - RNA, 64 nt, Homo Sapiens; identical to SEQ ID NO: 39360

SEQ ID NO: 319062 - RNA, 64 nt, Homo Sapiens; identical to SEQ ID NO: 39361

SEQ ID NO: 319063 - RNA, 64 nt, Homo Sapiens; identical to SEQ ID NO: 39362

SEQ ID NO: 319064 - RNA, 64 nt, Homo Sapiens; identical to SEQ ID NO: 39363

SEQ ID NO: 319065 - RNA, 64 nt, Homo Sapiens; identical to SEQ ID NO: 39364

SEQ ID NO: 319066 - RNA, 64 nt, Homo Sapiens; identical to SEQ ID NO: 39365

SEQ ID NO: 319067 - RNA, 64 nt, Homo Sapiens; identical to SEQ ID NO: 39366

SEQ ID NO: 319068 - RNA, 64 nt, Homo Sapiens; identical to SEQ ID NO: 39367

SEQ ID NO: 319069 - RNA, 64 nt, Homo Sapiens; identical to SEQ ID NO: 39368

SEQ ID NO: 319070 - RNA, 64 nt, Homo Sapiens; identical to SEQ ID NO: 39369

SEQ ID NO: 319071 - RNA, 64 nt, Homo Sapiens; identical to SEQ ID NO: 39370

SEQ ID NO: 319072 - RNA, 64 nt, Homo Sapiens; identical to SEQ ID NO: 39371

SEQ ID NO: 319073 - RNA, 64 nt, Homo Sapiens; identical to SEQ ID NO: 39372

SEQ ID NO: 319074 - RNA, 64 nt, Homo Sapiens; identical to SEQ ID NO: 39373

SEQ ID NO: 319075 - RNA, 64 nt, Homo Sapiens; identical to SEQ ID NO: 39374

SEQ ID NO: 319076 - RNA, 64 nt, Homo Sapiens; identical to SEQ ID NO: 39375

SEQ ID NO: 319077 - RNA, 64 nt, Homo Sapiens; identical to SEQ ID NO: 39376

SEQ ID NO: 319078 - RNA, 64 nt, Homo Sapiens; identical to SEQ ID NO: 39377

SEQ ID NO: 319079 - RNA, 64 nt, Homo Sapiens; identical to SEQ ID NO: 39378

SEQ ID NO: 319080 - RNA, 64 nt, Homo Sapiens; identical to SEQ ID NO: 39379

SEQ ID NO: 319081 - RNA, 64 nt, Homo Sapiens; identical to SEQ ID NO: 39380

SEQ ID NO: 319082 - RNA, 64 nt, Homo Sapiens; identical to SEQ ID NO: 39381

SEQ ID NO: 319083 - RNA, 64 nt, Homo Sapiens; identical to SEQ ID NO: 39382

SEQ ID NO: 319084 - RNA, 64 nt, Homo Sapiens; identical to SEQ ID NO: 39383

SEQ ID NO: 319085 - RNA, 64 nt, Homo Sapiens; identical to SEQ ID NO: 39384

SEQ ID NO: 319086 - RNA, 64 nt, Homo Sapiens; identical to SEQ ID NO: 39385

SEQ ID NO: 319087 - RNA, 64 nt, Homo Sapiens; identical to SEQ ID NO: 39386

SEQ ID NO: 319088 - RNA, 64 nt, Homo Sapiens; identical to SEQ ID NO: 39387

SEQ ID NO: 319089 - RNA, 64 nt, Homo Sapiens; identical to SEQ ID NO: 39388

SEQ ID NO: 319090 - RNA, 64 nt, Homo Sapiens; identical to SEQ ID NO: 39389

SEQ ID NO: 319091 - RNA, 64 nt, Homo Sapiens; identical to SEQ ID NO: 39390

SEQ ID NO: 319092 - RNA, 64 nt, Homo Sapiens; identical to SEQ ID NO: 39391

SEQ ID NO: 319093 - RNA, 64 nt, Homo Sapiens; identical to SEQ ID NO: 39392

SEQ ID NO: 319094 - RNA, 64 nt, Homo Sapiens; identical to SEQ ID NO: 39393

SEQ ID NO: 319095 - RNA, 64 nt, Homo Sapiens; identical to SEQ ID NO: 39394

SEQ ID NO: 319096 - RNA, 64 nt, Homo Sapiens; identical to SEQ ID NO: 39395

SEQ ID NO: 319097 - RNA, 64 nt, Homo Sapiens; identical to SEQ ID NO: 39396

SEQ ID NO: 319098 - RNA, 64 nt, Homo Sapiens; identical to SEQ ID NO: 39397

SEQ ID NO: 319099 - RNA, 64 nt, Homo Sapiens; identical to SEQ ID NO: 39398

SEQ ID NO: 319100 - RNA, 64 nt, Homo Sapiens; identical to SEQ ID NO: 39399

SEQ ID NO: 319101 - RNA, 64 nt, Homo Sapiens; identical to SEQ ID NO: 39400

SEQ ID NO: 319102 - RNA, 64 nt, Homo Sapiens; identical to SEQ ID NO: 39401

SEQ ID NO: 319103 - RNA, 64 nt, Homo Sapiens; identical to SEQ ID NO: 39402

SEQ ID NO: 319104 - RNA, 64 nt, Homo Sapiens; identical to SEQ ID NO: 39403

SEQ ID NO: 319105 - RNA, 64 nt, Homo Sapiens; identical to SEQ ID NO: 39404

SEQ ID NO: 319106 - RNA, 64 nt, Homo Sapiens; identical to SEQ ID NO: 39405

SEQ ID NO: 319107 - RNA, 64 nt, Homo Sapiens; identical to SEQ ID NO: 39406

SEQ ID NO: 319108 - RNA, 64 nt, Homo Sapiens; identical to SEQ ID NO: 39407

SEQ ID NO: 319109 - RNA, 64 nt, Homo Sapiens; identical to SEQ ID NO: 39408

SEQ ID NO: 319110 - RNA, 64 nt, Homo Sapiens; identical to SEQ ID NO: 39409

SEQ ID NO: 319111 - RNA, 64 nt, Homo Sapiens; identical to SEQ ID NO: 39410

SEQ ID NO: 319112 - RNA, 64 nt, Homo Sapiens; identical to SEQ ID NO: 39411

SEQ ID NO: 319113 - RNA, 64 nt, Homo Sapiens; identical to SEQ ID NO: 39412

SEQ ID NO: 319114 - RNA, 64 nt, Homo Sapiens; identical to SEQ ID NO: 39413

SEQ ID NO: 319115 - RNA, 64 nt, Homo Sapiens; identical to SEQ ID NO: 39414

SEQ ID NO: 319116 - RNA, 64 nt, Homo Sapiens; identical to SEQ ID NO: 39415

SEQ ID NO: 319117 - RNA, 64 nt, Homo Sapiens; identical to SEQ ID NO: 39416

SEQ ID NO: 319118 - RNA, 64 nt, Homo Sapiens; identical to SEQ ID NO: 39417

SEQ ID NO: 319119 - RNA, 64 nt, Homo Sapiens; identical to SEQ ID NO: 39418

SEQ ID NO: 319120 - RNA, 64 nt, Homo Sapiens; identical to SEQ ID NO: 39419

SEQ ID NO: 319121 - RNA, 64 nt, Homo Sapiens; identical to SEQ ID NO: 39420

SEQ ID NO: 319122 - RNA, 64 nt, Homo Sapiens; identical to SEQ ID NO: 39421

SEQ ID NO: 319123 - RNA, 64 nt, Homo Sapiens; identical to SEQ ID NO: 39422

SEQ ID NO: 319124 - RNA, 64 nt, Homo Sapiens; identical to SEQ ID NO: 39423

SEQ ID NO: 319125 - RNA, 64 nt, Homo Sapiens; identical to SEQ ID NO: 39424

SEQ ID NO: 319126 - RNA, 64 nt, Homo Sapiens; identical to SEQ ID NO: 39425

SEQ ID NO: 319127 - RNA, 64 nt, Homo Sapiens; identical to SEQ ID NO: 39426

SEQ ID NO: 319128 - RNA, 64 nt, Homo Sapiens; identical to SEQ ID NO: 39427

SEQ ID NO: 319129 - RNA, 64 nt, Homo Sapiens; identical to SEQ ID NO: 39428

SEQ ID NO: 319130 - RNA, 64 nt, Homo Sapiens; identical to SEQ ID NO: 39429

SEQ ID NO: 319131 - RNA, 64 nt, Homo Sapiens; identical to SEQ ID NO: 39430

SEQ ID NO: 319132 - RNA, 64 nt, Homo Sapiens; identical to SEQ ID NO: 39431

SEQ ID NO: 319133 - RNA, 64 nt, Homo Sapiens; identical to SEQ ID NO: 39432

SEQ ID NO: 319134 - RNA, 64 nt, Homo Sapiens; identical to SEQ ID NO: 39433

SEQ ID NO: 319135 - RNA, 64 nt, Homo Sapiens; identical to SEQ ID NO: 39434

SEQ ID NO: 319136 - RNA, 64 nt, Homo Sapiens; identical to SEQ ID NO: 39435

SEQ ID NO: 319137 - RNA, 64 nt, Homo Sapiens; identical to SEQ ID NO: 39436

SEQ ID NO: 319138 - RNA, 64 nt, Homo Sapiens; identical to SEQ ID NO: 39437

SEQ ID NO: 319139 - RNA, 64 nt, Homo Sapiens; identical to SEQ ID NO: 39438

SEQ ID NO: 319140 - RNA, 64 nt, Homo Sapiens; identical to SEQ ID NO: 39439

SEQ ID NO: 319141 - RNA, 64 nt, Homo Sapiens; identical to SEQ ID NO: 39440

SEQ ID NO: 319142 - RNA, 64 nt, Homo Sapiens; identical to SEQ ID NO: 39441

SEQ ID NO: 319143 - RNA, 64 nt, Homo Sapiens; identical to SEQ ID NO: 39442

SEQ ID NO: 319144 - RNA, 64 nt, Homo Sapiens; identical to SEQ ID NO: 39443

SEQ ID NO: 319145 - RNA, 64 nt, Homo Sapiens; identical to SEQ ID NO: 39444

SEQ ID NO: 319146 - RNA, 64 nt, Homo Sapiens; identical to SEQ ID NO: 39445

SEQ ID NO: 319147 - RNA, 64 nt, Homo Sapiens; identical to SEQ ID NO: 39446

SEQ ID NO: 319148 - RNA, 64 nt, Homo Sapiens; identical to SEQ ID NO: 39447

SEQ ID NO: 319149 - RNA, 64 nt, Homo Sapiens; identical to SEQ ID NO: 39448

SEQ ID NO: 319150 - RNA, 64 nt, Homo Sapiens; identical to SEQ ID NO: 39449

SEQ ID NO: 319151 - RNA, 64 nt, Homo Sapiens; identical to SEQ ID NO: 39450

SEQ ID NO: 319152 - RNA, 64 nt, Homo Sapiens; identical to SEQ ID NO: 39451

SEQ ID NO: 319153 - RNA, 64 nt, Homo Sapiens; identical to SEQ ID NO: 39452

SEQ ID NO: 319154 - RNA, 64 nt, Homo Sapiens; identical to SEQ ID NO: 39453

SEQ ID NO: 319155 - RNA, 64 nt, Homo Sapiens; identical to SEQ ID NO: 39454

SEQ ID NO: 319156 - RNA, 64 nt, Homo Sapiens; identical to SEQ ID NO: 39455

SEQ ID NO: 319157 - RNA, 64 nt, Homo Sapiens; identical to SEQ ID NO: 39456

SEQ ID NO: 319158 - RNA, 64 nt, Homo Sapiens; identical to SEQ ID NO: 39457

SEQ ID NO: 319159 - RNA, 64 nt, Homo Sapiens; identical to SEQ ID NO: 39458

SEQ ID NO: 319160 - RNA, 64 nt, Homo Sapiens; identical to SEQ ID NO: 39459

SEQ ID NO: 319161 - RNA, 64 nt, Homo Sapiens; identical to SEQ ID NO: 39460

SEQ ID NO: 319162 - RNA, 64 nt, Homo Sapiens; identical to SEQ ID NO: 39461

SEQ ID NO: 319163 - RNA, 64 nt, Homo Sapiens; identical to SEQ ID NO: 39462

SEQ ID NO: 319164 - RNA, 64 nt, Homo Sapiens; identical to SEQ ID NO: 39463

SEQ ID NO: 319165 - RNA, 64 nt, Homo Sapiens; identical to SEQ ID NO: 39464

SEQ ID NO: 319166 - RNA, 64 nt, Homo Sapiens; identical to SEQ ID NO: 39465

SEQ ID NO: 319167 - RNA, 64 nt, Homo Sapiens; identical to SEQ ID NO: 39466

SEQ ID NO: 319168 - RNA, 64 nt, Homo Sapiens; identical to SEQ ID NO: 39467

SEQ ID NO: 319169 - RNA, 64 nt, Homo Sapiens; identical to SEQ ID NO: 39468

SEQ ID NO: 319170 - RNA, 64 nt, Homo Sapiens; identical to SEQ ID NO: 39469

SEQ ID NO: 319171 - RNA, 64 nt, Homo Sapiens; identical to SEQ ID NO: 39470

SEQ ID NO: 319172 - RNA, 64 nt, Homo Sapiens; identical to SEQ ID NO: 39471

SEQ ID NO: 319173 - RNA, 64 nt, Homo Sapiens; identical to SEQ ID NO: 39472

SEQ ID NO: 319174 - RNA, 64 nt, Homo Sapiens; identical to SEQ ID NO: 39473

SEQ ID NO: 319175 - RNA, 64 nt, Homo Sapiens; identical to SEQ ID NO: 39474

SEQ ID NO: 319176 - RNA, 64 nt, Homo Sapiens; identical to SEQ ID NO: 39475

SEQ ID NO: 319177 - RNA, 64 nt, Homo Sapiens; identical to SEQ ID NO: 39476

SEQ ID NO: 319178 - RNA, 64 nt, Homo Sapiens; identical to SEQ ID NO: 39477

SEQ ID NO: 319179 - RNA, 64 nt, Homo Sapiens; identical to SEQ ID NO: 39478

SEQ ID NO: 319180 - RNA, 64 nt, Homo Sapiens; identical to SEQ ID NO: 39479

SEQ ID NO: 319181 - RNA, 64 nt, Homo Sapiens; identical to SEQ ID NO: 39480

SEQ ID NO: 319182 - RNA, 64 nt, Homo Sapiens; identical to SEQ ID NO: 39481

SEQ ID NO: 319183 - RNA, 64 nt, Homo Sapiens; identical to SEQ ID NO: 39482

SEQ ID NO: 319184 - RNA, 64 nt, Homo Sapiens; identical to SEQ ID NO: 39483

SEQ ID NO: 319185 - RNA, 64 nt, Homo Sapiens; identical to SEQ ID NO: 39484

SEQ ID NO: 319186 - RNA, 64 nt, Homo Sapiens; identical to SEQ ID NO: 39485

SEQ ID NO: 319187 - RNA, 64 nt, Homo Sapiens; identical to SEQ ID NO: 39486

SEQ ID NO: 319188 - RNA, 64 nt, Homo Sapiens; identical to SEQ ID NO: 39487

SEQ ID NO: 319189 - RNA, 64 nt, Homo Sapiens; identical to SEQ ID NO: 39488

SEQ ID NO: 319190 - RNA, 64 nt, Homo Sapiens; identical to SEQ ID NO: 39489

SEQ ID NO: 319191 - RNA, 64 nt, Homo Sapiens; identical to SEQ ID NO: 39490

SEQ ID NO: 319192 - RNA, 64 nt, Homo Sapiens; identical to SEQ ID NO: 39491

SEQ ID NO: 319193 - RNA, 64 nt, Homo Sapiens; identical to SEQ ID NO: 39492

SEQ ID NO: 319194 - RNA, 64 nt, Homo Sapiens; identical to SEQ ID NO: 39493

SEQ ID NO: 319195 - RNA, 64 nt, Homo Sapiens; identical to SEQ ID NO: 39494

SEQ ID NO: 319196 - RNA, 64 nt, Homo Sapiens; identical to SEQ ID NO: 39495

SEQ ID NO: 319197 - RNA, 64 nt, Homo Sapiens; identical to SEQ ID NO: 39496

SEQ ID NO: 319198 - RNA, 64 nt, Homo Sapiens; identical to SEQ ID NO: 39497

SEQ ID NO: 319199 - RNA, 64 nt, Homo Sapiens; identical to SEQ ID NO: 39498

SEQ ID NO: 319200 - RNA, 64 nt, Homo Sapiens; identical to SEQ ID NO: 39499

SEQ ID NO: 319201 - RNA, 64 nt, Homo Sapiens; identical to SEQ ID NO: 39500

SEQ ID NO: 319202 - RNA, 64 nt, Homo Sapiens; identical to SEQ ID NO: 39501

SEQ ID NO: 319203 - RNA, 64 nt, Homo Sapiens; identical to SEQ ID NO: 39502

SEQ ID NO: 319204 - RNA, 64 nt, Homo Sapiens; identical to SEQ ID NO: 39503

SEQ ID NO: 319205 - RNA, 64 nt, Homo Sapiens; identical to SEQ ID NO: 39504

SEQ ID NO: 319206 - RNA, 64 nt, Homo Sapiens; identical to SEQ ID NO: 39505

SEQ ID NO: 319207 - RNA, 64 nt, Homo Sapiens; identical to SEQ ID NO: 39506

SEQ ID NO: 319208 - RNA, 64 nt, Homo Sapiens; identical to SEQ ID NO: 39507

SEQ ID NO: 319209 - RNA, 64 nt, Homo Sapiens; identical to SEQ ID NO: 39508

SEQ ID NO: 319210 - RNA, 64 nt, Homo Sapiens; identical to SEQ ID NO: 39509

SEQ ID NO: 319211 - RNA, 64 nt, Homo Sapiens; identical to SEQ ID NO: 39510

SEQ ID NO: 319212 - RNA, 64 nt, Homo Sapiens; identical to SEQ ID NO: 39511

SEQ ID NO: 319213 - RNA, 64 nt, Homo Sapiens; identical to SEQ ID NO: 39512

SEQ ID NO: 319214 - RNA, 64 nt, Homo Sapiens; identical to SEQ ID NO: 39513

SEQ ID NO: 319215 - RNA, 64 nt, Homo Sapiens; identical to SEQ ID NO: 39514

SEQ ID NO: 319216 - RNA, 64 nt, Homo Sapiens; identical to SEQ ID NO: 39515

SEQ ID NO: 319217 - RNA, 64 nt, Homo Sapiens; identical to SEQ ID NO: 39516

SEQ ID NO: 319218 - RNA, 64 nt, Homo Sapiens; identical to SEQ ID NO: 39517

SEQ ID NO: 319219 - RNA, 64 nt, Homo Sapiens; identical to SEQ ID NO: 39518

SEQ ID NO: 319220 - RNA, 64 nt, Homo Sapiens; identical to SEQ ID NO: 39519

SEQ ID NO: 319221 - RNA, 64 nt, Homo Sapiens; identical to SEQ ID NO: 39520

SEQ ID NO: 319222 - RNA, 64 nt, Homo Sapiens; identical to SEQ ID NO: 39521

SEQ ID NO: 319223 - RNA, 64 nt, Homo Sapiens; identical to SEQ ID NO: 39522

SEQ ID NO: 319224 - RNA, 64 nt, Homo Sapiens; identical to SEQ ID NO: 39523

SEQ ID NO: 319225 - RNA, 64 nt, Homo Sapiens; identical to SEQ ID NO: 39524

SEQ ID NO: 319226 - RNA, 64 nt, Homo Sapiens; identical to SEQ ID NO: 39525

SEQ ID NO: 319227 - RNA, 64 nt, Homo Sapiens; identical to SEQ ID NO: 39526

SEQ ID NO: 319228 - RNA, 64 nt, Homo Sapiens; identical to SEQ ID NO: 39527

SEQ ID NO: 319229 - RNA, 64 nt, Homo Sapiens; identical to SEQ ID NO: 39528

SEQ ID NO: 319230 - RNA, 64 nt, Homo Sapiens; identical to SEQ ID NO: 39529

SEQ ID NO: 319231 - RNA, 64 nt, Homo Sapiens; identical to SEQ ID NO: 39530

SEQ ID NO: 319232 - RNA, 64 nt, Homo Sapiens; identical to SEQ ID NO: 39531

SEQ ID NO: 319233 - RNA, 64 nt, Homo Sapiens; identical to SEQ ID NO: 39532

SEQ ID NO: 319234 - RNA, 64 nt, Homo Sapiens; identical to SEQ ID NO: 39533

SEQ ID NO: 319235 - RNA, 64 nt, Homo Sapiens; identical to SEQ ID NO: 39534

SEQ ID NO: 319236 - RNA, 64 nt, Homo Sapiens; identical to SEQ ID NO: 39535

SEQ ID NO: 319237 - RNA, 64 nt, Homo Sapiens; identical to SEQ ID NO: 39536

SEQ ID NO: 319238 - RNA, 64 nt, Homo Sapiens; identical to SEQ ID NO: 39537

SEQ ID NO: 319239 - RNA, 64 nt, Homo Sapiens; identical to SEQ ID NO: 39538

SEQ ID NO: 319240 - RNA, 64 nt, Homo Sapiens; identical to SEQ ID NO: 39539

SEQ ID NO: 319241 - RNA, 64 nt, Homo Sapiens; identical to SEQ ID NO: 39540

SEQ ID NO: 319242 - RNA, 64 nt, Homo Sapiens; identical to SEQ ID NO: 39541

SEQ ID NO: 319243 - RNA, 64 nt, Homo Sapiens; identical to SEQ ID NO: 39542

SEQ ID NO: 319244 - RNA, 64 nt, Homo Sapiens; identical to SEQ ID NO: 39543

SEQ ID NO: 319245 - RNA, 64 nt, Homo Sapiens; identical to SEQ ID NO: 39544

SEQ ID NO: 319246 - RNA, 64 nt, Homo Sapiens; identical to SEQ ID NO: 39545

SEQ ID NO: 319247 - RNA, 64 nt, Homo Sapiens; identical to SEQ ID NO: 39546

SEQ ID NO: 319248 - RNA, 64 nt, Homo Sapiens; identical to SEQ ID NO: 39547

SEQ ID NO: 319249 - RNA, 64 nt, Homo Sapiens; identical to SEQ ID NO: 39548

SEQ ID NO: 319250 - RNA, 64 nt, Homo Sapiens; identical to SEQ ID NO: 39549

SEQ ID NO: 319251 - RNA, 64 nt, Homo Sapiens; identical to SEQ ID NO: 39550

SEQ ID NO: 319252 - RNA, 64 nt, Homo Sapiens; identical to SEQ ID NO: 39551

SEQ ID NO: 319253 - RNA, 64 nt, Homo Sapiens; identical to SEQ ID NO: 39552

SEQ ID NO: 319254 - RNA, 64 nt, Homo Sapiens; identical to SEQ ID NO: 39553

SEQ ID NO: 319255 - RNA, 64 nt, Homo Sapiens; identical to SEQ ID NO: 39554

SEQ ID NO: 319256 - RNA, 64 nt, Homo Sapiens; identical to SEQ ID NO: 39555

SEQ ID NO: 319257 - RNA, 64 nt, Homo Sapiens; identical to SEQ ID NO: 39556

SEQ ID NO: 319258 - RNA, 64 nt, Homo Sapiens; identical to SEQ ID NO: 39557

SEQ ID NO: 319259 - RNA, 64 nt, Homo Sapiens; identical to SEQ ID NO: 39558

SEQ ID NO: 319260 - RNA, 64 nt, Homo Sapiens; identical to SEQ ID NO: 39559

SEQ ID NO: 319261 - RNA, 64 nt, Homo Sapiens; identical to SEQ ID NO: 39560

SEQ ID NO: 319262 - RNA, 64 nt, Homo Sapiens; identical to SEQ ID NO: 39561

SEQ ID NO: 319263 - RNA, 64 nt, Homo Sapiens; identical to SEQ ID NO: 39562

SEQ ID NO: 319264 - RNA, 64 nt, Homo Sapiens; identical to SEQ ID NO: 39563

SEQ ID NO: 319265 - RNA, 64 nt, Homo Sapiens; identical to SEQ ID NO: 39564

SEQ ID NO: 319266 - RNA, 64 nt, Homo Sapiens; identical to SEQ ID NO: 39565

SEQ ID NO: 319267 - RNA, 64 nt, Homo Sapiens; identical to SEQ ID NO: 39566

SEQ ID NO: 319268 - RNA, 64 nt, Homo Sapiens; identical to SEQ ID NO: 39567

SEQ ID NO: 319269 - RNA, 64 nt, Homo Sapiens; identical to SEQ ID NO: 39568

SEQ ID NO: 319270 - RNA, 64 nt, Homo Sapiens; identical to SEQ ID NO: 39569

SEQ ID NO: 319271 - RNA, 64 nt, Homo Sapiens; identical to SEQ ID NO: 39570

SEQ ID NO: 319272 - RNA, 64 nt, Homo Sapiens; identical to SEQ ID NO: 39571

SEQ ID NO: 319273 - RNA, 64 nt, Homo Sapiens; identical to SEQ ID NO: 39572

SEQ ID NO: 319274 - RNA, 64 nt, Homo Sapiens; identical to SEQ ID NO: 39573

SEQ ID NO: 319275 - RNA, 64 nt, Homo Sapiens; identical to SEQ ID NO: 39574

SEQ ID NO: 319276 - RNA, 64 nt, Homo Sapiens; identical to SEQ ID NO: 39575

SEQ ID NO: 319277 - RNA, 64 nt, Homo Sapiens; identical to SEQ ID NO: 39576

SEQ ID NO: 319278 - RNA, 64 nt, Homo Sapiens; identical to SEQ ID NO: 39577

SEQ ID NO: 319279 - RNA, 64 nt, Homo Sapiens; identical to SEQ ID NO: 39578

SEQ ID NO: 319280 - RNA, 64 nt, Homo Sapiens; identical to SEQ ID NO: 39579

SEQ ID NO: 319281 - RNA, 64 nt, Homo Sapiens; identical to SEQ ID NO: 39580

SEQ ID NO: 319282 - RNA, 64 nt, Homo Sapiens; identical to SEQ ID NO: 39581

SEQ ID NO: 319283 - RNA, 64 nt, Homo Sapiens; identical to SEQ ID NO: 39582

SEQ ID NO: 319284 - RNA, 64 nt, Homo Sapiens; identical to SEQ ID NO: 39583

SEQ ID NO: 319285 - RNA, 64 nt, Homo Sapiens; identical to SEQ ID NO: 39584

SEQ ID NO: 319286 - RNA, 64 nt, Homo Sapiens; identical to SEQ ID NO: 39585

SEQ ID NO: 319287 - RNA, 64 nt, Homo Sapiens; identical to SEQ ID NO: 39586

SEQ ID NO: 319288 - RNA, 64 nt, Homo Sapiens; identical to SEQ ID NO: 39587

SEQ ID NO: 319289 - RNA, 64 nt, Homo Sapiens; identical to SEQ ID NO: 39588

SEQ ID NO: 319290 - RNA, 64 nt, Homo Sapiens; identical to SEQ ID NO: 39589

SEQ ID NO: 319291 - RNA, 64 nt, Homo Sapiens; identical to SEQ ID NO: 39590

SEQ ID NO: 319292 - RNA, 64 nt, Homo Sapiens; identical to SEQ ID NO: 39591

SEQ ID NO: 319293 - RNA, 64 nt, Homo Sapiens; identical to SEQ ID NO: 39592

SEQ ID NO: 319294 - RNA, 64 nt, Homo Sapiens; identical to SEQ ID NO: 39593

SEQ ID NO: 319295 - RNA, 64 nt, Homo Sapiens; identical to SEQ ID NO: 39594

SEQ ID NO: 319296 - RNA, 64 nt, Homo Sapiens; identical to SEQ ID NO: 39595

SEQ ID NO: 319297 - RNA, 64 nt, Homo Sapiens; identical to SEQ ID NO: 39596

SEQ ID NO: 319298 - RNA, 64 nt, Homo Sapiens; identical to SEQ ID NO: 39597

SEQ ID NO: 319299 - RNA, 64 nt, Homo Sapiens; identical to SEQ ID NO: 39598

SEQ ID NO: 319300 - RNA, 64 nt, Homo Sapiens; identical to SEQ ID NO: 39599

SEQ ID NO: 319301 - RNA, 64 nt, Homo Sapiens; identical to SEQ ID NO: 39600

SEQ ID NO: 319302 - RNA, 64 nt, Homo Sapiens; identical to SEQ ID NO: 39601

SEQ ID NO: 319303 - RNA, 64 nt, Homo Sapiens; identical to SEQ ID NO: 39602

SEQ ID NO: 319304 - RNA, 64 nt, Homo Sapiens; identical to SEQ ID NO: 39603

SEQ ID NO: 319305 - RNA, 64 nt, Homo Sapiens; identical to SEQ ID NO: 39604

SEQ ID NO: 319306 - RNA, 64 nt, Homo Sapiens; identical to SEQ ID NO: 39605

SEQ ID NO: 319307 - RNA, 64 nt, Homo Sapiens; identical to SEQ ID NO: 39606

SEQ ID NO: 319308 - RNA, 64 nt, Homo Sapiens; identical to SEQ ID NO: 39607

SEQ ID NO: 319309 - RNA, 64 nt, Homo Sapiens; identical to SEQ ID NO: 39608

SEQ ID NO: 319310 - RNA, 64 nt, Homo Sapiens; identical to SEQ ID NO: 39609

SEQ ID NO: 319311 - RNA, 64 nt, Homo Sapiens; identical to SEQ ID NO: 39610

SEQ ID NO: 319312 - RNA, 64 nt, Homo Sapiens; identical to SEQ ID NO: 39611

SEQ ID NO: 319313 - RNA, 64 nt, Homo Sapiens; identical to SEQ ID NO: 39612

SEQ ID NO: 319314 - RNA, 64 nt, Homo Sapiens; identical to SEQ ID NO: 39613

SEQ ID NO: 319315 - RNA, 64 nt, Homo Sapiens; identical to SEQ ID NO: 39614

SEQ ID NO: 319316 - RNA, 64 nt, Homo Sapiens; identical to SEQ ID NO: 39615

SEQ ID NO: 319317 - RNA, 64 nt, Homo Sapiens; identical to SEQ ID NO: 39616

SEQ ID NO: 319318 - RNA, 64 nt, Homo Sapiens; identical to SEQ ID NO: 39617

SEQ ID NO: 319319 - RNA, 64 nt, Homo Sapiens; identical to SEQ ID NO: 39618

SEQ ID NO: 319320 - RNA, 64 nt, Homo Sapiens; identical to SEQ ID NO: 39619

SEQ ID NO: 319321 - RNA, 64 nt, Homo Sapiens; identical to SEQ ID NO: 39620

SEQ ID NO: 319322 - RNA, 64 nt, Homo Sapiens; identical to SEQ ID NO: 39621

SEQ ID NO: 319323 - RNA, 64 nt, Homo Sapiens; identical to SEQ ID NO: 39622

SEQ ID NO: 319324 - RNA, 64 nt, Homo Sapiens; identical to SEQ ID NO: 39623

SEQ ID NO: 319325 - RNA, 64 nt, Homo Sapiens; identical to SEQ ID NO: 39624

SEQ ID NO: 319326 - RNA, 64 nt, Homo Sapiens; identical to SEQ ID NO: 39625

SEQ ID NO: 319327 - RNA, 64 nt, Homo Sapiens; identical to SEQ ID NO: 39626

SEQ ID NO: 319328 - RNA, 64 nt, Homo Sapiens; identical to SEQ ID NO: 39627

SEQ ID NO: 319329 - RNA, 64 nt, Homo Sapiens; identical to SEQ ID NO: 39628

SEQ ID NO: 319330 - RNA, 64 nt, Homo Sapiens; identical to SEQ ID NO: 39629

SEQ ID NO: 319331 - RNA, 64 nt, Homo Sapiens; identical to SEQ ID NO: 39630

SEQ ID NO: 319332 - RNA, 64 nt, Homo Sapiens; identical to SEQ ID NO: 39631

SEQ ID NO: 319333 - RNA, 64 nt, Homo Sapiens; identical to SEQ ID NO: 39632

SEQ ID NO: 319334 - RNA, 64 nt, Homo Sapiens; identical to SEQ ID NO: 39633

SEQ ID NO: 319335 - RNA, 64 nt, Homo Sapiens; identical to SEQ ID NO: 39634

SEQ ID NO: 319336 - RNA, 64 nt, Homo Sapiens; identical to SEQ ID NO: 39635

SEQ ID NO: 319337 - RNA, 64 nt, Homo Sapiens; identical to SEQ ID NO: 39636

SEQ ID NO: 319338 - RNA, 64 nt, Homo Sapiens; identical to SEQ ID NO: 39637

SEQ ID NO: 319339 - RNA, 64 nt, Homo Sapiens; identical to SEQ ID NO: 39638

SEQ ID NO: 319340 - RNA, 64 nt, Homo Sapiens; identical to SEQ ID NO: 39639

SEQ ID NO: 319341 - RNA, 64 nt, Homo Sapiens; identical to SEQ ID NO: 39640

SEQ ID NO: 319342 - RNA, 64 nt, Homo Sapiens; identical to SEQ ID NO: 39641

SEQ ID NO: 319343 - RNA, 64 nt, Homo Sapiens; identical to SEQ ID NO: 39642

SEQ ID NO: 319344 - RNA, 64 nt, Homo Sapiens; identical to SEQ ID NO: 39643

SEQ ID NO: 319345 - RNA, 64 nt, Homo Sapiens; identical to SEQ ID NO: 39644

SEQ ID NO: 319346 - RNA, 64 nt, Homo Sapiens; identical to SEQ ID NO: 39645

SEQ ID NO: 319347 - RNA, 64 nt, Homo Sapiens; identical to SEQ ID NO: 39646

SEQ ID NO: 319348 - RNA, 64 nt, Homo Sapiens; identical to SEQ ID NO: 39647

SEQ ID NO: 319349 - RNA, 64 nt, Homo Sapiens; identical to SEQ ID NO: 39648

SEQ ID NO: 319350 - RNA, 64 nt, Homo Sapiens; identical to SEQ ID NO: 39649

SEQ ID NO: 319351 - RNA, 64 nt, Homo Sapiens; identical to SEQ ID NO: 39650

SEQ ID NO: 319352 - RNA, 64 nt, Homo Sapiens; identical to SEQ ID NO: 39651

SEQ ID NO: 319353 - RNA, 64 nt, Homo Sapiens; identical to SEQ ID NO: 39652

SEQ ID NO: 319354 - RNA, 64 nt, Homo Sapiens; identical to SEQ ID NO: 39653

SEQ ID NO: 319355 - RNA, 64 nt, Homo Sapiens; identical to SEQ ID NO: 39654

SEQ ID NO: 319356 - RNA, 64 nt, Homo Sapiens; identical to SEQ ID NO: 39655

SEQ ID NO: 319357 - RNA, 64 nt, Homo Sapiens; identical to SEQ ID NO: 39656

SEQ ID NO: 319358 - RNA, 64 nt, Homo Sapiens; identical to SEQ ID NO: 39657

SEQ ID NO: 319359 - RNA, 64 nt, Homo Sapiens; identical to SEQ ID NO: 39658

SEQ ID NO: 319360 - RNA, 64 nt, Homo Sapiens; identical to SEQ ID NO: 39659

SEQ ID NO: 319361 - RNA, 64 nt, Homo Sapiens; identical to SEQ ID NO: 39660

SEQ ID NO: 319362 - RNA, 64 nt, Homo Sapiens; identical to SEQ ID NO: 39661

SEQ ID NO: 319363 - RNA, 64 nt, Homo Sapiens; identical to SEQ ID NO: 39662

SEQ ID NO: 319364 - RNA, 64 nt, Homo Sapiens; identical to SEQ ID NO: 39663

SEQ ID NO: 319365 - RNA, 64 nt, Homo Sapiens; identical to SEQ ID NO: 39664

SEQ ID NO: 319366 - RNA, 64 nt, Homo Sapiens; identical to SEQ ID NO: 39665

SEQ ID NO: 319367 - RNA, 64 nt, Homo Sapiens; identical to SEQ ID NO: 39666

SEQ ID NO: 319368 - RNA, 64 nt, Homo Sapiens; identical to SEQ ID NO: 39667

SEQ ID NO: 319369 - RNA, 64 nt, Homo Sapiens; identical to SEQ ID NO: 39668

SEQ ID NO: 319370 - RNA, 64 nt, Homo Sapiens; identical to SEQ ID NO: 39669

SEQ ID NO: 319371 - RNA, 64 nt, Homo Sapiens; identical to SEQ ID NO: 39670

SEQ ID NO: 319372 - RNA, 64 nt, Homo Sapiens; identical to SEQ ID NO: 39671

SEQ ID NO: 319373 - RNA, 64 nt, Homo Sapiens; identical to SEQ ID NO: 39672

SEQ ID NO: 319374 - RNA, 64 nt, Homo Sapiens; identical to SEQ ID NO: 39673

SEQ ID NO: 319375 - RNA, 64 nt, Homo Sapiens; identical to SEQ ID NO: 39674

SEQ ID NO: 319376 - RNA, 64 nt, Homo Sapiens; identical to SEQ ID NO: 39675

SEQ ID NO: 319377 - RNA, 64 nt, Homo Sapiens; identical to SEQ ID NO: 39676

SEQ ID NO: 319378 - RNA, 64 nt, Homo Sapiens; identical to SEQ ID NO: 39677

SEQ ID NO: 319379 - RNA, 64 nt, Homo Sapiens; identical to SEQ ID NO: 39678

SEQ ID NO: 319380 - RNA, 64 nt, Homo Sapiens; identical to SEQ ID NO: 39679

SEQ ID NO: 319381 - RNA, 64 nt, Homo Sapiens; identical to SEQ ID NO: 39680

SEQ ID NO: 319382 - RNA, 64 nt, Homo Sapiens; identical to SEQ ID NO: 39681

SEQ ID NO: 319383 - RNA, 64 nt, Homo Sapiens; identical to SEQ ID NO: 39682

SEQ ID NO: 319384 - RNA, 64 nt, Homo Sapiens; identical to SEQ ID NO: 39683

SEQ ID NO: 319385 - RNA, 64 nt, Homo Sapiens; identical to SEQ ID NO: 39684

SEQ ID NO: 319386 - RNA, 64 nt, Homo Sapiens; identical to SEQ ID NO: 39685

SEQ ID NO: 319387 - RNA, 64 nt, Homo Sapiens; identical to SEQ ID NO: 39686

SEQ ID NO: 319388 - RNA, 64 nt, Homo Sapiens; identical to SEQ ID NO: 39687

SEQ ID NO: 319389 - RNA, 64 nt, Homo Sapiens; identical to SEQ ID NO: 39688

SEQ ID NO: 319390 - RNA, 64 nt, Homo Sapiens; identical to SEQ ID NO: 39689

SEQ ID NO: 319391 - RNA, 64 nt, Homo Sapiens; identical to SEQ ID NO: 39690

SEQ ID NO: 319392 - RNA, 64 nt, Homo Sapiens; identical to SEQ ID NO: 39691

SEQ ID NO: 319393 - RNA, 64 nt, Homo Sapiens; identical to SEQ ID NO: 39692

SEQ ID NO: 319394 - RNA, 64 nt, Homo Sapiens; identical to SEQ ID NO: 39693

SEQ ID NO: 319395 - RNA, 64 nt, Homo Sapiens; identical to SEQ ID NO: 39694

SEQ ID NO: 319396 - RNA, 64 nt, Homo Sapiens; identical to SEQ ID NO: 39695

SEQ ID NO: 319397 - RNA, 64 nt, Homo Sapiens; identical to SEQ ID NO: 39696

SEQ ID NO: 319398 - RNA, 64 nt, Homo Sapiens; identical to SEQ ID NO: 39697

SEQ ID NO: 319399 - RNA, 64 nt, Homo Sapiens; identical to SEQ ID NO: 39698

SEQ ID NO: 319400 - RNA, 64 nt, Homo Sapiens; identical to SEQ ID NO: 39699

SEQ ID NO: 319401 - RNA, 64 nt, Homo Sapiens; identical to SEQ ID NO: 39700

SEQ ID NO: 319402 - RNA, 64 nt, Homo Sapiens; identical to SEQ ID NO: 39701

SEQ ID NO: 319403 - RNA, 64 nt, Homo Sapiens; identical to SEQ ID NO: 39702

SEQ ID NO: 319404 - RNA, 64 nt, Homo Sapiens; identical to SEQ ID NO: 39703

SEQ ID NO: 319405 - RNA, 64 nt, Homo Sapiens; identical to SEQ ID NO: 39704

SEQ ID NO: 319406 - RNA, 64 nt, Homo Sapiens; identical to SEQ ID NO: 39705

SEQ ID NO: 319407 - RNA, 64 nt, Homo Sapiens; identical to SEQ ID NO: 39706

SEQ ID NO: 319408 - RNA, 64 nt, Homo Sapiens; identical to SEQ ID NO: 39707

SEQ ID NO: 319409 - RNA, 64 nt, Homo Sapiens; identical to SEQ ID NO: 39708

SEQ ID NO: 319410 - RNA, 64 nt, Homo Sapiens; identical to SEQ ID NO: 39709

SEQ ID NO: 319411 - RNA, 64 nt, Homo Sapiens; identical to SEQ ID NO: 39710

SEQ ID NO: 319412 - RNA, 64 nt, Homo Sapiens; identical to SEQ ID NO: 39711

SEQ ID NO: 319413 - RNA, 64 nt, Homo Sapiens; identical to SEQ ID NO: 39712

SEQ ID NO: 319414 - RNA, 64 nt, Homo Sapiens; identical to SEQ ID NO: 39713

SEQ ID NO: 319415 - RNA, 64 nt, Homo Sapiens; identical to SEQ ID NO: 39714

SEQ ID NO: 319416 - RNA, 64 nt, Homo Sapiens; identical to SEQ ID NO: 39715

SEQ ID NO: 319417 - RNA, 64 nt, Homo Sapiens; identical to SEQ ID NO: 39716

SEQ ID NO: 319418 - RNA, 64 nt, Homo Sapiens; identical to SEQ ID NO: 39717

SEQ ID NO: 319419 - RNA, 64 nt, Homo Sapiens; identical to SEQ ID NO: 39718

SEQ ID NO: 319420 - RNA, 64 nt, Homo Sapiens; identical to SEQ ID NO: 39719

SEQ ID NO: 319421 - RNA, 64 nt, Homo Sapiens; identical to SEQ ID NO: 39720

SEQ ID NO: 319422 - RNA, 64 nt, Homo Sapiens; identical to SEQ ID NO: 39721

SEQ ID NO: 319423 - RNA, 64 nt, Homo Sapiens; identical to SEQ ID NO: 39722

SEQ ID NO: 319424 - RNA, 64 nt, Homo Sapiens; identical to SEQ ID NO: 39723

SEQ ID NO: 319425 - RNA, 64 nt, Homo Sapiens; identical to SEQ ID NO: 39724

SEQ ID NO: 319426 - RNA, 64 nt, Homo Sapiens; identical to SEQ ID NO: 39725

SEQ ID NO: 319427 - RNA, 64 nt, Homo Sapiens; identical to SEQ ID NO: 39726

SEQ ID NO: 319428 - RNA, 64 nt, Homo Sapiens; identical to SEQ ID NO: 39727

SEQ ID NO: 319429 - RNA, 64 nt, Homo Sapiens; identical to SEQ ID NO: 39728

SEQ ID NO: 319430 - RNA, 64 nt, Homo Sapiens; identical to SEQ ID NO: 39729

SEQ ID NO: 319431 - RNA, 64 nt, Homo Sapiens; identical to SEQ ID NO: 39730

SEQ ID NO: 319432 - RNA, 64 nt, Homo Sapiens; identical to SEQ ID NO: 39731

SEQ ID NO: 319433 - RNA, 64 nt, Homo Sapiens; identical to SEQ ID NO: 39732

SEQ ID NO: 319434 - RNA, 64 nt, Homo Sapiens; identical to SEQ ID NO: 39733

SEQ ID NO: 319435 - RNA, 64 nt, Homo Sapiens; identical to SEQ ID NO: 39734

SEQ ID NO: 319436 - RNA, 64 nt, Homo Sapiens; identical to SEQ ID NO: 39735

SEQ ID NO: 319437 - RNA, 64 nt, Homo Sapiens; identical to SEQ ID NO: 39736

SEQ ID NO: 319438 - RNA, 64 nt, Homo Sapiens; identical to SEQ ID NO: 39737

SEQ ID NO: 319439 - RNA, 64 nt, Homo Sapiens; identical to SEQ ID NO: 39738

SEQ ID NO: 319440 - RNA, 64 nt, Homo Sapiens; identical to SEQ ID NO: 39739

SEQ ID NO: 319441 - RNA, 64 nt, Homo Sapiens; identical to SEQ ID NO: 39740

SEQ ID NO: 319442 - RNA, 64 nt, Homo Sapiens; identical to SEQ ID NO: 39741

SEQ ID NO: 319443 - RNA, 64 nt, Homo Sapiens; identical to SEQ ID NO: 39742

SEQ ID NO: 319444 - RNA, 64 nt, Homo Sapiens; identical to SEQ ID NO: 39743

SEQ ID NO: 319445 - RNA, 64 nt, Homo Sapiens; identical to SEQ ID NO: 39744

SEQ ID NO: 319446 - RNA, 64 nt, Homo Sapiens; identical to SEQ ID NO: 39745

SEQ ID NO: 319447 - RNA, 64 nt, Homo Sapiens; identical to SEQ ID NO: 39746

SEQ ID NO: 319448 - RNA, 64 nt, Homo Sapiens; identical to SEQ ID NO: 39747

SEQ ID NO: 319449 - RNA, 64 nt, Homo Sapiens; identical to SEQ ID NO: 39748

SEQ ID NO: 319450 - RNA, 64 nt, Homo Sapiens; identical to SEQ ID NO: 39749

SEQ ID NO: 319451 - RNA, 64 nt, Homo Sapiens; identical to SEQ ID NO: 39750

SEQ ID NO: 319452 - RNA, 64 nt, Homo Sapiens; identical to SEQ ID NO: 39751

SEQ ID NO: 319453 - RNA, 64 nt, Homo Sapiens; identical to SEQ ID NO: 39752

SEQ ID NO: 319454 - RNA, 64 nt, Homo Sapiens; identical to SEQ ID NO: 39753

SEQ ID NO: 319455 - RNA, 64 nt, Homo Sapiens; identical to SEQ ID NO: 39754

SEQ ID NO: 319456 - RNA, 64 nt, Homo Sapiens; identical to SEQ ID NO: 39755

SEQ ID NO: 319457 - RNA, 64 nt, Homo Sapiens; identical to SEQ ID NO: 39756

SEQ ID NO: 319458 - RNA, 64 nt, Homo Sapiens; identical to SEQ ID NO: 39757

SEQ ID NO: 319459 - RNA, 64 nt, Homo Sapiens; identical to SEQ ID NO: 39758

SEQ ID NO: 319460 - RNA, 64 nt, Homo Sapiens; identical to SEQ ID NO: 39759

SEQ ID NO: 319461 - RNA, 64 nt, Homo Sapiens; identical to SEQ ID NO: 39760

SEQ ID NO: 319462 - RNA, 64 nt, Homo Sapiens; identical to SEQ ID NO: 39761

SEQ ID NO: 319463 - RNA, 64 nt, Homo Sapiens; identical to SEQ ID NO: 39762

SEQ ID NO: 319464 - RNA, 64 nt, Homo Sapiens; identical to SEQ ID NO: 39763

SEQ ID NO: 319465 - RNA, 64 nt, Homo Sapiens; identical to SEQ ID NO: 39764

SEQ ID NO: 319466 - RNA, 64 nt, Homo Sapiens; identical to SEQ ID NO: 39765

SEQ ID NO: 319467 - RNA, 64 nt, Homo Sapiens; identical to SEQ ID NO: 39766

SEQ ID NO: 319468 - RNA, 64 nt, Homo Sapiens; identical to SEQ ID NO: 39767

SEQ ID NO: 319469 - RNA, 64 nt, Homo Sapiens; identical to SEQ ID NO: 39768

SEQ ID NO: 319470 - RNA, 64 nt, Homo Sapiens; identical to SEQ ID NO: 39769

SEQ ID NO: 319471 - RNA, 64 nt, Homo Sapiens; identical to SEQ ID NO: 39770

SEQ ID NO: 319472 - RNA, 64 nt, Homo Sapiens; identical to SEQ ID NO: 39771

SEQ ID NO: 319473 - RNA, 64 nt, Homo Sapiens; identical to SEQ ID NO: 39772

SEQ ID NO: 319474 - RNA, 64 nt, Homo Sapiens; identical to SEQ ID NO: 39773

SEQ ID NO: 319475 - RNA, 64 nt, Homo Sapiens; identical to SEQ ID NO: 39774

SEQ ID NO: 319476 - RNA, 64 nt, Homo Sapiens; identical to SEQ ID NO: 39775

SEQ ID NO: 319477 - RNA, 64 nt, Homo Sapiens; identical to SEQ ID NO: 39776

SEQ ID NO: 319478 - RNA, 64 nt, Homo Sapiens; identical to SEQ ID NO: 39777

SEQ ID NO: 319479 - RNA, 64 nt, Homo Sapiens; identical to SEQ ID NO: 39778

SEQ ID NO: 319480 - RNA, 64 nt, Homo Sapiens; identical to SEQ ID NO: 39779

SEQ ID NO: 319481 - RNA, 64 nt, Homo Sapiens; identical to SEQ ID NO: 39780

SEQ ID NO: 319482 - RNA, 64 nt, Homo Sapiens; identical to SEQ ID NO: 39781

SEQ ID NO: 319483 - RNA, 64 nt, Homo Sapiens; identical to SEQ ID NO: 39782

SEQ ID NO: 319484 - RNA, 64 nt, Homo Sapiens; identical to SEQ ID NO: 39783

SEQ ID NO: 319485 - RNA, 64 nt, Homo Sapiens; identical to SEQ ID NO: 39784

SEQ ID NO: 319486 - RNA, 64 nt, Homo Sapiens; identical to SEQ ID NO: 39785

SEQ ID NO: 319487 - RNA, 64 nt, Homo Sapiens; identical to SEQ ID NO: 39786

SEQ ID NO: 319488 - RNA, 64 nt, Homo Sapiens; identical to SEQ ID NO: 39787

SEQ ID NO: 319489 - RNA, 64 nt, Homo Sapiens; identical to SEQ ID NO: 39788

SEQ ID NO: 319490 - RNA, 64 nt, Homo Sapiens; identical to SEQ ID NO: 39789

SEQ ID NO: 319491 - RNA, 64 nt, Homo Sapiens; identical to SEQ ID NO: 39790

SEQ ID NO: 319492 - RNA, 64 nt, Homo Sapiens; identical to SEQ ID NO: 39791

SEQ ID NO: 319493 - RNA, 64 nt, Homo Sapiens; identical to SEQ ID NO: 39792

SEQ ID NO: 319494 - RNA, 64 nt, Homo Sapiens; identical to SEQ ID NO: 39793

SEQ ID NO: 319495 - RNA, 64 nt, Homo Sapiens; identical to SEQ ID NO: 39794

SEQ ID NO: 319496 - RNA, 64 nt, Homo Sapiens; identical to SEQ ID NO: 39795

SEQ ID NO: 319497 - RNA, 64 nt, Homo Sapiens; identical to SEQ ID NO: 39796

SEQ ID NO: 319498 - RNA, 64 nt, Homo Sapiens; identical to SEQ ID NO: 39797

SEQ ID NO: 319499 - RNA, 64 nt, Homo Sapiens; identical to SEQ ID NO: 39798

SEQ ID NO: 319500 - RNA, 64 nt, Homo Sapiens; identical to SEQ ID NO: 39799

SEQ ID NO: 319501 - RNA, 64 nt, Homo Sapiens; identical to SEQ ID NO: 39800

SEQ ID NO: 319502 - RNA, 64 nt, Homo Sapiens; identical to SEQ ID NO: 39801

SEQ ID NO: 319503 - RNA, 64 nt, Homo Sapiens; identical to SEQ ID NO: 39802

SEQ ID NO: 319504 - RNA, 64 nt, Homo Sapiens; identical to SEQ ID NO: 39803

SEQ ID NO: 319505 - RNA, 64 nt, Homo Sapiens; identical to SEQ ID NO: 39804

SEQ ID NO: 319506 - RNA, 64 nt, Homo Sapiens; identical to SEQ ID NO: 39805

SEQ ID NO: 319507 - RNA, 64 nt, Homo Sapiens; identical to SEQ ID NO: 39806

SEQ ID NO: 319508 - RNA, 64 nt, Homo Sapiens; identical to SEQ ID NO: 39807

SEQ ID NO: 319509 - RNA, 64 nt, Homo Sapiens; identical to SEQ ID NO: 39808

SEQ ID NO: 319510 - RNA, 64 nt, Homo Sapiens; identical to SEQ ID NO: 39809

SEQ ID NO: 319511 - RNA, 64 nt, Homo Sapiens; identical to SEQ ID NO: 39810

SEQ ID NO: 319512 - RNA, 64 nt, Homo Sapiens; identical to SEQ ID NO: 39811

SEQ ID NO: 319513 - RNA, 64 nt, Homo Sapiens; identical to SEQ ID NO: 39812

SEQ ID NO: 319514 - RNA, 64 nt, Homo Sapiens; identical to SEQ ID NO: 39813

SEQ ID NO: 319515 - RNA, 64 nt, Homo Sapiens; identical to SEQ ID NO: 39814

SEQ ID NO: 319516 - RNA, 64 nt, Homo Sapiens; identical to SEQ ID NO: 39815

SEQ ID NO: 319517 - RNA, 64 nt, Homo Sapiens; identical to SEQ ID NO: 39816

SEQ ID NO: 319518 - RNA, 64 nt, Homo Sapiens; identical to SEQ ID NO: 39817

SEQ ID NO: 319519 - RNA, 64 nt, Homo Sapiens; identical to SEQ ID NO: 39818

SEQ ID NO: 319520 - RNA, 64 nt, Homo Sapiens; identical to SEQ ID NO: 39819

SEQ ID NO: 319521 - RNA, 64 nt, Homo Sapiens; identical to SEQ ID NO: 39820

SEQ ID NO: 319522 - RNA, 64 nt, Homo Sapiens; identical to SEQ ID NO: 39821

SEQ ID NO: 319523 - RNA, 64 nt, Homo Sapiens; identical to SEQ ID NO: 39822

SEQ ID NO: 319524 - RNA, 64 nt, Homo Sapiens; identical to SEQ ID NO: 39823

SEQ ID NO: 319525 - RNA, 64 nt, Homo Sapiens; identical to SEQ ID NO: 39824

SEQ ID NO: 319526 - RNA, 64 nt, Homo Sapiens; identical to SEQ ID NO: 39825

SEQ ID NO: 319527 - RNA, 64 nt, Homo Sapiens; identical to SEQ ID NO: 39826

SEQ ID NO: 319528 - RNA, 64 nt, Homo Sapiens; identical to SEQ ID NO: 39827

SEQ ID NO: 319529 - RNA, 64 nt, Homo Sapiens; identical to SEQ ID NO: 39828

SEQ ID NO: 319530 - RNA, 64 nt, Homo Sapiens; identical to SEQ ID NO: 39829

SEQ ID NO: 319531 - RNA, 64 nt, Homo Sapiens; identical to SEQ ID NO: 39830

SEQ ID NO: 319532 - RNA, 64 nt, Homo Sapiens; identical to SEQ ID NO: 39831

SEQ ID NO: 319533 - RNA, 64 nt, Homo Sapiens; identical to SEQ ID NO: 39832

SEQ ID NO: 319534 - RNA, 64 nt, Homo Sapiens; identical to SEQ ID NO: 39833

SEQ ID NO: 319535 - RNA, 64 nt, Homo Sapiens; identical to SEQ ID NO: 39834

SEQ ID NO: 319536 - RNA, 64 nt, Homo Sapiens; identical to SEQ ID NO: 39835

SEQ ID NO: 319537 - RNA, 64 nt, Homo Sapiens; identical to SEQ ID NO: 39836

SEQ ID NO: 319538 - RNA, 64 nt, Homo Sapiens; identical to SEQ ID NO: 39837

SEQ ID NO: 319539 - RNA, 64 nt, Homo Sapiens; identical to SEQ ID NO: 39838

SEQ ID NO: 319540 - RNA, 64 nt, Homo Sapiens; identical to SEQ ID NO: 39839

SEQ ID NO: 319541 - RNA, 64 nt, Homo Sapiens; identical to SEQ ID NO: 39840

SEQ ID NO: 319542 - RNA, 64 nt, Homo Sapiens; identical to SEQ ID NO: 39841

SEQ ID NO: 319543 - RNA, 64 nt, Homo Sapiens; identical to SEQ ID NO: 39842

SEQ ID NO: 319544 - RNA, 64 nt, Homo Sapiens; identical to SEQ ID NO: 39843

SEQ ID NO: 319545 - RNA, 64 nt, Homo Sapiens; identical to SEQ ID NO: 39844

SEQ ID NO: 319546 - RNA, 64 nt, Homo Sapiens; identical to SEQ ID NO: 39845

SEQ ID NO: 319547 - RNA, 64 nt, Homo Sapiens; identical to SEQ ID NO: 39846

SEQ ID NO: 319548 - RNA, 64 nt, Homo Sapiens; identical to SEQ ID NO: 39847

SEQ ID NO: 319549 - RNA, 64 nt, Homo Sapiens; identical to SEQ ID NO: 39848

SEQ ID NO: 319550 - RNA, 64 nt, Homo Sapiens; identical to SEQ ID NO: 39849

SEQ ID NO: 319551 - RNA, 64 nt, Homo Sapiens; identical to SEQ ID NO: 39850

SEQ ID NO: 319552 - RNA, 64 nt, Homo Sapiens; identical to SEQ ID NO: 39851

SEQ ID NO: 319553 - RNA, 64 nt, Homo Sapiens; identical to SEQ ID NO: 39852

SEQ ID NO: 319554 - RNA, 64 nt, Homo Sapiens; identical to SEQ ID NO: 39853

SEQ ID NO: 319555 - RNA, 64 nt, Homo Sapiens; identical to SEQ ID NO: 39854

SEQ ID NO: 319556 - RNA, 64 nt, Homo Sapiens; identical to SEQ ID NO: 39855

SEQ ID NO: 319557 - RNA, 64 nt, Homo Sapiens; identical to SEQ ID NO: 39856

SEQ ID NO: 319558 - RNA, 64 nt, Homo Sapiens; identical to SEQ ID NO: 39857

SEQ ID NO: 319559 - RNA, 64 nt, Homo Sapiens; identical to SEQ ID NO: 39858

SEQ ID NO: 319560 - RNA, 64 nt, Homo Sapiens; identical to SEQ ID NO: 39859

SEQ ID NO: 319561 - RNA, 64 nt, Homo Sapiens; identical to SEQ ID NO: 39860

SEQ ID NO: 319562 - RNA, 64 nt, Homo Sapiens; identical to SEQ ID NO: 39861

SEQ ID NO: 319563 - RNA, 64 nt, Homo Sapiens; identical to SEQ ID NO: 39862

SEQ ID NO: 319564 - RNA, 64 nt, Homo Sapiens; identical to SEQ ID NO: 39863

SEQ ID NO: 319565 - RNA, 64 nt, Homo Sapiens; identical to SEQ ID NO: 39864

SEQ ID NO: 319566 - RNA, 64 nt, Homo Sapiens; identical to SEQ ID NO: 39865

SEQ ID NO: 319567 - RNA, 64 nt, Homo Sapiens; identical to SEQ ID NO: 39866

SEQ ID NO: 319568 - RNA, 64 nt, Homo Sapiens; identical to SEQ ID NO: 39867

SEQ ID NO: 319569 - RNA, 64 nt, Homo Sapiens; identical to SEQ ID NO: 39868

SEQ ID NO: 319570 - RNA, 64 nt, Homo Sapiens; identical to SEQ ID NO: 39869

SEQ ID NO: 319571 - RNA, 64 nt, Homo Sapiens; identical to SEQ ID NO: 39870

SEQ ID NO: 319572 - RNA, 64 nt, Homo Sapiens; identical to SEQ ID NO: 39871

SEQ ID NO: 319573 - RNA, 64 nt, Homo Sapiens; identical to SEQ ID NO: 39872

SEQ ID NO: 319574 - RNA, 64 nt, Homo Sapiens; identical to SEQ ID NO: 39873

SEQ ID NO: 319575 - RNA, 64 nt, Homo Sapiens; identical to SEQ ID NO: 39874

SEQ ID NO: 319576 - RNA, 64 nt, Homo Sapiens; identical to SEQ ID NO: 39875

SEQ ID NO: 319577 - RNA, 64 nt, Homo Sapiens; identical to SEQ ID NO: 39876

SEQ ID NO: 319578 - RNA, 64 nt, Homo Sapiens; identical to SEQ ID NO: 39877

SEQ ID NO: 319579 - RNA, 64 nt, Homo Sapiens; identical to SEQ ID NO: 39878

SEQ ID NO: 319580 - RNA, 64 nt, Homo Sapiens; identical to SEQ ID NO: 39879

SEQ ID NO: 319581 - RNA, 64 nt, Homo Sapiens; identical to SEQ ID NO: 39880

SEQ ID NO: 319582 - RNA, 64 nt, Homo Sapiens; identical to SEQ ID NO: 39881

SEQ ID NO: 319583 - RNA, 64 nt, Homo Sapiens; identical to SEQ ID NO: 39882

SEQ ID NO: 319584 - RNA, 64 nt, Homo Sapiens; identical to SEQ ID NO: 39883

SEQ ID NO: 319585 - RNA, 64 nt, Homo Sapiens; identical to SEQ ID NO: 39884

SEQ ID NO: 319586 - RNA, 64 nt, Homo Sapiens; identical to SEQ ID NO: 39885

SEQ ID NO: 319587 - RNA, 64 nt, Homo Sapiens; identical to SEQ ID NO: 39886

SEQ ID NO: 319588 - RNA, 64 nt, Homo Sapiens; identical to SEQ ID NO: 39887

SEQ ID NO: 319589 - RNA, 64 nt, Homo Sapiens; identical to SEQ ID NO: 39888

SEQ ID NO: 319590 - RNA, 64 nt, Homo Sapiens; identical to SEQ ID NO: 39889

SEQ ID NO: 319591 - RNA, 64 nt, Homo Sapiens; identical to SEQ ID NO: 39890

SEQ ID NO: 319592 - RNA, 64 nt, Homo Sapiens; identical to SEQ ID NO: 39891

SEQ ID NO: 319593 - RNA, 64 nt, Homo Sapiens; identical to SEQ ID NO: 39892

SEQ ID NO: 319594 - RNA, 64 nt, Homo Sapiens; identical to SEQ ID NO: 39893

SEQ ID NO: 319595 - RNA, 64 nt, Homo Sapiens; identical to SEQ ID NO: 39894

SEQ ID NO: 319596 - RNA, 64 nt, Homo Sapiens; identical to SEQ ID NO: 39895

SEQ ID NO: 319597 - RNA, 64 nt, Homo Sapiens; identical to SEQ ID NO: 39896

SEQ ID NO: 319598 - RNA, 64 nt, Homo Sapiens; identical to SEQ ID NO: 39897

SEQ ID NO: 319599 - RNA, 64 nt, Homo Sapiens; identical to SEQ ID NO: 39898

SEQ ID NO: 319600 - RNA, 64 nt, Homo Sapiens; identical to SEQ ID NO: 39899

SEQ ID NO: 319601 - RNA, 64 nt, Homo Sapiens; identical to SEQ ID NO: 39900

SEQ ID NO: 319602 - RNA, 64 nt, Homo Sapiens; identical to SEQ ID NO: 39901

SEQ ID NO: 319603 - RNA, 64 nt, Homo Sapiens; identical to SEQ ID NO: 39902

SEQ ID NO: 319604 - RNA, 64 nt, Homo Sapiens; identical to SEQ ID NO: 39903

SEQ ID NO: 319605 - RNA, 64 nt, Homo Sapiens; identical to SEQ ID NO: 39904

SEQ ID NO: 319606 - RNA, 64 nt, Homo Sapiens; identical to SEQ ID NO: 39905

SEQ ID NO: 319607 - RNA, 64 nt, Homo Sapiens; identical to SEQ ID NO: 39906

SEQ ID NO: 319608 - RNA, 64 nt, Homo Sapiens; identical to SEQ ID NO: 39907

SEQ ID NO: 319609 - RNA, 64 nt, Homo Sapiens; identical to SEQ ID NO: 39908

SEQ ID NO: 319610 - RNA, 64 nt, Homo Sapiens; identical to SEQ ID NO: 39909

SEQ ID NO: 319611 - RNA, 64 nt, Homo Sapiens; identical to SEQ ID NO: 39910

SEQ ID NO: 319612 - RNA, 64 nt, Homo Sapiens; identical to SEQ ID NO: 39911

SEQ ID NO: 319613 - RNA, 64 nt, Homo Sapiens; identical to SEQ ID NO: 39912

SEQ ID NO: 319614 - RNA, 64 nt, Homo Sapiens; identical to SEQ ID NO: 39913

SEQ ID NO: 319615 - RNA, 64 nt, Homo Sapiens; identical to SEQ ID NO: 39914

SEQ ID NO: 319616 - RNA, 64 nt, Homo Sapiens; identical to SEQ ID NO: 39915

SEQ ID NO: 319617 - RNA, 64 nt, Homo Sapiens; identical to SEQ ID NO: 39916

SEQ ID NO: 319618 - RNA, 64 nt, Homo Sapiens; identical to SEQ ID NO: 39917

SEQ ID NO: 319619 - RNA, 64 nt, Homo Sapiens; identical to SEQ ID NO: 39918

SEQ ID NO: 319620 - RNA, 64 nt, Homo Sapiens; identical to SEQ ID NO: 39919

SEQ ID NO: 319621 - RNA, 64 nt, Homo Sapiens; identical to SEQ ID NO: 39920

SEQ ID NO: 319622 - RNA, 64 nt, Homo Sapiens; identical to SEQ ID NO: 39921

SEQ ID NO: 319623 - RNA, 64 nt, Homo Sapiens; identical to SEQ ID NO: 39922

SEQ ID NO: 319624 - RNA, 64 nt, Homo Sapiens; identical to SEQ ID NO: 39923

SEQ ID NO: 319625 - RNA, 64 nt, Homo Sapiens; identical to SEQ ID NO: 39924

SEQ ID NO: 319626 - RNA, 64 nt, Homo Sapiens; identical to SEQ ID NO: 39925

SEQ ID NO: 319627 - RNA, 64 nt, Homo Sapiens; identical to SEQ ID NO: 39926

SEQ ID NO: 319628 - RNA, 64 nt, Homo Sapiens; identical to SEQ ID NO: 39927

SEQ ID NO: 319629 - RNA, 64 nt, Homo Sapiens; identical to SEQ ID NO: 39928

SEQ ID NO: 319630 - RNA, 64 nt, Homo Sapiens; identical to SEQ ID NO: 39929

SEQ ID NO: 319631 - RNA, 64 nt, Homo Sapiens; identical to SEQ ID NO: 39930

SEQ ID NO: 319632 - RNA, 64 nt, Homo Sapiens; identical to SEQ ID NO: 39931

SEQ ID NO: 319633 - RNA, 64 nt, Homo Sapiens; identical to SEQ ID NO: 39932

SEQ ID NO: 319634 - RNA, 64 nt, Homo Sapiens; identical to SEQ ID NO: 39933

SEQ ID NO: 319635 - RNA, 64 nt, Homo Sapiens; identical to SEQ ID NO: 39934

SEQ ID NO: 319636 - RNA, 64 nt, Homo Sapiens; identical to SEQ ID NO: 39935

SEQ ID NO: 319637 - RNA, 64 nt, Homo Sapiens; identical to SEQ ID NO: 39936

SEQ ID NO: 319638 - RNA, 64 nt, Homo Sapiens; identical to SEQ ID NO: 39937

SEQ ID NO: 319639 - RNA, 64 nt, Homo Sapiens; identical to SEQ ID NO: 39938

SEQ ID NO: 319640 - RNA, 64 nt, Homo Sapiens; identical to SEQ ID NO: 39939

SEQ ID NO: 319641 - RNA, 64 nt, Homo Sapiens; identical to SEQ ID NO: 39940

SEQ ID NO: 319642 - RNA, 64 nt, Homo Sapiens; identical to SEQ ID NO: 39941

SEQ ID NO: 319643 - RNA, 64 nt, Homo Sapiens; identical to SEQ ID NO: 39942

SEQ ID NO: 319644 - RNA, 64 nt, Homo Sapiens; identical to SEQ ID NO: 39943

SEQ ID NO: 319645 - RNA, 64 nt, Homo Sapiens; identical to SEQ ID NO: 39944

SEQ ID NO: 319646 - RNA, 64 nt, Homo Sapiens; identical to SEQ ID NO: 39945

SEQ ID NO: 319647 - RNA, 64 nt, Homo Sapiens; identical to SEQ ID NO: 39946

SEQ ID NO: 319648 - RNA, 64 nt, Homo Sapiens; identical to SEQ ID NO: 39947

SEQ ID NO: 319649 - RNA, 64 nt, Homo Sapiens; identical to SEQ ID NO: 39948

SEQ ID NO: 319650 - RNA, 64 nt, Homo Sapiens; identical to SEQ ID NO: 39949

SEQ ID NO: 319651 - RNA, 64 nt, Homo Sapiens; identical to SEQ ID NO: 39950

SEQ ID NO: 319652 - RNA, 64 nt, Homo Sapiens; identical to SEQ ID NO: 39951

SEQ ID NO: 319653 - RNA, 64 nt, Homo Sapiens; identical to SEQ ID NO: 39952

SEQ ID NO: 319654 - RNA, 64 nt, Homo Sapiens; identical to SEQ ID NO: 39953

SEQ ID NO: 319655 - RNA, 64 nt, Homo Sapiens; identical to SEQ ID NO: 39954

SEQ ID NO: 319656 - RNA, 64 nt, Homo Sapiens; identical to SEQ ID NO: 39955

SEQ ID NO: 319657 - RNA, 64 nt, Homo Sapiens; identical to SEQ ID NO: 39956

SEQ ID NO: 319658 - RNA, 64 nt, Homo Sapiens; identical to SEQ ID NO: 39957

SEQ ID NO: 319659 - RNA, 64 nt, Homo Sapiens; identical to SEQ ID NO: 39958

SEQ ID NO: 319660 - RNA, 64 nt, Homo Sapiens; identical to SEQ ID NO: 39959

SEQ ID NO: 319661 - RNA, 64 nt, Homo Sapiens; identical to SEQ ID NO: 39960

SEQ ID NO: 319662 - RNA, 64 nt, Homo Sapiens; identical to SEQ ID NO: 39961

SEQ ID NO: 319663 - RNA, 64 nt, Homo Sapiens; identical to SEQ ID NO: 39962

SEQ ID NO: 319664 - RNA, 64 nt, Homo Sapiens; identical to SEQ ID NO: 39963

SEQ ID NO: 319665 - RNA, 64 nt, Homo Sapiens; identical to SEQ ID NO: 39964

SEQ ID NO: 319666 - RNA, 64 nt, Homo Sapiens; identical to SEQ ID NO: 39965

SEQ ID NO: 319667 - RNA, 64 nt, Homo Sapiens; identical to SEQ ID NO: 39966

SEQ ID NO: 319668 - RNA, 64 nt, Homo Sapiens; identical to SEQ ID NO: 39967

SEQ ID NO: 319669 - RNA, 64 nt, Homo Sapiens; identical to SEQ ID NO: 39968

SEQ ID NO: 319670 - RNA, 64 nt, Homo Sapiens; identical to SEQ ID NO: 39969

SEQ ID NO: 319671 - RNA, 64 nt, Homo Sapiens; identical to SEQ ID NO: 39970

SEQ ID NO: 319672 - RNA, 64 nt, Homo Sapiens; identical to SEQ ID NO: 39971

SEQ ID NO: 319673 - RNA, 64 nt, Homo Sapiens; identical to SEQ ID NO: 39972

SEQ ID NO: 319674 - RNA, 64 nt, Homo Sapiens; identical to SEQ ID NO: 39973

SEQ ID NO: 319675 - RNA, 64 nt, Homo Sapiens; identical to SEQ ID NO: 39974

SEQ ID NO: 319676 - RNA, 64 nt, Homo Sapiens; identical to SEQ ID NO: 39975

SEQ ID NO: 319677 - RNA, 64 nt, Homo Sapiens; identical to SEQ ID NO: 39976

SEQ ID NO: 319678 - RNA, 64 nt, Homo Sapiens; identical to SEQ ID NO: 39977

SEQ ID NO: 319679 - RNA, 64 nt, Homo Sapiens; identical to SEQ ID NO: 39978

SEQ ID NO: 319680 - RNA, 64 nt, Homo Sapiens; identical to SEQ ID NO: 39979

SEQ ID NO: 319681 - RNA, 64 nt, Homo Sapiens; identical to SEQ ID NO: 39980

SEQ ID NO: 319682 - RNA, 64 nt, Homo Sapiens; identical to SEQ ID NO: 39981

SEQ ID NO: 319683 - RNA, 64 nt, Homo Sapiens; identical to SEQ ID NO: 39982

SEQ ID NO: 319684 - RNA, 64 nt, Homo Sapiens; identical to SEQ ID NO: 39983

SEQ ID NO: 319685 - RNA, 64 nt, Homo Sapiens; identical to SEQ ID NO: 39984

SEQ ID NO: 319686 - RNA, 64 nt, Homo Sapiens; identical to SEQ ID NO: 39985

SEQ ID NO: 319687 - RNA, 64 nt, Homo Sapiens; identical to SEQ ID NO: 39986

SEQ ID NO: 319688 - RNA, 64 nt, Homo Sapiens; identical to SEQ ID NO: 39987

SEQ ID NO: 319689 - RNA, 64 nt, Homo Sapiens; identical to SEQ ID NO: 39988

SEQ ID NO: 319690 - RNA, 64 nt, Homo Sapiens; identical to SEQ ID NO: 39989

SEQ ID NO: 319691 - RNA, 64 nt, Homo Sapiens; identical to SEQ ID NO: 39990

SEQ ID NO: 319692 - RNA, 64 nt, Homo Sapiens; identical to SEQ ID NO: 39991

SEQ ID NO: 319693 - RNA, 64 nt, Homo Sapiens; identical to SEQ ID NO: 39992

SEQ ID NO: 319694 - RNA, 64 nt, Homo Sapiens; identical to SEQ ID NO: 39993

SEQ ID NO: 319695 - RNA, 64 nt, Homo Sapiens; identical to SEQ ID NO: 39994

SEQ ID NO: 319696 - RNA, 64 nt, Homo Sapiens; identical to SEQ ID NO: 39995

SEQ ID NO: 319697 - RNA, 64 nt, Homo Sapiens; identical to SEQ ID NO: 39996

SEQ ID NO: 319698 - RNA, 64 nt, Homo Sapiens; identical to SEQ ID NO: 39997

SEQ ID NO: 319699 - RNA, 64 nt, Homo Sapiens; identical to SEQ ID NO: 39998

SEQ ID NO: 319700 - RNA, 64 nt, Homo Sapiens; identical to SEQ ID NO: 39999

SEQ ID NO: 319701 - RNA, 64 nt, Homo Sapiens; identical to SEQ ID NO: 40000

SEQ ID NO: 319702 - RNA, 64 nt, Homo Sapiens; identical to SEQ ID NO: 40001

SEQ ID NO: 319703 - RNA, 64 nt, Homo Sapiens; identical to SEQ ID NO: 40002

SEQ ID NO: 319704 - RNA, 64 nt, Homo Sapiens; identical to SEQ ID NO: 40003

SEQ ID NO: 319705 - RNA, 64 nt, Homo Sapiens; identical to SEQ ID NO: 40004

SEQ ID NO: 319706 - RNA, 64 nt, Homo Sapiens; identical to SEQ ID NO: 40005

SEQ ID NO: 319707 - RNA, 64 nt, Homo Sapiens; identical to SEQ ID NO: 40006

SEQ ID NO: 319708 - RNA, 64 nt, Homo Sapiens; identical to SEQ ID NO: 40007

SEQ ID NO: 319709 - RNA, 64 nt, Homo Sapiens; identical to SEQ ID NO: 40008

SEQ ID NO: 319710 - RNA, 64 nt, Homo Sapiens; identical to SEQ ID NO: 40009

SEQ ID NO: 319711 - RNA, 64 nt, Homo Sapiens; identical to SEQ ID NO: 40010

SEQ ID NO: 319712 - RNA, 64 nt, Homo Sapiens; identical to SEQ ID NO: 40011

SEQ ID NO: 319713 - RNA, 64 nt, Homo Sapiens; identical to SEQ ID NO: 40012

SEQ ID NO: 319714 - RNA, 64 nt, Homo Sapiens; identical to SEQ ID NO: 40013

SEQ ID NO: 319715 - RNA, 64 nt, Homo Sapiens; identical to SEQ ID NO: 40014

SEQ ID NO: 319716 - RNA, 64 nt, Homo Sapiens; identical to SEQ ID NO: 40015

SEQ ID NO: 319717 - RNA, 64 nt, Homo Sapiens; identical to SEQ ID NO: 40016

SEQ ID NO: 319718 - RNA, 64 nt, Homo Sapiens; identical to SEQ ID NO: 40017

SEQ ID NO: 319719 - RNA, 64 nt, Homo Sapiens; identical to SEQ ID NO: 40018

SEQ ID NO: 319720 - RNA, 64 nt, Homo Sapiens; identical to SEQ ID NO: 40019

SEQ ID NO: 319721 - RNA, 64 nt, Homo Sapiens; identical to SEQ ID NO: 40020

SEQ ID NO: 319722 - RNA, 64 nt, Homo Sapiens; identical to SEQ ID NO: 40021

SEQ ID NO: 319723 - RNA, 64 nt, Homo Sapiens; identical to SEQ ID NO: 40022

SEQ ID NO: 319724 - RNA, 64 nt, Homo Sapiens; identical to SEQ ID NO: 40023

SEQ ID NO: 319725 - RNA, 64 nt, Homo Sapiens; identical to SEQ ID NO: 40024

SEQ ID NO: 319726 - RNA, 64 nt, Homo Sapiens; identical to SEQ ID NO: 40025

SEQ ID NO: 319727 - RNA, 64 nt, Homo Sapiens; identical to SEQ ID NO: 40026

SEQ ID NO: 319728 - RNA, 64 nt, Homo Sapiens; identical to SEQ ID NO: 40027

SEQ ID NO: 319729 - RNA, 64 nt, Homo Sapiens; identical to SEQ ID NO: 40028

SEQ ID NO: 319730 - RNA, 64 nt, Homo Sapiens; identical to SEQ ID NO: 40029

SEQ ID NO: 319731 - RNA, 64 nt, Homo Sapiens; identical to SEQ ID NO: 40030

SEQ ID NO: 319732 - RNA, 64 nt, Homo Sapiens; identical to SEQ ID NO: 40031

SEQ ID NO: 319733 - RNA, 64 nt, Homo Sapiens; identical to SEQ ID NO: 40032

SEQ ID NO: 319734 - RNA, 64 nt, Homo Sapiens; identical to SEQ ID NO: 40033

SEQ ID NO: 319735 - RNA, 64 nt, Homo Sapiens; identical to SEQ ID NO: 40034

SEQ ID NO: 319736 - RNA, 64 nt, Homo Sapiens; identical to SEQ ID NO: 40035

SEQ ID NO: 319737 - RNA, 64 nt, Homo Sapiens; identical to SEQ ID NO: 40036

SEQ ID NO: 319738 - RNA, 64 nt, Homo Sapiens; identical to SEQ ID NO: 40037

SEQ ID NO: 319739 - RNA, 64 nt, Homo Sapiens; identical to SEQ ID NO: 40038

SEQ ID NO: 319740 - RNA, 64 nt, Homo Sapiens; identical to SEQ ID NO: 40039

SEQ ID NO: 319741 - RNA, 64 nt, Homo Sapiens; identical to SEQ ID NO: 40040

SEQ ID NO: 319742 - RNA, 64 nt, Homo Sapiens; identical to SEQ ID NO: 40041

SEQ ID NO: 319743 - RNA, 64 nt, Homo Sapiens; identical to SEQ ID NO: 40042

SEQ ID NO: 319744 - RNA, 64 nt, Homo Sapiens; identical to SEQ ID NO: 40043

SEQ ID NO: 319745 - RNA, 64 nt, Homo Sapiens; identical to SEQ ID NO: 40044

SEQ ID NO: 319746 - RNA, 64 nt, Homo Sapiens; identical to SEQ ID NO: 40045

SEQ ID NO: 319747 - RNA, 64 nt, Homo Sapiens; identical to SEQ ID NO: 40046

SEQ ID NO: 319748 - RNA, 64 nt, Homo Sapiens; identical to SEQ ID NO: 40047

SEQ ID NO: 319749 - RNA, 64 nt, Homo Sapiens; identical to SEQ ID NO: 40048

SEQ ID NO: 319750 - RNA, 64 nt, Homo Sapiens; identical to SEQ ID NO: 40049

SEQ ID NO: 319751 - RNA, 64 nt, Homo Sapiens; identical to SEQ ID NO: 40050

SEQ ID NO: 319752 - RNA, 64 nt, Homo Sapiens; identical to SEQ ID NO: 40051

SEQ ID NO: 319753 - RNA, 64 nt, Homo Sapiens; identical to SEQ ID NO: 40052

SEQ ID NO: 319754 - RNA, 64 nt, Homo Sapiens; identical to SEQ ID NO: 40053

SEQ ID NO: 319755 - RNA, 64 nt, Homo Sapiens; identical to SEQ ID NO: 40054

SEQ ID NO: 319756 - RNA, 64 nt, Homo Sapiens; identical to SEQ ID NO: 40055

SEQ ID NO: 319757 - RNA, 64 nt, Homo Sapiens; identical to SEQ ID NO: 40056

SEQ ID NO: 319758 - RNA, 64 nt, Homo Sapiens; identical to SEQ ID NO: 40057

SEQ ID NO: 319759 - RNA, 64 nt, Homo Sapiens; identical to SEQ ID NO: 40058

SEQ ID NO: 319760 - RNA, 64 nt, Homo Sapiens; identical to SEQ ID NO: 40059

SEQ ID NO: 319761 - RNA, 64 nt, Homo Sapiens; identical to SEQ ID NO: 40060

SEQ ID NO: 319762 - RNA, 64 nt, Homo Sapiens; identical to SEQ ID NO: 40061

SEQ ID NO: 319763 - RNA, 64 nt, Homo Sapiens; identical to SEQ ID NO: 40062

SEQ ID NO: 319764 - RNA, 64 nt, Homo Sapiens; identical to SEQ ID NO: 40063

SEQ ID NO: 319765 - RNA, 64 nt, Homo Sapiens; identical to SEQ ID NO: 40064

SEQ ID NO: 319766 - RNA, 64 nt, Homo Sapiens; identical to SEQ ID NO: 40065

SEQ ID NO: 319767 - RNA, 64 nt, Homo Sapiens; identical to SEQ ID NO: 40066

SEQ ID NO: 319768 - RNA, 64 nt, Homo Sapiens; identical to SEQ ID NO: 40067

SEQ ID NO: 319769 - RNA, 64 nt, Homo Sapiens; identical to SEQ ID NO: 40068

SEQ ID NO: 319770 - RNA, 64 nt, Homo Sapiens; identical to SEQ ID NO: 40069

SEQ ID NO: 319771 - RNA, 64 nt, Homo Sapiens; identical to SEQ ID NO: 40070

SEQ ID NO: 319772 - RNA, 64 nt, Homo Sapiens; identical to SEQ ID NO: 40071

SEQ ID NO: 319773 - RNA, 64 nt, Homo Sapiens; identical to SEQ ID NO: 40072

SEQ ID NO: 319774 - RNA, 64 nt, Homo Sapiens; identical to SEQ ID NO: 40073

SEQ ID NO: 319775 - RNA, 64 nt, Homo Sapiens; identical to SEQ ID NO: 40074

SEQ ID NO: 319776 - RNA, 64 nt, Homo Sapiens; identical to SEQ ID NO: 40075

SEQ ID NO: 319777 - RNA, 64 nt, Homo Sapiens; identical to SEQ ID NO: 40076

SEQ ID NO: 319778 - RNA, 64 nt, Homo Sapiens; identical to SEQ ID NO: 40077

SEQ ID NO: 319779 - RNA, 64 nt, Homo Sapiens; identical to SEQ ID NO: 40078

SEQ ID NO: 319780 - RNA, 64 nt, Homo Sapiens; identical to SEQ ID NO: 40079

SEQ ID NO: 319781 - RNA, 64 nt, Homo Sapiens; identical to SEQ ID NO: 40080

SEQ ID NO: 319782 - RNA, 64 nt, Homo Sapiens; identical to SEQ ID NO: 40081

SEQ ID NO: 319783 - RNA, 64 nt, Homo Sapiens; identical to SEQ ID NO: 40082

SEQ ID NO: 319784 - RNA, 64 nt, Homo Sapiens; identical to SEQ ID NO: 40083

SEQ ID NO: 319785 - RNA, 64 nt, Homo Sapiens; identical to SEQ ID NO: 40084

SEQ ID NO: 319786 - RNA, 64 nt, Homo Sapiens; identical to SEQ ID NO: 40085

SEQ ID NO: 319787 - RNA, 64 nt, Homo Sapiens; identical to SEQ ID NO: 40086

SEQ ID NO: 319788 - RNA, 64 nt, Homo Sapiens; identical to SEQ ID NO: 40087

SEQ ID NO: 319789 - RNA, 64 nt, Homo Sapiens; identical to SEQ ID NO: 40088

SEQ ID NO: 319790 - RNA, 64 nt, Homo Sapiens; identical to SEQ ID NO: 40089

SEQ ID NO: 319791 - RNA, 64 nt, Homo Sapiens; identical to SEQ ID NO: 40090

SEQ ID NO: 319792 - RNA, 64 nt, Homo Sapiens; identical to SEQ ID NO: 40091

SEQ ID NO: 319793 - RNA, 64 nt, Homo Sapiens; identical to SEQ ID NO: 40092

SEQ ID NO: 319794 - RNA, 64 nt, Homo Sapiens; identical to SEQ ID NO: 40093

SEQ ID NO: 319795 - RNA, 64 nt, Homo Sapiens; identical to SEQ ID NO: 40094

SEQ ID NO: 319796 - RNA, 64 nt, Homo Sapiens; identical to SEQ ID NO: 40095

SEQ ID NO: 319797 - RNA, 64 nt, Homo Sapiens; identical to SEQ ID NO: 40096

SEQ ID NO: 319798 - RNA, 64 nt, Homo Sapiens; identical to SEQ ID NO: 40097

SEQ ID NO: 319799 - RNA, 64 nt, Homo Sapiens; identical to SEQ ID NO: 40098

SEQ ID NO: 319800 - RNA, 64 nt, Homo Sapiens; identical to SEQ ID NO: 40099

SEQ ID NO: 319801 - RNA, 64 nt, Homo Sapiens; identical to SEQ ID NO: 40100

SEQ ID NO: 319802 - RNA, 64 nt, Homo Sapiens; identical to SEQ ID NO: 40101

SEQ ID NO: 319803 - RNA, 64 nt, Homo Sapiens; identical to SEQ ID NO: 40102

SEQ ID NO: 319804 - RNA, 64 nt, Homo Sapiens; identical to SEQ ID NO: 40103

SEQ ID NO: 319805 - RNA, 64 nt, Homo Sapiens; identical to SEQ ID NO: 40104

SEQ ID NO: 319806 - RNA, 64 nt, Homo Sapiens; identical to SEQ ID NO: 40105

SEQ ID NO: 319807 - RNA, 64 nt, Homo Sapiens; identical to SEQ ID NO: 40106

SEQ ID NO: 319808 - RNA, 64 nt, Homo Sapiens; identical to SEQ ID NO: 40107

SEQ ID NO: 319809 - RNA, 64 nt, Homo Sapiens; identical to SEQ ID NO: 40108

SEQ ID NO: 319810 - RNA, 64 nt, Homo Sapiens; identical to SEQ ID NO: 40109

SEQ ID NO: 319811 - RNA, 64 nt, Homo Sapiens; identical to SEQ ID NO: 40110

SEQ ID NO: 319812 - RNA, 64 nt, Homo Sapiens; identical to SEQ ID NO: 40111

SEQ ID NO: 319813 - RNA, 64 nt, Homo Sapiens; identical to SEQ ID NO: 40112

SEQ ID NO: 319814 - RNA, 64 nt, Homo Sapiens; identical to SEQ ID NO: 40113

SEQ ID NO: 319815 - RNA, 64 nt, Homo Sapiens; identical to SEQ ID NO: 40114

SEQ ID NO: 319816 - RNA, 64 nt, Homo Sapiens; identical to SEQ ID NO: 40115

SEQ ID NO: 319817 - RNA, 64 nt, Homo Sapiens; identical to SEQ ID NO: 40116

SEQ ID NO: 319818 - RNA, 64 nt, Homo Sapiens; identical to SEQ ID NO: 40117

SEQ ID NO: 319819 - RNA, 64 nt, Homo Sapiens; identical to SEQ ID NO: 40118

SEQ ID NO: 319820 - RNA, 64 nt, Homo Sapiens; identical to SEQ ID NO: 40119

SEQ ID NO: 319821 - RNA, 64 nt, Homo Sapiens; identical to SEQ ID NO: 40120

SEQ ID NO: 319822 - RNA, 64 nt, Homo Sapiens; identical to SEQ ID NO: 40121

SEQ ID NO: 319823 - RNA, 64 nt, Homo Sapiens; identical to SEQ ID NO: 40122

SEQ ID NO: 319824 - RNA, 64 nt, Homo Sapiens; identical to SEQ ID NO: 40123

SEQ ID NO: 319825 - RNA, 64 nt, Homo Sapiens; identical to SEQ ID NO: 40124

SEQ ID NO: 319826 - RNA, 64 nt, Homo Sapiens; identical to SEQ ID NO: 40125

SEQ ID NO: 319827 - RNA, 64 nt, Homo Sapiens; identical to SEQ ID NO: 40126

SEQ ID NO: 319828 - RNA, 64 nt, Homo Sapiens; identical to SEQ ID NO: 40127

SEQ ID NO: 319829 - RNA, 64 nt, Homo Sapiens; identical to SEQ ID NO: 40128

SEQ ID NO: 319830 - RNA, 64 nt, Homo Sapiens; identical to SEQ ID NO: 40129

SEQ ID NO: 319831 - RNA, 64 nt, Homo Sapiens; identical to SEQ ID NO: 40130

SEQ ID NO: 319832 - RNA, 64 nt, Homo Sapiens; identical to SEQ ID NO: 40131

SEQ ID NO: 319833 - RNA, 64 nt, Homo Sapiens; identical to SEQ ID NO: 40132

SEQ ID NO: 319834 - RNA, 64 nt, Homo Sapiens; identical to SEQ ID NO: 40133

SEQ ID NO: 319835 - RNA, 64 nt, Homo Sapiens; identical to SEQ ID NO: 40134

SEQ ID NO: 319836 - RNA, 64 nt, Homo Sapiens; identical to SEQ ID NO: 40135

SEQ ID NO: 319837 - RNA, 64 nt, Homo Sapiens; identical to SEQ ID NO: 40136

SEQ ID NO: 319838 - RNA, 64 nt, Homo Sapiens; identical to SEQ ID NO: 40137

SEQ ID NO: 319839 - RNA, 64 nt, Homo Sapiens; identical to SEQ ID NO: 40138

SEQ ID NO: 319840 - RNA, 64 nt, Homo Sapiens; identical to SEQ ID NO: 40139

SEQ ID NO: 319841 - RNA, 64 nt, Homo Sapiens; identical to SEQ ID NO: 40140

SEQ ID NO: 319842 - RNA, 64 nt, Homo Sapiens; identical to SEQ ID NO: 40141

SEQ ID NO: 319843 - RNA, 64 nt, Homo Sapiens; identical to SEQ ID NO: 40142

SEQ ID NO: 319844 - RNA, 64 nt, Homo Sapiens; identical to SEQ ID NO: 40143

SEQ ID NO: 319845 - RNA, 64 nt, Homo Sapiens; identical to SEQ ID NO: 40144

SEQ ID NO: 319846 - RNA, 64 nt, Homo Sapiens; identical to SEQ ID NO: 40145

SEQ ID NO: 319847 - RNA, 64 nt, Homo Sapiens; identical to SEQ ID NO: 40146

SEQ ID NO: 319848 - RNA, 64 nt, Homo Sapiens; identical to SEQ ID NO: 40147

SEQ ID NO: 319849 - RNA, 64 nt, Homo Sapiens; identical to SEQ ID NO: 40148

SEQ ID NO: 319850 - RNA, 64 nt, Homo Sapiens; identical to SEQ ID NO: 40149

SEQ ID NO: 319851 - RNA, 64 nt, Homo Sapiens; identical to SEQ ID NO: 40150

SEQ ID NO: 319852 - RNA, 64 nt, Homo Sapiens; identical to SEQ ID NO: 40151

SEQ ID NO: 319853 - RNA, 64 nt, Homo Sapiens; identical to SEQ ID NO: 40152

SEQ ID NO: 319854 - RNA, 64 nt, Homo Sapiens; identical to SEQ ID NO: 40153

SEQ ID NO: 319855 - RNA, 64 nt, Homo Sapiens; identical to SEQ ID NO: 40154

SEQ ID NO: 319856 - RNA, 64 nt, Homo Sapiens; identical to SEQ ID NO: 40155

SEQ ID NO: 319857 - RNA, 64 nt, Homo Sapiens; identical to SEQ ID NO: 40156

SEQ ID NO: 319858 - RNA, 64 nt, Homo Sapiens; identical to SEQ ID NO: 40157

SEQ ID NO: 319859 - RNA, 64 nt, Homo Sapiens; identical to SEQ ID NO: 40158

SEQ ID NO: 319860 - RNA, 64 nt, Homo Sapiens; identical to SEQ ID NO: 40159

SEQ ID NO: 319861 - RNA, 64 nt, Homo Sapiens; identical to SEQ ID NO: 40160

SEQ ID NO: 319862 - RNA, 64 nt, Homo Sapiens; identical to SEQ ID NO: 40161

SEQ ID NO: 319863 - RNA, 64 nt, Homo Sapiens; identical to SEQ ID NO: 40162

SEQ ID NO: 319864 - RNA, 64 nt, Homo Sapiens; identical to SEQ ID NO: 40163

SEQ ID NO: 319865 - RNA, 64 nt, Homo Sapiens; identical to SEQ ID NO: 40164

SEQ ID NO: 319866 - RNA, 64 nt, Homo Sapiens; identical to SEQ ID NO: 40165

SEQ ID NO: 319867 - RNA, 64 nt, Homo Sapiens; identical to SEQ ID NO: 40166

SEQ ID NO: 319868 - RNA, 64 nt, Homo Sapiens; identical to SEQ ID NO: 40167

SEQ ID NO: 319869 - RNA, 64 nt, Homo Sapiens; identical to SEQ ID NO: 40168

SEQ ID NO: 319870 - RNA, 64 nt, Homo Sapiens; identical to SEQ ID NO: 40169

SEQ ID NO: 319871 - RNA, 64 nt, Homo Sapiens; identical to SEQ ID NO: 40170

SEQ ID NO: 319872 - RNA, 64 nt, Homo Sapiens; identical to SEQ ID NO: 40171

SEQ ID NO: 319873 - RNA, 64 nt, Homo Sapiens; identical to SEQ ID NO: 40172

SEQ ID NO: 319874 - RNA, 64 nt, Homo Sapiens; identical to SEQ ID NO: 40173

SEQ ID NO: 319875 - RNA, 64 nt, Homo Sapiens; identical to SEQ ID NO: 40174

SEQ ID NO: 319876 - RNA, 64 nt, Homo Sapiens; identical to SEQ ID NO: 40175

SEQ ID NO: 319877 - RNA, 64 nt, Homo Sapiens; identical to SEQ ID NO: 40176

SEQ ID NO: 319878 - RNA, 64 nt, Homo Sapiens; identical to SEQ ID NO: 40177

SEQ ID NO: 319879 - RNA, 64 nt, Homo Sapiens; identical to SEQ ID NO: 40178

SEQ ID NO: 319880 - RNA, 64 nt, Homo Sapiens; identical to SEQ ID NO: 40179

SEQ ID NO: 319881 - RNA, 64 nt, Homo Sapiens; identical to SEQ ID NO: 40180

SEQ ID NO: 319882 - RNA, 64 nt, Homo Sapiens; identical to SEQ ID NO: 40181

SEQ ID NO: 319883 - RNA, 64 nt, Homo Sapiens; identical to SEQ ID NO: 40182

SEQ ID NO: 319884 - RNA, 64 nt, Homo Sapiens; identical to SEQ ID NO: 40183

SEQ ID NO: 319885 - RNA, 64 nt, Homo Sapiens; identical to SEQ ID NO: 40184

SEQ ID NO: 319886 - RNA, 64 nt, Homo Sapiens; identical to SEQ ID NO: 40185

SEQ ID NO: 319887 - RNA, 64 nt, Homo Sapiens; identical to SEQ ID NO: 40186

SEQ ID NO: 319888 - RNA, 64 nt, Homo Sapiens; identical to SEQ ID NO: 40187

SEQ ID NO: 319889 - RNA, 64 nt, Homo Sapiens; identical to SEQ ID NO: 40188

SEQ ID NO: 319890 - RNA, 64 nt, Homo Sapiens; identical to SEQ ID NO: 40189

SEQ ID NO: 319891 - RNA, 64 nt, Homo Sapiens; identical to SEQ ID NO: 40190

SEQ ID NO: 319892 - RNA, 64 nt, Homo Sapiens; identical to SEQ ID NO: 40191

SEQ ID NO: 319893 - RNA, 64 nt, Homo Sapiens; identical to SEQ ID NO: 40192

SEQ ID NO: 319894 - RNA, 64 nt, Homo Sapiens; identical to SEQ ID NO: 40193

SEQ ID NO: 319895 - RNA, 64 nt, Homo Sapiens; identical to SEQ ID NO: 40194

SEQ ID NO: 319896 - RNA, 64 nt, Homo Sapiens; identical to SEQ ID NO: 40195

SEQ ID NO: 319897 - RNA, 64 nt, Homo Sapiens; identical to SEQ ID NO: 40196

SEQ ID NO: 319898 - RNA, 64 nt, Homo Sapiens; identical to SEQ ID NO: 40197

SEQ ID NO: 319899 - RNA, 64 nt, Homo Sapiens; identical to SEQ ID NO: 40198

SEQ ID NO: 319900 - RNA, 64 nt, Homo Sapiens; identical to SEQ ID NO: 40199

SEQ ID NO: 319901 - RNA, 64 nt, Homo Sapiens; identical to SEQ ID NO: 40200

SEQ ID NO: 319902 - RNA, 64 nt, Homo Sapiens; identical to SEQ ID NO: 40201

SEQ ID NO: 319903 - RNA, 64 nt, Homo Sapiens; identical to SEQ ID NO: 40202

SEQ ID NO: 319904 - RNA, 64 nt, Homo Sapiens; identical to SEQ ID NO: 40203

SEQ ID NO: 319905 - RNA, 64 nt, Homo Sapiens; identical to SEQ ID NO: 40204

SEQ ID NO: 319906 - RNA, 64 nt, Homo Sapiens; identical to SEQ ID NO: 40205

SEQ ID NO: 319907 - RNA, 64 nt, Homo Sapiens; identical to SEQ ID NO: 40206

SEQ ID NO: 319908 - RNA, 64 nt, Homo Sapiens; identical to SEQ ID NO: 40207

SEQ ID NO: 319909 - RNA, 64 nt, Homo Sapiens; identical to SEQ ID NO: 40208

SEQ ID NO: 319910 - RNA, 64 nt, Homo Sapiens; identical to SEQ ID NO: 40209

SEQ ID NO: 319911 - RNA, 64 nt, Homo Sapiens; identical to SEQ ID NO: 40210

SEQ ID NO: 319912 - RNA, 64 nt, Homo Sapiens; identical to SEQ ID NO: 40211

SEQ ID NO: 319913 - RNA, 64 nt, Homo Sapiens; identical to SEQ ID NO: 40212

SEQ ID NO: 319914 - RNA, 64 nt, Homo Sapiens; identical to SEQ ID NO: 40213

SEQ ID NO: 319915 - RNA, 64 nt, Homo Sapiens; identical to SEQ ID NO: 40214

SEQ ID NO: 319916 - RNA, 64 nt, Homo Sapiens; identical to SEQ ID NO: 40215

SEQ ID NO: 319917 - RNA, 64 nt, Homo Sapiens; identical to SEQ ID NO: 40216

SEQ ID NO: 319918 - RNA, 64 nt, Homo Sapiens; identical to SEQ ID NO: 40217

SEQ ID NO: 319919 - RNA, 64 nt, Homo Sapiens; identical to SEQ ID NO: 40218

SEQ ID NO: 319920 - RNA, 64 nt, Homo Sapiens; identical to SEQ ID NO: 40219

SEQ ID NO: 319921 - RNA, 64 nt, Homo Sapiens; identical to SEQ ID NO: 40220

SEQ ID NO: 319922 - RNA, 64 nt, Homo Sapiens; identical to SEQ ID NO: 40221

SEQ ID NO: 319923 - RNA, 64 nt, Homo Sapiens; identical to SEQ ID NO: 40222

SEQ ID NO: 319924 - RNA, 64 nt, Homo Sapiens; identical to SEQ ID NO: 40223

SEQ ID NO: 319925 - RNA, 64 nt, Homo Sapiens; identical to SEQ ID NO: 40224

SEQ ID NO: 319926 - RNA, 64 nt, Homo Sapiens; identical to SEQ ID NO: 40225

SEQ ID NO: 319927 - RNA, 64 nt, Homo Sapiens; identical to SEQ ID NO: 40226

SEQ ID NO: 319928 - RNA, 64 nt, Homo Sapiens; identical to SEQ ID NO: 40227

SEQ ID NO: 319929 - RNA, 64 nt, Homo Sapiens; identical to SEQ ID NO: 40228

SEQ ID NO: 319930 - RNA, 64 nt, Homo Sapiens; identical to SEQ ID NO: 40229

SEQ ID NO: 319931 - RNA, 64 nt, Homo Sapiens; identical to SEQ ID NO: 40230

SEQ ID NO: 319932 - RNA, 64 nt, Homo Sapiens; identical to SEQ ID NO: 40231

SEQ ID NO: 319933 - RNA, 64 nt, Homo Sapiens; identical to SEQ ID NO: 40232

SEQ ID NO: 319934 - RNA, 64 nt, Homo Sapiens; identical to SEQ ID NO: 40233

SEQ ID NO: 319935 - RNA, 64 nt, Homo Sapiens; identical to SEQ ID NO: 40234

SEQ ID NO: 319936 - RNA, 64 nt, Homo Sapiens; identical to SEQ ID NO: 40235

SEQ ID NO: 319937 - RNA, 64 nt, Homo Sapiens; identical to SEQ ID NO: 40236

SEQ ID NO: 319938 - RNA, 64 nt, Homo Sapiens; identical to SEQ ID NO: 40237

SEQ ID NO: 319939 - RNA, 64 nt, Homo Sapiens; identical to SEQ ID NO: 40238

SEQ ID NO: 319940 - RNA, 64 nt, Homo Sapiens; identical to SEQ ID NO: 40239

SEQ ID NO: 319941 - RNA, 64 nt, Homo Sapiens; identical to SEQ ID NO: 40240

SEQ ID NO: 319942 - RNA, 64 nt, Homo Sapiens; identical to SEQ ID NO: 40241

SEQ ID NO: 319943 - RNA, 64 nt, Homo Sapiens; identical to SEQ ID NO: 40242

SEQ ID NO: 319944 - RNA, 64 nt, Homo Sapiens; identical to SEQ ID NO: 40243

SEQ ID NO: 319945 - RNA, 64 nt, Homo Sapiens; identical to SEQ ID NO: 40244

SEQ ID NO: 319946 - RNA, 64 nt, Homo Sapiens; identical to SEQ ID NO: 40245

SEQ ID NO: 319947 - RNA, 64 nt, Homo Sapiens; identical to SEQ ID NO: 40246

SEQ ID NO: 319948 - RNA, 64 nt, Homo Sapiens; identical to SEQ ID NO: 40247

SEQ ID NO: 319949 - RNA, 64 nt, Homo Sapiens; identical to SEQ ID NO: 40248

SEQ ID NO: 319950 - RNA, 64 nt, Homo Sapiens; identical to SEQ ID NO: 40249

SEQ ID NO: 319951 - RNA, 64 nt, Homo Sapiens; identical to SEQ ID NO: 40250

SEQ ID NO: 319952 - RNA, 64 nt, Homo Sapiens; identical to SEQ ID NO: 40251

SEQ ID NO: 319953 - RNA, 64 nt, Homo Sapiens; identical to SEQ ID NO: 40252

SEQ ID NO: 319954 - RNA, 64 nt, Homo Sapiens; identical to SEQ ID NO: 40253

SEQ ID NO: 319955 - RNA, 64 nt, Homo Sapiens; identical to SEQ ID NO: 40254

SEQ ID NO: 319956 - RNA, 64 nt, Homo Sapiens; identical to SEQ ID NO: 40255

SEQ ID NO: 319957 - RNA, 64 nt, Homo Sapiens; identical to SEQ ID NO: 40256

SEQ ID NO: 319958 - RNA, 64 nt, Homo Sapiens; identical to SEQ ID NO: 40257

SEQ ID NO: 319959 - RNA, 64 nt, Homo Sapiens; identical to SEQ ID NO: 40258

SEQ ID NO: 319960 - RNA, 64 nt, Homo Sapiens; identical to SEQ ID NO: 40259

SEQ ID NO: 319961 - RNA, 64 nt, Homo Sapiens; identical to SEQ ID NO: 40260

SEQ ID NO: 319962 - RNA, 64 nt, Homo Sapiens; identical to SEQ ID NO: 40261

SEQ ID NO: 319963 - RNA, 64 nt, Homo Sapiens; identical to SEQ ID NO: 40262

SEQ ID NO: 319964 - RNA, 64 nt, Homo Sapiens; identical to SEQ ID NO: 40263

SEQ ID NO: 319965 - RNA, 64 nt, Homo Sapiens; identical to SEQ ID NO: 40264

SEQ ID NO: 319966 - RNA, 64 nt, Homo Sapiens; identical to SEQ ID NO: 40265

SEQ ID NO: 319967 - RNA, 64 nt, Homo Sapiens; identical to SEQ ID NO: 40266

SEQ ID NO: 319968 - RNA, 64 nt, Homo Sapiens; identical to SEQ ID NO: 40267

SEQ ID NO: 319969 - RNA, 64 nt, Homo Sapiens; identical to SEQ ID NO: 40268

SEQ ID NO: 319970 - RNA, 64 nt, Homo Sapiens; identical to SEQ ID NO: 40269

SEQ ID NO: 319971 - RNA, 64 nt, Homo Sapiens; identical to SEQ ID NO: 40270

SEQ ID NO: 319972 - RNA, 64 nt, Homo Sapiens; identical to SEQ ID NO: 40271

SEQ ID NO: 319973 - RNA, 64 nt, Homo Sapiens; identical to SEQ ID NO: 40272

SEQ ID NO: 319974 - RNA, 64 nt, Homo Sapiens; identical to SEQ ID NO: 40273

SEQ ID NO: 319975 - RNA, 64 nt, Homo Sapiens; identical to SEQ ID NO: 40274

SEQ ID NO: 319976 - RNA, 64 nt, Homo Sapiens; identical to SEQ ID NO: 40275

SEQ ID NO: 319977 - RNA, 64 nt, Homo Sapiens; identical to SEQ ID NO: 40276

SEQ ID NO: 319978 - RNA, 64 nt, Homo Sapiens; identical to SEQ ID NO: 40277

SEQ ID NO: 319979 - RNA, 64 nt, Homo Sapiens; identical to SEQ ID NO: 40278

SEQ ID NO: 319980 - RNA, 64 nt, Homo Sapiens; identical to SEQ ID NO: 40279

SEQ ID NO: 319981 - RNA, 64 nt, Homo Sapiens; identical to SEQ ID NO: 40280

SEQ ID NO: 319982 - RNA, 64 nt, Homo Sapiens; identical to SEQ ID NO: 40281

SEQ ID NO: 319983 - RNA, 64 nt, Homo Sapiens; identical to SEQ ID NO: 40282

SEQ ID NO: 319984 - RNA, 64 nt, Homo Sapiens; identical to SEQ ID NO: 40283

SEQ ID NO: 319985 - RNA, 64 nt, Homo Sapiens; identical to SEQ ID NO: 40284

SEQ ID NO: 319986 - RNA, 64 nt, Homo Sapiens; identical to SEQ ID NO: 40285

SEQ ID NO: 319987 - RNA, 64 nt, Homo Sapiens; identical to SEQ ID NO: 40286

SEQ ID NO: 319988 - RNA, 64 nt, Homo Sapiens; identical to SEQ ID NO: 40287

SEQ ID NO: 319989 - RNA, 64 nt, Homo Sapiens; identical to SEQ ID NO: 40288

SEQ ID NO: 319990 - RNA, 64 nt, Homo Sapiens; identical to SEQ ID NO: 40289

SEQ ID NO: 319991 - RNA, 64 nt, Homo Sapiens; identical to SEQ ID NO: 40290

SEQ ID NO: 319992 - RNA, 64 nt, Homo Sapiens; identical to SEQ ID NO: 40291

SEQ ID NO: 319993 - RNA, 64 nt, Homo Sapiens; identical to SEQ ID NO: 40292

SEQ ID NO: 319994 - RNA, 64 nt, Homo Sapiens; identical to SEQ ID NO: 40293

SEQ ID NO: 319995 - RNA, 64 nt, Homo Sapiens; identical to SEQ ID NO: 40294

SEQ ID NO: 319996 - RNA, 64 nt, Homo Sapiens; identical to SEQ ID NO: 40295

SEQ ID NO: 319997 - RNA, 64 nt, Homo Sapiens; identical to SEQ ID NO: 40296

SEQ ID NO: 319998 - RNA, 64 nt, Homo Sapiens; identical to SEQ ID NO: 40297

SEQ ID NO: 319999 - RNA, 64 nt, Homo Sapiens; identical to SEQ ID NO: 40298

SEQ ID NO: 320000 - RNA, 64 nt, Homo Sapiens; identical to SEQ ID NO: 40299

SEQ ID NO: 320001 - RNA, 64 nt, Homo Sapiens; identical to SEQ ID NO: 40300

SEQ ID NO: 320002 - RNA, 64 nt, Homo Sapiens; identical to SEQ ID NO: 40301

SEQ ID NO: 320003 - RNA, 64 nt, Homo Sapiens; identical to SEQ ID NO: 40302

SEQ ID NO: 320004 - RNA, 64 nt, Homo Sapiens; identical to SEQ ID NO: 40303

SEQ ID NO: 320005 - RNA, 64 nt, Homo Sapiens; identical to SEQ ID NO: 40304

SEQ ID NO: 320006 - RNA, 64 nt, Homo Sapiens; identical to SEQ ID NO: 40305

SEQ ID NO: 320007 - RNA, 64 nt, Homo Sapiens; identical to SEQ ID NO: 40306

SEQ ID NO: 320008 - RNA, 64 nt, Homo Sapiens; identical to SEQ ID NO: 40307

SEQ ID NO: 320009 - RNA, 64 nt, Homo Sapiens; identical to SEQ ID NO: 40308

SEQ ID NO: 320010 - RNA, 64 nt, Homo Sapiens; identical to SEQ ID NO: 40309

SEQ ID NO: 320011 - RNA, 64 nt, Homo Sapiens; identical to SEQ ID NO: 40310

SEQ ID NO: 320012 - RNA, 64 nt, Homo Sapiens; identical to SEQ ID NO: 40311

SEQ ID NO: 320013 - RNA, 64 nt, Homo Sapiens; identical to SEQ ID NO: 40312

SEQ ID NO: 320014 - RNA, 64 nt, Homo Sapiens; identical to SEQ ID NO: 40313

SEQ ID NO: 320015 - RNA, 64 nt, Homo Sapiens; identical to SEQ ID NO: 40314

SEQ ID NO: 320016 - RNA, 64 nt, Homo Sapiens; identical to SEQ ID NO: 40315

SEQ ID NO: 320017 - RNA, 64 nt, Homo Sapiens; identical to SEQ ID NO: 40316

SEQ ID NO: 320018 - RNA, 64 nt, Homo Sapiens; identical to SEQ ID NO: 40317

SEQ ID NO: 320019 - RNA, 64 nt, Homo Sapiens; identical to SEQ ID NO: 40318

SEQ ID NO: 320020 - RNA, 64 nt, Homo Sapiens; identical to SEQ ID NO: 40319

SEQ ID NO: 320021 - RNA, 64 nt, Homo Sapiens; identical to SEQ ID NO: 40320

SEQ ID NO: 320022 - RNA, 64 nt, Homo Sapiens; identical to SEQ ID NO: 40321

SEQ ID NO: 320023 - RNA, 64 nt, Homo Sapiens; identical to SEQ ID NO: 40322

SEQ ID NO: 320024 - RNA, 64 nt, Homo Sapiens; identical to SEQ ID NO: 40323

SEQ ID NO: 320025 - RNA, 64 nt, Homo Sapiens; identical to SEQ ID NO: 40324

SEQ ID NO: 320026 - RNA, 64 nt, Homo Sapiens; identical to SEQ ID NO: 40325

SEQ ID NO: 320027 - RNA, 64 nt, Homo Sapiens; identical to SEQ ID NO: 40326

SEQ ID NO: 320028 - RNA, 64 nt, Homo Sapiens; identical to SEQ ID NO: 40327

SEQ ID NO: 320029 - RNA, 64 nt, Homo Sapiens; identical to SEQ ID NO: 40328

SEQ ID NO: 320030 - RNA, 64 nt, Homo Sapiens; identical to SEQ ID NO: 40329

SEQ ID NO: 320031 - RNA, 64 nt, Homo Sapiens; identical to SEQ ID NO: 40330

SEQ ID NO: 320032 - RNA, 64 nt, Homo Sapiens; identical to SEQ ID NO: 40331

SEQ ID NO: 320033 - RNA, 64 nt, Homo Sapiens; identical to SEQ ID NO: 40332

SEQ ID NO: 320034 - RNA, 64 nt, Homo Sapiens; identical to SEQ ID NO: 40333

SEQ ID NO: 320035 - RNA, 64 nt, Homo Sapiens; identical to SEQ ID NO: 40334

SEQ ID NO: 320036 - RNA, 64 nt, Homo Sapiens; identical to SEQ ID NO: 40335

SEQ ID NO: 320037 - RNA, 64 nt, Homo Sapiens; identical to SEQ ID NO: 40336

SEQ ID NO: 320038 - RNA, 64 nt, Homo Sapiens; identical to SEQ ID NO: 40337

SEQ ID NO: 320039 - RNA, 64 nt, Homo Sapiens; identical to SEQ ID NO: 40338

SEQ ID NO: 320040 - RNA, 64 nt, Homo Sapiens; identical to SEQ ID NO: 40339

SEQ ID NO: 320041 - RNA, 64 nt, Homo Sapiens; identical to SEQ ID NO: 40340

SEQ ID NO: 320042 - RNA, 64 nt, Homo Sapiens; identical to SEQ ID NO: 40341

SEQ ID NO: 320043 - RNA, 64 nt, Homo Sapiens; identical to SEQ ID NO: 40342

SEQ ID NO: 320044 - RNA, 64 nt, Homo Sapiens; identical to SEQ ID NO: 40343

SEQ ID NO: 320045 - RNA, 64 nt, Homo Sapiens; identical to SEQ ID NO: 40344

SEQ ID NO: 320046 - RNA, 64 nt, Homo Sapiens; identical to SEQ ID NO: 40345

SEQ ID NO: 320047 - RNA, 64 nt, Homo Sapiens; identical to SEQ ID NO: 40346

SEQ ID NO: 320048 - RNA, 64 nt, Homo Sapiens; identical to SEQ ID NO: 40347

SEQ ID NO: 320049 - RNA, 64 nt, Homo Sapiens; identical to SEQ ID NO: 40348

SEQ ID NO: 320050 - RNA, 64 nt, Homo Sapiens; identical to SEQ ID NO: 40349

SEQ ID NO: 320051 - RNA, 64 nt, Homo Sapiens; identical to SEQ ID NO: 40350

SEQ ID NO: 320052 - RNA, 64 nt, Homo Sapiens; identical to SEQ ID NO: 40351

SEQ ID NO: 320053 - RNA, 64 nt, Homo Sapiens; identical to SEQ ID NO: 40352

SEQ ID NO: 320054 - RNA, 64 nt, Homo Sapiens; identical to SEQ ID NO: 40353

SEQ ID NO: 320055 - RNA, 64 nt, Homo Sapiens; identical to SEQ ID NO: 40354

SEQ ID NO: 320056 - RNA, 64 nt, Homo Sapiens; identical to SEQ ID NO: 40355

SEQ ID NO: 320057 - RNA, 64 nt, Homo Sapiens; identical to SEQ ID NO: 40356

SEQ ID NO: 320058 - RNA, 64 nt, Homo Sapiens; identical to SEQ ID NO: 40357

SEQ ID NO: 320059 - RNA, 64 nt, Homo Sapiens; identical to SEQ ID NO: 40358

SEQ ID NO: 320060 - RNA, 64 nt, Homo Sapiens; identical to SEQ ID NO: 40359

SEQ ID NO: 320061 - RNA, 64 nt, Homo Sapiens; identical to SEQ ID NO: 40360

SEQ ID NO: 320062 - RNA, 64 nt, Homo Sapiens; identical to SEQ ID NO: 40361

SEQ ID NO: 320063 - RNA, 64 nt, Homo Sapiens; identical to SEQ ID NO: 40362

SEQ ID NO: 320064 - RNA, 64 nt, Homo Sapiens; identical to SEQ ID NO: 40363

SEQ ID NO: 320065 - RNA, 64 nt, Homo Sapiens; identical to SEQ ID NO: 40364

SEQ ID NO: 320066 - RNA, 64 nt, Homo Sapiens; identical to SEQ ID NO: 40365

SEQ ID NO: 320067 - RNA, 64 nt, Homo Sapiens; identical to SEQ ID NO: 40366

SEQ ID NO: 320068 - RNA, 64 nt, Homo Sapiens; identical to SEQ ID NO: 40367

SEQ ID NO: 320069 - RNA, 64 nt, Homo Sapiens; identical to SEQ ID NO: 40368

SEQ ID NO: 320070 - RNA, 64 nt, Homo Sapiens; identical to SEQ ID NO: 40369

SEQ ID NO: 320071 - RNA, 64 nt, Homo Sapiens; identical to SEQ ID NO: 40370

SEQ ID NO: 320072 - RNA, 64 nt, Homo Sapiens; identical to SEQ ID NO: 40371

SEQ ID NO: 320073 - RNA, 64 nt, Homo Sapiens; identical to SEQ ID NO: 40372

SEQ ID NO: 320074 - RNA, 64 nt, Homo Sapiens; identical to SEQ ID NO: 40373

SEQ ID NO: 320075 - RNA, 64 nt, Homo Sapiens; identical to SEQ ID NO: 40374

SEQ ID NO: 320076 - RNA, 64 nt, Homo Sapiens; identical to SEQ ID NO: 40375

SEQ ID NO: 320077 - RNA, 64 nt, Homo Sapiens; identical to SEQ ID NO: 40376

SEQ ID NO: 320078 - RNA, 64 nt, Homo Sapiens; identical to SEQ ID NO: 40377

SEQ ID NO: 320079 - RNA, 64 nt, Homo Sapiens; identical to SEQ ID NO: 40378

SEQ ID NO: 320080 - RNA, 64 nt, Homo Sapiens; identical to SEQ ID NO: 40379

SEQ ID NO: 320081 - RNA, 64 nt, Homo Sapiens; identical to SEQ ID NO: 40380

SEQ ID NO: 320082 - RNA, 64 nt, Homo Sapiens; identical to SEQ ID NO: 40381

SEQ ID NO: 320083 - RNA, 64 nt, Homo Sapiens; identical to SEQ ID NO: 40382

SEQ ID NO: 320084 - RNA, 64 nt, Homo Sapiens; identical to SEQ ID NO: 40383

SEQ ID NO: 320085 - RNA, 64 nt, Homo Sapiens; identical to SEQ ID NO: 40384

SEQ ID NO: 320086 - RNA, 64 nt, Homo Sapiens; identical to SEQ ID NO: 40385

SEQ ID NO: 320087 - RNA, 64 nt, Homo Sapiens; identical to SEQ ID NO: 40386

SEQ ID NO: 320088 - RNA, 64 nt, Homo Sapiens; identical to SEQ ID NO: 40387

SEQ ID NO: 320089 - RNA, 64 nt, Homo Sapiens; identical to SEQ ID NO: 40388

SEQ ID NO: 320090 - RNA, 64 nt, Homo Sapiens; identical to SEQ ID NO: 40389

SEQ ID NO: 320091 - RNA, 64 nt, Homo Sapiens; identical to SEQ ID NO: 40390

SEQ ID NO: 320092 - RNA, 64 nt, Homo Sapiens; identical to SEQ ID NO: 40391

SEQ ID NO: 320093 - RNA, 64 nt, Homo Sapiens; identical to SEQ ID NO: 40392

SEQ ID NO: 320094 - RNA, 64 nt, Homo Sapiens; identical to SEQ ID NO: 40393

SEQ ID NO: 320095 - RNA, 64 nt, Homo Sapiens; identical to SEQ ID NO: 40394

SEQ ID NO: 320096 - RNA, 64 nt, Homo Sapiens; identical to SEQ ID NO: 40395

SEQ ID NO: 320097 - RNA, 64 nt, Homo Sapiens; identical to SEQ ID NO: 40396

SEQ ID NO: 320098 - RNA, 64 nt, Homo Sapiens; identical to SEQ ID NO: 40397

SEQ ID NO: 320099 - RNA, 64 nt, Homo Sapiens; identical to SEQ ID NO: 40398

SEQ ID NO: 320100 - RNA, 64 nt, Homo Sapiens; identical to SEQ ID NO: 40399

SEQ ID NO: 320101 - RNA, 64 nt, Homo Sapiens; identical to SEQ ID NO: 40400

SEQ ID NO: 320102 - RNA, 64 nt, Homo Sapiens; identical to SEQ ID NO: 40401

SEQ ID NO: 320103 - RNA, 64 nt, Homo Sapiens; identical to SEQ ID NO: 40402

SEQ ID NO: 320104 - RNA, 64 nt, Homo Sapiens; identical to SEQ ID NO: 40403

SEQ ID NO: 320105 - RNA, 64 nt, Homo Sapiens; identical to SEQ ID NO: 40404

SEQ ID NO: 320106 - RNA, 64 nt, Homo Sapiens; identical to SEQ ID NO: 40405

SEQ ID NO: 320107 - RNA, 64 nt, Homo Sapiens; identical to SEQ ID NO: 40406

SEQ ID NO: 320108 - RNA, 64 nt, Homo Sapiens; identical to SEQ ID NO: 40407

SEQ ID NO: 320109 - RNA, 64 nt, Homo Sapiens; identical to SEQ ID NO: 40408

SEQ ID NO: 320110 - RNA, 64 nt, Homo Sapiens; identical to SEQ ID NO: 40409

SEQ ID NO: 320111 - RNA, 64 nt, Homo Sapiens; identical to SEQ ID NO: 40410

SEQ ID NO: 320112 - RNA, 64 nt, Homo Sapiens; identical to SEQ ID NO: 40411

SEQ ID NO: 320113 - RNA, 64 nt, Homo Sapiens; identical to SEQ ID NO: 40412

SEQ ID NO: 320114 - RNA, 64 nt, Homo Sapiens; identical to SEQ ID NO: 40413

SEQ ID NO: 320115 - RNA, 64 nt, Homo Sapiens; identical to SEQ ID NO: 40414

SEQ ID NO: 320116 - RNA, 64 nt, Homo Sapiens; identical to SEQ ID NO: 40415

SEQ ID NO: 320117 - RNA, 64 nt, Homo Sapiens; identical to SEQ ID NO: 40416

SEQ ID NO: 320118 - RNA, 64 nt, Homo Sapiens; identical to SEQ ID NO: 40417

SEQ ID NO: 320119 - RNA, 64 nt, Homo Sapiens; identical to SEQ ID NO: 40418

SEQ ID NO: 320120 - RNA, 64 nt, Homo Sapiens; identical to SEQ ID NO: 40419

SEQ ID NO: 320121 - RNA, 64 nt, Homo Sapiens; identical to SEQ ID NO: 40420

SEQ ID NO: 320122 - RNA, 64 nt, Homo Sapiens; identical to SEQ ID NO: 40421

SEQ ID NO: 320123 - RNA, 64 nt, Homo Sapiens; identical to SEQ ID NO: 40422

SEQ ID NO: 320124 - RNA, 64 nt, Homo Sapiens; identical to SEQ ID NO: 40423

SEQ ID NO: 320125 - RNA, 64 nt, Homo Sapiens; identical to SEQ ID NO: 40424

SEQ ID NO: 320126 - RNA, 64 nt, Homo Sapiens; identical to SEQ ID NO: 40425

SEQ ID NO: 320127 - RNA, 64 nt, Homo Sapiens; identical to SEQ ID NO: 40426

SEQ ID NO: 320128 - RNA, 64 nt, Homo Sapiens; identical to SEQ ID NO: 40427

SEQ ID NO: 320129 - RNA, 64 nt, Homo Sapiens; identical to SEQ ID NO: 40428

SEQ ID NO: 320130 - RNA, 64 nt, Homo Sapiens; identical to SEQ ID NO: 40429

SEQ ID NO: 320131 - RNA, 64 nt, Homo Sapiens; identical to SEQ ID NO: 40430

SEQ ID NO: 320132 - RNA, 64 nt, Homo Sapiens; identical to SEQ ID NO: 40431

SEQ ID NO: 320133 - RNA, 64 nt, Homo Sapiens; identical to SEQ ID NO: 40432

SEQ ID NO: 320134 - RNA, 64 nt, Homo Sapiens; identical to SEQ ID NO: 40433

SEQ ID NO: 320135 - RNA, 64 nt, Homo Sapiens; identical to SEQ ID NO: 40434

SEQ ID NO: 320136 - RNA, 64 nt, Homo Sapiens; identical to SEQ ID NO: 40435

SEQ ID NO: 320137 - RNA, 64 nt, Homo Sapiens; identical to SEQ ID NO: 40436

SEQ ID NO: 320138 - RNA, 64 nt, Homo Sapiens; identical to SEQ ID NO: 40437

SEQ ID NO: 320139 - RNA, 64 nt, Homo Sapiens; identical to SEQ ID NO: 40438

SEQ ID NO: 320140 - RNA, 64 nt, Homo Sapiens; identical to SEQ ID NO: 40439

SEQ ID NO: 320141 - RNA, 64 nt, Homo Sapiens; identical to SEQ ID NO: 40440

SEQ ID NO: 320142 - RNA, 64 nt, Homo Sapiens; identical to SEQ ID NO: 40441

SEQ ID NO: 320143 - RNA, 64 nt, Homo Sapiens; identical to SEQ ID NO: 40442

SEQ ID NO: 320144 - RNA, 64 nt, Homo Sapiens; identical to SEQ ID NO: 40443

SEQ ID NO: 320145 - RNA, 64 nt, Homo Sapiens; identical to SEQ ID NO: 40444

SEQ ID NO: 320146 - RNA, 64 nt, Homo Sapiens; identical to SEQ ID NO: 40445

SEQ ID NO: 320147 - RNA, 64 nt, Homo Sapiens; identical to SEQ ID NO: 40446

SEQ ID NO: 320148 - RNA, 64 nt, Homo Sapiens; identical to SEQ ID NO: 40447

SEQ ID NO: 320149 - RNA, 64 nt, Homo Sapiens; identical to SEQ ID NO: 40448

SEQ ID NO: 320150 - RNA, 64 nt, Homo Sapiens; identical to SEQ ID NO: 40449

SEQ ID NO: 320151 - RNA, 64 nt, Homo Sapiens; identical to SEQ ID NO: 40450

SEQ ID NO: 320152 - RNA, 64 nt, Homo Sapiens; identical to SEQ ID NO: 40451

SEQ ID NO: 320153 - RNA, 64 nt, Homo Sapiens; identical to SEQ ID NO: 40452

SEQ ID NO: 320154 - RNA, 64 nt, Homo Sapiens; identical to SEQ ID NO: 40453

SEQ ID NO: 320155 - RNA, 64 nt, Homo Sapiens; identical to SEQ ID NO: 40454

SEQ ID NO: 320156 - RNA, 64 nt, Homo Sapiens; identical to SEQ ID NO: 40455

SEQ ID NO: 320157 - RNA, 64 nt, Homo Sapiens; identical to SEQ ID NO: 40456

SEQ ID NO: 320158 - RNA, 64 nt, Homo Sapiens; identical to SEQ ID NO: 40457

SEQ ID NO: 320159 - RNA, 64 nt, Homo Sapiens; identical to SEQ ID NO: 40458

SEQ ID NO: 320160 - RNA, 64 nt, Homo Sapiens; identical to SEQ ID NO: 40459

SEQ ID NO: 320161 - RNA, 64 nt, Homo Sapiens; identical to SEQ ID NO: 40460

SEQ ID NO: 320162 - RNA, 64 nt, Homo Sapiens; identical to SEQ ID NO: 40461

SEQ ID NO: 320163 - RNA, 64 nt, Homo Sapiens; identical to SEQ ID NO: 40462

SEQ ID NO: 320164 - RNA, 64 nt, Homo Sapiens; identical to SEQ ID NO: 40463

SEQ ID NO: 320165 - RNA, 64 nt, Homo Sapiens; identical to SEQ ID NO: 40464

SEQ ID NO: 320166 - RNA, 64 nt, Homo Sapiens; identical to SEQ ID NO: 40465

SEQ ID NO: 320167 - RNA, 64 nt, Homo Sapiens; identical to SEQ ID NO: 40466

SEQ ID NO: 320168 - RNA, 64 nt, Homo Sapiens; identical to SEQ ID NO: 40467

SEQ ID NO: 320169 - RNA, 64 nt, Homo Sapiens; identical to SEQ ID NO: 40468

SEQ ID NO: 320170 - RNA, 64 nt, Homo Sapiens; identical to SEQ ID NO: 40469

SEQ ID NO: 320171 - RNA, 64 nt, Homo Sapiens; identical to SEQ ID NO: 40470

SEQ ID NO: 320172 - RNA, 64 nt, Homo Sapiens; identical to SEQ ID NO: 40471

SEQ ID NO: 320173 - RNA, 64 nt, Homo Sapiens; identical to SEQ ID NO: 40472

SEQ ID NO: 320174 - RNA, 64 nt, Homo Sapiens; identical to SEQ ID NO: 40473

SEQ ID NO: 320175 - RNA, 64 nt, Homo Sapiens; identical to SEQ ID NO: 40474

SEQ ID NO: 320176 - RNA, 64 nt, Homo Sapiens; identical to SEQ ID NO: 40475

SEQ ID NO: 320177 - RNA, 64 nt, Homo Sapiens; identical to SEQ ID NO: 40476

SEQ ID NO: 320178 - RNA, 64 nt, Homo Sapiens; identical to SEQ ID NO: 40477

SEQ ID NO: 320179 - RNA, 64 nt, Homo Sapiens; identical to SEQ ID NO: 40478

SEQ ID NO: 320180 - RNA, 64 nt, Homo Sapiens; identical to SEQ ID NO: 40479

SEQ ID NO: 320181 - RNA, 64 nt, Homo Sapiens; identical to SEQ ID NO: 40480

SEQ ID NO: 320182 - RNA, 64 nt, Homo Sapiens; identical to SEQ ID NO: 40481

SEQ ID NO: 320183 - RNA, 64 nt, Homo Sapiens; identical to SEQ ID NO: 40482

SEQ ID NO: 320184 - RNA, 64 nt, Homo Sapiens; identical to SEQ ID NO: 40483

SEQ ID NO: 320185 - RNA, 64 nt, Homo Sapiens; identical to SEQ ID NO: 40484

SEQ ID NO: 320186 - RNA, 64 nt, Homo Sapiens; identical to SEQ ID NO: 40485

SEQ ID NO: 320187 - RNA, 64 nt, Homo Sapiens; identical to SEQ ID NO: 40486

SEQ ID NO: 320188 - RNA, 64 nt, Homo Sapiens; identical to SEQ ID NO: 40487

SEQ ID NO: 320189 - RNA, 64 nt, Homo Sapiens; identical to SEQ ID NO: 40488

SEQ ID NO: 320190 - RNA, 64 nt, Homo Sapiens; identical to SEQ ID NO: 40489

SEQ ID NO: 320191 - RNA, 64 nt, Homo Sapiens; identical to SEQ ID NO: 40490

SEQ ID NO: 320192 - RNA, 64 nt, Homo Sapiens; identical to SEQ ID NO: 40491

SEQ ID NO: 320193 - RNA, 64 nt, Homo Sapiens; identical to SEQ ID NO: 40492

SEQ ID NO: 320194 - RNA, 64 nt, Homo Sapiens; identical to SEQ ID NO: 40493

SEQ ID NO: 320195 - RNA, 64 nt, Homo Sapiens; identical to SEQ ID NO: 40494

SEQ ID NO: 320196 - RNA, 64 nt, Homo Sapiens; identical to SEQ ID NO: 40495

SEQ ID NO: 320197 - RNA, 64 nt, Homo Sapiens; identical to SEQ ID NO: 40496

SEQ ID NO: 320198 - RNA, 64 nt, Homo Sapiens; identical to SEQ ID NO: 40497

SEQ ID NO: 320199 - RNA, 64 nt, Homo Sapiens; identical to SEQ ID NO: 40498

SEQ ID NO: 320200 - RNA, 64 nt, Homo Sapiens; identical to SEQ ID NO: 40499

SEQ ID NO: 320201 - RNA, 64 nt, Homo Sapiens; identical to SEQ ID NO: 40500

SEQ ID NO: 320202 - RNA, 64 nt, Homo Sapiens; identical to SEQ ID NO: 40501

SEQ ID NO: 320203 - RNA, 64 nt, Homo Sapiens; identical to SEQ ID NO: 40502

SEQ ID NO: 320204 - RNA, 64 nt, Homo Sapiens; identical to SEQ ID NO: 40503

SEQ ID NO: 320205 - RNA, 64 nt, Homo Sapiens; identical to SEQ ID NO: 40504

SEQ ID NO: 320206 - RNA, 64 nt, Homo Sapiens; identical to SEQ ID NO: 40505

SEQ ID NO: 320207 - RNA, 64 nt, Homo Sapiens; identical to SEQ ID NO: 40506

SEQ ID NO: 320208 - RNA, 64 nt, Homo Sapiens; identical to SEQ ID NO: 40507

SEQ ID NO: 320209 - RNA, 64 nt, Homo Sapiens; identical to SEQ ID NO: 40508

SEQ ID NO: 320210 - RNA, 64 nt, Homo Sapiens; identical to SEQ ID NO: 40509

SEQ ID NO: 320211 - RNA, 64 nt, Homo Sapiens; identical to SEQ ID NO: 40510

SEQ ID NO: 320212 - RNA, 64 nt, Homo Sapiens; identical to SEQ ID NO: 40511

SEQ ID NO: 320213 - RNA, 64 nt, Homo Sapiens; identical to SEQ ID NO: 40512

SEQ ID NO: 320214 - RNA, 64 nt, Homo Sapiens; identical to SEQ ID NO: 40513

SEQ ID NO: 320215 - RNA, 64 nt, Homo Sapiens; identical to SEQ ID NO: 40514

SEQ ID NO: 320216 - RNA, 64 nt, Homo Sapiens; identical to SEQ ID NO: 40515

SEQ ID NO: 320217 - RNA, 64 nt, Homo Sapiens; identical to SEQ ID NO: 40516

SEQ ID NO: 320218 - RNA, 64 nt, Homo Sapiens; identical to SEQ ID NO: 40517

SEQ ID NO: 320219 - RNA, 64 nt, Homo Sapiens; identical to SEQ ID NO: 40518

SEQ ID NO: 320220 - RNA, 64 nt, Homo Sapiens; identical to SEQ ID NO: 40519

SEQ ID NO: 320221 - RNA, 64 nt, Homo Sapiens; identical to SEQ ID NO: 40520

SEQ ID NO: 320222 - RNA, 64 nt, Homo Sapiens; identical to SEQ ID NO: 40521

SEQ ID NO: 320223 - RNA, 64 nt, Homo Sapiens; identical to SEQ ID NO: 40522

SEQ ID NO: 320224 - RNA, 64 nt, Homo Sapiens; identical to SEQ ID NO: 40523

SEQ ID NO: 320225 - RNA, 64 nt, Homo Sapiens; identical to SEQ ID NO: 40524

SEQ ID NO: 320226 - RNA, 64 nt, Homo Sapiens; identical to SEQ ID NO: 40525

SEQ ID NO: 320227 - RNA, 64 nt, Homo Sapiens; identical to SEQ ID NO: 40526

SEQ ID NO: 320228 - RNA, 64 nt, Homo Sapiens; identical to SEQ ID NO: 40527

SEQ ID NO: 320229 - RNA, 64 nt, Homo Sapiens; identical to SEQ ID NO: 40528

SEQ ID NO: 320230 - RNA, 64 nt, Homo Sapiens; identical to SEQ ID NO: 40529

SEQ ID NO: 320231 - RNA, 64 nt, Homo Sapiens; identical to SEQ ID NO: 40530

SEQ ID NO: 320232 - RNA, 64 nt, Homo Sapiens; identical to SEQ ID NO: 40531

SEQ ID NO: 320233 - RNA, 64 nt, Homo Sapiens; identical to SEQ ID NO: 40532

SEQ ID NO: 320234 - RNA, 64 nt, Homo Sapiens; identical to SEQ ID NO: 40533

SEQ ID NO: 320235 - RNA, 64 nt, Homo Sapiens; identical to SEQ ID NO: 40534

SEQ ID NO: 320236 - RNA, 64 nt, Homo Sapiens; identical to SEQ ID NO: 40535

SEQ ID NO: 320237 - RNA, 64 nt, Homo Sapiens; identical to SEQ ID NO: 40536

SEQ ID NO: 320238 - RNA, 64 nt, Homo Sapiens; identical to SEQ ID NO: 40537

SEQ ID NO: 320239 - RNA, 64 nt, Homo Sapiens; identical to SEQ ID NO: 40538

SEQ ID NO: 320240 - RNA, 64 nt, Homo Sapiens; identical to SEQ ID NO: 40539

SEQ ID NO: 320241 - RNA, 64 nt, Homo Sapiens; identical to SEQ ID NO: 40540

SEQ ID NO: 320242 - RNA, 64 nt, Homo Sapiens; identical to SEQ ID NO: 40541

SEQ ID NO: 320243 - RNA, 64 nt, Homo Sapiens; identical to SEQ ID NO: 40542

SEQ ID NO: 320244 - RNA, 64 nt, Homo Sapiens; identical to SEQ ID NO: 40543

SEQ ID NO: 320245 - RNA, 64 nt, Homo Sapiens; identical to SEQ ID NO: 40544

SEQ ID NO: 320246 - RNA, 64 nt, Homo Sapiens; identical to SEQ ID NO: 40545

SEQ ID NO: 320247 - RNA, 64 nt, Homo Sapiens; identical to SEQ ID NO: 40546

SEQ ID NO: 320248 - RNA, 64 nt, Homo Sapiens; identical to SEQ ID NO: 40547

SEQ ID NO: 320249 - RNA, 64 nt, Homo Sapiens; identical to SEQ ID NO: 40548

SEQ ID NO: 320250 - RNA, 64 nt, Homo Sapiens; identical to SEQ ID NO: 40549

SEQ ID NO: 320251 - RNA, 64 nt, Homo Sapiens; identical to SEQ ID NO: 40550

SEQ ID NO: 320252 - RNA, 64 nt, Homo Sapiens; identical to SEQ ID NO: 40551

SEQ ID NO: 320253 - RNA, 64 nt, Homo Sapiens; identical to SEQ ID NO: 40552

SEQ ID NO: 320254 - RNA, 64 nt, Homo Sapiens; identical to SEQ ID NO: 40553

SEQ ID NO: 320255 - RNA, 64 nt, Homo Sapiens; identical to SEQ ID NO: 40554

SEQ ID NO: 320256 - RNA, 64 nt, Homo Sapiens; identical to SEQ ID NO: 40555

SEQ ID NO: 320257 - RNA, 64 nt, Homo Sapiens; identical to SEQ ID NO: 40556

SEQ ID NO: 320258 - RNA, 64 nt, Homo Sapiens; identical to SEQ ID NO: 40557

SEQ ID NO: 320259 - RNA, 64 nt, Homo Sapiens; identical to SEQ ID NO: 40558

SEQ ID NO: 320260 - RNA, 64 nt, Homo Sapiens; identical to SEQ ID NO: 40559

SEQ ID NO: 320261 - RNA, 64 nt, Homo Sapiens; identical to SEQ ID NO: 40560

SEQ ID NO: 320262 - RNA, 64 nt, Homo Sapiens; identical to SEQ ID NO: 40561

SEQ ID NO: 320263 - RNA, 64 nt, Homo Sapiens; identical to SEQ ID NO: 40562

SEQ ID NO: 320264 - RNA, 64 nt, Homo Sapiens; identical to SEQ ID NO: 40563

SEQ ID NO: 320265 - RNA, 64 nt, Homo Sapiens; identical to SEQ ID NO: 40564

SEQ ID NO: 320266 - RNA, 64 nt, Homo Sapiens; identical to SEQ ID NO: 40565

SEQ ID NO: 320267 - RNA, 64 nt, Homo Sapiens; identical to SEQ ID NO: 40566

SEQ ID NO: 320268 - RNA, 64 nt, Homo Sapiens; identical to SEQ ID NO: 40567

SEQ ID NO: 320269 - RNA, 64 nt, Homo Sapiens; identical to SEQ ID NO: 40568

SEQ ID NO: 320270 - RNA, 64 nt, Homo Sapiens; identical to SEQ ID NO: 40569

SEQ ID NO: 320271 - RNA, 64 nt, Homo Sapiens; identical to SEQ ID NO: 40570

SEQ ID NO: 320272 - RNA, 64 nt, Homo Sapiens; identical to SEQ ID NO: 40571

SEQ ID NO: 320273 - RNA, 64 nt, Homo Sapiens; identical to SEQ ID NO: 40572

SEQ ID NO: 320274 - RNA, 64 nt, Homo Sapiens; identical to SEQ ID NO: 40573

SEQ ID NO: 320275 - RNA, 64 nt, Homo Sapiens; identical to SEQ ID NO: 40574

SEQ ID NO: 320276 - RNA, 64 nt, Homo Sapiens; identical to SEQ ID NO: 40575

SEQ ID NO: 320277 - RNA, 64 nt, Homo Sapiens; identical to SEQ ID NO: 40576

SEQ ID NO: 320278 - RNA, 64 nt, Homo Sapiens; identical to SEQ ID NO: 40577

SEQ ID NO: 320279 - RNA, 64 nt, Homo Sapiens; identical to SEQ ID NO: 40578

SEQ ID NO: 320280 - RNA, 64 nt, Homo Sapiens; identical to SEQ ID NO: 40579

SEQ ID NO: 320281 - RNA, 64 nt, Homo Sapiens; identical to SEQ ID NO: 40580

SEQ ID NO: 320282 - RNA, 64 nt, Homo Sapiens; identical to SEQ ID NO: 40581

SEQ ID NO: 320283 - RNA, 64 nt, Homo Sapiens; identical to SEQ ID NO: 40582

SEQ ID NO: 320284 - RNA, 64 nt, Homo Sapiens; identical to SEQ ID NO: 40583

SEQ ID NO: 320285 - RNA, 64 nt, Homo Sapiens; identical to SEQ ID NO: 40584

SEQ ID NO: 320286 - RNA, 64 nt, Homo Sapiens; identical to SEQ ID NO: 40585

SEQ ID NO: 320287 - RNA, 64 nt, Homo Sapiens; identical to SEQ ID NO: 40586

SEQ ID NO: 320288 - RNA, 64 nt, Homo Sapiens; identical to SEQ ID NO: 40587

SEQ ID NO: 320289 - RNA, 64 nt, Homo Sapiens; identical to SEQ ID NO: 40588

SEQ ID NO: 320290 - RNA, 64 nt, Homo Sapiens; identical to SEQ ID NO: 40589

SEQ ID NO: 320291 - RNA, 64 nt, Homo Sapiens; identical to SEQ ID NO: 40590

SEQ ID NO: 320292 - RNA, 64 nt, Homo Sapiens; identical to SEQ ID NO: 40591

SEQ ID NO: 320293 - RNA, 64 nt, Homo Sapiens; identical to SEQ ID NO: 40592

SEQ ID NO: 320294 - RNA, 64 nt, Homo Sapiens; identical to SEQ ID NO: 40593

SEQ ID NO: 320295 - RNA, 64 nt, Homo Sapiens; identical to SEQ ID NO: 40594

SEQ ID NO: 320296 - RNA, 64 nt, Homo Sapiens; identical to SEQ ID NO: 40595

SEQ ID NO: 320297 - RNA, 64 nt, Homo Sapiens; identical to SEQ ID NO: 40596

SEQ ID NO: 320298 - RNA, 64 nt, Homo Sapiens; identical to SEQ ID NO: 40597

SEQ ID NO: 320299 - RNA, 64 nt, Homo Sapiens; identical to SEQ ID NO: 40598

SEQ ID NO: 320300 - RNA, 64 nt, Homo Sapiens; identical to SEQ ID NO: 40599

SEQ ID NO: 320301 - RNA, 64 nt, Homo Sapiens; identical to SEQ ID NO: 40600

SEQ ID NO: 320302 - RNA, 64 nt, Homo Sapiens; identical to SEQ ID NO: 40601

SEQ ID NO: 320303 - RNA, 64 nt, Homo Sapiens; identical to SEQ ID NO: 40602

SEQ ID NO: 320304 - RNA, 64 nt, Homo Sapiens; identical to SEQ ID NO: 40603

SEQ ID NO: 320305 - RNA, 64 nt, Homo Sapiens; identical to SEQ ID NO: 40604

SEQ ID NO: 320306 - RNA, 64 nt, Homo Sapiens; identical to SEQ ID NO: 40605

SEQ ID NO: 320307 - RNA, 64 nt, Homo Sapiens; identical to SEQ ID NO: 40606

SEQ ID NO: 320308 - RNA, 64 nt, Homo Sapiens; identical to SEQ ID NO: 40607

SEQ ID NO: 320309 - RNA, 64 nt, Homo Sapiens; identical to SEQ ID NO: 40608

SEQ ID NO: 320310 - RNA, 64 nt, Homo Sapiens; identical to SEQ ID NO: 40609

SEQ ID NO: 320311 - RNA, 64 nt, Homo Sapiens; identical to SEQ ID NO: 40610

SEQ ID NO: 320312 - RNA, 64 nt, Homo Sapiens; identical to SEQ ID NO: 40611

SEQ ID NO: 320313 - RNA, 64 nt, Homo Sapiens; identical to SEQ ID NO: 40612

SEQ ID NO: 320314 - RNA, 64 nt, Homo Sapiens; identical to SEQ ID NO: 40613

SEQ ID NO: 320315 - RNA, 64 nt, Homo Sapiens; identical to SEQ ID NO: 40614

SEQ ID NO: 320316 - RNA, 64 nt, Homo Sapiens; identical to SEQ ID NO: 40615

SEQ ID NO: 320317 - RNA, 64 nt, Homo Sapiens; identical to SEQ ID NO: 40616

SEQ ID NO: 320318 - RNA, 64 nt, Homo Sapiens; identical to SEQ ID NO: 40617

SEQ ID NO: 320319 - RNA, 64 nt, Homo Sapiens; identical to SEQ ID NO: 40618

SEQ ID NO: 320320 - RNA, 64 nt, Homo Sapiens; identical to SEQ ID NO: 40619

SEQ ID NO: 320321 - RNA, 64 nt, Homo Sapiens; identical to SEQ ID NO: 40620

SEQ ID NO: 320322 - RNA, 64 nt, Homo Sapiens; identical to SEQ ID NO: 40621

SEQ ID NO: 320323 - RNA, 64 nt, Homo Sapiens; identical to SEQ ID NO: 40622

SEQ ID NO: 320324 - RNA, 64 nt, Homo Sapiens; identical to SEQ ID NO: 40623

SEQ ID NO: 320325 - RNA, 64 nt, Homo Sapiens; identical to SEQ ID NO: 40624

SEQ ID NO: 320326 - RNA, 64 nt, Homo Sapiens; identical to SEQ ID NO: 40625

SEQ ID NO: 320327 - RNA, 64 nt, Homo Sapiens; identical to SEQ ID NO: 40626

SEQ ID NO: 320328 - RNA, 64 nt, Homo Sapiens; identical to SEQ ID NO: 40627

SEQ ID NO: 320329 - RNA, 64 nt, Homo Sapiens; identical to SEQ ID NO: 40628

SEQ ID NO: 320330 - RNA, 64 nt, Homo Sapiens; identical to SEQ ID NO: 40629

SEQ ID NO: 320331 - RNA, 64 nt, Homo Sapiens; identical to SEQ ID NO: 40630

SEQ ID NO: 320332 - RNA, 64 nt, Homo Sapiens; identical to SEQ ID NO: 40631

SEQ ID NO: 320333 - RNA, 64 nt, Homo Sapiens; identical to SEQ ID NO: 40632

SEQ ID NO: 320334 - RNA, 64 nt, Homo Sapiens; identical to SEQ ID NO: 40633

SEQ ID NO: 320335 - RNA, 64 nt, Homo Sapiens; identical to SEQ ID NO: 40634

SEQ ID NO: 320336 - RNA, 64 nt, Homo Sapiens; identical to SEQ ID NO: 40635

SEQ ID NO: 320337 - RNA, 64 nt, Homo Sapiens; identical to SEQ ID NO: 40636

SEQ ID NO: 320338 - RNA, 64 nt, Homo Sapiens; identical to SEQ ID NO: 40637

SEQ ID NO: 320339 - RNA, 64 nt, Homo Sapiens; identical to SEQ ID NO: 40638

SEQ ID NO: 320340 - RNA, 64 nt, Homo Sapiens; identical to SEQ ID NO: 40639

SEQ ID NO: 320341 - RNA, 64 nt, Homo Sapiens; identical to SEQ ID NO: 40640

SEQ ID NO: 320342 - RNA, 64 nt, Homo Sapiens; identical to SEQ ID NO: 40641

SEQ ID NO: 320343 - RNA, 64 nt, Homo Sapiens; identical to SEQ ID NO: 40642

SEQ ID NO: 320344 - RNA, 64 nt, Homo Sapiens; identical to SEQ ID NO: 40643

SEQ ID NO: 320345 - RNA, 64 nt, Homo Sapiens; identical to SEQ ID NO: 40644

SEQ ID NO: 320346 - RNA, 64 nt, Homo Sapiens; identical to SEQ ID NO: 40645

SEQ ID NO: 320347 - RNA, 64 nt, Homo Sapiens; identical to SEQ ID NO: 40646

SEQ ID NO: 320348 - RNA, 64 nt, Homo Sapiens; identical to SEQ ID NO: 40647

SEQ ID NO: 320349 - RNA, 64 nt, Homo Sapiens; identical to SEQ ID NO: 40648

SEQ ID NO: 320350 - RNA, 64 nt, Homo Sapiens; identical to SEQ ID NO: 40649

SEQ ID NO: 320351 - RNA, 64 nt, Homo Sapiens; identical to SEQ ID NO: 40650

SEQ ID NO: 320352 - RNA, 64 nt, Homo Sapiens; identical to SEQ ID NO: 40651

SEQ ID NO: 320353 - RNA, 64 nt, Homo Sapiens; identical to SEQ ID NO: 40652

SEQ ID NO: 320354 - RNA, 64 nt, Homo Sapiens; identical to SEQ ID NO: 40653

SEQ ID NO: 320355 - RNA, 64 nt, Homo Sapiens; identical to SEQ ID NO: 40654

SEQ ID NO: 320356 - RNA, 64 nt, Homo Sapiens; identical to SEQ ID NO: 40655

SEQ ID NO: 320357 - RNA, 64 nt, Homo Sapiens; identical to SEQ ID NO: 40656

SEQ ID NO: 320358 - RNA, 64 nt, Homo Sapiens; identical to SEQ ID NO: 40657

SEQ ID NO: 320359 - RNA, 64 nt, Homo Sapiens; identical to SEQ ID NO: 40658

SEQ ID NO: 320360 - RNA, 64 nt, Homo Sapiens; identical to SEQ ID NO: 40659

SEQ ID NO: 320361 - RNA, 64 nt, Homo Sapiens; identical to SEQ ID NO: 40660

SEQ ID NO: 320362 - RNA, 64 nt, Homo Sapiens; identical to SEQ ID NO: 40661

SEQ ID NO: 320363 - RNA, 64 nt, Homo Sapiens; identical to SEQ ID NO: 40662

SEQ ID NO: 320364 - RNA, 64 nt, Homo Sapiens; identical to SEQ ID NO: 40663

SEQ ID NO: 320365 - RNA, 64 nt, Homo Sapiens; identical to SEQ ID NO: 40664

SEQ ID NO: 320366 - RNA, 64 nt, Homo Sapiens; identical to SEQ ID NO: 40665

SEQ ID NO: 320367 - RNA, 64 nt, Homo Sapiens; identical to SEQ ID NO: 40666

SEQ ID NO: 320368 - RNA, 64 nt, Homo Sapiens; identical to SEQ ID NO: 40667

SEQ ID NO: 320369 - RNA, 64 nt, Homo Sapiens; identical to SEQ ID NO: 40668

SEQ ID NO: 320370 - RNA, 64 nt, Homo Sapiens; identical to SEQ ID NO: 40669

SEQ ID NO: 320371 - RNA, 64 nt, Homo Sapiens; identical to SEQ ID NO: 40670

SEQ ID NO: 320372 - RNA, 64 nt, Homo Sapiens; identical to SEQ ID NO: 40671

SEQ ID NO: 320373 - RNA, 64 nt, Homo Sapiens; identical to SEQ ID NO: 40672

SEQ ID NO: 320374 - RNA, 64 nt, Homo Sapiens; identical to SEQ ID NO: 40673

SEQ ID NO: 320375 - RNA, 64 nt, Homo Sapiens; identical to SEQ ID NO: 40674

SEQ ID NO: 320376 - RNA, 64 nt, Homo Sapiens; identical to SEQ ID NO: 40675

SEQ ID NO: 320377 - RNA, 64 nt, Homo Sapiens; identical to SEQ ID NO: 40676

SEQ ID NO: 320378 - RNA, 64 nt, Homo Sapiens; identical to SEQ ID NO: 40677

SEQ ID NO: 320379 - RNA, 64 nt, Homo Sapiens; identical to SEQ ID NO: 40678

SEQ ID NO: 320380 - RNA, 64 nt, Homo Sapiens; identical to SEQ ID NO: 40679

SEQ ID NO: 320381 - RNA, 64 nt, Homo Sapiens; identical to SEQ ID NO: 40680

SEQ ID NO: 320382 - RNA, 64 nt, Homo Sapiens; identical to SEQ ID NO: 40681

SEQ ID NO: 320383 - RNA, 64 nt, Homo Sapiens; identical to SEQ ID NO: 40682

SEQ ID NO: 320384 - RNA, 64 nt, Homo Sapiens; identical to SEQ ID NO: 40683

SEQ ID NO: 320385 - RNA, 64 nt, Homo Sapiens; identical to SEQ ID NO: 40684

SEQ ID NO: 320386 - RNA, 64 nt, Homo Sapiens; identical to SEQ ID NO: 40685

SEQ ID NO: 320387 - RNA, 64 nt, Homo Sapiens; identical to SEQ ID NO: 40686

SEQ ID NO: 320388 - RNA, 64 nt, Homo Sapiens; identical to SEQ ID NO: 40687

SEQ ID NO: 320389 - RNA, 64 nt, Homo Sapiens; identical to SEQ ID NO: 40688

SEQ ID NO: 320390 - RNA, 64 nt, Homo Sapiens; identical to SEQ ID NO: 40689

SEQ ID NO: 320391 - RNA, 64 nt, Homo Sapiens; identical to SEQ ID NO: 40690

SEQ ID NO: 320392 - RNA, 64 nt, Homo Sapiens; identical to SEQ ID NO: 40691

SEQ ID NO: 320393 - RNA, 64 nt, Homo Sapiens; identical to SEQ ID NO: 40692

SEQ ID NO: 320394 - RNA, 64 nt, Homo Sapiens; identical to SEQ ID NO: 40693

SEQ ID NO: 320395 - RNA, 64 nt, Homo Sapiens; identical to SEQ ID NO: 40694

SEQ ID NO: 320396 - RNA, 64 nt, Homo Sapiens; identical to SEQ ID NO: 40695

SEQ ID NO: 320397 - RNA, 64 nt, Homo Sapiens; identical to SEQ ID NO: 40696

SEQ ID NO: 320398 - RNA, 64 nt, Homo Sapiens; identical to SEQ ID NO: 40697

SEQ ID NO: 320399 - RNA, 64 nt, Homo Sapiens; identical to SEQ ID NO: 40698

SEQ ID NO: 320400 - RNA, 64 nt, Homo Sapiens; identical to SEQ ID NO: 40699

SEQ ID NO: 320401 - RNA, 64 nt, Homo Sapiens; identical to SEQ ID NO: 40700

SEQ ID NO: 320402 - RNA, 64 nt, Homo Sapiens; identical to SEQ ID NO: 40701

SEQ ID NO: 320403 - RNA, 64 nt, Homo Sapiens; identical to SEQ ID NO: 40702

SEQ ID NO: 320404 - RNA, 64 nt, Homo Sapiens; identical to SEQ ID NO: 40703

SEQ ID NO: 320405 - RNA, 64 nt, Homo Sapiens; identical to SEQ ID NO: 40704

SEQ ID NO: 320406 - RNA, 64 nt, Homo Sapiens; identical to SEQ ID NO: 40705

SEQ ID NO: 320407 - RNA, 64 nt, Homo Sapiens; identical to SEQ ID NO: 40706

SEQ ID NO: 320408 - RNA, 64 nt, Homo Sapiens; identical to SEQ ID NO: 40707

SEQ ID NO: 320409 - RNA, 64 nt, Homo Sapiens; identical to SEQ ID NO: 40708

SEQ ID NO: 320410 - RNA, 64 nt, Homo Sapiens; identical to SEQ ID NO: 40709

SEQ ID NO: 320411 - RNA, 64 nt, Homo Sapiens; identical to SEQ ID NO: 40710

SEQ ID NO: 320412 - RNA, 64 nt, Homo Sapiens; identical to SEQ ID NO: 40711

SEQ ID NO: 320413 - RNA, 64 nt, Homo Sapiens; identical to SEQ ID NO: 40712

SEQ ID NO: 320414 - RNA, 64 nt, Homo Sapiens; identical to SEQ ID NO: 40713

SEQ ID NO: 320415 - RNA, 64 nt, Homo Sapiens; identical to SEQ ID NO: 40714

SEQ ID NO: 320416 - RNA, 64 nt, Homo Sapiens; identical to SEQ ID NO: 40715

SEQ ID NO: 320417 - RNA, 64 nt, Homo Sapiens; identical to SEQ ID NO: 40716

SEQ ID NO: 320418 - RNA, 64 nt, Homo Sapiens; identical to SEQ ID NO: 40717

SEQ ID NO: 320419 - RNA, 64 nt, Homo Sapiens; identical to SEQ ID NO: 40718

SEQ ID NO: 320420 - RNA, 64 nt, Homo Sapiens; identical to SEQ ID NO: 40719

SEQ ID NO: 320421 - RNA, 64 nt, Homo Sapiens; identical to SEQ ID NO: 40720

SEQ ID NO: 320422 - RNA, 64 nt, Homo Sapiens; identical to SEQ ID NO: 40721

SEQ ID NO: 320423 - RNA, 64 nt, Homo Sapiens; identical to SEQ ID NO: 40722

SEQ ID NO: 320424 - RNA, 64 nt, Homo Sapiens; identical to SEQ ID NO: 40723

SEQ ID NO: 320425 - RNA, 64 nt, Homo Sapiens; identical to SEQ ID NO: 40724

SEQ ID NO: 320426 - RNA, 64 nt, Homo Sapiens; identical to SEQ ID NO: 40725

SEQ ID NO: 320427 - RNA, 64 nt, Homo Sapiens; identical to SEQ ID NO: 40726

SEQ ID NO: 320428 - RNA, 64 nt, Homo Sapiens; identical to SEQ ID NO: 40727

SEQ ID NO: 320429 - RNA, 64 nt, Homo Sapiens; identical to SEQ ID NO: 40728

SEQ ID NO: 320430 - RNA, 64 nt, Homo Sapiens; identical to SEQ ID NO: 40729

SEQ ID NO: 320431 - RNA, 64 nt, Homo Sapiens; identical to SEQ ID NO: 40730

SEQ ID NO: 320432 - RNA, 64 nt, Homo Sapiens; identical to SEQ ID NO: 40731

SEQ ID NO: 320433 - RNA, 64 nt, Homo Sapiens; identical to SEQ ID NO: 40732

SEQ ID NO: 320434 - RNA, 64 nt, Homo Sapiens; identical to SEQ ID NO: 40733

SEQ ID NO: 320435 - RNA, 64 nt, Homo Sapiens; identical to SEQ ID NO: 40734

SEQ ID NO: 320436 - RNA, 64 nt, Homo Sapiens; identical to SEQ ID NO: 40735

SEQ ID NO: 320437 - RNA, 64 nt, Homo Sapiens; identical to SEQ ID NO: 40736

SEQ ID NO: 320438 - RNA, 64 nt, Homo Sapiens; identical to SEQ ID NO: 40737

SEQ ID NO: 320439 - RNA, 64 nt, Homo Sapiens; identical to SEQ ID NO: 40738

SEQ ID NO: 320440 - RNA, 64 nt, Homo Sapiens; identical to SEQ ID NO: 40739

SEQ ID NO: 320441 - RNA, 64 nt, Homo Sapiens; identical to SEQ ID NO: 40740

SEQ ID NO: 320442 - RNA, 64 nt, Homo Sapiens; identical to SEQ ID NO: 40741

SEQ ID NO: 320443 - RNA, 64 nt, Homo Sapiens; identical to SEQ ID NO: 40742

SEQ ID NO: 320444 - RNA, 64 nt, Homo Sapiens; identical to SEQ ID NO: 40743

SEQ ID NO: 320445 - RNA, 64 nt, Homo Sapiens; identical to SEQ ID NO: 40744

SEQ ID NO: 320446 - RNA, 64 nt, Homo Sapiens; identical to SEQ ID NO: 40745

SEQ ID NO: 320447 - RNA, 64 nt, Homo Sapiens; identical to SEQ ID NO: 40746

SEQ ID NO: 320448 - RNA, 64 nt, Homo Sapiens; identical to SEQ ID NO: 40747

SEQ ID NO: 320449 - RNA, 64 nt, Homo Sapiens; identical to SEQ ID NO: 40748

SEQ ID NO: 320450 - RNA, 64 nt, Homo Sapiens; identical to SEQ ID NO: 40749

SEQ ID NO: 320451 - RNA, 64 nt, Homo Sapiens; identical to SEQ ID NO: 40750

SEQ ID NO: 320452 - RNA, 64 nt, Homo Sapiens; identical to SEQ ID NO: 40751

SEQ ID NO: 320453 - RNA, 64 nt, Homo Sapiens; identical to SEQ ID NO: 40752

SEQ ID NO: 320454 - RNA, 64 nt, Homo Sapiens; identical to SEQ ID NO: 40753

SEQ ID NO: 320455 - RNA, 64 nt, Homo Sapiens; identical to SEQ ID NO: 40754

SEQ ID NO: 320456 - RNA, 64 nt, Homo Sapiens; identical to SEQ ID NO: 40755

SEQ ID NO: 320457 - RNA, 64 nt, Homo Sapiens; identical to SEQ ID NO: 40756

SEQ ID NO: 320458 - RNA, 64 nt, Homo Sapiens; identical to SEQ ID NO: 40757

SEQ ID NO: 320459 - RNA, 64 nt, Homo Sapiens; identical to SEQ ID NO: 40758

SEQ ID NO: 320460 - RNA, 64 nt, Homo Sapiens; identical to SEQ ID NO: 40759

SEQ ID NO: 320461 - RNA, 64 nt, Homo Sapiens; identical to SEQ ID NO: 40760

SEQ ID NO: 320462 - RNA, 64 nt, Homo Sapiens; identical to SEQ ID NO: 40761

SEQ ID NO: 320463 - RNA, 64 nt, Homo Sapiens; identical to SEQ ID NO: 40762

SEQ ID NO: 320464 - RNA, 64 nt, Homo Sapiens; identical to SEQ ID NO: 40763

SEQ ID NO: 320465 - RNA, 64 nt, Homo Sapiens; identical to SEQ ID NO: 40764

SEQ ID NO: 320466 - RNA, 64 nt, Homo Sapiens; identical to SEQ ID NO: 40765

SEQ ID NO: 320467 - RNA, 64 nt, Homo Sapiens; identical to SEQ ID NO: 40766

SEQ ID NO: 320468 - RNA, 64 nt, Homo Sapiens; identical to SEQ ID NO: 40767

SEQ ID NO: 320469 - RNA, 64 nt, Homo Sapiens; identical to SEQ ID NO: 40768

SEQ ID NO: 320470 - RNA, 64 nt, Homo Sapiens; identical to SEQ ID NO: 40769

SEQ ID NO: 320471 - RNA, 64 nt, Homo Sapiens; identical to SEQ ID NO: 40770

SEQ ID NO: 320472 - RNA, 64 nt, Homo Sapiens; identical to SEQ ID NO: 40771

SEQ ID NO: 320473 - RNA, 64 nt, Homo Sapiens; identical to SEQ ID NO: 40772

SEQ ID NO: 320474 - RNA, 64 nt, Homo Sapiens; identical to SEQ ID NO: 40773

SEQ ID NO: 320475 - RNA, 64 nt, Homo Sapiens; identical to SEQ ID NO: 40774

SEQ ID NO: 320476 - RNA, 64 nt, Homo Sapiens; identical to SEQ ID NO: 40775

SEQ ID NO: 320477 - RNA, 64 nt, Homo Sapiens; identical to SEQ ID NO: 40776

SEQ ID NO: 320478 - RNA, 64 nt, Homo Sapiens; identical to SEQ ID NO: 40777

SEQ ID NO: 320479 - RNA, 64 nt, Homo Sapiens; identical to SEQ ID NO: 40778

SEQ ID NO: 320480 - RNA, 64 nt, Homo Sapiens; identical to SEQ ID NO: 40779

SEQ ID NO: 320481 - RNA, 64 nt, Homo Sapiens; identical to SEQ ID NO: 40780

SEQ ID NO: 320482 - RNA, 64 nt, Homo Sapiens; identical to SEQ ID NO: 40781

SEQ ID NO: 320483 - RNA, 64 nt, Homo Sapiens; identical to SEQ ID NO: 40782

SEQ ID NO: 320484 - RNA, 64 nt, Homo Sapiens; identical to SEQ ID NO: 40783

SEQ ID NO: 320485 - RNA, 64 nt, Homo Sapiens; identical to SEQ ID NO: 40784

SEQ ID NO: 320486 - RNA, 64 nt, Homo Sapiens; identical to SEQ ID NO: 40785

SEQ ID NO: 320487 - RNA, 64 nt, Homo Sapiens; identical to SEQ ID NO: 40786

SEQ ID NO: 320488 - RNA, 64 nt, Homo Sapiens; identical to SEQ ID NO: 40787

SEQ ID NO: 320489 - RNA, 64 nt, Homo Sapiens; identical to SEQ ID NO: 40788

SEQ ID NO: 320490 - RNA, 64 nt, Homo Sapiens; identical to SEQ ID NO: 40789

SEQ ID NO: 320491 - RNA, 64 nt, Homo Sapiens; identical to SEQ ID NO: 40790

SEQ ID NO: 320492 - RNA, 64 nt, Homo Sapiens; identical to SEQ ID NO: 40791

SEQ ID NO: 320493 - RNA, 64 nt, Homo Sapiens; identical to SEQ ID NO: 40792

SEQ ID NO: 320494 - RNA, 64 nt, Homo Sapiens; identical to SEQ ID NO: 40793

SEQ ID NO: 320495 - RNA, 64 nt, Homo Sapiens; identical to SEQ ID NO: 40794

SEQ ID NO: 320496 - RNA, 64 nt, Homo Sapiens; identical to SEQ ID NO: 40795

SEQ ID NO: 320497 - RNA, 64 nt, Homo Sapiens; identical to SEQ ID NO: 40796

SEQ ID NO: 320498 - RNA, 64 nt, Homo Sapiens; identical to SEQ ID NO: 40797

SEQ ID NO: 320499 - RNA, 64 nt, Homo Sapiens; identical to SEQ ID NO: 40798

SEQ ID NO: 320500 - RNA, 64 nt, Homo Sapiens; identical to SEQ ID NO: 40799

SEQ ID NO: 320501 - RNA, 64 nt, Homo Sapiens; identical to SEQ ID NO: 40800

SEQ ID NO: 320502 - RNA, 64 nt, Homo Sapiens; identical to SEQ ID NO: 40801

SEQ ID NO: 320503 - RNA, 64 nt, Homo Sapiens; identical to SEQ ID NO: 40802

SEQ ID NO: 320504 - RNA, 64 nt, Homo Sapiens; identical to SEQ ID NO: 40803

SEQ ID NO: 320505 - RNA, 64 nt, Homo Sapiens; identical to SEQ ID NO: 40804

SEQ ID NO: 320506 - RNA, 64 nt, Homo Sapiens; identical to SEQ ID NO: 40805

SEQ ID NO: 320507 - RNA, 64 nt, Homo Sapiens; identical to SEQ ID NO: 40806

SEQ ID NO: 320508 - RNA, 64 nt, Homo Sapiens; identical to SEQ ID NO: 40807

SEQ ID NO: 320509 - RNA, 64 nt, Homo Sapiens; identical to SEQ ID NO: 40808

SEQ ID NO: 320510 - RNA, 64 nt, Homo Sapiens; identical to SEQ ID NO: 40809

SEQ ID NO: 320511 - RNA, 64 nt, Homo Sapiens; identical to SEQ ID NO: 40810

SEQ ID NO: 320512 - RNA, 64 nt, Homo Sapiens; identical to SEQ ID NO: 40811

SEQ ID NO: 320513 - RNA, 64 nt, Homo Sapiens; identical to SEQ ID NO: 40812

SEQ ID NO: 320514 - RNA, 64 nt, Homo Sapiens; identical to SEQ ID NO: 40813

SEQ ID NO: 320515 - RNA, 64 nt, Homo Sapiens; identical to SEQ ID NO: 40814

SEQ ID NO: 320516 - RNA, 64 nt, Homo Sapiens; identical to SEQ ID NO: 40815

SEQ ID NO: 320517 - RNA, 64 nt, Homo Sapiens; identical to SEQ ID NO: 40816

SEQ ID NO: 320518 - RNA, 64 nt, Homo Sapiens; identical to SEQ ID NO: 40817

SEQ ID NO: 320519 - RNA, 64 nt, Homo Sapiens; identical to SEQ ID NO: 40818

SEQ ID NO: 320520 - RNA, 64 nt, Homo Sapiens; identical to SEQ ID NO: 40819

SEQ ID NO: 320521 - RNA, 64 nt, Homo Sapiens; identical to SEQ ID NO: 40820

SEQ ID NO: 320522 - RNA, 64 nt, Homo Sapiens; identical to SEQ ID NO: 40821

SEQ ID NO: 320523 - RNA, 64 nt, Homo Sapiens; identical to SEQ ID NO: 40822

SEQ ID NO: 320524 - RNA, 64 nt, Homo Sapiens; identical to SEQ ID NO: 40823

SEQ ID NO: 320525 - RNA, 64 nt, Homo Sapiens; identical to SEQ ID NO: 40824

SEQ ID NO: 320526 - RNA, 64 nt, Homo Sapiens; identical to SEQ ID NO: 40825

SEQ ID NO: 320527 - RNA, 64 nt, Homo Sapiens; identical to SEQ ID NO: 40826

SEQ ID NO: 320528 - RNA, 64 nt, Homo Sapiens; identical to SEQ ID NO: 40827

SEQ ID NO: 320529 - RNA, 64 nt, Homo Sapiens; identical to SEQ ID NO: 40828

SEQ ID NO: 320530 - RNA, 64 nt, Homo Sapiens; identical to SEQ ID NO: 40829

SEQ ID NO: 320531 - RNA, 64 nt, Homo Sapiens; identical to SEQ ID NO: 40830

SEQ ID NO: 320532 - RNA, 64 nt, Homo Sapiens; identical to SEQ ID NO: 40831

SEQ ID NO: 320533 - RNA, 64 nt, Homo Sapiens; identical to SEQ ID NO: 40832

SEQ ID NO: 320534 - RNA, 64 nt, Homo Sapiens; identical to SEQ ID NO: 40833

SEQ ID NO: 320535 - RNA, 64 nt, Homo Sapiens; identical to SEQ ID NO: 40834

SEQ ID NO: 320536 - RNA, 64 nt, Homo Sapiens; identical to SEQ ID NO: 40835

SEQ ID NO: 320537 - RNA, 64 nt, Homo Sapiens; identical to SEQ ID NO: 40836

SEQ ID NO: 320538 - RNA, 64 nt, Homo Sapiens; identical to SEQ ID NO: 40837

SEQ ID NO: 320539 - RNA, 64 nt, Homo Sapiens; identical to SEQ ID NO: 40838

SEQ ID NO: 320540 - RNA, 64 nt, Homo Sapiens; identical to SEQ ID NO: 40839

SEQ ID NO: 320541 - RNA, 64 nt, Homo Sapiens; identical to SEQ ID NO: 40840

SEQ ID NO: 320542 - RNA, 64 nt, Homo Sapiens; identical to SEQ ID NO: 40841

SEQ ID NO: 320543 - RNA, 64 nt, Homo Sapiens; identical to SEQ ID NO: 40842

SEQ ID NO: 320544 - RNA, 64 nt, Homo Sapiens; identical to SEQ ID NO: 40843

SEQ ID NO: 320545 - RNA, 64 nt, Homo Sapiens; identical to SEQ ID NO: 40844

SEQ ID NO: 320546 - RNA, 64 nt, Homo Sapiens; identical to SEQ ID NO: 40845

SEQ ID NO: 320547 - RNA, 64 nt, Homo Sapiens; identical to SEQ ID NO: 40846

SEQ ID NO: 320548 - RNA, 64 nt, Homo Sapiens; identical to SEQ ID NO: 40847

SEQ ID NO: 320549 - RNA, 64 nt, Homo Sapiens; identical to SEQ ID NO: 40848

SEQ ID NO: 320550 - RNA, 64 nt, Homo Sapiens; identical to SEQ ID NO: 40849

SEQ ID NO: 320551 - RNA, 64 nt, Homo Sapiens; identical to SEQ ID NO: 40850

SEQ ID NO: 320552 - RNA, 64 nt, Homo Sapiens; identical to SEQ ID NO: 40851

SEQ ID NO: 320553 - RNA, 64 nt, Homo Sapiens; identical to SEQ ID NO: 40852

SEQ ID NO: 320554 - RNA, 64 nt, Homo Sapiens; identical to SEQ ID NO: 40853

SEQ ID NO: 320555 - RNA, 64 nt, Homo Sapiens; identical to SEQ ID NO: 40854

SEQ ID NO: 320556 - RNA, 64 nt, Homo Sapiens; identical to SEQ ID NO: 40855

SEQ ID NO: 320557 - RNA, 64 nt, Homo Sapiens; identical to SEQ ID NO: 40856

SEQ ID NO: 320558 - RNA, 64 nt, Homo Sapiens; identical to SEQ ID NO: 40857

SEQ ID NO: 320559 - RNA, 64 nt, Homo Sapiens; identical to SEQ ID NO: 40858

SEQ ID NO: 320560 - RNA, 64 nt, Homo Sapiens; identical to SEQ ID NO: 40859

SEQ ID NO: 320561 - RNA, 64 nt, Homo Sapiens; identical to SEQ ID NO: 40860

SEQ ID NO: 320562 - RNA, 64 nt, Homo Sapiens; identical to SEQ ID NO: 40861

SEQ ID NO: 320563 - RNA, 64 nt, Homo Sapiens; identical to SEQ ID NO: 40862

SEQ ID NO: 320564 - RNA, 64 nt, Homo Sapiens; identical to SEQ ID NO: 40863

SEQ ID NO: 320565 - RNA, 64 nt, Homo Sapiens; identical to SEQ ID NO: 40864

SEQ ID NO: 320566 - RNA, 64 nt, Homo Sapiens; identical to SEQ ID NO: 40865

SEQ ID NO: 320567 - RNA, 64 nt, Homo Sapiens; identical to SEQ ID NO: 40866

SEQ ID NO: 320568 - RNA, 64 nt, Homo Sapiens; identical to SEQ ID NO: 40867

SEQ ID NO: 320569 - RNA, 64 nt, Homo Sapiens; identical to SEQ ID NO: 40868

SEQ ID NO: 320570 - RNA, 64 nt, Homo Sapiens; identical to SEQ ID NO: 40869

SEQ ID NO: 320571 - RNA, 64 nt, Homo Sapiens; identical to SEQ ID NO: 40870

SEQ ID NO: 320572 - RNA, 64 nt, Homo Sapiens; identical to SEQ ID NO: 40871

SEQ ID NO: 320573 - RNA, 64 nt, Homo Sapiens; identical to SEQ ID NO: 40872

SEQ ID NO: 320574 - RNA, 64 nt, Homo Sapiens; identical to SEQ ID NO: 40873

SEQ ID NO: 320575 - RNA, 64 nt, Homo Sapiens; identical to SEQ ID NO: 40874

SEQ ID NO: 320576 - RNA, 64 nt, Homo Sapiens; identical to SEQ ID NO: 40875

SEQ ID NO: 320577 - RNA, 64 nt, Homo Sapiens; identical to SEQ ID NO: 40876

SEQ ID NO: 320578 - RNA, 64 nt, Homo Sapiens; identical to SEQ ID NO: 40877

SEQ ID NO: 320579 - RNA, 64 nt, Homo Sapiens; identical to SEQ ID NO: 40878

SEQ ID NO: 320580 - RNA, 64 nt, Homo Sapiens; identical to SEQ ID NO: 40879

SEQ ID NO: 320581 - RNA, 64 nt, Homo Sapiens; identical to SEQ ID NO: 40880

SEQ ID NO: 320582 - RNA, 64 nt, Homo Sapiens; identical to SEQ ID NO: 40881

SEQ ID NO: 320583 - RNA, 64 nt, Homo Sapiens; identical to SEQ ID NO: 40882

SEQ ID NO: 320584 - RNA, 64 nt, Homo Sapiens; identical to SEQ ID NO: 40883

SEQ ID NO: 320585 - RNA, 64 nt, Homo Sapiens; identical to SEQ ID NO: 40884

SEQ ID NO: 320586 - RNA, 64 nt, Homo Sapiens; identical to SEQ ID NO: 40885

SEQ ID NO: 320587 - RNA, 64 nt, Homo Sapiens; identical to SEQ ID NO: 40886

SEQ ID NO: 320588 - RNA, 64 nt, Homo Sapiens; identical to SEQ ID NO: 40887

SEQ ID NO: 320589 - RNA, 64 nt, Homo Sapiens; identical to SEQ ID NO: 40888

SEQ ID NO: 320590 - RNA, 64 nt, Homo Sapiens; identical to SEQ ID NO: 40889

SEQ ID NO: 320591 - RNA, 64 nt, Homo Sapiens; identical to SEQ ID NO: 40890

SEQ ID NO: 320592 - RNA, 64 nt, Homo Sapiens; identical to SEQ ID NO: 40891

SEQ ID NO: 320593 - RNA, 64 nt, Homo Sapiens; identical to SEQ ID NO: 40892

SEQ ID NO: 320594 - RNA, 64 nt, Homo Sapiens; identical to SEQ ID NO: 40893

SEQ ID NO: 320595 - RNA, 64 nt, Homo Sapiens; identical to SEQ ID NO: 40894

SEQ ID NO: 320596 - RNA, 64 nt, Homo Sapiens; identical to SEQ ID NO: 40895

SEQ ID NO: 320597 - RNA, 64 nt, Homo Sapiens; identical to SEQ ID NO: 40896

SEQ ID NO: 320598 - RNA, 64 nt, Homo Sapiens; identical to SEQ ID NO: 40897

SEQ ID NO: 320599 - RNA, 64 nt, Homo Sapiens; identical to SEQ ID NO: 40898

SEQ ID NO: 320600 - RNA, 64 nt, Homo Sapiens; identical to SEQ ID NO: 40899

SEQ ID NO: 320601 - RNA, 64 nt, Homo Sapiens; identical to SEQ ID NO: 40900

SEQ ID NO: 320602 - RNA, 64 nt, Homo Sapiens; identical to SEQ ID NO: 40901

SEQ ID NO: 320603 - RNA, 64 nt, Homo Sapiens; identical to SEQ ID NO: 40902

SEQ ID NO: 320604 - RNA, 64 nt, Homo Sapiens; identical to SEQ ID NO: 40903

SEQ ID NO: 320605 - RNA, 64 nt, Homo Sapiens; identical to SEQ ID NO: 40904

SEQ ID NO: 320606 - RNA, 64 nt, Homo Sapiens; identical to SEQ ID NO: 40905

SEQ ID NO: 320607 - RNA, 64 nt, Homo Sapiens; identical to SEQ ID NO: 40906

SEQ ID NO: 320608 - RNA, 64 nt, Homo Sapiens; identical to SEQ ID NO: 40907

SEQ ID NO: 320609 - RNA, 64 nt, Homo Sapiens; identical to SEQ ID NO: 40908

SEQ ID NO: 320610 - RNA, 64 nt, Homo Sapiens; identical to SEQ ID NO: 40909

SEQ ID NO: 320611 - RNA, 64 nt, Homo Sapiens; identical to SEQ ID NO: 40910

SEQ ID NO: 320612 - RNA, 64 nt, Homo Sapiens; identical to SEQ ID NO: 40911

SEQ ID NO: 320613 - RNA, 64 nt, Homo Sapiens; identical to SEQ ID NO: 40912

SEQ ID NO: 320614 - RNA, 64 nt, Homo Sapiens; identical to SEQ ID NO: 40913

SEQ ID NO: 320615 - RNA, 64 nt, Homo Sapiens; identical to SEQ ID NO: 40914

SEQ ID NO: 320616 - RNA, 64 nt, Homo Sapiens; identical to SEQ ID NO: 40915

SEQ ID NO: 320617 - RNA, 64 nt, Homo Sapiens; identical to SEQ ID NO: 40916

SEQ ID NO: 320618 - RNA, 64 nt, Homo Sapiens; identical to SEQ ID NO: 40917

SEQ ID NO: 320619 - RNA, 64 nt, Homo Sapiens; identical to SEQ ID NO: 40918

SEQ ID NO: 320620 - RNA, 64 nt, Homo Sapiens; identical to SEQ ID NO: 40919

SEQ ID NO: 320621 - RNA, 64 nt, Homo Sapiens; identical to SEQ ID NO: 40920

SEQ ID NO: 320622 - RNA, 64 nt, Homo Sapiens; identical to SEQ ID NO: 40921

SEQ ID NO: 320623 - RNA, 64 nt, Homo Sapiens; identical to SEQ ID NO: 40922

SEQ ID NO: 320624 - RNA, 64 nt, Homo Sapiens; identical to SEQ ID NO: 40923

SEQ ID NO: 320625 - RNA, 64 nt, Homo Sapiens; identical to SEQ ID NO: 40924

SEQ ID NO: 320626 - RNA, 64 nt, Homo Sapiens; identical to SEQ ID NO: 40925

SEQ ID NO: 320627 - RNA, 64 nt, Homo Sapiens; identical to SEQ ID NO: 40926

SEQ ID NO: 320628 - RNA, 64 nt, Homo Sapiens; identical to SEQ ID NO: 40927

SEQ ID NO: 320629 - RNA, 64 nt, Homo Sapiens; identical to SEQ ID NO: 40928

SEQ ID NO: 320630 - RNA, 64 nt, Homo Sapiens; identical to SEQ ID NO: 40929

SEQ ID NO: 320631 - RNA, 64 nt, Homo Sapiens; identical to SEQ ID NO: 40930

SEQ ID NO: 320632 - RNA, 64 nt, Homo Sapiens; identical to SEQ ID NO: 40931

SEQ ID NO: 320633 - RNA, 64 nt, Homo Sapiens; identical to SEQ ID NO: 40932

SEQ ID NO: 320634 - RNA, 64 nt, Homo Sapiens; identical to SEQ ID NO: 40933

SEQ ID NO: 320635 - RNA, 64 nt, Homo Sapiens; identical to SEQ ID NO: 40934

SEQ ID NO: 320636 - RNA, 64 nt, Homo Sapiens; identical to SEQ ID NO: 40935

SEQ ID NO: 320637 - RNA, 64 nt, Homo Sapiens; identical to SEQ ID NO: 40936

SEQ ID NO: 320638 - RNA, 64 nt, Homo Sapiens; identical to SEQ ID NO: 40937

SEQ ID NO: 320639 - RNA, 64 nt, Homo Sapiens; identical to SEQ ID NO: 40938

SEQ ID NO: 320640 - RNA, 64 nt, Homo Sapiens; identical to SEQ ID NO: 40939

SEQ ID NO: 320641 - RNA, 64 nt, Homo Sapiens; identical to SEQ ID NO: 40940

SEQ ID NO: 320642 - RNA, 64 nt, Homo Sapiens; identical to SEQ ID NO: 40941

SEQ ID NO: 320643 - RNA, 64 nt, Homo Sapiens; identical to SEQ ID NO: 40942

SEQ ID NO: 320644 - RNA, 64 nt, Homo Sapiens; identical to SEQ ID NO: 40943

SEQ ID NO: 320645 - RNA, 64 nt, Homo Sapiens; identical to SEQ ID NO: 40944

SEQ ID NO: 320646 - RNA, 64 nt, Homo Sapiens; identical to SEQ ID NO: 40945

SEQ ID NO: 320647 - RNA, 64 nt, Homo Sapiens; identical to SEQ ID NO: 40946

SEQ ID NO: 320648 - RNA, 64 nt, Homo Sapiens; identical to SEQ ID NO: 40947

SEQ ID NO: 320649 - RNA, 64 nt, Homo Sapiens; identical to SEQ ID NO: 40948

SEQ ID NO: 320650 - RNA, 64 nt, Homo Sapiens; identical to SEQ ID NO: 40949

SEQ ID NO: 320651 - RNA, 64 nt, Homo Sapiens; identical to SEQ ID NO: 40950

SEQ ID NO: 320652 - RNA, 64 nt, Homo Sapiens; identical to SEQ ID NO: 40951

SEQ ID NO: 320653 - RNA, 64 nt, Homo Sapiens; identical to SEQ ID NO: 40952

SEQ ID NO: 320654 - RNA, 64 nt, Homo Sapiens; identical to SEQ ID NO: 40953

SEQ ID NO: 320655 - RNA, 64 nt, Homo Sapiens; identical to SEQ ID NO: 40954

SEQ ID NO: 320656 - RNA, 64 nt, Homo Sapiens; identical to SEQ ID NO: 40955

SEQ ID NO: 320657 - RNA, 64 nt, Homo Sapiens; identical to SEQ ID NO: 40956

SEQ ID NO: 320658 - RNA, 64 nt, Homo Sapiens; identical to SEQ ID NO: 40957

SEQ ID NO: 320659 - RNA, 64 nt, Homo Sapiens; identical to SEQ ID NO: 40958

SEQ ID NO: 320660 - RNA, 64 nt, Homo Sapiens; identical to SEQ ID NO: 40959

SEQ ID NO: 320661 - RNA, 64 nt, Homo Sapiens; identical to SEQ ID NO: 40960

SEQ ID NO: 320662 - RNA, 64 nt, Homo Sapiens; identical to SEQ ID NO: 40961

SEQ ID NO: 320663 - RNA, 64 nt, Homo Sapiens; identical to SEQ ID NO: 40962

SEQ ID NO: 320664 - RNA, 64 nt, Homo Sapiens; identical to SEQ ID NO: 40963

SEQ ID NO: 320665 - RNA, 64 nt, Homo Sapiens; identical to SEQ ID NO: 40964

SEQ ID NO: 320666 - RNA, 64 nt, Homo Sapiens; identical to SEQ ID NO: 40965

SEQ ID NO: 320667 - RNA, 64 nt, Homo Sapiens; identical to SEQ ID NO: 40966

SEQ ID NO: 320668 - RNA, 64 nt, Homo Sapiens; identical to SEQ ID NO: 40967

SEQ ID NO: 320669 - RNA, 64 nt, Homo Sapiens; identical to SEQ ID NO: 40968

SEQ ID NO: 320670 - RNA, 64 nt, Homo Sapiens; identical to SEQ ID NO: 40969

SEQ ID NO: 320671 - RNA, 64 nt, Homo Sapiens; identical to SEQ ID NO: 40970

SEQ ID NO: 320672 - RNA, 64 nt, Homo Sapiens; identical to SEQ ID NO: 40971

SEQ ID NO: 320673 - RNA, 64 nt, Homo Sapiens; identical to SEQ ID NO: 40972

SEQ ID NO: 320674 - RNA, 64 nt, Homo Sapiens; identical to SEQ ID NO: 40973

SEQ ID NO: 320675 - RNA, 64 nt, Homo Sapiens; identical to SEQ ID NO: 40974

SEQ ID NO: 320676 - RNA, 64 nt, Homo Sapiens; identical to SEQ ID NO: 40975

SEQ ID NO: 320677 - RNA, 64 nt, Homo Sapiens; identical to SEQ ID NO: 40976

SEQ ID NO: 320678 - RNA, 64 nt, Homo Sapiens; identical to SEQ ID NO: 40977

SEQ ID NO: 320679 - RNA, 64 nt, Homo Sapiens; identical to SEQ ID NO: 40978

SEQ ID NO: 320680 - RNA, 64 nt, Homo Sapiens; identical to SEQ ID NO: 40979

SEQ ID NO: 320681 - RNA, 64 nt, Homo Sapiens; identical to SEQ ID NO: 40980

SEQ ID NO: 320682 - RNA, 64 nt, Homo Sapiens; identical to SEQ ID NO: 40981

SEQ ID NO: 320683 - RNA, 64 nt, Homo Sapiens; identical to SEQ ID NO: 40982

SEQ ID NO: 320684 - RNA, 64 nt, Homo Sapiens; identical to SEQ ID NO: 40983

SEQ ID NO: 320685 - RNA, 64 nt, Homo Sapiens; identical to SEQ ID NO: 40984

SEQ ID NO: 320686 - RNA, 64 nt, Homo Sapiens; identical to SEQ ID NO: 40985

SEQ ID NO: 320687 - RNA, 64 nt, Homo Sapiens; identical to SEQ ID NO: 40986

SEQ ID NO: 320688 - RNA, 64 nt, Homo Sapiens; identical to SEQ ID NO: 40987

SEQ ID NO: 320689 - RNA, 64 nt, Homo Sapiens; identical to SEQ ID NO: 40988

SEQ ID NO: 320690 - RNA, 64 nt, Homo Sapiens; identical to SEQ ID NO: 40989

SEQ ID NO: 320691 - RNA, 64 nt, Homo Sapiens; identical to SEQ ID NO: 40990

SEQ ID NO: 320692 - RNA, 64 nt, Homo Sapiens; identical to SEQ ID NO: 40991

SEQ ID NO: 320693 - RNA, 64 nt, Homo Sapiens; identical to SEQ ID NO: 40992

SEQ ID NO: 320694 - RNA, 64 nt, Homo Sapiens; identical to SEQ ID NO: 40993

SEQ ID NO: 320695 - RNA, 64 nt, Homo Sapiens; identical to SEQ ID NO: 40994

SEQ ID NO: 320696 - RNA, 64 nt, Homo Sapiens; identical to SEQ ID NO: 40995

SEQ ID NO: 320697 - RNA, 64 nt, Homo Sapiens; identical to SEQ ID NO: 40996

SEQ ID NO: 320698 - RNA, 64 nt, Homo Sapiens; identical to SEQ ID NO: 40997

SEQ ID NO: 320699 - RNA, 64 nt, Homo Sapiens; identical to SEQ ID NO: 40998

SEQ ID NO: 320700 - RNA, 64 nt, Homo Sapiens; identical to SEQ ID NO: 40999

SEQ ID NO: 320701 - RNA, 64 nt, Homo Sapiens; identical to SEQ ID NO: 41000

SEQ ID NO: 320702 - RNA, 64 nt, Homo Sapiens; identical to SEQ ID NO: 41001

SEQ ID NO: 320703 - RNA, 64 nt, Homo Sapiens; identical to SEQ ID NO: 41002

SEQ ID NO: 320704 - RNA, 64 nt, Homo Sapiens; identical to SEQ ID NO: 41003

SEQ ID NO: 320705 - RNA, 64 nt, Homo Sapiens; identical to SEQ ID NO: 41004

SEQ ID NO: 320706 - RNA, 64 nt, Homo Sapiens; identical to SEQ ID NO: 41005

SEQ ID NO: 320707 - RNA, 64 nt, Homo Sapiens; identical to SEQ ID NO: 41006

SEQ ID NO: 320708 - RNA, 63 nt, Homo Sapiens; identical to SEQ ID NO: 41007

SEQ ID NO: 320709 - RNA, 64 nt, Homo Sapiens; identical to SEQ ID NO: 41008

SEQ ID NO: 320710 - RNA, 64 nt, Homo Sapiens; identical to SEQ ID NO: 41009

SEQ ID NO: 320711 - RNA, 64 nt, Homo Sapiens; identical to SEQ ID NO: 41010

SEQ ID NO: 320712 - RNA, 64 nt, Homo Sapiens; identical to SEQ ID NO: 41011

SEQ ID NO: 320713 - RNA, 64 nt, Homo Sapiens; identical to SEQ ID NO: 41012

SEQ ID NO: 320714 - RNA, 64 nt, Homo Sapiens; identical to SEQ ID NO: 41013

SEQ ID NO: 320715 - RNA, 64 nt, Homo Sapiens; identical to SEQ ID NO: 41014

SEQ ID NO: 320716 - RNA, 64 nt, Homo Sapiens; identical to SEQ ID NO: 41015

SEQ ID NO: 320717 - RNA, 64 nt, Homo Sapiens; identical to SEQ ID NO: 41016

SEQ ID NO: 320718 - RNA, 64 nt, Homo Sapiens; identical to SEQ ID NO: 41017

SEQ ID NO: 320719 - RNA, 64 nt, Homo Sapiens; identical to SEQ ID NO: 41018

SEQ ID NO: 320720 - RNA, 64 nt, Homo Sapiens; identical to SEQ ID NO: 41019

SEQ ID NO: 320721 - RNA, 64 nt, Homo Sapiens; identical to SEQ ID NO: 41020

SEQ ID NO: 320722 - RNA, 64 nt, Homo Sapiens; identical to SEQ ID NO: 41021

SEQ ID NO: 320723 - RNA, 64 nt, Homo Sapiens; identical to SEQ ID NO: 41022

SEQ ID NO: 320724 - RNA, 64 nt, Homo Sapiens; identical to SEQ ID NO: 41023

SEQ ID NO: 320725 - RNA, 64 nt, Homo Sapiens; identical to SEQ ID NO: 41024

SEQ ID NO: 320726 - RNA, 64 nt, Homo Sapiens; identical to SEQ ID NO: 41025

SEQ ID NO: 320727 - RNA, 64 nt, Homo Sapiens; identical to SEQ ID NO: 41026

SEQ ID NO: 320728 - RNA, 64 nt, Homo Sapiens; identical to SEQ ID NO: 41027

SEQ ID NO: 320729 - RNA, 64 nt, Homo Sapiens; identical to SEQ ID NO: 41028

SEQ ID NO: 320730 - RNA, 64 nt, Homo Sapiens; identical to SEQ ID NO: 41029

SEQ ID NO: 320731 - RNA, 64 nt, Homo Sapiens; identical to SEQ ID NO: 41030

SEQ ID NO: 320732 - RNA, 64 nt, Homo Sapiens; identical to SEQ ID NO: 41031

SEQ ID NO: 320733 - RNA, 64 nt, Homo Sapiens; identical to SEQ ID NO: 41032

SEQ ID NO: 320734 - RNA, 64 nt, Homo Sapiens; identical to SEQ ID NO: 41033

SEQ ID NO: 320735 - RNA, 64 nt, Homo Sapiens; identical to SEQ ID NO: 41034

SEQ ID NO: 320736 - RNA, 64 nt, Homo Sapiens; identical to SEQ ID NO: 41035

SEQ ID NO: 320737 - RNA, 64 nt, Homo Sapiens; identical to SEQ ID NO: 41036

SEQ ID NO: 320738 - RNA, 64 nt, Homo Sapiens; identical to SEQ ID NO: 41037

SEQ ID NO: 320739 - RNA, 64 nt, Homo Sapiens; identical to SEQ ID NO: 41038

SEQ ID NO: 320740 - RNA, 64 nt, Homo Sapiens; identical to SEQ ID NO: 41039

SEQ ID NO: 320741 - RNA, 64 nt, Homo Sapiens; identical to SEQ ID NO: 41040

SEQ ID NO: 320742 - RNA, 64 nt, Homo Sapiens; identical to SEQ ID NO: 41041

SEQ ID NO: 320743 - RNA, 64 nt, Homo Sapiens; identical to SEQ ID NO: 41042

SEQ ID NO: 320744 - RNA, 64 nt, Homo Sapiens; identical to SEQ ID NO: 41043

SEQ ID NO: 320745 - RNA, 64 nt, Homo Sapiens; identical to SEQ ID NO: 41044

SEQ ID NO: 320746 - RNA, 64 nt, Homo Sapiens; identical to SEQ ID NO: 41045

SEQ ID NO: 320747 - RNA, 64 nt, Homo Sapiens; identical to SEQ ID NO: 41046

SEQ ID NO: 320748 - RNA, 64 nt, Homo Sapiens; identical to SEQ ID NO: 41047

SEQ ID NO: 320749 - RNA, 64 nt, Homo Sapiens; identical to SEQ ID NO: 41048

SEQ ID NO: 320750 - RNA, 64 nt, Homo Sapiens; identical to SEQ ID NO: 41049

SEQ ID NO: 320751 - RNA, 64 nt, Homo Sapiens; identical to SEQ ID NO: 41050

SEQ ID NO: 320752 - RNA, 64 nt, Homo Sapiens; identical to SEQ ID NO: 41051

SEQ ID NO: 320753 - RNA, 64 nt, Homo Sapiens; identical to SEQ ID NO: 41052

SEQ ID NO: 320754 - RNA, 64 nt, Homo Sapiens; identical to SEQ ID NO: 41053

SEQ ID NO: 320755 - RNA, 64 nt, Homo Sapiens; identical to SEQ ID NO: 41054

SEQ ID NO: 320756 - RNA, 64 nt, Homo Sapiens; identical to SEQ ID NO: 41055

SEQ ID NO: 320757 - RNA, 64 nt, Homo Sapiens; identical to SEQ ID NO: 41056

SEQ ID NO: 320758 - RNA, 64 nt, Homo Sapiens; identical to SEQ ID NO: 41057

SEQ ID NO: 320759 - RNA, 64 nt, Homo Sapiens; identical to SEQ ID NO: 41058

SEQ ID NO: 320760 - RNA, 64 nt, Homo Sapiens; identical to SEQ ID NO: 41059

SEQ ID NO: 320761 - RNA, 64 nt, Homo Sapiens; identical to SEQ ID NO: 41060

SEQ ID NO: 320762 - RNA, 64 nt, Homo Sapiens; identical to SEQ ID NO: 41061

SEQ ID NO: 320763 - RNA, 64 nt, Homo Sapiens; identical to SEQ ID NO: 41062

SEQ ID NO: 320764 - RNA, 64 nt, Homo Sapiens; identical to SEQ ID NO: 41063

SEQ ID NO: 320765 - RNA, 64 nt, Homo Sapiens; identical to SEQ ID NO: 41064

SEQ ID NO: 320766 - RNA, 64 nt, Homo Sapiens; identical to SEQ ID NO: 41065

SEQ ID NO: 320767 - RNA, 64 nt, Homo Sapiens; identical to SEQ ID NO: 41066

SEQ ID NO: 320768 - RNA, 64 nt, Homo Sapiens; identical to SEQ ID NO: 41067

SEQ ID NO: 320769 - RNA, 64 nt, Homo Sapiens; identical to SEQ ID NO: 41068

SEQ ID NO: 320770 - RNA, 64 nt, Homo Sapiens; identical to SEQ ID NO: 41069

SEQ ID NO: 320771 - RNA, 64 nt, Homo Sapiens; identical to SEQ ID NO: 41070

SEQ ID NO: 320772 - RNA, 64 nt, Homo Sapiens; identical to SEQ ID NO: 41071

SEQ ID NO: 320773 - RNA, 64 nt, Homo Sapiens; identical to SEQ ID NO: 41072

SEQ ID NO: 320774 - RNA, 64 nt, Homo Sapiens; identical to SEQ ID NO: 41073

SEQ ID NO: 320775 - RNA, 64 nt, Homo Sapiens; identical to SEQ ID NO: 41074

SEQ ID NO: 320776 - RNA, 64 nt, Homo Sapiens; identical to SEQ ID NO: 41075

SEQ ID NO: 320777 - RNA, 64 nt, Homo Sapiens; identical to SEQ ID NO: 41076

SEQ ID NO: 320778 - RNA, 64 nt, Homo Sapiens; identical to SEQ ID NO: 41077

SEQ ID NO: 320779 - RNA, 64 nt, Homo Sapiens; identical to SEQ ID NO: 41078

SEQ ID NO: 320780 - RNA, 64 nt, Homo Sapiens; identical to SEQ ID NO: 41079

SEQ ID NO: 320781 - RNA, 64 nt, Homo Sapiens; identical to SEQ ID NO: 41080

SEQ ID NO: 320782 - RNA, 64 nt, Homo Sapiens; identical to SEQ ID NO: 41081

SEQ ID NO: 320783 - RNA, 64 nt, Homo Sapiens; identical to SEQ ID NO: 41082

SEQ ID NO: 320784 - RNA, 64 nt, Homo Sapiens; identical to SEQ ID NO: 41083

SEQ ID NO: 320785 - RNA, 64 nt, Homo Sapiens; identical to SEQ ID NO: 41084

SEQ ID NO: 320786 - RNA, 64 nt, Homo Sapiens; identical to SEQ ID NO: 41085

SEQ ID NO: 320787 - RNA, 64 nt, Homo Sapiens; identical to SEQ ID NO: 41086

SEQ ID NO: 320788 - RNA, 64 nt, Homo Sapiens; identical to SEQ ID NO: 41087

SEQ ID NO: 320789 - RNA, 64 nt, Homo Sapiens; identical to SEQ ID NO: 41088

SEQ ID NO: 320790 - RNA, 64 nt, Homo Sapiens; identical to SEQ ID NO: 41089

SEQ ID NO: 320791 - RNA, 64 nt, Homo Sapiens; identical to SEQ ID NO: 41090

SEQ ID NO: 320792 - RNA, 64 nt, Homo Sapiens; identical to SEQ ID NO: 41091

SEQ ID NO: 320793 - RNA, 64 nt, Homo Sapiens; identical to SEQ ID NO: 41092

SEQ ID NO: 320794 - RNA, 64 nt, Homo Sapiens; identical to SEQ ID NO: 41093

SEQ ID NO: 320795 - RNA, 64 nt, Homo Sapiens; identical to SEQ ID NO: 41094

SEQ ID NO: 320796 - RNA, 64 nt, Homo Sapiens; identical to SEQ ID NO: 41095

SEQ ID NO: 320797 - RNA, 64 nt, Homo Sapiens; identical to SEQ ID NO: 41096

SEQ ID NO: 320798 - RNA, 64 nt, Homo Sapiens; identical to SEQ ID NO: 41097

SEQ ID NO: 320799 - RNA, 64 nt, Homo Sapiens; identical to SEQ ID NO: 41098

SEQ ID NO: 320800 - RNA, 64 nt, Homo Sapiens; identical to SEQ ID NO: 41099

SEQ ID NO: 320801 - RNA, 64 nt, Homo Sapiens; identical to SEQ ID NO: 41100

SEQ ID NO: 320802 - RNA, 64 nt, Homo Sapiens; identical to SEQ ID NO: 41101

SEQ ID NO: 320803 - RNA, 64 nt, Homo Sapiens; identical to SEQ ID NO: 41102

SEQ ID NO: 320804 - RNA, 64 nt, Homo Sapiens; identical to SEQ ID NO: 41103

SEQ ID NO: 320805 - RNA, 64 nt, Homo Sapiens; identical to SEQ ID NO: 41104

SEQ ID NO: 320806 - RNA, 64 nt, Homo Sapiens; identical to SEQ ID NO: 41105

SEQ ID NO: 320807 - RNA, 64 nt, Homo Sapiens; identical to SEQ ID NO: 41106

SEQ ID NO: 320808 - RNA, 64 nt, Homo Sapiens; identical to SEQ ID NO: 41107

SEQ ID NO: 320809 - RNA, 64 nt, Homo Sapiens; identical to SEQ ID NO: 41108

SEQ ID NO: 320810 - RNA, 64 nt, Homo Sapiens; identical to SEQ ID NO: 41109

SEQ ID NO: 320811 - RNA, 64 nt, Homo Sapiens; identical to SEQ ID NO: 41110

SEQ ID NO: 320812 - RNA, 64 nt, Homo Sapiens; identical to SEQ ID NO: 41111

SEQ ID NO: 320813 - RNA, 64 nt, Homo Sapiens; identical to SEQ ID NO: 41112

SEQ ID NO: 320814 - RNA, 64 nt, Homo Sapiens; identical to SEQ ID NO: 41113

SEQ ID NO: 320815 - RNA, 64 nt, Homo Sapiens; identical to SEQ ID NO: 41114

SEQ ID NO: 320816 - RNA, 64 nt, Homo Sapiens; identical to SEQ ID NO: 41115

SEQ ID NO: 320817 - RNA, 64 nt, Homo Sapiens; identical to SEQ ID NO: 41116

SEQ ID NO: 320818 - RNA, 64 nt, Homo Sapiens; identical to SEQ ID NO: 41117

SEQ ID NO: 320819 - RNA, 64 nt, Homo Sapiens; identical to SEQ ID NO: 41118

SEQ ID NO: 320820 - RNA, 64 nt, Homo Sapiens; identical to SEQ ID NO: 41119

SEQ ID NO: 320821 - RNA, 64 nt, Homo Sapiens; identical to SEQ ID NO: 41120

SEQ ID NO: 320822 - RNA, 64 nt, Homo Sapiens; identical to SEQ ID NO: 41121

SEQ ID NO: 320823 - RNA, 64 nt, Homo Sapiens; identical to SEQ ID NO: 41122

SEQ ID NO: 320824 - RNA, 64 nt, Homo Sapiens; identical to SEQ ID NO: 41123

SEQ ID NO: 320825 - RNA, 64 nt, Homo Sapiens; identical to SEQ ID NO: 41124

SEQ ID NO: 320826 - RNA, 64 nt, Homo Sapiens; identical to SEQ ID NO: 41125

SEQ ID NO: 320827 - RNA, 64 nt, Homo Sapiens; identical to SEQ ID NO: 41126

SEQ ID NO: 320828 - RNA, 64 nt, Homo Sapiens; identical to SEQ ID NO: 41127

SEQ ID NO: 320829 - RNA, 64 nt, Homo Sapiens; identical to SEQ ID NO: 41128

SEQ ID NO: 320830 - RNA, 64 nt, Homo Sapiens; identical to SEQ ID NO: 41129

SEQ ID NO: 320831 - RNA, 64 nt, Homo Sapiens; identical to SEQ ID NO: 41130

SEQ ID NO: 320832 - RNA, 64 nt, Homo Sapiens; identical to SEQ ID NO: 41131

SEQ ID NO: 320833 - RNA, 64 nt, Homo Sapiens; identical to SEQ ID NO: 41132

SEQ ID NO: 320834 - RNA, 64 nt, Homo Sapiens; identical to SEQ ID NO: 41133

SEQ ID NO: 320835 - RNA, 64 nt, Homo Sapiens; identical to SEQ ID NO: 41134

SEQ ID NO: 320836 - RNA, 64 nt, Homo Sapiens; identical to SEQ ID NO: 41135

SEQ ID NO: 320837 - RNA, 64 nt, Homo Sapiens; identical to SEQ ID NO: 41136

SEQ ID NO: 320838 - RNA, 64 nt, Homo Sapiens; identical to SEQ ID NO: 41137

SEQ ID NO: 320839 - RNA, 64 nt, Homo Sapiens; identical to SEQ ID NO: 41138

SEQ ID NO: 320840 - RNA, 64 nt, Homo Sapiens; identical to SEQ ID NO: 41139

SEQ ID NO: 320841 - RNA, 64 nt, Homo Sapiens; identical to SEQ ID NO: 41140

SEQ ID NO: 320842 - RNA, 64 nt, Homo Sapiens; identical to SEQ ID NO: 41141

SEQ ID NO: 320843 - RNA, 64 nt, Homo Sapiens; identical to SEQ ID NO: 41142

SEQ ID NO: 320844 - RNA, 64 nt, Homo Sapiens; identical to SEQ ID NO: 41143

SEQ ID NO: 320845 - RNA, 64 nt, Homo Sapiens; identical to SEQ ID NO: 41144

SEQ ID NO: 320846 - RNA, 64 nt, Homo Sapiens; identical to SEQ ID NO: 41145

SEQ ID NO: 320847 - RNA, 64 nt, Homo Sapiens; identical to SEQ ID NO: 41146

SEQ ID NO: 320848 - RNA, 64 nt, Homo Sapiens; identical to SEQ ID NO: 41147

SEQ ID NO: 320849 - RNA, 64 nt, Homo Sapiens; identical to SEQ ID NO: 41148

SEQ ID NO: 320850 - RNA, 64 nt, Homo Sapiens; identical to SEQ ID NO: 41149

SEQ ID NO: 320851 - RNA, 64 nt, Homo Sapiens; identical to SEQ ID NO: 41150

SEQ ID NO: 320852 - RNA, 64 nt, Homo Sapiens; identical to SEQ ID NO: 41151

SEQ ID NO: 320853 - RNA, 64 nt, Homo Sapiens; identical to SEQ ID NO: 41152

SEQ ID NO: 320854 - RNA, 64 nt, Homo Sapiens; identical to SEQ ID NO: 41153

SEQ ID NO: 320855 - RNA, 64 nt, Homo Sapiens; identical to SEQ ID NO: 41154

SEQ ID NO: 320856 - RNA, 64 nt, Homo Sapiens; identical to SEQ ID NO: 41155

SEQ ID NO: 320857 - RNA, 64 nt, Homo Sapiens; identical to SEQ ID NO: 41156

SEQ ID NO: 320858 - RNA, 64 nt, Homo Sapiens; identical to SEQ ID NO: 41157

SEQ ID NO: 320859 - RNA, 64 nt, Homo Sapiens; identical to SEQ ID NO: 41158

SEQ ID NO: 320860 - RNA, 64 nt, Homo Sapiens; identical to SEQ ID NO: 41159

SEQ ID NO: 320861 - RNA, 64 nt, Homo Sapiens; identical to SEQ ID NO: 41160

SEQ ID NO: 320862 - RNA, 64 nt, Homo Sapiens; identical to SEQ ID NO: 41161

SEQ ID NO: 320863 - RNA, 64 nt, Homo Sapiens; identical to SEQ ID NO: 41162

SEQ ID NO: 320864 - RNA, 64 nt, Homo Sapiens; identical to SEQ ID NO: 41163

SEQ ID NO: 320865 - RNA, 64 nt, Homo Sapiens; identical to SEQ ID NO: 41164

SEQ ID NO: 320866 - RNA, 64 nt, Homo Sapiens; identical to SEQ ID NO: 41165

SEQ ID NO: 320867 - RNA, 64 nt, Homo Sapiens; identical to SEQ ID NO: 41166

SEQ ID NO: 320868 - RNA, 64 nt, Homo Sapiens; identical to SEQ ID NO: 41167

SEQ ID NO: 320869 - RNA, 64 nt, Homo Sapiens; identical to SEQ ID NO: 41168

SEQ ID NO: 320870 - RNA, 64 nt, Homo Sapiens; identical to SEQ ID NO: 41169

SEQ ID NO: 320871 - RNA, 64 nt, Homo Sapiens; identical to SEQ ID NO: 41170

SEQ ID NO: 320872 - RNA, 64 nt, Homo Sapiens; identical to SEQ ID NO: 41171

SEQ ID NO: 320873 - RNA, 64 nt, Homo Sapiens; identical to SEQ ID NO: 41172

SEQ ID NO: 320874 - RNA, 64 nt, Homo Sapiens; identical to SEQ ID NO: 41173

SEQ ID NO: 320875 - RNA, 64 nt, Homo Sapiens; identical to SEQ ID NO: 41174

SEQ ID NO: 320876 - RNA, 64 nt, Homo Sapiens; identical to SEQ ID NO: 41175

SEQ ID NO: 320877 - RNA, 64 nt, Homo Sapiens; identical to SEQ ID NO: 41176

SEQ ID NO: 320878 - RNA, 64 nt, Homo Sapiens; identical to SEQ ID NO: 41177

SEQ ID NO: 320879 - RNA, 64 nt, Homo Sapiens; identical to SEQ ID NO: 41178

SEQ ID NO: 320880 - RNA, 64 nt, Homo Sapiens; identical to SEQ ID NO: 41179

SEQ ID NO: 320881 - RNA, 64 nt, Homo Sapiens; identical to SEQ ID NO: 41180

SEQ ID NO: 320882 - RNA, 64 nt, Homo Sapiens; identical to SEQ ID NO: 41181

SEQ ID NO: 320883 - RNA, 64 nt, Homo Sapiens; identical to SEQ ID NO: 41182

SEQ ID NO: 320884 - RNA, 64 nt, Homo Sapiens; identical to SEQ ID NO: 41183

SEQ ID NO: 320885 - RNA, 64 nt, Homo Sapiens; identical to SEQ ID NO: 41184

SEQ ID NO: 320886 - RNA, 64 nt, Homo Sapiens; identical to SEQ ID NO: 41185

SEQ ID NO: 320887 - RNA, 64 nt, Homo Sapiens; identical to SEQ ID NO: 41186

SEQ ID NO: 320888 - RNA, 64 nt, Homo Sapiens; identical to SEQ ID NO: 41187

SEQ ID NO: 320889 - RNA, 64 nt, Homo Sapiens; identical to SEQ ID NO: 41188

SEQ ID NO: 320890 - RNA, 64 nt, Homo Sapiens; identical to SEQ ID NO: 41189

SEQ ID NO: 320891 - RNA, 64 nt, Homo Sapiens; identical to SEQ ID NO: 41190

SEQ ID NO: 320892 - RNA, 64 nt, Homo Sapiens; identical to SEQ ID NO: 41191

SEQ ID NO: 320893 - RNA, 64 nt, Homo Sapiens; identical to SEQ ID NO: 41192

SEQ ID NO: 320894 - RNA, 64 nt, Homo Sapiens; identical to SEQ ID NO: 41193

SEQ ID NO: 320895 - RNA, 64 nt, Homo Sapiens; identical to SEQ ID NO: 41194

SEQ ID NO: 320896 - RNA, 64 nt, Homo Sapiens; identical to SEQ ID NO: 41195

SEQ ID NO: 320897 - RNA, 64 nt, Homo Sapiens; identical to SEQ ID NO: 41196

SEQ ID NO: 320898 - RNA, 64 nt, Homo Sapiens; identical to SEQ ID NO: 41197

SEQ ID NO: 320899 - RNA, 64 nt, Homo Sapiens; identical to SEQ ID NO: 41198

SEQ ID NO: 320900 - RNA, 64 nt, Homo Sapiens; identical to SEQ ID NO: 41199

SEQ ID NO: 320901 - RNA, 64 nt, Homo Sapiens; identical to SEQ ID NO: 41200

SEQ ID NO: 320902 - RNA, 64 nt, Homo Sapiens; identical to SEQ ID NO: 41201

SEQ ID NO: 320903 - RNA, 64 nt, Homo Sapiens; identical to SEQ ID NO: 41202

SEQ ID NO: 320904 - RNA, 64 nt, Homo Sapiens; identical to SEQ ID NO: 41203

SEQ ID NO: 320905 - RNA, 64 nt, Homo Sapiens; identical to SEQ ID NO: 41204

SEQ ID NO: 320906 - RNA, 64 nt, Homo Sapiens; identical to SEQ ID NO: 41205

SEQ ID NO: 320907 - RNA, 64 nt, Homo Sapiens; identical to SEQ ID NO: 41206

SEQ ID NO: 320908 - RNA, 64 nt, Homo Sapiens; identical to SEQ ID NO: 41207

SEQ ID NO: 320909 - RNA, 64 nt, Homo Sapiens; identical to SEQ ID NO: 41208

SEQ ID NO: 320910 - RNA, 64 nt, Homo Sapiens; identical to SEQ ID NO: 41209

SEQ ID NO: 320911 - RNA, 64 nt, Homo Sapiens; identical to SEQ ID NO: 41210

SEQ ID NO: 320912 - RNA, 64 nt, Homo Sapiens; identical to SEQ ID NO: 41211

SEQ ID NO: 320913 - RNA, 64 nt, Homo Sapiens; identical to SEQ ID NO: 41212

SEQ ID NO: 320914 - RNA, 64 nt, Homo Sapiens; identical to SEQ ID NO: 41213

SEQ ID NO: 320915 - RNA, 64 nt, Homo Sapiens; identical to SEQ ID NO: 41214

SEQ ID NO: 320916 - RNA, 64 nt, Homo Sapiens; identical to SEQ ID NO: 41215

SEQ ID NO: 320917 - RNA, 64 nt, Homo Sapiens; identical to SEQ ID NO: 41216

SEQ ID NO: 320918 - RNA, 64 nt, Homo Sapiens; identical to SEQ ID NO: 41217

SEQ ID NO: 320919 - RNA, 64 nt, Homo Sapiens; identical to SEQ ID NO: 41218

SEQ ID NO: 320920 - RNA, 64 nt, Homo Sapiens; identical to SEQ ID NO: 41219

SEQ ID NO: 320921 - RNA, 64 nt, Homo Sapiens; identical to SEQ ID NO: 41220

SEQ ID NO: 320922 - RNA, 64 nt, Homo Sapiens; identical to SEQ ID NO: 41221

SEQ ID NO: 320923 - RNA, 64 nt, Homo Sapiens; identical to SEQ ID NO: 41222

SEQ ID NO: 320924 - RNA, 64 nt, Homo Sapiens; identical to SEQ ID NO: 41223

SEQ ID NO: 320925 - RNA, 64 nt, Homo Sapiens; identical to SEQ ID NO: 41224

SEQ ID NO: 320926 - RNA, 64 nt, Homo Sapiens; identical to SEQ ID NO: 41225

SEQ ID NO: 320927 - RNA, 64 nt, Homo Sapiens; identical to SEQ ID NO: 41226

SEQ ID NO: 320928 - RNA, 64 nt, Homo Sapiens; identical to SEQ ID NO: 41227

SEQ ID NO: 320929 - RNA, 64 nt, Homo Sapiens; identical to SEQ ID NO: 41228

SEQ ID NO: 320930 - RNA, 64 nt, Homo Sapiens; identical to SEQ ID NO: 41229

SEQ ID NO: 320931 - RNA, 64 nt, Homo Sapiens; identical to SEQ ID NO: 41230

SEQ ID NO: 320932 - RNA, 64 nt, Homo Sapiens; identical to SEQ ID NO: 41231

SEQ ID NO: 320933 - RNA, 64 nt, Homo Sapiens; identical to SEQ ID NO: 41232

SEQ ID NO: 320934 - RNA, 64 nt, Homo Sapiens; identical to SEQ ID NO: 41233

SEQ ID NO: 320935 - RNA, 64 nt, Homo Sapiens; identical to SEQ ID NO: 41234

SEQ ID NO: 320936 - RNA, 64 nt, Homo Sapiens; identical to SEQ ID NO: 41235

SEQ ID NO: 320937 - RNA, 62 nt, Homo Sapiens; identical to SEQ ID NO: 41236

SEQ ID NO: 320938 - RNA, 60 nt, Homo Sapiens; identical to SEQ ID NO: 41237

SEQ ID NO: 320939 - RNA, 58 nt, Homo Sapiens; identical to SEQ ID NO: 41238

SEQ ID NO: 320940 - RNA, 56 nt, Homo Sapiens; identical to SEQ ID NO: 41239

SEQ ID NO: 320941 - RNA, 54 nt, Homo Sapiens; identical to SEQ ID NO: 41240

SEQ ID NO: 320942 - RNA, 64 nt, Homo Sapiens; identical to SEQ ID NO: 41241

SEQ ID NO: 320943 - RNA, 64 nt, Homo Sapiens; identical to SEQ ID NO: 41242

SEQ ID NO: 320944 - RNA, 64 nt, Homo Sapiens; identical to SEQ ID NO: 41243

SEQ ID NO: 320945 - RNA, 64 nt, Homo Sapiens; identical to SEQ ID NO: 41244

SEQ ID NO: 320946 - RNA, 64 nt, Homo Sapiens; identical to SEQ ID NO: 41245

SEQ ID NO: 320947 - RNA, 64 nt, Homo Sapiens; identical to SEQ ID NO: 41246

SEQ ID NO: 320948 - RNA, 64 nt, Homo Sapiens; identical to SEQ ID NO: 41247

SEQ ID NO: 320949 - RNA, 64 nt, Homo Sapiens; identical to SEQ ID NO: 41248

SEQ ID NO: 320950 - RNA, 64 nt, Homo Sapiens; identical to SEQ ID NO: 41249

SEQ ID NO: 320951 - RNA, 64 nt, Homo Sapiens; identical to SEQ ID NO: 41250

SEQ ID NO: 320952 - RNA, 64 nt, Homo Sapiens; identical to SEQ ID NO: 41251

SEQ ID NO: 320953 - RNA, 64 nt, Homo Sapiens; identical to SEQ ID NO: 41252

SEQ ID NO: 320954 - RNA, 64 nt, Homo Sapiens; identical to SEQ ID NO: 41253

SEQ ID NO: 320955 - RNA, 64 nt, Homo Sapiens; identical to SEQ ID NO: 41254

SEQ ID NO: 320956 - RNA, 64 nt, Homo Sapiens; identical to SEQ ID NO: 41255

SEQ ID NO: 320957 - RNA, 64 nt, Homo Sapiens; identical to SEQ ID NO: 41256

SEQ ID NO: 320958 - RNA, 64 nt, Homo Sapiens; identical to SEQ ID NO: 41257

SEQ ID NO: 320959 - RNA, 64 nt, Homo Sapiens; identical to SEQ ID NO: 41258

SEQ ID NO: 320960 - RNA, 64 nt, Homo Sapiens; identical to SEQ ID NO: 41259

SEQ ID NO: 320961 - RNA, 64 nt, Homo Sapiens; identical to SEQ ID NO: 41260

SEQ ID NO: 320962 - RNA, 64 nt, Homo Sapiens; identical to SEQ ID NO: 41261

SEQ ID NO: 320963 - RNA, 64 nt, Homo Sapiens; identical to SEQ ID NO: 41262

SEQ ID NO: 320964 - RNA, 64 nt, Homo Sapiens; identical to SEQ ID NO: 41263

SEQ ID NO: 320965 - RNA, 64 nt, Homo Sapiens; identical to SEQ ID NO: 41264

SEQ ID NO: 320966 - RNA, 64 nt, Homo Sapiens; identical to SEQ ID NO: 41265

SEQ ID NO: 320967 - RNA, 64 nt, Homo Sapiens; identical to SEQ ID NO: 41266

SEQ ID NO: 320968 - RNA, 64 nt, Homo Sapiens; identical to SEQ ID NO: 41267

SEQ ID NO: 320969 - RNA, 64 nt, Homo Sapiens; identical to SEQ ID NO: 41268

SEQ ID NO: 320970 - RNA, 64 nt, Homo Sapiens; identical to SEQ ID NO: 41269

SEQ ID NO: 320971 - RNA, 64 nt, Homo Sapiens; identical to SEQ ID NO: 41270

SEQ ID NO: 320972 - RNA, 64 nt, Homo Sapiens; identical to SEQ ID NO: 41271

SEQ ID NO: 320973 - RNA, 64 nt, Homo Sapiens; identical to SEQ ID NO: 41272

SEQ ID NO: 320974 - RNA, 64 nt, Homo Sapiens; identical to SEQ ID NO: 41273

SEQ ID NO: 320975 - RNA, 64 nt, Homo Sapiens; identical to SEQ ID NO: 41274

SEQ ID NO: 320976 - RNA, 64 nt, Homo Sapiens; identical to SEQ ID NO: 41275

SEQ ID NO: 320977 - RNA, 64 nt, Homo Sapiens; identical to SEQ ID NO: 41276

SEQ ID NO: 320978 - RNA, 64 nt, Homo Sapiens; identical to SEQ ID NO: 41277

SEQ ID NO: 320979 - RNA, 64 nt, Homo Sapiens; identical to SEQ ID NO: 41278

SEQ ID NO: 320980 - RNA, 64 nt, Homo Sapiens; identical to SEQ ID NO: 41279

SEQ ID NO: 320981 - RNA, 64 nt, Homo Sapiens; identical to SEQ ID NO: 41280

SEQ ID NO: 320982 - RNA, 64 nt, Homo Sapiens; identical to SEQ ID NO: 41281

SEQ ID NO: 320983 - RNA, 64 nt, Homo Sapiens; identical to SEQ ID NO: 41282

SEQ ID NO: 320984 - RNA, 64 nt, Homo Sapiens; identical to SEQ ID NO: 41283

SEQ ID NO: 320985 - RNA, 64 nt, Homo Sapiens; identical to SEQ ID NO: 41284

SEQ ID NO: 320986 - RNA, 64 nt, Homo Sapiens; identical to SEQ ID NO: 41285

SEQ ID NO: 320987 - RNA, 64 nt, Homo Sapiens; identical to SEQ ID NO: 41286

SEQ ID NO: 320988 - RNA, 64 nt, Homo Sapiens; identical to SEQ ID NO: 41287

SEQ ID NO: 320989 - RNA, 64 nt, Homo Sapiens; identical to SEQ ID NO: 41288

SEQ ID NO: 320990 - RNA, 64 nt, Homo Sapiens; identical to SEQ ID NO: 41289

SEQ ID NO: 320991 - RNA, 64 nt, Homo Sapiens; identical to SEQ ID NO: 41290

SEQ ID NO: 320992 - RNA, 64 nt, Homo Sapiens; identical to SEQ ID NO: 41291

SEQ ID NO: 320993 - RNA, 64 nt, Homo Sapiens; identical to SEQ ID NO: 41292

SEQ ID NO: 320994 - RNA, 64 nt, Homo Sapiens; identical to SEQ ID NO: 41293

SEQ ID NO: 320995 - RNA, 64 nt, Homo Sapiens; identical to SEQ ID NO: 41294

SEQ ID NO: 320996 - RNA, 64 nt, Homo Sapiens; identical to SEQ ID NO: 41295

SEQ ID NO: 320997 - RNA, 64 nt, Homo Sapiens; identical to SEQ ID NO: 41296

SEQ ID NO: 320998 - RNA, 64 nt, Homo Sapiens; identical to SEQ ID NO: 41297

SEQ ID NO: 320999 - RNA, 64 nt, Homo Sapiens; identical to SEQ ID NO: 41298

SEQ ID NO: 321000 - RNA, 64 nt, Homo Sapiens; identical to SEQ ID NO: 41299

SEQ ID NO: 321001 - RNA, 64 nt, Homo Sapiens; identical to SEQ ID NO: 41300

SEQ ID NO: 321002 - RNA, 64 nt, Homo Sapiens; identical to SEQ ID NO: 41301

SEQ ID NO: 321003 - RNA, 64 nt, Homo Sapiens; identical to SEQ ID NO: 41302

SEQ ID NO: 321004 - RNA, 64 nt, Homo Sapiens; identical to SEQ ID NO: 41303

SEQ ID NO: 321005 - RNA, 64 nt, Homo Sapiens; identical to SEQ ID NO: 41304

SEQ ID NO: 321006 - RNA, 64 nt, Homo Sapiens; identical to SEQ ID NO: 41305

SEQ ID NO: 321007 - RNA, 64 nt, Homo Sapiens; identical to SEQ ID NO: 41306

SEQ ID NO: 321008 - RNA, 64 nt, Homo Sapiens; identical to SEQ ID NO: 41307

SEQ ID NO: 321009 - RNA, 64 nt, Homo Sapiens; identical to SEQ ID NO: 41308

SEQ ID NO: 321010 - RNA, 64 nt, Homo Sapiens; identical to SEQ ID NO: 41309

SEQ ID NO: 321011 - RNA, 64 nt, Homo Sapiens; identical to SEQ ID NO: 41310

SEQ ID NO: 321012 - RNA, 64 nt, Homo Sapiens; identical to SEQ ID NO: 41311

SEQ ID NO: 321013 - RNA, 64 nt, Homo Sapiens; identical to SEQ ID NO: 41312

SEQ ID NO: 321014 - RNA, 64 nt, Homo Sapiens; identical to SEQ ID NO: 41313

SEQ ID NO: 321015 - RNA, 64 nt, Homo Sapiens; identical to SEQ ID NO: 41314

SEQ ID NO: 321016 - RNA, 64 nt, Homo Sapiens; identical to SEQ ID NO: 41315

SEQ ID NO: 321017 - RNA, 64 nt, Homo Sapiens; identical to SEQ ID NO: 41316

SEQ ID NO: 321018 - RNA, 64 nt, Homo Sapiens; identical to SEQ ID NO: 41317

SEQ ID NO: 321019 - RNA, 64 nt, Homo Sapiens; identical to SEQ ID NO: 41318

SEQ ID NO: 321020 - RNA, 64 nt, Homo Sapiens; identical to SEQ ID NO: 41319

SEQ ID NO: 321021 - RNA, 64 nt, Homo Sapiens; identical to SEQ ID NO: 41320

SEQ ID NO: 321022 - RNA, 64 nt, Homo Sapiens; identical to SEQ ID NO: 41321

SEQ ID NO: 321023 - RNA, 64 nt, Homo Sapiens; identical to SEQ ID NO: 41322

SEQ ID NO: 321024 - RNA, 64 nt, Homo Sapiens; identical to SEQ ID NO: 41323

SEQ ID NO: 321025 - RNA, 64 nt, Homo Sapiens; identical to SEQ ID NO: 41324

SEQ ID NO: 321026 - RNA, 64 nt, Homo Sapiens; identical to SEQ ID NO: 41325

SEQ ID NO: 321027 - RNA, 64 nt, Homo Sapiens; identical to SEQ ID NO: 41326

SEQ ID NO: 321028 - RNA, 64 nt, Homo Sapiens; identical to SEQ ID NO: 41327

SEQ ID NO: 321029 - RNA, 64 nt, Homo Sapiens; identical to SEQ ID NO: 41328

SEQ ID NO: 321030 - RNA, 64 nt, Homo Sapiens; identical to SEQ ID NO: 41329

SEQ ID NO: 321031 - RNA, 64 nt, Homo Sapiens; identical to SEQ ID NO: 41330

SEQ ID NO: 321032 - RNA, 64 nt, Homo Sapiens; identical to SEQ ID NO: 41331

SEQ ID NO: 321033 - RNA, 64 nt, Homo Sapiens; identical to SEQ ID NO: 41332

SEQ ID NO: 321034 - RNA, 64 nt, Homo Sapiens; identical to SEQ ID NO: 41333

SEQ ID NO: 321035 - RNA, 64 nt, Homo Sapiens; identical to SEQ ID NO: 41334

SEQ ID NO: 321036 - RNA, 64 nt, Homo Sapiens; identical to SEQ ID NO: 41335

SEQ ID NO: 321037 - RNA, 64 nt, Homo Sapiens; identical to SEQ ID NO: 41336

SEQ ID NO: 321038 - RNA, 64 nt, Homo Sapiens; identical to SEQ ID NO: 41337

SEQ ID NO: 321039 - RNA, 64 nt, Homo Sapiens; identical to SEQ ID NO: 41338

SEQ ID NO: 321040 - RNA, 64 nt, Homo Sapiens; identical to SEQ ID NO: 41339

SEQ ID NO: 321041 - RNA, 64 nt, Homo Sapiens; identical to SEQ ID NO: 41340

SEQ ID NO: 321042 - RNA, 64 nt, Homo Sapiens; identical to SEQ ID NO: 41341

SEQ ID NO: 321043 - RNA, 64 nt, Homo Sapiens; identical to SEQ ID NO: 41342

SEQ ID NO: 321044 - RNA, 64 nt, Homo Sapiens; identical to SEQ ID NO: 41343

SEQ ID NO: 321045 - RNA, 64 nt, Homo Sapiens; identical to SEQ ID NO: 41344

SEQ ID NO: 321046 - RNA, 64 nt, Homo Sapiens; identical to SEQ ID NO: 41345

SEQ ID NO: 321047 - RNA, 64 nt, Homo Sapiens; identical to SEQ ID NO: 41346

SEQ ID NO: 321048 - RNA, 64 nt, Homo Sapiens; identical to SEQ ID NO: 41347

SEQ ID NO: 321049 - RNA, 64 nt, Homo Sapiens; identical to SEQ ID NO: 41348

SEQ ID NO: 321050 - RNA, 64 nt, Homo Sapiens; identical to SEQ ID NO: 41349

SEQ ID NO: 321051 - RNA, 64 nt, Homo Sapiens; identical to SEQ ID NO: 41350

SEQ ID NO: 321052 - RNA, 64 nt, Homo Sapiens; identical to SEQ ID NO: 41351

SEQ ID NO: 321053 - RNA, 64 nt, Homo Sapiens; identical to SEQ ID NO: 41352

SEQ ID NO: 321054 - RNA, 64 nt, Homo Sapiens; identical to SEQ ID NO: 41353

SEQ ID NO: 321055 - RNA, 64 nt, Homo Sapiens; identical to SEQ ID NO: 41354

SEQ ID NO: 321056 - RNA, 64 nt, Homo Sapiens; identical to SEQ ID NO: 41355

SEQ ID NO: 321057 - RNA, 64 nt, Homo Sapiens; identical to SEQ ID NO: 41356

SEQ ID NO: 321058 - RNA, 64 nt, Homo Sapiens; identical to SEQ ID NO: 41357

SEQ ID NO: 321059 - RNA, 64 nt, Homo Sapiens; identical to SEQ ID NO: 41358

SEQ ID NO: 321060 - RNA, 64 nt, Homo Sapiens; identical to SEQ ID NO: 41359

SEQ ID NO: 321061 - RNA, 64 nt, Homo Sapiens; identical to SEQ ID NO: 41360

SEQ ID NO: 321062 - RNA, 64 nt, Homo Sapiens; identical to SEQ ID NO: 41361

SEQ ID NO: 321063 - RNA, 64 nt, Homo Sapiens; identical to SEQ ID NO: 41362

SEQ ID NO: 321064 - RNA, 64 nt, Homo Sapiens; identical to SEQ ID NO: 41363

SEQ ID NO: 321065 - RNA, 64 nt, Homo Sapiens; identical to SEQ ID NO: 41364

SEQ ID NO: 321066 - RNA, 64 nt, Homo Sapiens; identical to SEQ ID NO: 41365

SEQ ID NO: 321067 - RNA, 64 nt, Homo Sapiens; identical to SEQ ID NO: 41366

SEQ ID NO: 321068 - RNA, 64 nt, Homo Sapiens; identical to SEQ ID NO: 41367

SEQ ID NO: 321069 - RNA, 64 nt, Homo Sapiens; identical to SEQ ID NO: 41368

SEQ ID NO: 321070 - RNA, 64 nt, Homo Sapiens; identical to SEQ ID NO: 41369

SEQ ID NO: 321071 - RNA, 64 nt, Homo Sapiens; identical to SEQ ID NO: 41370

SEQ ID NO: 321072 - RNA, 64 nt, Homo Sapiens; identical to SEQ ID NO: 41371

SEQ ID NO: 321073 - RNA, 64 nt, Homo Sapiens; identical to SEQ ID NO: 41372

SEQ ID NO: 321074 - RNA, 64 nt, Homo Sapiens; identical to SEQ ID NO: 41373

SEQ ID NO: 321075 - RNA, 64 nt, Homo Sapiens; identical to SEQ ID NO: 41374

SEQ ID NO: 321076 - RNA, 64 nt, Homo Sapiens; identical to SEQ ID NO: 41375

SEQ ID NO: 321077 - RNA, 64 nt, Homo Sapiens; identical to SEQ ID NO: 41376

SEQ ID NO: 321078 - RNA, 64 nt, Homo Sapiens; identical to SEQ ID NO: 41377

SEQ ID NO: 321079 - RNA, 64 nt, Homo Sapiens; identical to SEQ ID NO: 41378

SEQ ID NO: 321080 - RNA, 64 nt, Homo Sapiens; identical to SEQ ID NO: 41379

SEQ ID NO: 321081 - RNA, 64 nt, Homo Sapiens; identical to SEQ ID NO: 41380

SEQ ID NO: 321082 - RNA, 64 nt, Homo Sapiens; identical to SEQ ID NO: 41381

SEQ ID NO: 321083 - RNA, 64 nt, Homo Sapiens; identical to SEQ ID NO: 41382

SEQ ID NO: 321084 - RNA, 64 nt, Homo Sapiens; identical to SEQ ID NO: 41383

SEQ ID NO: 321085 - RNA, 64 nt, Homo Sapiens; identical to SEQ ID NO: 41384

SEQ ID NO: 321086 - RNA, 64 nt, Homo Sapiens; identical to SEQ ID NO: 41385

SEQ ID NO: 321087 - RNA, 64 nt, Homo Sapiens; identical to SEQ ID NO: 41386

SEQ ID NO: 321088 - RNA, 64 nt, Homo Sapiens; identical to SEQ ID NO: 41387

SEQ ID NO: 321089 - RNA, 64 nt, Homo Sapiens; identical to SEQ ID NO: 41388

SEQ ID NO: 321090 - RNA, 64 nt, Homo Sapiens; identical to SEQ ID NO: 41389

SEQ ID NO: 321091 - RNA, 64 nt, Homo Sapiens; identical to SEQ ID NO: 41390

SEQ ID NO: 321092 - RNA, 64 nt, Homo Sapiens; identical to SEQ ID NO: 41391

SEQ ID NO: 321093 - RNA, 64 nt, Homo Sapiens; identical to SEQ ID NO: 41392

SEQ ID NO: 321094 - RNA, 64 nt, Homo Sapiens; identical to SEQ ID NO: 41393

SEQ ID NO: 321095 - RNA, 64 nt, Homo Sapiens; identical to SEQ ID NO: 41394

SEQ ID NO: 321096 - RNA, 64 nt, Homo Sapiens; identical to SEQ ID NO: 41395

SEQ ID NO: 321097 - RNA, 64 nt, Homo Sapiens; identical to SEQ ID NO: 41396

SEQ ID NO: 321098 - RNA, 64 nt, Homo Sapiens; identical to SEQ ID NO: 41397

SEQ ID NO: 321099 - RNA, 64 nt, Homo Sapiens; identical to SEQ ID NO: 41398

SEQ ID NO: 321100 - RNA, 64 nt, Homo Sapiens; identical to SEQ ID NO: 41399

SEQ ID NO: 321101 - RNA, 64 nt, Homo Sapiens; identical to SEQ ID NO: 41400

SEQ ID NO: 321102 - RNA, 64 nt, Homo Sapiens; identical to SEQ ID NO: 41401

SEQ ID NO: 321103 - RNA, 64 nt, Homo Sapiens; identical to SEQ ID NO: 41402

SEQ ID NO: 321104 - RNA, 64 nt, Homo Sapiens; identical to SEQ ID NO: 41403

SEQ ID NO: 321105 - RNA, 64 nt, Homo Sapiens; identical to SEQ ID NO: 41404

SEQ ID NO: 321106 - RNA, 64 nt, Homo Sapiens; identical to SEQ ID NO: 41405

SEQ ID NO: 321107 - RNA, 64 nt, Homo Sapiens; identical to SEQ ID NO: 41406

SEQ ID NO: 321108 - RNA, 64 nt, Homo Sapiens; identical to SEQ ID NO: 41407

SEQ ID NO: 321109 - RNA, 64 nt, Homo Sapiens; identical to SEQ ID NO: 41408

SEQ ID NO: 321110 - RNA, 64 nt, Homo Sapiens; identical to SEQ ID NO: 41409

SEQ ID NO: 321111 - RNA, 64 nt, Homo Sapiens; identical to SEQ ID NO: 41410

SEQ ID NO: 321112 - RNA, 64 nt, Homo Sapiens; identical to SEQ ID NO: 41411

SEQ ID NO: 321113 - RNA, 64 nt, Homo Sapiens; identical to SEQ ID NO: 41412

SEQ ID NO: 321114 - RNA, 64 nt, Homo Sapiens; identical to SEQ ID NO: 41413

SEQ ID NO: 321115 - RNA, 64 nt, Homo Sapiens; identical to SEQ ID NO: 41414

SEQ ID NO: 321116 - RNA, 64 nt, Homo Sapiens; identical to SEQ ID NO: 41415

SEQ ID NO: 321117 - RNA, 64 nt, Homo Sapiens; identical to SEQ ID NO: 41416

SEQ ID NO: 321118 - RNA, 64 nt, Homo Sapiens; identical to SEQ ID NO: 41417

SEQ ID NO: 321119 - RNA, 64 nt, Homo Sapiens; identical to SEQ ID NO: 41418

SEQ ID NO: 321120 - RNA, 64 nt, Homo Sapiens; identical to SEQ ID NO: 41419

SEQ ID NO: 321121 - RNA, 64 nt, Homo Sapiens; identical to SEQ ID NO: 41420

SEQ ID NO: 321122 - RNA, 64 nt, Homo Sapiens; identical to SEQ ID NO: 41421

SEQ ID NO: 321123 - RNA, 64 nt, Homo Sapiens; identical to SEQ ID NO: 41422

SEQ ID NO: 321124 - RNA, 64 nt, Homo Sapiens; identical to SEQ ID NO: 41423

SEQ ID NO: 321125 - RNA, 64 nt, Homo Sapiens; identical to SEQ ID NO: 41424

SEQ ID NO: 321126 - RNA, 64 nt, Homo Sapiens; identical to SEQ ID NO: 41425

SEQ ID NO: 321127 - RNA, 64 nt, Homo Sapiens; identical to SEQ ID NO: 41426

SEQ ID NO: 321128 - RNA, 64 nt, Homo Sapiens; identical to SEQ ID NO: 41427

SEQ ID NO: 321129 - RNA, 64 nt, Homo Sapiens; identical to SEQ ID NO: 41428

SEQ ID NO: 321130 - RNA, 64 nt, Homo Sapiens; identical to SEQ ID NO: 41429

SEQ ID NO: 321131 - RNA, 64 nt, Homo Sapiens; identical to SEQ ID NO: 41430

SEQ ID NO: 321132 - RNA, 64 nt, Homo Sapiens; identical to SEQ ID NO: 41431

SEQ ID NO: 321133 - RNA, 64 nt, Homo Sapiens; identical to SEQ ID NO: 41432

SEQ ID NO: 321134 - RNA, 64 nt, Homo Sapiens; identical to SEQ ID NO: 41433

SEQ ID NO: 321135 - RNA, 64 nt, Homo Sapiens; identical to SEQ ID NO: 41434

SEQ ID NO: 321136 - RNA, 64 nt, Homo Sapiens; identical to SEQ ID NO: 41435

SEQ ID NO: 321137 - RNA, 64 nt, Homo Sapiens; identical to SEQ ID NO: 41436

SEQ ID NO: 321138 - RNA, 64 nt, Homo Sapiens; identical to SEQ ID NO: 41437

SEQ ID NO: 321139 - RNA, 64 nt, Homo Sapiens; identical to SEQ ID NO: 41438

SEQ ID NO: 321140 - RNA, 64 nt, Homo Sapiens; identical to SEQ ID NO: 41439

SEQ ID NO: 321141 - RNA, 64 nt, Homo Sapiens; identical to SEQ ID NO: 41440

SEQ ID NO: 321142 - RNA, 64 nt, Homo Sapiens; identical to SEQ ID NO: 41441

SEQ ID NO: 321143 - RNA, 64 nt, Homo Sapiens; identical to SEQ ID NO: 41442

SEQ ID NO: 321144 - RNA, 64 nt, Homo Sapiens; identical to SEQ ID NO: 41443

SEQ ID NO: 321145 - RNA, 64 nt, Homo Sapiens; identical to SEQ ID NO: 41444

SEQ ID NO: 321146 - RNA, 64 nt, Homo Sapiens; identical to SEQ ID NO: 41445

SEQ ID NO: 321147 - RNA, 64 nt, Homo Sapiens; identical to SEQ ID NO: 41446

SEQ ID NO: 321148 - RNA, 64 nt, Homo Sapiens; identical to SEQ ID NO: 41447

SEQ ID NO: 321149 - RNA, 64 nt, Homo Sapiens; identical to SEQ ID NO: 41448

SEQ ID NO: 321150 - RNA, 64 nt, Homo Sapiens; identical to SEQ ID NO: 41449

SEQ ID NO: 321151 - RNA, 64 nt, Homo Sapiens; identical to SEQ ID NO: 41450

SEQ ID NO: 321152 - RNA, 64 nt, Homo Sapiens; identical to SEQ ID NO: 41451

SEQ ID NO: 321153 - RNA, 64 nt, Homo Sapiens; identical to SEQ ID NO: 41452

SEQ ID NO: 321154 - RNA, 64 nt, Homo Sapiens; identical to SEQ ID NO: 41453

SEQ ID NO: 321155 - RNA, 64 nt, Homo Sapiens; identical to SEQ ID NO: 41454

SEQ ID NO: 321156 - RNA, 64 nt, Homo Sapiens; identical to SEQ ID NO: 41455

SEQ ID NO: 321157 - RNA, 64 nt, Homo Sapiens; identical to SEQ ID NO: 41456

SEQ ID NO: 321158 - RNA, 64 nt, Homo Sapiens; identical to SEQ ID NO: 41457

SEQ ID NO: 321159 - RNA, 64 nt, Homo Sapiens; identical to SEQ ID NO: 41458

SEQ ID NO: 321160 - RNA, 64 nt, Homo Sapiens; identical to SEQ ID NO: 41459

SEQ ID NO: 321161 - RNA, 64 nt, Homo Sapiens; identical to SEQ ID NO: 41460

SEQ ID NO: 321162 - RNA, 64 nt, Homo Sapiens; identical to SEQ ID NO: 41461

SEQ ID NO: 321163 - RNA, 64 nt, Homo Sapiens; identical to SEQ ID NO: 41462

SEQ ID NO: 321164 - RNA, 64 nt, Homo Sapiens; identical to SEQ ID NO: 41463

SEQ ID NO: 321165 - RNA, 64 nt, Homo Sapiens; identical to SEQ ID NO: 41464

SEQ ID NO: 321166 - RNA, 64 nt, Homo Sapiens; identical to SEQ ID NO: 41465

SEQ ID NO: 321167 - RNA, 64 nt, Homo Sapiens; identical to SEQ ID NO: 41466

SEQ ID NO: 321168 - RNA, 64 nt, Homo Sapiens; identical to SEQ ID NO: 41467

SEQ ID NO: 321169 - RNA, 64 nt, Homo Sapiens; identical to SEQ ID NO: 41468

SEQ ID NO: 321170 - RNA, 64 nt, Homo Sapiens; identical to SEQ ID NO: 41469

SEQ ID NO: 321171 - RNA, 64 nt, Homo Sapiens; identical to SEQ ID NO: 41470

SEQ ID NO: 321172 - RNA, 64 nt, Homo Sapiens; identical to SEQ ID NO: 41471

SEQ ID NO: 321173 - RNA, 64 nt, Homo Sapiens; identical to SEQ ID NO: 41472

SEQ ID NO: 321174 - RNA, 64 nt, Homo Sapiens; identical to SEQ ID NO: 41473

SEQ ID NO: 321175 - RNA, 64 nt, Homo Sapiens; identical to SEQ ID NO: 41474

SEQ ID NO: 321176 - RNA, 64 nt, Homo Sapiens; identical to SEQ ID NO: 41475

SEQ ID NO: 321177 - RNA, 64 nt, Homo Sapiens; identical to SEQ ID NO: 41476

SEQ ID NO: 321178 - RNA, 64 nt, Homo Sapiens; identical to SEQ ID NO: 41477

SEQ ID NO: 321179 - RNA, 64 nt, Homo Sapiens; identical to SEQ ID NO: 41478

SEQ ID NO: 321180 - RNA, 64 nt, Homo Sapiens; identical to SEQ ID NO: 41479

SEQ ID NO: 321181 - RNA, 64 nt, Homo Sapiens; identical to SEQ ID NO: 41480

SEQ ID NO: 321182 - RNA, 64 nt, Homo Sapiens; identical to SEQ ID NO: 41481

SEQ ID NO: 321183 - RNA, 64 nt, Homo Sapiens; identical to SEQ ID NO: 41482

SEQ ID NO: 321184 - RNA, 64 nt, Homo Sapiens; identical to SEQ ID NO: 41483

SEQ ID NO: 321185 - RNA, 64 nt, Homo Sapiens; identical to SEQ ID NO: 41484

SEQ ID NO: 321186 - RNA, 64 nt, Homo Sapiens; identical to SEQ ID NO: 41485

SEQ ID NO: 321187 - RNA, 64 nt, Homo Sapiens; identical to SEQ ID NO: 41486

SEQ ID NO: 321188 - RNA, 64 nt, Homo Sapiens; identical to SEQ ID NO: 41487

SEQ ID NO: 321189 - RNA, 64 nt, Homo Sapiens; identical to SEQ ID NO: 41488

SEQ ID NO: 321190 - RNA, 64 nt, Homo Sapiens; identical to SEQ ID NO: 41489

SEQ ID NO: 321191 - RNA, 64 nt, Homo Sapiens; identical to SEQ ID NO: 41490

SEQ ID NO: 321192 - RNA, 64 nt, Homo Sapiens; identical to SEQ ID NO: 41491

SEQ ID NO: 321193 - RNA, 64 nt, Homo Sapiens; identical to SEQ ID NO: 41492

SEQ ID NO: 321194 - RNA, 64 nt, Homo Sapiens; identical to SEQ ID NO: 41493

SEQ ID NO: 321195 - RNA, 64 nt, Homo Sapiens; identical to SEQ ID NO: 41494

SEQ ID NO: 321196 - RNA, 64 nt, Homo Sapiens; identical to SEQ ID NO: 41495

SEQ ID NO: 321197 - RNA, 64 nt, Homo Sapiens; identical to SEQ ID NO: 41496

SEQ ID NO: 321198 - RNA, 64 nt, Homo Sapiens; identical to SEQ ID NO: 41497

SEQ ID NO: 321199 - RNA, 64 nt, Homo Sapiens; identical to SEQ ID NO: 41498

SEQ ID NO: 321200 - RNA, 64 nt, Homo Sapiens; identical to SEQ ID NO: 41499

SEQ ID NO: 321201 - RNA, 64 nt, Homo Sapiens; identical to SEQ ID NO: 41500

SEQ ID NO: 321202 - RNA, 64 nt, Homo Sapiens; identical to SEQ ID NO: 41501

SEQ ID NO: 321203 - RNA, 64 nt, Homo Sapiens; identical to SEQ ID NO: 41502

SEQ ID NO: 321204 - RNA, 64 nt, Homo Sapiens; identical to SEQ ID NO: 41503

SEQ ID NO: 321205 - RNA, 64 nt, Homo Sapiens; identical to SEQ ID NO: 41504

SEQ ID NO: 321206 - RNA, 64 nt, Homo Sapiens; identical to SEQ ID NO: 41505

SEQ ID NO: 321207 - RNA, 64 nt, Homo Sapiens; identical to SEQ ID NO: 41506

SEQ ID NO: 321208 - RNA, 64 nt, Homo Sapiens; identical to SEQ ID NO: 41507

SEQ ID NO: 321209 - RNA, 64 nt, Homo Sapiens; identical to SEQ ID NO: 41508

SEQ ID NO: 321210 - RNA, 64 nt, Homo Sapiens; identical to SEQ ID NO: 41509

SEQ ID NO: 321211 - RNA, 64 nt, Homo Sapiens; identical to SEQ ID NO: 41510

SEQ ID NO: 321212 - RNA, 64 nt, Homo Sapiens; identical to SEQ ID NO: 41511

SEQ ID NO: 321213 - RNA, 64 nt, Homo Sapiens; identical to SEQ ID NO: 41512

SEQ ID NO: 321214 - RNA, 64 nt, Homo Sapiens; identical to SEQ ID NO: 41513

SEQ ID NO: 321215 - RNA, 64 nt, Homo Sapiens; identical to SEQ ID NO: 41514

SEQ ID NO: 321216 - RNA, 64 nt, Homo Sapiens; identical to SEQ ID NO: 41515

SEQ ID NO: 321217 - RNA, 64 nt, Homo Sapiens; identical to SEQ ID NO: 41516

SEQ ID NO: 321218 - RNA, 64 nt, Homo Sapiens; identical to SEQ ID NO: 41517

SEQ ID NO: 321219 - RNA, 64 nt, Homo Sapiens; identical to SEQ ID NO: 41518

SEQ ID NO: 321220 - RNA, 64 nt, Homo Sapiens; identical to SEQ ID NO: 41519

SEQ ID NO: 321221 - RNA, 64 nt, Homo Sapiens; identical to SEQ ID NO: 41520

SEQ ID NO: 321222 - RNA, 64 nt, Homo Sapiens; identical to SEQ ID NO: 41521

SEQ ID NO: 321223 - RNA, 64 nt, Homo Sapiens; identical to SEQ ID NO: 41522

SEQ ID NO: 321224 - RNA, 64 nt, Homo Sapiens; identical to SEQ ID NO: 41523

SEQ ID NO: 321225 - RNA, 64 nt, Homo Sapiens; identical to SEQ ID NO: 41524

SEQ ID NO: 321226 - RNA, 64 nt, Homo Sapiens; identical to SEQ ID NO: 41525

SEQ ID NO: 321227 - RNA, 64 nt, Homo Sapiens; identical to SEQ ID NO: 41526

SEQ ID NO: 321228 - RNA, 64 nt, Homo Sapiens; identical to SEQ ID NO: 41527

SEQ ID NO: 321229 - RNA, 64 nt, Homo Sapiens; identical to SEQ ID NO: 41528

SEQ ID NO: 321230 - RNA, 64 nt, Homo Sapiens; identical to SEQ ID NO: 41529

SEQ ID NO: 321231 - RNA, 64 nt, Homo Sapiens; identical to SEQ ID NO: 41530

SEQ ID NO: 321232 - RNA, 64 nt, Homo Sapiens; identical to SEQ ID NO: 41531

SEQ ID NO: 321233 - RNA, 64 nt, Homo Sapiens; identical to SEQ ID NO: 41532

SEQ ID NO: 321234 - RNA, 64 nt, Homo Sapiens; identical to SEQ ID NO: 41533

SEQ ID NO: 321235 - RNA, 64 nt, Homo Sapiens; identical to SEQ ID NO: 41534

SEQ ID NO: 321236 - RNA, 64 nt, Homo Sapiens; identical to SEQ ID NO: 41535

SEQ ID NO: 321237 - RNA, 64 nt, Homo Sapiens; identical to SEQ ID NO: 41536

SEQ ID NO: 321238 - RNA, 64 nt, Homo Sapiens; identical to SEQ ID NO: 41537

SEQ ID NO: 321239 - RNA, 64 nt, Homo Sapiens; identical to SEQ ID NO: 41538

SEQ ID NO: 321240 - RNA, 64 nt, Homo Sapiens; identical to SEQ ID NO: 41539

SEQ ID NO: 321241 - RNA, 64 nt, Homo Sapiens; identical to SEQ ID NO: 41540

SEQ ID NO: 321242 - RNA, 64 nt, Homo Sapiens; identical to SEQ ID NO: 41541

SEQ ID NO: 321243 - RNA, 64 nt, Homo Sapiens; identical to SEQ ID NO: 41542

SEQ ID NO: 321244 - RNA, 64 nt, Homo Sapiens; identical to SEQ ID NO: 41543

SEQ ID NO: 321245 - RNA, 64 nt, Homo Sapiens; identical to SEQ ID NO: 41544

SEQ ID NO: 321246 - RNA, 64 nt, Homo Sapiens; identical to SEQ ID NO: 41545

SEQ ID NO: 321247 - RNA, 64 nt, Homo Sapiens; identical to SEQ ID NO: 41546

SEQ ID NO: 321248 - RNA, 64 nt, Homo Sapiens; identical to SEQ ID NO: 41547

SEQ ID NO: 321249 - RNA, 64 nt, Homo Sapiens; identical to SEQ ID NO: 41548

SEQ ID NO: 321250 - RNA, 64 nt, Homo Sapiens; identical to SEQ ID NO: 41549

SEQ ID NO: 321251 - RNA, 64 nt, Homo Sapiens; identical to SEQ ID NO: 41550

SEQ ID NO: 321252 - RNA, 64 nt, Homo Sapiens; identical to SEQ ID NO: 41551

SEQ ID NO: 321253 - RNA, 64 nt, Homo Sapiens; identical to SEQ ID NO: 41552

SEQ ID NO: 321254 - RNA, 64 nt, Homo Sapiens; identical to SEQ ID NO: 41553

SEQ ID NO: 321255 - RNA, 64 nt, Homo Sapiens; identical to SEQ ID NO: 41554

SEQ ID NO: 321256 - RNA, 64 nt, Homo Sapiens; identical to SEQ ID NO: 41555

SEQ ID NO: 321257 - RNA, 64 nt, Homo Sapiens; identical to SEQ ID NO: 41556

SEQ ID NO: 321258 - RNA, 64 nt, Homo Sapiens; identical to SEQ ID NO: 41557

SEQ ID NO: 321259 - RNA, 64 nt, Homo Sapiens; identical to SEQ ID NO: 41558

SEQ ID NO: 321260 - RNA, 64 nt, Homo Sapiens; identical to SEQ ID NO: 41559

SEQ ID NO: 321261 - RNA, 64 nt, Homo Sapiens; identical to SEQ ID NO: 41560

SEQ ID NO: 321262 - RNA, 64 nt, Homo Sapiens; identical to SEQ ID NO: 41561

SEQ ID NO: 321263 - RNA, 64 nt, Homo Sapiens; identical to SEQ ID NO: 41562

SEQ ID NO: 321264 - RNA, 64 nt, Homo Sapiens; identical to SEQ ID NO: 41563

SEQ ID NO: 321265 - RNA, 64 nt, Homo Sapiens; identical to SEQ ID NO: 41564

SEQ ID NO: 321266 - RNA, 64 nt, Homo Sapiens; identical to SEQ ID NO: 41565

SEQ ID NO: 321267 - RNA, 64 nt, Homo Sapiens; identical to SEQ ID NO: 41566

SEQ ID NO: 321268 - RNA, 64 nt, Homo Sapiens; identical to SEQ ID NO: 41567

SEQ ID NO: 321269 - RNA, 64 nt, Homo Sapiens; identical to SEQ ID NO: 41568

SEQ ID NO: 321270 - RNA, 64 nt, Homo Sapiens; identical to SEQ ID NO: 41569

SEQ ID NO: 321271 - RNA, 64 nt, Homo Sapiens; identical to SEQ ID NO: 41570

SEQ ID NO: 321272 - RNA, 64 nt, Homo Sapiens; identical to SEQ ID NO: 41571

SEQ ID NO: 321273 - RNA, 64 nt, Homo Sapiens; identical to SEQ ID NO: 41572

SEQ ID NO: 321274 - RNA, 64 nt, Homo Sapiens; identical to SEQ ID NO: 41573

SEQ ID NO: 321275 - RNA, 64 nt, Homo Sapiens; identical to SEQ ID NO: 41574

SEQ ID NO: 321276 - RNA, 64 nt, Homo Sapiens; identical to SEQ ID NO: 41575

SEQ ID NO: 321277 - RNA, 64 nt, Homo Sapiens; identical to SEQ ID NO: 41576

SEQ ID NO: 321278 - RNA, 64 nt, Homo Sapiens; identical to SEQ ID NO: 41577

SEQ ID NO: 321279 - RNA, 64 nt, Homo Sapiens; identical to SEQ ID NO: 41578

SEQ ID NO: 321280 - RNA, 64 nt, Homo Sapiens; identical to SEQ ID NO: 41579

SEQ ID NO: 321281 - RNA, 64 nt, Homo Sapiens; identical to SEQ ID NO: 41580

SEQ ID NO: 321282 - RNA, 64 nt, Homo Sapiens; identical to SEQ ID NO: 41581

SEQ ID NO: 321283 - RNA, 64 nt, Homo Sapiens; identical to SEQ ID NO: 41582

SEQ ID NO: 321284 - RNA, 64 nt, Homo Sapiens; identical to SEQ ID NO: 41583

SEQ ID NO: 321285 - RNA, 64 nt, Homo Sapiens; identical to SEQ ID NO: 41584

SEQ ID NO: 321286 - RNA, 64 nt, Homo Sapiens; identical to SEQ ID NO: 41585

SEQ ID NO: 321287 - RNA, 64 nt, Homo Sapiens; identical to SEQ ID NO: 41586

SEQ ID NO: 321288 - RNA, 64 nt, Homo Sapiens; identical to SEQ ID NO: 41587

SEQ ID NO: 321289 - RNA, 64 nt, Homo Sapiens; identical to SEQ ID NO: 41588

SEQ ID NO: 321290 - RNA, 64 nt, Homo Sapiens; identical to SEQ ID NO: 41589

SEQ ID NO: 321291 - RNA, 64 nt, Homo Sapiens; identical to SEQ ID NO: 41590

SEQ ID NO: 321292 - RNA, 64 nt, Homo Sapiens; identical to SEQ ID NO: 41591

SEQ ID NO: 321293 - RNA, 64 nt, Homo Sapiens; identical to SEQ ID NO: 41592

SEQ ID NO: 321294 - RNA, 64 nt, Homo Sapiens; identical to SEQ ID NO: 41593

SEQ ID NO: 321295 - RNA, 64 nt, Homo Sapiens; identical to SEQ ID NO: 41594

SEQ ID NO: 321296 - RNA, 64 nt, Homo Sapiens; identical to SEQ ID NO: 41595

SEQ ID NO: 321297 - RNA, 64 nt, Homo Sapiens; identical to SEQ ID NO: 41596

SEQ ID NO: 321298 - RNA, 64 nt, Homo Sapiens; identical to SEQ ID NO: 41597

SEQ ID NO: 321299 - RNA, 64 nt, Homo Sapiens; identical to SEQ ID NO: 41598

SEQ ID NO: 321300 - RNA, 64 nt, Homo Sapiens; identical to SEQ ID NO: 41599

SEQ ID NO: 321301 - RNA, 64 nt, Homo Sapiens; identical to SEQ ID NO: 41600

SEQ ID NO: 321302 - RNA, 64 nt, Homo Sapiens; identical to SEQ ID NO: 41601

SEQ ID NO: 321303 - RNA, 64 nt, Homo Sapiens; identical to SEQ ID NO: 41602

SEQ ID NO: 321304 - RNA, 64 nt, Homo Sapiens; identical to SEQ ID NO: 41603

SEQ ID NO: 321305 - RNA, 64 nt, Homo Sapiens; identical to SEQ ID NO: 41604

SEQ ID NO: 321306 - RNA, 64 nt, Homo Sapiens; identical to SEQ ID NO: 41605

SEQ ID NO: 321307 - RNA, 64 nt, Homo Sapiens; identical to SEQ ID NO: 41606

SEQ ID NO: 321308 - RNA, 64 nt, Homo Sapiens; identical to SEQ ID NO: 41607

SEQ ID NO: 321309 - RNA, 64 nt, Homo Sapiens; identical to SEQ ID NO: 41608

SEQ ID NO: 321310 - RNA, 64 nt, Homo Sapiens; identical to SEQ ID NO: 41609

SEQ ID NO: 321311 - RNA, 64 nt, Homo Sapiens; identical to SEQ ID NO: 41610

SEQ ID NO: 321312 - RNA, 64 nt, Homo Sapiens; identical to SEQ ID NO: 41611

SEQ ID NO: 321313 - RNA, 64 nt, Homo Sapiens; identical to SEQ ID NO: 41612

SEQ ID NO: 321314 - RNA, 64 nt, Homo Sapiens; identical to SEQ ID NO: 41613

SEQ ID NO: 321315 - RNA, 64 nt, Homo Sapiens; identical to SEQ ID NO: 41614

SEQ ID NO: 321316 - RNA, 64 nt, Homo Sapiens; identical to SEQ ID NO: 41615

SEQ ID NO: 321317 - RNA, 64 nt, Homo Sapiens; identical to SEQ ID NO: 41616

SEQ ID NO: 321318 - RNA, 64 nt, Homo Sapiens; identical to SEQ ID NO: 41617

SEQ ID NO: 321319 - RNA, 64 nt, Homo Sapiens; identical to SEQ ID NO: 41618

SEQ ID NO: 321320 - RNA, 64 nt, Homo Sapiens; identical to SEQ ID NO: 41619

SEQ ID NO: 321321 - RNA, 64 nt, Homo Sapiens; identical to SEQ ID NO: 41620

SEQ ID NO: 321322 - RNA, 64 nt, Homo Sapiens; identical to SEQ ID NO: 41621

SEQ ID NO: 321323 - RNA, 63 nt, Homo Sapiens; identical to SEQ ID NO: 41622

SEQ ID NO: 321324 - RNA, 64 nt, Homo Sapiens; identical to SEQ ID NO: 41623

SEQ ID NO: 321325 - RNA, 64 nt, Homo Sapiens; identical to SEQ ID NO: 41624

SEQ ID NO: 321326 - RNA, 64 nt, Homo Sapiens; identical to SEQ ID NO: 41625

SEQ ID NO: 321327 - RNA, 64 nt, Homo Sapiens; identical to SEQ ID NO: 41626

SEQ ID NO: 321328 - RNA, 64 nt, Homo Sapiens; identical to SEQ ID NO: 41627

SEQ ID NO: 321329 - RNA, 64 nt, Homo Sapiens; identical to SEQ ID NO: 41628

SEQ ID NO: 321330 - RNA, 64 nt, Homo Sapiens; identical to SEQ ID NO: 41629

SEQ ID NO: 321331 - RNA, 64 nt, Homo Sapiens; identical to SEQ ID NO: 41630

SEQ ID NO: 321332 - RNA, 64 nt, Homo Sapiens; identical to SEQ ID NO: 41631

SEQ ID NO: 321333 - RNA, 64 nt, Homo Sapiens; identical to SEQ ID NO: 41632

SEQ ID NO: 321334 - RNA, 64 nt, Homo Sapiens; identical to SEQ ID NO: 41633

SEQ ID NO: 321335 - RNA, 64 nt, Homo Sapiens; identical to SEQ ID NO: 41634

SEQ ID NO: 321336 - RNA, 64 nt, Homo Sapiens; identical to SEQ ID NO: 41635

SEQ ID NO: 321337 - RNA, 64 nt, Homo Sapiens; identical to SEQ ID NO: 41636

SEQ ID NO: 321338 - RNA, 64 nt, Homo Sapiens; identical to SEQ ID NO: 41637

SEQ ID NO: 321339 - RNA, 64 nt, Homo Sapiens; identical to SEQ ID NO: 41638

SEQ ID NO: 321340 - RNA, 64 nt, Homo Sapiens; identical to SEQ ID NO: 41639

SEQ ID NO: 321341 - RNA, 64 nt, Homo Sapiens; identical to SEQ ID NO: 41640

SEQ ID NO: 321342 - RNA, 64 nt, Homo Sapiens; identical to SEQ ID NO: 41641

SEQ ID NO: 321343 - RNA, 64 nt, Homo Sapiens; identical to SEQ ID NO: 41642

SEQ ID NO: 321344 - RNA, 64 nt, Homo Sapiens; identical to SEQ ID NO: 41643

SEQ ID NO: 321345 - RNA, 64 nt, Homo Sapiens; identical to SEQ ID NO: 41644

SEQ ID NO: 321346 - RNA, 64 nt, Homo Sapiens; identical to SEQ ID NO: 41645

SEQ ID NO: 321347 - RNA, 64 nt, Homo Sapiens; identical to SEQ ID NO: 41646

SEQ ID NO: 321348 - RNA, 64 nt, Homo Sapiens; identical to SEQ ID NO: 41647

SEQ ID NO: 321349 - RNA, 64 nt, Homo Sapiens; identical to SEQ ID NO: 41648

SEQ ID NO: 321350 - RNA, 64 nt, Homo Sapiens; identical to SEQ ID NO: 41649

SEQ ID NO: 321351 - RNA, 64 nt, Homo Sapiens; identical to SEQ ID NO: 41650

SEQ ID NO: 321352 - RNA, 64 nt, Homo Sapiens; identical to SEQ ID NO: 41651

SEQ ID NO: 321353 - RNA, 64 nt, Homo Sapiens; identical to SEQ ID NO: 41652

SEQ ID NO: 321354 - RNA, 64 nt, Homo Sapiens; identical to SEQ ID NO: 41653

SEQ ID NO: 321355 - RNA, 64 nt, Homo Sapiens; identical to SEQ ID NO: 41654

SEQ ID NO: 321356 - RNA, 64 nt, Homo Sapiens; identical to SEQ ID NO: 41655

SEQ ID NO: 321357 - RNA, 64 nt, Homo Sapiens; identical to SEQ ID NO: 41656

SEQ ID NO: 321358 - RNA, 64 nt, Homo Sapiens; identical to SEQ ID NO: 41657

SEQ ID NO: 321359 - RNA, 64 nt, Homo Sapiens; identical to SEQ ID NO: 41658

SEQ ID NO: 321360 - RNA, 64 nt, Homo Sapiens; identical to SEQ ID NO: 41659

SEQ ID NO: 321361 - RNA, 64 nt, Homo Sapiens; identical to SEQ ID NO: 41660

SEQ ID NO: 321362 - RNA, 64 nt, Homo Sapiens; identical to SEQ ID NO: 41661

SEQ ID NO: 321363 - RNA, 64 nt, Homo Sapiens; identical to SEQ ID NO: 41662

SEQ ID NO: 321364 - RNA, 64 nt, Homo Sapiens; identical to SEQ ID NO: 41663

SEQ ID NO: 321365 - RNA, 64 nt, Homo Sapiens; identical to SEQ ID NO: 41664

SEQ ID NO: 321366 - RNA, 64 nt, Homo Sapiens; identical to SEQ ID NO: 41665

SEQ ID NO: 321367 - RNA, 64 nt, Homo Sapiens; identical to SEQ ID NO: 41666

SEQ ID NO: 321368 - RNA, 64 nt, Homo Sapiens; identical to SEQ ID NO: 41667

SEQ ID NO: 321369 - RNA, 64 nt, Homo Sapiens; identical to SEQ ID NO: 41668

SEQ ID NO: 321370 - RNA, 64 nt, Homo Sapiens; identical to SEQ ID NO: 41669

SEQ ID NO: 321371 - RNA, 64 nt, Homo Sapiens; identical to SEQ ID NO: 41670

SEQ ID NO: 321372 - RNA, 64 nt, Homo Sapiens; identical to SEQ ID NO: 41671

SEQ ID NO: 321373 - RNA, 64 nt, Homo Sapiens; identical to SEQ ID NO: 41672

SEQ ID NO: 321374 - RNA, 64 nt, Homo Sapiens; identical to SEQ ID NO: 41673

SEQ ID NO: 321375 - RNA, 64 nt, Homo Sapiens; identical to SEQ ID NO: 41674

SEQ ID NO: 321376 - RNA, 64 nt, Homo Sapiens; identical to SEQ ID NO: 41675

SEQ ID NO: 321377 - RNA, 64 nt, Homo Sapiens; identical to SEQ ID NO: 41676

SEQ ID NO: 321378 - RNA, 64 nt, Homo Sapiens; identical to SEQ ID NO: 41677

SEQ ID NO: 321379 - RNA, 64 nt, Homo Sapiens; identical to SEQ ID NO: 41678

SEQ ID NO: 321380 - RNA, 64 nt, Homo Sapiens; identical to SEQ ID NO: 41679

SEQ ID NO: 321381 - RNA, 64 nt, Homo Sapiens; identical to SEQ ID NO: 41680

SEQ ID NO: 321382 - RNA, 64 nt, Homo Sapiens; identical to SEQ ID NO: 41681

SEQ ID NO: 321383 - RNA, 64 nt, Homo Sapiens; identical to SEQ ID NO: 41682

SEQ ID NO: 321384 - RNA, 64 nt, Homo Sapiens; identical to SEQ ID NO: 41683

SEQ ID NO: 321385 - RNA, 64 nt, Homo Sapiens; identical to SEQ ID NO: 41684

SEQ ID NO: 321386 - RNA, 64 nt, Homo Sapiens; identical to SEQ ID NO: 41685

SEQ ID NO: 321387 - RNA, 64 nt, Homo Sapiens; identical to SEQ ID NO: 41686

SEQ ID NO: 321388 - RNA, 64 nt, Homo Sapiens; identical to SEQ ID NO: 41687

SEQ ID NO: 321389 - RNA, 64 nt, Homo Sapiens; identical to SEQ ID NO: 41688

SEQ ID NO: 321390 - RNA, 64 nt, Homo Sapiens; identical to SEQ ID NO: 41689

SEQ ID NO: 321391 - RNA, 64 nt, Homo Sapiens; identical to SEQ ID NO: 41690

SEQ ID NO: 321392 - RNA, 64 nt, Homo Sapiens; identical to SEQ ID NO: 41691

SEQ ID NO: 321393 - RNA, 64 nt, Homo Sapiens; identical to SEQ ID NO: 41692

SEQ ID NO: 321394 - RNA, 64 nt, Homo Sapiens; identical to SEQ ID NO: 41693

SEQ ID NO: 321395 - RNA, 64 nt, Homo Sapiens; identical to SEQ ID NO: 41694

SEQ ID NO: 321396 - RNA, 64 nt, Homo Sapiens; identical to SEQ ID NO: 41695

SEQ ID NO: 321397 - RNA, 64 nt, Homo Sapiens; identical to SEQ ID NO: 41696

SEQ ID NO: 321398 - RNA, 64 nt, Homo Sapiens; identical to SEQ ID NO: 41697

SEQ ID NO: 321399 - RNA, 64 nt, Homo Sapiens; identical to SEQ ID NO: 41698

SEQ ID NO: 321400 - RNA, 64 nt, Homo Sapiens; identical to SEQ ID NO: 41699

SEQ ID NO: 321401 - RNA, 64 nt, Homo Sapiens; identical to SEQ ID NO: 41700

SEQ ID NO: 321402 - RNA, 64 nt, Homo Sapiens; identical to SEQ ID NO: 41701

SEQ ID NO: 321403 - RNA, 64 nt, Homo Sapiens; identical to SEQ ID NO: 41702

SEQ ID NO: 321404 - RNA, 64 nt, Homo Sapiens; identical to SEQ ID NO: 41703

SEQ ID NO: 321405 - RNA, 64 nt, Homo Sapiens; identical to SEQ ID NO: 41704

SEQ ID NO: 321406 - RNA, 64 nt, Homo Sapiens; identical to SEQ ID NO: 41705

SEQ ID NO: 321407 - RNA, 64 nt, Homo Sapiens; identical to SEQ ID NO: 41706

SEQ ID NO: 321408 - RNA, 64 nt, Homo Sapiens; identical to SEQ ID NO: 41707

SEQ ID NO: 321409 - RNA, 64 nt, Homo Sapiens; identical to SEQ ID NO: 41708

SEQ ID NO: 321410 - RNA, 64 nt, Homo Sapiens; identical to SEQ ID NO: 41709

SEQ ID NO: 321411 - RNA, 64 nt, Homo Sapiens; identical to SEQ ID NO: 41710

SEQ ID NO: 321412 - RNA, 64 nt, Homo Sapiens; identical to SEQ ID NO: 41711

SEQ ID NO: 321413 - RNA, 64 nt, Homo Sapiens; identical to SEQ ID NO: 41712

SEQ ID NO: 321414 - RNA, 64 nt, Homo Sapiens; identical to SEQ ID NO: 41713

SEQ ID NO: 321415 - RNA, 64 nt, Homo Sapiens; identical to SEQ ID NO: 41714

SEQ ID NO: 321416 - RNA, 64 nt, Homo Sapiens; identical to SEQ ID NO: 41715

SEQ ID NO: 321417 - RNA, 64 nt, Homo Sapiens; identical to SEQ ID NO: 41716

SEQ ID NO: 321418 - RNA, 64 nt, Homo Sapiens; identical to SEQ ID NO: 41717

SEQ ID NO: 321419 - RNA, 64 nt, Homo Sapiens; identical to SEQ ID NO: 41718

SEQ ID NO: 321420 - RNA, 64 nt, Homo Sapiens; identical to SEQ ID NO: 41719

SEQ ID NO: 321421 - RNA, 64 nt, Homo Sapiens; identical to SEQ ID NO: 41720

SEQ ID NO: 321422 - RNA, 64 nt, Homo Sapiens; identical to SEQ ID NO: 41721

SEQ ID NO: 321423 - RNA, 64 nt, Homo Sapiens; identical to SEQ ID NO: 41722

SEQ ID NO: 321424 - RNA, 64 nt, Homo Sapiens; identical to SEQ ID NO: 41723

SEQ ID NO: 321425 - RNA, 64 nt, Homo Sapiens; identical to SEQ ID NO: 41724

SEQ ID NO: 321426 - RNA, 64 nt, Homo Sapiens; identical to SEQ ID NO: 41725

SEQ ID NO: 321427 - RNA, 64 nt, Homo Sapiens; identical to SEQ ID NO: 41726

SEQ ID NO: 321428 - RNA, 64 nt, Homo Sapiens; identical to SEQ ID NO: 41727

SEQ ID NO: 321429 - RNA, 64 nt, Homo Sapiens; identical to SEQ ID NO: 41728

SEQ ID NO: 321430 - RNA, 64 nt, Homo Sapiens; identical to SEQ ID NO: 41729

SEQ ID NO: 321431 - RNA, 64 nt, Homo Sapiens; identical to SEQ ID NO: 41730

SEQ ID NO: 321432 - RNA, 64 nt, Homo Sapiens; identical to SEQ ID NO: 41731

SEQ ID NO: 321433 - RNA, 64 nt, Homo Sapiens; identical to SEQ ID NO: 41732

SEQ ID NO: 321434 - RNA, 64 nt, Homo Sapiens; identical to SEQ ID NO: 41733

SEQ ID NO: 321435 - RNA, 64 nt, Homo Sapiens; identical to SEQ ID NO: 41734

SEQ ID NO: 321436 - RNA, 64 nt, Homo Sapiens; identical to SEQ ID NO: 41735

SEQ ID NO: 321437 - RNA, 64 nt, Homo Sapiens; identical to SEQ ID NO: 41736

SEQ ID NO: 321438 - RNA, 64 nt, Homo Sapiens; identical to SEQ ID NO: 41737

SEQ ID NO: 321439 - RNA, 64 nt, Homo Sapiens; identical to SEQ ID NO: 41738

SEQ ID NO: 321440 - RNA, 64 nt, Homo Sapiens; identical to SEQ ID NO: 41739

SEQ ID NO: 321441 - RNA, 64 nt, Homo Sapiens; identical to SEQ ID NO: 41740

SEQ ID NO: 321442 - RNA, 64 nt, Homo Sapiens; identical to SEQ ID NO: 41741

SEQ ID NO: 321443 - RNA, 64 nt, Homo Sapiens; identical to SEQ ID NO: 41742

SEQ ID NO: 321444 - RNA, 64 nt, Homo Sapiens; identical to SEQ ID NO: 41743

SEQ ID NO: 321445 - RNA, 64 nt, Homo Sapiens; identical to SEQ ID NO: 41744

SEQ ID NO: 321446 - RNA, 64 nt, Homo Sapiens; identical to SEQ ID NO: 41745

SEQ ID NO: 321447 - RNA, 64 nt, Homo Sapiens; identical to SEQ ID NO: 41746

SEQ ID NO: 321448 - RNA, 64 nt, Homo Sapiens; identical to SEQ ID NO: 41747

SEQ ID NO: 321449 - RNA, 64 nt, Homo Sapiens; identical to SEQ ID NO: 41748

SEQ ID NO: 321450 - RNA, 64 nt, Homo Sapiens; identical to SEQ ID NO: 41749

SEQ ID NO: 321451 - RNA, 64 nt, Homo Sapiens; identical to SEQ ID NO: 41750

SEQ ID NO: 321452 - RNA, 64 nt, Homo Sapiens; identical to SEQ ID NO: 41751

SEQ ID NO: 321453 - RNA, 64 nt, Homo Sapiens; identical to SEQ ID NO: 41752

SEQ ID NO: 321454 - RNA, 64 nt, Homo Sapiens; identical to SEQ ID NO: 41753

SEQ ID NO: 321455 - RNA, 64 nt, Homo Sapiens; identical to SEQ ID NO: 41754

SEQ ID NO: 321456 - RNA, 64 nt, Homo Sapiens; identical to SEQ ID NO: 41755

SEQ ID NO: 321457 - RNA, 64 nt, Homo Sapiens; identical to SEQ ID NO: 41756

SEQ ID NO: 321458 - RNA, 64 nt, Homo Sapiens; identical to SEQ ID NO: 41757

SEQ ID NO: 321459 - RNA, 64 nt, Homo Sapiens; identical to SEQ ID NO: 41758

SEQ ID NO: 321460 - RNA, 64 nt, Homo Sapiens; identical to SEQ ID NO: 41759

SEQ ID NO: 321461 - RNA, 64 nt, Homo Sapiens; identical to SEQ ID NO: 41760

SEQ ID NO: 321462 - RNA, 64 nt, Homo Sapiens; identical to SEQ ID NO: 41761

SEQ ID NO: 321463 - RNA, 64 nt, Homo Sapiens; identical to SEQ ID NO: 41762

SEQ ID NO: 321464 - RNA, 64 nt, Homo Sapiens; identical to SEQ ID NO: 41763

SEQ ID NO: 321465 - RNA, 64 nt, Homo Sapiens; identical to SEQ ID NO: 41764

SEQ ID NO: 321466 - RNA, 64 nt, Homo Sapiens; identical to SEQ ID NO: 41765

SEQ ID NO: 321467 - RNA, 64 nt, Homo Sapiens; identical to SEQ ID NO: 41766

SEQ ID NO: 321468 - RNA, 64 nt, Homo Sapiens; identical to SEQ ID NO: 41767

SEQ ID NO: 321469 - RNA, 64 nt, Homo Sapiens; identical to SEQ ID NO: 41768

SEQ ID NO: 321470 - RNA, 64 nt, Homo Sapiens; identical to SEQ ID NO: 41769

SEQ ID NO: 321471 - RNA, 64 nt, Homo Sapiens; identical to SEQ ID NO: 41770

SEQ ID NO: 321472 - RNA, 64 nt, Homo Sapiens; identical to SEQ ID NO: 41771

SEQ ID NO: 321473 - RNA, 64 nt, Homo Sapiens; identical to SEQ ID NO: 41772

SEQ ID NO: 321474 - RNA, 64 nt, Homo Sapiens; identical to SEQ ID NO: 41773

SEQ ID NO: 321475 - RNA, 64 nt, Homo Sapiens; identical to SEQ ID NO: 41774

SEQ ID NO: 321476 - RNA, 64 nt, Homo Sapiens; identical to SEQ ID NO: 41775

SEQ ID NO: 321477 - RNA, 64 nt, Homo Sapiens; identical to SEQ ID NO: 41776

SEQ ID NO: 321478 - RNA, 64 nt, Homo Sapiens; identical to SEQ ID NO: 41777

SEQ ID NO: 321479 - RNA, 64 nt, Homo Sapiens; identical to SEQ ID NO: 41778

SEQ ID NO: 321480 - RNA, 64 nt, Homo Sapiens; identical to SEQ ID NO: 41779

SEQ ID NO: 321481 - RNA, 64 nt, Homo Sapiens; identical to SEQ ID NO: 41780

SEQ ID NO: 321482 - RNA, 64 nt, Homo Sapiens; identical to SEQ ID NO: 41781

SEQ ID NO: 321483 - RNA, 64 nt, Homo Sapiens; identical to SEQ ID NO: 41782

SEQ ID NO: 321484 - RNA, 64 nt, Homo Sapiens; identical to SEQ ID NO: 41783

SEQ ID NO: 321485 - RNA, 64 nt, Homo Sapiens; identical to SEQ ID NO: 41784

SEQ ID NO: 321486 - RNA, 64 nt, Homo Sapiens; identical to SEQ ID NO: 41785

SEQ ID NO: 321487 - RNA, 64 nt, Homo Sapiens; identical to SEQ ID NO: 41786

SEQ ID NO: 321488 - RNA, 64 nt, Homo Sapiens; identical to SEQ ID NO: 41787

SEQ ID NO: 321489 - RNA, 64 nt, Homo Sapiens; identical to SEQ ID NO: 41788

SEQ ID NO: 321490 - RNA, 64 nt, Homo Sapiens; identical to SEQ ID NO: 41789

SEQ ID NO: 321491 - RNA, 64 nt, Homo Sapiens; identical to SEQ ID NO: 41790

SEQ ID NO: 321492 - RNA, 64 nt, Homo Sapiens; identical to SEQ ID NO: 41791

SEQ ID NO: 321493 - RNA, 64 nt, Homo Sapiens; identical to SEQ ID NO: 41792

SEQ ID NO: 321494 - RNA, 64 nt, Homo Sapiens; identical to SEQ ID NO: 41793

SEQ ID NO: 321495 - RNA, 64 nt, Homo Sapiens; identical to SEQ ID NO: 41794

SEQ ID NO: 321496 - RNA, 64 nt, Homo Sapiens; identical to SEQ ID NO: 41795

SEQ ID NO: 321497 - RNA, 64 nt, Homo Sapiens; identical to SEQ ID NO: 41796

SEQ ID NO: 321498 - RNA, 64 nt, Homo Sapiens; identical to SEQ ID NO: 41797

SEQ ID NO: 321499 - RNA, 64 nt, Homo Sapiens; identical to SEQ ID NO: 41798

SEQ ID NO: 321500 - RNA, 64 nt, Homo Sapiens; identical to SEQ ID NO: 41799

SEQ ID NO: 321501 - RNA, 64 nt, Homo Sapiens; identical to SEQ ID NO: 41800

SEQ ID NO: 321502 - RNA, 64 nt, Homo Sapiens; identical to SEQ ID NO: 41801

SEQ ID NO: 321503 - RNA, 64 nt, Homo Sapiens; identical to SEQ ID NO: 41802

SEQ ID NO: 321504 - RNA, 64 nt, Homo Sapiens; identical to SEQ ID NO: 41803

SEQ ID NO: 321505 - RNA, 64 nt, Homo Sapiens; identical to SEQ ID NO: 41804

SEQ ID NO: 321506 - RNA, 64 nt, Homo Sapiens; identical to SEQ ID NO: 41805

SEQ ID NO: 321507 - RNA, 64 nt, Homo Sapiens; identical to SEQ ID NO: 41806

SEQ ID NO: 321508 - RNA, 64 nt, Homo Sapiens; identical to SEQ ID NO: 41807

SEQ ID NO: 321509 - RNA, 64 nt, Homo Sapiens; identical to SEQ ID NO: 41808

SEQ ID NO: 321510 - RNA, 64 nt, Homo Sapiens; identical to SEQ ID NO: 41809

SEQ ID NO: 321511 - RNA, 64 nt, Homo Sapiens; identical to SEQ ID NO: 41810

SEQ ID NO: 321512 - RNA, 64 nt, Homo Sapiens; identical to SEQ ID NO: 41811

SEQ ID NO: 321513 - RNA, 64 nt, Homo Sapiens; identical to SEQ ID NO: 41812

SEQ ID NO: 321514 - RNA, 64 nt, Homo Sapiens; identical to SEQ ID NO: 41813

SEQ ID NO: 321515 - RNA, 64 nt, Homo Sapiens; identical to SEQ ID NO: 41814

SEQ ID NO: 321516 - RNA, 64 nt, Homo Sapiens; identical to SEQ ID NO: 41815

SEQ ID NO: 321517 - RNA, 64 nt, Homo Sapiens; identical to SEQ ID NO: 41816

SEQ ID NO: 321518 - RNA, 64 nt, Homo Sapiens; identical to SEQ ID NO: 41817

SEQ ID NO: 321519 - RNA, 64 nt, Homo Sapiens; identical to SEQ ID NO: 41818

SEQ ID NO: 321520 - RNA, 64 nt, Homo Sapiens; identical to SEQ ID NO: 41819

SEQ ID NO: 321521 - RNA, 64 nt, Homo Sapiens; identical to SEQ ID NO: 41820

SEQ ID NO: 321522 - RNA, 64 nt, Homo Sapiens; identical to SEQ ID NO: 41821

SEQ ID NO: 321523 - RNA, 64 nt, Homo Sapiens; identical to SEQ ID NO: 41822

SEQ ID NO: 321524 - RNA, 64 nt, Homo Sapiens; identical to SEQ ID NO: 41823

SEQ ID NO: 321525 - RNA, 64 nt, Homo Sapiens; identical to SEQ ID NO: 41824

SEQ ID NO: 321526 - RNA, 64 nt, Homo Sapiens; identical to SEQ ID NO: 41825

SEQ ID NO: 321527 - RNA, 64 nt, Homo Sapiens; identical to SEQ ID NO: 41826

SEQ ID NO: 321528 - RNA, 64 nt, Homo Sapiens; identical to SEQ ID NO: 41827

SEQ ID NO: 321529 - RNA, 64 nt, Homo Sapiens; identical to SEQ ID NO: 41828

SEQ ID NO: 321530 - RNA, 64 nt, Homo Sapiens; identical to SEQ ID NO: 41829

SEQ ID NO: 321531 - RNA, 64 nt, Homo Sapiens; identical to SEQ ID NO: 41830

SEQ ID NO: 321532 - RNA, 64 nt, Homo Sapiens; identical to SEQ ID NO: 41831

SEQ ID NO: 321533 - RNA, 64 nt, Homo Sapiens; identical to SEQ ID NO: 41832

SEQ ID NO: 321534 - RNA, 64 nt, Homo Sapiens; identical to SEQ ID NO: 41833

SEQ ID NO: 321535 - RNA, 64 nt, Homo Sapiens; identical to SEQ ID NO: 41834

SEQ ID NO: 321536 - RNA, 64 nt, Homo Sapiens; identical to SEQ ID NO: 41835

SEQ ID NO: 321537 - RNA, 64 nt, Homo Sapiens; identical to SEQ ID NO: 41836

SEQ ID NO: 321538 - RNA, 64 nt, Homo Sapiens; identical to SEQ ID NO: 41837

SEQ ID NO: 321539 - RNA, 64 nt, Homo Sapiens; identical to SEQ ID NO: 41838

SEQ ID NO: 321540 - RNA, 64 nt, Homo Sapiens; identical to SEQ ID NO: 41839

SEQ ID NO: 321541 - RNA, 64 nt, Homo Sapiens; identical to SEQ ID NO: 41840

SEQ ID NO: 321542 - RNA, 64 nt, Homo Sapiens; identical to SEQ ID NO: 41841

SEQ ID NO: 321543 - RNA, 64 nt, Homo Sapiens; identical to SEQ ID NO: 41842

SEQ ID NO: 321544 - RNA, 64 nt, Homo Sapiens; identical to SEQ ID NO: 41843

SEQ ID NO: 321545 - RNA, 64 nt, Homo Sapiens; identical to SEQ ID NO: 41844

SEQ ID NO: 321546 - RNA, 64 nt, Homo Sapiens; identical to SEQ ID NO: 41845

SEQ ID NO: 321547 - RNA, 64 nt, Homo Sapiens; identical to SEQ ID NO: 41846

SEQ ID NO: 321548 - RNA, 64 nt, Homo Sapiens; identical to SEQ ID NO: 41847

SEQ ID NO: 321549 - RNA, 64 nt, Homo Sapiens; identical to SEQ ID NO: 41848

SEQ ID NO: 321550 - RNA, 64 nt, Homo Sapiens; identical to SEQ ID NO: 41849

SEQ ID NO: 321551 - RNA, 64 nt, Homo Sapiens; identical to SEQ ID NO: 41850

SEQ ID NO: 321552 - RNA, 64 nt, Homo Sapiens; identical to SEQ ID NO: 41851

SEQ ID NO: 321553 - RNA, 64 nt, Homo Sapiens; identical to SEQ ID NO: 41852

SEQ ID NO: 321554 - RNA, 64 nt, Homo Sapiens; identical to SEQ ID NO: 41853

SEQ ID NO: 321555 - RNA, 64 nt, Homo Sapiens; identical to SEQ ID NO: 41854

SEQ ID NO: 321556 - RNA, 64 nt, Homo Sapiens; identical to SEQ ID NO: 41855

SEQ ID NO: 321557 - RNA, 64 nt, Homo Sapiens; identical to SEQ ID NO: 41856

SEQ ID NO: 321558 - RNA, 64 nt, Homo Sapiens; identical to SEQ ID NO: 41857

SEQ ID NO: 321559 - RNA, 64 nt, Homo Sapiens; identical to SEQ ID NO: 41858

SEQ ID NO: 321560 - RNA, 64 nt, Homo Sapiens; identical to SEQ ID NO: 41859

SEQ ID NO: 321561 - RNA, 64 nt, Homo Sapiens; identical to SEQ ID NO: 41860

SEQ ID NO: 321562 - RNA, 64 nt, Homo Sapiens; identical to SEQ ID NO: 41861

SEQ ID NO: 321563 - RNA, 64 nt, Homo Sapiens; identical to SEQ ID NO: 41862

SEQ ID NO: 321564 - RNA, 64 nt, Homo Sapiens; identical to SEQ ID NO: 41863

SEQ ID NO: 321565 - RNA, 64 nt, Homo Sapiens; identical to SEQ ID NO: 41864

SEQ ID NO: 321566 - RNA, 64 nt, Homo Sapiens; identical to SEQ ID NO: 41865

SEQ ID NO: 321567 - RNA, 64 nt, Homo Sapiens; identical to SEQ ID NO: 41866

SEQ ID NO: 321568 - RNA, 64 nt, Homo Sapiens; identical to SEQ ID NO: 41867

SEQ ID NO: 321569 - RNA, 64 nt, Homo Sapiens; identical to SEQ ID NO: 41868

SEQ ID NO: 321570 - RNA, 64 nt, Homo Sapiens; identical to SEQ ID NO: 41869

SEQ ID NO: 321571 - RNA, 64 nt, Homo Sapiens; identical to SEQ ID NO: 41870

SEQ ID NO: 321572 - RNA, 64 nt, Homo Sapiens; identical to SEQ ID NO: 41871

SEQ ID NO: 321573 - RNA, 64 nt, Homo Sapiens; identical to SEQ ID NO: 41872

SEQ ID NO: 321574 - RNA, 64 nt, Homo Sapiens; identical to SEQ ID NO: 41873

SEQ ID NO: 321575 - RNA, 64 nt, Homo Sapiens; identical to SEQ ID NO: 41874

SEQ ID NO: 321576 - RNA, 64 nt, Homo Sapiens; identical to SEQ ID NO: 41875

SEQ ID NO: 321577 - RNA, 64 nt, Homo Sapiens; identical to SEQ ID NO: 41876

SEQ ID NO: 321578 - RNA, 64 nt, Homo Sapiens; identical to SEQ ID NO: 41877

SEQ ID NO: 321579 - RNA, 64 nt, Homo Sapiens; identical to SEQ ID NO: 41878

SEQ ID NO: 321580 - RNA, 64 nt, Homo Sapiens; identical to SEQ ID NO: 41879

SEQ ID NO: 321581 - RNA, 64 nt, Homo Sapiens; identical to SEQ ID NO: 41880

SEQ ID NO: 321582 - RNA, 64 nt, Homo Sapiens; identical to SEQ ID NO: 41881

SEQ ID NO: 321583 - RNA, 64 nt, Homo Sapiens; identical to SEQ ID NO: 41882

SEQ ID NO: 321584 - RNA, 64 nt, Homo Sapiens; identical to SEQ ID NO: 41883

SEQ ID NO: 321585 - RNA, 64 nt, Homo Sapiens; identical to SEQ ID NO: 41884

SEQ ID NO: 321586 - RNA, 64 nt, Homo Sapiens; identical to SEQ ID NO: 41885

SEQ ID NO: 321587 - RNA, 64 nt, Homo Sapiens; identical to SEQ ID NO: 41886

SEQ ID NO: 321588 - RNA, 64 nt, Homo Sapiens; identical to SEQ ID NO: 41887

SEQ ID NO: 321589 - RNA, 64 nt, Homo Sapiens; identical to SEQ ID NO: 41888

SEQ ID NO: 321590 - RNA, 64 nt, Homo Sapiens; identical to SEQ ID NO: 41889

SEQ ID NO: 321591 - RNA, 64 nt, Homo Sapiens; identical to SEQ ID NO: 41890

SEQ ID NO: 321592 - RNA, 64 nt, Homo Sapiens; identical to SEQ ID NO: 41891

SEQ ID NO: 321593 - RNA, 64 nt, Homo Sapiens; identical to SEQ ID NO: 41892

SEQ ID NO: 321594 - RNA, 64 nt, Homo Sapiens; identical to SEQ ID NO: 41893

SEQ ID NO: 321595 - RNA, 64 nt, Homo Sapiens; identical to SEQ ID NO: 41894

SEQ ID NO: 321596 - RNA, 64 nt, Homo Sapiens; identical to SEQ ID NO: 41895

SEQ ID NO: 321597 - RNA, 64 nt, Homo Sapiens; identical to SEQ ID NO: 41896

SEQ ID NO: 321598 - RNA, 64 nt, Homo Sapiens; identical to SEQ ID NO: 41897

SEQ ID NO: 321599 - RNA, 64 nt, Homo Sapiens; identical to SEQ ID NO: 41898

SEQ ID NO: 321600 - RNA, 64 nt, Homo Sapiens; identical to SEQ ID NO: 41899

SEQ ID NO: 321601 - RNA, 64 nt, Homo Sapiens; identical to SEQ ID NO: 41900

SEQ ID NO: 321602 - RNA, 64 nt, Homo Sapiens; identical to SEQ ID NO: 41901

SEQ ID NO: 321603 - RNA, 64 nt, Homo Sapiens; identical to SEQ ID NO: 41902

SEQ ID NO: 321604 - RNA, 64 nt, Homo Sapiens; identical to SEQ ID NO: 41903

SEQ ID NO: 321605 - RNA, 64 nt, Homo Sapiens; identical to SEQ ID NO: 41904

SEQ ID NO: 321606 - RNA, 64 nt, Homo Sapiens; identical to SEQ ID NO: 41905

SEQ ID NO: 321607 - RNA, 64 nt, Homo Sapiens; identical to SEQ ID NO: 41906

SEQ ID NO: 321608 - RNA, 64 nt, Homo Sapiens; identical to SEQ ID NO: 41907

SEQ ID NO: 321609 - RNA, 64 nt, Homo Sapiens; identical to SEQ ID NO: 41908

SEQ ID NO: 321610 - RNA, 64 nt, Homo Sapiens; identical to SEQ ID NO: 41909

SEQ ID NO: 321611 - RNA, 64 nt, Homo Sapiens; identical to SEQ ID NO: 41910

SEQ ID NO: 321612 - RNA, 64 nt, Homo Sapiens; identical to SEQ ID NO: 41911

SEQ ID NO: 321613 - RNA, 64 nt, Homo Sapiens; identical to SEQ ID NO: 41912

SEQ ID NO: 321614 - RNA, 64 nt, Homo Sapiens; identical to SEQ ID NO: 41913

SEQ ID NO: 321615 - RNA, 64 nt, Homo Sapiens; identical to SEQ ID NO: 41914

SEQ ID NO: 321616 - RNA, 64 nt, Homo Sapiens; identical to SEQ ID NO: 41915

SEQ ID NO: 321617 - RNA, 64 nt, Homo Sapiens; identical to SEQ ID NO: 41916

SEQ ID NO: 321618 - RNA, 64 nt, Homo Sapiens; identical to SEQ ID NO: 41917

SEQ ID NO: 321619 - RNA, 64 nt, Homo Sapiens; identical to SEQ ID NO: 41918

SEQ ID NO: 321620 - RNA, 64 nt, Homo Sapiens; identical to SEQ ID NO: 41919

SEQ ID NO: 321621 - RNA, 64 nt, Homo Sapiens; identical to SEQ ID NO: 41920

SEQ ID NO: 321622 - RNA, 64 nt, Homo Sapiens; identical to SEQ ID NO: 41921

SEQ ID NO: 321623 - RNA, 64 nt, Homo Sapiens; identical to SEQ ID NO: 41922

SEQ ID NO: 321624 - RNA, 64 nt, Homo Sapiens; identical to SEQ ID NO: 41923

SEQ ID NO: 321625 - RNA, 64 nt, Homo Sapiens; identical to SEQ ID NO: 41924

SEQ ID NO: 321626 - RNA, 64 nt, Homo Sapiens; identical to SEQ ID NO: 41925

SEQ ID NO: 321627 - RNA, 64 nt, Homo Sapiens; identical to SEQ ID NO: 41926

SEQ ID NO: 321628 - RNA, 64 nt, Homo Sapiens; identical to SEQ ID NO: 41927

SEQ ID NO: 321629 - RNA, 64 nt, Homo Sapiens; identical to SEQ ID NO: 41928

SEQ ID NO: 321630 - RNA, 64 nt, Homo Sapiens; identical to SEQ ID NO: 41929

SEQ ID NO: 321631 - RNA, 64 nt, Homo Sapiens; identical to SEQ ID NO: 41930

SEQ ID NO: 321632 - RNA, 64 nt, Homo Sapiens; identical to SEQ ID NO: 41931

SEQ ID NO: 321633 - RNA, 64 nt, Homo Sapiens; identical to SEQ ID NO: 41932

SEQ ID NO: 321634 - RNA, 64 nt, Homo Sapiens; identical to SEQ ID NO: 41933

SEQ ID NO: 321635 - RNA, 64 nt, Homo Sapiens; identical to SEQ ID NO: 41934

SEQ ID NO: 321636 - RNA, 64 nt, Homo Sapiens; identical to SEQ ID NO: 41935

SEQ ID NO: 321637 - RNA, 64 nt, Homo Sapiens; identical to SEQ ID NO: 41936

SEQ ID NO: 321638 - RNA, 64 nt, Homo Sapiens; identical to SEQ ID NO: 41937

SEQ ID NO: 321639 - RNA, 64 nt, Homo Sapiens; identical to SEQ ID NO: 41938

SEQ ID NO: 321640 - RNA, 64 nt, Homo Sapiens; identical to SEQ ID NO: 41939

SEQ ID NO: 321641 - RNA, 64 nt, Homo Sapiens; identical to SEQ ID NO: 41940

SEQ ID NO: 321642 - RNA, 64 nt, Homo Sapiens; identical to SEQ ID NO: 41941

SEQ ID NO: 321643 - RNA, 64 nt, Homo Sapiens; identical to SEQ ID NO: 41942

SEQ ID NO: 321644 - RNA, 64 nt, Homo Sapiens; identical to SEQ ID NO: 41943

SEQ ID NO: 321645 - RNA, 64 nt, Homo Sapiens; identical to SEQ ID NO: 41944

SEQ ID NO: 321646 - RNA, 64 nt, Homo Sapiens; identical to SEQ ID NO: 41945

SEQ ID NO: 321647 - RNA, 64 nt, Homo Sapiens; identical to SEQ ID NO: 41946

SEQ ID NO: 321648 - RNA, 64 nt, Homo Sapiens; identical to SEQ ID NO: 41947

SEQ ID NO: 321649 - RNA, 64 nt, Homo Sapiens; identical to SEQ ID NO: 41948

SEQ ID NO: 321650 - RNA, 64 nt, Homo Sapiens; identical to SEQ ID NO: 41949

SEQ ID NO: 321651 - RNA, 64 nt, Homo Sapiens; identical to SEQ ID NO: 41950

SEQ ID NO: 321652 - RNA, 64 nt, Homo Sapiens; identical to SEQ ID NO: 41951

SEQ ID NO: 321653 - RNA, 64 nt, Homo Sapiens; identical to SEQ ID NO: 41952

SEQ ID NO: 321654 - RNA, 64 nt, Homo Sapiens; identical to SEQ ID NO: 41953

SEQ ID NO: 321655 - RNA, 64 nt, Homo Sapiens; identical to SEQ ID NO: 41954

SEQ ID NO: 321656 - RNA, 64 nt, Homo Sapiens; identical to SEQ ID NO: 41955

SEQ ID NO: 321657 - RNA, 64 nt, Homo Sapiens; identical to SEQ ID NO: 41956

SEQ ID NO: 321658 - RNA, 64 nt, Homo Sapiens; identical to SEQ ID NO: 41957

SEQ ID NO: 321659 - RNA, 64 nt, Homo Sapiens; identical to SEQ ID NO: 41958

SEQ ID NO: 321660 - RNA, 64 nt, Homo Sapiens; identical to SEQ ID NO: 41959

SEQ ID NO: 321661 - RNA, 64 nt, Homo Sapiens; identical to SEQ ID NO: 41960

SEQ ID NO: 321662 - RNA, 64 nt, Homo Sapiens; identical to SEQ ID NO: 41961

SEQ ID NO: 321663 - RNA, 64 nt, Homo Sapiens; identical to SEQ ID NO: 41962

SEQ ID NO: 321664 - RNA, 64 nt, Homo Sapiens; identical to SEQ ID NO: 41963

SEQ ID NO: 321665 - RNA, 64 nt, Homo Sapiens; identical to SEQ ID NO: 41964

SEQ ID NO: 321666 - RNA, 64 nt, Homo Sapiens; identical to SEQ ID NO: 41965

SEQ ID NO: 321667 - RNA, 64 nt, Homo Sapiens; identical to SEQ ID NO: 41966

SEQ ID NO: 321668 - RNA, 64 nt, Homo Sapiens; identical to SEQ ID NO: 41967

SEQ ID NO: 321669 - RNA, 64 nt, Homo Sapiens; identical to SEQ ID NO: 41968

SEQ ID NO: 321670 - RNA, 64 nt, Homo Sapiens; identical to SEQ ID NO: 41969

SEQ ID NO: 321671 - RNA, 64 nt, Homo Sapiens; identical to SEQ ID NO: 41970

SEQ ID NO: 321672 - RNA, 64 nt, Homo Sapiens; identical to SEQ ID NO: 41971

SEQ ID NO: 321673 - RNA, 64 nt, Homo Sapiens; identical to SEQ ID NO: 41972

SEQ ID NO: 321674 - RNA, 64 nt, Homo Sapiens; identical to SEQ ID NO: 41973

SEQ ID NO: 321675 - RNA, 64 nt, Homo Sapiens; identical to SEQ ID NO: 41974

SEQ ID NO: 321676 - RNA, 64 nt, Homo Sapiens; identical to SEQ ID NO: 41975

SEQ ID NO: 321677 - RNA, 64 nt, Homo Sapiens; identical to SEQ ID NO: 41976

SEQ ID NO: 321678 - RNA, 64 nt, Homo Sapiens; identical to SEQ ID NO: 41977

SEQ ID NO: 321679 - RNA, 64 nt, Homo Sapiens; identical to SEQ ID NO: 41978

SEQ ID NO: 321680 - RNA, 64 nt, Homo Sapiens; identical to SEQ ID NO: 41979

SEQ ID NO: 321681 - RNA, 64 nt, Homo Sapiens; identical to SEQ ID NO: 41980

SEQ ID NO: 321682 - RNA, 64 nt, Homo Sapiens; identical to SEQ ID NO: 41981

SEQ ID NO: 321683 - RNA, 64 nt, Homo Sapiens; identical to SEQ ID NO: 41982

SEQ ID NO: 321684 - RNA, 64 nt, Homo Sapiens; identical to SEQ ID NO: 41983

SEQ ID NO: 321685 - RNA, 64 nt, Homo Sapiens; identical to SEQ ID NO: 41984

SEQ ID NO: 321686 - RNA, 64 nt, Homo Sapiens; identical to SEQ ID NO: 41985

SEQ ID NO: 321687 - RNA, 64 nt, Homo Sapiens; identical to SEQ ID NO: 41986

SEQ ID NO: 321688 - RNA, 64 nt, Homo Sapiens; identical to SEQ ID NO: 41987

SEQ ID NO: 321689 - RNA, 64 nt, Homo Sapiens; identical to SEQ ID NO: 41988

SEQ ID NO: 321690 - RNA, 64 nt, Homo Sapiens; identical to SEQ ID NO: 41989

SEQ ID NO: 321691 - RNA, 64 nt, Homo Sapiens; identical to SEQ ID NO: 41990

SEQ ID NO: 321692 - RNA, 64 nt, Homo Sapiens; identical to SEQ ID NO: 41991

SEQ ID NO: 321693 - RNA, 64 nt, Homo Sapiens; identical to SEQ ID NO: 41992

SEQ ID NO: 321694 - RNA, 64 nt, Homo Sapiens; identical to SEQ ID NO: 41993

SEQ ID NO: 321695 - RNA, 64 nt, Homo Sapiens; identical to SEQ ID NO: 41994

SEQ ID NO: 321696 - RNA, 64 nt, Homo Sapiens; identical to SEQ ID NO: 41995

SEQ ID NO: 321697 - RNA, 64 nt, Homo Sapiens; identical to SEQ ID NO: 41996

SEQ ID NO: 321698 - RNA, 64 nt, Homo Sapiens; identical to SEQ ID NO: 41997

SEQ ID NO: 321699 - RNA, 64 nt, Homo Sapiens; identical to SEQ ID NO: 41998

SEQ ID NO: 321700 - RNA, 64 nt, Homo Sapiens; identical to SEQ ID NO: 41999

SEQ ID NO: 321701 - RNA, 64 nt, Homo Sapiens; identical to SEQ ID NO: 42000

SEQ ID NO: 321702 - RNA, 64 nt, Homo Sapiens; identical to SEQ ID NO: 42001

SEQ ID NO: 321703 - RNA, 64 nt, Homo Sapiens; identical to SEQ ID NO: 42002

SEQ ID NO: 321704 - RNA, 64 nt, Homo Sapiens; identical to SEQ ID NO: 42003

SEQ ID NO: 321705 - RNA, 64 nt, Homo Sapiens; identical to SEQ ID NO: 42004

SEQ ID NO: 321706 - RNA, 64 nt, Homo Sapiens; identical to SEQ ID NO: 42005

SEQ ID NO: 321707 - RNA, 64 nt, Homo Sapiens; identical to SEQ ID NO: 42006

SEQ ID NO: 321708 - RNA, 64 nt, Homo Sapiens; identical to SEQ ID NO: 42007

SEQ ID NO: 321709 - RNA, 64 nt, Homo Sapiens; identical to SEQ ID NO: 42008

SEQ ID NO: 321710 - RNA, 64 nt, Homo Sapiens; identical to SEQ ID NO: 42009

SEQ ID NO: 321711 - RNA, 64 nt, Homo Sapiens; identical to SEQ ID NO: 42010

SEQ ID NO: 321712 - RNA, 64 nt, Homo Sapiens; identical to SEQ ID NO: 42011

SEQ ID NO: 321713 - RNA, 64 nt, Homo Sapiens; identical to SEQ ID NO: 42012

SEQ ID NO: 321714 - RNA, 64 nt, Homo Sapiens; identical to SEQ ID NO: 42013

SEQ ID NO: 321715 - RNA, 64 nt, Homo Sapiens; identical to SEQ ID NO: 42014

SEQ ID NO: 321716 - RNA, 64 nt, Homo Sapiens; identical to SEQ ID NO: 42015

SEQ ID NO: 321717 - RNA, 64 nt, Homo Sapiens; identical to SEQ ID NO: 42016

SEQ ID NO: 321718 - RNA, 64 nt, Homo Sapiens; identical to SEQ ID NO: 42017

SEQ ID NO: 321719 - RNA, 64 nt, Homo Sapiens; identical to SEQ ID NO: 42018

SEQ ID NO: 321720 - RNA, 64 nt, Homo Sapiens; identical to SEQ ID NO: 42019

SEQ ID NO: 321721 - RNA, 64 nt, Homo Sapiens; identical to SEQ ID NO: 42020

SEQ ID NO: 321722 - RNA, 64 nt, Homo Sapiens; identical to SEQ ID NO: 42021

SEQ ID NO: 321723 - RNA, 64 nt, Homo Sapiens; identical to SEQ ID NO: 42022

SEQ ID NO: 321724 - RNA, 64 nt, Homo Sapiens; identical to SEQ ID NO: 42023

SEQ ID NO: 321725 - RNA, 64 nt, Homo Sapiens; identical to SEQ ID NO: 42024

SEQ ID NO: 321726 - RNA, 64 nt, Homo Sapiens; identical to SEQ ID NO: 42025

SEQ ID NO: 321727 - RNA, 64 nt, Homo Sapiens; identical to SEQ ID NO: 42026

SEQ ID NO: 321728 - RNA, 64 nt, Homo Sapiens; identical to SEQ ID NO: 42027

SEQ ID NO: 321729 - RNA, 64 nt, Homo Sapiens; identical to SEQ ID NO: 42028

SEQ ID NO: 321730 - RNA, 64 nt, Homo Sapiens; identical to SEQ ID NO: 42029

SEQ ID NO: 321731 - RNA, 64 nt, Homo Sapiens; identical to SEQ ID NO: 42030

SEQ ID NO: 321732 - RNA, 64 nt, Homo Sapiens; identical to SEQ ID NO: 42031

SEQ ID NO: 321733 - RNA, 64 nt, Homo Sapiens; identical to SEQ ID NO: 42032

SEQ ID NO: 321734 - RNA, 64 nt, Homo Sapiens; identical to SEQ ID NO: 42033

SEQ ID NO: 321735 - RNA, 64 nt, Homo Sapiens; identical to SEQ ID NO: 42034

SEQ ID NO: 321736 - RNA, 64 nt, Homo Sapiens; identical to SEQ ID NO: 42035

SEQ ID NO: 321737 - RNA, 64 nt, Homo Sapiens; identical to SEQ ID NO: 42036

SEQ ID NO: 321738 - RNA, 64 nt, Homo Sapiens; identical to SEQ ID NO: 42037

SEQ ID NO: 321739 - RNA, 64 nt, Homo Sapiens; identical to SEQ ID NO: 42038

SEQ ID NO: 321740 - RNA, 64 nt, Homo Sapiens; identical to SEQ ID NO: 42039

SEQ ID NO: 321741 - RNA, 64 nt, Homo Sapiens; identical to SEQ ID NO: 42040

SEQ ID NO: 321742 - RNA, 64 nt, Homo Sapiens; identical to SEQ ID NO: 42041

SEQ ID NO: 321743 - RNA, 64 nt, Homo Sapiens; identical to SEQ ID NO: 42042

SEQ ID NO: 321744 - RNA, 64 nt, Homo Sapiens; identical to SEQ ID NO: 42043

SEQ ID NO: 321745 - RNA, 64 nt, Homo Sapiens; identical to SEQ ID NO: 42044

SEQ ID NO: 321746 - RNA, 64 nt, Homo Sapiens; identical to SEQ ID NO: 42045

SEQ ID NO: 321747 - RNA, 64 nt, Homo Sapiens; identical to SEQ ID NO: 42046

SEQ ID NO: 321748 - RNA, 64 nt, Homo Sapiens; identical to SEQ ID NO: 42047

SEQ ID NO: 321749 - RNA, 64 nt, Homo Sapiens; identical to SEQ ID NO: 42048

SEQ ID NO: 321750 - RNA, 64 nt, Homo Sapiens; identical to SEQ ID NO: 42049

SEQ ID NO: 321751 - RNA, 64 nt, Homo Sapiens; identical to SEQ ID NO: 42050

SEQ ID NO: 321752 - RNA, 64 nt, Homo Sapiens; identical to SEQ ID NO: 42051

SEQ ID NO: 321753 - RNA, 64 nt, Homo Sapiens; identical to SEQ ID NO: 42052

SEQ ID NO: 321754 - RNA, 64 nt, Homo Sapiens; identical to SEQ ID NO: 42053

SEQ ID NO: 321755 - RNA, 64 nt, Homo Sapiens; identical to SEQ ID NO: 42054

SEQ ID NO: 321756 - RNA, 64 nt, Homo Sapiens; identical to SEQ ID NO: 42055

SEQ ID NO: 321757 - RNA, 64 nt, Homo Sapiens; identical to SEQ ID NO: 42056

SEQ ID NO: 321758 - RNA, 64 nt, Homo Sapiens; identical to SEQ ID NO: 42057

SEQ ID NO: 321759 - RNA, 64 nt, Homo Sapiens; identical to SEQ ID NO: 42058

SEQ ID NO: 321760 - RNA, 64 nt, Homo Sapiens; identical to SEQ ID NO: 42059

SEQ ID NO: 321761 - RNA, 64 nt, Homo Sapiens; identical to SEQ ID NO: 42060

SEQ ID NO: 321762 - RNA, 64 nt, Homo Sapiens; identical to SEQ ID NO: 42061

SEQ ID NO: 321763 - RNA, 64 nt, Homo Sapiens; identical to SEQ ID NO: 42062

SEQ ID NO: 321764 - RNA, 64 nt, Homo Sapiens; identical to SEQ ID NO: 42063

SEQ ID NO: 321765 - RNA, 64 nt, Homo Sapiens; identical to SEQ ID NO: 42064

SEQ ID NO: 321766 - RNA, 64 nt, Homo Sapiens; identical to SEQ ID NO: 42065

SEQ ID NO: 321767 - RNA, 64 nt, Homo Sapiens; identical to SEQ ID NO: 42066

SEQ ID NO: 321768 - RNA, 64 nt, Homo Sapiens; identical to SEQ ID NO: 42067

SEQ ID NO: 321769 - RNA, 64 nt, Homo Sapiens; identical to SEQ ID NO: 42068

SEQ ID NO: 321770 - RNA, 64 nt, Homo Sapiens; identical to SEQ ID NO: 42069

SEQ ID NO: 321771 - RNA, 64 nt, Homo Sapiens; identical to SEQ ID NO: 42070

SEQ ID NO: 321772 - RNA, 64 nt, Homo Sapiens; identical to SEQ ID NO: 42071

SEQ ID NO: 321773 - RNA, 64 nt, Homo Sapiens; identical to SEQ ID NO: 42072

SEQ ID NO: 321774 - RNA, 64 nt, Homo Sapiens; identical to SEQ ID NO: 42073

SEQ ID NO: 321775 - RNA, 64 nt, Homo Sapiens; identical to SEQ ID NO: 42074

SEQ ID NO: 321776 - RNA, 64 nt, Homo Sapiens; identical to SEQ ID NO: 42075

SEQ ID NO: 321777 - RNA, 64 nt, Homo Sapiens; identical to SEQ ID NO: 42076

SEQ ID NO: 321778 - RNA, 64 nt, Homo Sapiens; identical to SEQ ID NO: 42077

SEQ ID NO: 321779 - RNA, 64 nt, Homo Sapiens; identical to SEQ ID NO: 42078

SEQ ID NO: 321780 - RNA, 64 nt, Homo Sapiens; identical to SEQ ID NO: 42079

SEQ ID NO: 321781 - RNA, 64 nt, Homo Sapiens; identical to SEQ ID NO: 42080

SEQ ID NO: 321782 - RNA, 64 nt, Homo Sapiens; identical to SEQ ID NO: 42081

SEQ ID NO: 321783 - RNA, 64 nt, Homo Sapiens; identical to SEQ ID NO: 42082

SEQ ID NO: 321784 - RNA, 64 nt, Homo Sapiens; identical to SEQ ID NO: 42083

SEQ ID NO: 321785 - RNA, 64 nt, Homo Sapiens; identical to SEQ ID NO: 42084

SEQ ID NO: 321786 - RNA, 64 nt, Homo Sapiens; identical to SEQ ID NO: 42085

SEQ ID NO: 321787 - RNA, 64 nt, Homo Sapiens; identical to SEQ ID NO: 42086

SEQ ID NO: 321788 - RNA, 64 nt, Homo Sapiens; identical to SEQ ID NO: 42087

SEQ ID NO: 321789 - RNA, 64 nt, Homo Sapiens; identical to SEQ ID NO: 42088

SEQ ID NO: 321790 - RNA, 64 nt, Homo Sapiens; identical to SEQ ID NO: 42089

SEQ ID NO: 321791 - RNA, 64 nt, Homo Sapiens; identical to SEQ ID NO: 42090

SEQ ID NO: 321792 - RNA, 64 nt, Homo Sapiens; identical to SEQ ID NO: 42091

SEQ ID NO: 321793 - RNA, 64 nt, Homo Sapiens; identical to SEQ ID NO: 42092

SEQ ID NO: 321794 - RNA, 64 nt, Homo Sapiens; identical to SEQ ID NO: 42093

SEQ ID NO: 321795 - RNA, 64 nt, Homo Sapiens; identical to SEQ ID NO: 42094

SEQ ID NO: 321796 - RNA, 64 nt, Homo Sapiens; identical to SEQ ID NO: 42095

SEQ ID NO: 321797 - RNA, 64 nt, Homo Sapiens; identical to SEQ ID NO: 42096

SEQ ID NO: 321798 - RNA, 64 nt, Homo Sapiens; identical to SEQ ID NO: 42097

SEQ ID NO: 321799 - RNA, 64 nt, Homo Sapiens; identical to SEQ ID NO: 42098

SEQ ID NO: 321800 - RNA, 64 nt, Homo Sapiens; identical to SEQ ID NO: 42099

SEQ ID NO: 321801 - RNA, 64 nt, Homo Sapiens; identical to SEQ ID NO: 42100

SEQ ID NO: 321802 - RNA, 64 nt, Homo Sapiens; identical to SEQ ID NO: 42101

SEQ ID NO: 321803 - RNA, 64 nt, Homo Sapiens; identical to SEQ ID NO: 42102

SEQ ID NO: 321804 - RNA, 64 nt, Homo Sapiens; identical to SEQ ID NO: 42103

SEQ ID NO: 321805 - RNA, 64 nt, Homo Sapiens; identical to SEQ ID NO: 42104

SEQ ID NO: 321806 - RNA, 64 nt, Homo Sapiens; identical to SEQ ID NO: 42105

SEQ ID NO: 321807 - RNA, 64 nt, Homo Sapiens; identical to SEQ ID NO: 42106

SEQ ID NO: 321808 - RNA, 64 nt, Homo Sapiens; identical to SEQ ID NO: 42107

SEQ ID NO: 321809 - RNA, 64 nt, Homo Sapiens; identical to SEQ ID NO: 42108

SEQ ID NO: 321810 - RNA, 64 nt, Homo Sapiens; identical to SEQ ID NO: 42109

SEQ ID NO: 321811 - RNA, 64 nt, Homo Sapiens; identical to SEQ ID NO: 42110

SEQ ID NO: 321812 - RNA, 64 nt, Homo Sapiens; identical to SEQ ID NO: 42111

SEQ ID NO: 321813 - RNA, 64 nt, Homo Sapiens; identical to SEQ ID NO: 42112

SEQ ID NO: 321814 - RNA, 64 nt, Homo Sapiens; identical to SEQ ID NO: 42113

SEQ ID NO: 321815 - RNA, 64 nt, Homo Sapiens; identical to SEQ ID NO: 42114

SEQ ID NO: 321816 - RNA, 64 nt, Homo Sapiens; identical to SEQ ID NO: 42115

SEQ ID NO: 321817 - RNA, 64 nt, Homo Sapiens; identical to SEQ ID NO: 42116

SEQ ID NO: 321818 - RNA, 64 nt, Homo Sapiens; identical to SEQ ID NO: 42117

SEQ ID NO: 321819 - RNA, 64 nt, Homo Sapiens; identical to SEQ ID NO: 42118

SEQ ID NO: 321820 - RNA, 64 nt, Homo Sapiens; identical to SEQ ID NO: 42119

SEQ ID NO: 321821 - RNA, 64 nt, Homo Sapiens; identical to SEQ ID NO: 42120

SEQ ID NO: 321822 - RNA, 64 nt, Homo Sapiens; identical to SEQ ID NO: 42121

SEQ ID NO: 321823 - RNA, 64 nt, Homo Sapiens; identical to SEQ ID NO: 42122

SEQ ID NO: 321824 - RNA, 64 nt, Homo Sapiens; identical to SEQ ID NO: 42123

SEQ ID NO: 321825 - RNA, 64 nt, Homo Sapiens; identical to SEQ ID NO: 42124

SEQ ID NO: 321826 - RNA, 64 nt, Homo Sapiens; identical to SEQ ID NO: 42125

SEQ ID NO: 321827 - RNA, 64 nt, Homo Sapiens; identical to SEQ ID NO: 42126

SEQ ID NO: 321828 - RNA, 64 nt, Homo Sapiens; identical to SEQ ID NO: 42127

SEQ ID NO: 321829 - RNA, 64 nt, Homo Sapiens; identical to SEQ ID NO: 42128

SEQ ID NO: 321830 - RNA, 64 nt, Homo Sapiens; identical to SEQ ID NO: 42129

SEQ ID NO: 321831 - RNA, 64 nt, Homo Sapiens; identical to SEQ ID NO: 42130

SEQ ID NO: 321832 - RNA, 64 nt, Homo Sapiens; identical to SEQ ID NO: 42131

SEQ ID NO: 321833 - RNA, 64 nt, Homo Sapiens; identical to SEQ ID NO: 42132

SEQ ID NO: 321834 - RNA, 64 nt, Homo Sapiens; identical to SEQ ID NO: 42133

SEQ ID NO: 321835 - RNA, 64 nt, Homo Sapiens; identical to SEQ ID NO: 42134

SEQ ID NO: 321836 - RNA, 64 nt, Homo Sapiens; identical to SEQ ID NO: 42135

SEQ ID NO: 321837 - RNA, 64 nt, Homo Sapiens; identical to SEQ ID NO: 42136

SEQ ID NO: 321838 - RNA, 64 nt, Homo Sapiens; identical to SEQ ID NO: 42137

SEQ ID NO: 321839 - RNA, 64 nt, Homo Sapiens; identical to SEQ ID NO: 42138

SEQ ID NO: 321840 - RNA, 64 nt, Homo Sapiens; identical to SEQ ID NO: 42139

SEQ ID NO: 321841 - RNA, 64 nt, Homo Sapiens; identical to SEQ ID NO: 42140

SEQ ID NO: 321842 - RNA, 64 nt, Homo Sapiens; identical to SEQ ID NO: 42141

SEQ ID NO: 321843 - RNA, 64 nt, Homo Sapiens; identical to SEQ ID NO: 42142

SEQ ID NO: 321844 - RNA, 64 nt, Homo Sapiens; identical to SEQ ID NO: 42143

SEQ ID NO: 321845 - RNA, 64 nt, Homo Sapiens; identical to SEQ ID NO: 42144

SEQ ID NO: 321846 - RNA, 64 nt, Homo Sapiens; identical to SEQ ID NO: 42145

SEQ ID NO: 321847 - RNA, 64 nt, Homo Sapiens; identical to SEQ ID NO: 42146

SEQ ID NO: 321848 - RNA, 64 nt, Homo Sapiens; identical to SEQ ID NO: 42147

SEQ ID NO: 321849 - RNA, 64 nt, Homo Sapiens; identical to SEQ ID NO: 42148

SEQ ID NO: 321850 - RNA, 64 nt, Homo Sapiens; identical to SEQ ID NO: 42149

SEQ ID NO: 321851 - RNA, 64 nt, Homo Sapiens; identical to SEQ ID NO: 42150

SEQ ID NO: 321852 - RNA, 64 nt, Homo Sapiens; identical to SEQ ID NO: 42151

SEQ ID NO: 321853 - RNA, 64 nt, Homo Sapiens; identical to SEQ ID NO: 42152

SEQ ID NO: 321854 - RNA, 64 nt, Homo Sapiens; identical to SEQ ID NO: 42153

SEQ ID NO: 321855 - RNA, 64 nt, Homo Sapiens; identical to SEQ ID NO: 42154

SEQ ID NO: 321856 - RNA, 64 nt, Homo Sapiens; identical to SEQ ID NO: 42155

SEQ ID NO: 321857 - RNA, 64 nt, Homo Sapiens; identical to SEQ ID NO: 42156

SEQ ID NO: 321858 - RNA, 64 nt, Homo Sapiens; identical to SEQ ID NO: 42157

SEQ ID NO: 321859 - RNA, 64 nt, Homo Sapiens; identical to SEQ ID NO: 42158

SEQ ID NO: 321860 - RNA, 64 nt, Homo Sapiens; identical to SEQ ID NO: 42159

SEQ ID NO: 321861 - RNA, 64 nt, Homo Sapiens; identical to SEQ ID NO: 42160

SEQ ID NO: 321862 - RNA, 64 nt, Homo Sapiens; identical to SEQ ID NO: 42161

SEQ ID NO: 321863 - RNA, 64 nt, Homo Sapiens; identical to SEQ ID NO: 42162

SEQ ID NO: 321864 - RNA, 64 nt, Homo Sapiens; identical to SEQ ID NO: 42163

SEQ ID NO: 321865 - RNA, 64 nt, Homo Sapiens; identical to SEQ ID NO: 42164

SEQ ID NO: 321866 - RNA, 64 nt, Homo Sapiens; identical to SEQ ID NO: 42165

SEQ ID NO: 321867 - RNA, 64 nt, Homo Sapiens; identical to SEQ ID NO: 42166

SEQ ID NO: 321868 - RNA, 64 nt, Homo Sapiens; identical to SEQ ID NO: 42167

SEQ ID NO: 321869 - RNA, 64 nt, Homo Sapiens; identical to SEQ ID NO: 42168

SEQ ID NO: 321870 - RNA, 64 nt, Homo Sapiens; identical to SEQ ID NO: 42169

SEQ ID NO: 321871 - RNA, 64 nt, Homo Sapiens; identical to SEQ ID NO: 42170

SEQ ID NO: 321872 - RNA, 64 nt, Homo Sapiens; identical to SEQ ID NO: 42171

SEQ ID NO: 321873 - RNA, 64 nt, Homo Sapiens; identical to SEQ ID NO: 42172

SEQ ID NO: 321874 - RNA, 64 nt, Homo Sapiens; identical to SEQ ID NO: 42173

SEQ ID NO: 321875 - RNA, 64 nt, Homo Sapiens; identical to SEQ ID NO: 42174

SEQ ID NO: 321876 - RNA, 64 nt, Homo Sapiens; identical to SEQ ID NO: 42175

SEQ ID NO: 321877 - RNA, 64 nt, Homo Sapiens; identical to SEQ ID NO: 42176

SEQ ID NO: 321878 - RNA, 64 nt, Homo Sapiens; identical to SEQ ID NO: 42177

SEQ ID NO: 321879 - RNA, 64 nt, Homo Sapiens; identical to SEQ ID NO: 42178

SEQ ID NO: 321880 - RNA, 64 nt, Homo Sapiens; identical to SEQ ID NO: 42179

SEQ ID NO: 321881 - RNA, 64 nt, Homo Sapiens; identical to SEQ ID NO: 42180

SEQ ID NO: 321882 - RNA, 64 nt, Homo Sapiens; identical to SEQ ID NO: 42181

SEQ ID NO: 321883 - RNA, 64 nt, Homo Sapiens; identical to SEQ ID NO: 42182

SEQ ID NO: 321884 - RNA, 64 nt, Homo Sapiens; identical to SEQ ID NO: 42183

SEQ ID NO: 321885 - RNA, 64 nt, Homo Sapiens; identical to SEQ ID NO: 42184

SEQ ID NO: 321886 - RNA, 64 nt, Homo Sapiens; identical to SEQ ID NO: 42185

SEQ ID NO: 321887 - RNA, 64 nt, Homo Sapiens; identical to SEQ ID NO: 42186

SEQ ID NO: 321888 - RNA, 64 nt, Homo Sapiens; identical to SEQ ID NO: 42187

SEQ ID NO: 321889 - RNA, 64 nt, Homo Sapiens; identical to SEQ ID NO: 42188

SEQ ID NO: 321890 - RNA, 64 nt, Homo Sapiens; identical to SEQ ID NO: 42189

SEQ ID NO: 321891 - RNA, 64 nt, Homo Sapiens; identical to SEQ ID NO: 42190

SEQ ID NO: 321892 - RNA, 64 nt, Homo Sapiens; identical to SEQ ID NO: 42191

SEQ ID NO: 321893 - RNA, 64 nt, Homo Sapiens; identical to SEQ ID NO: 42192

SEQ ID NO: 321894 - RNA, 64 nt, Homo Sapiens; identical to SEQ ID NO: 42193

SEQ ID NO: 321895 - RNA, 64 nt, Homo Sapiens; identical to SEQ ID NO: 42194

SEQ ID NO: 321896 - RNA, 64 nt, Homo Sapiens; identical to SEQ ID NO: 42195

SEQ ID NO: 321897 - RNA, 64 nt, Homo Sapiens; identical to SEQ ID NO: 42196

SEQ ID NO: 321898 - RNA, 64 nt, Homo Sapiens; identical to SEQ ID NO: 42197

SEQ ID NO: 321899 - RNA, 64 nt, Homo Sapiens; identical to SEQ ID NO: 42198

SEQ ID NO: 321900 - RNA, 64 nt, Homo Sapiens; identical to SEQ ID NO: 42199

SEQ ID NO: 321901 - RNA, 64 nt, Homo Sapiens; identical to SEQ ID NO: 42200

SEQ ID NO: 321902 - RNA, 64 nt, Homo Sapiens; identical to SEQ ID NO: 42201

SEQ ID NO: 321903 - RNA, 64 nt, Homo Sapiens; identical to SEQ ID NO: 42202

SEQ ID NO: 321904 - RNA, 64 nt, Homo Sapiens; identical to SEQ ID NO: 42203

SEQ ID NO: 321905 - RNA, 64 nt, Homo Sapiens; identical to SEQ ID NO: 42204

SEQ ID NO: 321906 - RNA, 64 nt, Homo Sapiens; identical to SEQ ID NO: 42205

SEQ ID NO: 321907 - RNA, 64 nt, Homo Sapiens; identical to SEQ ID NO: 42206

SEQ ID NO: 321908 - RNA, 64 nt, Homo Sapiens; identical to SEQ ID NO: 42207

SEQ ID NO: 321909 - RNA, 64 nt, Homo Sapiens; identical to SEQ ID NO: 42208

SEQ ID NO: 321910 - RNA, 64 nt, Homo Sapiens; identical to SEQ ID NO: 42209

SEQ ID NO: 321911 - RNA, 64 nt, Homo Sapiens; identical to SEQ ID NO: 42210

SEQ ID NO: 321912 - RNA, 64 nt, Homo Sapiens; identical to SEQ ID NO: 42211

SEQ ID NO: 321913 - RNA, 64 nt, Homo Sapiens; identical to SEQ ID NO: 42212

SEQ ID NO: 321914 - RNA, 64 nt, Homo Sapiens; identical to SEQ ID NO: 42213

SEQ ID NO: 321915 - RNA, 64 nt, Homo Sapiens; identical to SEQ ID NO: 42214

SEQ ID NO: 321916 - RNA, 64 nt, Homo Sapiens; identical to SEQ ID NO: 42215

SEQ ID NO: 321917 - RNA, 64 nt, Homo Sapiens; identical to SEQ ID NO: 42216

SEQ ID NO: 321918 - RNA, 64 nt, Homo Sapiens; identical to SEQ ID NO: 42217

SEQ ID NO: 321919 - RNA, 64 nt, Homo Sapiens; identical to SEQ ID NO: 42218

SEQ ID NO: 321920 - RNA, 64 nt, Homo Sapiens; identical to SEQ ID NO: 42219

SEQ ID NO: 321921 - RNA, 64 nt, Homo Sapiens; identical to SEQ ID NO: 42220

SEQ ID NO: 321922 - RNA, 64 nt, Homo Sapiens; identical to SEQ ID NO: 42221

SEQ ID NO: 321923 - RNA, 64 nt, Homo Sapiens; identical to SEQ ID NO: 42222

SEQ ID NO: 321924 - RNA, 64 nt, Homo Sapiens; identical to SEQ ID NO: 42223

SEQ ID NO: 321925 - RNA, 64 nt, Homo Sapiens; identical to SEQ ID NO: 42224

SEQ ID NO: 321926 - RNA, 64 nt, Homo Sapiens; identical to SEQ ID NO: 42225

SEQ ID NO: 321927 - RNA, 64 nt, Homo Sapiens; identical to SEQ ID NO: 42226

SEQ ID NO: 321928 - RNA, 64 nt, Homo Sapiens; identical to SEQ ID NO: 42227

SEQ ID NO: 321929 - RNA, 64 nt, Homo Sapiens; identical to SEQ ID NO: 42228

SEQ ID NO: 321930 - RNA, 64 nt, Homo Sapiens; identical to SEQ ID NO: 42229

SEQ ID NO: 321931 - RNA, 64 nt, Homo Sapiens; identical to SEQ ID NO: 42230

SEQ ID NO: 321932 - RNA, 64 nt, Homo Sapiens; identical to SEQ ID NO: 42231

SEQ ID NO: 321933 - RNA, 64 nt, Homo Sapiens; identical to SEQ ID NO: 42232

SEQ ID NO: 321934 - RNA, 64 nt, Homo Sapiens; identical to SEQ ID NO: 42233

SEQ ID NO: 321935 - RNA, 64 nt, Homo Sapiens; identical to SEQ ID NO: 42234

SEQ ID NO: 321936 - RNA, 64 nt, Homo Sapiens; identical to SEQ ID NO: 42235

SEQ ID NO: 321937 - RNA, 64 nt, Homo Sapiens
agccacagcaccaggaagggcucaucccaugucagcucccuaggucucaagucagcucccuaga

SEQ ID NO: 321938 - RNA, 64 nt, Homo Sapiens
cucaucccaugucagcuccccccaucucaagucagcucccuagaggccacuaggggaugaagga

SEQ ID NO: 321939 - RNA, 64 nt, Homo Sapiens
ggcugaucagagaggagucuuagauaauaaaauugcucccuauuuuaacccaggcaugcaaugc

SEQ ID NO: 321940 - RNA, 64 nt, Homo Sapiens
ugacugccacagaacugggcuaacauuuacuuuugcucccuaccacuuuugugaacaaaaauua

SEQ ID NO: 321941 - RNA, 64 nt, Homo Sapiens; identical to SEQ ID NO: 266801

SEQ ID NO: 321942 - RNA, 64 nt, Homo Sapiens; identical to SEQ ID NO: 266802

SEQ ID NO: 321943 - RNA, 64 nt, Homo Sapiens; identical to SEQ ID NO: 266803

SEQ ID NO: 321944 - RNA, 64 nt, Homo Sapiens; identical to SEQ ID NO: 266804

SEQ ID NO: 321945 - RNA, 64 nt, Homo Sapiens; identical to SEQ ID NO: 266805

SEQ ID NO: 321946 - RNA, 64 nt, Homo Sapiens; identical to SEQ ID NO: 266806

SEQ ID NO: 321947 - RNA, 64 nt, Homo Sapiens; identical to SEQ ID NO: 116628

SEQ ID NO: 321948 - RNA, 64 nt, Homo Sapiens; identical to SEQ ID NO: 116629

SEQ ID NO: 321949 - RNA, 64 nt, Homo Sapiens; identical to SEQ ID NO: 116630

SEQ ID NO: 321950 - RNA, 64 nt, Homo Sapiens; identical to SEQ ID NO: 116631

SEQ ID NO: 321951 - RNA, 64 nt, Homo Sapiens; identical to SEQ ID NO: 116632

SEQ ID NO: 321952 - RNA, 64 nt, Homo Sapiens; identical to SEQ ID NO: 116633

SEQ ID NO: 321953 - RNA, 64 nt, Homo Sapiens; identical to SEQ ID NO: 55975

SEQ ID NO: 321954 - RNA, 64 nt, Homo Sapiens; identical to SEQ ID NO: 55976

SEQ ID NO: 321955 - RNA, 64 nt, Homo Sapiens; identical to SEQ ID NO: 55977

SEQ ID NO: 321956 - RNA, 64 nt, Homo Sapiens; identical to SEQ ID NO: 55978

SEQ ID NO: 321957 - RNA, 64 nt, Homo Sapiens; identical to SEQ ID NO: 55979

SEQ ID NO: 321958 - RNA, 64 nt, Homo Sapiens; identical to SEQ ID NO: 55980

SEQ ID NO: 321959 - RNA, 64 nt, Homo Sapiens; identical to SEQ ID NO: 55981

SEQ ID NO: 321960 - RNA, 64 nt, Homo Sapiens; identical to SEQ ID NO: 55982

SEQ ID NO: 321961 - RNA, 64 nt, Homo Sapiens; identical to SEQ ID NO: 55983

SEQ ID NO: 321962 - RNA, 64 nt, Homo Sapiens; identical to SEQ ID NO: 55984

SEQ ID NO: 321963 - RNA, 64 nt, Homo Sapiens; identical to SEQ ID NO: 55985

SEQ ID NO: 321964 - RNA, 64 nt, Homo Sapiens; identical to SEQ ID NO: 55986

SEQ ID NO: 321965 - RNA, 64 nt, Homo Sapiens; identical to SEQ ID NO: 55987

SEQ ID NO: 321966 - RNA, 64 nt, Homo Sapiens; identical to SEQ ID NO: 55988

SEQ ID NO: 321967 - RNA, 64 nt, Homo Sapiens; identical to SEQ ID NO: 55989

SEQ ID NO: 321968 - RNA, 64 nt, Homo Sapiens; identical to SEQ ID NO: 55990

SEQ ID NO: 321969 - RNA, 64 nt, Homo Sapiens; identical to SEQ ID NO: 55991

SEQ ID NO: 321970 - RNA, 64 nt, Homo Sapiens; identical to SEQ ID NO: 55992

SEQ ID NO: 321971 - RNA, 64 nt, Homo Sapiens; identical to SEQ ID NO: 55993

SEQ ID NO: 321972 - RNA, 64 nt, Homo Sapiens; identical to SEQ ID NO: 55994

SEQ ID NO: 321973 - RNA, 64 nt, Homo Sapiens; identical to SEQ ID NO: 55995

SEQ ID NO: 321974 - RNA, 64 nt, Homo Sapiens; identical to SEQ ID NO: 55996

SEQ ID NO: 321975 - RNA, 64 nt, Homo Sapiens; identical to SEQ ID NO: 55997

SEQ ID NO: 321976 - RNA, 64 nt, Homo Sapiens; identical to SEQ ID NO: 55998

SEQ ID NO: 321977 - RNA, 64 nt, Homo Sapiens; identical to SEQ ID NO: 55999

SEQ ID NO: 321978 - RNA, 64 nt, Homo Sapiens; identical to SEQ ID NO: 56000

SEQ ID NO: 321979 - RNA, 64 nt, Homo Sapiens; identical to SEQ ID NO: 56001

SEQ ID NO: 321980 - RNA, 64 nt, Homo Sapiens; identical to SEQ ID NO: 56002

SEQ ID NO: 321981 - RNA, 64 nt, Homo Sapiens; identical to SEQ ID NO: 56003

SEQ ID NO: 321982 - RNA, 64 nt, Homo Sapiens; identical to SEQ ID NO: 56004

SEQ ID NO: 321983 - RNA, 64 nt, Homo Sapiens; identical to SEQ ID NO: 56005

SEQ ID NO: 321984 - RNA, 64 nt, Homo Sapiens; identical to SEQ ID NO: 56006

SEQ ID NO: 321985 - RNA, 64 nt, Homo Sapiens; identical to SEQ ID NO: 56007

SEQ ID NO: 321986 - RNA, 64 nt, Homo Sapiens; identical to SEQ ID NO: 56008

SEQ ID NO: 321987 - RNA, 64 nt, Homo Sapiens; identical to SEQ ID NO: 56009

SEQ ID NO: 321988 - RNA, 64 nt, Homo Sapiens; identical to SEQ ID NO: 56010

SEQ ID NO: 321989 - RNA, 64 nt, Homo Sapiens; identical to SEQ ID NO: 56011

SEQ ID NO: 321990 - RNA, 64 nt, Homo Sapiens; identical to SEQ ID NO: 56012

SEQ ID NO: 321991 - RNA, 64 nt, Homo Sapiens; identical to SEQ ID NO: 56013

SEQ ID NO: 321992 - RNA, 64 nt, Homo Sapiens; identical to SEQ ID NO: 56014

SEQ ID NO: 321993 - RNA, 64 nt, Homo Sapiens; identical to SEQ ID NO: 56015

SEQ ID NO: 321994 - RNA, 64 nt, Homo Sapiens; identical to SEQ ID NO: 56016

SEQ ID NO: 321995 - RNA, 64 nt, Homo Sapiens; identical to SEQ ID NO: 56017

SEQ ID NO: 321996 - RNA, 64 nt, Homo Sapiens; identical to SEQ ID NO: 56018

SEQ ID NO: 321997 - RNA, 64 nt, Homo Sapiens; identical to SEQ ID NO: 56019

SEQ ID NO: 321998 - RNA, 64 nt, Homo Sapiens; identical to SEQ ID NO: 56020

SEQ ID NO: 321999 - RNA, 64 nt, Homo Sapiens; identical to SEQ ID NO: 56021

SEQ ID NO: 322000 - RNA, 64 nt, Homo Sapiens; identical to SEQ ID NO: 56022

SEQ ID NO: 322001 - RNA, 64 nt, Homo Sapiens; identical to SEQ ID NO: 56023

SEQ ID NO: 322002 - RNA, 64 nt, Homo Sapiens; identical to SEQ ID NO: 56024

SEQ ID NO: 322003 - RNA, 64 nt, Homo Sapiens; identical to SEQ ID NO: 56025

SEQ ID NO: 322004 - RNA, 64 nt, Homo Sapiens; identical to SEQ ID NO: 56026

SEQ ID NO: 322005 - RNA, 64 nt, Homo Sapiens; identical to SEQ ID NO: 56027

SEQ ID NO: 322006 - RNA, 64 nt, Homo Sapiens; identical to SEQ ID NO: 56028

SEQ ID NO: 322007 - RNA, 64 nt, Homo Sapiens; identical to SEQ ID NO: 56029

SEQ ID NO: 322008 - RNA, 64 nt, Homo Sapiens; identical to SEQ ID NO: 56030

SEQ ID NO: 322009 - RNA, 64 nt, Homo Sapiens; identical to SEQ ID NO: 56031

SEQ ID NO: 322010 - RNA, 64 nt, Homo Sapiens; identical to SEQ ID NO: 56032

SEQ ID NO: 322011 - RNA, 64 nt, Homo Sapiens; identical to SEQ ID NO: 56033

SEQ ID NO: 322012 - RNA, 64 nt, Homo Sapiens; identical to SEQ ID NO: 56034

SEQ ID NO: 322013 - RNA, 64 nt, Homo Sapiens; identical to SEQ ID NO: 56035

SEQ ID NO: 322014 - RNA, 64 nt, Homo Sapiens; identical to SEQ ID NO: 56036

SEQ ID NO: 322015 - RNA, 64 nt, Homo Sapiens; identical to SEQ ID NO: 56037

SEQ ID NO: 322016 - RNA, 64 nt, Homo Sapiens; identical to SEQ ID NO: 56038

SEQ ID NO: 322017 - RNA, 64 nt, Homo Sapiens; identical to SEQ ID NO: 56039

SEQ ID NO: 322018 - RNA, 64 nt, Homo Sapiens; identical to SEQ ID NO: 56040

SEQ ID NO: 322019 - RNA, 64 nt, Homo Sapiens; identical to SEQ ID NO: 56041

SEQ ID NO: 322020 - RNA, 64 nt, Homo Sapiens; identical to SEQ ID NO: 56042

SEQ ID NO: 322021 - RNA, 64 nt, Homo Sapiens; identical to SEQ ID NO: 56043

SEQ ID NO: 322022 - RNA, 64 nt, Homo Sapiens; identical to SEQ ID NO: 56044

SEQ ID NO: 322023 - RNA, 64 nt, Homo Sapiens; identical to SEQ ID NO: 56045

SEQ ID NO: 322024 - RNA, 64 nt, Homo Sapiens; identical to SEQ ID NO: 56046

SEQ ID NO: 322025 - RNA, 64 nt, Homo Sapiens; identical to SEQ ID NO: 56047

SEQ ID NO: 322026 - RNA, 64 nt, Homo Sapiens; identical to SEQ ID NO: 56048

SEQ ID NO: 322027 - RNA, 64 nt, Homo Sapiens; identical to SEQ ID NO: 56049

SEQ ID NO: 322028 - RNA, 64 nt, Homo Sapiens; identical to SEQ ID NO: 56050

SEQ ID NO: 322029 - RNA, 64 nt, Homo Sapiens; identical to SEQ ID NO: 56051

SEQ ID NO: 322030 - RNA, 64 nt, Homo Sapiens; identical to SEQ ID NO: 56052

SEQ ID NO: 322031 - RNA, 64 nt, Homo Sapiens; identical to SEQ ID NO: 56053

SEQ ID NO: 322032 - RNA, 64 nt, Homo Sapiens; identical to SEQ ID NO: 56054

SEQ ID NO: 322033 - RNA, 64 nt, Homo Sapiens; identical to SEQ ID NO: 56055

SEQ ID NO: 322034 - RNA, 64 nt, Homo Sapiens; identical to SEQ ID NO: 56056

SEQ ID NO: 322035 - RNA, 64 nt, Homo Sapiens; identical to SEQ ID NO: 56057

SEQ ID NO: 322036 - RNA, 64 nt, Homo Sapiens; identical to SEQ ID NO: 56058

SEQ ID NO: 322037 - RNA, 64 nt, Homo Sapiens; identical to SEQ ID NO: 56059

SEQ ID NO: 322038 - RNA, 64 nt, Homo Sapiens; identical to SEQ ID NO: 56060

SEQ ID NO: 322039 - RNA, 64 nt, Homo Sapiens; identical to SEQ ID NO: 56061

SEQ ID NO: 322040 - RNA, 64 nt, Homo Sapiens; identical to SEQ ID NO: 56062

SEQ ID NO: 322041 - RNA, 64 nt, Homo Sapiens; identical to SEQ ID NO: 56063

SEQ ID NO: 322042 - RNA, 64 nt, Homo Sapiens; identical to SEQ ID NO: 56064

SEQ ID NO: 322043 - RNA, 64 nt, Homo Sapiens; identical to SEQ ID NO: 56065

SEQ ID NO: 322044 - RNA, 64 nt, Homo Sapiens; identical to SEQ ID NO: 56066

SEQ ID NO: 322045 - RNA, 64 nt, Homo Sapiens; identical to SEQ ID NO: 56067

SEQ ID NO: 322046 - RNA, 64 nt, Homo Sapiens; identical to SEQ ID NO: 56068

SEQ ID NO: 322047 - RNA, 64 nt, Homo Sapiens; identical to SEQ ID NO: 56069

SEQ ID NO: 322048 - RNA, 64 nt, Homo Sapiens; identical to SEQ ID NO: 56070

SEQ ID NO: 322049 - RNA, 64 nt, Homo Sapiens; identical to SEQ ID NO: 56071

SEQ ID NO: 322050 - RNA, 64 nt, Homo Sapiens; identical to SEQ ID NO: 56072

SEQ ID NO: 322051 - RNA, 64 nt, Homo Sapiens; identical to SEQ ID NO: 56073

SEQ ID NO: 322052 - RNA, 64 nt, Homo Sapiens; identical to SEQ ID NO: 56074

SEQ ID NO: 322053 - RNA, 64 nt, Homo Sapiens; identical to SEQ ID NO: 56075

SEQ ID NO: 322054 - RNA, 64 nt, Homo Sapiens; identical to SEQ ID NO: 56076

SEQ ID NO: 322055 - RNA, 64 nt, Homo Sapiens; identical to SEQ ID NO: 56077

SEQ ID NO: 322056 - RNA, 64 nt, Homo Sapiens; identical to SEQ ID NO: 56078

SEQ ID NO: 322057 - RNA, 64 nt, Homo Sapiens; identical to SEQ ID NO: 56079

SEQ ID NO: 322058 - RNA, 64 nt, Homo Sapiens; identical to SEQ ID NO: 56080

SEQ ID NO: 322059 - RNA, 64 nt, Homo Sapiens; identical to SEQ ID NO: 56081

SEQ ID NO: 322060 - RNA, 64 nt, Homo Sapiens; identical to SEQ ID NO: 56082

SEQ ID NO: 322061 - RNA, 64 nt, Homo Sapiens; identical to SEQ ID NO: 56083

SEQ ID NO: 322062 - RNA, 64 nt, Homo Sapiens; identical to SEQ ID NO: 56084

SEQ ID NO: 322063 - RNA, 64 nt, Homo Sapiens; identical to SEQ ID NO: 56085

SEQ ID NO: 322064 - RNA, 64 nt, Homo Sapiens; identical to SEQ ID NO: 56086

SEQ ID NO: 322065 - RNA, 64 nt, Homo Sapiens; identical to SEQ ID NO: 56087

SEQ ID NO: 322066 - RNA, 64 nt, Homo Sapiens; identical to SEQ ID NO: 56088

SEQ ID NO: 322067 - RNA, 64 nt, Homo Sapiens; identical to SEQ ID NO: 56089

SEQ ID NO: 322068 - RNA, 64 nt, Homo Sapiens; identical to SEQ ID NO: 56090

SEQ ID NO: 322069 - RNA, 64 nt, Homo Sapiens; identical to SEQ ID NO: 56091

SEQ ID NO: 322070 - RNA, 64 nt, Homo Sapiens; identical to SEQ ID NO: 56092

SEQ ID NO: 322071 - RNA, 64 nt, Homo Sapiens; identical to SEQ ID NO: 56093

SEQ ID NO: 322072 - RNA, 64 nt, Homo Sapiens; identical to SEQ ID NO: 56094

SEQ ID NO: 322073 - RNA, 64 nt, Homo Sapiens; identical to SEQ ID NO: 56095

SEQ ID NO: 322074 - RNA, 64 nt, Homo Sapiens; identical to SEQ ID NO: 56096

SEQ ID NO: 322075 - RNA, 64 nt, Homo Sapiens; identical to SEQ ID NO: 56097

SEQ ID NO: 322076 - RNA, 64 nt, Homo Sapiens; identical to SEQ ID NO: 56098

SEQ ID NO: 322077 - RNA, 64 nt, Homo Sapiens; identical to SEQ ID NO: 56099

SEQ ID NO: 322078 - RNA, 64 nt, Homo Sapiens; identical to SEQ ID NO: 56100

SEQ ID NO: 322079 - RNA, 64 nt, Homo Sapiens; identical to SEQ ID NO: 56101

SEQ ID NO: 322080 - RNA, 64 nt, Homo Sapiens; identical to SEQ ID NO: 56102

SEQ ID NO: 322081 - RNA, 64 nt, Homo Sapiens; identical to SEQ ID NO: 56103

SEQ ID NO: 322082 - RNA, 64 nt, Homo Sapiens; identical to SEQ ID NO: 56104

SEQ ID NO: 322083 - RNA, 64 nt, Homo Sapiens; identical to SEQ ID NO: 56105

SEQ ID NO: 322084 - RNA, 64 nt, Homo Sapiens; identical to SEQ ID NO: 56106

SEQ ID NO: 322085 - RNA, 64 nt, Homo Sapiens; identical to SEQ ID NO: 56107

SEQ ID NO: 322086 - RNA, 64 nt, Homo Sapiens; identical to SEQ ID NO: 56108

SEQ ID NO: 322087 - RNA, 64 nt, Homo Sapiens; identical to SEQ ID NO: 56109

SEQ ID NO: 322088 - RNA, 64 nt, Homo Sapiens; identical to SEQ ID NO: 56110

SEQ ID NO: 322089 - RNA, 64 nt, Homo Sapiens; identical to SEQ ID NO: 56111

SEQ ID NO: 322090 - RNA, 64 nt, Homo Sapiens; identical to SEQ ID NO: 56112

SEQ ID NO: 322091 - RNA, 64 nt, Homo Sapiens; identical to SEQ ID NO: 56113

SEQ ID NO: 322092 - RNA, 64 nt, Homo Sapiens; identical to SEQ ID NO: 56114

SEQ ID NO: 322093 - RNA, 64 nt, Homo Sapiens; identical to SEQ ID NO: 56115

SEQ ID NO: 322094 - RNA, 64 nt, Homo Sapiens; identical to SEQ ID NO: 56116

SEQ ID NO: 322095 - RNA, 64 nt, Homo Sapiens; identical to SEQ ID NO: 56117

SEQ ID NO: 322096 - RNA, 64 nt, Homo Sapiens; identical to SEQ ID NO: 56118

SEQ ID NO: 322097 - RNA, 64 nt, Homo Sapiens; identical to SEQ ID NO: 56119

SEQ ID NO: 322098 - RNA, 64 nt, Homo Sapiens; identical to SEQ ID NO: 56120

SEQ ID NO: 322099 - RNA, 64 nt, Homo Sapiens; identical to SEQ ID NO: 56121

SEQ ID NO: 322100 - RNA, 64 nt, Homo Sapiens; identical to SEQ ID NO: 56122

SEQ ID NO: 322101 - RNA, 64 nt, Homo Sapiens; identical to SEQ ID NO: 56123

SEQ ID NO: 322102 - RNA, 64 nt, Homo Sapiens; identical to SEQ ID NO: 56124

SEQ ID NO: 322103 - RNA, 64 nt, Homo Sapiens; identical to SEQ ID NO: 56125

SEQ ID NO: 322104 - RNA, 64 nt, Homo Sapiens; identical to SEQ ID NO: 56126

SEQ ID NO: 322105 - RNA, 64 nt, Homo Sapiens; identical to SEQ ID NO: 56127

SEQ ID NO: 322106 - RNA, 64 nt, Homo Sapiens; identical to SEQ ID NO: 56128

SEQ ID NO: 322107 - RNA, 64 nt, Homo Sapiens; identical to SEQ ID NO: 56129

SEQ ID NO: 322108 - RNA, 64 nt, Homo Sapiens; identical to SEQ ID NO: 56130

SEQ ID NO: 322109 - RNA, 64 nt, Homo Sapiens; identical to SEQ ID NO: 56131

SEQ ID NO: 322110 - RNA, 64 nt, Homo Sapiens; identical to SEQ ID NO: 56132

SEQ ID NO: 322111 - RNA, 64 nt, Homo Sapiens; identical to SEQ ID NO: 56133

SEQ ID NO: 322112 - RNA, 64 nt, Homo Sapiens; identical to SEQ ID NO: 56134

SEQ ID NO: 322113 - RNA, 64 nt, Homo Sapiens; identical to SEQ ID NO: 56135

SEQ ID NO: 322114 - RNA, 64 nt, Homo Sapiens; identical to SEQ ID NO: 56136

SEQ ID NO: 322115 - RNA, 64 nt, Homo Sapiens; identical to SEQ ID NO: 56137

SEQ ID NO: 322116 - RNA, 64 nt, Homo Sapiens; identical to SEQ ID NO: 56138

SEQ ID NO: 322117 - RNA, 64 nt, Homo Sapiens; identical to SEQ ID NO: 56139

SEQ ID NO: 322118 - RNA, 64 nt, Homo Sapiens; identical to SEQ ID NO: 56140

SEQ ID NO: 322119 - RNA, 64 nt, Homo Sapiens; identical to SEQ ID NO: 56141

SEQ ID NO: 322120 - RNA, 64 nt, Homo Sapiens; identical to SEQ ID NO: 56142

SEQ ID NO: 322121 - RNA, 64 nt, Homo Sapiens; identical to SEQ ID NO: 56143

SEQ ID NO: 322122 - RNA, 64 nt, Homo Sapiens; identical to SEQ ID NO: 56144

SEQ ID NO: 322123 - RNA, 64 nt, Homo Sapiens; identical to SEQ ID NO: 56145

SEQ ID NO: 322124 - RNA, 64 nt, Homo Sapiens; identical to SEQ ID NO: 56146

SEQ ID NO: 322125 - RNA, 64 nt, Homo Sapiens; identical to SEQ ID NO: 56147

SEQ ID NO: 322126 - RNA, 64 nt, Homo Sapiens; identical to SEQ ID NO: 56148

SEQ ID NO: 322127 - RNA, 64 nt, Homo Sapiens; identical to SEQ ID NO: 56149

SEQ ID NO: 322128 - RNA, 64 nt, Homo Sapiens; identical to SEQ ID NO: 56150

SEQ ID NO: 322129 - RNA, 64 nt, Homo Sapiens; identical to SEQ ID NO: 56151

SEQ ID NO: 322130 - RNA, 64 nt, Homo Sapiens; identical to SEQ ID NO: 56152

SEQ ID NO: 322131 - RNA, 64 nt, Homo Sapiens; identical to SEQ ID NO: 56153

SEQ ID NO: 322132 - RNA, 64 nt, Homo Sapiens; identical to SEQ ID NO: 56154

SEQ ID NO: 322133 - RNA, 64 nt, Homo Sapiens; identical to SEQ ID NO: 56155

SEQ ID NO: 322134 - RNA, 64 nt, Homo Sapiens; identical to SEQ ID NO: 56156

SEQ ID NO: 322135 - RNA, 64 nt, Homo Sapiens; identical to SEQ ID NO: 56157

SEQ ID NO: 322136 - RNA, 64 nt, Homo Sapiens; identical to SEQ ID NO: 56158

SEQ ID NO: 322137 - RNA, 64 nt, Homo Sapiens; identical to SEQ ID NO: 56159

SEQ ID NO: 322138 - RNA, 64 nt, Homo Sapiens
uagaaggaaaugauagucaaauacacguuuagauuaaaacuaguuuaaaaaauuauaaaugaau

SEQ ID NO: 322139 - RNA, 64 nt, Homo Sapiens
aaagaaaauuggaugcaagacaauggagaaacuuuaaaacuaaacaggaccacccuuuauucuu

SEQ ID NO: 322140 - RNA, 64 nt, Homo Sapiens
cuaaguaacuuuggcuuauaaacuuugcaauaauuaaaacuaccaaggugagcuccucaacaau

SEQ ID NO: 322141 - RNA, 64 nt, Homo Sapiens
uaauaauuauaauccaguuuacacuuuucaaauauaaaacuauauguuuauguuuuaagaauga

SEQ ID NO: 322142 - RNA, 64 nt, Homo Sapiens
agugaggaaggcucgugggucauacuguucauuguaaaacuaaaaacugccagcagaaaaacuc

SEQ ID NO: 322143 - RNA, 64 nt, Homo Sapiens
gugcccccuuagccuccauuuugacuugcuugccuaaaacuacaagaauccuuaaaaagaaaaa

SEQ ID NO: 322144 - RNA, 64 nt, Homo Sapiens
cuacagguauagcugaccaacuaaauaaaacaaauaaaacuaggugaaggguuuuuuaaaagaa

SEQ ID NO: 322145 - RNA, 64 nt, Homo Sapiens
gaaggguuuuuuaaaagaaccagagaaauaagaauaaaacuaauuaaaaaugaguaaacuacag

SEQ ID NO: 322146 - RNA, 64 nt, Homo Sapiens
uagauuuaaaaguauaugacauguauuuuguauuuaaaacuagaauagccaguauuuauguuuu

SEQ ID NO: 322147 - RNA, 64 nt, Homo Sapiens
ucugaaccaacaugcuacaguagcuaagaaguauuaaaacuauauacauccauauaaagaugaa

SEQ ID NO: 322148 - RNA, 64 nt, Homo Sapiens
aagggggacuucuaggaauuuauaaccaaaauuuuaaaacuauuuuuauauuuuuuuaaaucuu

SEQ ID NO: 322149 - RNA, 64 nt, Homo Sapiens
aauugcauagcuuuuuguaacauuuacuuaauuuuaaaacuaaacucauacuuuugcuaucuuu

SEQ ID NO: 322150 - RNA, 64 nt, Homo Sapiens
uuuucaucacuuuuuauucauaacuucagauuuguaaaacuaauuuccaaaauauaagcuguuu

SEQ ID NO: 322151 - RNA, 64 nt, Homo Sapiens
gcaaaauuuuacaaaucauuuguggaaugaaugguaaaacuaaucugaugaaauggaaaauuau

SEQ ID NO: 322152 - RNA, 64 nt, Homo Sapiens
uaauaaauuugauaaauauauguagauugguuaguaaaacuauuaauguuaaauauaguaucua

SEQ ID NO: 322153 - RNA, 64 nt, Homo Sapiens
aauauggaucuuuuaugauuauuauucuuaaucuuaaaacuauaguuugcuaccuauuguaacu

SEQ ID NO: 322154 - RNA, 64 nt, Homo Sapiens
uaauaguucauagaaauguucauacauaguauauuaaaacuauagaaaugcaauucauuuugua

SEQ ID NO: 322155 - RNA, 64 nt, Homo Sapiens
gagagaaugcuucuuacaggcacauuuuuaaauauaaaacuaaaacauuaucugauccaguccu

SEQ ID NO: 322156 - RNA, 64 nt, Homo Sapiens
gaaaauuugacauggcaugugaggcauuuuucaauaaaacuacuuauuuauuucugaaacaaaa

SEQ ID NO: 322157 - RNA, 64 nt, Homo Sapiens
aaccagaggagucuaugccaaaagaggugcauaauaaaacuacucaugaggagccucaguuuug

SEQ ID NO: 322158 - RNA, 64 nt, Homo Sapiens
gcuucagccauaauauggagcugaugagcacaaguaaaacuaaggugggagacuaugaauauuc

SEQ ID NO: 322159 - RNA, 64 nt, Homo Sapiens
ugcuuccccccuuccaguaguuuugauuacauccuaaaacuacaaauuaccuugcuccuacuuc

SEQ ID NO: 322160 - RNA, 64 nt, Homo Sapiens
uuuuuuccucuuccauacuguuuugggagaacaauaaaacuacauuacuuuaaauuugccaaua

SEQ ID NO: 322161 - RNA, 64 nt, Homo Sapiens
uuauuccaacacuaaaagcauagaaaauuaauuuuaaaacuaaguaagaaagaugucaacaugc

SEQ ID NO: 322162 - RNA, 64 nt, Homo Sapiens
aucuuaaauaaaacagaaaaucuuucuucagaauuaaaacuaaauaaaaacaaggaaauguacc

SEQ ID NO: 322163 - RNA, 64 nt, Homo Sapiens
aacaaggaaauguaccucuuuuauaaccugacgcuaaaacuaaaaaaagaaaacagaaaccugg

SEQ ID NO: 322164 - RNA, 64 nt, Homo Sapiens
guccuauacaaaaauuagcuuuauaaacuugccuuaaaacuauaaggcucaaaugagccaaagg

SEQ ID NO: 322165 - RNA, 64 nt, Homo Sapiens
gugaucuuccuaaaacuucacucaucuuccacccuaaaacuagagucugaacccucucccaguc

SEQ ID NO: 322166 - RNA, 64 nt, Homo Sapiens
ccuguggacauguagcaaugucuauauuggcucauaaaacuaaccugaaaaacaaauaaaugcu

SEQ ID NO: 322167 - RNA, 64 nt, Homo Sapiens
auaauuuaucuuuauuuaaaagcuuagccugccuuaaaacuagagaucaacuuucucagcugca

SEQ ID NO: 322168 - RNA, 64 nt, Homo Sapiens
cucauuagugacagacuuguaauggaaaccuaaguaaaacuaagguauuuaaaaggguuucaug

SEQ ID NO: 322169 - RNA, 64 nt, Homo Sapiens
aacaaaaaguaaaaauuaguaucagucaaaauaauaaaacuaaaacuuauugcauauuuucaua

SEQ ID NO: 322170 - RNA, 64 nt, Homo Sapiens
ucuauuaauacauucaucacacaaguauuauauuuaaaacuagauuuuuaucuuuaaaucugag

SEQ ID NO: 322171 - RNA, 64 nt, Homo Sapiens
auauacugaaacauauaauggaagaugcagaugauaaaacuaauuuugaacuuuuuaauuuaua

SEQ ID NO: 322172 - RNA, 64 nt, Homo Sapiens
cccaauuauuguucuuuuaugaauccaaugaauuuaaaacuauuguuaaauauaauacugcccc

SEQ ID NO: 322173 - RNA, 64 nt, Homo Sapiens
caugguguacugaucagaaauguucaguuuuaacuaaaacuaaauuuauguuauuuggcuaaau

SEQ ID NO: 322174 - RNA, 64 nt, Homo Sapiens
uacccugcaaguucacugcaugucugaugcuugguaaaacuagucuucccuguaaaaugcagau

SEQ ID NO: 322175 - RNA, 64 nt, Homo Sapiens
uuauuuuguauuucacuuaauaguaagaaauuaauaaaacuaccaauagauuuuaagccaauuc

SEQ ID NO: 322176 - RNA, 64 nt, Homo Sapiens
ugucacuguuuuuauccuagaauuucagauucucuaaaacuacaauuccauucuugaauguaga

SEQ ID NO: 322177 - RNA, 64 nt, Homo Sapiens
auauuugaaugcauggguagaaaauaucauauuuuaaaacuauguauauuuaaauuuaguaauu

SEQ ID NO: 322178 - RNA, 64 nt, Homo Sapiens
cacugaauguuuauagacaaaagaaaauacacacuaaaacuaaucuucauuuuaaaaggguaaa

SEQ ID NO: 322179 - RNA, 64 nt, Homo Sapiens
uuauaguagaugccucuuguaauuauggcuuucuuaaaacuauaauccuagcagaggacaucag

SEQ ID NO: 322180 - RNA, 64 nt, Homo Sapiens
auguagcccuuauuuaaaaaagugaauuccauacuaaaacuaggaaugaaagugagagauuucu

SEQ ID NO: 322181 - RNA, 64 nt, Homo Sapiens
aaaugacacuggaauauguugugcagauucuauguaaaacuacuucccugaguauccaaguaua

SEQ ID NO: 322182 - RNA, 64 nt, Homo Sapiens
auauaugucaucuuauuuucgcucuuuugcguucuaaaacuacauauauuugucuaaaaugaaa

SEQ ID NO: 322183 - RNA, 64 nt, Homo Sapiens
uuaaauaaaagugaaccauauuuaucugguuauauaaaacuaaaaauggggguguuuauauaaa

SEQ ID NO: 322184 - RNA, 64 nt, Homo Sapiens
ugguuauauaaaacuaaaaauggggguguuuauauaaaacuaaaaacuaagaaugauguaaccu

SEQ ID NO: 322185 - RNA, 64 nt, Homo Sapiens
gaauggauugaaaggauaugauggauaaauuauguaaaacuaaaccuaguacuaagaauugguu

SEQ ID NO: 322186 - RNA, 64 nt, Homo Sapiens
aucaucaaaauuauuuguugacauauaugaauuguaaaacuagacauuuuugugauguuuugcu

SEQ ID NO: 322187 - RNA, 64 nt, Homo Sapiens
uaucuaaaccuuguauacagcagcuuaaacaaauuaaaacuaaauguguguguuuuuuuccuuc

SEQ ID NO: 322188 - RNA, 64 nt, Homo Sapiens
cacccaguaagucucuuaaauuuuaaauauuugauaaaacuacugauccaaaugaagagaacuc

SEQ ID NO: 322189 - RNA, 64 nt, Homo Sapiens
uauuuacuuuuguaaucuuggauuuuguagcuuuuaaaacuagaaaccauuguucuaacaaagc

SEQ ID NO: 322190 - RNA, 64 nt, Homo Sapiens
acacaugaauguguauaaucauguuaaaugcaaauaaaacuaguucauagauuuguuuuccuuu

SEQ ID NO: 322191 - RNA, 64 nt, Homo Sapiens
uaguaugcauuuauaauuuuagaauauucaccuuuaaaacuaguaguaauauuugaagauuugu

SEQ ID NO: 322192 - RNA, 64 nt, Homo Sapiens
gcauauggguuuacaugaaaaugcauuuuaaggauaaaacuaaauuguuuucuuaaagaaaucu

SEQ ID NO: 322193 - RNA, 64 nt, Homo Sapiens; identical to SEQ ID NO: 223226

SEQ ID NO: 322194 - RNA, 64 nt, Homo Sapiens; identical to SEQ ID NO: 223227

SEQ ID NO: 322195 - RNA, 64 nt, Homo Sapiens; identical to SEQ ID NO: 223228

SEQ ID NO: 322196 - RNA, 64 nt, Homo Sapiens; identical to SEQ ID NO: 223229

SEQ ID NO: 322197 - RNA, 64 nt, Homo Sapiens; identical to SEQ ID NO: 223230

SEQ ID NO: 322198 - RNA, 64 nt, Homo Sapiens; identical to SEQ ID NO: 223231

SEQ ID NO: 322199 - RNA, 64 nt, Homo Sapiens; identical to SEQ ID NO: 223232

SEQ ID NO: 322200 - RNA, 64 nt, Homo Sapiens; identical to SEQ ID NO: 223233

SEQ ID NO: 322201 - RNA, 64 nt, Homo Sapiens; identical to SEQ ID NO: 223234

SEQ ID NO: 322202 - RNA, 64 nt, Homo Sapiens; identical to SEQ ID NO: 223235

SEQ ID NO: 322203 - RNA, 64 nt, Homo Sapiens; identical to SEQ ID NO: 223236

SEQ ID NO: 322204 - RNA, 64 nt, Homo Sapiens; identical to SEQ ID NO: 223237

SEQ ID NO: 322205 - RNA, 64 nt, Homo Sapiens; identical to SEQ ID NO: 223238

SEQ ID NO: 322206 - RNA, 64 nt, Homo Sapiens; identical to SEQ ID NO: 223239

SEQ ID NO: 322207 - RNA, 64 nt, Homo Sapiens; identical to SEQ ID NO: 223240

SEQ ID NO: 322208 - RNA, 64 nt, Homo Sapiens; identical to SEQ ID NO: 223241

SEQ ID NO: 322209 - RNA, 64 nt, Homo Sapiens; identical to SEQ ID NO: 223242

SEQ ID NO: 322210 - RNA, 64 nt, Homo Sapiens; identical to SEQ ID NO: 223243

SEQ ID NO: 322211 - RNA, 64 nt, Homo Sapiens; identical to SEQ ID NO: 223244

SEQ ID NO: 322212 - RNA, 64 nt, Homo Sapiens; identical to SEQ ID NO: 223245

SEQ ID NO: 322213 - RNA, 64 nt, Homo Sapiens; identical to SEQ ID NO: 223246

SEQ ID NO: 322214 - RNA, 64 nt, Homo Sapiens; identical to SEQ ID NO: 223247

SEQ ID NO: 322215 - RNA, 64 nt, Homo Sapiens; identical to SEQ ID NO: 223248

SEQ ID NO: 322216 - RNA, 64 nt, Homo Sapiens; identical to SEQ ID NO: 223249

SEQ ID NO: 322217 - RNA, 64 nt, Homo Sapiens; identical to SEQ ID NO: 223250

SEQ ID NO: 322218 - RNA, 64 nt, Homo Sapiens; identical to SEQ ID NO: 223251

SEQ ID NO: 322219 - RNA, 64 nt, Homo Sapiens; identical to SEQ ID NO: 223252

SEQ ID NO: 322220 - RNA, 64 nt, Homo Sapiens; identical to SEQ ID NO: 223253

SEQ ID NO: 322221 - RNA, 64 nt, Homo Sapiens; identical to SEQ ID NO: 223254

SEQ ID NO: 322222 - RNA, 64 nt, Homo Sapiens; identical to SEQ ID NO: 223255

SEQ ID NO: 322223 - RNA, 64 nt, Homo Sapiens; identical to SEQ ID NO: 223256

SEQ ID NO: 322224 - RNA, 64 nt, Homo Sapiens; identical to SEQ ID NO: 223257

SEQ ID NO: 322225 - RNA, 64 nt, Homo Sapiens; identical to SEQ ID NO: 223258

SEQ ID NO: 322226 - RNA, 64 nt, Homo Sapiens; identical to SEQ ID NO: 223259

SEQ ID NO: 322227 - RNA, 64 nt, Homo Sapiens; identical to SEQ ID NO: 223260

SEQ ID NO: 322228 - RNA, 64 nt, Homo Sapiens; identical to SEQ ID NO: 223261

SEQ ID NO: 322229 - RNA, 64 nt, Homo Sapiens; identical to SEQ ID NO: 223262

SEQ ID NO: 322230 - RNA, 64 nt, Homo Sapiens; identical to SEQ ID NO: 223263

SEQ ID NO: 322231 - RNA, 64 nt, Homo Sapiens; identical to SEQ ID NO: 223264

SEQ ID NO: 322232 - RNA, 64 nt, Homo Sapiens; identical to SEQ ID NO: 223265

SEQ ID NO: 322233 - RNA, 64 nt, Homo Sapiens; identical to SEQ ID NO: 223266

SEQ ID NO: 322234 - RNA, 64 nt, Homo Sapiens; identical to SEQ ID NO: 223267

SEQ ID NO: 322235 - RNA, 64 nt, Homo Sapiens; identical to SEQ ID NO: 223268

SEQ ID NO: 322236 - RNA, 64 nt, Homo Sapiens; identical to SEQ ID NO: 223269

SEQ ID NO: 322237 - RNA, 64 nt, Homo Sapiens; identical to SEQ ID NO: 223270

SEQ ID NO: 322238 - RNA, 64 nt, Homo Sapiens; identical to SEQ ID NO: 223271

SEQ ID NO: 322239 - RNA, 64 nt, Homo Sapiens; identical to SEQ ID NO: 223272

SEQ ID NO: 322240 - RNA, 64 nt, Homo Sapiens; identical to SEQ ID NO: 223273

SEQ ID NO: 322241 - RNA, 64 nt, Homo Sapiens; identical to SEQ ID NO: 223274

SEQ ID NO: 322242 - RNA, 64 nt, Homo Sapiens; identical to SEQ ID NO: 223275

SEQ ID NO: 322243 - RNA, 64 nt, Homo Sapiens; identical to SEQ ID NO: 223276

SEQ ID NO: 322244 - RNA, 64 nt, Homo Sapiens; identical to SEQ ID NO: 223277

SEQ ID NO: 322245 - RNA, 64 nt, Homo Sapiens; identical to SEQ ID NO: 223278

SEQ ID NO: 322246 - RNA, 64 nt, Homo Sapiens; identical to SEQ ID NO: 223279

SEQ ID NO: 322247 - RNA, 64 nt, Homo Sapiens; identical to SEQ ID NO: 223280

SEQ ID NO: 322248 - RNA, 64 nt, Homo Sapiens; identical to SEQ ID NO: 223281

SEQ ID NO: 322249 - RNA, 64 nt, Homo Sapiens; identical to SEQ ID NO: 223282

SEQ ID NO: 322250 - RNA, 64 nt, Homo Sapiens; identical to SEQ ID NO: 223283

SEQ ID NO: 322251 - RNA, 64 nt, Homo Sapiens; identical to SEQ ID NO: 223284

SEQ ID NO: 322252 - RNA, 64 nt, Homo Sapiens; identical to SEQ ID NO: 223285

SEQ ID NO: 322253 - RNA, 64 nt, Homo Sapiens; identical to SEQ ID NO: 223286

SEQ ID NO: 322254 - RNA, 64 nt, Homo Sapiens; identical to SEQ ID NO: 223287

SEQ ID NO: 322255 - RNA, 64 nt, Homo Sapiens; identical to SEQ ID NO: 223288

SEQ ID NO: 322256 - RNA, 64 nt, Homo Sapiens; identical to SEQ ID NO: 223289

SEQ ID NO: 322257 - RNA, 64 nt, Homo Sapiens; identical to SEQ ID NO: 223290

SEQ ID NO: 322258 - RNA, 64 nt, Homo Sapiens; identical to SEQ ID NO: 223291

SEQ ID NO: 322259 - RNA, 64 nt, Homo Sapiens; identical to SEQ ID NO: 223292

SEQ ID NO: 322260 - RNA, 64 nt, Homo Sapiens; identical to SEQ ID NO: 223293

SEQ ID NO: 322261 - RNA, 64 nt, Homo Sapiens; identical to SEQ ID NO: 223294

SEQ ID NO: 322262 - RNA, 64 nt, Homo Sapiens; identical to SEQ ID NO: 223295

SEQ ID NO: 322263 - RNA, 64 nt, Homo Sapiens; identical to SEQ ID NO: 223296

SEQ ID NO: 322264 - RNA, 64 nt, Homo Sapiens; identical to SEQ ID NO: 223297

SEQ ID NO: 322265 - RNA, 64 nt, Homo Sapiens; identical to SEQ ID NO: 223298

SEQ ID NO: 322266 - RNA, 64 nt, Homo Sapiens; identical to SEQ ID NO: 223299

SEQ ID NO: 322267 - RNA, 64 nt, Homo Sapiens; identical to SEQ ID NO: 223300

SEQ ID NO: 322268 - RNA, 64 nt, Homo Sapiens; identical to SEQ ID NO: 223301

SEQ ID NO: 322269 - RNA, 64 nt, Homo Sapiens; identical to SEQ ID NO: 223302

SEQ ID NO: 322270 - RNA, 64 nt, Homo Sapiens; identical to SEQ ID NO: 223303

SEQ ID NO: 322271 - RNA, 64 nt, Homo Sapiens; identical to SEQ ID NO: 223304

SEQ ID NO: 322272 - RNA, 64 nt, Homo Sapiens; identical to SEQ ID NO: 223305

SEQ ID NO: 322273 - RNA, 64 nt, Homo Sapiens; identical to SEQ ID NO: 223306

SEQ ID NO: 322274 - RNA, 64 nt, Homo Sapiens; identical to SEQ ID NO: 223307

SEQ ID NO: 322275 - RNA, 64 nt, Homo Sapiens; identical to SEQ ID NO: 223308

SEQ ID NO: 322276 - RNA, 64 nt, Homo Sapiens; identical to SEQ ID NO: 223309

SEQ ID NO: 322277 - RNA, 64 nt, Homo Sapiens; identical to SEQ ID NO: 223310

SEQ ID NO: 322278 - RNA, 64 nt, Homo Sapiens; identical to SEQ ID NO: 223311

SEQ ID NO: 322279 - RNA, 64 nt, Homo Sapiens; identical to SEQ ID NO: 223312

SEQ ID NO: 322280 - RNA, 64 nt, Homo Sapiens; identical to SEQ ID NO: 223313

SEQ ID NO: 322281 - RNA, 64 nt, Homo Sapiens; identical to SEQ ID NO: 223314

SEQ ID NO: 322282 - RNA, 64 nt, Homo Sapiens; identical to SEQ ID NO: 223315

SEQ ID NO: 322283 - RNA, 64 nt, Homo Sapiens; identical to SEQ ID NO: 223316

SEQ ID NO: 322284 - RNA, 64 nt, Homo Sapiens; identical to SEQ ID NO: 223317

SEQ ID NO: 322285 - RNA, 64 nt, Homo Sapiens; identical to SEQ ID NO: 223318

SEQ ID NO: 322286 - RNA, 64 nt, Homo Sapiens; identical to SEQ ID NO: 223319

SEQ ID NO: 322287 - RNA, 64 nt, Homo Sapiens; identical to SEQ ID NO: 223320

SEQ ID NO: 322288 - RNA, 64 nt, Homo Sapiens; identical to SEQ ID NO: 223321

SEQ ID NO: 322289 - RNA, 64 nt, Homo Sapiens; identical to SEQ ID NO: 223322

SEQ ID NO: 322290 - RNA, 64 nt, Homo Sapiens; identical to SEQ ID NO: 223323

SEQ ID NO: 322291 - RNA, 64 nt, Homo Sapiens; identical to SEQ ID NO: 223324

SEQ ID NO: 322292 - RNA, 64 nt, Homo Sapiens; identical to SEQ ID NO: 223325

SEQ ID NO: 322293 - RNA, 64 nt, Homo Sapiens; identical to SEQ ID NO: 223326

SEQ ID NO: 322294 - RNA, 64 nt, Homo Sapiens; identical to SEQ ID NO: 223327

SEQ ID NO: 322295 - RNA, 64 nt, Homo Sapiens; identical to SEQ ID NO: 223328

SEQ ID NO: 322296 - RNA, 64 nt, Homo Sapiens; identical to SEQ ID NO: 223329

SEQ ID NO: 322297 - RNA, 64 nt, Homo Sapiens; identical to SEQ ID NO: 223330

SEQ ID NO: 322298 - RNA, 64 nt, Homo Sapiens; identical to SEQ ID NO: 223331

SEQ ID NO: 322299 - RNA, 64 nt, Homo Sapiens; identical to SEQ ID NO: 223332

SEQ ID NO: 322300 - RNA, 64 nt, Homo Sapiens; identical to SEQ ID NO: 223333

SEQ ID NO: 322301 - RNA, 64 nt, Homo Sapiens; identical to SEQ ID NO: 223334

SEQ ID NO: 322302 - RNA, 64 nt, Homo Sapiens; identical to SEQ ID NO: 223335

SEQ ID NO: 322303 - RNA, 64 nt, Homo Sapiens; identical to SEQ ID NO: 223336

SEQ ID NO: 322304 - RNA, 64 nt, Homo Sapiens; identical to SEQ ID NO: 223337

SEQ ID NO: 322305 - RNA, 64 nt, Homo Sapiens; identical to SEQ ID NO: 223338

SEQ ID NO: 322306 - RNA, 64 nt, Homo Sapiens; identical to SEQ ID NO: 223339

SEQ ID NO: 322307 - RNA, 64 nt, Homo Sapiens; identical to SEQ ID NO: 223340

SEQ ID NO: 322308 - RNA, 64 nt, Homo Sapiens; identical to SEQ ID NO: 223341

SEQ ID NO: 322309 - RNA, 64 nt, Homo Sapiens; identical to SEQ ID NO: 223342

SEQ ID NO: 322310 - RNA, 64 nt, Homo Sapiens; identical to SEQ ID NO: 223343

SEQ ID NO: 322311 - RNA, 64 nt, Homo Sapiens; identical to SEQ ID NO: 223344

SEQ ID NO: 322312 - RNA, 64 nt, Homo Sapiens; identical to SEQ ID NO: 223345

SEQ ID NO: 322313 - RNA, 64 nt, Homo Sapiens; identical to SEQ ID NO: 223346

SEQ ID NO: 322314 - RNA, 64 nt, Homo Sapiens; identical to SEQ ID NO: 223347

SEQ ID NO: 322315 - RNA, 64 nt, Homo Sapiens; identical to SEQ ID NO: 223348

SEQ ID NO: 322316 - RNA, 64 nt, Homo Sapiens; identical to SEQ ID NO: 223349

SEQ ID NO: 322317 - RNA, 64 nt, Homo Sapiens; identical to SEQ ID NO: 223350

SEQ ID NO: 322318 - RNA, 64 nt, Homo Sapiens; identical to SEQ ID NO: 223351

SEQ ID NO: 322319 - RNA, 64 nt, Homo Sapiens; identical to SEQ ID NO: 223352

SEQ ID NO: 322320 - RNA, 64 nt, Homo Sapiens; identical to SEQ ID NO: 223353

SEQ ID NO: 322321 - RNA, 64 nt, Homo Sapiens; identical to SEQ ID NO: 223354

SEQ ID NO: 322322 - RNA, 64 nt, Homo Sapiens; identical to SEQ ID NO: 223355

SEQ ID NO: 322323 - RNA, 64 nt, Homo Sapiens; identical to SEQ ID NO: 223356

SEQ ID NO: 322324 - RNA, 64 nt, Homo Sapiens; identical to SEQ ID NO: 223357

SEQ ID NO: 322325 - RNA, 64 nt, Homo Sapiens; identical to SEQ ID NO: 223358

SEQ ID NO: 322326 - RNA, 64 nt, Homo Sapiens; identical to SEQ ID NO: 223359

SEQ ID NO: 322327 - RNA, 64 nt, Homo Sapiens; identical to SEQ ID NO: 223360

SEQ ID NO: 322328 - RNA, 64 nt, Homo Sapiens; identical to SEQ ID NO: 223361

SEQ ID NO: 322329 - RNA, 64 nt, Homo Sapiens; identical to SEQ ID NO: 223362

SEQ ID NO: 322330 - RNA, 64 nt, Homo Sapiens; identical to SEQ ID NO: 223363

SEQ ID NO: 322331 - RNA, 64 nt, Homo Sapiens; identical to SEQ ID NO: 223364

SEQ ID NO: 322332 - RNA, 64 nt, Homo Sapiens; identical to SEQ ID NO: 223365

SEQ ID NO: 322333 - RNA, 64 nt, Homo Sapiens; identical to SEQ ID NO: 223366

SEQ ID NO: 322334 - RNA, 64 nt, Homo Sapiens; identical to SEQ ID NO: 223367

SEQ ID NO: 322335 - RNA, 64 nt, Homo Sapiens; identical to SEQ ID NO: 223368

SEQ ID NO: 322336 - RNA, 64 nt, Homo Sapiens; identical to SEQ ID NO: 223369

SEQ ID NO: 322337 - RNA, 64 nt, Homo Sapiens; identical to SEQ ID NO: 223370

SEQ ID NO: 322338 - RNA, 64 nt, Homo Sapiens; identical to SEQ ID NO: 223371

SEQ ID NO: 322339 - RNA, 64 nt, Homo Sapiens; identical to SEQ ID NO: 223372

SEQ ID NO: 322340 - RNA, 64 nt, Homo Sapiens; identical to SEQ ID NO: 223373

SEQ ID NO: 322341 - RNA, 64 nt, Homo Sapiens; identical to SEQ ID NO: 223374

SEQ ID NO: 322342 - RNA, 64 nt, Homo Sapiens; identical to SEQ ID NO: 223375

SEQ ID NO: 322343 - RNA, 64 nt, Homo Sapiens; identical to SEQ ID NO: 223376

SEQ ID NO: 322344 - RNA, 64 nt, Homo Sapiens; identical to SEQ ID NO: 223377

SEQ ID NO: 322345 - RNA, 64 nt, Homo Sapiens; identical to SEQ ID NO: 223378

SEQ ID NO: 322346 - RNA, 64 nt, Homo Sapiens; identical to SEQ ID NO: 223379

SEQ ID NO: 322347 - RNA, 64 nt, Homo Sapiens; identical to SEQ ID NO: 223380

SEQ ID NO: 322348 - RNA, 64 nt, Homo Sapiens; identical to SEQ ID NO: 223381

SEQ ID NO: 322349 - RNA, 64 nt, Homo Sapiens; identical to SEQ ID NO: 223382

SEQ ID NO: 322350 - RNA, 64 nt, Homo Sapiens; identical to SEQ ID NO: 223383

SEQ ID NO: 322351 - RNA, 64 nt, Homo Sapiens; identical to SEQ ID NO: 223384

SEQ ID NO: 322352 - RNA, 64 nt, Homo Sapiens; identical to SEQ ID NO: 223385

SEQ ID NO: 322353 - RNA, 64 nt, Homo Sapiens; identical to SEQ ID NO: 223386

SEQ ID NO: 322354 - RNA, 64 nt, Homo Sapiens; identical to SEQ ID NO: 223387

SEQ ID NO: 322355 - RNA, 64 nt, Homo Sapiens; identical to SEQ ID NO: 223388

SEQ ID NO: 322356 - RNA, 64 nt, Homo Sapiens; identical to SEQ ID NO: 223389

SEQ ID NO: 322357 - RNA, 64 nt, Homo Sapiens; identical to SEQ ID NO: 223390

SEQ ID NO: 322358 - RNA, 64 nt, Homo Sapiens; identical to SEQ ID NO: 223391

SEQ ID NO: 322359 - RNA, 64 nt, Homo Sapiens; identical to SEQ ID NO: 223392

SEQ ID NO: 322360 - RNA, 64 nt, Homo Sapiens; identical to SEQ ID NO: 223393

SEQ ID NO: 322361 - RNA, 64 nt, Homo Sapiens; identical to SEQ ID NO: 223394

SEQ ID NO: 322362 - RNA, 64 nt, Homo Sapiens; identical to SEQ ID NO: 223395

SEQ ID NO: 322363 - RNA, 64 nt, Homo Sapiens; identical to SEQ ID NO: 223396

SEQ ID NO: 322364 - RNA, 64 nt, Homo Sapiens; identical to SEQ ID NO: 223397

SEQ ID NO: 322365 - RNA, 64 nt, Homo Sapiens; identical to SEQ ID NO: 223398

SEQ ID NO: 322366 - RNA, 64 nt, Homo Sapiens; identical to SEQ ID NO: 223399

SEQ ID NO: 322367 - RNA, 64 nt, Homo Sapiens; identical to SEQ ID NO: 223400

SEQ ID NO: 322368 - RNA, 64 nt, Homo Sapiens; identical to SEQ ID NO: 223401

SEQ ID NO: 322369 - RNA, 64 nt, Homo Sapiens; identical to SEQ ID NO: 223402

SEQ ID NO: 322370 - RNA, 56 nt, Homo Sapiens; identical to SEQ ID NO: 223403

SEQ ID NO: 322371 - RNA, 51 nt, Homo Sapiens; identical to SEQ ID NO: 223404

SEQ ID NO: 322372 - RNA, 64 nt, Homo Sapiens; identical to SEQ ID NO: 223405

SEQ ID NO: 322373 - RNA, 64 nt, Homo Sapiens; identical to SEQ ID NO: 223406

SEQ ID NO: 322374 - RNA, 64 nt, Homo Sapiens; identical to SEQ ID NO: 223407

SEQ ID NO: 322375 - RNA, 64 nt, Homo Sapiens; identical to SEQ ID NO: 223408

SEQ ID NO: 322376 - RNA, 64 nt, Homo Sapiens; identical to SEQ ID NO: 223409

SEQ ID NO: 322377 - RNA, 64 nt, Homo Sapiens; identical to SEQ ID NO: 223410

SEQ ID NO: 322378 - RNA, 64 nt, Homo Sapiens; identical to SEQ ID NO: 223411

SEQ ID NO: 322379 - RNA, 64 nt, Homo Sapiens; identical to SEQ ID NO: 223412

SEQ ID NO: 322380 - RNA, 64 nt, Homo Sapiens; identical to SEQ ID NO: 223413

SEQ ID NO: 322381 - RNA, 64 nt, Homo Sapiens; identical to SEQ ID NO: 223414

SEQ ID NO: 322382 - RNA, 64 nt, Homo Sapiens; identical to SEQ ID NO: 223415

SEQ ID NO: 322383 - RNA, 64 nt, Homo Sapiens; identical to SEQ ID NO: 223416

SEQ ID NO: 322384 - RNA, 64 nt, Homo Sapiens; identical to SEQ ID NO: 223417

SEQ ID NO: 322385 - RNA, 64 nt, Homo Sapiens; identical to SEQ ID NO: 223418

SEQ ID NO: 322386 - RNA, 64 nt, Homo Sapiens; identical to SEQ ID NO: 223419

SEQ ID NO: 322387 - RNA, 64 nt, Homo Sapiens; identical to SEQ ID NO: 223420

SEQ ID NO: 322388 - RNA, 64 nt, Homo Sapiens; identical to SEQ ID NO: 223421

SEQ ID NO: 322389 - RNA, 64 nt, Homo Sapiens; identical to SEQ ID NO: 223422

SEQ ID NO: 322390 - RNA, 64 nt, Homo Sapiens; identical to SEQ ID NO: 223423

SEQ ID NO: 322391 - RNA, 64 nt, Homo Sapiens; identical to SEQ ID NO: 223424

SEQ ID NO: 322392 - RNA, 64 nt, Homo Sapiens; identical to SEQ ID NO: 223425

SEQ ID NO: 322393 - RNA, 64 nt, Homo Sapiens; identical to SEQ ID NO: 223426

SEQ ID NO: 322394 - RNA, 64 nt, Homo Sapiens; identical to SEQ ID NO: 223427

SEQ ID NO: 322395 - RNA, 64 nt, Homo Sapiens; identical to SEQ ID NO: 223428

SEQ ID NO: 322396 - RNA, 64 nt, Homo Sapiens; identical to SEQ ID NO: 223429

SEQ ID NO: 322397 - RNA, 64 nt, Homo Sapiens; identical to SEQ ID NO: 223430

SEQ ID NO: 322398 - RNA, 64 nt, Homo Sapiens; identical to SEQ ID NO: 223431

SEQ ID NO: 322399 - RNA, 64 nt, Homo Sapiens; identical to SEQ ID NO: 223432

SEQ ID NO: 322400 - RNA, 64 nt, Homo Sapiens; identical to SEQ ID NO: 223433

SEQ ID NO: 322401 - RNA, 64 nt, Homo Sapiens; identical to SEQ ID NO: 223434

SEQ ID NO: 322402 - RNA, 64 nt, Homo Sapiens; identical to SEQ ID NO: 223435

SEQ ID NO: 322403 - RNA, 64 nt, Homo Sapiens; identical to SEQ ID NO: 223436

SEQ ID NO: 322404 - RNA, 64 nt, Homo Sapiens; identical to SEQ ID NO: 223437

SEQ ID NO: 322405 - RNA, 64 nt, Homo Sapiens; identical to SEQ ID NO: 223438

SEQ ID NO: 322406 - RNA, 64 nt, Homo Sapiens; identical to SEQ ID NO: 223439

SEQ ID NO: 322407 - RNA, 64 nt, Homo Sapiens; identical to SEQ ID NO: 223440

SEQ ID NO: 322408 - RNA, 64 nt, Homo Sapiens; identical to SEQ ID NO: 223441

SEQ ID NO: 322409 - RNA, 64 nt, Homo Sapiens; identical to SEQ ID NO: 223442

SEQ ID NO: 322410 - RNA, 64 nt, Homo Sapiens; identical to SEQ ID NO: 223443

SEQ ID NO: 322411 - RNA, 64 nt, Homo Sapiens; identical to SEQ ID NO: 223444

SEQ ID NO: 322412 - RNA, 64 nt, Homo Sapiens; identical to SEQ ID NO: 223445

SEQ ID NO: 322413 - RNA, 64 nt, Homo Sapiens; identical to SEQ ID NO: 223446

SEQ ID NO: 322414 - RNA, 64 nt, Homo Sapiens; identical to SEQ ID NO: 223447

SEQ ID NO: 322415 - RNA, 64 nt, Homo Sapiens; identical to SEQ ID NO: 223448

SEQ ID NO: 322416 - RNA, 64 nt, Homo Sapiens; identical to SEQ ID NO: 223449

SEQ ID NO: 322417 - RNA, 64 nt, Homo Sapiens; identical to SEQ ID NO: 223450

SEQ ID NO: 322418 - RNA, 64 nt, Homo Sapiens; identical to SEQ ID NO: 223451

SEQ ID NO: 322419 - RNA, 64 nt, Homo Sapiens; identical to SEQ ID NO: 223452

SEQ ID NO: 322420 - RNA, 64 nt, Homo Sapiens; identical to SEQ ID NO: 223453

SEQ ID NO: 322421 - RNA, 64 nt, Homo Sapiens; identical to SEQ ID NO: 223454

SEQ ID NO: 322422 - RNA, 64 nt, Homo Sapiens; identical to SEQ ID NO: 223455

SEQ ID NO: 322423 - RNA, 64 nt, Homo Sapiens; identical to SEQ ID NO: 223456

SEQ ID NO: 322424 - RNA, 64 nt, Homo Sapiens; identical to SEQ ID NO: 223457

SEQ ID NO: 322425 - RNA, 64 nt, Homo Sapiens; identical to SEQ ID NO: 223458

SEQ ID NO: 322426 - RNA, 64 nt, Homo Sapiens
aucaaaauuacaaauuuucuaauccauucaggugacaacccaucgugaaguaauuuaaaauaua

SEQ ID NO: 322427 - RNA, 64 nt, Homo Sapiens
gauguucagcauccuguaucauccccuuggaaagacaacccagaauacaguggaccuggagacc

SEQ ID NO: 322428 - RNA, 64 nt, Homo Sapiens
uaucuuauuagucuugugccauuuuaagaguaauacaacccaucagcuagaggagaagucuuag

SEQ ID NO: 322429 - RNA, 64 nt, Homo Sapiens
gcuuauuuucuucugacuucgaccacuauuuucaacaacccagguuugauaaaguaaauauuuu

SEQ ID NO: 322430 - RNA, 64 nt, Homo Sapiens
gaagaguucuaccauagcaaauuuuuuuuaagaaacaacccaguuccuccugucaguugcguga

SEQ ID NO: 322431 - RNA, 64 nt, Homo Sapiens
gguaaacuauuauuccaguaucucauucugugguacaacccagguuguauaaucuuguagaauu

SEQ ID NO: 322432 - RNA, 64 nt, Homo Sapiens; identical to SEQ ID NO: 78937

SEQ ID NO: 322433 - RNA, 64 nt, Homo Sapiens; identical to SEQ ID NO: 78938

SEQ ID NO: 322434 - RNA, 64 nt, Homo Sapiens; identical to SEQ ID NO: 78939

SEQ ID NO: 322435 - RNA, 64 nt, Homo Sapiens; identical to SEQ ID NO: 78940

SEQ ID NO: 322436 - RNA, 64 nt, Homo Sapiens; identical to SEQ ID NO: 78941

SEQ ID NO: 322437 - RNA, 64 nt, Homo Sapiens; identical to SEQ ID NO: 78942

SEQ ID NO: 322438 - RNA, 64 nt, Homo Sapiens; identical to SEQ ID NO: 78943

SEQ ID NO: 322439 - RNA, 64 nt, Homo Sapiens; identical to SEQ ID NO: 78944

SEQ ID NO: 322440 - RNA, 64 nt, Homo Sapiens; identical to SEQ ID NO: 78945

SEQ ID NO: 322441 - RNA, 64 nt, Homo Sapiens; identical to SEQ ID NO: 78946

SEQ ID NO: 322442 - RNA, 64 nt, Homo Sapiens; identical to SEQ ID NO: 78947

SEQ ID NO: 322443 - RNA, 64 nt, Homo Sapiens; identical to SEQ ID NO: 78948

SEQ ID NO: 322444 - RNA, 64 nt, Homo Sapiens; identical to SEQ ID NO: 78949

SEQ ID NO: 322445 - RNA, 64 nt, Homo Sapiens; identical to SEQ ID NO: 78950

SEQ ID NO: 322446 - RNA, 64 nt, Homo Sapiens; identical to SEQ ID NO: 78951

SEQ ID NO: 322447 - RNA, 64 nt, Homo Sapiens; identical to SEQ ID NO: 78952

SEQ ID NO: 322448 - RNA, 64 nt, Homo Sapiens; identical to SEQ ID NO: 78953

SEQ ID NO: 322449 - RNA, 64 nt, Homo Sapiens; identical to SEQ ID NO: 78954

SEQ ID NO: 322450 - RNA, 64 nt, Homo Sapiens; identical to SEQ ID NO: 78955

SEQ ID NO: 322451 - RNA, 64 nt, Homo Sapiens; identical to SEQ ID NO: 78956

SEQ ID NO: 322452 - RNA, 64 nt, Homo Sapiens; identical to SEQ ID NO: 78957

SEQ ID NO: 322453 - RNA, 64 nt, Homo Sapiens; identical to SEQ ID NO: 78958

SEQ ID NO: 322454 - RNA, 64 nt, Homo Sapiens; identical to SEQ ID NO: 78959

SEQ ID NO: 322455 - RNA, 64 nt, Homo Sapiens; identical to SEQ ID NO: 78960

SEQ ID NO: 322456 - RNA, 64 nt, Homo Sapiens; identical to SEQ ID NO: 78961

SEQ ID NO: 322457 - RNA, 64 nt, Homo Sapiens; identical to SEQ ID NO: 78962

SEQ ID NO: 322458 - RNA, 64 nt, Homo Sapiens; identical to SEQ ID NO: 78963

SEQ ID NO: 322459 - RNA, 64 nt, Homo Sapiens; identical to SEQ ID NO: 78964

SEQ ID NO: 322460 - RNA, 64 nt, Homo Sapiens; identical to SEQ ID NO: 78965

SEQ ID NO: 322461 - RNA, 64 nt, Homo Sapiens; identical to SEQ ID NO: 78966

SEQ ID NO: 322462 - RNA, 64 nt, Homo Sapiens; identical to SEQ ID NO: 78967

SEQ ID NO: 322463 - RNA, 64 nt, Homo Sapiens; identical to SEQ ID NO: 78968

SEQ ID NO: 322464 - RNA, 64 nt, Homo Sapiens; identical to SEQ ID NO: 78969

SEQ ID NO: 322465 - RNA, 64 nt, Homo Sapiens; identical to SEQ ID NO: 78970

SEQ ID NO: 322466 - RNA, 64 nt, Homo Sapiens; identical to SEQ ID NO: 78971

SEQ ID NO: 322467 - RNA, 64 nt, Homo Sapiens; identical to SEQ ID NO: 78972

SEQ ID NO: 322468 - RNA, 64 nt, Homo Sapiens; identical to SEQ ID NO: 78973

SEQ ID NO: 322469 - RNA, 64 nt, Homo Sapiens; identical to SEQ ID NO: 78974

SEQ ID NO: 322470 - RNA, 64 nt, Homo Sapiens; identical to SEQ ID NO: 78975

SEQ ID NO: 322471 - RNA, 64 nt, Homo Sapiens; identical to SEQ ID NO: 78976

SEQ ID NO: 322472 - RNA, 64 nt, Homo Sapiens; identical to SEQ ID NO: 78977

SEQ ID NO: 322473 - RNA, 64 nt, Homo Sapiens; identical to SEQ ID NO: 78978

SEQ ID NO: 322474 - RNA, 64 nt, Homo Sapiens; identical to SEQ ID NO: 78979

SEQ ID NO: 322475 - RNA, 64 nt, Homo Sapiens; identical to SEQ ID NO: 78980

SEQ ID NO: 322476 - RNA, 64 nt, Homo Sapiens; identical to SEQ ID NO: 78981

SEQ ID NO: 322477 - RNA, 64 nt, Homo Sapiens; identical to SEQ ID NO: 78982

SEQ ID NO: 322478 - RNA, 64 nt, Homo Sapiens; identical to SEQ ID NO: 78983

SEQ ID NO: 322479 - RNA, 64 nt, Homo Sapiens; identical to SEQ ID NO: 78984

SEQ ID NO: 322480 - RNA, 64 nt, Homo Sapiens; identical to SEQ ID NO: 78985

SEQ ID NO: 322481 - RNA, 64 nt, Homo Sapiens; identical to SEQ ID NO: 78986

SEQ ID NO: 322482 - RNA, 64 nt, Homo Sapiens; identical to SEQ ID NO: 78987

SEQ ID NO: 322483 - RNA, 64 nt, Homo Sapiens; identical to SEQ ID NO: 78988

SEQ ID NO: 322484 - RNA, 64 nt, Homo Sapiens; identical to SEQ ID NO: 78989

SEQ ID NO: 322485 - RNA, 64 nt, Homo Sapiens; identical to SEQ ID NO: 78990

SEQ ID NO: 322486 - RNA, 64 nt, Homo Sapiens; identical to SEQ ID NO: 78991

SEQ ID NO: 322487 - RNA, 64 nt, Homo Sapiens; identical to SEQ ID NO: 78992

SEQ ID NO: 322488 - RNA, 64 nt, Homo Sapiens; identical to SEQ ID NO: 78993

SEQ ID NO: 322489 - RNA, 64 nt, Homo Sapiens; identical to SEQ ID NO: 78994

SEQ ID NO: 322490 - RNA, 64 nt, Homo Sapiens; identical to SEQ ID NO: 78995

SEQ ID NO: 322491 - RNA, 64 nt, Homo Sapiens; identical to SEQ ID NO: 78996

SEQ ID NO: 322492 - RNA, 64 nt, Homo Sapiens; identical to SEQ ID NO: 78997

SEQ ID NO: 322493 - RNA, 64 nt, Homo Sapiens; identical to SEQ ID NO: 78998

SEQ ID NO: 322494 - RNA, 64 nt, Homo Sapiens; identical to SEQ ID NO: 78999

SEQ ID NO: 322495 - RNA, 64 nt, Homo Sapiens; identical to SEQ ID NO: 79000

SEQ ID NO: 322496 - RNA, 64 nt, Homo Sapiens; identical to SEQ ID NO: 79001

SEQ ID NO: 322497 - RNA, 64 nt, Homo Sapiens; identical to SEQ ID NO: 79002

SEQ ID NO: 322498 - RNA, 64 nt, Homo Sapiens; identical to SEQ ID NO: 79003

SEQ ID NO: 322499 - RNA, 64 nt, Homo Sapiens; identical to SEQ ID NO: 79004

SEQ ID NO: 322500 - RNA, 64 nt, Homo Sapiens; identical to SEQ ID NO: 79005

SEQ ID NO: 322501 - RNA, 64 nt, Homo Sapiens; identical to SEQ ID NO: 79006

SEQ ID NO: 322502 - RNA, 64 nt, Homo Sapiens; identical to SEQ ID NO: 79007

SEQ ID NO: 322503 - RNA, 64 nt, Homo Sapiens; identical to SEQ ID NO: 79008

SEQ ID NO: 322504 - RNA, 64 nt, Homo Sapiens; identical to SEQ ID NO: 79009

SEQ ID NO: 322505 - RNA, 64 nt, Homo Sapiens; identical to SEQ ID NO: 79010

SEQ ID NO: 322506 - RNA, 64 nt, Homo Sapiens; identical to SEQ ID NO: 79011

SEQ ID NO: 322507 - RNA, 64 nt, Homo Sapiens; identical to SEQ ID NO: 79012

SEQ ID NO: 322508 - RNA, 64 nt, Homo Sapiens; identical to SEQ ID NO: 79013

SEQ ID NO: 322509 - RNA, 64 nt, Homo Sapiens; identical to SEQ ID NO: 79014

SEQ ID NO: 322510 - RNA, 64 nt, Homo Sapiens; identical to SEQ ID NO: 79015

SEQ ID NO: 322511 - RNA, 64 nt, Homo Sapiens; identical to SEQ ID NO: 79016

SEQ ID NO: 322512 - RNA, 64 nt, Homo Sapiens; identical to SEQ ID NO: 79017

SEQ ID NO: 322513 - RNA, 64 nt, Homo Sapiens; identical to SEQ ID NO: 79018

SEQ ID NO: 322514 - RNA, 64 nt, Homo Sapiens; identical to SEQ ID NO: 79019

SEQ ID NO: 322515 - RNA, 64 nt, Homo Sapiens; identical to SEQ ID NO: 79020

SEQ ID NO: 322516 - RNA, 64 nt, Homo Sapiens; identical to SEQ ID NO: 79021

SEQ ID NO: 322517 - RNA, 64 nt, Homo Sapiens; identical to SEQ ID NO: 79022

SEQ ID NO: 322518 - RNA, 64 nt, Homo Sapiens; identical to SEQ ID NO: 79023

SEQ ID NO: 322519 - RNA, 64 nt, Homo Sapiens; identical to SEQ ID NO: 79024

SEQ ID NO: 322520 - RNA, 64 nt, Homo Sapiens; identical to SEQ ID NO: 79025

SEQ ID NO: 322521 - RNA, 64 nt, Homo Sapiens; identical to SEQ ID NO: 79026

SEQ ID NO: 322522 - RNA, 64 nt, Homo Sapiens; identical to SEQ ID NO: 79027

SEQ ID NO: 322523 - RNA, 64 nt, Homo Sapiens; identical to SEQ ID NO: 79028

SEQ ID NO: 322524 - RNA, 64 nt, Homo Sapiens; identical to SEQ ID NO: 79029

SEQ ID NO: 322525 - RNA, 64 nt, Homo Sapiens; identical to SEQ ID NO: 79030

SEQ ID NO: 322526 - RNA, 64 nt, Homo Sapiens; identical to SEQ ID NO: 79031

SEQ ID NO: 322527 - RNA, 64 nt, Homo Sapiens; identical to SEQ ID NO: 79032

SEQ ID NO: 322528 - RNA, 64 nt, Homo Sapiens; identical to SEQ ID NO: 79033

SEQ ID NO: 322529 - RNA, 64 nt, Homo Sapiens; identical to SEQ ID NO: 79034

SEQ ID NO: 322530 - RNA, 64 nt, Homo Sapiens; identical to SEQ ID NO: 79035

SEQ ID NO: 322531 - RNA, 64 nt, Homo Sapiens; identical to SEQ ID NO: 79036

SEQ ID NO: 322532 - RNA, 64 nt, Homo Sapiens; identical to SEQ ID NO: 79037

SEQ ID NO: 322533 - RNA, 64 nt, Homo Sapiens; identical to SEQ ID NO: 79038

SEQ ID NO: 322534 - RNA, 64 nt, Homo Sapiens; identical to SEQ ID NO: 79039

SEQ ID NO: 322535 - RNA, 64 nt, Homo Sapiens; identical to SEQ ID NO: 79040

SEQ ID NO: 322536 - RNA, 64 nt, Homo Sapiens; identical to SEQ ID NO: 79041

SEQ ID NO: 322537 - RNA, 64 nt, Homo Sapiens; identical to SEQ ID NO: 79042

SEQ ID NO: 322538 - RNA, 64 nt, Homo Sapiens; identical to SEQ ID NO: 79043

SEQ ID NO: 322539 - RNA, 64 nt, Homo Sapiens; identical to SEQ ID NO: 79044

SEQ ID NO: 322540 - RNA, 64 nt, Homo Sapiens; identical to SEQ ID NO: 79045

SEQ ID NO: 322541 - RNA, 64 nt, Homo Sapiens; identical to SEQ ID NO: 79046

SEQ ID NO: 322542 - RNA, 64 nt, Homo Sapiens; identical to SEQ ID NO: 79047

SEQ ID NO: 322543 - RNA, 64 nt, Homo Sapiens; identical to SEQ ID NO: 79048

SEQ ID NO: 322544 - RNA, 64 nt, Homo Sapiens; identical to SEQ ID NO: 79049

SEQ ID NO: 322545 - RNA, 64 nt, Homo Sapiens; identical to SEQ ID NO: 79050

SEQ ID NO: 322546 - RNA, 64 nt, Homo Sapiens; identical to SEQ ID NO: 172495

SEQ ID NO: 322547 - RNA, 64 nt, Homo Sapiens; identical to SEQ ID NO: 172496

SEQ ID NO: 322548 - RNA, 64 nt, Homo Sapiens; identical to SEQ ID NO: 143712

SEQ ID NO: 322549 - RNA, 64 nt, Homo Sapiens; identical to SEQ ID NO: 143713

SEQ ID NO: 322550 - RNA, 64 nt, Homo Sapiens; identical to SEQ ID NO: 143714

SEQ ID NO: 322551 - RNA, 64 nt, Homo Sapiens; identical to SEQ ID NO: 143715

SEQ ID NO: 322552 - RNA, 64 nt, Homo Sapiens; identical to SEQ ID NO: 143716

SEQ ID NO: 322553 - RNA, 64 nt, Homo Sapiens; identical to SEQ ID NO: 143717

SEQ ID NO: 322554 - RNA, 64 nt, Homo Sapiens; identical to SEQ ID NO: 143718

SEQ ID NO: 322555 - RNA, 64 nt, Homo Sapiens; identical to SEQ ID NO: 143719

SEQ ID NO: 322556 - RNA, 64 nt, Homo Sapiens; identical to SEQ ID NO: 143720

SEQ ID NO: 322557 - RNA, 64 nt, Homo Sapiens; identical to SEQ ID NO: 143721

SEQ ID NO: 322558 - RNA, 64 nt, Homo Sapiens; identical to SEQ ID NO: 143722

SEQ ID NO: 322559 - RNA, 64 nt, Homo Sapiens; identical to SEQ ID NO: 143723

SEQ ID NO: 322560 - RNA, 64 nt, Homo Sapiens; identical to SEQ ID NO: 143724

SEQ ID NO: 322561 - RNA, 64 nt, Homo Sapiens; identical to SEQ ID NO: 143725

SEQ ID NO: 322562 - RNA, 64 nt, Homo Sapiens; identical to SEQ ID NO: 143726

SEQ ID NO: 322563 - RNA, 64 nt, Homo Sapiens; identical to SEQ ID NO: 143727

SEQ ID NO: 322564 - RNA, 64 nt, Homo Sapiens; identical to SEQ ID NO: 143728

SEQ ID NO: 322565 - RNA, 64 nt, Homo Sapiens; identical to SEQ ID NO: 143729

SEQ ID NO: 322566 - RNA, 64 nt, Homo Sapiens; identical to SEQ ID NO: 143730

SEQ ID NO: 322567 - RNA, 64 nt, Homo Sapiens; identical to SEQ ID NO: 143731

SEQ ID NO: 322568 - RNA, 64 nt, Homo Sapiens; identical to SEQ ID NO: 143732

SEQ ID NO: 322569 - RNA, 64 nt, Homo Sapiens; identical to SEQ ID NO: 143733

SEQ ID NO: 322570 - RNA, 64 nt, Homo Sapiens; identical to SEQ ID NO: 143734

SEQ ID NO: 322571 - RNA, 64 nt, Homo Sapiens; identical to SEQ ID NO: 143735

SEQ ID NO: 322572 - RNA, 64 nt, Homo Sapiens; identical to SEQ ID NO: 143736

SEQ ID NO: 322573 - RNA, 64 nt, Homo Sapiens; identical to SEQ ID NO: 143737

SEQ ID NO: 322574 - RNA, 64 nt, Homo Sapiens; identical to SEQ ID NO: 143738

SEQ ID NO: 322575 - RNA, 64 nt, Homo Sapiens; identical to SEQ ID NO: 143739

SEQ ID NO: 322576 - RNA, 64 nt, Homo Sapiens; identical to SEQ ID NO: 143740

SEQ ID NO: 322577 - RNA, 64 nt, Homo Sapiens; identical to SEQ ID NO: 143741

SEQ ID NO: 322578 - RNA, 64 nt, Homo Sapiens; identical to SEQ ID NO: 143742

SEQ ID NO: 322579 - RNA, 64 nt, Homo Sapiens; identical to SEQ ID NO: 143743

SEQ ID NO: 322580 - RNA, 64 nt, Homo Sapiens; identical to SEQ ID NO: 143744

SEQ ID NO: 322581 - RNA, 64 nt, Homo Sapiens; identical to SEQ ID NO: 143745

SEQ ID NO: 322582 - RNA, 64 nt, Homo Sapiens; identical to SEQ ID NO: 143746

SEQ ID NO: 322583 - RNA, 64 nt, Homo Sapiens; identical to SEQ ID NO: 143747

SEQ ID NO: 322584 - RNA, 64 nt, Homo Sapiens; identical to SEQ ID NO: 143748

SEQ ID NO: 322585 - RNA, 64 nt, Homo Sapiens; identical to SEQ ID NO: 143749

SEQ ID NO: 322586 - RNA, 64 nt, Homo Sapiens; identical to SEQ ID NO: 143750

SEQ ID NO: 322587 - RNA, 64 nt, Homo Sapiens; identical to SEQ ID NO: 143751

SEQ ID NO: 322588 - RNA, 64 nt, Homo Sapiens; identical to SEQ ID NO: 143752

SEQ ID NO: 322589 - RNA, 64 nt, Homo Sapiens; identical to SEQ ID NO: 143753

SEQ ID NO: 322590 - RNA, 64 nt, Homo Sapiens; identical to SEQ ID NO: 143754

SEQ ID NO: 322591 - RNA, 64 nt, Homo Sapiens; identical to SEQ ID NO: 143755

SEQ ID NO: 322592 - RNA, 64 nt, Homo Sapiens; identical to SEQ ID NO: 143756

SEQ ID NO: 322593 - RNA, 64 nt, Homo Sapiens; identical to SEQ ID NO: 143757

SEQ ID NO: 322594 - RNA, 64 nt, Homo Sapiens; identical to SEQ ID NO: 143758

SEQ ID NO: 322595 - RNA, 64 nt, Homo Sapiens; identical to SEQ ID NO: 143759

SEQ ID NO: 322596 - RNA, 64 nt, Homo Sapiens; identical to SEQ ID NO: 143760

SEQ ID NO: 322597 - RNA, 64 nt, Homo Sapiens; identical to SEQ ID NO: 143761

SEQ ID NO: 322598 - RNA, 64 nt, Homo Sapiens; identical to SEQ ID NO: 143762

SEQ ID NO: 322599 - RNA, 64 nt, Homo Sapiens; identical to SEQ ID NO: 143763

SEQ ID NO: 322600 - RNA, 64 nt, Homo Sapiens; identical to SEQ ID NO: 143764

SEQ ID NO: 322601 - RNA, 64 nt, Homo Sapiens; identical to SEQ ID NO: 143765

SEQ ID NO: 322602 - RNA, 64 nt, Homo Sapiens; identical to SEQ ID NO: 143766

SEQ ID NO: 322603 - RNA, 64 nt, Homo Sapiens; identical to SEQ ID NO: 143767

SEQ ID NO: 322604 - RNA, 64 nt, Homo Sapiens; identical to SEQ ID NO: 143768

SEQ ID NO: 322605 - RNA, 64 nt, Homo Sapiens; identical to SEQ ID NO: 143769

SEQ ID NO: 322606 - RNA, 64 nt, Homo Sapiens; identical to SEQ ID NO: 143770

SEQ ID NO: 322607 - RNA, 64 nt, Homo Sapiens; identical to SEQ ID NO: 143771

SEQ ID NO: 322608 - RNA, 64 nt, Homo Sapiens; identical to SEQ ID NO: 143772

SEQ ID NO: 322609 - RNA, 64 nt, Homo Sapiens; identical to SEQ ID NO: 143773

SEQ ID NO: 322610 - RNA, 64 nt, Homo Sapiens; identical to SEQ ID NO: 143774

SEQ ID NO: 322611 - RNA, 64 nt, Homo Sapiens; identical to SEQ ID NO: 143775

SEQ ID NO: 322612 - RNA, 64 nt, Homo Sapiens; identical to SEQ ID NO: 143776

SEQ ID NO: 322613 - RNA, 64 nt, Homo Sapiens; identical to SEQ ID NO: 143777

SEQ ID NO: 322614 - RNA, 64 nt, Homo Sapiens; identical to SEQ ID NO: 143778

SEQ ID NO: 322615 - RNA, 64 nt, Homo Sapiens; identical to SEQ ID NO: 143779

SEQ ID NO: 322616 - RNA, 64 nt, Homo Sapiens; identical to SEQ ID NO: 143780

SEQ ID NO: 322617 - RNA, 64 nt, Homo Sapiens; identical to SEQ ID NO: 143781

SEQ ID NO: 322618 - RNA, 64 nt, Homo Sapiens; identical to SEQ ID NO: 143782

SEQ ID NO: 322619 - RNA, 64 nt, Homo Sapiens; identical to SEQ ID NO: 143783

SEQ ID NO: 322620 - RNA, 64 nt, Homo Sapiens; identical to SEQ ID NO: 143784

SEQ ID NO: 322621 - RNA, 64 nt, Homo Sapiens; identical to SEQ ID NO: 143785

SEQ ID NO: 322622 - RNA, 64 nt, Homo Sapiens; identical to SEQ ID NO: 143786

SEQ ID NO: 322623 - RNA, 64 nt, Homo Sapiens; identical to SEQ ID NO: 143787

SEQ ID NO: 322624 - RNA, 64 nt, Homo Sapiens; identical to SEQ ID NO: 143788

SEQ ID NO: 322625 - RNA, 64 nt, Homo Sapiens; identical to SEQ ID NO: 143789

SEQ ID NO: 322626 - RNA, 57 nt, Homo Sapiens; identical to SEQ ID NO: 143790

SEQ ID NO: 322627 - RNA, 64 nt, Homo Sapiens; identical to SEQ ID NO: 143791

SEQ ID NO: 322628 - RNA, 64 nt, Homo Sapiens; identical to SEQ ID NO: 143792

SEQ ID NO: 322629 - RNA, 64 nt, Homo Sapiens; identical to SEQ ID NO: 143793

SEQ ID NO: 322630 - RNA, 64 nt, Homo Sapiens; identical to SEQ ID NO: 143794

SEQ ID NO: 322631 - RNA, 64 nt, Homo Sapiens; identical to SEQ ID NO: 143795

SEQ ID NO: 322632 - RNA, 64 nt, Homo Sapiens; identical to SEQ ID NO: 143796

SEQ ID NO: 322633 - RNA, 64 nt, Homo Sapiens; identical to SEQ ID NO: 143797

SEQ ID NO: 322634 - RNA, 64 nt, Homo Sapiens; identical to SEQ ID NO: 143798

SEQ ID NO: 322635 - RNA, 64 nt, Homo Sapiens; identical to SEQ ID NO: 143799

SEQ ID NO: 322636 - RNA, 64 nt, Homo Sapiens; identical to SEQ ID NO: 143800

SEQ ID NO: 322637 - RNA, 64 nt, Homo Sapiens; identical to SEQ ID NO: 143801

SEQ ID NO: 322638 - RNA, 64 nt, Homo Sapiens; identical to SEQ ID NO: 143802

SEQ ID NO: 322639 - RNA, 64 nt, Homo Sapiens; identical to SEQ ID NO: 143803

SEQ ID NO: 322640 - RNA, 64 nt, Homo Sapiens; identical to SEQ ID NO: 143804

SEQ ID NO: 322641 - RNA, 64 nt, Homo Sapiens; identical to SEQ ID NO: 143805

SEQ ID NO: 322642 - RNA, 64 nt, Homo Sapiens; identical to SEQ ID NO: 143806

SEQ ID NO: 322643 - RNA, 64 nt, Homo Sapiens; identical to SEQ ID NO: 143807

SEQ ID NO: 322644 - RNA, 64 nt, Homo Sapiens; identical to SEQ ID NO: 143808

SEQ ID NO: 322645 - RNA, 64 nt, Homo Sapiens; identical to SEQ ID NO: 143809

SEQ ID NO: 322646 - RNA, 64 nt, Homo Sapiens; identical to SEQ ID NO: 143810

SEQ ID NO: 322647 - RNA, 64 nt, Homo Sapiens; identical to SEQ ID NO: 143811

SEQ ID NO: 322648 - RNA, 64 nt, Homo Sapiens; identical to SEQ ID NO: 143812

SEQ ID NO: 322649 - RNA, 64 nt, Homo Sapiens; identical to SEQ ID NO: 161026

SEQ ID NO: 322650 - RNA, 64 nt, Homo Sapiens; identical to SEQ ID NO: 161027

SEQ ID NO: 322651 - RNA, 64 nt, Homo Sapiens; identical to SEQ ID NO: 161028

SEQ ID NO: 322652 - RNA, 64 nt, Homo Sapiens; identical to SEQ ID NO: 161029

SEQ ID NO: 322653 - RNA, 64 nt, Homo Sapiens; identical to SEQ ID NO: 161030

SEQ ID NO: 322654 - RNA, 64 nt, Homo Sapiens; identical to SEQ ID NO: 161031

SEQ ID NO: 322655 - RNA, 64 nt, Homo Sapiens; identical to SEQ ID NO: 161032

SEQ ID NO: 322656 - RNA, 64 nt, Homo Sapiens; identical to SEQ ID NO: 161033

SEQ ID NO: 322657 - RNA, 64 nt, Homo Sapiens; identical to SEQ ID NO: 161034

SEQ ID NO: 322658 - RNA, 50 nt, Homo Sapiens; identical to SEQ ID NO: 161035

SEQ ID NO: 322659 - RNA, 64 nt, Homo Sapiens; identical to SEQ ID NO: 161036

SEQ ID NO: 322660 - RNA, 64 nt, Homo Sapiens; identical to SEQ ID NO: 161037

SEQ ID NO: 322661 - RNA, 64 nt, Homo Sapiens; identical to SEQ ID NO: 161038

SEQ ID NO: 322662 - RNA, 64 nt, Homo Sapiens; identical to SEQ ID NO: 161039

SEQ ID NO: 322663 - RNA, 64 nt, Homo Sapiens; identical to SEQ ID NO: 161040

SEQ ID NO: 322664 - RNA, 64 nt, Homo Sapiens; identical to SEQ ID NO: 161041

SEQ ID NO: 322665 - RNA, 64 nt, Homo Sapiens; identical to SEQ ID NO: 161042

SEQ ID NO: 322666 - RNA, 64 nt, Homo Sapiens; identical to SEQ ID NO: 161043

SEQ ID NO: 322667 - RNA, 64 nt, Homo Sapiens; identical to SEQ ID NO: 161044

SEQ ID NO: 322668 - RNA, 64 nt, Homo Sapiens; identical to SEQ ID NO: 161045

SEQ ID NO: 322669 - RNA, 64 nt, Homo Sapiens; identical to SEQ ID NO: 161046

SEQ ID NO: 322670 - RNA, 64 nt, Homo Sapiens; identical to SEQ ID NO: 161047

SEQ ID NO: 322671 - RNA, 64 nt, Homo Sapiens; identical to SEQ ID NO: 72441

SEQ ID NO: 322672 - RNA, 64 nt, Homo Sapiens; identical to SEQ ID NO: 72442

SEQ ID NO: 322673 - RNA, 64 nt, Homo Sapiens; identical to SEQ ID NO: 72443

SEQ ID NO: 322674 - RNA, 64 nt, Homo Sapiens; identical to SEQ ID NO: 72444

SEQ ID NO: 322675 - RNA, 64 nt, Homo Sapiens; identical to SEQ ID NO: 72445

SEQ ID NO: 322676 - RNA, 64 nt, Homo Sapiens; identical to SEQ ID NO: 72446

SEQ ID NO: 322677 - RNA, 64 nt, Homo Sapiens; identical to SEQ ID NO: 72447

SEQ ID NO: 322678 - RNA, 64 nt, Homo Sapiens; identical to SEQ ID NO: 72448

SEQ ID NO: 322679 - RNA, 64 nt, Homo Sapiens; identical to SEQ ID NO: 72449

SEQ ID NO: 322680 - RNA, 64 nt, Homo Sapiens; identical to SEQ ID NO: 72450

SEQ ID NO: 322681 - RNA, 64 nt, Homo Sapiens; identical to SEQ ID NO: 72451

SEQ ID NO: 322682 - RNA, 64 nt, Homo Sapiens; identical to SEQ ID NO: 72452

SEQ ID NO: 322683 - RNA, 64 nt, Homo Sapiens; identical to SEQ ID NO: 72453

SEQ ID NO: 322684 - RNA, 64 nt, Homo Sapiens; identical to SEQ ID NO: 72454

SEQ ID NO: 322685 - RNA, 64 nt, Homo Sapiens; identical to SEQ ID NO: 72455

SEQ ID NO: 322686 - RNA, 64 nt, Homo Sapiens; identical to SEQ ID NO: 72456

SEQ ID NO: 322687 - RNA, 64 nt, Homo Sapiens; identical to SEQ ID NO: 72457

SEQ ID NO: 322688 - RNA, 64 nt, Homo Sapiens; identical to SEQ ID NO: 72458

SEQ ID NO: 322689 - RNA, 64 nt, Homo Sapiens; identical to SEQ ID NO: 72459

SEQ ID NO: 322690 - RNA, 64 nt, Homo Sapiens; identical to SEQ ID NO: 72460

SEQ ID NO: 322691 - RNA, 64 nt, Homo Sapiens; identical to SEQ ID NO: 72461

SEQ ID NO: 322692 - RNA, 64 nt, Homo Sapiens; identical to SEQ ID NO: 72462

SEQ ID NO: 322693 - RNA, 64 nt, Homo Sapiens; identical to SEQ ID NO: 72463

SEQ ID NO: 322694 - RNA, 64 nt, Homo Sapiens; identical to SEQ ID NO: 72464

SEQ ID NO: 322695 - RNA, 64 nt, Homo Sapiens; identical to SEQ ID NO: 72465

SEQ ID NO: 322696 - RNA, 64 nt, Homo Sapiens; identical to SEQ ID NO: 72466

SEQ ID NO: 322697 - RNA, 64 nt, Homo Sapiens; identical to SEQ ID NO: 72467

SEQ ID NO: 322698 - RNA, 64 nt, Homo Sapiens; identical to SEQ ID NO: 72468

SEQ ID NO: 322699 - RNA, 64 nt, Homo Sapiens; identical to SEQ ID NO: 72469

SEQ ID NO: 322700 - RNA, 64 nt, Homo Sapiens; identical to SEQ ID NO: 72470

SEQ ID NO: 322701 - RNA, 64 nt, Homo Sapiens; identical to SEQ ID NO: 72471

SEQ ID NO: 322702 - RNA, 64 nt, Homo Sapiens; identical to SEQ ID NO: 72472

SEQ ID NO: 322703 - RNA, 64 nt, Homo Sapiens; identical to SEQ ID NO: 72473

SEQ ID NO: 322704 - RNA, 64 nt, Homo Sapiens; identical to SEQ ID NO: 72474

SEQ ID NO: 322705 - RNA, 64 nt, Homo Sapiens; identical to SEQ ID NO: 72475

SEQ ID NO: 322706 - RNA, 64 nt, Homo Sapiens; identical to SEQ ID NO: 72476

SEQ ID NO: 322707 - RNA, 64 nt, Homo Sapiens; identical to SEQ ID NO: 72477

SEQ ID NO: 322708 - RNA, 64 nt, Homo Sapiens; identical to SEQ ID NO: 72478

SEQ ID NO: 322709 - RNA, 64 nt, Homo Sapiens; identical to SEQ ID NO: 72479

SEQ ID NO: 322710 - RNA, 64 nt, Homo Sapiens; identical to SEQ ID NO: 72480

SEQ ID NO: 322711 - RNA, 64 nt, Homo Sapiens; identical to SEQ ID NO: 72481

SEQ ID NO: 322712 - RNA, 64 nt, Homo Sapiens; identical to SEQ ID NO: 72482

SEQ ID NO: 322713 - RNA, 64 nt, Homo Sapiens; identical to SEQ ID NO: 72483

SEQ ID NO: 322714 - RNA, 64 nt, Homo Sapiens; identical to SEQ ID NO: 72484

SEQ ID NO: 322715 - RNA, 64 nt, Homo Sapiens; identical to SEQ ID NO: 72485

SEQ ID NO: 322716 - RNA, 64 nt, Homo Sapiens; identical to SEQ ID NO: 72486

SEQ ID NO: 322717 - RNA, 64 nt, Homo Sapiens; identical to SEQ ID NO: 72487

SEQ ID NO: 322718 - RNA, 64 nt, Homo Sapiens; identical to SEQ ID NO: 72488

SEQ ID NO: 322719 - RNA, 64 nt, Homo Sapiens; identical to SEQ ID NO: 72489

SEQ ID NO: 322720 - RNA, 64 nt, Homo Sapiens; identical to SEQ ID NO: 72490

SEQ ID NO: 322721 - RNA, 64 nt, Homo Sapiens; identical to SEQ ID NO: 72491

SEQ ID NO: 322722 - RNA, 64 nt, Homo Sapiens; identical to SEQ ID NO: 72492

SEQ ID NO: 322723 - RNA, 64 nt, Homo Sapiens; identical to SEQ ID NO: 72493

SEQ ID NO: 322724 - RNA, 62 nt, Homo Sapiens
acggugaccucuccgcuugccaaaauaaccgaaggaaagaccguucaccagacuuggcuccu

SEQ ID NO: 322725 - RNA, 62 nt, Homo Sapiens
gccaguuuuauaacauucacuuucugccucugaggaaagauacagggaacaaaaaucaauuu

SEQ ID NO: 322726 - RNA, 62 nt, Homo Sapiens
gcauuacuaccacagauagaaggaagcaguggaggaaagaauauuuuuaacacuaaaauuca

SEQ ID NO: 322727 - RNA, 62 nt, Homo Sapiens
uucugauucuaggcagaggagaagugugcuugaggaaagaaaucuuuuggaggguuccucau

SEQ ID NO: 322728 - RNA, 62 nt, Homo Sapiens
acauuuuucuuaauauccuuuuuugaauggggaggaaagaagcacaguagaagaauggcugc

SEQ ID NO: 322729 - RNA, 62 nt, Homo Sapiens
uuccuucuuuuguuucuccauauacauuggauaggaaagaaugagugcauuagucugaagag

SEQ ID NO: 322730 - RNA, 62 nt, Homo Sapiens
cagcuuagagaaaauguggaggugaacauuccaggaaagaaguggcaggacacagagaggua

SEQ ID NO: 322731 - RNA, 62 nt, Homo Sapiens
aaccaggaacuaguuucaauuuuuggggccucaggaaagaaaaugcuaugcuggauaugaac

SEQ ID NO: 322732 - RNA, 62 nt, Homo Sapiens
ugccccaaagugagaacuugcucuacguggucaggaaagagcagggagaccaagcagagucg

SEQ ID NO: 322733 - RNA, 62 nt, Homo Sapiens
augaugacauuaagguuuuuggccugaauagcaggaaagauggaguuaccaguuacugaaau

SEQ ID NO: 322734 - RNA, 62 nt, Homo Sapiens
ugaucaaaaucaauuaaaauagucucuuuaaaaggaaagaaaacaucuuuaaggggaggaac

SEQ ID NO: 322735 - RNA, 62 nt, Homo Sapiens
aguccaucugcgugugugcagggagacuggguaggaaagaggaagcaaauagaagagagagg

SEQ ID NO: 322736 - RNA, 62 nt, Homo Sapiens
aaaaaccccacaaucuaggaugggaacaaggaaggaaagaugugaauaggcugaugggcaaa

SEQ ID NO: 322737 - RNA, 62 nt, Homo Sapiens
gaugagaacaagcuauuugggcacaacacaucaggaaagagagcaccacgugauggaguuuc

SEQ ID NO: 322738 - RNA, 62 nt, Homo Sapiens
ucugugguagacauguccuuaauuuaaaugugaggaaagauaacuguaggaagaaauggaau

SEQ ID NO: 322739 - RNA, 62 nt, Homo Sapiens
uggaugaaguugaagagaaauuugagccaucuaggaaagauacauuaguggaggauagugcu

SEQ ID NO: 322740 - RNA, 62 nt, Homo Sapiens
aaauggcauggggaauauaugcaggcaauuugaggaaagaaguuugauuucuuauuucuugg

SEQ ID NO: 322741 - RNA, 62 nt, Homo Sapiens
uuccaugucaucagagauggaggccauucuaaaggaaagauggugaaccacuauguaauauu

SEQ ID NO: 322742 - RNA, 62 nt, Homo Sapiens
auauuguuucuuuagucucaaaacaagagacuaggaaagauccaaaacacagagcaggaguc

SEQ ID NO: 322743 - RNA, 62 nt, Homo Sapiens
caaggcuaguuccugcaccacccaggauucaaaggaaagacgaagggagcagaacuuguggc

SEQ ID NO: 322744 - RNA, 62 nt, Homo Sapiens
caacagugggcuuaagggugucugagcaggagaggaaagauaagcucuucguggugcccacg

SEQ ID NO: 322745 - RNA, 62 nt, Homo Sapiens
ggccucuuugauacacuuuugcuugccuccccaggaaagaaggaauugcauccaagguauac

SEQ ID NO: 322746 - RNA, 62 nt, Homo Sapiens
agccugagaucaauaagaaauguucaggagagaggaaagaaaaaaaauauaugcuccacaau

SEQ ID NO: 322747 - RNA, 62 nt, Homo Sapiens
guccagcaacugaaccugccauuaccugggcaaggaaagaucccuuugcucuaggaaagcuu

SEQ ID NO: 322748 - RNA, 62 nt, Homo Sapiens
gcuuauguaaccauuuuaaacgugguuucuauaggaaagaccaacauuuguuuagcuugcuu

SEQ ID NO: 322749 - RNA, 62 nt, Homo Sapiens
gcagucggacucuaccuuaaggagggaugggaaggaaagaguugaguugguuucuuucugau

SEQ ID NO: 322750 - RNA, 62 nt, Homo Sapiens
gauuuguuaaaacgguuaggacuguuuuguccaggaaagauaagaggaccaaacauauaagg

SEQ ID NO: 322751 - RNA, 62 nt, Homo Sapiens
auuagguauaaaaccuacugcaacuuagaaaaaggaaagaaaaaagaaaacuuuuccaacug

SEQ ID NO: 322752 - RNA, 62 nt, Homo Sapiens
aguuacuauuccugagaaaugaaauaccagguaggaaagaagguuacucaguaaacaaaaga

SEQ ID NO: 322753 - RNA, 62 nt, Homo Sapiens
uacccauuacauaguuacucauuacugaauauaggaaagagauuacaccugugugcaccugu

SEQ ID NO: 322754 - RNA, 62 nt, Homo Sapiens
gauguuggauuugcaccauuuggaguuucuuuaggaaagaaaaguuuucugcuuuuuuauag

SEQ ID NO: 322755 - RNA, 62 nt, Homo Sapiens
auagcuggaauacugaguucaguucagaaggcaggaaagacagucacaccgacguguccuga

SEQ ID NO: 322756 - RNA, 62 nt, Homo Sapiens
ucuugugagacuuacuaucacgagaauagcacaggaaagacuggcccccaugauucaauuac

SEQ ID NO: 322757 - RNA, 62 nt, Homo Sapiens
ucucaugagacuuacuaucaugagaauagcacaggaaagacuggccccccugauucgaugac

SEQ ID NO: 322758 - RNA, 62 nt, Homo Sapiens
uaauacaaauuggcuuucaaagugauaaguugaggaaagaaauguuggcauuuaguagaaau

SEQ ID NO: 322759 - RNA, 62 nt, Homo Sapiens
cuugcagcuuuaaccugcuguugccauuguccaggaaagaaacucucuuagaauuggaggau

SEQ ID NO: 322760 - RNA, 62 nt, Homo Sapiens
aauaaagaagagaaacguguaaaaagaaaagaaggaaagaagugaaagagcaagaggaaaga

SEQ ID NO: 322761 - RNA, 62 nt, Homo Sapiens
aaagaaaagaaggaaagaagugaaagagcaagaggaaagaaauaguuccaagaggugguuuu

SEQ ID NO: 322762 - RNA, 62 nt, Homo Sapiens
gaaggccacagugcugggcggcaucccugcagaggaaagacaggacccggggcccgccucac

SEQ ID NO: 322763 - RNA, 62 nt, Homo Sapiens
cacuuugucuaguguauucucuucacagugccaggaaagagugguuucugcguguguauauu

SEQ ID NO: 322764 - RNA, 62 nt, Homo Sapiens
uauauccccaucuccguuucggaauuucucccaggaaagaaaauaauugucuccccuccaua

SEQ ID NO: 322765 - RNA, 62 nt, Homo Sapiens
aucucucugacuaguacaaauggaacauaaucaggaaagacucuaguugagacauugggaaa

SEQ ID NO: 322766 - RNA, 62 nt, Homo Sapiens
aaaaugacacauugauaacaguacaguuauggaggaaagaaggucagcaguaagguuucaag

SEQ ID NO: 322767 - RNA, 62 nt, Homo Sapiens
uuuaauggacucaguuccgcuaauuauuauaaaggaaagaggaagaaauaccccaaacuggg

SEQ ID NO: 322768 - RNA, 62 nt, Homo Sapiens
aaagccuucugugcccaggcucaggaaagaacaggaaagagaggguccugaaguuugcuggu

SEQ ID NO: 322769 - RNA, 62 nt, Homo Sapiens
aggaaagagaaaagccuucuguuugcugguucaggaaagaacaguccagucaggguccugaa

SEQ ID NO: 322770 - RNA, 62 nt, Homo Sapiens
auugaucguuugcugccagcccagaaggaugaaggaaagaagcaccucacagcuccuuucua

SEQ ID NO: 322771 - RNA, 62 nt, Homo Sapiens
cuuucugguuucuucauuuucuuccauuacuuaggaaagaguggaaacuccacuaaaauuuc

SEQ ID NO: 322772 - RNA, 62 nt, Homo Sapiens
uucuuuuccuucugccuuuuugggaaagagacaggaaagauucacuugaaaacauaaaugaa

SEQ ID NO: 322773 - RNA, 62 nt, Homo Sapiens
aaggguuucuugaaaagcuugucgguucaaagaggaaagaugaauuucaaugugaaaacacg

SEQ ID NO: 322774 - RNA, 62 nt, Homo Sapiens
ggcaugguccacccucucaaacaagcggaccaaggaaagaguuugaacgccauggacgggac

SEQ ID NO: 322775 - RNA, 62 nt, Homo Sapiens
ucuugccuuuugaaaagaugaaagacuacagaaggaaagagagucuagauaaaaaaagagau

SEQ ID NO: 322776 - RNA, 62 nt, Homo Sapiens
ucuuguaucugggaguagaggucauuuacaucaggaaagagggcggugacagaagagaaagg

SEQ ID NO: 322777 - RNA, 62 nt, Homo Sapiens
acugacuuuguugcacuuuuuguucuaagcaaaggaaagaaagguaguaggacaaugaaaau

SEQ ID NO: 322778 - RNA, 62 nt, Homo Sapiens
gcguugugcugugugucccucgcaagaagcacaggaaagagaaguuucuuuaguagccacua

SEQ ID NO: 322779 - RNA, 62 nt, Homo Sapiens
ccagcccaguaaugcugaggaguucaguugugaggaaagaaggcuggagcugugagauucgc

SEQ ID NO: 322780 - RNA, 62 nt, Homo Sapiens
gagaugguugccaggacuuggggaaucaggaaaggaaagacuaaguggucccgcuaccauug

SEQ ID NO: 322781 - RNA, 62 nt, Homo Sapiens
auugggaguauuugcuggcccuagccacucuuaggaaagacucagcucccugcagcugggcc

SEQ ID NO: 322782 - RNA, 62 nt, Homo Sapiens
uguucauaucuuuaaauuaggauugcaaaccaaggaaagaacgcauuugagauuuuaagaug

SEQ ID NO: 322783 - RNA, 62 nt, Homo Sapiens
uuagucauugauuuuuguguuuaaaaaaaaauaggaaagagggaaacugcagcuuucauuac

SEQ ID NO: 322784 - RNA, 62 nt, Homo Sapiens
aaacuucaauuaaauguauaagacauacagucaggaaagaacauucugacuugcagaaaugc

SEQ ID NO: 322785 - RNA, 62 nt, Homo Sapiens
guacagugacauaaguucaucuuuuggaugauaggaaagauccaaacauauuugaaaguuaa

SEQ ID NO: 322786 - RNA, 62 nt, Homo Sapiens
aggggccaggauccaguucccucaucucuggcaggaaagauccacagcuuuuccuccauguc

SEQ ID NO: 322787 - RNA, 62 nt, Homo Sapiens
uuaaaaaagcaccguggagaauggcccucuucaggaaagaaaaauaagcaaaugaauggucc

SEQ ID NO: 322788 - RNA, 62 nt, Homo Sapiens
cuaaccaacaaaagagaaaaaaaaaaaaaaaaaggaaagaaaaaaaaaacaaccaaccaaaa

SEQ ID NO: 322789 - RNA, 62 nt, Homo Sapiens
aaaaaaacaaccaaccaaaagagugacaagggaggaaagaccgcagaggguccucagagcag

SEQ ID NO: 322790 - RNA, 62 nt, Homo Sapiens
gagauuuuggaauucgugcaggaagccaugaaaggaaagaucagugaagacagcaaucacgg

SEQ ID NO: 322791 - RNA, 62 nt, Homo Sapiens
uguaauuuuaugugcuuucaucacaaauccaaaggaaagaauaaaaauuucuuaacacaacc

SEQ ID NO: 322792 - RNA, 59 nt, Homo Sapiens
ccuaucugugauaggcaugaagaaucgagaggaaagaucccagcauuuuuucgacacau

SEQ ID NO: 322793 - RNA, 62 nt, Homo Sapiens
gcggaccugguauucccugacaaacauugcuuaggaaagagggccggagaauaagaagccag

SEQ ID NO: 322794 - RNA, 62 nt, Homo Sapiens
cacacaauuaaucaacauguucugcuuugcacaggaaagaguugcuguugcauuuagaacuu

SEQ ID NO: 322795 - RNA, 62 nt, Homo Sapiens
uacauucccucuccugcccacuggggugagagaggaaagacccugaccuuggcugacugggg

SEQ ID NO: 322796 - RNA, 62 nt, Homo Sapiens
gcgguaggagagaaaagugauaccuuggcugaaggaaagaugcccacugccccggccucaau

SEQ ID NO: 322797 - RNA, 62 nt, Homo Sapiens
gagguggcagagcagaccaccaguccagagaaaggaaagauuugaccugguggauguggcug

SEQ ID NO: 322798 - RNA, 62 nt, Homo Sapiens
cccacagucuugcauuugcaagcuagagacucaggaaagacaguggcauaaugcagucugag

SEQ ID NO: 322799 - RNA, 62 nt, Homo Sapiens
cacgggcaggagaagguggauauuucagcuccaggaaagagagcuaauucacucucucuuua

SEQ ID NO: 322800 - RNA, 62 nt, Homo Sapiens
agcagaaauaggguuuucucaggaaaacggaaaggaaagaucaauauaccuuauauucuuua

SEQ ID NO: 322801 - RNA, 62 nt, Homo Sapiens
ugcuccaaggaauacuuuuuucagaaacaggcaggaaagaaucuggaauaaaaugccucuac

SEQ ID NO: 322802 - RNA, 62 nt, Homo Sapiens
uaaauuuucuucucuuccuguuucuuauguuaaggaaagauacucuguguuuuggcauaugu

SEQ ID NO: 322803 - RNA, 62 nt, Homo Sapiens
auuguuugcacuuguaauuucccagaguugaaaggaaagauugaacuggaauauuguguaaa

SEQ ID NO: 322804 - RNA, 62 nt, Homo Sapiens
aaggguacuuccacugauggaaacaaaguggaaggaaagaugcucagguacagagaaggaau

SEQ ID NO: 322805 - RNA, 62 nt, Homo Sapiens
aaaaaaaaaaaagucugauugguuuuaauugaaggaaagauuuguacuacaguucuuuuguu

SEQ ID NO: 322806 - RNA, 62 nt, Homo Sapiens
gagagaaagaaagucuccagaggaaagagagaaggaaagagaucagcaacauagaagaggga

SEQ ID NO: 322807 - RNA, 62 nt, Homo Sapiens
gaaggaaagagagagagaaaauagaagagggaaggaaagagaugcccuacccgcucagcaac

SEQ ID NO: 322808 - RNA, 62 nt, Homo Sapiens
aagcugggcggaaggaggugagucacagcucaaggaaagauaucugagcacaugcuggguga

SEQ ID NO: 322809 - RNA, 62 nt, Homo Sapiens
ccuuggccuggucucgagaaguggugccaugaaggaaagaaacacugcagaaaugccucugc

SEQ ID NO: 322810 - RNA, 62 nt, Homo Sapiens
caaaacuucccuacaauuuuucaguucaaaaaaggaaagaaaugagagucgacuggauucug

SEQ ID NO: 322811 - RNA, 62 nt, Homo Sapiens
cacuauaacccaaaugccauuacccuauaacuaggaaagagaacaaauugucccaugcaaau

SEQ ID NO: 322812 - RNA, 64 nt, Homo Sapiens; identical to SEQ ID NO: 84343

SEQ ID NO: 322813 - RNA, 64 nt, Homo Sapiens; identical to SEQ ID NO: 84344

SEQ ID NO: 322814 - RNA, 64 nt, Homo Sapiens; identical to SEQ ID NO: 84345

SEQ ID NO: 322815 - RNA, 64 nt, Homo Sapiens; identical to SEQ ID NO: 84346

SEQ ID NO: 322816 - RNA, 64 nt, Homo Sapiens; identical to SEQ ID NO: 84347

SEQ ID NO: 322817 - RNA, 64 nt, Homo Sapiens; identical to SEQ ID NO: 84348

SEQ ID NO: 322818 - RNA, 64 nt, Homo Sapiens; identical to SEQ ID NO: 84349

SEQ ID NO: 322819 - RNA, 64 nt, Homo Sapiens; identical to SEQ ID NO: 84350

SEQ ID NO: 322820 - RNA, 64 nt, Homo Sapiens; identical to SEQ ID NO: 84351

SEQ ID NO: 322821 - RNA, 64 nt, Homo Sapiens; identical to SEQ ID NO: 84352

SEQ ID NO: 322822 - RNA, 64 nt, Homo Sapiens; identical to SEQ ID NO: 84353

SEQ ID NO: 322823 - RNA, 64 nt, Homo Sapiens; identical to SEQ ID NO: 84354

SEQ ID NO: 322824 - RNA, 64 nt, Homo Sapiens; identical to SEQ ID NO: 84355

SEQ ID NO: 322825 - RNA, 64 nt, Homo Sapiens; identical to SEQ ID NO: 84356

SEQ ID NO: 322826 - RNA, 64 nt, Homo Sapiens; identical to SEQ ID NO: 84357

SEQ ID NO: 322827 - RNA, 64 nt, Homo Sapiens; identical to SEQ ID NO: 84358

SEQ ID NO: 322828 - RNA, 64 nt, Homo Sapiens; identical to SEQ ID NO: 84359

SEQ ID NO: 322829 - RNA, 64 nt, Homo Sapiens; identical to SEQ ID NO: 84360

SEQ ID NO: 322830 - RNA, 64 nt, Homo Sapiens; identical to SEQ ID NO: 84361

SEQ ID NO: 322831 - RNA, 64 nt, Homo Sapiens; identical to SEQ ID NO: 84362

SEQ ID NO: 322832 - RNA, 64 nt, Homo Sapiens; identical to SEQ ID NO: 84363

SEQ ID NO: 322833 - RNA, 64 nt, Homo Sapiens; identical to SEQ ID NO: 84364

SEQ ID NO: 322834 - RNA, 64 nt, Homo Sapiens; identical to SEQ ID NO: 84365

SEQ ID NO: 322835 - RNA, 64 nt, Homo Sapiens; identical to SEQ ID NO: 84366

SEQ ID NO: 322836 - RNA, 64 nt, Homo Sapiens; identical to SEQ ID NO: 84367

SEQ ID NO: 322837 - RNA, 64 nt, Homo Sapiens; identical to SEQ ID NO: 84368

SEQ ID NO: 322838 - RNA, 64 nt, Homo Sapiens; identical to SEQ ID NO: 84369

SEQ ID NO: 322839 - RNA, 64 nt, Homo Sapiens; identical to SEQ ID NO: 84370

SEQ ID NO: 322840 - RNA, 64 nt, Homo Sapiens; identical to SEQ ID NO: 84371

SEQ ID NO: 322841 - RNA, 64 nt, Homo Sapiens; identical to SEQ ID NO: 84372

SEQ ID NO: 322842 - RNA, 64 nt, Homo Sapiens; identical to SEQ ID NO: 84373

SEQ ID NO: 322843 - RNA, 64 nt, Homo Sapiens; identical to SEQ ID NO: 84374

SEQ ID NO: 322844 - RNA, 64 nt, Homo Sapiens; identical to SEQ ID NO: 84375

SEQ ID NO: 322845 - RNA, 64 nt, Homo Sapiens; identical to SEQ ID NO: 84376

SEQ ID NO: 322846 - RNA, 64 nt, Homo Sapiens
acacuaccauucaccccaucauuucccugcucucucugcucagacugaaccacuccuccuccug

SEQ ID NO: 322847 - RNA, 64 nt, Homo Sapiens
gcaaccucugccuccugggugcagcggugcgaucucugcucacuucugucgccgaggcugcagu

SEQ ID NO: 322848 - RNA, 64 nt, Homo Sapiens
guaacuuccaauccuccuucuauguauuccuuucucugcucauugacuuauaaauaguuuucau

SEQ ID NO: 322849 - RNA, 64 nt, Homo Sapiens
uaggaugugacagagaagggauagggaaauccucucugcucauugggccuuacaugauggguga

SEQ ID NO: 322850 - RNA, 64 nt, Homo Sapiens
cuuccaaguuguucucaaugcuucaugagauaucucugcucacggaaauguagguucacugcca

SEQ ID NO: 322851 - RNA, 64 nt, Homo Sapiens
ccuguaacaggguagggagacaucuaccaccaacucugcucagcauaguugcuugaauuaugau

SEQ ID NO: 322852 - RNA, 64 nt, Homo Sapiens
cuaugucugaugacauaaggaaaacuuggcuuccucugcucaagguuccccucugcucaucccu

SEQ ID NO: 322853 - RNA, 64 nt, Homo Sapiens
aggaaaacuuggcuuccucugcucaagguuccccucugcucaucccuccucauucagacauccu

SEQ ID NO: 322854 - RNA, 64 nt, Homo Sapiens
uauucuggauauuaccucuuagccuuuguuuuguucugcucagaggccucaaacugugcaugua

SEQ ID NO: 322855 - RNA, 64 nt, Homo Sapiens
aagcugugugcgugcccuggaauucagcuuguguucugcucacucugcagcuaauggaggcugg

SEQ ID NO: 322856 - RNA, 64 nt, Homo Sapiens
gacaugaaaagacucauacuucguauaucacaacucugcucaaauaaaaaaugugggaaagugu

SEQ ID NO: 322857 - RNA, 64 nt, Homo Sapiens
aacaugaaaaggcucauacuuccgauaccaccaaucugcucaaauaaagaauguggaaaagcau

SEQ ID NO: 322858 - RNA, 64 nt, Homo Sapiens
cuuagaaggccuacauuaacgcuucugcucagaaucugcucauuuaaugaauguagaacaucuu

SEQ ID NO: 322859 - RNA, 64 nt, Homo Sapiens
aucugcucauucuuagaagguagaacaucuugcuucugcucagauuucauaucuauaaugaaug

SEQ ID NO: 322860 - RNA, 64 nt, Homo Sapiens
aauuugaggacaaccauucccugcagggggugugucugcucagugaaucuauauuuaacaagau

SEQ ID NO: 322861 - RNA, 64 nt, Homo Sapiens
cagaaccccuacaugaaacauuugcucuuagcugucugcucagacugugccugacccuacuucu

SEQ ID NO: 322862 - RNA, 64 nt, Homo Sapiens
aaggggugaaauagcuggcauccuaagauuuuuuucugcucaggggagagcuauuuaacacaaa

SEQ ID NO: 322863 - RNA, 64 nt, Homo Sapiens
guuuuguugcuggaacuaaacaucuauuugucugucugcucauugcgugcacuuuuuaauauca

SEQ ID NO: 322864 - RNA, 64 nt, Homo Sapiens
gguguguuucuugagaagcucccuuuuuucuugcucugcucaccgguguggccugggcuggagu

SEQ ID NO: 322865 - RNA, 64 nt, Homo Sapiens
cucagaagauucacugaggaaacucauggaagccucugcucauuugggucacugggacaccccu

SEQ ID NO: 322866 - RNA, 64 nt, Homo Sapiens
guucuuaccuucaaggcggaguaggggaguuuccucugcucacacaaaugaccaaaagcccaag

SEQ ID NO: 322867 - RNA, 64 nt, Homo Sapiens
uuuugucucagugauacuguagcagggguaauuuucugcucauuuuucuuacaaaagccuaagu

SEQ ID NO: 322868 - RNA, 64 nt, Homo Sapiens; identical to SEQ ID NO: 43762

SEQ ID NO: 322869 - RNA, 64 nt, Homo Sapiens; identical to SEQ ID NO: 43763

SEQ ID NO: 322870 - RNA, 64 nt, Homo Sapiens; identical to SEQ ID NO: 43764

SEQ ID NO: 322871 - RNA, 64 nt, Homo Sapiens; identical to SEQ ID NO: 43765

SEQ ID NO: 322872 - RNA, 64 nt, Homo Sapiens; identical to SEQ ID NO: 43766

SEQ ID NO: 322873 - RNA, 64 nt, Homo Sapiens; identical to SEQ ID NO: 43767

SEQ ID NO: 322874 - RNA, 64 nt, Homo Sapiens; identical to SEQ ID NO: 43768

SEQ ID NO: 322875 - RNA, 64 nt, Homo Sapiens; identical to SEQ ID NO: 43769

SEQ ID NO: 322876 - RNA, 64 nt, Homo Sapiens; identical to SEQ ID NO: 43770

SEQ ID NO: 322877 - RNA, 64 nt, Homo Sapiens; identical to SEQ ID NO: 43771

SEQ ID NO: 322878 - RNA, 64 nt, Homo Sapiens; identical to SEQ ID NO: 43772

SEQ ID NO: 322879 - RNA, 64 nt, Homo Sapiens; identical to SEQ ID NO: 43773

SEQ ID NO: 322880 - RNA, 64 nt, Homo Sapiens; identical to SEQ ID NO: 43774

SEQ ID NO: 322881 - RNA, 64 nt, Homo Sapiens; identical to SEQ ID NO: 43775

SEQ ID NO: 322882 - RNA, 64 nt, Homo Sapiens; identical to SEQ ID NO: 43776

SEQ ID NO: 322883 - RNA, 64 nt, Homo Sapiens; identical to SEQ ID NO: 43777

SEQ ID NO: 322884 - RNA, 64 nt, Homo Sapiens; identical to SEQ ID NO: 43778

SEQ ID NO: 322885 - RNA, 64 nt, Homo Sapiens; identical to SEQ ID NO: 43779

SEQ ID NO: 322886 - RNA, 64 nt, Homo Sapiens; identical to SEQ ID NO: 43780

SEQ ID NO: 322887 - RNA, 64 nt, Homo Sapiens; identical to SEQ ID NO: 43781

SEQ ID NO: 322888 - RNA, 64 nt, Homo Sapiens; identical to SEQ ID NO: 43782

SEQ ID NO: 322889 - RNA, 64 nt, Homo Sapiens
gccagaccauagggcuaugaucugcaguaguccuguggugaagagacuuguuucaucuccggaa

SEQ ID NO: 322890 - RNA, 64 nt, Homo Sapiens
ucacucacugacggcagcagccaugucucucaaaguggugaaacuaauaucugagcaucuuuua

SEQ ID NO: 322891 - RNA, 64 nt, Homo Sapiens
cagaagcuccgugaaccaaccggcagaggccuccguggugaagauguggaccugcccugcgaau

SEQ ID NO: 322892 - RNA, 64 nt, Homo Sapiens
cggucagcuguggaccugccgccguggagcagucguggugaaacgggccuuccgggugaccgug

SEQ ID NO: 322893 - RNA, 64 nt, Homo Sapiens
cccgucucuuacuaaaaauaccauccuggcuaacguggugaaacaugaggucaggagaucgaga

SEQ ID NO: 322894 - RNA, 64 nt, Homo Sapiens
cagugccacaucugcacuggucugagguguaccaguggugaaguagcgagaucaaaguuguaua

SEQ ID NO: 322895 - RNA, 64 nt, Homo Sapiens
cccauugcucuccuccaggggcagaacauggggaggggacuagaugggcaaggggcagcacugc

SEQ ID NO: 322896 - RNA, 64 nt, Homo Sapiens
uuuaccccacagcuuaguggccaguaaacacccuggggacuaggaaaaggaaccaacuguaggc

SEQ ID NO: 322897 - RNA, 64 nt, Homo Sapiens
gucugagggauaauaauuuaauuguucuagacaaggggacuauagggacugacuguuauuaaaa

SEQ ID NO: 322898 - RNA, 64 nt, Homo Sapiens
uuccagugucucccuccagcucuucucaggggcaggggacuacccugcccaacccucaucccca

SEQ ID NO: 322899 - RNA, 64 nt, Homo Sapiens
agagagaagcauguuauuaccacacacucuuuuaggggacuaagcacacacacacacacacaca

SEQ ID NO: 322900 - RNA, 64 nt, Homo Sapiens
cagaggcaaagaggagcugcaagagggaacauguggggacuacucuggcaguugaaaucucugg

SEQ ID NO: 322901 - RNA, 64 nt, Homo Sapiens
agacucuaaauuggcuucuaggaagguaaaguuaggggacuagauuuauuuuuguauaauuuaa

SEQ ID NO: 322902 - RNA, 64 nt, Homo Sapiens
uauagaauugaagguucuuaucagaugggauacuggggacuauaaacaauggaaauaaagccac

SEQ ID NO: 322903 - RNA, 64 nt, Homo Sapiens
uguuuuaagucuucauggauguucugcaugucauggggacuaaaacucacccaacagaucuuuc

SEQ ID NO: 322904 - RNA, 64 nt, Homo Sapiens
cacucucuuccuuggguguuuggugcuggcuccuggggacuacaaaucccagagugcggugugc

SEQ ID NO: 322905 - RNA, 64 nt, Homo Sapiens
agcccaggagagagaaagccaggcagguagccagggggacuagccccuguggagacuggggggc

SEQ ID NO: 322906 - RNA, 64 nt, Homo Sapiens
gacccuugguaaaccccugauucgggguggggugggggacuaggcucagccggaaccagcaccu

SEQ ID NO: 322907 - RNA, 64 nt, Homo Sapiens
uucugucacuggaguuuugaucuagcagcugguuggggacuauagccuggagaguguucuuguc

SEQ ID NO: 322908 - RNA, 64 nt, Homo Sapiens
ugaaaugauucugguauuucaugagacuauuugaggggacuauucuuggaaagguagucaucaa

SEQ ID NO: 322909 - RNA, 64 nt, Homo Sapiens
uauuuuguuuaugaaaaugggaaaagaugagagaggggacuaauuauacaaaagacaugauaga

SEQ ID NO: 322910 - RNA, 64 nt, Homo Sapiens
auggaaaaggucuguccauauggaacuuacccauggggacuaaugguguguuuuggggcauuug

SEQ ID NO: 322911 - RNA, 64 nt, Homo Sapiens
aacuuuuaugagagagauccuggacuucuuuuugggggacuauuuuuguacagagaaaaccugg

SEQ ID NO: 322912 - RNA, 64 nt, Homo Sapiens
ggcuuccagagaguggcugggucugcagggaguuggggacuaagccagcgacccugugacaccg

SEQ ID NO: 322913 - RNA, 64 nt, Homo Sapiens
aaagacagcuguuuagggucccggccaggugggcggggacuaacauggccuuguugcuggcauc

SEQ ID NO: 322914 - RNA, 64 nt, Homo Sapiens
gugcaaccuauuuggguaaaguagaaaaccauauggggacuauagaaauagugguuguggaaca

SEQ ID NO: 322915 - RNA, 64 nt, Homo Sapiens
aaggguguuagucuuggagagacuugaauuuuuuggggacuauucugccuucuugggauacuaa

SEQ ID NO: 322916 - RNA, 64 nt, Homo Sapiens
auacuguaauaauauuuuuacaguuguuguuaguggggacuaugauacauuguuauauguaccc

SEQ ID NO: 322917 - RNA, 64 nt, Homo Sapiens
gaacauagaauuuuauuagcagaaaauauaguagggggacuaagugaaccuucggaucuaugaa

SEQ ID NO: 322918 - RNA, 64 nt, Homo Sapiens
guggaagauucccuauuuaacacacugugauaaaggggacuagacuauaucuuguucugaacaa

SEQ ID NO: 322919 - RNA, 64 nt, Homo Sapiens
aagaauaaagccuuuucuaacuggugggugacuuggggacuagaucggguggccaacuugcuau

SEQ ID NO: 322920 - RNA, 64 nt, Homo Sapiens
auggaggagcuugggggaugacuagaggcagggaggggacuauuuaugaaggcaaaaaaauuaa

SEQ ID NO: 322921 - RNA, 64 nt, Homo Sapiens
ucaucauugcucagcuccucagagugggccgggaggggacuagaagagcugcaugaugguggcu

SEQ ID NO: 322922 - RNA, 64 nt, Homo Sapiens
uucuacugcuuacacuuuagaauguuuauuuuauggggacuaagggauuaggagugugaacuaa

SEQ ID NO: 322923 - RNA, 64 nt, Homo Sapiens
guauuuauauauuuaauugaaacuuuggauaaguggggacuaguauggaaaccaaggaaaguga

SEQ ID NO: 322924 - RNA, 64 nt, Homo Sapiens
ugugcauggcaccugcucugacagacggagagugggggacuagcggaggggcgaagcuuuggug

SEQ ID NO: 322925 - RNA, 64 nt, Homo Sapiens
agaggcucaaaugcuguccccggcagcuuuccugggggacuagagcuccuucuggccauguuau

SEQ ID NO: 322926 - RNA, 64 nt, Homo Sapiens
ggagaaaauaagguggagucgaccuguacugcuuggggacuauugaauguuuaugucuucaagu

SEQ ID NO: 322927 - RNA, 64 nt, Homo Sapiens
ggaaugcuguccaaguuuuagaguauuuggggagggggacuacuagaaaauuguuaggauuuug

SEQ ID NO: 322928 - RNA, 64 nt, Homo Sapiens
cuccaaaggccccaccuccuaauaccaucacucuggggacuaggugucagcaugugaauuuugg

SEQ ID NO: 322929 - RNA, 64 nt, Homo Sapiens
gggaaagcaaagaagcugcuuuaaaaaauaaaaaggggacuaaaaauuuguuuuguauaaagag

SEQ ID NO: 322930 - RNA, 64 nt, Homo Sapiens
auugccaacuaggcaggcacaaaucuugggucuuggggacuaacccaaugccugugaagcaguc

SEQ ID NO: 322931 - RNA, 64 nt, Homo Sapiens
uggugacugauggauggguagugggcugagaagaggggacuaggaagggcuauuccaggcucag

SEQ ID NO: 322932 - RNA, 64 nt, Homo Sapiens
caagcugacagcggaugguauagagucagaaugaggggacuacagcaaaucacauggccaaguc

SEQ ID NO: 322933 - RNA, 51 nt, Homo Sapiens; identical to SEQ ID NO: 201885

SEQ ID NO: 322934 - RNA, 64 nt, Homo Sapiens
caguuagagacucugucacccaucccuaacuaaaggggacuagacauggcaauaaauauucuag

SEQ ID NO: 322935 - RNA, 64 nt, Homo Sapiens
caccuccuucuuaagagggugagccgcacucucaggggacuagcgguuuccugcaccccaaagu

SEQ ID NO: 322936 - RNA, 64 nt, Homo Sapiens
ugccacuggggcuuugauuuggaggaauggggcaggggacuaucugaagcgcuuccauccuaaa

SEQ ID NO: 322937 - RNA, 64 nt, Homo Sapiens
ugggcucgucucucucugcuacaaguuagcgcugggggacuauccggacgcagcggcuucggga

SEQ ID NO: 322938 - RNA, 64 nt, Homo Sapiens
uuguagaggugggaaggcccacuguagcugaccaggggacuagguuaccaaguugccuuuugcc

SEQ ID NO: 322939 - RNA, 64 nt, Homo Sapiens
ugaggaguacccccagcccaagagaugaacaucuggggacuaauaucauagacccaucuggagg

SEQ ID NO: 322940 - RNA, 64 nt, Homo Sapiens
cagaacacuaaucagauuucaaggcccacaacuuggggacuagaccaccuuauguugagggaac

SEQ ID NO: 322941 - RNA, 64 nt, Homo Sapiens
acaauuuuaaauaagauggagaauaaauuauugaggggacuaggcuauaugcauuugccuucau

SEQ ID NO: 322942 - RNA, 64 nt, Homo Sapiens
ggaucacuguccccccaccucccagucacucccuggggacuaugccuguuccaaucuucugccu

SEQ ID NO: 322943 - RNA, 64 nt, Homo Sapiens
gucacacggcuugugggcacguuuauauuaucaaggggacuaaauuauaagugagagaaaugaa

SEQ ID NO: 322944 - RNA, 64 nt, Homo Sapiens
gugggguaagggggcgccugggcauuuacuaaugggggacuacuuucuugaggacagggacuuc

SEQ ID NO: 322945 - RNA, 64 nt, Homo Sapiens
ccaguguugggcaccuccagguuucgucagccuuggggacuaggcuggggucaggccagaccau

SEQ ID NO: 322946 - RNA, 64 nt, Homo Sapiens
aaguaucuguuaucuccugcguaguaccaagguaggggacuaguggaucuuaucauaguuuugg

SEQ ID NO: 322947 - RNA, 64 nt, Homo Sapiens
ugagcaguucuacaaaagaauggccagcacgagcggggacuagaggguccugauuuugugucug

SEQ ID NO: 322948 - RNA, 64 nt, Homo Sapiens
gugucugcccuuccaaucacgaagccagguagcuggggacuauguguggggaacgggggcucuu

SEQ ID NO: 322949 - RNA, 64 nt, Homo Sapiens
ucacuggcgaggugcggccaguaagaccuugguaggggacuaaugugagaggaagggugggucu

SEQ ID NO: 322950 - RNA, 64 nt, Homo Sapiens
aaugugggcauguggagagguugaguacagugguggggacuaaauucagcagcuugcccagcuc

SEQ ID NO: 322951 - RNA, 64 nt, Homo Sapiens
acuuaagucucagacugauuucuugcgggaggagggggacuaaacucaaccuaacacauuaaau

SEQ ID NO: 322952 - RNA, 64 nt, Homo Sapiens
ccagggaacuuccaaggaaggagccugagccacuggggacuaagugggcagaagaaacccuugg

SEQ ID NO: 322953 - RNA, 64 nt, Homo Sapiens
agauuacauuuugaaaaggaaaucuagcaugugaggggacuaaguguucucagagugauguuuu

SEQ ID NO: 322954 - RNA, 64 nt, Homo Sapiens
agucuaucugcagagguauucaguuccuggcacaggggacuaggggcauguagaguauaugagg

SEQ ID NO: 322955 - RNA, 64 nt, Homo Sapiens
uuucucagggugguccuaugugcagagcaugccaggggacuacgucccucucuauuuucagguu

SEQ ID NO: 322956 - RNA, 64 nt, Homo Sapiens
agucccucacucuuagguuuauacuccagucaacggggacuacucuuugaugauguucccagcc

SEQ ID NO: 322957 - RNA, 64 nt, Homo Sapiens
acggacucccgggcugggcuuuugaauuggccuuggggacuacucggcucucacucagcuccca

SEQ ID NO: 322958 - RNA, 64 nt, Homo Sapiens
uauuacugaaagcuaaauccucaaaaccuaguaaggggacuaaugauucauuaaaguaaauuga

SEQ ID NO: 322959 - RNA, 64 nt, Homo Sapiens
uucaacaauaagucaguucuaguggcugucgccuggggacuagugagaaagcuacucuucuccc

SEQ ID NO: 322960 - RNA, 64 nt, Homo Sapiens
gaaggacuauggacucuuguuguguggaauggaaggggacuagccagcucucugcauggcacau

SEQ ID NO: 322961 - RNA, 64 nt, Homo Sapiens
auucuucggaggagguggacauuucggaagugguggggacuaagggaagaacucucuaguuccc

SEQ ID NO: 322962 - RNA, 64 nt, Homo Sapiens
ggaaggauaguucuguguacuccuuuagggagugggggacuagaacugggaugucuuggcuugu

SEQ ID NO: 322963 - RNA, 64 nt, Homo Sapiens
acaacaaauuucugcucaacugacucaucuuuugggggacuaauuuaauuugcugcugacagcc

SEQ ID NO: 322964 - RNA, 64 nt, Homo Sapiens
acaacaacuuucugcucaacugacuuaucuuuugggggacuaauuuaauuugcugcugacagcc

SEQ ID NO: 322965 - RNA, 64 nt, Homo Sapiens
aagccaagagggaaagccagaguucccuguucuaggggacuagccaaaugccuacaucagcugu

SEQ ID NO: 322966 - RNA, 64 nt, Homo Sapiens
ggagccugguauacaugcgguggggcaaggugguggggacuaggccccaccacgucaugaugga

SEQ ID NO: 322967 - RNA, 64 nt, Homo Sapiens
aggaaggguguggcauggcuucccaggagagcauggggacuaggaguaagcagagcugccaggc

SEQ ID NO: 322968 - RNA, 64 nt, Homo Sapiens
ggguccccaaaguggcccacucucuugucacuagggggacuaggauccugccaccaccuucucu

SEQ ID NO: 322969 - RNA, 64 nt, Homo Sapiens
ccggcucugcccaccaccacugccaggcugaacaggggacuagugcccaggugacacugcacac

SEQ ID NO: 322970 - RNA, 64 nt, Homo Sapiens
uagguaaugauuuuccuagucccaccaaaauaaaggggacuaaaauuauucuucucauguuaaa

SEQ ID NO: 322971 - RNA, 64 nt, Homo Sapiens
aaaaacccguccagugugguggguuacuggugcaggggacuagguguguccucauuauagcaaa

SEQ ID NO: 322972 - RNA, 54 nt, Homo Sapiens; identical to SEQ ID NO: 201924

SEQ ID NO: 322973 - RNA, 64 nt, Homo Sapiens
cacccccagcccugucccugccaccccuccuaguggggacuagugaaugacuugaccugugacc

SEQ ID NO: 322974 - RNA, 64 nt, Homo Sapiens
cccugcgccugggggcugggguaggcgaggccguggggacuacccauuuuauagcuggggaaac

SEQ ID NO: 322975 - RNA, 64 nt, Homo Sapiens
cccuggggacagaggucagccuaaggugacacacggggacuacugugcuuccggaggcucccug

SEQ ID NO: 322976 - RNA, 64 nt, Homo Sapiens
cuguucuuuuauuucuuuuucucuuugauugaaaggggacuacgucuuagcaggaaaaaaaacu

SEQ ID NO: 322977 - RNA, 64 nt, Homo Sapiens
gacccuccugccucagccuccugaguacccuccuggggacuacaggugcgugcuaccauaccca

SEQ ID NO: 322978 - RNA, 64 nt, Homo Sapiens
uguuucccaccccagguuccggccucugagguugggggacuacuugucccccaccugugguucu

SEQ ID NO: 322979 - RNA, 64 nt, Homo Sapiens
agcagaaucuaccucccaaccugugugugucaaaggggacuaaccugcugcccauucuccauuu

SEQ ID NO: 322980 - RNA, 64 nt, Homo Sapiens
cccccgaccccaccccaguccacauccacuccaaggggacuauucucccuugacucuggggguc

SEQ ID NO: 322981 - RNA, 64 nt, Homo Sapiens
gagacuggccccgucugaaccuucucugggcacuggggacuaagguugcaggccuuagccucgu

SEQ ID NO: 322982 - RNA, 64 nt, Homo Sapiens
caaaguggauaaacuaguacgagauauuuauggaggggacuaugagagguuuggacugccaggc

SEQ ID NO: 322983 - RNA, 64 nt, Homo Sapiens
aggcaugugccuucugccaccugacuuuccgugaggggacuaaaauuuacuaauuguaguugcu

SEQ ID NO: 322984 - RNA, 64 nt, Homo Sapiens
ucaauuuucauagaccuaauuugcaaacucaaucggggacuaaaauuucccacugaaaauguua

SEQ ID NO: 322985 - RNA, 64 nt, Homo Sapiens
cugccacuggcggcuucccuucuuggcucuugggggggacuagauccuguggagaagaugacuu

SEQ ID NO: 322986 - RNA, 64 nt, Homo Sapiens
ggggcugcuuacuucugggguauuggaaauguuuggggacuagguagaggugaauguacuaaau

SEQ ID NO: 322987 - RNA, 64 nt, Homo Sapiens
ugaaacaaacagucacaagcaaaggaagaggcugggggacuagaaagaggcccugcccucuaga

SEQ ID NO: 322988 - RNA, 64 nt, Homo Sapiens
ggagggaggcaggcugcagcuucagccacagaauggggacuauggaagacagcaggagcucauu

SEQ ID NO: 322989 - RNA, 64 nt, Homo Sapiens
ggaaacaguuggagguucgugccuccgaugccccggggacuaggcucucccaugugggaaccca

SEQ ID NO: 322990 - RNA, 64 nt, Homo Sapiens
agggcagcauugcuggggagcagaauuuccacggggggacuaggagagacacaugucuuacuuu

SEQ ID NO: 322991 - RNA, 64 nt, Homo Sapiens
uuggggcuuucuccagacuugggcucugggaacaggggacuacucucccaucuguuuauucuuu

SEQ ID NO: 322992 - RNA, 64 nt, Homo Sapiens
aauggaccccuggguuccuugagagccuuucaggggggacuaugagaucaaaauauuuuuauua

SEQ ID NO: 322993 - RNA, 64 nt, Homo Sapiens
cccccgcccgccauccccaguugcagggggaucuggggacuaccagagacucugggaaauggac

SEQ ID NO: 322994 - RNA, 64 nt, Homo Sapiens
acacaaauccaacgcuuuucgccacugguaucugggggacuagauuaccuaagagccacaauaa

SEQ ID NO: 322995 - RNA, 64 nt, Homo Sapiens; identical to SEQ ID NO: 104950

SEQ ID NO: 322996 - RNA, 64 nt, Homo Sapiens; identical to SEQ ID NO: 104951

SEQ ID NO: 322997 - RNA, 64 nt, Homo Sapiens
ugcacuuacauuuaaaaaaacaacaacaacauuuuuucaacaauuucaacaaugacacaaaaau

SEQ ID NO: 322998 - RNA, 64 nt, Homo Sapiens
auuuaaaaaaacaacaacaacauuuuuucaacaauuucaacaaugacacaaaaauucacaugga

SEQ ID NO: 322999 - RNA, 64 nt, Homo Sapiens
aaagguuuguaguugagacacauguuagagacccuuucaacauguucauaauaauaaaacaacu

SEQ ID NO: 323000 - RNA, 64 nt, Homo Sapiens
augcuuagagaacucaugaagaugugacacugguuuucaacaacguuggaagaaggauccuaag

SEQ ID NO: 323001 - RNA, 64 nt, Homo Sapiens
uuuuuuucuccauaaaugacucauccuuuacauuuuucaacauucuaucaaauuaucuucaccc

SEQ ID NO: 323002 - RNA, 64 nt, Homo Sapiens
uuuugguuuuuuucauuuugacuaguaauuauguuuucaacacuaaaucuccauuaaaguuaua

SEQ ID NO: 323003 - RNA, 64 nt, Homo Sapiens
uggucauauuuaaacagaaguauacguuuuucaguuucaacaugaauuuuuuuauuucugucag

SEQ ID NO: 323004 - RNA, 64 nt, Homo Sapiens
uaaaguauuuggguuuuguucuuguauugcuuucuuucaacaguuucaaaauaaaauaucauau

SEQ ID NO: 323005 - RNA, 64 nt, Homo Sapiens
auuuuuuucaucaccuuacauguguuaacagcuguuucaacauaaacuccauuauaaucuauau

SEQ ID NO: 323006 - RNA, 64 nt, Homo Sapiens
gccuguguugagcaagacuaucagugccauuuuuuuucaacagcaugugcucauuucauuuuuc

SEQ ID NO: 323007 - RNA, 64 nt, Homo Sapiens
agcaucauauacgacugaaagaagaaaacuagauuuucaacauuacaggguugaaaugaaugau

SEQ ID NO: 323008 - RNA, 64 nt, Homo Sapiens
cugcagaugauggagaacuaccuaggcuucaucuuuucaacauaugucuacacaaccagaaaaa

SEQ ID NO: 323009 - RNA, 64 nt, Homo Sapiens
cuucaggggucucagcugccuuagacuaaaggacuuucaacacacuggucucuuuuaauuuagu

SEQ ID NO: 323010 - RNA, 64 nt, Homo Sapiens
aaaaagcaagccacaauaccaugauuccuuccauuuucaacaguagaugaaggaaaugauacug

SEQ ID NO: 323011 - RNA, 64 nt, Homo Sapiens
acccacagcgucauuuugaaucaucaugugacgcuuucaacaacguucuuaguuuacuuauacc

SEQ ID NO: 323012 - RNA, 64 nt, Homo Sapiens
aaaaacaaaaccacacaaggagaacccaauuuuguuucaacaauuuuugaucaauguauaugaa

SEQ ID NO: 323013 - RNA, 64 nt, Homo Sapiens
cucggguuugagauauccucuguaagggaagaaauuucaacagaugaacuucauuuugucuuug

SEQ ID NO: 323014 - RNA, 61 nt, Homo Sapiens
gaucaucaaugcuaacaccuaccacaauguauuucaacaaauuauucgucaaagaauuuag

SEQ ID NO: 323015 - RNA, 64 nt, Homo Sapiens
cacuauagcacuuugacuaauauagaacuguugauuucaacauaaggaauuaaauacuauugag

SEQ ID NO: 323016 - RNA, 64 nt, Homo Sapiens
uuaguugaaugacucccuucucagggccuuccccuuucaacaauccaagaacaguugagcucuc

SEQ ID NO: 323017 - RNA, 64 nt, Homo Sapiens
uaaaaauauauuagugagacacauuugccaaauauuucaacauaauaaaaguuuauuuaaucca

SEQ ID NO: 323018 - RNA, 64 nt, Homo Sapiens
aggcuaucaaaauuuuaauuuaaauuuacauauuuuucaacagauucgucuuuucugagaaaca

SEQ ID NO: 323019 - RNA, 64 nt, Homo Sapiens
cugagugucuaaaacuugacaccccugguaaaucuuucaacacacuuccacugccugcguaaug

SEQ ID NO: 323020 - RNA, 64 nt, Homo Sapiens
uucucaauaaaagaaaaucaugaaugcuccacaauuucaacauaccacaagagaaguuaauuuc

SEQ ID NO: 323021 - RNA, 64 nt, Homo Sapiens
ugucacagaauggcugggcugcaacagcugauucuuucaacaacuugucgcuugagaaaaaaag

SEQ ID NO: 323022 - RNA, 64 nt, Homo Sapiens
ggaggagccaaggaauucugaccagacguggggauuucaacagguguuccuccggguguucgac

SEQ ID NO: 323023 - RNA, 64 nt, Homo Sapiens
aaaggcaaacucaugaaaugccacugaaaagaacuuucaacacagcauacuucauguaaaagaa

SEQ ID NO: 323024 - RNA, 64 nt, Homo Sapiens
ucaaacacaguuaucuuaguuuaccgguggaguauuucaacaccaaccacauuucccuuccucc

SEQ ID NO: 323025 - RNA, 64 nt, Homo Sapiens
gaaauuguugaaaaccgucuuuaaauaaauccuauuucaacacuuuuuuaagcaaagaaauauu

SEQ ID NO: 323026 - RNA, 64 nt, Homo Sapiens
gauacaguccugucauuuauaccugagacagacauuucaacaaucuuaucgcuagcggauucac

SEQ ID NO: 323027 - RNA, 64 nt, Homo Sapiens
uggugguuuucuauuggguaaucauuuucaauacuuucaacauuauccaccugucucuauaggu

SEQ ID NO: 323028 - RNA, 64 nt, Homo Sapiens
agaccuucugcucuucgagugguauuuuacaauauuucaacagcauaaauaccguuuuuccaaa

SEQ ID NO: 323029 - RNA, 64 nt, Homo Sapiens
aauaauuggcuuguauaaucgucuuaugcccaaauuucaacaggcauauggagaaagucccuuu

SEQ ID NO: 323030 - RNA, 64 nt, Homo Sapiens
gguuguuaagucuccuuuguauguaagguaguuuuuucaacaucuaaaauuuuuguuuuagccu

SEQ ID NO: 323031 - RNA, 64 nt, Homo Sapiens
aacuauuaacagagugcauuucuugcuugcuggguuucaacagacaucagccaaaagaacaaaa

SEQ ID NO: 323032 - RNA, 64 nt, Homo Sapiens
guauacaauugauucuuuucaaaauaugaacaacuuucaacaauaacuacugcaauuagaaaau

SEQ ID NO: 323033 - RNA, 64 nt, Homo Sapiens
ucccuaagcuaagggaagaguguugaaaagccuuuuucaacauacuuguaaaaaauaaaauacu

SEQ ID NO: 323034 - RNA, 64 nt, Homo Sapiens
auaaaggaacuugaaauguggggagugauaauaguccagugauuaaacuacaguccagugauua

SEQ ID NO: 323035 - RNA, 64 nt, Homo Sapiens
ggggagugauaauaguccagugauuaaacuacaguccagugauuaccaccaacuuucugacuaa

SEQ ID NO: 323036 - RNA, 64 nt, Homo Sapiens
cccuguucugagaacgagcagucugauaaaagauuccagugaagaucagggauucuggaacuaa

SEQ ID NO: 323037 - RNA, 64 nt, Homo Sapiens
uuggaagugggccccugagccuuaaaagaaaguguccagugaacuucaggugcuuugccaaacu

SEQ ID NO: 323038 - RNA, 64 nt, Homo Sapiens
acuccaugaguagacuccaagugcugcgguugauuccagugagggagaaagugaucugcaggga

SEQ ID NO: 323039 - RNA, 64 nt, Homo Sapiens
ucacgauuuuucugccacuucaccuuagggagcuuccagugauugauuuuaggaggcccacacc

SEQ ID NO: 323040 - RNA, 64 nt, Homo Sapiens
ugcagccucagagcccucccagguugcugcuguuuccagugaaucacauuucgucauuugaagc

SEQ ID NO: 323041 - RNA, 64 nt, Homo Sapiens
caugaguuuucucugcucugacauuccuuauacauccagugaacaaagcuggaauagaaaaccu

SEQ ID NO: 323042 - RNA, 64 nt, Homo Sapiens
agauugccuucugggaaaucccgcgauacuaaaauccagugagcuuugggagaucauucccuaa

SEQ ID NO: 323043 - RNA, 64 nt, Homo Sapiens
ugauuacuccuccauuacucuaugauacugucucuccagugaaauuuaaagaaaugcacuugcc

SEQ ID NO: 323044 - RNA, 64 nt, Homo Sapiens
aguguugcguuuuuccuuguaauuuaucuucauguccagugagcggguagguggggcuuucccu

SEQ ID NO: 323045 - RNA, 64 nt, Homo Sapiens
aaccuccuccucuggcuccuccagaggccgcuucuccagugacucagcucaggcucucugccuu

SEQ ID NO: 323046 - RNA, 64 nt, Homo Sapiens
gaaaguuguauuucucaaucuuuauuauccauuauccagugauguaauaacuggagccucuaaa

SEQ ID NO: 323047 - RNA, 64 nt, Homo Sapiens
cugaaaguagugggggcaaggacgauguguuuguuccagugauaagaaacgauuguuagaaauu

SEQ ID NO: 323048 - RNA, 64 nt, Homo Sapiens
ccauguggagagagcacugugagcaugcaccaaauccagugaguuaguagccuugcuuucuaua

SEQ ID NO: 323049 - RNA, 64 nt, Homo Sapiens
gaaaugccuaugaaagagggcaagagagugggucuccagugagacucagucauaaaggaaugac

SEQ ID NO: 323050 - RNA, 64 nt, Homo Sapiens
ucuacccuguggaggcugagagcagguggaggcauccagugauuguguuccucaguagaagaca

SEQ ID NO: 323051 - RNA, 64 nt, Homo Sapiens
ugcccagcucucugacgcuugugacagugccucuuccagugaacauucccagcccagccccgcc

SEQ ID NO: 323052 - RNA, 64 nt, Homo Sapiens
ggaacuagcuucaggcacagccugauucuggugauccagugaucuauggaagucgugucuuacu

SEQ ID NO: 323053 - RNA, 64 nt, Homo Sapiens
cugcacugggcauuauggaauuuguucuccagacuccagugauucugauauuuagaaaggugcu

SEQ ID NO: 323054 - RNA, 64 nt, Homo Sapiens
aaaugaucaaaagugagcugaaagcaaaaugaaauccagugaagcuucuuaguagccacuucac

SEQ ID NO: 323055 - RNA, 64 nt, Homo Sapiens
ccuccggaccccaggcucugcccucccccugugguccagugaaggccaggccacauucacauuc

SEQ ID NO: 323056 - RNA, 64 nt, Homo Sapiens
gcaugucccagccccuggugccaagcacaaagguuccagugagccacagccgcgcugccgaggg

SEQ ID NO: 323057 - RNA, 64 nt, Homo Sapiens
cugaauguccucacuuuguguccugaccucuggcuccagugaagcuggccucagcaaggggccu

SEQ ID NO: 323058 - RNA, 64 nt, Homo Sapiens
gacuccagcaagugcagccacaagggagccagccuccagugaguaccucucguuccagcaggac

SEQ ID NO: 323059 - RNA, 64 nt, Homo Sapiens
ccuguaccaggucauucuuaagauuucuccugacuccagugagcuggaauucuaaaugcugguc

SEQ ID NO: 323060 - RNA, 64 nt, Homo Sapiens
uccuaucuucuccauucuagaugcuucccuuguauccagugaugugcuggagcuggcuuugcca

SEQ ID NO: 323061 - RNA, 64 nt, Homo Sapiens; identical to SEQ ID NO: 165778

SEQ ID NO: 323062 - RNA, 64 nt, Homo Sapiens; identical to SEQ ID NO: 165779

SEQ ID NO: 323063 - RNA, 64 nt, Homo Sapiens; identical to SEQ ID NO: 165780

SEQ ID NO: 323064 - RNA, 64 nt, Homo Sapiens; identical to SEQ ID NO: 165781

SEQ ID NO: 323065 - RNA, 64 nt, Homo Sapiens; identical to SEQ ID NO: 165782

SEQ ID NO: 323066 - RNA, 64 nt, Homo Sapiens; identical to SEQ ID NO: 165783

SEQ ID NO: 323067 - RNA, 64 nt, Homo Sapiens; identical to SEQ ID NO: 165784

SEQ ID NO: 323068 - RNA, 64 nt, Homo Sapiens; identical to SEQ ID NO: 165785

SEQ ID NO: 323069 - RNA, 64 nt, Homo Sapiens; identical to SEQ ID NO: 165786

SEQ ID NO: 323070 - RNA, 64 nt, Homo Sapiens; identical to SEQ ID NO: 165787

SEQ ID NO: 323071 - RNA, 64 nt, Homo Sapiens; identical to SEQ ID NO: 165788

SEQ ID NO: 323072 - RNA, 64 nt, Homo Sapiens; identical to SEQ ID NO: 165789

SEQ ID NO: 323073 - RNA, 64 nt, Homo Sapiens; identical to SEQ ID NO: 165790

SEQ ID NO: 323074 - RNA, 64 nt, Homo Sapiens; identical to SEQ ID NO: 165791

SEQ ID NO: 323075 - RNA, 64 nt, Homo Sapiens; identical to SEQ ID NO: 165792

SEQ ID NO: 323076 - RNA, 64 nt, Homo Sapiens; identical to SEQ ID NO: 165793

SEQ ID NO: 323077 - RNA, 64 nt, Homo Sapiens; identical to SEQ ID NO: 165794

SEQ ID NO: 323078 - RNA, 64 nt, Homo Sapiens; identical to SEQ ID NO: 165795

SEQ ID NO: 323079 - RNA, 64 nt, Homo Sapiens; identical to SEQ ID NO: 165796

SEQ ID NO: 323080 - RNA, 64 nt, Homo Sapiens; identical to SEQ ID NO: 165797

SEQ ID NO: 323081 - RNA, 64 nt, Homo Sapiens; identical to SEQ ID NO: 165798

SEQ ID NO: 323082 - RNA, 64 nt, Homo Sapiens; identical to SEQ ID NO: 165799

SEQ ID NO: 323083 - RNA, 64 nt, Homo Sapiens; identical to SEQ ID NO: 165753

SEQ ID NO: 323084 - RNA, 64 nt, Homo Sapiens; identical to SEQ ID NO: 165754

SEQ ID NO: 323085 - RNA, 64 nt, Homo Sapiens; identical to SEQ ID NO: 165755

SEQ ID NO: 323086 - RNA, 64 nt, Homo Sapiens; identical to SEQ ID NO: 165756

SEQ ID NO: 323087 - RNA, 64 nt, Homo Sapiens; identical to SEQ ID NO: 165757

SEQ ID NO: 323088 - RNA, 64 nt, Homo Sapiens; identical to SEQ ID NO: 165758

SEQ ID NO: 323089 - RNA, 64 nt, Homo Sapiens; identical to SEQ ID NO: 165759

SEQ ID NO: 323090 - RNA, 64 nt, Homo Sapiens; identical to SEQ ID NO: 165760

SEQ ID NO: 323091 - RNA, 64 nt, Homo Sapiens; identical to SEQ ID NO: 165761

SEQ ID NO: 323092 - RNA, 64 nt, Homo Sapiens; identical to SEQ ID NO: 165762

SEQ ID NO: 323093 - RNA, 64 nt, Homo Sapiens; identical to SEQ ID NO: 165763

SEQ ID NO: 323094 - RNA, 64 nt, Homo Sapiens; identical to SEQ ID NO: 165764

SEQ ID NO: 323095 - RNA, 64 nt, Homo Sapiens; identical to SEQ ID NO: 165765

SEQ ID NO: 323096 - RNA, 64 nt, Homo Sapiens; identical to SEQ ID NO: 165766

SEQ ID NO: 323097 - RNA, 64 nt, Homo Sapiens; identical to SEQ ID NO: 165767

SEQ ID NO: 323098 - RNA, 64 nt, Homo Sapiens; identical to SEQ ID NO: 165768

SEQ ID NO: 323099 - RNA, 64 nt, Homo Sapiens; identical to SEQ ID NO: 165769

SEQ ID NO: 323100 - RNA, 64 nt, Homo Sapiens; identical to SEQ ID NO: 165770

SEQ ID NO: 323101 - RNA, 64 nt, Homo Sapiens; identical to SEQ ID NO: 165771

SEQ ID NO: 323102 - RNA, 64 nt, Homo Sapiens; identical to SEQ ID NO: 165772

SEQ ID NO: 323103 - RNA, 64 nt, Homo Sapiens; identical to SEQ ID NO: 165773

SEQ ID NO: 323104 - RNA, 64 nt, Homo Sapiens; identical to SEQ ID NO: 165774

SEQ ID NO: 323105 - RNA, 64 nt, Homo Sapiens; identical to SEQ ID NO: 165775

SEQ ID NO: 323106 - RNA, 64 nt, Homo Sapiens; identical to SEQ ID NO: 165776

SEQ ID NO: 323107 - RNA, 64 nt, Homo Sapiens; identical to SEQ ID NO: 165777

SEQ ID NO: 323108 - RNA, 64 nt, Homo Sapiens
agaggaugacacaucaaauaauaacucggauuccagcccacauuggauucaucagcauuuggac

SEQ ID NO: 323109 - RNA, 64 nt, Homo Sapiens
agcccacauuggauucaucagcauuuggaccaauagcccacagcugagaauguggaauaccuaa

SEQ ID NO: 323110 - RNA, 64 nt, Homo Sapiens
cagcggggacggccuccugcugcagguccugggcagcccacaguagugcuagcugaggcccaga

SEQ ID NO: 323111 - RNA, 64 nt, Homo Sapiens
ugccccuggaggccacgccaggcgcucaccccugagcccacagccccugcuugggcugccuggc

SEQ ID NO: 323112 - RNA, 64 nt, Homo Sapiens
uccagaauacucucucugggguugugagucagucagcccacaagcauucacagagugcuuaccu

SEQ ID NO: 323113 - RNA, 64 nt, Homo Sapiens
uuguuagucuccauuucauagaugaaaauagugaagcccacagaaaauaaguagcuccuccaca

SEQ ID NO: 323114 - RNA, 64 nt, Homo Sapiens
guuuugcuguugaauggggugagcccacaguugaagcccacaucagcuucuccaggcgucugcg

SEQ ID NO: 323115 - RNA, 64 nt, Homo Sapiens
ugaagcccacaucguuuugcccaggcgucugcggagcccacaguaggugugggcuccagcuucu

SEQ ID NO: 323116 - RNA, 64 nt, Homo Sapiens
uggccaucuagccccaguucagggcagcauccauagcccacaagccagcguggguggggcgggg

SEQ ID NO: 323117 - RNA, 64 nt, Homo Sapiens
ucguugagggccauccauaugccagcugggggccagcccacaguggccauauuggcugcagcag

SEQ ID NO: 323118 - RNA, 64 nt, Homo Sapiens
aacauaaaggaggaugucccggaucuggaauugcagcccacauauuaugagcugaggucagccu

SEQ ID NO: 323119 - RNA, 64 nt, Homo Sapiens
agccugggugcaucugcuaaugugccgugaucccagcccacacugugaagcacguuggccuaag

SEQ ID NO: 323120 - RNA, 64 nt, Homo Sapiens
ucccugagccagccuccgcucaguguggcuccucagcccacagaggggagggagcauggggcca

SEQ ID NO: 323121 - RNA, 64 nt, Homo Sapiens
agggguaggccugagcgccagagucgcccagguuagcccacaggauuccuuugugugccaugga

SEQ ID NO: 323122 - RNA, 64 nt, Homo Sapiens
ccagccagcauggccacccucaagaggcgagaugagcccacagaggcauauccugcggggaugc

SEQ ID NO: 323123 - RNA, 64 nt, Homo Sapiens
ugaaugaaugaaugagccaaagaacaaauaaaugagcccacacacccugaacgcaugcgacaca

SEQ ID NO: 323124 - RNA, 64 nt, Homo Sapiens
gcuugaagugaaggaacagaccgaccccuuucccagcccacaggaccauugcuccagacguguu

SEQ ID NO: 323125 - RNA, 64 nt, Homo Sapiens
cacgcucaaccccaaguccuugcauggucacuugagcccacacaaggaaggaggugacagcacu

SEQ ID NO: 323126 - RNA, 64 nt, Homo Sapiens
cagggcccuaagcacuucauccccagcacccuccagcccacaaaugccccuguacaguccugcc

SEQ ID NO: 323127 - RNA, 64 nt, Homo Sapiens
cccacugccccuguacagucccacccccugcaccagcccacauccaguuugcuccacauggccg

SEQ ID NO: 323128 - RNA, 64 nt, Homo Sapiens
accuuaaggacacagccaaauuggugugauaguuuccgaguaagaaaauuaucccaaagguagg

SEQ ID NO: 323129 - RNA, 64 nt, Homo Sapiens
uuaaaauaagucacuguugacagggucaugaguuuccgaguauaguuuucuuuuuaucuuauuu

SEQ ID NO: 323130 - RNA, 64 nt, Homo Sapiens
aucccuggaaauauuuauuaaacuuuauaguuuauccgaguauguuggaugcuuugacaauaaa

SEQ ID NO: 323131 - RNA, 64 nt, Homo Sapiens
uccuacuauauuuucuaaggagugaauaauauuguccgaguaacuaacuuauuuaaaagacauu

SEQ ID NO: 323132 - RNA, 64 nt, Homo Sapiens
guuauuuuuaaacacuuuuuuucauaauacauauuccgaguagauauuuauaaaauauauguuu

SEQ ID NO: 323133 - RNA, 64 nt, Homo Sapiens
uccuguuuaggaucugauagucuaugccuuugucuccgaguacugcagaacugacauuuugacg

SEQ ID NO: 323134 - RNA, 64 nt, Homo Sapiens
ugcugcucuucggcaccgccugcacgccucgcuguccgaguauggaugggcgccaugugccuuc

SEQ ID NO: 323135 - RNA, 64 nt, Homo Sapiens
ucuuaacuuuugcuucacuucacagucaggccucuccgaguauuuuuuacacauauccuggagu

SEQ ID NO: 323136 - RNA, 64 nt, Homo Sapiens
ugucagcucuuuccuuuggcagcguguuuccuuuuccgaguaugugcuguuaaacuagauuggc

SEQ ID NO: 323137 - RNA, 64 nt, Homo Sapiens
cucccaggcuuaggugauccuucugucucagccuuccgaguagcugggaccacaggcaugcaca

SEQ ID NO: 323138 - RNA, 64 nt, Homo Sapiens
ccuccuggguucaagcaagucuccugccucagccuccgaguagcugggacuacaggugcacgcc

SEQ ID NO: 323139 - RNA, 64 nt, Homo Sapiens
ugggacuacaggugugaguccaucucagccugccuccgaguagcucaggcucaggugauccucc

SEQ ID NO: 323140 - RNA, 64 nt, Homo Sapiens
guucaucuuuauauuaaacuuuuaaacucuaugcuccgaguagaggguguuguguagaacucuu

SEQ ID NO: 323141 - RNA, 64 nt, Homo Sapiens
gauaaucaagaaacuuaguuuuauuucaaauuguuccgaguaacuauguuuuucuauuggagac

SEQ ID NO: 323142 - RNA, 64 nt, Homo Sapiens
ugugcuagcucugucagacucgcaaguugcuuacuccgaguagcuagugugccuuggaaaaggc

SEQ ID NO: 323143 - RNA, 64 nt, Homo Sapiens
uguauguuuuucuauuucugaauuacgaaugaaauccgaguaccuauuagaaaugaguuaugca

SEQ ID NO: 323144 - RNA, 64 nt, Homo Sapiens
cccaagaauuugauaaugcucaaccaaaaaacaauccgaguagguccaaaguuuuucuuagaac

SEQ ID NO: 323145 - RNA, 64 nt, Homo Sapiens
gucugagacucugcucugcaccuccccaccagguuccgaguagugcugaguauaguacuagcug

SEQ ID NO: 323146 - RNA, 64 nt, Homo Sapiens
ccucugcgggacuuuaaaaaucuauucagauauuuccgaguaaguggcuuguuuaaauucuucc

SEQ ID NO: 323147 - RNA, 64 nt, Homo Sapiens
uggggcagggaggcccaggagaugagagagaagguccgaguaggugauagaagacaagggggag

SEQ ID NO: 323148 - RNA, 64 nt, Homo Sapiens
caucccugagcucauccacggcucaugcuguggcuccgaguagugguuugagugggcaggaagg

SEQ ID NO: 323149 - RNA, 64 nt, Homo Sapiens
caccuagguucaagcgauucuugugccccaaacuuccgaguagcugggacuacaggcaugaguc

SEQ ID NO: 323150 - RNA, 64 nt, Homo Sapiens
gcgggcgguagggccggaguuccacaccccagacuccgaguaaagauagcgccacccacgcccc

SEQ ID NO: 323151 - RNA, 64 nt, Homo Sapiens
ugggauuacaggcuccugccuccugccucagccuuccgaguagccucccggguuccagcgauuc

SEQ ID NO: 323152 - RNA, 64 nt, Homo Sapiens
accaucgacuuggccagugagacugagaauggauuccgaguagugaugggccguuugcaccucg

SEQ ID NO: 323153 - RNA, 64 nt, Homo Sapiens
cucccaggcucaagcacuuuuccugucucagccuuccgaguagcugggauuacaggugugugcc

SEQ ID NO: 323154 - RNA, 64 nt, Homo Sapiens
ugggaccacagguguacgacucaugccucagcccuccgaguagccucccagguucaagcgauuc

SEQ ID NO: 323155 - RNA, 64 nt, Homo Sapiens
uggcuggucaacuauaugaaaccuuguucauuccuccgaguacuguaauguucacacuuguaca

SEQ ID NO: 323156 - RNA, 64 nt, Homo Sapiens
uucccuagggcuuguuggagaagagcaagcuggauccgaguagacugggcaccacaguguuucc

SEQ ID NO: 323157 - RNA, 64 nt, Homo Sapiens
uguaguggcgcgaucucggcucagccucccgaguagcugggauuacaggcaugugccaccacgc

SEQ ID NO: 323158 - RNA, 64 nt, Homo Sapiens
guucaagugguucuccuuccucagccucccaaguagcugggauuacaggcaccuaccaccaggg

SEQ ID NO: 323159 - RNA, 64 nt, Homo Sapiens
gcaugguguuccuccaaagaauaggguaaaggagagcugggagggagcccucuccguuggguga

SEQ ID NO: 323160 - RNA, 64 nt, Homo Sapiens
accccuuggaacugugccgaguuccuuaaaucucagcugggauccuggaccugggaggccccug

SEQ ID NO: 323161 - RNA, 64 nt, Homo Sapiens
cagcccuacccaccagcccccaggugaggcuuccagcugggaccugcccagacaggcugagccu

SEQ ID NO: 323162 - RNA, 64 nt, Homo Sapiens
gcccuucucacuccagaggcuaguggucacagacagcugggaauggcagccacagagggucccc

SEQ ID NO: 323163 - RNA, 64 nt, Homo Sapiens
guucaagcgauucuugugccucggccucccuaguagcugggauuacaggcgcacaccaccacac

SEQ ID NO: 323164 - RNA, 64 nt, Homo Sapiens
cggguucaagccauucugccucagccucccaaguagcugggaguacaggcgucugccaccaugc

SEQ ID NO: 323165 - RNA, 64 nt, Homo Sapiens
gcucaggugauccuuccgccucacccuccugaguagcugggacuacaggugugcaccaccacac

SEQ ID NO: 323166 - RNA, 64 nt, Homo Sapiens
guucaagcgauucuccugccucagccucccaaguagcugggauuacaggcauacaccaccacgc

SEQ ID NO: 323167 - RNA, 64 nt, Homo Sapiens
cccuacucgcucagagugggacaguagugaacagagcugggauuccaugcgacagcuugaaugc

SEQ ID NO: 323168 - RNA, 64 nt, Homo Sapiens
guucaagcgauucuccugccucagccuccugaguagcugggauuacaggcacacaccaccacgc

SEQ ID NO: 323169 - RNA, 64 nt, Homo Sapiens
uagugggucgggggauucuucaggaaugguuuggagcugggaguggguagggggauuuuaaaug

SEQ ID NO: 323170 - RNA, 64 nt, Homo Sapiens
uccuuagaacugcccagaaacucugagucccagcagcugggagccagaacuuugccugcccucc

SEQ ID NO: 323171 - RNA, 64 nt, Homo Sapiens
guucaagcgauucuccugccucagccuccugaguagcugggauuacaggugugcaccaacacac

SEQ ID NO: 323172 - RNA, 64 nt, Homo Sapiens
acaggcaugcgccaccauccucagcuuccuaaguagcugggaccgcucaggugauccuuccacc

SEQ ID NO: 323173 - RNA, 64 nt, Homo Sapiens
acaggcaugcaccaccauaccagccucccaaagcagcugggacucucaagugguccuccugcuu

SEQ ID NO: 323174 - RNA, 64 nt, Homo Sapiens
auaggcguccgccaccaugcucagccucucgaguagcugggauuguucaagcaauucuccugcc

SEQ ID NO: 323175 - RNA, 64 nt, Homo Sapiens
gcaggcacacacugccacgcucagccucccgaguagcugggacugugcaagcaauuauccugcc

SEQ ID NO: 323176 - RNA, 64 nt, Homo Sapiens
acaggcuccugccaccacgcucagccuccugaguagcugggauuguucaagugauucucaugcc

SEQ ID NO: 323177 - RNA, 64 nt, Homo Sapiens
aagagagagcuucuguugcuggggccucggacuuagcugggagaggcugcccuuucugggcacc

SEQ ID NO: 323178 - RNA, 64 nt, Homo Sapiens
uggggccugccacugaguaagacaacaccaguagagcugggagccagucuucucucaccaugga

SEQ ID NO: 323179 - RNA, 64 nt, Homo Sapiens
acaggugcgugccaccacacucaaccuccugaguagcugggauuguucaagcgauucuccugcu

SEQ ID NO: 323180 - RNA, 64 nt, Homo Sapiens
acagaugugggccaccauguucagccucucaaguagcugggacuguucaagcuauucucaugcc

SEQ ID NO: 323181 - RNA, 64 nt, Homo Sapiens
acaggcgccugccagcacgcucacccucccaaguagcugggacuguugacaccauucuccugcc

SEQ ID NO: 323182 - RNA, 64 nt, Homo Sapiens
acaggcaugcaccaccaugcucagccucccaaguagcugggauuguucaagcaauucuccuucc

SEQ ID NO: 323183 - RNA, 64 nt, Homo Sapiens
acaggcaugcgucaccacucucagccucucgaguagcugggauugcucaagcgauucuccugcc

SEQ ID NO: 323184 - RNA, 64 nt, Homo Sapiens
ggagccagccccaugccuguaugcugggggaggcagcugggauguguguaccccaccucugaag

SEQ ID NO: 323185 - RNA, 64 nt, Homo Sapiens
cccauugccccggcagcucuacagcccuuaccaaagcugggagcccgggugccacuuaaugcca

SEQ ID NO: 323186 - RNA, 64 nt, Homo Sapiens
guucucaccauucuccugccucagccucccgaguagcugggacuacaggcgcccaccaccacgc

SEQ ID NO: 323187 - RNA, 64 nt, Homo Sapiens
guucaagugauucuccagccucagccucccgaguagcugggauuaugggcgcccaccaccaugc

SEQ ID NO: 323188 - RNA, 64 nt, Homo Sapiens
gugaaacuugguggggucagggaggaaaggcagaagcugggagccucccuucccuuugaaaauc

SEQ ID NO: 323189 - RNA, 64 nt, Homo Sapiens
aagaaggagggacaggcaggcagcaggaggggcgagcugggaggcaggaggcagcggccuguca

SEQ ID NO: 323190 - RNA, 64 nt, Homo Sapiens
guucaagcgauucuccugccccagccucccauauagcugggauuauaggugccugccaccaugc

SEQ ID NO: 323191 - RNA, 64 nt, Homo Sapiens
cuucaagcgauucuccuguaucagccucccaaguagcugggauuauaggcaugugccaccaugc

SEQ ID NO: 323192 - RNA, 64 nt, Homo Sapiens
uucacgccauucuccugccucagcccccccgaguagcugggacuacaggcgcccgccaccacgc

SEQ ID NO: 323193 - RNA, 64 nt, Homo Sapiens
agugcugggauuacaggugucagccacugcgcucagcugggagaugaauuuucauuuaaugacu

SEQ ID NO: 323194 - RNA, 64 nt, Homo Sapiens
guucaagugauucucuugccuuagccucccgagcagcugggauuauaggcguccaccaccacgc

SEQ ID NO: 323195 - RNA, 64 nt, Homo Sapiens
aucccaaaagacaagccaugcuuuuaaaauaaacagcugggaccggcucuauuuuaauuuuuuu

SEQ ID NO: 323196 - RNA, 64 nt, Homo Sapiens
gacuuacuauucuuguuuauaccucaucucuagaagcugggaugaacauuucuuagcaugagcu

SEQ ID NO: 323197 - RNA, 64 nt, Homo Sapiens
guucaagcgauucuccuccuucagacucucgaauagcugggauuacaggcacgccucaccacgc

SEQ ID NO: 323198 - RNA, 64 nt, Homo Sapiens
auuaauuagcuuacaaaaugucuaagaggagcuaagcugggaugccacauaggcagaagccagg

SEQ ID NO: 323199 - RNA, 64 nt, Homo Sapiens
gcaguaugguccaauaggcagcauccucugcugcagcugggagagcugaguuccagggcugugu

SEQ ID NO: 323200 - RNA, 64 nt, Homo Sapiens
aguaagcugaugguacaugcauuuucuagaauagagcugggacuucccauguggcccacaucug

SEQ ID NO: 323201 - RNA, 64 nt, Homo Sapiens
guucaagugauucuccugugucagccuccugaguagcugggauuacaggcgugugccaccaugc

SEQ ID NO: 323202 - RNA, 64 nt, Homo Sapiens
ggucaaaugauucuccugcuuuagccucccaaguagcugggacuacagguguacgccaccacac

SEQ ID NO: 323203 - RNA, 64 nt, Homo Sapiens
guucaugccauucuccuaccucagccucccgaguagcugggacuacaggcgcccaccaccaugc

SEQ ID NO: 323204 - RNA, 64 nt, Homo Sapiens
guucaagcgauucuccugccucagccuccugaguagcugggauuacaggugugugccuccacac

SEQ ID NO: 323205 - RNA, 64 nt, Homo Sapiens
auaggugcgcaccaccacacucaggcuucugaguagcugggauuguucaaguaauucuccugcc

SEQ ID NO: 323206 - RNA, 64 nt, Homo Sapiens
acaggcaccuaccaccuugcucagccuccccaguagcugggauuguuuaagcaauucuccugcc

SEQ ID NO: 323207 - RNA, 64 nt, Homo Sapiens
acaggcgugcaccaccacgcuuagccucccaaguagcugggauuauucaagugauucuugugcc

SEQ ID NO: 323208 - RNA, 64 nt, Homo Sapiens
gcagccugcaccaccacaccucagccaccugacuagcugggauuguucaagcgauucuuuugcc

SEQ ID NO: 323209 - RNA, 64 nt, Homo Sapiens
cuggaaucuucuuuauaauaggcuggaggggggcagcugggacuacuggcucagagcccauggg

SEQ ID NO: 323210 - RNA, 64 nt, Homo Sapiens
cccgucuccaggaaaaggagauggggggcacaggagcugggagcagggaggguggaggggaggg

SEQ ID NO: 323211 - RNA, 64 nt, Homo Sapiens
guucaagcgauuuuccugccucagccucccgaguagcugggauuccaggcgcccgccaccacgc

SEQ ID NO: 323212 - RNA, 64 nt, Homo Sapiens
guucaaucgauucuccugccucacccucccauguagcugggauuacagcugccugccaaauuuu

SEQ ID NO: 323213 - RNA, 64 nt, Homo Sapiens
guucaagugauucuugugccucagccuccugaguagcugggauuauaggcaugcaccaccaugc

SEQ ID NO: 323214 - RNA, 64 nt, Homo Sapiens
guucaagcgauucuugugcuucagccuccugaguagcugggacuauaggccuguaccgucaugc

SEQ ID NO: 323215 - RNA, 64 nt, Homo Sapiens
guucaagcaauucuucugccucagccucccaaguagcugggauuacaggugccugccaccaugc

SEQ ID NO: 323216 - RNA, 64 nt, Homo Sapiens
guucaagugauucuccugccucagccuccugaguagcugggacuacaggcgccugccaccacgc

SEQ ID NO: 323217 - RNA, 64 nt, Homo Sapiens
gcucagauuguccuuccaccuuagccucuggagcagcugggacuacaggugugcacuaccacac

SEQ ID NO: 323218 - RNA, 64 nt, Homo Sapiens
guucaagcaauucuccugccucagccucccaaguagcugggauuacaggugucugccaccaugc

SEQ ID NO: 323219 - RNA, 64 nt, Homo Sapiens
guucaagcaauucuccugccucagccuccugaguagcugggauuauaggcacaugccaccgcgc

SEQ ID NO: 323220 - RNA, 64 nt, Homo Sapiens
guucacgccauucuccugccucagccucccgaguagcugggacuacaggcgccugccaccaugc

SEQ ID NO: 323221 - RNA, 64 nt, Homo Sapiens
auuaggguggucuacuugaggcagaugggauaguagcugggaacuguucccuuucugauuaauu

SEQ ID NO: 323222 - RNA, 64 nt, Homo Sapiens
guucaagugauucuccugucucagccucccaaguagcugggacuacaggcaugagccaucacac

SEQ ID NO: 323223 - RNA, 64 nt, Homo Sapiens
cguggccaccacagccagacugaacguuugugaaagcugggacaucccaccacacgcugagcca

SEQ ID NO: 323224 - RNA, 64 nt, Homo Sapiens
ccucacauggugcuaggcugggagcugcccugagagcugggaugcccaccaaggcccacagaac

SEQ ID NO: 323225 - RNA, 64 nt, Homo Sapiens
gggagguggccugcuuggccgacgucauggagccagcugggagcagggcugagcguugaacccg

SEQ ID NO: 323226 - RNA, 64 nt, Homo Sapiens
acaggggcccgccaccacgcucagcuucccgaguagcugggacuguucacgccauucuccugcc

SEQ ID NO: 323227 - RNA, 64 nt, Homo Sapiens
acaggcacaugccaccacacucagccuccggaguagcugggauuguucaagcaauucuguggcu

SEQ ID NO: 323228 - RNA, 64 nt, Homo Sapiens
guugacgccauucuccugccucagccucccgaguagcugggacuacaggagcucgccaccacac

SEQ ID NO: 323229 - RNA, 64 nt, Homo Sapiens
guucacgccauucuccugccucagccucccguguagcugggacuacaggcacgcgccaccaugc

SEQ ID NO: 323230 - RNA, 64 nt, Homo Sapiens
uucaguggacugucugugucccccugccgaacaaagcugggaguaaaggcaaaaccuugacacg

SEQ ID NO: 323231 - RNA, 64 nt, Homo Sapiens
ugggaguaaaggcaaaaccuugacacguguugguagcugggaccucaucuuccugagggcucug

SEQ ID NO: 323232 - RNA, 64 nt, Homo Sapiens
ugcccuccugccccgugcuggaucuucccuccccagcugggaucugcucccaggcaacugugug

SEQ ID NO: 323233 - RNA, 64 nt, Homo Sapiens
acaagcaugcgccaccaugcucagccucucaaguagcugggauuguucaagcgauucuccugac

SEQ ID NO: 323234 - RNA, 64 nt, Homo Sapiens
acaggcacccgccaccacgcucagccuccugaguagcugggauuuugcaagugauucuccugcc

SEQ ID NO: 323235 - RNA, 64 nt, Homo Sapiens
acagguguucgccaccaugcucagcuucccaaguagcugggacugcucaagcgauucucucacu

SEQ ID NO: 323236 - RNA, 64 nt, Homo Sapiens
acuggugugcaccaccacacucagcuuccugacuagcugggacugcucaaggcauccucccacc

SEQ ID NO: 323237 - RNA, 64 nt, Homo Sapiens
uccuucugccauuccaacuaccaacacagcucuuagcugggagcugccuagagagcuggcccag

SEQ ID NO: 323238 - RNA, 64 nt, Homo Sapiens
gcaggcacccgccaccacgcucagccuccggaguagcugggauuguucaagcgauucucgugcc

SEQ ID NO: 323239 - RNA, 64 nt, Homo Sapiens
acaggugugcaccaccacgcucagccauccaaauagcugggaccgcucaagcgauucucccacc

SEQ ID NO: 323240 - RNA, 64 nt, Homo Sapiens
agaggcacgcaccaccgcgcccagccuccugaguagcugggacugcuugagugauccucccgcc

SEQ ID NO: 323241 - RNA, 64 nt, Homo Sapiens
caguucuuggccugcuagcguccgauggcccgagagcugggacuccgagcacgguugccugagg

SEQ ID NO: 323242 - RNA, 64 nt, Homo Sapiens
guucaagcgauucuccugccucagccucccuaguagcugggacuacagcacccaccaccacacc

SEQ ID NO: 323243 - RNA, 64 nt, Homo Sapiens
guucaagugauucuccugccuuagccuccugaaaagcugggauuacagggcccugccaccaagc

SEQ ID NO: 323244 - RNA, 64 nt, Homo Sapiens
uccacugagcuccuauccagaugggguaggagacagcugggaggcuccgcacgccagaggccuu

SEQ ID NO: 323245 - RNA, 64 nt, Homo Sapiens
guuugagugauucucaugccucagccucccgaguagcugggauuacaggcaugagccacugugc

SEQ ID NO: 323246 - RNA, 64 nt, Homo Sapiens
guagcugggauuacaggcaugagccacugugcccagcugggauauagaaucuaagaguugauug

SEQ ID NO: 323247 - RNA, 64 nt, Homo Sapiens
ccccagggagacagggaugccaagaguagaccagagcugggacccacagacagaaccuccaccu

SEQ ID NO: 323248 - RNA, 64 nt, Homo Sapiens
acagacagaaccuccaccugccugcugcccacugagcugggaccuggucaccuuggauuuuagc

SEQ ID NO: 323249 - RNA, 64 nt, Homo Sapiens
uaaauaaggguauaauaugcauaugagcugauggagcugggagcuauggauggagcaaggucaa

SEQ ID NO: 323250 - RNA, 64 nt, Homo Sapiens
acaggugcacaccaccaugcucagccucccgaguagcugggaguguucaagcaauucuucugac

SEQ ID NO: 323251 - RNA, 64 nt, Homo Sapiens
acaggugugcaccacuaugcucagucuuccggguagcugggacugcuugagcgauucuuguguc

SEQ ID NO: 323252 - RNA, 64 nt, Homo Sapiens
auuguucuuguguaccucauugcuuggaugagucagcugggaauccucaaguuccacacgaaga

SEQ ID NO: 323253 - RNA, 64 nt, Homo Sapiens
acaggcgcccgccaucacgcucagccuccugaguagcugggacugcucaccccauucuccugcc

SEQ ID NO: 323254 - RNA, 64 nt, Homo Sapiens
gaccaagccucagcaccccaagggcauuugcagaagcugggaagcugaauuggagggcagugcc

SEQ ID NO: 323255 - RNA, 64 nt, Homo Sapiens
ggccaagcgauccuccugccucagccuucugaguagcugggaccacaggcgugcaccaccaugc

SEQ ID NO: 323256 - RNA, 64 nt, Homo Sapiens
ugcacuuaggucacuguaagguucuagggcugggagcugggauuugaaccaggaucugucagcg

SEQ ID NO: 323257 - RNA, 64 nt, Homo Sapiens
acagacaccugccaccacgcucagccuccggaguagcugggacuacuuacaccacuguccugcc

SEQ ID NO: 323258 - RNA, 64 nt, Homo Sapiens
acuggcgcccgccaccaugcucagccucccaaguagcugggauuguucaagcgauucuccugcc

SEQ ID NO: 323259 - RNA, 64 nt, Homo Sapiens
accagcacgcuccaccaugcucagccuccugaauagcugggacugcucaacugaucuucccacc

SEQ ID NO: 323260 - RNA, 64 nt, Homo Sapiens
gugucugagguccccaauuaaacacaacauuagcagcugggaagagauaggcagccuuacccag

SEQ ID NO: 323261 - RNA, 64 nt, Homo Sapiens
guucaagugauucuccuaucucagccucccaaguagcugggacuauaggcacacgccaccacgc

SEQ ID NO: 323262 - RNA, 64 nt, Homo Sapiens
guucaagcaauucuccugccucagccucccgaguagcugggauuacaggcgaccgccaccacgc

SEQ ID NO: 323263 - RNA, 64 nt, Homo Sapiens
acaggaacgcgccaccacgcucagccucuugaguagcugggauuccucaagcgauucucuuaac

SEQ ID NO: 323264 - RNA, 64 nt, Homo Sapiens
acaggcgccuaucaccaugcucagccucccgaguagcugggacuauucacgccauucuccugcc

SEQ ID NO: 323265 - RNA, 64 nt, Homo Sapiens
aaucauuuaacacaaagccuuuauauuagccuacagcugggaaacuuaaaugcucugagaacac

SEQ ID NO: 323266 - RNA, 64 nt, Homo Sapiens
acaggugcccgccaccaugcucagccucccuaguagcugggacuguucaugccguucuccugcc

SEQ ID NO: 323267 - RNA, 64 nt, Homo Sapiens
guucacgccauucuccugccucagccucccgagcagcugggacuacaggcgcccgccaccucgc

SEQ ID NO: 323268 - RNA, 64 nt, Homo Sapiens
gaccuugugauccacccgccucggccucccuaacagcugggauuuacaggcgugagccaccgcg

SEQ ID NO: 323269 - RNA, 64 nt, Homo Sapiens
cagcaugucuggaaucccgaggguuauauuuaggagcugggaagauuacccccaaagauguucu

SEQ ID NO: 323270 - RNA, 64 nt, Homo Sapiens
uagcaaaugaaaauaccagaccaagaaaugagugagcugggaaguguuuccaaauacaguuagu

SEQ ID NO: 323271 - RNA, 64 nt, Homo Sapiens
ugccucuuccaaacaaaaacagccuccucuccauagcugggaaguuuauuuuguuuugucucug

SEQ ID NO: 323272 - RNA, 64 nt, Homo Sapiens
gaagcccaugagguugcccagggaagccuccaaaagcugggaugcuugaggguauccaaguuga

SEQ ID NO: 323273 - RNA, 64 nt, Homo Sapiens
uggguuuuaggcuccuuuuuugagccaaaauggaagcugggaaucuggugccauaacuaaugag

SEQ ID NO: 323274 - RNA, 64 nt, Homo Sapiens
cugguucaagcgauucugccucgaccucucaaguagcugggauuacaagcaccagccaccaugc

SEQ ID NO: 323275 - RNA, 64 nt, Homo Sapiens
acagucaggcaccaccacacucagccucccaaguagcugggauuguucaagcaauucuccugcc

SEQ ID NO: 323276 - RNA, 64 nt, Homo Sapiens
acaggugcaugccaccaugcucagccccucaaguagcugggacucacugcagcuaucucucgcc

SEQ ID NO: 323277 - RNA, 64 nt, Homo Sapiens
acaggugcaugccaccacacucagccuucugaguagcugggacucggguucaagcaguucuguc

SEQ ID NO: 323278 - RNA, 64 nt, Homo Sapiens
gauugcuaagaggcuccagugagaagccuaugccagcugggaguuugcagacuaacuuuauuag

SEQ ID NO: 323279 - RNA, 64 nt, Homo Sapiens
ggacagaugaggggaccucguuccaaggccugcgagcugggaaacagcggggcccugggcgggg

SEQ ID NO: 323280 - RNA, 64 nt, Homo Sapiens
acugcuguguaccucuugcuaggucacugcugugagcugggagacccuugcugcuggagaucug

SEQ ID NO: 323281 - RNA, 64 nt, Homo Sapiens
acgggcgccccaccaccacgucagccuccagaguagcugggacuguccacgccauucuccugcc

SEQ ID NO: 323282 - RNA, 64 nt, Homo Sapiens
agaggcgccagccaacacacucagccucccgaguagcugggauuguucaagcaauucuccugcc

SEQ ID NO: 323283 - RNA, 64 nt, Homo Sapiens
acaguugccgccacacccggucggccuccugaguagcugggauuguucaagccauucuccugcc

SEQ ID NO: 323284 - RNA, 64 nt, Homo Sapiens
acaggugcgcaccaccaugcucagccucccaaguagcugggauuauucaagcaauucuccuguc

SEQ ID NO: 323285 - RNA, 64 nt, Homo Sapiens
acauccauucagaaguuuuguuguuuuacucuaaagcugggaaaggaaaugagagggaaaagac

SEQ ID NO: 323286 - RNA, 64 nt, Homo Sapiens
ugucaccaagcaggagaguuaaggauucaccaugagcugggaaaugcuuuugccaugaguauga

SEQ ID NO: 323287 - RNA, 64 nt, Homo Sapiens
guucaagugauucucccaccucagccucccaaguagcugggacuacgggcacaugccacugcac

SEQ ID NO: 323288 - RNA, 64 nt, Homo Sapiens
guucaagcgauucuccugccucagcaucucgaguagcugggauuacaggcaugcaccaccacgc

SEQ ID NO: 323289 - RNA, 64 nt, Homo Sapiens
ucagaaccaugguggaauaacuccaacccaaacuagcugggaguaguuuacaagcagagacuca

SEQ ID NO: 323290 - RNA, 64 nt, Homo Sapiens
acaccgugacaucaggccaggaggaugauuuccuagcugggaagcagucacaggcaggggccuu

SEQ ID NO: 323291 - RNA, 64 nt, Homo Sapiens
auuuaagugauucuccugccucagccucccaaguagcugggauuacaggugugcaccaccaugc

SEQ ID NO: 323292 - RNA, 64 nt, Homo Sapiens
guucaagcaauucucccaccucagccucccaaguagcugggauuacagacgugugccaccauac

SEQ ID NO: 323293 - RNA, 64 nt, Homo Sapiens
gggagacgggugggggucgcugacuauagacuguagcugggaggaggggaugcucccagggcug

SEQ ID NO: 323294 - RNA, 64 nt, Homo Sapiens
cuccugccucccugccucagccugggaccugaguagcugggaccacaggcaugcgccaccacuc

SEQ ID NO: 323295 - RNA, 64 nt, Homo Sapiens
guucaagcgauucuucugcuucagccucccgaguagcugggacuacaggcacccaccaucaugu

SEQ ID NO: 323296 - RNA, 64 nt, Homo Sapiens
ggcuaagugauccucccaccucagccucccgaauagcugggacuacaggugugagucaccaagc

SEQ ID NO: 323297 - RNA, 64 nt, Homo Sapiens
guucaagcaauucuccugccucaggcuccugaguagcugggauuacaggcacgugacaccaggc

SEQ ID NO: 323298 - RNA, 64 nt, Homo Sapiens
cggguucacgccauucugcgucagccucccaaguagcugggacuacaggcaccugccacgaugc

SEQ ID NO: 323299 - RNA, 64 nt, Homo Sapiens
guucaaacgauccuacugccucauccuucggaguagcugggauuacaggcaggugccaccaugc

SEQ ID NO: 323300 - RNA, 64 nt, Homo Sapiens
guucaagugauucucuugccucagccuccugaguagcugggauuacagguuccugcuaccacgc

SEQ ID NO: 323301 - RNA, 64 nt, Homo Sapiens
guucaagcgauucucccaccccagccucccaaguagcugggauuacaggugugugccacuacgg

SEQ ID NO: 323302 - RNA, 64 nt, Homo Sapiens
acaggcgcccgccaccaugcucagccuccgaaguagcugggauuguucaagagauucuccugcc

SEQ ID NO: 323303 - RNA, 64 nt, Homo Sapiens
acaggugcgugccaccacacucagccuccugagcagcugggauuguucaagcgauucuccugcc

SEQ ID NO: 323304 - RNA, 64 nt, Homo Sapiens
cacguucugcuucucacccucuggugacucugugagcugggaaaugagggacuggaagugaggc

SEQ ID NO: 323305 - RNA, 64 nt, Homo Sapiens
guucaagcgauucucccgccucagguucccgaguagcugggacuacaggcaugugccaccaugc

SEQ ID NO: 323306 - RNA, 64 nt, Homo Sapiens
caccauggauuuuuaauggaucuuuguucuaggcagcugggaauagacaugguacuuaccuuag

SEQ ID NO: 323307 - RNA, 64 nt, Homo Sapiens
gcucaagcgauccucccgccuuaacugccugaguagcugggacuacaggcaugcaccaccacgc

SEQ ID NO: 323308 - RNA, 64 nt, Homo Sapiens
uccugggcccccaccauucagggccuucucuccaagcugggagcccggguuccugggucuggaa

SEQ ID NO: 323309 - RNA, 64 nt, Homo Sapiens
cucugguggaugcuaugaacucuucagcuugaggagcugggaagccugguuuuugcucagccug

SEQ ID NO: 323310 - RNA, 64 nt, Homo Sapiens
ugaaccaggccuucugauuugaacugagccgugcagcugggauuaggucacauagcugggauuu

SEQ ID NO: 323311 - RNA, 64 nt, Homo Sapiens
ugaacugagccgugcagcugacccaaggucacauagcugggauucaucauuugucuuugaacgu

SEQ ID NO: 323312 - RNA, 64 nt, Homo Sapiens
ucuuagugcaucaguggccugucaccuuccggggagcugggacuccucugccuucauuucuccu

SEQ ID NO: 323313 - RNA, 64 nt, Homo Sapiens
ucuggcaucacuugaguaguaucaugugccaccgagcugggacugagccaucggcuuugugguc

SEQ ID NO: 323314 - RNA, 64 nt, Homo Sapiens
guucuuucagcaaaaagucugagccaccaugcccagcugggagcagugcuaggauuacaggcgu

SEQ ID NO: 323315 - RNA, 64 nt, Homo Sapiens
acaggcaugcaccaccauacucagccucccuaguagcugggauuguucaagugauucuccugcc

SEQ ID NO: 323316 - RNA, 64 nt, Homo Sapiens
gcaggcaugcaccaucacacucagccucccgaguagcugggauuauucaagcgacucuccugcc

SEQ ID NO: 323317 - RNA, 64 nt, Homo Sapiens
guucaagcgauucuugugccuaagccaccugagcagcugggauuacaggugcaugccaccaugc

SEQ ID NO: 323318 - RNA, 64 nt, Homo Sapiens
gcuccagcaaucuucuuacgucagccuccagaguagcugggaccgcaggcacuugccaccacgc

SEQ ID NO: 323319 - RNA, 64 nt, Homo Sapiens
acagggguaugccaccacacucagacuccugcguagcugggaccggcuuaggugaucuucccac

SEQ ID NO: 323320 - RNA, 64 nt, Homo Sapiens
acaagcgugugcccccacaguuagccucccagguagcugggacuguucaagugauucuccugcc

SEQ ID NO: 323321 - RNA, 64 nt, Homo Sapiens
cgagggcugggaguaccuggggccccauccccccagcugggaugguggaagccggugguggcca

SEQ ID NO: 323322 - RNA, 64 nt, Homo Sapiens
guucaagcaguucuccugccucagccucccaaauagcugggauuacaguugccugccaccacgc

SEQ ID NO: 323323 - RNA, 64 nt, Homo Sapiens
guuuaugccauucuccugucucagccucccgaguagcugggacuacaggcacccgccaacacgc

SEQ ID NO: 323324 - RNA, 64 nt, Homo Sapiens
gcucaagcaguucuccugccucagccuccugaguagcugggacuacaggcacccgccaccaugc

SEQ ID NO: 323325 - RNA, 64 nt, Homo Sapiens
gcucaagcgcuucuccugccucagccuccugaguagcugggauuacaggcaugugccagcaugc

SEQ ID NO: 323326 - RNA, 64 nt, Homo Sapiens
guucaagugauucuccugccucagccucuugaguagcugggacuacaggcgcacaccaccacgc

SEQ ID NO: 323327 - RNA, 64 nt, Homo Sapiens
gaucaagcaacucuccugccucagccucccuaguagcugggauuacaggcaugcacuaccacgc

SEQ ID NO: 323328 - RNA, 64 nt, Homo Sapiens
agaucaagagauucuccagucucagcucccaaguagcugggauuacaggcauguacuaccaugc

SEQ ID NO: 323329 - RNA, 64 nt, Homo Sapiens
acaggcacccaccgucacacucagccuccccagcagcugggacuauucacgccauucuccugcc

SEQ ID NO: 323330 - RNA, 64 nt, Homo Sapiens
acaggugugcgccaccacgcucagccucccaaguagcugggauuguucaagugauucuccugcu

SEQ ID NO: 323331 - RNA, 64 nt, Homo Sapiens
acaggcaccugccaccaugcucagccuccugaguagcugggacuguucacgccauucuccugcc

SEQ ID NO: 323332 - RNA, 64 nt, Homo Sapiens
acaggcaugcgccaccacacucagccuccaaaguagcugggauuguucaagcgauucuccugcc

SEQ ID NO: 323333 - RNA, 64 nt, Homo Sapiens
auaggcgcgugccaccacaaucagccuccugaguagcugggacuguucaagcaauucuccugcc

SEQ ID NO: 323334 - RNA, 64 nt, Homo Sapiens
acaggcgcccgccaccacgcucagccucccgaguagcugggacuguucacgccauucuccugcc

SEQ ID NO: 323335 - RNA, 64 nt, Homo Sapiens
acaagugcccaccaccaugcucagccuuccaaguagcugggauuguucaagcaauucuucugcc

SEQ ID NO: 323336 - RNA, 64 nt, Homo Sapiens
acaggcaugcgccaccacgcgcagccucccaagaagcugggauuauucaagcaauucuccugcc

SEQ ID NO: 323337 - RNA, 64 nt, Homo Sapiens
acaggcaccugccaccacauucagccucccaaguagcugggauuguucaagcaauuauccugcc

SEQ ID NO: 323338 - RNA, 64 nt, Homo Sapiens
acaggcacccaccaccaugcucagccuccuaaguagcugggauuguucacgcaauucuccugcc

SEQ ID NO: 323339 - RNA, 64 nt, Homo Sapiens
acaggcaugcgccaccaugcucagccugccaaguagcugggauuguucaagcgauuccccugcc

SEQ ID NO: 323340 - RNA, 64 nt, Homo Sapiens
acaggcaugcgccaccaugaucagccuccugauuagcugggauugguucaggcuauucuccugc

SEQ ID NO: 323341 - RNA, 64 nt, Homo Sapiens
acaggcaugcaccaccacgcucagccucccgaguagcugggauuguucaagugauucuccugcc

SEQ ID NO: 323342 - RNA, 64 nt, Homo Sapiens
ugccagcaugaacgccuccaccccagguccugccagcugggaagcccugcuccaccaggauguc

SEQ ID NO: 323343 - RNA, 64 nt, Homo Sapiens
acaggcaugagccaccaugcucagccuccugaguagcugggacuccuuaagugauccucccacc

SEQ ID NO: 323344 - RNA, 64 nt, Homo Sapiens
cugggcaugcaucgccacguucagccucccaaguagcugggagcgcucaagcgauccuccugcc

SEQ ID NO: 323345 - RNA, 64 nt, Homo Sapiens
gaacgagagugcacugcaugauagcguucuggugagcugggaaggacccaccacugccacugag

SEQ ID NO: 323346 - RNA, 64 nt, Homo Sapiens
gaagguggggcuggaaaaggguuagaagccuccuagcugggauugucuuuguuucaccuuucuu

SEQ ID NO: 323347 - RNA, 64 nt, Homo Sapiens
gguucaagcaauuauuugccucagccucccgaguagcugggauuauaggcacccgccaccaugu

SEQ ID NO: 323348 - RNA, 64 nt, Homo Sapiens
cggcuccuagaauccuuagagucugaauuccuuuagcugggaacagcugucauggucaccccug

SEQ ID NO: 323349 - RNA, 64 nt, Homo Sapiens
aucugccucccuccauggcagggguggauucgggagcugggaguaaccaggcaaagucaaccag

SEQ ID NO: 323350 - RNA, 64 nt, Homo Sapiens
agaaggcaggggaaggaccugaugagaacagaauagcugggaggcugcagagggugcugggagc

SEQ ID NO: 323351 - RNA, 64 nt, Homo Sapiens
guucaagggauccucccgccucagccuccugagcagcugggauuacaggcgcacaucaccaugc

SEQ ID NO: 323352 - RNA, 64 nt, Homo Sapiens
acaggugcacaccaccacacucagccucccgaguagcugggacugcucaagccauuuucccacc

SEQ ID NO: 323353 - RNA, 64 nt, Homo Sapiens
cagguaagaccggauugaaggugugcuguggggcagcugggaucccagggagcuggugacacuu

SEQ ID NO: 323354 - RNA, 64 nt, Homo Sapiens
cuggugcggcucagagcucggcgaguuugcugggagcugggagcaggcuugccuggcagagaac

SEQ ID NO: 323355 - RNA, 64 nt, Homo Sapiens
auucaagugauccucccaucucagccucccaaguagcugggacuacaguugugcaccacaaugc

SEQ ID NO: 323356 - RNA, 64 nt, Homo Sapiens
guugaagcgauucuccugccucagccucccaaguagcugggauuacaggcaugcaccaccaugc

SEQ ID NO: 323357 - RNA, 64 nt, Homo Sapiens
guucaugccauucuccugccucagccucccgaguagcugggacuacaggcacgugugaccaugc

SEQ ID NO: 323358 - RNA, 64 nt, Homo Sapiens
guucaagcaauucuccugccucagccucccaaguagcugggacuacaggcaugcaccaccacac

SEQ ID NO: 323359 - RNA, 64 nt, Homo Sapiens
guacaagagauucuccugccucagccucccgaguagcugggacuacaggcgugugccaccaugc

SEQ ID NO: 323360 - RNA, 64 nt, Homo Sapiens
cuccuggcauaacacccagcuugguuuggguggcagcugggagaacuucucucccagcccugca

SEQ ID NO: 323361 - RNA, 64 nt, Homo Sapiens
cugcacacacagcgguggggaggcggggaggagcagcugggacccagaacugagccugggaggg

SEQ ID NO: 323362 - RNA, 64 nt, Homo Sapiens
gccccauuagcuuuaaaauguagccccagguuggagcugggaacacuguacuggccacuuaccc

SEQ ID NO: 323363 - RNA, 64 nt, Homo Sapiens
ggagugguccacccacggucccagcacaaggcagagcugggaugaaaacagggcugaaaagacu

SEQ ID NO: 323364 - RNA, 64 nt, Homo Sapiens
guucaagcgauucuccugccucagccuccugaguagcugggaauacaggcaugcgccacuacac

SEQ ID NO: 323365 - RNA, 64 nt, Homo Sapiens
ccucaggugauccguccaccucagccucccaaagagcugggauuacaggugugagcuaccgcgc

SEQ ID NO: 323366 - RNA, 64 nt, Homo Sapiens
acaggcaugcaccaccacacucagccucccgaguagcugggauuguucaagcaauucuccuucu

SEQ ID NO: 323367 - RNA, 64 nt, Homo Sapiens
acaggcgcgugccaccacgccucagccuccaaguagcugggacugguucaggcgauucuccugc

SEQ ID NO: 323368 - RNA, 64 nt, Homo Sapiens
ggcaggaaggauccuccccucuggagcccccaggagcugggagaggccacaagcccagggacac

SEQ ID NO: 323369 - RNA, 64 nt, Homo Sapiens
ggcaggaaggacccuccccucuggaguccccaggagcugggagaugccccaagcccagggaugc

SEQ ID NO: 323370 - RNA, 61 nt, Homo Sapiens
uacaggauggugggcaggaucucaagccagcccccuccagcucaugacacuguuuggccuu

SEQ ID NO: 323371 - RNA, 61 nt, Homo Sapiens
ugacgcccagcuccgccugcugggaagagcuccccuccacagcugcagcugauccauagga

SEQ ID NO: 323372 - RNA, 61 nt, Homo Sapiens
uguccaggguaaaguguaaccuugaucccugccccuccaggcacucacagaggcuccuggc

SEQ ID NO: 323373 - RNA, 61 nt, Homo Sapiens
ccuucuucaugcacagcugcccccacuccagccccuccaccggccgaccucacugcacaga

SEQ ID NO: 323374 - RNA, 61 nt, Homo Sapiens
gcccugaguuucuuggcugcaguaaggcucuccccuccagagugcauguggaaaguaucag

SEQ ID NO: 323375 - RNA, 61 nt, Homo Sapiens
acucccacccugacagcccaucaaagagaaaccccuccagagcuuuccuagauccacacuu

SEQ ID NO: 323376 - RNA, 61 nt, Homo Sapiens
caccgggugccacuuaaugcucccugggagaccccuccagcguguggggcaggcuccgucc

SEQ ID NO: 323377 - RNA, 61 nt, Homo Sapiens
ccacugaguguuuuggccacugccucuccugccccuccaggcccuccuggaggaguccugu

SEQ ID NO: 323378 - RNA, 61 nt, Homo Sapiens
agcacaaacccuggggacucugcuuggcuguccccuccaucuggggauggagaaugccagc

SEQ ID NO: 323379 - RNA, 61 nt, Homo Sapiens
cccagaaggaacccggucccaggccgcauggccccuccaggaacauucccacauaauacau

SEQ ID NO: 323380 - RNA, 61 nt, Homo Sapiens
agugacugaggcuggggugccucucccuggcccccuccaacugccaaauucugcuucccuc

SEQ ID NO: 323381 - RNA, 61 nt, Homo Sapiens
guucagguggcuccaucgucuauucugugguccccuccaugagccuuugccccaggguggg

SEQ ID NO: 323382 - RNA, 61 nt, Homo Sapiens
gccuggcucagcgggccggacccucccggggccccuccacugggugcucccccgcccauca

SEQ ID NO: 323383 - RNA, 61 nt, Homo Sapiens
ccacagcccccaucccguagcucagucccugccccuccagcgggggcgguguggcugcagc

SEQ ID NO: 323384 - RNA, 61 nt, Homo Sapiens
ccugggggcggccauguuguccaggcccaggccccuccaggacuguggcugccuccccucc

SEQ ID NO: 323385 - RNA, 61 nt, Homo Sapiens
ggcccaggccccuccaggacuguggcugccuccccuccacggccuccagggcggcuggcug

SEQ ID NO: 323386 - RNA, 61 nt, Homo Sapiens
cucccccaucccgggggccagcagaggcgccccccuccauccccggcccggccuccagggc

SEQ ID NO: 323387 - RNA, 61 nt, Homo Sapiens
ucagaggcccccuggccgcgagcacagaagcccccuccacgcacacuuaaaccuuccaagu

SEQ ID NO: 323388 - RNA, 61 nt, Homo Sapiens
uuaccucccgcaccuccucccagacucacagccccuccaugcccacauccucccugcuccu

SEQ ID NO: 323389 - RNA, 61 nt, Homo Sapiens
gggcuuuuucucucaugcauggccacugcagccccuccaauccccucugcagaucuccucu

SEQ ID NO: 323390 - RNA, 61 nt, Homo Sapiens
uaggacccagcccauccccacacugcuguccccccuccagcucuccagguuggguuggggg

SEQ ID NO: 323391 - RNA, 61 nt, Homo Sapiens
ccagcccacuggaccagaacggaagacauccccccuccaucgcugcauggccaggguggca

SEQ ID NO: 323392 - RNA, 61 nt, Homo Sapiens
ccgcuucagccugggcaucaagcuccuugaaccccuccagcgggcaaagagcgcucaaucc

SEQ ID NO: 323393 - RNA, 61 nt, Homo Sapiens
caccccucucccaaccucuccuguauccccaccccuccaccaaccccuguaccucccaccc

SEQ ID NO: 323394 - RNA, 61 nt, Homo Sapiens
cuccaccccugccucuccuccaccccugccuccccuccaccccugccucuccuccacccgc

SEQ ID NO: 323395 - RNA, 61 nt, Homo Sapiens
cuccaccccugccucuccuccaccccugccuccccuccaccugccccagugcccagaccaa

SEQ ID NO: 323396 - RNA, 61 nt, Homo Sapiens
gacacugccacagggacgccuucccuccccuccccuccagcccaccccugcacagccccuc

SEQ ID NO: 323397 - RNA, 61 nt, Homo Sapiens
uccccagcaggagagccuaguccucccccagccccuccagccaccaggguguccucuagga

SEQ ID NO: 323398 - RNA, 61 nt, Homo Sapiens
cucucccccagccgcacgggcaucuaaguggccccuccacccccgguggugaugacuccua

SEQ ID NO: 323399 - RNA, 61 nt, Homo Sapiens
gguaagccccccuccacagggaacaggagccccccuccacaucauugagauacaaguuucc

SEQ ID NO: 323400 - RNA, 61 nt, Homo Sapiens
ccccaaugcuuguagaccuuucuuuccuccaccccuccaucccugugcagaccuccacccu

SEQ ID NO: 323401 - RNA, 61 nt, Homo Sapiens
ggcccgccaggugggcauggagacaggcagaccccuccagaagcucgagagccagacggcc

SEQ ID NO: 323402 - RNA, 61 nt, Homo Sapiens
cuccucuucaucucagcauucuccaucacuuccccuccagaaaaacggauggaaggaagcc

SEQ ID NO: 323403 - RNA, 61 nt, Homo Sapiens
ucagugcagguugcccuuaauuuuccccaaaccccuccaucggcaagucuaguugcccuuu

SEQ ID NO: 323404 - RNA, 61 nt, Homo Sapiens
uuaugcggagugcccgcaaggcugggguagcccccuccaguacaccccaaagugaaaggga

SEQ ID NO: 323405 - RNA, 61 nt, Homo Sapiens
gcccugcccccggccccugccccugcccgccccccuccaguccaggcagucgagcuccacc

SEQ ID NO: 323406 - RNA, 61 nt, Homo Sapiens
cauccccuucuguacauagcggaaucaguucccccuccaccacagauaccauuuucucaau

SEQ ID NO: 323407 - RNA, 61 nt, Homo Sapiens
guucccuccuugagagcugagacuccacauuccccuccaguaaaccccaccucccuuuauu

SEQ ID NO: 323408 - RNA, 61 nt, Homo Sapiens
ggcuuugggccacagaaugauuagaucccuuccccuccaugauaacuugacaugagcaccu

SEQ ID NO: 323409 - RNA, 61 nt, Homo Sapiens
aguagcugggugagaccugucucccauucucccccuccaguuuuguccccuggcugcugcc

SEQ ID NO: 323410 - RNA, 61 nt, Homo Sapiens
aggaaagaguuguuggugccauugcaggugcccccuccaggccugacuggcuccgccaggc

SEQ ID NO: 323411 - RNA, 61 nt, Homo Sapiens
cuccuccccacacugagcuccuuuguuccucccccuccagccuuugccugggaacuggucc

SEQ ID NO: 323412 - RNA, 61 nt, Homo Sapiens
gggcuggccugugagccuugugcccggcccaccccuccaaggagcauccugcugggcucuc

SEQ ID NO: 323413 - RNA, 61 nt, Homo Sapiens
guccagagccaggaaggggccccaagcccugccccuccagaggaagcaccgucugcccggg

SEQ ID NO: 323414 - RNA, 61 nt, Homo Sapiens
gagugcccggugcuugggggcugggccauguccccuccauccuugcagcugcagcccaucc

SEQ ID NO: 323415 - RNA, 61 nt, Homo Sapiens
gguggauuuguuccaaagccucaaucccuacccccuccaaggggcagguuuccaguccagc

SEQ ID NO: 323416 - RNA, 61 nt, Homo Sapiens
aggggccaggcuggacgcuuccugugggaguccccuccagaccuggcuggccccugcagcc

SEQ ID NO: 323417 - RNA, 61 nt, Homo Sapiens
aaccuugugucccagcccuguugggcuuuggccccuccagcccuguucuuggugaccccag

SEQ ID NO: 323418 - RNA, 61 nt, Homo Sapiens
gagccuuggcuacaucugugucugucaugccccccuccacuuaggaggugagacauggggu

SEQ ID NO: 323419 - RNA, 61 nt, Homo Sapiens
aagaugaugggguuuagaucccucaggcucuccccuccagacuccgcccuucccucccucc

SEQ ID NO: 323420 - RNA, 61 nt, Homo Sapiens
gggagggaggggaggaugagcacgcccagcuccccuccagggugugacuuggccccucugg

SEQ ID NO: 323421 - RNA, 61 nt, Homo Sapiens
cucccaggagucgcugaucaaccugcgcccaccccuccacuguguccaggggcuuggagag

SEQ ID NO: 323422 - RNA, 61 nt, Homo Sapiens
gagugaggagggggccugagacaccccugccccccuccagagccgugggcaaacccugaag

SEQ ID NO: 323423 - RNA, 61 nt, Homo Sapiens
cugcccaggagaggggccgacacgagagcagccccuccacucccagcgaggacacacacuc

SEQ ID NO: 323424 - RNA, 61 nt, Homo Sapiens
uggagacauggccuagggggaggcuccccgcccccuccacgccagcucagggcggaagguc

SEQ ID NO: 323425 - RNA, 61 nt, Homo Sapiens
ccgagcugggggggaaucuggcacugcccuaccccuccacuugccggugcccugcccccca

SEQ ID NO: 323426 - RNA, 61 nt, Homo Sapiens
gugggucuggggaggggacauagugagacccccccuccagguccgccccuuccaguucaca

SEQ ID NO: 323427 - RNA, 61 nt, Homo Sapiens
ucugcuccucuagggccgcccgccccuccacccccuccaacccacgcuccccguccuuggc

SEQ ID NO: 323428 - RNA, 61 nt, Homo Sapiens
cccuccaacucugcuccucuguccuuggccgccccuccaccauaccccggccacgcucccc

SEQ ID NO: 323429 - RNA, 61 nt, Homo Sapiens
ccauuuucugccgugaaaccucuacaacugcccccuccagccuuccccugcaaccagacag

SEQ ID NO: 323430 - RNA, 61 nt, Homo Sapiens
uuuccgaccccacaccgacacgcucucacacccccuccagcgacccuuccacugacacccu

SEQ ID NO: 323431 - RNA, 61 nt, Homo Sapiens
cgcuggaggaaaccagcccuuuagccagcagccccuccaccacaggcacugcuguguggaa

SEQ ID NO: 323432 - RNA, 61 nt, Homo Sapiens
caaggauuucacaugcagaagagaaaaggccccccuccaccccccgcauucccugccgagu

SEQ ID NO: 323433 - RNA, 61 nt, Homo Sapiens
ccaguggccucgugguuauugaggaggcagcccccuccacaaggagacugaggcuuagaga

SEQ ID NO: 323434 - RNA, 61 nt, Homo Sapiens
ucccagcagcccaagcuuaaaggcccaagguccccuccacaagcuggguggggacagugau

SEQ ID NO: 323435 - RNA, 61 nt, Homo Sapiens
uaucuuuccuaggcagaucacccuaccccgaccccuccacgcuccugcaaggggcucaacc

SEQ ID NO: 323436 - RNA, 61 nt, Homo Sapiens
ggaggggucuccucugcagcccucccacugcccccuccacuugaugcugccaggccuggga

SEQ ID NO: 323437 - RNA, 61 nt, Homo Sapiens
acaaucccacuggaagaaaaagauugcccagccccuccaguuccauuucgagaacauaaau

SEQ ID NO: 323438 - RNA, 61 nt, Homo Sapiens
uugccugccccugaagaccucaguguucuucccccuccaugagggcaucugacucccucuu

SEQ ID NO: 323439 - RNA, 61 nt, Homo Sapiens
gcccugugcuccuccccgcaggacauggcucccccuccaccugcucugugcccacccucca

SEQ ID NO: 323440 - RNA, 61 nt, Homo Sapiens
ggcccccaaccccccauuucuuccccaccaaccccuccaaugcuguuaucccugccugguc

SEQ ID NO: 323441 - RNA, 61 nt, Homo Sapiens
ccauagcagccccugcuucagccccaccgcaccccuccagggggccugccuuucccugaca

SEQ ID NO: 323442 - RNA, 61 nt, Homo Sapiens
uaucacaacccaccaaaaauagaugccucucccccuccagcccuagccgagcugguccuag

SEQ ID NO: 323443 - RNA, 64 nt, Homo Sapiens
cuuacgcugaguucugaacugacggugcucguucauagcacaagcgugugggugggaauucucu

SEQ ID NO: 323444 - RNA, 64 nt, Homo Sapiens
gguggggcuucgggcagggauugcagucacucgcauagcacagauuccugggccagcuuccugc

SEQ ID NO: 323445 - RNA, 64 nt, Homo Sapiens
aacuugaagccacauccuacagauggcagcccaaauagcacaugggcaauuggcaccaucuuua

SEQ ID NO: 323446 - RNA, 64 nt, Homo Sapiens
aaacuuugccucugaugcucagccccacccccaaauagcacacaagcuuguuaaccccaccucu

SEQ ID NO: 323447 - RNA, 64 nt, Homo Sapiens
ccuaucagaucuugugagacuuacuaucacgagaauagcacaggaaagacuggcccccaugauu

SEQ ID NO: 323448 - RNA, 64 nt, Homo Sapiens
cccaucagaucucaugagacuuacuaucaugagaauagcacaggaaagacuggccccccugauu

SEQ ID NO: 323449 - RNA, 64 nt, Homo Sapiens
aucagaauuuuuuuaggauucacaacuaaucacuauagcacaugaccuugggauuacauuuuua

SEQ ID NO: 323450 - RNA, 64 nt, Homo Sapiens
cuauuuugaaugcaugugacuaagagcaugauuuauagcacaaccuuuccaauaaucccuuaau

SEQ ID NO: 323451 - RNA, 64 nt, Homo Sapiens
ugcucgcaucuuuguuuuuaaucuggcuucgaacauagcacaaguaacuugaauagcacaucaa

SEQ ID NO: 323452 - RNA, 64 nt, Homo Sapiens
uaaucuggcuucgaacauagcacaaguaacuugaauagcacaucaauagguuacuggacaaaag

SEQ ID NO: 323453 - RNA, 64 nt, Homo Sapiens
cccaccaugccccagguaacaaaagaaggggaagaagaucaaaaaagaaaagaagaaggggaag

SEQ ID NO: 323454 - RNA, 64 nt, Homo Sapiens
aagaaaagaagaaggggaagaaaagaaggggaagaagaucaaagaaaagaaggggaaggggaag

SEQ ID NO: 323455 - RNA, 64 nt, Homo Sapiens
uguuuuuguuuuuaaagcgcuaucacacaccuccaagaucaagauccuguucugagucagauga

SEQ ID NO: 323456 - RNA, 64 nt, Homo Sapiens
aaucucacucacagucuuauucuagaggaagcucaagaucaaggacugcgucaaaguccucauc

SEQ ID NO: 323457 - RNA, 64 nt, Homo Sapiens
aaauggaaaauaaucuaacucgaaggcgccugaaaagaucaaauucuauaucccagauaccuuc

SEQ ID NO: 323458 - RNA, 64 nt, Homo Sapiens
auuggauuuguagguccugugccaccaaaacccaaagaucaaagguccaucaucaaaacaccaa

SEQ ID NO: 323459 - RNA, 64 nt, Homo Sapiens
ugcggagggggcagccucagcucucuuuucagagaagaucaaagcugggcuucccagggugccu

SEQ ID NO: 323460 - RNA, 64 nt, Homo Sapiens
uggcugccugagaaaggucuuucuuuuuauagaaaagaucaaggcugucuggcgcgggacucca

SEQ ID NO: 323461 - RNA, 64 nt, Homo Sapiens
caucucugggcuuguuccgggaagcgaaaagaccaagaucaaauaauagcugggguggagaaaa

SEQ ID NO: 323462 - RNA, 64 nt, Homo Sapiens
ccuuuugagauucuccaacuugacaaaugugccaaagaucaacagacagaaaauaucauccugu

SEQ ID NO: 323463 - RNA, 64 nt, Homo Sapiens
ccucuuccaguucuuuaaaaacguuuaugauauuaagaucaaagggaggaagggaagacagcag

SEQ ID NO: 323464 - RNA, 64 nt, Homo Sapiens
gcauucucuaggccaaaagggcuagccagguggcaagaucaauuuagcuacuuuguauuuucag

SEQ ID NO: 323465 - RNA, 64 nt, Homo Sapiens
ugagaaauaccauacagauaaugagauugggaaaaagaucaauauuucucauuuuaucccacuu

SEQ ID NO: 323466 - RNA, 64 nt, Homo Sapiens
cuuuauagaacagucaacauuuccacucaugcucaagaucaaaaaaggagugccaaauaggacu

SEQ ID NO: 323467 - RNA, 64 nt, Homo Sapiens
guucaccugggggccauggaggggggacccacuaaagaucaagaucaaagauucuccccaucuc

SEQ ID NO: 323468 - RNA, 64 nt, Homo Sapiens
cugggggccauggaggggggacccacuaaagaucaagaucaaagauucuccccaucucacagac

SEQ ID NO: 323469 - RNA, 64 nt, Homo Sapiens; identical to SEQ ID NO: 303515

SEQ ID NO: 323470 - RNA, 64 nt, Homo Sapiens; identical to SEQ ID NO: 303516

SEQ ID NO: 323471 - RNA, 64 nt, Homo Sapiens; identical to SEQ ID NO: 303517

SEQ ID NO: 323472 - RNA, 64 nt, Homo Sapiens; identical to SEQ ID NO: 303518

SEQ ID NO: 323473 - RNA, 64 nt, Homo Sapiens; identical to SEQ ID NO: 303519

SEQ ID NO: 323474 - RNA, 64 nt, Homo Sapiens; identical to SEQ ID NO: 303520

SEQ ID NO: 323475 - RNA, 64 nt, Homo Sapiens; identical to SEQ ID NO: 303521

SEQ ID NO: 323476 - RNA, 64 nt, Homo Sapiens; identical to SEQ ID NO: 303522

SEQ ID NO: 323477 - RNA, 64 nt, Homo Sapiens; identical to SEQ ID NO: 303523

SEQ ID NO: 323478 - RNA, 64 nt, Homo Sapiens; identical to SEQ ID NO: 303524

SEQ ID NO: 323479 - RNA, 64 nt, Homo Sapiens; identical to SEQ ID NO: 303525

SEQ ID NO: 323480 - RNA, 64 nt, Homo Sapiens; identical to SEQ ID NO: 303526

SEQ ID NO: 323481 - RNA, 64 nt, Homo Sapiens; identical to SEQ ID NO: 303527

SEQ ID NO: 323482 - RNA, 64 nt, Homo Sapiens; identical to SEQ ID NO: 303528

SEQ ID NO: 323483 - RNA, 64 nt, Homo Sapiens; identical to SEQ ID NO: 303529

SEQ ID NO: 323484 - RNA, 64 nt, Homo Sapiens; identical to SEQ ID NO: 303530

SEQ ID NO: 323485 - RNA, 64 nt, Homo Sapiens; identical to SEQ ID NO: 303531

SEQ ID NO: 323486 - RNA, 64 nt, Homo Sapiens; identical to SEQ ID NO: 303532

SEQ ID NO: 323487 - RNA, 64 nt, Homo Sapiens; identical to SEQ ID NO: 303533

SEQ ID NO: 323488 - RNA, 64 nt, Homo Sapiens; identical to SEQ ID NO: 303534

SEQ ID NO: 323489 - RNA, 64 nt, Homo Sapiens; identical to SEQ ID NO: 303535

SEQ ID NO: 323490 - RNA, 64 nt, Homo Sapiens; identical to SEQ ID NO: 303536

SEQ ID NO: 323491 - RNA, 64 nt, Homo Sapiens; identical to SEQ ID NO: 303537

SEQ ID NO: 323492 - RNA, 64 nt, Homo Sapiens; identical to SEQ ID NO: 303538

SEQ ID NO: 323493 - RNA, 64 nt, Homo Sapiens; identical to SEQ ID NO: 210821

SEQ ID NO: 323494 - RNA, 64 nt, Homo Sapiens; identical to SEQ ID NO: 210822

SEQ ID NO: 323495 - RNA, 64 nt, Homo Sapiens; identical to SEQ ID NO: 210823

SEQ ID NO: 323496 - RNA, 64 nt, Homo Sapiens; identical to SEQ ID NO: 210824

SEQ ID NO: 323497 - RNA, 64 nt, Homo Sapiens; identical to SEQ ID NO: 210825

SEQ ID NO: 323498 - RNA, 64 nt, Homo Sapiens; identical to SEQ ID NO: 210826

SEQ ID NO: 323499 - RNA, 64 nt, Homo Sapiens; identical to SEQ ID NO: 210827

SEQ ID NO: 323500 - RNA, 64 nt, Homo Sapiens; identical to SEQ ID NO: 210828

SEQ ID NO: 323501 - RNA, 64 nt, Homo Sapiens; identical to SEQ ID NO: 210829

SEQ ID NO: 323502 - RNA, 64 nt, Homo Sapiens; identical to SEQ ID NO: 210830

SEQ ID NO: 323503 - RNA, 64 nt, Homo Sapiens; identical to SEQ ID NO: 210831

SEQ ID NO: 323504 - RNA, 64 nt, Homo Sapiens; identical to SEQ ID NO: 210832

SEQ ID NO: 323505 - RNA, 64 nt, Homo Sapiens; identical to SEQ ID NO: 210833

SEQ ID NO: 323506 - RNA, 64 nt, Homo Sapiens; identical to SEQ ID NO: 210834

SEQ ID NO: 323507 - RNA, 64 nt, Homo Sapiens; identical to SEQ ID NO: 210835

SEQ ID NO: 323508 - RNA, 64 nt, Homo Sapiens; identical to SEQ ID NO: 210836

SEQ ID NO: 323509 - RNA, 64 nt, Homo Sapiens; identical to SEQ ID NO: 210837

SEQ ID NO: 323510 - RNA, 64 nt, Homo Sapiens; identical to SEQ ID NO: 210838

SEQ ID NO: 323511 - RNA, 64 nt, Homo Sapiens; identical to SEQ ID NO: 210839

SEQ ID NO: 323512 - RNA, 64 nt, Homo Sapiens; identical to SEQ ID NO: 210840

SEQ ID NO: 323513 - RNA, 64 nt, Homo Sapiens; identical to SEQ ID NO: 210841

SEQ ID NO: 323514 - RNA, 64 nt, Homo Sapiens; identical to SEQ ID NO: 226834

SEQ ID NO: 323515 - RNA, 64 nt, Homo Sapiens; identical to SEQ ID NO: 226835

SEQ ID NO: 323516 - RNA, 64 nt, Homo Sapiens; identical to SEQ ID NO: 226836

SEQ ID NO: 323517 - RNA, 64 nt, Homo Sapiens; identical to SEQ ID NO: 226837

SEQ ID NO: 323518 - RNA, 64 nt, Homo Sapiens; identical to SEQ ID NO: 226838

SEQ ID NO: 323519 - RNA, 64 nt, Homo Sapiens; identical to SEQ ID NO: 226839

SEQ ID NO: 323520 - RNA, 64 nt, Homo Sapiens; identical to SEQ ID NO: 226840

SEQ ID NO: 323521 - RNA, 64 nt, Homo Sapiens; identical to SEQ ID NO: 226841

SEQ ID NO: 323522 - RNA, 64 nt, Homo Sapiens; identical to SEQ ID NO: 226842

SEQ ID NO: 323523 - RNA, 64 nt, Homo Sapiens; identical to SEQ ID NO: 226843

SEQ ID NO: 323524 - RNA, 64 nt, Homo Sapiens; identical to SEQ ID NO: 226844

SEQ ID NO: 323525 - RNA, 64 nt, Homo Sapiens; identical to SEQ ID NO: 226845

SEQ ID NO: 323526 - RNA, 64 nt, Homo Sapiens; identical to SEQ ID NO: 226846

SEQ ID NO: 323527 - RNA, 64 nt, Homo Sapiens; identical to SEQ ID NO: 226847

SEQ ID NO: 323528 - RNA, 64 nt, Homo Sapiens; identical to SEQ ID NO: 226848

SEQ ID NO: 323529 - RNA, 64 nt, Homo Sapiens; identical to SEQ ID NO: 226849

SEQ ID NO: 323530 - RNA, 64 nt, Homo Sapiens; identical to SEQ ID NO: 226850

SEQ ID NO: 323531 - RNA, 64 nt, Homo Sapiens; identical to SEQ ID NO: 226851

SEQ ID NO: 323532 - RNA, 64 nt, Homo Sapiens; identical to SEQ ID NO: 226852

SEQ ID NO: 323533 - RNA, 64 nt, Homo Sapiens; identical to SEQ ID NO: 226853

SEQ ID NO: 323534 - RNA, 64 nt, Homo Sapiens; identical to SEQ ID NO: 226854

SEQ ID NO: 323535 - RNA, 64 nt, Homo Sapiens; identical to SEQ ID NO: 226855

SEQ ID NO: 323536 - RNA, 64 nt, Homo Sapiens; identical to SEQ ID NO: 226856

SEQ ID NO: 323537 - RNA, 64 nt, Homo Sapiens; identical to SEQ ID NO: 226857

SEQ ID NO: 323538 - RNA, 64 nt, Homo Sapiens; identical to SEQ ID NO: 226858

SEQ ID NO: 323539 - RNA, 64 nt, Homo Sapiens; identical to SEQ ID NO: 226859

SEQ ID NO: 323540 - RNA, 64 nt, Homo Sapiens; identical to SEQ ID NO: 226860

SEQ ID NO: 323541 - RNA, 64 nt, Homo Sapiens; identical to SEQ ID NO: 226861

SEQ ID NO: 323542 - RNA, 64 nt, Homo Sapiens; identical to SEQ ID NO: 226862

SEQ ID NO: 323543 - RNA, 64 nt, Homo Sapiens; identical to SEQ ID NO: 226863

SEQ ID NO: 323544 - RNA, 64 nt, Homo Sapiens; identical to SEQ ID NO: 226864

SEQ ID NO: 323545 - RNA, 64 nt, Homo Sapiens; identical to SEQ ID NO: 226865

SEQ ID NO: 323546 - RNA, 64 nt, Homo Sapiens; identical to SEQ ID NO: 226866

SEQ ID NO: 323547 - RNA, 64 nt, Homo Sapiens; identical to SEQ ID NO: 226867

SEQ ID NO: 323548 - RNA, 64 nt, Homo Sapiens; identical to SEQ ID NO: 226868

SEQ ID NO: 323549 - RNA, 64 nt, Homo Sapiens; identical to SEQ ID NO: 226869

SEQ ID NO: 323550 - RNA, 64 nt, Homo Sapiens; identical to SEQ ID NO: 226870

SEQ ID NO: 323551 - RNA, 64 nt, Homo Sapiens; identical to SEQ ID NO: 226871

SEQ ID NO: 323552 - RNA, 64 nt, Homo Sapiens; identical to SEQ ID NO: 226872

SEQ ID NO: 323553 - RNA, 64 nt, Homo Sapiens; identical to SEQ ID NO: 226873

SEQ ID NO: 323554 - RNA, 64 nt, Homo Sapiens; identical to SEQ ID NO: 226874

SEQ ID NO: 323555 - RNA, 64 nt, Homo Sapiens; identical to SEQ ID NO: 226875

SEQ ID NO: 323556 - RNA, 64 nt, Homo Sapiens; identical to SEQ ID NO: 226876

SEQ ID NO: 323557 - RNA, 64 nt, Homo Sapiens; identical to SEQ ID NO: 226877

SEQ ID NO: 323558 - RNA, 64 nt, Homo Sapiens; identical to SEQ ID NO: 226878

SEQ ID NO: 323559 - RNA, 64 nt, Homo Sapiens; identical to SEQ ID NO: 226879

SEQ ID NO: 323560 - RNA, 64 nt, Homo Sapiens; identical to SEQ ID NO: 226880

SEQ ID NO: 323561 - RNA, 64 nt, Homo Sapiens; identical to SEQ ID NO: 226881

SEQ ID NO: 323562 - RNA, 64 nt, Homo Sapiens; identical to SEQ ID NO: 226882

SEQ ID NO: 323563 - RNA, 64 nt, Homo Sapiens; identical to SEQ ID NO: 226883

SEQ ID NO: 323564 - RNA, 64 nt, Homo Sapiens; identical to SEQ ID NO: 226884

SEQ ID NO: 323565 - RNA, 64 nt, Homo Sapiens; identical to SEQ ID NO: 226885

SEQ ID NO: 323566 - RNA, 64 nt, Homo Sapiens; identical to SEQ ID NO: 226886

SEQ ID NO: 323567 - RNA, 64 nt, Homo Sapiens; identical to SEQ ID NO: 226887

SEQ ID NO: 323568 - RNA, 64 nt, Homo Sapiens; identical to SEQ ID NO: 226888

SEQ ID NO: 323569 - RNA, 64 nt, Homo Sapiens; identical to SEQ ID NO: 226889

SEQ ID NO: 323570 - RNA, 64 nt, Homo Sapiens; identical to SEQ ID NO: 226890

SEQ ID NO: 323571 - RNA, 64 nt, Homo Sapiens; identical to SEQ ID NO: 236560

SEQ ID NO: 323572 - RNA, 64 nt, Homo Sapiens; identical to SEQ ID NO: 236561

SEQ ID NO: 323573 - RNA, 64 nt, Homo Sapiens; identical to SEQ ID NO: 236562

SEQ ID NO: 323574 - RNA, 64 nt, Homo Sapiens; identical to SEQ ID NO: 236563

SEQ ID NO: 323575 - RNA, 64 nt, Homo Sapiens; identical to SEQ ID NO: 236564

SEQ ID NO: 323576 - RNA, 64 nt, Homo Sapiens; identical to SEQ ID NO: 236565

SEQ ID NO: 323577 - RNA, 64 nt, Homo Sapiens; identical to SEQ ID NO: 236566

SEQ ID NO: 323578 - RNA, 64 nt, Homo Sapiens; identical to SEQ ID NO: 236567

SEQ ID NO: 323579 - RNA, 64 nt, Homo Sapiens; identical to SEQ ID NO: 236568

SEQ ID NO: 323580 - RNA, 64 nt, Homo Sapiens; identical to SEQ ID NO: 236569

SEQ ID NO: 323581 - RNA, 64 nt, Homo Sapiens; identical to SEQ ID NO: 236570

SEQ ID NO: 323582 - RNA, 64 nt, Homo Sapiens; identical to SEQ ID NO: 236571

SEQ ID NO: 323583 - RNA, 64 nt, Homo Sapiens; identical to SEQ ID NO: 236572

SEQ ID NO: 323584 - RNA, 64 nt, Homo Sapiens; identical to SEQ ID NO: 236573

SEQ ID NO: 323585 - RNA, 64 nt, Homo Sapiens; identical to SEQ ID NO: 236574

SEQ ID NO: 323586 - RNA, 64 nt, Homo Sapiens; identical to SEQ ID NO: 236575

SEQ ID NO: 323587 - RNA, 64 nt, Homo Sapiens; identical to SEQ ID NO: 236576

SEQ ID NO: 323588 - RNA, 64 nt, Homo Sapiens; identical to SEQ ID NO: 236577

SEQ ID NO: 323589 - RNA, 64 nt, Homo Sapiens; identical to SEQ ID NO: 236578

SEQ ID NO: 323590 - RNA, 64 nt, Homo Sapiens; identical to SEQ ID NO: 236579

SEQ ID NO: 323591 - RNA, 64 nt, Homo Sapiens
cagcaaguacugagaacucauuuucuacccugccucgucuuaagacauauuuauguaauaccau

SEQ ID NO: 323592 - RNA, 64 nt, Homo Sapiens
gagcuuucauaauguauaacccuuuccacuuucaucgucuuauauaugaagcgccuugagugug

SEQ ID NO: 323593 - RNA, 64 nt, Homo Sapiens
uaaaaagggagccguacaguuuguuugaagcacuucgucuuacccauuuauguaggggccccag

SEQ ID NO: 323594 - RNA, 64 nt, Homo Sapiens
ugcccucuccaugucuucguccuggcaaacagggucgucuuaaaauuaugcgcuaauucuguau

SEQ ID NO: 323595 - RNA, 64 nt, Homo Sapiens
uucauuuuuugauuacaaaugguuucugggccauucgucuuacuaugacugucaauaaaaugcg

SEQ ID NO: 323596 - RNA, 64 nt, Homo Sapiens
uauuuagcggggugaauauucguuugcaauaaugucgucuuauucucaggggggguuuaagugc

SEQ ID NO: 323597 - RNA, 64 nt, Homo Sapiens
auuuuaagugacuuuuuauggguuauuuagguuuucgucuuaguuguagcacacuuacccuaau

SEQ ID NO: 323598 - RNA, 64 nt, Homo Sapiens
gcgugacugcaaagaaaaagauggagcagcagccucgucuuacagaggagaagagcauaggguc

SEQ ID NO: 323599 - RNA, 64 nt, Homo Sapiens
ucuauucuucauuagcucagugacuuguccacacucgucuuagcacuuacguuucaaaagcuug

SEQ ID NO: 323600 - RNA, 64 nt, Homo Sapiens
aagaaguaaaaugagaaauuacaauucccugcugucgucuuagcgauugcccauccaucugcuu

SEQ ID NO: 323601 - RNA, 64 nt, Homo Sapiens
uuucaucuauucuggucucaacagauucauguucucgucuuagccuaagcucaucagaacacca

SEQ ID NO: 323602 - RNA, 64 nt, Homo Sapiens
uugcaugcauuauugugacuucaaguuuaaaaaaucgucuuacauguguacaauaugcaaauua

SEQ ID NO: 323603 - RNA, 64 nt, Homo Sapiens
auucaguuaaguguuaauaaggaucuacugagccucgucuuaguuaaucuguggaaaguccuuu

SEQ ID NO: 323604 - RNA, 64 nt, Homo Sapiens
aggacuuuuuuugucuuucuuuaacgcccaggcuucgucuuauuucuacuguuuuugucgcaac

SEQ ID NO: 323605 - RNA, 64 nt, Homo Sapiens
ggaaaauuuaauuuuuacucaaauaauuguaaaaucgucuuaaaagugaaauuauggacaagag

SEQ ID NO: 323606 - RNA, 64 nt, Homo Sapiens
uuugcccuaauaccaaggcgcuacguuuauugccucgucuuauucacugaccuuuguaaugaua

SEQ ID NO: 323607 - RNA, 64 nt, Homo Sapiens
ugaauucuaacacuugcaggagcagagcuggucaucgucuuagcauacauauccuacacugagu

SEQ ID NO: 323608 - RNA, 64 nt, Homo Sapiens
acuaguggacaauucuagcauuuccucaguuuucucgucuuaacagauaguaagacagcugagu

SEQ ID NO: 323609 - RNA, 64 nt, Homo Sapiens
uguccaacagggugucaggauuuaaggaaaaccuucgucuuaggcuaagucugaaaugguacug

SEQ ID NO: 323610 - RNA, 64 nt, Homo Sapiens
ccacugaaaccaacagggauucagccucucuucgucgucuuaccacucugagccuuccagagcu

SEQ ID NO: 323611 - RNA, 64 nt, Homo Sapiens
cucuaagguggucucaguauuuuuuucuuaaaaaucgucuuaaguuaaauuuugugccaguauu

SEQ ID NO: 323612 - RNA, 64 nt, Homo Sapiens
uuuuuuaugccuuuauauacauaaguucauacaaucgucuuaaguaaauguaaaauauuugaga

SEQ ID NO: 323613 - RNA, 64 nt, Homo Sapiens
cuggaaguagaucugaauaguuuugauucaagaaucgucuuauuaagcgccgacugacuuaugg

SEQ ID NO: 323614 - RNA, 64 nt, Homo Sapiens
cccucguccccauguccccacgcagggcucuccuucgucuuaggaucuguccagcgcugcucug

SEQ ID NO: 323615 - RNA, 64 nt, Homo Sapiens
uccucagaaaugcuccaccuguaagaacagaaaaucgucuuauaguugagaauuuauccucaag

SEQ ID NO: 323616 - RNA, 64 nt, Homo Sapiens
aacacugcaggcaucacagcuaacaauugugaagucgucuuaacucaccauaaaaaggaaucca

SEQ ID NO: 323617 - RNA, 64 nt, Homo Sapiens
uuccuucuuccuagaugacuguucacuugugcagucgucuuauuuucugguagaagugagcacu

SEQ ID NO: 323618 - RNA, 64 nt, Homo Sapiens
uagacaguuuaguuuuggggaacagaagcucucuucgucuuaagccagauucucugauucuuuu

SEQ ID NO: 323619 - RNA, 64 nt, Homo Sapiens
guucaccguccacagcuuuggcgagucaccucuuucgucuuaauguccguguuucagguuccac

SEQ ID NO: 323620 - RNA, 64 nt, Homo Sapiens
aucauuuuucaccuguacaaggaauacuaauggaucgucuuaaaauuggucuaggaaaaaaccu

SEQ ID NO: 323621 - RNA, 64 nt, Homo Sapiens
cccauaauccuugccaucccacguagccuggacaucgucuuaucuacagaucagcugccccccc

SEQ ID NO: 323622 - RNA, 64 nt, Homo Sapiens
uaaaaaguugcaguaggguuuaaaauauauguaaucgucuuaauuugcuuuaaagcaauugguc

SEQ ID NO: 323623 - RNA, 64 nt, Homo Sapiens
gccccucggagcucccccugccuccuccuccuccucgucuuaggggggucucccugcaaugcag

SEQ ID NO: 323624 - RNA, 64 nt, Homo Sapiens
uuacaaaaagggagauuuuuccuuuguuaaaccaucgucuuauaagcaauagcaaauucauguu

SEQ ID NO: 323625 - RNA, 64 nt, Homo Sapiens
agagccaccgccaagguuuguguggguccuggggucgucuuagcccuccgucccucuguccacu

SEQ ID NO: 323626 - RNA, 51 nt, Homo Sapiens
augcugaggagaagcaauaaaucgucuuauuuuauuuucuuuuccucucuu

SEQ ID NO: 323627 - RNA, 64 nt, Homo Sapiens; identical to SEQ ID NO: 271308

SEQ ID NO: 323628 - RNA, 64 nt, Homo Sapiens; identical to SEQ ID NO: 271309

SEQ ID NO: 323629 - RNA, 64 nt, Homo Sapiens; identical to SEQ ID NO: 271310

SEQ ID NO: 323630 - RNA, 64 nt, Homo Sapiens; identical to SEQ ID NO: 271311

SEQ ID NO: 323631 - RNA, 64 nt, Homo Sapiens; identical to SEQ ID NO: 271312

SEQ ID NO: 323632 - RNA, 64 nt, Homo Sapiens; identical to SEQ ID NO: 271313

SEQ ID NO: 323633 - RNA, 64 nt, Homo Sapiens; identical to SEQ ID NO: 271314

SEQ ID NO: 323634 - RNA, 64 nt, Homo Sapiens; identical to SEQ ID NO: 271315

SEQ ID NO: 323635 - RNA, 64 nt, Homo Sapiens; identical to SEQ ID NO: 271316

SEQ ID NO: 323636 - RNA, 64 nt, Homo Sapiens; identical to SEQ ID NO: 271317

SEQ ID NO: 323637 - RNA, 64 nt, Homo Sapiens; identical to SEQ ID NO: 271318

SEQ ID NO: 323638 - RNA, 64 nt, Homo Sapiens; identical to SEQ ID NO: 271319

SEQ ID NO: 323639 - RNA, 64 nt, Homo Sapiens; identical to SEQ ID NO: 271320

SEQ ID NO: 323640 - RNA, 64 nt, Homo Sapiens; identical to SEQ ID NO: 271321

SEQ ID NO: 323641 - RNA, 64 nt, Homo Sapiens; identical to SEQ ID NO: 271322

SEQ ID NO: 323642 - RNA, 64 nt, Homo Sapiens; identical to SEQ ID NO: 271323

SEQ ID NO: 323643 - RNA, 64 nt, Homo Sapiens; identical to SEQ ID NO: 271324

SEQ ID NO: 323644 - RNA, 64 nt, Homo Sapiens; identical to SEQ ID NO: 271325

SEQ ID NO: 323645 - RNA, 64 nt, Homo Sapiens; identical to SEQ ID NO: 271326

SEQ ID NO: 323646 - RNA, 64 nt, Homo Sapiens; identical to SEQ ID NO: 271327

SEQ ID NO: 323647 - RNA, 64 nt, Homo Sapiens; identical to SEQ ID NO: 271328

SEQ ID NO: 323648 - RNA, 64 nt, Homo Sapiens; identical to SEQ ID NO: 271329

SEQ ID NO: 323649 - RNA, 64 nt, Homo Sapiens; identical to SEQ ID NO: 271330

SEQ ID NO: 323650 - RNA, 64 nt, Homo Sapiens; identical to SEQ ID NO: 271331

SEQ ID NO: 323651 - RNA, 64 nt, Homo Sapiens; identical to SEQ ID NO: 271332

SEQ ID NO: 323652 - RNA, 64 nt, Homo Sapiens; identical to SEQ ID NO: 271333

SEQ ID NO: 323653 - RNA, 64 nt, Homo Sapiens; identical to SEQ ID NO: 271334

SEQ ID NO: 323654 - RNA, 64 nt, Homo Sapiens; identical to SEQ ID NO: 271335

SEQ ID NO: 323655 - RNA, 59 nt, Homo Sapiens; identical to SEQ ID NO: 271336

SEQ ID NO: 323656 - RNA, 64 nt, Homo Sapiens; identical to SEQ ID NO: 271337

SEQ ID NO: 323657 - RNA, 64 nt, Homo Sapiens; identical to SEQ ID NO: 271338

SEQ ID NO: 323658 - RNA, 64 nt, Homo Sapiens; identical to SEQ ID NO: 271339

SEQ ID NO: 323659 - RNA, 64 nt, Homo Sapiens; identical to SEQ ID NO: 271340

SEQ ID NO: 323660 - RNA, 64 nt, Homo Sapiens
uuucuuguuuuggguuguuuguugccucaaucuaucaaucuauccucuuccuaaggaugcuugu

SEQ ID NO: 323661 - RNA, 64 nt, Homo Sapiens
aaucuaucuuucuuguuuugaugcuuguguugccucaaucuaucucuuccuucucuuccuaagg

SEQ ID NO: 323662 - RNA, 64 nt, Homo Sapiens
gagaguuagcuacuagcugccuaagugugcacuuucaaucuaacugugaaagaaucuucugaug

SEQ ID NO: 323663 - RNA, 64 nt, Homo Sapiens
uuauauuaacgaaauaaaucaaguugugguauagucaaucuauuucuuaauaauacugcaaaaa

SEQ ID NO: 323664 - RNA, 64 nt, Homo Sapiens
uaccacuacggccaccccaaaggaccccgacgccaacagacagucaaacgcugauguugcgggc

SEQ ID NO: 323665 - RNA, 64 nt, Homo Sapiens
aaucaccaccacgaggacaagagggcaaaagcaaaacagacaaaaagaaaaaaaaucgccgucu

SEQ ID NO: 323666 - RNA, 64 nt, Homo Sapiens
auauuacaacauuuaugugagguaauuauugcucaacagacaauuagaaaaaaguccacacuug

SEQ ID NO: 323667 - RNA, 64 nt, Homo Sapiens
aguccuggcccuggcccuuacuauuaggaaaauaaacagacaaaaacaaguaaauauauauggu

SEQ ID NO: 323668 - RNA, 64 nt, Homo Sapiens
uucauucuuuuccuauucuuacuguuaacauuuuaacagacaaccccuucuuucagagagaacu

SEQ ID NO: 323669 - RNA, 64 nt, Homo Sapiens
auauguuggaguugggaauccauuggggguaaauaacagacacuguuuagagguuaaaaugaca

SEQ ID NO: 323670 - RNA, 64 nt, Homo Sapiens
cuucugcacagaaaaagaaacuagcaacacaguaaacagacagccuguagaauggggaaaacua

SEQ ID NO: 323671 - RNA, 64 nt, Homo Sapiens
agaaaaaacccaauuaaaauugggcaaaggcaugaacagacacuuuucaaaagaagaccuacaa

SEQ ID NO: 323672 - RNA, 64 nt, Homo Sapiens
gucagagaugguggugaggcugcagagcaaaagaaacagacacuguuggugggaaagcaaacuu

SEQ ID NO: 323673 - RNA, 64 nt, Homo Sapiens
uuucaaaagaagacaucugugggcaaaggacaugaacagacacuaaaccaccccauuaaaaagu

SEQ ID NO: 323674 - RNA, 64 nt, Homo Sapiens
uuacagaaugggagaaaauucuaucaagagaguaaacagacagcgagcugcacagcaaaagaaa

SEQ ID NO: 323675 - RNA, 64 nt, Homo Sapiens
gguagaaguuacacagcaauuuagcaauguuguuaacagacauacagaauugugugugugugug

SEQ ID NO: 323676 - RNA, 64 nt, Homo Sapiens
ugacaaaacaccuaagacuggguaguuuauaaagaacagacauucaggccaggcacggugacuc

SEQ ID NO: 323677 - RNA, 64 nt, Homo Sapiens
agguaugcuugcuuuggaauuccacucagaauuaaacagacaaacaaauauaugcauuguguaa

SEQ ID NO: 323678 - RNA, 64 nt, Homo Sapiens
uccucugucuuaaaaagguuuccaagacuaaacaaacagacagggcccuccaagucacacaagc

SEQ ID NO: 323679 - RNA, 64 nt, Homo Sapiens
gcgggccuucaagucucacuguuccguaugaggaaacagacagcggacugaggaagcgauggcc

SEQ ID NO: 323680 - RNA, 64 nt, Homo Sapiens
agaaacaaacaaaauauauauauauauguccaaaaacagacaaauccaagggugugagguaaac

SEQ ID NO: 323681 - RNA, 64 nt, Homo Sapiens
uuucugcuucuguguuuuugaaugacuucuucacaacagacauaggguacucacugggagugaa

SEQ ID NO: 323682 - RNA, 64 nt, Homo Sapiens
ugcauuuccuagugagcugcauuuuccagcuguaaacagacaucgugagugaaauuaauguuac

SEQ ID NO: 323683 - RNA, 64 nt, Homo Sapiens
aucugugcuuauuacacaaaauuacuuugugguaaacagacaguauuguaaucccaucaaaaga

SEQ ID NO: 323684 - RNA, 64 nt, Homo Sapiens
agccauaguucugaaugcacuucaauuaagccaaaacagacagcuagugaucuuuuuauaugcu

SEQ ID NO: 323685 - RNA, 64 nt, Homo Sapiens
uguugucaaacaucuucagggaaaucaacaagccaacagacaagaaggagcgaaagugaguauc

SEQ ID NO: 323686 - RNA, 64 nt, Homo Sapiens
gucugagagucuuccacgaccggcugaucagugaaacagacaagcagcuggucaguacauccaa

SEQ ID NO: 323687 - RNA, 64 nt, Homo Sapiens
aacagccucacagaagaauaacccaaggaggaaaaacagacaaaacgaacccaccugcugagag

SEQ ID NO: 323688 - RNA, 64 nt, Homo Sapiens
agaaaugcauccauuccucaacugauguugagggaacagacaggcgcugccuaaguggcugcug

SEQ ID NO: 323689 - RNA, 64 nt, Homo Sapiens
acuauucuagauccagaagaugcaauguugaacaaacagacaaagcccugcccucagaaggcug

SEQ ID NO: 323690 - RNA, 64 nt, Homo Sapiens
gguuuucagauccauuccaaccugacugaauguuaacagacagaauucuucacauuaaggaacu

SEQ ID NO: 323691 - RNA, 64 nt, Homo Sapiens
gccccucagcaaggaugacucagcacugccgcucaacagacaugacucagggauggcuuaguac

SEQ ID NO: 323692 - RNA, 64 nt, Homo Sapiens; identical to SEQ ID NO: 323691

SEQ ID NO: 323693 - RNA, 64 nt, Homo Sapiens
gccccucaccaaggaugacucagcacugccgcucaacagacaugacucagggauggcuuaguac

SEQ ID NO: 323694 - RNA, 64 nt, Homo Sapiens
cagacucagcagggaugacucagcacugccccucaacagacaugacucagcagggaugacucag

SEQ ID NO: 323695 - RNA, 64 nt, Homo Sapiens
gacagacagacacagccugaaacagacccagacaaacagacagacagacacagccugaaacaga

SEQ ID NO: 323696 - RNA, 64 nt, Homo Sapiens
gacagacagacacagauugaaacagacccagacaaacagacagacacagccugaaacagaccca

SEQ ID NO: 323697 - RNA, 64 nt, Homo Sapiens
gacagacaggcagacguagucugaaacagaccugaacagacagacagacgcacacacacaacag

SEQ ID NO: 323698 - RNA, 64 nt, Homo Sapiens
uaggacaccagagagcugauuuuucaagggauccaacagacagaaauucacccucauacaucug

SEQ ID NO: 323699 - RNA, 64 nt, Homo Sapiens
gauuacuuguacuuucuaaucugcccaguguuacaacagacacuaccauguggcauauccucac

SEQ ID NO: 323700 - RNA, 64 nt, Homo Sapiens
ugcaccuacugauguuuugaagacaugagcccucaacagacaacgaaggcaucaucuuggaaac

SEQ ID NO: 323701 - RNA, 64 nt, Homo Sapiens
agcccucaacagacaacugcggcaucaucuuggaaacagacauguccaaaagaugcagcaugaa

SEQ ID NO: 323702 - RNA, 64 nt, Homo Sapiens
ugugacauuaguaugaaauugcuacauccaaagaaaugccaauaaauguguuuuaaaauauaaa

SEQ ID NO: 323703 - RNA, 64 nt, Homo Sapiens
ugauaauaaaauacauuuguuagcaacuaauacaaaugccaauauauagacauggugguaggaa

SEQ ID NO: 323704 - RNA, 64 nt, Homo Sapiens
uuuauuuauacuauauucugcauacaguacuuuaaaugccaauuacagugcaaucuuuauuuau

SEQ ID NO: 323705 - RNA, 64 nt, Homo Sapiens
uguuuuuaaaaagauaagagcaucuagugcauuaaaugccaaaaaaaaaauacauuaucaguga

SEQ ID NO: 323706 - RNA, 64 nt, Homo Sapiens
agaaaaagaaaaaaaaaagcgaccaaaccauccaaaugccaaaaggaauaaggaagagaagauu

SEQ ID NO: 323707 - RNA, 64 nt, Homo Sapiens
ccagagccaugugagauucugucccgggaagguaaaugccaaacgcgaaugccccauagcagaa

SEQ ID NO: 323708 - RNA, 64 nt, Homo Sapiens
agauauuuuuucuuauuugaguccaccaaaggauaaugccaacuuauauaaguucucaaaucau

SEQ ID NO: 323709 - RNA, 64 nt, Homo Sapiens
gcuuggaaugagaaggggaaggaaagaauuaacaaaugccaagauuucuggagcagauuguaca

SEQ ID NO: 323710 - RNA, 64 nt, Homo Sapiens
uuagaaaagacaauaaaugcgcaaaauaaagaaaaaugccaacccuguaaguauggaucaaauu

SEQ ID NO: 323711 - RNA, 64 nt, Homo Sapiens
auccaaggcaaacucuaauaagaacagucuaaucaaugccaaguacuaagcauaaccaaauuuc

SEQ ID NO: 323712 - RNA, 64 nt, Homo Sapiens
guaguaucaaaggaggcucuauaagccaguugauaaugccaaauuccugugguuggucagaaag

SEQ ID NO: 323713 - RNA, 64 nt, Homo Sapiens
uagcugauguauuggacguugggagucugaaucaaaugccaaaguucugaugacucacaugaug

SEQ ID NO: 323714 - RNA, 64 nt, Homo Sapiens
gcagaaagcaaaccuaguuagauggagaucacccaaugccaaggaaggcugauaaccuauaugu

SEQ ID NO: 323715 - RNA, 64 nt, Homo Sapiens
agugguuaauauuaauaagauuguuaaugugguuaaugccaaaaacauugagaagugguuauca

SEQ ID NO: 323716 - RNA, 64 nt, Homo Sapiens
acagagaugugcauguggguauuguuaggaaaugucaucaaacuccacccaccuggcuucauac

SEQ ID NO: 323717 - RNA, 64 nt, Homo Sapiens
uucacacaaugcccaacuuacugucuucuucaugucaucaaaaucugcacagucacuggcccaa

SEQ ID NO: 323718 - RNA, 64 nt, Homo Sapiens
uacuauaaaaaacauucaagucacuggcugcucuucaucaaaccugcccuaugacauuucuaca

SEQ ID NO: 323719 - RNA, 64 nt, Homo Sapiens
uguauagaauauuauaguuuauaauacauggcuaucaucaaaagauaaaaacauaaauaauacc

SEQ ID NO: 323720 - RNA, 64 nt, Homo Sapiens
uaauuuguguagauuuuugcaaaagcuuuccauaucaucaaaacgaugaauguuugaugcuaug

SEQ ID NO: 323721 - RNA, 64 nt, Homo Sapiens
gagaucauaaguguuaaugugauaaccuaguaaaucaucaaaauugauucaccuucagggggcu

SEQ ID NO: 323722 - RNA, 64 nt, Homo Sapiens
uagcuaacauggguauuuuuguugugcacagacaucaucaaaauauugguuaguuuguucagau

SEQ ID NO: 323723 - RNA, 64 nt, Homo Sapiens
auacuauauagagaaucuuauagcuguauaaaugucaucaaacucaguaguacuucaaagaaga

SEQ ID NO: 323724 - RNA, 64 nt, Homo Sapiens
auaaagcugugauuauaucaaaaauccagauaaaucaucaaauauaucagauuaagaccagggu

SEQ ID NO: 323725 - RNA, 64 nt, Homo Sapiens
auauucucacaauauagguuuuggggcuuccauaucaucaaaagacugaaaaauuauaauuuua

SEQ ID NO: 323726 - RNA, 64 nt, Homo Sapiens
agaacuccuagcaccacggggaagaauagagguaucaucaaacguggcaaauuuucuuucagga

SEQ ID NO: 323727 - RNA, 64 nt, Homo Sapiens
aucuugacaauuuacuuaacaaguaaccaguaguucaucaaaaccaacuuguacagacuaauaa

SEQ ID NO: 323728 - RNA, 64 nt, Homo Sapiens
uguuacuaaaccagccuagugggaagaggcacguucaucaaaccaagcuaccaguaagacaagu

SEQ ID NO: 323729 - RNA, 64 nt, Homo Sapiens
uucccacucccuacuucugcuaugaggaaacugaucaucaaaagucuucccucucuccugccuu

SEQ ID NO: 323730 - RNA, 64 nt, Homo Sapiens
gacccacucugaccccacuaaaaugaccccugauucaucaaaagugaggccuagaauuacccua

SEQ ID NO: 323731 - RNA, 64 nt, Homo Sapiens
agguaucauuaucaguuacaaauugaguuauucuucaucaaaugacuuuuggaguagagauuuu

SEQ ID NO: 323732 - RNA, 64 nt, Homo Sapiens
aggcaagugggguuuaaacagacccacagucuacucaucaaaccagguguccuuggcauugugu

SEQ ID NO: 323733 - RNA, 64 nt, Homo Sapiens
ccucucagaggauacauuuguaaccauuacacagucaucaaaggaauaauuuuuuuuaaucacc

SEQ ID NO: 323734 - RNA, 64 nt, Homo Sapiens
acaaaacacagcaaacauaaaaaguuguuacacuucaucaaaaguacaaaguucuguucaucaa

SEQ ID NO: 323735 - RNA, 64 nt, Homo Sapiens
guuguuacacuucaucaaaaguacaaaguucuguucaucaaaugaugcuguuaagauagggaaa

SEQ ID NO: 323736 - RNA, 64 nt, Homo Sapiens
caggugguuaaucugacauacaucaaaaauauugucaucaaauaacuguuuaaaaaauugagcu

SEQ ID NO: 323737 - RNA, 64 nt, Homo Sapiens
uauugucaucaaauacagguuuaaaaaauugagcucaucaaaaaccaguaauaguauugacugu

SEQ ID NO: 323738 - RNA, 64 nt, Homo Sapiens
ccagggcaagggggccaucacugcagucaggcccucagaggaguccugcaggcuuccuaccagu

SEQ ID NO: 323739 - RNA, 64 nt, Homo Sapiens
gacacucucgcauacuuugccaaaugaggccugcucagaggaguaggagcugaaagauggugcc

SEQ ID NO: 323740 - RNA, 64 nt, Homo Sapiens
cagagacuggcagccagggagcccggggcagagcucagaggagucugggaaggggcgugucccu

SEQ ID NO: 323741 - RNA, 64 nt, Homo Sapiens
ccccaagaggcuagccccagggugagcagggcccucagaggaaaggcaguauggcggaggccau

SEQ ID NO: 323742 - RNA, 64 nt, Homo Sapiens
uuaggggauccugaugccacuuagcagugggauuucagaggaccuuucagaggagcuaagguaa

SEQ ID NO: 323743 - RNA, 64 nt, Homo Sapiens
gaugccacuuagcagugggauuucagaggaccuuucagaggagcuaagguaagaugagauggag

SEQ ID NO: 323744 - RNA, 64 nt, Homo Sapiens
gaagaucagugaucuugggucauugaucccuggcucagaggauagcgguuuccaucauaaacca

SEQ ID NO: 323745 - RNA, 64 nt, Homo Sapiens
ggcuggcauucgagacuuccuccuguucccugggucagaggauagcgguuuccaucauaaacca

SEQ ID NO: 323746 - RNA, 64 nt, Homo Sapiens
uuccaauccauuugccccgcugugccugcuucccucagaggaccuugggguucccaaggcaccc

SEQ ID NO: 323747 - RNA, 64 nt, Homo Sapiens
ugggggagcgguggccagcccccccagcugggucucagaggagccgguucucuccuagccucag

SEQ ID NO: 323748 - RNA, 64 nt, Homo Sapiens
aacaggugggacuuugcgaggggagaggcagggaucagaggacggacucugggacuccugagau

SEQ ID NO: 323749 - RNA, 64 nt, Homo Sapiens
ggaagauaccagcuuuuucucucaggguucugagucagaggacaccauccaagaauguuguuag

SEQ ID NO: 323750 - RNA, 64 nt, Homo Sapiens
cuagugaaugugccuuaaaaaucaagacacuaguucagaggaagcacauaauguccagaucuau

SEQ ID NO: 323751 - RNA, 64 nt, Homo Sapiens
ugugaggagugagggaacccuggggcucacccucucagaggaagggcacagagaggaagggaag

SEQ ID NO: 323752 - RNA, 64 nt, Homo Sapiens
ggcgaauucccuguggccugccaugccuucggcaucagaggauggaguggucgaggcuagugga

SEQ ID NO: 323753 - RNA, 64 nt, Homo Sapiens
aauccagugugacagagugcaggcugcagcuggaucagaggaaaaagagugaacuucuuauggg

SEQ ID NO: 323754 - RNA, 64 nt, Homo Sapiens
uaucuugccaggauaccuacucacguuuacuauuucagaggaaacuagacaguaacuucuaagg

SEQ ID NO: 323755 - RNA, 64 nt, Homo Sapiens
caacauaggccugcucagccucuagcaccaggacucagaggaugaggucaauuuccugaugcau

SEQ ID NO: 323756 - RNA, 64 nt, Homo Sapiens
gaaauaccagggcuugugccccgcuauuccucacucagaggaagacuuugauccaggugccaag

SEQ ID NO: 323757 - RNA, 64 nt, Homo Sapiens
cccagggucuggugauggcaaaacagagucacgaucagaggaacagcaggcaacagugugggau

SEQ ID NO: 323758 - RNA, 64 nt, Homo Sapiens
aggcaacagugugggauaaauaauauacuuuuccucagaggagcgauauauauauauauauaaa

SEQ ID NO: 323759 - RNA, 64 nt, Homo Sapiens
gccuuggugggagaugacuguuaauccccaugugucagaggaggacccaaaucccaucucaauu

SEQ ID NO: 323760 - RNA, 64 nt, Homo Sapiens
uguaguacacuacagaaauaaagcuuuacagcuuucagaggagugacuguuuuaucuugcaggu

SEQ ID NO: 323761 - RNA, 64 nt, Homo Sapiens
aggcugcucuaaagacuguuagcaggugguggaaucagaggacgggcaggagagggauauggag

SEQ ID NO: 323762 - RNA, 64 nt, Homo Sapiens
cucauuagcuggcuacaugccuaccacuggcuacucagaggagggagaacagcuggcccaggag

SEQ ID NO: 323763 - RNA, 64 nt, Homo Sapiens
agagugacugaggguaaagugcuucuagcugaucucagaggacccacgaggaugcccagugaga

SEQ ID NO: 323764 - RNA, 64 nt, Homo Sapiens
ugaagaaaucaagagcaaagcuggcgagggcaggucagaggaagccucuucugcagguccagcc

SEQ ID NO: 323765 - RNA, 64 nt, Homo Sapiens
ccgagacaauauccuuccucaaugagagcuugagucagaggaaguaaacugccuuguaaacaaa

SEQ ID NO: 323766 - RNA, 64 nt, Homo Sapiens
gccuggggcuccugcaagucuuggaauucuucuuucagaggagcgggcacugugguugcugugg

SEQ ID NO: 323767 - RNA, 64 nt, Homo Sapiens
ugacuuaaugcuuaaaaguauaucauaguuuucuuacggaaaagaucaguagaugagauugggg

SEQ ID NO: 323768 - RNA, 64 nt, Homo Sapiens
gacaccaagaauaucuccugucuucaggaguuauuacggaaaugcuccaggaugagcuauccca

SEQ ID NO: 323769 - RNA, 64 nt, Homo Sapiens
aacuauuauguuugcacuaaauugucuugggguuuacggaaauuauaacuuuguugauacguaa

SEQ ID NO: 323770 - RNA, 64 nt, Homo Sapiens
uuuuagauuggaagauagcacucuagaguggacauacggaaagacugugacuuuauuuuguaau

SEQ ID NO: 323771 - RNA, 64 nt, Homo Sapiens
ucuuacauugcagaacuaaugguaaaguaaauuuuacggaaaaaguuaagauagcuuugggaac

SEQ ID NO: 323772 - RNA, 64 nt, Homo Sapiens
cccauuucugggcccacugaggcacgccuuagccuacggaaaggagucugguggagguggagug

SEQ ID NO: 323773 - RNA, 64 nt, Homo Sapiens
auuguauugaaaacacuuagucccaguauuuuuauacggaaaaaaccuguuauuuaucaauuuu

SEQ ID NO: 323774 - RNA, 64 nt, Homo Sapiens
aaaaaaguauagaguuggaaacucugggaaaacuuacggaaauacacaaaugcuucucuguaau

SEQ ID NO: 323775 - RNA, 64 nt, Homo Sapiens
aaccaugcugauacagcuggaaucuuuuaugauguacggaaaaaaaagagcauagagaaacaaa

SEQ ID NO: 323776 - RNA, 64 nt, Homo Sapiens
guauuuuaaaauaguauugguaucaauuuuacaguacggaaauaugugacuuuuuuuccucuaa

SEQ ID NO: 323777 - RNA, 64 nt, Homo Sapiens
ucccuaggcuuuggagauccggcccacucucuuuuacggaaaaaaauaaaaggguaaccagaac

SEQ ID NO: 323778 - RNA, 64 nt, Homo Sapiens
aguuuuuaauacauugguuaggacucagaggaaauacggaaaaaacauuguagaugguuaauuu

SEQ ID NO: 323779 - RNA, 64 nt, Homo Sapiens
gguuagaaauauuuuguggcaaugaagaaaacacuacggaaaauaaaaaauaagauaaagccuu

SEQ ID NO: 323780 - RNA, 64 nt, Homo Sapiens
uguuuaucacaaaagacuguauuugaaauaugcauacggaaaauugaaauuauauuaguaauaa

SEQ ID NO: 323781 - RNA, 64 nt, Homo Sapiens
acauacacaacaacauagggaguuguaugacugauacggaaaacuuccagaaaguuuuaaucaa

SEQ ID NO: 323782 - RNA, 64 nt, Homo Sapiens
aauuucuagguguuugggucacaguuccuacaaauacggaaaaggggguuaaaaagcagugcuu

SEQ ID NO: 323783 - RNA, 64 nt, Homo Sapiens
gagaaaaauccuguucaaccuggguucucccaguuacggaaaccuuuuaaagauccacauuagc

SEQ ID NO: 323784 - RNA, 64 nt, Homo Sapiens
cagagcuggaaauggggggugggggacagauucuuacggaaauuuuuuuaccugacuugcuaug

SEQ ID NO: 323785 - RNA, 64 nt, Homo Sapiens
gauggcuuccaggcaaggaaguucuaucuugugauacggaaacaauaaauuccugagauacauu

SEQ ID NO: 323786 - RNA, 64 nt, Homo Sapiens
ucuucagagguuggaacuuggccagugugaugaguacggaaaagucacaguaaagggaaacccu

SEQ ID NO: 323787 - RNA, 64 nt, Homo Sapiens
ugaucagcuauuuucaacauaaauguucagaauguacggaaagagccagcacucugaaacugag

SEQ ID NO: 323788 - RNA, 64 nt, Homo Sapiens
cggaaccuuuagggauaguugauuggugguauauuacggaaauaggguauuauaaauuuagagu

SEQ ID NO: 323789 - RNA, 64 nt, Homo Sapiens
gccuguaaagucugaguaagaggacugauugaauuacggaaaauuccuguguugugcugggagc

SEQ ID NO: 323790 - RNA, 64 nt, Homo Sapiens
cagaaacuuaacucuuuugucauaagaugcuugauacggaaaauaauucuuaccacagcaaagg

SEQ ID NO: 323791 - RNA, 64 nt, Homo Sapiens
acucaguuaguauagagauggacaggaucaguuuuacggaaacagaugcuagccaucuccagga

SEQ ID NO: 323792 - RNA, 64 nt, Homo Sapiens
gggagguaucaaggagcauaauuaaacuugucaauacggaaaguuguuuuuucuaacacaacaa

SEQ ID NO: 323793 - RNA, 64 nt, Homo Sapiens
cuaagaacugucuucucagcaguugauccagcuguacggaaauuuaggguauuuaaacuuuuaa

SEQ ID NO: 323794 - RNA, 64 nt, Homo Sapiens
accaguucacuaaaagcaccgcucagaaaaaguuuacggaaaacaaaaauucuuaucccuugcu

SEQ ID NO: 323795 - RNA, 64 nt, Homo Sapiens
acagagaaaaccccuuuuauauccaguggaaucuuacggaaaacuguaauauguaacuauucua

SEQ ID NO: 323796 - RNA, 64 nt, Homo Sapiens
aguugucagaagacaucauugguucuguguuuccuacggaaauaagaaacgauaaauauugcac

SEQ ID NO: 323797 - RNA, 64 nt, Homo Sapiens
cugugguucccucucauuugucccaguuacuaacuacggaaauagcauccucugcuggugcuaa

SEQ ID NO: 323798 - RNA, 64 nt, Homo Sapiens
ggauaccuucccacucagcagagaggacugagccuacggaaaggccaccucuccugggggccug

SEQ ID NO: 323799 - RNA, 64 nt, Homo Sapiens
acauuuuauuccuacuuucagaagaaaaauauaauacggaaaaaauuauagauuuacuuguagc

SEQ ID NO: 323800 - RNA, 64 nt, Homo Sapiens
agugccaugauugauuagcaaugucugcacuggauacggaaaaaagaaggugcuugcagguuua

SEQ ID NO: 323801 - RNA, 64 nt, Homo Sapiens
auauuucuuugcacugaggccuugcugcuguggauacggaaaugguuaaguacugugcuuccuc

SEQ ID NO: 323802 - RNA, 64 nt, Homo Sapiens
uagucuagacuuuaaagaauaaauguggaaaacauacggaaaacaaagauaugaugucagaaua

SEQ ID NO: 323803 - RNA, 64 nt, Homo Sapiens
cuaccccuuccaugcucaucggacuuggggccaauacggaaaccacaugggagggcuagccccg

SEQ ID NO: 323804 - RNA, 64 nt, Homo Sapiens
cagcacguguguagagccucauagcagcauguccuacggaaaccggcugcugcaccgcguuucc

SEQ ID NO: 323805 - RNA, 64 nt, Homo Sapiens
cuuucggcgugcauaaggaauauaaugucauuuuuacggaaaccgauggguguacagauuugua

SEQ ID NO: 323806 - RNA, 64 nt, Homo Sapiens
uuagaaaaauucugauaauaagaaauggucauuuuacggaaaaagaccauuaagcuauauguuu

SEQ ID NO: 323807 - RNA, 64 nt, Homo Sapiens
auuaacucuguucugccuggaaauuuaggcuucauacggaaaguguuugagagcaaguaguuga

SEQ ID NO: 323808 - RNA, 64 nt, Homo Sapiens
uuauacuccauaccugcuuuucccauggccgcccuacggaaaaucccauccacagaggccaggg

SEQ ID NO: 323809 - RNA, 64 nt, Homo Sapiens
aauugcuuuuguauguagaacaggaaaugauucuuacggaaaaauuuauggacuuauuucuccc

SEQ ID NO: 323810 - RNA, 64 nt, Homo Sapiens
guuuugucugaguucaaacuagugccuguguuguuacggaaagcagcaguguaccagugucacu

SEQ ID NO: 323811 - RNA, 64 nt, Homo Sapiens
agugucuucacuccagccagggcucagcucuugauacggaaacgccaacgaugagcauuucuua

SEQ ID NO: 323812 - RNA, 64 nt, Homo Sapiens
guuuuccuuuggaauauggauaaauacaccaugauacggaaacuagaaggacaucaccaugaug

SEQ ID NO: 323813 - RNA, 64 nt, Homo Sapiens
acauuucaguugagaaugaaguuuuaacuugcaauacggaaaagaguagcagaauuaacacagg

SEQ ID NO: 323814 - RNA, 64 nt, Homo Sapiens
gccuuagacacuacaguacuaagcaaacugacauuacggaaaguccuguuuuugguugguaguu

SEQ ID NO: 323815 - RNA, 64 nt, Homo Sapiens
aaaaugauccucagugcaaacuggucugggaguauacggaaacacuggguaggccccacaaggc

SEQ ID NO: 323816 - RNA, 64 nt, Homo Sapiens
acacgugcuccugugaacuuuccaugguuaugucuacggaaaaugccacuagagagagagugau

SEQ ID NO: 323817 - RNA, 64 nt, Homo Sapiens
guuucuuagguucuaugugaaauuacugcuuaauuacggaaagaucagagauguauauauugug

SEQ ID NO: 323818 - RNA, 64 nt, Homo Sapiens
acuggcugggaguggggagggcguggagacagucuacggaaagcgcuagcagacccccgagagg

SEQ ID NO: 323819 - RNA, 53 nt, Homo Sapiens
gguacugguggaaaaacugaagauacggaaaccugccccacucacacccaucu

SEQ ID NO: 323820 - RNA, 64 nt, Homo Sapiens
ccgacaagccuucagccacacugggggagccucuuacggaaaauacacggacccauagacagcc

SEQ ID NO: 323821 - RNA, 64 nt, Homo Sapiens
cagggcuuggcaacugaaauagcuauguggcggauacggaaaacagaggacaauuugaggaucu

SEQ ID NO: 323822 - RNA, 64 nt, Homo Sapiens
cucccacugaagcaggcuuuucaccagcauguuguacggaaacuccaaaaaaauugaaggaaua

SEQ ID NO: 323823 - RNA, 64 nt, Homo Sapiens
agcgggcgcauuguuguccguuaccucggacgucuacggaaacgguucgucgugguugagauga

SEQ ID NO: 323824 - RNA, 64 nt, Homo Sapiens
auuuaaaacaaagcaacccccuuuccccuaccacuacggaaaagagcaagcucauuuuuccgug

SEQ ID NO: 323825 - RNA, 62 nt, Homo Sapiens
cucugggucauauggugcagacugugaccagcaccaggcaggcaguccugucugcgugugga

SEQ ID NO: 323826 - RNA, 62 nt, Homo Sapiens
aagguuggagucugcuggugcgguguuuacacaccaggcagggcugucugccaccuugugug

SEQ ID NO: 323827 - RNA, 62 nt, Homo Sapiens
agccucugcagcaaugggucaguauggggaaaaccaggcaccucuuuggguuuagaagacca

SEQ ID NO: 323828 - RNA, 62 nt, Homo Sapiens
cucuggcacuguugcuugccgggcuuccugugaccaggcaccgcagcauggaacaugcagcu

SEQ ID NO: 323829 - RNA, 62 nt, Homo Sapiens
cgggcugaaguggggucccacuggagcagcggaccaggcagaaggcugaggauggccugaac

SEQ ID NO: 323830 - RNA, 62 nt, Homo Sapiens
gggcuaaauacuuacauuuaggccuacuguggaccaggcacuauggcuaaauauuuauggag

SEQ ID NO: 323831 - RNA, 62 nt, Homo Sapiens
agcaugaacaccaagcuggggcaauaucuaaaaccaggcaccuguccuuugaggggcugaug

SEQ ID NO: 323832 - RNA, 62 nt, Homo Sapiens
ugauucacagugugaaucuuggugucuacguuaccaggcaggaaggcugagaggagagagac

SEQ ID NO: 323833 - RNA, 62 nt, Homo Sapiens
cugaugcaagcaagaaacacugggcuucuagaaccaggcaacuugggaacuagacucccaag

SEQ ID NO: 323834 - RNA, 62 nt, Homo Sapiens
ccauccacugaaggcuguguuagagucugugcaccaggcaguucauuucauccuggucaguc

SEQ ID NO: 323835 - RNA, 62 nt, Homo Sapiens
guguguagccccaggguuugugacaguuguuuaccaggcacuucauuccucaggcacuugag

SEQ ID NO: 323836 - RNA, 62 nt, Homo Sapiens
gccuacugaccccaaggagcagaaagccugauaccaggcacaauucaucccuucaguucugg

SEQ ID NO: 323837 - RNA, 62 nt, Homo Sapiens
caagggagccaaacacacuaccuuugaagaaaaccaggcagcuaggaaccuucuuggagacc

SEQ ID NO: 323838 - RNA, 62 nt, Homo Sapiens
ugggcaaggcgcucaggcaugcaaccaugggcaccaggcaauacccauccaucacccaucuc

SEQ ID NO: 323839 - RNA, 62 nt, Homo Sapiens
cuaucucacacugcaccaagcacccacugugcaccaggcacuaagucucuagccucuuucuc

SEQ ID NO: 323840 - RNA, 62 nt, Homo Sapiens
ucauggcacuuuuuaacgcuucagcaacaaacaccaggcagcuguugccacuggccuccuac

SEQ ID NO: 323841 - RNA, 62 nt, Homo Sapiens
agaggugagaauggggaggcaagaucucaggcaccaggcaggaggugccuuguaagcuaacu

SEQ ID NO: 323842 - RNA, 62 nt, Homo Sapiens
ccaucucuggaugccugauugccaagcucaggaccaggcaaugugacuuugcaucagcaaca

SEQ ID NO: 323843 - RNA, 62 nt, Homo Sapiens
ugggccugggguaccaagagacuccuugagagaccaggcaaagcaagugauugggacagagg

SEQ ID NO: 323844 - RNA, 62 nt, Homo Sapiens
gccauccagggcuacccacugcuuacucagggaccaggcagcccccauggcaguaaaagcag

SEQ ID NO: 323845 - RNA, 62 nt, Homo Sapiens
aagcccuggcuggccccacuugguaccaauccaccaggcagcucagggcuccugcccagccc

SEQ ID NO: 323846 - RNA, 62 nt, Homo Sapiens
accuacgagugaaacucuguccucccgcgaggaccaggcaucgcugugugaggacggcacgg

SEQ ID NO: 323847 - RNA, 62 nt, Homo Sapiens
ggggagccauccccgccgcccucacaggacccaccaggcagcggagacauguggaauuagag

SEQ ID NO: 323848 - RNA, 62 nt, Homo Sapiens
acagccgcaguuccucaguugucugcucaugcaccaggcagcgccggcaggcgccccuguac

SEQ ID NO: 323849 - RNA, 62 nt, Homo Sapiens
gagcuagcucccugcacggcauccaguacagaaccaggcaucgccaccagugauccccaagc

SEQ ID NO: 323850 - RNA, 62 nt, Homo Sapiens
acaaacccccaaacaccuccccaaagagacauaccaggcaaguggugccaaaccccaaaucu

SEQ ID NO: 323851 - RNA, 62 nt, Homo Sapiens
aggcgccuccguccuagccaaaggaccccaggaccaggcagaucuggccugcacccuugaca

SEQ ID NO: 323852 - RNA, 62 nt, Homo Sapiens
gcugugugaccauccagggguggagggggaaaaccaggcaauuucguuccuggaaucaacca

SEQ ID NO: 323853 - RNA, 62 nt, Homo Sapiens
cauggcagggguggauucgggagcugggaguaaccaggcaaagucaaccagaugccuagcuc

SEQ ID NO: 323854 - RNA, 62 nt, Homo Sapiens
auucugggaacauguuguaagcacugacugggaccaggcaccaggcagggucuagaaggcug

SEQ ID NO: 323855 - RNA, 62 nt, Homo Sapiens
gaacauguuguaagcacugacugggaccaggcaccaggcagggucuagaaggcuguggugag

SEQ ID NO: 323856 - RNA, 62 nt, Homo Sapiens
aggcuggacucagcaggaacaccaaaucccggaccaggcagaaaccacccaagacugagggg

SEQ ID NO: 323857 - RNA, 62 nt, Homo Sapiens
agacuaacggcuaaagagacugaugcaucaacaccaggcagagaauaaagcagauuuuuuug

SEQ ID NO: 323858 - RNA, 64 nt, Homo Sapiens
uguagacccuuucauguacuguacuguacaccugauacuguaaacauacuguaauaauaauguc

SEQ ID NO: 323859 - RNA, 64 nt, Homo Sapiens
ucauguacuguacuguacaccugauacuguaaacauacuguaauaauaaugucucacauggaaa

SEQ ID NO: 323860 - RNA, 64 nt, Homo Sapiens
caacuguaauucuauuuuuaauaauaaaaauggcauacuguagggucuucagaguaguguagga

SEQ ID NO: 323861 - RNA, 64 nt, Homo Sapiens
uggcauacuguagggucuucagaguaguguaggaauacuguagaaauacuuuuucagaaacgaa

SEQ ID NO: 323862 - RNA, 64 nt, Homo Sapiens
uuuuaagaaguuccagcaugcacugcgcccagcuauacuguauacugggauuacaggcgugagc

SEQ ID NO: 323863 - RNA, 64 nt, Homo Sapiens
uuuuuuuuugagacggaguuucaacugcucuuuuauacuguacuauacuauccagcucuaaguc

SEQ ID NO: 323864 - RNA, 64 nt, Homo Sapiens
guauuugucuaacuggggauauaauacuauauuuauacuguauauauaauacugacugagaaua

SEQ ID NO: 323865 - RNA, 64 nt, Homo Sapiens
uuauacuguauauauaauacugacugagaauauaauacuguauuugagaauauaaaaaacuuuu

SEQ ID NO: 323866 - RNA, 64 nt, Homo Sapiens
caagucuuuaucuccacauaugauaguguuauaaauacuguaaaagcauggaaggugcaaaacu

SEQ ID NO: 323867 - RNA, 64 nt, Homo Sapiens
aagaugccucaagcauucauuauuuaugauuugaauacuguagcuauuuuuuguugcuuggcuu

SEQ ID NO: 323868 - RNA, 64 nt, Homo Sapiens
auuagaaaaaaauguaaaacaugauuuaugugaaauacuguauaguaaaaguuggucuaauagu

SEQ ID NO: 323869 - RNA, 64 nt, Homo Sapiens
agcuguccuuuccaacacauugcuacuuuuuuaaauacuguaucauaaguucagccugucauac

SEQ ID NO: 323870 - RNA, 64 nt, Homo Sapiens
uacuuuagaagccugcauaauguuucuggauuucauacuguaacauucaggaauucuuggagaa

SEQ ID NO: 323871 - RNA, 64 nt, Homo Sapiens
acugaacucuagugcgguuuacucacugcugcaaauacuguauauucaggacuugaaagaaaug

SEQ ID NO: 323872 - RNA, 64 nt, Homo Sapiens
ugccaaagcuuuacuacuguggugauuauuuuuuauacuguaugaauuugguauaauuauggug

SEQ ID NO: 323873 - RNA, 64 nt, Homo Sapiens
aacaagcaugaucuuguuacgugucuggcccgcaauacuguaggacacuucugcuuucacuuaa

SEQ ID NO: 323874 - RNA, 64 nt, Homo Sapiens
auuuuggaauucugcacauucauggagugcaauaauacuguauagcuuuccccaccucccacaa

SEQ ID NO: 323875 - RNA, 64 nt, Homo Sapiens
aauggucuugauugugauagcuucaagguggaacauacuguaaucuccagaugcuaggaaguua

SEQ ID NO: 323876 - RNA, 64 nt, Homo Sapiens
guagaauauuucaguauuuaaguggaauuucaguauacuguacuauccuuuauaagucauuaaa

SEQ ID NO: 323877 - RNA, 64 nt, Homo Sapiens
ugcuaaguaagucugaaaauguaauauuuugauaauacuguaauauaccugucacacaaaugcu

SEQ ID NO: 323878 - RNA, 64 nt, Homo Sapiens
uuguagauauauauuuccaaauauucuaaaaaagauacuguauaugucaaaaauauuuuuaugu

SEQ ID NO: 323879 - RNA, 64 nt, Homo Sapiens
aauagcuuuuauugaguaauauuacauuucauuuauacuguagcaauauauuuguagguauacu

SEQ ID NO: 323880 - RNA, 64 nt, Homo Sapiens
uucuuugcuuuuaguuaaaagguauaacucaaguauacuguauauuaaaugaaguuguaacuuc

SEQ ID NO: 323881 - RNA, 64 nt, Homo Sapiens
guaauggucaacuuugccacuguuuuccuugcagauacuguacauuuguuuuuguuuuuguuuu

SEQ ID NO: 323882 - RNA, 64 nt, Homo Sapiens
gaauauauccaguauguaaauuuuuacuuuucugauacuguaaacucugccuuguuagugcaua

SEQ ID NO: 323883 - RNA, 64 nt, Homo Sapiens
agugucaaaugcugcagccuaauuugccauugcuauacuguaccuaugccaaauuauuuaugau

SEQ ID NO: 323884 - RNA, 64 nt, Homo Sapiens
cugaaaggcaacauaauucuucaggcuaucauauauacuguaucucagaaguuuccuggaguuu

SEQ ID NO: 323885 - RNA, 64 nt, Homo Sapiens
ucauuuuuuuugcuucuggccauuccuccagugcauacuguagggaaaguuuuaauaccuaagu

SEQ ID NO: 323886 - RNA, 64 nt, Homo Sapiens
gagaggcaauuuaauguuaaugaugcucagccacauacuguagaggcagagggaggaaggucca

SEQ ID NO: 323887 - RNA, 64 nt, Homo Sapiens
uugauuuaucuaauuagcuuuaaucugaaggaugauacuguaacuugguuauaucagagcacuu

SEQ ID NO: 323888 - RNA, 64 nt, Homo Sapiens
ugauuauggccuacaauguuaccaccuuuuccuuauacuguauaauaacugcuuacucaacacu

SEQ ID NO: 323889 - RNA, 64 nt, Homo Sapiens
accugucuccuacuuugaaagaaacuguaaaaugauacuguagauacuuguuuucaauguguug

SEQ ID NO: 323890 - RNA, 64 nt, Homo Sapiens
cuaagacagguuguuuuugcacuuaaaacaucugauacuguauuuuguacuguugaucacaugu

SEQ ID NO: 323891 - RNA, 64 nt, Homo Sapiens
guuaauauugaacuguuuauuugugcuggcaaauauacuguauuagguguuuauacugauuuga

SEQ ID NO: 323892 - RNA, 64 nt, Homo Sapiens
aauauugcucuaauucuuuucuaguaauaauguaauacuguagauguacccuuguuauuaucua

SEQ ID NO: 323893 - RNA, 64 nt, Homo Sapiens
gauacuauucaaugcaaugcaagaaguaaacuggauacuguacugagccagaaguugauguggg

SEQ ID NO: 323894 - RNA, 64 nt, Homo Sapiens
uguggaauuuuauuguauuauucuuccauucuuaauacuguaccacauuccugcucagaaacug

SEQ ID NO: 323895 - RNA, 64 nt, Homo Sapiens
ugcaguuaaagcucaauaugccuuuuuuuacuggauacuguacauuuggcuaaaagcuuuuauu

SEQ ID NO: 323896 - RNA, 64 nt, Homo Sapiens
aacuauucgugacauaguucuaucuuaauacuguauacuguauuucuuuagagaccagaaaaac

SEQ ID NO: 323897 - RNA, 64 nt, Homo Sapiens
cuguauuaacuauucgugacgaaaaacuaucuuaauacuguauauaccauuucuuuagagacca

SEQ ID NO: 323898 - RNA, 64 nt, Homo Sapiens
uuucuaagugguaagaaugaccugucacuauaauauacuguauguuuacauuuuauuuaaauuu

SEQ ID NO: 323899 - RNA, 64 nt, Homo Sapiens
aacaauuuuuaauguaaucuugauuuuaccucauauacuguacauuccaaaaacucuaaacuuu

SEQ ID NO: 323900 - RNA, 64 nt, Homo Sapiens
auauuuauuaauauuugaaaaagaaugcuuguaaauacuguaaucugucagugucggaguguau

SEQ ID NO: 323901 - RNA, 64 nt, Homo Sapiens
auuuugguaugcuuacaaaucucauacgugggcuauacuguauuaaaugucucaguguguuugg

SEQ ID NO: 323902 - RNA, 64 nt, Homo Sapiens
uuuauucagcugcccucguuuucucuaauauuguauacuguaaaugagcaauugcaacauaaua

SEQ ID NO: 323903 - RNA, 64 nt, Homo Sapiens
cauaaaaguuaugugaauauacaauuauaacaauauacuguaauaauaauaaacauaauaugga

SEQ ID NO: 323904 - RNA, 64 nt, Homo Sapiens
gaaaaagagauagaaggaaccaccuaugcuuaaaauacuguaaauaugcagugagguuuggcaa

SEQ ID NO: 323905 - RNA, 64 nt, Homo Sapiens
uuuuuaaauggaauuuugcacauaauacauuguaauacuguaugauaaucaugugugaaaauaa

SEQ ID NO: 323906 - RNA, 64 nt, Homo Sapiens
gagccccgccugcaggcgguguagauacauguagauacuguagauacuguagauaccgccccgg

SEQ ID NO: 323907 - RNA, 64 nt, Homo Sapiens
cugcaggcgguguagauacauguagauacuguagauacuguagauaccgccccggcgccgacuu

SEQ ID NO: 323908 - RNA, 64 nt, Homo Sapiens
ugagauuuucugccaguuaaacuaaaacaagaucauacuguaaauguuuguaacuugcuucccc

SEQ ID NO: 323909 - RNA, 64 nt, Homo Sapiens
cuguaaauguuuguaacuugcuuccccccacuguauacuguaaacaucuuugcaugucaauaaa

SEQ ID NO: 323910 - RNA, 64 nt, Homo Sapiens; identical to SEQ ID NO: 301531

SEQ ID NO: 323911 - RNA, 64 nt, Homo Sapiens; identical to SEQ ID NO: 301532

SEQ ID NO: 323912 - RNA, 64 nt, Homo Sapiens; identical to SEQ ID NO: 301533

SEQ ID NO: 323913 - RNA, 64 nt, Homo Sapiens; identical to SEQ ID NO: 301534

SEQ ID NO: 323914 - RNA, 64 nt, Homo Sapiens; identical to SEQ ID NO: 301535

SEQ ID NO: 323915 - RNA, 64 nt, Homo Sapiens; identical to SEQ ID NO: 301536

SEQ ID NO: 323916 - RNA, 64 nt, Homo Sapiens; identical to SEQ ID NO: 301537

SEQ ID NO: 323917 - RNA, 64 nt, Homo Sapiens; identical to SEQ ID NO: 301538

SEQ ID NO: 323918 - RNA, 64 nt, Homo Sapiens; identical to SEQ ID NO: 301539

SEQ ID NO: 323919 - RNA, 64 nt, Homo Sapiens; identical to SEQ ID NO: 301540

SEQ ID NO: 323920 - RNA, 64 nt, Homo Sapiens; identical to SEQ ID NO: 301541

SEQ ID NO: 323921 - RNA, 64 nt, Homo Sapiens; identical to SEQ ID NO: 301542

SEQ ID NO: 323922 - RNA, 64 nt, Homo Sapiens; identical to SEQ ID NO: 301543

SEQ ID NO: 323923 - RNA, 64 nt, Homo Sapiens; identical to SEQ ID NO: 301544

SEQ ID NO: 323924 - RNA, 64 nt, Homo Sapiens; identical to SEQ ID NO: 301545

SEQ ID NO: 323925 - RNA, 64 nt, Homo Sapiens; identical to SEQ ID NO: 301546

SEQ ID NO: 323926 - RNA, 64 nt, Homo Sapiens; identical to SEQ ID NO: 301547

SEQ ID NO: 323927 - RNA, 64 nt, Homo Sapiens; identical to SEQ ID NO: 301548

SEQ ID NO: 323928 - RNA, 64 nt, Homo Sapiens; identical to SEQ ID NO: 301549

SEQ ID NO: 323929 - RNA, 64 nt, Homo Sapiens; identical to SEQ ID NO: 301550

SEQ ID NO: 323930 - RNA, 64 nt, Homo Sapiens; identical to SEQ ID NO: 301551

SEQ ID NO: 323931 - RNA, 64 nt, Homo Sapiens; identical to SEQ ID NO: 301552

SEQ ID NO: 323932 - RNA, 64 nt, Homo Sapiens; identical to SEQ ID NO: 301553

SEQ ID NO: 323933 - RNA, 64 nt, Homo Sapiens; identical to SEQ ID NO: 301554

SEQ ID NO: 323934 - RNA, 64 nt, Homo Sapiens; identical to SEQ ID NO: 301555

SEQ ID NO: 323935 - RNA, 64 nt, Homo Sapiens; identical to SEQ ID NO: 301556

SEQ ID NO: 323936 - RNA, 64 nt, Homo Sapiens; identical to SEQ ID NO: 301557

SEQ ID NO: 323937 - RNA, 64 nt, Homo Sapiens; identical to SEQ ID NO: 301558

SEQ ID NO: 323938 - RNA, 64 nt, Homo Sapiens; identical to SEQ ID NO: 301559

SEQ ID NO: 323939 - RNA, 64 nt, Homo Sapiens; identical to SEQ ID NO: 301560

SEQ ID NO: 323940 - RNA, 60 nt, Homo Sapiens; identical to SEQ ID NO: 301561

SEQ ID NO: 323941 - RNA, 64 nt, Homo Sapiens; identical to SEQ ID NO: 301562

SEQ ID NO: 323942 - RNA, 64 nt, Homo Sapiens; identical to SEQ ID NO: 301563

SEQ ID NO: 323943 - RNA, 64 nt, Homo Sapiens; identical to SEQ ID NO: 301564

SEQ ID NO: 323944 - RNA, 64 nt, Homo Sapiens; identical to SEQ ID NO: 301565

SEQ ID NO: 323945 - RNA, 64 nt, Homo Sapiens; identical to SEQ ID NO: 301566

SEQ ID NO: 323946 - RNA, 64 nt, Homo Sapiens; identical to SEQ ID NO: 301567

SEQ ID NO: 323947 - RNA, 64 nt, Homo Sapiens; identical to SEQ ID NO: 301568

SEQ ID NO: 323948 - RNA, 64 nt, Homo Sapiens; identical to SEQ ID NO: 301569

SEQ ID NO: 323949 - RNA, 64 nt, Homo Sapiens; identical to SEQ ID NO: 301570

SEQ ID NO: 323950 - RNA, 64 nt, Homo Sapiens; identical to SEQ ID NO: 301571

SEQ ID NO: 323951 - RNA, 64 nt, Homo Sapiens; identical to SEQ ID NO: 301572

SEQ ID NO: 323952 - RNA, 64 nt, Homo Sapiens; identical to SEQ ID NO: 301573

SEQ ID NO: 323953 - RNA, 64 nt, Homo Sapiens; identical to SEQ ID NO: 301574

SEQ ID NO: 323954 - RNA, 64 nt, Homo Sapiens; identical to SEQ ID NO: 301575

SEQ ID NO: 323955 - RNA, 64 nt, Homo Sapiens; identical to SEQ ID NO: 301576

SEQ ID NO: 323956 - RNA, 64 nt, Homo Sapiens; identical to SEQ ID NO: 301577

SEQ ID NO: 323957 - RNA, 64 nt, Homo Sapiens; identical to SEQ ID NO: 301578

SEQ ID NO: 323958 - RNA, 64 nt, Homo Sapiens; identical to SEQ ID NO: 301579

SEQ ID NO: 323959 - RNA, 64 nt, Homo Sapiens; identical to SEQ ID NO: 301580

SEQ ID NO: 323960 - RNA, 64 nt, Homo Sapiens; identical to SEQ ID NO: 301581

SEQ ID NO: 323961 - RNA, 64 nt, Homo Sapiens; identical to SEQ ID NO: 301582

SEQ ID NO: 323962 - RNA, 64 nt, Homo Sapiens; identical to SEQ ID NO: 301583

SEQ ID NO: 323963 - RNA, 64 nt, Homo Sapiens; identical to SEQ ID NO: 301584

SEQ ID NO: 323964 - RNA, 64 nt, Homo Sapiens; identical to SEQ ID NO: 301585

SEQ ID NO: 323965 - RNA, 64 nt, Homo Sapiens; identical to SEQ ID NO: 301586

SEQ ID NO: 323966 - RNA, 64 nt, Homo Sapiens; identical to SEQ ID NO: 301587

SEQ ID NO: 323967 - RNA, 64 nt, Homo Sapiens; identical to SEQ ID NO: 301588

SEQ ID NO: 323968 - RNA, 64 nt, Homo Sapiens; identical to SEQ ID NO: 301589

SEQ ID NO: 323969 - RNA, 64 nt, Homo Sapiens; identical to SEQ ID NO: 301590

SEQ ID NO: 323970 - RNA, 64 nt, Homo Sapiens; identical to SEQ ID NO: 301591

SEQ ID NO: 323971 - RNA, 64 nt, Homo Sapiens; identical to SEQ ID NO: 301592

SEQ ID NO: 323972 - RNA, 64 nt, Homo Sapiens; identical to SEQ ID NO: 301593

SEQ ID NO: 323973 - RNA, 64 nt, Homo Sapiens; identical to SEQ ID NO: 301594

SEQ ID NO: 323974 - RNA, 64 nt, Homo Sapiens; identical to SEQ ID NO: 301595

SEQ ID NO: 323975 - RNA, 64 nt, Homo Sapiens; identical to SEQ ID NO: 301596

SEQ ID NO: 323976 - RNA, 64 nt, Homo Sapiens; identical to SEQ ID NO: 301597

SEQ ID NO: 323977 - RNA, 64 nt, Homo Sapiens; identical to SEQ ID NO: 301598

SEQ ID NO: 323978 - RNA, 64 nt, Homo Sapiens; identical to SEQ ID NO: 301599

SEQ ID NO: 323979 - RNA, 64 nt, Homo Sapiens; identical to SEQ ID NO: 301600

SEQ ID NO: 323980 - RNA, 64 nt, Homo Sapiens; identical to SEQ ID NO: 301601

SEQ ID NO: 323981 - RNA, 64 nt, Homo Sapiens; identical to SEQ ID NO: 301602

SEQ ID NO: 323982 - RNA, 64 nt, Homo Sapiens; identical to SEQ ID NO: 301603

SEQ ID NO: 323983 - RNA, 64 nt, Homo Sapiens; identical to SEQ ID NO: 301604

SEQ ID NO: 323984 - RNA, 64 nt, Homo Sapiens; identical to SEQ ID NO: 301605

SEQ ID NO: 323985 - RNA, 64 nt, Homo Sapiens; identical to SEQ ID NO: 301606

SEQ ID NO: 323986 - RNA, 64 nt, Homo Sapiens; identical to SEQ ID NO: 301607

SEQ ID NO: 323987 - RNA, 64 nt, Homo Sapiens; identical to SEQ ID NO: 301608

SEQ ID NO: 323988 - RNA, 64 nt, Homo Sapiens; identical to SEQ ID NO: 301609

SEQ ID NO: 323989 - RNA, 64 nt, Homo Sapiens; identical to SEQ ID NO: 301610

SEQ ID NO: 323990 - RNA, 64 nt, Homo Sapiens; identical to SEQ ID NO: 301611

SEQ ID NO: 323991 - RNA, 64 nt, Homo Sapiens; identical to SEQ ID NO: 301612

SEQ ID NO: 323992 - RNA, 64 nt, Homo Sapiens; identical to SEQ ID NO: 301613

SEQ ID NO: 323993 - RNA, 64 nt, Homo Sapiens; identical to SEQ ID NO: 301614

SEQ ID NO: 323994 - RNA, 64 nt, Homo Sapiens; identical to SEQ ID NO: 301615

SEQ ID NO: 323995 - RNA, 64 nt, Homo Sapiens; identical to SEQ ID NO: 301616

SEQ ID NO: 323996 - RNA, 64 nt, Homo Sapiens; identical to SEQ ID NO: 301617

SEQ ID NO: 323997 - RNA, 64 nt, Homo Sapiens; identical to SEQ ID NO: 301618

SEQ ID NO: 323998 - RNA, 64 nt, Homo Sapiens; identical to SEQ ID NO: 301619

SEQ ID NO: 323999 - RNA, 64 nt, Homo Sapiens; identical to SEQ ID NO: 301620

SEQ ID NO: 324000 - RNA, 64 nt, Homo Sapiens; identical to SEQ ID NO: 301621

SEQ ID NO: 324001 - RNA, 64 nt, Homo Sapiens; identical to SEQ ID NO: 301622

SEQ ID NO: 324002 - RNA, 64 nt, Homo Sapiens; identical to SEQ ID NO: 301623

SEQ ID NO: 324003 - RNA, 64 nt, Homo Sapiens; identical to SEQ ID NO: 301624

SEQ ID NO: 324004 - RNA, 64 nt, Homo Sapiens; identical to SEQ ID NO: 301625

SEQ ID NO: 324005 - RNA, 64 nt, Homo Sapiens; identical to SEQ ID NO: 301626

SEQ ID NO: 324006 - RNA, 64 nt, Homo Sapiens; identical to SEQ ID NO: 301627

SEQ ID NO: 324007 - RNA, 64 nt, Homo Sapiens; identical to SEQ ID NO: 301628

SEQ ID NO: 324008 - RNA, 64 nt, Homo Sapiens; identical to SEQ ID NO: 301629

SEQ ID NO: 324009 - RNA, 64 nt, Homo Sapiens; identical to SEQ ID NO: 301630

SEQ ID NO: 324010 - RNA, 64 nt, Homo Sapiens; identical to SEQ ID NO: 301631

SEQ ID NO: 324011 - RNA, 64 nt, Homo Sapiens; identical to SEQ ID NO: 301632

SEQ ID NO: 324012 - RNA, 64 nt, Homo Sapiens; identical to SEQ ID NO: 301633

SEQ ID NO: 324013 - RNA, 64 nt, Homo Sapiens; identical to SEQ ID NO: 301634

SEQ ID NO: 324014 - RNA, 64 nt, Homo Sapiens; identical to SEQ ID NO: 301635

SEQ ID NO: 324015 - RNA, 64 nt, Homo Sapiens; identical to SEQ ID NO: 301636

SEQ ID NO: 324016 - RNA, 64 nt, Homo Sapiens; identical to SEQ ID NO: 301637

SEQ ID NO: 324017 - RNA, 64 nt, Homo Sapiens; identical to SEQ ID NO: 301638

SEQ ID NO: 324018 - RNA, 64 nt, Homo Sapiens; identical to SEQ ID NO: 301639

SEQ ID NO: 324019 - RNA, 64 nt, Homo Sapiens; identical to SEQ ID NO: 301640

SEQ ID NO: 324020 - RNA, 64 nt, Homo Sapiens; identical to SEQ ID NO: 301641

SEQ ID NO: 324021 - RNA, 64 nt, Homo Sapiens; identical to SEQ ID NO: 301642

SEQ ID NO: 324022 - RNA, 64 nt, Homo Sapiens; identical to SEQ ID NO: 301643

SEQ ID NO: 324023 - RNA, 64 nt, Homo Sapiens; identical to SEQ ID NO: 301644

SEQ ID NO: 324024 - RNA, 64 nt, Homo Sapiens; identical to SEQ ID NO: 301645

SEQ ID NO: 324025 - RNA, 64 nt, Homo Sapiens; identical to SEQ ID NO: 301646

SEQ ID NO: 324026 - RNA, 64 nt, Homo Sapiens; identical to SEQ ID NO: 301647

SEQ ID NO: 324027 - RNA, 64 nt, Homo Sapiens; identical to SEQ ID NO: 301648

SEQ ID NO: 324028 - RNA, 64 nt, Homo Sapiens; identical to SEQ ID NO: 301649

SEQ ID NO: 324029 - RNA, 64 nt, Homo Sapiens; identical to SEQ ID NO: 301650

SEQ ID NO: 324030 - RNA, 64 nt, Homo Sapiens; identical to SEQ ID NO: 301651

SEQ ID NO: 324031 - RNA, 64 nt, Homo Sapiens; identical to SEQ ID NO: 301652

SEQ ID NO: 324032 - RNA, 64 nt, Homo Sapiens; identical to SEQ ID NO: 301653

SEQ ID NO: 324033 - RNA, 64 nt, Homo Sapiens; identical to SEQ ID NO: 301654

SEQ ID NO: 324034 - RNA, 64 nt, Homo Sapiens; identical to SEQ ID NO: 301655

SEQ ID NO: 324035 - RNA, 64 nt, Homo Sapiens; identical to SEQ ID NO: 301656

SEQ ID NO: 324036 - RNA, 64 nt, Homo Sapiens; identical to SEQ ID NO: 301657

SEQ ID NO: 324037 - RNA, 64 nt, Homo Sapiens; identical to SEQ ID NO: 301658

SEQ ID NO: 324038 - RNA, 64 nt, Homo Sapiens; identical to SEQ ID NO: 301659

SEQ ID NO: 324039 - RNA, 64 nt, Homo Sapiens; identical to SEQ ID NO: 301660

SEQ ID NO: 324040 - RNA, 64 nt, Homo Sapiens; identical to SEQ ID NO: 301661

SEQ ID NO: 324041 - RNA, 64 nt, Homo Sapiens; identical to SEQ ID NO: 301662

SEQ ID NO: 324042 - RNA, 64 nt, Homo Sapiens; identical to SEQ ID NO: 301663

SEQ ID NO: 324043 - RNA, 64 nt, Homo Sapiens; identical to SEQ ID NO: 301664

SEQ ID NO: 324044 - RNA, 64 nt, Homo Sapiens; identical to SEQ ID NO: 301665

SEQ ID NO: 324045 - RNA, 64 nt, Homo Sapiens; identical to SEQ ID NO: 301666

SEQ ID NO: 324046 - RNA, 64 nt, Homo Sapiens; identical to SEQ ID NO: 301667

SEQ ID NO: 324047 - RNA, 62 nt, Homo Sapiens; identical to SEQ ID NO: 301668

SEQ ID NO: 324048 - RNA, 59 nt, Homo Sapiens; identical to SEQ ID NO: 301669

SEQ ID NO: 324049 - RNA, 64 nt, Homo Sapiens; identical to SEQ ID NO: 301670

SEQ ID NO: 324050 - RNA, 64 nt, Homo Sapiens; identical to SEQ ID NO: 301671

SEQ ID NO: 324051 - RNA, 64 nt, Homo Sapiens; identical to SEQ ID NO: 301672

SEQ ID NO: 324052 - RNA, 64 nt, Homo Sapiens; identical to SEQ ID NO: 301673

SEQ ID NO: 324053 - RNA, 64 nt, Homo Sapiens; identical to SEQ ID NO: 301674

SEQ ID NO: 324054 - RNA, 64 nt, Homo Sapiens; identical to SEQ ID NO: 301675

SEQ ID NO: 324055 - RNA, 64 nt, Homo Sapiens; identical to SEQ ID NO: 301676

SEQ ID NO: 324056 - RNA, 64 nt, Homo Sapiens; identical to SEQ ID NO: 301677

SEQ ID NO: 324057 - RNA, 64 nt, Homo Sapiens; identical to SEQ ID NO: 301678

SEQ ID NO: 324058 - RNA, 64 nt, Homo Sapiens; identical to SEQ ID NO: 301679

SEQ ID NO: 324059 - RNA, 64 nt, Homo Sapiens; identical to SEQ ID NO: 301680

SEQ ID NO: 324060 - RNA, 64 nt, Homo Sapiens; identical to SEQ ID NO: 301681

SEQ ID NO: 324061 - RNA, 64 nt, Homo Sapiens; identical to SEQ ID NO: 301682

SEQ ID NO: 324062 - RNA, 64 nt, Homo Sapiens; identical to SEQ ID NO: 301683

SEQ ID NO: 324063 - RNA, 64 nt, Homo Sapiens; identical to SEQ ID NO: 301684

SEQ ID NO: 324064 - RNA, 64 nt, Homo Sapiens; identical to SEQ ID NO: 301685

SEQ ID NO: 324065 - RNA, 64 nt, Homo Sapiens; identical to SEQ ID NO: 301686

SEQ ID NO: 324066 - RNA, 64 nt, Homo Sapiens; identical to SEQ ID NO: 301687

SEQ ID NO: 324067 - RNA, 64 nt, Homo Sapiens; identical to SEQ ID NO: 301688

SEQ ID NO: 324068 - RNA, 64 nt, Homo Sapiens; identical to SEQ ID NO: 301689

SEQ ID NO: 324069 - RNA, 64 nt, Homo Sapiens; identical to SEQ ID NO: 301690

SEQ ID NO: 324070 - RNA, 64 nt, Homo Sapiens; identical to SEQ ID NO: 301691

SEQ ID NO: 324071 - RNA, 64 nt, Homo Sapiens; identical to SEQ ID NO: 301692

SEQ ID NO: 324072 - RNA, 64 nt, Homo Sapiens; identical to SEQ ID NO: 301693

SEQ ID NO: 324073 - RNA, 64 nt, Homo Sapiens; identical to SEQ ID NO: 301694

SEQ ID NO: 324074 - RNA, 64 nt, Homo Sapiens; identical to SEQ ID NO: 301695

SEQ ID NO: 324075 - RNA, 64 nt, Homo Sapiens; identical to SEQ ID NO: 301696

SEQ ID NO: 324076 - RNA, 64 nt, Homo Sapiens; identical to SEQ ID NO: 301697

SEQ ID NO: 324077 - RNA, 64 nt, Homo Sapiens; identical to SEQ ID NO: 301698

SEQ ID NO: 324078 - RNA, 64 nt, Homo Sapiens; identical to SEQ ID NO: 301699

SEQ ID NO: 324079 - RNA, 64 nt, Homo Sapiens; identical to SEQ ID NO: 301700

SEQ ID NO: 324080 - RNA, 64 nt, Homo Sapiens; identical to SEQ ID NO: 301701

SEQ ID NO: 324081 - RNA, 64 nt, Homo Sapiens; identical to SEQ ID NO: 301702

SEQ ID NO: 324082 - RNA, 65 nt, Homo Sapiens
aaucaggguagcugaccauguuuggcagauacuauaauggagacacagaagugugcauggcccaa

SEQ ID NO: 324083 - RNA, 65 nt, Homo Sapiens
ggcugcuuuugauauguucccugacacauaucuugaauggagaccucccuaccaagugaugaaag

SEQ ID NO: 324084 - RNA, 65 nt, Homo Sapiens
auuccuuucaccaucauuuagaaaugguuugccuuaauggagacaauagcagauccuguaguauu

SEQ ID NO: 324085 - RNA, 65 nt, Homo Sapiens
gaagcugggcagcgucugcucuguguucuguguggaauggagaaaaaaacgccugcccugcugcc

SEQ ID NO: 324086 - RNA, 65 nt, Homo Sapiens
aaguccaaaugaugaaggaaauguuuuaauucacaaauggagauuuguauguguuaucagguuca

SEQ ID NO: 324087 - RNA, 65 nt, Homo Sapiens
cuucgcuauuaaauaaagaaaauuggaugcaagacaauggagaaacuuuaaaacuaaacaggacc

SEQ ID NO: 324088 - RNA, 65 nt, Homo Sapiens
ucuagagacagaggaggccuggcaggggugauaaaaauggagauugaaaugaagagaaauagcca

SEQ ID NO: 324089 - RNA, 65 nt, Homo Sapiens
cuuuaaagacuacaagauuugcuagauaaacuggaaauggagaaguuauugcagacagucaugaa

SEQ ID NO: 324090 - RNA, 65 nt, Homo Sapiens
aauucaccaauuuccuuuaaaacauaagcuaccugaauggagaauacaucuuguuucugaguuuc

SEQ ID NO: 324091 - RNA, 65 nt, Homo Sapiens
gucuuccauuaagaacacuaaaaaguccuugcaagaauggagauaugcauucaagagaggugcua

SEQ ID NO: 324092 - RNA, 65 nt, Homo Sapiens
ugaccccucucuccccaguauuaucuuacuugcaaaauggagaccaaauucuauccugugaggcu

SEQ ID NO: 324093 - RNA, 65 nt, Homo Sapiens
uuaaagucacugguacuauggacaacuccauagugaauggagauacuugcagagcuugucaugca

SEQ ID NO: 324094 - RNA, 65 nt, Homo Sapiens
cugucacauagcagcauuccgauucuauguaacugaauggagaugauaagugcuuuccccucuuu

SEQ ID NO: 324095 - RNA, 65 nt, Homo Sapiens
ugagaugcuuaaauauuguagauagucaacucuuaaauggagacuauuuauaacagucauucuuu

SEQ ID NO: 324096 - RNA, 59 nt, Homo Sapiens; identical to SEQ ID NO: 173059

SEQ ID NO: 324097 - RNA, 65 nt, Homo Sapiens
caccagcaccagcucccugucucuucuagccacuuaauggagacacaauggagagguaagacaga

SEQ ID NO: 324098 - RNA, 65 nt, Homo Sapiens
gcucccugucucuucuagccacuuaauggagacacaauggagagguaagacagaccacaaacuag

SEQ ID NO: 324099 - RNA, 65 nt, Homo Sapiens
guuuaugguuucaggaaaaguuucacauuccagacaauggagaguacaggguuauaggccucucc

SEQ ID NO: 324100 - RNA, 65 nt, Homo Sapiens
uuuucaguuuuauaaagggauggucuacuuaggacaauggagacuauaagaauguuaucagaauc

SEQ ID NO: 324101 - RNA, 53 nt, Homo Sapiens; identical to SEQ ID NO: 173064

SEQ ID NO: 324102 - RNA, 65 nt, Homo Sapiens
auugacuagaucaagaacuguuuauagcuuuagcaaauggagacagcuuugugaaacuucuucac

SEQ ID NO: 324103 - RNA, 65 nt, Homo Sapiens
ugagccaccgugccuggccaggccccuucucuuuuaauggagacagggucuugcacuaucaccca

SEQ ID NO: 324104 - RNA, 65 nt, Homo Sapiens
aagaaacauuuucucugaaauauauuauuaagggcaauggagauaaauuaauaguagaugugguu

SEQ ID NO: 324105 - RNA, 65 nt, Homo Sapiens
cccgcacaguaauguagaaaucuugaaugggcaugaauggagaugagugggaucaacaaugauuu

SEQ ID NO: 324106 - RNA, 65 nt, Homo Sapiens
augaauggacaaagcucaggggcuguggaagggccaauggagaaagcaagaauuucuggaagaaa

SEQ ID NO: 324107 - RNA, 65 nt, Homo Sapiens
ugaagcagaggaaggaaacacccugagguuagcccaauggagaaauuaugugugcagacaauucu

SEQ ID NO: 324108 - RNA, 65 nt, Homo Sapiens
gcugagcugaggccugacuucaccaagcugagccgaauggagacacuacuaugggcagggccccc

SEQ ID NO: 324109 - RNA, 65 nt, Homo Sapiens
gaucccaggucuugugggacaggccugggccucaaaauggagauggcuaggucuccuuggaaacc

SEQ ID NO: 324110 - RNA, 65 nt, Homo Sapiens
ugaagccaaagcugggcucaguggggaaggucaggaauggagaaauugccuuuucucguuagccu

SEQ ID NO: 324111 - RNA, 65 nt, Homo Sapiens
guuggagaucauuauucuaagugaaauaacucaggaauggagaaccaaauauuguacauccucac

SEQ ID NO: 324112 - RNA, 65 nt, Homo Sapiens
cugccaagauccuuugaauacaugcaagaacacacaauggagagaaacccuaugaauguaaagaa

SEQ ID NO: 324113 - RNA, 65 nt, Homo Sapiens
ugggaggccgaggcgggcggaucacuaggucaggaaauggagaccauccuggccaacacagugaa

SEQ ID NO: 324114 - RNA, 65 nt, Homo Sapiens
cugagguuugugaaacaguaggauucucuuuuggcaauggagaauugcaucugaugguucaagug

SEQ ID NO: 324115 - RNA, 65 nt, Homo Sapiens
auguggcuuuuguugaguuaaauaagaugcuauauaauggagaagaauuugaaaaugcacaaaaa

SEQ ID NO: 324116 - RNA, 64 nt, Homo Sapiens
cggcuacaugacucugaaccccagggcaccuacugacgaugauaaaaacaucuaccugacucuu

SEQ ID NO: 324117 - RNA, 64 nt, Homo Sapiens
auugcaccgaaagcaggcccuuagggcaggaagggacgaugagcaagucugccacaccaccugg

SEQ ID NO: 324118 - RNA, 64 nt, Homo Sapiens
ugggagggacgcgugaagggccaccuugggagaggacgaugacuucaucugcaccuacuuguuc

SEQ ID NO: 324119 - RNA, 64 nt, Homo Sapiens
gaaugacucugucuugugggugucugacaguggcgacgaugaacaugccguugguuuuauuggc

SEQ ID NO: 324120 - RNA, 64 nt, Homo Sapiens
ggcuucgacucugugguuuccauuggucuaugaggacgaugacaaacaaguacguguggcuacu

SEQ ID NO: 324121 - RNA, 64 nt, Homo Sapiens
cugcagcugcaggagugcuugugggcugcuaugggacgaugacuugggagcgcuaugggccugc

SEQ ID NO: 324122 - RNA, 64 nt, Homo Sapiens
gcccucagggcuuccagcaggauugagucacccugacgaugaccggggagaagccgugugcucu

SEQ ID NO: 324123 - RNA, 64 nt, Homo Sapiens
gauagguaucuagagcuuaaugcuacaugugagugacgaugauguacagauucuuucaguucuu

SEQ ID NO: 324124 - RNA, 64 nt, Homo Sapiens
uggggaaacccuccaccuccgcuguccugaccuggacgaugacguuggugaagaaacuguguga

SEQ ID NO: 324125 - RNA, 64 nt, Homo Sapiens
ggucugaaaggccaacccgacaggaugccucauagacgaugaggccuggccacagcugcacuua

SEQ ID NO: 324126 - RNA, 64 nt, Homo Sapiens
ccuuaaaaaaacacggaagcacaguuggaggugggacgaugagacuuugaaacuaucucaugcc

SEQ ID NO: 324127 - RNA, 64 nt, Homo Sapiens
auguaaaguuucucgguguguucuguuaauguaagacgaugaacaguuguguauaguguuuuac

SEQ ID NO: 324128 - RNA, 64 nt, Homo Sapiens
guucaagccuuagcaagcccagaggcccccagcagacgaugaggacauugucggcucaacaucu

SEQ ID NO: 324129 - RNA, 64 nt, Homo Sapiens
uaucuucuacauucuagaaauguagucuggcugagacgaugagucaucaucggguauuagaaaa

SEQ ID NO: 324130 - RNA, 64 nt, Homo Sapiens
aggagaugucuguuggauuccuguucuaugcugugacgaugagguaggucuuuguuauuuucaa

SEQ ID NO: 324131 - RNA, 64 nt, Homo Sapiens
ugaguauuuagaauguaccaaauggugugggagugacgaugauguguuguggggucaaccguac

SEQ ID NO: 324132 - RNA, 64 nt, Homo Sapiens
cacucuacuugcugaccacauuucccagagcuaugacgaugagaggaagacugcgcuguauuuu

SEQ ID NO: 324133 - RNA, 64 nt, Homo Sapiens
cuugggugagcaacggcaccuuuucaggaaauccgacgaugacuuguggagcaccagccucggu

SEQ ID NO: 324134 - RNA, 64 nt, Homo Sapiens
gugaaggguuaauguagaaaccauaucuguagaugacgaugaauucuggcagaaugugugaaug

SEQ ID NO: 324135 - RNA, 64 nt, Homo Sapiens
cuacuugaccuuuucuucccuggcuacagcaaaggacgaugaucugccugcuuucacuguguug

SEQ ID NO: 324136 - RNA, 64 nt, Homo Sapiens
aacauuuuuaucuacguuuuauaacuuggugagugacgaugagagcccugcaccuggccagagu

SEQ ID NO: 324137 - RNA, 64 nt, Homo Sapiens
uccugcccuuucaaagaauaaccacagcucagaagacgaugacguggucaucugugucgccauc

SEQ ID NO: 324138 - RNA, 64 nt, Homo Sapiens
ccguuggggcggaggcugccauguugucuuugaugacgaugauggaaucacgcccuccugggcc

SEQ ID NO: 324139 - RNA, 64 nt, Homo Sapiens
gagaugucacuuuacaugggaguuauccauugaugacgaugaaaugccugauuuagaaaacaga

SEQ ID NO: 324140 - RNA, 64 nt, Homo Sapiens
uuugaaacguaacugguucccugaccaggucaccgacgaugagggcgcaccugcuguccuggag

SEQ ID NO: 324141 - RNA, 64 nt, Homo Sapiens
caggccugagccccacacaggugucuucacaccugacgaugagcacauccaucggcuccccaug

SEQ ID NO: 324142 - RNA, 64 nt, Homo Sapiens
uaccugcaguggugauggcccugggcccagaaaggacgaugaacugccguguggcccugggacc

SEQ ID NO: 324143 - RNA, 64 nt, Homo Sapiens
ucuuugacuguaagacagggcucuguaucagugagacgaugagaaaagucccaggcuaauggca

SEQ ID NO: 324144 - RNA, 64 nt, Homo Sapiens
gagccacgcaaggcugcaccucuguguguugggagacgaugaugauguccauugcugugugaug

SEQ ID NO: 324145 - RNA, 64 nt, Homo Sapiens
uccugaaacuuggaggggcaaucaggcuggaggugacgaugagugcucccagcccagagcagcc

SEQ ID NO: 324146 - RNA, 64 nt, Homo Sapiens
ccguggacucacuccaccagcuuccuauaacuuggacgaugaccaggcggcuugggagaaugag

SEQ ID NO: 324147 - RNA, 64 nt, Homo Sapiens
accagucguacuaucuuacuaaagagaagaagaugacgaugaugcaggcuucugccaaaaaaaa

SEQ ID NO: 324148 - RNA, 64 nt, Homo Sapiens
guccucuuguacuucgugugcuccgacccauggugacgaugacacacccugguggcaugcccgu

SEQ ID NO: 324149 - RNA, 64 nt, Homo Sapiens
caacccucaguaccgucugaagcuccuggaggaggacgaugacccugaugacucggaggugauu

SEQ ID NO: 324150 - RNA, 64 nt, Homo Sapiens
ugcuggaggcugccaaggcauuuucauagaacaagacgaugacagugcaaauggcugucucggg

SEQ ID NO: 324151 - RNA, 64 nt, Homo Sapiens
guguagcugacaugcacgaacagcugagaaaggagacgaugaacgauggguccacucauggccu

SEQ ID NO: 324152 - RNA, 64 nt, Homo Sapiens
cacucgguaaguuuucuuucgugacaccacugaugacgaugaugcacgcuguuccgguuggcga

SEQ ID NO: 324153 - RNA, 58 nt, Homo Sapiens
aggauacuguggccccgcugagagaguggacgaugagguuucuuugcacuggucuuga

SEQ ID NO: 324154 - RNA, 64 nt, Homo Sapiens
augugaaaccaucacagcugccucccggggggacgacgaugacaccaggccccugaugcuccaa

SEQ ID NO: 324155 - RNA, 64 nt, Homo Sapiens
guagcuauuaugcgcccgucuacagggggugcccgacgaugacggugccuucgcagucaaauua

SEQ ID NO: 324156 - RNA, 64 nt, Homo Sapiens
agaaguccuucuggacagugugaugccccugucagacgaugaccaguuuucaccggaagcagau

SEQ ID NO: 324157 - RNA, 64 nt, Homo Sapiens
cgccccucgcccacccgcuccuccgggcggggcagacgaugacucccucacccgccgggguccc

SEQ ID NO: 324158 - RNA, 64 nt, Homo Sapiens
cagggucagacgugcuguuaagagcaaagccacagacgaugacuuguccauucucaguggaugc

SEQ ID NO: 324159 - RNA, 64 nt, Homo Sapiens
ggugcuaagcccgggcgaggccuacagcgagagugacgaugauucaggaagggccugcacgaac

SEQ ID NO: 324160 - RNA, 64 nt, Homo Sapiens
cuacagaacaggugggcccccgcggcggccagaggacgaugacccgugcuggacuucuacgagc

SEQ ID NO: 324161 - RNA, 64 nt, Homo Sapiens
uaguaaacaaauaaacaagaauucuacuugaguagacgaugaacucccugcccucauggugcuc

SEQ ID NO: 324162 - RNA, 64 nt, Homo Sapiens
cuggagcccgaguggaccaaucggaagccuaagugacgaugacccucgcauguccuaggucccu

SEQ ID NO: 324163 - RNA, 64 nt, Homo Sapiens
cugcuaggcagagagcgcacccuacucuuuccgugacgaugagggcggcaaaaacagacauuuc

SEQ ID NO: 324164 - RNA, 64 nt, Homo Sapiens
cuagaaggagaaauacuuucuuccuuucaaaucagacgaugagaauguuuuauauauauauuuu

SEQ ID NO: 324165 - RNA, 64 nt, Homo Sapiens
uauguauauaguuagauguuacugccacagaggugacgaugaacaauuuaaucuggcacuuugc

SEQ ID NO: 324166 - RNA, 64 nt, Homo Sapiens
gggcuggagggcuauggauuccaagcaguagcaggacgaugauacagaagguauuuuuuaacuc

SEQ ID NO: 324167 - RNA, 64 nt, Homo Sapiens
guguuuuguuauaucuucaaaauaaaaagacucugacgaugauuaauuuuacuggauuuaucuu

SEQ ID NO: 324168 - RNA, 63 nt, Homo Sapiens
caacaaccuguaucugguauuagcuugcuacccacgaugaaauagcacuuugaaauuuauuac

SEQ ID NO: 324169 - RNA, 63 nt, Homo Sapiens
caaugauuguaacuuuucucggcaagauuuugcacgaugaaggaucuuuuccaucuuccugag

SEQ ID NO: 324170 - RNA, 63 nt, Homo Sapiens
uccgucucuacuaaaauacacagucugggcaacacgaugaaacugagcucaggaguucaagau

SEQ ID NO: 324171 - RNA, 63 nt, Homo Sapiens
acuuccaugaggccaaacguauaugugguuuccacgaugaaaaugucagauauuuuuucagaa

SEQ ID NO: 324172 - RNA, 63 nt, Homo Sapiens
uuugcuuuaguauuuuaauacaugaauuguucuacgaugaauucugaggcaaaccuuugugga

SEQ ID NO: 324173 - RNA, 63 nt, Homo Sapiens
auuggauacaaggaucagaauggaaagaaacucacgaugaaauugaaccugguuuuuguauau

SEQ ID NO: 324174 - RNA, 63 nt, Homo Sapiens
augacucugucuugugggugucugacaguggcgacgaugaacaugccguugguuuuauuggca

SEQ ID NO: 324175 - RNA, 63 nt, Homo Sapiens
augagcugcagcucccaaauuucaaauuuuggcacgaugaauuauuuuuguuucucuuugcag

SEQ ID NO: 324176 - RNA, 63 nt, Homo Sapiens
gcuaacuguucccaaguguuaauuuaauguaccacgaugaauaaguggcucuuggggaaaagc

SEQ ID NO: 324177 - RNA, 63 nt, Homo Sapiens
agacuguuuucccuguagcagauaacagaaccuacgaugaaaugguaagggucaacugggcua

SEQ ID NO: 324178 - RNA, 63 nt, Homo Sapiens
agauuucaacugauaaagaguuaucuauuggccacgaugaaacugcugaaaaguuagucuuaa

SEQ ID NO: 324179 - RNA, 63 nt, Homo Sapiens
aguaaauugccugauuuguuuucauuauagacaacgaugaauuucuucuaauuauuuaaauaa

SEQ ID NO: 324180 - RNA, 63 nt, Homo Sapiens
ggaaacuaguguugaaauagcaucugaauaacaacgaugaauguaguuggcaaucauaagaaa

SEQ ID NO: 324181 - RNA, 63 nt, Homo Sapiens
aaauauuuucuaaaaagauaaaaaauauacauaacgaugaaaaauaauacaaauuuaaaaacc

SEQ ID NO: 324182 - RNA, 63 nt, Homo Sapiens
uaugcugucaugguccuuucccaccucaccaaaacgaugaaguaaggcuuuguauaaucccac

SEQ ID NO: 324183 - RNA, 63 nt, Homo Sapiens
guaaaguuucucgguguguucuguuaauguaagacgaugaacaguuguguauaguguuuuacc

SEQ ID NO: 324184 - RNA, 63 nt, Homo Sapiens
gaaucucuuuucaaucugugcaucauggaguccacgaugaagauauggugagucauuacucag

SEQ ID NO: 324185 - RNA, 63 nt, Homo Sapiens
augcuagaagcuguaacagaauauuagguugucacgaugaagcugaaaauaugaggcuugaua

SEQ ID NO: 324186 - RNA, 63 nt, Homo Sapiens
ugaaggguuaauguagaaauauaucuguagaugacgaugaauguggcagaaugugugaaugcc

SEQ ID NO: 324187 - RNA, 63 nt, Homo Sapiens
cgaggcugcaggacugaagagagcuacugaguaacgaugaaaguucucaaggaaggaggcaaa

SEQ ID NO: 324188 - RNA, 63 nt, Homo Sapiens
ccaguggcagacaaacagaccauaaauaaggaaacgaugaaauaagauauauacaaggugagu

SEQ ID NO: 324189 - RNA, 63 nt, Homo Sapiens
cagccuguauuugagggagaggcuggacuagacacgaugaaaacuagcacagggcccagacag

SEQ ID NO: 324190 - RNA, 63 nt, Homo Sapiens
cugaugccgagagcgggcuggcuuuucucucuuacgaugaaggccugcccggccucggaacca

SEQ ID NO: 324191 - RNA, 63 nt, Homo Sapiens
gaugucacuuuacaugggaguuauccauugaugacgaugaaaugccugauuuagaaaacagag

SEQ ID NO: 324192 - RNA, 63 nt, Homo Sapiens
gcaccugaacccuagaaaaagagccaguuugcuacgaugaaggugacauuucucuggucauuu

SEQ ID NO: 324193 - RNA, 63 nt, Homo Sapiens
ugcuugguuauguaaagugacaauagugugacaacgaugaaaauaacuugcugaugugguuua

SEQ ID NO: 324194 - RNA, 63 nt, Homo Sapiens
accugcaguggugauggccugggcccagaaaggacgaugaacuccguguggcccugggacccu

SEQ ID NO: 324195 - RNA, 63 nt, Homo Sapiens
cuuuggaaauuuccuuucucgggugucguugcuacgaugaagacaccacuuuucuauuucagu

SEQ ID NO: 324196 - RNA, 63 nt, Homo Sapiens
guccuaaugaaauuucugacauugucauauacaacgaugaauaucauuaaaauuuuuaaaaua

SEQ ID NO: 324197 - RNA, 63 nt, Homo Sapiens
aucucugcugaagacaguggaggaaugucacacacgaugaaauggacuuugauagcaacuucc

SEQ ID NO: 324198 - RNA, 63 nt, Homo Sapiens
agcccaacuggaguguugcuaucaugcagcuaaacgaugaagauuacaaaugucguagaagaa

SEQ ID NO: 324199 - RNA, 63 nt, Homo Sapiens
caagagcucggccaucacgucaagcuuuggauaacgaugaaugagccguauacaaggaauaug

SEQ ID NO: 324200 - RNA, 63 nt, Homo Sapiens
agguaccggaaguugugcuugauaugucuaacuacgaugaagauuggaaacaugauugcggau

SEQ ID NO: 324201 - RNA, 63 nt, Homo Sapiens
uuauuuaaaacugucauagcaguaaaaaguauuacgaugaaauuguuaggguauuaauggaac

SEQ ID NO: 324202 - RNA, 63 nt, Homo Sapiens
caaccugcacagauccugaacaacaaaugaauaacgaugaaugucuuuuugguuguaauuuaa

SEQ ID NO: 324203 - RNA, 63 nt, Homo Sapiens
uguagcugacaugcacgaaggcugagaaaggagacgaugaacguggguccacucauggccuca

SEQ ID NO: 324204 - RNA, 63 nt, Homo Sapiens
cagucuguaugucugugucucccuagaauucauacgaugaaaucuucacucucaaguugauag

SEQ ID NO: 324205 - RNA, 63 nt, Homo Sapiens
ucagaaggcugucaaacucagcaacuucucaaaacgaugaaagaauuccuauugcuuccuugc

SEQ ID NO: 324206 - RNA, 63 nt, Homo Sapiens
cuagggacaccccaggcaguccuggguguggacacgaugaagcaccggcuccauaagacaccu

SEQ ID NO: 324207 - RNA, 63 nt, Homo Sapiens
ggauuuugggguucaccagaugcuuccuggcccacgaugaaaccugagagggguguccccuug

SEQ ID NO: 324208 - RNA, 63 nt, Homo Sapiens
aauguucauggcagcccuauucacaguagccaaacgaugaaaacaaccccaagcuauauauua

SEQ ID NO: 324209 - RNA, 63 nt, Homo Sapiens
ugugcaaagugaaaacacugggcucccuguuaaacgaugaagaauucaagacagugacagcau

SEQ ID NO: 324210 - RNA, 63 nt, Homo Sapiens
aaauaggcauucaagaaguauugucuuaaauuuacgaugaauuucuugugagcagaggacgaa

SEQ ID NO: 324211 - RNA, 63 nt, Homo Sapiens
caaccccaagcuauauauuaucacaguagccaaacgaugaaaaaauguucauggcggcccuau

SEQ ID NO: 324212 - RNA, 63 nt, Homo Sapiens
aguaaacaaauaaacaagaaucuacuugaguagacgaugaacuccugcccucauggugcucau

SEQ ID NO: 324213 - RNA, 63 nt, Homo Sapiens
ugauuuuaauugcugucuaaugacggggaaagcacgaugaaaagauguacaauccugcauccu

SEQ ID NO: 324214 - RNA, 63 nt, Homo Sapiens
ugcucuuuuccuuugaugaggcaaaggaaccccacgaugaacugugccucaaagcaaaggcaa

SEQ ID NO: 324215 - RNA, 63 nt, Homo Sapiens
uuucucuaugcaagacuggcauccugggacugcacgaugaacuauuggagcauacaguacugc

SEQ ID NO: 324216 - RNA, 63 nt, Homo Sapiens
auguauauaguuagauguuuugccacagaggugacgaugaacuuuuaaucuggcacuuugcac

SEQ ID NO: 324217 - RNA, 63 nt, Homo Sapiens
cuuugcuuguugcugggcggaugauguuuacuaacgaugaauuuuacauccaaagggggauag

SEQ ID NO: 324218 - RNA, 64 nt, Homo Sapiens
caauaaaaacuugcauccaacaugaauuuccagccgaugauaauccaggccaaagguuuaguug

SEQ ID NO: 324219 - RNA, 64 nt, Homo Sapiens
gcuacaugacucugaaccccagggcaccuacugacgaugauaaaaacaucuaccugacucuucc

SEQ ID NO: 324220 - RNA, 64 nt, Homo Sapiens
gagugacuuggagagagauuaguauuugcagugccgaugauauauuguccgugaagagaaagac

SEQ ID NO: 324221 - RNA, 64 nt, Homo Sapiens
accagaaaucaaaaagggaacccuggggcuagaucgaugauauggacagagaaauugaggaugc

SEQ ID NO: 324222 - RNA, 64 nt, Homo Sapiens
uaaaaagaacaguuguaguaaauuauuauaaagccgaugauauuucauggcagguuauucuacc

SEQ ID NO: 324223 - RNA, 64 nt, Homo Sapiens
cacucacagagcuuacaugccagugagugaagaucgaugauaaauaaagcaaaugcaucauaug

SEQ ID NO: 324224 - RNA, 64 nt, Homo Sapiens
gagaugggaugguaucuaaaaacucaaguauuuucgaugauagagguaagaaaauaaacaauag

SEQ ID NO: 324225 - RNA, 64 nt, Homo Sapiens
uuugccagagccugagagagcgauguccucgaggcgaugauauucucaccauccugacugaagu

SEQ ID NO: 324226 - RNA, 64 nt, Homo Sapiens
uuacuuaauggguacaauguggguuggcagggggcgaugauaauggagacuuggaagaguugga

SEQ ID NO: 324227 - RNA, 64 nt, Homo Sapiens
guuuucuuugguagaguauauggcagucccacaucgaugauaauuggugcucccuucauccaac

SEQ ID NO: 324228 - RNA, 64 nt, Homo Sapiens
gacaaaacgaauuuaaguaccagccaaguacacacgaugauagcuucaaggaauacaacugacu

SEQ ID NO: 324229 - RNA, 64 nt, Homo Sapiens
cuuccagcugaccugugacuuauacugcucuuaccgaugauacuuuuggaaaaaauagagcgug

SEQ ID NO: 324230 - RNA, 64 nt, Homo Sapiens
gcuucaguuguucuuuagaggcuuucaaauguaccgaugauacuguuucuugcacugaauauau

SEQ ID NO: 324231 - RNA, 64 nt, Homo Sapiens
uuagaaauagcaaaccuguccccuugaaggcugucgaugauaggucuugaugccucgacgggac

SEQ ID NO: 324232 - RNA, 64 nt, Homo Sapiens
uagcuaccgugaguucucagcaggaacuucccagcgaugauaauguacaugaaauuagccacgu

SEQ ID NO: 324233 - RNA, 64 nt, Homo Sapiens
acuggaaagauaauuuaucguguuaggagaagaacgaugauaccuacuuaacaccucagcaucu

SEQ ID NO: 324234 - RNA, 64 nt, Homo Sapiens
uauauauguaucuacaauaccccuuuucuccccacgaugauaucucuucaaaccgugguacccc

SEQ ID NO: 324235 - RNA, 64 nt, Homo Sapiens
uauguuacaauaagccuccauuagucccucaaaacgaugauauaaauaagucuguacaaccuag

SEQ ID NO: 324236 - RNA, 64 nt, Homo Sapiens
ucacugaugguagaucgcaggacauaaaaagggucgaugauauucuuaagguugaaacuguaau

SEQ ID NO: 324237 - RNA, 64 nt, Homo Sapiens
cugauggacugguuuggucuauucucauuuuggucgaugauauuccuaauggcccaacagggaa

SEQ ID NO: 324238 - RNA, 64 nt, Homo Sapiens
cuagucaggaugagcagagcaccuuguaugcaaacgaugauaaaaaucagcuuuacauaaauau

SEQ ID NO: 324239 - RNA, 64 nt, Homo Sapiens
uuuguuugcauacuggucuucagauuaugagacucgaugauaacaguaugguacugcuucugug

SEQ ID NO: 324240 - RNA, 64 nt, Homo Sapiens
agugaaugugugagaacacuaagaccacucugaacgaugauaaugaguugggggguggacugcu

SEQ ID NO: 324241 - RNA, 64 nt, Homo Sapiens
agaguccacgcugacauacaucucggcaaaggcacgaugauacccuucaaauucagcuguggug

SEQ ID NO: 324242 - RNA, 64 nt, Homo Sapiens; identical to SEQ ID NO: 324241

SEQ ID NO: 324243 - RNA, 64 nt, Homo Sapiens
ucauuguuccagcaguuugaaaauaaauuguugucgaugauagucaccuuuagugcugcagaac

SEQ ID NO: 324244 - RNA, 64 nt, Homo Sapiens
aagcaugcaaaaauaccaaggaagaacuucucuucgaugauaaugucgaguggaaaucaugcuu

SEQ ID NO: 324245 - RNA, 64 nt, Homo Sapiens
aggugggggcuguggccauguguggccgugaugucgaugauacucguuuucccugauccguggu

SEQ ID NO: 324246 - RNA, 64 nt, Homo Sapiens
gcuggagggcuauggauuccaagcaguagcaggacgaugauagggaagguauuuuuuaacuccc

SEQ ID NO: 324247 - RNA, 62 nt, Homo Sapiens
gcuacaugacucugaaccccagggcaccuacugacgaugauaaaaacaucuaccugacucuu

SEQ ID NO: 324248 - RNA, 62 nt, Homo Sapiens
ugcaccgaaagcaggcccuuagggcaggaagggacgaugagcaagucugccacaccaccugg

SEQ ID NO: 324249 - RNA, 62 nt, Homo Sapiens
ugggagggacgcgugaagggaccuugggagaggacgaugacuaucugcaccuacuuguuccc

SEQ ID NO: 324250 - RNA, 62 nt, Homo Sapiens
augacucugucuugugggugucugacaguggcgacgaugaacaugccguugguuuuauuggc

SEQ ID NO: 324251 - RNA, 62 nt, Homo Sapiens
ggcuucgacucugugguuucuuggucuaugaggacgaugacacaaguacguguggcuacuca

SEQ ID NO: 324252 - RNA, 62 nt, Homo Sapiens
gcagcugcaggagugcuugugggcugcuaugggacgaugacuugggagcgcuaugggccugc

SEQ ID NO: 324253 - RNA, 62 nt, Homo Sapiens
ccucagggcuuccagcaggauugagucacccugacgaugaccggggagaagccgugugcucu

SEQ ID NO: 324254 - RNA, 62 nt, Homo Sapiens
uagguaucuagagcuuaaugcuacaugugagugacgaugauguacagauucuuucaguucuu

SEQ ID NO: 324255 - RNA, 62 nt, Homo Sapiens
uggggaaacccuccaccuccuguccugaccuggacgaugacgggugaagaaacugugugagc

SEQ ID NO: 324256 - RNA, 62 nt, Homo Sapiens
ggucugaaaggccaacccgaggaugccucauagacgaugagguggccacagcugcacuuaca

SEQ ID NO: 324257 - RNA, 62 nt, Homo Sapiens
uuaaaaaaacacggaagcacaguuggaggugggacgaugagacuuugaaacuaucucaugcc

SEQ ID NO: 324258 - RNA, 62 nt, Homo Sapiens
guaaaguuucucgguguguucuguuaauguaagacgaugaacaguuguguauaguguuuuac

SEQ ID NO: 324259 - RNA, 62 nt, Homo Sapiens
ucaagccuuagcaagcccagaggcccccagcagacgaugaggacauugucggcucaacaucu

SEQ ID NO: 324260 - RNA, 62 nt, Homo Sapiens
uaucuucuacauucuagaaauagucuggcugagacgaugaguucaucggguauuagaaaaug

SEQ ID NO: 324261 - RNA, 62 nt, Homo Sapiens
aggagaugucuguuggauucguucuaugcugugacgaugaggggucuuuguuauuuucaacu

SEQ ID NO: 324262 - RNA, 62 nt, Homo Sapiens
ugaguauuuagaauguaccauggugugggagugacgaugauguuguggggucaaccguacaa

SEQ ID NO: 324263 - RNA, 62 nt, Homo Sapiens
cucuacuugcugaccacauuucccagagcuaugacgaugagaggaagacugcgcuguauuuu

SEQ ID NO: 324264 - RNA, 62 nt, Homo Sapiens
cuugggugagcaacggcaccuucaggaaauccgacgaugacuuggagcaccagccucgguuu

SEQ ID NO: 324265 - RNA, 62 nt, Homo Sapiens
gugaaggguuaauguagaaaauaucuguagaugacgaugaauuggcagaaugugugaaugcc

SEQ ID NO: 324266 - RNA, 62 nt, Homo Sapiens
acuugaccuuuucuucccuggcuacagcaaaggacgaugaucugccugcuuucacuguguug

SEQ ID NO: 324267 - RNA, 62 nt, Homo Sapiens
cauuuuuaucuacguuuuauaacuuggugagugacgaugagagcccugcaccuggccagagu

SEQ ID NO: 324268 - RNA, 62 nt, Homo Sapiens
cugcccuuucaaagaauaaccacagcucagaagacgaugacguggucaucugugucgccauc

SEQ ID NO: 324269 - RNA, 62 nt, Homo Sapiens
ccguuggggcggaggcugccguugucuuugaugacgaugaugaucacgcccuccugggccau

SEQ ID NO: 324270 - RNA, 62 nt, Homo Sapiens
gaugucacuuuacaugggaguuauccauugaugacgaugaaaugccugauuuagaaaacaga

SEQ ID NO: 324271 - RNA, 62 nt, Homo Sapiens
ugaaacguaacugguucccugaccaggucaccgacgaugagggcgcaccugcuguccuggag

SEQ ID NO: 324272 - RNA, 62 nt, Homo Sapiens
caggccugagccccacacaggucuucacaccugacgaugagcauccaucggcuccccauggu

SEQ ID NO: 324273 - RNA, 62 nt, Homo Sapiens
uaccugcaguggugauggccgggcccagaaaggacgaugaacccguguggcccugggacccu

SEQ ID NO: 324274 - RNA, 62 nt, Homo Sapiens
uuugacuguaagacagggcucuguaucagugagacgaugagaaaagucccaggcuaauggca

SEQ ID NO: 324275 - RNA, 62 nt, Homo Sapiens
gccacgcaaggcugcaccucuguguguugggagacgaugaugauguccauugcugugugaug

SEQ ID NO: 324276 - RNA, 62 nt, Homo Sapiens
uccugaaacuuggaggggcacaggcuggaggugacgaugaguucccagcccagagcagccau

SEQ ID NO: 324277 - RNA, 62 nt, Homo Sapiens
guggacucacuccaccagcuuccuauaacuuggacgaugaccaggcggcuugggagaaugag

SEQ ID NO: 324278 - RNA, 62 nt, Homo Sapiens
accagucguacuaucuuacuagagaagaagaugacgaugaugggcuucugccaaaaaaaaaa

SEQ ID NO: 324279 - RNA, 62 nt, Homo Sapiens
ccucuuguacuucgugugcuccgacccauggugacgaugacacacccugguggcaugcccgu

SEQ ID NO: 324280 - RNA, 62 nt, Homo Sapiens
acccucaguaccgucugaagcuccuggaggaggacgaugacccugaugacucggaggugauu

SEQ ID NO: 324281 - RNA, 62 nt, Homo Sapiens
ugcuggaggcugccaaggcauucauagaacaagacgaugacagcaaauggcugucucggguu

SEQ ID NO: 324282 - RNA, 62 nt, Homo Sapiens
guguagcugacaugcacgaagcugagaaaggagacgaugaacuggguccacucauggccuca

SEQ ID NO: 324283 - RNA, 62 nt, Homo Sapiens
cacucgguaaguuuucuuucgacaccacugaugacgaugaugcgcuguuccgguuggcgagu

SEQ ID NO: 324284 - RNA, 58 nt, Homo Sapiens; identical to SEQ ID NO: 324153

SEQ ID NO: 324285 - RNA, 62 nt, Homo Sapiens
augugaaaccaucacagcugucccggggggacgacgaugacaaggccccugaugcuccaacc

SEQ ID NO: 324286 - RNA, 62 nt, Homo Sapiens
agcuauuaugcgcccgucuacagggggugcccgacgaugacggugccuucgcagucaaauua

SEQ ID NO: 324287 - RNA, 62 nt, Homo Sapiens
aaguccuucuggacagugugaugccccugucagacgaugaccaguuuucaccggaagcagau

SEQ ID NO: 324288 - RNA, 62 nt, Homo Sapiens
cgccccucgcccacccgcucccgggcggggcagacgaugacucucacccgccgggguccccu

SEQ ID NO: 324289 - RNA, 62 nt, Homo Sapiens
gggucagacgugcuguuaagagcaaagccacagacgaugacuuguccauucucaguggaugc

SEQ ID NO: 324290 - RNA, 62 nt, Homo Sapiens
ggugcuaagcccgggcgagguacagcgagagugacgaugauuggaagggccugcacgaaccc

SEQ ID NO: 324291 - RNA, 62 nt, Homo Sapiens
cuacagaacaggugggcccccggcggccagaggacgaugaccugcuggacuucuacgagccg

SEQ ID NO: 324292 - RNA, 62 nt, Homo Sapiens
uaguaaacaaauaaacaagaucuacuugaguagacgaugaacccugcccucauggugcucau

SEQ ID NO: 324293 - RNA, 62 nt, Homo Sapiens
ggagcccgaguggaccaaucggaagccuaagugacgaugacccucgcauguccuaggucccu

SEQ ID NO: 324294 - RNA, 62 nt, Homo Sapiens
gcuaggcagagagcgcacccuacucuuuccgugacgaugagggcggcaaaaacagacauuuc

SEQ ID NO: 324295 - RNA, 62 nt, Homo Sapiens
cuagaaggagaaauacuuucccuuucaaaucagacgaugagaguuuuauauauauauuuuuu

SEQ ID NO: 324296 - RNA, 62 nt, Homo Sapiens
uauguauauaguuagauguuugccacagaggugacgaugaacuuuaaucuggcacuuugcac

SEQ ID NO: 324297 - RNA, 62 nt, Homo Sapiens
gggcuggagggcuauggauuaagcaguagcaggacgaugauagaagguauuuuuuaacuccc

SEQ ID NO: 324298 - RNA, 62 nt, Homo Sapiens
guguuuuguuauaucuucaauaaaaagacucugacgaugauuuuuuacuggauuuaucuuaa

SEQ ID NO: 324299 - RNA, 64 nt, Homo Sapiens
uauuauggaacagaucuugauagaugguuuaauuuucuccuaaagagaaauaaucaguugagaa

SEQ ID NO: 324300 - RNA, 64 nt, Homo Sapiens
uuaaaaaagucguuucaggcuuaucagauaauaauucuccuauauuugaggggggcaugggaua

SEQ ID NO: 324301 - RNA, 64 nt, Homo Sapiens
accagggaagccuggcuuacucuagucuaaaacauucuccuagggcccagacuucuccuagaca

SEQ ID NO: 324302 - RNA, 64 nt, Homo Sapiens
caucuagucuaaaacauucugguagugcccagacuucuccuagagcaggucuaugaagaccagu

SEQ ID NO: 324303 - RNA, 64 nt, Homo Sapiens
uuucugcuuuagcguaauuguuugaacugacaguuucuccuaacccaaaggacacuaugaacuu

SEQ ID NO: 324304 - RNA, 64 nt, Homo Sapiens
gagcagugaaggaaaugucaucaaccaaaggugauucuccuaaaauucugucugccuaagagaa

SEQ ID NO: 324305 - RNA, 64 nt, Homo Sapiens
aaaaagcaauucuuagaauacuuccuuuacauuauucuccuauuuuagacauuuugugaaagag

SEQ ID NO: 324306 - RNA, 64 nt, Homo Sapiens
uaaaucuguagccuggguguacguuucacucaaguucuccuacugaggacucuugacuaacagc

SEQ ID NO: 324307 - RNA, 64 nt, Homo Sapiens
aucccaguggcguuuaucaggcaugguccccagcuucuccuagggguccccuucaguaccucac

SEQ ID NO: 324308 - RNA, 64 nt, Homo Sapiens
gacugguagucaguggggcaauagccggagaccuuucuccuagucaagcaucacugggaagggc

SEQ ID NO: 324309 - RNA, 64 nt, Homo Sapiens
uugauuucacuggaauauagacuuaagggaaaaguucuccuaucuuuuuuuuuaacuaccuuaa

SEQ ID NO: 324310 - RNA, 64 nt, Homo Sapiens
uuuuuuuuuaacuaccuuaaucuccaugaauuaguucuccuauuggcucauaacuuggccaugu

SEQ ID NO: 324311 - RNA, 54 nt, Homo Sapiens
aggggccaacguugcugugaauauuucuccuacccgauuccccaacaccacuag

SEQ ID NO: 324312 - RNA, 64 nt, Homo Sapiens
acgucgcuaaacaggauaggacuaaaauuuccaauucuccuacacucugucagaagccuagaac

SEQ ID NO: 324313 - RNA, 64 nt, Homo Sapiens
acagcccugucaaggaauaccaacagaauauugauucuccuaaacuguauaguaaccugcuaac

SEQ ID NO: 324314 - RNA, 64 nt, Homo Sapiens
aaucauguugucuguguuguguuaugugagaauuuucuccuaagucaugcagguaaugacaaua

SEQ ID NO: 324315 - RNA, 64 nt, Homo Sapiens
acaguuuuaaaaagaaaaaaaggucuauuuuuuuuucuccuauacuugggcuacauuuuuugau

SEQ ID NO: 324316 - RNA, 64 nt, Homo Sapiens
caucuauguuuguguuugcucuuuaaacuauuguuucuccuaucccaaguucgcuuugcaucua

SEQ ID NO: 324317 - RNA, 64 nt, Homo Sapiens
ucuccaaagccuugugugaaaaggcaguaaugccuucuccuauuaacaagagagagagaaagua

SEQ ID NO: 324318 - RNA, 64 nt, Homo Sapiens
cuuccuuccuaauaggcaucggacagaaacaacuuucuccuacucuguagggguagaggggugg

SEQ ID NO: 324319 - RNA, 64 nt, Homo Sapiens
agguaauuagacacugauugggauuuuugugggaggagaguaaugccaagaccuuaggacauug

SEQ ID NO: 324320 - RNA, 64 nt, Homo Sapiens
guggcuuagaggaaagaaauccuuucuccuaccaggagaguacuuucugauaauguucagggug

SEQ ID NO: 324321 - RNA, 64 nt, Homo Sapiens; identical to SEQ ID NO: 89905

SEQ ID NO: 324322 - RNA, 64 nt, Homo Sapiens; identical to SEQ ID NO: 89906

SEQ ID NO: 324323 - RNA, 64 nt, Homo Sapiens; identical to SEQ ID NO: 89907

SEQ ID NO: 324324 - RNA, 64 nt, Homo Sapiens; identical to SEQ ID NO: 89908

SEQ ID NO: 324325 - RNA, 64 nt, Homo Sapiens; identical to SEQ ID NO: 89909

SEQ ID NO: 324326 - RNA, 64 nt, Homo Sapiens; identical to SEQ ID NO: 89910

SEQ ID NO: 324327 - RNA, 64 nt, Homo Sapiens; identical to SEQ ID NO: 89911

SEQ ID NO: 324328 - RNA, 64 nt, Homo Sapiens; identical to SEQ ID NO: 89912

SEQ ID NO: 324329 - RNA, 64 nt, Homo Sapiens; identical to SEQ ID NO: 89913

SEQ ID NO: 324330 - RNA, 64 nt, Homo Sapiens; identical to SEQ ID NO: 89914

SEQ ID NO: 324331 - RNA, 64 nt, Homo Sapiens; identical to SEQ ID NO: 89915

SEQ ID NO: 324332 - RNA, 64 nt, Homo Sapiens; identical to SEQ ID NO: 89916

SEQ ID NO: 324333 - RNA, 64 nt, Homo Sapiens; identical to SEQ ID NO: 89917

SEQ ID NO: 324334 - RNA, 64 nt, Homo Sapiens; identical to SEQ ID NO: 89918

SEQ ID NO: 324335 - RNA, 64 nt, Homo Sapiens; identical to SEQ ID NO: 89919

SEQ ID NO: 324336 - RNA, 64 nt, Homo Sapiens; identical to SEQ ID NO: 89920

SEQ ID NO: 324337 - RNA, 64 nt, Homo Sapiens; identical to SEQ ID NO: 89921

SEQ ID NO: 324338 - RNA, 64 nt, Homo Sapiens; identical to SEQ ID NO: 89922

SEQ ID NO: 324339 - RNA, 64 nt, Homo Sapiens; identical to SEQ ID NO: 89923

SEQ ID NO: 324340 - RNA, 64 nt, Homo Sapiens; identical to SEQ ID NO: 89924

SEQ ID NO: 324341 - RNA, 64 nt, Homo Sapiens; identical to SEQ ID NO: 89925

SEQ ID NO: 324342 - RNA, 64 nt, Homo Sapiens; identical to SEQ ID NO: 89926

SEQ ID NO: 324343 - RNA, 64 nt, Homo Sapiens; identical to SEQ ID NO: 89927

SEQ ID NO: 324344 - RNA, 64 nt, Homo Sapiens; identical to SEQ ID NO: 89928

SEQ ID NO: 324345 - RNA, 50 nt, Homo Sapiens; identical to SEQ ID NO: 89929

SEQ ID NO: 324346 - RNA, 64 nt, Homo Sapiens; identical to SEQ ID NO: 89930

SEQ ID NO: 324347 - RNA, 64 nt, Homo Sapiens; identical to SEQ ID NO: 89931

SEQ ID NO: 324348 - RNA, 64 nt, Homo Sapiens; identical to SEQ ID NO: 89932

SEQ ID NO: 324349 - RNA, 64 nt, Homo Sapiens; identical to SEQ ID NO: 89933

SEQ ID NO: 324350 - RNA, 64 nt, Homo Sapiens; identical to SEQ ID NO: 89934

SEQ ID NO: 324351 - RNA, 64 nt, Homo Sapiens; identical to SEQ ID NO: 89935

SEQ ID NO: 324352 - RNA, 64 nt, Homo Sapiens; identical to SEQ ID NO: 89936

SEQ ID NO: 324353 - RNA, 64 nt, Homo Sapiens; identical to SEQ ID NO: 89937

SEQ ID NO: 324354 - RNA, 64 nt, Homo Sapiens; identical to SEQ ID NO: 89938

SEQ ID NO: 324355 - RNA, 64 nt, Homo Sapiens; identical to SEQ ID NO: 89939

SEQ ID NO: 324356 - RNA, 64 nt, Homo Sapiens; identical to SEQ ID NO: 89940

SEQ ID NO: 324357 - RNA, 64 nt, Homo Sapiens; identical to SEQ ID NO: 89941

SEQ ID NO: 324358 - RNA, 55 nt, Homo Sapiens; identical to SEQ ID NO: 89942

SEQ ID NO: 324359 - RNA, 64 nt, Homo Sapiens; identical to SEQ ID NO: 89943

SEQ ID NO: 324360 - RNA, 64 nt, Homo Sapiens; identical to SEQ ID NO: 89944

SEQ ID NO: 324361 - RNA, 64 nt, Homo Sapiens; identical to SEQ ID NO: 89945

SEQ ID NO: 324362 - RNA, 64 nt, Homo Sapiens; identical to SEQ ID NO: 89946

SEQ ID NO: 324363 - RNA, 64 nt, Homo Sapiens; identical to SEQ ID NO: 89947

SEQ ID NO: 324364 - RNA, 64 nt, Homo Sapiens; identical to SEQ ID NO: 89948

SEQ ID NO: 324365 - RNA, 64 nt, Homo Sapiens; identical to SEQ ID NO: 89949

SEQ ID NO: 324366 - RNA, 64 nt, Homo Sapiens; identical to SEQ ID NO: 89950

SEQ ID NO: 324367 - RNA, 64 nt, Homo Sapiens; identical to SEQ ID NO: 89951

SEQ ID NO: 324368 - RNA, 64 nt, Homo Sapiens; identical to SEQ ID NO: 89952

SEQ ID NO: 324369 - RNA, 64 nt, Homo Sapiens; identical to SEQ ID NO: 89953

SEQ ID NO: 324370 - RNA, 64 nt, Homo Sapiens; identical to SEQ ID NO: 89954

SEQ ID NO: 324371 - RNA, 64 nt, Homo Sapiens; identical to SEQ ID NO: 89955

SEQ ID NO: 324372 - RNA, 64 nt, Homo Sapiens; identical to SEQ ID NO: 89956

SEQ ID NO: 324373 - RNA, 64 nt, Homo Sapiens; identical to SEQ ID NO: 89957

SEQ ID NO: 324374 - RNA, 64 nt, Homo Sapiens; identical to SEQ ID NO: 89958

SEQ ID NO: 324375 - RNA, 64 nt, Homo Sapiens; identical to SEQ ID NO: 89959

SEQ ID NO: 324376 - RNA, 64 nt, Homo Sapiens; identical to SEQ ID NO: 89960

SEQ ID NO: 324377 - RNA, 64 nt, Homo Sapiens; identical to SEQ ID NO: 89961

SEQ ID NO: 324378 - RNA, 64 nt, Homo Sapiens; identical to SEQ ID NO: 89962

SEQ ID NO: 324379 - RNA, 64 nt, Homo Sapiens; identical to SEQ ID NO: 89963

SEQ ID NO: 324380 - RNA, 64 nt, Homo Sapiens; identical to SEQ ID NO: 89964

SEQ ID NO: 324381 - RNA, 64 nt, Homo Sapiens; identical to SEQ ID NO: 89965

SEQ ID NO: 324382 - RNA, 64 nt, Homo Sapiens; identical to SEQ ID NO: 89966

SEQ ID NO: 324383 - RNA, 64 nt, Homo Sapiens; identical to SEQ ID NO: 89967

SEQ ID NO: 324384 - RNA, 64 nt, Homo Sapiens; identical to SEQ ID NO: 89968

SEQ ID NO: 324385 - RNA, 64 nt, Homo Sapiens; identical to SEQ ID NO: 89969

SEQ ID NO: 324386 - RNA, 64 nt, Homo Sapiens; identical to SEQ ID NO: 89970

SEQ ID NO: 324387 - RNA, 64 nt, Homo Sapiens; identical to SEQ ID NO: 89971

SEQ ID NO: 324388 - RNA, 64 nt, Homo Sapiens; identical to SEQ ID NO: 89972

SEQ ID NO: 324389 - RNA, 64 nt, Homo Sapiens; identical to SEQ ID NO: 89973

SEQ ID NO: 324390 - RNA, 64 nt, Homo Sapiens; identical to SEQ ID NO: 89974

SEQ ID NO: 324391 - RNA, 64 nt, Homo Sapiens; identical to SEQ ID NO: 89975

SEQ ID NO: 324392 - RNA, 64 nt, Homo Sapiens; identical to SEQ ID NO: 89976

SEQ ID NO: 324393 - RNA, 64 nt, Homo Sapiens; identical to SEQ ID NO: 89977

SEQ ID NO: 324394 - RNA, 64 nt, Homo Sapiens; identical to SEQ ID NO: 89978

SEQ ID NO: 324395 - RNA, 64 nt, Homo Sapiens; identical to SEQ ID NO: 89979

SEQ ID NO: 324396 - RNA, 64 nt, Homo Sapiens; identical to SEQ ID NO: 89980

SEQ ID NO: 324397 - RNA, 64 nt, Homo Sapiens; identical to SEQ ID NO: 89981

SEQ ID NO: 324398 - RNA, 64 nt, Homo Sapiens; identical to SEQ ID NO: 89982

SEQ ID NO: 324399 - RNA, 64 nt, Homo Sapiens; identical to SEQ ID NO: 89983

SEQ ID NO: 324400 - RNA, 64 nt, Homo Sapiens; identical to SEQ ID NO: 89984

SEQ ID NO: 324401 - RNA, 64 nt, Homo Sapiens; identical to SEQ ID NO: 89985

SEQ ID NO: 324402 - RNA, 64 nt, Homo Sapiens; identical to SEQ ID NO: 89986

SEQ ID NO: 324403 - RNA, 64 nt, Homo Sapiens; identical to SEQ ID NO: 89987

SEQ ID NO: 324404 - RNA, 64 nt, Homo Sapiens; identical to SEQ ID NO: 89988

SEQ ID NO: 324405 - RNA, 59 nt, Homo Sapiens; identical to SEQ ID NO: 89989

SEQ ID NO: 324406 - RNA, 64 nt, Homo Sapiens; identical to SEQ ID NO: 89990

SEQ ID NO: 324407 - RNA, 64 nt, Homo Sapiens; identical to SEQ ID NO: 89991

SEQ ID NO: 324408 - RNA, 64 nt, Homo Sapiens; identical to SEQ ID NO: 89992

SEQ ID NO: 324409 - RNA, 64 nt, Homo Sapiens; identical to SEQ ID NO: 89993

SEQ ID NO: 324410 - RNA, 64 nt, Homo Sapiens; identical to SEQ ID NO: 89994

SEQ ID NO: 324411 - RNA, 64 nt, Homo Sapiens; identical to SEQ ID NO: 89995

SEQ ID NO: 324412 - RNA, 64 nt, Homo Sapiens; identical to SEQ ID NO: 89996

SEQ ID NO: 324413 - RNA, 64 nt, Homo Sapiens; identical to SEQ ID NO: 89997

SEQ ID NO: 324414 - RNA, 64 nt, Homo Sapiens; identical to SEQ ID NO: 89998

SEQ ID NO: 324415 - RNA, 64 nt, Homo Sapiens; identical to SEQ ID NO: 89999

SEQ ID NO: 324416 - RNA, 64 nt, Homo Sapiens; identical to SEQ ID NO: 90000

SEQ ID NO: 324417 - RNA, 64 nt, Homo Sapiens; identical to SEQ ID NO: 90001

SEQ ID NO: 324418 - RNA, 64 nt, Homo Sapiens; identical to SEQ ID NO: 90002

SEQ ID NO: 324419 - RNA, 64 nt, Homo Sapiens; identical to SEQ ID NO: 90003

SEQ ID NO: 324420 - RNA, 64 nt, Homo Sapiens; identical to SEQ ID NO: 90004

SEQ ID NO: 324421 - RNA, 64 nt, Homo Sapiens; identical to SEQ ID NO: 90005

SEQ ID NO: 324422 - RNA, 64 nt, Homo Sapiens; identical to SEQ ID NO: 90006

SEQ ID NO: 324423 - RNA, 64 nt, Homo Sapiens; identical to SEQ ID NO: 90007

SEQ ID NO: 324424 - RNA, 64 nt, Homo Sapiens; identical to SEQ ID NO: 90008

SEQ ID NO: 324425 - RNA, 64 nt, Homo Sapiens; identical to SEQ ID NO: 90009

SEQ ID NO: 324426 - RNA, 64 nt, Homo Sapiens; identical to SEQ ID NO: 90010

SEQ ID NO: 324427 - RNA, 64 nt, Homo Sapiens; identical to SEQ ID NO: 90011

SEQ ID NO: 324428 - RNA, 64 nt, Homo Sapiens; identical to SEQ ID NO: 90012

SEQ ID NO: 324429 - RNA, 64 nt, Homo Sapiens; identical to SEQ ID NO: 90013

SEQ ID NO: 324430 - RNA, 64 nt, Homo Sapiens; identical to SEQ ID NO: 90014

SEQ ID NO: 324431 - RNA, 64 nt, Homo Sapiens; identical to SEQ ID NO: 90015

SEQ ID NO: 324432 - RNA, 64 nt, Homo Sapiens; identical to SEQ ID NO: 90016

SEQ ID NO: 324433 - RNA, 64 nt, Homo Sapiens; identical to SEQ ID NO: 90017

SEQ ID NO: 324434 - RNA, 64 nt, Homo Sapiens; identical to SEQ ID NO: 90018

SEQ ID NO: 324435 - RNA, 64 nt, Homo Sapiens; identical to SEQ ID NO: 90019

SEQ ID NO: 324436 - RNA, 64 nt, Homo Sapiens; identical to SEQ ID NO: 90020

SEQ ID NO: 324437 - RNA, 64 nt, Homo Sapiens; identical to SEQ ID NO: 90021

SEQ ID NO: 324438 - RNA, 64 nt, Homo Sapiens; identical to SEQ ID NO: 90022

SEQ ID NO: 324439 - RNA, 64 nt, Homo Sapiens; identical to SEQ ID NO: 90023

SEQ ID NO: 324440 - RNA, 64 nt, Homo Sapiens; identical to SEQ ID NO: 90024

SEQ ID NO: 324441 - RNA, 64 nt, Homo Sapiens; identical to SEQ ID NO: 90025

SEQ ID NO: 324442 - RNA, 64 nt, Homo Sapiens; identical to SEQ ID NO: 90026

SEQ ID NO: 324443 - RNA, 64 nt, Homo Sapiens; identical to SEQ ID NO: 90027

SEQ ID NO: 324444 - RNA, 64 nt, Homo Sapiens; identical to SEQ ID NO: 90028

SEQ ID NO: 324445 - RNA, 64 nt, Homo Sapiens; identical to SEQ ID NO: 90029

SEQ ID NO: 324446 - RNA, 64 nt, Homo Sapiens; identical to SEQ ID NO: 90030

SEQ ID NO: 324447 - RNA, 64 nt, Homo Sapiens; identical to SEQ ID NO: 90031

SEQ ID NO: 324448 - RNA, 64 nt, Homo Sapiens; identical to SEQ ID NO: 90032

SEQ ID NO: 324449 - RNA, 64 nt, Homo Sapiens; identical to SEQ ID NO: 90033

SEQ ID NO: 324450 - RNA, 64 nt, Homo Sapiens; identical to SEQ ID NO: 90034

SEQ ID NO: 324451 - RNA, 64 nt, Homo Sapiens; identical to SEQ ID NO: 90035

SEQ ID NO: 324452 - RNA, 64 nt, Homo Sapiens; identical to SEQ ID NO: 90036

SEQ ID NO: 324453 - RNA, 64 nt, Homo Sapiens; identical to SEQ ID NO: 90037

SEQ ID NO: 324454 - RNA, 64 nt, Homo Sapiens; identical to SEQ ID NO: 90038

SEQ ID NO: 324455 - RNA, 64 nt, Homo Sapiens; identical to SEQ ID NO: 90039

SEQ ID NO: 324456 - RNA, 64 nt, Homo Sapiens; identical to SEQ ID NO: 90040

SEQ ID NO: 324457 - RNA, 64 nt, Homo Sapiens; identical to SEQ ID NO: 90041

SEQ ID NO: 324458 - RNA, 64 nt, Homo Sapiens; identical to SEQ ID NO: 90042

SEQ ID NO: 324459 - RNA, 64 nt, Homo Sapiens; identical to SEQ ID NO: 90043

SEQ ID NO: 324460 - RNA, 64 nt, Homo Sapiens; identical to SEQ ID NO: 90044

SEQ ID NO: 324461 - RNA, 64 nt, Homo Sapiens; identical to SEQ ID NO: 90045

SEQ ID NO: 324462 - RNA, 64 nt, Homo Sapiens; identical to SEQ ID NO: 90046

SEQ ID NO: 324463 - RNA, 64 nt, Homo Sapiens; identical to SEQ ID NO: 90047

SEQ ID NO: 324464 - RNA, 64 nt, Homo Sapiens; identical to SEQ ID NO: 90048

SEQ ID NO: 324465 - RNA, 64 nt, Homo Sapiens; identical to SEQ ID NO: 90049

SEQ ID NO: 324466 - RNA, 64 nt, Homo Sapiens; identical to SEQ ID NO: 90050

SEQ ID NO: 324467 - RNA, 64 nt, Homo Sapiens; identical to SEQ ID NO: 90051

SEQ ID NO: 324468 - RNA, 64 nt, Homo Sapiens; identical to SEQ ID NO: 90052

SEQ ID NO: 324469 - RNA, 64 nt, Homo Sapiens; identical to SEQ ID NO: 90053

SEQ ID NO: 324470 - RNA, 64 nt, Homo Sapiens; identical to SEQ ID NO: 90054

SEQ ID NO: 324471 - RNA, 64 nt, Homo Sapiens; identical to SEQ ID NO: 90055

SEQ ID NO: 324472 - RNA, 64 nt, Homo Sapiens; identical to SEQ ID NO: 90056

SEQ ID NO: 324473 - RNA, 64 nt, Homo Sapiens; identical to SEQ ID NO: 90057

SEQ ID NO: 324474 - RNA, 64 nt, Homo Sapiens; identical to SEQ ID NO: 90058

SEQ ID NO: 324475 - RNA, 64 nt, Homo Sapiens; identical to SEQ ID NO: 90059

SEQ ID NO: 324476 - RNA, 64 nt, Homo Sapiens; identical to SEQ ID NO: 90060

SEQ ID NO: 324477 - RNA, 64 nt, Homo Sapiens; identical to SEQ ID NO: 90061

SEQ ID NO: 324478 - RNA, 64 nt, Homo Sapiens; identical to SEQ ID NO: 90062

SEQ ID NO: 324479 - RNA, 64 nt, Homo Sapiens; identical to SEQ ID NO: 90063

SEQ ID NO: 324480 - RNA, 64 nt, Homo Sapiens; identical to SEQ ID NO: 90064

SEQ ID NO: 324481 - RNA, 64 nt, Homo Sapiens; identical to SEQ ID NO: 90065

SEQ ID NO: 324482 - RNA, 64 nt, Homo Sapiens; identical to SEQ ID NO: 90066

SEQ ID NO: 324483 - RNA, 64 nt, Homo Sapiens; identical to SEQ ID NO: 90067

SEQ ID NO: 324484 - RNA, 64 nt, Homo Sapiens; identical to SEQ ID NO: 90068

SEQ ID NO: 324485 - RNA, 64 nt, Homo Sapiens; identical to SEQ ID NO: 90069

SEQ ID NO: 324486 - RNA, 64 nt, Homo Sapiens; identical to SEQ ID NO: 90070

SEQ ID NO: 324487 - RNA, 64 nt, Homo Sapiens; identical to SEQ ID NO: 90071

SEQ ID NO: 324488 - RNA, 64 nt, Homo Sapiens; identical to SEQ ID NO: 90072

SEQ ID NO: 324489 - RNA, 64 nt, Homo Sapiens; identical to SEQ ID NO: 90073

SEQ ID NO: 324490 - RNA, 64 nt, Homo Sapiens; identical to SEQ ID NO: 90074

SEQ ID NO: 324491 - RNA, 64 nt, Homo Sapiens; identical to SEQ ID NO: 90075

SEQ ID NO: 324492 - RNA, 64 nt, Homo Sapiens; identical to SEQ ID NO: 90076

SEQ ID NO: 324493 - RNA, 64 nt, Homo Sapiens; identical to SEQ ID NO: 90077

SEQ ID NO: 324494 - RNA, 64 nt, Homo Sapiens; identical to SEQ ID NO: 90078

SEQ ID NO: 324495 - RNA, 64 nt, Homo Sapiens; identical to SEQ ID NO: 90079

SEQ ID NO: 324496 - RNA, 64 nt, Homo Sapiens; identical to SEQ ID NO: 90080

SEQ ID NO: 324497 - RNA, 64 nt, Homo Sapiens; identical to SEQ ID NO: 90081

SEQ ID NO: 324498 - RNA, 64 nt, Homo Sapiens; identical to SEQ ID NO: 90082

SEQ ID NO: 324499 - RNA, 64 nt, Homo Sapiens; identical to SEQ ID NO: 90083

SEQ ID NO: 324500 - RNA, 64 nt, Homo Sapiens; identical to SEQ ID NO: 90084

SEQ ID NO: 324501 - RNA, 64 nt, Homo Sapiens; identical to SEQ ID NO: 22031

SEQ ID NO: 324502 - RNA, 64 nt, Homo Sapiens; identical to SEQ ID NO: 22032

SEQ ID NO: 324503 - RNA, 64 nt, Homo Sapiens; identical to SEQ ID NO: 22033

SEQ ID NO: 324504 - RNA, 64 nt, Homo Sapiens; identical to SEQ ID NO: 22034

SEQ ID NO: 324505 - RNA, 64 nt, Homo Sapiens; identical to SEQ ID NO: 22035

SEQ ID NO: 324506 - RNA, 64 nt, Homo Sapiens; identical to SEQ ID NO: 22036

SEQ ID NO: 324507 - RNA, 64 nt, Homo Sapiens; identical to SEQ ID NO: 22037

SEQ ID NO: 324508 - RNA, 64 nt, Homo Sapiens; identical to SEQ ID NO: 22038

SEQ ID NO: 324509 - RNA, 64 nt, Homo Sapiens; identical to SEQ ID NO: 22039

SEQ ID NO: 324510 - RNA, 64 nt, Homo Sapiens; identical to SEQ ID NO: 22040

SEQ ID NO: 324511 - RNA, 64 nt, Homo Sapiens; identical to SEQ ID NO: 22041

SEQ ID NO: 324512 - RNA, 64 nt, Homo Sapiens; identical to SEQ ID NO: 22042

SEQ ID NO: 324513 - RNA, 64 nt, Homo Sapiens; identical to SEQ ID NO: 22043

SEQ ID NO: 324514 - RNA, 64 nt, Homo Sapiens; identical to SEQ ID NO: 22044

SEQ ID NO: 324515 - RNA, 64 nt, Homo Sapiens; identical to SEQ ID NO: 22045

SEQ ID NO: 324516 - RNA, 64 nt, Homo Sapiens; identical to SEQ ID NO: 22046

SEQ ID NO: 324517 - RNA, 64 nt, Homo Sapiens; identical to SEQ ID NO: 22047

SEQ ID NO: 324518 - RNA, 64 nt, Homo Sapiens; identical to SEQ ID NO: 22048

SEQ ID NO: 324519 - RNA, 64 nt, Homo Sapiens; identical to SEQ ID NO: 22049

SEQ ID NO: 324520 - RNA, 64 nt, Homo Sapiens; identical to SEQ ID NO: 22050

SEQ ID NO: 324521 - RNA, 64 nt, Homo Sapiens; identical to SEQ ID NO: 22051

SEQ ID NO: 324522 - RNA, 64 nt, Homo Sapiens; identical to SEQ ID NO: 22052

SEQ ID NO: 324523 - RNA, 64 nt, Homo Sapiens; identical to SEQ ID NO: 22053

SEQ ID NO: 324524 - RNA, 64 nt, Homo Sapiens; identical to SEQ ID NO: 22054

SEQ ID NO: 324525 - RNA, 64 nt, Homo Sapiens; identical to SEQ ID NO: 22055

SEQ ID NO: 324526 - RNA, 64 nt, Homo Sapiens; identical to SEQ ID NO: 22056

SEQ ID NO: 324527 - RNA, 64 nt, Homo Sapiens; identical to SEQ ID NO: 22057

SEQ ID NO: 324528 - RNA, 64 nt, Homo Sapiens; identical to SEQ ID NO: 22058

SEQ ID NO: 324529 - RNA, 64 nt, Homo Sapiens; identical to SEQ ID NO: 22059

SEQ ID NO: 324530 - RNA, 64 nt, Homo Sapiens; identical to SEQ ID NO: 22060

SEQ ID NO: 324531 - RNA, 64 nt, Homo Sapiens; identical to SEQ ID NO: 22061

SEQ ID NO: 324532 - RNA, 64 nt, Homo Sapiens; identical to SEQ ID NO: 22062

SEQ ID NO: 324533 - RNA, 64 nt, Homo Sapiens; identical to SEQ ID NO: 22063

SEQ ID NO: 324534 - RNA, 64 nt, Homo Sapiens; identical to SEQ ID NO: 22064

SEQ ID NO: 324535 - RNA, 64 nt, Homo Sapiens; identical to SEQ ID NO: 22065

SEQ ID NO: 324536 - RNA, 64 nt, Homo Sapiens; identical to SEQ ID NO: 22066

SEQ ID NO: 324537 - RNA, 64 nt, Homo Sapiens; identical to SEQ ID NO: 22067

SEQ ID NO: 324538 - RNA, 52 nt, Homo Sapiens; identical to SEQ ID NO: 22068

SEQ ID NO: 324539 - RNA, 64 nt, Homo Sapiens; identical to SEQ ID NO: 22069

SEQ ID NO: 324540 - RNA, 64 nt, Homo Sapiens; identical to SEQ ID NO: 22070

SEQ ID NO: 324541 - RNA, 64 nt, Homo Sapiens; identical to SEQ ID NO: 22071

SEQ ID NO: 324542 - RNA, 64 nt, Homo Sapiens; identical to SEQ ID NO: 22072

SEQ ID NO: 324543 - RNA, 64 nt, Homo Sapiens; identical to SEQ ID NO: 22073

SEQ ID NO: 324544 - RNA, 64 nt, Homo Sapiens; identical to SEQ ID NO: 22074

SEQ ID NO: 324545 - RNA, 64 nt, Homo Sapiens; identical to SEQ ID NO: 22075

SEQ ID NO: 324546 - RNA, 64 nt, Homo Sapiens; identical to SEQ ID NO: 22076

SEQ ID NO: 324547 - RNA, 64 nt, Homo Sapiens; identical to SEQ ID NO: 22077

SEQ ID NO: 324548 - RNA, 64 nt, Homo Sapiens; identical to SEQ ID NO: 22078

SEQ ID NO: 324549 - RNA, 64 nt, Homo Sapiens; identical to SEQ ID NO: 22079

SEQ ID NO: 324550 - RNA, 64 nt, Homo Sapiens; identical to SEQ ID NO: 22080

SEQ ID NO: 324551 - RNA, 64 nt, Homo Sapiens; identical to SEQ ID NO: 22081

SEQ ID NO: 324552 - RNA, 64 nt, Homo Sapiens; identical to SEQ ID NO: 22082

SEQ ID NO: 324553 - RNA, 53 nt, Homo Sapiens; identical to SEQ ID NO: 22083

SEQ ID NO: 324554 - RNA, 64 nt, Homo Sapiens; identical to SEQ ID NO: 22084

SEQ ID NO: 324555 - RNA, 64 nt, Homo Sapiens; identical to SEQ ID NO: 22085

SEQ ID NO: 324556 - RNA, 64 nt, Homo Sapiens; identical to SEQ ID NO: 22086

SEQ ID NO: 324557 - RNA, 64 nt, Homo Sapiens; identical to SEQ ID NO: 22087

SEQ ID NO: 324558 - RNA, 64 nt, Homo Sapiens; identical to SEQ ID NO: 22088

SEQ ID NO: 324559 - RNA, 64 nt, Homo Sapiens; identical to SEQ ID NO: 22089

SEQ ID NO: 324560 - RNA, 64 nt, Homo Sapiens; identical to SEQ ID NO: 22090

SEQ ID NO: 324561 - RNA, 64 nt, Homo Sapiens; identical to SEQ ID NO: 22091

SEQ ID NO: 324562 - RNA, 64 nt, Homo Sapiens; identical to SEQ ID NO: 82929

SEQ ID NO: 324563 - RNA, 64 nt, Homo Sapiens; identical to SEQ ID NO: 82930

SEQ ID NO: 324564 - RNA, 64 nt, Homo Sapiens; identical to SEQ ID NO: 82931

SEQ ID NO: 324565 - RNA, 64 nt, Homo Sapiens; identical to SEQ ID NO: 82932

SEQ ID NO: 324566 - RNA, 64 nt, Homo Sapiens; identical to SEQ ID NO: 82933

SEQ ID NO: 324567 - RNA, 64 nt, Homo Sapiens; identical to SEQ ID NO: 82934

SEQ ID NO: 324568 - RNA, 64 nt, Homo Sapiens; identical to SEQ ID NO: 82935

SEQ ID NO: 324569 - RNA, 64 nt, Homo Sapiens; identical to SEQ ID NO: 82936

SEQ ID NO: 324570 - RNA, 64 nt, Homo Sapiens; identical to SEQ ID NO: 82937

SEQ ID NO: 324571 - RNA, 64 nt, Homo Sapiens; identical to SEQ ID NO: 82938

SEQ ID NO: 324572 - RNA, 64 nt, Homo Sapiens; identical to SEQ ID NO: 82939

SEQ ID NO: 324573 - RNA, 64 nt, Homo Sapiens; identical to SEQ ID NO: 82940

SEQ ID NO: 324574 - RNA, 64 nt, Homo Sapiens; identical to SEQ ID NO: 82941

SEQ ID NO: 324575 - RNA, 64 nt, Homo Sapiens; identical to SEQ ID NO: 82942

SEQ ID NO: 324576 - RNA, 64 nt, Homo Sapiens; identical to SEQ ID NO: 82943

SEQ ID NO: 324577 - RNA, 64 nt, Homo Sapiens; identical to SEQ ID NO: 82944

SEQ ID NO: 324578 - RNA, 64 nt, Homo Sapiens; identical to SEQ ID NO: 82945

SEQ ID NO: 324579 - RNA, 64 nt, Homo Sapiens; identical to SEQ ID NO: 82946

SEQ ID NO: 324580 - RNA, 64 nt, Homo Sapiens; identical to SEQ ID NO: 82947

SEQ ID NO: 324581 - RNA, 64 nt, Homo Sapiens; identical to SEQ ID NO: 82948

SEQ ID NO: 324582 - RNA, 64 nt, Homo Sapiens; identical to SEQ ID NO: 82949

SEQ ID NO: 324583 - RNA, 64 nt, Homo Sapiens; identical to SEQ ID NO: 82950

SEQ ID NO: 324584 - RNA, 64 nt, Homo Sapiens; identical to SEQ ID NO: 82951

SEQ ID NO: 324585 - RNA, 64 nt, Homo Sapiens; identical to SEQ ID NO: 82952

SEQ ID NO: 324586 - RNA, 64 nt, Homo Sapiens; identical to SEQ ID NO: 82953

SEQ ID NO: 324587 - RNA, 64 nt, Homo Sapiens; identical to SEQ ID NO: 82954

SEQ ID NO: 324588 - RNA, 64 nt, Homo Sapiens; identical to SEQ ID NO: 82955

SEQ ID NO: 324589 - RNA, 64 nt, Homo Sapiens; identical to SEQ ID NO: 82956

SEQ ID NO: 324590 - RNA, 64 nt, Homo Sapiens; identical to SEQ ID NO: 82957

SEQ ID NO: 324591 - RNA, 64 nt, Homo Sapiens; identical to SEQ ID NO: 82958

SEQ ID NO: 324592 - RNA, 64 nt, Homo Sapiens; identical to SEQ ID NO: 82959

SEQ ID NO: 324593 - RNA, 64 nt, Homo Sapiens; identical to SEQ ID NO: 82960

SEQ ID NO: 324594 - RNA, 64 nt, Homo Sapiens; identical to SEQ ID NO: 82961

SEQ ID NO: 324595 - RNA, 64 nt, Homo Sapiens; identical to SEQ ID NO: 82962

SEQ ID NO: 324596 - RNA, 64 nt, Homo Sapiens; identical to SEQ ID NO: 82963

SEQ ID NO: 324597 - RNA, 64 nt, Homo Sapiens; identical to SEQ ID NO: 82964

SEQ ID NO: 324598 - RNA, 64 nt, Homo Sapiens; identical to SEQ ID NO: 82965

SEQ ID NO: 324599 - RNA, 64 nt, Homo Sapiens; identical to SEQ ID NO: 82966

SEQ ID NO: 324600 - RNA, 64 nt, Homo Sapiens; identical to SEQ ID NO: 82967

SEQ ID NO: 324601 - RNA, 64 nt, Homo Sapiens; identical to SEQ ID NO: 82968

SEQ ID NO: 324602 - RNA, 64 nt, Homo Sapiens; identical to SEQ ID NO: 82969

SEQ ID NO: 324603 - RNA, 64 nt, Homo Sapiens; identical to SEQ ID NO: 82970

SEQ ID NO: 324604 - RNA, 64 nt, Homo Sapiens; identical to SEQ ID NO: 82971

SEQ ID NO: 324605 - RNA, 64 nt, Homo Sapiens; identical to SEQ ID NO: 82972

SEQ ID NO: 324606 - RNA, 64 nt, Homo Sapiens; identical to SEQ ID NO: 82973

SEQ ID NO: 324607 - RNA, 64 nt, Homo Sapiens; identical to SEQ ID NO: 82974

SEQ ID NO: 324608 - RNA, 64 nt, Homo Sapiens; identical to SEQ ID NO: 82975

SEQ ID NO: 324609 - RNA, 64 nt, Homo Sapiens; identical to SEQ ID NO: 82976

SEQ ID NO: 324610 - RNA, 64 nt, Homo Sapiens; identical to SEQ ID NO: 82977

SEQ ID NO: 324611 - RNA, 64 nt, Homo Sapiens; identical to SEQ ID NO: 82978

SEQ ID NO: 324612 - RNA, 64 nt, Homo Sapiens; identical to SEQ ID NO: 82979

SEQ ID NO: 324613 - RNA, 64 nt, Homo Sapiens; identical to SEQ ID NO: 82980

SEQ ID NO: 324614 - RNA, 64 nt, Homo Sapiens; identical to SEQ ID NO: 82981

SEQ ID NO: 324615 - RNA, 64 nt, Homo Sapiens; identical to SEQ ID NO: 82982

SEQ ID NO: 324616 - RNA, 64 nt, Homo Sapiens
agaucuuagguuccaagauuuuacuucaaauuacaccuucaaaacuggagcagcauauagccga

SEQ ID NO: 324617 - RNA, 64 nt, Homo Sapiens
auacaguuguuuuugaaauuuaacuuuuguuuguaccuucaauguguaaguacaugcauguuuu

SEQ ID NO: 324618 - RNA, 64 nt, Homo Sapiens
uuaccacugcacuccagcuuuugaggcugcagugaacuaugauugauuguuugagcgagggaag

SEQ ID NO: 324619 - RNA, 64 nt, Homo Sapiens
gcuuuuuuuuuucucuuuccuaugccaauuuuuaaacuaugacaauuuaaucuggaagagaaca

SEQ ID NO: 324620 - RNA, 64 nt, Homo Sapiens
acuauuuuuguaauaaaacaaugacagcuguaguaacuaugauggguguaacaacauuuuuuua

SEQ ID NO: 324621 - RNA, 64 nt, Homo Sapiens
aucacacauuuaaaaaaucuguagaauuuauuuuaacuaugaccuuuaauugaaaauaaauaau

SEQ ID NO: 324622 - RNA, 64 nt, Homo Sapiens
uuauuaaaucuguauccauuaaaguaacuuuuuuaacuaugagaauuagaaaauaagggacaac

SEQ ID NO: 324623 - RNA, 64 nt, Homo Sapiens
ccuagaacuaagaucuuauaaccacacuccaugcaacuaugagucucuaaaucucucuguaaga

SEQ ID NO: 324624 - RNA, 64 nt, Homo Sapiens
aaaguagaauccguuacuuuaagcaaaauuuuaaaacuaugaugacuaaagaccagaauauaaa

SEQ ID NO: 324625 - RNA, 64 nt, Homo Sapiens
gugggauagccuucugaaaacuuccagaguagaaaacuaugaaucauugcacauuacaugauca

SEQ ID NO: 324626 - RNA, 64 nt, Homo Sapiens; identical to SEQ ID NO: 154357

SEQ ID NO: 324627 - RNA, 64 nt, Homo Sapiens; identical to SEQ ID NO: 154358

SEQ ID NO: 324628 - RNA, 64 nt, Homo Sapiens; identical to SEQ ID NO: 154359

SEQ ID NO: 324629 - RNA, 64 nt, Homo Sapiens; identical to SEQ ID NO: 154360

SEQ ID NO: 324630 - RNA, 64 nt, Homo Sapiens; identical to SEQ ID NO: 154361

SEQ ID NO: 324631 - RNA, 64 nt, Homo Sapiens; identical to SEQ ID NO: 154362

SEQ ID NO: 324632 - RNA, 64 nt, Homo Sapiens; identical to SEQ ID NO: 154363

SEQ ID NO: 324633 - RNA, 64 nt, Homo Sapiens; identical to SEQ ID NO: 154364

SEQ ID NO: 324634 - RNA, 64 nt, Homo Sapiens; identical to SEQ ID NO: 154365

SEQ ID NO: 324635 - RNA, 64 nt, Homo Sapiens; identical to SEQ ID NO: 154366

SEQ ID NO: 324636 - RNA, 64 nt, Homo Sapiens; identical to SEQ ID NO: 154367

SEQ ID NO: 324637 - RNA, 64 nt, Homo Sapiens; identical to SEQ ID NO: 154368

SEQ ID NO: 324638 - RNA, 64 nt, Homo Sapiens; identical to SEQ ID NO: 154369

SEQ ID NO: 324639 - RNA, 64 nt, Homo Sapiens; identical to SEQ ID NO: 154370

SEQ ID NO: 324640 - RNA, 64 nt, Homo Sapiens; identical to SEQ ID NO: 154371

SEQ ID NO: 324641 - RNA, 64 nt, Homo Sapiens; identical to SEQ ID NO: 154372

SEQ ID NO: 324642 - RNA, 64 nt, Homo Sapiens; identical to SEQ ID NO: 154373

SEQ ID NO: 324643 - RNA, 64 nt, Homo Sapiens; identical to SEQ ID NO: 154374

SEQ ID NO: 324644 - RNA, 64 nt, Homo Sapiens; identical to SEQ ID NO: 154375

SEQ ID NO: 324645 - RNA, 64 nt, Homo Sapiens; identical to SEQ ID NO: 154376

SEQ ID NO: 324646 - RNA, 64 nt, Homo Sapiens; identical to SEQ ID NO: 154377

SEQ ID NO: 324647 - RNA, 64 nt, Homo Sapiens; identical to SEQ ID NO: 154378

SEQ ID NO: 324648 - RNA, 64 nt, Homo Sapiens; identical to SEQ ID NO: 154379

SEQ ID NO: 324649 - RNA, 64 nt, Homo Sapiens; identical to SEQ ID NO: 154380

SEQ ID NO: 324650 - RNA, 64 nt, Homo Sapiens; identical to SEQ ID NO: 154381

SEQ ID NO: 324651 - RNA, 64 nt, Homo Sapiens; identical to SEQ ID NO: 154382

SEQ ID NO: 324652 - RNA, 64 nt, Homo Sapiens; identical to SEQ ID NO: 154383

SEQ ID NO: 324653 - RNA, 64 nt, Homo Sapiens; identical to SEQ ID NO: 154384

SEQ ID NO: 324654 - RNA, 64 nt, Homo Sapiens; identical to SEQ ID NO: 154385

SEQ ID NO: 324655 - RNA, 64 nt, Homo Sapiens; identical to SEQ ID NO: 154386

SEQ ID NO: 324656 - RNA, 64 nt, Homo Sapiens; identical to SEQ ID NO: 154387

SEQ ID NO: 324657 - RNA, 64 nt, Homo Sapiens; identical to SEQ ID NO: 154388

SEQ ID NO: 324658 - RNA, 64 nt, Homo Sapiens; identical to SEQ ID NO: 154389

SEQ ID NO: 324659 - RNA, 64 nt, Homo Sapiens; identical to SEQ ID NO: 154390

SEQ ID NO: 324660 - RNA, 64 nt, Homo Sapiens
uuuauauuucguuuuaaaaacacccaugauguggcacaguaaacaaacccuguuaugcuguauu

SEQ ID NO: 324661 - RNA, 64 nt, Homo Sapiens
cacagccgagaaacagugcagcaguauaugugcacacaguaaguacacaaauuugagcaacagu

SEQ ID NO: 324662 - RNA, 64 nt, Homo Sapiens
caauaguuugagauuuaaaaaaaagcaaauuuugcacaguaaacucaaugcuauuaaaucauac

SEQ ID NO: 324663 - RNA, 64 nt, Homo Sapiens
cauguaaguggaagcuuuacgugauuuguuuuuucacaguaaaccuauuucauauuaauuccag

SEQ ID NO: 324664 - RNA, 64 nt, Homo Sapiens
uacaauguaaaccuaggagcauuaagacuugucacacaguaaaccugauacaucagaggugaau

SEQ ID NO: 324665 - RNA, 64 nt, Homo Sapiens
gaccacacagaaccagggcugccccuguaauccccacaguaagaaaguuguauggcauauucca

SEQ ID NO: 324666 - RNA, 64 nt, Homo Sapiens
gacuaacaacagcucacagcguuuauaaguuaggcacaguaagacguacauaugauaaaguuca

SEQ ID NO: 324667 - RNA, 64 nt, Homo Sapiens
uucagggucugucuaucuuauggaauuucaggagcacaguaaauagguuuuccuagauacaaaa

SEQ ID NO: 324668 - RNA, 64 nt, Homo Sapiens
gaaagcggacuuuaaaaaaaauaaugugcuguaacacaguaaauauguacuuguagccuggaua

SEQ ID NO: 324669 - RNA, 64 nt, Homo Sapiens
caauugaugugaccacacucuucuuaauuuuguucacaguaaaaacacuuuuuugaguuauuag

SEQ ID NO: 324670 - RNA, 64 nt, Homo Sapiens; identical to SEQ ID NO: 296934

SEQ ID NO: 324671 - RNA, 64 nt, Homo Sapiens; identical to SEQ ID NO: 296935

SEQ ID NO: 324672 - RNA, 64 nt, Homo Sapiens; identical to SEQ ID NO: 296936

SEQ ID NO: 324673 - RNA, 64 nt, Homo Sapiens; identical to SEQ ID NO: 296937

SEQ ID NO: 324674 - RNA, 64 nt, Homo Sapiens; identical to SEQ ID NO: 296938

SEQ ID NO: 324675 - RNA, 64 nt, Homo Sapiens; identical to SEQ ID NO: 296939

SEQ ID NO: 324676 - RNA, 64 nt, Homo Sapiens; identical to SEQ ID NO: 296940

SEQ ID NO: 324677 - RNA, 64 nt, Homo Sapiens; identical to SEQ ID NO: 296941

SEQ ID NO: 324678 - RNA, 64 nt, Homo Sapiens; identical to SEQ ID NO: 296942

SEQ ID NO: 324679 - RNA, 64 nt, Homo Sapiens; identical to SEQ ID NO: 296943

SEQ ID NO: 324680 - RNA, 64 nt, Homo Sapiens; identical to SEQ ID NO: 296944

SEQ ID NO: 324681 - RNA, 64 nt, Homo Sapiens; identical to SEQ ID NO: 296945

SEQ ID NO: 324682 - RNA, 64 nt, Homo Sapiens; identical to SEQ ID NO: 296946

SEQ ID NO: 324683 - RNA, 64 nt, Homo Sapiens; identical to SEQ ID NO: 296947

SEQ ID NO: 324684 - RNA, 64 nt, Homo Sapiens; identical to SEQ ID NO: 296948

SEQ ID NO: 324685 - RNA, 64 nt, Homo Sapiens; identical to SEQ ID NO: 296949

SEQ ID NO: 324686 - RNA, 64 nt, Homo Sapiens; identical to SEQ ID NO: 296950

SEQ ID NO: 324687 - RNA, 64 nt, Homo Sapiens; identical to SEQ ID NO: 296951

SEQ ID NO: 324688 - RNA, 64 nt, Homo Sapiens; identical to SEQ ID NO: 296952

SEQ ID NO: 324689 - RNA, 64 nt, Homo Sapiens; identical to SEQ ID NO: 296953

SEQ ID NO: 324690 - RNA, 64 nt, Homo Sapiens; identical to SEQ ID NO: 296954

SEQ ID NO: 324691 - RNA, 64 nt, Homo Sapiens; identical to SEQ ID NO: 296955

SEQ ID NO: 324692 - RNA, 64 nt, Homo Sapiens; identical to SEQ ID NO: 296956

SEQ ID NO: 324693 - RNA, 64 nt, Homo Sapiens; identical to SEQ ID NO: 296957

SEQ ID NO: 324694 - RNA, 64 nt, Homo Sapiens; identical to SEQ ID NO: 296958

SEQ ID NO: 324695 - RNA, 64 nt, Homo Sapiens; identical to SEQ ID NO: 296959

SEQ ID NO: 324696 - RNA, 64 nt, Homo Sapiens; identical to SEQ ID NO: 296960

SEQ ID NO: 324697 - RNA, 64 nt, Homo Sapiens; identical to SEQ ID NO: 296961

SEQ ID NO: 324698 - RNA, 64 nt, Homo Sapiens; identical to SEQ ID NO: 296962

SEQ ID NO: 324699 - RNA, 64 nt, Homo Sapiens; identical to SEQ ID NO: 296963

SEQ ID NO: 324700 - RNA, 64 nt, Homo Sapiens; identical to SEQ ID NO: 296964

SEQ ID NO: 324701 - RNA, 64 nt, Homo Sapiens; identical to SEQ ID NO: 296965

SEQ ID NO: 324702 - RNA, 64 nt, Homo Sapiens; identical to SEQ ID NO: 296966

SEQ ID NO: 324703 - RNA, 64 nt, Homo Sapiens; identical to SEQ ID NO: 296967

SEQ ID NO: 324704 - RNA, 64 nt, Homo Sapiens; identical to SEQ ID NO: 296968

SEQ ID NO: 324705 - RNA, 64 nt, Homo Sapiens; identical to SEQ ID NO: 296969

SEQ ID NO: 324706 - RNA, 64 nt, Homo Sapiens; identical to SEQ ID NO: 296970

SEQ ID NO: 324707 - RNA, 64 nt, Homo Sapiens; identical to SEQ ID NO: 296971

SEQ ID NO: 324708 - RNA, 64 nt, Homo Sapiens; identical to SEQ ID NO: 296972

SEQ ID NO: 324709 - RNA, 64 nt, Homo Sapiens; identical to SEQ ID NO: 296973

SEQ ID NO: 324710 - RNA, 64 nt, Homo Sapiens; identical to SEQ ID NO: 296974

SEQ ID NO: 324711 - RNA, 64 nt, Homo Sapiens; identical to SEQ ID NO: 296975

SEQ ID NO: 324712 - RNA, 64 nt, Homo Sapiens; identical to SEQ ID NO: 296976

SEQ ID NO: 324713 - RNA, 64 nt, Homo Sapiens; identical to SEQ ID NO: 296977

SEQ ID NO: 324714 - RNA, 64 nt, Homo Sapiens; identical to SEQ ID NO: 296978

SEQ ID NO: 324715 - RNA, 64 nt, Homo Sapiens; identical to SEQ ID NO: 296979

SEQ ID NO: 324716 - RNA, 64 nt, Homo Sapiens; identical to SEQ ID NO: 296980

SEQ ID NO: 324717 - RNA, 64 nt, Homo Sapiens; identical to SEQ ID NO: 296981

SEQ ID NO: 324718 - RNA, 64 nt, Homo Sapiens; identical to SEQ ID NO: 296982

SEQ ID NO: 324719 - RNA, 64 nt, Homo Sapiens; identical to SEQ ID NO: 296983

SEQ ID NO: 324720 - RNA, 64 nt, Homo Sapiens; identical to SEQ ID NO: 296984

SEQ ID NO: 324721 - RNA, 64 nt, Homo Sapiens; identical to SEQ ID NO: 296985

SEQ ID NO: 324722 - RNA, 64 nt, Homo Sapiens; identical to SEQ ID NO: 296986

SEQ ID NO: 324723 - RNA, 64 nt, Homo Sapiens; identical to SEQ ID NO: 296987

SEQ ID NO: 324724 - RNA, 64 nt, Homo Sapiens; identical to SEQ ID NO: 296988

SEQ ID NO: 324725 - RNA, 64 nt, Homo Sapiens; identical to SEQ ID NO: 296989

SEQ ID NO: 324726 - RNA, 64 nt, Homo Sapiens; identical to SEQ ID NO: 296990

SEQ ID NO: 324727 - RNA, 64 nt, Homo Sapiens; identical to SEQ ID NO: 296991

SEQ ID NO: 324728 - RNA, 64 nt, Homo Sapiens; identical to SEQ ID NO: 296992

SEQ ID NO: 324729 - RNA, 64 nt, Homo Sapiens; identical to SEQ ID NO: 296993

SEQ ID NO: 324730 - RNA, 64 nt, Homo Sapiens; identical to SEQ ID NO: 296994

SEQ ID NO: 324731 - RNA, 64 nt, Homo Sapiens
ccuccuucuggaaucauagauccauuucuacccagaccuccagggagaccauauuuucucuccc

SEQ ID NO: 324732 - RNA, 64 nt, Homo Sapiens
gaccauauuuucucucccucaggaaccugcccuagaccuccagaccaacacugcaccuuauccc

SEQ ID NO: 324733 - RNA, 64 nt, Homo Sapiens
ggucucuucguguuccucgugcugccccugccucgaccuccaugauaacucaccaaagcucaac

SEQ ID NO: 324734 - RNA, 64 nt, Homo Sapiens
cucucgaaggcaucaagacaaggugaguccaaaugaccuccagcagggagcggagauuccucau

SEQ ID NO: 324735 - RNA, 64 nt, Homo Sapiens
cuaccagaagaaggguggagucagaaaccaaagugaccuccagagcuguccuccuggcaccuga

SEQ ID NO: 324736 - RNA, 64 nt, Homo Sapiens
gacagaggcagggcagcauggagacagguagacagaccuccaggucccuaagcuggggacagag

SEQ ID NO: 324737 - RNA, 64 nt, Homo Sapiens
gaguaccugcaaaaaugaguuuuuaagguucucagaccuccaguaaaaaaauguagcgacagca

SEQ ID NO: 324738 - RNA, 64 nt, Homo Sapiens
ccacaucugcaucacucaugagcaccucaccugagaccuccacuucuguuacccagggcucugc

SEQ ID NO: 324739 - RNA, 64 nt, Homo Sapiens
cagcuaaaaugugauuauuuuccaagcucaguuggaccuccagacccaucacugaccauuugcc

SEQ ID NO: 324740 - RNA, 64 nt, Homo Sapiens
ccuuggggggugaagcugucaaugccaccaguuggaccuccauacauucugagcuaacccagaa

SEQ ID NO: 324741 - RNA, 64 nt, Homo Sapiens
uugcuugaaaucaaggugcuccaacuuaguuuaagaccuccagacucuaacuuuauagaucauc

SEQ ID NO: 324742 - RNA, 64 nt, Homo Sapiens
gagaaguguauaguaguacacggggggaagaggggaccuccaugucccuuuguuggauacauau

SEQ ID NO: 324743 - RNA, 60 nt, Homo Sapiens
gggaugggcucgcugaaccucgaggaacuccaggacgaggaggacaugggacuugcgugg

SEQ ID NO: 324744 - RNA, 60 nt, Homo Sapiens
aggccugcggggcgggggcgggguggcgcccaggacgacuccccgggcucagcuuggcug

SEQ ID NO: 324745 - RNA, 60 nt, Homo Sapiens
caugaccguaacaugugaccugugugcuggcaggacgacucacugcggcugcgccacugg

SEQ ID NO: 324746 - RNA, 60 nt, Homo Sapiens
augcagcuuucccuagggggaggccuacaacaggacgaccauucugagccagugagucua

SEQ ID NO: 324747 - RNA, 60 nt, Homo Sapiens
agcuggggagcuuccucacacuggaccuaccaggacgaggaccaaggugcugcuggucuc

SEQ ID NO: 324748 - RNA, 60 nt, Homo Sapiens
ucaguccagcaugguuuugaccagcucuuccaggacgaacuuuccuuguggcccugccaa

SEQ ID NO: 324749 - RNA, 60 nt, Homo Sapiens
cuuuugcccuacaucuuuccuucucauuuucaggacgagaaguggggagggggagauuua

SEQ ID NO: 324750 - RNA, 60 nt, Homo Sapiens
aaucuucucaaugggggggccgcgacuucucaggacgacggacacacuccaccuccagca

SEQ ID NO: 324751 - RNA, 60 nt, Homo Sapiens
uuuuccaaacacaggcaaauccgaaaucagcaggacgacuguuuucccaacacggguaaa

SEQ ID NO: 324752 - RNA, 60 nt, Homo Sapiens
ggagacaucugggugccaggcugugucagccaggacgaaggagcagaugaccaccaugcu

SEQ ID NO: 324753 - RNA, 60 nt, Homo Sapiens
augaggguccuuugggaaagcccaaaguaucaggacgagagugaaaaacauccagauaca

SEQ ID NO: 324754 - RNA, 60 nt, Homo Sapiens
auccuuuuuuaaaaaaucugccaauagacccaggacgaguaagagaggaagcaucaaccu

SEQ ID NO: 324755 - RNA, 60 nt, Homo Sapiens
agacaacggagggcagcgcccccccgagaucaggacgaaggaccaccgucgguccucagc

SEQ ID NO: 324756 - RNA, 60 nt, Homo Sapiens
caccuggaggauguaccagaagcacuagaccaggacgaccuccagcgcgaucuccagcag

SEQ ID NO: 324757 - RNA, 60 nt, Homo Sapiens
uugaagauuggucuucuguuacccaucuugcaggacgacauaggaggagauguuaaagua

SEQ ID NO: 324758 - RNA, 60 nt, Homo Sapiens
gaggccuuauaugguguguucaggucuccucaggacgauggucaggaaaaggcaauauau

SEQ ID NO: 324759 - RNA, 60 nt, Homo Sapiens
auguauuuuugucaauuaccagaaagauaacaggacgagaugacgguguuauuccaaggg

SEQ ID NO: 324760 - RNA, 60 nt, Homo Sapiens
ugagcccaagaguuccagacggcucagcagcaggacgacuguagucccagcuacucagga

SEQ ID NO: 324761 - RNA, 60 nt, Homo Sapiens
ggcuguccuccugcccacccgggcuggcagcaggacgacuaccugccgcuggaagcuauu

SEQ ID NO: 324762 - RNA, 60 nt, Homo Sapiens
ugcguguugagggcucaucugcuucucguccaggacgacauuuccagcuucaucuuugau

SEQ ID NO: 324763 - RNA, 60 nt, Homo Sapiens
gacucuuccacggugugcugccugcuuccccaggacgagucaacuucaaauagucugaug

SEQ ID NO: 324764 - RNA, 60 nt, Homo Sapiens
gugugucagggucacgaacccguuacauuucaggacgauccuuuuuccuucagcagcauu

SEQ ID NO: 324765 - RNA, 60 nt, Homo Sapiens
cuguuuuugaacacggggucauucugcagucaggacgaaccgguccccgucgcagacgga

SEQ ID NO: 324766 - RNA, 60 nt, Homo Sapiens
gaugcuguuucuccggcagaaccaacccuccaggacgaaguuucagaauuggcugauggu

SEQ ID NO: 324767 - RNA, 60 nt, Homo Sapiens
caguuccagaaagaacccaagcucaagacgcaggacgagcucaguuguagagggcuaauu

SEQ ID NO: 324768 - RNA, 60 nt, Homo Sapiens
uugagaaggaaaacgccaaaauguagcaaccaggacgaagucuuuucuaaaugaaacucc

SEQ ID NO: 324769 - RNA, 60 nt, Homo Sapiens
caugacuuuuagauaugagaugacgggaagcaggacgaaauaucggcguguggcuggagc

SEQ ID NO: 324770 - RNA, 60 nt, Homo Sapiens
ucuaaacggaugcugcuggguguugcgacccaggacgagaugccuuguuucuuuuacaau

SEQ ID NO: 324771 - RNA, 60 nt, Homo Sapiens
aagaggcauacacacagcaggagccccaagcaggacgaaacucagagcgccaggaagcca

SEQ ID NO: 324772 - RNA, 60 nt, Homo Sapiens
agugcauccucaagcucugcagucauccuccaggacgacccuuuaacauggacacucaug

SEQ ID NO: 324773 - RNA, 60 nt, Homo Sapiens
caagggcuggccgcagcuccugugcccugucaggacgacugagggcucaaacacaccaca

SEQ ID NO: 324774 - RNA, 60 nt, Homo Sapiens
cuguaaucccagcuacucgggaggcugaggcaggacgauuacuugagcuugggaaaucaa

SEQ ID NO: 324775 - RNA, 60 nt, Homo Sapiens
gcauauucaacacacugccuguucauuccacaggacgaauucauguaucucucuguggug

SEQ ID NO: 324776 - RNA, 60 nt, Homo Sapiens
gggauauuuugcccccaacuuccagaugaccaggacgagugcucaucauucagauggcuu

SEQ ID NO: 324777 - RNA, 60 nt, Homo Sapiens
auagugguccucuuacagagaaacggggagcaggacgacgggggggcuggggguggcggg

SEQ ID NO: 324778 - RNA, 60 nt, Homo Sapiens
ggaccucuaaugugggcaugucguccaccccaggacgagccaucagggacagacccccca

SEQ ID NO: 324779 - RNA, 60 nt, Homo Sapiens
agcugugugucuugggccaccaguggccugcaggacgaagguacuguuccaucaccugcg

SEQ ID NO: 324780 - RNA, 60 nt, Homo Sapiens
agacugcuaaguaggggcagugaugguugccaggacgaauugagauaauaucugugaggu

SEQ ID NO: 324781 - RNA, 60 nt, Homo Sapiens
acuucugaguuacagcucagacauuguuugcaggacgaaauaauaaacacauuuguaaau

SEQ ID NO: 324782 - RNA, 60 nt, Homo Sapiens
ccauccuggcuaacacggugaucacaaagucaggacgagaugggaggccgaggcgggcgg

SEQ ID NO: 324783 - RNA, 60 nt, Homo Sapiens
guuucagcaauuccugcagagccugcagcccaggacgacugaaggugaggcaggagggug

SEQ ID NO: 324784 - RNA, 60 nt, Homo Sapiens
aggguacgaugaggccugggcucagugagccaggacgaaugugacagacaccccuugcug

SEQ ID NO: 324785 - RNA, 60 nt, Homo Sapiens
uuucacuagagggcccacgauccuacuccccaggacgaguucucugcuucucagcagcug

SEQ ID NO: 324786 - RNA, 60 nt, Homo Sapiens
ccuguuguggcgucuucuggcugacggcagcaggacgaaguuuuccaagccgccaggguc

SEQ ID NO: 324787 - RNA, 60 nt, Homo Sapiens
ugucgauguuucuuagcagauuggaggcugcaggacgaacgauggcugagguuagugugc

SEQ ID NO: 324788 - RNA, 60 nt, Homo Sapiens
gccaggcagagucuugugcuguucccagaacaggacgacagugaaaagaacacucuugac

SEQ ID NO: 324789 - RNA, 60 nt, Homo Sapiens
gaagcagucccuccucaccagcucuccagccaggacgaucacacagagaugaauggcauc

SEQ ID NO: 324790 - RNA, 60 nt, Homo Sapiens
gugccccaucagcagcuugacgcguggucacaggacgauuucacugacacugcgaacucu

SEQ ID NO: 324791 - RNA, 60 nt, Homo Sapiens
caccaccccccugcugagggggccuccaggcaggacgagacuccucgggcaagggccgug

SEQ ID NO: 324792 - RNA, 60 nt, Homo Sapiens
accagggccgcagcuuccggugugagccuacaggacgagccuggaggccauggacagccc

SEQ ID NO: 324793 - RNA, 60 nt, Homo Sapiens
uaaugucagagcuccaucaggcccaucugccaggacgaggcugcugugggccaaagccaa

SEQ ID NO: 324794 - RNA, 60 nt, Homo Sapiens
accgcggccccuguaggccaaggcgccaggcaggacgacagcagcagcagcgcgucuccu

SEQ ID NO: 324795 - RNA, 60 nt, Homo Sapiens
ccaggacaggccaucugcagugacccagcccaggacgaaguuuacaaacaccuccuggaa

SEQ ID NO: 324796 - RNA, 60 nt, Homo Sapiens
gcaucugacuugccacuagcacaggaagcucaggacgaaggcagcguuaggagaauaguu

SEQ ID NO: 324797 - RNA, 60 nt, Homo Sapiens
cuguaaucccagcacuuugggaggccaaagcaggacgaucacuugagcccaggaguucaa

SEQ ID NO: 324798 - RNA, 60 nt, Homo Sapiens
cugugggguuugcagaauuagugaaggguccaggacgaucccagugggcucgcuuccaaa

SEQ ID NO: 324799 - RNA, 60 nt, Homo Sapiens
gcugauggcacacccauccuuaagcuaagacaggacgauugugguccucccacacuaagg

SEQ ID NO: 324800 - RNA, 60 nt, Homo Sapiens
gagugucacaucucugccuggaacuucuaccaggacgacgauuucaggugcucacagcgg

SEQ ID NO: 324801 - RNA, 60 nt, Homo Sapiens
ccuggcuugccacccacaguuugccaacuucaggacgacacaaaggaugaggaaucugag

SEQ ID NO: 324802 - RNA, 60 nt, Homo Sapiens
cagaaaagcacauuuuaaaagaagacgagacaggacgaggcgcccgggagugggguagag

SEQ ID NO: 324803 - RNA, 60 nt, Homo Sapiens
ugcuggccugagacaguaucccagcuacaacaggacgacaccggguucaggaauaugugg

SEQ ID NO: 324804 - RNA, 60 nt, Homo Sapiens
agaaggcuggcauuggcaggaggagagcaccaggacgaggaugggaagcgaccuccagau

SEQ ID NO: 324805 - RNA, 60 nt, Homo Sapiens
ugcaaggucccagccagcagcacuccaaaccaggacgaccauccuucaccuccuaucccc

SEQ ID NO: 324806 - RNA, 60 nt, Homo Sapiens
uggaaaaaaaggcggcggacugucuuaaggcaggacgacugaaccgcucaccccaacaug

SEQ ID NO: 324807 - RNA, 60 nt, Homo Sapiens
ugaguagugucacugggccaaaagauagaucaggacgacagccuuuaguuuuccugaaau

SEQ ID NO: 324808 - RNA, 55 nt, Homo Sapiens
cagacguggaugaagaauagcucugcaggacgaaugccuuaguuuccacuuucca

SEQ ID NO: 324809 - RNA, 60 nt, Homo Sapiens
gcccugcuucucaguguggggcaggugucucaggacgaaggcgccgcgugaccacauggg

SEQ ID NO: 324810 - RNA, 60 nt, Homo Sapiens
aagaggacuuugggggacagaaauacucaccaggacgaggugacaagcaauccaggaaca

SEQ ID NO: 324811 - RNA, 60 nt, Homo Sapiens
gagugaggggagagcugcccggugcagacccaggacgagggcugcacuugguguggccgu

SEQ ID NO: 324812 - RNA, 60 nt, Homo Sapiens
auagggcuggagggcuauggcaagcaguagcaggacgaugagaagguauuuuuuaacucc

SEQ ID NO: 324813 - RNA, 64 nt, Homo Sapiens; identical to SEQ ID NO: 55647

SEQ ID NO: 324814 - RNA, 64 nt, Homo Sapiens; identical to SEQ ID NO: 55648

SEQ ID NO: 324815 - RNA, 64 nt, Homo Sapiens; identical to SEQ ID NO: 55649

SEQ ID NO: 324816 - RNA, 64 nt, Homo Sapiens; identical to SEQ ID NO: 55650

SEQ ID NO: 324817 - RNA, 64 nt, Homo Sapiens; identical to SEQ ID NO: 55651

SEQ ID NO: 324818 - RNA, 64 nt, Homo Sapiens; identical to SEQ ID NO: 55652

SEQ ID NO: 324819 - RNA, 64 nt, Homo Sapiens; identical to SEQ ID NO: 55653

SEQ ID NO: 324820 - RNA, 64 nt, Homo Sapiens; identical to SEQ ID NO: 55654

SEQ ID NO: 324821 - RNA, 64 nt, Homo Sapiens; identical to SEQ ID NO: 55655

SEQ ID NO: 324822 - RNA, 64 nt, Homo Sapiens; identical to SEQ ID NO: 55656

SEQ ID NO: 324823 - RNA, 64 nt, Homo Sapiens; identical to SEQ ID NO: 55657

SEQ ID NO: 324824 - RNA, 64 nt, Homo Sapiens; identical to SEQ ID NO: 55658

SEQ ID NO: 324825 - RNA, 64 nt, Homo Sapiens; identical to SEQ ID NO: 55659

SEQ ID NO: 324826 - RNA, 64 nt, Homo Sapiens; identical to SEQ ID NO: 55660

SEQ ID NO: 324827 - RNA, 64 nt, Homo Sapiens; identical to SEQ ID NO: 55661

SEQ ID NO: 324828 - RNA, 64 nt, Homo Sapiens; identical to SEQ ID NO: 55662

SEQ ID NO: 324829 - RNA, 64 nt, Homo Sapiens; identical to SEQ ID NO: 55663

SEQ ID NO: 324830 - RNA, 64 nt, Homo Sapiens; identical to SEQ ID NO: 55664

SEQ ID NO: 324831 - RNA, 64 nt, Homo Sapiens; identical to SEQ ID NO: 55665

SEQ ID NO: 324832 - RNA, 64 nt, Homo Sapiens; identical to SEQ ID NO: 55666

SEQ ID NO: 324833 - RNA, 64 nt, Homo Sapiens; identical to SEQ ID NO: 134178

SEQ ID NO: 324834 - RNA, 64 nt, Homo Sapiens; identical to SEQ ID NO: 134179

SEQ ID NO: 324835 - RNA, 64 nt, Homo Sapiens; identical to SEQ ID NO: 134180

SEQ ID NO: 324836 - RNA, 64 nt, Homo Sapiens; identical to SEQ ID NO: 134181

SEQ ID NO: 324837 - RNA, 64 nt, Homo Sapiens; identical to SEQ ID NO: 134182

SEQ ID NO: 324838 - RNA, 64 nt, Homo Sapiens; identical to SEQ ID NO: 134183

SEQ ID NO: 324839 - RNA, 64 nt, Homo Sapiens; identical to SEQ ID NO: 134184

SEQ ID NO: 324840 - RNA, 64 nt, Homo Sapiens; identical to SEQ ID NO: 134185

SEQ ID NO: 324841 - RNA, 64 nt, Homo Sapiens; identical to SEQ ID NO: 134186

SEQ ID NO: 324842 - RNA, 64 nt, Homo Sapiens; identical to SEQ ID NO: 134187

SEQ ID NO: 324843 - RNA, 64 nt, Homo Sapiens; identical to SEQ ID NO: 134188

SEQ ID NO: 324844 - RNA, 64 nt, Homo Sapiens; identical to SEQ ID NO: 134189

SEQ ID NO: 324845 - RNA, 64 nt, Homo Sapiens
cagucuccaucuccucaaaacuuggccuguccucacuggaaaaaucccuccugcugcgguuucu

SEQ ID NO: 324846 - RNA, 64 nt, Homo Sapiens
gucccccacccccaccacccagauuugagucagaacuggaaaguagcccccucugcauuuacac

SEQ ID NO: 324847 - RNA, 64 nt, Homo Sapiens
uucaguauaagcugaauaaauuuagagcuuucaaacuggaaaaaaaaaugaaacaaaacaaaua

SEQ ID NO: 324848 - RNA, 64 nt, Homo Sapiens
aucguguguccaggcaaacgcacacuagugucugacuggaaagcucaggaauuuuaaucuugca

SEQ ID NO: 324849 - RNA, 64 nt, Homo Sapiens
acaauuacaugauuugaaaacaguacucaaugagacuggaaauaccuuuuguaccuaaauguuu

SEQ ID NO: 324850 - RNA, 64 nt, Homo Sapiens
cuugaaauuaaacuaugaaauuaaaggcagaaaaacuggaaaaccuacugcagguccagagacu

SEQ ID NO: 324851 - RNA, 64 nt, Homo Sapiens
acugaaucaauacaaugcguagcaagcuguguacacuggaaaacauaaaggucaaacaucagug

SEQ ID NO: 324852 - RNA, 64 nt, Homo Sapiens
uccucucucgacauucucucucccgcauaucgucacuggaaacugcaaaauaccacauggcuuc

SEQ ID NO: 324853 - RNA, 64 nt, Homo Sapiens
auuuauucauugcagauacuaucugcagugcuucacuggaaauauagcagacuggugugugugg

SEQ ID NO: 324854 - RNA, 64 nt, Homo Sapiens
gugaagugccauuuguugaaaacauuucagggucacuggaaacacccaggccccacuuacguaa

SEQ ID NO: 324855 - RNA, 64 nt, Homo Sapiens
caauuccuaaaagcugaauggauaauaaaauuggacuggaaaguaaguagguggcugguccuca

SEQ ID NO: 324856 - RNA, 64 nt, Homo Sapiens
uggcuuauucaaccauagccccuccaacauaucuacuggaaauucugcugguuaacuuuaucuc

SEQ ID NO: 324857 - RNA, 64 nt, Homo Sapiens
uccagggcgggaggcaagcccccuugccuuucaaacuggaaaccccagagaaaacggugccccc

SEQ ID NO: 324858 - RNA, 64 nt, Homo Sapiens
guauaacucuaaacgcccaugauaguagcuucaaacuggaaauagcgaaauaaaauaacucagu

SEQ ID NO: 324859 - RNA, 64 nt, Homo Sapiens
uccuuaacccuuaacuguagauaagaaaauucauacuggaaagaaacccuacaaaugugaaguc

SEQ ID NO: 324860 - RNA, 64 nt, Homo Sapiens
auucucaacucuuacuacauguaagaguauuuauacuggaaagaaacccuacaaauguaaaaaa

SEQ ID NO: 324861 - RNA, 64 nt, Homo Sapiens
gaaguaaauguguuuauugaacccaugcugauagacuggaaauacuuuggauaacuguaaaggg

SEQ ID NO: 324862 - RNA, 64 nt, Homo Sapiens
guaaaaugauaacuuaccuugcuggcuauugagaacuggaaagaccaccccuugcucuuugagg

SEQ ID NO: 324863 - RNA, 64 nt, Homo Sapiens
uguaaaaaaaaaaaaaaaaaaaaagaaccaaaccacuggaaauaaucaaaugcaaaaagguaac

SEQ ID NO: 324864 - RNA, 64 nt, Homo Sapiens
aaauaaucaaaugcaaaaagguaacaaauucauaacuggaaagcaaagagaagaacaaguauga

SEQ ID NO: 324865 - RNA, 64 nt, Homo Sapiens
uucagaggccuaaaguuuaagcugaacuguguuuacuggaaaaacccauugacuuugccacaua

SEQ ID NO: 324866 - RNA, 64 nt, Homo Sapiens
aggaugacuauaugaugaggguaugagccaucagacuggaaaaaauaaaaagagggccaaggag

SEQ ID NO: 324867 - RNA, 64 nt, Homo Sapiens
uacccaauagcaugaggugaugcaauuguuuuuuacuggaaaguuuuuggaaaagaaaacaaag

SEQ ID NO: 324868 - RNA, 64 nt, Homo Sapiens
uguaauagcauacaucaaugcuuuguuaucuuccacuggaaaaggucuuuaaauuuuauauggg

SEQ ID NO: 324869 - RNA, 64 nt, Homo Sapiens
cuuaaccaauuauaauagcugauuuuaacuuacuacuggaaaucgcuauccauuccucuccuga

SEQ ID NO: 324870 - RNA, 64 nt, Homo Sapiens
aaagguguuaaguaccucuggcuuugauaacuaaacuggaaaacaagcauuuuguucacaccac

SEQ ID NO: 324871 - RNA, 64 nt, Homo Sapiens
gcugcaguuagcacuguuaucugagcaugaaagaacuggaaacgcuccuuacgucgagauguug

SEQ ID NO: 324872 - RNA, 64 nt, Homo Sapiens
ugugggcuggggcagaggucuuuuuucauuuaauacuggaaaaauauugaagagcauccauguu

SEQ ID NO: 324873 - RNA, 64 nt, Homo Sapiens
aacgcuugagaggcacuuuguaaagauuuguuaaacuggaaacguuuuacaugaucugauacaa

SEQ ID NO: 324874 - RNA, 64 nt, Homo Sapiens
aaugcuugagaggcacugaguaaagauuuguugaacuggaaauguuuuacaugauucuuaaacu

SEQ ID NO: 324875 - RNA, 64 nt, Homo Sapiens
gcaacauaccacauaacugaaaagcauugaacaaacuggaaaaucagaggcauccuugagcuuu

SEQ ID NO: 324876 - RNA, 64 nt, Homo Sapiens
caaauccacuuaaaagaucugcaacaaaugacccacuggaaagguccugcugucaucaacuugg

SEQ ID NO: 324877 - RNA, 64 nt, Homo Sapiens
acuugauuguacccguaaguaaauauuuuucccaacuggaaagcaaguauauuccuauuguacu

SEQ ID NO: 324878 - RNA, 64 nt, Homo Sapiens
aagaacuugcugcuguuuuagcuguggauauuuuacuggaaauuuccuuccguuuccagaaaga

SEQ ID NO: 324879 - RNA, 64 nt, Homo Sapiens
uguuccuugcucucuuggggaaauuuuuuaagcaacuggaaaagacauuuuucauuauaacuuu

SEQ ID NO: 324880 - RNA, 64 nt, Homo Sapiens
caugacuucccuccaccccugcaaagugcuagccacuggaaauggauacucgccaaggcagagc

SEQ ID NO: 324881 - RNA, 64 nt, Homo Sapiens
gauuuuuuuuuuuuuugcaaaggaaaaaauugauacuggaaaagauuguugugcauaguuauua

SEQ ID NO: 324882 - RNA, 64 nt, Homo Sapiens
aaagguaucuucuggaguuuuugggaggagagaaacuggaaaauuaaauuguauuuuugccaga

SEQ ID NO: 324883 - RNA, 58 nt, Homo Sapiens
uagcucuaggagcaccauccggguuuguccagcucaggcuuucuguucugucugccau

SEQ ID NO: 324884 - RNA, 58 nt, Homo Sapiens
aaugaaaacgucagccucugaagauacaccagcucacauaaaauuaaaaauaauuccg

SEQ ID NO: 324885 - RNA, 58 nt, Homo Sapiens
auggccugcugggcccaagugaggagugccagcucaaguuggaguugacugcucauac

SEQ ID NO: 324886 - RNA, 58 nt, Homo Sapiens
cggugccacugaggacccgugugacucgccagcucauucucaccaaucgcuccccaau

SEQ ID NO: 324887 - RNA, 58 nt, Homo Sapiens
gcaccuccacaacgaaugaagcauuuugccagcucagcugaagguguucuuagaauuc

SEQ ID NO: 324888 - RNA, 58 nt, Homo Sapiens
gucuuuuucagucaucccagauggggcaccagcucauguuuucccuccuugugugccc

SEQ ID NO: 324889 - RNA, 58 nt, Homo Sapiens
gauuggcugugaggucccuccgcaucacccagcucacgucccccaaaacgugcauggu

SEQ ID NO: 324890 - RNA, 58 nt, Homo Sapiens
gccauccucaggugggaggugucagagcccagcucaugcacaucagcugguggagcag

SEQ ID NO: 324891 - RNA, 58 nt, Homo Sapiens
cacaggccacaggcccuccaccucaccuccagcucaggggccgcaccccgccgcuggc

SEQ ID NO: 324892 - RNA, 58 nt, Homo Sapiens
ccagaugcagagcgaguggaugcacuucccagcucaucucuggaagccuuugcuacuc

SEQ ID NO: 324893 - RNA, 58 nt, Homo Sapiens
gagcugugcuucucucuccgguacgugcccagcucaggccggcugaccgugguggugc

SEQ ID NO: 324894 - RNA, 58 nt, Homo Sapiens
uugcccucccagagcccuacgugaagguccagcucaugcugaaccagaggaaguggaa

SEQ ID NO: 324895 - RNA, 58 nt, Homo Sapiens
cagccccaggccagagaggccucccgguccagcucagggaugcuccugccagcacagg

SEQ ID NO: 324896 - RNA, 58 nt, Homo Sapiens
ggcacauagugagcccgggcagcccugcccagcucaggccccuuuccuuccccauuga

SEQ ID NO: 324897 - RNA, 58 nt, Homo Sapiens
gcugguuuucuacccaacggcccugcagccagcucacguccagguucaacccacagcu

SEQ ID NO: 324898 - RNA, 58 nt, Homo Sapiens
uuuaaagagacuccaaaucucaaugaagccagcucacagugcugugugccccggucac

SEQ ID NO: 324899 - RNA, 58 nt, Homo Sapiens
aagggagccgagacccuggauggggcuuccagcucagaacccaucccucuggugggua

SEQ ID NO: 324900 - RNA, 58 nt, Homo Sapiens
cccuuugggcggccucugggcuugggcaccagcucaugccagccccagagggucaggg

SEQ ID NO: 324901 - RNA, 58 nt, Homo Sapiens
uuguucacagauuuggaaugucccacugccagcucagggugugugugagagagagccc

SEQ ID NO: 324902 - RNA, 58 nt, Homo Sapiens
uuugaucuacaccucuugcccuuuugucccagcucagcccagagaggcucaaagcagc

SEQ ID NO: 324903 - RNA, 58 nt, Homo Sapiens
uaaaaccugcaauucugcaucaguguuaccagcucaacgggaaaaaagaaagugguac

SEQ ID NO: 324904 - RNA, 58 nt, Homo Sapiens
guaaaggagaauguugcuaagagucuacccagcucaaggacaguaggacauuguggcu

SEQ ID NO: 324905 - RNA, 58 nt, Homo Sapiens
gcuuccuccaggguuccccagccaccucccagcucagggcacaguguaucgacaaucu

SEQ ID NO: 324906 - RNA, 58 nt, Homo Sapiens
gaggacaccuccccaucacucagcauucccagcucagggcacaggcaggcuggggucc

SEQ ID NO: 324907 - RNA, 58 nt, Homo Sapiens
ucgaauuauauauccauauaucucagucccagcucagaaguugcaauugcuauuuucu

SEQ ID NO: 324908 - RNA, 58 nt, Homo Sapiens
accacgggggucugugccgggccgggguccagcucagaacccacgggggcuccucccu

SEQ ID NO: 324909 - RNA, 58 nt, Homo Sapiens
ccuccacagagcccccuugcugggacagccagcucaccuccaaggacauccccuccug

SEQ ID NO: 324910 - RNA, 58 nt, Homo Sapiens
caggcacuguagggucacccauaugccuccagcucaguugacgcuuaaaaacaggugc

SEQ ID NO: 324911 - RNA, 58 nt, Homo Sapiens
cuuauggggaaggcucugacacuccaccccagcucaggccaugggcagcagggcucca

SEQ ID NO: 324912 - RNA, 58 nt, Homo Sapiens
ugcaauuggguguugccucaguuuccucccagcucaguuuuauuagaucaaagcuguu

SEQ ID NO: 324913 - RNA, 58 nt, Homo Sapiens
caauauuaaugaaguagguuuaaagaagccagcucaagaacauuagagaaaauguuuu

SEQ ID NO: 324914 - RNA, 58 nt, Homo Sapiens
acagcaugagaacagcaguuuacucaugccagcucauuguggagccauguggcacaaa

SEQ ID NO: 324915 - RNA, 58 nt, Homo Sapiens
ggguggucacagcaugugucgggaaaggccagcucagaucugaugguggugagaccag

SEQ ID NO: 324916 - RNA, 58 nt, Homo Sapiens
cagggguggagccuggccugcgcccuucccagcucaucgggugggguggggguacuga

SEQ ID NO: 324917 - RNA, 58 nt, Homo Sapiens
cugggauuacaggugggugucaccacacccagcucaguauuguauuuuuagcagagau

SEQ ID NO: 324918 - RNA, 58 nt, Homo Sapiens
uccccaagagugaugcccggcagcauucccagcucagggcuaaugguucacggaagcc

SEQ ID NO: 324919 - RNA, 58 nt, Homo Sapiens
auggcagcagugcggaggccuagaaacaccagcucagcugcaugggacaggcccugcc

SEQ ID NO: 324920 - RNA, 58 nt, Homo Sapiens
ccagaagcugacuuuggccgggugcugcccagcucaagucuccccucccccaccaccc

SEQ ID NO: 324921 - RNA, 58 nt, Homo Sapiens
gaggcagaggaguugcucagcucucagaccagcucacuacggcguguguuggucccau

SEQ ID NO: 324922 - RNA, 58 nt, Homo Sapiens
cuccccaguuuaccacuuugagucagucccagcucauccggaugaacuucagcacccg

SEQ ID NO: 324923 - RNA, 64 nt, Homo Sapiens
ccccuggaagcagcauugugugauauucucagaggcaggggaaaauagagggaaaaauagagac

SEQ ID NO: 324924 - RNA, 64 nt, Homo Sapiens
cagggccacaggguugcuuucugucuuugguggggcaggggaguugacagggaugaggguccaa

SEQ ID NO: 324925 - RNA, 64 nt, Homo Sapiens
gacgccaaucacugucacaggggccugcgcagcugcaggggacauggcacaccagcucagacag

SEQ ID NO: 324926 - RNA, 64 nt, Homo Sapiens
gcaggaugccggguggaggaggcauucccagaaugcaggggagaccucucaguguguccaggau

SEQ ID NO: 324927 - RNA, 64 nt, Homo Sapiens
gggcaaugguggagguggcgucaggggccagagugcaggggaggaagagugggaacaggugggg

SEQ ID NO: 324928 - RNA, 64 nt, Homo Sapiens
aaggcugccaggagcugaggcugagccugguucugcaggggaggggaggcuaccuguggaaugg

SEQ ID NO: 324929 - RNA, 64 nt, Homo Sapiens
cucacagaaaaaucugcccauccugauguggcaggcaggggagaccacagggcaccagggauga

SEQ ID NO: 324930 - RNA, 64 nt, Homo Sapiens
gagcagugauuuggggugaguucagcaguggacugcaggggaaaucggugccugucaacugcuu

SEQ ID NO: 324931 - RNA, 64 nt, Homo Sapiens
uuggcacccaaggaguucugccuacuaaauuauagcaggggacucagacaaccuuugaauugug

SEQ ID NO: 324932 - RNA, 64 nt, Homo Sapiens
aggcaauucugaaugaaugaggggaagggagggggcaggggaggaacugguuaggaaagcccag

SEQ ID NO: 324933 - RNA, 64 nt, Homo Sapiens
ccuguggagggcauuucccgaagaggcugugggugcaggggacacucgugguggugcaggggac

SEQ ID NO: 324934 - RNA, 64 nt, Homo Sapiens
agaggcugugggugcaggggaggcucgugguggugcaggggacaccggacacauuucacaccuc

SEQ ID NO: 324935 - RNA, 64 nt, Homo Sapiens
gacggaaggcuggcaccucucccuagcggggagggcaggggaggccuucaagaggcgccauaga

SEQ ID NO: 324936 - RNA, 64 nt, Homo Sapiens
gugaccugaggaggcucggcuggaaggggaggaagcaggggaagccgagggccaguuucagguc

SEQ ID NO: 324937 - RNA, 64 nt, Homo Sapiens
ccagacuggucucaggagcgggccuucauaaaaugcaggggaagaguucuuccuuccccaucug

SEQ ID NO: 324938 - RNA, 64 nt, Homo Sapiens
cugcaguggggucgggaaguaggcacagggcagugcaggggacugacaggcacaggcugggcag

SEQ ID NO: 324939 - RNA, 64 nt, Homo Sapiens
uauucuucuguccaucuuuggccugcuggugccagcaggggacacagacugcaaagagaagcac

SEQ ID NO: 324940 - RNA, 64 nt, Homo Sapiens
acagccucauccuguauaguuuaaugaugaaugugcaggggaccugucucaggcuccuauaugg

SEQ ID NO: 324941 - RNA, 64 nt, Homo Sapiens
gccgugcagagccugggcuccggcagggagaggugcaggggagucaccgcccagaccuccccag

SEQ ID NO: 324942 - RNA, 64 nt, Homo Sapiens
gcagacaucugccaugucccugagacugcgggaggcaggggaugcauggguguccccaucuguc

SEQ ID NO: 324943 - RNA, 64 nt, Homo Sapiens
cccaggcugcacagcaggcagggagggaggcaaggcaggggaguggggccugagcugagcacug

SEQ ID NO: 324944 - RNA, 64 nt, Homo Sapiens
cugagggagccaggaggccggggggccgggggcugcaggggaggcuguggggguccuggcagcc

SEQ ID NO: 324945 - RNA, 64 nt, Homo Sapiens
aaggcagggucguaucuguggggaccugacaagggcaggggaagcggagaccagggugcaggcu

SEQ ID NO: 324946 - RNA, 64 nt, Homo Sapiens
aauuccagcagucccugaucuuccccugacauaugcaggggauuaguuuauuucaaauacaguu

SEQ ID NO: 324947 - RNA, 64 nt, Homo Sapiens
ggcucgaacacaggagacggcucuggaggcugaggcaggggaaucgcaccuguagucccagcua

SEQ ID NO: 324948 - RNA, 64 nt, Homo Sapiens
gagggacaauuuuauaaugacccacaaggucacagcaggggaggagugccuagguuucucauac

SEQ ID NO: 324949 - RNA, 59 nt, Homo Sapiens
ugugugccccgcaccccccagggcugugggcaggggaccuggagcaccgagacuccuga

SEQ ID NO: 324950 - RNA, 64 nt, Homo Sapiens
ggcuucccaaggucucacagaccugagucucagagcaggggagucucuguuuuccaggggagaa

SEQ ID NO: 324951 - RNA, 64 nt, Homo Sapiens
gaagccgggcgaaguggcccgacagagaccaagagcaggggauaacagaaauccagagugggga

SEQ ID NO: 324952 - RNA, 64 nt, Homo Sapiens
cggucacaggagcucuucugacgcgaggcuguuugcaggggacagccucugugcugcugggguc

SEQ ID NO: 324953 - RNA, 64 nt, Homo Sapiens
acuuggggcagcccccagaauggacucccagacugcaggggagcgccagguggcagcuugagca

SEQ ID NO: 324954 - RNA, 64 nt, Homo Sapiens
gguuaaugcagauggcaaguuguagcugagcacagcaggggaggguuagugacuuuggcauuuc

SEQ ID NO: 324955 - RNA, 64 nt, Homo Sapiens
ugagccauacacaggccacggaccagugcagccagcaggggaggugccauacccacugacccca

SEQ ID NO: 324956 - RNA, 62 nt, Homo Sapiens
ucugcccuuccucacccccacgccccaccccacucccccagaguacuccccacugugaaaag

SEQ ID NO: 324957 - RNA, 62 nt, Homo Sapiens
gaggcauugucacccuagaccccucuuccucucucccccaccauagugugcaauaaaguguc

SEQ ID NO: 324958 - RNA, 62 nt, Homo Sapiens
gugucuaaagacuugguguccccuucucucuccucccccacccgccacuccuggguacaucu

SEQ ID NO: 324959 - RNA, 62 nt, Homo Sapiens
uugcaguaauuuauuuucuguauggacugucccucccccagaggcuuccccacccuccauug

SEQ ID NO: 324960 - RNA, 62 nt, Homo Sapiens
ccagccacugugggaccaacaccccucccacacucccccagacugcucgucuaucaccagga

SEQ ID NO: 324961 - RNA, 62 nt, Homo Sapiens
cccagcccugccccucaccugccugcccuccccucccccacucuauacuagggacuggaucu

SEQ ID NO: 324962 - RNA, 62 nt, Homo Sapiens
auugugcaauagucagaguggucccuggggcacucccccaggcacacacacuccuuccccuu

SEQ ID NO: 324963 - RNA, 62 nt, Homo Sapiens
ucucucugccugcugggcucucuguccaaccccucccccacgcccuuccucaucugugccug

SEQ ID NO: 324964 - RNA, 62 nt, Homo Sapiens
uagauacacuacuguauuagauacucccccaccucccccauuuaacuaauauuaggcaguug

SEQ ID NO: 324965 - RNA, 62 nt, Homo Sapiens
ucccccauuuagauacacuaaggcaguugauacucccccaccaaaauucaguaacuaauauu

SEQ ID NO: 324966 - RNA, 62 nt, Homo Sapiens
ggcccccucuaaggagggugaaaacucacugccucccccaagauuccugggcucccagccuu

SEQ ID NO: 324967 - RNA, 62 nt, Homo Sapiens
agugggccuguucuacccguguuuguacuugccucccccaacacaggccuucuguacccagc

SEQ ID NO: 324968 - RNA, 62 nt, Homo Sapiens
uuuagcagaugugguuucaaaguaaaggccuccucccccaccccuuaggccccguggugaca

SEQ ID NO: 324969 - RNA, 62 nt, Homo Sapiens
ucagcuucccagccaugcccaggacguccuaucucccccaacccaccucuggcccuguguag

SEQ ID NO: 324970 - RNA, 62 nt, Homo Sapiens
cgccacacucagugccauggggaagcgggcgucucccccaccagccccaccaggcgguguag

SEQ ID NO: 324971 - RNA, 62 nt, Homo Sapiens
agacuucugccuuaaccagccccggggcuuggcucccccagcucugagcgugggggcauagg

SEQ ID NO: 324972 - RNA, 62 nt, Homo Sapiens
gggaugucaaguggugaugucguugugcuccccucccccagagcgggugggcggggggugaa

SEQ ID NO: 324973 - RNA, 62 nt, Homo Sapiens
ucccgggucccuucugucggugcccaccucuucucccccaccaguguguuuccuuucguguc

SEQ ID NO: 324974 - RNA, 62 nt, Homo Sapiens
gccucgcugcccccgcccaguuauuuuauccccucccccaccaauuauuauaauuauuauaa

SEQ ID NO: 324975 - RNA, 62 nt, Homo Sapiens
agcgcucccucagcucucucacccccaccgcgcucccccagggagcccccaucccuuaucuu

SEQ ID NO: 324976 - RNA, 62 nt, Homo Sapiens
uggccccuugacccgggcggcgccugcccgcccucccccacgaguuauugaccucccggucc

SEQ ID NO: 324977 - RNA, 62 nt, Homo Sapiens
ccggagguacaguuuuuccaggugcuuaagcccucccccacugugccacccuugugaccuuc

SEQ ID NO: 324978 - RNA, 62 nt, Homo Sapiens
uucagaaaggcacaauguggagccuggggugucucccccaccccaggaccgucagguuuacc

SEQ ID NO: 324979 - RNA, 62 nt, Homo Sapiens; identical to SEQ ID NO: 113690

SEQ ID NO: 324980 - RNA, 62 nt, Homo Sapiens
aucuguuggccaccugcaggccagucucaacccucccccaggugggcaggcacuugauggcu

SEQ ID NO: 324981 - RNA, 59 nt, Homo Sapiens; identical to SEQ ID NO: 113692

SEQ ID NO: 324982 - RNA, 62 nt, Homo Sapiens
aggccugaaacauuucuuuucuuucuuuuuuccucccccaauuuacccugggccuggagcag

SEQ ID NO: 324983 - RNA, 62 nt, Homo Sapiens
ccacccuccuccacagguccaggugccgcucccucccccaccacacaucagugucuccuccc

SEQ ID NO: 324984 - RNA, 62 nt, Homo Sapiens
agugggaggguugguugccccucaccucagagcucccccaaaggccaguaauggauccccgg

SEQ ID NO: 324985 - RNA, 62 nt, Homo Sapiens
uggaugcacguucacuacugugacggccgcaccucccccaugcaccccacccucccccaaag

SEQ ID NO: 324986 - RNA, 62 nt, Homo Sapiens
gugacggccgcaccucccccaugcaccccacccucccccaaagcccggaucccgagaaagau

SEQ ID NO: 324987 - RNA, 62 nt, Homo Sapiens
ccagagcggggugagggggcuuaugccccccccucccccaguguguugggugggguggaauu

SEQ ID NO: 324988 - RNA, 62 nt, Homo Sapiens
ggggaacuuacucuaggaaaagccaugucucucucccccaggguggggggaccuguguugga

SEQ ID NO: 324989 - RNA, 62 nt, Homo Sapiens
gagaccccucccuuccagaauccaggccccaucucccccaacuccacagccccucccgagcc

SEQ ID NO: 324990 - RNA, 62 nt, Homo Sapiens
uccccccaaccaccagcagcagcagggcccuccucccccaccagcucuccccacagggcccc

SEQ ID NO: 324991 - RNA, 62 nt, Homo Sapiens
caagcugcuaagccaaagauggccccugacaccucccccagccccagcacaccagccugcac

SEQ ID NO: 324992 - RNA, 62 nt, Homo Sapiens
cgggggcuggggguaagagaaaucuaacugcgcucccccaaccccucgcccugccaucuucc

SEQ ID NO: 324993 - RNA, 62 nt, Homo Sapiens
ccggcagcucagggaguguuuuccugugaggccucccccaucaguggaccagagggagaagc

SEQ ID NO: 324994 - RNA, 62 nt, Homo Sapiens
cgucuucuuccucugucccauagccagaucaacucccccaccggcacuguccagcucugggc

SEQ ID NO: 324995 - RNA, 62 nt, Homo Sapiens
cccucacuggcccaucccucugauuuuuuuuucucccccaucaggcuuuggugguaauccug

SEQ ID NO: 324996 - RNA, 62 nt, Homo Sapiens
agcacuccagucccaucaccugaaccuucagucucccccaucuguuacacuagagggcugca

SEQ ID NO: 324997 - RNA, 62 nt, Homo Sapiens
auccccagcacccccugcuacaccucagcagccucccccaugcaaaaaggaaagagaaaaau

SEQ ID NO: 324998 - RNA, 62 nt, Homo Sapiens
aggguggcaggucacugucacugccgacaucccucccccagcagaauggaggcaggggacaa

SEQ ID NO: 324999 - RNA, 62 nt, Homo Sapiens
acacaucugggugcccugaaagggcccuuccccucccccacuccucuaagacaaaguagauu

SEQ ID NO: 325000 - RNA, 62 nt, Homo Sapiens
caccacggggucgggggaggagcacccccagccucccccaggcugcgccugcccgcccgccg

SEQ ID NO: 325001 - RNA, 62 nt, Homo Sapiens
ccuugaccccacacgccggggcuggcccugcccucccccacggccgucccugacuucccagc

SEQ ID NO: 325002 - RNA, 62 nt, Homo Sapiens
ggguguccguucuuaauuccaaaacacagccucucccccaaaacuuuuuuaaaggggauuaa

SEQ ID NO: 325003 - RNA, 62 nt, Homo Sapiens
augacacccaccgucgucagcccggcaccucacucccccaaagggaggagcagcuguguguc

SEQ ID NO: 325004 - RNA, 62 nt, Homo Sapiens
cacaacuccuggccuucgaccuaccccauuaccucccccagcaagugcucuuggggguggcu

SEQ ID NO: 325005 - RNA, 62 nt, Homo Sapiens
ccccuccuugccaggggcacagacuucccugacucccccacuugcagccacucuggcuccca

SEQ ID NO: 325006 - RNA, 62 nt, Homo Sapiens
caccccaacuugugacugcucacuuaugacgucucccccaguacccuccaucucaaauaggc

SEQ ID NO: 325007 - RNA, 62 nt, Homo Sapiens
ccccuauuuuuuccaagcacgaagccaccagucucccccagggagcaucaggaagggacaug

SEQ ID NO: 325008 - RNA, 62 nt, Homo Sapiens
cagauaaguggcucuuacccagcucucagugacucccccacaaaacagcaacagccuccacc

SEQ ID NO: 325009 - RNA, 62 nt, Homo Sapiens
gcugcuggagcaggcaccuugggcugggccugcucccccagggcccagggccccccagcuua

SEQ ID NO: 325010 - RNA, 62 nt, Homo Sapiens
ucuguguccuuuauuguagcgggcucccccaccucccccauuuugacuuuguuauaaaaaua

SEQ ID NO: 325011 - RNA, 62 nt, Homo Sapiens
ucccccauuucuguguccuuauaaaaauagggcucccccacccagaucuguuugacuuuguu

SEQ ID NO: 325012 - RNA, 62 nt, Homo Sapiens
guugucucaugccaguaacagugacauacccccucccccaccgagcuuugacucaggagccu

SEQ ID NO: 325013 - RNA, 62 nt, Homo Sapiens
agcuggacccugaccagcucucccucacucgucucccccaaccacccccgucaagagugaau

SEQ ID NO: 325014 - RNA, 62 nt, Homo Sapiens
gaucuucuauuuaaguggcugcaggauaucuucucccccaggacacucuguaaggaccuggg

SEQ ID NO: 325015 - RNA, 62 nt, Homo Sapiens
aguuccaggagaacucagccgugugagucaugcucccccaggcucacagcccccugucucca

SEQ ID NO: 325016 - RNA, 62 nt, Homo Sapiens
ggaauccugguccccagcaggagagccuaguccucccccagccccuccagccaccagggugu

SEQ ID NO: 325017 - RNA, 62 nt, Homo Sapiens
cauuuugaaaguguuuuucucauucuccauaccucccccaagcucuccuccagcccuuccca

SEQ ID NO: 325018 - RNA, 62 nt, Homo Sapiens
gaggggaccccuugggcccucuggggcuuccccucccccaccugguugggguagagcaaaag

SEQ ID NO: 325019 - RNA, 62 nt, Homo Sapiens
ucuuccgaggucucccugaaaugaauguauuucucccccaaaagagcugauauuuaauguuu

SEQ ID NO: 325020 - RNA, 62 nt, Homo Sapiens
cuccgacccgaggcagaauacuggaggucucgcucccccagccucccccagccgcacgggca

SEQ ID NO: 325021 - RNA, 62 nt, Homo Sapiens
cgcacgggcacuggaggucuccccuccacccucucccccagcugacuccuacaucuaagugg

SEQ ID NO: 325022 - RNA, 62 nt, Homo Sapiens
cccuucugcuccugucuccugacaggucaggucucccccagcaucuggggggagagaggaag

SEQ ID NO: 325023 - RNA, 62 nt, Homo Sapiens
ccucccaauuccuauggagcccaggacugccccucccccacugguugguuccauuucggcca

SEQ ID NO: 325024 - RNA, 62 nt, Homo Sapiens
uugaugucaucagcaccauccaucaggacuggcucccccaucugcuccaagggagcgugguc

SEQ ID NO: 325025 - RNA, 62 nt, Homo Sapiens
gggaagggucagagaugccagcccccugggaccucccccauccuuuuugccuccaaguuucu

SEQ ID NO: 325026 - RNA, 62 nt, Homo Sapiens
uuuaaauuuuaacuuauaucagucacuugccacucccccacccuccuguccacaacuccuuu

SEQ ID NO: 325027 - RNA, 62 nt, Homo Sapiens
uaaaaaacuuucuccucuuuguccuccuuuuucucccccacucugagguuuccccaagagaa

SEQ ID NO: 325028 - RNA, 62 nt, Homo Sapiens
uugauguuaagguggagagguaaauucuccuccucccccauucucuuagggacccagacccc

SEQ ID NO: 325029 - RNA, 62 nt, Homo Sapiens
gcuaaccugggaggugcugacccagcccucaccucccccagacuuguugcccuagaguggga

SEQ ID NO: 325030 - RNA, 62 nt, Homo Sapiens
gaaagagccgcccucccuuccccaaggauccacucccccagcuccuuuagagaauggcuacu

SEQ ID NO: 325031 - RNA, 62 nt, Homo Sapiens
aucccaacauuugacaccccagcaaugugugacucccccaacauuccacuaugccauccugc

SEQ ID NO: 325032 - RNA, 62 nt, Homo Sapiens
gaaggacaugucccacuccaucccccuuccugcucccccauuuccuaacucccccaguguga

SEQ ID NO: 325033 - RNA, 62 nt, Homo Sapiens
uccaucccccuuccugcucccccauuuccuaacucccccagugugaauucucagggucacuu

SEQ ID NO: 325034 - RNA, 62 nt, Homo Sapiens
gaagugggcccuucccugggucucugcacugacucccccacuccugacccuggugauggucg

SEQ ID NO: 325035 - RNA, 62 nt, Homo Sapiens
ccagguccugugaggaagccuggagcaagggucucccccagcaggauggguggggccugcuc

SEQ ID NO: 325036 - RNA, 62 nt, Homo Sapiens
uccaugggcagggagcuggggggacaucucaccucccccauggcacagagcccuccacaccc

SEQ ID NO: 325037 - RNA, 62 nt, Homo Sapiens
ggccccuuuuauuuuuaccugccacccagcaucucccccaccugccccuucugggugacaca

SEQ ID NO: 325038 - RNA, 62 nt, Homo Sapiens
agacggccccucucuucccagcacuucccugccucccccaggccucaggcccagcacccagu

SEQ ID NO: 325039 - RNA, 62 nt, Homo Sapiens
gcucccgccugugccccuucuccucaccaugucucccccacccugccucaguucuccguucc

SEQ ID NO: 325040 - RNA, 62 nt, Homo Sapiens
cauccucauccuguaccuauagaguucgugcacucccccauccaugcuaccuaccuccccgu

SEQ ID NO: 325041 - RNA, 62 nt, Homo Sapiens
ucucagccccuuaggacgcgggucuccuugggcucccccaaggguucugcgaagaggcagug

SEQ ID NO: 325042 - RNA, 62 nt, Homo Sapiens
acuacugacguccucccugaucccacccccuccucccccaguguccccuuucuuccuauuua

SEQ ID NO: 325043 - RNA, 62 nt, Homo Sapiens
cuuggcuuucagagccagccuggcucugcccccucccccaugggcuguguccuaaggcccau

SEQ ID NO: 325044 - RNA, 62 nt, Homo Sapiens
cagcagcaagugacccuucuccggccugcagccucccccaggguggaagccguggggucccu

SEQ ID NO: 325045 - RNA, 62 nt, Homo Sapiens
caaauguccccacuaccccagggaucccccagcucccccagccccuggcuuccugacccugc

SEQ ID NO: 325046 - RNA, 62 nt, Homo Sapiens
ugguauguaagugucuugaaacccuccucucccucccccagcucauuuuccaaaccucuugu

SEQ ID NO: 325047 - RNA, 62 nt, Homo Sapiens
ccucagccguuccuccaccuagagaagggccucucccccaacccgaggagucugcccugccu

SEQ ID NO: 325048 - RNA, 62 nt, Homo Sapiens
aagcggggucucaagccacaccugccccacuucucccccacagacccucguacccaaaggcc

SEQ ID NO: 325049 - RNA, 62 nt, Homo Sapiens
cucagauccuccucuuaugcgugccaaccucccucccccaaguaauacagcugcuuuucucg

SEQ ID NO: 325050 - RNA, 62 nt, Homo Sapiens
acccuccccuggcccucugaaaaccacucugucucccccacacuuccccuccuccccuauuu

SEQ ID NO: 325051 - RNA, 62 nt, Homo Sapiens
accgaacuuccccuccucccauaccugccucccucccccauccccccugagccuucuuguaa

SEQ ID NO: 325052 - RNA, 62 nt, Homo Sapiens
uucuuucuuucuuuaaaaaaugccccccuggccucccccacucucccccauguucugucccu

SEQ ID NO: 325053 - RNA, 62 nt, Homo Sapiens
uucugucccuugccccccugccaccuuuguuucucccccauggagcuccccuccccaacuga

SEQ ID NO: 325054 - RNA, 61 nt, Homo Sapiens; identical to SEQ ID NO: 113765

SEQ ID NO: 325055 - RNA, 62 nt, Homo Sapiens
ucuuuuguacugccccccgcucauuaaacagccucccccagcccugagugcacugauguccg

SEQ ID NO: 325056 - RNA, 62 nt, Homo Sapiens
auuccccagccacuucccuuccgcacuuaccacucccccagccacgccccuccccgcugacc

SEQ ID NO: 325057 - RNA, 62 nt, Homo Sapiens
ucaccucugucuaguuacagaacgguuucuuucucccccaaagaaaccccaucgccaucagc

SEQ ID NO: 325058 - RNA, 62 nt, Homo Sapiens
gaaaccccaucgccaucagcacucacuccccacucccccagccccuggcaaccacaaaucuu

SEQ ID NO: 325059 - RNA, 62 nt, Homo Sapiens
gggguucucucacccucuuucucuuuccuucccucccccauucuccagaucucccucugucu

SEQ ID NO: 325060 - RNA, 62 nt, Homo Sapiens
gccccugucucucuccauguuggggguccuaacucccccaccccauaucuacguguccuccg

SEQ ID NO: 325061 - RNA, 62 nt, Homo Sapiens
gucccgggaccugcugggagggacaagaggcccucccccaggcagaagagcaugcccuuugc

SEQ ID NO: 325062 - RNA, 62 nt, Homo Sapiens
ccucuucccucgcccaccugccugcccccauacucccccagcggagagcaugauccgugccc

SEQ ID NO: 325063 - RNA, 62 nt, Homo Sapiens
gcugcaggugccgccaggacgggguucagcggcucccccagucucccccagcgcugaagcac

SEQ ID NO: 325064 - RNA, 62 nt, Homo Sapiens
gcugaagcacgggguucagcggggcccagcggcucccccagccaugguuuguggcggaagac

SEQ ID NO: 325065 - RNA, 62 nt, Homo Sapiens
cagauacggaauaaaacuacucggagaccacccucccccagcccacccucacuccauccacc

SEQ ID NO: 325066 - RNA, 62 nt, Homo Sapiens
gcucgggaugucuccagcagccacaccucugucucccccaggggaagaugaagcccaaacac

SEQ ID NO: 325067 - RNA, 62 nt, Homo Sapiens
guggggucuguguagccuucugggugcccccacucccccaucgcccccucuccccccgcaug

SEQ ID NO: 325068 - RNA, 62 nt, Homo Sapiens
accgacacccuccucggccugacccccgcugccucccccaacgcccgccgcccacccccacu

SEQ ID NO: 325069 - RNA, 62 nt, Homo Sapiens
ccccuccccaucaauaaaacucuggaguuugccucccccagcuggcuggguccucugcccuc

SEQ ID NO: 325070 - RNA, 62 nt, Homo Sapiens
ccuggaaaggucccuccccacagaccuaagcccucccccaccggaauggggggccacagcug

SEQ ID NO: 325071 - RNA, 62 nt, Homo Sapiens
ccucccgguguuguuauuaaguccagcucucucucccccaccuauggcgcccccaucugacu

SEQ ID NO: 325072 - RNA, 62 nt, Homo Sapiens
aggacugggccuccccggcaccagcccugagccucccccacccacacagcugagggagaggc

SEQ ID NO: 325073 - RNA, 62 nt, Homo Sapiens
uucucauuugugcuuuuuucuguccaucaccucucccccacuccuccagcuuagcugucagc

SEQ ID NO: 325074 - RNA, 62 nt, Homo Sapiens
cugggcgccccuccuccagcaccagcuuccgccucccccaucgcugccuguuuuacucaccc

SEQ ID NO: 325075 - RNA, 62 nt, Homo Sapiens
ucaucaucagucgcugucuccacuacccuucucucccccagcaacaucccagacccguuacc

SEQ ID NO: 325076 - RNA, 62 nt, Homo Sapiens
cgcccuccacuaccucugagcagacauuccagcucccccacuacauuuugaaccugcaacuu

SEQ ID NO: 325077 - RNA, 62 nt, Homo Sapiens
gcggacgaucgcaucuugugucgcugaagcgccucccccagggaccggcggaccccagccau

SEQ ID NO: 325078 - RNA, 62 nt, Homo Sapiens
agggggcaagaggaauuacgugcucugugggucucccccaacgcgccucgccggaucugagg

SEQ ID NO: 325079 - RNA, 62 nt, Homo Sapiens
cucccgggccuguccccaacuccuccccaccccucccccaucuccucuuugaaagccagaac

SEQ ID NO: 325080 - RNA, 62 nt, Homo Sapiens
gugcagacccugccaugcagacccaugccccccucccccaggcagcuccaagaaagcucccu

SEQ ID NO: 325081 - RNA, 62 nt, Homo Sapiens
cagggaaacagggccagcacagaggggccuuccucccccacagagcccccaugacauagucu

SEQ ID NO: 325082 - RNA, 62 nt, Homo Sapiens
ccccacacccaugcagaacuccuguccggugccucccccaacugcccccaguguccucugau

SEQ ID NO: 325083 - RNA, 62 nt, Homo Sapiens
aguauggccccaccugcucugccugcucuuuccucccccacccccccgccagguguggcccc

SEQ ID NO: 325084 - RNA, 62 nt, Homo Sapiens
aaagaugcagguuuauauggaacccccacccccucccccacucucccacucuguucguucug

SEQ ID NO: 325085 - RNA, 62 nt, Homo Sapiens
augucuucacgagcgugcaucagggcgccuggcucccccaccucagccagugagucagacac

SEQ ID NO: 325086 - RNA, 62 nt, Homo Sapiens
ggggcaggcucuuugucuuggggaccaggaugcucccccaguccuucccagaugauggcugc

SEQ ID NO: 325087 - RNA, 62 nt, Homo Sapiens
ccagaugauggcugccugugggaccccagcuacucccccagacccaaguucugcagaacuaa

SEQ ID NO: 325088 - RNA, 62 nt, Homo Sapiens
uccuggccccgggcuguggcgagacagcccaacucccccagcccagcucccccagcccagag

SEQ ID NO: 325089 - RNA, 62 nt, Homo Sapiens
uguggcgagacagcccaacucccccagcccagcucccccagcccagagccagggaagaggaa

SEQ ID NO: 325090 - RNA, 62 nt, Homo Sapiens
uccugggccucucugaccuccacugggccugccucccccaccagaccaggagagggccaccu

SEQ ID NO: 325091 - RNA, 62 nt, Homo Sapiens
ucucccugaguucucccaccuuccucccucugcucccccaugcccgggcuguugggcucugc

SEQ ID NO: 325092 - RNA, 62 nt, Homo Sapiens
gaauguaccugcacucaaacuccugaggugcccucccccaaaggaaggguauaaaugcaugu

SEQ ID NO: 325093 - RNA, 62 nt, Homo Sapiens
agugucugcucaggccugacugaacuuucucucucccccagcccgugcuugguggggggaug

SEQ ID NO: 325094 - RNA, 62 nt, Homo Sapiens
gacugacugagggggccugaagcuacaugcaccucccccacugcugcccuccugucgagaau

SEQ ID NO: 325095 - RNA, 62 nt, Homo Sapiens
ggcgaagguucugauggcugccuugcuccuugcucccccacccccugugaggacuucucuag

SEQ ID NO: 325096 - RNA, 62 nt, Homo Sapiens
ccaaguguuuauuuuugauaucuuccugccgccucccccacuggaagggauuugggggggaa

SEQ ID NO: 325097 - RNA, 62 nt, Homo Sapiens
uccccacuuuuuuccccaagugguuaggacaucucccccaccccugaccuaaccuuuuaggg

SEQ ID NO: 325098 - RNA, 62 nt, Homo Sapiens
cuuguuccaguuguuaguuacacauccacagucucccccaccuggggcuaggucauuaaggc

SEQ ID NO: 325099 - RNA, 62 nt, Homo Sapiens
cccaaccacguugggacaggagcuccccccaccucccccacugccccgucuacagcuccccc

SEQ ID NO: 325100 - RNA, 62 nt, Homo Sapiens
uccccccaccucccccacucccccgucuacagcucccccagccguuuucggugccaucagug

SEQ ID NO: 325101 - RNA, 64 nt, Homo Sapiens; identical to SEQ ID NO: 110167

SEQ ID NO: 325102 - RNA, 64 nt, Homo Sapiens; identical to SEQ ID NO: 110168

SEQ ID NO: 325103 - RNA, 64 nt, Homo Sapiens; identical to SEQ ID NO: 110169

SEQ ID NO: 325104 - RNA, 64 nt, Homo Sapiens; identical to SEQ ID NO: 110170

SEQ ID NO: 325105 - RNA, 64 nt, Homo Sapiens; identical to SEQ ID NO: 110171

SEQ ID NO: 325106 - RNA, 64 nt, Homo Sapiens; identical to SEQ ID NO: 110172

SEQ ID NO: 325107 - RNA, 64 nt, Homo Sapiens
ccuucuauagaggugguguaagaguggggaacagggccagcaagacagaccaccagccagaaau

SEQ ID NO: 325108 - RNA, 64 nt, Homo Sapiens
uuuuuggauacuuuuuuuuucuguuugugaauaaggccagcacucaagaugggcagccaagggu

SEQ ID NO: 325109 - RNA, 64 nt, Homo Sapiens
cagggaagcucuuagaauccggucaccugauuuaggccagcaaccuggucagaaacaaagggcu

SEQ ID NO: 325110 - RNA, 64 nt, Homo Sapiens
uauccuugccagaguuuuuuagagcacauuuucaggccagcaacgugagucacugcuaagagac

SEQ ID NO: 325111 - RNA, 64 nt, Homo Sapiens
cacagcugggcccaccgaggugcuauccugcccaggccagcacuuggcugaguuggguuggagu

SEQ ID NO: 325112 - RNA, 64 nt, Homo Sapiens
gagcgggugccgaagcuacuggacuaugcugaugggccagcaggagccagccaaggccgcugug

SEQ ID NO: 325113 - RNA, 64 nt, Homo Sapiens
ucgcuugcagaagccauccacagcaagccccucaggccagcacucugauggagaugcucaaggc

SEQ ID NO: 325114 - RNA, 64 nt, Homo Sapiens
ccccucaggccagcacuucgauggagaugcucaaggccagcaagcuccuagccccgaggugcug

SEQ ID NO: 325115 - RNA, 64 nt, Homo Sapiens
cugccgucccaccacacguguccucaccuggaggggccagcagggccacagccugugcuccugg

SEQ ID NO: 325116 - RNA, 64 nt, Homo Sapiens
gugggcagcugccggccgcuagagcccugcuuggggccagcacggaacuuccaggccucagcgc

SEQ ID NO: 325117 - RNA, 64 nt, Homo Sapiens
acagauucccaccuguauguagcacgccaugcugggccagcagugucauaggaguggaggggga

SEQ ID NO: 325118 - RNA, 64 nt, Homo Sapiens
gggccugggcuugaaugugacucuguugagacauggccagcaauucuggcacuuggcugucauu

SEQ ID NO: 325119 - RNA, 64 nt, Homo Sapiens
uggcaggcaggaggugcgguccccgcugaccccgggccagcacuguggucaccaaggcagugag

SEQ ID NO: 325120 - RNA, 64 nt, Homo Sapiens
gcugcugcccugaggggaaauggccugggugagaggccagcacuuggguccgcuggugucacua

SEQ ID NO: 325121 - RNA, 56 nt, Homo Sapiens
ccagcugguucgggcugugacgggguggccagcagggacgcgccccaggugggcag

SEQ ID NO: 325122 - RNA, 64 nt, Homo Sapiens
cggcauccccagcugguucgggccgugacggggcggccagcagggacgcgccccaggugggcag

SEQ ID NO: 325123 - RNA, 64 nt, Homo Sapiens
ggauggcccggccccggggcccguacacaggcggggccagcacaguagugaaggcggucuccug

SEQ ID NO: 325124 - RNA, 64 nt, Homo Sapiens
caguccuggggggcugggacgcccaagaucaagaggccagcagauucggacuccgcugagggcu

SEQ ID NO: 325125 - RNA, 64 nt, Homo Sapiens
ugaaugcugaaggaaccaacaguccaccucagcgggccagcagcccagggaaccccugcccacc

SEQ ID NO: 325126 - RNA, 64 nt, Homo Sapiens
caccuaaacagaaucagugacccgggugcuuuguggccagcagcacagaaucaaacccgcaucc

SEQ ID NO: 325127 - RNA, 64 nt, Homo Sapiens
cucuucacugaaacugguuguucuuuacuucccaggccagcaagcugcuguauuuggaaacccc

SEQ ID NO: 325128 - RNA, 64 nt, Homo Sapiens
ccacacuggagccaucucuuccacgaacuggccuggccagcaccaccccagcccauguacgucc

SEQ ID NO: 325129 - RNA, 64 nt, Homo Sapiens
ggaagucuggucgcaguggcaaagccagcaccauggccagcagagcggugagcagcacucccac

SEQ ID NO: 325130 - RNA, 64 nt, Homo Sapiens
uggcauugguucuaggaaccugagaguggagugaggccagcaugcaggaaggaguuuggagaga

SEQ ID NO: 325131 - RNA, 64 nt, Homo Sapiens
ucuucagcuuugagaugguggagaggauguguguggccagcagcagaaggagggagaaaaccgu

SEQ ID NO: 325132 - RNA, 64 nt, Homo Sapiens
gccggcguucagaaggaggguccagagauuccagggccagcaaaucaccuccugaguuuauuuu

SEQ ID NO: 325133 - RNA, 64 nt, Homo Sapiens
gaccagggggucucacuuuggccaccaguucuucggccagcaccucugcccuccagaaccugca

SEQ ID NO: 325134 - RNA, 64 nt, Homo Sapiens
ugcuagccagcaggcuccugucugggugccacggggccagcauuuuggagggagcuuccuuccu

SEQ ID NO: 325135 - RNA, 64 nt, Homo Sapiens
uuccugcuucucaagggacacaguggccugcaugggccagcauggacccugggcugaucaugug

SEQ ID NO: 325136 - RNA, 64 nt, Homo Sapiens
uccugcuucucuggggacacagugggcccacaugggccagcauggacccugggcuagagcaagc

SEQ ID NO: 325137 - RNA, 64 nt, Homo Sapiens
gcuggauggcucagagcaagaagcucggaggcuuggccagcacuucuggggccagcauuuggcc

SEQ ID NO: 325138 - RNA, 64 nt, Homo Sapiens
uggccaagcucggaggcuugguugucuccucuggggccagcauugaggugaggggcgggagaag

SEQ ID NO: 325139 - RNA, 64 nt, Homo Sapiens
uggauaaauauauagauauugagugcuuggaauccuagccuacuaugugaaaauuaagucuaau

SEQ ID NO: 325140 - RNA, 64 nt, Homo Sapiens
aucuauucccagcuuuaucacuuauuuagccaugcuagccuaggccucuauuuccuugucucca

SEQ ID NO: 325141 - RNA, 64 nt, Homo Sapiens
ccaaguguauaugcuuuacuaccuaacaauuauucuagccuaggugaaucccuaauugaaacac

SEQ ID NO: 325142 - RNA, 64 nt, Homo Sapiens
uuaacagaguuauaauaaaacaguguuuuaaaaucuagccuauaaacaaaaacuaguuugaggc

SEQ ID NO: 325143 - RNA, 64 nt, Homo Sapiens
gugggaaucagaaaaaccuguucccaucaccggccuagccuagaauccuagccuagaagcccuc

SEQ ID NO: 325144 - RNA, 64 nt, Homo Sapiens
aaaccuguucccaucaccggccuagccuagaauccuagccuagaagcccucucucccucugggc

SEQ ID NO: 325145 - RNA, 64 nt, Homo Sapiens
uccugucucuucaagccucccccccuuagcauuuguucuucaucccaggguuccuggccaggug

SEQ ID NO: 325146 - RNA, 64 nt, Homo Sapiens
ugugccugcuccugguggucggcagagccuguguguucuucaccgcugccugguccuggccugg

SEQ ID NO: 325147 - RNA, 64 nt, Homo Sapiens
gccucaggcaagucacugcccaccuaagaugaugguucuucaacuauaaaauggagauaauggu

SEQ ID NO: 325148 - RNA, 64 nt, Homo Sapiens
cgugugccacuugccagcuucuugggcacacagaguucuucaauccaaguuaucagauuguauu

SEQ ID NO: 325149 - RNA, 64 nt, Homo Sapiens
ugucggggaggugccaggcucuuuuuaacaagcaguucuucaggaacuaagagugagucacucc

SEQ ID NO: 325150 - RNA, 64 nt, Homo Sapiens
gaauauaugacaugcuaaauuuuauuuuuaaacgguucuucaagucagauuaaaguaauaauag

SEQ ID NO: 325151 - RNA, 64 nt, Homo Sapiens
agugcauuuugaaaaagaaagaauaugaacuuugguucuucaugagacauacagauuuaauuug

SEQ ID NO: 325152 - RNA, 64 nt, Homo Sapiens
guuggguugauuccccaaaaguucaaaauguguaguucuucauuaaucacaaaaaaaaacccca

SEQ ID NO: 325153 - RNA, 64 nt, Homo Sapiens
aguugcugucuagugcauucaaaggucacuuuuuguucuucacagaucuuuuuaauguucuuuc

SEQ ID NO: 325154 - RNA, 64 nt, Homo Sapiens
ugccugcugucggcguuugaccuuccacgugacaguucuucacaauuccuuucaucauuuuuua

SEQ ID NO: 325155 - RNA, 64 nt, Homo Sapiens
agauguuggcuuuucuggauuuuuuuugccauggguucuucacugaccuuggacuuuggcauga

SEQ ID NO: 325156 - RNA, 64 nt, Homo Sapiens
cucuucucagagcaacucuuccuuugggaaaagaguucuucagaucauagaccaaaaaagucau

SEQ ID NO: 325157 - RNA, 64 nt, Homo Sapiens
uaucacuguuuuucagaucuauccaguuucuuuaguucuucauauucuccuuuugagacuccuc

SEQ ID NO: 325158 - RNA, 64 nt, Homo Sapiens
ggagacucagagaagacuucccacagcauuggcuguucuucauaaacccugagaccccagguac

SEQ ID NO: 325159 - RNA, 64 nt, Homo Sapiens
cucagcuggaaggggaaaaggacuugagcgccguguucuucagcgcaccaagagagcgaugaug

SEQ ID NO: 325160 - RNA, 64 nt, Homo Sapiens
guccccucaacaugagcggacagggaaaggagcuguucuucaaggggcucuguggggagagaua

SEQ ID NO: 325161 - RNA, 64 nt, Homo Sapiens
cacucacucaacaaauacccuauauuccuuguagguucuucacugguucuugaaguuuuuacaa

SEQ ID NO: 325162 - RNA, 64 nt, Homo Sapiens
guagugagccucccaggaucccuccccugcuaaaguucuucaugaugccccuacaguagagauu

SEQ ID NO: 325163 - RNA, 64 nt, Homo Sapiens
ggcagccuaucccauugcaagaagacccagccaucugcagcagauggcacuugucauggguuug

SEQ ID NO: 325164 - RNA, 64 nt, Homo Sapiens
uaagccuagauaacucuacaguucaacuuuuauccugcagcaaggcucaaugcuugguguucua

SEQ ID NO: 325165 - RNA, 64 nt, Homo Sapiens
gaaaagcacauaaucuuucuaucagucuuccggucugcagcacguuccucauucaggaaaucaa

SEQ ID NO: 325166 - RNA, 64 nt, Homo Sapiens
aacaucucuucacugggcuccuuugcauaauugccugcagcaggaggaaagcaaucacuucuca

SEQ ID NO: 325167 - RNA, 64 nt, Homo Sapiens
cguuugccugggcauugaggagagggccucuccccugcagcaaagguucucuccccugccgcug

SEQ ID NO: 325168 - RNA, 64 nt, Homo Sapiens
uugguaaaaaccuguagcgaauuuccaacuacugcugcagcauuuuaguaaugcaaaauaacuc

SEQ ID NO: 325169 - RNA, 64 nt, Homo Sapiens
gggagacuagagagagauuuacaggcugggaaagcugcagcaaaaaaauaaaacagaggauacu

SEQ ID NO: 325170 - RNA, 64 nt, Homo Sapiens
auucacaauagccaagauaugaacccuauguuuacugcagcacuuguauauuaaagagacauuu

SEQ ID NO: 325171 - RNA, 64 nt, Homo Sapiens
gcuugcucaacaacagucuuggacaccaguaccccugcagcaugaugcacuaagccuuaauccu

SEQ ID NO: 325172 - RNA, 64 nt, Homo Sapiens
caaacuuggagugguuauuggcagggaccugcuccugcagcaacacucaggaugaacucucuga

SEQ ID NO: 325173 - RNA, 64 nt, Homo Sapiens
cuugaauauuuuuaacacugguauacaauuuugucugcagcauuggaaggauacauagugauuc

SEQ ID NO: 325174 - RNA, 64 nt, Homo Sapiens
uaaauaauauugggacucauaaauugugcuggggcugcagcaaagggguuucaaugugcccuua

SEQ ID NO: 325175 - RNA, 64 nt, Homo Sapiens
ugugucguucuacugagcacgcugaggacggaggcugcagcaucacuccagcgcagcuugaggg

SEQ ID NO: 325176 - RNA, 64 nt, Homo Sapiens
cagggcuucaggaggugcccgaagagcggcgccucugcagcaaggccccucacccugcaucacu

SEQ ID NO: 325177 - RNA, 64 nt, Homo Sapiens
agucgggcccugccucccuccguccccagagccacugcagcaggcccgcuggccgccagcugcc

SEQ ID NO: 325178 - RNA, 64 nt, Homo Sapiens
gggcaggagccccagcuuagcagagaggagucggcugcagcagagacagcccagaggggggcua

SEQ ID NO: 325179 - RNA, 64 nt, Homo Sapiens
gcagggcgcaaacccaggacaccugcucacggcccugcagcagauuggggcagggagagaggga

SEQ ID NO: 325180 - RNA, 64 nt, Homo Sapiens
ccuagaguuuuccaggggguguggcacugcugagcugcagcaguguuucccugcccugggcuca

SEQ ID NO: 325181 - RNA, 64 nt, Homo Sapiens
gggugagcuccgucugccacugggcaccguggaucugcagcauguucuggagcacugguaccug

SEQ ID NO: 325182 - RNA, 64 nt, Homo Sapiens
ggugcaccugggugcccgggccucggggcagccccugcagcacugggcagacaugcuggcccac

SEQ ID NO: 325183 - RNA, 64 nt, Homo Sapiens
aguuccgggagcggauggaguccggcagaagcagcugcagcagcggccacgcaccagcggaagc

SEQ ID NO: 325184 - RNA, 64 nt, Homo Sapiens
ugaccuccccuuccagacccugggacacccacagcugcagcaggcugccgaccgaacauggccc

SEQ ID NO: 325185 - RNA, 64 nt, Homo Sapiens
guugaaaauugccuccaaauccauguuauagaaacugcagcagaaguggguacuaucauuaguc

SEQ ID NO: 325186 - RNA, 64 nt, Homo Sapiens
uucccaccagugcugcaggagaccccaccugugacugcagcaucaccuccuccuccuggugaca

SEQ ID NO: 325187 - RNA, 64 nt, Homo Sapiens
gaaagacgaccugccauguccuccgagcccaggccugcagcacucacggaggcccccagcugcc

SEQ ID NO: 325188 - RNA, 64 nt, Homo Sapiens
uguacaagcugaacaggaaguguaccugcggaagcugcagcaggugaggaggaggaggcagagg

SEQ ID NO: 325189 - RNA, 64 nt, Homo Sapiens
cagguuuuuccucccuguugcuggaugccagcagcugcagcaagacacacccaaaaucaagggc

SEQ ID NO: 325190 - RNA, 64 nt, Homo Sapiens
cagaauacacaaucuuaaccuccuuucccucauucugcagcaauuuauaagaucgaauuuaauu

SEQ ID NO: 325191 - RNA, 64 nt, Homo Sapiens
ccugacucuaggggcacauccagucuccaucgugcugcagcagcuggacugagggcagagccug

SEQ ID NO: 325192 - RNA, 64 nt, Homo Sapiens
ggagccucaguucccuccugugucaaguagcuaacugcagcagcuggacugagggcagagucug

SEQ ID NO: 325193 - RNA, 64 nt, Homo Sapiens
agagaaaagaguagcagagaagcucguggaccagcugcagcaccgcaguuauuucugcagaucc

SEQ ID NO: 325194 - RNA, 64 nt, Homo Sapiens
acuaucagcagcugaucucuagugcugaggucuucugcagcaguccugccgcagcggggagacc

SEQ ID NO: 325195 - RNA, 64 nt, Homo Sapiens
uccaggccuguugcuauagaauuuucccccacuacugcagcacccacuccacccuccaccuucc

SEQ ID NO: 325196 - RNA, 64 nt, Homo Sapiens
cacuccacccuccaccuuccuccacucagcuguccugcagcaaaguuugcaccuguccccaccc

SEQ ID NO: 325197 - RNA, 64 nt, Homo Sapiens
caaguaccgccugucucaggaugaccgcgauggccugcagcaacucuaugguagggggagaggg

SEQ ID NO: 325198 - RNA, 64 nt, Homo Sapiens
gccgcgaaaccaucauugccccauccaguguccucugcagcagggccaggggacgcacaccugc

SEQ ID NO: 325199 - RNA, 64 nt, Homo Sapiens
cucugguaccaccucugagugcaacaggauuugucugcagcagcauauccgagaggaagcugau

SEQ ID NO: 325200 - RNA, 64 nt, Homo Sapiens
ugagggggugcccuggcacuucuggugacacauccugcagcagcuuccccuuuaacucucuccu

SEQ ID NO: 325201 - RNA, 64 nt, Homo Sapiens
gaaaauaaucaugcagucauuccucaauuacugccugcagcaauuccuccauuuuuaugaaucu

SEQ ID NO: 325202 - RNA, 64 nt, Homo Sapiens
cgacccuggccuccccuguggccucuuugagugucugcagcagcccuggacuuccagacuucua

SEQ ID NO: 325203 - RNA, 64 nt, Homo Sapiens
uugucaaugcacacagaauacaaccucaugcucccugcagcaagaccccugaaagugauucaug

SEQ ID NO: 325204 - RNA, 64 nt, Homo Sapiens
uugggaauguuucacugcuacccgcauccagcgacugcagcaccagaaaacgacuaauguaacu

SEQ ID NO: 325205 - RNA, 64 nt, Homo Sapiens
uacagaacaguuucucauuagaugaguguuucuccugcagcacuccaaaacccacucugcacug

SEQ ID NO: 325206 - RNA, 64 nt, Homo Sapiens
guuucuccugcagcacuccaaaacccacucugcacugcagcacagugaaugauaugcacucacc

SEQ ID NO: 325207 - RNA, 64 nt, Homo Sapiens
ggccggggcucugcguggcuugcugggaggugggcugcagcacagaggccugugacugcguucc

SEQ ID NO: 325208 - RNA, 64 nt, Homo Sapiens
augcucccuggucaccccacuucccggucgccgucugcagcacuccuggagcagccugggcccu

SEQ ID NO: 325209 - RNA, 64 nt, Homo Sapiens
uuccugcuauucagaauaaguaggagaaugaaaacugcagcauaucagacagcaauuuaacagc

SEQ ID NO: 325210 - RNA, 64 nt, Homo Sapiens
uuguaaaaaugauuguaacagauaaaaaauguaucugcagcaacucugcagguuugugaaauag

SEQ ID NO: 325211 - RNA, 64 nt, Homo Sapiens; identical to SEQ ID NO: 132800

SEQ ID NO: 325212 - RNA, 64 nt, Homo Sapiens; identical to SEQ ID NO: 132801

SEQ ID NO: 325213 - RNA, 64 nt, Homo Sapiens; identical to SEQ ID NO: 132802

SEQ ID NO: 325214 - RNA, 64 nt, Homo Sapiens; identical to SEQ ID NO: 132803

SEQ ID NO: 325215 - RNA, 64 nt, Homo Sapiens; identical to SEQ ID NO: 132804

SEQ ID NO: 325216 - RNA, 64 nt, Homo Sapiens; identical to SEQ ID NO: 132805

SEQ ID NO: 325217 - RNA, 64 nt, Homo Sapiens; identical to SEQ ID NO: 132806

SEQ ID NO: 325218 - RNA, 64 nt, Homo Sapiens; identical to SEQ ID NO: 132807

SEQ ID NO: 325219 - RNA, 64 nt, Homo Sapiens; identical to SEQ ID NO: 132808

SEQ ID NO: 325220 - RNA, 64 nt, Homo Sapiens; identical to SEQ ID NO: 132809

SEQ ID NO: 325221 - RNA, 64 nt, Homo Sapiens; identical to SEQ ID NO: 132810

SEQ ID NO: 325222 - RNA, 64 nt, Homo Sapiens; identical to SEQ ID NO: 132811

SEQ ID NO: 325223 - RNA, 64 nt, Homo Sapiens; identical to SEQ ID NO: 132812

SEQ ID NO: 325224 - RNA, 64 nt, Homo Sapiens; identical to SEQ ID NO: 132813

SEQ ID NO: 325225 - RNA, 64 nt, Homo Sapiens; identical to SEQ ID NO: 132814

SEQ ID NO: 325226 - RNA, 64 nt, Homo Sapiens; identical to SEQ ID NO: 132815

SEQ ID NO: 325227 - RNA, 64 nt, Homo Sapiens; identical to SEQ ID NO: 132816

SEQ ID NO: 325228 - RNA, 64 nt, Homo Sapiens; identical to SEQ ID NO: 132817

SEQ ID NO: 325229 - RNA, 64 nt, Homo Sapiens; identical to SEQ ID NO: 132818

SEQ ID NO: 325230 - RNA, 64 nt, Homo Sapiens; identical to SEQ ID NO: 132819

SEQ ID NO: 325231 - RNA, 64 nt, Homo Sapiens; identical to SEQ ID NO: 132820

SEQ ID NO: 325232 - RNA, 64 nt, Homo Sapiens; identical to SEQ ID NO: 132821

SEQ ID NO: 325233 - RNA, 64 nt, Homo Sapiens; identical to SEQ ID NO: 132822

SEQ ID NO: 325234 - RNA, 64 nt, Homo Sapiens; identical to SEQ ID NO: 132823

SEQ ID NO: 325235 - RNA, 64 nt, Homo Sapiens; identical to SEQ ID NO: 132824

SEQ ID NO: 325236 - RNA, 64 nt, Homo Sapiens; identical to SEQ ID NO: 132825

SEQ ID NO: 325237 - RNA, 64 nt, Homo Sapiens; identical to SEQ ID NO: 132826

SEQ ID NO: 325238 - RNA, 64 nt, Homo Sapiens; identical to SEQ ID NO: 132827

SEQ ID NO: 325239 - RNA, 64 nt, Homo Sapiens; identical to SEQ ID NO: 132828

SEQ ID NO: 325240 - RNA, 64 nt, Homo Sapiens; identical to SEQ ID NO: 132829

SEQ ID NO: 325241 - RNA, 64 nt, Homo Sapiens; identical to SEQ ID NO: 132830

SEQ ID NO: 325242 - RNA, 64 nt, Homo Sapiens; identical to SEQ ID NO: 132831

SEQ ID NO: 325243 - RNA, 64 nt, Homo Sapiens; identical to SEQ ID NO: 132832

SEQ ID NO: 325244 - RNA, 64 nt, Homo Sapiens; identical to SEQ ID NO: 132833

SEQ ID NO: 325245 - RNA, 64 nt, Homo Sapiens; identical to SEQ ID NO: 132834

SEQ ID NO: 325246 - RNA, 64 nt, Homo Sapiens; identical to SEQ ID NO: 132835

SEQ ID NO: 325247 - RNA, 64 nt, Homo Sapiens; identical to SEQ ID NO: 132836

SEQ ID NO: 325248 - RNA, 64 nt, Homo Sapiens; identical to SEQ ID NO: 132837

SEQ ID NO: 325249 - RNA, 64 nt, Homo Sapiens; identical to SEQ ID NO: 132838

SEQ ID NO: 325250 - RNA, 64 nt, Homo Sapiens; identical to SEQ ID NO: 132839

SEQ ID NO: 325251 - RNA, 64 nt, Homo Sapiens; identical to SEQ ID NO: 132840

SEQ ID NO: 325252 - RNA, 64 nt, Homo Sapiens; identical to SEQ ID NO: 132841

SEQ ID NO: 325253 - RNA, 64 nt, Homo Sapiens; identical to SEQ ID NO: 132842

SEQ ID NO: 325254 - RNA, 64 nt, Homo Sapiens; identical to SEQ ID NO: 132843

SEQ ID NO: 325255 - RNA, 64 nt, Homo Sapiens; identical to SEQ ID NO: 132844

SEQ ID NO: 325256 - RNA, 58 nt, Homo Sapiens; identical to SEQ ID NO: 132845

SEQ ID NO: 325257 - RNA, 64 nt, Homo Sapiens; identical to SEQ ID NO: 132846

SEQ ID NO: 325258 - RNA, 64 nt, Homo Sapiens; identical to SEQ ID NO: 132847

SEQ ID NO: 325259 - RNA, 64 nt, Homo Sapiens; identical to SEQ ID NO: 132848

SEQ ID NO: 325260 - RNA, 64 nt, Homo Sapiens; identical to SEQ ID NO: 132849

SEQ ID NO: 325261 - RNA, 64 nt, Homo Sapiens; identical to SEQ ID NO: 132850

SEQ ID NO: 325262 - RNA, 64 nt, Homo Sapiens; identical to SEQ ID NO: 132851

SEQ ID NO: 325263 - RNA, 64 nt, Homo Sapiens; identical to SEQ ID NO: 132852

SEQ ID NO: 325264 - RNA, 64 nt, Homo Sapiens; identical to SEQ ID NO: 132853

SEQ ID NO: 325265 - RNA, 64 nt, Homo Sapiens; identical to SEQ ID NO: 132854

SEQ ID NO: 325266 - RNA, 64 nt, Homo Sapiens; identical to SEQ ID NO: 132855

SEQ ID NO: 325267 - RNA, 64 nt, Homo Sapiens; identical to SEQ ID NO: 132856

SEQ ID NO: 325268 - RNA, 64 nt, Homo Sapiens; identical to SEQ ID NO: 132857

SEQ ID NO: 325269 - RNA, 64 nt, Homo Sapiens; identical to SEQ ID NO: 132858

SEQ ID NO: 325270 - RNA, 64 nt, Homo Sapiens; identical to SEQ ID NO: 132859

SEQ ID NO: 325271 - RNA, 64 nt, Homo Sapiens; identical to SEQ ID NO: 132860

SEQ ID NO: 325272 - RNA, 64 nt, Homo Sapiens; identical to SEQ ID NO: 132861

SEQ ID NO: 325273 - RNA, 64 nt, Homo Sapiens; identical to SEQ ID NO: 132862

SEQ ID NO: 325274 - RNA, 64 nt, Homo Sapiens; identical to SEQ ID NO: 132863

SEQ ID NO: 325275 - RNA, 64 nt, Homo Sapiens; identical to SEQ ID NO: 132864

SEQ ID NO: 325276 - RNA, 64 nt, Homo Sapiens; identical to SEQ ID NO: 132865

SEQ ID NO: 325277 - RNA, 64 nt, Homo Sapiens; identical to SEQ ID NO: 132866

SEQ ID NO: 325278 - RNA, 64 nt, Homo Sapiens; identical to SEQ ID NO: 132867

SEQ ID NO: 325279 - RNA, 64 nt, Homo Sapiens; identical to SEQ ID NO: 132868

SEQ ID NO: 325280 - RNA, 64 nt, Homo Sapiens; identical to SEQ ID NO: 132869

SEQ ID NO: 325281 - RNA, 64 nt, Homo Sapiens; identical to SEQ ID NO: 132870

SEQ ID NO: 325282 - RNA, 64 nt, Homo Sapiens; identical to SEQ ID NO: 132871

SEQ ID NO: 325283 - RNA, 64 nt, Homo Sapiens; identical to SEQ ID NO: 132872

SEQ ID NO: 325284 - RNA, 64 nt, Homo Sapiens; identical to SEQ ID NO: 132873

SEQ ID NO: 325285 - RNA, 64 nt, Homo Sapiens; identical to SEQ ID NO: 132874

SEQ ID NO: 325286 - RNA, 64 nt, Homo Sapiens; identical to SEQ ID NO: 132875

SEQ ID NO: 325287 - RNA, 64 nt, Homo Sapiens; identical to SEQ ID NO: 132876

SEQ ID NO: 325288 - RNA, 64 nt, Homo Sapiens; identical to SEQ ID NO: 132877

SEQ ID NO: 325289 - RNA, 64 nt, Homo Sapiens; identical to SEQ ID NO: 132878

SEQ ID NO: 325290 - RNA, 64 nt, Homo Sapiens; identical to SEQ ID NO: 132879

SEQ ID NO: 325291 - RNA, 64 nt, Homo Sapiens; identical to SEQ ID NO: 132880

SEQ ID NO: 325292 - RNA, 64 nt, Homo Sapiens; identical to SEQ ID NO: 132881

SEQ ID NO: 325293 - RNA, 64 nt, Homo Sapiens; identical to SEQ ID NO: 132882

SEQ ID NO: 325294 - RNA, 64 nt, Homo Sapiens; identical to SEQ ID NO: 132883

SEQ ID NO: 325295 - RNA, 64 nt, Homo Sapiens; identical to SEQ ID NO: 132884

SEQ ID NO: 325296 - RNA, 64 nt, Homo Sapiens; identical to SEQ ID NO: 132885

SEQ ID NO: 325297 - RNA, 64 nt, Homo Sapiens; identical to SEQ ID NO: 132886

SEQ ID NO: 325298 - RNA, 64 nt, Homo Sapiens; identical to SEQ ID NO: 132887

SEQ ID NO: 325299 - RNA, 64 nt, Homo Sapiens; identical to SEQ ID NO: 132888

SEQ ID NO: 325300 - RNA, 64 nt, Homo Sapiens; identical to SEQ ID NO: 132889

SEQ ID NO: 325301 - RNA, 64 nt, Homo Sapiens
acagcagagcaaguauucacugaguaggggugucccaugacacuauuucauauucuacagaagu

SEQ ID NO: 325302 - RNA, 64 nt, Homo Sapiens
guagucauuuugagagguacaaagcucauaauuaccaugacaacaugguaauguccauagacau

SEQ ID NO: 325303 - RNA, 64 nt, Homo Sapiens
ugcaaaauaaguucugccugcagugcugugaugcccaugacaccgcuacacugcaacuuccguc

SEQ ID NO: 325304 - RNA, 64 nt, Homo Sapiens
cccuuuggcaacuaacguaguuccucugaagcggccaugacauuauuuucugcuaccauuucuu

SEQ ID NO: 325305 - RNA, 64 nt, Homo Sapiens
gugcaagugguagggacaagcagugaggugguggccaugacacuggagaccaagccucagcgga

SEQ ID NO: 325306 - RNA, 64 nt, Homo Sapiens
uggcugcccugcccuacugugggcauagcgcccgccaugacacgcugcccgugccccuagcagg

SEQ ID NO: 325307 - RNA, 64 nt, Homo Sapiens
ccccuuugauuccucagaaucucacaucacauuuccaugacaauaaaucccuagucuucaucag

SEQ ID NO: 325308 - RNA, 64 nt, Homo Sapiens
ugcaguuauucccagugagauauuuuccuguggcccaugacauucuccacaaaugcaaaagaug

SEQ ID NO: 325309 - RNA, 64 nt, Homo Sapiens
gcgaaacccggugcaucuggcacguggccaggagccaugacaggggcgcuugggaggggccgga

SEQ ID NO: 325310 - RNA, 64 nt, Homo Sapiens
ucucagacuguggaaccaaagcuggcccaguuguccaugacaaaagaggcuuuugggccaaaau

SEQ ID NO: 325311 - RNA, 64 nt, Homo Sapiens
guuaaccaaagaauauguuuauuauagugagaacccaugacauaauaugaaguaugcuuuguug

SEQ ID NO: 325312 - RNA, 64 nt, Homo Sapiens
acuauaaucaaguuauuaaagacagguccacgcgccaugacaaacugaaacacacaauugacug

SEQ ID NO: 325313 - RNA, 64 nt, Homo Sapiens
caagauucuauggagguuggccacagucaccacuccaugacaucccugucuuccucaacgacuu

SEQ ID NO: 325314 - RNA, 64 nt, Homo Sapiens
acaaugaggcaaggggcugauagagaagagucccccaugacaggaguuugugugcaacagaguc

SEQ ID NO: 325315 - RNA, 64 nt, Homo Sapiens
gaaauacccucaaugaucuccugaagcaucugaaugacccaaauaguaaccccaaagccaucau

SEQ ID NO: 325316 - RNA, 64 nt, Homo Sapiens
agauuaccaagcaguuugcuaaaaauucaaucuuugacccaagcuguagcauuuuuuuuucaug

SEQ ID NO: 325317 - RNA, 64 nt, Homo Sapiens
ccaugccugggggccgagauucuccagcagaaagaugcaauauuuuuuguuuccuuuuuuucca

SEQ ID NO: 325318 - RNA, 64 nt, Homo Sapiens
uagucuccuuugcauggacuucaagcugcaugaaaugcaauaaaucucauuuuagauaauuuag

SEQ ID NO: 325319 - RNA, 64 nt, Homo Sapiens
auuuaguugaguuauuccacuuuuaggguucuaaaugcaauaagaggauaaauuuuuugaccua

SEQ ID NO: 325320 - RNA, 64 nt, Homo Sapiens
aagcaugcauaaaucaaugguucuguguauuaacaugcaauaacuaaaaaacuguauaaggaga

SEQ ID NO: 325321 - RNA, 64 nt, Homo Sapiens
aauaaauggcaaacaagcaauuucuccauuaaaaaugcaauaaauuuugaaaacagaugacuua

SEQ ID NO: 325322 - RNA, 64 nt, Homo Sapiens
aacugguaucagaauuccuuauuguugggaaaauaugcaauacaacuggauuuaugcuugaugc

SEQ ID NO: 325323 - RNA, 64 nt, Homo Sapiens
guauacucaauuguguauagugcuguuuucuuccaugcaauauuuucuaauauuucaguugagc

SEQ ID NO: 325324 - RNA, 64 nt, Homo Sapiens
ugaauguaccucaaauuuuuauuaagaccaagucaugcaauaaucauauaagcuugcuaaaaau

SEQ ID NO: 325325 - RNA, 64 nt, Homo Sapiens
gagacaaacuguaaaaaauguguguauucuuaaaaugcaauauuuguaaggcuuguuccaaugc

SEQ ID NO: 325326 - RNA, 64 nt, Homo Sapiens
cagcucccauucuaugugucaucaauaguguccuaugcaauaaaauuauuugcaggucuuuaaa

SEQ ID NO: 325327 - RNA, 64 nt, Homo Sapiens
caacuugcugaaauacaccauuauuauuuguuguaugcaauacuggauuuauuuugauaacgua

SEQ ID NO: 325328 - RNA, 64 nt, Homo Sapiens
acauucuuguaauaucuuugccagguucuauaaaaugcaauaauaagcaaauaaauuacuuugu

SEQ ID NO: 325329 - RNA, 64 nt, Homo Sapiens
auaaaguacauuauuuaugauccuuaauagccauaugcaauaaauguauugaucauggaugccc

SEQ ID NO: 325330 - RNA, 64 nt, Homo Sapiens
uacauuuuuaauuuaguuuaucacaaaaaggcauaugcaauauuuuuccucuauccuguacauu

SEQ ID NO: 325331 - RNA, 64 nt, Homo Sapiens; identical to SEQ ID NO: 56842

SEQ ID NO: 325332 - RNA, 64 nt, Homo Sapiens; identical to SEQ ID NO: 56843

SEQ ID NO: 325333 - RNA, 64 nt, Homo Sapiens; identical to SEQ ID NO: 56844

SEQ ID NO: 325334 - RNA, 64 nt, Homo Sapiens; identical to SEQ ID NO: 56845

SEQ ID NO: 325335 - RNA, 64 nt, Homo Sapiens; identical to SEQ ID NO: 56846

SEQ ID NO: 325336 - RNA, 64 nt, Homo Sapiens; identical to SEQ ID NO: 56847

SEQ ID NO: 325337 - RNA, 64 nt, Homo Sapiens; identical to SEQ ID NO: 56848

SEQ ID NO: 325338 - RNA, 64 nt, Homo Sapiens; identical to SEQ ID NO: 56849

SEQ ID NO: 325339 - RNA, 64 nt, Homo Sapiens; identical to SEQ ID NO: 56850

SEQ ID NO: 325340 - RNA, 64 nt, Homo Sapiens; identical to SEQ ID NO: 56851

SEQ ID NO: 325341 - RNA, 64 nt, Homo Sapiens; identical to SEQ ID NO: 56852

SEQ ID NO: 325342 - RNA, 64 nt, Homo Sapiens; identical to SEQ ID NO: 56853

SEQ ID NO: 325343 - RNA, 64 nt, Homo Sapiens; identical to SEQ ID NO: 56854

SEQ ID NO: 325344 - RNA, 64 nt, Homo Sapiens; identical to SEQ ID NO: 56855

SEQ ID NO: 325345 - RNA, 64 nt, Homo Sapiens; identical to SEQ ID NO: 56856

SEQ ID NO: 325346 - RNA, 64 nt, Homo Sapiens; identical to SEQ ID NO: 56857

SEQ ID NO: 325347 - RNA, 64 nt, Homo Sapiens; identical to SEQ ID NO: 124312

SEQ ID NO: 325348 - RNA, 64 nt, Homo Sapiens; identical to SEQ ID NO: 124313

SEQ ID NO: 325349 - RNA, 64 nt, Homo Sapiens; identical to SEQ ID NO: 124314

SEQ ID NO: 325350 - RNA, 64 nt, Homo Sapiens; identical to SEQ ID NO: 124315

SEQ ID NO: 325351 - RNA, 64 nt, Homo Sapiens; identical to SEQ ID NO: 124316

SEQ ID NO: 325352 - RNA, 64 nt, Homo Sapiens; identical to SEQ ID NO: 124317

SEQ ID NO: 325353 - RNA, 64 nt, Homo Sapiens; identical to SEQ ID NO: 124318

SEQ ID NO: 325354 - RNA, 64 nt, Homo Sapiens; identical to SEQ ID NO: 124319

SEQ ID NO: 325355 - RNA, 64 nt, Homo Sapiens; identical to SEQ ID NO: 124320

SEQ ID NO: 325356 - RNA, 64 nt, Homo Sapiens; identical to SEQ ID NO: 124321

SEQ ID NO: 325357 - RNA, 64 nt, Homo Sapiens; identical to SEQ ID NO: 124322

SEQ ID NO: 325358 - RNA, 64 nt, Homo Sapiens; identical to SEQ ID NO: 124323

SEQ ID NO: 325359 - RNA, 64 nt, Homo Sapiens; identical to SEQ ID NO: 124324

SEQ ID NO: 325360 - RNA, 64 nt, Homo Sapiens; identical to SEQ ID NO: 124325

SEQ ID NO: 325361 - RNA, 64 nt, Homo Sapiens; identical to SEQ ID NO: 124326

SEQ ID NO: 325362 - RNA, 64 nt, Homo Sapiens; identical to SEQ ID NO: 124327

SEQ ID NO: 325363 - RNA, 64 nt, Homo Sapiens; identical to SEQ ID NO: 124328

SEQ ID NO: 325364 - RNA, 64 nt, Homo Sapiens; identical to SEQ ID NO: 124329

SEQ ID NO: 325365 - RNA, 64 nt, Homo Sapiens; identical to SEQ ID NO: 124330

SEQ ID NO: 325366 - RNA, 64 nt, Homo Sapiens; identical to SEQ ID NO: 124331

SEQ ID NO: 325367 - RNA, 64 nt, Homo Sapiens; identical to SEQ ID NO: 124332

SEQ ID NO: 325368 - RNA, 64 nt, Homo Sapiens; identical to SEQ ID NO: 124324

SEQ ID NO: 325369 - RNA, 64 nt, Homo Sapiens; identical to SEQ ID NO: 124325

SEQ ID NO: 325370 - RNA, 64 nt, Homo Sapiens; identical to SEQ ID NO: 124335

SEQ ID NO: 325371 - RNA, 64 nt, Homo Sapiens; identical to SEQ ID NO: 124336

SEQ ID NO: 325372 - RNA, 64 nt, Homo Sapiens; identical to SEQ ID NO: 124337

SEQ ID NO: 325373 - RNA, 64 nt, Homo Sapiens; identical to SEQ ID NO: 124338

SEQ ID NO: 325374 - RNA, 64 nt, Homo Sapiens; identical to SEQ ID NO: 124339

SEQ ID NO: 325375 - RNA, 64 nt, Homo Sapiens; identical to SEQ ID NO: 124340

SEQ ID NO: 325376 - RNA, 64 nt, Homo Sapiens; identical to SEQ ID NO: 124341

SEQ ID NO: 325377 - RNA, 64 nt, Homo Sapiens; identical to SEQ ID NO: 124342

SEQ ID NO: 325378 - RNA, 64 nt, Homo Sapiens; identical to SEQ ID NO: 124343

SEQ ID NO: 325379 - RNA, 64 nt, Homo Sapiens; identical to SEQ ID NO: 124344

SEQ ID NO: 325380 - RNA, 64 nt, Homo Sapiens; identical to SEQ ID NO: 124345

SEQ ID NO: 325381 - RNA, 64 nt, Homo Sapiens; identical to SEQ ID NO: 124346

SEQ ID NO: 325382 - RNA, 64 nt, Homo Sapiens; identical to SEQ ID NO: 124347

SEQ ID NO: 325383 - RNA, 64 nt, Homo Sapiens; identical to SEQ ID NO: 124348

SEQ ID NO: 325384 - RNA, 64 nt, Homo Sapiens; identical to SEQ ID NO: 124349

SEQ ID NO: 325385 - RNA, 64 nt, Homo Sapiens; identical to SEQ ID NO: 124350

SEQ ID NO: 325386 - RNA, 64 nt, Homo Sapiens; identical to SEQ ID NO: 124351

SEQ ID NO: 325387 - RNA, 64 nt, Homo Sapiens; identical to SEQ ID NO: 124352

SEQ ID NO: 325388 - RNA, 64 nt, Homo Sapiens; identical to SEQ ID NO: 124353

SEQ ID NO: 325389 - RNA, 64 nt, Homo Sapiens; identical to SEQ ID NO: 124354

SEQ ID NO: 325390 - RNA, 64 nt, Homo Sapiens; identical to SEQ ID NO: 124355

SEQ ID NO: 325391 - RNA, 64 nt, Homo Sapiens; identical to SEQ ID NO: 124356

SEQ ID NO: 325392 - RNA, 64 nt, Homo Sapiens; identical to SEQ ID NO: 124357

SEQ ID NO: 325393 - RNA, 64 nt, Homo Sapiens; identical to SEQ ID NO: 124358

SEQ ID NO: 325394 - RNA, 64 nt, Homo Sapiens; identical to SEQ ID NO: 124359

SEQ ID NO: 325395 - RNA, 64 nt, Homo Sapiens; identical to SEQ ID NO: 124360

SEQ ID NO: 325396 - RNA, 64 nt, Homo Sapiens; identical to SEQ ID NO: 124361

SEQ ID NO: 325397 - RNA, 64 nt, Homo Sapiens; identical to SEQ ID NO: 124362

SEQ ID NO: 325398 - RNA, 64 nt, Homo Sapiens; identical to SEQ ID NO: 124363

SEQ ID NO: 325399 - RNA, 64 nt, Homo Sapiens; identical to SEQ ID NO: 124364

SEQ ID NO: 325400 - RNA, 64 nt, Homo Sapiens; identical to SEQ ID NO: 124365

SEQ ID NO: 325401 - RNA, 64 nt, Homo Sapiens; identical to SEQ ID NO: 124366

SEQ ID NO: 325402 - RNA, 61 nt, Homo Sapiens; identical to SEQ ID NO: 124367

SEQ ID NO: 325403 - RNA, 64 nt, Homo Sapiens; identical to SEQ ID NO: 124368

SEQ ID NO: 325404 - RNA, 64 nt, Homo Sapiens; identical to SEQ ID NO: 124369

SEQ ID NO: 325405 - RNA, 64 nt, Homo Sapiens; identical to SEQ ID NO: 124370

SEQ ID NO: 325406 - RNA, 64 nt, Homo Sapiens; identical to SEQ ID NO: 124371

SEQ ID NO: 325407 - RNA, 64 nt, Homo Sapiens; identical to SEQ ID NO: 124372

SEQ ID NO: 325408 - RNA, 64 nt, Homo Sapiens; identical to SEQ ID NO: 124373

SEQ ID NO: 325409 - RNA, 64 nt, Homo Sapiens; identical to SEQ ID NO: 124374

SEQ ID NO: 325410 - RNA, 64 nt, Homo Sapiens; identical to SEQ ID NO: 124375

SEQ ID NO: 325411 - RNA, 64 nt, Homo Sapiens; identical to SEQ ID NO: 124376

SEQ ID NO: 325412 - RNA, 64 nt, Homo Sapiens; identical to SEQ ID NO: 64767

SEQ ID NO: 325413 - RNA, 64 nt, Homo Sapiens; identical to SEQ ID NO: 64768

SEQ ID NO: 325414 - RNA, 64 nt, Homo Sapiens; identical to SEQ ID NO: 64769

SEQ ID NO: 325415 - RNA, 64 nt, Homo Sapiens; identical to SEQ ID NO: 64770

SEQ ID NO: 325416 - RNA, 64 nt, Homo Sapiens; identical to SEQ ID NO: 64771

SEQ ID NO: 325417 - RNA, 64 nt, Homo Sapiens; identical to SEQ ID NO: 64772

SEQ ID NO: 325418 - RNA, 64 nt, Homo Sapiens; identical to SEQ ID NO: 64773

SEQ ID NO: 325419 - RNA, 64 nt, Homo Sapiens; identical to SEQ ID NO: 64774

SEQ ID NO: 325420 - RNA, 64 nt, Homo Sapiens; identical to SEQ ID NO: 64775

SEQ ID NO: 325421 - RNA, 64 nt, Homo Sapiens; identical to SEQ ID NO: 64776

SEQ ID NO: 325422 - RNA, 64 nt, Homo Sapiens; identical to SEQ ID NO: 64777

SEQ ID NO: 325423 - RNA, 64 nt, Homo Sapiens; identical to SEQ ID NO: 64778

SEQ ID NO: 325424 - RNA, 64 nt, Homo Sapiens; identical to SEQ ID NO: 64779

SEQ ID NO: 325425 - RNA, 64 nt, Homo Sapiens; identical to SEQ ID NO: 64780

SEQ ID NO: 325426 - RNA, 64 nt, Homo Sapiens; identical to SEQ ID NO: 64781

SEQ ID NO: 325427 - RNA, 64 nt, Homo Sapiens; identical to SEQ ID NO: 64782

SEQ ID NO: 325428 - RNA, 64 nt, Homo Sapiens; identical to SEQ ID NO: 64783

SEQ ID NO: 325429 - RNA, 64 nt, Homo Sapiens; identical to SEQ ID NO: 64784

SEQ ID NO: 325430 - RNA, 64 nt, Homo Sapiens; identical to SEQ ID NO: 64785

SEQ ID NO: 325431 - RNA, 64 nt, Homo Sapiens; identical to SEQ ID NO: 64786

SEQ ID NO: 325432 - RNA, 64 nt, Homo Sapiens; identical to SEQ ID NO: 64787

SEQ ID NO: 325433 - RNA, 64 nt, Homo Sapiens; identical to SEQ ID NO: 64788

SEQ ID NO: 325434 - RNA, 64 nt, Homo Sapiens; identical to SEQ ID NO: 64789

SEQ ID NO: 325435 - RNA, 64 nt, Homo Sapiens; identical to SEQ ID NO: 64790

SEQ ID NO: 325436 - RNA, 64 nt, Homo Sapiens; identical to SEQ ID NO: 64791

SEQ ID NO: 325437 - RNA, 64 nt, Homo Sapiens; identical to SEQ ID NO: 64792

SEQ ID NO: 325438 - RNA, 64 nt, Homo Sapiens; identical to SEQ ID NO: 64793

SEQ ID NO: 325439 - RNA, 64 nt, Homo Sapiens; identical to SEQ ID NO: 64794

SEQ ID NO: 325440 - RNA, 64 nt, Homo Sapiens; identical to SEQ ID NO: 64795

SEQ ID NO: 325441 - RNA, 64 nt, Homo Sapiens; identical to SEQ ID NO: 64796

SEQ ID NO: 325442 - RNA, 64 nt, Homo Sapiens; identical to SEQ ID NO: 64797

SEQ ID NO: 325443 - RNA, 64 nt, Homo Sapiens; identical to SEQ ID NO: 64798

SEQ ID NO: 325444 - RNA, 64 nt, Homo Sapiens; identical to SEQ ID NO: 64799

SEQ ID NO: 325445 - RNA, 64 nt, Homo Sapiens; identical to SEQ ID NO: 64800

SEQ ID NO: 325446 - RNA, 64 nt, Homo Sapiens; identical to SEQ ID NO: 64801

SEQ ID NO: 325447 - RNA, 64 nt, Homo Sapiens; identical to SEQ ID NO: 64802

SEQ ID NO: 325448 - RNA, 64 nt, Homo Sapiens; identical to SEQ ID NO: 64803

SEQ ID NO: 325449 - RNA, 64 nt, Homo Sapiens
uuuccuacauuuauuagauuuucauuuucuauuaacaauugaauaccauuucaguuuauagacu

SEQ ID NO: 325450 - RNA, 64 nt, Homo Sapiens
aguuaaguuguugcuaucgcaacaauccuggcagacaauugaguaauauuuugaugauuuauuu

SEQ ID NO: 325451 - RNA, 64 nt, Homo Sapiens
uuuuaauugauuuaguauuugaggauaacagaugacaauugaauuuaguugaucucgauaauuu

SEQ ID NO: 325452 - RNA, 64 nt, Homo Sapiens
gucuuuuuuucuugcuucuuuuugugaauuuuauacaauugaaagugucuuuauacuuuacugg

SEQ ID NO: 325453 - RNA, 64 nt, Homo Sapiens
acagugugaguuugaugaaaaccuuuuaauuuucacaauugauguugauguaacaucuuaauua

SEQ ID NO: 325454 - RNA, 64 nt, Homo Sapiens
uaacaucuuaauuaaccuuuacauuuuaauuuuuacaauugauguguguagucuggaauuguua

SEQ ID NO: 325455 - RNA, 64 nt, Homo Sapiens
guguuugcucaugaaaucagcuuauguacauacaacaauugaaaucucauuagaucaaaaggga

SEQ ID NO: 325456 - RNA, 64 nt, Homo Sapiens
gcagucuagcccuuuggauguucagccucuguauacaauugagguuugcacaagagucuguguu

SEQ ID NO: 325457 - RNA, 64 nt, Homo Sapiens
augccuuuuucugcgggaguaaaauuaguaugggacaauugaauagggagaguuagguuauuca

SEQ ID NO: 325458 - RNA, 64 nt, Homo Sapiens
caaguuagggauuugccagcuucuguugcucuuaacaauugauaaaggcuuugaauaagaaauu

SEQ ID NO: 325459 - RNA, 64 nt, Homo Sapiens
ucauggauauagagaguagaaucuaaaagucaaaacaauugaacuguucucaauuauuugcggg

SEQ ID NO: 325460 - RNA, 64 nt, Homo Sapiens
caaaaaauaacagcuaguauaaaagagauaaaauacaauugaagugaaaucauguuuuuuuaac

SEQ ID NO: 325461 - RNA, 64 nt, Homo Sapiens
ggacaggggguuuucaaaaggaacauggcucacucagagcuauaugguuagacguuucuccccu

SEQ ID NO: 325462 - RNA, 64 nt, Homo Sapiens
cggacccacgcccagaggaacgugcagaaaaaagcagagcuacauggcugugggcaacuauaag

SEQ ID NO: 325463 - RNA, 64 nt, Homo Sapiens
ugcugccucaggucaggccagggcagugcugcugcagagcuagaaggcccugcagcuacagcug

SEQ ID NO: 325464 - RNA, 64 nt, Homo Sapiens
cccguuccagaacuugcauacacugagcgggcuacagagcuagaaggcccugcagcuacagcug

SEQ ID NO: 325465 - RNA, 64 nt, Homo Sapiens
acuauuuugcuccuuuucugguguuacacauacacacucauacguguguguguguguaugugug

SEQ ID NO: 325466 - RNA, 64 nt, Homo Sapiens
cacagacuuccaccaugugcaucaggaaacaccucacucauacugucauauaaugcaacaggga

SEQ ID NO: 325467 - RNA, 64 nt, Homo Sapiens
cuuaugugugaguuggugaauucauuagugcucccacucauaucagcaauuacagcagagaaaa

SEQ ID NO: 325468 - RNA, 64 nt, Homo Sapiens
uuuagcugcaaccacacuaacauucuuguuacaucacucauacucacuugacucauuacgucgu

SEQ ID NO: 325469 - RNA, 64 nt, Homo Sapiens; identical to SEQ ID NO: 134270

SEQ ID NO: 325470 - RNA, 64 nt, Homo Sapiens; identical to SEQ ID NO: 134271

SEQ ID NO: 325471 - RNA, 64 nt, Homo Sapiens; identical to SEQ ID NO: 134272

SEQ ID NO: 325472 - RNA, 64 nt, Homo Sapiens; identical to SEQ ID NO: 134273

SEQ ID NO: 325473 - RNA, 64 nt, Homo Sapiens; identical to SEQ ID NO: 134274

SEQ ID NO: 325474 - RNA, 64 nt, Homo Sapiens; identical to SEQ ID NO: 134275

SEQ ID NO: 325475 - RNA, 64 nt, Homo Sapiens; identical to SEQ ID NO: 134276

SEQ ID NO: 325476 - RNA, 64 nt, Homo Sapiens; identical to SEQ ID NO: 134277

SEQ ID NO: 325477 - RNA, 64 nt, Homo Sapiens; identical to SEQ ID NO: 134278

SEQ ID NO: 325478 - RNA, 64 nt, Homo Sapiens; identical to SEQ ID NO: 134279

SEQ ID NO: 325479 - RNA, 64 nt, Homo Sapiens; identical to SEQ ID NO: 134280

SEQ ID NO: 325480 - RNA, 64 nt, Homo Sapiens; identical to SEQ ID NO: 134281

SEQ ID NO: 325481 - RNA, 64 nt, Homo Sapiens; identical to SEQ ID NO: 134282

SEQ ID NO: 325482 - RNA, 64 nt, Homo Sapiens; identical to SEQ ID NO: 134283

SEQ ID NO: 325483 - RNA, 64 nt, Homo Sapiens; identical to SEQ ID NO: 134284

SEQ ID NO: 325484 - RNA, 64 nt, Homo Sapiens; identical to SEQ ID NO: 134285

SEQ ID NO: 325485 - RNA, 64 nt, Homo Sapiens; identical to SEQ ID NO: 134286

SEQ ID NO: 325486 - RNA, 64 nt, Homo Sapiens; identical to SEQ ID NO: 134287

SEQ ID NO: 325487 - RNA, 64 nt, Homo Sapiens; identical to SEQ ID NO: 134288

SEQ ID NO: 325488 - RNA, 64 nt, Homo Sapiens; identical to SEQ ID NO: 134289

SEQ ID NO: 325489 - RNA, 64 nt, Homo Sapiens; identical to SEQ ID NO: 134290

SEQ ID NO: 325490 - RNA, 64 nt, Homo Sapiens; identical to SEQ ID NO: 134291

SEQ ID NO: 325491 - RNA, 64 nt, Homo Sapiens; identical to SEQ ID NO: 134292

SEQ ID NO: 325492 - RNA, 64 nt, Homo Sapiens; identical to SEQ ID NO: 134293

SEQ ID NO: 325493 - RNA, 64 nt, Homo Sapiens; identical to SEQ ID NO: 134294

SEQ ID NO: 325494 - RNA, 64 nt, Homo Sapiens; identical to SEQ ID NO: 134295

SEQ ID NO: 325495 - RNA, 64 nt, Homo Sapiens; identical to SEQ ID NO: 134296

SEQ ID NO: 325496 - RNA, 64 nt, Homo Sapiens; identical to SEQ ID NO: 134297

SEQ ID NO: 325497 - RNA, 64 nt, Homo Sapiens; identical to SEQ ID NO: 134298

SEQ ID NO: 325498 - RNA, 64 nt, Homo Sapiens; identical to SEQ ID NO: 134299

SEQ ID NO: 325499 - RNA, 64 nt, Homo Sapiens; identical to SEQ ID NO: 134300

SEQ ID NO: 325500 - RNA, 64 nt, Homo Sapiens; identical to SEQ ID NO: 134301

SEQ ID NO: 325501 - RNA, 64 nt, Homo Sapiens; identical to SEQ ID NO: 134302

SEQ ID NO: 325502 - RNA, 64 nt, Homo Sapiens; identical to SEQ ID NO: 134303

SEQ ID NO: 325503 - RNA, 64 nt, Homo Sapiens; identical to SEQ ID NO: 50556

SEQ ID NO: 325504 - RNA, 64 nt, Homo Sapiens; identical to SEQ ID NO: 50557

SEQ ID NO: 325505 - RNA, 64 nt, Homo Sapiens; identical to SEQ ID NO: 50558

SEQ ID NO: 325506 - RNA, 64 nt, Homo Sapiens; identical to SEQ ID NO: 50559

SEQ ID NO: 325507 - RNA, 64 nt, Homo Sapiens; identical to SEQ ID NO: 50560

SEQ ID NO: 325508 - RNA, 64 nt, Homo Sapiens; identical to SEQ ID NO: 50561

SEQ ID NO: 325509 - RNA, 64 nt, Homo Sapiens; identical to SEQ ID NO: 50562

SEQ ID NO: 325510 - RNA, 64 nt, Homo Sapiens; identical to SEQ ID NO: 50563

SEQ ID NO: 325511 - RNA, 64 nt, Homo Sapiens; identical to SEQ ID NO: 50564

SEQ ID NO: 325512 - RNA, 64 nt, Homo Sapiens; identical to SEQ ID NO: 50565

SEQ ID NO: 325513 - RNA, 64 nt, Homo Sapiens; identical to SEQ ID NO: 50566

SEQ ID NO: 325514 - RNA, 64 nt, Homo Sapiens; identical to SEQ ID NO: 50567

SEQ ID NO: 325515 - RNA, 64 nt, Homo Sapiens; identical to SEQ ID NO: 50568

SEQ ID NO: 325516 - RNA, 64 nt, Homo Sapiens; identical to SEQ ID NO: 50569

SEQ ID NO: 325517 - RNA, 64 nt, Homo Sapiens; identical to SEQ ID NO: 50570

SEQ ID NO: 325518 - RNA, 64 nt, Homo Sapiens; identical to SEQ ID NO: 50571

SEQ ID NO: 325519 - RNA, 64 nt, Homo Sapiens; identical to SEQ ID NO: 50572

SEQ ID NO: 325520 - RNA, 64 nt, Homo Sapiens; identical to SEQ ID NO: 50573

SEQ ID NO: 325521 - RNA, 64 nt, Homo Sapiens; identical to SEQ ID NO: 50574

SEQ ID NO: 325522 - RNA, 64 nt, Homo Sapiens; identical to SEQ ID NO: 50575

SEQ ID NO: 325523 - RNA, 64 nt, Homo Sapiens; identical to SEQ ID NO: 50576

SEQ ID NO: 325524 - RNA, 64 nt, Homo Sapiens; identical to SEQ ID NO: 50577

SEQ ID NO: 325525 - RNA, 64 nt, Homo Sapiens; identical to SEQ ID NO: 50578

SEQ ID NO: 325526 - RNA, 64 nt, Homo Sapiens; identical to SEQ ID NO: 50579

SEQ ID NO: 325527 - RNA, 64 nt, Homo Sapiens; identical to SEQ ID NO: 50580

SEQ ID NO: 325528 - RNA, 64 nt, Homo Sapiens; identical to SEQ ID NO: 50581

SEQ ID NO: 325529 - RNA, 64 nt, Homo Sapiens; identical to SEQ ID NO: 50582

SEQ ID NO: 325530 - RNA, 64 nt, Homo Sapiens; identical to SEQ ID NO: 50583

SEQ ID NO: 325531 - RNA, 64 nt, Homo Sapiens; identical to SEQ ID NO: 50584

SEQ ID NO: 325532 - RNA, 64 nt, Homo Sapiens; identical to SEQ ID NO: 50585

SEQ ID NO: 325533 - RNA, 64 nt, Homo Sapiens; identical to SEQ ID NO: 50586

SEQ ID NO: 325534 - RNA, 64 nt, Homo Sapiens; identical to SEQ ID NO: 50587

SEQ ID NO: 325535 - RNA, 64 nt, Homo Sapiens; identical to SEQ ID NO: 50588

SEQ ID NO: 325536 - RNA, 64 nt, Homo Sapiens; identical to SEQ ID NO: 50589

SEQ ID NO: 325537 - RNA, 64 nt, Homo Sapiens; identical to SEQ ID NO: 50590

SEQ ID NO: 325538 - RNA, 64 nt, Homo Sapiens; identical to SEQ ID NO: 50591

SEQ ID NO: 325539 - RNA, 64 nt, Homo Sapiens; identical to SEQ ID NO: 50592

SEQ ID NO: 325540 - RNA, 64 nt, Homo Sapiens; identical to SEQ ID NO: 50593

SEQ ID NO: 325541 - RNA, 64 nt, Homo Sapiens; identical to SEQ ID NO: 50594

SEQ ID NO: 325542 - RNA, 64 nt, Homo Sapiens; identical to SEQ ID NO: 50595

SEQ ID NO: 325543 - RNA, 64 nt, Homo Sapiens; identical to SEQ ID NO: 50596

SEQ ID NO: 325544 - RNA, 64 nt, Homo Sapiens; identical to SEQ ID NO: 50597

SEQ ID NO: 325545 - RNA, 64 nt, Homo Sapiens; identical to SEQ ID NO: 50598

SEQ ID NO: 325546 - RNA, 64 nt, Homo Sapiens; identical to SEQ ID NO: 50599

SEQ ID NO: 325547 - RNA, 64 nt, Homo Sapiens; identical to SEQ ID NO: 50600

SEQ ID NO: 325548 - RNA, 64 nt, Homo Sapiens; identical to SEQ ID NO: 50601

SEQ ID NO: 325549 - RNA, 64 nt, Homo Sapiens; identical to SEQ ID NO: 50602

SEQ ID NO: 325550 - RNA, 64 nt, Homo Sapiens; identical to SEQ ID NO: 50603

SEQ ID NO: 325551 - RNA, 64 nt, Homo Sapiens; identical to SEQ ID NO: 50604

SEQ ID NO: 325552 - RNA, 64 nt, Homo Sapiens; identical to SEQ ID NO: 50605

SEQ ID NO: 325553 - RNA, 64 nt, Homo Sapiens; identical to SEQ ID NO: 50606

SEQ ID NO: 325554 - RNA, 64 nt, Homo Sapiens; identical to SEQ ID NO: 50607

SEQ ID NO: 325555 - RNA, 64 nt, Homo Sapiens; identical to SEQ ID NO: 50608

SEQ ID NO: 325556 - RNA, 64 nt, Homo Sapiens; identical to SEQ ID NO: 50609

SEQ ID NO: 325557 - RNA, 64 nt, Homo Sapiens; identical to SEQ ID NO: 50610

SEQ ID NO: 325558 - RNA, 64 nt, Homo Sapiens; identical to SEQ ID NO: 50611

SEQ ID NO: 325559 - RNA, 64 nt, Homo Sapiens; identical to SEQ ID NO: 50612

SEQ ID NO: 325560 - RNA, 64 nt, Homo Sapiens; identical to SEQ ID NO: 50613

SEQ ID NO: 325561 - RNA, 64 nt, Homo Sapiens; identical to SEQ ID NO: 50614

SEQ ID NO: 325562 - RNA, 64 nt, Homo Sapiens; identical to SEQ ID NO: 50615

SEQ ID NO: 325563 - RNA, 64 nt, Homo Sapiens; identical to SEQ ID NO: 50616

SEQ ID NO: 325564 - RNA, 64 nt, Homo Sapiens; identical to SEQ ID NO: 50617

SEQ ID NO: 325565 - RNA, 64 nt, Homo Sapiens; identical to SEQ ID NO: 50618

SEQ ID NO: 325566 - RNA, 64 nt, Homo Sapiens; identical to SEQ ID NO: 50619

SEQ ID NO: 325567 - RNA, 64 nt, Homo Sapiens; identical to SEQ ID NO: 50620

SEQ ID NO: 325568 - RNA, 64 nt, Homo Sapiens; identical to SEQ ID NO: 50621

SEQ ID NO: 325569 - RNA, 64 nt, Homo Sapiens; identical to SEQ ID NO: 50622

SEQ ID NO: 325570 - RNA, 64 nt, Homo Sapiens; identical to SEQ ID NO: 50623

SEQ ID NO: 325571 - RNA, 64 nt, Homo Sapiens; identical to SEQ ID NO: 50624

SEQ ID NO: 325572 - RNA, 64 nt, Homo Sapiens; identical to SEQ ID NO: 50625

SEQ ID NO: 325573 - RNA, 64 nt, Homo Sapiens; identical to SEQ ID NO: 50626

SEQ ID NO: 325574 - RNA, 64 nt, Homo Sapiens; identical to SEQ ID NO: 50627

SEQ ID NO: 325575 - RNA, 64 nt, Homo Sapiens; identical to SEQ ID NO: 50628

SEQ ID NO: 325576 - RNA, 64 nt, Homo Sapiens; identical to SEQ ID NO: 50629

SEQ ID NO: 325577 - RNA, 64 nt, Homo Sapiens; identical to SEQ ID NO: 50630

SEQ ID NO: 325578 - RNA, 64 nt, Homo Sapiens; identical to SEQ ID NO: 50631

SEQ ID NO: 325579 - RNA, 64 nt, Homo Sapiens; identical to SEQ ID NO: 50632

SEQ ID NO: 325580 - RNA, 64 nt, Homo Sapiens; identical to SEQ ID NO: 50633

SEQ ID NO: 325581 - RNA, 64 nt, Homo Sapiens; identical to SEQ ID NO: 50634

SEQ ID NO: 325582 - RNA, 64 nt, Homo Sapiens; identical to SEQ ID NO: 50635

SEQ ID NO: 325583 - RNA, 64 nt, Homo Sapiens; identical to SEQ ID NO: 50636

SEQ ID NO: 325584 - RNA, 64 nt, Homo Sapiens; identical to SEQ ID NO: 50637

SEQ ID NO: 325585 - RNA, 64 nt, Homo Sapiens; identical to SEQ ID NO: 50638

SEQ ID NO: 325586 - RNA, 64 nt, Homo Sapiens; identical to SEQ ID NO: 50639

SEQ ID NO: 325587 - RNA, 64 nt, Homo Sapiens; identical to SEQ ID NO: 50640

SEQ ID NO: 325588 - RNA, 64 nt, Homo Sapiens; identical to SEQ ID NO: 50641

SEQ ID NO: 325589 - RNA, 64 nt, Homo Sapiens; identical to SEQ ID NO: 50642

SEQ ID NO: 325590 - RNA, 64 nt, Homo Sapiens; identical to SEQ ID NO: 50643

SEQ ID NO: 325591 - RNA, 64 nt, Homo Sapiens; identical to SEQ ID NO: 50644

SEQ ID NO: 325592 - RNA, 61 nt, Homo Sapiens
ggauucaaauguuuucauguaacuauguaaaaagcucuaagcucuagagucuagauccagu

SEQ ID NO: 325593 - RNA, 61 nt, Homo Sapiens
aauguuuucauguaacuauguaaaaagcucuaagcucuagagucuagauccagucacugac

SEQ ID NO: 325594 - RNA, 64 nt, Homo Sapiens
uucauuaaauggaauaauauugucaaaaagggcuugaggugaauuauaucccauauauuuaaua

SEQ ID NO: 325595 - RNA, 64 nt, Homo Sapiens
uucaguuauaaagucaaggaauuaauguauaauuugaggugaaaccuaauauuuuguucugcaa

SEQ ID NO: 325596 - RNA, 64 nt, Homo Sapiens
uagcaagaaguuucugugagguuacacagugaggugaggugaggaaaguuuguuagguuacaug

SEQ ID NO: 325597 - RNA, 64 nt, Homo Sapiens
ugagguagcaagaaguuucuacaugguuacacagugaggugaggcagugaaaguuuguuagguu

SEQ ID NO: 325598 - RNA, 64 nt, Homo Sapiens
accaugguuucucagccugcgacugcagacagagugaggugagccagguuugugauccucagga

SEQ ID NO: 325599 - RNA, 64 nt, Homo Sapiens
accuuauuaguguugugauaauuggaugacucauugaggugaaagaagacacuacucguuacau

SEQ ID NO: 325600 - RNA, 64 nt, Homo Sapiens
guggggacccaugauguaugggucucaccugacuugaggugaauuuuggagugaagggcccuga

SEQ ID NO: 325601 - RNA, 64 nt, Homo Sapiens
aggagcuggggcagaggcugagccgggaggcccuugaggugaggacacagcaggcccaggacca

SEQ ID NO: 325602 - RNA, 64 nt, Homo Sapiens; identical to SEQ ID NO: 284934

SEQ ID NO: 325603 - RNA, 64 nt, Homo Sapiens; identical to SEQ ID NO: 284935

SEQ ID NO: 325604 - RNA, 64 nt, Homo Sapiens; identical to SEQ ID NO: 284936

SEQ ID NO: 325605 - RNA, 64 nt, Homo Sapiens; identical to SEQ ID NO: 284937

SEQ ID NO: 325606 - RNA, 64 nt, Homo Sapiens; identical to SEQ ID NO: 284938

SEQ ID NO: 325607 - RNA, 64 nt, Homo Sapiens; identical to SEQ ID NO: 284939

SEQ ID NO: 325608 - RNA, 64 nt, Homo Sapiens; identical to SEQ ID NO: 284940

SEQ ID NO: 325609 - RNA, 64 nt, Homo Sapiens; identical to SEQ ID NO: 284941

SEQ ID NO: 325610 - RNA, 64 nt, Homo Sapiens; identical to SEQ ID NO: 284942

SEQ ID NO: 325611 - RNA, 64 nt, Homo Sapiens; identical to SEQ ID NO: 284943

SEQ ID NO: 325612 - RNA, 64 nt, Homo Sapiens; identical to SEQ ID NO: 284944

SEQ ID NO: 325613 - RNA, 64 nt, Homo Sapiens; identical to SEQ ID NO: 284945

SEQ ID NO: 325614 - RNA, 64 nt, Homo Sapiens; identical to SEQ ID NO: 284946

SEQ ID NO: 325615 - RNA, 64 nt, Homo Sapiens; identical to SEQ ID NO: 284947

SEQ ID NO: 325616 - RNA, 64 nt, Homo Sapiens; identical to SEQ ID NO: 284948

SEQ ID NO: 325617 - RNA, 63 nt, Homo Sapiens; identical to SEQ ID NO: 284949

SEQ ID NO: 325618 - RNA, 64 nt, Homo Sapiens
uugccuccccgaucagugugugccuguuuacagcacuaucuaucuuucucucuccaaaugucac

SEQ ID NO: 325619 - RNA, 64 nt, Homo Sapiens
guuaucagacagagcacugacuauguacuaucaaacuaucuaacaaucugcauaagucugauuc

SEQ ID NO: 325620 - RNA, 64 nt, Homo Sapiens
ucuguuuucgaauuucaacacuagaaugacuaaaacuaucuaccuauagaacuaucuguagaua

SEQ ID NO: 325621 - RNA, 64 nt, Homo Sapiens
acuaucuaccuauagaacuaucuguagauaguauacuaucuacacucugcucaacaagcucaga

SEQ ID NO: 325622 - RNA, 64 nt, Homo Sapiens
caauccacuuuugggguucauccauuuguggacugaaaaguauuauuaaguggggucacugaau

SEQ ID NO: 325623 - RNA, 64 nt, Homo Sapiens
auucuuugcaccaaauguuaguauucccaaccaugaaaaguaucgaagcaagagaguauuccua

SEQ ID NO: 325624 - RNA, 64 nt, Homo Sapiens
aaaaucgccuguaugaaaaauaccucgcuggauggaaaaguagauaugaacuuacauuucugug

SEQ ID NO: 325625 - RNA, 64 nt, Homo Sapiens
aggccacuuggcucacacagaagaaaggaguuaggaaaaguacugauugacuuaucaaaagaag

SEQ ID NO: 325626 - RNA, 64 nt, Homo Sapiens
aaaggaaaaaaaccagaaauuuaaaauagauacagaaaaguacacugguaauauuuuuauuucc

SEQ ID NO: 325627 - RNA, 64 nt, Homo Sapiens
guauaauauuuuuuccuuauaauuuagcauacaggaaaaguauuuauuuuuuaaguaggguauc

SEQ ID NO: 325628 - RNA, 64 nt, Homo Sapiens
caaaacccacauuuccuauccuuccccuaugauugaaaaguaaauaguccugccucguacuccc

SEQ ID NO: 325629 - RNA, 64 nt, Homo Sapiens
ugguugucaccuaugagaccgggagaagaaacaagaaaaguaacgccuugaugauucacuguug

SEQ ID NO: 325630 - RNA, 64 nt, Homo Sapiens
ugcucucguuuuauguucugacuguugaauggcagaaaaguauuggaggugauagucacuaaga

SEQ ID NO: 325631 - RNA, 64 nt, Homo Sapiens
gcaaauuguuucuuugugcugaaaauauucguaagaaaaguaaaacaaaaagcaauugcuauau

SEQ ID NO: 325632 - RNA, 64 nt, Homo Sapiens
aaucuugaacagguucacuaagcacccacccugugaaaaguauuauggaaaucacugcugcaca

SEQ ID NO: 325633 - RNA, 64 nt, Homo Sapiens
ugugaaaaguauuauggaaaucacugcugcacaggaaaaguaauucagauguuaaugccacuug

SEQ ID NO: 325634 - RNA, 64 nt, Homo Sapiens
ucuuuaaaaaucauauugccuuuagguuauaugggaaaaguagcacuauuauuugggaaaauug

SEQ ID NO: 325635 - RNA, 64 nt, Homo Sapiens
aaaaaagauucagguaauuaaacuuaagauaagugaaaaguacugccacagaaagggcucuuuu

SEQ ID NO: 325636 - RNA, 64 nt, Homo Sapiens
gauaaauaugagcaaaugaaguguaauaucuauagaaaaguagagugagggugaauuuauauau

SEQ ID NO: 325637 - RNA, 64 nt, Homo Sapiens
aaaguuuuugcuuguguccuccucagucagaauagaaaaguaacugaaauacuuuuaccuuucu

SEQ ID NO: 325638 - RNA, 64 nt, Homo Sapiens
uucugguucaagacugucauuuucuauuucaaccgaaaaguaagcauuuaacccggugaauaaa

SEQ ID NO: 325639 - RNA, 64 nt, Homo Sapiens
cuacuauaaaaagccaggaccauguuagaauuaggaaaaguaaccagcauuacugcaccucuug

SEQ ID NO: 325640 - RNA, 64 nt, Homo Sapiens
cacagagaaauuuaguaauuuuacuuaagaaauggaaaaguaguacuuuuggaaaccaaccaaa

SEQ ID NO: 325641 - RNA, 64 nt, Homo Sapiens
guuaaugguuucaaauaugcaaaauaaugaaaaagaaaaguauauauuuuaucaaauuugccuu

SEQ ID NO: 325642 - RNA, 64 nt, Homo Sapiens
uaguuacauguuuguuuguuuggaaaacgguauggaaaaguauuuuuucuggucauucuugacu

SEQ ID NO: 325643 - RNA, 64 nt, Homo Sapiens
uuuaauaaaguuuaaucucauacugaauuuucuggaaaaguaacuguuccuauauuaccauauu

SEQ ID NO: 325644 - RNA, 64 nt, Homo Sapiens
gacuacacaauuauguaccaucacaguauuaguggaaaaguaccaugugauuuaauucuccauu

SEQ ID NO: 325645 - RNA, 64 nt, Homo Sapiens
ugcagcaaaguuugggagcuacugauggacaugugaaaaguaaguauaaauggaauaaaauuaa

SEQ ID NO: 325646 - RNA, 64 nt, Homo Sapiens
ggccuugagcucuuuguuuuuauauuaaugaggagaaaaguaugaaaacaagaagucuuaagua

SEQ ID NO: 325647 - RNA, 64 nt, Homo Sapiens
uucuuaauugcuaaguaaucuguuugcacucuaggaaaaguaaauggagagguaaaagaaaggc

SEQ ID NO: 325648 - RNA, 64 nt, Homo Sapiens
aucggaauaacucugcaguggaugugccaugguggaaaaguacucaguuaauuuuaacaugugu

SEQ ID NO: 325649 - RNA, 64 nt, Homo Sapiens
cacaaagggcucugaagcucuaugaggaaugugugaaaaguauaauggaaagcuguguuaaugg

SEQ ID NO: 325650 - RNA, 64 nt, Homo Sapiens
gaugguauugguuuguuugguagauaagugggaggaaaaguacuguugcuacacuauuauaggc

SEQ ID NO: 325651 - RNA, 64 nt, Homo Sapiens
guucaucacucuuaaaauauguguuuucucuauagaaaaguaaaauguguuuauggucccaaac

SEQ ID NO: 325652 - RNA, 64 nt, Homo Sapiens
uuaauuaaugaaagagcuaaacggcaccugggcagaaaaguaucugugauuacaagcgugagcc

SEQ ID NO: 325653 - RNA, 64 nt, Homo Sapiens
ccuuuuuuuuuuuuugagacgucaaaaauccauagaaaaguaucuuagauuuuaaauuauuaaa

SEQ ID NO: 325654 - RNA, 64 nt, Homo Sapiens
ucuacagccauguccuauucacaaaaaagaagaagaaaaguacuagacucugucucaaaaaaaa

SEQ ID NO: 325655 - RNA, 64 nt, Homo Sapiens
ucaggcugggcacaguggcuaaugcugaguucaagaaaaguacugggggaggguucagggcagc

SEQ ID NO: 325656 - RNA, 64 nt, Homo Sapiens
uaaggauaacauuaucuacccagagaguuuagaagaaaaguaggaguccaaaggaagaguaaac

SEQ ID NO: 325657 - RNA, 64 nt, Homo Sapiens
uuugaacugauauaaaaaaaaaugcugaguaacagaaaaguauuaaugugcuugacaccaugac

SEQ ID NO: 325658 - RNA, 64 nt, Homo Sapiens
guuuggaggagcaaaguuaagcuuguuuuccaaagaaaaguauuuggaaggaucucuccacagg

SEQ ID NO: 325659 - RNA, 64 nt, Homo Sapiens
cguuacaucuuguaggaucuuaucuugauguuuagaaaaguauuuauugaaguguucugagcug

SEQ ID NO: 325660 - RNA, 64 nt, Homo Sapiens
aaauauugaaguguuuuuaaaaauuaaagaagaagaaaaguaaaagagcuuaccacuggcgccu

SEQ ID NO: 325661 - RNA, 64 nt, Homo Sapiens
ugcuuuuggaaauggccuuggcuaaaguaaaagggaaaaguagauccgauaacuuaaaaacgua

SEQ ID NO: 325662 - RNA, 64 nt, Homo Sapiens
aagagaaagagagagagagagaaagaaaaagaaagaaaaguaagaaagaaaaaagaaaaagaaa

SEQ ID NO: 325663 - RNA, 64 nt, Homo Sapiens
gaaagaaaaguaagaaagaaaaaagaaaaagaaagaaaaguaagaaagaaaaaaagaaaaagaa

SEQ ID NO: 325664 - RNA, 64 nt, Homo Sapiens
uguugauacugucuuagaaguuuaaaguagugaugaaaaguacacacuccauuggaucuuuuac

SEQ ID NO: 325665 - RNA, 64 nt, Homo Sapiens
gguuacuggugauguugaaaacuuuuuucauuuugaaaaguauuaaaagcaugguauaauugaa

SEQ ID NO: 325666 - RNA, 64 nt, Homo Sapiens
uuggagcgcagauaaauauaaggaugagguugaagaaaaguauaaggugagauuuaaaauaaau

SEQ ID NO: 325667 - RNA, 64 nt, Homo Sapiens
uuccaaguucuagauuaccugcauuguucaauuggaaaaguacagagcuuaccauaguuuuaua

SEQ ID NO: 325668 - RNA, 64 nt, Homo Sapiens; identical to SEQ ID NO: 200808

SEQ ID NO: 325669 - RNA, 64 nt, Homo Sapiens; identical to SEQ ID NO: 200809

SEQ ID NO: 325670 - RNA, 64 nt, Homo Sapiens; identical to SEQ ID NO: 200810

SEQ ID NO: 325671 - RNA, 64 nt, Homo Sapiens; identical to SEQ ID NO: 200811

SEQ ID NO: 325672 - RNA, 64 nt, Homo Sapiens; identical to SEQ ID NO: 200812

SEQ ID NO: 325673 - RNA, 64 nt, Homo Sapiens; identical to SEQ ID NO: 200813

SEQ ID NO: 325674 - RNA, 64 nt, Homo Sapiens; identical to SEQ ID NO: 200814

SEQ ID NO: 325675 - RNA, 64 nt, Homo Sapiens; identical to SEQ ID NO: 200815

SEQ ID NO: 325676 - RNA, 64 nt, Homo Sapiens; identical to SEQ ID NO: 216160

SEQ ID NO: 325677 - RNA, 64 nt, Homo Sapiens; identical to SEQ ID NO: 216161

SEQ ID NO: 325678 - RNA, 64 nt, Homo Sapiens; identical to SEQ ID NO: 216162

SEQ ID NO: 325679 - RNA, 64 nt, Homo Sapiens; identical to SEQ ID NO: 216163

SEQ ID NO: 325680 - RNA, 64 nt, Homo Sapiens; identical to SEQ ID NO: 216164

SEQ ID NO: 325681 - RNA, 64 nt, Homo Sapiens; identical to SEQ ID NO: 216165

SEQ ID NO: 325682 - RNA, 64 nt, Homo Sapiens; identical to SEQ ID NO: 216166

SEQ ID NO: 325683 - RNA, 64 nt, Homo Sapiens; identical to SEQ ID NO: 216167

SEQ ID NO: 325684 - RNA, 64 nt, Homo Sapiens; identical to SEQ ID NO: 216168

SEQ ID NO: 325685 - RNA, 64 nt, Homo Sapiens; identical to SEQ ID NO: 216169

SEQ ID NO: 325686 - RNA, 64 nt, Homo Sapiens; identical to SEQ ID NO: 216170

SEQ ID NO: 325687 - RNA, 64 nt, Homo Sapiens; identical to SEQ ID NO: 216171

SEQ ID NO: 325688 - RNA, 64 nt, Homo Sapiens; identical to SEQ ID NO: 216172

SEQ ID NO: 325689 - RNA, 64 nt, Homo Sapiens; identical to SEQ ID NO: 216173

SEQ ID NO: 325690 - RNA, 64 nt, Homo Sapiens; identical to SEQ ID NO: 216174

SEQ ID NO: 325691 - RNA, 64 nt, Homo Sapiens; identical to SEQ ID NO: 216175

SEQ ID NO: 325692 - RNA, 64 nt, Homo Sapiens; identical to SEQ ID NO: 216176

SEQ ID NO: 325693 - RNA, 64 nt, Homo Sapiens; identical to SEQ ID NO: 216177

SEQ ID NO: 325694 - RNA, 64 nt, Homo Sapiens; identical to SEQ ID NO: 216178

SEQ ID NO: 325695 - RNA, 64 nt, Homo Sapiens; identical to SEQ ID NO: 216179

SEQ ID NO: 325696 - RNA, 64 nt, Homo Sapiens; identical to SEQ ID NO: 70884

SEQ ID NO: 325697 - RNA, 64 nt, Homo Sapiens; identical to SEQ ID NO: 70885

SEQ ID NO: 325698 - RNA, 64 nt, Homo Sapiens; identical to SEQ ID NO: 70886

SEQ ID NO: 325699 - RNA, 64 nt, Homo Sapiens; identical to SEQ ID NO: 70887

SEQ ID NO: 325700 - RNA, 64 nt, Homo Sapiens; identical to SEQ ID NO: 70888

SEQ ID NO: 325701 - RNA, 64 nt, Homo Sapiens; identical to SEQ ID NO: 70889

SEQ ID NO: 325702 - RNA, 64 nt, Homo Sapiens
agagaaucuuuugaaauuguugugaucauauuuugcuuucuauggcuucuccuuaacuuauuga

SEQ ID NO: 325703 - RNA, 64 nt, Homo Sapiens
acaucauuaucaauuuccacaugaaaaagguggagcuuucuagaaaaaccaaccucuaaggcau

SEQ ID NO: 325704 - RNA, 64 nt, Homo Sapiens
acuggaggaccuggcaaaccugcccagauuccaugcuuucuauauuucuugcagagaacaaguc

SEQ ID NO: 325705 - RNA, 64 nt, Homo Sapiens
uucuaauuuacuuuuuccccaugauaugauaaaggcuuucuacaucuaagcaaaagauuugagu

SEQ ID NO: 325706 - RNA, 64 nt, Homo Sapiens
ucucuugcuugugcauaucuauauuuuagcaaaugcuuucuauuuacauaaguauuuguuacaa

SEQ ID NO: 325707 - RNA, 64 nt, Homo Sapiens
uauguaguagguuggcuuuauauagauauauguagcuuucuauauacauauguaaauauuuaua

SEQ ID NO: 325708 - RNA, 64 nt, Homo Sapiens
uaucugugaaguagacccuacagauuuuauucaagcuuucuaaauuuugucugauuuuacaaau

SEQ ID NO: 325709 - RNA, 64 nt, Homo Sapiens
uuaccucaaauguuuuguuuuaugcucugucugugcuuucuagguaucucuaagaugucuauua

SEQ ID NO: 325710 - RNA, 64 nt, Homo Sapiens
ucaaaccuguaacuuguauccugacuuaucucuugcuuucuaaaccuuguuucuaacugucuau

SEQ ID NO: 325711 - RNA, 64 nt, Homo Sapiens
auuuuagcaaguuuucuuaugaaaauaccuuugugcuuucuaaguauaaagauuuaaauuauuu

SEQ ID NO: 325712 - RNA, 64 nt, Homo Sapiens
acacuaacuauggaaaaugagcagcauuuuaaaugcuuucuagugaaaaauuauaaucuacuua

SEQ ID NO: 325713 - RNA, 64 nt, Homo Sapiens
cagcugucacaagagucuagaucaguuagcacaugcuuucuacucuucgauuauuaguauuauu

SEQ ID NO: 325714 - RNA, 64 nt, Homo Sapiens
aaaguacagaacauauccucuacgguuauuuccugcuuucuaauuaaaaaaauaauaaccaugg

SEQ ID NO: 325715 - RNA, 64 nt, Homo Sapiens
uuauauucuaaauuuuuacuuaacuuaauucaaugcuuucuacucauuuuucuauacuuuuuuu

SEQ ID NO: 325716 - RNA, 64 nt, Homo Sapiens
agccauugccuuccauguugauuuuugcaaaugugcuuucuaauaagucucugggcuauuuuuu

SEQ ID NO: 325717 - RNA, 64 nt, Homo Sapiens
uucuuauugauggcuaauauucaguccuuuuauagcuuucuaaguaaaauccauucuuuaucaa

SEQ ID NO: 325718 - RNA, 64 nt, Homo Sapiens; identical to SEQ ID NO: 117710

SEQ ID NO: 325719 - RNA, 64 nt, Homo Sapiens; identical to SEQ ID NO: 117711

SEQ ID NO: 325720 - RNA, 64 nt, Homo Sapiens; identical to SEQ ID NO: 117712

SEQ ID NO: 325721 - RNA, 64 nt, Homo Sapiens; identical to SEQ ID NO: 117713

SEQ ID NO: 325722 - RNA, 64 nt, Homo Sapiens; identical to SEQ ID NO: 117714

SEQ ID NO: 325723 - RNA, 64 nt, Homo Sapiens; identical to SEQ ID NO: 117715

SEQ ID NO: 325724 - RNA, 64 nt, Homo Sapiens; identical to SEQ ID NO: 117716

SEQ ID NO: 325725 - RNA, 64 nt, Homo Sapiens; identical to SEQ ID NO: 117717

SEQ ID NO: 325726 - RNA, 64 nt, Homo Sapiens; identical to SEQ ID NO: 117718

SEQ ID NO: 325727 - RNA, 64 nt, Homo Sapiens; identical to SEQ ID NO: 117719

SEQ ID NO: 325728 - RNA, 64 nt, Homo Sapiens; identical to SEQ ID NO: 117720

SEQ ID NO: 325729 - RNA, 64 nt, Homo Sapiens; identical to SEQ ID NO: 117721

SEQ ID NO: 325730 - RNA, 64 nt, Homo Sapiens; identical to SEQ ID NO: 117722

SEQ ID NO: 325731 - RNA, 64 nt, Homo Sapiens; identical to SEQ ID NO: 117723

SEQ ID NO: 325732 - RNA, 64 nt, Homo Sapiens; identical to SEQ ID NO: 117724

SEQ ID NO: 325733 - RNA, 64 nt, Homo Sapiens; identical to SEQ ID NO: 117725

SEQ ID NO: 325734 - RNA, 64 nt, Homo Sapiens; identical to SEQ ID NO: 117726

SEQ ID NO: 325735 - RNA, 64 nt, Homo Sapiens; identical to SEQ ID NO: 117727

SEQ ID NO: 325736 - RNA, 64 nt, Homo Sapiens; identical to SEQ ID NO: 117728

SEQ ID NO: 325737 - RNA, 64 nt, Homo Sapiens; identical to SEQ ID NO: 117729

SEQ ID NO: 325738 - RNA, 64 nt, Homo Sapiens; identical to SEQ ID NO: 117730

SEQ ID NO: 325739 - RNA, 64 nt, Homo Sapiens; identical to SEQ ID NO: 117731

SEQ ID NO: 325740 - RNA, 64 nt, Homo Sapiens; identical to SEQ ID NO: 117732

SEQ ID NO: 325741 - RNA, 64 nt, Homo Sapiens; identical to SEQ ID NO: 117733

SEQ ID NO: 325742 - RNA, 64 nt, Homo Sapiens; identical to SEQ ID NO: 117734

SEQ ID NO: 325743 - RNA, 64 nt, Homo Sapiens; identical to SEQ ID NO: 117735

SEQ ID NO: 325744 - RNA, 64 nt, Homo Sapiens; identical to SEQ ID NO: 117736

SEQ ID NO: 325745 - RNA, 64 nt, Homo Sapiens; identical to SEQ ID NO: 117737

SEQ ID NO: 325746 - RNA, 64 nt, Homo Sapiens; identical to SEQ ID NO: 117738

SEQ ID NO: 325747 - RNA, 64 nt, Homo Sapiens; identical to SEQ ID NO: 117739

SEQ ID NO: 325748 - RNA, 64 nt, Homo Sapiens; identical to SEQ ID NO: 117740

SEQ ID NO: 325749 - RNA, 64 nt, Homo Sapiens; identical to SEQ ID NO: 117741

SEQ ID NO: 325750 - RNA, 64 nt, Homo Sapiens; identical to SEQ ID NO: 117742

SEQ ID NO: 325751 - RNA, 64 nt, Homo Sapiens; identical to SEQ ID NO: 117743

SEQ ID NO: 325752 - RNA, 64 nt, Homo Sapiens; identical to SEQ ID NO: 117744

SEQ ID NO: 325753 - RNA, 64 nt, Homo Sapiens; identical to SEQ ID NO: 117745

SEQ ID NO: 325754 - RNA, 64 nt, Homo Sapiens; identical to SEQ ID NO: 117746

SEQ ID NO: 325755 - RNA, 64 nt, Homo Sapiens; identical to SEQ ID NO: 117747

SEQ ID NO: 325756 - RNA, 64 nt, Homo Sapiens; identical to SEQ ID NO: 117748

SEQ ID NO: 325757 - RNA, 64 nt, Homo Sapiens; identical to SEQ ID NO: 117749

SEQ ID NO: 325758 - RNA, 64 nt, Homo Sapiens; identical to SEQ ID NO: 117750

SEQ ID NO: 325759 - RNA, 64 nt, Homo Sapiens; identical to SEQ ID NO: 117751

SEQ ID NO: 325760 - RNA, 64 nt, Homo Sapiens; identical to SEQ ID NO: 117752

SEQ ID NO: 325761 - RNA, 64 nt, Homo Sapiens; identical to SEQ ID NO: 117753

SEQ ID NO: 325762 - RNA, 64 nt, Homo Sapiens; identical to SEQ ID NO: 117754

SEQ ID NO: 325763 - RNA, 64 nt, Homo Sapiens; identical to SEQ ID NO: 117755

SEQ ID NO: 325764 - RNA, 64 nt, Homo Sapiens; identical to SEQ ID NO: 117756

SEQ ID NO: 325765 - RNA, 64 nt, Homo Sapiens; identical to SEQ ID NO: 117757

SEQ ID NO: 325766 - RNA, 64 nt, Homo Sapiens; identical to SEQ ID NO: 117758

SEQ ID NO: 325767 - RNA, 64 nt, Homo Sapiens; identical to SEQ ID NO: 117759

SEQ ID NO: 325768 - RNA, 64 nt, Homo Sapiens; identical to SEQ ID NO: 117760

SEQ ID NO: 325769 - RNA, 64 nt, Homo Sapiens; identical to SEQ ID NO: 117761

SEQ ID NO: 325770 - RNA, 64 nt, Homo Sapiens; identical to SEQ ID NO: 117762

SEQ ID NO: 325771 - RNA, 64 nt, Homo Sapiens; identical to SEQ ID NO: 117763

SEQ ID NO: 325772 - RNA, 64 nt, Homo Sapiens; identical to SEQ ID NO: 117764

SEQ ID NO: 325773 - RNA, 64 nt, Homo Sapiens; identical to SEQ ID NO: 117765

SEQ ID NO: 325774 - RNA, 64 nt, Homo Sapiens; identical to SEQ ID NO: 117766

SEQ ID NO: 325775 - RNA, 64 nt, Homo Sapiens; identical to SEQ ID NO: 117767

SEQ ID NO: 325776 - RNA, 64 nt, Homo Sapiens; identical to SEQ ID NO: 117768

SEQ ID NO: 325777 - RNA, 64 nt, Homo Sapiens; identical to SEQ ID NO: 117769

SEQ ID NO: 325778 - RNA, 64 nt, Homo Sapiens; identical to SEQ ID NO: 117770

SEQ ID NO: 325779 - RNA, 64 nt, Homo Sapiens; identical to SEQ ID NO: 117771

SEQ ID NO: 325780 - RNA, 64 nt, Homo Sapiens; identical to SEQ ID NO: 117772

SEQ ID NO: 325781 - RNA, 64 nt, Homo Sapiens; identical to SEQ ID NO: 117773

SEQ ID NO: 325782 - RNA, 64 nt, Homo Sapiens; identical to SEQ ID NO: 117774

SEQ ID NO: 325783 - RNA, 64 nt, Homo Sapiens; identical to SEQ ID NO: 117775

SEQ ID NO: 325784 - RNA, 64 nt, Homo Sapiens; identical to SEQ ID NO: 117776

SEQ ID NO: 325785 - RNA, 64 nt, Homo Sapiens; identical to SEQ ID NO: 117777

SEQ ID NO: 325786 - RNA, 64 nt, Homo Sapiens; identical to SEQ ID NO: 117778

SEQ ID NO: 325787 - RNA, 64 nt, Homo Sapiens; identical to SEQ ID NO: 117779

SEQ ID NO: 325788 - RNA, 64 nt, Homo Sapiens; identical to SEQ ID NO: 117780

SEQ ID NO: 325789 - RNA, 64 nt, Homo Sapiens; identical to SEQ ID NO: 117781

SEQ ID NO: 325790 - RNA, 64 nt, Homo Sapiens; identical to SEQ ID NO: 117782

SEQ ID NO: 325791 - RNA, 64 nt, Homo Sapiens; identical to SEQ ID NO: 117783

SEQ ID NO: 325792 - RNA, 64 nt, Homo Sapiens; identical to SEQ ID NO: 117784

SEQ ID NO: 325793 - RNA, 64 nt, Homo Sapiens; identical to SEQ ID NO: 117785

SEQ ID NO: 325794 - RNA, 64 nt, Homo Sapiens; identical to SEQ ID NO: 117786

SEQ ID NO: 325795 - RNA, 59 nt, Homo Sapiens; identical to SEQ ID NO: 58889

SEQ ID NO: 325796 - RNA, 64 nt, Homo Sapiens; identical to SEQ ID NO: 117788

SEQ ID NO: 325797 - RNA, 64 nt, Homo Sapiens; identical to SEQ ID NO: 117789

SEQ ID NO: 325798 - RNA, 64 nt, Homo Sapiens; identical to SEQ ID NO: 117790

SEQ ID NO: 325799 - RNA, 64 nt, Homo Sapiens; identical to SEQ ID NO: 117791

SEQ ID NO: 325800 - RNA, 64 nt, Homo Sapiens; identical to SEQ ID NO: 117792

SEQ ID NO: 325801 - RNA, 64 nt, Homo Sapiens; identical to SEQ ID NO: 117793

SEQ ID NO: 325802 - RNA, 64 nt, Homo Sapiens; identical to SEQ ID NO: 117794

SEQ ID NO: 325803 - RNA, 64 nt, Homo Sapiens; identical to SEQ ID NO: 117795

SEQ ID NO: 325804 - RNA, 64 nt, Homo Sapiens; identical to SEQ ID NO: 117796

SEQ ID NO: 325805 - RNA, 64 nt, Homo Sapiens; identical to SEQ ID NO: 117797

SEQ ID NO: 325806 - RNA, 64 nt, Homo Sapiens; identical to SEQ ID NO: 117798

SEQ ID NO: 325807 - RNA, 64 nt, Homo Sapiens; identical to SEQ ID NO: 117799

SEQ ID NO: 325808 - RNA, 64 nt, Homo Sapiens; identical to SEQ ID NO: 117800

SEQ ID NO: 325809 - RNA, 64 nt, Homo Sapiens; identical to SEQ ID NO: 117801

SEQ ID NO: 325810 - RNA, 64 nt, Homo Sapiens; identical to SEQ ID NO: 117802

SEQ ID NO: 325811 - RNA, 64 nt, Homo Sapiens; identical to SEQ ID NO: 117803

SEQ ID NO: 325812 - RNA, 64 nt, Homo Sapiens; identical to SEQ ID NO: 117804

SEQ ID NO: 325813 - RNA, 64 nt, Homo Sapiens; identical to SEQ ID NO: 117805

SEQ ID NO: 325814 - RNA, 64 nt, Homo Sapiens; identical to SEQ ID NO: 117806

SEQ ID NO: 325815 - RNA, 64 nt, Homo Sapiens; identical to SEQ ID NO: 117807

SEQ ID NO: 325816 - RNA, 64 nt, Homo Sapiens; identical to SEQ ID NO: 117808

SEQ ID NO: 325817 - RNA, 64 nt, Homo Sapiens; identical to SEQ ID NO: 117809

SEQ ID NO: 325818 - RNA, 64 nt, Homo Sapiens; identical to SEQ ID NO: 117810

SEQ ID NO: 325819 - RNA, 64 nt, Homo Sapiens; identical to SEQ ID NO: 117811

SEQ ID NO: 325820 - RNA, 64 nt, Homo Sapiens; identical to SEQ ID NO: 117812

SEQ ID NO: 325821 - RNA, 64 nt, Homo Sapiens; identical to SEQ ID NO: 117813

SEQ ID NO: 325822 - RNA, 64 nt, Homo Sapiens; identical to SEQ ID NO: 117814

SEQ ID NO: 325823 - RNA, 64 nt, Homo Sapiens; identical to SEQ ID NO: 117815

SEQ ID NO: 325824 - RNA, 64 nt, Homo Sapiens; identical to SEQ ID NO: 117816

SEQ ID NO: 325825 - RNA, 64 nt, Homo Sapiens; identical to SEQ ID NO: 117817

SEQ ID NO: 325826 - RNA, 64 nt, Homo Sapiens; identical to SEQ ID NO: 117818

SEQ ID NO: 325827 - RNA, 64 nt, Homo Sapiens; identical to SEQ ID NO: 117819

SEQ ID NO: 325828 - RNA, 64 nt, Homo Sapiens; identical to SEQ ID NO: 117820

SEQ ID NO: 325829 - RNA, 64 nt, Homo Sapiens; identical to SEQ ID NO: 117821

SEQ ID NO: 325830 - RNA, 64 nt, Homo Sapiens; identical to SEQ ID NO: 117822

SEQ ID NO: 325831 - RNA, 64 nt, Homo Sapiens; identical to SEQ ID NO: 117823

SEQ ID NO: 325832 - RNA, 64 nt, Homo Sapiens
cgaagcgcugaaggaauaggcagggcaaguggugucgauggagugaaaaagugaggccaacaca

SEQ ID NO: 325833 - RNA, 64 nt, Homo Sapiens
cacagguccgcguggcugggaaagaaaaauagguucgauggacuccugagacuggguaauuuau

SEQ ID NO: 325834 - RNA, 64 nt, Homo Sapiens
ccuggguuguuuccaguuuguguucauugaccuaucgauggacaacugcuucauugaauagauu

SEQ ID NO: 325835 - RNA, 64 nt, Homo Sapiens
aaaaguauguuuuaaagguuccuugacagauguaucgauggaauguuggguugauuccccaaaa

SEQ ID NO: 325836 - RNA, 64 nt, Homo Sapiens
uuucuggcauccauguugguuuguagguguauggucgauggaagaccacuugcaacccacaugu

SEQ ID NO: 325837 - RNA, 64 nt, Homo Sapiens
uaaaaaggcucagguuuuuguuuuucccagaauaucgauggacuaagaaaaaagccugguuuug

SEQ ID NO: 325838 - RNA, 64 nt, Homo Sapiens
cacauuaauaauacuuuucauuggaacccccaaaucgauggagcaauaaaaagcccuccucaga

SEQ ID NO: 325839 - RNA, 64 nt, Homo Sapiens
guaaauaagcugccauuaacacuuguucaaaggaucgauggaccugacagccaugcuuuccuau

SEQ ID NO: 325840 - RNA, 64 nt, Homo Sapiens
uucuaaaaauuaauacagaggcucaaucuaaucuucgauggaaaaacaaacagacuugacuguu

SEQ ID NO: 325841 - RNA, 64 nt, Homo Sapiens
uugcauacaaggcuuuguaacgaucaagugcuaaucgauggaaauguuaagguagauuaacaua

SEQ ID NO: 325842 - RNA, 64 nt, Homo Sapiens
aguuuaggccacauaaaauugcuguuuaauguagucgauggaagacuuuaaacuaugcuucuag

SEQ ID NO: 325843 - RNA, 64 nt, Homo Sapiens
uuccuuguuucuguauagauguaagcacauaaauucgauggaauagaauuacguuaacaauguu

SEQ ID NO: 325844 - RNA, 64 nt, Homo Sapiens
ccuuuaguuggaguccgcguagucgggacagaauucgauggauucaagguggggauggaagcac

SEQ ID NO: 325845 - RNA, 64 nt, Homo Sapiens
ucagcaagcugcccagcccuggcccccacagcgcucgauggaccccaugugugugccaagcccu

SEQ ID NO: 325846 - RNA, 64 nt, Homo Sapiens
gcaagaaugaacugcuguuggguuugauugacugucgauggauuguggugugguguaucugaag

SEQ ID NO: 325847 - RNA, 64 nt, Homo Sapiens
ggcagccagagcccuuggacuggcacagggacccucgauggagcgaagcccucaaacgggaugc

SEQ ID NO: 325848 - RNA, 64 nt, Homo Sapiens
cacuggggcagucugccuuggcugucccccagccucgauggagaugucuccagugggggcagca

SEQ ID NO: 325849 - RNA, 64 nt, Homo Sapiens
cugcauugcuucucaucggacucuugcuccuccaucgauggacaaagccugagaggcgccggcu

SEQ ID NO: 325850 - RNA, 64 nt, Homo Sapiens
gagaaaggagacaagauguggcuuguaaaucuuaucgauggaagaucuuaauuauuuucaauag

SEQ ID NO: 325851 - RNA, 64 nt, Homo Sapiens
cauuuccacugggaagauuggaaagucacaaaaaucgauggaauucuuuuuagcauucucauca

SEQ ID NO: 325852 - RNA, 64 nt, Homo Sapiens
cgagugcggcggucuucagagggacaaucgugccucgauggaugucccuguguuccagcgugga

SEQ ID NO: 325853 - RNA, 64 nt, Homo Sapiens
cuaccuaagugugugucgccacccgauggaagauucgauggacauggacaugagcccccugagg

SEQ ID NO: 325854 - RNA, 64 nt, Homo Sapiens
cccuuugcugaccucugccaggacccacacagcuucgauggaucucaguguuuguuaacaaaau

SEQ ID NO: 325855 - RNA, 64 nt, Homo Sapiens
cuaacaguuauuuccccggguccagcuuaaagacucgauggaaggagguagaaccucugcuguu

SEQ ID NO: 325856 - RNA, 64 nt, Homo Sapiens
uaauggucacccuaaaaacacccacauaugcuuuucgauggaaccagguaaguugacgcuaaag

SEQ ID NO: 325857 - RNA, 64 nt, Homo Sapiens
cacacuuuuuggcugucaccuuaacagugccuuuucgauggaauucagauuauucugaguauug

SEQ ID NO: 325858 - RNA, 64 nt, Homo Sapiens
uuuaaacaggguggauuccacucugugggagccuucgauggaacucaagguggagcucagccuu

SEQ ID NO: 325859 - RNA, 64 nt, Homo Sapiens
guuauuucaauaaagccauguuuuauuggaauuuucgauggaauugcucauaauauauuccaau

SEQ ID NO: 325860 - RNA, 64 nt, Homo Sapiens
ggaugcacucucagaccaagccagagccauccgaucgauggauggccuugggaccauggccacc

SEQ ID NO: 325861 - RNA, 64 nt, Homo Sapiens
augaacggccuugcugggggaugagcagaagcucucgauggacaaagcccagcuccagggccag

SEQ ID NO: 325862 - RNA, 64 nt, Homo Sapiens
gcagaccaggcugagauggaggaaccugcuaaaaucgauggagaugcuucuagccucccaguag

SEQ ID NO: 325863 - RNA, 64 nt, Homo Sapiens
ucgugaagucacgucacacaggggagaggcgaggucgauggaacuggccacgcacaggcucugg

SEQ ID NO: 325864 - RNA, 64 nt, Homo Sapiens
ccguggagcaacuuccugcuccacgggaaagaggucgauggauuuaccccuggacccauaaguc

SEQ ID NO: 325865 - RNA, 64 nt, Homo Sapiens
gccucacccaccccaccuggccccccaagagcccucgauggacagcagugcccagagcccacgc

SEQ ID NO: 325866 - RNA, 64 nt, Homo Sapiens
gugaccugaaucuuucccuuaaccguacaguuucucgauggaauugugugaucagaagguggaa

SEQ ID NO: 325867 - RNA, 64 nt, Homo Sapiens
augccgcugggugcccggaggcggccauggugucucgauggacggcagccaggauggagcaccc

SEQ ID NO: 325868 - RNA, 64 nt, Homo Sapiens
auuuuauuaaauuuuuuccuuuuuucuauucauuucgauggacgcaaucuuaagccacccuggc

SEQ ID NO: 325869 - RNA, 64 nt, Homo Sapiens
uugcuucccuguucuugaagaaaaaaacaacacaucgauggacuguuuuuuaguuuuuccuuaa

SEQ ID NO: 325870 - RNA, 64 nt, Homo Sapiens
aggagcagggguuggagaaaggcaucccaaagcuucgauggagagcagggaagggggacccaag

SEQ ID NO: 325871 - RNA, 64 nt, Homo Sapiens
gguaggaggaugcauggaugaguggaugaguggaucgauggauguauugauaaauagauagaac

SEQ ID NO: 325872 - RNA, 64 nt, Homo Sapiens
gagaugaucauuagguacuucccugagcaaucuuucgauggaugcccuuguuugagugucuuau

SEQ ID NO: 325873 - RNA, 64 nt, Homo Sapiens
ugugcccuguugaaacuuagguuuuuccacgcaaucgauggauuguguccuaggaagacuuuuc

SEQ ID NO: 325874 - RNA, 64 nt, Homo Sapiens
cuccccccccccccacccauagggcagugggaucucgauggagcuuuccaccagcugccaguca

SEQ ID NO: 325875 - RNA, 64 nt, Homo Sapiens
acauccccccaccuccauuucuggcaaucuggacucgauggagaccucccaccgccuugccuca

SEQ ID NO: 325876 - RNA, 64 nt, Homo Sapiens
aauagugcuuguuuauucagaaacccuuaccccuuauucuuaaggagaagcaaaucugagagua

SEQ ID NO: 325877 - RNA, 64 nt, Homo Sapiens
aagugcuuucuugcauucauaagucccugaauuauauucuuaauuauuuauuguacaagagccc

SEQ ID NO: 325878 - RNA, 64 nt, Homo Sapiens
aaguccacaagaaugaucaaguaagauuuguuuuuauucuuacagacaucacccguguucaagu

SEQ ID NO: 325879 - RNA, 64 nt, Homo Sapiens
aaauauuucauuaaaaaugaugcacacauagauauauucuuacaaauuuugcuguauugcuguu

SEQ ID NO: 325880 - RNA, 64 nt, Homo Sapiens
gcaguucccucucguaaugauguaacuuuacaacuauucuuaaugcuugaacauguauuuaggg

SEQ ID NO: 325881 - RNA, 64 nt, Homo Sapiens
ggcaguuguuucuuugaauaugccuaaauaacaguauucuuaaaaucugacagacaaguaacau

SEQ ID NO: 325882 - RNA, 64 nt, Homo Sapiens
aagacaaaaaauauugauagucacuagaguaauguauucuuaaccuuuguaagaacugaucuca

SEQ ID NO: 325883 - RNA, 64 nt, Homo Sapiens
auucuuaaccuuuguaagaacugaucucagcauguauucuuaaaccuuuguaauuaccuauggu

SEQ ID NO: 325884 - RNA, 64 nt, Homo Sapiens
guaacaguuuguuaucaaaaugccugauaaaauauauucuuaauaaaagucuucauuucauaau

SEQ ID NO: 325885 - RNA, 64 nt, Homo Sapiens
uuugucucaaauauaccuugauggaggacuuuuuuauucuuauggaaauagugaauuccaacaa

SEQ ID NO: 325886 - RNA, 64 nt, Homo Sapiens
ccaaaauguuguuaugcaggcaugacuguaguuguauucuuaagauuuuucaguucuuguguuu

SEQ ID NO: 325887 - RNA, 64 nt, Homo Sapiens
uuuuuuuauauaaauuagagcgucaauucccuuuuauucuuacauucucuugccaaaauggauc

SEQ ID NO: 325888 - RNA, 64 nt, Homo Sapiens
uccauuuggcagauagauggucucuagccuauuguauucuuagaccaaaaaucauaaccugcug

SEQ ID NO: 325889 - RNA, 64 nt, Homo Sapiens
auaaugacuauguaaucucaaaaaacaaauaaaauauucuuaacauggacucuuaaggguauuu

SEQ ID NO: 325890 - RNA, 64 nt, Homo Sapiens
uaacaaauguuugccuuuacauuuauacuauuuauauucuuauauuauucuuacauuuuaucau

SEQ ID NO: 325891 - RNA, 64 nt, Homo Sapiens
uuuuaucauauuuauacuauuuuacucauuuauuuauucuuacaucccuaagauguuauuuauu

SEQ ID NO: 325892 - RNA, 64 nt, Homo Sapiens
gaaauguuugucauaugcgugaugucuucugaaauauucuuauaaccuuaaugaccaauugcuu

SEQ ID NO: 325893 - RNA, 64 nt, Homo Sapiens
gcuuuuagaauauuaauaggagacucaaaguuaauauucuuaacaacuuaaaauuaaaaaaagu

SEQ ID NO: 325894 - RNA, 64 nt, Homo Sapiens
cucugucuuaaaagagaccaucaaaccuauuaaguauucuuauuguuuaucuuuuuuuaauugc

SEQ ID NO: 325895 - RNA, 64 nt, Homo Sapiens
aauauaguuucguagaaaaacauuuuauauguacuauucuuaaagaucacaauuauuuuuaaac

SEQ ID NO: 325896 - RNA, 64 nt, Homo Sapiens
augguugcuuucccuauuugucuaucaauucaaguauucuuacuaaguagagaguaacucauau

SEQ ID NO: 325897 - RNA, 64 nt, Homo Sapiens
uuaagaauaucuuagucaucaaacuuggugaguguauucuuauaagagacucuaaaaacuaacc

SEQ ID NO: 325898 - RNA, 64 nt, Homo Sapiens
ucguuuacuugcauaauauaucaucaauuugacauauucuuaaaacuagagggugugagaagca

SEQ ID NO: 325899 - RNA, 64 nt, Homo Sapiens
ucuuuauaaaaauggcacauuuuacaaaguaguuuauucuuauuauacuuucugcuggagagug

SEQ ID NO: 325900 - RNA, 64 nt, Homo Sapiens
gacaagucccaagaugccagaugacugucuucccuauucuuagggagcuuugcuccaggacagg

SEQ ID NO: 325901 - RNA, 64 nt, Homo Sapiens
auuaagugggcuggagaagagucuuauuagugucuauucuuaaacagcagguuggggugguuaa

SEQ ID NO: 325902 - RNA, 64 nt, Homo Sapiens
ugaaaguaaaauauacuaugucuugguuuugaggauauuggauacaaaacucucuuccuuuagg

SEQ ID NO: 325903 - RNA, 64 nt, Homo Sapiens
auggaugagcacuucagaacaggucauuuuccugauauuggaagugacauguggcccuauagga

SEQ ID NO: 325904 - RNA, 64 nt, Homo Sapiens
ucuucaaucuuaaacauuucguccaguuuuaaaaauauuggacauucuaccuguauaugguaau

SEQ ID NO: 325905 - RNA, 64 nt, Homo Sapiens
uacugguuuuaauaccugcucaaacugguuuuaaauauuggacauuuagaaguucccccaauua

SEQ ID NO: 325906 - RNA, 64 nt, Homo Sapiens
uaaaaaugguuugagcgucaauguauugaaauacauauuggaaaugggaaaaguggaaacaaac

SEQ ID NO: 325907 - RNA, 64 nt, Homo Sapiens
aaguuuuuuccuguuaaugcucaaagucacugguauauuggauuuugcuugcaacauuuaagac

SEQ ID NO: 325908 - RNA, 64 nt, Homo Sapiens
aaaacauagaacaaaaucaccagugacaaucaucauauuggagcguuugugaggaccuuugacu

SEQ ID NO: 325909 - RNA, 64 nt, Homo Sapiens
uguugcacuuucagccugugaaugaacugauuauauauuggaauuaauuacagauuuaauauaa

SEQ ID NO: 325910 - RNA, 64 nt, Homo Sapiens
cuuggagaaaacuguucaguaaaauauacuggaaauauuggauuuagagauaagaaaguauaug

SEQ ID NO: 325911 - RNA, 64 nt, Homo Sapiens
aguagauaaugaauuaagcagacacauuuacucaauauuggagaucuacaugugugccccuaaa

SEQ ID NO: 325912 - RNA, 64 nt, Homo Sapiens
agggugguuagcacauucauucuaggauggauguauauuggagaacugugagacuuuauugucc

SEQ ID NO: 325913 - RNA, 64 nt, Homo Sapiens
ucaugacugugagacuuuauaaccuaaauauguuauauuggaaacuauuauuccagcagucuga

SEQ ID NO: 325914 - RNA, 64 nt, Homo Sapiens
ugauucucauaccuuacuaaauauaagauaauucauauuggagagaaauucuacagaugugaag

SEQ ID NO: 325915 - RNA, 64 nt, Homo Sapiens
aaaugguugucacacuugauuauagguaauauucauauuggaaaaauuuccuacaaguaagaac

SEQ ID NO: 325916 - RNA, 64 nt, Homo Sapiens
ggucacucaaacuuuguucaacaucagggaauuuauauuggagagcugucuugcaaauguaaua

SEQ ID NO: 325917 - RNA, 64 nt, Homo Sapiens
auuuuucagugauucuucuccuaugaguauauuaauauuggaaacuucucccuggaugcaaaac

SEQ ID NO: 325918 - RNA, 64 nt, Homo Sapiens
gcuuucuguuuuucuacauuauugaacaucaucaauauuggagaaauucuggagagaaugcccc

SEQ ID NO: 325919 - RNA, 64 nt, Homo Sapiens
gcuaaaugcaauagaaagaucuuuuuuaggagcaauauuggaagacaauuagacugacagcuga

SEQ ID NO: 325920 - RNA, 64 nt, Homo Sapiens
agggccuccccaugaccuaauaaagacacuagucauauuggauuguccuaaucuucucuucuua

SEQ ID NO: 325921 - RNA, 64 nt, Homo Sapiens
guucacacuagagaagagucucugcucuccuuggauauuggagaggaaaauguuuacccaaagg

SEQ ID NO: 325922 - RNA, 64 nt, Homo Sapiens
auacacaccugaguaagaucuccagucucauuaaauauuggagagggcuuaugagugcagugag

SEQ ID NO: 325923 - RNA, 64 nt, Homo Sapiens
caguaugcaugaagacaugagaaggaauuuccagauauuggaaaauuagccaguugaggaagua

SEQ ID NO: 325924 - RNA, 64 nt, Homo Sapiens
ccuguuuuagaaggagccuacaaaauaauaaaggauauuggagaugugcaugugaguauguuug

SEQ ID NO: 325925 - RNA, 64 nt, Homo Sapiens
cuaaagaauucuguccacuuuagugguuuauuagauauuggaaccucaccuuguucauuucaca

SEQ ID NO: 325926 - RNA, 64 nt, Homo Sapiens
ucagcugcugagaaagauggaaucaaagaagauaauauuggaaagaggaggcuuacaaacagca

SEQ ID NO: 325927 - RNA, 64 nt, Homo Sapiens; identical to SEQ ID NO: 60878

SEQ ID NO: 325928 - RNA, 64 nt, Homo Sapiens; identical to SEQ ID NO: 60879

SEQ ID NO: 325929 - RNA, 64 nt, Homo Sapiens; identical to SEQ ID NO: 60880

SEQ ID NO: 325930 - RNA, 64 nt, Homo Sapiens; identical to SEQ ID NO: 60881

SEQ ID NO: 325931 - RNA, 64 nt, Homo Sapiens; identical to SEQ ID NO: 60882

SEQ ID NO: 325932 - RNA, 64 nt, Homo Sapiens; identical to SEQ ID NO: 60883

SEQ ID NO: 325933 - RNA, 64 nt, Homo Sapiens; identical to SEQ ID NO: 60884

SEQ ID NO: 325934 - RNA, 64 nt, Homo Sapiens; identical to SEQ ID NO: 60885

SEQ ID NO: 325935 - RNA, 64 nt, Homo Sapiens; identical to SEQ ID NO: 60886

SEQ ID NO: 325936 - RNA, 64 nt, Homo Sapiens; identical to SEQ ID NO: 60887

SEQ ID NO: 325937 - RNA, 64 nt, Homo Sapiens; identical to SEQ ID NO: 60888

SEQ ID NO: 325938 - RNA, 64 nt, Homo Sapiens; identical to SEQ ID NO: 60889

SEQ ID NO: 325939 - RNA, 64 nt, Homo Sapiens; identical to SEQ ID NO: 60890

SEQ ID NO: 325940 - RNA, 64 nt, Homo Sapiens; identical to SEQ ID NO: 60891

SEQ ID NO: 325941 - RNA, 64 nt, Homo Sapiens; identical to SEQ ID NO: 60892

SEQ ID NO: 325942 - RNA, 64 nt, Homo Sapiens; identical to SEQ ID NO: 60893

SEQ ID NO: 325943 - RNA, 64 nt, Homo Sapiens; identical to SEQ ID NO: 60894

SEQ ID NO: 325944 - RNA, 64 nt, Homo Sapiens; identical to SEQ ID NO: 60895

SEQ ID NO: 325945 - RNA, 64 nt, Homo Sapiens; identical to SEQ ID NO: 60896

SEQ ID NO: 325946 - RNA, 64 nt, Homo Sapiens; identical to SEQ ID NO: 60897

SEQ ID NO: 325947 - RNA, 64 nt, Homo Sapiens; identical to SEQ ID NO: 60898

SEQ ID NO: 325948 - RNA, 64 nt, Homo Sapiens; identical to SEQ ID NO: 60899

SEQ ID NO: 325949 - RNA, 64 nt, Homo Sapiens; identical to SEQ ID NO: 60900

SEQ ID NO: 325950 - RNA, 64 nt, Homo Sapiens; identical to SEQ ID NO: 60901

SEQ ID NO: 325951 - RNA, 64 nt, Homo Sapiens; identical to SEQ ID NO: 60902

SEQ ID NO: 325952 - RNA, 64 nt, Homo Sapiens; identical to SEQ ID NO: 60903

SEQ ID NO: 325953 - RNA, 64 nt, Homo Sapiens; identical to SEQ ID NO: 60904

SEQ ID NO: 325954 - RNA, 64 nt, Homo Sapiens; identical to SEQ ID NO: 60905

SEQ ID NO: 325955 - RNA, 64 nt, Homo Sapiens; identical to SEQ ID NO: 60906

SEQ ID NO: 325956 - RNA, 64 nt, Homo Sapiens; identical to SEQ ID NO: 60907

SEQ ID NO: 325957 - RNA, 64 nt, Homo Sapiens; identical to SEQ ID NO: 60908

SEQ ID NO: 325958 - RNA, 64 nt, Homo Sapiens; identical to SEQ ID NO: 60909

SEQ ID NO: 325959 - RNA, 64 nt, Homo Sapiens; identical to SEQ ID NO: 60910

SEQ ID NO: 325960 - RNA, 64 nt, Homo Sapiens; identical to SEQ ID NO: 60911

SEQ ID NO: 325961 - RNA, 64 nt, Homo Sapiens; identical to SEQ ID NO: 60912

SEQ ID NO: 325962 - RNA, 64 nt, Homo Sapiens; identical to SEQ ID NO: 60913

SEQ ID NO: 325963 - RNA, 64 nt, Homo Sapiens; identical to SEQ ID NO: 60914

SEQ ID NO: 325964 - RNA, 64 nt, Homo Sapiens; identical to SEQ ID NO: 60915

SEQ ID NO: 325965 - RNA, 64 nt, Homo Sapiens; identical to SEQ ID NO: 60916

SEQ ID NO: 325966 - RNA, 64 nt, Homo Sapiens; identical to SEQ ID NO: 60917

SEQ ID NO: 325967 - RNA, 64 nt, Homo Sapiens; identical to SEQ ID NO: 60918

SEQ ID NO: 325968 - RNA, 64 nt, Homo Sapiens; identical to SEQ ID NO: 60919

SEQ ID NO: 325969 - RNA, 64 nt, Homo Sapiens; identical to SEQ ID NO: 60920

SEQ ID NO: 325970 - RNA, 64 nt, Homo Sapiens; identical to SEQ ID NO: 60921

SEQ ID NO: 325971 - RNA, 64 nt, Homo Sapiens; identical to SEQ ID NO: 60922

SEQ ID NO: 325972 - RNA, 64 nt, Homo Sapiens; identical to SEQ ID NO: 60923

SEQ ID NO: 325973 - RNA, 64 nt, Homo Sapiens; identical to SEQ ID NO: 60924

SEQ ID NO: 325974 - RNA, 64 nt, Homo Sapiens; identical to SEQ ID NO: 60925

SEQ ID NO: 325975 - RNA, 64 nt, Homo Sapiens; identical to SEQ ID NO: 60926

SEQ ID NO: 325976 - RNA, 64 nt, Homo Sapiens; identical to SEQ ID NO: 60927

SEQ ID NO: 325977 - RNA, 64 nt, Homo Sapiens; identical to SEQ ID NO: 60928

SEQ ID NO: 325978 - RNA, 64 nt, Homo Sapiens; identical to SEQ ID NO: 60929

SEQ ID NO: 325979 - RNA, 64 nt, Homo Sapiens; identical to SEQ ID NO: 60930

SEQ ID NO: 325980 - RNA, 64 nt, Homo Sapiens; identical to SEQ ID NO: 60931

SEQ ID NO: 325981 - RNA, 64 nt, Homo Sapiens; identical to SEQ ID NO: 60932

SEQ ID NO: 325982 - RNA, 64 nt, Homo Sapiens; identical to SEQ ID NO: 60933

SEQ ID NO: 325983 - RNA, 64 nt, Homo Sapiens
uuaagaggacuagcacccugcgggguuggguugccggucagagcagugggcauaccaguuucca

SEQ ID NO: 325984 - RNA, 64 nt, Homo Sapiens
accuccucaaagugggcauagcuugacccuggaacggucagacauuccaccuugcagugaugca

SEQ ID NO: 325985 - RNA, 64 nt, Homo Sapiens
uggaccuggccagaugucuggguugaccaggagccggucagagacacucuuccagcucccuggg

SEQ ID NO: 325986 - RNA, 64 nt, Homo Sapiens
cugaaaaggggcacugcacgggcacaggggcacacggucagaggcggggaugucucgcuucugu

SEQ ID NO: 325987 - RNA, 64 nt, Homo Sapiens; identical to SEQ ID NO: 58312

SEQ ID NO: 325988 - RNA, 64 nt, Homo Sapiens; identical to SEQ ID NO: 58313

SEQ ID NO: 325989 - RNA, 64 nt, Homo Sapiens; identical to SEQ ID NO: 58314

SEQ ID NO: 325990 - RNA, 64 nt, Homo Sapiens; identical to SEQ ID NO: 58315

SEQ ID NO: 325991 - RNA, 64 nt, Homo Sapiens; identical to SEQ ID NO: 58316

SEQ ID NO: 325992 - RNA, 64 nt, Homo Sapiens; identical to SEQ ID NO: 58317

SEQ ID NO: 325993 - RNA, 64 nt, Homo Sapiens; identical to SEQ ID NO: 58318

SEQ ID NO: 325994 - RNA, 64 nt, Homo Sapiens; identical to SEQ ID NO: 58319

SEQ ID NO: 325995 - RNA, 64 nt, Homo Sapiens; identical to SEQ ID NO: 58320

SEQ ID NO: 325996 - RNA, 64 nt, Homo Sapiens; identical to SEQ ID NO: 58321

SEQ ID NO: 325997 - RNA, 64 nt, Homo Sapiens; identical to SEQ ID NO: 58322

SEQ ID NO: 325998 - RNA, 64 nt, Homo Sapiens; identical to SEQ ID NO: 58323

SEQ ID NO: 325999 - RNA, 64 nt, Homo Sapiens; identical to SEQ ID NO: 58324

SEQ ID NO: 326000 - RNA, 64 nt, Homo Sapiens; identical to SEQ ID NO: 58325

SEQ ID NO: 326001 - RNA, 64 nt, Homo Sapiens; identical to SEQ ID NO: 58326

SEQ ID NO: 326002 - RNA, 64 nt, Homo Sapiens; identical to SEQ ID NO: 58327

SEQ ID NO: 326003 - RNA, 64 nt, Homo Sapiens; identical to SEQ ID NO: 58328

SEQ ID NO: 326004 - RNA, 64 nt, Homo Sapiens; identical to SEQ ID NO: 58329

SEQ ID NO: 326005 - RNA, 64 nt, Homo Sapiens; identical to SEQ ID NO: 58330

SEQ ID NO: 326006 - RNA, 64 nt, Homo Sapiens; identical to SEQ ID NO: 58331

SEQ ID NO: 326007 - RNA, 64 nt, Homo Sapiens; identical to SEQ ID NO: 58332

SEQ ID NO: 326008 - RNA, 64 nt, Homo Sapiens; identical to SEQ ID NO: 58333

SEQ ID NO: 326009 - RNA, 64 nt, Homo Sapiens; identical to SEQ ID NO: 58334

SEQ ID NO: 326010 - RNA, 64 nt, Homo Sapiens; identical to SEQ ID NO: 58335

SEQ ID NO: 326011 - RNA, 64 nt, Homo Sapiens; identical to SEQ ID NO: 58336

SEQ ID NO: 326012 - RNA, 64 nt, Homo Sapiens; identical to SEQ ID NO: 58337

SEQ ID NO: 326013 - RNA, 64 nt, Homo Sapiens; identical to SEQ ID NO: 58338

SEQ ID NO: 326014 - RNA, 64 nt, Homo Sapiens; identical to SEQ ID NO: 58339

SEQ ID NO: 326015 - RNA, 64 nt, Homo Sapiens; identical to SEQ ID NO: 58340

SEQ ID NO: 326016 - RNA, 64 nt, Homo Sapiens; identical to SEQ ID NO: 58341

SEQ ID NO: 326017 - RNA, 64 nt, Homo Sapiens; identical to SEQ ID NO: 58342

SEQ ID NO: 326018 - RNA, 64 nt, Homo Sapiens; identical to SEQ ID NO: 58343

SEQ ID NO: 326019 - RNA, 64 nt, Homo Sapiens; identical to SEQ ID NO: 58344

SEQ ID NO: 326020 - RNA, 64 nt, Homo Sapiens; identical to SEQ ID NO: 58345

SEQ ID NO: 326021 - RNA, 64 nt, Homo Sapiens; identical to SEQ ID NO: 58346

SEQ ID NO: 326022 - RNA, 64 nt, Homo Sapiens; identical to SEQ ID NO: 58347

SEQ ID NO: 326023 - RNA, 64 nt, Homo Sapiens; identical to SEQ ID NO: 58348

SEQ ID NO: 326024 - RNA, 64 nt, Homo Sapiens; identical to SEQ ID NO: 58349

SEQ ID NO: 326025 - RNA, 64 nt, Homo Sapiens; identical to SEQ ID NO: 58350

SEQ ID NO: 326026 - RNA, 64 nt, Homo Sapiens; identical to SEQ ID NO: 58351

SEQ ID NO: 326027 - RNA, 64 nt, Homo Sapiens; identical to SEQ ID NO: 58352

SEQ ID NO: 326028 - RNA, 64 nt, Homo Sapiens; identical to SEQ ID NO: 58353

SEQ ID NO: 326029 - RNA, 64 nt, Homo Sapiens; identical to SEQ ID NO: 58354

SEQ ID NO: 326030 - RNA, 64 nt, Homo Sapiens; identical to SEQ ID NO: 58355

SEQ ID NO: 326031 - RNA, 64 nt, Homo Sapiens; identical to SEQ ID NO: 58356

SEQ ID NO: 326032 - RNA, 64 nt, Homo Sapiens; identical to SEQ ID NO: 58357

SEQ ID NO: 326033 - RNA, 64 nt, Homo Sapiens; identical to SEQ ID NO: 58358

SEQ ID NO: 326034 - RNA, 64 nt, Homo Sapiens; identical to SEQ ID NO: 58359

SEQ ID NO: 326035 - RNA, 64 nt, Homo Sapiens; identical to SEQ ID NO: 58360

SEQ ID NO: 326036 - RNA, 64 nt, Homo Sapiens; identical to SEQ ID NO: 58361

SEQ ID NO: 326037 - RNA, 64 nt, Homo Sapiens; identical to SEQ ID NO: 58362

SEQ ID NO: 326038 - RNA, 64 nt, Homo Sapiens; identical to SEQ ID NO: 58363

SEQ ID NO: 326039 - RNA, 64 nt, Homo Sapiens; identical to SEQ ID NO: 58364

SEQ ID NO: 326040 - RNA, 64 nt, Homo Sapiens; identical to SEQ ID NO: 58365

SEQ ID NO: 326041 - RNA, 64 nt, Homo Sapiens; identical to SEQ ID NO: 58366

SEQ ID NO: 326042 - RNA, 64 nt, Homo Sapiens; identical to SEQ ID NO: 58367

SEQ ID NO: 326043 - RNA, 64 nt, Homo Sapiens; identical to SEQ ID NO: 58368

SEQ ID NO: 326044 - RNA, 64 nt, Homo Sapiens; identical to SEQ ID NO: 58369

SEQ ID NO: 326045 - RNA, 64 nt, Homo Sapiens; identical to SEQ ID NO: 58370

SEQ ID NO: 326046 - RNA, 64 nt, Homo Sapiens; identical to SEQ ID NO: 58371

SEQ ID NO: 326047 - RNA, 64 nt, Homo Sapiens; identical to SEQ ID NO: 58372

SEQ ID NO: 326048 - RNA, 64 nt, Homo Sapiens; identical to SEQ ID NO: 58373

SEQ ID NO: 326049 - RNA, 64 nt, Homo Sapiens; identical to SEQ ID NO: 58374

SEQ ID NO: 326050 - RNA, 64 nt, Homo Sapiens; identical to SEQ ID NO: 58375

SEQ ID NO: 326051 - RNA, 64 nt, Homo Sapiens; identical to SEQ ID NO: 58376

SEQ ID NO: 326052 - RNA, 64 nt, Homo Sapiens; identical to SEQ ID NO: 58377

SEQ ID NO: 326053 - RNA, 64 nt, Homo Sapiens; identical to SEQ ID NO: 58378

SEQ ID NO: 326054 - RNA, 64 nt, Homo Sapiens; identical to SEQ ID NO: 58379

SEQ ID NO: 326055 - RNA, 64 nt, Homo Sapiens; identical to SEQ ID NO: 58380

SEQ ID NO: 326056 - RNA, 64 nt, Homo Sapiens; identical to SEQ ID NO: 58381

SEQ ID NO: 326057 - RNA, 64 nt, Homo Sapiens; identical to SEQ ID NO: 58382

SEQ ID NO: 326058 - RNA, 64 nt, Homo Sapiens; identical to SEQ ID NO: 58383

SEQ ID NO: 326059 - RNA, 64 nt, Homo Sapiens; identical to SEQ ID NO: 58384

SEQ ID NO: 326060 - RNA, 64 nt, Homo Sapiens; identical to SEQ ID NO: 58385

SEQ ID NO: 326061 - RNA, 64 nt, Homo Sapiens; identical to SEQ ID NO: 58386

SEQ ID NO: 326062 - RNA, 64 nt, Homo Sapiens; identical to SEQ ID NO: 58387

SEQ ID NO: 326063 - RNA, 64 nt, Homo Sapiens; identical to SEQ ID NO: 58388

SEQ ID NO: 326064 - RNA, 64 nt, Homo Sapiens; identical to SEQ ID NO: 58389

SEQ ID NO: 326065 - RNA, 64 nt, Homo Sapiens; identical to SEQ ID NO: 58390

SEQ ID NO: 326066 - RNA, 64 nt, Homo Sapiens; identical to SEQ ID NO: 58391

SEQ ID NO: 326067 - RNA, 64 nt, Homo Sapiens; identical to SEQ ID NO: 58392

SEQ ID NO: 326068 - RNA, 64 nt, Homo Sapiens; identical to SEQ ID NO: 58393

SEQ ID NO: 326069 - RNA, 64 nt, Homo Sapiens; identical to SEQ ID NO: 58394

SEQ ID NO: 326070 - RNA, 64 nt, Homo Sapiens; identical to SEQ ID NO: 58395

SEQ ID NO: 326071 - RNA, 64 nt, Homo Sapiens; identical to SEQ ID NO: 58396

SEQ ID NO: 326072 - RNA, 64 nt, Homo Sapiens; identical to SEQ ID NO: 58397

SEQ ID NO: 326073 - RNA, 64 nt, Homo Sapiens; identical to SEQ ID NO: 58398

SEQ ID NO: 326074 - RNA, 64 nt, Homo Sapiens; identical to SEQ ID NO: 58399

SEQ ID NO: 326075 - RNA, 64 nt, Homo Sapiens; identical to SEQ ID NO: 58400

SEQ ID NO: 326076 - RNA, 64 nt, Homo Sapiens; identical to SEQ ID NO: 58401

SEQ ID NO: 326077 - RNA, 64 nt, Homo Sapiens; identical to SEQ ID NO: 58402

SEQ ID NO: 326078 - RNA, 64 nt, Homo Sapiens; identical to SEQ ID NO: 58403

SEQ ID NO: 326079 - RNA, 64 nt, Homo Sapiens; identical to SEQ ID NO: 58404

SEQ ID NO: 326080 - RNA, 64 nt, Homo Sapiens; identical to SEQ ID NO: 58405

SEQ ID NO: 326081 - RNA, 64 nt, Homo Sapiens; identical to SEQ ID NO: 58406

SEQ ID NO: 326082 - RNA, 64 nt, Homo Sapiens; identical to SEQ ID NO: 58407

SEQ ID NO: 326083 - RNA, 64 nt, Homo Sapiens; identical to SEQ ID NO: 58408

SEQ ID NO: 326084 - RNA, 64 nt, Homo Sapiens; identical to SEQ ID NO: 58409

SEQ ID NO: 326085 - RNA, 64 nt, Homo Sapiens; identical to SEQ ID NO: 58410

SEQ ID NO: 326086 - RNA, 64 nt, Homo Sapiens; identical to SEQ ID NO: 58411

SEQ ID NO: 326087 - RNA, 64 nt, Homo Sapiens; identical to SEQ ID NO: 58412

SEQ ID NO: 326088 - RNA, 64 nt, Homo Sapiens; identical to SEQ ID NO: 58413

SEQ ID NO: 326089 - RNA, 64 nt, Homo Sapiens; identical to SEQ ID NO: 58414

SEQ ID NO: 326090 - RNA, 64 nt, Homo Sapiens; identical to SEQ ID NO: 58415

SEQ ID NO: 326091 - RNA, 64 nt, Homo Sapiens; identical to SEQ ID NO: 58416

SEQ ID NO: 326092 - RNA, 64 nt, Homo Sapiens; identical to SEQ ID NO: 58417

SEQ ID NO: 326093 - RNA, 64 nt, Homo Sapiens; identical to SEQ ID NO: 58418

SEQ ID NO: 326094 - RNA, 64 nt, Homo Sapiens; identical to SEQ ID NO: 58419

SEQ ID NO: 326095 - RNA, 64 nt, Homo Sapiens; identical to SEQ ID NO: 58420

SEQ ID NO: 326096 - RNA, 64 nt, Homo Sapiens; identical to SEQ ID NO: 58421

SEQ ID NO: 326097 - RNA, 64 nt, Homo Sapiens; identical to SEQ ID NO: 58422

SEQ ID NO: 326098 - RNA, 64 nt, Homo Sapiens; identical to SEQ ID NO: 58423

SEQ ID NO: 326099 - RNA, 64 nt, Homo Sapiens; identical to SEQ ID NO: 58424

SEQ ID NO: 326100 - RNA, 64 nt, Homo Sapiens; identical to SEQ ID NO: 58425

SEQ ID NO: 326101 - RNA, 64 nt, Homo Sapiens; identical to SEQ ID NO: 58426

SEQ ID NO: 326102 - RNA, 64 nt, Homo Sapiens; identical to SEQ ID NO: 58427

SEQ ID NO: 326103 - RNA, 64 nt, Homo Sapiens; identical to SEQ ID NO: 58428

SEQ ID NO: 326104 - RNA, 64 nt, Homo Sapiens; identical to SEQ ID NO: 58429

SEQ ID NO: 326105 - RNA, 64 nt, Homo Sapiens; identical to SEQ ID NO: 58430

SEQ ID NO: 326106 - RNA, 64 nt, Homo Sapiens; identical to SEQ ID NO: 58431

SEQ ID NO: 326107 - RNA, 64 nt, Homo Sapiens; identical to SEQ ID NO: 58432

SEQ ID NO: 326108 - RNA, 64 nt, Homo Sapiens; identical to SEQ ID NO: 58433

SEQ ID NO: 326109 - RNA, 64 nt, Homo Sapiens; identical to SEQ ID NO: 58434

SEQ ID NO: 326110 - RNA, 64 nt, Homo Sapiens; identical to SEQ ID NO: 58435

SEQ ID NO: 326111 - RNA, 50 nt, Homo Sapiens; identical to SEQ ID NO: 58436

SEQ ID NO: 326112 - RNA, 64 nt, Homo Sapiens; identical to SEQ ID NO: 58437

SEQ ID NO: 326113 - RNA, 64 nt, Homo Sapiens; identical to SEQ ID NO: 58438

SEQ ID NO: 326114 - RNA, 64 nt, Homo Sapiens; identical to SEQ ID NO: 58439

SEQ ID NO: 326115 - RNA, 64 nt, Homo Sapiens; identical to SEQ ID NO: 58440

SEQ ID NO: 326116 - RNA, 64 nt, Homo Sapiens; identical to SEQ ID NO: 58441

SEQ ID NO: 326117 - RNA, 64 nt, Homo Sapiens; identical to SEQ ID NO: 58442

SEQ ID NO: 326118 - RNA, 64 nt, Homo Sapiens; identical to SEQ ID NO: 58443

SEQ ID NO: 326119 - RNA, 64 nt, Homo Sapiens; identical to SEQ ID NO: 58444

SEQ ID NO: 326120 - RNA, 64 nt, Homo Sapiens; identical to SEQ ID NO: 58445

SEQ ID NO: 326121 - RNA, 64 nt, Homo Sapiens; identical to SEQ ID NO: 58446

SEQ ID NO: 326122 - RNA, 64 nt, Homo Sapiens; identical to SEQ ID NO: 58447

SEQ ID NO: 326123 - RNA, 64 nt, Homo Sapiens; identical to SEQ ID NO: 58448

SEQ ID NO: 326124 - RNA, 64 nt, Homo Sapiens; identical to SEQ ID NO: 58449

SEQ ID NO: 326125 - RNA, 64 nt, Homo Sapiens; identical to SEQ ID NO: 58450

SEQ ID NO: 326126 - RNA, 64 nt, Homo Sapiens; identical to SEQ ID NO: 58451

SEQ ID NO: 326127 - RNA, 64 nt, Homo Sapiens; identical to SEQ ID NO: 58452

SEQ ID NO: 326128 - RNA, 64 nt, Homo Sapiens; identical to SEQ ID NO: 58453

SEQ ID NO: 326129 - RNA, 64 nt, Homo Sapiens; identical to SEQ ID NO: 58454

SEQ ID NO: 326130 - RNA, 64 nt, Homo Sapiens; identical to SEQ ID NO: 58455

SEQ ID NO: 326131 - RNA, 64 nt, Homo Sapiens; identical to SEQ ID NO: 58456

SEQ ID NO: 326132 - RNA, 64 nt, Homo Sapiens; identical to SEQ ID NO: 58457

SEQ ID NO: 326133 - RNA, 64 nt, Homo Sapiens; identical to SEQ ID NO: 58458

SEQ ID NO: 326134 - RNA, 64 nt, Homo Sapiens; identical to SEQ ID NO: 58459

SEQ ID NO: 326135 - RNA, 64 nt, Homo Sapiens; identical to SEQ ID NO: 58460

SEQ ID NO: 326136 - RNA, 64 nt, Homo Sapiens; identical to SEQ ID NO: 58461

SEQ ID NO: 326137 - RNA, 64 nt, Homo Sapiens; identical to SEQ ID NO: 58462

SEQ ID NO: 326138 - RNA, 64 nt, Homo Sapiens; identical to SEQ ID NO: 58463

SEQ ID NO: 326139 - RNA, 64 nt, Homo Sapiens; identical to SEQ ID NO: 58464

SEQ ID NO: 326140 - RNA, 64 nt, Homo Sapiens; identical to SEQ ID NO: 58465

SEQ ID NO: 326141 - RNA, 64 nt, Homo Sapiens; identical to SEQ ID NO: 58466

SEQ ID NO: 326142 - RNA, 64 nt, Homo Sapiens; identical to SEQ ID NO: 58467

SEQ ID NO: 326143 - RNA, 64 nt, Homo Sapiens; identical to SEQ ID NO: 101929

SEQ ID NO: 326144 - RNA, 64 nt, Homo Sapiens; identical to SEQ ID NO: 101930

SEQ ID NO: 326145 - RNA, 64 nt, Homo Sapiens; identical to SEQ ID NO: 101931

SEQ ID NO: 326146 - RNA, 64 nt, Homo Sapiens; identical to SEQ ID NO: 101932

SEQ ID NO: 326147 - RNA, 64 nt, Homo Sapiens; identical to SEQ ID NO: 101933

SEQ ID NO: 326148 - RNA, 64 nt, Homo Sapiens; identical to SEQ ID NO: 101934

SEQ ID NO: 326149 - RNA, 64 nt, Homo Sapiens; identical to SEQ ID NO: 101935

SEQ ID NO: 326150 - RNA, 64 nt, Homo Sapiens; identical to SEQ ID NO: 101936

SEQ ID NO: 326151 - RNA, 64 nt, Homo Sapiens; identical to SEQ ID NO: 101937

SEQ ID NO: 326152 - RNA, 64 nt, Homo Sapiens; identical to SEQ ID NO: 101938

SEQ ID NO: 326153 - RNA, 64 nt, Homo Sapiens; identical to SEQ ID NO: 101939

SEQ ID NO: 326154 - RNA, 64 nt, Homo Sapiens; identical to SEQ ID NO: 101940

SEQ ID NO: 326155 - RNA, 64 nt, Homo Sapiens; identical to SEQ ID NO: 101941

SEQ ID NO: 326156 - RNA, 64 nt, Homo Sapiens; identical to SEQ ID NO: 101942

SEQ ID NO: 326157 - RNA, 64 nt, Homo Sapiens; identical to SEQ ID NO: 101943

SEQ ID NO: 326158 - RNA, 64 nt, Homo Sapiens; identical to SEQ ID NO: 101944

SEQ ID NO: 326159 - RNA, 64 nt, Homo Sapiens; identical to SEQ ID NO: 101945

SEQ ID NO: 326160 - RNA, 64 nt, Homo Sapiens; identical to SEQ ID NO: 101946

SEQ ID NO: 326161 - RNA, 64 nt, Homo Sapiens; identical to SEQ ID NO: 101947

SEQ ID NO: 326162 - RNA, 64 nt, Homo Sapiens; identical to SEQ ID NO: 217362

SEQ ID NO: 326163 - RNA, 64 nt, Homo Sapiens; identical to SEQ ID NO: 217363

SEQ ID NO: 326164 - RNA, 64 nt, Homo Sapiens; identical to SEQ ID NO: 217364

SEQ ID NO: 326165 - RNA, 64 nt, Homo Sapiens; identical to SEQ ID NO: 217365

SEQ ID NO: 326166 - RNA, 64 nt, Homo Sapiens; identical to SEQ ID NO: 217366

SEQ ID NO: 326167 - RNA, 64 nt, Homo Sapiens; identical to SEQ ID NO: 217367

SEQ ID NO: 326168 - RNA, 64 nt, Homo Sapiens; identical to SEQ ID NO: 217368

SEQ ID NO: 326169 - RNA, 64 nt, Homo Sapiens; identical to SEQ ID NO: 217369

SEQ ID NO: 326170 - RNA, 64 nt, Homo Sapiens; identical to SEQ ID NO: 217370

SEQ ID NO: 326171 - RNA, 64 nt, Homo Sapiens; identical to SEQ ID NO: 217371

SEQ ID NO: 326172 - RNA, 64 nt, Homo Sapiens; identical to SEQ ID NO: 217372

SEQ ID NO: 326173 - RNA, 64 nt, Homo Sapiens; identical to SEQ ID NO: 217373

SEQ ID NO: 326174 - RNA, 64 nt, Homo Sapiens; identical to SEQ ID NO: 217374

SEQ ID NO: 326175 - RNA, 64 nt, Homo Sapiens; identical to SEQ ID NO: 217375

SEQ ID NO: 326176 - RNA, 64 nt, Homo Sapiens; identical to SEQ ID NO: 217376

SEQ ID NO: 326177 - RNA, 64 nt, Homo Sapiens; identical to SEQ ID NO: 217377

SEQ ID NO: 326178 - RNA, 64 nt, Homo Sapiens; identical to SEQ ID NO: 217378

SEQ ID NO: 326179 - RNA, 64 nt, Homo Sapiens; identical to SEQ ID NO: 217379

SEQ ID NO: 326180 - RNA, 64 nt, Homo Sapiens; identical to SEQ ID NO: 217380

SEQ ID NO: 326181 - RNA, 64 nt, Homo Sapiens; identical to SEQ ID NO: 217381

SEQ ID NO: 326182 - RNA, 64 nt, Homo Sapiens; identical to SEQ ID NO: 217382

SEQ ID NO: 326183 - RNA, 64 nt, Homo Sapiens; identical to SEQ ID NO: 217383

SEQ ID NO: 326184 - RNA, 64 nt, Homo Sapiens; identical to SEQ ID NO: 217384

SEQ ID NO: 326185 - RNA, 64 nt, Homo Sapiens; identical to SEQ ID NO: 217385

SEQ ID NO: 326186 - RNA, 55 nt, Homo Sapiens; identical to SEQ ID NO: 217386

SEQ ID NO: 326187 - RNA, 64 nt, Homo Sapiens; identical to SEQ ID NO: 217387

SEQ ID NO: 326188 - RNA, 64 nt, Homo Sapiens; identical to SEQ ID NO: 217388

SEQ ID NO: 326189 - RNA, 64 nt, Homo Sapiens; identical to SEQ ID NO: 217389

SEQ ID NO: 326190 - RNA, 64 nt, Homo Sapiens; identical to SEQ ID NO: 217390

SEQ ID NO: 326191 - RNA, 64 nt, Homo Sapiens; identical to SEQ ID NO: 217391

SEQ ID NO: 326192 - RNA, 64 nt, Homo Sapiens; identical to SEQ ID NO: 217392

SEQ ID NO: 326193 - RNA, 64 nt, Homo Sapiens; identical to SEQ ID NO: 217393

SEQ ID NO: 326194 - RNA, 64 nt, Homo Sapiens; identical to SEQ ID NO: 217394

SEQ ID NO: 326195 - RNA, 64 nt, Homo Sapiens; identical to SEQ ID NO: 72787

SEQ ID NO: 326196 - RNA, 64 nt, Homo Sapiens; identical to SEQ ID NO: 72788

SEQ ID NO: 326197 - RNA, 64 nt, Homo Sapiens; identical to SEQ ID NO: 72789

SEQ ID NO: 326198 - RNA, 64 nt, Homo Sapiens; identical to SEQ ID NO: 72790

SEQ ID NO: 326199 - RNA, 64 nt, Homo Sapiens; identical to SEQ ID NO: 72791

SEQ ID NO: 326200 - RNA, 64 nt, Homo Sapiens; identical to SEQ ID NO: 72792

SEQ ID NO: 326201 - RNA, 64 nt, Homo Sapiens; identical to SEQ ID NO: 72793

SEQ ID NO: 326202 - RNA, 64 nt, Homo Sapiens; identical to SEQ ID NO: 72794

SEQ ID NO: 326203 - RNA, 64 nt, Homo Sapiens; identical to SEQ ID NO: 72795

SEQ ID NO: 326204 - RNA, 64 nt, Homo Sapiens; identical to SEQ ID NO: 72796

SEQ ID NO: 326205 - RNA, 64 nt, Homo Sapiens; identical to SEQ ID NO: 72797

SEQ ID NO: 326206 - RNA, 64 nt, Homo Sapiens; identical to SEQ ID NO: 72798

SEQ ID NO: 326207 - RNA, 64 nt, Homo Sapiens; identical to SEQ ID NO: 72799

SEQ ID NO: 326208 - RNA, 64 nt, Homo Sapiens; identical to SEQ ID NO: 72800

SEQ ID NO: 326209 - RNA, 64 nt, Homo Sapiens; identical to SEQ ID NO: 72801

SEQ ID NO: 326210 - RNA, 64 nt, Homo Sapiens; identical to SEQ ID NO: 72802

SEQ ID NO: 326211 - RNA, 64 nt, Homo Sapiens; identical to SEQ ID NO: 72803

SEQ ID NO: 326212 - RNA, 64 nt, Homo Sapiens; identical to SEQ ID NO: 72804

SEQ ID NO: 326213 - RNA, 64 nt, Homo Sapiens; identical to SEQ ID NO: 72805

SEQ ID NO: 326214 - RNA, 64 nt, Homo Sapiens; identical to SEQ ID NO: 72806

SEQ ID NO: 326215 - RNA, 64 nt, Homo Sapiens; identical to SEQ ID NO: 72807

SEQ ID NO: 326216 - RNA, 64 nt, Homo Sapiens; identical to SEQ ID NO: 72808

SEQ ID NO: 326217 - RNA, 64 nt, Homo Sapiens; identical to SEQ ID NO: 72809

SEQ ID NO: 326218 - RNA, 64 nt, Homo Sapiens; identical to SEQ ID NO: 72810

SEQ ID NO: 326219 - RNA, 64 nt, Homo Sapiens; identical to SEQ ID NO: 72811

SEQ ID NO: 326220 - RNA, 64 nt, Homo Sapiens; identical to SEQ ID NO: 72812

SEQ ID NO: 326221 - RNA, 64 nt, Homo Sapiens; identical to SEQ ID NO: 72813

SEQ ID NO: 326222 - RNA, 64 nt, Homo Sapiens; identical to SEQ ID NO: 72814

SEQ ID NO: 326223 - RNA, 64 nt, Homo Sapiens; identical to SEQ ID NO: 72815

SEQ ID NO: 326224 - RNA, 64 nt, Homo Sapiens; identical to SEQ ID NO: 72816

SEQ ID NO: 326225 - RNA, 64 nt, Homo Sapiens; identical to SEQ ID NO: 72817

SEQ ID NO: 326226 - RNA, 64 nt, Homo Sapiens; identical to SEQ ID NO: 72818

SEQ ID NO: 326227 - RNA, 64 nt, Homo Sapiens; identical to SEQ ID NO: 72819

SEQ ID NO: 326228 - RNA, 64 nt, Homo Sapiens; identical to SEQ ID NO: 72820

SEQ ID NO: 326229 - RNA, 64 nt, Homo Sapiens; identical to SEQ ID NO: 72821

SEQ ID NO: 326230 - RNA, 64 nt, Homo Sapiens; identical to SEQ ID NO: 72822

SEQ ID NO: 326231 - RNA, 64 nt, Homo Sapiens; identical to SEQ ID NO: 72823

SEQ ID NO: 326232 - RNA, 64 nt, Homo Sapiens; identical to SEQ ID NO: 72824

SEQ ID NO: 326233 - RNA, 64 nt, Homo Sapiens; identical to SEQ ID NO: 72825

SEQ ID NO: 326234 - RNA, 64 nt, Homo Sapiens; identical to SEQ ID NO: 72826

SEQ ID NO: 326235 - RNA, 64 nt, Homo Sapiens; identical to SEQ ID NO: 72827

SEQ ID NO: 326236 - RNA, 64 nt, Homo Sapiens; identical to SEQ ID NO: 72828

SEQ ID NO: 326237 - RNA, 64 nt, Homo Sapiens; identical to SEQ ID NO: 72829

SEQ ID NO: 326238 - RNA, 64 nt, Homo Sapiens; identical to SEQ ID NO: 72830

SEQ ID NO: 326239 - RNA, 64 nt, Homo Sapiens; identical to SEQ ID NO: 72831

SEQ ID NO: 326240 - RNA, 64 nt, Homo Sapiens; identical to SEQ ID NO: 72832

SEQ ID NO: 326241 - RNA, 64 nt, Homo Sapiens; identical to SEQ ID NO: 72833

SEQ ID NO: 326242 - RNA, 64 nt, Homo Sapiens; identical to SEQ ID NO: 72834

SEQ ID NO: 326243 - RNA, 64 nt, Homo Sapiens; identical to SEQ ID NO: 72835

SEQ ID NO: 326244 - RNA, 64 nt, Homo Sapiens; identical to SEQ ID NO: 72836

SEQ ID NO: 326245 - RNA, 64 nt, Homo Sapiens; identical to SEQ ID NO: 72837

SEQ ID NO: 326246 - RNA, 64 nt, Homo Sapiens; identical to SEQ ID NO: 72838

SEQ ID NO: 326247 - RNA, 64 nt, Homo Sapiens; identical to SEQ ID NO: 72839

SEQ ID NO: 326248 - RNA, 64 nt, Homo Sapiens; identical to SEQ ID NO: 72840

SEQ ID NO: 326249 - RNA, 64 nt, Homo Sapiens; identical to SEQ ID NO: 72841

SEQ ID NO: 326250 - RNA, 64 nt, Homo Sapiens
cccccauccagugggucacccaggaguaaugucccuccagcaacguucccccuauggccuccag

SEQ ID NO: 326251 - RNA, 64 nt, Homo Sapiens
aguaaugucccuccagcaacguucccccuauggccuccagcagagcugaucugccucucacaca

SEQ ID NO: 326252 - RNA, 64 nt, Homo Sapiens
gauagaaaggacuucaacgccagugacuguguaccuccagcagaagaaaaucaggugucugguc

SEQ ID NO: 326253 - RNA, 64 nt, Homo Sapiens
agguucccagcucccccccugcaagccuugaagccuccagcaacgucuaucuccaggagagcag

SEQ ID NO: 326254 - RNA, 64 nt, Homo Sapiens
ccugaucacaccaugagagcccccuccacccucccuccagcagccuugguuccuggagagugug

SEQ ID NO: 326255 - RNA, 64 nt, Homo Sapiens
gggaacugccacugcucuccucccgcccuucuuccuccagcagcgaagucuaggccucaggggc

SEQ ID NO: 326256 - RNA, 64 nt, Homo Sapiens
gacccucggaccccugcaggggaguuggggccuccuccagcagacucuucccuaagaggcugcc

SEQ ID NO: 326257 - RNA, 64 nt, Homo Sapiens
cugucccuggagcaccucuguccaccuggcuucacuccagcaccaggcuccacagcuccaccgc

SEQ ID NO: 326258 - RNA, 64 nt, Homo Sapiens
caguggguccggaccugcuucugguggugacaagcuccagcagcagacccugcccgccgcccac

SEQ ID NO: 326259 - RNA, 64 nt, Homo Sapiens
cagcccucaccccagcacagcaugcaggggcucccuccagcacagcaggaagcccaccgugccc

SEQ ID NO: 326260 - RNA, 64 nt, Homo Sapiens
augcugaggccacccacugacccaacugauccugcuccagcagcacaccucagccccacugaca

SEQ ID NO: 326261 - RNA, 64 nt, Homo Sapiens
cacugguuugccaggccaauguugcugauggccccuccagcacacacacauaagcacugaaauc

SEQ ID NO: 326262 - RNA, 64 nt, Homo Sapiens
cggaggacugaacuggggagaggcucacccaggucuccagcaaaaaacaguuugaaagggacug

SEQ ID NO: 326263 - RNA, 64 nt, Homo Sapiens
gggccuggccaggcuauucgcagcagcccucuggcuccagcaugccggcagagcaggccggacg

SEQ ID NO: 326264 - RNA, 64 nt, Homo Sapiens
uggcugggcuggaaaggagggggcaggggugaaacuccagcaggcuuccguccagagcaguccc

SEQ ID NO: 326265 - RNA, 64 nt, Homo Sapiens
accacagagcuccagaccaaggucugccgguggccuccagcagcaagacacacaccucuagucc

SEQ ID NO: 326266 - RNA, 64 nt, Homo Sapiens
aggcagaaccgugucuguggaaccaggccucucacuccagcagcugccaugcugcagccucaga

SEQ ID NO: 326267 - RNA, 64 nt, Homo Sapiens
agccugcaggcagggcgcugccugguuccguggccuccagcaugacagaaucugcccugugccg

SEQ ID NO: 326268 - RNA, 64 nt, Homo Sapiens
gggagugcauggucucagaugccauccuucucuucuccagcauuuccacucaccuccguguucu

SEQ ID NO: 326269 - RNA, 64 nt, Homo Sapiens
gggagugcguggucuuggaugccauccugcucaucuccagcauuuccucucaccuccguguucu

SEQ ID NO: 326270 - RNA, 64 nt, Homo Sapiens
gggagugcguggugucagaucccauccugcucaucuccagcauuuccucucaccucuguguucu

SEQ ID NO: 326271 - RNA, 64 nt, Homo Sapiens
gggagugcguggugucagaucccauccugcuccucuccagcauuuccucucaccuccguguucu

SEQ ID NO: 326272 - RNA, 64 nt, Homo Sapiens
aggaugcagcugccagauccacucacucugcugccuccagcaggacccaaggccacuuucaacu

SEQ ID NO: 326273 - RNA, 64 nt, Homo Sapiens
cugggcccagacccauccucccagccagguuucccuccagcaggcuccuucccucccugucacc

SEQ ID NO: 326274 - RNA, 64 nt, Homo Sapiens
ugaggaaagaagggacacggcgugccucugcuuucuccagcagcccuucucccgcucccucucc

SEQ ID NO: 326275 - RNA, 64 nt, Homo Sapiens
uguaggaacucccggaagagcaagccugccucaccuccagcaccccugaggcagauccagagga

SEQ ID NO: 326276 - RNA, 64 nt, Homo Sapiens
ccaggaagaaggcacagucccccacucccccugccuccagcagguuccccuuccucccuccaug

SEQ ID NO: 326277 - RNA, 64 nt, Homo Sapiens
aggcucugccaaggccccuccucugaggcuccuccuccagcaucuugucuccaccuccucgcuc

SEQ ID NO: 326278 - RNA, 64 nt, Homo Sapiens
aaugggccucauggaauggaaugucuccacuucacuccagcaucaacaaguggggaauucugau

SEQ ID NO: 326279 - RNA, 64 nt, Homo Sapiens
cacuucaguuuauaccuugccuguaguccagucucuccagcaucaauuccaucagcacaaagac

SEQ ID NO: 326280 - RNA, 64 nt, Homo Sapiens
guuccagagagcugccggaauuccagguuugacucuccagcacagagcagagcuacacagaggu

SEQ ID NO: 326281 - RNA, 64 nt, Homo Sapiens
gcugucacagcaccuuguaugauggcaggacaggcuccagcagagagaacugcacagugaccac

SEQ ID NO: 326282 - RNA, 64 nt, Homo Sapiens
gcaaauuugacacaaaaggcucaugcacagcagccuccagcaagggugacaagugccgugaaca

SEQ ID NO: 326283 - RNA, 64 nt, Homo Sapiens
gacugucucugugccaugaucgggcucuguccagcuccagcauuuuguuaagaagugcauuggg

SEQ ID NO: 326284 - RNA, 64 nt, Homo Sapiens
auuugaacacauggaacaggugcuacuauugcuacuccagcaguaagauuauugaagaagcacc

SEQ ID NO: 326285 - RNA, 64 nt, Homo Sapiens
auuuguuacucgcuuugggguuucacuguggcuucuccagcagaaaaauagauucucaacgaga

SEQ ID NO: 326286 - RNA, 64 nt, Homo Sapiens
gauucccuuaagugacuccaugcuaaagcaacaccuccagcagagcccccuucuuucggcuuuc

SEQ ID NO: 326287 - RNA, 64 nt, Homo Sapiens
ggaauuaaggucucuaaagcugguaaaucucaaacuccagcacuaaaauguuaaaacagacaac

SEQ ID NO: 326288 - RNA, 64 nt, Homo Sapiens
ucugggucacgucggccaggaguagggugcaggccuccagcagguccuaauccugugugccagg

SEQ ID NO: 326289 - RNA, 64 nt, Homo Sapiens
gaagcacagaucccagcacuuuucccagcuuucucuccagcaucagucccugcagcagcugggg

SEQ ID NO: 326290 - RNA, 64 nt, Homo Sapiens
ggugauacccaggcagauauggucuggaguggaccuccagcaaacuccagcagaccugcagccg

SEQ ID NO: 326291 - RNA, 64 nt, Homo Sapiens
aggcagauauggucuggaguggaccuccagcaaacuccagcagaccugcagccgaggggccuca

SEQ ID NO: 326292 - RNA, 64 nt, Homo Sapiens
cuggaacccacgccuccugagcaucucucagcgccuccagcagcgcagggcuccuuacugcaag

SEQ ID NO: 326293 - RNA, 64 nt, Homo Sapiens
acuccaggaugguucagcccaaggucucuagcaucuccagcagguucccgguggaacagaugac

SEQ ID NO: 326294 - RNA, 64 nt, Homo Sapiens; identical to SEQ ID NO: 173359

SEQ ID NO: 326295 - RNA, 64 nt, Homo Sapiens; identical to SEQ ID NO: 173360

SEQ ID NO: 326296 - RNA, 64 nt, Homo Sapiens; identical to SEQ ID NO: 173361

SEQ ID NO: 326297 - RNA, 64 nt, Homo Sapiens; identical to SEQ ID NO: 173362

SEQ ID NO: 326298 - RNA, 64 nt, Homo Sapiens; identical to SEQ ID NO: 42333

SEQ ID NO: 326299 - RNA, 64 nt, Homo Sapiens; identical to SEQ ID NO: 42334

SEQ ID NO: 326300 - RNA, 64 nt, Homo Sapiens; identical to SEQ ID NO: 42335

SEQ ID NO: 326301 - RNA, 64 nt, Homo Sapiens; identical to SEQ ID NO: 42336

SEQ ID NO: 326302 - RNA, 64 nt, Homo Sapiens; identical to SEQ ID NO: 42337

SEQ ID NO: 326303 - RNA, 64 nt, Homo Sapiens; identical to SEQ ID NO: 42338

SEQ ID NO: 326304 - RNA, 64 nt, Homo Sapiens; identical to SEQ ID NO: 42339

SEQ ID NO: 326305 - RNA, 64 nt, Homo Sapiens; identical to SEQ ID NO: 42340

SEQ ID NO: 326306 - RNA, 64 nt, Homo Sapiens; identical to SEQ ID NO: 42341

SEQ ID NO: 326307 - RNA, 64 nt, Homo Sapiens; identical to SEQ ID NO: 42342

SEQ ID NO: 326308 - RNA, 64 nt, Homo Sapiens; identical to SEQ ID NO: 42343

SEQ ID NO: 326309 - RNA, 64 nt, Homo Sapiens; identical to SEQ ID NO: 42344

SEQ ID NO: 326310 - RNA, 64 nt, Homo Sapiens; identical to SEQ ID NO: 42345

SEQ ID NO: 326311 - RNA, 64 nt, Homo Sapiens; identical to SEQ ID NO: 42346

SEQ ID NO: 326312 - RNA, 64 nt, Homo Sapiens; identical to SEQ ID NO: 42347

SEQ ID NO: 326313 - RNA, 64 nt, Homo Sapiens; identical to SEQ ID NO: 42348

SEQ ID NO: 326314 - RNA, 64 nt, Homo Sapiens; identical to SEQ ID NO: 42349

SEQ ID NO: 326315 - RNA, 64 nt, Homo Sapiens; identical to SEQ ID NO: 42350

SEQ ID NO: 326316 - RNA, 64 nt, Homo Sapiens; identical to SEQ ID NO: 42351

SEQ ID NO: 326317 - RNA, 64 nt, Homo Sapiens; identical to SEQ ID NO: 42352

SEQ ID NO: 326318 - RNA, 64 nt, Homo Sapiens; identical to SEQ ID NO: 42353

SEQ ID NO: 326319 - RNA, 64 nt, Homo Sapiens; identical to SEQ ID NO: 42354

SEQ ID NO: 326320 - RNA, 64 nt, Homo Sapiens; identical to SEQ ID NO: 42355

SEQ ID NO: 326321 - RNA, 64 nt, Homo Sapiens; identical to SEQ ID NO: 42356

SEQ ID NO: 326322 - RNA, 64 nt, Homo Sapiens; identical to SEQ ID NO: 42357

SEQ ID NO: 326323 - RNA, 64 nt, Homo Sapiens; identical to SEQ ID NO: 42358

SEQ ID NO: 326324 - RNA, 64 nt, Homo Sapiens; identical to SEQ ID NO: 42359

SEQ ID NO: 326325 - RNA, 64 nt, Homo Sapiens; identical to SEQ ID NO: 42360

SEQ ID NO: 326326 - RNA, 64 nt, Homo Sapiens; identical to SEQ ID NO: 42361

SEQ ID NO: 326327 - RNA, 64 nt, Homo Sapiens; identical to SEQ ID NO: 42362

SEQ ID NO: 326328 - RNA, 64 nt, Homo Sapiens; identical to SEQ ID NO: 42363

SEQ ID NO: 326329 - RNA, 64 nt, Homo Sapiens; identical to SEQ ID NO: 42364

SEQ ID NO: 326330 - RNA, 64 nt, Homo Sapiens; identical to SEQ ID NO: 42365

SEQ ID NO: 326331 - RNA, 64 nt, Homo Sapiens; identical to SEQ ID NO: 42366

SEQ ID NO: 326332 - RNA, 64 nt, Homo Sapiens; identical to SEQ ID NO: 42367

SEQ ID NO: 326333 - RNA, 64 nt, Homo Sapiens; identical to SEQ ID NO: 42368

SEQ ID NO: 326334 - RNA, 64 nt, Homo Sapiens; identical to SEQ ID NO: 42369

SEQ ID NO: 326335 - RNA, 64 nt, Homo Sapiens; identical to SEQ ID NO: 42370

SEQ ID NO: 326336 - RNA, 64 nt, Homo Sapiens; identical to SEQ ID NO: 42371

SEQ ID NO: 326337 - RNA, 64 nt, Homo Sapiens; identical to SEQ ID NO: 42372

SEQ ID NO: 326338 - RNA, 64 nt, Homo Sapiens; identical to SEQ ID NO: 42373

SEQ ID NO: 326339 - RNA, 64 nt, Homo Sapiens; identical to SEQ ID NO: 42374

SEQ ID NO: 326340 - RNA, 64 nt, Homo Sapiens; identical to SEQ ID NO: 42375

SEQ ID NO: 326341 - RNA, 64 nt, Homo Sapiens; identical to SEQ ID NO: 42376

SEQ ID NO: 326342 - RNA, 64 nt, Homo Sapiens; identical to SEQ ID NO: 42377

SEQ ID NO: 326343 - RNA, 64 nt, Homo Sapiens; identical to SEQ ID NO: 42378

SEQ ID NO: 326344 - RNA, 64 nt, Homo Sapiens; identical to SEQ ID NO: 42379

SEQ ID NO: 326345 - RNA, 64 nt, Homo Sapiens; identical to SEQ ID NO: 42380

SEQ ID NO: 326346 - RNA, 64 nt, Homo Sapiens; identical to SEQ ID NO: 42381

SEQ ID NO: 326347 - RNA, 64 nt, Homo Sapiens; identical to SEQ ID NO: 42382

SEQ ID NO: 326348 - RNA, 64 nt, Homo Sapiens; identical to SEQ ID NO: 42383

SEQ ID NO: 326349 - RNA, 64 nt, Homo Sapiens; identical to SEQ ID NO: 42384

SEQ ID NO: 326350 - RNA, 64 nt, Homo Sapiens; identical to SEQ ID NO: 42385

SEQ ID NO: 326351 - RNA, 64 nt, Homo Sapiens; identical to SEQ ID NO: 42386

SEQ ID NO: 326352 - RNA, 64 nt, Homo Sapiens; identical to SEQ ID NO: 42387

SEQ ID NO: 326353 - RNA, 64 nt, Homo Sapiens; identical to SEQ ID NO: 42388

SEQ ID NO: 326354 - RNA, 64 nt, Homo Sapiens; identical to SEQ ID NO: 42389

SEQ ID NO: 326355 - RNA, 64 nt, Homo Sapiens; identical to SEQ ID NO: 42390

SEQ ID NO: 326356 - RNA, 64 nt, Homo Sapiens; identical to SEQ ID NO: 42391

SEQ ID NO: 326357 - RNA, 64 nt, Homo Sapiens; identical to SEQ ID NO: 42392

SEQ ID NO: 326358 - RNA, 64 nt, Homo Sapiens; identical to SEQ ID NO: 42393

SEQ ID NO: 326359 - RNA, 64 nt, Homo Sapiens; identical to SEQ ID NO: 42394

SEQ ID NO: 326360 - RNA, 64 nt, Homo Sapiens; identical to SEQ ID NO: 42395

SEQ ID NO: 326361 - RNA, 64 nt, Homo Sapiens; identical to SEQ ID NO: 42396

SEQ ID NO: 326362 - RNA, 64 nt, Homo Sapiens; identical to SEQ ID NO: 42397

SEQ ID NO: 326363 - RNA, 64 nt, Homo Sapiens; identical to SEQ ID NO: 42398

SEQ ID NO: 326364 - RNA, 64 nt, Homo Sapiens; identical to SEQ ID NO: 42399

SEQ ID NO: 326365 - RNA, 64 nt, Homo Sapiens; identical to SEQ ID NO: 42400

SEQ ID NO: 326366 - RNA, 64 nt, Homo Sapiens; identical to SEQ ID NO: 42401

SEQ ID NO: 326367 - RNA, 64 nt, Homo Sapiens; identical to SEQ ID NO: 42402

SEQ ID NO: 326368 - RNA, 64 nt, Homo Sapiens; identical to SEQ ID NO: 42403

SEQ ID NO: 326369 - RNA, 64 nt, Homo Sapiens; identical to SEQ ID NO: 42404

SEQ ID NO: 326370 - RNA, 64 nt, Homo Sapiens; identical to SEQ ID NO: 42405

SEQ ID NO: 326371 - RNA, 64 nt, Homo Sapiens; identical to SEQ ID NO: 42406

SEQ ID NO: 326372 - RNA, 64 nt, Homo Sapiens; identical to SEQ ID NO: 42407

SEQ ID NO: 326373 - RNA, 64 nt, Homo Sapiens; identical to SEQ ID NO: 42408

SEQ ID NO: 326374 - RNA, 64 nt, Homo Sapiens; identical to SEQ ID NO: 42409

SEQ ID NO: 326375 - RNA, 64 nt, Homo Sapiens; identical to SEQ ID NO: 42410

SEQ ID NO: 326376 - RNA, 64 nt, Homo Sapiens; identical to SEQ ID NO: 42411

SEQ ID NO: 326377 - RNA, 64 nt, Homo Sapiens; identical to SEQ ID NO: 42412

SEQ ID NO: 326378 - RNA, 64 nt, Homo Sapiens; identical to SEQ ID NO: 42413

SEQ ID NO: 326379 - RNA, 64 nt, Homo Sapiens; identical to SEQ ID NO: 42414

SEQ ID NO: 326380 - RNA, 64 nt, Homo Sapiens; identical to SEQ ID NO: 42415

SEQ ID NO: 326381 - RNA, 64 nt, Homo Sapiens; identical to SEQ ID NO: 42416

SEQ ID NO: 326382 - RNA, 64 nt, Homo Sapiens; identical to SEQ ID NO: 42417

SEQ ID NO: 326383 - RNA, 64 nt, Homo Sapiens; identical to SEQ ID NO: 42418

SEQ ID NO: 326384 - RNA, 64 nt, Homo Sapiens; identical to SEQ ID NO: 42419

SEQ ID NO: 326385 - RNA, 64 nt, Homo Sapiens; identical to SEQ ID NO: 42420

SEQ ID NO: 326386 - RNA, 64 nt, Homo Sapiens; identical to SEQ ID NO: 42421

SEQ ID NO: 326387 - RNA, 64 nt, Homo Sapiens; identical to SEQ ID NO: 42422

SEQ ID NO: 326388 - RNA, 64 nt, Homo Sapiens; identical to SEQ ID NO: 42423

SEQ ID NO: 326389 - RNA, 64 nt, Homo Sapiens; identical to SEQ ID NO: 42424

SEQ ID NO: 326390 - RNA, 64 nt, Homo Sapiens; identical to SEQ ID NO: 42425

SEQ ID NO: 326391 - RNA, 64 nt, Homo Sapiens; identical to SEQ ID NO: 42426

SEQ ID NO: 326392 - RNA, 64 nt, Homo Sapiens; identical to SEQ ID NO: 42427

SEQ ID NO: 326393 - RNA, 64 nt, Homo Sapiens; identical to SEQ ID NO: 42428

SEQ ID NO: 326394 - RNA, 64 nt, Homo Sapiens; identical to SEQ ID NO: 42429

SEQ ID NO: 326395 - RNA, 64 nt, Homo Sapiens; identical to SEQ ID NO: 42430

SEQ ID NO: 326396 - RNA, 64 nt, Homo Sapiens; identical to SEQ ID NO: 42431

SEQ ID NO: 326397 - RNA, 64 nt, Homo Sapiens; identical to SEQ ID NO: 42432

SEQ ID NO: 326398 - RNA, 64 nt, Homo Sapiens; identical to SEQ ID NO: 42433

SEQ ID NO: 326399 - RNA, 64 nt, Homo Sapiens; identical to SEQ ID NO: 42434

SEQ ID NO: 326400 - RNA, 64 nt, Homo Sapiens; identical to SEQ ID NO: 42435

SEQ ID NO: 326401 - RNA, 64 nt, Homo Sapiens; identical to SEQ ID NO: 42436

SEQ ID NO: 326402 - RNA, 64 nt, Homo Sapiens; identical to SEQ ID NO: 42437

SEQ ID NO: 326403 - RNA, 64 nt, Homo Sapiens; identical to SEQ ID NO: 42438

SEQ ID NO: 326404 - RNA, 64 nt, Homo Sapiens; identical to SEQ ID NO: 42439

SEQ ID NO: 326405 - RNA, 64 nt, Homo Sapiens; identical to SEQ ID NO: 42440

SEQ ID NO: 326406 - RNA, 64 nt, Homo Sapiens; identical to SEQ ID NO: 42441

SEQ ID NO: 326407 - RNA, 64 nt, Homo Sapiens; identical to SEQ ID NO: 42442

SEQ ID NO: 326408 - RNA, 64 nt, Homo Sapiens; identical to SEQ ID NO: 42443

SEQ ID NO: 326409 - RNA, 64 nt, Homo Sapiens; identical to SEQ ID NO: 42444

SEQ ID NO: 326410 - RNA, 64 nt, Homo Sapiens; identical to SEQ ID NO: 42445

SEQ ID NO: 326411 - RNA, 64 nt, Homo Sapiens; identical to SEQ ID NO: 42446

SEQ ID NO: 326412 - RNA, 64 nt, Homo Sapiens; identical to SEQ ID NO: 42447

SEQ ID NO: 326413 - RNA, 64 nt, Homo Sapiens; identical to SEQ ID NO: 42448

SEQ ID NO: 326414 - RNA, 64 nt, Homo Sapiens; identical to SEQ ID NO: 42449

SEQ ID NO: 326415 - RNA, 64 nt, Homo Sapiens; identical to SEQ ID NO: 42450

SEQ ID NO: 326416 - RNA, 64 nt, Homo Sapiens; identical to SEQ ID NO: 42451

SEQ ID NO: 326417 - RNA, 64 nt, Homo Sapiens; identical to SEQ ID NO: 42452

SEQ ID NO: 326418 - RNA, 64 nt, Homo Sapiens; identical to SEQ ID NO: 42453

SEQ ID NO: 326419 - RNA, 64 nt, Homo Sapiens; identical to SEQ ID NO: 42454

SEQ ID NO: 326420 - RNA, 64 nt, Homo Sapiens; identical to SEQ ID NO: 42455

SEQ ID NO: 326421 - RNA, 64 nt, Homo Sapiens; identical to SEQ ID NO: 42456

SEQ ID NO: 326422 - RNA, 64 nt, Homo Sapiens; identical to SEQ ID NO: 42457

SEQ ID NO: 326423 - RNA, 64 nt, Homo Sapiens; identical to SEQ ID NO: 42458

SEQ ID NO: 326424 - RNA, 64 nt, Homo Sapiens; identical to SEQ ID NO: 42459

SEQ ID NO: 326425 - RNA, 64 nt, Homo Sapiens; identical to SEQ ID NO: 42460

SEQ ID NO: 326426 - RNA, 64 nt, Homo Sapiens; identical to SEQ ID NO: 42461

SEQ ID NO: 326427 - RNA, 64 nt, Homo Sapiens; identical to SEQ ID NO: 42462

SEQ ID NO: 326428 - RNA, 64 nt, Homo Sapiens; identical to SEQ ID NO: 42463

SEQ ID NO: 326429 - RNA, 64 nt, Homo Sapiens; identical to SEQ ID NO: 42464

SEQ ID NO: 326430 - RNA, 64 nt, Homo Sapiens; identical to SEQ ID NO: 42465

SEQ ID NO: 326431 - RNA, 64 nt, Homo Sapiens; identical to SEQ ID NO: 42466

SEQ ID NO: 326432 - RNA, 64 nt, Homo Sapiens; identical to SEQ ID NO: 42467

SEQ ID NO: 326433 - RNA, 64 nt, Homo Sapiens; identical to SEQ ID NO: 42468

SEQ ID NO: 326434 - RNA, 64 nt, Homo Sapiens; identical to SEQ ID NO: 42469

SEQ ID NO: 326435 - RNA, 64 nt, Homo Sapiens; identical to SEQ ID NO: 42470

SEQ ID NO: 326436 - RNA, 64 nt, Homo Sapiens; identical to SEQ ID NO: 42471

SEQ ID NO: 326437 - RNA, 64 nt, Homo Sapiens; identical to SEQ ID NO: 42472

SEQ ID NO: 326438 - RNA, 64 nt, Homo Sapiens; identical to SEQ ID NO: 42473

SEQ ID NO: 326439 - RNA, 64 nt, Homo Sapiens; identical to SEQ ID NO: 42474

SEQ ID NO: 326440 - RNA, 64 nt, Homo Sapiens; identical to SEQ ID NO: 42475

SEQ ID NO: 326441 - RNA, 64 nt, Homo Sapiens; identical to SEQ ID NO: 42476

SEQ ID NO: 326442 - RNA, 64 nt, Homo Sapiens; identical to SEQ ID NO: 42477

SEQ ID NO: 326443 - RNA, 64 nt, Homo Sapiens; identical to SEQ ID NO: 42478

SEQ ID NO: 326444 - RNA, 64 nt, Homo Sapiens; identical to SEQ ID NO: 42479

SEQ ID NO: 326445 - RNA, 64 nt, Homo Sapiens; identical to SEQ ID NO: 42480

SEQ ID NO: 326446 - RNA, 64 nt, Homo Sapiens; identical to SEQ ID NO: 42481

SEQ ID NO: 326447 - RNA, 64 nt, Homo Sapiens; identical to SEQ ID NO: 42482

SEQ ID NO: 326448 - RNA, 64 nt, Homo Sapiens; identical to SEQ ID NO: 42483

SEQ ID NO: 326449 - RNA, 64 nt, Homo Sapiens; identical to SEQ ID NO: 42484

SEQ ID NO: 326450 - RNA, 64 nt, Homo Sapiens; identical to SEQ ID NO: 42485

SEQ ID NO: 326451 - RNA, 64 nt, Homo Sapiens; identical to SEQ ID NO: 42486

SEQ ID NO: 326452 - RNA, 64 nt, Homo Sapiens; identical to SEQ ID NO: 42487

SEQ ID NO: 326453 - RNA, 64 nt, Homo Sapiens; identical to SEQ ID NO: 42488

SEQ ID NO: 326454 - RNA, 64 nt, Homo Sapiens; identical to SEQ ID NO: 42489

SEQ ID NO: 326455 - RNA, 64 nt, Homo Sapiens; identical to SEQ ID NO: 42490

SEQ ID NO: 326456 - RNA, 64 nt, Homo Sapiens; identical to SEQ ID NO: 42491

SEQ ID NO: 326457 - RNA, 64 nt, Homo Sapiens; identical to SEQ ID NO: 42492

SEQ ID NO: 326458 - RNA, 64 nt, Homo Sapiens; identical to SEQ ID NO: 42493

SEQ ID NO: 326459 - RNA, 64 nt, Homo Sapiens; identical to SEQ ID NO: 42494

SEQ ID NO: 326460 - RNA, 64 nt, Homo Sapiens; identical to SEQ ID NO: 42495

SEQ ID NO: 326461 - RNA, 64 nt, Homo Sapiens; identical to SEQ ID NO: 42496

SEQ ID NO: 326462 - RNA, 64 nt, Homo Sapiens; identical to SEQ ID NO: 42497

SEQ ID NO: 326463 - RNA, 64 nt, Homo Sapiens; identical to SEQ ID NO: 42498

SEQ ID NO: 326464 - RNA, 64 nt, Homo Sapiens; identical to SEQ ID NO: 42499

SEQ ID NO: 326465 - RNA, 64 nt, Homo Sapiens; identical to SEQ ID NO: 42500

SEQ ID NO: 326466 - RNA, 64 nt, Homo Sapiens; identical to SEQ ID NO: 42501

SEQ ID NO: 326467 - RNA, 64 nt, Homo Sapiens; identical to SEQ ID NO: 42502

SEQ ID NO: 326468 - RNA, 64 nt, Homo Sapiens; identical to SEQ ID NO: 42503

SEQ ID NO: 326469 - RNA, 64 nt, Homo Sapiens; identical to SEQ ID NO: 42504

SEQ ID NO: 326470 - RNA, 64 nt, Homo Sapiens; identical to SEQ ID NO: 42505

SEQ ID NO: 326471 - RNA, 64 nt, Homo Sapiens; identical to SEQ ID NO: 42506

SEQ ID NO: 326472 - RNA, 64 nt, Homo Sapiens; identical to SEQ ID NO: 42507

SEQ ID NO: 326473 - RNA, 64 nt, Homo Sapiens; identical to SEQ ID NO: 42508

SEQ ID NO: 326474 - RNA, 64 nt, Homo Sapiens; identical to SEQ ID NO: 42509

SEQ ID NO: 326475 - RNA, 64 nt, Homo Sapiens; identical to SEQ ID NO: 42510

SEQ ID NO: 326476 - RNA, 64 nt, Homo Sapiens; identical to SEQ ID NO: 42511

SEQ ID NO: 326477 - RNA, 64 nt, Homo Sapiens; identical to SEQ ID NO: 42512

SEQ ID NO: 326478 - RNA, 64 nt, Homo Sapiens; identical to SEQ ID NO: 42513

SEQ ID NO: 326479 - RNA, 64 nt, Homo Sapiens; identical to SEQ ID NO: 42514

SEQ ID NO: 326480 - RNA, 64 nt, Homo Sapiens; identical to SEQ ID NO: 42515

SEQ ID NO: 326481 - RNA, 64 nt, Homo Sapiens; identical to SEQ ID NO: 42516

SEQ ID NO: 326482 - RNA, 64 nt, Homo Sapiens; identical to SEQ ID NO: 42517

SEQ ID NO: 326483 - RNA, 64 nt, Homo Sapiens; identical to SEQ ID NO: 42518

SEQ ID NO: 326484 - RNA, 64 nt, Homo Sapiens; identical to SEQ ID NO: 42519

SEQ ID NO: 326485 - RNA, 64 nt, Homo Sapiens; identical to SEQ ID NO: 42520

SEQ ID NO: 326486 - RNA, 64 nt, Homo Sapiens; identical to SEQ ID NO: 42521

SEQ ID NO: 326487 - RNA, 64 nt, Homo Sapiens; identical to SEQ ID NO: 42522

SEQ ID NO: 326488 - RNA, 64 nt, Homo Sapiens; identical to SEQ ID NO: 42523

SEQ ID NO: 326489 - RNA, 64 nt, Homo Sapiens; identical to SEQ ID NO: 42524

SEQ ID NO: 326490 - RNA, 64 nt, Homo Sapiens; identical to SEQ ID NO: 42525

SEQ ID NO: 326491 - RNA, 64 nt, Homo Sapiens; identical to SEQ ID NO: 42526

SEQ ID NO: 326492 - RNA, 64 nt, Homo Sapiens; identical to SEQ ID NO: 42527

SEQ ID NO: 326493 - RNA, 64 nt, Homo Sapiens; identical to SEQ ID NO: 42528

SEQ ID NO: 326494 - RNA, 64 nt, Homo Sapiens; identical to SEQ ID NO: 42529

SEQ ID NO: 326495 - RNA, 64 nt, Homo Sapiens; identical to SEQ ID NO: 42530

SEQ ID NO: 326496 - RNA, 64 nt, Homo Sapiens; identical to SEQ ID NO: 42531

SEQ ID NO: 326497 - RNA, 64 nt, Homo Sapiens; identical to SEQ ID NO: 42532

SEQ ID NO: 326498 - RNA, 64 nt, Homo Sapiens; identical to SEQ ID NO: 42533

SEQ ID NO: 326499 - RNA, 64 nt, Homo Sapiens; identical to SEQ ID NO: 42534

SEQ ID NO: 326500 - RNA, 64 nt, Homo Sapiens; identical to SEQ ID NO: 42535

SEQ ID NO: 326501 - RNA, 64 nt, Homo Sapiens; identical to SEQ ID NO: 42536

SEQ ID NO: 326502 - RNA, 64 nt, Homo Sapiens; identical to SEQ ID NO: 42537

SEQ ID NO: 326503 - RNA, 64 nt, Homo Sapiens; identical to SEQ ID NO: 42538

SEQ ID NO: 326504 - RNA, 64 nt, Homo Sapiens; identical to SEQ ID NO: 42539

SEQ ID NO: 326505 - RNA, 64 nt, Homo Sapiens; identical to SEQ ID NO: 42540

SEQ ID NO: 326506 - RNA, 64 nt, Homo Sapiens; identical to SEQ ID NO: 42541

SEQ ID NO: 326507 - RNA, 64 nt, Homo Sapiens; identical to SEQ ID NO: 305695

SEQ ID NO: 326508 - RNA, 64 nt, Homo Sapiens; identical to SEQ ID NO: 305696

SEQ ID NO: 326509 - RNA, 64 nt, Homo Sapiens; identical to SEQ ID NO: 305697

SEQ ID NO: 326510 - RNA, 64 nt, Homo Sapiens; identical to SEQ ID NO: 305698

SEQ ID NO: 326511 - RNA, 64 nt, Homo Sapiens; identical to SEQ ID NO: 305699

SEQ ID NO: 326512 - RNA, 64 nt, Homo Sapiens; identical to SEQ ID NO: 305700

SEQ ID NO: 326513 - RNA, 64 nt, Homo Sapiens; identical to SEQ ID NO: 305701

SEQ ID NO: 326514 - RNA, 64 nt, Homo Sapiens; identical to SEQ ID NO: 305702

SEQ ID NO: 326515 - RNA, 64 nt, Homo Sapiens; identical to SEQ ID NO: 305703

SEQ ID NO: 326516 - RNA, 64 nt, Homo Sapiens; identical to SEQ ID NO: 305704

SEQ ID NO: 326517 - RNA, 64 nt, Homo Sapiens; identical to SEQ ID NO: 305705

SEQ ID NO: 326518 - RNA, 64 nt, Homo Sapiens; identical to SEQ ID NO: 305706

SEQ ID NO: 326519 - RNA, 64 nt, Homo Sapiens; identical to SEQ ID NO: 305707

SEQ ID NO: 326520 - RNA, 64 nt, Homo Sapiens; identical to SEQ ID NO: 305708

SEQ ID NO: 326521 - RNA, 64 nt, Homo Sapiens; identical to SEQ ID NO: 305709

SEQ ID NO: 326522 - RNA, 64 nt, Homo Sapiens; identical to SEQ ID NO: 305710

SEQ ID NO: 326523 - RNA, 64 nt, Homo Sapiens; identical to SEQ ID NO: 305711

SEQ ID NO: 326524 - RNA, 64 nt, Homo Sapiens; identical to SEQ ID NO: 305712

SEQ ID NO: 326525 - RNA, 64 nt, Homo Sapiens; identical to SEQ ID NO: 305713

SEQ ID NO: 326526 - RNA, 64 nt, Homo Sapiens; identical to SEQ ID NO: 305714

SEQ ID NO: 326527 - RNA, 64 nt, Homo Sapiens; identical to SEQ ID NO: 305715

SEQ ID NO: 326528 - RNA, 64 nt, Homo Sapiens; identical to SEQ ID NO: 305716

SEQ ID NO: 326529 - RNA, 64 nt, Homo Sapiens; identical to SEQ ID NO: 305717

SEQ ID NO: 326530 - RNA, 64 nt, Homo Sapiens; identical to SEQ ID NO: 305718

SEQ ID NO: 326531 - RNA, 64 nt, Homo Sapiens; identical to SEQ ID NO: 305719

SEQ ID NO: 326532 - RNA, 64 nt, Homo Sapiens; identical to SEQ ID NO: 305720

SEQ ID NO: 326533 - RNA, 64 nt, Homo Sapiens; identical to SEQ ID NO: 305721

SEQ ID NO: 326534 - RNA, 64 nt, Homo Sapiens; identical to SEQ ID NO: 305722

SEQ ID NO: 326535 - RNA, 64 nt, Homo Sapiens; identical to SEQ ID NO: 305723

SEQ ID NO: 326536 - RNA, 64 nt, Homo Sapiens; identical to SEQ ID NO: 305724

SEQ ID NO: 326537 - RNA, 64 nt, Homo Sapiens
gacuuuaaaacucuggcuggcaaacaccuuaacuucuaaccaaaaccaggcagacagaaccuug

SEQ ID NO: 326538 - RNA, 64 nt, Homo Sapiens
gaacaagaaucucacuaucaccugcgccaggaagucuaaccaagcucagucuuccgcaggcuua

SEQ ID NO: 326539 - RNA, 64 nt, Homo Sapiens
aagaggagauaauguggauuaaaaccuuaagaguucuaaccaugccuacuaaauguacagauau

SEQ ID NO: 326540 - RNA, 64 nt, Homo Sapiens
aaucugauacuuagaccaaaagcaacauucguucucuaaccauucuguauugauuauauaagca

SEQ ID NO: 326541 - RNA, 64 nt, Homo Sapiens; identical to SEQ ID NO: 206387

SEQ ID NO: 326542 - RNA, 64 nt, Homo Sapiens; identical to SEQ ID NO: 206388

SEQ ID NO: 326543 - RNA, 64 nt, Homo Sapiens; identical to SEQ ID NO: 206389

SEQ ID NO: 326544 - RNA, 64 nt, Homo Sapiens; identical to SEQ ID NO: 206390

SEQ ID NO: 326545 - RNA, 64 nt, Homo Sapiens; identical to SEQ ID NO: 206391

SEQ ID NO: 326546 - RNA, 64 nt, Homo Sapiens; identical to SEQ ID NO: 206392

SEQ ID NO: 326547 - RNA, 64 nt, Homo Sapiens; identical to SEQ ID NO: 206393

SEQ ID NO: 326548 - RNA, 64 nt, Homo Sapiens; identical to SEQ ID NO: 206394

SEQ ID NO: 326549 - RNA, 64 nt, Homo Sapiens; identical to SEQ ID NO: 206395

SEQ ID NO: 326550 - RNA, 64 nt, Homo Sapiens; identical to SEQ ID NO: 206396

SEQ ID NO: 326551 - RNA, 64 nt, Homo Sapiens; identical to SEQ ID NO: 206397

SEQ ID NO: 326552 - RNA, 64 nt, Homo Sapiens; identical to SEQ ID NO: 206398

SEQ ID NO: 326553 - RNA, 64 nt, Homo Sapiens; identical to SEQ ID NO: 206399

SEQ ID NO: 326554 - RNA, 64 nt, Homo Sapiens; identical to SEQ ID NO: 206400

SEQ ID NO: 326555 - RNA, 64 nt, Homo Sapiens; identical to SEQ ID NO: 206401

SEQ ID NO: 326556 - RNA, 64 nt, Homo Sapiens; identical to SEQ ID NO: 206402

SEQ ID NO: 326557 - RNA, 64 nt, Homo Sapiens; identical to SEQ ID NO: 206403

SEQ ID NO: 326558 - RNA, 64 nt, Homo Sapiens; identical to SEQ ID NO: 206404

SEQ ID NO: 326559 - RNA, 64 nt, Homo Sapiens; identical to SEQ ID NO: 206405

SEQ ID NO: 326560 - RNA, 64 nt, Homo Sapiens; identical to SEQ ID NO: 206406

SEQ ID NO: 326561 - RNA, 64 nt, Homo Sapiens; identical to SEQ ID NO: 206407

SEQ ID NO: 326562 - RNA, 64 nt, Homo Sapiens; identical to SEQ ID NO: 206408

SEQ ID NO: 326563 - RNA, 64 nt, Homo Sapiens; identical to SEQ ID NO: 206409

SEQ ID NO: 326564 - RNA, 64 nt, Homo Sapiens; identical to SEQ ID NO: 206410

SEQ ID NO: 326565 - RNA, 64 nt, Homo Sapiens; identical to SEQ ID NO: 206411

SEQ ID NO: 326566 - RNA, 64 nt, Homo Sapiens; identical to SEQ ID NO: 206412

SEQ ID NO: 326567 - RNA, 64 nt, Homo Sapiens; identical to SEQ ID NO: 206413

SEQ ID NO: 326568 - RNA, 64 nt, Homo Sapiens; identical to SEQ ID NO: 206414

SEQ ID NO: 326569 - RNA, 64 nt, Homo Sapiens; identical to SEQ ID NO: 206415

SEQ ID NO: 326570 - RNA, 64 nt, Homo Sapiens; identical to SEQ ID NO: 206416

SEQ ID NO: 326571 - RNA, 64 nt, Homo Sapiens; identical to SEQ ID NO: 206417

SEQ ID NO: 326572 - RNA, 64 nt, Homo Sapiens; identical to SEQ ID NO: 206418

SEQ ID NO: 326573 - RNA, 64 nt, Homo Sapiens; identical to SEQ ID NO: 206419

SEQ ID NO: 326574 - RNA, 64 nt, Homo Sapiens; identical to SEQ ID NO: 206420

SEQ ID NO: 326575 - RNA, 64 nt, Homo Sapiens; identical to SEQ ID NO: 206421

SEQ ID NO: 326576 - RNA, 64 nt, Homo Sapiens; identical to SEQ ID NO: 206422

SEQ ID NO: 326577 - RNA, 64 nt, Homo Sapiens; identical to SEQ ID NO: 206423

SEQ ID NO: 326578 - RNA, 64 nt, Homo Sapiens
ucacaccuucuuauaaagugugagaacaaccacaccaccaaaugucauuuauuauuuuauaaau

SEQ ID NO: 326579 - RNA, 64 nt, Homo Sapiens
aaacuuuucaaugaucaaaagcuuucugcaccucccaccaaaacaagaaauuugaauaguuccu

SEQ ID NO: 326580 - RNA, 64 nt, Homo Sapiens
aaaaaaaaaaaaaaaaaaaaguacuauuuucucgccaccaaaaaggguaagauuugccuuaaca

SEQ ID NO: 326581 - RNA, 64 nt, Homo Sapiens
ggcccucacuuguggucagugugccccuugaagcccaccaaagcccuggccaccacaccggccu

SEQ ID NO: 326582 - RNA, 64 nt, Homo Sapiens
ucaaugucaagagaggaagaaugagcgucacugcccaccaaaggcuugaacccaacagucccuu

SEQ ID NO: 326583 - RNA, 64 nt, Homo Sapiens
caaacgacuaaccuaucuauuuacaagauggcgaccaccaaagugaucauuucugccaugaugu

SEQ ID NO: 326584 - RNA, 64 nt, Homo Sapiens
uucaucugggaauagcagcggucauggucuccuuccaccaaaucaacuguuccguuugucaucu

SEQ ID NO: 326585 - RNA, 64 nt, Homo Sapiens
uggcaaacaucaccagcuccuuggagagcuugcaccaccaaaaaauccguccuuggcucaggau

SEQ ID NO: 326586 - RNA, 64 nt, Homo Sapiens
ccaaaaucugugaaaagauuugaaucugauaucuccaccaaagccuugauguuuucucuguaca

SEQ ID NO: 326587 - RNA, 64 nt, Homo Sapiens
ucagccucucaaguagcgggauuacaggcgcccaccaccaaaaauuagcccagcuaauuuuugu

SEQ ID NO: 326588 - RNA, 64 nt, Homo Sapiens
gucccuccaacagcaauaucuuauaauauuuaacccaccaaaaauugaccagaaaacaaugauu

SEQ ID NO: 326589 - RNA, 64 nt, Homo Sapiens
gcuccuauccaacaauuauuagucugugcaaaacccaccaaaauacauucugacacaagaugca

SEQ ID NO: 326590 - RNA, 64 nt, Homo Sapiens
augaggaaucugaguugccauccuccuguggccaccaccaaaggcuccugaagccucugggaac

SEQ ID NO: 326591 - RNA, 64 nt, Homo Sapiens
ccagccaaugggccaccucuacgauguccacacaccaccaaaacucacaccccaaaaugaccca

SEQ ID NO: 326592 - RNA, 64 nt, Homo Sapiens
aauauuccauuuuccuuuccuugugguugaaaaccacagucaguggagagauguuuggaaacca

SEQ ID NO: 326593 - RNA, 64 nt, Homo Sapiens
gaaaaccacagucaguggagagauguuuggaaaccacagucaguggagccugggugguacccag

SEQ ID NO: 326594 - RNA, 64 nt, Homo Sapiens
accagaaagaugauucagaggaccaugacccagccacagucaauaauccaggacaggacauugu

SEQ ID NO: 326595 - RNA, 64 nt, Homo Sapiens
uuuggacagacuuuccucuaggcauucccuauuccacagucaucggggaccugcagagaaccau

SEQ ID NO: 326596 - RNA, 64 nt, Homo Sapiens
uuuaaaauugccauuauagaugagagcgugcaugcacagucauuuuuguuuaagaguaauauuu

SEQ ID NO: 326597 - RNA, 64 nt, Homo Sapiens
caaaaaugguuucacguuugcuuaaaugcuucaucacagucacauucaaaauagugacucuaaa

SEQ ID NO: 326598 - RNA, 64 nt, Homo Sapiens
gcuuuuauagguagacucauuacaggcucacagucacagucaucagagauuuucuuuggccucc

SEQ ID NO: 326599 - RNA, 64 nt, Homo Sapiens
gucaucgcuuuuauagguaggccuccuacaggcucacagucacaguuaaaagagauuuucuuug

SEQ ID NO: 326600 - RNA, 64 nt, Homo Sapiens
cagcaggcaguggcaggcagcugaaugacaugcucacagucacagaaacugagacccagagagg

SEQ ID NO: 326601 - RNA, 64 nt, Homo Sapiens
augcccugaaugaauggguggaggacgugucuaucacagucagugacugucggccugugaggau

SEQ ID NO: 326602 - RNA, 64 nt, Homo Sapiens
acugaaucugcguuguugggcagcccccagaucccacagucagacuauaaaccacucaaagauu

SEQ ID NO: 326603 - RNA, 64 nt, Homo Sapiens
cgaauaccugccuucucuggucuccuccucgagucacagucacaguuguuugcuccaggguuau

SEQ ID NO: 326604 - RNA, 64 nt, Homo Sapiens
uggcagcugaacuucagaauuucuccaucaacaucacagucagcgucuuucuaaugugguaaaa

SEQ ID NO: 326605 - RNA, 64 nt, Homo Sapiens
cugugcaaaggccccguggccaggacgguccccccacagucagcgggaccugccccccaugagc

SEQ ID NO: 326606 - RNA, 64 nt, Homo Sapiens
aauuucuucauggaaaucauauacauuagaaaaucacagucagauguuuaaucaauccaaaaug

SEQ ID NO: 326607 - RNA, 64 nt, Homo Sapiens
aaaacaguccuguguaaacugcuggaaguucuuccacagucaggucaauuuugucaaacccuuc

SEQ ID NO: 326608 - RNA, 64 nt, Homo Sapiens
gauuagaauucaccuggggacacacacucacacgcacagucacucuuacacauaugccuagucc

SEQ ID NO: 326609 - RNA, 64 nt, Homo Sapiens
aaacaaacaaaaaaaaucacugaaauuuuucccucacagucaguagcuuuguuugauauuuaac

SEQ ID NO: 326610 - RNA, 64 nt, Homo Sapiens
ugccacauuugaucuccuaacucaucuacaaagucacagucacagaguuauggcagagguucca

SEQ ID NO: 326611 - RNA, 64 nt, Homo Sapiens
caaacuuacauuccugccaaaacaugaagguuaacacagucaauuucugcuucaaaaggcucuc

SEQ ID NO: 326612 - RNA, 64 nt, Homo Sapiens
ggcugugcuuucccuuccaaccuccuccaccauccacagucaauccugagauccagccagagac

SEQ ID NO: 326613 - RNA, 64 nt, Homo Sapiens
acugugcaggacccagguuccccaagccggaguucacagucaucgggcacaggcugccagagcu

SEQ ID NO: 326614 - RNA, 64 nt, Homo Sapiens
uaugaggucagcaaggauaugaugagauuuugcucacagucaugugaaaacaaaaucucagcuc

SEQ ID NO: 326615 - RNA, 64 nt, Homo Sapiens
aaagccaaguuagugcaggcugagccccuugguucacagucaagccuccuuguuuccuagggug

SEQ ID NO: 326616 - RNA, 64 nt, Homo Sapiens
guugggcaugauuuguaccauccacccauacccacacagucacagucacacacacauauguauu

SEQ ID NO: 326617 - RNA, 64 nt, Homo Sapiens
caugauuuguaccauccacccauacccacacagucacagucacacacacauauguauuacuuac

SEQ ID NO: 326618 - RNA, 64 nt, Homo Sapiens
ggcagaggucugggcauuaucugcugccugacgccacagucauuccccacaagccugagccaac

SEQ ID NO: 326619 - RNA, 64 nt, Homo Sapiens
uuaggucccuuuggaaacaucgcugcgcccuguccacagucaccccccugguggcgcuuccugg

SEQ ID NO: 326620 - RNA, 64 nt, Homo Sapiens
uuuacauuuaucuauuaaaauccauuugguauuacacagucaaaucugugugguucagcuacuu

SEQ ID NO: 326621 - RNA, 64 nt, Homo Sapiens
uuuaacagcuuacacugauuuuugguuauuuaaucacagucaucaccuuauuggauauuugaua

SEQ ID NO: 326622 - RNA, 64 nt, Homo Sapiens
gcggcucuagcucugauaaccuucugcagaucaacacagucaaaaccgccugcaucuagugcug

SEQ ID NO: 326623 - RNA, 64 nt, Homo Sapiens
gaaagagaaaaaagauaaagguuugugccuccuacacagucaaagcacagcagguuacucagca

SEQ ID NO: 326624 - RNA, 64 nt, Homo Sapiens
ccgagaaagccugggggacccagacaccuguccccacagucaaagccuggggacccagacaucc

SEQ ID NO: 326625 - RNA, 64 nt, Homo Sapiens
cagucaaagccuggggacccagacauccuguccccacagucagccuccugucccugcuggugcc

SEQ ID NO: 326626 - RNA, 64 nt, Homo Sapiens
ugcuagguucucccuucacgccuuuauuaaugcacacagucauugccaugguaucuuucucuca

SEQ ID NO: 326627 - RNA, 64 nt, Homo Sapiens
ugagauuugagcugugcuggccagcgcauugccucacagucacgccgcagcauggaugugucgc

SEQ ID NO: 326628 - RNA, 64 nt, Homo Sapiens; identical to SEQ ID NO: 21142

SEQ ID NO: 326629 - RNA, 64 nt, Homo Sapiens; identical to SEQ ID NO: 21143

SEQ ID NO: 326630 - RNA, 62 nt, Homo Sapiens
aauuucacuugcuuugaaaguugauuuaauugacugacuaaaugaaaaugccuacccacuca

SEQ ID NO: 326631 - RNA, 62 nt, Homo Sapiens
aaaauuugcuagugguuugaaaauaauaauguacugacuacauguaugcuguuauugucagu

SEQ ID NO: 326632 - RNA, 64 nt, Homo Sapiens; identical to SEQ ID NO: 173401

SEQ ID NO: 326633 - RNA, 64 nt, Homo Sapiens; identical to SEQ ID NO: 173402

SEQ ID NO: 326634 - RNA, 64 nt, Homo Sapiens; identical to SEQ ID NO: 173403

SEQ ID NO: 326635 - RNA, 64 nt, Homo Sapiens; identical to SEQ ID NO: 173404

SEQ ID NO: 326636 - RNA, 64 nt, Homo Sapiens
gagagcucaugcugacugugaugagaaauugcagcaccucuaucucgcagguaauggaguaguu

SEQ ID NO: 326637 - RNA, 64 nt, Homo Sapiens
uguucuuuggaaugacugcuccacuccacacucacaccucuauucacagaccagcaucuccucu

SEQ ID NO: 326638 - RNA, 64 nt, Homo Sapiens
accucgucagccuucaggacugaucugccauuuucaccucuaaauccccaugucugaccauuag

SEQ ID NO: 326639 - RNA, 64 nt, Homo Sapiens
uucagcugccugaaacagccauguccaaguucuucaccucuauccaaagaacuugauuugcaug

SEQ ID NO: 326640 - RNA, 64 nt, Homo Sapiens
auggcuugacaugugcaauugugagggacaugcucaccucuagccuuaaggggggcagggagug

SEQ ID NO: 326641 - RNA, 64 nt, Homo Sapiens; identical to SEQ ID NO: 143712

SEQ ID NO: 326642 - RNA, 64 nt, Homo Sapiens; identical to SEQ ID NO: 143713

SEQ ID NO: 326643 - RNA, 64 nt, Homo Sapiens; identical to SEQ ID NO: 143714

SEQ ID NO: 326644 - RNA, 64 nt, Homo Sapiens; identical to SEQ ID NO: 143715

SEQ ID NO: 326645 - RNA, 64 nt, Homo Sapiens; identical to SEQ ID NO: 143716

SEQ ID NO: 326646 - RNA, 64 nt, Homo Sapiens; identical to SEQ ID NO: 143717

SEQ ID NO: 326647 - RNA, 64 nt, Homo Sapiens; identical to SEQ ID NO: 143718

SEQ ID NO: 326648 - RNA, 64 nt, Homo Sapiens; identical to SEQ ID NO: 143719

SEQ ID NO: 326649 - RNA, 64 nt, Homo Sapiens; identical to SEQ ID NO: 143720

SEQ ID NO: 326650 - RNA, 64 nt, Homo Sapiens; identical to SEQ ID NO: 143721

SEQ ID NO: 326651 - RNA, 64 nt, Homo Sapiens; identical to SEQ ID NO: 143722

SEQ ID NO: 326652 - RNA, 64 nt, Homo Sapiens; identical to SEQ ID NO: 143723

SEQ ID NO: 326653 - RNA, 64 nt, Homo Sapiens; identical to SEQ ID NO: 143724

SEQ ID NO: 326654 - RNA, 64 nt, Homo Sapiens; identical to SEQ ID NO: 143725

SEQ ID NO: 326655 - RNA, 64 nt, Homo Sapiens; identical to SEQ ID NO: 143726

SEQ ID NO: 326656 - RNA, 64 nt, Homo Sapiens; identical to SEQ ID NO: 143727

SEQ ID NO: 326657 - RNA, 64 nt, Homo Sapiens; identical to SEQ ID NO: 143728

SEQ ID NO: 326658 - RNA, 64 nt, Homo Sapiens; identical to SEQ ID NO: 143729

SEQ ID NO: 326659 - RNA, 64 nt, Homo Sapiens; identical to SEQ ID NO: 143730

SEQ ID NO: 326660 - RNA, 64 nt, Homo Sapiens; identical to SEQ ID NO: 143731

SEQ ID NO: 326661 - RNA, 64 nt, Homo Sapiens; identical to SEQ ID NO: 143732

SEQ ID NO: 326662 - RNA, 64 nt, Homo Sapiens; identical to SEQ ID NO: 143733

SEQ ID NO: 326663 - RNA, 64 nt, Homo Sapiens; identical to SEQ ID NO: 143734

SEQ ID NO: 326664 - RNA, 64 nt, Homo Sapiens; identical to SEQ ID NO: 143735

SEQ ID NO: 326665 - RNA, 64 nt, Homo Sapiens; identical to SEQ ID NO: 143736

SEQ ID NO: 326666 - RNA, 64 nt, Homo Sapiens; identical to SEQ ID NO: 143737

SEQ ID NO: 326667 - RNA, 64 nt, Homo Sapiens; identical to SEQ ID NO: 143738

SEQ ID NO: 326668 - RNA, 64 nt, Homo Sapiens; identical to SEQ ID NO: 143739

SEQ ID NO: 326669 - RNA, 64 nt, Homo Sapiens; identical to SEQ ID NO: 143740

SEQ ID NO: 326670 - RNA, 64 nt, Homo Sapiens; identical to SEQ ID NO: 143741

SEQ ID NO: 326671 - RNA, 64 nt, Homo Sapiens; identical to SEQ ID NO: 143742

SEQ ID NO: 326672 - RNA, 64 nt, Homo Sapiens; identical to SEQ ID NO: 143743

SEQ ID NO: 326673 - RNA, 64 nt, Homo Sapiens; identical to SEQ ID NO: 143744

SEQ ID NO: 326674 - RNA, 64 nt, Homo Sapiens; identical to SEQ ID NO: 143745

SEQ ID NO: 326675 - RNA, 64 nt, Homo Sapiens; identical to SEQ ID NO: 143746

SEQ ID NO: 326676 - RNA, 64 nt, Homo Sapiens; identical to SEQ ID NO: 143747

SEQ ID NO: 326677 - RNA, 64 nt, Homo Sapiens; identical to SEQ ID NO: 143748

SEQ ID NO: 326678 - RNA, 64 nt, Homo Sapiens; identical to SEQ ID NO: 143749

SEQ ID NO: 326679 - RNA, 64 nt, Homo Sapiens; identical to SEQ ID NO: 143750

SEQ ID NO: 326680 - RNA, 64 nt, Homo Sapiens; identical to SEQ ID NO: 143751

SEQ ID NO: 326681 - RNA, 64 nt, Homo Sapiens; identical to SEQ ID NO: 143752

SEQ ID NO: 326682 - RNA, 64 nt, Homo Sapiens; identical to SEQ ID NO: 143753

SEQ ID NO: 326683 - RNA, 64 nt, Homo Sapiens; identical to SEQ ID NO: 143754

SEQ ID NO: 326684 - RNA, 64 nt, Homo Sapiens; identical to SEQ ID NO: 143755

SEQ ID NO: 326685 - RNA, 64 nt, Homo Sapiens; identical to SEQ ID NO: 143756

SEQ ID NO: 326686 - RNA, 64 nt, Homo Sapiens; identical to SEQ ID NO: 143757

SEQ ID NO: 326687 - RNA, 64 nt, Homo Sapiens; identical to SEQ ID NO: 143758

SEQ ID NO: 326688 - RNA, 64 nt, Homo Sapiens; identical to SEQ ID NO: 143759

SEQ ID NO: 326689 - RNA, 64 nt, Homo Sapiens; identical to SEQ ID NO: 143760

SEQ ID NO: 326690 - RNA, 64 nt, Homo Sapiens; identical to SEQ ID NO: 143761

SEQ ID NO: 326691 - RNA, 64 nt, Homo Sapiens; identical to SEQ ID NO: 143762

SEQ ID NO: 326692 - RNA, 64 nt, Homo Sapiens; identical to SEQ ID NO: 143763

SEQ ID NO: 326693 - RNA, 64 nt, Homo Sapiens; identical to SEQ ID NO: 143764

SEQ ID NO: 326694 - RNA, 64 nt, Homo Sapiens; identical to SEQ ID NO: 143765

SEQ ID NO: 326695 - RNA, 64 nt, Homo Sapiens; identical to SEQ ID NO: 143766

SEQ ID NO: 326696 - RNA, 64 nt, Homo Sapiens; identical to SEQ ID NO: 143767

SEQ ID NO: 326697 - RNA, 64 nt, Homo Sapiens; identical to SEQ ID NO: 143768

SEQ ID NO: 326698 - RNA, 64 nt, Homo Sapiens; identical to SEQ ID NO: 143769

SEQ ID NO: 326699 - RNA, 64 nt, Homo Sapiens; identical to SEQ ID NO: 143770

SEQ ID NO: 326700 - RNA, 64 nt, Homo Sapiens; identical to SEQ ID NO: 143771

SEQ ID NO: 326701 - RNA, 64 nt, Homo Sapiens; identical to SEQ ID NO: 143772

SEQ ID NO: 326702 - RNA, 64 nt, Homo Sapiens; identical to SEQ ID NO: 143773

SEQ ID NO: 326703 - RNA, 64 nt, Homo Sapiens; identical to SEQ ID NO: 143774

SEQ ID NO: 326704 - RNA, 64 nt, Homo Sapiens; identical to SEQ ID NO: 143775

SEQ ID NO: 326705 - RNA, 64 nt, Homo Sapiens; identical to SEQ ID NO: 143776

SEQ ID NO: 326706 - RNA, 64 nt, Homo Sapiens; identical to SEQ ID NO: 143777

SEQ ID NO: 326707 - RNA, 64 nt, Homo Sapiens; identical to SEQ ID NO: 143778

SEQ ID NO: 326708 - RNA, 64 nt, Homo Sapiens; identical to SEQ ID NO: 143779

SEQ ID NO: 326709 - RNA, 64 nt, Homo Sapiens; identical to SEQ ID NO: 143780

SEQ ID NO: 326710 - RNA, 64 nt, Homo Sapiens; identical to SEQ ID NO: 143781

SEQ ID NO: 326711 - RNA, 64 nt, Homo Sapiens; identical to SEQ ID NO: 143782

SEQ ID NO: 326712 - RNA, 64 nt, Homo Sapiens; identical to SEQ ID NO: 143783

SEQ ID NO: 326713 - RNA, 64 nt, Homo Sapiens; identical to SEQ ID NO: 143784

SEQ ID NO: 326714 - RNA, 64 nt, Homo Sapiens; identical to SEQ ID NO: 143785

SEQ ID NO: 326715 - RNA, 64 nt, Homo Sapiens; identical to SEQ ID NO: 143786

SEQ ID NO: 326716 - RNA, 64 nt, Homo Sapiens; identical to SEQ ID NO: 143787

SEQ ID NO: 326717 - RNA, 64 nt, Homo Sapiens; identical to SEQ ID NO: 143788

SEQ ID NO: 326718 - RNA, 64 nt, Homo Sapiens; identical to SEQ ID NO: 143789

SEQ ID NO: 326719 - RNA, 57 nt, Homo Sapiens; identical to SEQ ID NO: 143790

SEQ ID NO: 326720 - RNA, 64 nt, Homo Sapiens; identical to SEQ ID NO: 143791

SEQ ID NO: 326721 - RNA, 64 nt, Homo Sapiens; identical to SEQ ID NO: 143792

SEQ ID NO: 326722 - RNA, 64 nt, Homo Sapiens; identical to SEQ ID NO: 143793

SEQ ID NO: 326723 - RNA, 64 nt, Homo Sapiens; identical to SEQ ID NO: 143794

SEQ ID NO: 326724 - RNA, 64 nt, Homo Sapiens; identical to SEQ ID NO: 143795

SEQ ID NO: 326725 - RNA, 64 nt, Homo Sapiens; identical to SEQ ID NO: 143796

SEQ ID NO: 326726 - RNA, 64 nt, Homo Sapiens; identical to SEQ ID NO: 143797

SEQ ID NO: 326727 - RNA, 64 nt, Homo Sapiens; identical to SEQ ID NO: 143798

SEQ ID NO: 326728 - RNA, 64 nt, Homo Sapiens; identical to SEQ ID NO: 143799

SEQ ID NO: 326729 - RNA, 64 nt, Homo Sapiens; identical to SEQ ID NO: 143800

SEQ ID NO: 326730 - RNA, 64 nt, Homo Sapiens; identical to SEQ ID NO: 143801

SEQ ID NO: 326731 - RNA, 64 nt, Homo Sapiens; identical to SEQ ID NO: 143802

SEQ ID NO: 326732 - RNA, 64 nt, Homo Sapiens; identical to SEQ ID NO: 143803

SEQ ID NO: 326733 - RNA, 64 nt, Homo Sapiens; identical to SEQ ID NO: 143804

SEQ ID NO: 326734 - RNA, 64 nt, Homo Sapiens; identical to SEQ ID NO: 143805

SEQ ID NO: 326735 - RNA, 64 nt, Homo Sapiens; identical to SEQ ID NO: 143806

SEQ ID NO: 326736 - RNA, 64 nt, Homo Sapiens; identical to SEQ ID NO: 143807

SEQ ID NO: 326737 - RNA, 64 nt, Homo Sapiens; identical to SEQ ID NO: 143808

SEQ ID NO: 326738 - RNA, 64 nt, Homo Sapiens; identical to SEQ ID NO: 143809

SEQ ID NO: 326739 - RNA, 64 nt, Homo Sapiens; identical to SEQ ID NO: 143810

SEQ ID NO: 326740 - RNA, 64 nt, Homo Sapiens; identical to SEQ ID NO: 143811

SEQ ID NO: 326741 - RNA, 64 nt, Homo Sapiens; identical to SEQ ID NO: 143812

SEQ ID NO: 326742 - RNA, 64 nt, Homo Sapiens; identical to SEQ ID NO: 141176

SEQ ID NO: 326743 - RNA, 64 nt, Homo Sapiens; identical to SEQ ID NO: 141177

SEQ ID NO: 326744 - RNA, 64 nt, Homo Sapiens; identical to SEQ ID NO: 141178

SEQ ID NO: 326745 - RNA, 64 nt, Homo Sapiens; identical to SEQ ID NO: 141179

SEQ ID NO: 326746 - RNA, 64 nt, Homo Sapiens; identical to SEQ ID NO: 141180

SEQ ID NO: 326747 - RNA, 64 nt, Homo Sapiens; identical to SEQ ID NO: 141181

SEQ ID NO: 326748 - RNA, 64 nt, Homo Sapiens; identical to SEQ ID NO: 141182

SEQ ID NO: 326749 - RNA, 64 nt, Homo Sapiens; identical to SEQ ID NO: 141183

SEQ ID NO: 326750 - RNA, 64 nt, Homo Sapiens; identical to SEQ ID NO: 141184

SEQ ID NO: 326751 - RNA, 64 nt, Homo Sapiens; identical to SEQ ID NO: 141185

SEQ ID NO: 326752 - RNA, 64 nt, Homo Sapiens; identical to SEQ ID NO: 141186

SEQ ID NO: 326753 - RNA, 64 nt, Homo Sapiens; identical to SEQ ID NO: 141187

SEQ ID NO: 326754 - RNA, 64 nt, Homo Sapiens; identical to SEQ ID NO: 141188

SEQ ID NO: 326755 - RNA, 64 nt, Homo Sapiens; identical to SEQ ID NO: 141189

SEQ ID NO: 326756 - RNA, 64 nt, Homo Sapiens; identical to SEQ ID NO: 141190

SEQ ID NO: 326757 - RNA, 64 nt, Homo Sapiens; identical to SEQ ID NO: 141191

SEQ ID NO: 326758 - RNA, 64 nt, Homo Sapiens; identical to SEQ ID NO: 141192

SEQ ID NO: 326759 - RNA, 64 nt, Homo Sapiens; identical to SEQ ID NO: 141193

SEQ ID NO: 326760 - RNA, 64 nt, Homo Sapiens; identical to SEQ ID NO: 141194

SEQ ID NO: 326761 - RNA, 64 nt, Homo Sapiens; identical to SEQ ID NO: 141195

SEQ ID NO: 326762 - RNA, 64 nt, Homo Sapiens; identical to SEQ ID NO: 141196

SEQ ID NO: 326763 - RNA, 64 nt, Homo Sapiens; identical to SEQ ID NO: 141197

SEQ ID NO: 326764 - RNA, 64 nt, Homo Sapiens; identical to SEQ ID NO: 141198

SEQ ID NO: 326765 - RNA, 64 nt, Homo Sapiens; identical to SEQ ID NO: 141199

SEQ ID NO: 326766 - RNA, 64 nt, Homo Sapiens; identical to SEQ ID NO: 141200

SEQ ID NO: 326767 - RNA, 64 nt, Homo Sapiens; identical to SEQ ID NO: 141201

SEQ ID NO: 326768 - RNA, 64 nt, Homo Sapiens; identical to SEQ ID NO: 141202

SEQ ID NO: 326769 - RNA, 64 nt, Homo Sapiens; identical to SEQ ID NO: 141203

SEQ ID NO: 326770 - RNA, 64 nt, Homo Sapiens; identical to SEQ ID NO: 141204

SEQ ID NO: 326771 - RNA, 64 nt, Homo Sapiens; identical to SEQ ID NO: 141205

SEQ ID NO: 326772 - RNA, 64 nt, Homo Sapiens; identical to SEQ ID NO: 141206

SEQ ID NO: 326773 - RNA, 64 nt, Homo Sapiens; identical to SEQ ID NO: 141207

SEQ ID NO: 326774 - RNA, 64 nt, Homo Sapiens; identical to SEQ ID NO: 141208

SEQ ID NO: 326775 - RNA, 64 nt, Homo Sapiens; identical to SEQ ID NO: 141209

SEQ ID NO: 326776 - RNA, 64 nt, Homo Sapiens; identical to SEQ ID NO: 141210

SEQ ID NO: 326777 - RNA, 64 nt, Homo Sapiens; identical to SEQ ID NO: 141211

SEQ ID NO: 326778 - RNA, 64 nt, Homo Sapiens; identical to SEQ ID NO: 141212

SEQ ID NO: 326779 - RNA, 64 nt, Homo Sapiens; identical to SEQ ID NO: 141213

SEQ ID NO: 326780 - RNA, 64 nt, Homo Sapiens; identical to SEQ ID NO: 141214

SEQ ID NO: 326781 - RNA, 64 nt, Homo Sapiens; identical to SEQ ID NO: 141215

SEQ ID NO: 326782 - RNA, 64 nt, Homo Sapiens; identical to SEQ ID NO: 141216

SEQ ID NO: 326783 - RNA, 64 nt, Homo Sapiens; identical to SEQ ID NO: 141217

SEQ ID NO: 326784 - RNA, 64 nt, Homo Sapiens; identical to SEQ ID NO: 141218

SEQ ID NO: 326785 - RNA, 64 nt, Homo Sapiens; identical to SEQ ID NO: 141219

SEQ ID NO: 326786 - RNA, 64 nt, Homo Sapiens; identical to SEQ ID NO: 141220

SEQ ID NO: 326787 - RNA, 64 nt, Homo Sapiens; identical to SEQ ID NO: 141221

SEQ ID NO: 326788 - RNA, 64 nt, Homo Sapiens; identical to SEQ ID NO: 237917

SEQ ID NO: 326789 - RNA, 64 nt, Homo Sapiens; identical to SEQ ID NO: 237918

SEQ ID NO: 326790 - RNA, 64 nt, Homo Sapiens; identical to SEQ ID NO: 237919

SEQ ID NO: 326791 - RNA, 64 nt, Homo Sapiens; identical to SEQ ID NO: 237920

SEQ ID NO: 326792 - RNA, 64 nt, Homo Sapiens; identical to SEQ ID NO: 237921

SEQ ID NO: 326793 - RNA, 64 nt, Homo Sapiens; identical to SEQ ID NO: 237922

SEQ ID NO: 326794 - RNA, 64 nt, Homo Sapiens; identical to SEQ ID NO: 237923

SEQ ID NO: 326795 - RNA, 64 nt, Homo Sapiens; identical to SEQ ID NO: 237924

SEQ ID NO: 326796 - RNA, 64 nt, Homo Sapiens; identical to SEQ ID NO: 237925

SEQ ID NO: 326797 - RNA, 64 nt, Homo Sapiens; identical to SEQ ID NO: 237926

SEQ ID NO: 326798 - RNA, 64 nt, Homo Sapiens; identical to SEQ ID NO: 237927

SEQ ID NO: 326799 - RNA, 64 nt, Homo Sapiens; identical to SEQ ID NO: 237928

SEQ ID NO: 326800 - RNA, 64 nt, Homo Sapiens; identical to SEQ ID NO: 237927

SEQ ID NO: 326801 - RNA, 64 nt, Homo Sapiens; identical to SEQ ID NO: 237930

SEQ ID NO: 326802 - RNA, 64 nt, Homo Sapiens; identical to SEQ ID NO: 237931

SEQ ID NO: 326803 - RNA, 64 nt, Homo Sapiens; identical to SEQ ID NO: 237932

SEQ ID NO: 326804 - RNA, 64 nt, Homo Sapiens; identical to SEQ ID NO: 237933

SEQ ID NO: 326805 - RNA, 64 nt, Homo Sapiens; identical to SEQ ID NO: 237934

SEQ ID NO: 326806 - RNA, 64 nt, Homo Sapiens; identical to SEQ ID NO: 237935

SEQ ID NO: 326807 - RNA, 64 nt, Homo Sapiens; identical to SEQ ID NO: 237936

SEQ ID NO: 326808 - RNA, 64 nt, Homo Sapiens; identical to SEQ ID NO: 237937

SEQ ID NO: 326809 - RNA, 64 nt, Homo Sapiens; identical to SEQ ID NO: 237938

SEQ ID NO: 326810 - RNA, 64 nt, Homo Sapiens; identical to SEQ ID NO: 237939

SEQ ID NO: 326811 - RNA, 64 nt, Homo Sapiens; identical to SEQ ID NO: 237940

SEQ ID NO: 326812 - RNA, 64 nt, Homo Sapiens; identical to SEQ ID NO: 237941

SEQ ID NO: 326813 - RNA, 64 nt, Homo Sapiens; identical to SEQ ID NO: 237942

SEQ ID NO: 326814 - RNA, 64 nt, Homo Sapiens; identical to SEQ ID NO: 237943

SEQ ID NO: 326815 - RNA, 64 nt, Homo Sapiens; identical to SEQ ID NO: 237944

SEQ ID NO: 326816 - RNA, 64 nt, Homo Sapiens; identical to SEQ ID NO: 237945

SEQ ID NO: 326817 - RNA, 64 nt, Homo Sapiens; identical to SEQ ID NO: 237946

SEQ ID NO: 326818 - RNA, 64 nt, Homo Sapiens; identical to SEQ ID NO: 237947

SEQ ID NO: 326819 - RNA, 64 nt, Homo Sapiens; identical to SEQ ID NO: 237948

SEQ ID NO: 326820 - RNA, 64 nt, Homo Sapiens; identical to SEQ ID NO: 237949

SEQ ID NO: 326821 - RNA, 64 nt, Homo Sapiens; identical to SEQ ID NO: 237950

SEQ ID NO: 326822 - RNA, 64 nt, Homo Sapiens; identical to SEQ ID NO: 237951

SEQ ID NO: 326823 - RNA, 64 nt, Homo Sapiens; identical to SEQ ID NO: 237952

SEQ ID NO: 326824 - RNA, 64 nt, Homo Sapiens; identical to SEQ ID NO: 237953

SEQ ID NO: 326825 - RNA, 64 nt, Homo Sapiens; identical to SEQ ID NO: 237954

SEQ ID NO: 326826 - RNA, 64 nt, Homo Sapiens; identical to SEQ ID NO: 237955

SEQ ID NO: 326827 - RNA, 64 nt, Homo Sapiens; identical to SEQ ID NO: 237956

SEQ ID NO: 326828 - RNA, 64 nt, Homo Sapiens; identical to SEQ ID NO: 237957

SEQ ID NO: 326829 - RNA, 64 nt, Homo Sapiens; identical to SEQ ID NO: 237958

SEQ ID NO: 326830 - RNA, 64 nt, Homo Sapiens; identical to SEQ ID NO: 237959

SEQ ID NO: 326831 - RNA, 64 nt, Homo Sapiens; identical to SEQ ID NO: 237960

SEQ ID NO: 326832 - RNA, 64 nt, Homo Sapiens; identical to SEQ ID NO: 237961

SEQ ID NO: 326833 - RNA, 64 nt, Homo Sapiens; identical to SEQ ID NO: 237962

SEQ ID NO: 326834 - RNA, 64 nt, Homo Sapiens; identical to SEQ ID NO: 237963

SEQ ID NO: 326835 - RNA, 64 nt, Homo Sapiens; identical to SEQ ID NO: 237964

SEQ ID NO: 326836 - RNA, 64 nt, Homo Sapiens; identical to SEQ ID NO: 237965

SEQ ID NO: 326837 - RNA, 64 nt, Homo Sapiens; identical to SEQ ID NO: 237966

SEQ ID NO: 326838 - RNA, 64 nt, Homo Sapiens; identical to SEQ ID NO: 237967

SEQ ID NO: 326839 - RNA, 63 nt, Homo Sapiens
ucaggagucagggcauggacgggugaugcagggaagggugacauccaccaaauacacagggaa

SEQ ID NO: 326840 - RNA, 63 nt, Homo Sapiens
cagggaagggugacaucaggcaaauacacagggaagggugaugcucaaucaagccuuauccac

SEQ ID NO: 326841 - RNA, 63 nt, Homo Sapiens
ccaaaaggagaaagcuauguagaaagauacauuaagggugaaaauagcaauacaguagauuug

SEQ ID NO: 326842 - RNA, 63 nt, Homo Sapiens
ucauucuggagguccuauuagagaauauuauaaaagggugaccuuguaggaaggaucugaguc

SEQ ID NO: 326843 - RNA, 63 nt, Homo Sapiens
uuacuuucaaccauaagcgguaauagcagaggaaagggugaagggagucugggcaagcaaagc

SEQ ID NO: 326844 - RNA, 63 nt, Homo Sapiens
gucuaguagguggaucccauccaguugguuuccaagggugauccugaaacaguguaaaaggag

SEQ ID NO: 326845 - RNA, 63 nt, Homo Sapiens
cuaggacagcuggcugagaaguggguucaggcgaagggugaagccauguguagcaguuccugc

SEQ ID NO: 326846 - RNA, 63 nt, Homo Sapiens
auuguauuuguguguuuguguuuguuuuuuuuuaagggugagccaggucuagcccaacagucu

SEQ ID NO: 326847 - RNA, 63 nt, Homo Sapiens
cuaaucaguugaacuuaacauuuaauaaaaagaaagggugaaauaaacugaagaccauuuuag

SEQ ID NO: 326848 - RNA, 63 nt, Homo Sapiens
caggacugcacgguuuaacacagcagaguacagaagggugaagaagugagcagaggcuuauga

SEQ ID NO: 326849 - RNA, 63 nt, Homo Sapiens
ucuugccagccgcaucgagacagucacuugcagaagggugacuuguauaucuggcaugugucc

SEQ ID NO: 326850 - RNA, 63 nt, Homo Sapiens
ugggggugugugugccguguaggggguggguguaagggugaggguggaaggaggucgguuccg

SEQ ID NO: 326851 - RNA, 63 nt, Homo Sapiens
ugagucaucccuacucccaacaucuggaggggaaagggugauucuggggguccacuugucugu

SEQ ID NO: 326852 - RNA, 63 nt, Homo Sapiens
aaggaaucaaaugucaucucccaggaguuauucaagggugagcccuuuacuugggauguacag

SEQ ID NO: 326853 - RNA, 64 nt, Homo Sapiens; identical to SEQ ID NO: 159445

SEQ ID NO: 326854 - RNA, 64 nt, Homo Sapiens; identical to SEQ ID NO: 159446

SEQ ID NO: 326855 - RNA, 64 nt, Homo Sapiens; identical to SEQ ID NO: 159447

SEQ ID NO: 326856 - RNA, 64 nt, Homo Sapiens; identical to SEQ ID NO: 159448

SEQ ID NO: 326857 - RNA, 64 nt, Homo Sapiens; identical to SEQ ID NO: 159449

SEQ ID NO: 326858 - RNA, 64 nt, Homo Sapiens; identical to SEQ ID NO: 159450

SEQ ID NO: 326859 - RNA, 64 nt, Homo Sapiens; identical to SEQ ID NO: 159451

SEQ ID NO: 326860 - RNA, 64 nt, Homo Sapiens; identical to SEQ ID NO: 159452

SEQ ID NO: 326861 - RNA, 64 nt, Homo Sapiens; identical to SEQ ID NO: 159453

SEQ ID NO: 326862 - RNA, 64 nt, Homo Sapiens; identical to SEQ ID NO: 159454

SEQ ID NO: 326863 - RNA, 64 nt, Homo Sapiens; identical to SEQ ID NO: 159455

SEQ ID NO: 326864 - RNA, 64 nt, Homo Sapiens; identical to SEQ ID NO: 159456

SEQ ID NO: 326865 - RNA, 64 nt, Homo Sapiens
ggaauaucaucacugaucccacagaaauacaaacuaccaucagagaauacuacaaacaccucua

SEQ ID NO: 326866 - RNA, 64 nt, Homo Sapiens
uuaaacuaaagaccuucugcacagcaaaagaaacuaccaucagagucaacaggcaaccuacaaa

SEQ ID NO: 326867 - RNA, 64 nt, Homo Sapiens
uugauaauacaacuuaaacauguuugcuauaaaauaccaucacaaguaaaugagcuugguguga

SEQ ID NO: 326868 - RNA, 64 nt, Homo Sapiens
uguguuccucugaacaaagcggagaaaaugaugauaccaucaauauugaaauuaaacuuccaac

SEQ ID NO: 326869 - RNA, 64 nt, Homo Sapiens; identical to SEQ ID NO: 23640

SEQ ID NO: 326870 - RNA, 64 nt, Homo Sapiens; identical to SEQ ID NO: 23641

SEQ ID NO: 326871 - RNA, 64 nt, Homo Sapiens; identical to SEQ ID NO: 23642

SEQ ID NO: 326872 - RNA, 64 nt, Homo Sapiens; identical to SEQ ID NO: 23643

SEQ ID NO: 326873 - RNA, 64 nt, Homo Sapiens; identical to SEQ ID NO: 23644

SEQ ID NO: 326874 - RNA, 64 nt, Homo Sapiens; identical to SEQ ID NO: 23645

SEQ ID NO: 326875 - RNA, 64 nt, Homo Sapiens; identical to SEQ ID NO: 23646

SEQ ID NO: 326876 - RNA, 64 nt, Homo Sapiens; identical to SEQ ID NO: 23647

SEQ ID NO: 326877 - RNA, 64 nt, Homo Sapiens; identical to SEQ ID NO: 23648

SEQ ID NO: 326878 - RNA, 64 nt, Homo Sapiens; identical to SEQ ID NO: 23649

SEQ ID NO: 326879 - RNA, 64 nt, Homo Sapiens; identical to SEQ ID NO: 23650

SEQ ID NO: 326880 - RNA, 64 nt, Homo Sapiens; identical to SEQ ID NO: 23651

SEQ ID NO: 326881 - RNA, 64 nt, Homo Sapiens; identical to SEQ ID NO: 23652

SEQ ID NO: 326882 - RNA, 64 nt, Homo Sapiens; identical to SEQ ID NO: 23653

SEQ ID NO: 326883 - RNA, 64 nt, Homo Sapiens; identical to SEQ ID NO: 23654

SEQ ID NO: 326884 - RNA, 64 nt, Homo Sapiens; identical to SEQ ID NO: 23655

SEQ ID NO: 326885 - RNA, 64 nt, Homo Sapiens; identical to SEQ ID NO: 23656

SEQ ID NO: 326886 - RNA, 64 nt, Homo Sapiens; identical to SEQ ID NO: 23657

SEQ ID NO: 326887 - RNA, 64 nt, Homo Sapiens; identical to SEQ ID NO: 23658

SEQ ID NO: 326888 - RNA, 64 nt, Homo Sapiens; identical to SEQ ID NO: 23659

SEQ ID NO: 326889 - RNA, 64 nt, Homo Sapiens; identical to SEQ ID NO: 23660

SEQ ID NO: 326890 - RNA, 64 nt, Homo Sapiens; identical to SEQ ID NO: 23661

SEQ ID NO: 326891 - RNA, 64 nt, Homo Sapiens; identical to SEQ ID NO: 23662

SEQ ID NO: 326892 - RNA, 64 nt, Homo Sapiens; identical to SEQ ID NO: 23663

SEQ ID NO: 326893 - RNA, 64 nt, Homo Sapiens; identical to SEQ ID NO: 23664

SEQ ID NO: 326894 - RNA, 64 nt, Homo Sapiens; identical to SEQ ID NO: 23665

SEQ ID NO: 326895 - RNA, 64 nt, Homo Sapiens; identical to SEQ ID NO: 23666

SEQ ID NO: 326896 - RNA, 64 nt, Homo Sapiens; identical to SEQ ID NO: 23667

SEQ ID NO: 326897 - RNA, 64 nt, Homo Sapiens; identical to SEQ ID NO: 23668

SEQ ID NO: 326898 - RNA, 64 nt, Homo Sapiens; identical to SEQ ID NO: 23669

SEQ ID NO: 326899 - RNA, 64 nt, Homo Sapiens; identical to SEQ ID NO: 23670

SEQ ID NO: 326900 - RNA, 64 nt, Homo Sapiens
gagaaacagagugaggccuugaggaauucuuaggaauuccuaaggcuguucugaaauuccuaag

SEQ ID NO: 326901 - RNA, 64 nt, Homo Sapiens
gaggaauucuuaggaauuccaagggcuguucugaaauuccuaagcccaggagaagauacuucag

SEQ ID NO: 326902 - RNA, 64 nt, Homo Sapiens
ucuaaaauugugguuuaacucacgcaggaaguaaaauuccuauagcaagacauaguuucauuuu

SEQ ID NO: 326903 - RNA, 64 nt, Homo Sapiens
aaaauaaugaagagaacuuuuaaacuuuuuuaugaauuccuaaacauuaccauuuauguggcag

SEQ ID NO: 326904 - RNA, 64 nt, Homo Sapiens
aucuaaagcaugaaaccuagcuccucuacacacaaauuccuauggaaauaccuuuguguacagu

SEQ ID NO: 326905 - RNA, 64 nt, Homo Sapiens
aucaagcucaauacaccaaggaaacuggauccagaauuccuaaacuuuaaaaugguacugucug

SEQ ID NO: 326906 - RNA, 64 nt, Homo Sapiens
aaauaccacccuaccacuaauuaaugaaacaaaaaauuccuaaguacuguacuuuuguuuaaau

SEQ ID NO: 326907 - RNA, 64 nt, Homo Sapiens
aaguacagccgcaagaaagaauuuucacacauuuaauuccuauuuaacuuuauuguuauuauuu

SEQ ID NO: 326908 - RNA, 64 nt, Homo Sapiens
uggauccaauacacacauuguuacaacuaacacaaauuccuauuaaauauuaaaaguaguucug

SEQ ID NO: 326909 - RNA, 64 nt, Homo Sapiens
uugaacauaguaaaacuauugaauuucucuuaagaauuccuaauaggucaauagauuuacccuc

SEQ ID NO: 326910 - RNA, 64 nt, Homo Sapiens
acaggauuauauaacgaaauuuugaauaaacuugaauuccuaaaagauggaaacaggaaaguag

SEQ ID NO: 326911 - RNA, 64 nt, Homo Sapiens
uugagcauccacgugcuggacgauacuuauuuacaauuccuaaguauuuuugguaccucugaug

SEQ ID NO: 326912 - RNA, 64 nt, Homo Sapiens
uacuuuauuaagcaguauugugacuuguugcagaaauuccuaucuaccauuccuguaaauguuu

SEQ ID NO: 326913 - RNA, 64 nt, Homo Sapiens
gcuuccuugcgcaacuucucaacaaagcuaaggcaauuccuauuggggaaaagggucgaguuag

SEQ ID NO: 326914 - RNA, 64 nt, Homo Sapiens
gggauugacucucccagcauugccuuagaaacagaauuccuaaggugauggugccugagacccc

SEQ ID NO: 326915 - RNA, 64 nt, Homo Sapiens
auaugugaucgugaaucagacaguguuuacuuucaauuccuagguccauuauugggcagaaucu

SEQ ID NO: 326916 - RNA, 64 nt, Homo Sapiens
aguggaaaugcuagauaaaaauaucuuuaagguaaauuccuagauuauuuuguacauguguaau

SEQ ID NO: 326917 - RNA, 64 nt, Homo Sapiens
acaaaaaugacccgauuaaaguuaaauuucugacaauuccuaaucuucuugccauucaaaauau

SEQ ID NO: 326918 - RNA, 64 nt, Homo Sapiens
guuuugcaauaacuucuauauuuuaauagaaauaaauuccuaaacucccuucccucucucccau

SEQ ID NO: 326919 - RNA, 64 nt, Homo Sapiens
uucccuuuuaaucaacuguagguuauuuaaaauaaauuccuacaacuuaauggaaacuuaagug

SEQ ID NO: 326920 - RNA, 64 nt, Homo Sapiens
gcaaguuagaaauuuuuagcuguucacugccccuaauuccuaaaugagagagagucagguugca

SEQ ID NO: 326921 - RNA, 64 nt, Homo Sapiens
gcaaguuagaaguuuuuagcuguucacugcccccaauuccuaaaugagagggauucggguugcg

SEQ ID NO: 326922 - RNA, 64 nt, Homo Sapiens
ucaaacugugaauaguaagggauuagcaaauguuaauuccuagcggaaaaacugaguccaacua

SEQ ID NO: 326923 - RNA, 64 nt, Homo Sapiens
gucagccucccuuuuuguaaucccauauucaaauaauuccuaagugaauaaaaggaaaaguuua

SEQ ID NO: 326924 - RNA, 64 nt, Homo Sapiens
gcacuguccccacccaaccuucuucauugguugucucugugagaaaaucugcccuacaaaaugc

SEQ ID NO: 326925 - RNA, 64 nt, Homo Sapiens
auaagcaacauccccgcccccgugauuaugauagcucugugauugucucuuacagguauaguuc

SEQ ID NO: 326926 - RNA, 64 nt, Homo Sapiens
ucccccacuguacccacaggauacaucaucgccccucugugaagguggcuggagcaggccucug

SEQ ID NO: 326927 - RNA, 64 nt, Homo Sapiens
caugaccuugugaauugugugcuguccuucugugcucugugagaacucgugguacuucaguguc

SEQ ID NO: 326928 - RNA, 64 nt, Homo Sapiens
acaaggggcuaauccaugagcaguguucuguaggcucugugacaucuuugguuuauaggauuuu

SEQ ID NO: 326929 - RNA, 64 nt, Homo Sapiens
ugaguuuauuguggaaucuuugaaaggacaaggccucugugaaugaaucagucccagggaagca

SEQ ID NO: 326930 - RNA, 64 nt, Homo Sapiens
cccuugucuccaguucucucacuacuuuuuccuccucugugagugaccauccaggcagucacca

SEQ ID NO: 326931 - RNA, 64 nt, Homo Sapiens
cucuccaacugccugcuugcucuuuacagccucucucugugacuggaaucucuccaccucaucg

SEQ ID NO: 326932 - RNA, 64 nt, Homo Sapiens
gagccacuaucucugcuguccacuuuccuucaggcucugugaauacuucaaccugcugugauuu

SEQ ID NO: 326933 - RNA, 64 nt, Homo Sapiens
cugggaugauaauaaugccugccucgauguccuccucugugaaaacaagcuacuuaacuuggua

SEQ ID NO: 326934 - RNA, 64 nt, Homo Sapiens
uuuguaauauggggaaguaguucucaccuaaacccucugugaaacuuuguaaacuuccaaguca

SEQ ID NO: 326935 - RNA, 64 nt, Homo Sapiens
ggacaguaaguacagcuagcaucuauaugagaagcucugugaggggcagcccagcgucuggagu

SEQ ID NO: 326936 - RNA, 64 nt, Homo Sapiens
ugcugggaacucgcauggaaagaaauuucccgagcucugugacaacugacauacucaggcacag

SEQ ID NO: 326937 - RNA, 64 nt, Homo Sapiens
auaacuguccacugcaagagucuggcucucccuucucugugacccggcaugacugggcgccugg

SEQ ID NO: 326938 - RNA, 64 nt, Homo Sapiens
gacccggcaugacugggcgccuggagcaguuucacucugugaggagugagggaacccuggggcu

SEQ ID NO: 326939 - RNA, 64 nt, Homo Sapiens
agggcccgcaguguuggcugcugccugccacagccucugugacugcaguggagcggcgaauucc

SEQ ID NO: 326940 - RNA, 64 nt, Homo Sapiens
uucuuuaucccuucuuccccuggaaugcaggacccucugugacaucccucuguaccaucugcug

SEQ ID NO: 326941 - RNA, 56 nt, Homo Sapiens
caggcuuacgauggugacgguccgagcucugugacuaucgcuacgguuccuacuga

SEQ ID NO: 326942 - RNA, 64 nt, Homo Sapiens
acuuccccuccagaaaaacggauggaaggaagcccucugugacacugcuucugagaagaagcau

SEQ ID NO: 326943 - RNA, 64 nt, Homo Sapiens
gaagcauuuccgggaccgauaucaucugucuggucucugugaacagcaaggaaucuucuugacc

SEQ ID NO: 326944 - RNA, 64 nt, Homo Sapiens
aguuguuucugacuuuuuucaugauguuuuuuuccucugugauguucagauuaaucucuucuga

SEQ ID NO: 326945 - RNA, 64 nt, Homo Sapiens
guguuuguguguguagggcauuguaagcugucuucucugugaacuaccucagauuccucugauu

SEQ ID NO: 326946 - RNA, 64 nt, Homo Sapiens
ccuuggccugcacggucuguaguugacuccaagucucugugagcagugacuugaaccaaacaca

SEQ ID NO: 326947 - RNA, 64 nt, Homo Sapiens
ugucuuaauguucaucucuuuuccacugcccauccucugugaacccauaccucucuagauggag

SEQ ID NO: 326948 - RNA, 64 nt, Homo Sapiens
gucacugcugcccacugcagagcuuucccagcuucucugugaggcccagcugugugucaccagc

SEQ ID NO: 326949 - RNA, 64 nt, Homo Sapiens
ggucccaccagcccagggcuagcuuucccggcuucucugugaggcccagcugugugucaccaga

SEQ ID NO: 326950 - RNA, 64 nt, Homo Sapiens
cuuugcagguuuuuuauuggccugacucuggaaccucugugaucccucugugacgccaguucuc

SEQ ID NO: 326951 - RNA, 64 nt, Homo Sapiens
ccaguucucccugacucuggccugacucuggaaccucugugacgagcugcuccucucaguucuc

SEQ ID NO: 326952 - RNA, 64 nt, Homo Sapiens
cgaggcguguggauugguuuccacccggaacaggcucugugauggcugaauggaaagaaacgua

SEQ ID NO: 326953 - RNA, 64 nt, Homo Sapiens
cccuggaugaggugaugauuucccgucccaaggacucugugaaguuuagaguacaguuuguugg

SEQ ID NO: 326954 - RNA, 64 nt, Homo Sapiens
gugguuugaauagauugcuuuuaaggucuuucugcucugugauuccuugauaauacauuucuuu

SEQ ID NO: 326955 - RNA, 64 nt, Homo Sapiens
ucaccaucuuugcucuguuuugaaagucaggcuucucugugacugugaagccugcuguucccug

SEQ ID NO: 326956 - RNA, 64 nt, Homo Sapiens
auauauugauaaaaagugacugcauuuuugcaaaacaagauaaccuuuggaaaccuuuuaaaaa

SEQ ID NO: 326957 - RNA, 64 nt, Homo Sapiens
aaaugaaaaaucaaucuuuccugcagcauguaucacaagauaagagagauagugguguuuacug

SEQ ID NO: 326958 - RNA, 64 nt, Homo Sapiens
uuucuuuguguucccagugucuugcccaguagauacaagauaaauauugccagaaucagauauc

SEQ ID NO: 326959 - RNA, 64 nt, Homo Sapiens
caggccccucccacaacauggaauaaugggagauacaagauauuuggguggagacacagagcca

SEQ ID NO: 326960 - RNA, 64 nt, Homo Sapiens
gcacuuucaaaaugaaucuaauacuacacauauuacaagauauaauagagcuuggucaaccucu

SEQ ID NO: 326961 - RNA, 64 nt, Homo Sapiens
gaaccucauucaguuucacuaauuugggccucagacaagauauuauuaaauaaaaguaguuuag

SEQ ID NO: 326962 - RNA, 64 nt, Homo Sapiens
auguuauuaauaaaaauagaugaacucugguuaaacaagauaaucuauucaauagcucagaggu

SEQ ID NO: 326963 - RNA, 64 nt, Homo Sapiens
gaacagcuguuaauauuuuuuuuguguauuaagcacaagauaaaaagaagcaaauuuauaccua

SEQ ID NO: 326964 - RNA, 64 nt, Homo Sapiens
gaugauaacacuuaaaauuguggguguugaucuuacaagauauuauaaguacuagaugcaucac

SEQ ID NO: 326965 - RNA, 64 nt, Homo Sapiens
ggugcuucuggaaacuaccaauccaacuuccaagacaagauaccaacuucaguugaucuucuuc

SEQ ID NO: 326966 - RNA, 64 nt, Homo Sapiens
cauauucuacuuagacguuauucaaaaucauguuacaagauagauggacuguaauuuaugauuu

SEQ ID NO: 326967 - RNA, 64 nt, Homo Sapiens
aggugaauuguucugaguguaaggugcggucucaacaagauaccaagacagacacaaagggcag

SEQ ID NO: 326968 - RNA, 64 nt, Homo Sapiens; identical to SEQ ID NO: 172960

SEQ ID NO: 326969 - RNA, 64 nt, Homo Sapiens; identical to SEQ ID NO: 172961

SEQ ID NO: 326970 - RNA, 64 nt, Homo Sapiens; identical to SEQ ID NO: 172962

SEQ ID NO: 326971 - RNA, 64 nt, Homo Sapiens; identical to SEQ ID NO: 172963

SEQ ID NO: 326972 - RNA, 64 nt, Homo Sapiens; identical to SEQ ID NO: 172964

SEQ ID NO: 326973 - RNA, 64 nt, Homo Sapiens; identical to SEQ ID NO: 172965

SEQ ID NO: 326974 - RNA, 64 nt, Homo Sapiens; identical to SEQ ID NO: 195921

SEQ ID NO: 326975 - RNA, 64 nt, Homo Sapiens; identical to SEQ ID NO: 195922

SEQ ID NO: 326976 - RNA, 64 nt, Homo Sapiens; identical to SEQ ID NO: 195923

SEQ ID NO: 326977 - RNA, 64 nt, Homo Sapiens; identical to SEQ ID NO: 195924

SEQ ID NO: 326978 - RNA, 64 nt, Homo Sapiens; identical to SEQ ID NO: 195925

SEQ ID NO: 326979 - RNA, 64 nt, Homo Sapiens; identical to SEQ ID NO: 195926

SEQ ID NO: 326980 - RNA, 64 nt, Homo Sapiens; identical to SEQ ID NO: 195927

SEQ ID NO: 326981 - RNA, 64 nt, Homo Sapiens; identical to SEQ ID NO: 195928

SEQ ID NO: 326982 - RNA, 64 nt, Homo Sapiens; identical to SEQ ID NO: 195929

SEQ ID NO: 326983 - RNA, 64 nt, Homo Sapiens; identical to SEQ ID NO: 195930

SEQ ID NO: 326984 - RNA, 64 nt, Homo Sapiens; identical to SEQ ID NO: 195931

SEQ ID NO: 326985 - RNA, 64 nt, Homo Sapiens; identical to SEQ ID NO: 195932

SEQ ID NO: 326986 - RNA, 64 nt, Homo Sapiens; identical to SEQ ID NO: 195933

SEQ ID NO: 326987 - RNA, 64 nt, Homo Sapiens; identical to SEQ ID NO: 195934

SEQ ID NO: 326988 - RNA, 53 nt, Homo Sapiens; identical to SEQ ID NO: 244527

SEQ ID NO: 326989 - RNA, 64 nt, Homo Sapiens; identical to SEQ ID NO: 244528

SEQ ID NO: 326990 - RNA, 64 nt, Homo Sapiens; identical to SEQ ID NO: 244529

SEQ ID NO: 326991 - RNA, 64 nt, Homo Sapiens; identical to SEQ ID NO: 244530

SEQ ID NO: 326992 - RNA, 64 nt, Homo Sapiens; identical to SEQ ID NO: 244531

SEQ ID NO: 326993 - RNA, 64 nt, Homo Sapiens; identical to SEQ ID NO: 244532

SEQ ID NO: 326994 - RNA, 64 nt, Homo Sapiens; identical to SEQ ID NO: 244533

SEQ ID NO: 326995 - RNA, 64 nt, Homo Sapiens; identical to SEQ ID NO: 244534

SEQ ID NO: 326996 - RNA, 64 nt, Homo Sapiens; identical to SEQ ID NO: 244535

SEQ ID NO: 326997 - RNA, 64 nt, Homo Sapiens; identical to SEQ ID NO: 244536

SEQ ID NO: 326998 - RNA, 64 nt, Homo Sapiens; identical to SEQ ID NO: 244537

SEQ ID NO: 326999 - RNA, 64 nt, Homo Sapiens; identical to SEQ ID NO: 244538

SEQ ID NO: 327000 - RNA, 64 nt, Homo Sapiens; identical to SEQ ID NO: 244539

SEQ ID NO: 327001 - RNA, 64 nt, Homo Sapiens; identical to SEQ ID NO: 244540

SEQ ID NO: 327002 - RNA, 64 nt, Homo Sapiens; identical to SEQ ID NO: 244541

SEQ ID NO: 327003 - RNA, 64 nt, Homo Sapiens; identical to SEQ ID NO: 229347

SEQ ID NO: 327004 - RNA, 64 nt, Homo Sapiens; identical to SEQ ID NO: 229348

SEQ ID NO: 327005 - RNA, 64 nt, Homo Sapiens; identical to SEQ ID NO: 229349

SEQ ID NO: 327006 - RNA, 64 nt, Homo Sapiens; identical to SEQ ID NO: 229350

SEQ ID NO: 327007 - RNA, 64 nt, Homo Sapiens; identical to SEQ ID NO: 229351

SEQ ID NO: 327008 - RNA, 64 nt, Homo Sapiens; identical to SEQ ID NO: 229352

SEQ ID NO: 327009 - RNA, 64 nt, Homo Sapiens; identical to SEQ ID NO: 229353

SEQ ID NO: 327010 - RNA, 64 nt, Homo Sapiens; identical to SEQ ID NO: 229354

SEQ ID NO: 327011 - RNA, 64 nt, Homo Sapiens; identical to SEQ ID NO: 229355

SEQ ID NO: 327012 - RNA, 64 nt, Homo Sapiens; identical to SEQ ID NO: 229356

SEQ ID NO: 327013 - RNA, 64 nt, Homo Sapiens; identical to SEQ ID NO: 229357

SEQ ID NO: 327014 - RNA, 64 nt, Homo Sapiens; identical to SEQ ID NO: 229358

SEQ ID NO: 327015 - RNA, 64 nt, Homo Sapiens; identical to SEQ ID NO: 229359

SEQ ID NO: 327016 - RNA, 64 nt, Homo Sapiens; identical to SEQ ID NO: 229360

SEQ ID NO: 327017 - RNA, 64 nt, Homo Sapiens; identical to SEQ ID NO: 229361

SEQ ID NO: 327018 - RNA, 64 nt, Homo Sapiens
uguggcuugcuucccccagggcagcacaggcuaagucaggaacaucggaugccagggagggagg

SEQ ID NO: 327019 - RNA, 64 nt, Homo Sapiens
ucacccacacaguaggugcugagaguuaggacaggucaggaagucccccaggguccacaaaggu

SEQ ID NO: 327020 - RNA, 64 nt, Homo Sapiens
uaaaccuagaaaaacggguaguaaacuguggauagucaggaaaacacccagcaagggacacagc

SEQ ID NO: 327021 - RNA, 64 nt, Homo Sapiens
auagucaggaaaacacccagcaagggacacagcugucaggaaaugaaucuuccccccaaccccc

SEQ ID NO: 327022 - RNA, 64 nt, Homo Sapiens
ggucuagaaguguacggucacugaacggggccuagucaggaagcgggcauugucaguauccguc

SEQ ID NO: 327023 - RNA, 64 nt, Homo Sapiens
gggaaggggagugggggcacuugcauuuucuucugucaggaauggcaaauauucagaagaucuu

SEQ ID NO: 327024 - RNA, 64 nt, Homo Sapiens
agcaguggcaagggacggagaggucccaacaggagucaggaagagguuugauuauaaccaagaa

SEQ ID NO: 327025 - RNA, 64 nt, Homo Sapiens
aauuccuguuuucauggguccuguagauguuugagucaggaagguaaggcggggagugacugaa

SEQ ID NO: 327026 - RNA, 64 nt, Homo Sapiens
gaggugcuguuaugagcagccaaaagccagcucugucaggaaagcuuggagcacauugauuuuu

SEQ ID NO: 327027 - RNA, 64 nt, Homo Sapiens
cagaaagggcuugaaauuuauggguagaauuguagucaggaaaaaaggauuuuuaaauuuuuua

SEQ ID NO: 327028 - RNA, 64 nt, Homo Sapiens
ugggggcuguaggaggaggcagggauuccagggugucaggaaggcaggggugccaggucccacc

SEQ ID NO: 327029 - RNA, 64 nt, Homo Sapiens
ugggggcucuaggaggaggcagggacuccagggugucaggaaggcaggggugccgggucccacc

SEQ ID NO: 327030 - RNA, 64 nt, Homo Sapiens
gaaaagaaacuuaguucuacaauucauacaugaagucaggaaaaaaggucugaggugggucuga

SEQ ID NO: 327031 - RNA, 64 nt, Homo Sapiens
aacaaacuucaauuaaauguaaugcagacauacagucaggaaagaacaaauucugacuugcaga

SEQ ID NO: 327032 - RNA, 64 nt, Homo Sapiens
uaggaaggccuuuaggcagagaaacccuuugaaugucaggaaugcagagaauucacacugguga

SEQ ID NO: 327033 - RNA, 64 nt, Homo Sapiens
cagcaaggccuuuaagcagaagaaaccuaugaaugucaggaaugcuauagaacucauacuaaug

SEQ ID NO: 327034 - RNA, 64 nt, Homo Sapiens
ccgugggcuuccugcccucaucccucgacuccaagucaggaauaucgggccccuccguucuguc

SEQ ID NO: 327035 - RNA, 64 nt, Homo Sapiens
caguuuauucuacuccaagaaguccugccccuuagucaggaauguuacugcugaggcuucauuc

SEQ ID NO: 327036 - RNA, 64 nt, Homo Sapiens; identical to SEQ ID NO: 100727

SEQ ID NO: 327037 - RNA, 64 nt, Homo Sapiens; identical to SEQ ID NO: 100728

SEQ ID NO: 327038 - RNA, 64 nt, Homo Sapiens; identical to SEQ ID NO: 100729

SEQ ID NO: 327039 - RNA, 64 nt, Homo Sapiens; identical to SEQ ID NO: 100730

SEQ ID NO: 327040 - RNA, 64 nt, Homo Sapiens; identical to SEQ ID NO: 100731

SEQ ID NO: 327041 - RNA, 64 nt, Homo Sapiens; identical to SEQ ID NO: 100732

SEQ ID NO: 327042 - RNA, 64 nt, Homo Sapiens; identical to SEQ ID NO: 243458

SEQ ID NO: 327043 - RNA, 64 nt, Homo Sapiens; identical to SEQ ID NO: 243459

SEQ ID NO: 327044 - RNA, 64 nt, Homo Sapiens; identical to SEQ ID NO: 243460

SEQ ID NO: 327045 - RNA, 64 nt, Homo Sapiens; identical to SEQ ID NO: 243461

SEQ ID NO: 327046 - RNA, 64 nt, Homo Sapiens; identical to SEQ ID NO: 243462

SEQ ID NO: 327047 - RNA, 64 nt, Homo Sapiens; identical to SEQ ID NO: 256768

SEQ ID NO: 327048 - RNA, 64 nt, Homo Sapiens; identical to SEQ ID NO: 256769

SEQ ID NO: 327049 - RNA, 64 nt, Homo Sapiens; identical to SEQ ID NO: 256770

SEQ ID NO: 327050 - RNA, 64 nt, Homo Sapiens; identical to SEQ ID NO: 256771

SEQ ID NO: 327051 - RNA, 64 nt, Homo Sapiens; identical to SEQ ID NO: 256772

SEQ ID NO: 327052 - RNA, 64 nt, Homo Sapiens; identical to SEQ ID NO: 256773

SEQ ID NO: 327053 - RNA, 64 nt, Homo Sapiens; identical to SEQ ID NO: 256774

SEQ ID NO: 327054 - RNA, 64 nt, Homo Sapiens; identical to SEQ ID NO: 256775

SEQ ID NO: 327055 - RNA, 64 nt, Homo Sapiens; identical to SEQ ID NO: 256776

SEQ ID NO: 327056 - RNA, 64 nt, Homo Sapiens; identical to SEQ ID NO: 256777

SEQ ID NO: 327057 - RNA, 64 nt, Homo Sapiens; identical to SEQ ID NO: 256778

SEQ ID NO: 327058 - RNA, 64 nt, Homo Sapiens; identical to SEQ ID NO: 256779

SEQ ID NO: 327059 - RNA, 64 nt, Homo Sapiens; identical to SEQ ID NO: 256780

SEQ ID NO: 327060 - RNA, 64 nt, Homo Sapiens; identical to SEQ ID NO: 256781

SEQ ID NO: 327061 - RNA, 64 nt, Homo Sapiens
caccggugucccccagcagccuggggucugacaauaccucgagccacaaccgaccagaugccag

SEQ ID NO: 327062 - RNA, 64 nt, Homo Sapiens
aucaguugggaucccuccucuuuagcucccuccauaccucgaacggaagacacaugauuaauga

SEQ ID NO: 327063 - RNA, 52 nt, Homo Sapiens
agcggccugaaggccucugagcuaccucgacuuuggacagaguaaugacucc

SEQ ID NO: 327064 - RNA, 64 nt, Homo Sapiens
uuucuaggaguuacacauacauuuuauccugucauaccucgagauaaaguggcauguuagugag

SEQ ID NO: 327065 - RNA, 64 nt, Homo Sapiens
uaaagaccuauuggggcuggaacagcagaaccucuaccucgaacuucuagcucaccugggaaau

SEQ ID NO: 327066 - RNA, 64 nt, Homo Sapiens
caccauuccagccagggacgucccagcucccugguaccucgaggagcgaggagggcaagcggcc

SEQ ID NO: 327067 - RNA, 64 nt, Homo Sapiens
gacccagugacaucaguggccuuucaaacaugcuuaccucgaguccuuguucuuugauucagcc

SEQ ID NO: 327068 - RNA, 64 nt, Homo Sapiens
ucacauguccguuuucuuuccuuuuaccaaguuguaccucgagauugucauuugccuauucaga

SEQ ID NO: 327069 - RNA, 64 nt, Homo Sapiens
cacuugaugucugaggauaccuuccaucucaaccuaccucgaguggcgaguccagacaccauca

SEQ ID NO: 327070 - RNA, 64 nt, Homo Sapiens
ucacgccucggccugggagccuggccucuugauauaccucgagcuuccccugugcuccccagcc

SEQ ID NO: 327071 - RNA, 64 nt, Homo Sapiens
ccuccuguguuggacagagguuucagccguuugcuaccucgauuuuuaaccccuagucagagca

SEQ ID NO: 327072 - RNA, 64 nt, Homo Sapiens
gaauuuacaggaguccacaugaagagugcuuacuuaccucgagacccccaaguggugcuuguug

SEQ ID NO: 327073 - RNA, 64 nt, Homo Sapiens
accuugggcacauguucccaauaaaaccaagcuguaccucgacccucauuccucccuaaaaugu

SEQ ID NO: 327074 - RNA, 64 nt, Homo Sapiens
caaauuggugaaagaaaaggagguggauaccaacuaccucgaagcccaugagcaguuguaaaac

SEQ ID NO: 327075 - RNA, 64 nt, Homo Sapiens
ucauaaucauaaugcggcccccuuccccagagcuuaccucgaaugugaaaucccuacuucuuau

SEQ ID NO: 327076 - RNA, 64 nt, Homo Sapiens
aaacucagagugggguggggagcauguucauuuguaccucgaguuuuaaacugguuccuaggga

SEQ ID NO: 327077 - RNA, 64 nt, Homo Sapiens
uuuaagaacacacauugccaacaccuggaaaauuuaccucgauuggaaaagagaagacuguuuu

SEQ ID NO: 327078 - RNA, 64 nt, Homo Sapiens
gaggcccagcuagauaaugagucagucgccaucauaccucgaguuuuucagccuuguggagccu

SEQ ID NO: 327079 - RNA, 64 nt, Homo Sapiens
agccauggccugccugccuucuauagccgucugcuaccucgagaucuaagacaacaguaugcug

SEQ ID NO: 327080 - RNA, 64 nt, Homo Sapiens
guagggccuggggugaauucccugucccccaugguaccucgagaggggcuggggagcucagcuu

SEQ ID NO: 327081 - RNA, 64 nt, Homo Sapiens
ccacaaggggaagaaauguacaugaagucuccauuaccucgaauuuuuuucucagucucacugg

SEQ ID NO: 327082 - RNA, 64 nt, Homo Sapiens
auuaagcuuuugccagaaaauguugcauguguuuuaccucgacuugcuaaaaucgauuagcaga

SEQ ID NO: 327083 - RNA, 64 nt, Homo Sapiens
ugaaucugccggggccccaguauuaacgcugcuguaccucgaucuauuaacgcuccaagaguau

SEQ ID NO: 327084 - RNA, 64 nt, Homo Sapiens
aagcaccagcuuuucacacagggccugguugcccuaccucgaacagucaucccucuuguaugcu

SEQ ID NO: 327085 - RNA, 60 nt, Homo Sapiens
gcaucgacugggaggacuaguucguagccauaccucgagucccugcauuggacggcucug

SEQ ID NO: 327086 - RNA, 64 nt, Homo Sapiens
gaaauuuaaugauguguucaacuccaccagaaauuaccucgagucagcauugacgauauuggag

SEQ ID NO: 327087 - RNA, 64 nt, Homo Sapiens
uuccaaaagaggucaccagaccaccccauaacaauaccucgaauuuucuuuccccggagucccu

SEQ ID NO: 327088 - RNA, 64 nt, Homo Sapiens
aagaaacagaaaacgugucucagauggcuggcuuuaccucgauagcauaagagagaccuaagac

SEQ ID NO: 327089 - RNA, 64 nt, Homo Sapiens
accccacaacuuggggaucuagcugagacauuucuaccucgaacaagucacauguaccacaggu

SEQ ID NO: 327090 - RNA, 64 nt, Homo Sapiens
ccgccuggccaggccuccuggccgccacgcagaauaccucgaaccaggcgggcugugaaccagc

SEQ ID NO: 327091 - RNA, 64 nt, Homo Sapiens
ccauccccucacguuucagaacuuccaggcuuucuaccucgacucucaccacagccagcacaua

SEQ ID NO: 327092 - RNA, 64 nt, Homo Sapiens
aggacuguggagacguaaauguaaacugugacucuaccucgacccuguuucuuauuuuucuucu

SEQ ID NO: 327093 - RNA, 64 nt, Homo Sapiens
cccgcuaacaaaugaggcccucgguggcgaccauuaccucgacaugccgaggagaagacgggcc

SEQ ID NO: 327094 - RNA, 64 nt, Homo Sapiens
cucuuccauccccaaacuguagaacccccacauuuaccucgaggaacugaggucacuggguucu

SEQ ID NO: 327095 - RNA, 64 nt, Homo Sapiens
acaucaaccccaucaccaaggacauacucaccucuaccucgaccggcaguugcuugaggcucca

SEQ ID NO: 327096 - RNA, 64 nt, Homo Sapiens
aguugugaggcuaaaaaggguuaauaacagaaccuaccucgaaguccucaucugucaaaugggg

SEQ ID NO: 327097 - RNA, 64 nt, Homo Sapiens
cccaggggaggaaaaugaaaacugcuuuccaacuuaccucgaguugcucaucaaccucagagac

SEQ ID NO: 327098 - RNA, 64 nt, Homo Sapiens
cuuuugggccacagacaucauugcuguuccccguuaccucgagcugacucuagaggggaaggca

SEQ ID NO: 327099 - RNA, 64 nt, Homo Sapiens
ggcaugaaaauuguguuacuauaaugccuuauuuuaccucgagaauuguuaccuuaaauuagua

SEQ ID NO: 327100 - RNA, 64 nt, Homo Sapiens
gcuccgccaaguacaacugggcuggcgcugcggcuaccucgaguggccgcccuagugcgcaggg

SEQ ID NO: 327101 - RNA, 64 nt, Homo Sapiens
cuguagccuuuuuggauaaaauuggguuuuaacauaccucgaguccaacuaaucucauuaaaca

SEQ ID NO: 327102 - RNA, 64 nt, Homo Sapiens
ggagggcuggcucccaguuaccuccccgauggucuaccucgaagugggagcuacuucucgguuc

SEQ ID NO: 327103 - RNA, 64 nt, Homo Sapiens
aaaaaagaaugcuguuccugcaccugccgguuauuuccaagaagcugaaucuuugggacugauu

SEQ ID NO: 327104 - RNA, 64 nt, Homo Sapiens
acagaguuuaaacuauuuucuuguccccaccaccuuccaagaaccugcgaggguaguaaucauc

SEQ ID NO: 327105 - RNA, 64 nt, Homo Sapiens
ggagauaggcagggcuaaaaugcuucuguuauuauuccaagacuuuagauacugaaaggugcua

SEQ ID NO: 327106 - RNA, 64 nt, Homo Sapiens
gucaauuaaaaaugaguuuauuugugaccucucauuccaagauuaaaauagaaauuagugcccu

SEQ ID NO: 327107 - RNA, 64 nt, Homo Sapiens
auggaggcaaggggaacaaagagcaugagucuuuuuccaagaaaacuggugaguuaaguaagau

SEQ ID NO: 327108 - RNA, 64 nt, Homo Sapiens
caggauggaaacagucaggcacugacuggggugcuuccaagaggcaugagagugccuacucugg

SEQ ID NO: 327109 - RNA, 64 nt, Homo Sapiens
ccgugugugccaagaauaaagauguauuuuuacuuuccaagaugcaauagcagaaaauuggcaa

SEQ ID NO: 327110 - RNA, 64 nt, Homo Sapiens
gaagccacuuaaauaagcuuaauuguuuucuuucuuccaagaaaaaaagaaaauuguuaguuua

SEQ ID NO: 327111 - RNA, 64 nt, Homo Sapiens
aacuugauaucauucagcuguaucauaauugaauuuccaagaacuaguagucacuuguuuucau

SEQ ID NO: 327112 - RNA, 64 nt, Homo Sapiens
aaaucuugcacaagcaaagucauuugaaccaguuuuccaagaacauaagaaagggcaaaaaauu

SEQ ID NO: 327113 - RNA, 64 nt, Homo Sapiens
aucuggaaaguuaaauaaaucuaccugacauuuauuccaagaagcaagguuuguacaaauucua

SEQ ID NO: 327114 - RNA, 64 nt, Homo Sapiens
uuuaaauuugcuaguugcaucucuauaucuuaaauuccaagaugauaaaaucccuuaauuugac

SEQ ID NO: 327115 - RNA, 64 nt, Homo Sapiens
gccaucagcuaggaagaaacgugggagaugugaauuccaagaguugccuggacagggcaaguca

SEQ ID NO: 327116 - RNA, 64 nt, Homo Sapiens
uggacagggcaagucauguuagcgugggucacacuuccaagauauuuaaagcaaauacaaaaca

SEQ ID NO: 327117 - RNA, 64 nt, Homo Sapiens
acuacacccuagcagaucagcugaguguacuuuauuccaagaacuuacuggaucucugguuuuu

SEQ ID NO: 327118 - RNA, 64 nt, Homo Sapiens
accaccagauggcagagugaccgcgcauaccugcuuccaagaauaaaacaguucugaaaagcaa

SEQ ID NO: 327119 - RNA, 64 nt, Homo Sapiens
gcacggcggcaaguuuucaagcacugaguuucuauuccaagaucauagacuuacuaaagagagu

SEQ ID NO: 327120 - RNA, 64 nt, Homo Sapiens
uguuaauuuguuagaauucuaacacacuauauacuuccaagaaguaugucaaugucaauauuuu

SEQ ID NO: 327121 - RNA, 64 nt, Homo Sapiens
aauguuuuuuguuuuuuuuuuccuuuucuugccuuuccaagaaaguagcagaaaacuacuuaug

SEQ ID NO: 327122 - RNA, 64 nt, Homo Sapiens
aucauggaccagguccucuaugugaagugcaucuuuccaagaccagauaaaauagagcacaaac

SEQ ID NO: 327123 - RNA, 64 nt, Homo Sapiens
aagccagugcuagcugagaaauauuuccaagauuuuccaagauggggggcuagaaccaucuucc

SEQ ID NO: 327124 - RNA, 64 nt, Homo Sapiens
uuccaagaugaagccagugcaccaucuuccauauuuccaagauuuucuguauuugggggcuaga

SEQ ID NO: 327125 - RNA, 64 nt, Homo Sapiens
auugcaauaucugaagcccucccagguguuaacauuccaagacucuagaguccaagguuuaaag

SEQ ID NO: 327126 - RNA, 64 nt, Homo Sapiens
agggucgaaagcucuagaaucugcaauucaaaaguuccaagagucuaaagauggaguuucuaag

SEQ ID NO: 327127 - RNA, 64 nt, Homo Sapiens
gugugauggugugaaacccagaaauuagaagcgauuccaagaaccagccauacagaacaaauga

SEQ ID NO: 327128 - RNA, 64 nt, Homo Sapiens
cuacaaugacauugaaguugugggagcgaauuuauuccaagaaugaaacaaagaggggaagaua

SEQ ID NO: 327129 - RNA, 64 nt, Homo Sapiens
aagcuggauccgaguagauugggcaccacaguguuuccaagagcggcuaugcucacgggaggcu

SEQ ID NO: 327130 - RNA, 64 nt, Homo Sapiens
gcuuaggaugacagcaccccuaggcugaauuugauuccaagagagaccuguuuuagaaggagcc

SEQ ID NO: 327131 - RNA, 64 nt, Homo Sapiens
aacuugaagauuacauaaaaggacauaugauucuuuccaagauggcuaccaacccauucaaaga

SEQ ID NO: 327132 - RNA, 64 nt, Homo Sapiens
aacuugaagauuacaucaaaagacauaugacucuuuccaagauggcaguuaccucauucaaaga

SEQ ID NO: 327133 - RNA, 64 nt, Homo Sapiens
aggugccgaggggccacugcuggggguucaugggaucccgaaggagcaagcagucggcagcacc

SEQ ID NO: 327134 - RNA, 64 nt, Homo Sapiens
aaggucucccauguaccagagaaggaaaagucugaucccgaaacagcuugaacgaaaggugguu

SEQ ID NO: 327135 - RNA, 64 nt, Homo Sapiens
uagauucccaguucuaaggcagucaagugaucagaucccgaaucaggaaagagcaaguuugcuc

SEQ ID NO: 327136 - RNA, 64 nt, Homo Sapiens
gggcuucccgggaaaccucgcuugagccacuuggaucccgaaguaccugauaccaagaagacaa

SEQ ID NO: 327137 - RNA, 64 nt, Homo Sapiens
cugcaggcggaguuuucagaggaugcaauuuuggaucccgaauuuugauguaccuuaaacuucc

SEQ ID NO: 327138 - RNA, 64 nt, Homo Sapiens
cuuacuccauuugaccagauuguuuggcuaacacaucccgaagaaugauuuugucaggaauuau

SEQ ID NO: 327139 - RNA, 64 nt, Homo Sapiens
ccugugugccugcaguugucagggaccauuugggaucccgaaucucauucucuaaaacugcuuu

SEQ ID NO: 327140 - RNA, 64 nt, Homo Sapiens
agagcaauguguuuccucuccucggucaugacuuaucccgaagugagcgucucugaaauugagu

SEQ ID NO: 327141 - RNA, 50 nt, Homo Sapiens
acaaaaaguaacacaguggaaucccgaaaucccggcaagcacgcaacuaa

SEQ ID NO: 327142 - RNA, 64 nt, Homo Sapiens
agcagccacagccaggcuucugucauacagguagaucccgaagcacagagacauaaaaaagguc

SEQ ID NO: 327143 - RNA, 64 nt, Homo Sapiens
auggagaggaacacaggcgcaguaugucugauggaucccgaagagggauggggguacucaaugg

SEQ ID NO: 327144 - RNA, 64 nt, Homo Sapiens
uuucacuuguauacuacucuuacaauggaaaaaaaucccgaaaacuguauacuucugauuaaau

SEQ ID NO: 327145 - RNA, 64 nt, Homo Sapiens
accaacuccuacaaaugagaugaacagauuuaccaucccgaagauacugcuaggcccagcacaa

SEQ ID NO: 327146 - RNA, 64 nt, Homo Sapiens
auacguauguguuuucuuaguaaaaugguaauuuaucccgaaaaaguguacauagaucuaaaau

SEQ ID NO: 327147 - RNA, 64 nt, Homo Sapiens
agggacuggggcugagagcaagccuccugggaggaucccgaagugaggagugagcagccggcac

SEQ ID NO: 327148 - RNA, 64 nt, Homo Sapiens
augaacguagaaaucuaucuggaaauuucuaauaaucccgaauauacgcauuguucaaacugaa

SEQ ID NO: 327149 - RNA, 64 nt, Homo Sapiens
agagucauuuuaauccaaauuuucacagagaagaaucccgaagaauguaacaagaagcaaagcc

SEQ ID NO: 327150 - RNA, 64 nt, Homo Sapiens
ggacggggguucucucaccaacagcugugauuucaucccgaaguggaagggggucuaaacagaa

SEQ ID NO: 327151 - RNA, 64 nt, Homo Sapiens
gucaccugcagauuucucgugauugacuccaaacaucccgaaauugucauaaugugcuuuaucu

SEQ ID NO: 327152 - RNA, 64 nt, Homo Sapiens
aagauacauauacuuaaauaugcacuaugacauaaucccgaaaaaccauaacuaagauuuacau

SEQ ID NO: 327153 - RNA, 64 nt, Homo Sapiens
uuuuaaaguauuuaugaagcgcaugguuaaggccaucccgaacuaaaggauugguggagacuau

SEQ ID NO: 327154 - RNA, 64 nt, Homo Sapiens
aaaauauaaguguuccacaaacaaaguuucuuaaaucccgaagaauguagucuuucaguacgag

SEQ ID NO: 327155 - RNA, 64 nt, Homo Sapiens
cugccuuucaaggguaauugaggcugaaugaaugaucccgaaucuguaaaagcugcuuugauga

SEQ ID NO: 327156 - RNA, 64 nt, Homo Sapiens
ggugcuauggucuguuaaacuuuagacgugcuucaucccgaaguuuccuucuuuccuuuauuug

SEQ ID NO: 327157 - RNA, 64 nt, Homo Sapiens
acuccccugagcccucuucucuccaggcuaaagaaucccgaaggcaucgaggccauuucugcug

SEQ ID NO: 327158 - RNA, 64 nt, Homo Sapiens
ucucucgguuccacguccccuuccaucagguuccaucccgaaaacuccuccugaccacggacgu

SEQ ID NO: 327159 - RNA, 62 nt, Homo Sapiens
uccacccguucccacugcccccuucgcuccacaucccgaaacgcuccgcccccucccaguga

SEQ ID NO: 327160 - RNA, 64 nt, Homo Sapiens
uuugacagccccucaggccuccagaauuuugaaaaucccgaauucuaauuugcuucaagaaaca

SEQ ID NO: 327161 - RNA, 64 nt, Homo Sapiens
agcccaaucauuccaaccaaagcaggguuggggaaucccgaauggccccaauucuugccucauc

SEQ ID NO: 327162 - RNA, 64 nt, Homo Sapiens
gcccugcauauuuagugaccaaggcaucaaggacaucccgaaacuggaaauucauauccaucug

SEQ ID NO: 327163 - RNA, 64 nt, Homo Sapiens
uucuugaauugcuuucccuacugaacauuuaaguaucccgaauucucuugcacaucuaaaaagg

SEQ ID NO: 327164 - RNA, 64 nt, Homo Sapiens
cucuggugccccuguauauguggaucucgccuacaucccgaaucauugcaguggcaagacugcu

SEQ ID NO: 327165 - RNA, 64 nt, Homo Sapiens
agauuuuuaaaucccauuuuaauuaucuuugaacaucccgaaccauugcaaaauuugccuuagc

SEQ ID NO: 327166 - RNA, 64 nt, Homo Sapiens
cgccuauguacguaaguuugggccauuguaguuuaucccgaagaucuucugucugugacacagu

SEQ ID NO: 327167 - RNA, 64 nt, Homo Sapiens
aggcucccaaucagcuuuuguucuagacuuccccaucccgaagccaucacuucuccccgcagcc

SEQ ID NO: 327168 - RNA, 64 nt, Homo Sapiens
cauagagacauuugcugucaguguggacauuuucaucccgaagcuucuucucgggucuuaaagu

SEQ ID NO: 327169 - RNA, 64 nt, Homo Sapiens
guacaaggacgcacuuguaaaaucaguacagguuaucccgaaaguugaaaagguccugcagaga

SEQ ID NO: 327170 - RNA, 64 nt, Homo Sapiens
auuuggagcauacugguuuuccaggugcaugugaaucccgaaggacugaugauauuugaauguu

SEQ ID NO: 327171 - RNA, 64 nt, Homo Sapiens
cugggccuguccagggucaaccucauugugaagaaucccgaaucgaagaaaccugguccauucc

SEQ ID NO: 327172 - RNA, 64 nt, Homo Sapiens
cugggucuuggguuuuuuaacacgggcacuuucaaucccgaauggucaauacuugaacucccau

SEQ ID NO: 327173 - RNA, 64 nt, Homo Sapiens; identical to SEQ ID NO: 327170

SEQ ID NO: 327174 - RNA, 64 nt, Homo Sapiens; identical to SEQ ID NO: 197404

SEQ ID NO: 327175 - RNA, 64 nt, Homo Sapiens; identical to SEQ ID NO: 197405

SEQ ID NO: 327176 - RNA, 64 nt, Homo Sapiens; identical to SEQ ID NO: 197469

SEQ ID NO: 327177 - RNA, 64 nt, Homo Sapiens; identical to SEQ ID NO: 197470

SEQ ID NO: 327178 - RNA, 64 nt, Homo Sapiens; identical to SEQ ID NO: 197517

SEQ ID NO: 327179 - RNA, 64 nt, Homo Sapiens; identical to SEQ ID NO: 197518

SEQ ID NO: 327180 - RNA, 64 nt, Homo Sapiens; identical to SEQ ID NO: 197519

SEQ ID NO: 327181 - RNA, 64 nt, Homo Sapiens; identical to SEQ ID NO: 197520

SEQ ID NO: 327182 - RNA, 64 nt, Homo Sapiens; identical to SEQ ID NO: 197521

SEQ ID NO: 327183 - RNA, 64 nt, Homo Sapiens; identical to SEQ ID NO: 197543

SEQ ID NO: 327184 - RNA, 64 nt, Homo Sapiens; identical to SEQ ID NO: 197544

SEQ ID NO: 327185 - RNA, 64 nt, Homo Sapiens
ugugaaacccuauguugucaacacuuggaagacucuuauccauccauguauauuucccccuggu

SEQ ID NO: 327186 - RNA, 64 nt, Homo Sapiens
ucuugaacuuuauacucuuguuaccuccuagcuacuuauccaucacuugccuaccuuucuggcc

SEQ ID NO: 327187 - RNA, 64 nt, Homo Sapiens
uagccaaagcgaagcuuguacagguugaguaucccuuauccaaaaugcuuggaaccagaagugu

SEQ ID NO: 327188 - RNA, 64 nt, Homo Sapiens
cuaaacacaaaauucauugaugugucaguuacaccuuauccacauagccugaggguaauuuuau

SEQ ID NO: 327189 - RNA, 64 nt, Homo Sapiens
augaauguguuuguuguuucguagguagauguuuugccacaaaugacuauuugccaugucauga

SEQ ID NO: 327190 - RNA, 64 nt, Homo Sapiens
acaauacucuggugacacaugacauugcuuccucugccacaaagauguuaacaauuuaguguuu

SEQ ID NO: 327191 - RNA, 64 nt, Homo Sapiens
aaccuguacccagcugugucccuuucaccuccagugccacaauaggugcuggccacaccagccc

SEQ ID NO: 327192 - RNA, 64 nt, Homo Sapiens
ucauccgguggguggccuguccgugugucaccagugccacaaggcagcaacaacggcaagacuc

SEQ ID NO: 327193 - RNA, 64 nt, Homo Sapiens
uacagggucacucaguaugcgugagcccaggcccugccacaaccaacugcgggguccucauggg

SEQ ID NO: 327194 - RNA, 64 nt, Homo Sapiens
ugaagaaggccuucaccuugaggauguuaguuucugccacaaugcuagugcccaucuuccugaa

SEQ ID NO: 327195 - RNA, 64 nt, Homo Sapiens
cauuagcuuuugugaucugguuaagaaguauuagugccacaagccugaaaagacaguucuccug

SEQ ID NO: 327196 - RNA, 64 nt, Homo Sapiens
auggccuaaaugguguucccuuugaaauaacgcuugccacaaguauauaauaagcuauauuaau

SEQ ID NO: 327197 - RNA, 64 nt, Homo Sapiens
uaauagauauuuauuaaacuguccagugaaaaggugccacaaugcccaguauuguaaacaacag

SEQ ID NO: 327198 - RNA, 64 nt, Homo Sapiens
cugcacauaacucuuuuuucacaagaagggucacugccacaacagcacagucagcgggugaauu

SEQ ID NO: 327199 - RNA, 64 nt, Homo Sapiens; identical to SEQ ID NO: 80199

SEQ ID NO: 327200 - RNA, 64 nt, Homo Sapiens; identical to SEQ ID NO: 80200

SEQ ID NO: 327201 - RNA, 64 nt, Homo Sapiens; identical to SEQ ID NO: 80201

SEQ ID NO: 327202 - RNA, 64 nt, Homo Sapiens; identical to SEQ ID NO: 80202

SEQ ID NO: 327203 - RNA, 64 nt, Homo Sapiens; identical to SEQ ID NO: 80203

SEQ ID NO: 327204 - RNA, 64 nt, Homo Sapiens; identical to SEQ ID NO: 80204

SEQ ID NO: 327205 - RNA, 64 nt, Homo Sapiens; identical to SEQ ID NO: 80205

SEQ ID NO: 327206 - RNA, 64 nt, Homo Sapiens; identical to SEQ ID NO: 80206

SEQ ID NO: 327207 - RNA, 64 nt, Homo Sapiens; identical to SEQ ID NO: 80207

SEQ ID NO: 327208 - RNA, 64 nt, Homo Sapiens; identical to SEQ ID NO: 80208

SEQ ID NO: 327209 - RNA, 64 nt, Homo Sapiens; identical to SEQ ID NO: 80209

SEQ ID NO: 327210 - RNA, 64 nt, Homo Sapiens; identical to SEQ ID NO: 80210

SEQ ID NO: 327211 - RNA, 64 nt, Homo Sapiens; identical to SEQ ID NO: 80211

SEQ ID NO: 327212 - RNA, 64 nt, Homo Sapiens; identical to SEQ ID NO: 80212

SEQ ID NO: 327213 - RNA, 64 nt, Homo Sapiens; identical to SEQ ID NO: 80213

SEQ ID NO: 327214 - RNA, 64 nt, Homo Sapiens; identical to SEQ ID NO: 80214

SEQ ID NO: 327215 - RNA, 64 nt, Homo Sapiens; identical to SEQ ID NO: 80215

SEQ ID NO: 327216 - RNA, 64 nt, Homo Sapiens; identical to SEQ ID NO: 80216

SEQ ID NO: 327217 - RNA, 64 nt, Homo Sapiens; identical to SEQ ID NO: 80217

SEQ ID NO: 327218 - RNA, 64 nt, Homo Sapiens; identical to SEQ ID NO: 80218

SEQ ID NO: 327219 - RNA, 64 nt, Homo Sapiens; identical to SEQ ID NO: 80219

SEQ ID NO: 327220 - RNA, 64 nt, Homo Sapiens; identical to SEQ ID NO: 80220

SEQ ID NO: 327221 - RNA, 64 nt, Homo Sapiens; identical to SEQ ID NO: 80221

SEQ ID NO: 327222 - RNA, 64 nt, Homo Sapiens; identical to SEQ ID NO: 80222

SEQ ID NO: 327223 - RNA, 64 nt, Homo Sapiens; identical to SEQ ID NO: 80223

SEQ ID NO: 327224 - RNA, 64 nt, Homo Sapiens; identical to SEQ ID NO: 80224

SEQ ID NO: 327225 - RNA, 64 nt, Homo Sapiens; identical to SEQ ID NO: 80225

SEQ ID NO: 327226 - RNA, 64 nt, Homo Sapiens; identical to SEQ ID NO: 80226

SEQ ID NO: 327227 - RNA, 64 nt, Homo Sapiens; identical to SEQ ID NO: 80227

SEQ ID NO: 327228 - RNA, 64 nt, Homo Sapiens; identical to SEQ ID NO: 80228

SEQ ID NO: 327229 - RNA, 64 nt, Homo Sapiens; identical to SEQ ID NO: 80229

SEQ ID NO: 327230 - RNA, 64 nt, Homo Sapiens; identical to SEQ ID NO: 80230

SEQ ID NO: 327231 - RNA, 64 nt, Homo Sapiens; identical to SEQ ID NO: 80231

SEQ ID NO: 327232 - RNA, 52 nt, Homo Sapiens; identical to SEQ ID NO: 80232

SEQ ID NO: 327233 - RNA, 64 nt, Homo Sapiens; identical to SEQ ID NO: 80233

SEQ ID NO: 327234 - RNA, 64 nt, Homo Sapiens; identical to SEQ ID NO: 80234

SEQ ID NO: 327235 - RNA, 64 nt, Homo Sapiens; identical to SEQ ID NO: 80235

SEQ ID NO: 327236 - RNA, 64 nt, Homo Sapiens; identical to SEQ ID NO: 80236

SEQ ID NO: 327237 - RNA, 64 nt, Homo Sapiens; identical to SEQ ID NO: 80237

SEQ ID NO: 327238 - RNA, 64 nt, Homo Sapiens; identical to SEQ ID NO: 80238

SEQ ID NO: 327239 - RNA, 64 nt, Homo Sapiens; identical to SEQ ID NO: 80239

SEQ ID NO: 327240 - RNA, 64 nt, Homo Sapiens; identical to SEQ ID NO: 80240

SEQ ID NO: 327241 - RNA, 64 nt, Homo Sapiens; identical to SEQ ID NO: 80241

SEQ ID NO: 327242 - RNA, 64 nt, Homo Sapiens; identical to SEQ ID NO: 80242

SEQ ID NO: 327243 - RNA, 64 nt, Homo Sapiens; identical to SEQ ID NO: 80243

SEQ ID NO: 327244 - RNA, 64 nt, Homo Sapiens; identical to SEQ ID NO: 80244

SEQ ID NO: 327245 - RNA, 64 nt, Homo Sapiens; identical to SEQ ID NO: 80245

SEQ ID NO: 327246 - RNA, 64 nt, Homo Sapiens; identical to SEQ ID NO: 80246

SEQ ID NO: 327247 - RNA, 64 nt, Homo Sapiens; identical to SEQ ID NO: 80247

SEQ ID NO: 327248 - RNA, 64 nt, Homo Sapiens; identical to SEQ ID NO: 80248

SEQ ID NO: 327249 - RNA, 64 nt, Homo Sapiens; identical to SEQ ID NO: 80249

SEQ ID NO: 327250 - RNA, 64 nt, Homo Sapiens; identical to SEQ ID NO: 80250

SEQ ID NO: 327251 - RNA, 64 nt, Homo Sapiens; identical to SEQ ID NO: 80251

SEQ ID NO: 327252 - RNA, 64 nt, Homo Sapiens; identical to SEQ ID NO: 80252

SEQ ID NO: 327253 - RNA, 64 nt, Homo Sapiens; identical to SEQ ID NO: 80253

SEQ ID NO: 327254 - RNA, 64 nt, Homo Sapiens; identical to SEQ ID NO: 80254

SEQ ID NO: 327255 - RNA, 64 nt, Homo Sapiens; identical to SEQ ID NO: 80255

SEQ ID NO: 327256 - RNA, 64 nt, Homo Sapiens; identical to SEQ ID NO: 80256

SEQ ID NO: 327257 - RNA, 64 nt, Homo Sapiens; identical to SEQ ID NO: 80257

SEQ ID NO: 327258 - RNA, 64 nt, Homo Sapiens; identical to SEQ ID NO: 80258

SEQ ID NO: 327259 - RNA, 64 nt, Homo Sapiens; identical to SEQ ID NO: 80259

SEQ ID NO: 327260 - RNA, 64 nt, Homo Sapiens; identical to SEQ ID NO: 80260

SEQ ID NO: 327261 - RNA, 64 nt, Homo Sapiens; identical to SEQ ID NO: 80261

SEQ ID NO: 327262 - RNA, 64 nt, Homo Sapiens; identical to SEQ ID NO: 80262

SEQ ID NO: 327263 - RNA, 64 nt, Homo Sapiens; identical to SEQ ID NO: 80263

SEQ ID NO: 327264 - RNA, 64 nt, Homo Sapiens; identical to SEQ ID NO: 80264

SEQ ID NO: 327265 - RNA, 64 nt, Homo Sapiens; identical to SEQ ID NO: 80265

SEQ ID NO: 327266 - RNA, 64 nt, Homo Sapiens; identical to SEQ ID NO: 80266

SEQ ID NO: 327267 - RNA, 64 nt, Homo Sapiens; identical to SEQ ID NO: 80267

SEQ ID NO: 327268 - RNA, 64 nt, Homo Sapiens; identical to SEQ ID NO: 80268

SEQ ID NO: 327269 - RNA, 64 nt, Homo Sapiens; identical to SEQ ID NO: 80269

SEQ ID NO: 327270 - RNA, 64 nt, Homo Sapiens; identical to SEQ ID NO: 80270

SEQ ID NO: 327271 - RNA, 64 nt, Homo Sapiens; identical to SEQ ID NO: 80271

SEQ ID NO: 327272 - RNA, 64 nt, Homo Sapiens; identical to SEQ ID NO: 80272

SEQ ID NO: 327273 - RNA, 64 nt, Homo Sapiens; identical to SEQ ID NO: 80273

SEQ ID NO: 327274 - RNA, 64 nt, Homo Sapiens; identical to SEQ ID NO: 80274

SEQ ID NO: 327275 - RNA, 64 nt, Homo Sapiens; identical to SEQ ID NO: 80275

SEQ ID NO: 327276 - RNA, 64 nt, Homo Sapiens; identical to SEQ ID NO: 80276

SEQ ID NO: 327277 - RNA, 64 nt, Homo Sapiens; identical to SEQ ID NO: 80277

SEQ ID NO: 327278 - RNA, 64 nt, Homo Sapiens; identical to SEQ ID NO: 80278

SEQ ID NO: 327279 - RNA, 64 nt, Homo Sapiens; identical to SEQ ID NO: 80279

SEQ ID NO: 327280 - RNA, 64 nt, Homo Sapiens; identical to SEQ ID NO: 80280

SEQ ID NO: 327281 - RNA, 64 nt, Homo Sapiens; identical to SEQ ID NO: 80281

SEQ ID NO: 327282 - RNA, 64 nt, Homo Sapiens; identical to SEQ ID NO: 80282

SEQ ID NO: 327283 - RNA, 64 nt, Homo Sapiens; identical to SEQ ID NO: 80283

SEQ ID NO: 327284 - RNA, 64 nt, Homo Sapiens; identical to SEQ ID NO: 80284

SEQ ID NO: 327285 - RNA, 64 nt, Homo Sapiens; identical to SEQ ID NO: 80285

SEQ ID NO: 327286 - RNA, 64 nt, Homo Sapiens; identical to SEQ ID NO: 80286

SEQ ID NO: 327287 - RNA, 64 nt, Homo Sapiens; identical to SEQ ID NO: 80287

SEQ ID NO: 327288 - RNA, 64 nt, Homo Sapiens; identical to SEQ ID NO: 80288

SEQ ID NO: 327289 - RNA, 64 nt, Homo Sapiens; identical to SEQ ID NO: 80289

SEQ ID NO: 327290 - RNA, 64 nt, Homo Sapiens; identical to SEQ ID NO: 80290

SEQ ID NO: 327291 - RNA, 64 nt, Homo Sapiens; identical to SEQ ID NO: 80291

SEQ ID NO: 327292 - RNA, 64 nt, Homo Sapiens; identical to SEQ ID NO: 80292

SEQ ID NO: 327293 - RNA, 64 nt, Homo Sapiens; identical to SEQ ID NO: 80293

SEQ ID NO: 327294 - RNA, 64 nt, Homo Sapiens; identical to SEQ ID NO: 80294

SEQ ID NO: 327295 - RNA, 64 nt, Homo Sapiens; identical to SEQ ID NO: 80295

SEQ ID NO: 327296 - RNA, 64 nt, Homo Sapiens; identical to SEQ ID NO: 80296

SEQ ID NO: 327297 - RNA, 64 nt, Homo Sapiens; identical to SEQ ID NO: 80297

SEQ ID NO: 327298 - RNA, 64 nt, Homo Sapiens; identical to SEQ ID NO: 80298

SEQ ID NO: 327299 - RNA, 64 nt, Homo Sapiens; identical to SEQ ID NO: 80299

SEQ ID NO: 327300 - RNA, 64 nt, Homo Sapiens; identical to SEQ ID NO: 80300

SEQ ID NO: 327301 - RNA, 64 nt, Homo Sapiens; identical to SEQ ID NO: 80301

SEQ ID NO: 327302 - RNA, 64 nt, Homo Sapiens; identical to SEQ ID NO: 80302

SEQ ID NO: 327303 - RNA, 64 nt, Homo Sapiens; identical to SEQ ID NO: 80303

SEQ ID NO: 327304 - RNA, 64 nt, Homo Sapiens; identical to SEQ ID NO: 80304

SEQ ID NO: 327305 - RNA, 64 nt, Homo Sapiens; identical to SEQ ID NO: 80305

SEQ ID NO: 327306 - RNA, 64 nt, Homo Sapiens; identical to SEQ ID NO: 80306

SEQ ID NO: 327307 - RNA, 64 nt, Homo Sapiens; identical to SEQ ID NO: 80307

SEQ ID NO: 327308 - RNA, 64 nt, Homo Sapiens; identical to SEQ ID NO: 80308

SEQ ID NO: 327309 - RNA, 64 nt, Homo Sapiens; identical to SEQ ID NO: 80309

SEQ ID NO: 327310 - RNA, 64 nt, Homo Sapiens; identical to SEQ ID NO: 80310

SEQ ID NO: 327311 - RNA, 64 nt, Homo Sapiens; identical to SEQ ID NO: 80311

SEQ ID NO: 327312 - RNA, 64 nt, Homo Sapiens; identical to SEQ ID NO: 80312

SEQ ID NO: 327313 - RNA, 64 nt, Homo Sapiens; identical to SEQ ID NO: 80313

SEQ ID NO: 327314 - RNA, 64 nt, Homo Sapiens; identical to SEQ ID NO: 80314

SEQ ID NO: 327315 - RNA, 64 nt, Homo Sapiens; identical to SEQ ID NO: 80315

SEQ ID NO: 327316 - RNA, 64 nt, Homo Sapiens; identical to SEQ ID NO: 80316

SEQ ID NO: 327317 - RNA, 64 nt, Homo Sapiens; identical to SEQ ID NO: 80317

SEQ ID NO: 327318 - RNA, 64 nt, Homo Sapiens; identical to SEQ ID NO: 80318

SEQ ID NO: 327319 - RNA, 64 nt, Homo Sapiens; identical to SEQ ID NO: 80319

SEQ ID NO: 327320 - RNA, 64 nt, Homo Sapiens; identical to SEQ ID NO: 80320

SEQ ID NO: 327321 - RNA, 64 nt, Homo Sapiens; identical to SEQ ID NO: 80321

SEQ ID NO: 327322 - RNA, 64 nt, Homo Sapiens; identical to SEQ ID NO: 80322

SEQ ID NO: 327323 - RNA, 64 nt, Homo Sapiens; identical to SEQ ID NO: 80323

SEQ ID NO: 327324 - RNA, 64 nt, Homo Sapiens; identical to SEQ ID NO: 80324

SEQ ID NO: 327325 - RNA, 51 nt, Homo Sapiens; identical to SEQ ID NO: 80325

SEQ ID NO: 327326 - RNA, 64 nt, Homo Sapiens; identical to SEQ ID NO: 80326

SEQ ID NO: 327327 - RNA, 64 nt, Homo Sapiens; identical to SEQ ID NO: 80327

SEQ ID NO: 327328 - RNA, 64 nt, Homo Sapiens; identical to SEQ ID NO: 80328

SEQ ID NO: 327329 - RNA, 64 nt, Homo Sapiens; identical to SEQ ID NO: 80329

SEQ ID NO: 327330 - RNA, 64 nt, Homo Sapiens; identical to SEQ ID NO: 80330

SEQ ID NO: 327331 - RNA, 62 nt, Homo Sapiens; identical to SEQ ID NO: 80331

SEQ ID NO: 327332 - RNA, 64 nt, Homo Sapiens; identical to SEQ ID NO: 80332

SEQ ID NO: 327333 - RNA, 64 nt, Homo Sapiens; identical to SEQ ID NO: 80333

SEQ ID NO: 327334 - RNA, 64 nt, Homo Sapiens; identical to SEQ ID NO: 80334

SEQ ID NO: 327335 - RNA, 54 nt, Homo Sapiens; identical to SEQ ID NO: 80335

SEQ ID NO: 327336 - RNA, 64 nt, Homo Sapiens; identical to SEQ ID NO: 80336

SEQ ID NO: 327337 - RNA, 64 nt, Homo Sapiens; identical to SEQ ID NO: 80337

SEQ ID NO: 327338 - RNA, 64 nt, Homo Sapiens; identical to SEQ ID NO: 80338

SEQ ID NO: 327339 - RNA, 64 nt, Homo Sapiens; identical to SEQ ID NO: 80339

SEQ ID NO: 327340 - RNA, 64 nt, Homo Sapiens; identical to SEQ ID NO: 80340

SEQ ID NO: 327341 - RNA, 64 nt, Homo Sapiens; identical to SEQ ID NO: 80341

SEQ ID NO: 327342 - RNA, 64 nt, Homo Sapiens; identical to SEQ ID NO: 80342

SEQ ID NO: 327343 - RNA, 64 nt, Homo Sapiens; identical to SEQ ID NO: 80343

SEQ ID NO: 327344 - RNA, 64 nt, Homo Sapiens; identical to SEQ ID NO: 80344

SEQ ID NO: 327345 - RNA, 64 nt, Homo Sapiens; identical to SEQ ID NO: 80345

SEQ ID NO: 327346 - RNA, 64 nt, Homo Sapiens; identical to SEQ ID NO: 80346

SEQ ID NO: 327347 - RNA, 64 nt, Homo Sapiens; identical to SEQ ID NO: 80347

SEQ ID NO: 327348 - RNA, 64 nt, Homo Sapiens; identical to SEQ ID NO: 80348

SEQ ID NO: 327349 - RNA, 64 nt, Homo Sapiens; identical to SEQ ID NO: 80349

SEQ ID NO: 327350 - RNA, 64 nt, Homo Sapiens; identical to SEQ ID NO: 80350

SEQ ID NO: 327351 - RNA, 64 nt, Homo Sapiens; identical to SEQ ID NO: 80351

SEQ ID NO: 327352 - RNA, 59 nt, Homo Sapiens; identical to SEQ ID NO: 80352

SEQ ID NO: 327353 - RNA, 64 nt, Homo Sapiens; identical to SEQ ID NO: 80353

SEQ ID NO: 327354 - RNA, 64 nt, Homo Sapiens; identical to SEQ ID NO: 80354

SEQ ID NO: 327355 - RNA, 64 nt, Homo Sapiens; identical to SEQ ID NO: 80355

SEQ ID NO: 327356 - RNA, 64 nt, Homo Sapiens; identical to SEQ ID NO: 80356

SEQ ID NO: 327357 - RNA, 64 nt, Homo Sapiens; identical to SEQ ID NO: 80357

SEQ ID NO: 327358 - RNA, 64 nt, Homo Sapiens; identical to SEQ ID NO: 80358

SEQ ID NO: 327359 - RNA, 64 nt, Homo Sapiens; identical to SEQ ID NO: 80359

SEQ ID NO: 327360 - RNA, 64 nt, Homo Sapiens; identical to SEQ ID NO: 80360

SEQ ID NO: 327361 - RNA, 64 nt, Homo Sapiens; identical to SEQ ID NO: 80361

SEQ ID NO: 327362 - RNA, 64 nt, Homo Sapiens; identical to SEQ ID NO: 80362

SEQ ID NO: 327363 - RNA, 64 nt, Homo Sapiens; identical to SEQ ID NO: 80363

SEQ ID NO: 327364 - RNA, 64 nt, Homo Sapiens; identical to SEQ ID NO: 80364

SEQ ID NO: 327365 - RNA, 64 nt, Homo Sapiens; identical to SEQ ID NO: 80365

SEQ ID NO: 327366 - RNA, 64 nt, Homo Sapiens; identical to SEQ ID NO: 80366

SEQ ID NO: 327367 - RNA, 64 nt, Homo Sapiens; identical to SEQ ID NO: 80367

SEQ ID NO: 327368 - RNA, 64 nt, Homo Sapiens; identical to SEQ ID NO: 80368

SEQ ID NO: 327369 - RNA, 64 nt, Homo Sapiens; identical to SEQ ID NO: 80369

SEQ ID NO: 327370 - RNA, 64 nt, Homo Sapiens; identical to SEQ ID NO: 80370

SEQ ID NO: 327371 - RNA, 64 nt, Homo Sapiens; identical to SEQ ID NO: 80371

SEQ ID NO: 327372 - RNA, 64 nt, Homo Sapiens; identical to SEQ ID NO: 80372

SEQ ID NO: 327373 - RNA, 64 nt, Homo Sapiens; identical to SEQ ID NO: 80373

SEQ ID NO: 327374 - RNA, 64 nt, Homo Sapiens; identical to SEQ ID NO: 80374

SEQ ID NO: 327375 - RNA, 64 nt, Homo Sapiens; identical to SEQ ID NO: 80375

SEQ ID NO: 327376 - RNA, 64 nt, Homo Sapiens; identical to SEQ ID NO: 80376

SEQ ID NO: 327377 - RNA, 64 nt, Homo Sapiens; identical to SEQ ID NO: 80377

SEQ ID NO: 327378 - RNA, 64 nt, Homo Sapiens; identical to SEQ ID NO: 80378

SEQ ID NO: 327379 - RNA, 64 nt, Homo Sapiens; identical to SEQ ID NO: 80379

SEQ ID NO: 327380 - RNA, 64 nt, Homo Sapiens; identical to SEQ ID NO: 80380

SEQ ID NO: 327381 - RNA, 64 nt, Homo Sapiens; identical to SEQ ID NO: 80381

SEQ ID NO: 327382 - RNA, 64 nt, Homo Sapiens; identical to SEQ ID NO: 80382

SEQ ID NO: 327383 - RNA, 64 nt, Homo Sapiens; identical to SEQ ID NO: 80383

SEQ ID NO: 327384 - RNA, 64 nt, Homo Sapiens; identical to SEQ ID NO: 80384

SEQ ID NO: 327385 - RNA, 64 nt, Homo Sapiens; identical to SEQ ID NO: 80385

SEQ ID NO: 327386 - RNA, 64 nt, Homo Sapiens; identical to SEQ ID NO: 80386

SEQ ID NO: 327387 - RNA, 64 nt, Homo Sapiens; identical to SEQ ID NO: 80387

SEQ ID NO: 327388 - RNA, 64 nt, Homo Sapiens; identical to SEQ ID NO: 80388

SEQ ID NO: 327389 - RNA, 64 nt, Homo Sapiens; identical to SEQ ID NO: 80389

SEQ ID NO: 327390 - RNA, 64 nt, Homo Sapiens; identical to SEQ ID NO: 80390

SEQ ID NO: 327391 - RNA, 64 nt, Homo Sapiens; identical to SEQ ID NO: 80391

SEQ ID NO: 327392 - RNA, 53 nt, Homo Sapiens; identical to SEQ ID NO: 80392

SEQ ID NO: 327393 - RNA, 64 nt, Homo Sapiens; identical to SEQ ID NO: 80393

SEQ ID NO: 327394 - RNA, 64 nt, Homo Sapiens; identical to SEQ ID NO: 80394

SEQ ID NO: 327395 - RNA, 64 nt, Homo Sapiens; identical to SEQ ID NO: 80395

SEQ ID NO: 327396 - RNA, 64 nt, Homo Sapiens; identical to SEQ ID NO: 80396

SEQ ID NO: 327397 - RNA, 64 nt, Homo Sapiens; identical to SEQ ID NO: 80397

SEQ ID NO: 327398 - RNA, 64 nt, Homo Sapiens; identical to SEQ ID NO: 80398

SEQ ID NO: 327399 - RNA, 64 nt, Homo Sapiens; identical to SEQ ID NO: 80399

SEQ ID NO: 327400 - RNA, 64 nt, Homo Sapiens; identical to SEQ ID NO: 80400

SEQ ID NO: 327401 - RNA, 64 nt, Homo Sapiens; identical to SEQ ID NO: 80401

SEQ ID NO: 327402 - RNA, 64 nt, Homo Sapiens; identical to SEQ ID NO: 80402

SEQ ID NO: 327403 - RNA, 64 nt, Homo Sapiens; identical to SEQ ID NO: 80403

SEQ ID NO: 327404 - RNA, 64 nt, Homo Sapiens; identical to SEQ ID NO: 80404

SEQ ID NO: 327405 - RNA, 64 nt, Homo Sapiens; identical to SEQ ID NO: 80405

SEQ ID NO: 327406 - RNA, 64 nt, Homo Sapiens; identical to SEQ ID NO: 80406

SEQ ID NO: 327407 - RNA, 64 nt, Homo Sapiens; identical to SEQ ID NO: 80407

SEQ ID NO: 327408 - RNA, 64 nt, Homo Sapiens; identical to SEQ ID NO: 80408

SEQ ID NO: 327409 - RNA, 64 nt, Homo Sapiens; identical to SEQ ID NO: 80409

SEQ ID NO: 327410 - RNA, 64 nt, Homo Sapiens; identical to SEQ ID NO: 80410

SEQ ID NO: 327411 - RNA, 64 nt, Homo Sapiens; identical to SEQ ID NO: 80411

SEQ ID NO: 327412 - RNA, 64 nt, Homo Sapiens; identical to SEQ ID NO: 80412

SEQ ID NO: 327413 - RNA, 64 nt, Homo Sapiens; identical to SEQ ID NO: 80413

SEQ ID NO: 327414 - RNA, 64 nt, Homo Sapiens; identical to SEQ ID NO: 80414

SEQ ID NO: 327415 - RNA, 64 nt, Homo Sapiens; identical to SEQ ID NO: 80415

SEQ ID NO: 327416 - RNA, 64 nt, Homo Sapiens; identical to SEQ ID NO: 80416

SEQ ID NO: 327417 - RNA, 64 nt, Homo Sapiens; identical to SEQ ID NO: 80417

SEQ ID NO: 327418 - RNA, 64 nt, Homo Sapiens; identical to SEQ ID NO: 80418

SEQ ID NO: 327419 - RNA, 64 nt, Homo Sapiens
ucugauuugaaaucgggagaaacagagcugcugccaaugggaucuuuuagguaacucccucccu

SEQ ID NO: 327420 - RNA, 64 nt, Homo Sapiens
uccgugugucugugcagugcccaugagcugcugccaaugggaucuuucagguacccccucccca

SEQ ID NO: 327421 - RNA, 64 nt, Homo Sapiens
aauuuauuuggggggaaauaccuugagcagaauacaaugggaaaagagucucuaccccuuucug

SEQ ID NO: 327422 - RNA, 64 nt, Homo Sapiens
auucucuccuaaugaugacuugagcccugccacucaaugggagaaucagcagaaccuguaggau

SEQ ID NO: 327423 - RNA, 64 nt, Homo Sapiens
agagggcccucucaacgcucccuguugccuucaccaaugggagagggaguggaucgguggugaa

SEQ ID NO: 327424 - RNA, 64 nt, Homo Sapiens
gccuggaaagccuggaguccaagcuguaucagugcaaugggaucauuuugaagaaggcauccag

SEQ ID NO: 327425 - RNA, 64 nt, Homo Sapiens; identical to SEQ ID NO: 52004

SEQ ID NO: 327426 - RNA, 64 nt, Homo Sapiens; identical to SEQ ID NO: 52005

SEQ ID NO: 327427 - RNA, 64 nt, Homo Sapiens; identical to SEQ ID NO: 52006

SEQ ID NO: 327428 - RNA, 64 nt, Homo Sapiens; identical to SEQ ID NO: 52007

SEQ ID NO: 327429 - RNA, 64 nt, Homo Sapiens; identical to SEQ ID NO: 52008

SEQ ID NO: 327430 - RNA, 64 nt, Homo Sapiens; identical to SEQ ID NO: 52009

SEQ ID NO: 327431 - RNA, 64 nt, Homo Sapiens; identical to SEQ ID NO: 52010

SEQ ID NO: 327432 - RNA, 64 nt, Homo Sapiens; identical to SEQ ID NO: 52011

SEQ ID NO: 327433 - RNA, 64 nt, Homo Sapiens; identical to SEQ ID NO: 52012

SEQ ID NO: 327434 - RNA, 64 nt, Homo Sapiens; identical to SEQ ID NO: 52013

SEQ ID NO: 327435 - RNA, 64 nt, Homo Sapiens; identical to SEQ ID NO: 52014

SEQ ID NO: 327436 - RNA, 64 nt, Homo Sapiens; identical to SEQ ID NO: 52015

SEQ ID NO: 327437 - RNA, 64 nt, Homo Sapiens; identical to SEQ ID NO: 52016

SEQ ID NO: 327438 - RNA, 64 nt, Homo Sapiens; identical to SEQ ID NO: 52017

SEQ ID NO: 327439 - RNA, 64 nt, Homo Sapiens; identical to SEQ ID NO: 52018

SEQ ID NO: 327440 - RNA, 64 nt, Homo Sapiens; identical to SEQ ID NO: 52019

SEQ ID NO: 327441 - RNA, 64 nt, Homo Sapiens; identical to SEQ ID NO: 52020

SEQ ID NO: 327442 - RNA, 64 nt, Homo Sapiens; identical to SEQ ID NO: 52021

SEQ ID NO: 327443 - RNA, 64 nt, Homo Sapiens; identical to SEQ ID NO: 52022

SEQ ID NO: 327444 - RNA, 64 nt, Homo Sapiens; identical to SEQ ID NO: 52023

SEQ ID NO: 327445 - RNA, 64 nt, Homo Sapiens; identical to SEQ ID NO: 52024

SEQ ID NO: 327446 - RNA, 64 nt, Homo Sapiens; identical to SEQ ID NO: 52025

SEQ ID NO: 327447 - RNA, 64 nt, Homo Sapiens; identical to SEQ ID NO: 52026

SEQ ID NO: 327448 - RNA, 64 nt, Homo Sapiens; identical to SEQ ID NO: 52027

SEQ ID NO: 327449 - RNA, 64 nt, Homo Sapiens; identical to SEQ ID NO: 52028

SEQ ID NO: 327450 - RNA, 64 nt, Homo Sapiens; identical to SEQ ID NO: 52029

SEQ ID NO: 327451 - RNA, 64 nt, Homo Sapiens; identical to SEQ ID NO: 52030

SEQ ID NO: 327452 - RNA, 64 nt, Homo Sapiens; identical to SEQ ID NO: 52031

SEQ ID NO: 327453 - RNA, 64 nt, Homo Sapiens; identical to SEQ ID NO: 52032

SEQ ID NO: 327454 - RNA, 64 nt, Homo Sapiens; identical to SEQ ID NO: 52033

SEQ ID NO: 327455 - RNA, 64 nt, Homo Sapiens; identical to SEQ ID NO: 52034

SEQ ID NO: 327456 - RNA, 64 nt, Homo Sapiens; identical to SEQ ID NO: 52035

SEQ ID NO: 327457 - RNA, 64 nt, Homo Sapiens; identical to SEQ ID NO: 52036

SEQ ID NO: 327458 - RNA, 64 nt, Homo Sapiens; identical to SEQ ID NO: 52037

SEQ ID NO: 327459 - RNA, 64 nt, Homo Sapiens; identical to SEQ ID NO: 52038

SEQ ID NO: 327460 - RNA, 64 nt, Homo Sapiens; identical to SEQ ID NO: 52039

SEQ ID NO: 327461 - RNA, 64 nt, Homo Sapiens; identical to SEQ ID NO: 52040

SEQ ID NO: 327462 - RNA, 64 nt, Homo Sapiens; identical to SEQ ID NO: 52041

SEQ ID NO: 327463 - RNA, 64 nt, Homo Sapiens; identical to SEQ ID NO: 52042

SEQ ID NO: 327464 - RNA, 64 nt, Homo Sapiens; identical to SEQ ID NO: 52043

SEQ ID NO: 327465 - RNA, 64 nt, Homo Sapiens; identical to SEQ ID NO: 52044

SEQ ID NO: 327466 - RNA, 64 nt, Homo Sapiens; identical to SEQ ID NO: 52045

SEQ ID NO: 327467 - RNA, 64 nt, Homo Sapiens; identical to SEQ ID NO: 52046

SEQ ID NO: 327468 - RNA, 64 nt, Homo Sapiens; identical to SEQ ID NO: 52047

SEQ ID NO: 327469 - RNA, 64 nt, Homo Sapiens; identical to SEQ ID NO: 52048

SEQ ID NO: 327470 - RNA, 64 nt, Homo Sapiens; identical to SEQ ID NO: 52049

SEQ ID NO: 327471 - RNA, 64 nt, Homo Sapiens; identical to SEQ ID NO: 52050

SEQ ID NO: 327472 - RNA, 64 nt, Homo Sapiens; identical to SEQ ID NO: 52051

SEQ ID NO: 327473 - RNA, 64 nt, Homo Sapiens; identical to SEQ ID NO: 52052

SEQ ID NO: 327474 - RNA, 64 nt, Homo Sapiens; identical to SEQ ID NO: 52053

SEQ ID NO: 327475 - RNA, 64 nt, Homo Sapiens; identical to SEQ ID NO: 52054

SEQ ID NO: 327476 - RNA, 64 nt, Homo Sapiens; identical to SEQ ID NO: 52055

SEQ ID NO: 327477 - RNA, 64 nt, Homo Sapiens; identical to SEQ ID NO: 52056

SEQ ID NO: 327478 - RNA, 64 nt, Homo Sapiens; identical to SEQ ID NO: 52057

SEQ ID NO: 327479 - RNA, 64 nt, Homo Sapiens; identical to SEQ ID NO: 52058

SEQ ID NO: 327480 - RNA, 64 nt, Homo Sapiens; identical to SEQ ID NO: 52059

SEQ ID NO: 327481 - RNA, 64 nt, Homo Sapiens; identical to SEQ ID NO: 52060

SEQ ID NO: 327482 - RNA, 64 nt, Homo Sapiens; identical to SEQ ID NO: 52061

SEQ ID NO: 327483 - RNA, 64 nt, Homo Sapiens; identical to SEQ ID NO: 52062

SEQ ID NO: 327484 - RNA, 64 nt, Homo Sapiens; identical to SEQ ID NO: 52063

SEQ ID NO: 327485 - RNA, 64 nt, Homo Sapiens; identical to SEQ ID NO: 52064

SEQ ID NO: 327486 - RNA, 64 nt, Homo Sapiens; identical to SEQ ID NO: 52065

SEQ ID NO: 327487 - RNA, 64 nt, Homo Sapiens; identical to SEQ ID NO: 52066

SEQ ID NO: 327488 - RNA, 64 nt, Homo Sapiens; identical to SEQ ID NO: 52067

SEQ ID NO: 327489 - RNA, 64 nt, Homo Sapiens; identical to SEQ ID NO: 52068

SEQ ID NO: 327490 - RNA, 64 nt, Homo Sapiens; identical to SEQ ID NO: 52069

SEQ ID NO: 327491 - RNA, 64 nt, Homo Sapiens; identical to SEQ ID NO: 52070

SEQ ID NO: 327492 - RNA, 64 nt, Homo Sapiens; identical to SEQ ID NO: 52071

SEQ ID NO: 327493 - RNA, 64 nt, Homo Sapiens; identical to SEQ ID NO: 52072

SEQ ID NO: 327494 - RNA, 64 nt, Homo Sapiens; identical to SEQ ID NO: 52073

SEQ ID NO: 327495 - RNA, 64 nt, Homo Sapiens; identical to SEQ ID NO: 52074

SEQ ID NO: 327496 - RNA, 64 nt, Homo Sapiens; identical to SEQ ID NO: 52075

SEQ ID NO: 327497 - RNA, 64 nt, Homo Sapiens; identical to SEQ ID NO: 52076

SEQ ID NO: 327498 - RNA, 64 nt, Homo Sapiens; identical to SEQ ID NO: 52077

SEQ ID NO: 327499 - RNA, 64 nt, Homo Sapiens; identical to SEQ ID NO: 52078

SEQ ID NO: 327500 - RNA, 64 nt, Homo Sapiens; identical to SEQ ID NO: 52079

SEQ ID NO: 327501 - RNA, 64 nt, Homo Sapiens; identical to SEQ ID NO: 52080

SEQ ID NO: 327502 - RNA, 64 nt, Homo Sapiens; identical to SEQ ID NO: 52081

SEQ ID NO: 327503 - RNA, 64 nt, Homo Sapiens; identical to SEQ ID NO: 52082

SEQ ID NO: 327504 - RNA, 64 nt, Homo Sapiens; identical to SEQ ID NO: 52083

SEQ ID NO: 327505 - RNA, 64 nt, Homo Sapiens; identical to SEQ ID NO: 52084

SEQ ID NO: 327506 - RNA, 64 nt, Homo Sapiens; identical to SEQ ID NO: 52085

SEQ ID NO: 327507 - RNA, 64 nt, Homo Sapiens; identical to SEQ ID NO: 52086

SEQ ID NO: 327508 - RNA, 64 nt, Homo Sapiens; identical to SEQ ID NO: 52087

SEQ ID NO: 327509 - RNA, 64 nt, Homo Sapiens; identical to SEQ ID NO: 52088

SEQ ID NO: 327510 - RNA, 64 nt, Homo Sapiens; identical to SEQ ID NO: 52089

SEQ ID NO: 327511 - RNA, 64 nt, Homo Sapiens; identical to SEQ ID NO: 52090

SEQ ID NO: 327512 - RNA, 64 nt, Homo Sapiens; identical to SEQ ID NO: 52091

SEQ ID NO: 327513 - RNA, 64 nt, Homo Sapiens; identical to SEQ ID NO: 52092

SEQ ID NO: 327514 - RNA, 64 nt, Homo Sapiens; identical to SEQ ID NO: 52093

SEQ ID NO: 327515 - RNA, 64 nt, Homo Sapiens; identical to SEQ ID NO: 52094

SEQ ID NO: 327516 - RNA, 64 nt, Homo Sapiens; identical to SEQ ID NO: 52095

SEQ ID NO: 327517 - RNA, 64 nt, Homo Sapiens; identical to SEQ ID NO: 52096

SEQ ID NO: 327518 - RNA, 64 nt, Homo Sapiens; identical to SEQ ID NO: 52097

SEQ ID NO: 327519 - RNA, 64 nt, Homo Sapiens; identical to SEQ ID NO: 52098

SEQ ID NO: 327520 - RNA, 64 nt, Homo Sapiens; identical to SEQ ID NO: 52099

SEQ ID NO: 327521 - RNA, 64 nt, Homo Sapiens; identical to SEQ ID NO: 52100

SEQ ID NO: 327522 - RNA, 64 nt, Homo Sapiens; identical to SEQ ID NO: 52101

SEQ ID NO: 327523 - RNA, 64 nt, Homo Sapiens; identical to SEQ ID NO: 52102

SEQ ID NO: 327524 - RNA, 64 nt, Homo Sapiens; identical to SEQ ID NO: 52103

SEQ ID NO: 327525 - RNA, 64 nt, Homo Sapiens; identical to SEQ ID NO: 52104

SEQ ID NO: 327526 - RNA, 64 nt, Homo Sapiens; identical to SEQ ID NO: 52105

SEQ ID NO: 327527 - RNA, 64 nt, Homo Sapiens; identical to SEQ ID NO: 52106

SEQ ID NO: 327528 - RNA, 64 nt, Homo Sapiens; identical to SEQ ID NO: 52107

SEQ ID NO: 327529 - RNA, 64 nt, Homo Sapiens; identical to SEQ ID NO: 52108

SEQ ID NO: 327530 - RNA, 64 nt, Homo Sapiens; identical to SEQ ID NO: 52109

SEQ ID NO: 327531 - RNA, 64 nt, Homo Sapiens; identical to SEQ ID NO: 52110

SEQ ID NO: 327532 - RNA, 64 nt, Homo Sapiens; identical to SEQ ID NO: 52111

SEQ ID NO: 327533 - RNA, 64 nt, Homo Sapiens; identical to SEQ ID NO: 52112

SEQ ID NO: 327534 - RNA, 64 nt, Homo Sapiens; identical to SEQ ID NO: 52113

SEQ ID NO: 327535 - RNA, 64 nt, Homo Sapiens; identical to SEQ ID NO: 52114

SEQ ID NO: 327536 - RNA, 64 nt, Homo Sapiens; identical to SEQ ID NO: 52115

SEQ ID NO: 327537 - RNA, 64 nt, Homo Sapiens; identical to SEQ ID NO: 52116

SEQ ID NO: 327538 - RNA, 64 nt, Homo Sapiens; identical to SEQ ID NO: 52117

SEQ ID NO: 327539 - RNA, 64 nt, Homo Sapiens; identical to SEQ ID NO: 52118

SEQ ID NO: 327540 - RNA, 64 nt, Homo Sapiens; identical to SEQ ID NO: 52119

SEQ ID NO: 327541 - RNA, 64 nt, Homo Sapiens; identical to SEQ ID NO: 52120

SEQ ID NO: 327542 - RNA, 64 nt, Homo Sapiens; identical to SEQ ID NO: 52121

SEQ ID NO: 327543 - RNA, 64 nt, Homo Sapiens; identical to SEQ ID NO: 52122

SEQ ID NO: 327544 - RNA, 64 nt, Homo Sapiens; identical to SEQ ID NO: 52123

SEQ ID NO: 327545 - RNA, 64 nt, Homo Sapiens; identical to SEQ ID NO: 52124

SEQ ID NO: 327546 - RNA, 64 nt, Homo Sapiens; identical to SEQ ID NO: 52125

SEQ ID NO: 327547 - RNA, 64 nt, Homo Sapiens; identical to SEQ ID NO: 52126

SEQ ID NO: 327548 - RNA, 64 nt, Homo Sapiens; identical to SEQ ID NO: 52127

SEQ ID NO: 327549 - RNA, 64 nt, Homo Sapiens; identical to SEQ ID NO: 52128

SEQ ID NO: 327550 - RNA, 64 nt, Homo Sapiens; identical to SEQ ID NO: 52129

SEQ ID NO: 327551 - RNA, 64 nt, Homo Sapiens; identical to SEQ ID NO: 52130

SEQ ID NO: 327552 - RNA, 64 nt, Homo Sapiens; identical to SEQ ID NO: 52131

SEQ ID NO: 327553 - RNA, 64 nt, Homo Sapiens; identical to SEQ ID NO: 52132

SEQ ID NO: 327554 - RNA, 64 nt, Homo Sapiens; identical to SEQ ID NO: 52133

SEQ ID NO: 327555 - RNA, 64 nt, Homo Sapiens; identical to SEQ ID NO: 52134

SEQ ID NO: 327556 - RNA, 64 nt, Homo Sapiens; identical to SEQ ID NO: 52135

SEQ ID NO: 327557 - RNA, 64 nt, Homo Sapiens; identical to SEQ ID NO: 52136

SEQ ID NO: 327558 - RNA, 64 nt, Homo Sapiens; identical to SEQ ID NO: 52137

SEQ ID NO: 327559 - RNA, 64 nt, Homo Sapiens; identical to SEQ ID NO: 52138

SEQ ID NO: 327560 - RNA, 64 nt, Homo Sapiens; identical to SEQ ID NO: 52139

SEQ ID NO: 327561 - RNA, 64 nt, Homo Sapiens; identical to SEQ ID NO: 52140

SEQ ID NO: 327562 - RNA, 64 nt, Homo Sapiens; identical to SEQ ID NO: 52141

SEQ ID NO: 327563 - RNA, 64 nt, Homo Sapiens; identical to SEQ ID NO: 52142

SEQ ID NO: 327564 - RNA, 64 nt, Homo Sapiens; identical to SEQ ID NO: 52143

SEQ ID NO: 327565 - RNA, 64 nt, Homo Sapiens; identical to SEQ ID NO: 52144

SEQ ID NO: 327566 - RNA, 64 nt, Homo Sapiens; identical to SEQ ID NO: 52145

SEQ ID NO: 327567 - RNA, 64 nt, Homo Sapiens; identical to SEQ ID NO: 52146

SEQ ID NO: 327568 - RNA, 64 nt, Homo Sapiens; identical to SEQ ID NO: 52147

SEQ ID NO: 327569 - RNA, 64 nt, Homo Sapiens; identical to SEQ ID NO: 52148

SEQ ID NO: 327570 - RNA, 64 nt, Homo Sapiens; identical to SEQ ID NO: 52149

SEQ ID NO: 327571 - RNA, 64 nt, Homo Sapiens; identical to SEQ ID NO: 52150

SEQ ID NO: 327572 - RNA, 64 nt, Homo Sapiens; identical to SEQ ID NO: 52151

SEQ ID NO: 327573 - RNA, 64 nt, Homo Sapiens; identical to SEQ ID NO: 52152

SEQ ID NO: 327574 - RNA, 64 nt, Homo Sapiens; identical to SEQ ID NO: 52153

SEQ ID NO: 327575 - RNA, 63 nt, Homo Sapiens; identical to SEQ ID NO: 52154

SEQ ID NO: 327576 - RNA, 64 nt, Homo Sapiens; identical to SEQ ID NO: 52155

SEQ ID NO: 327577 - RNA, 64 nt, Homo Sapiens; identical to SEQ ID NO: 52156

SEQ ID NO: 327578 - RNA, 64 nt, Homo Sapiens; identical to SEQ ID NO: 52157

SEQ ID NO: 327579 - RNA, 64 nt, Homo Sapiens; identical to SEQ ID NO: 52158

SEQ ID NO: 327580 - RNA, 64 nt, Homo Sapiens; identical to SEQ ID NO: 52159

SEQ ID NO: 327581 - RNA, 64 nt, Homo Sapiens; identical to SEQ ID NO: 52160

SEQ ID NO: 327582 - RNA, 64 nt, Homo Sapiens; identical to SEQ ID NO: 52161

SEQ ID NO: 327583 - RNA, 64 nt, Homo Sapiens; identical to SEQ ID NO: 52162

SEQ ID NO: 327584 - RNA, 64 nt, Homo Sapiens; identical to SEQ ID NO: 52163

SEQ ID NO: 327585 - RNA, 64 nt, Homo Sapiens; identical to SEQ ID NO: 52164

SEQ ID NO: 327586 - RNA, 64 nt, Homo Sapiens; identical to SEQ ID NO: 52165

SEQ ID NO: 327587 - RNA, 64 nt, Homo Sapiens; identical to SEQ ID NO: 52166

SEQ ID NO: 327588 - RNA, 64 nt, Homo Sapiens; identical to SEQ ID NO: 52167

SEQ ID NO: 327589 - RNA, 64 nt, Homo Sapiens; identical to SEQ ID NO: 52168

SEQ ID NO: 327590 - RNA, 64 nt, Homo Sapiens; identical to SEQ ID NO: 52169

SEQ ID NO: 327591 - RNA, 64 nt, Homo Sapiens; identical to SEQ ID NO: 52170

SEQ ID NO: 327592 - RNA, 64 nt, Homo Sapiens; identical to SEQ ID NO: 52171

SEQ ID NO: 327593 - RNA, 64 nt, Homo Sapiens; identical to SEQ ID NO: 52172

SEQ ID NO: 327594 - RNA, 64 nt, Homo Sapiens; identical to SEQ ID NO: 52173

SEQ ID NO: 327595 - RNA, 64 nt, Homo Sapiens; identical to SEQ ID NO: 52174

SEQ ID NO: 327596 - RNA, 64 nt, Homo Sapiens; identical to SEQ ID NO: 52175

SEQ ID NO: 327597 - RNA, 64 nt, Homo Sapiens; identical to SEQ ID NO: 52176

SEQ ID NO: 327598 - RNA, 64 nt, Homo Sapiens; identical to SEQ ID NO: 52177

SEQ ID NO: 327599 - RNA, 64 nt, Homo Sapiens; identical to SEQ ID NO: 52178

SEQ ID NO: 327600 - RNA, 64 nt, Homo Sapiens; identical to SEQ ID NO: 52179

SEQ ID NO: 327601 - RNA, 64 nt, Homo Sapiens; identical to SEQ ID NO: 52180

SEQ ID NO: 327602 - RNA, 64 nt, Homo Sapiens; identical to SEQ ID NO: 52181

SEQ ID NO: 327603 - RNA, 64 nt, Homo Sapiens; identical to SEQ ID NO: 52182

SEQ ID NO: 327604 - RNA, 64 nt, Homo Sapiens; identical to SEQ ID NO: 52183

SEQ ID NO: 327605 - RNA, 57 nt, Homo Sapiens; identical to SEQ ID NO: 52184

SEQ ID NO: 327606 - RNA, 52 nt, Homo Sapiens; identical to SEQ ID NO: 52185

SEQ ID NO: 327607 - RNA, 64 nt, Homo Sapiens; identical to SEQ ID NO: 52186

SEQ ID NO: 327608 - RNA, 64 nt, Homo Sapiens; identical to SEQ ID NO: 52187

SEQ ID NO: 327609 - RNA, 64 nt, Homo Sapiens; identical to SEQ ID NO: 52188

SEQ ID NO: 327610 - RNA, 64 nt, Homo Sapiens; identical to SEQ ID NO: 52189

SEQ ID NO: 327611 - RNA, 64 nt, Homo Sapiens; identical to SEQ ID NO: 52190

SEQ ID NO: 327612 - RNA, 64 nt, Homo Sapiens; identical to SEQ ID NO: 52191

SEQ ID NO: 327613 - RNA, 64 nt, Homo Sapiens; identical to SEQ ID NO: 52192

SEQ ID NO: 327614 - RNA, 64 nt, Homo Sapiens; identical to SEQ ID NO: 52193

SEQ ID NO: 327615 - RNA, 64 nt, Homo Sapiens; identical to SEQ ID NO: 52194

SEQ ID NO: 327616 - RNA, 64 nt, Homo Sapiens; identical to SEQ ID NO: 52195

SEQ ID NO: 327617 - RNA, 64 nt, Homo Sapiens; identical to SEQ ID NO: 52196

SEQ ID NO: 327618 - RNA, 64 nt, Homo Sapiens; identical to SEQ ID NO: 52197

SEQ ID NO: 327619 - RNA, 64 nt, Homo Sapiens; identical to SEQ ID NO: 52198

SEQ ID NO: 327620 - RNA, 64 nt, Homo Sapiens; identical to SEQ ID NO: 52199

SEQ ID NO: 327621 - RNA, 64 nt, Homo Sapiens; identical to SEQ ID NO: 52200

SEQ ID NO: 327622 - RNA, 64 nt, Homo Sapiens; identical to SEQ ID NO: 52201

SEQ ID NO: 327623 - RNA, 64 nt, Homo Sapiens; identical to SEQ ID NO: 52202

SEQ ID NO: 327624 - RNA, 64 nt, Homo Sapiens; identical to SEQ ID NO: 52203

SEQ ID NO: 327625 - RNA, 64 nt, Homo Sapiens; identical to SEQ ID NO: 52204

SEQ ID NO: 327626 - RNA, 64 nt, Homo Sapiens; identical to SEQ ID NO: 52205

SEQ ID NO: 327627 - RNA, 64 nt, Homo Sapiens; identical to SEQ ID NO: 52206

SEQ ID NO: 327628 - RNA, 64 nt, Homo Sapiens; identical to SEQ ID NO: 52207

SEQ ID NO: 327629 - RNA, 64 nt, Homo Sapiens; identical to SEQ ID NO: 52208

SEQ ID NO: 327630 - RNA, 64 nt, Homo Sapiens; identical to SEQ ID NO: 52209

SEQ ID NO: 327631 - RNA, 64 nt, Homo Sapiens; identical to SEQ ID NO: 52210

SEQ ID NO: 327632 - RNA, 64 nt, Homo Sapiens; identical to SEQ ID NO: 52211

SEQ ID NO: 327633 - RNA, 64 nt, Homo Sapiens; identical to SEQ ID NO: 52212

SEQ ID NO: 327634 - RNA, 64 nt, Homo Sapiens; identical to SEQ ID NO: 52213

SEQ ID NO: 327635 - RNA, 64 nt, Homo Sapiens; identical to SEQ ID NO: 52214

SEQ ID NO: 327636 - RNA, 64 nt, Homo Sapiens; identical to SEQ ID NO: 52215

SEQ ID NO: 327637 - RNA, 64 nt, Homo Sapiens; identical to SEQ ID NO: 52216

SEQ ID NO: 327638 - RNA, 64 nt, Homo Sapiens; identical to SEQ ID NO: 52217

SEQ ID NO: 327639 - RNA, 64 nt, Homo Sapiens; identical to SEQ ID NO: 52218

SEQ ID NO: 327640 - RNA, 64 nt, Homo Sapiens; identical to SEQ ID NO: 52219

SEQ ID NO: 327641 - RNA, 64 nt, Homo Sapiens; identical to SEQ ID NO: 52220

SEQ ID NO: 327642 - RNA, 64 nt, Homo Sapiens; identical to SEQ ID NO: 52221

SEQ ID NO: 327643 - RNA, 64 nt, Homo Sapiens; identical to SEQ ID NO: 52222

SEQ ID NO: 327644 - RNA, 64 nt, Homo Sapiens; identical to SEQ ID NO: 52223

SEQ ID NO: 327645 - RNA, 64 nt, Homo Sapiens; identical to SEQ ID NO: 52224

SEQ ID NO: 327646 - RNA, 64 nt, Homo Sapiens; identical to SEQ ID NO: 52225

SEQ ID NO: 327647 - RNA, 64 nt, Homo Sapiens; identical to SEQ ID NO: 52226

SEQ ID NO: 327648 - RNA, 64 nt, Homo Sapiens; identical to SEQ ID NO: 52227

SEQ ID NO: 327649 - RNA, 64 nt, Homo Sapiens; identical to SEQ ID NO: 52228

SEQ ID NO: 327650 - RNA, 64 nt, Homo Sapiens; identical to SEQ ID NO: 52229

SEQ ID NO: 327651 - RNA, 64 nt, Homo Sapiens; identical to SEQ ID NO: 52230

SEQ ID NO: 327652 - RNA, 64 nt, Homo Sapiens; identical to SEQ ID NO: 52231

SEQ ID NO: 327653 - RNA, 64 nt, Homo Sapiens; identical to SEQ ID NO: 52232

SEQ ID NO: 327654 - RNA, 64 nt, Homo Sapiens; identical to SEQ ID NO: 52233

SEQ ID NO: 327655 - RNA, 64 nt, Homo Sapiens; identical to SEQ ID NO: 52234

SEQ ID NO: 327656 - RNA, 64 nt, Homo Sapiens; identical to SEQ ID NO: 52235

SEQ ID NO: 327657 - RNA, 64 nt, Homo Sapiens
ugccaccuacaugcuuauuuagauguauuuaagggguauucagauagaaucaaaaacaagggcc

SEQ ID NO: 327658 - RNA, 64 nt, Homo Sapiens
gacaguguagcaaguagcuuuguauaaaguuagugguauucaggguagcagaggacuuggugac

SEQ ID NO: 327659 - RNA, 64 nt, Homo Sapiens
gugggauagugucauaacuauacuggcaaauggugguauucaguguuugguuuaaaaacuucug

SEQ ID NO: 327660 - RNA, 64 nt, Homo Sapiens
ugucuuugcucuuucugcuuagauuguuaagaaggguauucauggguggaggcauaaguagaag

SEQ ID NO: 327661 - RNA, 64 nt, Homo Sapiens
uuuguuuuuuuuuaaucacaguaggucugauagagaauuggagcuaaauuauaauauuuuuguu

SEQ ID NO: 327662 - RNA, 64 nt, Homo Sapiens
ugagaauaacaaugguaaucguuaguaauauuuagaauuggaauuugccuacugaaauaguuau

SEQ ID NO: 327663 - RNA, 64 nt, Homo Sapiens
cucaguuuuuaugagacacacucauuuggguucugaauuggagaguaagauggauaaucacuuu

SEQ ID NO: 327664 - RNA, 64 nt, Homo Sapiens
guuggacuuguuuucuaugaauguucaagugcaggaauuggaaaacugaagacauggacuuuau

SEQ ID NO: 327665 - RNA, 64 nt, Homo Sapiens
gagaagagugaagauccaagauauuccagcauuugaauuggaaaaauauuauaaaaagaguguc

SEQ ID NO: 327666 - RNA, 64 nt, Homo Sapiens
uuuuugcuaaagaaauuaauaauuaaauauaaaggaauuggaggucaaagaugauauguggagg

SEQ ID NO: 327667 - RNA, 64 nt, Homo Sapiens
augucaaauuagucacauuaagcuauaguagaaggaauuggacacuucuccagauauuuggcuu

SEQ ID NO: 327668 - RNA, 64 nt, Homo Sapiens
aaauuaauaacuguggcucuuccaguugaaauaggaauuggagagaaaggauuagaauauuuua

SEQ ID NO: 327669 - RNA, 64 nt, Homo Sapiens
uuagcauguaaaacaaagaaagauauacaugacugaauuggauaucuuuguuuguuuguuugag

SEQ ID NO: 327670 - RNA, 64 nt, Homo Sapiens
ugggauuacguguguaagccacagugcccagcccgaauuggauaucuuuaagauaucuguaagu

SEQ ID NO: 327671 - RNA, 64 nt, Homo Sapiens
ugcuuuaaauagacugacgucgcauacccuuauagaauuggaauaugauuucucaaaaauuaau

SEQ ID NO: 327672 - RNA, 64 nt, Homo Sapiens
uaauaccccaagcuugcccugaauacuuugauuggaauuggaauauaucaaaaaagguuaguau

SEQ ID NO: 327673 - RNA, 64 nt, Homo Sapiens
cagcauaaauguugacaugggacauuugcucauggaauuggagcucgugggacagucaccucau

SEQ ID NO: 327674 - RNA, 64 nt, Homo Sapiens
auggaauuggagcucgugggacagucaccucauggaauuggagcucguggaacaguuaccucug

SEQ ID NO: 327675 - RNA, 64 nt, Homo Sapiens
cauauuaaggaaugauucucaaagcccaguucuggaauuggagcgccauuccuucugugaugau

SEQ ID NO: 327676 - RNA, 64 nt, Homo Sapiens
gaugugguguguaccuguaguguguugugcaaaagaauuggaaggcccauuacagcuucuagcc

SEQ ID NO: 327677 - RNA, 64 nt, Homo Sapiens
auugguauagccuuaugugcuuuccuacaaaauggaauuggaggccgggcgcaguggcucacgc

SEQ ID NO: 327678 - RNA, 64 nt, Homo Sapiens
uagauagauagauagauagauagauagauaaacggaauuggagccauuuugcuuuaagugaaug

SEQ ID NO: 327679 - RNA, 64 nt, Homo Sapiens
uguaguuuucuagaugagauuucaguaugauuuuaucagcuauuucuuauauaucauaaucugg

SEQ ID NO: 327680 - RNA, 64 nt, Homo Sapiens
ucaccuuaguuauggugcucaccaaacgaaggguaucagcuauuuuuuuuaaaauucaaaaaga

SEQ ID NO: 327681 - RNA, 64 nt, Homo Sapiens
uuucaaacuaucucuaguuuuucaauggaaauauaucagcuagggaaaaaccaucaagcucauu

SEQ ID NO: 327682 - RNA, 64 nt, Homo Sapiens
aaucacugucacccccggacagcagaacgcuggcaucagcuaucuuagcuccuccucuccccuc

SEQ ID NO: 327683 - RNA, 64 nt, Homo Sapiens
gcugccacagaagaggcaucaagccaauacaaaaaucagcuaaauuuuacagaauucuguagca

SEQ ID NO: 327684 - RNA, 64 nt, Homo Sapiens
gauccagccacuggauauuuccacuucugaaaguaucagcuacuucugcccuccugcuccagcc

SEQ ID NO: 327685 - RNA, 64 nt, Homo Sapiens
ccugcuuucuuuucuccucacuugcuaaguugagaucagcuagaccaggcuacucuuauuuuag

SEQ ID NO: 327686 - RNA, 64 nt, Homo Sapiens
cuuuguuuuuaaguuuguuuugcaauuucuggauaucagcuacagcccuuuaucaauacagugc

SEQ ID NO: 327687 - RNA, 64 nt, Homo Sapiens
gacuacuuaauaggugaguuccaguguuucuacaaucagcuaggauggccugaagcucuucucu

SEQ ID NO: 327688 - RNA, 64 nt, Homo Sapiens
uuugucuuaaacaccaguaauauggcucuuguuuaucagcuaaucuugaauuuauucuguggua

SEQ ID NO: 327689 - RNA, 64 nt, Homo Sapiens
aacucauucagaaaugauucucccaacaaugcguaucagcuauucauugauacuuagagugggu

SEQ ID NO: 327690 - RNA, 64 nt, Homo Sapiens
gacauuuaaaauggaacuucuuuuaucugacaggaucagcuacaaugcccuguguuaaauuguu

SEQ ID NO: 327691 - RNA, 64 nt, Homo Sapiens
agcuugccagucuuuuuggcuuugaacacugcccaucagcuacagucauuacuguuccccaacc

SEQ ID NO: 327692 - RNA, 64 nt, Homo Sapiens
aggauggacucgugucugauuagaaugucaguugaucagcuagauuuguguccacacuaccagu

SEQ ID NO: 327693 - RNA, 64 nt, Homo Sapiens
cucucuccaaaagccucugcccaggagcaugggcaucagcuaccucacgggaaccagccugcug

SEQ ID NO: 327694 - RNA, 64 nt, Homo Sapiens
cgcuauaccguggacucuccauccucuggcagaaaucagcuagaugucugcucuuucccucccc

SEQ ID NO: 327695 - RNA, 64 nt, Homo Sapiens
uauccaaauuacaggaaaugcacugaugaauguuaucagcuauucaguggaugccauucauaac

SEQ ID NO: 327696 - RNA, 64 nt, Homo Sapiens
uuagguagaacagggaagcagguuugugugauuuaucagcuaauaaccaaggcccucgguuauu

SEQ ID NO: 327697 - RNA, 64 nt, Homo Sapiens
aaauauauaauuguauuuuaggauauauaagcaaaucagcuaggccuuucuuuuuuuaugaccu

SEQ ID NO: 327698 - RNA, 64 nt, Homo Sapiens
gcugaagaugaauaucccuaauccuucauaaagaaucagcuagaguugucaugauaaagucagc

SEQ ID NO: 327699 - RNA, 64 nt, Homo Sapiens
augucugcugugacuaauauaaauuucuugcagaaucagcuacacuuaauuauguugcugauag

SEQ ID NO: 327700 - RNA, 64 nt, Homo Sapiens
gagaaaagcaaagcucuuucuuauuuuccucauaaucagcuacccuggaggggagggagaacuc

SEQ ID NO: 327701 - RNA, 64 nt, Homo Sapiens
uuugaaucucuucuuugugaaaugaagugagacuaucagcuaguuguggguggaguguguucuc

SEQ ID NO: 327702 - RNA, 64 nt, Homo Sapiens
aaauugacauuccaucugucuuuauuggugaaucaucagcuaauucucugaaagaugaauucac

SEQ ID NO: 327703 - RNA, 64 nt, Homo Sapiens
agacuucagauuagacuuuaauauucaacauaaaaucagcuaucgaacacuuuuuaaaagacgu

SEQ ID NO: 327704 - RNA, 64 nt, Homo Sapiens
cagauuaguaaccucuuuguucugauuaauuagaaucagcuagccagaggccaauuucauuaac

SEQ ID NO: 327705 - RNA, 64 nt, Homo Sapiens
aggauaugaaaucacaggugagcucuuuagcaauaucagcuaaaugacuugaaaaaguuuggga

SEQ ID NO: 327706 - RNA, 64 nt, Homo Sapiens
auuguaaacuaguuacuaaauauccuuguuaaguaucagcuacaaaaauuugaauagcccuauu

SEQ ID NO: 327707 - RNA, 64 nt, Homo Sapiens
aaauuuuauugauuacaaaauauguaagaaaauuaucagcuacaguuuuaaaguuuaaaaugcu

SEQ ID NO: 327708 - RNA, 64 nt, Homo Sapiens
uacaugaaaaauuauacuugauagcuuaacuauaaucagcuauuuuuguauuuuuguaauauuu

SEQ ID NO: 327709 - RNA, 64 nt, Homo Sapiens
accugcacugaguacuucauuaggacaagugagaaucagcuauugauaauggccagagauaucc

SEQ ID NO: 327710 - RNA, 63 nt, Homo Sapiens
gaagaaucauaaucagaauaaagauaaauucuugaucagcuauaacuucuguuucaucuaguu

SEQ ID NO: 327711 - RNA, 64 nt, Homo Sapiens
ccaaacuugaauuuucacaugaguaugccacucuaucagcuacucugauuaaccugacagucgg

SEQ ID NO: 327712 - RNA, 64 nt, Homo Sapiens
guaaagacugcuuuuugaaugcauaugauuuugcaucagcuagacugaguugauucugaccaga

SEQ ID NO: 327713 - RNA, 64 nt, Homo Sapiens
gaauuggugaauuuccugacguuuccacauaaagaucagcuacuaaggacaaagcccuauuuuu

SEQ ID NO: 327714 - RNA, 64 nt, Homo Sapiens
aauuacucuauauaguaucuacuagagauuugaaaucagcuauggcuugguacacauaagaaaa

SEQ ID NO: 327715 - RNA, 64 nt, Homo Sapiens
cccuucugaucuuggaaagaucucucuguuaaagaucagcuauuaaaaaaaauuccaugcacuc

SEQ ID NO: 327716 - RNA, 64 nt, Homo Sapiens
cuaacagacauagacugcaaaagaauaauuuggaaucagcuaugcaaaucagucucacaauagc

SEQ ID NO: 327717 - RNA, 64 nt, Homo Sapiens
auauauauuuaaaauaauaauggaaacauaggaaaucagcuauuuaaaccagaucacccuuguu

SEQ ID NO: 327718 - RNA, 64 nt, Homo Sapiens
uauaaaacucuuugaagaaauaugauuuuuagaaaucagcuacccauuauagcacaaaaucagc

SEQ ID NO: 327719 - RNA, 64 nt, Homo Sapiens
ucccuguauguggaagcagcaccucauucccgccaucagcuaccucucaucaccccaccuucau

SEQ ID NO: 327720 - RNA, 64 nt, Homo Sapiens
ugggaaggcuggcugcugcccucagcuccgccucaucagcuaugugaagggguguguguggagu

SEQ ID NO: 327721 - RNA, 64 nt, Homo Sapiens
uuauguauagauuuuccagcugcucauugaaacaaucagcuaauuuguauaguuagaugcuaaa

SEQ ID NO: 327722 - RNA, 64 nt, Homo Sapiens
aaguguaaaaguggcucauaucuucuccagccaaaucagcuaggccauggccuugccuugcuuc

SEQ ID NO: 327723 - RNA, 64 nt, Homo Sapiens
ucacuagacaauaauucaaguuuagaaacagguaaucagcuauuugaucuuaaaaggcaaugaa

SEQ ID NO: 327724 - RNA, 64 nt, Homo Sapiens
gaggcuuauuaaaaauagugauucuaauguaagaaucagcuaagaugcauuauauauauuuuaa

SEQ ID NO: 327725 - RNA, 64 nt, Homo Sapiens
uucaacauaacugaaggcauuguacggaaagaugaucagcuauuaaacugagaaauguucagaa

SEQ ID NO: 327726 - RNA, 51 nt, Homo Sapiens
uugcaccaacuuugaagucugaucagcuaagauuccaaagaauuuucauga

SEQ ID NO: 327727 - RNA, 64 nt, Homo Sapiens
gccaggcuuacguauuucuauguuagaaugugccaucagcuaauuguuuuuuaaugcuauaaaa

SEQ ID NO: 327728 - RNA, 64 nt, Homo Sapiens
uacuauuuauauacaagugaacaccuuauuaaugaucagcuauauuagaauacauuguacuuau

SEQ ID NO: 327729 - RNA, 64 nt, Homo Sapiens
guuuuuguuuuguuuuuaaauggagcccugaggcaucagcuauuauacuugggacucuaccucu

SEQ ID NO: 327730 - RNA, 64 nt, Homo Sapiens
agugauuauaugugugcucaaauaaguguuauguaucagcuagauacugagcuuugauagaaua

SEQ ID NO: 327731 - RNA, 64 nt, Homo Sapiens
gccugagaggcaaaugcaucccgccuugugauguaucagcuauuuguagauaaauaaauugcag

SEQ ID NO: 327732 - RNA, 64 nt, Homo Sapiens
aggcaaauuaagauuuuuacaaaauuuaacagcaaucagcuaacguuuuuuaaaaaauaaauuu

SEQ ID NO: 327733 - RNA, 64 nt, Homo Sapiens
gaucaucaacggcaauuuuugcuacauacacuucaucagcuauggaagaccacacggaagagua

SEQ ID NO: 327734 - RNA, 64 nt, Homo Sapiens
augacagguuugggaccccuucugagagcugugcaucagcuagaauuccuaauaaucauuggau

SEQ ID NO: 327735 - RNA, 64 nt, Homo Sapiens
cacccuugaccuugugcauuugucaucacaguccaucagcuaucguagcugugauauuacaugu

SEQ ID NO: 327736 - RNA, 64 nt, Homo Sapiens
ccuggguuggggugcuuucugggaagugguaaagaucagcuaaaagauugcuguagcucucaca

SEQ ID NO: 327737 - RNA, 64 nt, Homo Sapiens
uacucugcuuggugcauaagcacacucacaagacaucagcuauaggaguacccuggcuguucuc

SEQ ID NO: 327738 - RNA, 64 nt, Homo Sapiens
uuuauacuauuuugaauucauucauuucauugugaucagcuagcuuauucuuguguacuuuuuu

SEQ ID NO: 327739 - RNA, 64 nt, Homo Sapiens
uuucuuucugauccuaaaucauuuuguuuuauaaaucagcuauagcaucuuucuagaauuaauc

SEQ ID NO: 327740 - RNA, 64 nt, Homo Sapiens
acagcaaguugaaaaacucagcggaaaaggauucaucagcuagaguggaggauacaaugcacca

SEQ ID NO: 327741 - RNA, 64 nt, Homo Sapiens
aauuuggaaguacuuguccaacuccucaccucgcaucagcuauaccuucccgccaauucugucc

SEQ ID NO: 327742 - RNA, 64 nt, Homo Sapiens
gucaaccugguuucaucuguuagcugcaucacuuaucagcuauggaccccauguguccaucacc

SEQ ID NO: 327743 - RNA, 64 nt, Homo Sapiens
auugcaagugcaauucuuauaaucuaaugaauucaucagcuagacacauuauuugccuuauaaa

SEQ ID NO: 327744 - RNA, 64 nt, Homo Sapiens
uucagaacauugugcugucugucagcauauguauaucagcuacaaaauauauucaacuuugacu

SEQ ID NO: 327745 - RNA, 64 nt, Homo Sapiens
auaucuaaucauuccucaagucuuacugauuuuuaucagcuagaaucuaucuccuuauuucuac

SEQ ID NO: 327746 - RNA, 64 nt, Homo Sapiens
cacgcuuuuaaauuuacagcucaucacagaaaucaucagcuauacauuaguaaaaauaaggaca

SEQ ID NO: 327747 - RNA, 64 nt, Homo Sapiens
aaaaauauagaauagaaauaagugcaggcuuggaaucagcuacaaauccuaaagauggggugug

SEQ ID NO: 327748 - RNA, 64 nt, Homo Sapiens
uacaaaucacauauaguuuauucuuggcauaauaaucagcuacaaaguguguuaaagaccaaaa

SEQ ID NO: 327749 - RNA, 64 nt, Homo Sapiens
caccacgucacuucaugcagcauccugugccuccaucagcuaaaaggagcacacccagccccca

SEQ ID NO: 327750 - RNA, 64 nt, Homo Sapiens
aaucacccuacuguggugggcguaguagggagccaucagcuaggaagaaacgugggagauguga

SEQ ID NO: 327751 - RNA, 64 nt, Homo Sapiens
uaaacaaagcgagguuaagguuagacucuugggaaucagcuaguuuucaaucuuauuagggugc

SEQ ID NO: 327752 - RNA, 64 nt, Homo Sapiens
uagagguggauaaauuggaauuuucuucuuaaaaaucagcuauuuacaagauuuuaauucaaau

SEQ ID NO: 327753 - RNA, 64 nt, Homo Sapiens
uaccuucuacuuuccauuuuaaguaucauuagugaucagcuagcuuguuaauuuuaaacaaaca

SEQ ID NO: 327754 - RNA, 64 nt, Homo Sapiens
caauuuccacaaaauaaaguuaaaacacuuuagaaucagcuaguagaagcccuuuacauuucca

SEQ ID NO: 327755 - RNA, 64 nt, Homo Sapiens
guaaccaaguggcugguucaccacuaguguuguuaucagcuacuugggguauaagcaauaauau

SEQ ID NO: 327756 - RNA, 64 nt, Homo Sapiens
cgaaagagcuuucugucaagcagcaauaucaaacaucagcuaacucagagcaaugaccugcaug

SEQ ID NO: 327757 - RNA, 64 nt, Homo Sapiens
acaaaugauuucccagagcaaacagaauccagucaucagcuaauguugcauguccauguuagaa

SEQ ID NO: 327758 - RNA, 64 nt, Homo Sapiens
uuagcauuaaaggcugaugguuggcucuagauuuaucagcuauuauguauuuuuggaaauauuc

SEQ ID NO: 327759 - RNA, 64 nt, Homo Sapiens
gauaucucucaauuaaagaaauacauugugaacuaucagcuacaaaguuguacugaauaacuau

SEQ ID NO: 327760 - RNA, 64 nt, Homo Sapiens
ucccuccaagcuugggucaguguguuaacugcuuaucagcuauucagacaucuccaugguuucu

SEQ ID NO: 327761 - RNA, 64 nt, Homo Sapiens
ugccugcucucgaggcagcaguggguucaggcccaucagcuaccccugcagcuggggaagacuu

SEQ ID NO: 327762 - RNA, 64 nt, Homo Sapiens
ugcugaggaaacggccaaacgugauugcugcugaaucagcuacacucaauaaauguuaacuauu

SEQ ID NO: 327763 - RNA, 64 nt, Homo Sapiens
agaccaguuauucaggguccgcugggcacagagaaucagcuagggacaaaucacuccaaacaaa

SEQ ID NO: 327764 - RNA, 64 nt, Homo Sapiens
aaagugaaaaaggacaagauacugguauugagaaaucagcuaccuugaaacuucuccugugguu

SEQ ID NO: 327765 - RNA, 64 nt, Homo Sapiens
ggcucuucucaugcaucagugagcugugggccacaucagcuaguaagccaugcuggcucagucu

SEQ ID NO: 327766 - RNA, 64 nt, Homo Sapiens
gguaauauaauaauguccuugaauggaaaaaaaaaucagcuauuuguaagcauuuuagguccca

SEQ ID NO: 327767 - RNA, 64 nt, Homo Sapiens
cuggagugauuuguuacaaaguuuaccccaaagcaucagcuaggaugaugacuccuacuccauu

SEQ ID NO: 327768 - RNA, 64 nt, Homo Sapiens
gaugugcuuccuccgugucugucucuguuuaaguaucagcuaaacggguguaugugcgcucagg

SEQ ID NO: 327769 - RNA, 64 nt, Homo Sapiens
acuucucucaacaaaaauggucugcauuugagagaucagcuaaucaguuguuacucucuuaaca

SEQ ID NO: 327770 - RNA, 64 nt, Homo Sapiens
ugguaacaugcaaugucagcaagcagagcguaacaucagcuagaagaggcaggcaguagcaaga

SEQ ID NO: 327771 - RNA, 64 nt, Homo Sapiens
cucgggaucauuuccauaagcccauggcuuguggaucagcuaagucaaagcguggacguguguc

SEQ ID NO: 327772 - RNA, 64 nt, Homo Sapiens
uaauuugcauauuuuaucccuguuuauucuuucuaucagcuagaauacuaugcauacauuaucu

SEQ ID NO: 327773 - RNA, 64 nt, Homo Sapiens
gugacagaaguaaauauagucaguccaccacagaaucagcuaauaaggagcuuuucaaauuacc

SEQ ID NO: 327774 - RNA, 64 nt, Homo Sapiens
aaaagaaguaacaagagugaaaagucaugaacacaucagcuagcuuauuuuuuaauaacccuug

SEQ ID NO: 327775 - RNA, 64 nt, Homo Sapiens
gugggggcagcguagaagugguauauccaaguauaucagcuacuguaguugucacagucuugug

SEQ ID NO: 327776 - RNA, 64 nt, Homo Sapiens
gagaagcuucagaaaguuccgaggaccugcuaaaaucagcuacuagaaucugcugccagagggg

SEQ ID NO: 327777 - RNA, 64 nt, Homo Sapiens
uuuuaaaaaucaguuucauuuucauauuucauagaucagcuauugguagcuuuuugauuucccc

SEQ ID NO: 327778 - RNA, 64 nt, Homo Sapiens
agcaucugcaaagccgauucauguacugaugccaaucagcuagagcaauguaggcuuuuuuuaa

SEQ ID NO: 327779 - RNA, 64 nt, Homo Sapiens
gaaagaccucagagcaguugauauaggauuauaaaucagcuaguagacuauagauuuuuuuuua

SEQ ID NO: 327780 - RNA, 64 nt, Homo Sapiens
gcagcguguaaauaggagugaauaccgcgaaugcaucagcuaaacucuuauacagugcaaccca

SEQ ID NO: 327781 - RNA, 64 nt, Homo Sapiens
uggcaaauagguaucaucaauuucaucaguugggaucagcuauauauugauguuuuagaauggu

SEQ ID NO: 327782 - RNA, 64 nt, Homo Sapiens
cccagagccaccccuauacuccagucucccuggcaucagcuacugcaguacugggguacuugcc

SEQ ID NO: 327783 - RNA, 64 nt, Homo Sapiens
ucuaucuguggccuuguucuucauuucaguguuaaucagcuaaacagaaguuguugcuuaugau

SEQ ID NO: 327784 - RNA, 64 nt, Homo Sapiens
cagagauauaaauuaccacauuugccuucccuucaucagcuaacacuuaucacuuauacuacca

SEQ ID NO: 327785 - RNA, 64 nt, Homo Sapiens
uguaaggcuguggcagaaguugcacaccuguaguaucagcuacuuaaaaaucagccaggcgucg

SEQ ID NO: 327786 - RNA, 64 nt, Homo Sapiens
uauagcugauauauauauauagcuacucaucaacaucagcuaaauuuaaaacauuuuaagauac

SEQ ID NO: 327787 - RNA, 64 nt, Homo Sapiens
uuucaggaauuucuguucaggcuuccuccuccucaucagcuauuuuacccaucucagaacgucc

SEQ ID NO: 327788 - RNA, 64 nt, Homo Sapiens
aauuauauaugcugaauauuaagcuacugggguuaucagcuauuugggaagaguguaagugacu

SEQ ID NO: 327789 - RNA, 64 nt, Homo Sapiens
aaauuagcugggugugguggcacaugccuguaauaucagcuacucaggaggcugaggcaggaga

SEQ ID NO: 327790 - RNA, 64 nt, Homo Sapiens
auguaacagcauauuaaacuggagacagugaugaaucagcuacaaagguaauauuguauuaaaa

SEQ ID NO: 327791 - RNA, 64 nt, Homo Sapiens
uugugaagccaugaguuccaagaaauauuuuaaaaucagcuauucccccauuaaucaguucauu

SEQ ID NO: 327792 - RNA, 64 nt, Homo Sapiens
aggagcgaugcugguggucaucccucacguugccaucagcuaccaccugugaaaugaggcaguu

SEQ ID NO: 327793 - RNA, 64 nt, Homo Sapiens
cacuggaccaugugaacagccauccugaacugccaucagcuaccacacuggacucugcagggca

SEQ ID NO: 327794 - RNA, 64 nt, Homo Sapiens
cagcacuaagacucucaggucagguaccuuggugaucagcuacuaguucuuccagcccucauug

SEQ ID NO: 327795 - RNA, 64 nt, Homo Sapiens
agaauguaugaggaagugggaaguaucucagagaaucagcuaaguuuccuaacuuguccaucca

SEQ ID NO: 327796 - RNA, 64 nt, Homo Sapiens
cauguucauccaaaaguauuaauagaaauucucuaucagcuauucagucuuaauuucacuagua

SEQ ID NO: 327797 - RNA, 64 nt, Homo Sapiens
gcuuuuuuuucaucacuugauuauuuucuuuaaaaucagcuauuacaggauauuuuuuuauuuu

SEQ ID NO: 327798 - RNA, 64 nt, Homo Sapiens
cugggggcagagcuucuauuuauggcacauagacaucagcuaggcuuuugggaaucguuugugu

SEQ ID NO: 327799 - RNA, 64 nt, Homo Sapiens
gacauguauggacaucaauugagucuaucuuccuaucagcuauuagcuucgccauaaccaagua

SEQ ID NO: 327800 - RNA, 64 nt, Homo Sapiens
guuaugaaaaaggaagaauuugcucauaauuuuaaucagcuacaaaccauccuaaagcguuaac

SEQ ID NO: 327801 - RNA, 64 nt, Homo Sapiens
uuuaaacauuauuuacucggugaacuucaaauguaucagcuauuaaaauaugagguuuuuagcc

SEQ ID NO: 327802 - RNA, 64 nt, Homo Sapiens
ucucuguggauguugcuguagucacugucauguaaucagcuaaugguuucuuuaguucuuuacu

SEQ ID NO: 327803 - RNA, 64 nt, Homo Sapiens
aggaaaaaaaaagacuucuguucaaaguuaacuuaucagcuacauccucuguaacgugguucau

SEQ ID NO: 327804 - RNA, 64 nt, Homo Sapiens
agucccucagagauggcccuggcucugaggucacaucagcuagguuugggaggccccucagcuu

SEQ ID NO: 327805 - RNA, 64 nt, Homo Sapiens
acucagaagaauggcauauucguucucauuaguaaucagcuauuuugucacuuucuuguugacu

SEQ ID NO: 327806 - RNA, 64 nt, Homo Sapiens
uaauuauuacuugauucuuuuaccacccucaggaaucagcuaagaugaguucagcuagaaguca

SEQ ID NO: 327807 - RNA, 64 nt, Homo Sapiens
uacugccaaagggaaauaucaggcaaaacgucgaaucagcuauucacaacaauuaacagucuuc

SEQ ID NO: 327808 - RNA, 64 nt, Homo Sapiens
ucagcagcaguaagaggaaugucucccuccugauaucagcuaauucagguaaggacucuugguc

SEQ ID NO: 327809 - RNA, 64 nt, Homo Sapiens
uauaaaauaaguaugaucauuauuauugaacucuaucagcuaugaagcuaaauuuuaaagucaa

SEQ ID NO: 327810 - RNA, 64 nt, Homo Sapiens
gaugccaaggagcgggcagcagccaaagacaaguaucagcuagcaucaggacagaaaggugucc

SEQ ID NO: 327811 - RNA, 64 nt, Homo Sapiens
gcaugaaccacccagaguggcccaagacucccagaucagcuaccaggcaggauauuccaagggc

SEQ ID NO: 327812 - RNA, 64 nt, Homo Sapiens
augagggcucaccaaguguaagccacaaauacacaucagcuauagcacaaauauacuuguguua

SEQ ID NO: 327813 - RNA, 64 nt, Homo Sapiens
gcaaugcucugugaguacccuuugugagggaaccaucagcuagcagaugagcaccguauauuca

SEQ ID NO: 327814 - RNA, 64 nt, Homo Sapiens
aguauuccuuaugagaaagaccuauagauuguagaucagcuauaagccugugauaaacauuauu

SEQ ID NO: 327815 - RNA, 64 nt, Homo Sapiens
auucaaaauugcuucuucuuucaaagcauuugcaaucagcuaccacaguuguuuuuauucuucc

SEQ ID NO: 327816 - RNA, 64 nt, Homo Sapiens
guccaaaauugcuuuuuguuucaaaguauuuaccaucagcuacaacaguugcuuucauucuucc

SEQ ID NO: 327817 - RNA, 64 nt, Homo Sapiens
guccaaaauugcuuuuucuuucaaaguauuuaaaaucagcuacaaaaguugcuuugauucuucc

SEQ ID NO: 327818 - RNA, 64 nt, Homo Sapiens
acaccuggugugcauuuucaguauaaccuuaaacaucagcuaauugagugcuuuuucuuaauaa

SEQ ID NO: 327819 - RNA, 64 nt, Homo Sapiens
ugaagaaucucagcuggguggaaauggcaagauaaucagcuauauggauaaagcuuguaaguua

SEQ ID NO: 327820 - RNA, 64 nt, Homo Sapiens
gugugguguaauuuauaaaauuagaaagcaacuuaucagcuacuuaagagaaauggcaaguuuu

SEQ ID NO: 327821 - RNA, 64 nt, Homo Sapiens
gugauaaaaaccgacagguuguucaaaggcccagaucagcuaaagcauguauauaagagcacgu

SEQ ID NO: 327822 - RNA, 64 nt, Homo Sapiens
ccaccuggcuuugaaucugggcccuacuuaacuuaucagcuaugugguuuugggcauaagccac

SEQ ID NO: 327823 - RNA, 64 nt, Homo Sapiens
gcggugucagaucacuucucgucacuggacgagcaucagcuacuuuuucagccugacugcuuua

SEQ ID NO: 327824 - RNA, 64 nt, Homo Sapiens
uaugauucuauaagcuauuuuacaggaacugugcaucagcuauucuuaacugccuaaucuuaau

SEQ ID NO: 327825 - RNA, 64 nt, Homo Sapiens
ugugauuuauguguuaaccucagucacgagguugaucagcuaauugugggaccaaaaugugccc

SEQ ID NO: 327826 - RNA, 64 nt, Homo Sapiens
aagugauggagcccagauuuucugccuggugucaaucagcuagcggcacagagaggugauguca

SEQ ID NO: 327827 - RNA, 64 nt, Homo Sapiens
ccugauauagaucacauaacagaaugcaccagucaucagcuauucaguugguaagcuuccagga

SEQ ID NO: 327828 - RNA, 64 nt, Homo Sapiens
uacaaccuucauuucaucacaggcccauaaguuuaucagcuauuacuugguuuugcacauuaag

SEQ ID NO: 327829 - RNA, 64 nt, Homo Sapiens
uucaaauuauugaccuggacaccugaucaagaucaucagcuaccagggguucaagacagagccc

SEQ ID NO: 327830 - RNA, 64 nt, Homo Sapiens
aaaauggacuuuagacaaaagauuaauugaggaaaucagcuaaguuuaguuuuguuugcccaag

SEQ ID NO: 327831 - RNA, 64 nt, Homo Sapiens
ccaagagauacugguuguauuuaaacagucucccaccaccuaccgcccagggaaggccgauaau

SEQ ID NO: 327832 - RNA, 64 nt, Homo Sapiens
ggcccagggaaggccgauaagcccugcgccggcaaccaccuaguugccgaugaccgccugccua

SEQ ID NO: 327833 - RNA, 64 nt, Homo Sapiens
cugaguuccagggcugcuguaccauggcagacucaccaccuauuagugugcugcccaguagcaa

SEQ ID NO: 327834 - RNA, 64 nt, Homo Sapiens
ccccccaccuaacucaugccgguugaggggccacaccaccuauugaggcugauucuaauugucu

SEQ ID NO: 327835 - RNA, 64 nt, Homo Sapiens
aaaaugaaauuauggaaccucaugagcaaaacuguugucucaacauugcacuucagccugguga

SEQ ID NO: 327836 - RNA, 64 nt, Homo Sapiens
cucugcuguucucggaaacuuuggguggagagguuugucucagccaaguaguaauuaggcugag

SEQ ID NO: 327837 - RNA, 64 nt, Homo Sapiens
agaaacauuuauuucugaccuaagccuuuacugcuugucucacugaagguacccaguagacucu

SEQ ID NO: 327838 - RNA, 64 nt, Homo Sapiens
aacaagaauaaaauugaaauaauagacaauguuuuugucucaaggcauuaguauaucaucauaa

SEQ ID NO: 327839 - RNA, 64 nt, Homo Sapiens
uagguucccucgugcagugccuggugcucucaaauugucucaaaaggaccaagaggaaaagagu

SEQ ID NO: 327840 - RNA, 64 nt, Homo Sapiens
uccagagaggguacagaaaaagcacacagauggcuugucucaggaguguugaaugugugccccg

SEQ ID NO: 327841 - RNA, 64 nt, Homo Sapiens
ugcuagcaacauaccagguagcagaugcaaucucuugucucacaaguggaucuucuuggagcga

SEQ ID NO: 327842 - RNA, 64 nt, Homo Sapiens
aagaaaacgaacugggaaaagggcgacagaagucuugucucaaggagccguugugcuccagccu

SEQ ID NO: 327843 - RNA, 64 nt, Homo Sapiens
gaaaacaaaugaguuacucuagacaaauuacagauugucucagauacuuaaggauaauaggaca

SEQ ID NO: 327844 - RNA, 64 nt, Homo Sapiens
uguaacugguaaaggcugauuuggaaaguuuaccuugucucagacuucugaugauuccaaugug

SEQ ID NO: 327845 - RNA, 64 nt, Homo Sapiens
uagaaacauccauauuuuucuuauaauugucucauugucucauugauauuaauacaugaaauuu

SEQ ID NO: 327846 - RNA, 64 nt, Homo Sapiens
gucucauuuagaaacauccaugaaauuuuuauaauugucucauucuugucuugauauuaauaca

SEQ ID NO: 327847 - RNA, 64 nt, Homo Sapiens
cucaaucucagggguggugggauaguggguauucuugucucaucgaaugcugacuauaaguagu

SEQ ID NO: 327848 - RNA, 64 nt, Homo Sapiens
uccuguccacaaggcaacucaaaccuggccuggguugucucaaaaugcuucccauggaccagag

SEQ ID NO: 327849 - RNA, 64 nt, Homo Sapiens
aaagcaauauuagaagagccuaagaugaaaugaauugucucaacgaaacugguacaaccugcca

SEQ ID NO: 327850 - RNA, 64 nt, Homo Sapiens
ucugugaaacugguacaaccuuccuucuucccacuugucucauguuuuugcuguggcccugcuu

SEQ ID NO: 327851 - RNA, 64 nt, Homo Sapiens
cuccacagcguggagacgucccucuaacaagaacuugucucagcacaugcgcacacgcacacuc

SEQ ID NO: 327852 - RNA, 64 nt, Homo Sapiens
aaaccaccaacgugcacuggcacccucagaaggcuugucucaccuccaccggcauccacacaaa

SEQ ID NO: 327853 - RNA, 64 nt, Homo Sapiens; identical to SEQ ID NO: 88546

SEQ ID NO: 327854 - RNA, 64 nt, Homo Sapiens; identical to SEQ ID NO: 88547

SEQ ID NO: 327855 - RNA, 51 nt, Homo Sapiens; identical to SEQ ID NO: 88548

SEQ ID NO: 327856 - RNA, 64 nt, Homo Sapiens; identical to SEQ ID NO: 88549

SEQ ID NO: 327857 - RNA, 64 nt, Homo Sapiens; identical to SEQ ID NO: 88550

SEQ ID NO: 327858 - RNA, 64 nt, Homo Sapiens; identical to SEQ ID NO: 88551

SEQ ID NO: 327859 - RNA, 64 nt, Homo Sapiens; identical to SEQ ID NO: 88552

SEQ ID NO: 327860 - RNA, 64 nt, Homo Sapiens; identical to SEQ ID NO: 88553

SEQ ID NO: 327861 - RNA, 64 nt, Homo Sapiens; identical to SEQ ID NO: 88554

SEQ ID NO: 327862 - RNA, 64 nt, Homo Sapiens; identical to SEQ ID NO: 88555

SEQ ID NO: 327863 - RNA, 64 nt, Homo Sapiens; identical to SEQ ID NO: 88556

SEQ ID NO: 327864 - RNA, 64 nt, Homo Sapiens; identical to SEQ ID NO: 88557

SEQ ID NO: 327865 - RNA, 64 nt, Homo Sapiens; identical to SEQ ID NO: 88558

SEQ ID NO: 327866 - RNA, 64 nt, Homo Sapiens; identical to SEQ ID NO: 88559

SEQ ID NO: 327867 - RNA, 64 nt, Homo Sapiens; identical to SEQ ID NO: 88560

SEQ ID NO: 327868 - RNA, 64 nt, Homo Sapiens; identical to SEQ ID NO: 88561

SEQ ID NO: 327869 - RNA, 64 nt, Homo Sapiens; identical to SEQ ID NO: 88562

SEQ ID NO: 327870 - RNA, 64 nt, Homo Sapiens; identical to SEQ ID NO: 88563

SEQ ID NO: 327871 - RNA, 64 nt, Homo Sapiens; identical to SEQ ID NO: 88564

SEQ ID NO: 327872 - RNA, 64 nt, Homo Sapiens; identical to SEQ ID NO: 88565

SEQ ID NO: 327873 - RNA, 64 nt, Homo Sapiens; identical to SEQ ID NO: 88566

SEQ ID NO: 327874 - RNA, 64 nt, Homo Sapiens; identical to SEQ ID NO: 88567

SEQ ID NO: 327875 - RNA, 64 nt, Homo Sapiens; identical to SEQ ID NO: 88568

SEQ ID NO: 327876 - RNA, 64 nt, Homo Sapiens; identical to SEQ ID NO: 88569

SEQ ID NO: 327877 - RNA, 64 nt, Homo Sapiens; identical to SEQ ID NO: 88570

SEQ ID NO: 327878 - RNA, 64 nt, Homo Sapiens; identical to SEQ ID NO: 88571

SEQ ID NO: 327879 - RNA, 64 nt, Homo Sapiens; identical to SEQ ID NO: 88572

SEQ ID NO: 327880 - RNA, 64 nt, Homo Sapiens; identical to SEQ ID NO: 88573

SEQ ID NO: 327881 - RNA, 64 nt, Homo Sapiens; identical to SEQ ID NO: 88574

SEQ ID NO: 327882 - RNA, 64 nt, Homo Sapiens; identical to SEQ ID NO: 88575

SEQ ID NO: 327883 - RNA, 64 nt, Homo Sapiens; identical to SEQ ID NO: 88576

SEQ ID NO: 327884 - RNA, 64 nt, Homo Sapiens; identical to SEQ ID NO: 88577

SEQ ID NO: 327885 - RNA, 64 nt, Homo Sapiens; identical to SEQ ID NO: 88578

SEQ ID NO: 327886 - RNA, 64 nt, Homo Sapiens; identical to SEQ ID NO: 88579

SEQ ID NO: 327887 - RNA, 64 nt, Homo Sapiens; identical to SEQ ID NO: 88580

SEQ ID NO: 327888 - RNA, 64 nt, Homo Sapiens; identical to SEQ ID NO: 88581

SEQ ID NO: 327889 - RNA, 64 nt, Homo Sapiens; identical to SEQ ID NO: 88582

SEQ ID NO: 327890 - RNA, 64 nt, Homo Sapiens; identical to SEQ ID NO: 88583

SEQ ID NO: 327891 - RNA, 64 nt, Homo Sapiens; identical to SEQ ID NO: 88584

SEQ ID NO: 327892 - RNA, 64 nt, Homo Sapiens; identical to SEQ ID NO: 88585

SEQ ID NO: 327893 - RNA, 64 nt, Homo Sapiens; identical to SEQ ID NO: 88586

SEQ ID NO: 327894 - RNA, 64 nt, Homo Sapiens; identical to SEQ ID NO: 88587

SEQ ID NO: 327895 - RNA, 64 nt, Homo Sapiens; identical to SEQ ID NO: 88588

SEQ ID NO: 327896 - RNA, 64 nt, Homo Sapiens; identical to SEQ ID NO: 88589

SEQ ID NO: 327897 - RNA, 64 nt, Homo Sapiens; identical to SEQ ID NO: 88590

SEQ ID NO: 327898 - RNA, 64 nt, Homo Sapiens; identical to SEQ ID NO: 88591

SEQ ID NO: 327899 - RNA, 64 nt, Homo Sapiens; identical to SEQ ID NO: 88592

SEQ ID NO: 327900 - RNA, 64 nt, Homo Sapiens; identical to SEQ ID NO: 88593

SEQ ID NO: 327901 - RNA, 62 nt, Homo Sapiens
gcagaucacgagaucaggaguucaagaccagccuggccaauaugaugaaaccccgucucuac

SEQ ID NO: 327902 - RNA, 62 nt, Homo Sapiens
ggaucaccugaggucagaaguuugagaccagccuggccaacauggugaaaccccgucucuac

SEQ ID NO: 327903 - RNA, 62 nt, Homo Sapiens
agugcugggauuacaggcaugagccaccacgccuggccaaaaaaauauguuuuaaauguccc

SEQ ID NO: 327904 - RNA, 62 nt, Homo Sapiens
ggaucacccaaggucaggaguuugagaccagccuggccaaauggugaaaccccaucucuacg

SEQ ID NO: 327905 - RNA, 62 nt, Homo Sapiens
ugcuccaguaaugcaauaaaagaggggacagucuggccaacuuuuguuuaauaccuucccca

SEQ ID NO: 327906 - RNA, 62 nt, Homo Sapiens
augaggcccucccaacacuucuuaccacugaucuggccaagacuggauagacugccugcguc

SEQ ID NO: 327907 - RNA, 62 nt, Homo Sapiens
uggugaaaccccgucuccacuucaagaccagccuggccaacaggaucaccugaggucaggaa

SEQ ID NO: 327908 - RNA, 62 nt, Homo Sapiens
uuaucagaagugagcuaccacaccgcacccggcuggccaauccugggauuacaggugugagc

SEQ ID NO: 327909 - RNA, 62 nt, Homo Sapiens
uggugaaaccccaucucuacuucgagaccacccuggccaacaagaucaccugaggucaggag

SEQ ID NO: 327910 - RNA, 62 nt, Homo Sapiens
uggugaaaccuggccucuacuuugagaccagccuggccaacaggaucaccugagguuagaag

SEQ ID NO: 327911 - RNA, 62 nt, Homo Sapiens
uggugaaaccccaucucuacuucgagauuagucuggccaacaggaucaccugaggucaggag

SEQ ID NO: 327912 - RNA, 62 nt, Homo Sapiens
uuuccuucuguaucacuccaaggauuuucuuucuggccaagaugcuacuucagaagccuuau

SEQ ID NO: 327913 - RNA, 62 nt, Homo Sapiens
acggaucacgaggucaggagaucaagaccauccuggccaacauggugaaaccccaucucuac

SEQ ID NO: 327914 - RNA, 62 nt, Homo Sapiens
ggaucucuugaggucgggaguuugagaccagccuggccaacauggugaaacccugucuuuac

SEQ ID NO: 327915 - RNA, 62 nt, Homo Sapiens
uggugaaaccccgucucuaaaucgagaccauccuggccaacaggggaucacgaggucaagag

SEQ ID NO: 327916 - RNA, 62 nt, Homo Sapiens
ccccuccuguggggugcccacugcaucccaaccuggccaaggacccuccugccuguuuuucu

SEQ ID NO: 327917 - RNA, 62 nt, Homo Sapiens
agugcugggauuacagacaugagccaccgagccuggccaauuuuuguguuuuuuguagagac

SEQ ID NO: 327918 - RNA, 62 nt, Homo Sapiens
gcagaucacgaggucaagagaucaagaccauccuggccaacauggugaaauccugccucuac

SEQ ID NO: 327919 - RNA, 62 nt, Homo Sapiens
agggcugagauuacaggugugagcuaccucaccuggccaaaacaguuuuuuuagaaaugaag

SEQ ID NO: 327920 - RNA, 62 nt, Homo Sapiens
ugaugaccuucugaagugucacugcggagacucuggccaagcgugcuuggcuuuccaaggau

SEQ ID NO: 327921 - RNA, 62 nt, Homo Sapiens
cucugaccaugcuuaguacuaaucaucuucuccuggccaaggcagaaagccaucaggugcuc

SEQ ID NO: 327922 - RNA, 62 nt, Homo Sapiens
ggaccacaugaggucaggaguuugagaucagccuggccaacauggugaaaccccaucucuac

SEQ ID NO: 327923 - RNA, 62 nt, Homo Sapiens
gcggaucaugaggucaagagaucaagaucauccuggccaacauggugaaacccugucucuac

SEQ ID NO: 327924 - RNA, 62 nt, Homo Sapiens
uggugaaaccccgucucuacaucgagaccauccuggccaacagcggaucacaagguccagag

SEQ ID NO: 327925 - RNA, 62 nt, Homo Sapiens
uggcaaaaucccaucucuacuucaagaccagccuggccaacaggaucacuugaggccaggag

SEQ ID NO: 327926 - RNA, 62 nt, Homo Sapiens
ucuuuugaauauuuuuuauuaagccaccacuccuggccaacuguaguugaacucagguauug

SEQ ID NO: 327927 - RNA, 62 nt, Homo Sapiens
ggaucacuugaggucaggaguucaaaaccagccuggccaagauggugaaaccccaucucuac

SEQ ID NO: 327928 - RNA, 62 nt, Homo Sapiens
ggaucaccugaggacaggaguucgagaccagucuggccaacauggggaaaccccgucucuac

SEQ ID NO: 327929 - RNA, 62 nt, Homo Sapiens
agaucaccugaggucaggaguuugagaccagccuggccaauguggugaaaccccaucucuac

SEQ ID NO: 327930 - RNA, 62 nt, Homo Sapiens
aaaacacuugagaagacaucuauuggccaucucuggccaauuacacuaagaaacauaucaag

SEQ ID NO: 327931 - RNA, 62 nt, Homo Sapiens
gccuagacgguucucuuggucuuauucccauccuggccaaugcuuaaauacuauuuguugaa

SEQ ID NO: 327932 - RNA, 62 nt, Homo Sapiens
uggugaaaccccaucucuacuuugagaccagccuggccaacaaaaucaccugaggucaagag

SEQ ID NO: 327933 - RNA, 62 nt, Homo Sapiens
uggugaaacgcugucucuacuucgagaccagccuggccaacgggauugcuugaggccaggag

SEQ ID NO: 327934 - RNA, 62 nt, Homo Sapiens
aagggaaaggaaauuaguaugaagacgacagccuggccaaccggucucuauuagucaguaau

SEQ ID NO: 327935 - RNA, 62 nt, Homo Sapiens
augggcuggaggucauucagcggccuggggcucuggccaagguggacucgcccagcucuccu

SEQ ID NO: 327936 - RNA, 62 nt, Homo Sapiens
gcacuuugggaggccaggaguucgagaccagccuggccaacauggugaaacccggucucuac

SEQ ID NO: 327937 - RNA, 62 nt, Homo Sapiens
ggaucaccugaggucaggaguuugagaccagccuggccaacauggcaaaaccccgucucuac

SEQ ID NO: 327938 - RNA, 62 nt, Homo Sapiens
cggugaaaccccaucucuaccucgagaccagccuggccaacaggaucacuugaggucaggag

SEQ ID NO: 327939 - RNA, 62 nt, Homo Sapiens
uggugaaaccccaucucuaccucaagaccagccuggccaacaggaucacuugaggucaggag

SEQ ID NO: 327940 - RNA, 62 nt, Homo Sapiens
aguuguuaaaagcuaacagccuauccaaauaacuggccaacucucaguucuugucagugaag

SEQ ID NO: 327941 - RNA, 62 nt, Homo Sapiens
cgguaauacgugaaagcaaaauaugaaagagucuggccaaaagugcuauuuuguaguuuguu

SEQ ID NO: 327942 - RNA, 62 nt, Homo Sapiens
ggaucaccugagaucaggaguuccagaccagccuggccaacauggcgaaaccccaucucuac

SEQ ID NO: 327943 - RNA, 62 nt, Homo Sapiens
gcggaucacaaggucaggaguucgagaccagccuggccaauauggugaaaccccaucucuac

SEQ ID NO: 327944 - RNA, 62 nt, Homo Sapiens
aggccugccaggucuucacguugaggauucaacuggccaaucacaggacagguguccuggcc

SEQ ID NO: 327945 - RNA, 62 nt, Homo Sapiens
ggaucaccugaagucagguguuugagaccagccuggccaacaugguggaacccaaucucuac

SEQ ID NO: 327946 - RNA, 62 nt, Homo Sapiens
acugcuaauaauucuguaaggacacaucaaagcuggccaaaauaaugaauuuuuuuuaaaaa

SEQ ID NO: 327947 - RNA, 62 nt, Homo Sapiens
ggccaagaccaugggaaaaaaagccaugcucacuggccaauaaagagcuugaugcugccugg

SEQ ID NO: 327948 - RNA, 62 nt, Homo Sapiens
ugcucacuggccaauaaagagcuugaugcugccuggccaaaugaggugacucagauagaauc

SEQ ID NO: 327949 - RNA, 62 nt, Homo Sapiens
uagugaaaccccgucucuauuuugagaccagccuggccaacaggaucacucaaggucaggca

SEQ ID NO: 327950 - RNA, 62 nt, Homo Sapiens
uggcaaaaccccgucucuacuugcagaccagccuggccaacaagaucaccugaggcuaggag

SEQ ID NO: 327951 - RNA, 62 nt, Homo Sapiens
ggaucaccugaggucaggaguucaagaccagccuggccaacauggugaaaccccaucucuac

SEQ ID NO: 327952 - RNA, 62 nt, Homo Sapiens
gcaugcagcuuguggugaguacuguucuaggacuggccaaaaaugggcaaaauguaucacuc

SEQ ID NO: 327953 - RNA, 62 nt, Homo Sapiens
cagcagcccugucuguuaccaugugagucauacuggccaaagcuuaguccuagcauaugcac

SEQ ID NO: 327954 - RNA, 62 nt, Homo Sapiens
agcuuaguccuagcauaugcaccugagccaaccuggccaaucagauuguuuugucaauaauu

SEQ ID NO: 327955 - RNA, 62 nt, Homo Sapiens
uggugaaaccccaucucuacuucaagaccagccuggccaacacgaucacuugaggucaggag

SEQ ID NO: 327956 - RNA, 62 nt, Homo Sapiens
ugaugagaccuccgucucuauucaagaccagccuggccaacaggaucacuugaggccaggag

SEQ ID NO: 327957 - RNA, 62 nt, Homo Sapiens
uggugaaaccccaucucuacuuugagaccacccuggccaacaagguggguggaucacuggag

SEQ ID NO: 327958 - RNA, 62 nt, Homo Sapiens
uagugaaaccccaucucuacuucgagaccagccuggccaacagcggaucacgaggucaggag

SEQ ID NO: 327959 - RNA, 62 nt, Homo Sapiens
aacacuucucagggccucuugagccacagcaccuggccaaccaguguugggauuacaggugu

SEQ ID NO: 327960 - RNA, 62 nt, Homo Sapiens
cacauuuuucuuucuauuaugagccaccaugccuggccaacuguagcugggacuacaggcau

SEQ ID NO: 327961 - RNA, 62 nt, Homo Sapiens
cccagcagcaccugcacccacuuccagcugcucuggccaaaaucuccgcucggccaggcccc

SEQ ID NO: 327962 - RNA, 62 nt, Homo Sapiens
acaucaccugaguucaggaguucaagaccagccuggccaacauggugaaaucccgucucuac

SEQ ID NO: 327963 - RNA, 62 nt, Homo Sapiens
uggugaaaccccaucucuacuucaagaccagccuggccaacaagaucacuugaggucaggag

SEQ ID NO: 327964 - RNA, 62 nt, Homo Sapiens
uagcaaaaccucaucucuacuugagaacuggccuggccaacagaucacuugagguuaggagu

SEQ ID NO: 327965 - RNA, 62 nt, Homo Sapiens
uggugaaaccccgucucuacuucgagaccauccuggccaacagcagaucacgaggucaggag

SEQ ID NO: 327966 - RNA, 62 nt, Homo Sapiens
aggcaaaaccccgucucuacuuagagaccagccuggccaacaggauugcuugaggccaggag

SEQ ID NO: 327967 - RNA, 62 nt, Homo Sapiens
aacauggugaaaccucguguuucgagaccagccuggccaaccgcucacgcugaggucaggag

SEQ ID NO: 327968 - RNA, 62 nt, Homo Sapiens
uggcgaaaccccgucucuacaucgagaccagccuggccaacaagaucagcugaggucaggag

SEQ ID NO: 327969 - RNA, 64 nt, Homo Sapiens
gacggauucaaauguuuucauguaacuauguaaaaagcucuaagcucuagagucuagauccagu

SEQ ID NO: 327970 - RNA, 64 nt, Homo Sapiens
ucaaauguuuucauguaacuauguaaaaagcucuaagcucuagagucuagauccagucacugac

SEQ ID NO: 327971 - RNA, 64 nt, Homo Sapiens
agaagcguaaaaagugaguugaaaaacuaauaaaaacuaauaaacuguuauuucugauacuuuu

SEQ ID NO: 327972 - RNA, 64 nt, Homo Sapiens
aacuaauaaaagaagcguaaugauacuuuugaaaaacuaauaaaucccaacauucuguuauuuc

SEQ ID NO: 327973 - RNA, 64 nt, Homo Sapiens
augguuuaaauguuuuauuauccauaaugaucuaaacuaauaagauucaccaaaaaguaaaaau

SEQ ID NO: 327974 - RNA, 64 nt, Homo Sapiens
ugaguuuaauagcauaacauuaccaagguaaucaaacuaauaaaauuccauauaucuucccugc

SEQ ID NO: 327975 - RNA, 64 nt, Homo Sapiens
acaaaucagaagaaaaagcaagcauuauaaacaaaacuaauaacuguuuuacugcuuuaagaaa

SEQ ID NO: 327976 - RNA, 64 nt, Homo Sapiens
agcugagacauuuuaagaucucaaguuuuuauuuaacuaauacucaaaauauggacuuuucaug

SEQ ID NO: 327977 - RNA, 64 nt, Homo Sapiens
uuacauuaaguuuagcacuguaucagaaugaagaaacuaauauuuuacauaaaaacuaauacuu

SEQ ID NO: 327978 - RNA, 64 nt, Homo Sapiens
guaucagaaugaagaaacuaauauuuuacauaaaaacuaauacuuucaauuuuuuauauaguaa

SEQ ID NO: 327979 - RNA, 64 nt, Homo Sapiens
uguuucaguauuuugucugaauaguuuguuuuuaaacuaauauuuacgguaugaagucuucugu

SEQ ID NO: 327980 - RNA, 64 nt, Homo Sapiens
gcuuagaugaacaugguguuauaacacauuuuuuaacuaauaagacuaguuuauuugccuugcc

SEQ ID NO: 327981 - RNA, 64 nt, Homo Sapiens
ucauuuucaccagcauaauuuuaucuuaaggaauaacuaauaggaaaagucagcuuaauuauuu

SEQ ID NO: 327982 - RNA, 64 nt, Homo Sapiens
auauucgauagaaaugaaaaucugccguggaauuaacuaauaaguaguaacaauaaacuucaua

SEQ ID NO: 327983 - RNA, 64 nt, Homo Sapiens
ggaauucuuuccaaagcaauucucaucuucuauaaacuaauacaacccauuucgucaagugacc

SEQ ID NO: 327984 - RNA, 64 nt, Homo Sapiens
uuuuuccauguaucaagauuggcacuuuaaggagaacuaauaacaauuaagucuuuaaaauuua

SEQ ID NO: 327985 - RNA, 64 nt, Homo Sapiens
uacacauucuuuucuuaaacuuuaccuguguuuuaacuaauauugugucaguguauuaaaaauu

SEQ ID NO: 327986 - RNA, 64 nt, Homo Sapiens
augguagcaguuacaaagagccucugccuucccaaacuaauauuuaucacacauggucauuaaa

SEQ ID NO: 327987 - RNA, 64 nt, Homo Sapiens; identical to SEQ ID NO: 327985

SEQ ID NO: 327988 - RNA, 64 nt, Homo Sapiens; identical to SEQ ID NO: 327986

SEQ ID NO: 327989 - RNA, 64 nt, Homo Sapiens; identical to SEQ ID NO: 160506

SEQ ID NO: 327990 - RNA, 64 nt, Homo Sapiens; identical to SEQ ID NO: 160507

SEQ ID NO: 327991 - RNA, 64 nt, Homo Sapiens; identical to SEQ ID NO: 160508

SEQ ID NO: 327992 - RNA, 64 nt, Homo Sapiens; identical to SEQ ID NO: 160509

SEQ ID NO: 327993 - RNA, 64 nt, Homo Sapiens; identical to SEQ ID NO: 160510

SEQ ID NO: 327994 - RNA, 64 nt, Homo Sapiens; identical to SEQ ID NO: 160511

SEQ ID NO: 327995 - RNA, 64 nt, Homo Sapiens; identical to SEQ ID NO: 160512

SEQ ID NO: 327996 - RNA, 64 nt, Homo Sapiens; identical to SEQ ID NO: 160513

SEQ ID NO: 327997 - RNA, 64 nt, Homo Sapiens; identical to SEQ ID NO: 160514

SEQ ID NO: 327998 - RNA, 64 nt, Homo Sapiens; identical to SEQ ID NO: 160515

SEQ ID NO: 327999 - RNA, 64 nt, Homo Sapiens; identical to SEQ ID NO: 160516

SEQ ID NO: 328000 - RNA, 64 nt, Homo Sapiens; identical to SEQ ID NO: 160517

SEQ ID NO: 328001 - RNA, 64 nt, Homo Sapiens
uguacgcuagagcaugcugccugaguauuacuaguggacguaggauauuuucccuaccuaagaa

SEQ ID NO: 328002 - RNA, 64 nt, Homo Sapiens
gagauaaauaaaagauagcaauaugagacacagguggacguagaguuggccuuuuuacaggcaa

SEQ ID NO: 328003 - RNA, 64 nt, Homo Sapiens; identical to SEQ ID NO: 246823

SEQ ID NO: 328004 - RNA, 64 nt, Homo Sapiens; identical to SEQ ID NO: 246824

SEQ ID NO: 328005 - RNA, 64 nt, Homo Sapiens; identical to SEQ ID NO: 246825

SEQ ID NO: 328006 - RNA, 64 nt, Homo Sapiens; identical to SEQ ID NO: 246826

SEQ ID NO: 328007 - RNA, 64 nt, Homo Sapiens; identical to SEQ ID NO: 246827

SEQ ID NO: 328008 - RNA, 64 nt, Homo Sapiens; identical to SEQ ID NO: 246828

SEQ ID NO: 328009 - RNA, 64 nt, Homo Sapiens; identical to SEQ ID NO: 246829

SEQ ID NO: 328010 - RNA, 50 nt, Homo Sapiens; identical to SEQ ID NO: 246830

SEQ ID NO: 328011 - RNA, 64 nt, Homo Sapiens; identical to SEQ ID NO: 246831

SEQ ID NO: 328012 - RNA, 64 nt, Homo Sapiens; identical to SEQ ID NO: 246832

SEQ ID NO: 328013 - RNA, 64 nt, Homo Sapiens; identical to SEQ ID NO: 246833

SEQ ID NO: 328014 - RNA, 64 nt, Homo Sapiens; identical to SEQ ID NO: 246834

SEQ ID NO: 328015 - RNA, 64 nt, Homo Sapiens; identical to SEQ ID NO: 246835

SEQ ID NO: 328016 - RNA, 64 nt, Homo Sapiens; identical to SEQ ID NO: 246836

SEQ ID NO: 328017 - RNA, 64 nt, Homo Sapiens; identical to SEQ ID NO: 246837

SEQ ID NO: 328018 - RNA, 64 nt, Homo Sapiens; identical to SEQ ID NO: 246838

SEQ ID NO: 328019 - RNA, 64 nt, Homo Sapiens; identical to SEQ ID NO: 246839

SEQ ID NO: 328020 - RNA, 64 nt, Homo Sapiens; identical to SEQ ID NO: 246840

SEQ ID NO: 328021 - RNA, 64 nt, Homo Sapiens; identical to SEQ ID NO: 246841

SEQ ID NO: 328022 - RNA, 64 nt, Homo Sapiens; identical to SEQ ID NO: 246842

SEQ ID NO: 328023 - RNA, 64 nt, Homo Sapiens; identical to SEQ ID NO: 246843

SEQ ID NO: 328024 - RNA, 64 nt, Homo Sapiens; identical to SEQ ID NO: 246844

SEQ ID NO: 328025 - RNA, 64 nt, Homo Sapiens; identical to SEQ ID NO: 246845

SEQ ID NO: 328026 - RNA, 64 nt, Homo Sapiens; identical to SEQ ID NO: 246846

SEQ ID NO: 328027 - RNA, 64 nt, Homo Sapiens; identical to SEQ ID NO: 246847

SEQ ID NO: 328028 - RNA, 64 nt, Homo Sapiens; identical to SEQ ID NO: 246848

SEQ ID NO: 328029 - RNA, 64 nt, Homo Sapiens; identical to SEQ ID NO: 246849

SEQ ID NO: 328030 - RNA, 64 nt, Homo Sapiens; identical to SEQ ID NO: 246850

SEQ ID NO: 328031 - RNA, 64 nt, Homo Sapiens; identical to SEQ ID NO: 246851

SEQ ID NO: 328032 - RNA, 64 nt, Homo Sapiens; identical to SEQ ID NO: 246852

SEQ ID NO: 328033 - RNA, 64 nt, Homo Sapiens; identical to SEQ ID NO: 246853

SEQ ID NO: 328034 - RNA, 64 nt, Homo Sapiens; identical to SEQ ID NO: 246854

SEQ ID NO: 328035 - RNA, 64 nt, Homo Sapiens; identical to SEQ ID NO: 246855

SEQ ID NO: 328036 - RNA, 64 nt, Homo Sapiens; identical to SEQ ID NO: 246856

SEQ ID NO: 328037 - RNA, 64 nt, Homo Sapiens; identical to SEQ ID NO: 246857

SEQ ID NO: 328038 - RNA, 64 nt, Homo Sapiens; identical to SEQ ID NO: 246858

SEQ ID NO: 328039 - RNA, 64 nt, Homo Sapiens; identical to SEQ ID NO: 246859

SEQ ID NO: 328040 - RNA, 64 nt, Homo Sapiens; identical to SEQ ID NO: 246860

SEQ ID NO: 328041 - RNA, 64 nt, Homo Sapiens; identical to SEQ ID NO: 246861

SEQ ID NO: 328042 - RNA, 64 nt, Homo Sapiens; identical to SEQ ID NO: 246862

SEQ ID NO: 328043 - RNA, 64 nt, Homo Sapiens; identical to SEQ ID NO: 246863

SEQ ID NO: 328044 - RNA, 64 nt, Homo Sapiens; identical to SEQ ID NO: 246864

SEQ ID NO: 328045 - RNA, 64 nt, Homo Sapiens; identical to SEQ ID NO: 246865

SEQ ID NO: 328046 - RNA, 64 nt, Homo Sapiens; identical to SEQ ID NO: 246866

SEQ ID NO: 328047 - RNA, 64 nt, Homo Sapiens; identical to SEQ ID NO: 246867

SEQ ID NO: 328048 - RNA, 64 nt, Homo Sapiens; identical to SEQ ID NO: 246868

SEQ ID NO: 328049 - RNA, 64 nt, Homo Sapiens; identical to SEQ ID NO: 246869

SEQ ID NO: 328050 - RNA, 64 nt, Homo Sapiens; identical to SEQ ID NO: 246870

SEQ ID NO: 328051 - RNA, 64 nt, Homo Sapiens; identical to SEQ ID NO: 246871

SEQ ID NO: 328052 - RNA, 64 nt, Homo Sapiens; identical to SEQ ID NO: 246872

SEQ ID NO: 328053 - RNA, 64 nt, Homo Sapiens; identical to SEQ ID NO: 246873

SEQ ID NO: 328054 - RNA, 64 nt, Homo Sapiens; identical to SEQ ID NO: 246874

SEQ ID NO: 328055 - RNA, 64 nt, Homo Sapiens; identical to SEQ ID NO: 246875

SEQ ID NO: 328056 - RNA, 64 nt, Homo Sapiens; identical to SEQ ID NO: 246876

SEQ ID NO: 328057 - RNA, 52 nt, Homo Sapiens; identical to SEQ ID NO: 246877

SEQ ID NO: 328058 - RNA, 64 nt, Homo Sapiens; identical to SEQ ID NO: 246878

SEQ ID NO: 328059 - RNA, 64 nt, Homo Sapiens; identical to SEQ ID NO: 246879

SEQ ID NO: 328060 - RNA, 64 nt, Homo Sapiens; identical to SEQ ID NO: 246880

SEQ ID NO: 328061 - RNA, 64 nt, Homo Sapiens; identical to SEQ ID NO: 246881

SEQ ID NO: 328062 - RNA, 64 nt, Homo Sapiens; identical to SEQ ID NO: 246882

SEQ ID NO: 328063 - RNA, 64 nt, Homo Sapiens; identical to SEQ ID NO: 246883

SEQ ID NO: 328064 - RNA, 64 nt, Homo Sapiens; identical to SEQ ID NO: 246884

SEQ ID NO: 328065 - RNA, 64 nt, Homo Sapiens; identical to SEQ ID NO: 246885

SEQ ID NO: 328066 - RNA, 64 nt, Homo Sapiens; identical to SEQ ID NO: 246886

SEQ ID NO: 328067 - RNA, 64 nt, Homo Sapiens; identical to SEQ ID NO: 246887

SEQ ID NO: 328068 - RNA, 64 nt, Homo Sapiens; identical to SEQ ID NO: 246888

SEQ ID NO: 328069 - RNA, 64 nt, Homo Sapiens; identical to SEQ ID NO: 246889

SEQ ID NO: 328070 - RNA, 64 nt, Homo Sapiens; identical to SEQ ID NO: 246890

SEQ ID NO: 328071 - RNA, 64 nt, Homo Sapiens; identical to SEQ ID NO: 246891

SEQ ID NO: 328072 - RNA, 64 nt, Homo Sapiens; identical to SEQ ID NO: 246892

SEQ ID NO: 328073 - RNA, 64 nt, Homo Sapiens; identical to SEQ ID NO: 246893

SEQ ID NO: 328074 - RNA, 64 nt, Homo Sapiens
gggcagaucacgagaucaggaguucaagaccagccuggccaauaugaugaaaccccgucucuac

SEQ ID NO: 328075 - RNA, 64 nt, Homo Sapiens
guggaucaccugaggucagaaguuugagaccagccuggccaacauggugaaaccccgucucuac

SEQ ID NO: 328076 - RNA, 64 nt, Homo Sapiens
aaagugcugggauuacaggcaugagccaccacgccuggccaaaaaaauauguuuuaaauguccc

SEQ ID NO: 328077 - RNA, 64 nt, Homo Sapiens
guggaucacccaaggucaggaguuugagaccagccuggccaaauggugaaaccccaucucuacg

SEQ ID NO: 328078 - RNA, 64 nt, Homo Sapiens
ugcuccaguaaugcaauaaacaagaggggacagucuggccaacuuuuuuguuuaauaccuuccc

SEQ ID NO: 328079 - RNA, 64 nt, Homo Sapiens
augaggcccucccaacacuuuccuuaccacugaucuggccaagagccuggauagacugccugcg

SEQ ID NO: 328080 - RNA, 64 nt, Homo Sapiens
uggugaaaccccgucuccacaauucaagaccagccuggccaacaguggaucaccugaggucagg

SEQ ID NO: 328081 - RNA, 64 nt, Homo Sapiens
uuaucagaagugagcuaccagccaccgcacccggcuggccaaucugcugggauuacagguguga

SEQ ID NO: 328082 - RNA, 64 nt, Homo Sapiens
uggugaaaccccaucucuacaguucgagaccacccuggccaacaccagaucaccugaggucagg

SEQ ID NO: 328083 - RNA, 64 nt, Homo Sapiens
uggugaaaccuggccucuacaguuugagaccagccuggccaacagcggaucaccugagguuaga

SEQ ID NO: 328084 - RNA, 64 nt, Homo Sapiens
uggugaaaccccaucucuacaguucgagauuagucuggccaacagcggaucaccugaggucagg

SEQ ID NO: 328085 - RNA, 64 nt, Homo Sapiens
uuuccuucuguaucacuccaauaggauuuucuuucuggccaagaagugcuacuucagaagccuu

SEQ ID NO: 328086 - RNA, 64 nt, Homo Sapiens
aaacggaucacgaggucaggagaucaagaccauccuggccaacauggugaaaccccaucucuac

SEQ ID NO: 328087 - RNA, 64 nt, Homo Sapiens
guggaucucuugaggucgggaguuugagaccagccuggccaacauggugaaacccugucuuuac

SEQ ID NO: 328088 - RNA, 64 nt, Homo Sapiens
uggugaaaccccgucucuaaagaucgagaccauccuggccaacaggggggaucacgaggucaag

SEQ ID NO: 328089 - RNA, 64 nt, Homo Sapiens
ccccuccuguggggugcccacucugcaucccaaccuggccaaggacacccuccugccuguuuuu

SEQ ID NO: 328090 - RNA, 64 nt, Homo Sapiens
aaagugcugggauuacagacaugagccaccgagccuggccaauuuuuguguuuuuuguagagac

SEQ ID NO: 328091 - RNA, 64 nt, Homo Sapiens
gggcagaucacgaggucaagagaucaagaccauccuggccaacauggugaaauccugccucuac

SEQ ID NO: 328092 - RNA, 64 nt, Homo Sapiens
aaagggcugagauuacaggugugagcuaccucaccuggccaaaacaguuuuuuuagaaaugaag

SEQ ID NO: 328093 - RNA, 64 nt, Homo Sapiens
ugaugaccuucugaagugucauacugcggagacucuggccaagcgagugcuuggcuuuccaagg

SEQ ID NO: 328094 - RNA, 64 nt, Homo Sapiens
cucugaccaugcuuaguacuucaaucaucuucuccuggccaaggggcagaaagccaucaggugc

SEQ ID NO: 328095 - RNA, 64 nt, Homo Sapiens
guggaccacaugaggucaggaguuugagaucagccuggccaacauggugaaaccccaucucuac

SEQ ID NO: 328096 - RNA, 64 nt, Homo Sapiens
gggcggaucaugaggucaagagaucaagaucauccuggccaacauggugaaacccugucucuac

SEQ ID NO: 328097 - RNA, 64 nt, Homo Sapiens
uggugaaaccccgucucuacagaucgagaccauccuggccaacaaggcggaucacaagguccag

SEQ ID NO: 328098 - RNA, 64 nt, Homo Sapiens
uggcaaaaucccaucucuacaguucaagaccagccuggccaacagcggaucacuugaggccagg

SEQ ID NO: 328099 - RNA, 64 nt, Homo Sapiens
ugucuuuugaauauuuuuuauuaagccaccacuccuggccaacuguaguugaacucagguauug

SEQ ID NO: 328100 - RNA, 64 nt, Homo Sapiens
gcggaucacuugaggucaggaguucaaaaccagccuggccaagauggugaaaccccaucucuac

SEQ ID NO: 328101 - RNA, 64 nt, Homo Sapiens
cuggaucaccugaggacaggaguucgagaccagucuggccaacauggggaaaccccgucucuac

SEQ ID NO: 328102 - RNA, 64 nt, Homo Sapiens
gcagaucaccugaggucaggaguuugagaccagccuggccaauguggugaaaccccaucucuac

SEQ ID NO: 328103 - RNA, 64 nt, Homo Sapiens
caaaaacacuugagaagacaucuauuggccaucucuggccaauuacacuaagaaacauaucaag

SEQ ID NO: 328104 - RNA, 64 nt, Homo Sapiens
cugccuagacgguucucuuggucuuauucccauccuggccaaugcuuaaauacuauuuguugaa

SEQ ID NO: 328105 - RNA, 64 nt, Homo Sapiens
uggugaaaccccaucucuacaguuugagaccagccuggccaacagcaaaucaccugaggucaag

SEQ ID NO: 328106 - RNA, 64 nt, Homo Sapiens
uggugaaacgcugucucuacaguucgagaccagccuggccaacgguggauugcuugaggccagg

SEQ ID NO: 328107 - RNA, 64 nt, Homo Sapiens
aagggaaaggaaauuaguauaugaagacgacagccuggccaaccuuggucucuauuagucagua

SEQ ID NO: 328108 - RNA, 64 nt, Homo Sapiens
augggcuggaggucauucagcucggccuggggcucuggccaaggcauggacucgcccagcucuc

SEQ ID NO: 328109 - RNA, 64 nt, Homo Sapiens
cagcacuuugggaggccaggaguucgagaccagccuggccaacauggugaaacccggucucuac

SEQ ID NO: 328110 - RNA, 64 nt, Homo Sapiens
gcggaucaccugaggucaggaguuugagaccagccuggccaacauggcaaaaccccgucucuac

SEQ ID NO: 328111 - RNA, 64 nt, Homo Sapiens
cggugaaaccccaucucuacagcucgagaccagccuggccaacagcggaucacuugaggucagg

SEQ ID NO: 328112 - RNA, 64 nt, Homo Sapiens
uggugaaaccccaucucuacagcucaagaccagccuggccaacagcggaucacuugaggucagg

SEQ ID NO: 328113 - RNA, 64 nt, Homo Sapiens
aguuguuaaaagcuaacagcagcuauccaaauaacuggccaacuaucucaguucuugucaguga

SEQ ID NO: 328114 - RNA, 64 nt, Homo Sapiens
cgguaauacgugaaagcaaauuauaugaaagagucuggccaaaauggugcuauuuuguaguuug

SEQ ID NO: 328115 - RNA, 64 nt, Homo Sapiens
aaggaucaccugagaucaggaguuccagaccagccuggccaacauggcgaaaccccaucucuac

SEQ ID NO: 328116 - RNA, 64 nt, Homo Sapiens
gggcggaucacaaggucaggaguucgagaccagccuggccaauauggugaaaccccaucucuac

SEQ ID NO: 328117 - RNA, 64 nt, Homo Sapiens
ccaggccugccaggucuucacguugaggauucaacuggccaaucacaggacagguguccuggcc

SEQ ID NO: 328118 - RNA, 64 nt, Homo Sapiens
guggaucaccugaagucagguguuugagaccagccuggccaacaugguggaacccaaucucuac

SEQ ID NO: 328119 - RNA, 64 nt, Homo Sapiens
ucacugcuaauaauucuguaaggacacaucaaagcuggccaaaauaaugaauuuuuuuuaaaaa

SEQ ID NO: 328120 - RNA, 64 nt, Homo Sapiens
caggccaagaccaugggaaaaaaagccaugcucacuggccaauaaagagcuugaugcugccugg

SEQ ID NO: 328121 - RNA, 64 nt, Homo Sapiens
caugcucacuggccaauaaagagcuugaugcugccuggccaaaugaggugacucagauagaauc

SEQ ID NO: 328122 - RNA, 64 nt, Homo Sapiens
uagugaaaccccgucucuaucauuugagaccagccuggccaacaguggaucacucaaggucagg

SEQ ID NO: 328123 - RNA, 64 nt, Homo Sapiens
uggcaaaaccccgucucuacaguugcagaccagccuggccaacagcagaucaccugaggcuagg

SEQ ID NO: 328124 - RNA, 64 nt, Homo Sapiens
gcggaucaccugaggucaggaguucaagaccagccuggccaacauggugaaaccccaucucuac

SEQ ID NO: 328125 - RNA, 64 nt, Homo Sapiens
uggcaugcagcuuguggugaguacuguucuaggacuggccaaaaaugggcaaaauguaucacuc

SEQ ID NO: 328126 - RNA, 64 nt, Homo Sapiens
cccagcagcccugucuguuaccaugugagucauacuggccaaagcuuaguccuagcauaugcac

SEQ ID NO: 328127 - RNA, 64 nt, Homo Sapiens
aaagcuuaguccuagcauaugcaccugagccaaccuggccaaucagauuguuuugucaauaauu

SEQ ID NO: 328128 - RNA, 64 nt, Homo Sapiens
uggugaaaccccaucucuacaguucaagaccagccuggccaacagccgaucacuugaggucagg

SEQ ID NO: 328129 - RNA, 64 nt, Homo Sapiens
ugaugagaccuccgucucuaaguucaagaccagccuggccaacaguggaucacuugaggccagg

SEQ ID NO: 328130 - RNA, 64 nt, Homo Sapiens
uggugaaaccccaucucuacaguuugagaccacccuggccaacaugagguggguggaucacugg

SEQ ID NO: 328131 - RNA, 64 nt, Homo Sapiens
uagugaaaccccaucucuacaguucgagaccagccuggccaacagggcggaucacgaggucagg

SEQ ID NO: 328132 - RNA, 64 nt, Homo Sapiens
aacacuucucagggccucuugugagccacagcaccuggccaaccaaaguguugggauuacaggu

SEQ ID NO: 328133 - RNA, 64 nt, Homo Sapiens
cacauuuuucuuucuauuauaugagccaccaugccuggccaacugaguagcugggacuacaggc

SEQ ID NO: 328134 - RNA, 64 nt, Homo Sapiens
ggcccagcagcaccugcacccacuuccagcugcucuggccaaaaucuccgcucggccaggcccc

SEQ ID NO: 328135 - RNA, 64 nt, Homo Sapiens
gcacaucaccugaguucaggaguucaagaccagccuggccaacauggugaaaucccgucucuac

SEQ ID NO: 328136 - RNA, 64 nt, Homo Sapiens
uggugaaaccccaucucuacaguucaagaccagccuggccaacagcagaucacuugaggucagg

SEQ ID NO: 328137 - RNA, 64 nt, Homo Sapiens
uagcaaaaccucaucucuacguuugagaacuggccuggccaacacagaucacuugagguuagga

SEQ ID NO: 328138 - RNA, 64 nt, Homo Sapiens
uggugaaaccccgucucuacaguucgagaccauccuggccaacaaggcagaucacgaggucagg

SEQ ID NO: 328139 - RNA, 64 nt, Homo Sapiens
aggcaaaaccccgucucuacaguuagagaccagccuggccaacaguggauugcuugaggccagg

SEQ ID NO: 328140 - RNA, 64 nt, Homo Sapiens
aacauggugaaaccucguguaguucgagaccagccuggccaaccuggcucacgcugaggucagg

SEQ ID NO: 328141 - RNA, 64 nt, Homo Sapiens
uggcgaaaccccgucucuacagaucgagaccagccuggccaacagcagaucagcugaggucagg

SEQ ID NO: 328142 - RNA, 64 nt, Homo Sapiens; identical to SEQ ID NO: 193740

SEQ ID NO: 328143 - RNA, 64 nt, Homo Sapiens; identical to SEQ ID NO: 193741

SEQ ID NO: 328144 - RNA, 64 nt, Homo Sapiens; identical to SEQ ID NO: 193742

SEQ ID NO: 328145 - RNA, 64 nt, Homo Sapiens; identical to SEQ ID NO: 193743

SEQ ID NO: 328146 - RNA, 64 nt, Homo Sapiens; identical to SEQ ID NO: 193744

SEQ ID NO: 328147 - RNA, 64 nt, Homo Sapiens; identical to SEQ ID NO: 193745

SEQ ID NO: 328148 - RNA, 61 nt, Homo Sapiens
aauaggacaguaaaucuguguggggcuagaacaaaauuaagacauguuuggcaauauuuca

SEQ ID NO: 328149 - RNA, 61 nt, Homo Sapiens
ucauuguuuuaaguuuuucuucugaguaaaacaaaauuauagaaaacaaaugcaacaaugu

SEQ ID NO: 328150 - RNA, 61 nt, Homo Sapiens
uagcaaaagagccagucauuuuaugaaaaaucaaaauuauaagugauuuuaaaaaccagaa

SEQ ID NO: 328151 - RNA, 61 nt, Homo Sapiens
auuugcucauacagcuugaacguuguauuugcaaaauuaagccuucgauuuuuauaaaugu

SEQ ID NO: 328152 - RNA, 61 nt, Homo Sapiens
uguuuaagugaaguuuugugaaacuguaugccaaaauuaguuucuaauauuguccaguuga

SEQ ID NO: 328153 - RNA, 61 nt, Homo Sapiens
ccgggcaugguggcucacgcggcaagauuaacaaaauuaggugugucaauggcuugaaacu

SEQ ID NO: 328154 - RNA, 61 nt, Homo Sapiens
cauugucuuggaccuccugcaucagccuauucaaaauuaucucucucucuagcuuuccaca

SEQ ID NO: 328155 - RNA, 61 nt, Homo Sapiens
ggagacaugugauuaugaucaggaaacugcacaaaauuauuguuuucagcccccguguuau

SEQ ID NO: 328156 - RNA, 61 nt, Homo Sapiens
gaauaugucaggaaauaaggucacuuuaugucaaaauuauuugaguacuaugggaccuggc

SEQ ID NO: 328157 - RNA, 61 nt, Homo Sapiens
caacaacaacaacaacaacaacaacaaaccacaaaauuauuugaguacugugaaggauuau

SEQ ID NO: 328158 - RNA, 61 nt, Homo Sapiens
auuucauuuuaggcuauuggaugugaacaagcaaaauuaaagggaaaaaaaacccaaaauu

SEQ ID NO: 328159 - RNA, 61 nt, Homo Sapiens
ugaacaagcaaaauuaaaaugaaaaaaaacccaaaauuauggaagucagaacagagaaggg

SEQ ID NO: 328160 - RNA, 61 nt, Homo Sapiens
uugucacuaaacgguuuuguguuagaaccaccaaaauuauagcuuuuaagagcuuccuuug

SEQ ID NO: 328161 - RNA, 61 nt, Homo Sapiens
uuguuauuucuguaggagcaacuucucugaucaaaauuacuuuucuggguaugugcugauu

SEQ ID NO: 328162 - RNA, 61 nt, Homo Sapiens
auuacuuuuaucuuuugucuucauuuguggccaaaauuauguuuacuagaggaaauuuggg

SEQ ID NO: 328163 - RNA, 61 nt, Homo Sapiens
aguaggacagcuaagaaauuaauauuaauaucaaaauuauugauaaucuuaaauuauugau

SEQ ID NO: 328164 - RNA, 61 nt, Homo Sapiens
caggcgugauggugggcgccacuaaaaauaccaaaauuagccauggugaaaccccgucucu

SEQ ID NO: 328165 - RNA, 61 nt, Homo Sapiens
aacaugauuucucuaauuuucugaaauaacacaaaauuaaacaaguguuugaauuugugau

SEQ ID NO: 328166 - RNA, 61 nt, Homo Sapiens
caaugguaaaacaagcauucaagcacuuuuacaaaauuaccaaauucuuaaaaugaagcca

SEQ ID NO: 328167 - RNA, 61 nt, Homo Sapiens
acacggugaaaccccaucucuacuaaaaauacaaaauuagcugggcgugguggccggcgcc

SEQ ID NO: 328168 - RNA, 61 nt, Homo Sapiens
cucacuuaaauuaauuuuugaauuccauggacaaaauuagguaauauuuuauuuaucuucg

SEQ ID NO: 328169 - RNA, 61 nt, Homo Sapiens
uauaaagaauugggaaggauaacauagaccccaaaauuagacuuucaauguuuuuaaugcu

SEQ ID NO: 328170 - RNA, 61 nt, Homo Sapiens
ggccccaugauuucauuuugugcugagcccucaaaauuaugucuguuucguggugggaaau

SEQ ID NO: 328171 - RNA, 61 nt, Homo Sapiens
aaacagugaaaccccgucucuacuaaaaauacaaaauuagccagaugugguggcgcacacc

SEQ ID NO: 328172 - RNA, 61 nt, Homo Sapiens
aaaugaaauguguagguaacuaguuuugggacaaaauuauaaugaaaaugaaacagaucua

SEQ ID NO: 328173 - RNA, 61 nt, Homo Sapiens
aaaauaaacauugucuuggaagaaauuugcacaaaauuaaaccuuaaaugguagaauauuu

SEQ ID NO: 328174 - RNA, 61 nt, Homo Sapiens
cuguagacuguuuuaaauugccaagacugcacaaaauuacagugcuaauguauaugguugc

SEQ ID NO: 328175 - RNA, 61 nt, Homo Sapiens
aaguauuauuaguuaaagauguaaaccuagccaaaauuaccaguuuauuaauaauuaggau

SEQ ID NO: 328176 - RNA, 61 nt, Homo Sapiens
gacuucuguuguaaaauaauccagaacacuucaaaauuauuccuaaaucauuaagauuuuc

SEQ ID NO: 328177 - RNA, 61 nt, Homo Sapiens
uucaaucuuaaaauauaauacaacaaucuugcaaaauuauggugucaguuacacaagcucu

SEQ ID NO: 328178 - RNA, 61 nt, Homo Sapiens
uuuauugaugcuugcugcagauaauuauaaucaaaauuaguucaucaaagaucaccagggc

SEQ ID NO: 328179 - RNA, 61 nt, Homo Sapiens
caguuuucaaaaaaucaagauagaaguuauucaaaauuauacaauuacagauccugauaua

SEQ ID NO: 328180 - RNA, 61 nt, Homo Sapiens
gcuuuuagaaaagggaguuuaaaaaugguaucaaaauuacauauacuacagucaagauaga

SEQ ID NO: 328181 - RNA, 61 nt, Homo Sapiens
auugaauggugcauuguauagauauaaugaacaaaauuauuuguaagauauuugcaguuuu

SEQ ID NO: 328182 - RNA, 61 nt, Homo Sapiens
aagcaaaaguauggagcaagaccuguagugacaaaauuacacaguagugguuaguccacug

SEQ ID NO: 328183 - RNA, 61 nt, Homo Sapiens
caacauacugauaaaaugacuuuguacuccacaaaauuaugacugaaagguuuauuaaaau

SEQ ID NO: 328184 - RNA, 61 nt, Homo Sapiens
ucuauaugacacaaaguaugcauacuguuuccaaaauuauugacaauuuacacacccaaca

SEQ ID NO: 328185 - RNA, 61 nt, Homo Sapiens
uucaaaucaagauguuuaaaacuaucaaauccaaaauuauucgauguuggaauuuagcaga

SEQ ID NO: 328186 - RNA, 61 nt, Homo Sapiens
aaucuaaaguaauuuccauagccuuccaacucaaaauuagcaaaauuauucaaauucucac

SEQ ID NO: 328187 - RNA, 61 nt, Homo Sapiens
caaauucucacgccuuccaaaauacuauuuacaaaauuauuucaguuaucuuaaauauucc

SEQ ID NO: 328188 - RNA, 61 nt, Homo Sapiens
aagcuguauuuggacaacuauaccaaaacaacaaaauuauacuaaucuuuuugccucagaa

SEQ ID NO: 328189 - RNA, 61 nt, Homo Sapiens
uaaucuuuuugccucagaauauacagauucacaaaauuaacagguacuaaggacccaaggc

SEQ ID NO: 328190 - RNA, 61 nt, Homo Sapiens
uggaacucaauguggaacuuuaaacauuuugcaaaauuacauuuagagaaacccaauuuuu

SEQ ID NO: 328191 - RNA, 61 nt, Homo Sapiens
uuucaaaguuuaagaaauauacaaaguaugacaaaauuaucuucauaagaacaugcugcau

SEQ ID NO: 328192 - RNA, 61 nt, Homo Sapiens
caacuuuugucauagauuugauuuauuaaaccaaaauuauacauauuaaaauuauaucaca

SEQ ID NO: 328193 - RNA, 61 nt, Homo Sapiens
ucaguccauuccgcaaacucuugugaucuuccaaaauuagcucugauuagcuuucacuucc

SEQ ID NO: 328194 - RNA, 61 nt, Homo Sapiens
ugcuugguacuuagucuguguccaugugauccaaaauuaccuuccuauugcauuuccuacu

SEQ ID NO: 328195 - RNA, 61 nt, Homo Sapiens
uaaauauuucucuuaccuuaucguucuugugcaaaauuaaaugaauuuguucaguauaagc

SEQ ID NO: 328196 - RNA, 61 nt, Homo Sapiens
ccucaagucugccucuacugaauuacuggggcaaaauuagaugacaaaaucacaaaaggaa

SEQ ID NO: 328197 - RNA, 61 nt, Homo Sapiens
caguauagaucucagcccaccaaugccaagacaaaauuauuuuucuuauacuuauuuuuua

SEQ ID NO: 328198 - RNA, 61 nt, Homo Sapiens
uuacuugcauaucuguucaaaacacuuuuaacaaaauuaauucauuaaaguccaguuguug

SEQ ID NO: 328199 - RNA, 61 nt, Homo Sapiens
ccaaaugcaauuugauugacugcccauucaccaaaauuauccugaacucuucugcaaaaau

SEQ ID NO: 328200 - RNA, 61 nt, Homo Sapiens
uuuuuucauagagauuugucuaauugcaucucaaaauuauucugcccuccuuaauuuggga

SEQ ID NO: 328201 - RNA, 61 nt, Homo Sapiens
uggcauguucaaagccacauuauuucuaguccaaaauuacaaguaaucaagggucauuaug

SEQ ID NO: 328202 - RNA, 61 nt, Homo Sapiens
accuuuuuguuuggggcaccaaaucugaagacaaaauuaauuugcaccaguaaacuucaag

SEQ ID NO: 328203 - RNA, 61 nt, Homo Sapiens
uaauaguauacuugccauuugagccucacugcaaaauuagugcagaggagaaaacaauuuu

SEQ ID NO: 328204 - RNA, 61 nt, Homo Sapiens
uagcuuuaaaauaauuuuuuaguaauuauuacaaaauuaaggaaaaucucuauuaccguua

SEQ ID NO: 328205 - RNA, 61 nt, Homo Sapiens
uuugguaaagcaaauuucacaggaaaauagacaaaauuauaagagauuccuggagacaaca

SEQ ID NO: 328206 - RNA, 61 nt, Homo Sapiens
uuguuuaauuuuauguaugaaauacacuguucaaaauuaaauuaagaauuugauguauuuc

SEQ ID NO: 328207 - RNA, 61 nt, Homo Sapiens
uuuucauauccaugaucuugcuuuaguacuucaaaauuaccuuugucuguuuuacucuagu

SEQ ID NO: 328208 - RNA, 61 nt, Homo Sapiens
uuggguaacuuuugauaacugcauucaacgucaaaauuaccuuuuuuuauuguuuaaagcu

SEQ ID NO: 328209 - RNA, 61 nt, Homo Sapiens
guugccaacuuaauuuugugacacuacaucucaaaauuaauccaaaaguuugcucagcauc

SEQ ID NO: 328210 - RNA, 61 nt, Homo Sapiens
caggcaugguggugcaugccuauuaaagauacaaaauuagcacacugagaaaccccaucuc

SEQ ID NO: 328211 - RNA, 61 nt, Homo Sapiens
gacuauguagaaaugaaugaaaaaucaaaaccaaaauuauaauuucaauaauaaaauguuu

SEQ ID NO: 328212 - RNA, 61 nt, Homo Sapiens
uguuguugaagcagucauaaacuagaaucaucaaaauuauucuacauauaugaauuguaaa

SEQ ID NO: 328213 - RNA, 61 nt, Homo Sapiens
auuuuugugauguuuugcuaaaauuaagagacaaaauuaucaugagauguaugaggauuug

SEQ ID NO: 328214 - RNA, 61 nt, Homo Sapiens
ggauuuuuuuuucuucuuuuuguauaaaaaccaaaauuauauuucuuuuuuaguaaaaacc

SEQ ID NO: 328215 - RNA, 61 nt, Homo Sapiens
ggauuuuuuucuuuuuuaguuauaugaaaaccaaaauuauauuucuuuuuuaguaaaaacc

SEQ ID NO: 328216 - RNA, 61 nt, Homo Sapiens
ggauuuuuucuuuuuuaguauauauaaaaaccaaaauuauauuucuuuuuuaguaaaaacc

SEQ ID NO: 328217 - RNA, 61 nt, Homo Sapiens
ggauuuuuuucuuuuuuagugguaucaaaaccaaaauuauauuucuuuuuuaguaaaaacc

SEQ ID NO: 328218 - RNA, 61 nt, Homo Sapiens
ggauuuuuucuuuuuuaguauauauaaaaaccaaaauuauagccacuggugaguaaaaacc

SEQ ID NO: 328219 - RNA, 61 nt, Homo Sapiens
uacuccccaaagcagagauagauugauuuaucaaaauuauuaucuggccaacagugugacu

SEQ ID NO: 328220 - RNA, 61 nt, Homo Sapiens
auauacaacuuucaccauauauauaagccugcaaaauuagaguagugaaagucaugcuagu

SEQ ID NO: 328221 - RNA, 61 nt, Homo Sapiens
cuaugacccauuuaauuucuauuguguuucacaaaauuaaguguuguucauuauacucucu

SEQ ID NO: 328222 - RNA, 61 nt, Homo Sapiens
cuuaaccuaggcuucagggagcauaugaaaccaaaauuauauggaacauuuucugugugua

SEQ ID NO: 328223 - RNA, 61 nt, Homo Sapiens
ugaauuguguuguuuucuuggucggggcaaacaaaauuaugauuaacugcuuaaauguuuu

SEQ ID NO: 328224 - RNA, 61 nt, Homo Sapiens
ugcuuaaauguuuugucgggacaaaacaaaacaaaauuaacguucuucaaaaacaaacaaa

SEQ ID NO: 328225 - RNA, 64 nt, Homo Sapiens
ucccuuccuuauuuuaagcauugugaguaaaucagauguugaauucuuuugccaagggaauuau

SEQ ID NO: 328226 - RNA, 64 nt, Homo Sapiens
ccuugauuggggaauuaaaagucauuuaacugaagauguugagaaaccugggcucugguuuuag

SEQ ID NO: 328227 - RNA, 64 nt, Homo Sapiens
accagcuuucaagaaaaagcccuaucuaguacuugauguugauguuuuuauuuugcugagcaaa

SEQ ID NO: 328228 - RNA, 64 nt, Homo Sapiens
aacuacaguucaccuuuccaaauuugguccuauggauguugagcauagggaagcaacucucagu

SEQ ID NO: 328229 - RNA, 64 nt, Homo Sapiens
ccccagggggugcccccaggcugaucucauuucugauguugagggcuguuuggcucugucugua

SEQ ID NO: 328230 - RNA, 64 nt, Homo Sapiens
guggccuccagacguagccauuuccugacaucaagauguugaauguaaucuggucugagcuggg

SEQ ID NO: 328231 - RNA, 64 nt, Homo Sapiens
cuguuauucacaaagacuccaugaccccugauaagauguugaaagcucaucugcuuuguguaac

SEQ ID NO: 328232 - RNA, 64 nt, Homo Sapiens
uggugucugggaguucccgacuuuccaccagauggauguugacugccucacgcaccaucccccu

SEQ ID NO: 328233 - RNA, 64 nt, Homo Sapiens
gaaugagaaucaugaacuuuugguagcaaacagugauguugauggcuggacaacuaagaagcua

SEQ ID NO: 328234 - RNA, 64 nt, Homo Sapiens
gcaccugcagcaaucugguccagcucuucccagugauguugagacauuuuuuuccuuuggcugg

SEQ ID NO: 328235 - RNA, 64 nt, Homo Sapiens
gugaugcacaggacagguguaguugggacaagaugauguugaaauaaauggaaaacuuauuuua

SEQ ID NO: 328236 - RNA, 64 nt, Homo Sapiens
uuugugaaaugcuuuuucucuuccaugaugacuggauguugaaucuuucuauuuuguuuaggau

SEQ ID NO: 328237 - RNA, 64 nt, Homo Sapiens
cuuaccugugauuuugcaugaacagauauauaaagauguugacuaaaguuuauuauaaaauaua

SEQ ID NO: 328238 - RNA, 64 nt, Homo Sapiens
caugucuuugggaaacacauaaaauaacuuuucugauguugaugaugcaaauuaaaaugcaggg

SEQ ID NO: 328239 - RNA, 64 nt, Homo Sapiens
uaguaauggcggaaacugucuuuaaugaauaaaguuuaaucaaucacaaauaaaacagugaagu

SEQ ID NO: 328240 - RNA, 64 nt, Homo Sapiens
aguggaaauuuuuauucuucauggaaguauuuuuuuuaaucaucaauuauuagcugcugauauu

SEQ ID NO: 328241 - RNA, 64 nt, Homo Sapiens
cauaacuugaaggaaaaguuuaaagacaguucaauuuaaucaucagaaugcauucuuuuuuuuu

SEQ ID NO: 328242 - RNA, 64 nt, Homo Sapiens
cauuauuccuauuuuggaauaaaaacugaccuucuuuaaucauauacuugucuuuuguaaauag

SEQ ID NO: 328243 - RNA, 64 nt, Homo Sapiens
augcuuuugauucugaaaauugggggaaaaaacuuuuaaucacaauuuucuucaauacaagggg

SEQ ID NO: 328244 - RNA, 64 nt, Homo Sapiens
cuuuuaagauacgaguuuuguguaauuugguauuuuuaaucauuuauguuauuuuaaaagcuca

SEQ ID NO: 328245 - RNA, 64 nt, Homo Sapiens
ggugguggggcuuucuuacuaauacacaaauaaauuuaaucauuucaaaggcauucuauuuggu

SEQ ID NO: 328246 - RNA, 64 nt, Homo Sapiens
auucuauuuuauuauuuuuacuguuauguauguuuuuaaucauauuucuuaggaaguauaggcu

SEQ ID NO: 328247 - RNA, 64 nt, Homo Sapiens
gucugaaaaccuuugaauagaauggcaugaagauuuuaaucaauuacuuauaaacaaagucuua

SEQ ID NO: 328248 - RNA, 64 nt, Homo Sapiens
ugccagaaucucaggugccugcuuagaguauuucuuuaaucacagucacugggaaguaaggaga

SEQ ID NO: 328249 - RNA, 64 nt, Homo Sapiens
gaaaucauauacauuagaaaaucacagucagauguuuaaucaauccaaaauguccacuauuucu

SEQ ID NO: 328250 - RNA, 64 nt, Homo Sapiens
uuagucuacauguuucuaaacauauaaaugugaauuuaaucaauuccuuucauaguuuuauaau

SEQ ID NO: 328251 - RNA, 64 nt, Homo Sapiens
uucuuccccaaggauuucaagaugaauugaaauuuuuaaucaagauagugugcuuuauucuguu

SEQ ID NO: 328252 - RNA, 64 nt, Homo Sapiens
uuuuuuuuuuuuaaagaaaaaaagguagugaauuuuuaaucaucuggacuuuaagaaggauucu

SEQ ID NO: 328253 - RNA, 64 nt, Homo Sapiens
auuccacuucaauugauagacccaaaaaauauaauuuaaucaaaguucuagaguuuuuguuugu

SEQ ID NO: 328254 - RNA, 64 nt, Homo Sapiens
ugucuuucagcuccagaauuauuguuacucauauuuuaaucaguaagucauuuaagcuaugaca

SEQ ID NO: 328255 - RNA, 64 nt, Homo Sapiens
aagagaaaauuaguagcauuuaaaagauuuuuuuuuuaaucaugccagucaccccaaauauggu

SEQ ID NO: 328256 - RNA, 64 nt, Homo Sapiens
agauuuauacuagcuauaugaacaaaacuauuuuuuuaaucaucgaaccaaguguuuuuaagga

SEQ ID NO: 328257 - RNA, 64 nt, Homo Sapiens
uauuguaguccugucauuuaaguuauguaaaaaauuuaaucauuauuuugaugcuuuaaacauu

SEQ ID NO: 328258 - RNA, 64 nt, Homo Sapiens
gaucugaggucucaagcuaggagagacugagaauuuuaaucaguuugggcauauaguuuggacu

SEQ ID NO: 328259 - RNA, 64 nt, Homo Sapiens
aauguacaugcuucaugucaugucuuuaaaauaauuuaaucaacuuuauugucuuaguauuuag

SEQ ID NO: 328260 - RNA, 64 nt, Homo Sapiens
aauggauucuuuuauaaguuauuaauuuuuaugguuuaaucagucuaauuguuuugacuguuau

SEQ ID NO: 328261 - RNA, 64 nt, Homo Sapiens
ucuuuuaauccuucauuguuucauguaugaaguuuuuaaucacccccuaacccccaaaaaagau

SEQ ID NO: 328262 - RNA, 64 nt, Homo Sapiens
ggagccuccugaaugugaugaauacggcaaagccuuuaaucacaucucagcccuuagcaucgga

SEQ ID NO: 328263 - RNA, 64 nt, Homo Sapiens
agugacacaagcacuuuaauggccuggagggacuuuuaaucagugaagaugcaaucagacaagu

SEQ ID NO: 328264 - RNA, 64 nt, Homo Sapiens
uuugucaguuugguugggcuauagcacacaguuauuuaaucaaacaguaaucuagguguggcug

SEQ ID NO: 328265 - RNA, 64 nt, Homo Sapiens
aguuuguuuuuaaaaaguuuucucuguagaaaauuuuaaucauucauacccuuuaccuuuaggu

SEQ ID NO: 328266 - RNA, 64 nt, Homo Sapiens
auaacauuccaguguauacaaagaaggcaaauucuuuaaucaaauaaagcgcauuauaaaauga

SEQ ID NO: 328267 - RNA, 64 nt, Homo Sapiens
ucucuuuuugugugucuacugugauuuaaguauuuuuaaucaucagccaagcauuguuaguagu

SEQ ID NO: 328268 - RNA, 64 nt, Homo Sapiens
guuggcuucuaggaaauaauuaaauuagugauauuuuaaucagguuuuacuaucugcuaggccc

SEQ ID NO: 328269 - RNA, 64 nt, Homo Sapiens
gaauaaagcauuaaaaaugauaaauguauauucuuuuaaucaauugauguuguaugguuuaugu

SEQ ID NO: 328270 - RNA, 64 nt, Homo Sapiens
auuagcuuuauagaauuauaccuuuugugcuguguuuaaucaguuuucaguagugugaauuaau

SEQ ID NO: 328271 - RNA, 64 nt, Homo Sapiens
acuucuuuuuuucuaguccaacuuguaaauauauuuuaaucauuaaaaugauuuuucacaacua

SEQ ID NO: 328272 - RNA, 64 nt, Homo Sapiens
aaucucuuaauauuuauaaagauuugugaucaaguuuaaucacagugaauuuuauucugagggu

SEQ ID NO: 328273 - RNA, 64 nt, Homo Sapiens
uaguauuguuuuaauagaguuuuaaucauagagcuuuaaucaagucugguaacccggaauauuu

SEQ ID NO: 328274 - RNA, 64 nt, Homo Sapiens
gagcuuuaaucaaguaguauaacccggaauauuuuuuaaucauauuaacgaacuuucuucuggu

SEQ ID NO: 328275 - RNA, 64 nt, Homo Sapiens
gcaguuaagagaaauggaaagguuuuuuucauuuuuuaaucauuuuaaguugcaauauguuuuu

SEQ ID NO: 328276 - RNA, 64 nt, Homo Sapiens
aauuccuuuuagcugacaaccuggaccacuuuaguuuaaucagagguguguauguaacuuauca

SEQ ID NO: 328277 - RNA, 64 nt, Homo Sapiens
cauuuugaccuaaguauauuauguuuuccaucacuuuaaucaauccuuguaggccuccaccauc

SEQ ID NO: 328278 - RNA, 64 nt, Homo Sapiens
cacaacauauucgaauugagggcuacuucaaauguuuaaucacauaugaauauuaucagcaaug

SEQ ID NO: 328279 - RNA, 64 nt, Homo Sapiens
ccuuuauuaaauucagaacaacuacugagcagaauuuaaucaauaaaauguucaguuacuugua

SEQ ID NO: 328280 - RNA, 64 nt, Homo Sapiens
agauucgaaauucugugccaauuauuuaccugauuuuaaucaucggauauaauucuuaacuauc

SEQ ID NO: 328281 - RNA, 64 nt, Homo Sapiens
uugaucaauguuuguagauuuguauuuauauguuuuuaaucauucaaucaguauggauuguaug

SEQ ID NO: 328282 - RNA, 64 nt, Homo Sapiens
agucacaccuugcaagucauaauguggcauaguuuuuaaucaacgaaacccuacaaguguaaug

SEQ ID NO: 328283 - RNA, 64 nt, Homo Sapiens
aaacaacccuugcacgucauaauguggcaagguuuuuaaucaaagaaacuuuacaaguguaaug

SEQ ID NO: 328284 - RNA, 64 nt, Homo Sapiens
uugaucaauguuuauagauuuauuuauacauguuuuuaaucauuaucaguaugggauuuauauc

SEQ ID NO: 328285 - RNA, 64 nt, Homo Sapiens
aaucacaccuugcaagucauaaugugacaugguuuuuaaucaacgaaaccuuacaagcacaaug

SEQ ID NO: 328286 - RNA, 64 nt, Homo Sapiens
aagcaaccuuugcacaucacaauguggcaagguuuuuaaucaaagaaaccuuacaagcauaaug

SEQ ID NO: 328287 - RNA, 64 nt, Homo Sapiens
gcacuugaaagggcuccccgguuuguaaaauaucuuuaaucauucacauuagguaccucggagu

SEQ ID NO: 328288 - RNA, 64 nt, Homo Sapiens
uccauuccauuuucuaaaacugucauaaacuauuuuuaaucauuuuaaauaaauguaaaagaaa

SEQ ID NO: 328289 - RNA, 64 nt, Homo Sapiens
uucugcaaggugacaaaugucugggagccaugauuuuaaucacauggcagacuuuuugcuggcu

SEQ ID NO: 328290 - RNA, 64 nt, Homo Sapiens
uucccccuuuuauugguucuucagcaaaaaugcuuuuaaucauuaaaucaagagcugcagauua

SEQ ID NO: 328291 - RNA, 64 nt, Homo Sapiens; identical to SEQ ID NO: 53544

SEQ ID NO: 328292 - RNA, 64 nt, Homo Sapiens; identical to SEQ ID NO: 53545

SEQ ID NO: 328293 - RNA, 64 nt, Homo Sapiens; identical to SEQ ID NO: 53546

SEQ ID NO: 328294 - RNA, 64 nt, Homo Sapiens; identical to SEQ ID NO: 53547

SEQ ID NO: 328295 - RNA, 64 nt, Homo Sapiens; identical to SEQ ID NO: 53548

SEQ ID NO: 328296 - RNA, 64 nt, Homo Sapiens; identical to SEQ ID NO: 53549

SEQ ID NO: 328297 - RNA, 64 nt, Homo Sapiens; identical to SEQ ID NO: 53550

SEQ ID NO: 328298 - RNA, 64 nt, Homo Sapiens; identical to SEQ ID NO: 53551

SEQ ID NO: 328299 - RNA, 64 nt, Homo Sapiens; identical to SEQ ID NO: 53552

SEQ ID NO: 328300 - RNA, 64 nt, Homo Sapiens; identical to SEQ ID NO: 53553

SEQ ID NO: 328301 - RNA, 64 nt, Homo Sapiens; identical to SEQ ID NO: 53554

SEQ ID NO: 328302 - RNA, 64 nt, Homo Sapiens; identical to SEQ ID NO: 53555

SEQ ID NO: 328303 - RNA, 64 nt, Homo Sapiens; identical to SEQ ID NO: 53556

SEQ ID NO: 328304 - RNA, 64 nt, Homo Sapiens; identical to SEQ ID NO: 53557

SEQ ID NO: 328305 - RNA, 64 nt, Homo Sapiens; identical to SEQ ID NO: 53558

SEQ ID NO: 328306 - RNA, 64 nt, Homo Sapiens; identical to SEQ ID NO: 53559

SEQ ID NO: 328307 - RNA, 64 nt, Homo Sapiens; identical to SEQ ID NO: 53560

SEQ ID NO: 328308 - RNA, 64 nt, Homo Sapiens; identical to SEQ ID NO: 53561

SEQ ID NO: 328309 - RNA, 64 nt, Homo Sapiens; identical to SEQ ID NO: 53562

SEQ ID NO: 328310 - RNA, 64 nt, Homo Sapiens; identical to SEQ ID NO: 53563

SEQ ID NO: 328311 - RNA, 64 nt, Homo Sapiens; identical to SEQ ID NO: 53564

SEQ ID NO: 328312 - RNA, 64 nt, Homo Sapiens; identical to SEQ ID NO: 53565

SEQ ID NO: 328313 - RNA, 64 nt, Homo Sapiens; identical to SEQ ID NO: 53566

SEQ ID NO: 328314 - RNA, 64 nt, Homo Sapiens; identical to SEQ ID NO: 53567

SEQ ID NO: 328315 - RNA, 64 nt, Homo Sapiens; identical to SEQ ID NO: 53568

SEQ ID NO: 328316 - RNA, 64 nt, Homo Sapiens; identical to SEQ ID NO: 53569

SEQ ID NO: 328317 - RNA, 64 nt, Homo Sapiens; identical to SEQ ID NO: 53570

SEQ ID NO: 328318 - RNA, 64 nt, Homo Sapiens; identical to SEQ ID NO: 53571

SEQ ID NO: 328319 - RNA, 64 nt, Homo Sapiens; identical to SEQ ID NO: 53572

SEQ ID NO: 328320 - RNA, 64 nt, Homo Sapiens; identical to SEQ ID NO: 53573

SEQ ID NO: 328321 - RNA, 64 nt, Homo Sapiens; identical to SEQ ID NO: 53574

SEQ ID NO: 328322 - RNA, 64 nt, Homo Sapiens; identical to SEQ ID NO: 53575

SEQ ID NO: 328323 - RNA, 64 nt, Homo Sapiens; identical to SEQ ID NO: 53576

SEQ ID NO: 328324 - RNA, 64 nt, Homo Sapiens; identical to SEQ ID NO: 53577

SEQ ID NO: 328325 - RNA, 64 nt, Homo Sapiens; identical to SEQ ID NO: 53578

SEQ ID NO: 328326 - RNA, 64 nt, Homo Sapiens; identical to SEQ ID NO: 53579

SEQ ID NO: 328327 - RNA, 64 nt, Homo Sapiens; identical to SEQ ID NO: 53580

SEQ ID NO: 328328 - RNA, 64 nt, Homo Sapiens; identical to SEQ ID NO: 53580

SEQ ID NO: 328329 - RNA, 64 nt, Homo Sapiens; identical to SEQ ID NO: 53582

SEQ ID NO: 328330 - RNA, 64 nt, Homo Sapiens; identical to SEQ ID NO: 53583

SEQ ID NO: 328331 - RNA, 64 nt, Homo Sapiens; identical to SEQ ID NO: 53584

SEQ ID NO: 328332 - RNA, 64 nt, Homo Sapiens; identical to SEQ ID NO: 53585

SEQ ID NO: 328333 - RNA, 64 nt, Homo Sapiens; identical to SEQ ID NO: 53586

SEQ ID NO: 328334 - RNA, 64 nt, Homo Sapiens; identical to SEQ ID NO: 193740

SEQ ID NO: 328335 - RNA, 64 nt, Homo Sapiens; identical to SEQ ID NO: 193741

SEQ ID NO: 328336 - RNA, 64 nt, Homo Sapiens; identical to SEQ ID NO: 193742

SEQ ID NO: 328337 - RNA, 64 nt, Homo Sapiens; identical to SEQ ID NO: 193743

SEQ ID NO: 328338 - RNA, 64 nt, Homo Sapiens; identical to SEQ ID NO: 193744

SEQ ID NO: 328339 - RNA, 64 nt, Homo Sapiens; identical to SEQ ID NO: 193745

SEQ ID NO: 328340 - RNA, 64 nt, Homo Sapiens; identical to SEQ ID NO: 155572

SEQ ID NO: 328341 - RNA, 64 nt, Homo Sapiens; identical to SEQ ID NO: 155573

SEQ ID NO: 328342 - RNA, 64 nt, Homo Sapiens
gacgacaugaauauguugaccaaauuauacuugcacuauggaaagauaaguuagagaaaacacc

SEQ ID NO: 328343 - RNA, 64 nt, Homo Sapiens
auugaauuuucuucagacaauucugaaguucaaaacuauggaaaauaucuauaugugggaacca

SEQ ID NO: 328344 - RNA, 64 nt, Homo Sapiens
uauuuaagggaucaguuaucucacugugaccuagacuauggauuauucaaccacugucugacca

SEQ ID NO: 328345 - RNA, 64 nt, Homo Sapiens
cccucacuuuuaaauccaccauacugaaugccacacuauggaaugcagcuaccugccaagcaag

SEQ ID NO: 328346 - RNA, 64 nt, Homo Sapiens
acacguuauagaugccagccaccuccugguagucacuauggacaacuaaugagaugcaaagucu

SEQ ID NO: 328347 - RNA, 64 nt, Homo Sapiens
ugacaaauauucuguguuuuguuuuuuaaaauaaacuauggauauguaugguuaguuuuuaaca

SEQ ID NO: 328348 - RNA, 64 nt, Homo Sapiens
cuccuggugaauguuuacaacuguuacuuacuguacuauggaaggacugacucuugggccaccu

SEQ ID NO: 328349 - RNA, 64 nt, Homo Sapiens
uucuggcccucagcagugggcauuguaagcaugaacuauggaagaggcgccgguucaccaauuc

SEQ ID NO: 328350 - RNA, 64 nt, Homo Sapiens
gcugagggauuggacagcucugacuuuccucgagacuauggauauaguccuucucagauuagcu

SEQ ID NO: 328351 - RNA, 64 nt, Homo Sapiens; identical to SEQ ID NO: 168101

SEQ ID NO: 328352 - RNA, 64 nt, Homo Sapiens; identical to SEQ ID NO: 168102

SEQ ID NO: 328353 - RNA, 64 nt, Homo Sapiens; identical to SEQ ID NO: 168103

SEQ ID NO: 328354 - RNA, 64 nt, Homo Sapiens; identical to SEQ ID NO: 168104

SEQ ID NO: 328355 - RNA, 64 nt, Homo Sapiens; identical to SEQ ID NO: 168105

SEQ ID NO: 328356 - RNA, 64 nt, Homo Sapiens; identical to SEQ ID NO: 168106

SEQ ID NO: 328357 - RNA, 64 nt, Homo Sapiens; identical to SEQ ID NO: 168107

SEQ ID NO: 328358 - RNA, 64 nt, Homo Sapiens; identical to SEQ ID NO: 168108

SEQ ID NO: 328359 - RNA, 64 nt, Homo Sapiens; identical to SEQ ID NO: 168109

SEQ ID NO: 328360 - RNA, 64 nt, Homo Sapiens; identical to SEQ ID NO: 168110

SEQ ID NO: 328361 - RNA, 64 nt, Homo Sapiens; identical to SEQ ID NO: 168111

SEQ ID NO: 328362 - RNA, 64 nt, Homo Sapiens; identical to SEQ ID NO: 168112

SEQ ID NO: 328363 - RNA, 64 nt, Homo Sapiens; identical to SEQ ID NO: 168113

SEQ ID NO: 328364 - RNA, 64 nt, Homo Sapiens; identical to SEQ ID NO: 168114

SEQ ID NO: 328365 - RNA, 64 nt, Homo Sapiens; identical to SEQ ID NO: 168115

SEQ ID NO: 328366 - RNA, 64 nt, Homo Sapiens; identical to SEQ ID NO: 168116

SEQ ID NO: 328367 - RNA, 64 nt, Homo Sapiens; identical to SEQ ID NO: 168117

SEQ ID NO: 328368 - RNA, 64 nt, Homo Sapiens; identical to SEQ ID NO: 168118

SEQ ID NO: 328369 - RNA, 64 nt, Homo Sapiens; identical to SEQ ID NO: 168119

SEQ ID NO: 328370 - RNA, 64 nt, Homo Sapiens; identical to SEQ ID NO: 168120

SEQ ID NO: 328371 - RNA, 64 nt, Homo Sapiens; identical to SEQ ID NO: 168121

SEQ ID NO: 328372 - RNA, 64 nt, Homo Sapiens; identical to SEQ ID NO: 168122

SEQ ID NO: 328373 - RNA, 64 nt, Homo Sapiens; identical to SEQ ID NO: 296589

SEQ ID NO: 328374 - RNA, 64 nt, Homo Sapiens; identical to SEQ ID NO: 296590

SEQ ID NO: 328375 - RNA, 64 nt, Homo Sapiens; identical to SEQ ID NO: 296591

SEQ ID NO: 328376 - RNA, 64 nt, Homo Sapiens; identical to SEQ ID NO: 296592

SEQ ID NO: 328377 - RNA, 64 nt, Homo Sapiens; identical to SEQ ID NO: 296593

SEQ ID NO: 328378 - RNA, 64 nt, Homo Sapiens; identical to SEQ ID NO: 296594

SEQ ID NO: 328379 - RNA, 64 nt, Homo Sapiens; identical to SEQ ID NO: 296595

SEQ ID NO: 328380 - RNA, 64 nt, Homo Sapiens; identical to SEQ ID NO: 296596

SEQ ID NO: 328381 - RNA, 64 nt, Homo Sapiens; identical to SEQ ID NO: 296597

SEQ ID NO: 328382 - RNA, 64 nt, Homo Sapiens; identical to SEQ ID NO: 296598

SEQ ID NO: 328383 - RNA, 64 nt, Homo Sapiens
auguucaaagcuucccuaauuuuuuucuuauuuguagccacauaaguuucaagaauaacauggc

SEQ ID NO: 328384 - RNA, 64 nt, Homo Sapiens
cuuaguucuaaauuuuuuuaugguaacauauacauagccacauuuacaguuuuaaccauuuuaa

SEQ ID NO: 328385 - RNA, 64 nt, Homo Sapiens
gcuacaagugacgacaaagauucuguuucaaauauagccacagaaauaaaggagggaccaauau

SEQ ID NO: 328386 - RNA, 64 nt, Homo Sapiens
gcuacaagugacgagaaagauucuguuucaaauauagccacagaaauaaagaagggacaacaau

SEQ ID NO: 328387 - RNA, 64 nt, Homo Sapiens
gcuacaacugacgaggaagacucuguuucgaauauagccacagaaauaaaggauggagaaaaau

SEQ ID NO: 328388 - RNA, 64 nt, Homo Sapiens
gcuacaacugaugagaaagauucuguuucgaacauagccacagaaauaaaggauggagaaaaau

SEQ ID NO: 328389 - RNA, 64 nt, Homo Sapiens
gucuaagauucuguauccucuucugaguucagccuagccacagaccuagccacagagucugaga

SEQ ID NO: 328390 - RNA, 64 nt, Homo Sapiens
gucugagauucugaguucaguaagaaugucagccuagccacagagcuauuucaaagccacagca

SEQ ID NO: 328391 - RNA, 64 nt, Homo Sapiens
gucaaguguucaaaucacaguuuucgaauuacauuagccacauuaaauuuaguuuaaaauccag

SEQ ID NO: 328392 - RNA, 64 nt, Homo Sapiens
aggcuauuuaaguaaauuuaguccaaugagccacuagccacaugcaaacgucuacaacuacaau

SEQ ID NO: 328393 - RNA, 64 nt, Homo Sapiens
ucgcagcuacugcuaugguuucaggaggccuguuuagccacauggugagaccguggugaaaggg

SEQ ID NO: 328394 - RNA, 64 nt, Homo Sapiens
gugcuggugaaaagguagggcugagugauuaccuuagccacaggguggcugagcaggaacuuua

SEQ ID NO: 328395 - RNA, 64 nt, Homo Sapiens
cagggagcugccuagcaucuggccuggaguguacuagccacauucccaaggucccaaggagaag

SEQ ID NO: 328396 - RNA, 64 nt, Homo Sapiens
uuucaguguccauaaacaaaauguuauuagagcauagccacacccauucauuuaugguauuguc

SEQ ID NO: 328397 - RNA, 64 nt, Homo Sapiens
agcuuuggcuucagggagugacagccaucacaaauagccacauucugcucuacucuccaacaua

SEQ ID NO: 328398 - RNA, 64 nt, Homo Sapiens
ccgugucaacaaugugacuacauguucuccagauuagccacacaugcaaacaucaguguccuuc

SEQ ID NO: 328399 - RNA, 64 nt, Homo Sapiens
ggccaacagcauugccaaccugagacugaaggccaaggaauauaguuuacagaggaaccaggug

SEQ ID NO: 328400 - RNA, 64 nt, Homo Sapiens
cugaucuaucaugggaauugcaguuagagagaguaaggaauaccauuuagucaucuauccguuc

SEQ ID NO: 328401 - RNA, 64 nt, Homo Sapiens
cauaugauacccacuuggacuuuuaacaaaaguaaaggaauaaauuugcauauaggcuuggaaa

SEQ ID NO: 328402 - RNA, 64 nt, Homo Sapiens
agucagccuuuugaccaccuggugccagcuauauaaggaauaaaguugauucauaucaacauua

SEQ ID NO: 328403 - RNA, 64 nt, Homo Sapiens
agaccauaagcaaacugguuauuuaaaauguaaaaaggaauaugaaagucuuauuaaaacacuu

SEQ ID NO: 328404 - RNA, 64 nt, Homo Sapiens
acuauuuggcaacuacugggacucuucagcacaaaaggaauagaucuaugauugacccugauuu

SEQ ID NO: 328405 - RNA, 64 nt, Homo Sapiens
cuuagagaagaccaagggacaguauuuuuuaucaaaggaauacuauuuuuucacacuacgucaa

SEQ ID NO: 328406 - RNA, 64 nt, Homo Sapiens
uuuuucugugcauuguuuuuuuuuuuccuccuaaaaggaauaucacgguuuuuugaaacacuca

SEQ ID NO: 328407 - RNA, 64 nt, Homo Sapiens
cuacaguguaaacauaucccuuuugggggcagucaaggaauaaagagcuucuuagaguaguaua

SEQ ID NO: 328408 - RNA, 64 nt, Homo Sapiens
caauauucugccuuucagaaaacaaaugauuuucaaggaauauuauagucuaaaaaaugaucaa

SEQ ID NO: 328409 - RNA, 64 nt, Homo Sapiens
gaauugugccagagaaaucugauuucuaguacaaaaggaauacuuagccagggccucaagcuca

SEQ ID NO: 328410 - RNA, 64 nt, Homo Sapiens
cuacuauaaagaaaugucuucgagauguagaaauaaggaauauucugaaaauaaaaauuauaca

SEQ ID NO: 328411 - RNA, 64 nt, Homo Sapiens
aguucuggccagaccccguuccccuuccucuaugaaggaauaaguuggaccaagggaagucggg

SEQ ID NO: 328412 - RNA, 64 nt, Homo Sapiens
uaauguaaugccguauuuauuguuuuuaaaaugaaaggaauacuaauaagucuuaaaaguuccu

SEQ ID NO: 328413 - RNA, 64 nt, Homo Sapiens
ccaaaggauuuaagaguuuuguuguuguuaauaaaaggaauacuccuuuuccuuuuggaucaua

SEQ ID NO: 328414 - RNA, 64 nt, Homo Sapiens
guuaguguaucaguaagaaacagaccuaguuuaaaaggaauaaucaacaauuuuauaaaggaga

SEQ ID NO: 328415 - RNA, 64 nt, Homo Sapiens
gaugaggcagagaggaguacgggcugaucucagaaaggaauaagcagaggauuacugauauuau

SEQ ID NO: 328416 - RNA, 64 nt, Homo Sapiens
uaucuuccugcauuuugauuaguguuuuuaaucuaaggaauaauuuaacuuuccaucagucuuc

SEQ ID NO: 328417 - RNA, 64 nt, Homo Sapiens
guauuaaguuccuguaacucaaaccagaauuuuuaaggaauagaacuccaagccuuuucuccac

SEQ ID NO: 328418 - RNA, 64 nt, Homo Sapiens
uauacguaaucaucuaguucugucaucuuacugaaaggaauaacacuucuaaagaucaccauuu

SEQ ID NO: 328419 - RNA, 64 nt, Homo Sapiens
aguugaguaugacaggcacuucauucauucauuuaaggaauauuaagcuagaaauacucuucau

SEQ ID NO: 328420 - RNA, 64 nt, Homo Sapiens
agaauaacuuagcucagccuauuagagcucuaaaaaggaauagucuuuuggauuaggguacaau

SEQ ID NO: 328421 - RNA, 64 nt, Homo Sapiens
caaggacuguuucagugugagucagaaugugaaaaaggaauaaaaaauacuguugggcucaaac

SEQ ID NO: 328422 - RNA, 64 nt, Homo Sapiens
acauguauugacaacaguuuuauaauuuaauaaaaaggaauacauugcaauccguaauuuucuu

SEQ ID NO: 328423 - RNA, 64 nt, Homo Sapiens
gcuagcaagaaagcaauuuagcuuuucaaguaggaaggaauacacauaggaggaaaagaaauuc

SEQ ID NO: 328424 - RNA, 64 nt, Homo Sapiens
aaguuuaauuauauacaagguagcuguuuuuaagaaggaauagcaagcacuuuagugguaguau

SEQ ID NO: 328425 - RNA, 64 nt, Homo Sapiens
uuguuuucauaaagaggaaaaguuuuauaaagaaaaggaauauucuugauaaauuugccuauaa

SEQ ID NO: 328426 - RNA, 64 nt, Homo Sapiens
guuuuuuuccuuaaaaaaaaaguuccuaggaaaaaaggaauaaagucacuaaaguauccugaca

SEQ ID NO: 328427 - RNA, 64 nt, Homo Sapiens
cuuucaauuccugcucuucacuuuguucagcaauaaggaauauuagugaauauacuucgcagcu

SEQ ID NO: 328428 - RNA, 64 nt, Homo Sapiens
uuccuaaaguguugaguaaaauuucuaaagucucaaggaauagcuuuuuguaggcaaaaagaac

SEQ ID NO: 328429 - RNA, 64 nt, Homo Sapiens
aacaggaucucaaacuugaugccagguuuuucaaaaggaauauauuucuuuugcauggacaugg

SEQ ID NO: 328430 - RNA, 64 nt, Homo Sapiens
augggaccaaauaauuccauuaaaaucuaaaauuaaggaauaucgauaaaaagcuauaccauaa

SEQ ID NO: 328431 - RNA, 64 nt, Homo Sapiens
uuuaucauuuuauauuuugaaaggauuauuuuguaaggaauaacuuuuaauacuauaguuucac

SEQ ID NO: 328432 - RNA, 64 nt, Homo Sapiens
uugucaaauauuaaaagaaagauauucuuccuguaaggaauacaguuuuuagucaaaguggcca

SEQ ID NO: 328433 - RNA, 64 nt, Homo Sapiens
aaaauucugguuguauugggcaggcaugcaguccaaggaauaucguucuuuaaucuuccucuag

SEQ ID NO: 328434 - RNA, 64 nt, Homo Sapiens
aaaauucugauuguaugggacaggcaugcaguccaaggaauaucgcucuuuaauuuuccucuag

SEQ ID NO: 328435 - RNA, 64 nt, Homo Sapiens
gaucauguguuuaaaaaaaguguccuccaaagaugaguacuaggcuaacauauggaaagccuuu

SEQ ID NO: 328436 - RNA, 64 nt, Homo Sapiens
agauucaaauuuuucuaacacugcucauuguugugaguacuaugaugcaucacaacuuacaaug

SEQ ID NO: 328437 - RNA, 64 nt, Homo Sapiens; identical to SEQ ID NO: 233973

SEQ ID NO: 328438 - RNA, 64 nt, Homo Sapiens; identical to SEQ ID NO: 233974

SEQ ID NO: 328439 - RNA, 64 nt, Homo Sapiens; identical to SEQ ID NO: 233975

SEQ ID NO: 328440 - RNA, 64 nt, Homo Sapiens; identical to SEQ ID NO: 233976

SEQ ID NO: 328441 - RNA, 64 nt, Homo Sapiens; identical to SEQ ID NO: 233977

SEQ ID NO: 328442 - RNA, 64 nt, Homo Sapiens; identical to SEQ ID NO: 233978

SEQ ID NO: 328443 - RNA, 64 nt, Homo Sapiens; identical to SEQ ID NO: 233979

SEQ ID NO: 328444 - RNA, 64 nt, Homo Sapiens; identical to SEQ ID NO: 233980

SEQ ID NO: 328445 - RNA, 64 nt, Homo Sapiens; identical to SEQ ID NO: 233981

SEQ ID NO: 328446 - RNA, 64 nt, Homo Sapiens; identical to SEQ ID NO: 233982

SEQ ID NO: 328447 - RNA, 64 nt, Homo Sapiens; identical to SEQ ID NO: 233983

SEQ ID NO: 328448 - RNA, 64 nt, Homo Sapiens; identical to SEQ ID NO: 233984

SEQ ID NO: 328449 - RNA, 64 nt, Homo Sapiens; identical to SEQ ID NO: 233985

SEQ ID NO: 328450 - RNA, 64 nt, Homo Sapiens; identical to SEQ ID NO: 233986

SEQ ID NO: 328451 - RNA, 64 nt, Homo Sapiens; identical to SEQ ID NO: 233987

SEQ ID NO: 328452 - RNA, 64 nt, Homo Sapiens; identical to SEQ ID NO: 233988

SEQ ID NO: 328453 - RNA, 64 nt, Homo Sapiens; identical to SEQ ID NO: 233989

SEQ ID NO: 328454 - RNA, 58 nt, Homo Sapiens; identical to SEQ ID NO: 233990

SEQ ID NO: 328455 - RNA, 64 nt, Homo Sapiens; identical to SEQ ID NO: 233991

SEQ ID NO: 328456 - RNA, 64 nt, Homo Sapiens; identical to SEQ ID NO: 233992

SEQ ID NO: 328457 - RNA, 64 nt, Homo Sapiens; identical to SEQ ID NO: 233993

SEQ ID NO: 328458 - RNA, 64 nt, Homo Sapiens; identical to SEQ ID NO: 233994

SEQ ID NO: 328459 - RNA, 64 nt, Homo Sapiens; identical to SEQ ID NO: 233995

SEQ ID NO: 328460 - RNA, 64 nt, Homo Sapiens; identical to SEQ ID NO: 233996

SEQ ID NO: 328461 - RNA, 64 nt, Homo Sapiens; identical to SEQ ID NO: 233997

SEQ ID NO: 328462 - RNA, 64 nt, Homo Sapiens; identical to SEQ ID NO: 233998

SEQ ID NO: 328463 - RNA, 64 nt, Homo Sapiens; identical to SEQ ID NO: 233999

SEQ ID NO: 328464 - RNA, 64 nt, Homo Sapiens; identical to SEQ ID NO: 234000

SEQ ID NO: 328465 - RNA, 64 nt, Homo Sapiens; identical to SEQ ID NO: 234001

SEQ ID NO: 328466 - RNA, 64 nt, Homo Sapiens; identical to SEQ ID NO: 234002

SEQ ID NO: 328467 - RNA, 64 nt, Homo Sapiens; identical to SEQ ID NO: 234003

SEQ ID NO: 328468 - RNA, 64 nt, Homo Sapiens; identical to SEQ ID NO: 234004

SEQ ID NO: 328469 - RNA, 64 nt, Homo Sapiens; identical to SEQ ID NO: 234005

SEQ ID NO: 328470 - RNA, 64 nt, Homo Sapiens; identical to SEQ ID NO: 234006

SEQ ID NO: 328471 - RNA, 64 nt, Homo Sapiens; identical to SEQ ID NO: 234007

SEQ ID NO: 328472 - RNA, 64 nt, Homo Sapiens; identical to SEQ ID NO: 234008

SEQ ID NO: 328473 - RNA, 64 nt, Homo Sapiens; identical to SEQ ID NO: 234009

SEQ ID NO: 328474 - RNA, 64 nt, Homo Sapiens; identical to SEQ ID NO: 234010

SEQ ID NO: 328475 - RNA, 64 nt, Homo Sapiens; identical to SEQ ID NO: 234011

SEQ ID NO: 328476 - RNA, 64 nt, Homo Sapiens; identical to SEQ ID NO: 234012

SEQ ID NO: 328477 - RNA, 64 nt, Homo Sapiens; identical to SEQ ID NO: 234013

SEQ ID NO: 328478 - RNA, 64 nt, Homo Sapiens; identical to SEQ ID NO: 234014

SEQ ID NO: 328479 - RNA, 64 nt, Homo Sapiens; identical to SEQ ID NO: 234015

SEQ ID NO: 328480 - RNA, 64 nt, Homo Sapiens; identical to SEQ ID NO: 234016

SEQ ID NO: 328481 - RNA, 64 nt, Homo Sapiens; identical to SEQ ID NO: 234017

SEQ ID NO: 328482 - RNA, 64 nt, Homo Sapiens; identical to SEQ ID NO: 234018

SEQ ID NO: 328483 - RNA, 64 nt, Homo Sapiens; identical to SEQ ID NO: 234019

SEQ ID NO: 328484 - RNA, 64 nt, Homo Sapiens; identical to SEQ ID NO: 234020

SEQ ID NO: 328485 - RNA, 64 nt, Homo Sapiens; identical to SEQ ID NO: 234021

SEQ ID NO: 328486 - RNA, 64 nt, Homo Sapiens; identical to SEQ ID NO: 234022

SEQ ID NO: 328487 - RNA, 64 nt, Homo Sapiens; identical to SEQ ID NO: 234023

SEQ ID NO: 328488 - RNA, 64 nt, Homo Sapiens; identical to SEQ ID NO: 234024

SEQ ID NO: 328489 - RNA, 64 nt, Homo Sapiens; identical to SEQ ID NO: 234025

SEQ ID NO: 328490 - RNA, 64 nt, Homo Sapiens; identical to SEQ ID NO: 234026

SEQ ID NO: 328491 - RNA, 64 nt, Homo Sapiens; identical to SEQ ID NO: 234027

SEQ ID NO: 328492 - RNA, 64 nt, Homo Sapiens; identical to SEQ ID NO: 234028

SEQ ID NO: 328493 - RNA, 64 nt, Homo Sapiens; identical to SEQ ID NO: 234029

SEQ ID NO: 328494 - RNA, 64 nt, Homo Sapiens; identical to SEQ ID NO: 234030

SEQ ID NO: 328495 - RNA, 64 nt, Homo Sapiens; identical to SEQ ID NO: 234031

SEQ ID NO: 328496 - RNA, 64 nt, Homo Sapiens; identical to SEQ ID NO: 234032

SEQ ID NO: 328497 - RNA, 64 nt, Homo Sapiens; identical to SEQ ID NO: 234033

SEQ ID NO: 328498 - RNA, 64 nt, Homo Sapiens; identical to SEQ ID NO: 234034

SEQ ID NO: 328499 - RNA, 64 nt, Homo Sapiens; identical to SEQ ID NO: 234035

SEQ ID NO: 328500 - RNA, 64 nt, Homo Sapiens; identical to SEQ ID NO: 234036

SEQ ID NO: 328501 - RNA, 64 nt, Homo Sapiens; identical to SEQ ID NO: 234037

SEQ ID NO: 328502 - RNA, 64 nt, Homo Sapiens; identical to SEQ ID NO: 234038

SEQ ID NO: 328503 - RNA, 64 nt, Homo Sapiens; identical to SEQ ID NO: 234039

SEQ ID NO: 328504 - RNA, 64 nt, Homo Sapiens; identical to SEQ ID NO: 234040

SEQ ID NO: 328505 - RNA, 64 nt, Homo Sapiens; identical to SEQ ID NO: 234041

SEQ ID NO: 328506 - RNA, 64 nt, Homo Sapiens; identical to SEQ ID NO: 234042

SEQ ID NO: 328507 - RNA, 64 nt, Homo Sapiens; identical to SEQ ID NO: 234043

SEQ ID NO: 328508 - RNA, 64 nt, Homo Sapiens; identical to SEQ ID NO: 234044

SEQ ID NO: 328509 - RNA, 64 nt, Homo Sapiens; identical to SEQ ID NO: 234045

SEQ ID NO: 328510 - RNA, 64 nt, Homo Sapiens; identical to SEQ ID NO: 234046

SEQ ID NO: 328511 - RNA, 64 nt, Homo Sapiens; identical to SEQ ID NO: 234047

SEQ ID NO: 328512 - RNA, 64 nt, Homo Sapiens; identical to SEQ ID NO: 131208

SEQ ID NO: 328513 - RNA, 64 nt, Homo Sapiens; identical to SEQ ID NO: 131209

SEQ ID NO: 328514 - RNA, 64 nt, Homo Sapiens; identical to SEQ ID NO: 131210

SEQ ID NO: 328515 - RNA, 64 nt, Homo Sapiens; identical to SEQ ID NO: 131211

SEQ ID NO: 328516 - RNA, 64 nt, Homo Sapiens; identical to SEQ ID NO: 131212

SEQ ID NO: 328517 - RNA, 64 nt, Homo Sapiens; identical to SEQ ID NO: 131213

SEQ ID NO: 328518 - RNA, 62 nt, Homo Sapiens
cugcaaaacaggcugauuucaauuaggcagcacuucccaaagugcacugaggaagguggccc

SEQ ID NO: 328519 - RNA, 62 nt, Homo Sapiens
uccugaccucaggcgauccacccccaccucggcuucccaaagugcugagauuacagguguga

SEQ ID NO: 328520 - RNA, 62 nt, Homo Sapiens
ccaaaggacuuaccaucuguucccuaggguuucuucccaacaucuucauucugcauauucuu

SEQ ID NO: 328521 - RNA, 62 nt, Homo Sapiens
uccccaucugaagcuggccuucagagagaugccuucccaaacucagcuuaaauuuugccucc

SEQ ID NO: 328522 - RNA, 62 nt, Homo Sapiens
aaaggugaggucacguggccucccaggccugacuucccaaccuacagcauugacgccaacuu

SEQ ID NO: 328523 - RNA, 62 nt, Homo Sapiens
uuauucauauuuauguucaugguugauuguaccuucccaagcccgcccagugggaugggagg

SEQ ID NO: 328524 - RNA, 62 nt, Homo Sapiens
ugacccagaggguggaaccggccuggacuccucuucccaacuuccuccaggucauuucccag

SEQ ID NO: 328525 - RNA, 62 nt, Homo Sapiens
acuuguggaucauuccuuccucccugcaggagcuucccaagcuggucacagagucuccuggg

SEQ ID NO: 328526 - RNA, 62 nt, Homo Sapiens
aucagugucuagggacuaguuucucuuacauccuucccaaaacccuaaaucugagucaguaa

SEQ ID NO: 328527 - RNA, 62 nt, Homo Sapiens
aucagugucuagggacugguucucuaaaaauccuucccaaaaccuaaaucugagucaguaau

SEQ ID NO: 328528 - RNA, 62 nt, Homo Sapiens
gacgagccuugccugaccucuucggugcugaccuucccaaagugaugccuuacugguuuugu

SEQ ID NO: 328529 - RNA, 62 nt, Homo Sapiens
auguugaguuaccaauggaagccaaaaguucucuucccaaacugccaagaaugauacaggcc

SEQ ID NO: 328530 - RNA, 62 nt, Homo Sapiens
auuuuaagcauuuuguaaauagcuuccucuugcuucccaaaguaacaugggaccuucuguuu

SEQ ID NO: 328531 - RNA, 62 nt, Homo Sapiens
uagcuugucuccucuccuguaagaccaagacucuucccaaguuucagugggggagaagcuga

SEQ ID NO: 328532 - RNA, 62 nt, Homo Sapiens
gcugcgugagcagacaccuuccucaggccaaccuucccaacuaccguucuggguuuugaaag

SEQ ID NO: 328533 - RNA, 62 nt, Homo Sapiens
aggaaacggauucaggaagacagcccucccaucuucccaaugcacagcacucugaacaggca

SEQ ID NO: 328534 - RNA, 62 nt, Homo Sapiens
caaucaguaaaaguuugauaaucaguauaucccuucccaacccccauugugacaguuucuuu

SEQ ID NO: 328535 - RNA, 62 nt, Homo Sapiens
uuuuuccuaccaagaucauucuugaucaucagcuucccaaacuaguaagucugugcaucauu

SEQ ID NO: 328536 - RNA, 62 nt, Homo Sapiens
guuggagacugucuggccccccugguccccuccuucccaagugagucucucugggccuuagg

SEQ ID NO: 328537 - RNA, 62 nt, Homo Sapiens
guggcccuugaguccccauugaggcuugguuccuucccaauccaguggacuucgcaguccac

SEQ ID NO: 328538 - RNA, 62 nt, Homo Sapiens
gcccugaggacagaugccuccuuccucuuuuccuucccaaagcaagcaagaggccguggcug

SEQ ID NO: 328539 - RNA, 62 nt, Homo Sapiens
cacaaagcaguuuuucccccuuucagagacaacuucccaaagcugcguccucuguccccggg

SEQ ID NO: 328540 - RNA, 62 nt, Homo Sapiens
cugucuccccagaagacacauccccuccacuccuucccaaauuccacaccccccuuggggcc

SEQ ID NO: 328541 - RNA, 62 nt, Homo Sapiens
cagcaucuguccccagaaucaggcagaauccacuucccaaacagagccccacgcagguucac

SEQ ID NO: 328542 - RNA, 62 nt, Homo Sapiens
ugguuuugaaaccagcuguuucccaaacucugcuucccaagggcaaccguugcuguucacac

SEQ ID NO: 328543 - RNA, 62 nt, Homo Sapiens
gguggcaugauuguggauccccugagaucuggcuucccaagagcacuuauugacccuuccuc

SEQ ID NO: 328544 - RNA, 62 nt, Homo Sapiens
gcuccuccccuuucaccaccagcuccucuccacuucccaagggagacuccggcaaccuucag

SEQ ID NO: 328545 - RNA, 62 nt, Homo Sapiens
ccucccagccacgugccaguggccacagcccacuucccaacccacuguuguacccaggccuc

SEQ ID NO: 328546 - RNA, 62 nt, Homo Sapiens
acuccugaccucaggugauccucccaccccggcuucccaaaguucugggauuauaggcguga

SEQ ID NO: 328547 - RNA, 64 nt, Homo Sapiens
ugagguuaucggaccaugggcugagcucaggcacuuucuguaggagacuguuauuucuguaaag

SEQ ID NO: 328548 - RNA, 64 nt, Homo Sapiens
gcugagcucaggcacuuucuguaggagacuguuauuucuguaaagaugguuauuuaacccuccu

SEQ ID NO: 328549 - RNA, 64 nt, Homo Sapiens
agauuuaaucuuauuaaauguuuuuaucuuacucuuucuguacagauauaucaaaucacaugaa

SEQ ID NO: 328550 - RNA, 64 nt, Homo Sapiens
ggagguuagcccuuaaucucuucauugcauuucauuucuguaaaucagauuaaguccuuaauau

SEQ ID NO: 328551 - RNA, 64 nt, Homo Sapiens
aaauuuugacuuaaaacaucugcugaauuccaaauuucuguaauagcuacuguaucugugauaa

SEQ ID NO: 328552 - RNA, 64 nt, Homo Sapiens
ucuauuaugcugccucuccaguguaauauuugccuuucuguaaaugggauuaaauaugauuugu

SEQ ID NO: 328553 - RNA, 64 nt, Homo Sapiens
caaccugggaacaaauuuuaguuuucauuuuagguuucuguacuuucuguaguuucuguguaaa

SEQ ID NO: 328554 - RNA, 64 nt, Homo Sapiens
aacaaauuuuaguuuucauuuuagguuucuguacuuucuguaguuucuguguaaacugccauau

SEQ ID NO: 328555 - RNA, 64 nt, Homo Sapiens
gcuggcaucugugcuaagcuuuucuuguuggccauuucuguauuuuuauuuuugacuguuuugu

SEQ ID NO: 328556 - RNA, 64 nt, Homo Sapiens
cagaauaaaaguuccucuccuuaaaaagcaaaucuuucuguaaagaaaaaaucacuguuuguuu

SEQ ID NO: 328557 - RNA, 64 nt, Homo Sapiens
cuagguuuagucagagcuuucacaaguaauaaccuuucuguauuaaaaucagaguaacccuuuc

SEQ ID NO: 328558 - RNA, 64 nt, Homo Sapiens
uaauaaccuuucuguauuaaaaucagaguaacccuuucuguauugagugcaguguuuuuuacuc

SEQ ID NO: 328559 - RNA, 64 nt, Homo Sapiens
augcugaucuaugaucaccugcuucaguagaauuuuucuguagaguguuguuugaauuuugagc

SEQ ID NO: 328560 - RNA, 64 nt, Homo Sapiens
uauuuucacaaucuaaauauugucacaaucuaaauuucuguaguagagagagccguagcccuuu

SEQ ID NO: 328561 - RNA, 64 nt, Homo Sapiens
uuuccucugccauucuuguguugauuggagaauuuuucuguauguaauuagaaaaaaauguaaa

SEQ ID NO: 328562 - RNA, 64 nt, Homo Sapiens
auuuuuauauacauuuccaaaauauuaagauaacuuucuguaagagucaaugauucuguucgac

SEQ ID NO: 328563 - RNA, 64 nt, Homo Sapiens
acgguagggaaaagaacugcugggugggggccuguuucuguaacuuucucccccucuacugaga

SEQ ID NO: 328564 - RNA, 64 nt, Homo Sapiens
acuuaaauuuauuaaucuuaaaucauguacuuuuuuucuguaauagaacucggauucuuuugca

SEQ ID NO: 328565 - RNA, 64 nt, Homo Sapiens
ucucuccuccccaacuuuuuucugaaagccuugauuucuguagacagaacuaugguuuuuggca

SEQ ID NO: 328566 - RNA, 64 nt, Homo Sapiens
agguuuguaaucaugccacucacuaacgauuuuauuucuguagcagaaucauuuuuucuaugua

SEQ ID NO: 328567 - RNA, 64 nt, Homo Sapiens
uacugccuauuguuuauguuaaaccuuaauuuuuuuucuguaaucacuuuuaacacugcuaaua

SEQ ID NO: 328568 - RNA, 64 nt, Homo Sapiens
aacucagcuguuucacacuguauauguacauuguuuucuguaggaauaggauaaugauauauag

SEQ ID NO: 328569 - RNA, 64 nt, Homo Sapiens
aagguguauuucuuuuuuauacaucuguauaaaauuucuguauauuacaaucaauuuuaaagcu

SEQ ID NO: 328570 - RNA, 64 nt, Homo Sapiens
acuccacacugaucuuuggacucuccuauaauuauuucuguagcccuucugugauuaugauuuc

SEQ ID NO: 328571 - RNA, 64 nt, Homo Sapiens
aagggcagucuguggucacgaagcuucacucugcuuucuguauauucucuggcaguuacuuuug

SEQ ID NO: 328572 - RNA, 64 nt, Homo Sapiens
uugugaugaauguuaauagguggaggcuuaaaguuuucuguacccauuugggccgauggccucu

SEQ ID NO: 328573 - RNA, 64 nt, Homo Sapiens
aaauaacagaaauguaugguuuguuuuaccuucauuucuguacaaguaaagcuuauuagucuaa

SEQ ID NO: 328574 - RNA, 64 nt, Homo Sapiens
uguaauauuaaagcaacuaguuucuaauucccaguuucuguauagaaucgcacaagugguuuau

SEQ ID NO: 328575 - RNA, 64 nt, Homo Sapiens
caggaaauuauugaguuuuggaaagcuacaguaauuucuguauuacaucauuuauaugugaaaa

SEQ ID NO: 328576 - RNA, 64 nt, Homo Sapiens
uguauuacaucauuuauaugugaaaaguuggacauuucuguaaguuuuuaaaauuauccauuug

SEQ ID NO: 328577 - RNA, 64 nt, Homo Sapiens
ggucauagcucaagaauuguuagcaaaugacagauuucuguaagccuauauauauagucaaauc

SEQ ID NO: 328578 - RNA, 64 nt, Homo Sapiens
gauucugccuauguaaaaugaauugaaaaacaauuuucuguaaucuuuuauuuaaguagugggc

SEQ ID NO: 328579 - RNA, 64 nt, Homo Sapiens
aauguaacaauuuccuuaaaaaugacuuauccaauuucuguauuucaccuuuaggguuaaaaaa

SEQ ID NO: 328580 - RNA, 64 nt, Homo Sapiens
uuuagcuuaaaagugaaagugguaauacuguugguuucuguaaauguugcaggguuuuaaacuu

SEQ ID NO: 328581 - RNA, 64 nt, Homo Sapiens
aguaauuuuaaacucacuggcuugaaaugugugcuuucuguacaaugaaguuauugcuuuccau

SEQ ID NO: 328582 - RNA, 64 nt, Homo Sapiens
ccaggagaagaaaguuaggggaaaucucauuuucuuucuguaauucauucaguggugccaaagc

SEQ ID NO: 328583 - RNA, 64 nt, Homo Sapiens
accagagaauccauccaaagccauuuacuguuuuuuucuguagcacacugauacacuugaagga

SEQ ID NO: 328584 - RNA, 64 nt, Homo Sapiens
auuuuccauuguauccucuuaucccagacauuuguuucuguaagggcggcugugcaucaguggg

SEQ ID NO: 328585 - RNA, 64 nt, Homo Sapiens
aauucaauaaauggaauugaugugccuaaguuaauuucuguaucuaacacauguaauuucuuaa

SEQ ID NO: 328586 - RNA, 64 nt, Homo Sapiens
augacagggauuucaaucacaucguuuauauucauuucuguagcaaaccaagaacuaguuugaa

SEQ ID NO: 328587 - RNA, 64 nt, Homo Sapiens
auucugugacauguuuauauucacccauguacauuuucuguaaauaccaaacgcuacugauucc

SEQ ID NO: 328588 - RNA, 64 nt, Homo Sapiens
guuguggaaaguuaacacuagcuuuguauuuuuuuuucuguaaaacugugaacugauauauuuu

SEQ ID NO: 328589 - RNA, 64 nt, Homo Sapiens
uuuuaaaaauaucuuuagcguuuggucuuuuuuuuuucuguaaacauuuaauuuggucugagaa

SEQ ID NO: 328590 - RNA, 64 nt, Homo Sapiens
cgagcaaguuauauaacaacuaacaacauugcacuuucuguauaugaaaucaauauuuaaauaa

SEQ ID NO: 328591 - RNA, 64 nt, Homo Sapiens
cuuaaauguggauuaaguggaaagaaauaaaacauuucuguaaauucuacaagguaauuuucaa

SEQ ID NO: 328592 - RNA, 64 nt, Homo Sapiens
gauggacucauuucucucaacucccauugcugauuuucuguauuuucaaagaaucucuucuugc

SEQ ID NO: 328593 - RNA, 64 nt, Homo Sapiens
auauaugaaaaguaaauuaaauauuuauuuucauuuucuguauuaguccuuuacuauaagguua

SEQ ID NO: 328594 - RNA, 64 nt, Homo Sapiens
auauucucaacucguuaucuugaagcugaauucauuucuguauuauauauaugcaagcacaacu

SEQ ID NO: 328595 - RNA, 64 nt, Homo Sapiens
cuuuaaggauuauuuuauuaauucucaugugaacuuucuguacuagaauacaagauacuuuggc

SEQ ID NO: 328596 - RNA, 64 nt, Homo Sapiens
acaggaaugacuaugaagguuuacuuaaaagagauuucuguaauaaucauccaacuucuuugca

SEQ ID NO: 328597 - RNA, 64 nt, Homo Sapiens
uuugucaugacagugcuugcuguugaucugcauauuucuguauauaaacuaaauuacuguuuua

SEQ ID NO: 328598 - RNA, 64 nt, Homo Sapiens
aaauugggaucugucuuggccaguaaucuauguguuucuguaacuauuuaaaaacaaaaagcaa

SEQ ID NO: 328599 - RNA, 64 nt, Homo Sapiens
uuucuuuucuggaacaguggaagauguguggguuuuucuguauuauuuuaagguggaguacagu

SEQ ID NO: 328600 - RNA, 55 nt, Homo Sapiens
uugaaaaaauguaauuuauucagcauuucuguaucugggcucccagccaucauag

SEQ ID NO: 328601 - RNA, 64 nt, Homo Sapiens
ucguuuuacuuuucuuuuuuuuggagagauuuucuuucuguacuccuugagggaagcauuguuu

SEQ ID NO: 328602 - RNA, 64 nt, Homo Sapiens
gggggaaagguggcuggaccgaguuccugagcccuuucuguagugaaggcccacgggcggcacg

SEQ ID NO: 328603 - RNA, 64 nt, Homo Sapiens
gacaagcuuccucgcugcuuaugcccacaggguuuuucuguaugacacaccucagaggagccug

SEQ ID NO: 328604 - RNA, 64 nt, Homo Sapiens
ucuuucuuguuucauggcuguguuuuugcuuuuguuucuguaggagcgccucuuccaagcagug

SEQ ID NO: 328605 - RNA, 64 nt, Homo Sapiens
auuuucauuaauggaugaaaacuucagggcuucuuuucuguauauaacaaauuaagucuguaca

SEQ ID NO: 328606 - RNA, 64 nt, Homo Sapiens
uacaugguguuuaaagaaugguaagcauuguuaauuucuguaaugaacauuuucaauuaaauuu

SEQ ID NO: 328607 - RNA, 64 nt, Homo Sapiens
cagaggcuaaguauaagucuugugggaaguaacuuuucuguaccaacauuuucaaugagaaaaa

SEQ ID NO: 328608 - RNA, 64 nt, Homo Sapiens
augcagggaaauggggaacacucucacaggcuguuuucuguaguguaagugaugcuuguagauu

SEQ ID NO: 328609 - RNA, 64 nt, Homo Sapiens
aaaauguuuucauuuuacuggaaaucuauaaaacuuucuguaguuaacauauuuuuucuuuaug

SEQ ID NO: 328610 - RNA, 64 nt, Homo Sapiens
ucaauuucauguuucuugacuaauuguucugcuuuuucuguagugaagauuuggcaacguggcu

SEQ ID NO: 328611 - RNA, 64 nt, Homo Sapiens
augaaaugcaugcccuucuuuuuacucuaucgcauuucuguaacuuguaaauaauuuauuacag

SEQ ID NO: 328612 - RNA, 64 nt, Homo Sapiens
gcacacagauuguguacugccagcugaugagggcuuucuguacuagaauacaguucucuggcca

SEQ ID NO: 328613 - RNA, 64 nt, Homo Sapiens
uucuuuuuauaaccaguuuuugauugguaauuguuuucuguauuguuuaaaacggaucaaaaau

SEQ ID NO: 328614 - RNA, 64 nt, Homo Sapiens
ccucuugcacuuuuagaugcaaaucaguuuuucauuucuguaauagaaaauuauucacguauuu

SEQ ID NO: 328615 - RNA, 64 nt, Homo Sapiens
agaaaauauaaucaaaauucaaagauuuuuuuuguuucuguaacuggaacuaaaucaaaugauu

SEQ ID NO: 328616 - RNA, 64 nt, Homo Sapiens
gugaaaagugaaaccuuaauuuuaucaaaagaaauuucuguaaaugguaugucuccuuagaaua

SEQ ID NO: 328617 - RNA, 64 nt, Homo Sapiens
gaaacaggacuuacuaaaagucagugggacuggguuucuguagccaagccagacuugacuguuu

SEQ ID NO: 328618 - RNA, 64 nt, Homo Sapiens
gacuggguuucuguagccaagccagacuugacuguuucuguagagcacuaucucgggcaggcca

SEQ ID NO: 328619 - RNA, 64 nt, Homo Sapiens
uugugagguuuguuagagauuaauauagguuuucuuucuguauuauaaaaugcaccaagcaauu

SEQ ID NO: 328620 - RNA, 64 nt, Homo Sapiens
acuagggaggcauuuacaguauuuccaauggauauuucuguauuuucccacuggugcuauuuuu

SEQ ID NO: 328621 - RNA, 64 nt, Homo Sapiens
ugucgaccuacagguaggcugggagaggcugugauuucuguauuaucuuaaccaagaaauugaa

SEQ ID NO: 328622 - RNA, 64 nt, Homo Sapiens
uaccugacauuuauuuuaauagugauuauauauuuuucuguauuuugauaaaaugcugagaacu

SEQ ID NO: 328623 - RNA, 64 nt, Homo Sapiens
uaccagcuauuuuaaaugagcuguauauuuaugcuuucuguauuacaaucaguguuuaaacuua

SEQ ID NO: 328624 - RNA, 64 nt, Homo Sapiens
auaauucugggauuugagaggaucuaaaacuauuuuucuguauaaauauuauuugccaaaaguu

SEQ ID NO: 328625 - RNA, 64 nt, Homo Sapiens
ucagccauaccacugguaacauuucuacuaaaucuuucuguaacacuuaaagaauucccucauu

SEQ ID NO: 328626 - RNA, 64 nt, Homo Sapiens
cuuucccacaaaaaaacauuuuuaacauuauaauuuucuguaaggaacugauuuggcuaugagg

SEQ ID NO: 328627 - RNA, 64 nt, Homo Sapiens
uuaaaaaauacuuugaugcauccagaaguacacguuucuguauuaaggaaauuaauaucaguca

SEQ ID NO: 328628 - RNA, 64 nt, Homo Sapiens
cccugagcuuggaaauuacuugucccuaguggcuuuucuguaguucuaaguucuuaacauguua

SEQ ID NO: 328629 - RNA, 57 nt, Homo Sapiens
ugcugcucuuugucccacaggccuguuuuucuguaccaugaccccacgaucccauga

SEQ ID NO: 328630 - RNA, 64 nt, Homo Sapiens
uacuagguuaaggcagauuuuuauguauacacuuuuucuguacuuuuucuguaauuuucagcac

SEQ ID NO: 328631 - RNA, 64 nt, Homo Sapiens
uuucagcacuuauguauacaauucauugaauauuuuucuguaauaaaugugaacauuuuugcuu

SEQ ID NO: 328632 - RNA, 64 nt, Homo Sapiens
uccucacaaacuucuuugugaagagugaaauguguuucuguaccucuggguuucacuuacgggc

SEQ ID NO: 328633 - RNA, 64 nt, Homo Sapiens
uucuaaaaugugaguucaauucaauaaauuugaauuucuguaggaagaaucaaaucaccgauuu

SEQ ID NO: 328634 - RNA, 64 nt, Homo Sapiens
aagaaucaaaucaccgauuuucaauaaauuugaauuucuguagguucuaaaaugugaguucaau

SEQ ID NO: 328635 - RNA, 64 nt, Homo Sapiens
ucuggguuucacuuacgggcaagagugaaauguguuucuguaccuccucacaaacuucuuugug

SEQ ID NO: 328636 - RNA, 64 nt, Homo Sapiens
cucgaauauuucuagaguacuugagccacauguauuucuguauuuaaagaauugcugacuaacu

SEQ ID NO: 328637 - RNA, 64 nt, Homo Sapiens
ugggggugggaugaauuuaaaaguuauaccaaaauuucuguaaagucuuugaaagucuaggagu

SEQ ID NO: 328638 - RNA, 64 nt, Homo Sapiens
gcaugaccuuuuggccuuuguaagacacacagccuuucuguaucaagccccugucuaaccuacg

SEQ ID NO: 328639 - RNA, 64 nt, Homo Sapiens
aaccuacgaccccagagugacugacggcuguguauuucuguagaaugcuguagaauccgguuuu

SEQ ID NO: 328640 - RNA, 64 nt, Homo Sapiens
uguucacacguggcaucagcccaugcaagauagguuucuguauuuauauauuaaaauacaaaaa

SEQ ID NO: 328641 - RNA, 64 nt, Homo Sapiens
uauuucagugaacaguguacuuguucuuucaacuuuucuguauguuuggaauuuuucuuaauaa

SEQ ID NO: 328642 - RNA, 64 nt, Homo Sapiens
guaucuucaugggacauuagaauuucuguauuuuuuucuguauuacuguuauaaaaacuuuuuu

SEQ ID NO: 328643 - RNA, 64 nt, Homo Sapiens
uuuuucuguauuguaucuucaaaaacuuuuuuaauuucuguauuagauuuagaaauacuguuau

SEQ ID NO: 328644 - RNA, 64 nt, Homo Sapiens
ccagagcgcaagggcucucuugaaagaaaaguaguuucuguaccaauuaaaggauugacguggu

SEQ ID NO: 328645 - RNA, 64 nt, Homo Sapiens
uucaaaucuuuuugauacuuuuuagagcaggauuuuucuguaugugaacuuggguggggggguu

SEQ ID NO: 328646 - RNA, 64 nt, Homo Sapiens
uuguauuguauguuuucuucgacggaaccaacuuuuucuguauuuaagggggggagugggaggg

SEQ ID NO: 328647 - RNA, 64 nt, Homo Sapiens
aauacuaauucaauuuuaagauuccaccugcaccuuucuguacaaucauaggccggagugaguc

SEQ ID NO: 328648 - RNA, 64 nt, Homo Sapiens
uaagaaacuuaagcagccggguaucagcauagccuuucuguauuauuaaagggcaaaaaacacu

SEQ ID NO: 328649 - RNA, 64 nt, Homo Sapiens
caaaugccacaggccaccuacauccuucugccuguuucuguaaggugccuccuggugccugcgg

SEQ ID NO: 328650 - RNA, 64 nt, Homo Sapiens
uuaauuaaaacauuuucuuguauuauaaccauuguuucuguaguuuuugcuuaugaauauucug

SEQ ID NO: 328651 - RNA, 64 nt, Homo Sapiens
cuacugguuugaccagagccggcuggguggaacauuucuguaccauugggccuuuuaaaaacau

SEQ ID NO: 328652 - RNA, 64 nt, Homo Sapiens
ucaccaaguaucuuuggcauuuguucagcaacgauuucuguacacuuacuuuugguuggcauaa

SEQ ID NO: 328653 - RNA, 64 nt, Homo Sapiens
caccuacucccaccccaaggguuguauuuacuuguuucuguacucccccacauggcaaugcaga

SEQ ID NO: 328654 - RNA, 64 nt, Homo Sapiens
ggaagaaacccugacuaacgcauugagaaaagccuuucuguaaagaaugguacaagacagguug

SEQ ID NO: 328655 - RNA, 64 nt, Homo Sapiens
cagauuaggaauacccaaccuguauguacguauauuucuguaucuauguauguauauauaugca

SEQ ID NO: 328656 - RNA, 64 nt, Homo Sapiens
agcugcuuccauuuaugagacuuuagaguuugaguuucuguagggcugaaugacucuuuuuccu

SEQ ID NO: 328657 - RNA, 64 nt, Homo Sapiens
uacuguagcucuucugagguaucugccaggcuguuuucuguagccucagauugccuaucugcuu

SEQ ID NO: 328658 - RNA, 64 nt, Homo Sapiens
uuucuuaccaucggguauuuguguaauggaaauuuuucuguaaugauuccaaacauuuucgaca

SEQ ID NO: 328659 - RNA, 64 nt, Homo Sapiens
auaguuuugauaauuuauagacgaauuuguaauuuuucuguacggcaguauaauguauuuugca

SEQ ID NO: 328660 - RNA, 64 nt, Homo Sapiens
uuuauucuuuucagauaggcuuaacaaauggagcuuucuguauauaaauguggagauuagaguu

SEQ ID NO: 328661 - RNA, 64 nt, Homo Sapiens
aagaguucucagugucuacauguagacuauuccuuuucuguauaaaguucacucuaggauuuca

SEQ ID NO: 328662 - RNA, 64 nt, Homo Sapiens
cuguaaaauauugaaaacuacuuugagcuauuuuuuucuguaccaugcucuuauuuaaagaaga

SEQ ID NO: 328663 - RNA, 64 nt, Homo Sapiens
gaaaggacacuauuacauauucauaauacaacuauuucuguaaauuaauccuugugcauaugug

SEQ ID NO: 328664 - RNA, 64 nt, Homo Sapiens
agaaauucugaauuuugguaaaucacacugaaacuuucuguauaacuuguauuauuagacucuc

SEQ ID NO: 328665 - RNA, 64 nt, Homo Sapiens
ccgacauacaucauucugugauuaaaucuccagauuucuguaaaugauaccuacauucuaaaga

SEQ ID NO: 328666 - RNA, 64 nt, Homo Sapiens; identical to SEQ ID NO: 328664

SEQ ID NO: 328667 - RNA, 64 nt, Homo Sapiens; identical to SEQ ID NO: 328665

SEQ ID NO: 328668 - RNA, 60 nt, Homo Sapiens
uugucauugccuccgugugagccacugagugguuaucaccucagugaaucuucccagggc

SEQ ID NO: 328669 - RNA, 64 nt, Homo Sapiens
agccacauuacugucuguguagugccaggugaaggguuaucagaaggcugguugguuuuaauaa

SEQ ID NO: 328670 - RNA, 64 nt, Homo Sapiens
cauauaugcgaucuggccuaaccauggagauauugguuaucaguuugcagaugaauacacaguu

SEQ ID NO: 328671 - RNA, 64 nt, Homo Sapiens
aagaggcggcagaggcaacaguguuuaggauuuggguuaucauaagguguuaagagucccuugu

SEQ ID NO: 328672 - RNA, 64 nt, Homo Sapiens
ugagauguucuuucuaccaaucuauaugucuuucgguuaucaaguguuucugcaugguaauguc

SEQ ID NO: 328673 - RNA, 64 nt, Homo Sapiens
uuuaguguuguauaucacucagucauuuaauauugguuaucaccauacaguuuaauauuuguau

SEQ ID NO: 328674 - RNA, 64 nt, Homo Sapiens
ugaugaauuuuguugggaucugacuuggggaaaggguuaucagagccuagaggggcuuaaaaag

SEQ ID NO: 328675 - RNA, 64 nt, Homo Sapiens
caauuuuuguucuucuccuguaaagaaugucaaugguuaucaccuucaauaguuucaauauguc

SEQ ID NO: 328676 - RNA, 64 nt, Homo Sapiens
auuauuauaaggccuuuaggcaucagugcaucuggguuaucaacauuuucucaaaugcugucaa

SEQ ID NO: 328677 - RNA, 64 nt, Homo Sapiens
uauuacauagcauggcccuuaugucuugaguugagguuaucaucucaaugaggcuuaagcuccu

SEQ ID NO: 328678 - RNA, 64 nt, Homo Sapiens
gaaaucuuuuaaugacaauuuucauuaauuucaggguuaucauuuuugagaaaucuacaccaaa

SEQ ID NO: 328679 - RNA, 64 nt, Homo Sapiens
uuuugguaaguaccuuaguugaauaaaagcacaagguuaucaccuuuuuuauccguccaccgug

SEQ ID NO: 328680 - RNA, 64 nt, Homo Sapiens
aaaacaaccuccaguauauaucuuacuaggcuuugguuaucaccgcgaaccccugagcagagaa

SEQ ID NO: 328681 - RNA, 64 nt, Homo Sapiens
gauaaugaaaaugacaaucauuauugagguauuugguuaucaaaggauuauggcuucauuaaau

SEQ ID NO: 328682 - RNA, 64 nt, Homo Sapiens
auccuuuggacuuuugauaucauacauaauuuuagguuaucauuuucuguguugucuuuccauu

SEQ ID NO: 328683 - RNA, 64 nt, Homo Sapiens
cacacaucauaaaugcugaacccauuuccuccuggguuaucacuccuggaaugcaaggucugca

SEQ ID NO: 328684 - RNA, 64 nt, Homo Sapiens
uauccuauagaucauccuauucuuaugugucuuugguuaucagaucaauuacagaauaauugug

SEQ ID NO: 328685 - RNA, 64 nt, Homo Sapiens
gcgaugacuggaugucucuguacuguauguaucugguuaucaagaugccucugugcagaaagua

SEQ ID NO: 328686 - RNA, 64 nt, Homo Sapiens
gguuuuacuggaaguauaugugaugagcagaagagguuaucagcauuaaauuguuuugguucua

SEQ ID NO: 328687 - RNA, 64 nt, Homo Sapiens
cugacugugcauuguaccuguauuuauaguuuaugguuaucaggaagcucuguaagaaagaaaa

SEQ ID NO: 328688 - RNA, 64 nt, Homo Sapiens
gguggccauuccuuuuuguauaggcuaagaaacagguuaucagugaaaaguuaauuauggcuuu

SEQ ID NO: 328689 - RNA, 64 nt, Homo Sapiens
caggaaauuuuuagcauucagucauauaacaucugguuaucaaugcacguuuacacaauaaaua

SEQ ID NO: 328690 - RNA, 64 nt, Homo Sapiens
gacuguuacuuguagauuuccauguaaucauugagguuaucacccagauuagaaagacauauuu

SEQ ID NO: 328691 - RNA, 64 nt, Homo Sapiens
ggucagaagucuuucccgggagagagauggccuggguuaucauugcugauagcuuuggcugcau

SEQ ID NO: 328692 - RNA, 64 nt, Homo Sapiens
cagaauuggguaagaaugcuuuuagaugaagcaagguuaucaugcagagaaagagaguuguggg

SEQ ID NO: 328693 - RNA, 64 nt, Homo Sapiens
uuugcacuuaacuaugccaauugugacaaguacagguuaucaagcgccauuuuacaauggagag

SEQ ID NO: 328694 - RNA, 64 nt, Homo Sapiens
ggagccuucuuguguccucauaccuagguugccagguuaucauccucacacuuggcuggguuuc

SEQ ID NO: 328695 - RNA, 64 nt, Homo Sapiens
uuaaguuuugacaccuagauaaacauugcuuugugguuaucacuaaaauuaugagugauuaaga

SEQ ID NO: 328696 - RNA, 64 nt, Homo Sapiens
uaagcugcagguagaagcaagcacuucacagcaugguuaucauguauuguaugaagcauaugua

SEQ ID NO: 328697 - RNA, 64 nt, Homo Sapiens
gugaugccuugcuuuucauaauaggauccuguaugguuaucaauaguuuagaccaguuaaaccc

SEQ ID NO: 328698 - RNA, 64 nt, Homo Sapiens
ggggggacuuaauucuaauccugcucaguggccagguuaucaguagaugaugggauaacaugga

SEQ ID NO: 328699 - RNA, 64 nt, Homo Sapiens
acaagcaauagugacaugagcacuugacucgcuggguuaucaggcuuuggcuccaaauguuugg

SEQ ID NO: 328700 - RNA, 64 nt, Homo Sapiens
cugccaaaaccaaaaaccauuuugaucucccugugguuaucaauauaacgcacaaucacaagug

SEQ ID NO: 328701 - RNA, 64 nt, Homo Sapiens
cuagcccauguuuagauccaggucuccaauucaugguuaucagggcauguguucaacaaccccc

SEQ ID NO: 328702 - RNA, 64 nt, Homo Sapiens
ugcuucuaugaugucaacuuucuuacuaauaacugguuaucaugacaaauguuagguuuaucau

SEQ ID NO: 328703 - RNA, 64 nt, Homo Sapiens
uuauaauaucccaggccccuugauaaaagcugaggguuaucaugaccuuaaugcuaauucaaug

SEQ ID NO: 328704 - RNA, 64 nt, Homo Sapiens
ucaaaauuauugugauucucguagaaguaugggugguuaucauugagaaaguggcucauuccug

SEQ ID NO: 328705 - RNA, 64 nt, Homo Sapiens
cacacauccaguccugacauuuuuacugaacaaagguuaucaacucaaaaccuacuaugauuug

SEQ ID NO: 328706 - RNA, 64 nt, Homo Sapiens
caagacuacucuacccugcagucauuuagaacaugguuaucaucaccacagugucucuucacua

SEQ ID NO: 328707 - RNA, 64 nt, Homo Sapiens
uaacauuaacaucuauuauagaucauauagcguggguuaucaguacacuaaaaagguuucaccu

SEQ ID NO: 328708 - RNA, 64 nt, Homo Sapiens
aaggaugucuccagacacugccccguguccaugggguuaucacccacugugcugagucaaaggg

SEQ ID NO: 328709 - RNA, 64 nt, Homo Sapiens
aaaaaaaauuauuuuuccagucuaccgugguccagguuaucagcucuuuaagagcucuauuaau

SEQ ID NO: 328710 - RNA, 64 nt, Homo Sapiens
ucagugaaugaauguaguaaaauucacuuuggaagguuaucaggcuuuuaaaaaucuaguuuau

SEQ ID NO: 328711 - RNA, 64 nt, Homo Sapiens
agagggaguuuggaaauguguggguaugauucuugguuaucauaaugaugggggugcuacuggc

SEQ ID NO: 328712 - RNA, 64 nt, Homo Sapiens
uuuacaguagguauuacucuugugacauuuuuuugguuaucaacaacuaaauauaaauuacuuu

SEQ ID NO: 328713 - RNA, 64 nt, Homo Sapiens
uaaauugagguggacauuauugaaaagcaucuuugguuaucaguuuuugaucauuucuuugaug

SEQ ID NO: 328714 - RNA, 64 nt, Homo Sapiens
uaguuucaaaauguuaacaacuugaauuacaaccgguuaucaguuggacaguaagauuuuaucc

SEQ ID NO: 328715 - RNA, 64 nt, Homo Sapiens
uucaguggugugaagaaaggaagcacaauuggcagguuaucacuuuccagucguuccaauagau

SEQ ID NO: 328716 - RNA, 64 nt, Homo Sapiens
caggaaacuuuagggcagaugaggagaaugaauugguuaucagaguggaagaccauggcccagg

SEQ ID NO: 328717 - RNA, 64 nt, Homo Sapiens
cccuggccagaggacauaaauggugcugguaggagguuaucagaguaaggaagguagcagauau

SEQ ID NO: 328718 - RNA, 64 nt, Homo Sapiens
agggcuuuugauuuauaaaaugaauucuaaaaaugguuaucauuucugauucuacagugaugau

SEQ ID NO: 328719 - RNA, 64 nt, Homo Sapiens
caguugucucagggguacaagccuacuguauaaugguuaucaaauaaaguaugcuuauuucugu

SEQ ID NO: 328720 - RNA, 64 nt, Homo Sapiens
accagccgccauggccaagcuucugccaagaaaugguuaucagcgccacagcuuuggcgggcac

SEQ ID NO: 328721 - RNA, 64 nt, Homo Sapiens
cuugaaagauaagcacauagcaagaaaaaugaaggguuaucauaaaaagagaguauauggaucg

SEQ ID NO: 328722 - RNA, 64 nt, Homo Sapiens
aacuuuguuuccuucugucuauuuaacucuacaagguuaucaggaaucagauggucuagggcag

SEQ ID NO: 328723 - RNA, 64 nt, Homo Sapiens
uuugauuuacaaaaacgcuaaauauuuuuagucggguuaucaaacuuaaauaauaaagcuggaa

SEQ ID NO: 328724 - RNA, 64 nt, Homo Sapiens
uuaaacuugcuggauucaugcagccagcuuugcagguuaucagagaucaaagauuguaauaaua

SEQ ID NO: 328725 - RNA, 64 nt, Homo Sapiens
aaguugaacucauagaaggagagaauagaauggugguuaucaagggcugguggggcaguggagg

SEQ ID NO: 328726 - RNA, 64 nt, Homo Sapiens
cauaugaauuuacuacuuuaaugagaguuucaaagguuaucaacucacacuauggcagccaucc

SEQ ID NO: 328727 - RNA, 64 nt, Homo Sapiens
uagcauagaauucuuaaaagacaguggauaagcagguuaucacauuagaaauuuugguauuggg

SEQ ID NO: 328728 - RNA, 64 nt, Homo Sapiens
gauaaggagugguugaauaaugggagaaugugcggguuaucauuuuucaaagaaaauuauucuc

SEQ ID NO: 328729 - RNA, 64 nt, Homo Sapiens
uaauuuaacaaaauuguacaauccuaccauucaagguuaucauaauucuaaguugaguaaaugc

SEQ ID NO: 328730 - RNA, 64 nt, Homo Sapiens
auuaaccucaccaauaaaggcaaccucuugacuagguuaucaaaaugcaauggaaaaaaaugga

SEQ ID NO: 328731 - RNA, 64 nt, Homo Sapiens
guaguugaccuuauaagaaaaguggaaaccaggagguuaucauguuugggaagccuacuuaugg

SEQ ID NO: 328732 - RNA, 64 nt, Homo Sapiens
gaagaaaaggauuuuggaaaccaugcuuuauguggguuaucaugugcccuauauaccucacuag

SEQ ID NO: 328733 - RNA, 64 nt, Homo Sapiens
cuagagggcugcaggacucuauccaccgcccccggguuaucauucagggccccaucaucuugga

SEQ ID NO: 328734 - RNA, 64 nt, Homo Sapiens
cauauauuagucuuuaucagauggauuaucacuagguuaucaaguguugugaaauaccaaacuu

SEQ ID NO: 328735 - RNA, 64 nt, Homo Sapiens
ggcaaguagaguaauaaaucacuagauguaaucagguuaucaaacaauacuaaacugcuaaaca

SEQ ID NO: 328736 - RNA, 64 nt, Homo Sapiens
cuuguuuuuuuuuccauagcacaguaaugaaugugguuaucaaucacauacuuuuuuggauuau

SEQ ID NO: 328737 - RNA, 64 nt, Homo Sapiens
gccauagagcacccuuccuccugggccagagcuggguuaucaugguuggcuuagguaccucagg

SEQ ID NO: 328738 - RNA, 64 nt, Homo Sapiens
agccauguguuccaaggcauuuuagcggggaggggguuaucaaaaaaaaaaaaaugugacucaa

SEQ ID NO: 328739 - RNA, 64 nt, Homo Sapiens
guaagccuguuaacagaaaguagaggcuauucaagguuaucaagaaagugcccugugcuaauga

SEQ ID NO: 328740 - RNA, 64 nt, Homo Sapiens
ugcccauggaggaggcucuuugaaauauuuauuugguuaucaacacuugcaguguagcccaguu

SEQ ID NO: 328741 - RNA, 64 nt, Homo Sapiens
auuaauaaaaguaucuguuauccaccauucaggagguuaucagagaacuguuuggaaacuucuu

SEQ ID NO: 328742 - RNA, 64 nt, Homo Sapiens
auuauuuguauuuugugaauagcuauauguuagagguuaucaucaauagugucugagacacaag

SEQ ID NO: 328743 - RNA, 64 nt, Homo Sapiens
auuucaaaguauaaauauaugcaugggaaaaaucgguuaucauagcaagugcccuuaggaugcc

SEQ ID NO: 328744 - RNA, 64 nt, Homo Sapiens
ucuugcuguugaauggagacuagaguugggaaaggguuaucaacugcaaugggagaaguaugua

SEQ ID NO: 328745 - RNA, 64 nt, Homo Sapiens
ucaagccugagcagaugaaugacuccaggaagaagguuaucaugaaacugaacucaccauuucu

SEQ ID NO: 328746 - RNA, 64 nt, Homo Sapiens
ccccugucuggauccccucccuugugagccccaggguuaucaguugcuggcugugccugagcag

SEQ ID NO: 328747 - RNA, 64 nt, Homo Sapiens
ucuuacuguguucacugggauuugccugccacuugguuaucauuacuguugggugaaccuguga

SEQ ID NO: 328748 - RNA, 64 nt, Homo Sapiens
aagaauuugcuuaaugacuauccucucuguaauugguuaucaggaaaaaacuuacucucuuuuu

SEQ ID NO: 328749 - RNA, 64 nt, Homo Sapiens
gaaugcuacaugauggccagcugcuucccuccuugguuaucauccacugcagcugcuaguuaga

SEQ ID NO: 328750 - RNA, 64 nt, Homo Sapiens
auaaaauuuucauugucuugccauauaaagccuugguuaucaacagguggaauguagauauugu

SEQ ID NO: 328751 - RNA, 64 nt, Homo Sapiens
gaacuaauacuggugaaaauuuaccuaaaaccuugguuaucaaauacaucuccaguacauuccg

SEQ ID NO: 328752 - RNA, 64 nt, Homo Sapiens
acuguugucaccauugcacaaccuaacuuuuauagguuaucaaaacacugcauaggaauuuaga

SEQ ID NO: 328753 - RNA, 64 nt, Homo Sapiens
agaagguggucuccccucaggguagcuagggguugguuaucaucuccccugaugaauacagagu

SEQ ID NO: 328754 - RNA, 52 nt, Homo Sapiens
acuucagaguaauauuacacuggguuaucacaucaaugacuugcaaggauaa

SEQ ID NO: 328755 - RNA, 64 nt, Homo Sapiens
ggugauuugaaauuuucugcgagaaaagaaaguggguuaucaaguugaucaagaauuugggugg

SEQ ID NO: 328756 - RNA, 64 nt, Homo Sapiens
uaggccaggagacauggaauaccauucaugggaugguuaucacaggaguuuagaaagacucugc

SEQ ID NO: 328757 - RNA, 64 nt, Homo Sapiens
aauuucauggaaggaccacaggguuuuuggagaagguuaucaaauuuuaaaccucaccuuugug

SEQ ID NO: 328758 - RNA, 64 nt, Homo Sapiens
uggagucccaaugacuucucuggaaagacaaagagguuaucacaaaaauuccucccagaggcac

SEQ ID NO: 328759 - RNA, 64 nt, Homo Sapiens
aauaaaaggccuuuuucuaaccuaccucuaaugggguuaucagauauguuuuuaaaucucucgc

SEQ ID NO: 328760 - RNA, 64 nt, Homo Sapiens
aaugaauuauauaugcugaauauuaagcuacugggguuaucagcuauuugggaagaguguaagu

SEQ ID NO: 328761 - RNA, 64 nt, Homo Sapiens
cugcccuggcccucuuucuucugucacuaacccugguuaucauuuuacaggcuuguaacuggau

SEQ ID NO: 328762 - RNA, 64 nt, Homo Sapiens
uaagcagacuaaauguugcccagaaucaguguuggguuaucaguuuauauuaaauauacugagu

SEQ ID NO: 328763 - RNA, 64 nt, Homo Sapiens
uaguacccacuuucugcucuuuggagagaacacagguuaucaaguucaucucucuugacuacuc

SEQ ID NO: 328764 - RNA, 64 nt, Homo Sapiens
aguuuggugugccuauugugauuuaaaacagguggguuaucaagaggaacuugagaucucuuua

SEQ ID NO: 328765 - RNA, 64 nt, Homo Sapiens
gugaacuuuuuuuuuuuaaguucugcaguuugcagguuaucauuagcuugaaacccguggcgcu

SEQ ID NO: 328766 - RNA, 64 nt, Homo Sapiens
ggauugaggucaccugggaccugugcaaggcauggguuaucaggugaagaaacacccucuuagg

SEQ ID NO: 328767 - RNA, 64 nt, Homo Sapiens
ggucguugaguuaugggaaguccaaucagaaaaagguuaucauuucuuccaaaguauggaacac

SEQ ID NO: 328768 - RNA, 64 nt, Homo Sapiens
caaaaugucucuuguggccccacuuccgcccuccgguuaucaagaaaacaaugugcugcugcuu

SEQ ID NO: 328769 - RNA, 64 nt, Homo Sapiens
cagaaaaugugugugaucccugcuauggagcagagguuaucaaacuaaagcccauggaccaaau

SEQ ID NO: 328770 - RNA, 64 nt, Homo Sapiens
auaacuuucggauuaguuaauaacuggagaguuugguuaucaauaugcacugaauaauuguuuu

SEQ ID NO: 328771 - RNA, 64 nt, Homo Sapiens
uuccuucuaacaaguagguaacaugggaaagggugguuaucauuagaccuguuccacaucaugc

SEQ ID NO: 328772 - RNA, 64 nt, Homo Sapiens
ucauuuuaggucuuaaagacuucaagaaaauacagguuaucaauuuauuuuaaaucucauuguu

SEQ ID NO: 328773 - RNA, 64 nt, Homo Sapiens
caccaucauaugccccaaacaacugaaaguuggcgguuaucaccagacugugaguuucuggcaa

SEQ ID NO: 328774 - RNA, 64 nt, Homo Sapiens
ugaagccaaaucugaacccauguccucacuucaagguuaucaaucuuggauugugaugcuauug

SEQ ID NO: 328775 - RNA, 64 nt, Homo Sapiens
acguuauauauucccuaccgucugccuagugacagguuaucaccgucccugcagaguggaugcu

SEQ ID NO: 328776 - RNA, 64 nt, Homo Sapiens
uuuaaaaucuuucaggagcuuuacugaaagacuugguuaucaagucuuuuggggagagaaugac

SEQ ID NO: 328777 - RNA, 64 nt, Homo Sapiens
guuaaugugguuaaugccaaccacauugagaagugguuaucauuaaagaucacuugguaguuag

SEQ ID NO: 328778 - RNA, 64 nt, Homo Sapiens
accaaugagcauuacuuucaacacuagacauccugguuaucaaaaagaguuugaaauauguuaa

SEQ ID NO: 328779 - RNA, 64 nt, Homo Sapiens
uuacugcaaagccacaagauacagggaguaaaaggguuaucaucgaaugggaaaucaaggggug

SEQ ID NO: 328780 - RNA, 64 nt, Homo Sapiens
uccccauaauacccuuuuccaaccuaccucacaagguuaucagaaagaucaaauuaaauaauag

SEQ ID NO: 328781 - RNA, 64 nt, Homo Sapiens
uacuugguccaacugcaacucaucaucggugacugguuaucacaccaucgcuggccccuuuggg

SEQ ID NO: 328782 - RNA, 64 nt, Homo Sapiens
ugguauauaauuccauguagccuuuaauaugcuggguuaucaaauucuguucacugaguuauga

SEQ ID NO: 328783 - RNA, 64 nt, Homo Sapiens
ugguccucugaaguuaacugaguagaauucaucugguuaucaccucuaaaugucucaguagagg

SEQ ID NO: 328784 - RNA, 64 nt, Homo Sapiens
cuuggcugcgcaucagaaucuccacuguacaggugguuaucaaccaagucauucaagugcuuuc

SEQ ID NO: 328785 - RNA, 64 nt, Homo Sapiens
ggaaaguauucucuuuucaauuucuaaaguaauugguuaucauguuauagugucaugcagagua

SEQ ID NO: 328786 - RNA, 64 nt, Homo Sapiens
auaucuaacuauaaccucccaagaauguuuucaugguuaucauugugcuaaccaaauuucugug

SEQ ID NO: 328787 - RNA, 64 nt, Homo Sapiens
caccuaaaggccuguaggccucuaacucuuucugcccuuucauucaaaccucuccaaaguucuu

SEQ ID NO: 328788 - RNA, 64 nt, Homo Sapiens
ccuagccuuuucuucuggaucuguccucccucaccccuuucaccugagcuguccacaguaggaa

SEQ ID NO: 328789 - RNA, 64 nt, Homo Sapiens
ccauuccagccucuuccucugaauagaccagacgcccuuucacuuaguucagugccaguccuuu

SEQ ID NO: 328790 - RNA, 64 nt, Homo Sapiens
agaaguccuaacguaaccacaguaaagcagacuccccuuucagcaaccucaaagcaaaaaaaaa

SEQ ID NO: 328791 - RNA, 64 nt, Homo Sapiens
caaguacccguggugucuguucccacaacaauggcccuuucacaagcucuugccucacaacccc

SEQ ID NO: 328792 - RNA, 64 nt, Homo Sapiens
gcugcugcucuuuaugaacugcccaacuuccugucccuuucaggggcuagacacaggcuucucg

SEQ ID NO: 328793 - RNA, 64 nt, Homo Sapiens
ucucgacaccuugcaguuuuacuucauuuccugccccuuucagggccugugaggaugcccauga

SEQ ID NO: 328794 - RNA, 64 nt, Homo Sapiens
auuugcaacuuuagaaagaaaauguacuuucauucccuuucauguacagggaagaaaucaaguu

SEQ ID NO: 328795 - RNA, 64 nt, Homo Sapiens
uuguccacacaagacagcagagaagcuccugaaucccuuucagucagcagaguaaaauuacaga

SEQ ID NO: 328796 - RNA, 64 nt, Homo Sapiens
auguccaugaaaaacagcagagaaacuccuggaucccuuucacuaacuacagccaaauugcaga

SEQ ID NO: 328797 - RNA, 64 nt, Homo Sapiens
acauggaauuuuuccauauaaaucucaaugaauucccuuucauuugaauaggcaaacccaaauc

SEQ ID NO: 328798 - RNA, 64 nt, Homo Sapiens
auagcucaaguugaauuuucuuuccagccaguuacccuuucaaccuacccauacuuuguacaac

SEQ ID NO: 328799 - RNA, 64 nt, Homo Sapiens
ccaggcuggccugugaaggauugccccagguguccccuuucacgguugucacauuuacagugac

SEQ ID NO: 328800 - RNA, 64 nt, Homo Sapiens
uacaggucacaaugaccacauuugaaauuguuuucccuuucauuuuacccugugaaagcaucuc

SEQ ID NO: 328801 - RNA, 64 nt, Homo Sapiens
ccauuuuuuucuuucuguccccuuucaucccacucccuuucauccaaagauuucauccaacucc

SEQ ID NO: 328802 - RNA, 64 nt, Homo Sapiens
ccacucccuuucaucccauuauuucauccaacuccccuuucaucagaucugucuuucuccaaag

SEQ ID NO: 328803 - RNA, 64 nt, Homo Sapiens
cccagucuguuggagccaugagcuuccuuauuaacccuuucagauaaaaauaacuccuuugaug

SEQ ID NO: 328804 - RNA, 64 nt, Homo Sapiens
ccacuuaaagugcuucugcccccugcggcggggucccuuucaucuaaaagcgccuccggagccg

SEQ ID NO: 328805 - RNA, 64 nt, Homo Sapiens; identical to SEQ ID NO: 194985

SEQ ID NO: 328806 - RNA, 64 nt, Homo Sapiens; identical to SEQ ID NO: 194986

SEQ ID NO: 328807 - RNA, 64 nt, Homo Sapiens; identical to SEQ ID NO: 194987

SEQ ID NO: 328808 - RNA, 64 nt, Homo Sapiens; identical to SEQ ID NO: 194988

SEQ ID NO: 328809 - RNA, 64 nt, Homo Sapiens; identical to SEQ ID NO: 194989

SEQ ID NO: 328810 - RNA, 64 nt, Homo Sapiens; identical to SEQ ID NO: 194990

SEQ ID NO: 328811 - RNA, 64 nt, Homo Sapiens; identical to SEQ ID NO: 194991

SEQ ID NO: 328812 - RNA, 64 nt, Homo Sapiens; identical to SEQ ID NO: 194992

SEQ ID NO: 328813 - RNA, 64 nt, Homo Sapiens; identical to SEQ ID NO: 194993

SEQ ID NO: 328814 - RNA, 64 nt, Homo Sapiens; identical to SEQ ID NO: 194994

SEQ ID NO: 328815 - RNA, 64 nt, Homo Sapiens; identical to SEQ ID NO: 194995

SEQ ID NO: 328816 - RNA, 64 nt, Homo Sapiens; identical to SEQ ID NO: 194996

SEQ ID NO: 328817 - RNA, 64 nt, Homo Sapiens; identical to SEQ ID NO: 194997

SEQ ID NO: 328818 - RNA, 64 nt, Homo Sapiens; identical to SEQ ID NO: 194998

SEQ ID NO: 328819 - RNA, 64 nt, Homo Sapiens; identical to SEQ ID NO: 194999

SEQ ID NO: 328820 - RNA, 64 nt, Homo Sapiens; identical to SEQ ID NO: 195000

SEQ ID NO: 328821 - RNA, 64 nt, Homo Sapiens; identical to SEQ ID NO: 195001

SEQ ID NO: 328822 - RNA, 64 nt, Homo Sapiens; identical to SEQ ID NO: 195002

SEQ ID NO: 328823 - RNA, 64 nt, Homo Sapiens; identical to SEQ ID NO: 195003

SEQ ID NO: 328824 - RNA, 64 nt, Homo Sapiens; identical to SEQ ID NO: 195004

SEQ ID NO: 328825 - RNA, 64 nt, Homo Sapiens; identical to SEQ ID NO: 195005

SEQ ID NO: 328826 - RNA, 64 nt, Homo Sapiens; identical to SEQ ID NO: 195006

SEQ ID NO: 328827 - RNA, 64 nt, Homo Sapiens; identical to SEQ ID NO: 195007

SEQ ID NO: 328828 - RNA, 64 nt, Homo Sapiens; identical to SEQ ID NO: 195008

SEQ ID NO: 328829 - RNA, 64 nt, Homo Sapiens; identical to SEQ ID NO: 195009

SEQ ID NO: 328830 - RNA, 64 nt, Homo Sapiens; identical to SEQ ID NO: 195010

SEQ ID NO: 328831 - RNA, 64 nt, Homo Sapiens; identical to SEQ ID NO: 195011

SEQ ID NO: 328832 - RNA, 64 nt, Homo Sapiens; identical to SEQ ID NO: 195012

SEQ ID NO: 328833 - RNA, 64 nt, Homo Sapiens; identical to SEQ ID NO: 195013

SEQ ID NO: 328834 - RNA, 64 nt, Homo Sapiens; identical to SEQ ID NO: 195014

SEQ ID NO: 328835 - RNA, 64 nt, Homo Sapiens; identical to SEQ ID NO: 195015

SEQ ID NO: 328836 - RNA, 64 nt, Homo Sapiens; identical to SEQ ID NO: 195016

SEQ ID NO: 328837 - RNA, 64 nt, Homo Sapiens; identical to SEQ ID NO: 195017

SEQ ID NO: 328838 - RNA, 64 nt, Homo Sapiens; identical to SEQ ID NO: 195018

SEQ ID NO: 328839 - RNA, 64 nt, Homo Sapiens; identical to SEQ ID NO: 195019

SEQ ID NO: 328840 - RNA, 64 nt, Homo Sapiens; identical to SEQ ID NO: 195020

SEQ ID NO: 328841 - RNA, 64 nt, Homo Sapiens; identical to SEQ ID NO: 195021

SEQ ID NO: 328842 - RNA, 64 nt, Homo Sapiens; identical to SEQ ID NO: 195022

SEQ ID NO: 328843 - RNA, 64 nt, Homo Sapiens; identical to SEQ ID NO: 195023

SEQ ID NO: 328844 - RNA, 64 nt, Homo Sapiens; identical to SEQ ID NO: 195024

SEQ ID NO: 328845 - RNA, 64 nt, Homo Sapiens; identical to SEQ ID NO: 195025

SEQ ID NO: 328846 - RNA, 64 nt, Homo Sapiens; identical to SEQ ID NO: 195026

SEQ ID NO: 328847 - RNA, 64 nt, Homo Sapiens; identical to SEQ ID NO: 129470

SEQ ID NO: 328848 - RNA, 64 nt, Homo Sapiens; identical to SEQ ID NO: 129471

SEQ ID NO: 328849 - RNA, 64 nt, Homo Sapiens; identical to SEQ ID NO: 129472

SEQ ID NO: 328850 - RNA, 64 nt, Homo Sapiens; identical to SEQ ID NO: 129473

SEQ ID NO: 328851 - RNA, 64 nt, Homo Sapiens; identical to SEQ ID NO: 129474

SEQ ID NO: 328852 - RNA, 64 nt, Homo Sapiens; identical to SEQ ID NO: 129475

SEQ ID NO: 328853 - RNA, 64 nt, Homo Sapiens; identical to SEQ ID NO: 129476

SEQ ID NO: 328854 - RNA, 64 nt, Homo Sapiens; identical to SEQ ID NO: 129477

SEQ ID NO: 328855 - RNA, 64 nt, Homo Sapiens; identical to SEQ ID NO: 129478

SEQ ID NO: 328856 - RNA, 64 nt, Homo Sapiens; identical to SEQ ID NO: 129479

SEQ ID NO: 328857 - RNA, 64 nt, Homo Sapiens
aaacaacacccauaccugaaaguucuggggcaaagacacugaugucuucugcuucaauuacacc

SEQ ID NO: 328858 - RNA, 64 nt, Homo Sapiens
uucugagacaucccugauucuguauuugcugccagacacugagccugccucugaguuuugaugc

SEQ ID NO: 328859 - RNA, 64 nt, Homo Sapiens
aagcugcaaaucugauggccuuaauuuccuuuuugacacugaaaguuuuguaaaagaaaucaug

SEQ ID NO: 328860 - RNA, 64 nt, Homo Sapiens
uguccauacacuuuguugcaagaugugaauuauugacacugaacuuaauaacuguguacuguuc

SEQ ID NO: 328861 - RNA, 64 nt, Homo Sapiens
uauaguucacuguuuaccugacugauauuuucgugacacugacuuacucuagccuuuucaugac

SEQ ID NO: 328862 - RNA, 64 nt, Homo Sapiens
uuuucgugacacugacuuauucuagccuuuucaugacacugauauaucuucccccuccauguac

SEQ ID NO: 328863 - RNA, 64 nt, Homo Sapiens
uaauuaacuuaaagacugauuuuaaucugacuaugacacugagcauauucuuuaaauuacucau

SEQ ID NO: 328864 - RNA, 64 nt, Homo Sapiens
uugcuguaaagugcaaggaaauuuuaaauucugggacacugaguuagaugguaaauacugacuu

SEQ ID NO: 328865 - RNA, 64 nt, Homo Sapiens
uugaacuucauauaucagucaauaaaacuuuauggacacugagcaaugaucauggcuauguuuu

SEQ ID NO: 328866 - RNA, 64 nt, Homo Sapiens
uugaacuuccauugugauauaauaaaacuuuacagacacugaacaaugaucauggcuauguuuu

SEQ ID NO: 328867 - RNA, 64 nt, Homo Sapiens
aaugauacagaccuuugcagcugaggacacugaugacacugauucuggacucugcuagugucuu

SEQ ID NO: 328868 - RNA, 64 nt, Homo Sapiens
acacugauuaaugauacagauagugucuucugaggacacugaugcgcaucacccuggacucugc

SEQ ID NO: 328869 - RNA, 64 nt, Homo Sapiens; identical to SEQ ID NO: 109235

SEQ ID NO: 328870 - RNA, 64 nt, Homo Sapiens; identical to SEQ ID NO: 109236

SEQ ID NO: 328871 - RNA, 64 nt, Homo Sapiens; identical to SEQ ID NO: 109237

SEQ ID NO: 328872 - RNA, 64 nt, Homo Sapiens; identical to SEQ ID NO: 109238

SEQ ID NO: 328873 - RNA, 64 nt, Homo Sapiens; identical to SEQ ID NO: 109239

SEQ ID NO: 328874 - RNA, 64 nt, Homo Sapiens; identical to SEQ ID NO: 109240

SEQ ID NO: 328875 - RNA, 64 nt, Homo Sapiens; identical to SEQ ID NO: 109241

SEQ ID NO: 328876 - RNA, 64 nt, Homo Sapiens; identical to SEQ ID NO: 109242

SEQ ID NO: 328877 - RNA, 64 nt, Homo Sapiens; identical to SEQ ID NO: 109243

SEQ ID NO: 328878 - RNA, 64 nt, Homo Sapiens; identical to SEQ ID NO: 109244

SEQ ID NO: 328879 - RNA, 64 nt, Homo Sapiens; identical to SEQ ID NO: 109245

SEQ ID NO: 328880 - RNA, 64 nt, Homo Sapiens; identical to SEQ ID NO: 109246

SEQ ID NO: 328881 - RNA, 64 nt, Homo Sapiens; identical to SEQ ID NO: 109247

SEQ ID NO: 328882 - RNA, 64 nt, Homo Sapiens; identical to SEQ ID NO: 109248

SEQ ID NO: 328883 - RNA, 64 nt, Homo Sapiens; identical to SEQ ID NO: 109249

SEQ ID NO: 328884 - RNA, 64 nt, Homo Sapiens; identical to SEQ ID NO: 109250

SEQ ID NO: 328885 - RNA, 64 nt, Homo Sapiens; identical to SEQ ID NO: 39347

SEQ ID NO: 328886 - RNA, 64 nt, Homo Sapiens; identical to SEQ ID NO: 39348

SEQ ID NO: 328887 - RNA, 64 nt, Homo Sapiens; identical to SEQ ID NO: 39349

SEQ ID NO: 328888 - RNA, 64 nt, Homo Sapiens; identical to SEQ ID NO: 39350

SEQ ID NO: 328889 - RNA, 64 nt, Homo Sapiens; identical to SEQ ID NO: 39351

SEQ ID NO: 328890 - RNA, 64 nt, Homo Sapiens; identical to SEQ ID NO: 39352

SEQ ID NO: 328891 - RNA, 64 nt, Homo Sapiens; identical to SEQ ID NO: 39353

SEQ ID NO: 328892 - RNA, 64 nt, Homo Sapiens; identical to SEQ ID NO: 39354

SEQ ID NO: 328893 - RNA, 64 nt, Homo Sapiens; identical to SEQ ID NO: 39355

SEQ ID NO: 328894 - RNA, 64 nt, Homo Sapiens; identical to SEQ ID NO: 39356

SEQ ID NO: 328895 - RNA, 64 nt, Homo Sapiens; identical to SEQ ID NO: 39357

SEQ ID NO: 328896 - RNA, 64 nt, Homo Sapiens; identical to SEQ ID NO: 39358

SEQ ID NO: 328897 - RNA, 64 nt, Homo Sapiens; identical to SEQ ID NO: 39359

SEQ ID NO: 328898 - RNA, 64 nt, Homo Sapiens; identical to SEQ ID NO: 39360

SEQ ID NO: 328899 - RNA, 64 nt, Homo Sapiens; identical to SEQ ID NO: 39361

SEQ ID NO: 328900 - RNA, 64 nt, Homo Sapiens; identical to SEQ ID NO: 39362

SEQ ID NO: 328901 - RNA, 64 nt, Homo Sapiens; identical to SEQ ID NO: 39363

SEQ ID NO: 328902 - RNA, 64 nt, Homo Sapiens; identical to SEQ ID NO: 39364

SEQ ID NO: 328903 - RNA, 64 nt, Homo Sapiens; identical to SEQ ID NO: 39365

SEQ ID NO: 328904 - RNA, 64 nt, Homo Sapiens; identical to SEQ ID NO: 39366

SEQ ID NO: 328905 - RNA, 64 nt, Homo Sapiens; identical to SEQ ID NO: 39367

SEQ ID NO: 328906 - RNA, 64 nt, Homo Sapiens; identical to SEQ ID NO: 39368

SEQ ID NO: 328907 - RNA, 64 nt, Homo Sapiens; identical to SEQ ID NO: 39369

SEQ ID NO: 328908 - RNA, 64 nt, Homo Sapiens; identical to SEQ ID NO: 39370

SEQ ID NO: 328909 - RNA, 64 nt, Homo Sapiens; identical to SEQ ID NO: 39371

SEQ ID NO: 328910 - RNA, 64 nt, Homo Sapiens; identical to SEQ ID NO: 39372

SEQ ID NO: 328911 - RNA, 64 nt, Homo Sapiens; identical to SEQ ID NO: 39373

SEQ ID NO: 328912 - RNA, 64 nt, Homo Sapiens; identical to SEQ ID NO: 39374

SEQ ID NO: 328913 - RNA, 64 nt, Homo Sapiens; identical to SEQ ID NO: 39375

SEQ ID NO: 328914 - RNA, 64 nt, Homo Sapiens; identical to SEQ ID NO: 39376

SEQ ID NO: 328915 - RNA, 64 nt, Homo Sapiens; identical to SEQ ID NO: 39377

SEQ ID NO: 328916 - RNA, 64 nt, Homo Sapiens; identical to SEQ ID NO: 39378

SEQ ID NO: 328917 - RNA, 64 nt, Homo Sapiens; identical to SEQ ID NO: 39379

SEQ ID NO: 328918 - RNA, 64 nt, Homo Sapiens; identical to SEQ ID NO: 39380

SEQ ID NO: 328919 - RNA, 64 nt, Homo Sapiens; identical to SEQ ID NO: 39381

SEQ ID NO: 328920 - RNA, 64 nt, Homo Sapiens; identical to SEQ ID NO: 39382

SEQ ID NO: 328921 - RNA, 64 nt, Homo Sapiens; identical to SEQ ID NO: 39383

SEQ ID NO: 328922 - RNA, 64 nt, Homo Sapiens; identical to SEQ ID NO: 39384

SEQ ID NO: 328923 - RNA, 64 nt, Homo Sapiens; identical to SEQ ID NO: 39385

SEQ ID NO: 328924 - RNA, 64 nt, Homo Sapiens; identical to SEQ ID NO: 39386

SEQ ID NO: 328925 - RNA, 64 nt, Homo Sapiens; identical to SEQ ID NO: 39387

SEQ ID NO: 328926 - RNA, 64 nt, Homo Sapiens; identical to SEQ ID NO: 39388

SEQ ID NO: 328927 - RNA, 64 nt, Homo Sapiens; identical to SEQ ID NO: 39389

SEQ ID NO: 328928 - RNA, 64 nt, Homo Sapiens; identical to SEQ ID NO: 39390

SEQ ID NO: 328929 - RNA, 64 nt, Homo Sapiens; identical to SEQ ID NO: 39391

SEQ ID NO: 328930 - RNA, 64 nt, Homo Sapiens; identical to SEQ ID NO: 39392

SEQ ID NO: 328931 - RNA, 64 nt, Homo Sapiens; identical to SEQ ID NO: 39393

SEQ ID NO: 328932 - RNA, 64 nt, Homo Sapiens; identical to SEQ ID NO: 39394

SEQ ID NO: 328933 - RNA, 64 nt, Homo Sapiens; identical to SEQ ID NO: 39395

SEQ ID NO: 328934 - RNA, 64 nt, Homo Sapiens; identical to SEQ ID NO: 39396

SEQ ID NO: 328935 - RNA, 64 nt, Homo Sapiens; identical to SEQ ID NO: 39397

SEQ ID NO: 328936 - RNA, 64 nt, Homo Sapiens; identical to SEQ ID NO: 39398

SEQ ID NO: 328937 - RNA, 64 nt, Homo Sapiens; identical to SEQ ID NO: 39399

SEQ ID NO: 328938 - RNA, 64 nt, Homo Sapiens; identical to SEQ ID NO: 39400

SEQ ID NO: 328939 - RNA, 64 nt, Homo Sapiens; identical to SEQ ID NO: 39401

SEQ ID NO: 328940 - RNA, 64 nt, Homo Sapiens; identical to SEQ ID NO: 39402

SEQ ID NO: 328941 - RNA, 64 nt, Homo Sapiens; identical to SEQ ID NO: 39403

SEQ ID NO: 328942 - RNA, 64 nt, Homo Sapiens; identical to SEQ ID NO: 39404

SEQ ID NO: 328943 - RNA, 64 nt, Homo Sapiens; identical to SEQ ID NO: 39405

SEQ ID NO: 328944 - RNA, 64 nt, Homo Sapiens; identical to SEQ ID NO: 39406

SEQ ID NO: 328945 - RNA, 64 nt, Homo Sapiens; identical to SEQ ID NO: 39407

SEQ ID NO: 328946 - RNA, 64 nt, Homo Sapiens; identical to SEQ ID NO: 39408

SEQ ID NO: 328947 - RNA, 64 nt, Homo Sapiens; identical to SEQ ID NO: 39409

SEQ ID NO: 328948 - RNA, 64 nt, Homo Sapiens; identical to SEQ ID NO: 39410

SEQ ID NO: 328949 - RNA, 64 nt, Homo Sapiens; identical to SEQ ID NO: 39411

SEQ ID NO: 328950 - RNA, 64 nt, Homo Sapiens; identical to SEQ ID NO: 39412

SEQ ID NO: 328951 - RNA, 64 nt, Homo Sapiens; identical to SEQ ID NO: 39413

SEQ ID NO: 328952 - RNA, 64 nt, Homo Sapiens; identical to SEQ ID NO: 39414

SEQ ID NO: 328953 - RNA, 64 nt, Homo Sapiens; identical to SEQ ID NO: 39415

SEQ ID NO: 328954 - RNA, 64 nt, Homo Sapiens; identical to SEQ ID NO: 39416

SEQ ID NO: 328955 - RNA, 64 nt, Homo Sapiens; identical to SEQ ID NO: 39417

SEQ ID NO: 328956 - RNA, 64 nt, Homo Sapiens; identical to SEQ ID NO: 39418

SEQ ID NO: 328957 - RNA, 64 nt, Homo Sapiens; identical to SEQ ID NO: 39419

SEQ ID NO: 328958 - RNA, 64 nt, Homo Sapiens; identical to SEQ ID NO: 39420

SEQ ID NO: 328959 - RNA, 64 nt, Homo Sapiens; identical to SEQ ID NO: 39421

SEQ ID NO: 328960 - RNA, 64 nt, Homo Sapiens; identical to SEQ ID NO: 39422

SEQ ID NO: 328961 - RNA, 64 nt, Homo Sapiens; identical to SEQ ID NO: 39423

SEQ ID NO: 328962 - RNA, 64 nt, Homo Sapiens; identical to SEQ ID NO: 39424

SEQ ID NO: 328963 - RNA, 64 nt, Homo Sapiens; identical to SEQ ID NO: 39425

SEQ ID NO: 328964 - RNA, 64 nt, Homo Sapiens; identical to SEQ ID NO: 39426

SEQ ID NO: 328965 - RNA, 64 nt, Homo Sapiens; identical to SEQ ID NO: 39427

SEQ ID NO: 328966 - RNA, 64 nt, Homo Sapiens; identical to SEQ ID NO: 39428

SEQ ID NO: 328967 - RNA, 64 nt, Homo Sapiens; identical to SEQ ID NO: 39429

SEQ ID NO: 328968 - RNA, 64 nt, Homo Sapiens; identical to SEQ ID NO: 39430

SEQ ID NO: 328969 - RNA, 64 nt, Homo Sapiens; identical to SEQ ID NO: 39431

SEQ ID NO: 328970 - RNA, 64 nt, Homo Sapiens; identical to SEQ ID NO: 39432

SEQ ID NO: 328971 - RNA, 64 nt, Homo Sapiens; identical to SEQ ID NO: 39433

SEQ ID NO: 328972 - RNA, 64 nt, Homo Sapiens; identical to SEQ ID NO: 39434

SEQ ID NO: 328973 - RNA, 64 nt, Homo Sapiens; identical to SEQ ID NO: 39435

SEQ ID NO: 328974 - RNA, 64 nt, Homo Sapiens; identical to SEQ ID NO: 39436

SEQ ID NO: 328975 - RNA, 64 nt, Homo Sapiens; identical to SEQ ID NO: 39437

SEQ ID NO: 328976 - RNA, 64 nt, Homo Sapiens; identical to SEQ ID NO: 39438

SEQ ID NO: 328977 - RNA, 64 nt, Homo Sapiens; identical to SEQ ID NO: 39439

SEQ ID NO: 328978 - RNA, 64 nt, Homo Sapiens; identical to SEQ ID NO: 39440

SEQ ID NO: 328979 - RNA, 64 nt, Homo Sapiens; identical to SEQ ID NO: 39441

SEQ ID NO: 328980 - RNA, 64 nt, Homo Sapiens; identical to SEQ ID NO: 39442

SEQ ID NO: 328981 - RNA, 64 nt, Homo Sapiens; identical to SEQ ID NO: 39443

SEQ ID NO: 328982 - RNA, 64 nt, Homo Sapiens; identical to SEQ ID NO: 39444

SEQ ID NO: 328983 - RNA, 64 nt, Homo Sapiens; identical to SEQ ID NO: 39445

SEQ ID NO: 328984 - RNA, 64 nt, Homo Sapiens; identical to SEQ ID NO: 39446

SEQ ID NO: 328985 - RNA, 64 nt, Homo Sapiens; identical to SEQ ID NO: 39447

SEQ ID NO: 328986 - RNA, 64 nt, Homo Sapiens; identical to SEQ ID NO: 39448

SEQ ID NO: 328987 - RNA, 64 nt, Homo Sapiens; identical to SEQ ID NO: 39449

SEQ ID NO: 328988 - RNA, 64 nt, Homo Sapiens; identical to SEQ ID NO: 39450

SEQ ID NO: 328989 - RNA, 64 nt, Homo Sapiens; identical to SEQ ID NO: 39451

SEQ ID NO: 328990 - RNA, 64 nt, Homo Sapiens; identical to SEQ ID NO: 39452

SEQ ID NO: 328991 - RNA, 64 nt, Homo Sapiens; identical to SEQ ID NO: 39453

SEQ ID NO: 328992 - RNA, 64 nt, Homo Sapiens; identical to SEQ ID NO: 39454

SEQ ID NO: 328993 - RNA, 64 nt, Homo Sapiens; identical to SEQ ID NO: 39455

SEQ ID NO: 328994 - RNA, 64 nt, Homo Sapiens; identical to SEQ ID NO: 39456

SEQ ID NO: 328995 - RNA, 64 nt, Homo Sapiens; identical to SEQ ID NO: 39457

SEQ ID NO: 328996 - RNA, 64 nt, Homo Sapiens; identical to SEQ ID NO: 39458

SEQ ID NO: 328997 - RNA, 64 nt, Homo Sapiens; identical to SEQ ID NO: 39459

SEQ ID NO: 328998 - RNA, 64 nt, Homo Sapiens; identical to SEQ ID NO: 39460

SEQ ID NO: 328999 - RNA, 64 nt, Homo Sapiens; identical to SEQ ID NO: 39461

SEQ ID NO: 329000 - RNA, 64 nt, Homo Sapiens; identical to SEQ ID NO: 39462

SEQ ID NO: 329001 - RNA, 64 nt, Homo Sapiens; identical to SEQ ID NO: 39463

SEQ ID NO: 329002 - RNA, 64 nt, Homo Sapiens; identical to SEQ ID NO: 39464

SEQ ID NO: 329003 - RNA, 64 nt, Homo Sapiens; identical to SEQ ID NO: 39465

SEQ ID NO: 329004 - RNA, 64 nt, Homo Sapiens; identical to SEQ ID NO: 39466

SEQ ID NO: 329005 - RNA, 64 nt, Homo Sapiens; identical to SEQ ID NO: 39467

SEQ ID NO: 329006 - RNA, 64 nt, Homo Sapiens; identical to SEQ ID NO: 39468

SEQ ID NO: 329007 - RNA, 64 nt, Homo Sapiens; identical to SEQ ID NO: 39469

SEQ ID NO: 329008 - RNA, 64 nt, Homo Sapiens; identical to SEQ ID NO: 39470

SEQ ID NO: 329009 - RNA, 64 nt, Homo Sapiens; identical to SEQ ID NO: 39471

SEQ ID NO: 329010 - RNA, 64 nt, Homo Sapiens; identical to SEQ ID NO: 39472

SEQ ID NO: 329011 - RNA, 64 nt, Homo Sapiens; identical to SEQ ID NO: 39473

SEQ ID NO: 329012 - RNA, 64 nt, Homo Sapiens; identical to SEQ ID NO: 39474

SEQ ID NO: 329013 - RNA, 64 nt, Homo Sapiens; identical to SEQ ID NO: 39475

SEQ ID NO: 329014 - RNA, 64 nt, Homo Sapiens; identical to SEQ ID NO: 39476

SEQ ID NO: 329015 - RNA, 64 nt, Homo Sapiens; identical to SEQ ID NO: 39477

SEQ ID NO: 329016 - RNA, 64 nt, Homo Sapiens; identical to SEQ ID NO: 39478

SEQ ID NO: 329017 - RNA, 64 nt, Homo Sapiens; identical to SEQ ID NO: 39479

SEQ ID NO: 329018 - RNA, 64 nt, Homo Sapiens; identical to SEQ ID NO: 39480

SEQ ID NO: 329019 - RNA, 64 nt, Homo Sapiens; identical to SEQ ID NO: 39481

SEQ ID NO: 329020 - RNA, 64 nt, Homo Sapiens; identical to SEQ ID NO: 39482

SEQ ID NO: 329021 - RNA, 64 nt, Homo Sapiens; identical to SEQ ID NO: 39483

SEQ ID NO: 329022 - RNA, 64 nt, Homo Sapiens; identical to SEQ ID NO: 39484

SEQ ID NO: 329023 - RNA, 64 nt, Homo Sapiens; identical to SEQ ID NO: 39485

SEQ ID NO: 329024 - RNA, 64 nt, Homo Sapiens; identical to SEQ ID NO: 39486

SEQ ID NO: 329025 - RNA, 64 nt, Homo Sapiens; identical to SEQ ID NO: 39487

SEQ ID NO: 329026 - RNA, 64 nt, Homo Sapiens; identical to SEQ ID NO: 39488

SEQ ID NO: 329027 - RNA, 64 nt, Homo Sapiens; identical to SEQ ID NO: 39489

SEQ ID NO: 329028 - RNA, 64 nt, Homo Sapiens; identical to SEQ ID NO: 39490

SEQ ID NO: 329029 - RNA, 64 nt, Homo Sapiens; identical to SEQ ID NO: 39491

SEQ ID NO: 329030 - RNA, 64 nt, Homo Sapiens; identical to SEQ ID NO: 39492

SEQ ID NO: 329031 - RNA, 64 nt, Homo Sapiens; identical to SEQ ID NO: 39493

SEQ ID NO: 329032 - RNA, 64 nt, Homo Sapiens; identical to SEQ ID NO: 39494

SEQ ID NO: 329033 - RNA, 64 nt, Homo Sapiens; identical to SEQ ID NO: 39495

SEQ ID NO: 329034 - RNA, 64 nt, Homo Sapiens; identical to SEQ ID NO: 39496

SEQ ID NO: 329035 - RNA, 64 nt, Homo Sapiens; identical to SEQ ID NO: 39497

SEQ ID NO: 329036 - RNA, 64 nt, Homo Sapiens; identical to SEQ ID NO: 39498

SEQ ID NO: 329037 - RNA, 64 nt, Homo Sapiens; identical to SEQ ID NO: 39499

SEQ ID NO: 329038 - RNA, 64 nt, Homo Sapiens; identical to SEQ ID NO: 39500

SEQ ID NO: 329039 - RNA, 64 nt, Homo Sapiens; identical to SEQ ID NO: 39501

SEQ ID NO: 329040 - RNA, 64 nt, Homo Sapiens; identical to SEQ ID NO: 39502

SEQ ID NO: 329041 - RNA, 64 nt, Homo Sapiens; identical to SEQ ID NO: 39503

SEQ ID NO: 329042 - RNA, 64 nt, Homo Sapiens; identical to SEQ ID NO: 39504

SEQ ID NO: 329043 - RNA, 64 nt, Homo Sapiens; identical to SEQ ID NO: 39505

SEQ ID NO: 329044 - RNA, 64 nt, Homo Sapiens; identical to SEQ ID NO: 39506

SEQ ID NO: 329045 - RNA, 64 nt, Homo Sapiens; identical to SEQ ID NO: 39507

SEQ ID NO: 329046 - RNA, 64 nt, Homo Sapiens; identical to SEQ ID NO: 39508

SEQ ID NO: 329047 - RNA, 64 nt, Homo Sapiens; identical to SEQ ID NO: 39509

SEQ ID NO: 329048 - RNA, 64 nt, Homo Sapiens; identical to SEQ ID NO: 39510

SEQ ID NO: 329049 - RNA, 64 nt, Homo Sapiens; identical to SEQ ID NO: 39511

SEQ ID NO: 329050 - RNA, 64 nt, Homo Sapiens; identical to SEQ ID NO: 39512

SEQ ID NO: 329051 - RNA, 64 nt, Homo Sapiens; identical to SEQ ID NO: 39513

SEQ ID NO: 329052 - RNA, 64 nt, Homo Sapiens; identical to SEQ ID NO: 39514

SEQ ID NO: 329053 - RNA, 64 nt, Homo Sapiens; identical to SEQ ID NO: 39515

SEQ ID NO: 329054 - RNA, 64 nt, Homo Sapiens; identical to SEQ ID NO: 39516

SEQ ID NO: 329055 - RNA, 64 nt, Homo Sapiens; identical to SEQ ID NO: 39517

SEQ ID NO: 329056 - RNA, 64 nt, Homo Sapiens; identical to SEQ ID NO: 39518

SEQ ID NO: 329057 - RNA, 64 nt, Homo Sapiens; identical to SEQ ID NO: 39519

SEQ ID NO: 329058 - RNA, 64 nt, Homo Sapiens; identical to SEQ ID NO: 39520

SEQ ID NO: 329059 - RNA, 64 nt, Homo Sapiens; identical to SEQ ID NO: 39521

SEQ ID NO: 329060 - RNA, 64 nt, Homo Sapiens; identical to SEQ ID NO: 39522

SEQ ID NO: 329061 - RNA, 64 nt, Homo Sapiens; identical to SEQ ID NO: 39523

SEQ ID NO: 329062 - RNA, 64 nt, Homo Sapiens; identical to SEQ ID NO: 39524

SEQ ID NO: 329063 - RNA, 64 nt, Homo Sapiens; identical to SEQ ID NO: 39525

SEQ ID NO: 329064 - RNA, 64 nt, Homo Sapiens; identical to SEQ ID NO: 39526

SEQ ID NO: 329065 - RNA, 64 nt, Homo Sapiens; identical to SEQ ID NO: 39527

SEQ ID NO: 329066 - RNA, 64 nt, Homo Sapiens; identical to SEQ ID NO: 39528

SEQ ID NO: 329067 - RNA, 64 nt, Homo Sapiens; identical to SEQ ID NO: 39529

SEQ ID NO: 329068 - RNA, 64 nt, Homo Sapiens; identical to SEQ ID NO: 39530

SEQ ID NO: 329069 - RNA, 64 nt, Homo Sapiens; identical to SEQ ID NO: 39531

SEQ ID NO: 329070 - RNA, 64 nt, Homo Sapiens; identical to SEQ ID NO: 39532

SEQ ID NO: 329071 - RNA, 64 nt, Homo Sapiens; identical to SEQ ID NO: 39533

SEQ ID NO: 329072 - RNA, 64 nt, Homo Sapiens; identical to SEQ ID NO: 39534

SEQ ID NO: 329073 - RNA, 64 nt, Homo Sapiens; identical to SEQ ID NO: 39535

SEQ ID NO: 329074 - RNA, 64 nt, Homo Sapiens; identical to SEQ ID NO: 39536

SEQ ID NO: 329075 - RNA, 64 nt, Homo Sapiens; identical to SEQ ID NO: 39537

SEQ ID NO: 329076 - RNA, 64 nt, Homo Sapiens; identical to SEQ ID NO: 39538

SEQ ID NO: 329077 - RNA, 64 nt, Homo Sapiens; identical to SEQ ID NO: 39539

SEQ ID NO: 329078 - RNA, 64 nt, Homo Sapiens; identical to SEQ ID NO: 39540

SEQ ID NO: 329079 - RNA, 64 nt, Homo Sapiens; identical to SEQ ID NO: 39541

SEQ ID NO: 329080 - RNA, 64 nt, Homo Sapiens; identical to SEQ ID NO: 39542

SEQ ID NO: 329081 - RNA, 64 nt, Homo Sapiens; identical to SEQ ID NO: 39543

SEQ ID NO: 329082 - RNA, 64 nt, Homo Sapiens; identical to SEQ ID NO: 39544

SEQ ID NO: 329083 - RNA, 64 nt, Homo Sapiens; identical to SEQ ID NO: 39545

SEQ ID NO: 329084 - RNA, 64 nt, Homo Sapiens; identical to SEQ ID NO: 39546

SEQ ID NO: 329085 - RNA, 64 nt, Homo Sapiens; identical to SEQ ID NO: 39547

SEQ ID NO: 329086 - RNA, 64 nt, Homo Sapiens; identical to SEQ ID NO: 39548

SEQ ID NO: 329087 - RNA, 64 nt, Homo Sapiens; identical to SEQ ID NO: 39549

SEQ ID NO: 329088 - RNA, 64 nt, Homo Sapiens; identical to SEQ ID NO: 39550

SEQ ID NO: 329089 - RNA, 64 nt, Homo Sapiens; identical to SEQ ID NO: 39551

SEQ ID NO: 329090 - RNA, 64 nt, Homo Sapiens; identical to SEQ ID NO: 39552

SEQ ID NO: 329091 - RNA, 64 nt, Homo Sapiens; identical to SEQ ID NO: 39553

SEQ ID NO: 329092 - RNA, 64 nt, Homo Sapiens; identical to SEQ ID NO: 39554

SEQ ID NO: 329093 - RNA, 64 nt, Homo Sapiens; identical to SEQ ID NO: 39555

SEQ ID NO: 329094 - RNA, 64 nt, Homo Sapiens; identical to SEQ ID NO: 39556

SEQ ID NO: 329095 - RNA, 64 nt, Homo Sapiens; identical to SEQ ID NO: 39557

SEQ ID NO: 329096 - RNA, 64 nt, Homo Sapiens; identical to SEQ ID NO: 39558

SEQ ID NO: 329097 - RNA, 64 nt, Homo Sapiens; identical to SEQ ID NO: 39559

SEQ ID NO: 329098 - RNA, 64 nt, Homo Sapiens; identical to SEQ ID NO: 39560

SEQ ID NO: 329099 - RNA, 64 nt, Homo Sapiens; identical to SEQ ID NO: 39561

SEQ ID NO: 329100 - RNA, 64 nt, Homo Sapiens; identical to SEQ ID NO: 39562

SEQ ID NO: 329101 - RNA, 64 nt, Homo Sapiens; identical to SEQ ID NO: 39563

SEQ ID NO: 329102 - RNA, 64 nt, Homo Sapiens; identical to SEQ ID NO: 39564

SEQ ID NO: 329103 - RNA, 64 nt, Homo Sapiens; identical to SEQ ID NO: 39565

SEQ ID NO: 329104 - RNA, 64 nt, Homo Sapiens; identical to SEQ ID NO: 39566

SEQ ID NO: 329105 - RNA, 64 nt, Homo Sapiens; identical to SEQ ID NO: 39567

SEQ ID NO: 329106 - RNA, 64 nt, Homo Sapiens; identical to SEQ ID NO: 39568

SEQ ID NO: 329107 - RNA, 64 nt, Homo Sapiens; identical to SEQ ID NO: 39569

SEQ ID NO: 329108 - RNA, 64 nt, Homo Sapiens; identical to SEQ ID NO: 39570

SEQ ID NO: 329109 - RNA, 64 nt, Homo Sapiens; identical to SEQ ID NO: 39571

SEQ ID NO: 329110 - RNA, 64 nt, Homo Sapiens; identical to SEQ ID NO: 39572

SEQ ID NO: 329111 - RNA, 64 nt, Homo Sapiens; identical to SEQ ID NO: 39573

SEQ ID NO: 329112 - RNA, 64 nt, Homo Sapiens; identical to SEQ ID NO: 39574

SEQ ID NO: 329113 - RNA, 64 nt, Homo Sapiens; identical to SEQ ID NO: 39575

SEQ ID NO: 329114 - RNA, 64 nt, Homo Sapiens; identical to SEQ ID NO: 39576

SEQ ID NO: 329115 - RNA, 64 nt, Homo Sapiens; identical to SEQ ID NO: 39577

SEQ ID NO: 329116 - RNA, 64 nt, Homo Sapiens; identical to SEQ ID NO: 39578

SEQ ID NO: 329117 - RNA, 64 nt, Homo Sapiens; identical to SEQ ID NO: 39579

SEQ ID NO: 329118 - RNA, 64 nt, Homo Sapiens; identical to SEQ ID NO: 39580

SEQ ID NO: 329119 - RNA, 64 nt, Homo Sapiens; identical to SEQ ID NO: 39581

SEQ ID NO: 329120 - RNA, 64 nt, Homo Sapiens; identical to SEQ ID NO: 39582

SEQ ID NO: 329121 - RNA, 64 nt, Homo Sapiens; identical to SEQ ID NO: 39583

SEQ ID NO: 329122 - RNA, 64 nt, Homo Sapiens; identical to SEQ ID NO: 39584

SEQ ID NO: 329123 - RNA, 64 nt, Homo Sapiens; identical to SEQ ID NO: 39585

SEQ ID NO: 329124 - RNA, 64 nt, Homo Sapiens; identical to SEQ ID NO: 39586

SEQ ID NO: 329125 - RNA, 64 nt, Homo Sapiens; identical to SEQ ID NO: 39587

SEQ ID NO: 329126 - RNA, 64 nt, Homo Sapiens; identical to SEQ ID NO: 39588

SEQ ID NO: 329127 - RNA, 64 nt, Homo Sapiens; identical to SEQ ID NO: 39589

SEQ ID NO: 329128 - RNA, 64 nt, Homo Sapiens; identical to SEQ ID NO: 39590

SEQ ID NO: 329129 - RNA, 64 nt, Homo Sapiens; identical to SEQ ID NO: 39591

SEQ ID NO: 329130 - RNA, 64 nt, Homo Sapiens; identical to SEQ ID NO: 39592

SEQ ID NO: 329131 - RNA, 64 nt, Homo Sapiens; identical to SEQ ID NO: 39593

SEQ ID NO: 329132 - RNA, 64 nt, Homo Sapiens; identical to SEQ ID NO: 39594

SEQ ID NO: 329133 - RNA, 64 nt, Homo Sapiens; identical to SEQ ID NO: 39595

SEQ ID NO: 329134 - RNA, 64 nt, Homo Sapiens; identical to SEQ ID NO: 39596

SEQ ID NO: 329135 - RNA, 64 nt, Homo Sapiens; identical to SEQ ID NO: 39597

SEQ ID NO: 329136 - RNA, 64 nt, Homo Sapiens; identical to SEQ ID NO: 39598

SEQ ID NO: 329137 - RNA, 64 nt, Homo Sapiens; identical to SEQ ID NO: 39599

SEQ ID NO: 329138 - RNA, 64 nt, Homo Sapiens; identical to SEQ ID NO: 39600

SEQ ID NO: 329139 - RNA, 64 nt, Homo Sapiens; identical to SEQ ID NO: 39601

SEQ ID NO: 329140 - RNA, 64 nt, Homo Sapiens; identical to SEQ ID NO: 39602

SEQ ID NO: 329141 - RNA, 64 nt, Homo Sapiens; identical to SEQ ID NO: 39603

SEQ ID NO: 329142 - RNA, 64 nt, Homo Sapiens; identical to SEQ ID NO: 39604

SEQ ID NO: 329143 - RNA, 64 nt, Homo Sapiens; identical to SEQ ID NO: 39605

SEQ ID NO: 329144 - RNA, 64 nt, Homo Sapiens; identical to SEQ ID NO: 39606

SEQ ID NO: 329145 - RNA, 64 nt, Homo Sapiens; identical to SEQ ID NO: 39607

SEQ ID NO: 329146 - RNA, 64 nt, Homo Sapiens; identical to SEQ ID NO: 39608

SEQ ID NO: 329147 - RNA, 64 nt, Homo Sapiens; identical to SEQ ID NO: 39609

SEQ ID NO: 329148 - RNA, 64 nt, Homo Sapiens; identical to SEQ ID NO: 39610

SEQ ID NO: 329149 - RNA, 64 nt, Homo Sapiens; identical to SEQ ID NO: 39611

SEQ ID NO: 329150 - RNA, 64 nt, Homo Sapiens; identical to SEQ ID NO: 39612

SEQ ID NO: 329151 - RNA, 64 nt, Homo Sapiens; identical to SEQ ID NO: 39613

SEQ ID NO: 329152 - RNA, 64 nt, Homo Sapiens; identical to SEQ ID NO: 39614

SEQ ID NO: 329153 - RNA, 64 nt, Homo Sapiens; identical to SEQ ID NO: 39615

SEQ ID NO: 329154 - RNA, 64 nt, Homo Sapiens; identical to SEQ ID NO: 39616

SEQ ID NO: 329155 - RNA, 64 nt, Homo Sapiens; identical to SEQ ID NO: 39617

SEQ ID NO: 329156 - RNA, 64 nt, Homo Sapiens; identical to SEQ ID NO: 39618

SEQ ID NO: 329157 - RNA, 64 nt, Homo Sapiens; identical to SEQ ID NO: 39619

SEQ ID NO: 329158 - RNA, 64 nt, Homo Sapiens; identical to SEQ ID NO: 39620

SEQ ID NO: 329159 - RNA, 64 nt, Homo Sapiens; identical to SEQ ID NO: 39621

SEQ ID NO: 329160 - RNA, 64 nt, Homo Sapiens; identical to SEQ ID NO: 39622

SEQ ID NO: 329161 - RNA, 64 nt, Homo Sapiens; identical to SEQ ID NO: 39623

SEQ ID NO: 329162 - RNA, 64 nt, Homo Sapiens; identical to SEQ ID NO: 39624

SEQ ID NO: 329163 - RNA, 64 nt, Homo Sapiens; identical to SEQ ID NO: 39625

SEQ ID NO: 329164 - RNA, 64 nt, Homo Sapiens; identical to SEQ ID NO: 39626

SEQ ID NO: 329165 - RNA, 64 nt, Homo Sapiens; identical to SEQ ID NO: 39627

SEQ ID NO: 329166 - RNA, 64 nt, Homo Sapiens; identical to SEQ ID NO: 39628

SEQ ID NO: 329167 - RNA, 64 nt, Homo Sapiens; identical to SEQ ID NO: 39629

SEQ ID NO: 329168 - RNA, 64 nt, Homo Sapiens; identical to SEQ ID NO: 39630

SEQ ID NO: 329169 - RNA, 64 nt, Homo Sapiens; identical to SEQ ID NO: 39631

SEQ ID NO: 329170 - RNA, 64 nt, Homo Sapiens; identical to SEQ ID NO: 39632

SEQ ID NO: 329171 - RNA, 64 nt, Homo Sapiens; identical to SEQ ID NO: 39633

SEQ ID NO: 329172 - RNA, 64 nt, Homo Sapiens; identical to SEQ ID NO: 39634

SEQ ID NO: 329173 - RNA, 64 nt, Homo Sapiens; identical to SEQ ID NO: 39635

SEQ ID NO: 329174 - RNA, 64 nt, Homo Sapiens; identical to SEQ ID NO: 39636

SEQ ID NO: 329175 - RNA, 64 nt, Homo Sapiens; identical to SEQ ID NO: 39637

SEQ ID NO: 329176 - RNA, 64 nt, Homo Sapiens; identical to SEQ ID NO: 39638

SEQ ID NO: 329177 - RNA, 64 nt, Homo Sapiens; identical to SEQ ID NO: 39639

SEQ ID NO: 329178 - RNA, 64 nt, Homo Sapiens; identical to SEQ ID NO: 39640

SEQ ID NO: 329179 - RNA, 64 nt, Homo Sapiens; identical to SEQ ID NO: 39641

SEQ ID NO: 329180 - RNA, 64 nt, Homo Sapiens; identical to SEQ ID NO: 39642

SEQ ID NO: 329181 - RNA, 64 nt, Homo Sapiens; identical to SEQ ID NO: 39643

SEQ ID NO: 329182 - RNA, 64 nt, Homo Sapiens; identical to SEQ ID NO: 39644

SEQ ID NO: 329183 - RNA, 64 nt, Homo Sapiens; identical to SEQ ID NO: 39645

SEQ ID NO: 329184 - RNA, 64 nt, Homo Sapiens; identical to SEQ ID NO: 39646

SEQ ID NO: 329185 - RNA, 64 nt, Homo Sapiens; identical to SEQ ID NO: 39647

SEQ ID NO: 329186 - RNA, 64 nt, Homo Sapiens; identical to SEQ ID NO: 39648

SEQ ID NO: 329187 - RNA, 64 nt, Homo Sapiens; identical to SEQ ID NO: 39649

SEQ ID NO: 329188 - RNA, 64 nt, Homo Sapiens; identical to SEQ ID NO: 39650

SEQ ID NO: 329189 - RNA, 64 nt, Homo Sapiens; identical to SEQ ID NO: 39651

SEQ ID NO: 329190 - RNA, 64 nt, Homo Sapiens; identical to SEQ ID NO: 39652

SEQ ID NO: 329191 - RNA, 64 nt, Homo Sapiens; identical to SEQ ID NO: 39653

SEQ ID NO: 329192 - RNA, 64 nt, Homo Sapiens; identical to SEQ ID NO: 39654

SEQ ID NO: 329193 - RNA, 64 nt, Homo Sapiens; identical to SEQ ID NO: 39655

SEQ ID NO: 329194 - RNA, 64 nt, Homo Sapiens; identical to SEQ ID NO: 39656

SEQ ID NO: 329195 - RNA, 64 nt, Homo Sapiens; identical to SEQ ID NO: 39657

SEQ ID NO: 329196 - RNA, 64 nt, Homo Sapiens; identical to SEQ ID NO: 39658

SEQ ID NO: 329197 - RNA, 64 nt, Homo Sapiens; identical to SEQ ID NO: 39659

SEQ ID NO: 329198 - RNA, 64 nt, Homo Sapiens; identical to SEQ ID NO: 39660

SEQ ID NO: 329199 - RNA, 64 nt, Homo Sapiens; identical to SEQ ID NO: 39661

SEQ ID NO: 329200 - RNA, 64 nt, Homo Sapiens; identical to SEQ ID NO: 39662

SEQ ID NO: 329201 - RNA, 64 nt, Homo Sapiens; identical to SEQ ID NO: 39663

SEQ ID NO: 329202 - RNA, 64 nt, Homo Sapiens; identical to SEQ ID NO: 39664

SEQ ID NO: 329203 - RNA, 64 nt, Homo Sapiens; identical to SEQ ID NO: 39665

SEQ ID NO: 329204 - RNA, 64 nt, Homo Sapiens; identical to SEQ ID NO: 39666

SEQ ID NO: 329205 - RNA, 64 nt, Homo Sapiens; identical to SEQ ID NO: 39667

SEQ ID NO: 329206 - RNA, 64 nt, Homo Sapiens; identical to SEQ ID NO: 39668

SEQ ID NO: 329207 - RNA, 64 nt, Homo Sapiens; identical to SEQ ID NO: 39669

SEQ ID NO: 329208 - RNA, 64 nt, Homo Sapiens; identical to SEQ ID NO: 39670

SEQ ID NO: 329209 - RNA, 64 nt, Homo Sapiens; identical to SEQ ID NO: 39671

SEQ ID NO: 329210 - RNA, 64 nt, Homo Sapiens; identical to SEQ ID NO: 39672

SEQ ID NO: 329211 - RNA, 64 nt, Homo Sapiens; identical to SEQ ID NO: 39673

SEQ ID NO: 329212 - RNA, 64 nt, Homo Sapiens; identical to SEQ ID NO: 39674

SEQ ID NO: 329213 - RNA, 64 nt, Homo Sapiens; identical to SEQ ID NO: 39675

SEQ ID NO: 329214 - RNA, 64 nt, Homo Sapiens; identical to SEQ ID NO: 39676

SEQ ID NO: 329215 - RNA, 64 nt, Homo Sapiens; identical to SEQ ID NO: 39677

SEQ ID NO: 329216 - RNA, 64 nt, Homo Sapiens; identical to SEQ ID NO: 39678

SEQ ID NO: 329217 - RNA, 64 nt, Homo Sapiens; identical to SEQ ID NO: 39679

SEQ ID NO: 329218 - RNA, 64 nt, Homo Sapiens; identical to SEQ ID NO: 39680

SEQ ID NO: 329219 - RNA, 64 nt, Homo Sapiens; identical to SEQ ID NO: 39681

SEQ ID NO: 329220 - RNA, 64 nt, Homo Sapiens; identical to SEQ ID NO: 39682

SEQ ID NO: 329221 - RNA, 64 nt, Homo Sapiens; identical to SEQ ID NO: 39683

SEQ ID NO: 329222 - RNA, 64 nt, Homo Sapiens; identical to SEQ ID NO: 39684

SEQ ID NO: 329223 - RNA, 64 nt, Homo Sapiens; identical to SEQ ID NO: 39685

SEQ ID NO: 329224 - RNA, 64 nt, Homo Sapiens; identical to SEQ ID NO: 39686

SEQ ID NO: 329225 - RNA, 64 nt, Homo Sapiens; identical to SEQ ID NO: 39687

SEQ ID NO: 329226 - RNA, 64 nt, Homo Sapiens; identical to SEQ ID NO: 39688

SEQ ID NO: 329227 - RNA, 64 nt, Homo Sapiens; identical to SEQ ID NO: 39689

SEQ ID NO: 329228 - RNA, 64 nt, Homo Sapiens; identical to SEQ ID NO: 39690

SEQ ID NO: 329229 - RNA, 64 nt, Homo Sapiens; identical to SEQ ID NO: 39691

SEQ ID NO: 329230 - RNA, 64 nt, Homo Sapiens; identical to SEQ ID NO: 39692

SEQ ID NO: 329231 - RNA, 64 nt, Homo Sapiens; identical to SEQ ID NO: 39693

SEQ ID NO: 329232 - RNA, 64 nt, Homo Sapiens; identical to SEQ ID NO: 39694

SEQ ID NO: 329233 - RNA, 64 nt, Homo Sapiens; identical to SEQ ID NO: 39695

SEQ ID NO: 329234 - RNA, 64 nt, Homo Sapiens; identical to SEQ ID NO: 39696

SEQ ID NO: 329235 - RNA, 64 nt, Homo Sapiens; identical to SEQ ID NO: 39697

SEQ ID NO: 329236 - RNA, 64 nt, Homo Sapiens; identical to SEQ ID NO: 39698

SEQ ID NO: 329237 - RNA, 64 nt, Homo Sapiens; identical to SEQ ID NO: 39699

SEQ ID NO: 329238 - RNA, 64 nt, Homo Sapiens; identical to SEQ ID NO: 39700

SEQ ID NO: 329239 - RNA, 64 nt, Homo Sapiens; identical to SEQ ID NO: 39701

SEQ ID NO: 329240 - RNA, 64 nt, Homo Sapiens; identical to SEQ ID NO: 39702

SEQ ID NO: 329241 - RNA, 64 nt, Homo Sapiens; identical to SEQ ID NO: 39703

SEQ ID NO: 329242 - RNA, 64 nt, Homo Sapiens; identical to SEQ ID NO: 39704

SEQ ID NO: 329243 - RNA, 64 nt, Homo Sapiens; identical to SEQ ID NO: 39705

SEQ ID NO: 329244 - RNA, 64 nt, Homo Sapiens; identical to SEQ ID NO: 39706

SEQ ID NO: 329245 - RNA, 64 nt, Homo Sapiens; identical to SEQ ID NO: 39707

SEQ ID NO: 329246 - RNA, 64 nt, Homo Sapiens; identical to SEQ ID NO: 39708

SEQ ID NO: 329247 - RNA, 64 nt, Homo Sapiens; identical to SEQ ID NO: 39709

SEQ ID NO: 329248 - RNA, 64 nt, Homo Sapiens; identical to SEQ ID NO: 39710

SEQ ID NO: 329249 - RNA, 64 nt, Homo Sapiens; identical to SEQ ID NO: 39711

SEQ ID NO: 329250 - RNA, 64 nt, Homo Sapiens; identical to SEQ ID NO: 39712

SEQ ID NO: 329251 - RNA, 64 nt, Homo Sapiens; identical to SEQ ID NO: 39713

SEQ ID NO: 329252 - RNA, 64 nt, Homo Sapiens; identical to SEQ ID NO: 39714

SEQ ID NO: 329253 - RNA, 64 nt, Homo Sapiens; identical to SEQ ID NO: 39715

SEQ ID NO: 329254 - RNA, 64 nt, Homo Sapiens; identical to SEQ ID NO: 39716

SEQ ID NO: 329255 - RNA, 64 nt, Homo Sapiens; identical to SEQ ID NO: 39717

SEQ ID NO: 329256 - RNA, 64 nt, Homo Sapiens; identical to SEQ ID NO: 39718

SEQ ID NO: 329257 - RNA, 64 nt, Homo Sapiens; identical to SEQ ID NO: 39719

SEQ ID NO: 329258 - RNA, 64 nt, Homo Sapiens; identical to SEQ ID NO: 39720

SEQ ID NO: 329259 - RNA, 64 nt, Homo Sapiens; identical to SEQ ID NO: 39721

SEQ ID NO: 329260 - RNA, 64 nt, Homo Sapiens; identical to SEQ ID NO: 39722

SEQ ID NO: 329261 - RNA, 64 nt, Homo Sapiens; identical to SEQ ID NO: 39723

SEQ ID NO: 329262 - RNA, 64 nt, Homo Sapiens; identical to SEQ ID NO: 39724

SEQ ID NO: 329263 - RNA, 64 nt, Homo Sapiens; identical to SEQ ID NO: 39725

SEQ ID NO: 329264 - RNA, 64 nt, Homo Sapiens; identical to SEQ ID NO: 39726

SEQ ID NO: 329265 - RNA, 64 nt, Homo Sapiens; identical to SEQ ID NO: 39727

SEQ ID NO: 329266 - RNA, 64 nt, Homo Sapiens; identical to SEQ ID NO: 39728

SEQ ID NO: 329267 - RNA, 64 nt, Homo Sapiens; identical to SEQ ID NO: 39729

SEQ ID NO: 329268 - RNA, 64 nt, Homo Sapiens; identical to SEQ ID NO: 39730

SEQ ID NO: 329269 - RNA, 64 nt, Homo Sapiens; identical to SEQ ID NO: 39731

SEQ ID NO: 329270 - RNA, 64 nt, Homo Sapiens; identical to SEQ ID NO: 39732

SEQ ID NO: 329271 - RNA, 64 nt, Homo Sapiens; identical to SEQ ID NO: 39733

SEQ ID NO: 329272 - RNA, 64 nt, Homo Sapiens; identical to SEQ ID NO: 39734

SEQ ID NO: 329273 - RNA, 64 nt, Homo Sapiens; identical to SEQ ID NO: 39735

SEQ ID NO: 329274 - RNA, 64 nt, Homo Sapiens; identical to SEQ ID NO: 39736

SEQ ID NO: 329275 - RNA, 64 nt, Homo Sapiens; identical to SEQ ID NO: 39737

SEQ ID NO: 329276 - RNA, 64 nt, Homo Sapiens; identical to SEQ ID NO: 39738

SEQ ID NO: 329277 - RNA, 64 nt, Homo Sapiens; identical to SEQ ID NO: 39739

SEQ ID NO: 329278 - RNA, 64 nt, Homo Sapiens; identical to SEQ ID NO: 39740

SEQ ID NO: 329279 - RNA, 64 nt, Homo Sapiens; identical to SEQ ID NO: 39741

SEQ ID NO: 329280 - RNA, 64 nt, Homo Sapiens; identical to SEQ ID NO: 39742

SEQ ID NO: 329281 - RNA, 64 nt, Homo Sapiens; identical to SEQ ID NO: 39743

SEQ ID NO: 329282 - RNA, 64 nt, Homo Sapiens; identical to SEQ ID NO: 39744

SEQ ID NO: 329283 - RNA, 64 nt, Homo Sapiens; identical to SEQ ID NO: 39745

SEQ ID NO: 329284 - RNA, 64 nt, Homo Sapiens; identical to SEQ ID NO: 39746

SEQ ID NO: 329285 - RNA, 64 nt, Homo Sapiens; identical to SEQ ID NO: 39747

SEQ ID NO: 329286 - RNA, 64 nt, Homo Sapiens; identical to SEQ ID NO: 39748

SEQ ID NO: 329287 - RNA, 64 nt, Homo Sapiens; identical to SEQ ID NO: 39749

SEQ ID NO: 329288 - RNA, 64 nt, Homo Sapiens; identical to SEQ ID NO: 39750

SEQ ID NO: 329289 - RNA, 64 nt, Homo Sapiens; identical to SEQ ID NO: 39751

SEQ ID NO: 329290 - RNA, 64 nt, Homo Sapiens; identical to SEQ ID NO: 39752

SEQ ID NO: 329291 - RNA, 64 nt, Homo Sapiens; identical to SEQ ID NO: 39753

SEQ ID NO: 329292 - RNA, 64 nt, Homo Sapiens; identical to SEQ ID NO: 39754

SEQ ID NO: 329293 - RNA, 64 nt, Homo Sapiens; identical to SEQ ID NO: 39755

SEQ ID NO: 329294 - RNA, 64 nt, Homo Sapiens; identical to SEQ ID NO: 39756

SEQ ID NO: 329295 - RNA, 64 nt, Homo Sapiens; identical to SEQ ID NO: 39757

SEQ ID NO: 329296 - RNA, 64 nt, Homo Sapiens; identical to SEQ ID NO: 39758

SEQ ID NO: 329297 - RNA, 64 nt, Homo Sapiens; identical to SEQ ID NO: 39759

SEQ ID NO: 329298 - RNA, 64 nt, Homo Sapiens; identical to SEQ ID NO: 39760

SEQ ID NO: 329299 - RNA, 64 nt, Homo Sapiens; identical to SEQ ID NO: 39761

SEQ ID NO: 329300 - RNA, 64 nt, Homo Sapiens; identical to SEQ ID NO: 39762

SEQ ID NO: 329301 - RNA, 64 nt, Homo Sapiens; identical to SEQ ID NO: 39763

SEQ ID NO: 329302 - RNA, 64 nt, Homo Sapiens; identical to SEQ ID NO: 39764

SEQ ID NO: 329303 - RNA, 64 nt, Homo Sapiens; identical to SEQ ID NO: 39765

SEQ ID NO: 329304 - RNA, 64 nt, Homo Sapiens; identical to SEQ ID NO: 39766

SEQ ID NO: 329305 - RNA, 64 nt, Homo Sapiens; identical to SEQ ID NO: 39767

SEQ ID NO: 329306 - RNA, 64 nt, Homo Sapiens; identical to SEQ ID NO: 39768

SEQ ID NO: 329307 - RNA, 64 nt, Homo Sapiens; identical to SEQ ID NO: 39769

SEQ ID NO: 329308 - RNA, 64 nt, Homo Sapiens; identical to SEQ ID NO: 39770

SEQ ID NO: 329309 - RNA, 64 nt, Homo Sapiens; identical to SEQ ID NO: 39771

SEQ ID NO: 329310 - RNA, 64 nt, Homo Sapiens; identical to SEQ ID NO: 39772

SEQ ID NO: 329311 - RNA, 64 nt, Homo Sapiens; identical to SEQ ID NO: 39773

SEQ ID NO: 329312 - RNA, 64 nt, Homo Sapiens; identical to SEQ ID NO: 39774

SEQ ID NO: 329313 - RNA, 64 nt, Homo Sapiens; identical to SEQ ID NO: 39775

SEQ ID NO: 329314 - RNA, 64 nt, Homo Sapiens; identical to SEQ ID NO: 39776

SEQ ID NO: 329315 - RNA, 64 nt, Homo Sapiens; identical to SEQ ID NO: 39777

SEQ ID NO: 329316 - RNA, 64 nt, Homo Sapiens; identical to SEQ ID NO: 39778

SEQ ID NO: 329317 - RNA, 64 nt, Homo Sapiens; identical to SEQ ID NO: 39779

SEQ ID NO: 329318 - RNA, 64 nt, Homo Sapiens; identical to SEQ ID NO: 39780

SEQ ID NO: 329319 - RNA, 64 nt, Homo Sapiens; identical to SEQ ID NO: 39781

SEQ ID NO: 329320 - RNA, 64 nt, Homo Sapiens; identical to SEQ ID NO: 39782

SEQ ID NO: 329321 - RNA, 64 nt, Homo Sapiens; identical to SEQ ID NO: 39783

SEQ ID NO: 329322 - RNA, 64 nt, Homo Sapiens; identical to SEQ ID NO: 39784

SEQ ID NO: 329323 - RNA, 64 nt, Homo Sapiens; identical to SEQ ID NO: 39785

SEQ ID NO: 329324 - RNA, 64 nt, Homo Sapiens; identical to SEQ ID NO: 39786

SEQ ID NO: 329325 - RNA, 64 nt, Homo Sapiens; identical to SEQ ID NO: 39787

SEQ ID NO: 329326 - RNA, 64 nt, Homo Sapiens; identical to SEQ ID NO: 39788

SEQ ID NO: 329327 - RNA, 64 nt, Homo Sapiens; identical to SEQ ID NO: 39789

SEQ ID NO: 329328 - RNA, 64 nt, Homo Sapiens; identical to SEQ ID NO: 39790

SEQ ID NO: 329329 - RNA, 64 nt, Homo Sapiens; identical to SEQ ID NO: 39791

SEQ ID NO: 329330 - RNA, 64 nt, Homo Sapiens; identical to SEQ ID NO: 39792

SEQ ID NO: 329331 - RNA, 64 nt, Homo Sapiens; identical to SEQ ID NO: 39793

SEQ ID NO: 329332 - RNA, 64 nt, Homo Sapiens; identical to SEQ ID NO: 39794

SEQ ID NO: 329333 - RNA, 64 nt, Homo Sapiens; identical to SEQ ID NO: 39795

SEQ ID NO: 329334 - RNA, 64 nt, Homo Sapiens; identical to SEQ ID NO: 39796

SEQ ID NO: 329335 - RNA, 64 nt, Homo Sapiens; identical to SEQ ID NO: 39797

SEQ ID NO: 329336 - RNA, 64 nt, Homo Sapiens; identical to SEQ ID NO: 39798

SEQ ID NO: 329337 - RNA, 64 nt, Homo Sapiens; identical to SEQ ID NO: 39799

SEQ ID NO: 329338 - RNA, 64 nt, Homo Sapiens; identical to SEQ ID NO: 39800

SEQ ID NO: 329339 - RNA, 64 nt, Homo Sapiens; identical to SEQ ID NO: 39801

SEQ ID NO: 329340 - RNA, 64 nt, Homo Sapiens; identical to SEQ ID NO: 39802

SEQ ID NO: 329341 - RNA, 64 nt, Homo Sapiens; identical to SEQ ID NO: 39803

SEQ ID NO: 329342 - RNA, 64 nt, Homo Sapiens; identical to SEQ ID NO: 39804

SEQ ID NO: 329343 - RNA, 64 nt, Homo Sapiens; identical to SEQ ID NO: 39805

SEQ ID NO: 329344 - RNA, 64 nt, Homo Sapiens; identical to SEQ ID NO: 39806

SEQ ID NO: 329345 - RNA, 64 nt, Homo Sapiens; identical to SEQ ID NO: 39807

SEQ ID NO: 329346 - RNA, 64 nt, Homo Sapiens; identical to SEQ ID NO: 39808

SEQ ID NO: 329347 - RNA, 64 nt, Homo Sapiens; identical to SEQ ID NO: 39809

SEQ ID NO: 329348 - RNA, 64 nt, Homo Sapiens; identical to SEQ ID NO: 39810

SEQ ID NO: 329349 - RNA, 64 nt, Homo Sapiens; identical to SEQ ID NO: 39811

SEQ ID NO: 329350 - RNA, 64 nt, Homo Sapiens; identical to SEQ ID NO: 39812

SEQ ID NO: 329351 - RNA, 64 nt, Homo Sapiens; identical to SEQ ID NO: 39813

SEQ ID NO: 329352 - RNA, 64 nt, Homo Sapiens; identical to SEQ ID NO: 39814

SEQ ID NO: 329353 - RNA, 64 nt, Homo Sapiens; identical to SEQ ID NO: 39815

SEQ ID NO: 329354 - RNA, 64 nt, Homo Sapiens; identical to SEQ ID NO: 39816

SEQ ID NO: 329355 - RNA, 64 nt, Homo Sapiens; identical to SEQ ID NO: 39817

SEQ ID NO: 329356 - RNA, 64 nt, Homo Sapiens; identical to SEQ ID NO: 39818

SEQ ID NO: 329357 - RNA, 64 nt, Homo Sapiens; identical to SEQ ID NO: 39819

SEQ ID NO: 329358 - RNA, 64 nt, Homo Sapiens; identical to SEQ ID NO: 39820

SEQ ID NO: 329359 - RNA, 64 nt, Homo Sapiens; identical to SEQ ID NO: 39821

SEQ ID NO: 329360 - RNA, 64 nt, Homo Sapiens; identical to SEQ ID NO: 39822

SEQ ID NO: 329361 - RNA, 64 nt, Homo Sapiens; identical to SEQ ID NO: 39823

SEQ ID NO: 329362 - RNA, 64 nt, Homo Sapiens; identical to SEQ ID NO: 39824

SEQ ID NO: 329363 - RNA, 64 nt, Homo Sapiens; identical to SEQ ID NO: 39825

SEQ ID NO: 329364 - RNA, 64 nt, Homo Sapiens; identical to SEQ ID NO: 39826

SEQ ID NO: 329365 - RNA, 64 nt, Homo Sapiens; identical to SEQ ID NO: 39827

SEQ ID NO: 329366 - RNA, 64 nt, Homo Sapiens; identical to SEQ ID NO: 39828

SEQ ID NO: 329367 - RNA, 64 nt, Homo Sapiens; identical to SEQ ID NO: 39829

SEQ ID NO: 329368 - RNA, 64 nt, Homo Sapiens; identical to SEQ ID NO: 39830

SEQ ID NO: 329369 - RNA, 64 nt, Homo Sapiens; identical to SEQ ID NO: 39831

SEQ ID NO: 329370 - RNA, 64 nt, Homo Sapiens; identical to SEQ ID NO: 39832

SEQ ID NO: 329371 - RNA, 64 nt, Homo Sapiens; identical to SEQ ID NO: 39833

SEQ ID NO: 329372 - RNA, 64 nt, Homo Sapiens; identical to SEQ ID NO: 39834

SEQ ID NO: 329373 - RNA, 64 nt, Homo Sapiens; identical to SEQ ID NO: 39835

SEQ ID NO: 329374 - RNA, 64 nt, Homo Sapiens; identical to SEQ ID NO: 39836

SEQ ID NO: 329375 - RNA, 64 nt, Homo Sapiens; identical to SEQ ID NO: 39837

SEQ ID NO: 329376 - RNA, 64 nt, Homo Sapiens; identical to SEQ ID NO: 39838

SEQ ID NO: 329377 - RNA, 64 nt, Homo Sapiens; identical to SEQ ID NO: 39839

SEQ ID NO: 329378 - RNA, 64 nt, Homo Sapiens; identical to SEQ ID NO: 39840

SEQ ID NO: 329379 - RNA, 64 nt, Homo Sapiens; identical to SEQ ID NO: 39841

SEQ ID NO: 329380 - RNA, 64 nt, Homo Sapiens; identical to SEQ ID NO: 39842

SEQ ID NO: 329381 - RNA, 64 nt, Homo Sapiens; identical to SEQ ID NO: 39843

SEQ ID NO: 329382 - RNA, 64 nt, Homo Sapiens; identical to SEQ ID NO: 39844

SEQ ID NO: 329383 - RNA, 64 nt, Homo Sapiens; identical to SEQ ID NO: 39845

SEQ ID NO: 329384 - RNA, 64 nt, Homo Sapiens; identical to SEQ ID NO: 39846

SEQ ID NO: 329385 - RNA, 64 nt, Homo Sapiens; identical to SEQ ID NO: 39847

SEQ ID NO: 329386 - RNA, 64 nt, Homo Sapiens; identical to SEQ ID NO: 39848

SEQ ID NO: 329387 - RNA, 64 nt, Homo Sapiens; identical to SEQ ID NO: 39849

SEQ ID NO: 329388 - RNA, 64 nt, Homo Sapiens; identical to SEQ ID NO: 39850

SEQ ID NO: 329389 - RNA, 64 nt, Homo Sapiens; identical to SEQ ID NO: 39851

SEQ ID NO: 329390 - RNA, 64 nt, Homo Sapiens; identical to SEQ ID NO: 39852

SEQ ID NO: 329391 - RNA, 64 nt, Homo Sapiens; identical to SEQ ID NO: 39853

SEQ ID NO: 329392 - RNA, 64 nt, Homo Sapiens; identical to SEQ ID NO: 39854

SEQ ID NO: 329393 - RNA, 64 nt, Homo Sapiens; identical to SEQ ID NO: 39855

SEQ ID NO: 329394 - RNA, 64 nt, Homo Sapiens; identical to SEQ ID NO: 39856

SEQ ID NO: 329395 - RNA, 64 nt, Homo Sapiens; identical to SEQ ID NO: 39857

SEQ ID NO: 329396 - RNA, 64 nt, Homo Sapiens; identical to SEQ ID NO: 39858

SEQ ID NO: 329397 - RNA, 64 nt, Homo Sapiens; identical to SEQ ID NO: 39859

SEQ ID NO: 329398 - RNA, 64 nt, Homo Sapiens; identical to SEQ ID NO: 39860

SEQ ID NO: 329399 - RNA, 64 nt, Homo Sapiens; identical to SEQ ID NO: 39861

SEQ ID NO: 329400 - RNA, 64 nt, Homo Sapiens; identical to SEQ ID NO: 39862

SEQ ID NO: 329401 - RNA, 64 nt, Homo Sapiens; identical to SEQ ID NO: 39863

SEQ ID NO: 329402 - RNA, 64 nt, Homo Sapiens; identical to SEQ ID NO: 39864

SEQ ID NO: 329403 - RNA, 64 nt, Homo Sapiens; identical to SEQ ID NO: 39865

SEQ ID NO: 329404 - RNA, 64 nt, Homo Sapiens; identical to SEQ ID NO: 39866

SEQ ID NO: 329405 - RNA, 64 nt, Homo Sapiens; identical to SEQ ID NO: 39867

SEQ ID NO: 329406 - RNA, 64 nt, Homo Sapiens; identical to SEQ ID NO: 39868

SEQ ID NO: 329407 - RNA, 64 nt, Homo Sapiens; identical to SEQ ID NO: 39869

SEQ ID NO: 329408 - RNA, 64 nt, Homo Sapiens; identical to SEQ ID NO: 39870

SEQ ID NO: 329409 - RNA, 64 nt, Homo Sapiens; identical to SEQ ID NO: 39871

SEQ ID NO: 329410 - RNA, 64 nt, Homo Sapiens; identical to SEQ ID NO: 39872

SEQ ID NO: 329411 - RNA, 64 nt, Homo Sapiens; identical to SEQ ID NO: 39873

SEQ ID NO: 329412 - RNA, 64 nt, Homo Sapiens; identical to SEQ ID NO: 39874

SEQ ID NO: 329413 - RNA, 64 nt, Homo Sapiens; identical to SEQ ID NO: 39875

SEQ ID NO: 329414 - RNA, 64 nt, Homo Sapiens; identical to SEQ ID NO: 39876

SEQ ID NO: 329415 - RNA, 64 nt, Homo Sapiens; identical to SEQ ID NO: 39877

SEQ ID NO: 329416 - RNA, 64 nt, Homo Sapiens; identical to SEQ ID NO: 39878

SEQ ID NO: 329417 - RNA, 64 nt, Homo Sapiens; identical to SEQ ID NO: 39879

SEQ ID NO: 329418 - RNA, 64 nt, Homo Sapiens; identical to SEQ ID NO: 39880

SEQ ID NO: 329419 - RNA, 64 nt, Homo Sapiens; identical to SEQ ID NO: 39881

SEQ ID NO: 329420 - RNA, 64 nt, Homo Sapiens; identical to SEQ ID NO: 39882

SEQ ID NO: 329421 - RNA, 64 nt, Homo Sapiens; identical to SEQ ID NO: 39883

SEQ ID NO: 329422 - RNA, 64 nt, Homo Sapiens; identical to SEQ ID NO: 39884

SEQ ID NO: 329423 - RNA, 64 nt, Homo Sapiens; identical to SEQ ID NO: 39885

SEQ ID NO: 329424 - RNA, 64 nt, Homo Sapiens; identical to SEQ ID NO: 39886

SEQ ID NO: 329425 - RNA, 64 nt, Homo Sapiens; identical to SEQ ID NO: 39887

SEQ ID NO: 329426 - RNA, 64 nt, Homo Sapiens; identical to SEQ ID NO: 39888

SEQ ID NO: 329427 - RNA, 64 nt, Homo Sapiens; identical to SEQ ID NO: 39889

SEQ ID NO: 329428 - RNA, 64 nt, Homo Sapiens; identical to SEQ ID NO: 39890

SEQ ID NO: 329429 - RNA, 64 nt, Homo Sapiens; identical to SEQ ID NO: 39891

SEQ ID NO: 329430 - RNA, 64 nt, Homo Sapiens; identical to SEQ ID NO: 39892

SEQ ID NO: 329431 - RNA, 64 nt, Homo Sapiens; identical to SEQ ID NO: 39893

SEQ ID NO: 329432 - RNA, 64 nt, Homo Sapiens; identical to SEQ ID NO: 39894

SEQ ID NO: 329433 - RNA, 64 nt, Homo Sapiens; identical to SEQ ID NO: 39895

SEQ ID NO: 329434 - RNA, 64 nt, Homo Sapiens; identical to SEQ ID NO: 39896

SEQ ID NO: 329435 - RNA, 64 nt, Homo Sapiens; identical to SEQ ID NO: 39897

SEQ ID NO: 329436 - RNA, 64 nt, Homo Sapiens; identical to SEQ ID NO: 39898

SEQ ID NO: 329437 - RNA, 64 nt, Homo Sapiens; identical to SEQ ID NO: 39899

SEQ ID NO: 329438 - RNA, 64 nt, Homo Sapiens; identical to SEQ ID NO: 39900

SEQ ID NO: 329439 - RNA, 64 nt, Homo Sapiens; identical to SEQ ID NO: 39901

SEQ ID NO: 329440 - RNA, 64 nt, Homo Sapiens; identical to SEQ ID NO: 39902

SEQ ID NO: 329441 - RNA, 64 nt, Homo Sapiens; identical to SEQ ID NO: 39903

SEQ ID NO: 329442 - RNA, 64 nt, Homo Sapiens; identical to SEQ ID NO: 39904

SEQ ID NO: 329443 - RNA, 64 nt, Homo Sapiens; identical to SEQ ID NO: 39905

SEQ ID NO: 329444 - RNA, 64 nt, Homo Sapiens; identical to SEQ ID NO: 39906

SEQ ID NO: 329445 - RNA, 64 nt, Homo Sapiens; identical to SEQ ID NO: 39907

SEQ ID NO: 329446 - RNA, 64 nt, Homo Sapiens; identical to SEQ ID NO: 39908

SEQ ID NO: 329447 - RNA, 64 nt, Homo Sapiens; identical to SEQ ID NO: 39909

SEQ ID NO: 329448 - RNA, 64 nt, Homo Sapiens; identical to SEQ ID NO: 39910

SEQ ID NO: 329449 - RNA, 64 nt, Homo Sapiens; identical to SEQ ID NO: 39911

SEQ ID NO: 329450 - RNA, 64 nt, Homo Sapiens; identical to SEQ ID NO: 39912

SEQ ID NO: 329451 - RNA, 64 nt, Homo Sapiens; identical to SEQ ID NO: 39913

SEQ ID NO: 329452 - RNA, 64 nt, Homo Sapiens; identical to SEQ ID NO: 39914

SEQ ID NO: 329453 - RNA, 64 nt, Homo Sapiens; identical to SEQ ID NO: 39915

SEQ ID NO: 329454 - RNA, 64 nt, Homo Sapiens; identical to SEQ ID NO: 39916

SEQ ID NO: 329455 - RNA, 64 nt, Homo Sapiens; identical to SEQ ID NO: 39917

SEQ ID NO: 329456 - RNA, 64 nt, Homo Sapiens; identical to SEQ ID NO: 39918

SEQ ID NO: 329457 - RNA, 64 nt, Homo Sapiens; identical to SEQ ID NO: 39919

SEQ ID NO: 329458 - RNA, 64 nt, Homo Sapiens; identical to SEQ ID NO: 39920

SEQ ID NO: 329459 - RNA, 64 nt, Homo Sapiens; identical to SEQ ID NO: 39921

SEQ ID NO: 329460 - RNA, 64 nt, Homo Sapiens; identical to SEQ ID NO: 39922

SEQ ID NO: 329461 - RNA, 64 nt, Homo Sapiens; identical to SEQ ID NO: 39923

SEQ ID NO: 329462 - RNA, 64 nt, Homo Sapiens; identical to SEQ ID NO: 39924

SEQ ID NO: 329463 - RNA, 64 nt, Homo Sapiens; identical to SEQ ID NO: 39925

SEQ ID NO: 329464 - RNA, 64 nt, Homo Sapiens; identical to SEQ ID NO: 39926

SEQ ID NO: 329465 - RNA, 64 nt, Homo Sapiens; identical to SEQ ID NO: 39927

SEQ ID NO: 329466 - RNA, 64 nt, Homo Sapiens; identical to SEQ ID NO: 39928

SEQ ID NO: 329467 - RNA, 64 nt, Homo Sapiens; identical to SEQ ID NO: 39929

SEQ ID NO: 329468 - RNA, 64 nt, Homo Sapiens; identical to SEQ ID NO: 39930

SEQ ID NO: 329469 - RNA, 64 nt, Homo Sapiens; identical to SEQ ID NO: 39931

SEQ ID NO: 329470 - RNA, 64 nt, Homo Sapiens; identical to SEQ ID NO: 39932

SEQ ID NO: 329471 - RNA, 64 nt, Homo Sapiens; identical to SEQ ID NO: 39933

SEQ ID NO: 329472 - RNA, 64 nt, Homo Sapiens; identical to SEQ ID NO: 39934

SEQ ID NO: 329473 - RNA, 64 nt, Homo Sapiens; identical to SEQ ID NO: 39935

SEQ ID NO: 329474 - RNA, 64 nt, Homo Sapiens; identical to SEQ ID NO: 39936

SEQ ID NO: 329475 - RNA, 64 nt, Homo Sapiens; identical to SEQ ID NO: 39937

SEQ ID NO: 329476 - RNA, 64 nt, Homo Sapiens; identical to SEQ ID NO: 39938

SEQ ID NO: 329477 - RNA, 64 nt, Homo Sapiens; identical to SEQ ID NO: 39939

SEQ ID NO: 329478 - RNA, 64 nt, Homo Sapiens; identical to SEQ ID NO: 39940

SEQ ID NO: 329479 - RNA, 64 nt, Homo Sapiens; identical to SEQ ID NO: 39941

SEQ ID NO: 329480 - RNA, 64 nt, Homo Sapiens; identical to SEQ ID NO: 39942

SEQ ID NO: 329481 - RNA, 64 nt, Homo Sapiens; identical to SEQ ID NO: 39943

SEQ ID NO: 329482 - RNA, 64 nt, Homo Sapiens; identical to SEQ ID NO: 39944

SEQ ID NO: 329483 - RNA, 64 nt, Homo Sapiens; identical to SEQ ID NO: 39945

SEQ ID NO: 329484 - RNA, 64 nt, Homo Sapiens; identical to SEQ ID NO: 39946

SEQ ID NO: 329485 - RNA, 64 nt, Homo Sapiens; identical to SEQ ID NO: 39947

SEQ ID NO: 329486 - RNA, 64 nt, Homo Sapiens; identical to SEQ ID NO: 39948

SEQ ID NO: 329487 - RNA, 64 nt, Homo Sapiens; identical to SEQ ID NO: 39949

SEQ ID NO: 329488 - RNA, 64 nt, Homo Sapiens; identical to SEQ ID NO: 39950

SEQ ID NO: 329489 - RNA, 64 nt, Homo Sapiens; identical to SEQ ID NO: 39951

SEQ ID NO: 329490 - RNA, 64 nt, Homo Sapiens; identical to SEQ ID NO: 39952

SEQ ID NO: 329491 - RNA, 64 nt, Homo Sapiens; identical to SEQ ID NO: 39953

SEQ ID NO: 329492 - RNA, 64 nt, Homo Sapiens; identical to SEQ ID NO: 39954

SEQ ID NO: 329493 - RNA, 64 nt, Homo Sapiens; identical to SEQ ID NO: 39955

SEQ ID NO: 329494 - RNA, 64 nt, Homo Sapiens; identical to SEQ ID NO: 39956

SEQ ID NO: 329495 - RNA, 64 nt, Homo Sapiens; identical to SEQ ID NO: 39957

SEQ ID NO: 329496 - RNA, 64 nt, Homo Sapiens; identical to SEQ ID NO: 39958

SEQ ID NO: 329497 - RNA, 64 nt, Homo Sapiens; identical to SEQ ID NO: 39959

SEQ ID NO: 329498 - RNA, 64 nt, Homo Sapiens; identical to SEQ ID NO: 39960

SEQ ID NO: 329499 - RNA, 64 nt, Homo Sapiens; identical to SEQ ID NO: 39961

SEQ ID NO: 329500 - RNA, 64 nt, Homo Sapiens; identical to SEQ ID NO: 39962

SEQ ID NO: 329501 - RNA, 64 nt, Homo Sapiens; identical to SEQ ID NO: 39963

SEQ ID NO: 329502 - RNA, 64 nt, Homo Sapiens; identical to SEQ ID NO: 39964

SEQ ID NO: 329503 - RNA, 64 nt, Homo Sapiens; identical to SEQ ID NO: 39965

SEQ ID NO: 329504 - RNA, 64 nt, Homo Sapiens; identical to SEQ ID NO: 39966

SEQ ID NO: 329505 - RNA, 64 nt, Homo Sapiens; identical to SEQ ID NO: 39967

SEQ ID NO: 329506 - RNA, 64 nt, Homo Sapiens; identical to SEQ ID NO: 39968

SEQ ID NO: 329507 - RNA, 64 nt, Homo Sapiens; identical to SEQ ID NO: 39969

SEQ ID NO: 329508 - RNA, 64 nt, Homo Sapiens; identical to SEQ ID NO: 39970

SEQ ID NO: 329509 - RNA, 64 nt, Homo Sapiens; identical to SEQ ID NO: 39971

SEQ ID NO: 329510 - RNA, 64 nt, Homo Sapiens; identical to SEQ ID NO: 39972

SEQ ID NO: 329511 - RNA, 64 nt, Homo Sapiens; identical to SEQ ID NO: 39973

SEQ ID NO: 329512 - RNA, 64 nt, Homo Sapiens; identical to SEQ ID NO: 39974

SEQ ID NO: 329513 - RNA, 64 nt, Homo Sapiens; identical to SEQ ID NO: 39975

SEQ ID NO: 329514 - RNA, 64 nt, Homo Sapiens; identical to SEQ ID NO: 39976

SEQ ID NO: 329515 - RNA, 64 nt, Homo Sapiens; identical to SEQ ID NO: 39977

SEQ ID NO: 329516 - RNA, 64 nt, Homo Sapiens; identical to SEQ ID NO: 39978

SEQ ID NO: 329517 - RNA, 64 nt, Homo Sapiens; identical to SEQ ID NO: 39979

SEQ ID NO: 329518 - RNA, 64 nt, Homo Sapiens; identical to SEQ ID NO: 39980

SEQ ID NO: 329519 - RNA, 64 nt, Homo Sapiens; identical to SEQ ID NO: 39981

SEQ ID NO: 329520 - RNA, 64 nt, Homo Sapiens; identical to SEQ ID NO: 39982

SEQ ID NO: 329521 - RNA, 64 nt, Homo Sapiens; identical to SEQ ID NO: 39983

SEQ ID NO: 329522 - RNA, 64 nt, Homo Sapiens; identical to SEQ ID NO: 39984

SEQ ID NO: 329523 - RNA, 64 nt, Homo Sapiens; identical to SEQ ID NO: 39985

SEQ ID NO: 329524 - RNA, 64 nt, Homo Sapiens; identical to SEQ ID NO: 39986

SEQ ID NO: 329525 - RNA, 64 nt, Homo Sapiens; identical to SEQ ID NO: 39987

SEQ ID NO: 329526 - RNA, 64 nt, Homo Sapiens; identical to SEQ ID NO: 39988

SEQ ID NO: 329527 - RNA, 64 nt, Homo Sapiens; identical to SEQ ID NO: 39989

SEQ ID NO: 329528 - RNA, 64 nt, Homo Sapiens; identical to SEQ ID NO: 39990

SEQ ID NO: 329529 - RNA, 64 nt, Homo Sapiens; identical to SEQ ID NO: 39991

SEQ ID NO: 329530 - RNA, 64 nt, Homo Sapiens; identical to SEQ ID NO: 39992

SEQ ID NO: 329531 - RNA, 64 nt, Homo Sapiens; identical to SEQ ID NO: 39993

SEQ ID NO: 329532 - RNA, 64 nt, Homo Sapiens; identical to SEQ ID NO: 39994

SEQ ID NO: 329533 - RNA, 64 nt, Homo Sapiens; identical to SEQ ID NO: 39995

SEQ ID NO: 329534 - RNA, 64 nt, Homo Sapiens; identical to SEQ ID NO: 39996

SEQ ID NO: 329535 - RNA, 64 nt, Homo Sapiens; identical to SEQ ID NO: 39997

SEQ ID NO: 329536 - RNA, 64 nt, Homo Sapiens; identical to SEQ ID NO: 39998

SEQ ID NO: 329537 - RNA, 64 nt, Homo Sapiens; identical to SEQ ID NO: 39999

SEQ ID NO: 329538 - RNA, 64 nt, Homo Sapiens; identical to SEQ ID NO: 40000

SEQ ID NO: 329539 - RNA, 64 nt, Homo Sapiens; identical to SEQ ID NO: 40001

SEQ ID NO: 329540 - RNA, 64 nt, Homo Sapiens; identical to SEQ ID NO: 40002

SEQ ID NO: 329541 - RNA, 64 nt, Homo Sapiens; identical to SEQ ID NO: 40003

SEQ ID NO: 329542 - RNA, 64 nt, Homo Sapiens; identical to SEQ ID NO: 40004

SEQ ID NO: 329543 - RNA, 64 nt, Homo Sapiens; identical to SEQ ID NO: 40005

SEQ ID NO: 329544 - RNA, 64 nt, Homo Sapiens; identical to SEQ ID NO: 40006

SEQ ID NO: 329545 - RNA, 64 nt, Homo Sapiens; identical to SEQ ID NO: 40007

SEQ ID NO: 329546 - RNA, 64 nt, Homo Sapiens; identical to SEQ ID NO: 40008

SEQ ID NO: 329547 - RNA, 64 nt, Homo Sapiens; identical to SEQ ID NO: 40009

SEQ ID NO: 329548 - RNA, 64 nt, Homo Sapiens; identical to SEQ ID NO: 40010

SEQ ID NO: 329549 - RNA, 64 nt, Homo Sapiens; identical to SEQ ID NO: 40011

SEQ ID NO: 329550 - RNA, 64 nt, Homo Sapiens; identical to SEQ ID NO: 40012

SEQ ID NO: 329551 - RNA, 64 nt, Homo Sapiens; identical to SEQ ID NO: 40013

SEQ ID NO: 329552 - RNA, 64 nt, Homo Sapiens; identical to SEQ ID NO: 40014

SEQ ID NO: 329553 - RNA, 64 nt, Homo Sapiens; identical to SEQ ID NO: 40015

SEQ ID NO: 329554 - RNA, 64 nt, Homo Sapiens; identical to SEQ ID NO: 40016

SEQ ID NO: 329555 - RNA, 64 nt, Homo Sapiens; identical to SEQ ID NO: 40017

SEQ ID NO: 329556 - RNA, 64 nt, Homo Sapiens; identical to SEQ ID NO: 40018

SEQ ID NO: 329557 - RNA, 64 nt, Homo Sapiens; identical to SEQ ID NO: 40019

SEQ ID NO: 329558 - RNA, 64 nt, Homo Sapiens; identical to SEQ ID NO: 40020

SEQ ID NO: 329559 - RNA, 64 nt, Homo Sapiens; identical to SEQ ID NO: 40021

SEQ ID NO: 329560 - RNA, 64 nt, Homo Sapiens; identical to SEQ ID NO: 40022

SEQ ID NO: 329561 - RNA, 64 nt, Homo Sapiens; identical to SEQ ID NO: 40023

SEQ ID NO: 329562 - RNA, 64 nt, Homo Sapiens; identical to SEQ ID NO: 40024

SEQ ID NO: 329563 - RNA, 64 nt, Homo Sapiens; identical to SEQ ID NO: 40025

SEQ ID NO: 329564 - RNA, 64 nt, Homo Sapiens; identical to SEQ ID NO: 40026

SEQ ID NO: 329565 - RNA, 64 nt, Homo Sapiens; identical to SEQ ID NO: 40027

SEQ ID NO: 329566 - RNA, 64 nt, Homo Sapiens; identical to SEQ ID NO: 40028

SEQ ID NO: 329567 - RNA, 64 nt, Homo Sapiens; identical to SEQ ID NO: 40029

SEQ ID NO: 329568 - RNA, 64 nt, Homo Sapiens; identical to SEQ ID NO: 40030

SEQ ID NO: 329569 - RNA, 64 nt, Homo Sapiens; identical to SEQ ID NO: 40031

SEQ ID NO: 329570 - RNA, 64 nt, Homo Sapiens; identical to SEQ ID NO: 40032

SEQ ID NO: 329571 - RNA, 64 nt, Homo Sapiens; identical to SEQ ID NO: 40033

SEQ ID NO: 329572 - RNA, 64 nt, Homo Sapiens; identical to SEQ ID NO: 40034

SEQ ID NO: 329573 - RNA, 64 nt, Homo Sapiens; identical to SEQ ID NO: 40035

SEQ ID NO: 329574 - RNA, 64 nt, Homo Sapiens; identical to SEQ ID NO: 40036

SEQ ID NO: 329575 - RNA, 64 nt, Homo Sapiens; identical to SEQ ID NO: 40037

SEQ ID NO: 329576 - RNA, 64 nt, Homo Sapiens; identical to SEQ ID NO: 40038

SEQ ID NO: 329577 - RNA, 64 nt, Homo Sapiens; identical to SEQ ID NO: 40039

SEQ ID NO: 329578 - RNA, 64 nt, Homo Sapiens; identical to SEQ ID NO: 40040

SEQ ID NO: 329579 - RNA, 64 nt, Homo Sapiens; identical to SEQ ID NO: 40041

SEQ ID NO: 329580 - RNA, 64 nt, Homo Sapiens; identical to SEQ ID NO: 40042

SEQ ID NO: 329581 - RNA, 64 nt, Homo Sapiens; identical to SEQ ID NO: 40043

SEQ ID NO: 329582 - RNA, 64 nt, Homo Sapiens; identical to SEQ ID NO: 40044

SEQ ID NO: 329583 - RNA, 64 nt, Homo Sapiens; identical to SEQ ID NO: 40045

SEQ ID NO: 329584 - RNA, 64 nt, Homo Sapiens; identical to SEQ ID NO: 40046

SEQ ID NO: 329585 - RNA, 64 nt, Homo Sapiens; identical to SEQ ID NO: 40047

SEQ ID NO: 329586 - RNA, 64 nt, Homo Sapiens; identical to SEQ ID NO: 40048

SEQ ID NO: 329587 - RNA, 64 nt, Homo Sapiens; identical to SEQ ID NO: 40049

SEQ ID NO: 329588 - RNA, 64 nt, Homo Sapiens; identical to SEQ ID NO: 40050

SEQ ID NO: 329589 - RNA, 64 nt, Homo Sapiens; identical to SEQ ID NO: 40051

SEQ ID NO: 329590 - RNA, 64 nt, Homo Sapiens; identical to SEQ ID NO: 40052

SEQ ID NO: 329591 - RNA, 64 nt, Homo Sapiens; identical to SEQ ID NO: 40053

SEQ ID NO: 329592 - RNA, 64 nt, Homo Sapiens; identical to SEQ ID NO: 40054

SEQ ID NO: 329593 - RNA, 64 nt, Homo Sapiens; identical to SEQ ID NO: 40055

SEQ ID NO: 329594 - RNA, 64 nt, Homo Sapiens; identical to SEQ ID NO: 40056

SEQ ID NO: 329595 - RNA, 64 nt, Homo Sapiens; identical to SEQ ID NO: 40057

SEQ ID NO: 329596 - RNA, 64 nt, Homo Sapiens; identical to SEQ ID NO: 40058

SEQ ID NO: 329597 - RNA, 64 nt, Homo Sapiens; identical to SEQ ID NO: 40059

SEQ ID NO: 329598 - RNA, 64 nt, Homo Sapiens; identical to SEQ ID NO: 40060

SEQ ID NO: 329599 - RNA, 64 nt, Homo Sapiens; identical to SEQ ID NO: 40061

SEQ ID NO: 329600 - RNA, 64 nt, Homo Sapiens; identical to SEQ ID NO: 40062

SEQ ID NO: 329601 - RNA, 64 nt, Homo Sapiens; identical to SEQ ID NO: 40063

SEQ ID NO: 329602 - RNA, 64 nt, Homo Sapiens; identical to SEQ ID NO: 40064

SEQ ID NO: 329603 - RNA, 64 nt, Homo Sapiens; identical to SEQ ID NO: 40065

SEQ ID NO: 329604 - RNA, 64 nt, Homo Sapiens; identical to SEQ ID NO: 40066

SEQ ID NO: 329605 - RNA, 64 nt, Homo Sapiens; identical to SEQ ID NO: 40067

SEQ ID NO: 329606 - RNA, 64 nt, Homo Sapiens; identical to SEQ ID NO: 40068

SEQ ID NO: 329607 - RNA, 64 nt, Homo Sapiens; identical to SEQ ID NO: 40069

SEQ ID NO: 329608 - RNA, 64 nt, Homo Sapiens; identical to SEQ ID NO: 40070

SEQ ID NO: 329609 - RNA, 64 nt, Homo Sapiens; identical to SEQ ID NO: 40071

SEQ ID NO: 329610 - RNA, 64 nt, Homo Sapiens; identical to SEQ ID NO: 40072

SEQ ID NO: 329611 - RNA, 64 nt, Homo Sapiens; identical to SEQ ID NO: 40073

SEQ ID NO: 329612 - RNA, 64 nt, Homo Sapiens; identical to SEQ ID NO: 40074

SEQ ID NO: 329613 - RNA, 64 nt, Homo Sapiens; identical to SEQ ID NO: 40075

SEQ ID NO: 329614 - RNA, 64 nt, Homo Sapiens; identical to SEQ ID NO: 40076

SEQ ID NO: 329615 - RNA, 64 nt, Homo Sapiens; identical to SEQ ID NO: 40077

SEQ ID NO: 329616 - RNA, 64 nt, Homo Sapiens; identical to SEQ ID NO: 40078

SEQ ID NO: 329617 - RNA, 64 nt, Homo Sapiens; identical to SEQ ID NO: 40079

SEQ ID NO: 329618 - RNA, 64 nt, Homo Sapiens; identical to SEQ ID NO: 40080

SEQ ID NO: 329619 - RNA, 64 nt, Homo Sapiens; identical to SEQ ID NO: 40081

SEQ ID NO: 329620 - RNA, 64 nt, Homo Sapiens; identical to SEQ ID NO: 40082

SEQ ID NO: 329621 - RNA, 64 nt, Homo Sapiens; identical to SEQ ID NO: 40083

SEQ ID NO: 329622 - RNA, 64 nt, Homo Sapiens; identical to SEQ ID NO: 40084

SEQ ID NO: 329623 - RNA, 64 nt, Homo Sapiens; identical to SEQ ID NO: 40085

SEQ ID NO: 329624 - RNA, 64 nt, Homo Sapiens; identical to SEQ ID NO: 40086

SEQ ID NO: 329625 - RNA, 64 nt, Homo Sapiens; identical to SEQ ID NO: 40087

SEQ ID NO: 329626 - RNA, 64 nt, Homo Sapiens; identical to SEQ ID NO: 40088

SEQ ID NO: 329627 - RNA, 64 nt, Homo Sapiens; identical to SEQ ID NO: 40089

SEQ ID NO: 329628 - RNA, 64 nt, Homo Sapiens; identical to SEQ ID NO: 40090

SEQ ID NO: 329629 - RNA, 64 nt, Homo Sapiens; identical to SEQ ID NO: 40091

SEQ ID NO: 329630 - RNA, 64 nt, Homo Sapiens; identical to SEQ ID NO: 40092

SEQ ID NO: 329631 - RNA, 64 nt, Homo Sapiens; identical to SEQ ID NO: 40093

SEQ ID NO: 329632 - RNA, 64 nt, Homo Sapiens; identical to SEQ ID NO: 40094

SEQ ID NO: 329633 - RNA, 64 nt, Homo Sapiens; identical to SEQ ID NO: 40095

SEQ ID NO: 329634 - RNA, 64 nt, Homo Sapiens; identical to SEQ ID NO: 40096

SEQ ID NO: 329635 - RNA, 64 nt, Homo Sapiens; identical to SEQ ID NO: 40097

SEQ ID NO: 329636 - RNA, 64 nt, Homo Sapiens; identical to SEQ ID NO: 40098

SEQ ID NO: 329637 - RNA, 64 nt, Homo Sapiens; identical to SEQ ID NO: 40099

SEQ ID NO: 329638 - RNA, 64 nt, Homo Sapiens; identical to SEQ ID NO: 40100

SEQ ID NO: 329639 - RNA, 64 nt, Homo Sapiens; identical to SEQ ID NO: 40101

SEQ ID NO: 329640 - RNA, 64 nt, Homo Sapiens; identical to SEQ ID NO: 40102

SEQ ID NO: 329641 - RNA, 64 nt, Homo Sapiens; identical to SEQ ID NO: 40103

SEQ ID NO: 329642 - RNA, 64 nt, Homo Sapiens; identical to SEQ ID NO: 40104

SEQ ID NO: 329643 - RNA, 64 nt, Homo Sapiens; identical to SEQ ID NO: 40105

SEQ ID NO: 329644 - RNA, 64 nt, Homo Sapiens; identical to SEQ ID NO: 40106

SEQ ID NO: 329645 - RNA, 64 nt, Homo Sapiens; identical to SEQ ID NO: 40107

SEQ ID NO: 329646 - RNA, 64 nt, Homo Sapiens; identical to SEQ ID NO: 40108

SEQ ID NO: 329647 - RNA, 64 nt, Homo Sapiens; identical to SEQ ID NO: 40109

SEQ ID NO: 329648 - RNA, 64 nt, Homo Sapiens; identical to SEQ ID NO: 40110

SEQ ID NO: 329649 - RNA, 64 nt, Homo Sapiens; identical to SEQ ID NO: 40111

SEQ ID NO: 329650 - RNA, 64 nt, Homo Sapiens; identical to SEQ ID NO: 40112

SEQ ID NO: 329651 - RNA, 64 nt, Homo Sapiens; identical to SEQ ID NO: 40113

SEQ ID NO: 329652 - RNA, 64 nt, Homo Sapiens; identical to SEQ ID NO: 40114

SEQ ID NO: 329653 - RNA, 64 nt, Homo Sapiens; identical to SEQ ID NO: 40115

SEQ ID NO: 329654 - RNA, 64 nt, Homo Sapiens; identical to SEQ ID NO: 40116

SEQ ID NO: 329655 - RNA, 64 nt, Homo Sapiens; identical to SEQ ID NO: 40117

SEQ ID NO: 329656 - RNA, 64 nt, Homo Sapiens; identical to SEQ ID NO: 40118

SEQ ID NO: 329657 - RNA, 64 nt, Homo Sapiens; identical to SEQ ID NO: 40119

SEQ ID NO: 329658 - RNA, 64 nt, Homo Sapiens; identical to SEQ ID NO: 40120

SEQ ID NO: 329659 - RNA, 64 nt, Homo Sapiens; identical to SEQ ID NO: 40121

SEQ ID NO: 329660 - RNA, 64 nt, Homo Sapiens; identical to SEQ ID NO: 40122

SEQ ID NO: 329661 - RNA, 64 nt, Homo Sapiens; identical to SEQ ID NO: 40123

SEQ ID NO: 329662 - RNA, 64 nt, Homo Sapiens; identical to SEQ ID NO: 40124

SEQ ID NO: 329663 - RNA, 64 nt, Homo Sapiens; identical to SEQ ID NO: 40125

SEQ ID NO: 329664 - RNA, 64 nt, Homo Sapiens; identical to SEQ ID NO: 40126

SEQ ID NO: 329665 - RNA, 64 nt, Homo Sapiens; identical to SEQ ID NO: 40127

SEQ ID NO: 329666 - RNA, 64 nt, Homo Sapiens; identical to SEQ ID NO: 40128

SEQ ID NO: 329667 - RNA, 64 nt, Homo Sapiens; identical to SEQ ID NO: 40129

SEQ ID NO: 329668 - RNA, 64 nt, Homo Sapiens; identical to SEQ ID NO: 40130

SEQ ID NO: 329669 - RNA, 64 nt, Homo Sapiens; identical to SEQ ID NO: 40131

SEQ ID NO: 329670 - RNA, 64 nt, Homo Sapiens; identical to SEQ ID NO: 40132

SEQ ID NO: 329671 - RNA, 64 nt, Homo Sapiens; identical to SEQ ID NO: 40133

SEQ ID NO: 329672 - RNA, 64 nt, Homo Sapiens; identical to SEQ ID NO: 40134

SEQ ID NO: 329673 - RNA, 64 nt, Homo Sapiens; identical to SEQ ID NO: 40135

SEQ ID NO: 329674 - RNA, 64 nt, Homo Sapiens; identical to SEQ ID NO: 40136

SEQ ID NO: 329675 - RNA, 64 nt, Homo Sapiens; identical to SEQ ID NO: 40137

SEQ ID NO: 329676 - RNA, 64 nt, Homo Sapiens; identical to SEQ ID NO: 40138

SEQ ID NO: 329677 - RNA, 64 nt, Homo Sapiens; identical to SEQ ID NO: 40139

SEQ ID NO: 329678 - RNA, 64 nt, Homo Sapiens; identical to SEQ ID NO: 40140

SEQ ID NO: 329679 - RNA, 64 nt, Homo Sapiens; identical to SEQ ID NO: 40141

SEQ ID NO: 329680 - RNA, 64 nt, Homo Sapiens; identical to SEQ ID NO: 40142

SEQ ID NO: 329681 - RNA, 64 nt, Homo Sapiens; identical to SEQ ID NO: 40143

SEQ ID NO: 329682 - RNA, 64 nt, Homo Sapiens; identical to SEQ ID NO: 40144

SEQ ID NO: 329683 - RNA, 64 nt, Homo Sapiens; identical to SEQ ID NO: 40145

SEQ ID NO: 329684 - RNA, 64 nt, Homo Sapiens; identical to SEQ ID NO: 40146

SEQ ID NO: 329685 - RNA, 64 nt, Homo Sapiens; identical to SEQ ID NO: 40147

SEQ ID NO: 329686 - RNA, 64 nt, Homo Sapiens; identical to SEQ ID NO: 40148

SEQ ID NO: 329687 - RNA, 64 nt, Homo Sapiens; identical to SEQ ID NO: 40149

SEQ ID NO: 329688 - RNA, 64 nt, Homo Sapiens; identical to SEQ ID NO: 40150

SEQ ID NO: 329689 - RNA, 64 nt, Homo Sapiens; identical to SEQ ID NO: 40151

SEQ ID NO: 329690 - RNA, 64 nt, Homo Sapiens; identical to SEQ ID NO: 40152

SEQ ID NO: 329691 - RNA, 64 nt, Homo Sapiens; identical to SEQ ID NO: 40153

SEQ ID NO: 329692 - RNA, 64 nt, Homo Sapiens; identical to SEQ ID NO: 40154

SEQ ID NO: 329693 - RNA, 64 nt, Homo Sapiens; identical to SEQ ID NO: 40155

SEQ ID NO: 329694 - RNA, 64 nt, Homo Sapiens; identical to SEQ ID NO: 40156

SEQ ID NO: 329695 - RNA, 64 nt, Homo Sapiens; identical to SEQ ID NO: 40157

SEQ ID NO: 329696 - RNA, 64 nt, Homo Sapiens; identical to SEQ ID NO: 40158

SEQ ID NO: 329697 - RNA, 64 nt, Homo Sapiens; identical to SEQ ID NO: 40159

SEQ ID NO: 329698 - RNA, 64 nt, Homo Sapiens; identical to SEQ ID NO: 40160

SEQ ID NO: 329699 - RNA, 64 nt, Homo Sapiens; identical to SEQ ID NO: 40161

SEQ ID NO: 329700 - RNA, 64 nt, Homo Sapiens; identical to SEQ ID NO: 40162

SEQ ID NO: 329701 - RNA, 64 nt, Homo Sapiens; identical to SEQ ID NO: 40163

SEQ ID NO: 329702 - RNA, 64 nt, Homo Sapiens; identical to SEQ ID NO: 40164

SEQ ID NO: 329703 - RNA, 64 nt, Homo Sapiens; identical to SEQ ID NO: 40165

SEQ ID NO: 329704 - RNA, 64 nt, Homo Sapiens; identical to SEQ ID NO: 40166

SEQ ID NO: 329705 - RNA, 64 nt, Homo Sapiens; identical to SEQ ID NO: 40167

SEQ ID NO: 329706 - RNA, 64 nt, Homo Sapiens; identical to SEQ ID NO: 40168

SEQ ID NO: 329707 - RNA, 64 nt, Homo Sapiens; identical to SEQ ID NO: 40169

SEQ ID NO: 329708 - RNA, 64 nt, Homo Sapiens; identical to SEQ ID NO: 40170

SEQ ID NO: 329709 - RNA, 64 nt, Homo Sapiens; identical to SEQ ID NO: 40171

SEQ ID NO: 329710 - RNA, 64 nt, Homo Sapiens; identical to SEQ ID NO: 40172

SEQ ID NO: 329711 - RNA, 64 nt, Homo Sapiens; identical to SEQ ID NO: 40173

SEQ ID NO: 329712 - RNA, 64 nt, Homo Sapiens; identical to SEQ ID NO: 40174

SEQ ID NO: 329713 - RNA, 64 nt, Homo Sapiens; identical to SEQ ID NO: 40175

SEQ ID NO: 329714 - RNA, 64 nt, Homo Sapiens; identical to SEQ ID NO: 40176

SEQ ID NO: 329715 - RNA, 64 nt, Homo Sapiens; identical to SEQ ID NO: 40177

SEQ ID NO: 329716 - RNA, 64 nt, Homo Sapiens; identical to SEQ ID NO: 40178

SEQ ID NO: 329717 - RNA, 64 nt, Homo Sapiens; identical to SEQ ID NO: 40179

SEQ ID NO: 329718 - RNA, 64 nt, Homo Sapiens; identical to SEQ ID NO: 40180

SEQ ID NO: 329719 - RNA, 64 nt, Homo Sapiens; identical to SEQ ID NO: 40181

SEQ ID NO: 329720 - RNA, 64 nt, Homo Sapiens; identical to SEQ ID NO: 40182

SEQ ID NO: 329721 - RNA, 64 nt, Homo Sapiens; identical to SEQ ID NO: 40183

SEQ ID NO: 329722 - RNA, 64 nt, Homo Sapiens; identical to SEQ ID NO: 40184

SEQ ID NO: 329723 - RNA, 64 nt, Homo Sapiens; identical to SEQ ID NO: 40185

SEQ ID NO: 329724 - RNA, 64 nt, Homo Sapiens; identical to SEQ ID NO: 40186

SEQ ID NO: 329725 - RNA, 64 nt, Homo Sapiens; identical to SEQ ID NO: 40187

SEQ ID NO: 329726 - RNA, 64 nt, Homo Sapiens; identical to SEQ ID NO: 40188

SEQ ID NO: 329727 - RNA, 64 nt, Homo Sapiens; identical to SEQ ID NO: 40189

SEQ ID NO: 329728 - RNA, 64 nt, Homo Sapiens; identical to SEQ ID NO: 40190

SEQ ID NO: 329729 - RNA, 64 nt, Homo Sapiens; identical to SEQ ID NO: 40191

SEQ ID NO: 329730 - RNA, 64 nt, Homo Sapiens; identical to SEQ ID NO: 40192

SEQ ID NO: 329731 - RNA, 64 nt, Homo Sapiens; identical to SEQ ID NO: 40193

SEQ ID NO: 329732 - RNA, 64 nt, Homo Sapiens; identical to SEQ ID NO: 40194

SEQ ID NO: 329733 - RNA, 64 nt, Homo Sapiens; identical to SEQ ID NO: 40195

SEQ ID NO: 329734 - RNA, 64 nt, Homo Sapiens; identical to SEQ ID NO: 40196

SEQ ID NO: 329735 - RNA, 64 nt, Homo Sapiens; identical to SEQ ID NO: 40197

SEQ ID NO: 329736 - RNA, 64 nt, Homo Sapiens; identical to SEQ ID NO: 40198

SEQ ID NO: 329737 - RNA, 64 nt, Homo Sapiens; identical to SEQ ID NO: 40199

SEQ ID NO: 329738 - RNA, 64 nt, Homo Sapiens; identical to SEQ ID NO: 40200

SEQ ID NO: 329739 - RNA, 64 nt, Homo Sapiens; identical to SEQ ID NO: 40201

SEQ ID NO: 329740 - RNA, 64 nt, Homo Sapiens; identical to SEQ ID NO: 40202

SEQ ID NO: 329741 - RNA, 64 nt, Homo Sapiens; identical to SEQ ID NO: 40203

SEQ ID NO: 329742 - RNA, 64 nt, Homo Sapiens; identical to SEQ ID NO: 40204

SEQ ID NO: 329743 - RNA, 64 nt, Homo Sapiens; identical to SEQ ID NO: 40205

SEQ ID NO: 329744 - RNA, 64 nt, Homo Sapiens; identical to SEQ ID NO: 40206

SEQ ID NO: 329745 - RNA, 64 nt, Homo Sapiens; identical to SEQ ID NO: 40207

SEQ ID NO: 329746 - RNA, 64 nt, Homo Sapiens; identical to SEQ ID NO: 40208

SEQ ID NO: 329747 - RNA, 64 nt, Homo Sapiens; identical to SEQ ID NO: 40209

SEQ ID NO: 329748 - RNA, 64 nt, Homo Sapiens; identical to SEQ ID NO: 40210

SEQ ID NO: 329749 - RNA, 64 nt, Homo Sapiens; identical to SEQ ID NO: 40211

SEQ ID NO: 329750 - RNA, 64 nt, Homo Sapiens; identical to SEQ ID NO: 40212

SEQ ID NO: 329751 - RNA, 64 nt, Homo Sapiens; identical to SEQ ID NO: 40213

SEQ ID NO: 329752 - RNA, 64 nt, Homo Sapiens; identical to SEQ ID NO: 40214

SEQ ID NO: 329753 - RNA, 64 nt, Homo Sapiens; identical to SEQ ID NO: 40215

SEQ ID NO: 329754 - RNA, 64 nt, Homo Sapiens; identical to SEQ ID NO: 40216

SEQ ID NO: 329755 - RNA, 64 nt, Homo Sapiens; identical to SEQ ID NO: 40217

SEQ ID NO: 329756 - RNA, 64 nt, Homo Sapiens; identical to SEQ ID NO: 40218

SEQ ID NO: 329757 - RNA, 64 nt, Homo Sapiens; identical to SEQ ID NO: 40219

SEQ ID NO: 329758 - RNA, 64 nt, Homo Sapiens; identical to SEQ ID NO: 40220

SEQ ID NO: 329759 - RNA, 64 nt, Homo Sapiens; identical to SEQ ID NO: 40221

SEQ ID NO: 329760 - RNA, 64 nt, Homo Sapiens; identical to SEQ ID NO: 40222

SEQ ID NO: 329761 - RNA, 64 nt, Homo Sapiens; identical to SEQ ID NO: 40223

SEQ ID NO: 329762 - RNA, 64 nt, Homo Sapiens; identical to SEQ ID NO: 40224

SEQ ID NO: 329763 - RNA, 64 nt, Homo Sapiens; identical to SEQ ID NO: 40225

SEQ ID NO: 329764 - RNA, 64 nt, Homo Sapiens; identical to SEQ ID NO: 40226

SEQ ID NO: 329765 - RNA, 64 nt, Homo Sapiens; identical to SEQ ID NO: 40227

SEQ ID NO: 329766 - RNA, 64 nt, Homo Sapiens; identical to SEQ ID NO: 40228

SEQ ID NO: 329767 - RNA, 64 nt, Homo Sapiens; identical to SEQ ID NO: 40229

SEQ ID NO: 329768 - RNA, 64 nt, Homo Sapiens; identical to SEQ ID NO: 40230

SEQ ID NO: 329769 - RNA, 64 nt, Homo Sapiens; identical to SEQ ID NO: 40231

SEQ ID NO: 329770 - RNA, 64 nt, Homo Sapiens; identical to SEQ ID NO: 40232

SEQ ID NO: 329771 - RNA, 64 nt, Homo Sapiens; identical to SEQ ID NO: 40233

SEQ ID NO: 329772 - RNA, 64 nt, Homo Sapiens; identical to SEQ ID NO: 40234

SEQ ID NO: 329773 - RNA, 64 nt, Homo Sapiens; identical to SEQ ID NO: 40235

SEQ ID NO: 329774 - RNA, 64 nt, Homo Sapiens; identical to SEQ ID NO: 40236

SEQ ID NO: 329775 - RNA, 64 nt, Homo Sapiens; identical to SEQ ID NO: 40237

SEQ ID NO: 329776 - RNA, 64 nt, Homo Sapiens; identical to SEQ ID NO: 40238

SEQ ID NO: 329777 - RNA, 64 nt, Homo Sapiens; identical to SEQ ID NO: 40239

SEQ ID NO: 329778 - RNA, 64 nt, Homo Sapiens; identical to SEQ ID NO: 40240

SEQ ID NO: 329779 - RNA, 64 nt, Homo Sapiens; identical to SEQ ID NO: 40241

SEQ ID NO: 329780 - RNA, 64 nt, Homo Sapiens; identical to SEQ ID NO: 40242

SEQ ID NO: 329781 - RNA, 64 nt, Homo Sapiens; identical to SEQ ID NO: 40243

SEQ ID NO: 329782 - RNA, 64 nt, Homo Sapiens; identical to SEQ ID NO: 40244

SEQ ID NO: 329783 - RNA, 64 nt, Homo Sapiens; identical to SEQ ID NO: 40245

SEQ ID NO: 329784 - RNA, 64 nt, Homo Sapiens; identical to SEQ ID NO: 40246

SEQ ID NO: 329785 - RNA, 64 nt, Homo Sapiens; identical to SEQ ID NO: 40247

SEQ ID NO: 329786 - RNA, 64 nt, Homo Sapiens; identical to SEQ ID NO: 40248

SEQ ID NO: 329787 - RNA, 64 nt, Homo Sapiens; identical to SEQ ID NO: 40249

SEQ ID NO: 329788 - RNA, 64 nt, Homo Sapiens; identical to SEQ ID NO: 40250

SEQ ID NO: 329789 - RNA, 64 nt, Homo Sapiens; identical to SEQ ID NO: 40251

SEQ ID NO: 329790 - RNA, 64 nt, Homo Sapiens; identical to SEQ ID NO: 40252

SEQ ID NO: 329791 - RNA, 64 nt, Homo Sapiens; identical to SEQ ID NO: 40253

SEQ ID NO: 329792 - RNA, 64 nt, Homo Sapiens; identical to SEQ ID NO: 40254

SEQ ID NO: 329793 - RNA, 64 nt, Homo Sapiens; identical to SEQ ID NO: 40255

SEQ ID NO: 329794 - RNA, 64 nt, Homo Sapiens; identical to SEQ ID NO: 40256

SEQ ID NO: 329795 - RNA, 64 nt, Homo Sapiens; identical to SEQ ID NO: 40257

SEQ ID NO: 329796 - RNA, 64 nt, Homo Sapiens; identical to SEQ ID NO: 40258

SEQ ID NO: 329797 - RNA, 64 nt, Homo Sapiens; identical to SEQ ID NO: 40259

SEQ ID NO: 329798 - RNA, 64 nt, Homo Sapiens; identical to SEQ ID NO: 40260

SEQ ID NO: 329799 - RNA, 64 nt, Homo Sapiens; identical to SEQ ID NO: 40261

SEQ ID NO: 329800 - RNA, 64 nt, Homo Sapiens; identical to SEQ ID NO: 40262

SEQ ID NO: 329801 - RNA, 64 nt, Homo Sapiens; identical to SEQ ID NO: 40263

SEQ ID NO: 329802 - RNA, 64 nt, Homo Sapiens; identical to SEQ ID NO: 40264

SEQ ID NO: 329803 - RNA, 64 nt, Homo Sapiens; identical to SEQ ID NO: 40265

SEQ ID NO: 329804 - RNA, 64 nt, Homo Sapiens; identical to SEQ ID NO: 40266

SEQ ID NO: 329805 - RNA, 64 nt, Homo Sapiens; identical to SEQ ID NO: 40267

SEQ ID NO: 329806 - RNA, 64 nt, Homo Sapiens; identical to SEQ ID NO: 40268

SEQ ID NO: 329807 - RNA, 64 nt, Homo Sapiens; identical to SEQ ID NO: 40269

SEQ ID NO: 329808 - RNA, 64 nt, Homo Sapiens; identical to SEQ ID NO: 40270

SEQ ID NO: 329809 - RNA, 64 nt, Homo Sapiens; identical to SEQ ID NO: 40271

SEQ ID NO: 329810 - RNA, 64 nt, Homo Sapiens; identical to SEQ ID NO: 40272

SEQ ID NO: 329811 - RNA, 64 nt, Homo Sapiens; identical to SEQ ID NO: 40273

SEQ ID NO: 329812 - RNA, 64 nt, Homo Sapiens; identical to SEQ ID NO: 40274

SEQ ID NO: 329813 - RNA, 64 nt, Homo Sapiens; identical to SEQ ID NO: 40275

SEQ ID NO: 329814 - RNA, 64 nt, Homo Sapiens; identical to SEQ ID NO: 40276

SEQ ID NO: 329815 - RNA, 64 nt, Homo Sapiens; identical to SEQ ID NO: 40277

SEQ ID NO: 329816 - RNA, 64 nt, Homo Sapiens; identical to SEQ ID NO: 40278

SEQ ID NO: 329817 - RNA, 64 nt, Homo Sapiens; identical to SEQ ID NO: 40279

SEQ ID NO: 329818 - RNA, 64 nt, Homo Sapiens; identical to SEQ ID NO: 40280

SEQ ID NO: 329819 - RNA, 64 nt, Homo Sapiens; identical to SEQ ID NO: 40281

SEQ ID NO: 329820 - RNA, 64 nt, Homo Sapiens; identical to SEQ ID NO: 40282

SEQ ID NO: 329821 - RNA, 64 nt, Homo Sapiens; identical to SEQ ID NO: 40283

SEQ ID NO: 329822 - RNA, 64 nt, Homo Sapiens; identical to SEQ ID NO: 40284

SEQ ID NO: 329823 - RNA, 64 nt, Homo Sapiens; identical to SEQ ID NO: 40285

SEQ ID NO: 329824 - RNA, 64 nt, Homo Sapiens; identical to SEQ ID NO: 40286

SEQ ID NO: 329825 - RNA, 64 nt, Homo Sapiens; identical to SEQ ID NO: 40287

SEQ ID NO: 329826 - RNA, 64 nt, Homo Sapiens; identical to SEQ ID NO: 40288

SEQ ID NO: 329827 - RNA, 64 nt, Homo Sapiens; identical to SEQ ID NO: 40289

SEQ ID NO: 329828 - RNA, 64 nt, Homo Sapiens; identical to SEQ ID NO: 40290

SEQ ID NO: 329829 - RNA, 64 nt, Homo Sapiens; identical to SEQ ID NO: 40291

SEQ ID NO: 329830 - RNA, 64 nt, Homo Sapiens; identical to SEQ ID NO: 40292

SEQ ID NO: 329831 - RNA, 64 nt, Homo Sapiens; identical to SEQ ID NO: 40293

SEQ ID NO: 329832 - RNA, 64 nt, Homo Sapiens; identical to SEQ ID NO: 40294

SEQ ID NO: 329833 - RNA, 64 nt, Homo Sapiens; identical to SEQ ID NO: 40295

SEQ ID NO: 329834 - RNA, 64 nt, Homo Sapiens; identical to SEQ ID NO: 40296

SEQ ID NO: 329835 - RNA, 64 nt, Homo Sapiens; identical to SEQ ID NO: 40297

SEQ ID NO: 329836 - RNA, 64 nt, Homo Sapiens; identical to SEQ ID NO: 40298

SEQ ID NO: 329837 - RNA, 64 nt, Homo Sapiens; identical to SEQ ID NO: 40299

SEQ ID NO: 329838 - RNA, 64 nt, Homo Sapiens; identical to SEQ ID NO: 40300

SEQ ID NO: 329839 - RNA, 64 nt, Homo Sapiens; identical to SEQ ID NO: 40301

SEQ ID NO: 329840 - RNA, 64 nt, Homo Sapiens; identical to SEQ ID NO: 40302

SEQ ID NO: 329841 - RNA, 64 nt, Homo Sapiens; identical to SEQ ID NO: 40303

SEQ ID NO: 329842 - RNA, 64 nt, Homo Sapiens; identical to SEQ ID NO: 40304

SEQ ID NO: 329843 - RNA, 64 nt, Homo Sapiens; identical to SEQ ID NO: 40305

SEQ ID NO: 329844 - RNA, 64 nt, Homo Sapiens; identical to SEQ ID NO: 40306

SEQ ID NO: 329845 - RNA, 64 nt, Homo Sapiens; identical to SEQ ID NO: 40307

SEQ ID NO: 329846 - RNA, 64 nt, Homo Sapiens; identical to SEQ ID NO: 40308

SEQ ID NO: 329847 - RNA, 64 nt, Homo Sapiens; identical to SEQ ID NO: 40309

SEQ ID NO: 329848 - RNA, 64 nt, Homo Sapiens; identical to SEQ ID NO: 40310

SEQ ID NO: 329849 - RNA, 64 nt, Homo Sapiens; identical to SEQ ID NO: 40311

SEQ ID NO: 329850 - RNA, 64 nt, Homo Sapiens; identical to SEQ ID NO: 40312

SEQ ID NO: 329851 - RNA, 64 nt, Homo Sapiens; identical to SEQ ID NO: 40313

SEQ ID NO: 329852 - RNA, 64 nt, Homo Sapiens; identical to SEQ ID NO: 40314

SEQ ID NO: 329853 - RNA, 64 nt, Homo Sapiens; identical to SEQ ID NO: 40315

SEQ ID NO: 329854 - RNA, 64 nt, Homo Sapiens; identical to SEQ ID NO: 40316

SEQ ID NO: 329855 - RNA, 64 nt, Homo Sapiens; identical to SEQ ID NO: 40317

SEQ ID NO: 329856 - RNA, 64 nt, Homo Sapiens; identical to SEQ ID NO: 40318

SEQ ID NO: 329857 - RNA, 64 nt, Homo Sapiens; identical to SEQ ID NO: 40319

SEQ ID NO: 329858 - RNA, 64 nt, Homo Sapiens; identical to SEQ ID NO: 40320

SEQ ID NO: 329859 - RNA, 64 nt, Homo Sapiens; identical to SEQ ID NO: 40321

SEQ ID NO: 329860 - RNA, 64 nt, Homo Sapiens; identical to SEQ ID NO: 40322

SEQ ID NO: 329861 - RNA, 64 nt, Homo Sapiens; identical to SEQ ID NO: 40323

SEQ ID NO: 329862 - RNA, 64 nt, Homo Sapiens; identical to SEQ ID NO: 40324

SEQ ID NO: 329863 - RNA, 64 nt, Homo Sapiens; identical to SEQ ID NO: 40325

SEQ ID NO: 329864 - RNA, 64 nt, Homo Sapiens; identical to SEQ ID NO: 40326

SEQ ID NO: 329865 - RNA, 64 nt, Homo Sapiens; identical to SEQ ID NO: 40327

SEQ ID NO: 329866 - RNA, 64 nt, Homo Sapiens; identical to SEQ ID NO: 40328

SEQ ID NO: 329867 - RNA, 64 nt, Homo Sapiens; identical to SEQ ID NO: 40329

SEQ ID NO: 329868 - RNA, 64 nt, Homo Sapiens; identical to SEQ ID NO: 40330

SEQ ID NO: 329869 - RNA, 64 nt, Homo Sapiens; identical to SEQ ID NO: 40331

SEQ ID NO: 329870 - RNA, 64 nt, Homo Sapiens; identical to SEQ ID NO: 40332

SEQ ID NO: 329871 - RNA, 64 nt, Homo Sapiens; identical to SEQ ID NO: 40333

SEQ ID NO: 329872 - RNA, 64 nt, Homo Sapiens; identical to SEQ ID NO: 40334

SEQ ID NO: 329873 - RNA, 64 nt, Homo Sapiens; identical to SEQ ID NO: 40335

SEQ ID NO: 329874 - RNA, 64 nt, Homo Sapiens; identical to SEQ ID NO: 40336

SEQ ID NO: 329875 - RNA, 64 nt, Homo Sapiens; identical to SEQ ID NO: 40337

SEQ ID NO: 329876 - RNA, 64 nt, Homo Sapiens; identical to SEQ ID NO: 40338

SEQ ID NO: 329877 - RNA, 64 nt, Homo Sapiens; identical to SEQ ID NO: 40339

SEQ ID NO: 329878 - RNA, 64 nt, Homo Sapiens; identical to SEQ ID NO: 40340

SEQ ID NO: 329879 - RNA, 64 nt, Homo Sapiens; identical to SEQ ID NO: 40341

SEQ ID NO: 329880 - RNA, 64 nt, Homo Sapiens; identical to SEQ ID NO: 40342

SEQ ID NO: 329881 - RNA, 64 nt, Homo Sapiens; identical to SEQ ID NO: 40343

SEQ ID NO: 329882 - RNA, 64 nt, Homo Sapiens; identical to SEQ ID NO: 40344

SEQ ID NO: 329883 - RNA, 64 nt, Homo Sapiens; identical to SEQ ID NO: 40345

SEQ ID NO: 329884 - RNA, 64 nt, Homo Sapiens; identical to SEQ ID NO: 40346

SEQ ID NO: 329885 - RNA, 64 nt, Homo Sapiens; identical to SEQ ID NO: 40347

SEQ ID NO: 329886 - RNA, 64 nt, Homo Sapiens; identical to SEQ ID NO: 40348

SEQ ID NO: 329887 - RNA, 64 nt, Homo Sapiens; identical to SEQ ID NO: 40349

SEQ ID NO: 329888 - RNA, 64 nt, Homo Sapiens; identical to SEQ ID NO: 40350

SEQ ID NO: 329889 - RNA, 64 nt, Homo Sapiens; identical to SEQ ID NO: 40351

SEQ ID NO: 329890 - RNA, 64 nt, Homo Sapiens; identical to SEQ ID NO: 40352

SEQ ID NO: 329891 - RNA, 64 nt, Homo Sapiens; identical to SEQ ID NO: 40353

SEQ ID NO: 329892 - RNA, 64 nt, Homo Sapiens; identical to SEQ ID NO: 40354

SEQ ID NO: 329893 - RNA, 64 nt, Homo Sapiens; identical to SEQ ID NO: 40355

SEQ ID NO: 329894 - RNA, 64 nt, Homo Sapiens; identical to SEQ ID NO: 40356

SEQ ID NO: 329895 - RNA, 64 nt, Homo Sapiens; identical to SEQ ID NO: 40357

SEQ ID NO: 329896 - RNA, 64 nt, Homo Sapiens; identical to SEQ ID NO: 40358

SEQ ID NO: 329897 - RNA, 64 nt, Homo Sapiens; identical to SEQ ID NO: 40359

SEQ ID NO: 329898 - RNA, 64 nt, Homo Sapiens; identical to SEQ ID NO: 40360

SEQ ID NO: 329899 - RNA, 64 nt, Homo Sapiens; identical to SEQ ID NO: 40361

SEQ ID NO: 329900 - RNA, 64 nt, Homo Sapiens; identical to SEQ ID NO: 40362

SEQ ID NO: 329901 - RNA, 64 nt, Homo Sapiens; identical to SEQ ID NO: 40363

SEQ ID NO: 329902 - RNA, 64 nt, Homo Sapiens; identical to SEQ ID NO: 40364

SEQ ID NO: 329903 - RNA, 64 nt, Homo Sapiens; identical to SEQ ID NO: 40365

SEQ ID NO: 329904 - RNA, 64 nt, Homo Sapiens; identical to SEQ ID NO: 40366

SEQ ID NO: 329905 - RNA, 64 nt, Homo Sapiens; identical to SEQ ID NO: 40367

SEQ ID NO: 329906 - RNA, 64 nt, Homo Sapiens; identical to SEQ ID NO: 40368

SEQ ID NO: 329907 - RNA, 64 nt, Homo Sapiens; identical to SEQ ID NO: 40369

SEQ ID NO: 329908 - RNA, 64 nt, Homo Sapiens; identical to SEQ ID NO: 40370

SEQ ID NO: 329909 - RNA, 64 nt, Homo Sapiens; identical to SEQ ID NO: 40371

SEQ ID NO: 329910 - RNA, 64 nt, Homo Sapiens; identical to SEQ ID NO: 40372

SEQ ID NO: 329911 - RNA, 64 nt, Homo Sapiens; identical to SEQ ID NO: 40373

SEQ ID NO: 329912 - RNA, 64 nt, Homo Sapiens; identical to SEQ ID NO: 40374

SEQ ID NO: 329913 - RNA, 64 nt, Homo Sapiens; identical to SEQ ID NO: 40375

SEQ ID NO: 329914 - RNA, 64 nt, Homo Sapiens; identical to SEQ ID NO: 40376

SEQ ID NO: 329915 - RNA, 64 nt, Homo Sapiens; identical to SEQ ID NO: 40377

SEQ ID NO: 329916 - RNA, 64 nt, Homo Sapiens; identical to SEQ ID NO: 40378

SEQ ID NO: 329917 - RNA, 64 nt, Homo Sapiens; identical to SEQ ID NO: 40379

SEQ ID NO: 329918 - RNA, 64 nt, Homo Sapiens; identical to SEQ ID NO: 40380

SEQ ID NO: 329919 - RNA, 64 nt, Homo Sapiens; identical to SEQ ID NO: 40381

SEQ ID NO: 329920 - RNA, 64 nt, Homo Sapiens; identical to SEQ ID NO: 40382

SEQ ID NO: 329921 - RNA, 64 nt, Homo Sapiens; identical to SEQ ID NO: 40383

SEQ ID NO: 329922 - RNA, 64 nt, Homo Sapiens; identical to SEQ ID NO: 40384

SEQ ID NO: 329923 - RNA, 64 nt, Homo Sapiens; identical to SEQ ID NO: 40385

SEQ ID NO: 329924 - RNA, 64 nt, Homo Sapiens; identical to SEQ ID NO: 40386

SEQ ID NO: 329925 - RNA, 64 nt, Homo Sapiens; identical to SEQ ID NO: 40387

SEQ ID NO: 329926 - RNA, 64 nt, Homo Sapiens; identical to SEQ ID NO: 40388

SEQ ID NO: 329927 - RNA, 64 nt, Homo Sapiens; identical to SEQ ID NO: 40389

SEQ ID NO: 329928 - RNA, 64 nt, Homo Sapiens; identical to SEQ ID NO: 40390

SEQ ID NO: 329929 - RNA, 64 nt, Homo Sapiens; identical to SEQ ID NO: 40391

SEQ ID NO: 329930 - RNA, 64 nt, Homo Sapiens; identical to SEQ ID NO: 40392

SEQ ID NO: 329931 - RNA, 64 nt, Homo Sapiens; identical to SEQ ID NO: 40393

SEQ ID NO: 329932 - RNA, 64 nt, Homo Sapiens; identical to SEQ ID NO: 40394

SEQ ID NO: 329933 - RNA, 64 nt, Homo Sapiens; identical to SEQ ID NO: 40395

SEQ ID NO: 329934 - RNA, 64 nt, Homo Sapiens; identical to SEQ ID NO: 40396

SEQ ID NO: 329935 - RNA, 64 nt, Homo Sapiens; identical to SEQ ID NO: 40397

SEQ ID NO: 329936 - RNA, 64 nt, Homo Sapiens; identical to SEQ ID NO: 40398

SEQ ID NO: 329937 - RNA, 64 nt, Homo Sapiens; identical to SEQ ID NO: 40399

SEQ ID NO: 329938 - RNA, 64 nt, Homo Sapiens; identical to SEQ ID NO: 40400

SEQ ID NO: 329939 - RNA, 64 nt, Homo Sapiens; identical to SEQ ID NO: 40401

SEQ ID NO: 329940 - RNA, 64 nt, Homo Sapiens; identical to SEQ ID NO: 40402

SEQ ID NO: 329941 - RNA, 64 nt, Homo Sapiens; identical to SEQ ID NO: 40403

SEQ ID NO: 329942 - RNA, 64 nt, Homo Sapiens; identical to SEQ ID NO: 40404

SEQ ID NO: 329943 - RNA, 64 nt, Homo Sapiens; identical to SEQ ID NO: 40405

SEQ ID NO: 329944 - RNA, 64 nt, Homo Sapiens; identical to SEQ ID NO: 40406

SEQ ID NO: 329945 - RNA, 64 nt, Homo Sapiens; identical to SEQ ID NO: 40407

SEQ ID NO: 329946 - RNA, 64 nt, Homo Sapiens; identical to SEQ ID NO: 40408

SEQ ID NO: 329947 - RNA, 64 nt, Homo Sapiens; identical to SEQ ID NO: 40409

SEQ ID NO: 329948 - RNA, 64 nt, Homo Sapiens; identical to SEQ ID NO: 40410

SEQ ID NO: 329949 - RNA, 64 nt, Homo Sapiens; identical to SEQ ID NO: 40411

SEQ ID NO: 329950 - RNA, 64 nt, Homo Sapiens; identical to SEQ ID NO: 40412

SEQ ID NO: 329951 - RNA, 64 nt, Homo Sapiens; identical to SEQ ID NO: 40413

SEQ ID NO: 329952 - RNA, 64 nt, Homo Sapiens; identical to SEQ ID NO: 40414

SEQ ID NO: 329953 - RNA, 64 nt, Homo Sapiens; identical to SEQ ID NO: 40415

SEQ ID NO: 329954 - RNA, 64 nt, Homo Sapiens; identical to SEQ ID NO: 40416

SEQ ID NO: 329955 - RNA, 64 nt, Homo Sapiens; identical to SEQ ID NO: 40417

SEQ ID NO: 329956 - RNA, 64 nt, Homo Sapiens; identical to SEQ ID NO: 40418

SEQ ID NO: 329957 - RNA, 64 nt, Homo Sapiens; identical to SEQ ID NO: 40419

SEQ ID NO: 329958 - RNA, 64 nt, Homo Sapiens; identical to SEQ ID NO: 40420

SEQ ID NO: 329959 - RNA, 64 nt, Homo Sapiens; identical to SEQ ID NO: 40421

SEQ ID NO: 329960 - RNA, 64 nt, Homo Sapiens; identical to SEQ ID NO: 40422

SEQ ID NO: 329961 - RNA, 64 nt, Homo Sapiens; identical to SEQ ID NO: 40423

SEQ ID NO: 329962 - RNA, 64 nt, Homo Sapiens; identical to SEQ ID NO: 40424

SEQ ID NO: 329963 - RNA, 64 nt, Homo Sapiens; identical to SEQ ID NO: 40425

SEQ ID NO: 329964 - RNA, 64 nt, Homo Sapiens; identical to SEQ ID NO: 40426

SEQ ID NO: 329965 - RNA, 64 nt, Homo Sapiens; identical to SEQ ID NO: 40427

SEQ ID NO: 329966 - RNA, 64 nt, Homo Sapiens; identical to SEQ ID NO: 40428

SEQ ID NO: 329967 - RNA, 64 nt, Homo Sapiens; identical to SEQ ID NO: 40429

SEQ ID NO: 329968 - RNA, 64 nt, Homo Sapiens; identical to SEQ ID NO: 40430

SEQ ID NO: 329969 - RNA, 64 nt, Homo Sapiens; identical to SEQ ID NO: 40431

SEQ ID NO: 329970 - RNA, 64 nt, Homo Sapiens; identical to SEQ ID NO: 40432

SEQ ID NO: 329971 - RNA, 64 nt, Homo Sapiens; identical to SEQ ID NO: 40433

SEQ ID NO: 329972 - RNA, 64 nt, Homo Sapiens; identical to SEQ ID NO: 40434

SEQ ID NO: 329973 - RNA, 64 nt, Homo Sapiens; identical to SEQ ID NO: 40435

SEQ ID NO: 329974 - RNA, 64 nt, Homo Sapiens; identical to SEQ ID NO: 40436

SEQ ID NO: 329975 - RNA, 64 nt, Homo Sapiens; identical to SEQ ID NO: 40437

SEQ ID NO: 329976 - RNA, 64 nt, Homo Sapiens; identical to SEQ ID NO: 40438

SEQ ID NO: 329977 - RNA, 64 nt, Homo Sapiens; identical to SEQ ID NO: 40439

SEQ ID NO: 329978 - RNA, 64 nt, Homo Sapiens; identical to SEQ ID NO: 40440

SEQ ID NO: 329979 - RNA, 64 nt, Homo Sapiens; identical to SEQ ID NO: 40441

SEQ ID NO: 329980 - RNA, 64 nt, Homo Sapiens; identical to SEQ ID NO: 40442

SEQ ID NO: 329981 - RNA, 64 nt, Homo Sapiens; identical to SEQ ID NO: 40443

SEQ ID NO: 329982 - RNA, 64 nt, Homo Sapiens; identical to SEQ ID NO: 40444

SEQ ID NO: 329983 - RNA, 64 nt, Homo Sapiens; identical to SEQ ID NO: 40445

SEQ ID NO: 329984 - RNA, 64 nt, Homo Sapiens; identical to SEQ ID NO: 40446

SEQ ID NO: 329985 - RNA, 64 nt, Homo Sapiens; identical to SEQ ID NO: 40447

SEQ ID NO: 329986 - RNA, 64 nt, Homo Sapiens; identical to SEQ ID NO: 40448

SEQ ID NO: 329987 - RNA, 64 nt, Homo Sapiens; identical to SEQ ID NO: 40449

SEQ ID NO: 329988 - RNA, 64 nt, Homo Sapiens; identical to SEQ ID NO: 40450

SEQ ID NO: 329989 - RNA, 64 nt, Homo Sapiens; identical to SEQ ID NO: 40451

SEQ ID NO: 329990 - RNA, 64 nt, Homo Sapiens; identical to SEQ ID NO: 40452

SEQ ID NO: 329991 - RNA, 64 nt, Homo Sapiens; identical to SEQ ID NO: 40453

SEQ ID NO: 329992 - RNA, 64 nt, Homo Sapiens; identical to SEQ ID NO: 40454

SEQ ID NO: 329993 - RNA, 64 nt, Homo Sapiens; identical to SEQ ID NO: 40455

SEQ ID NO: 329994 - RNA, 64 nt, Homo Sapiens; identical to SEQ ID NO: 40456

SEQ ID NO: 329995 - RNA, 64 nt, Homo Sapiens; identical to SEQ ID NO: 40457

SEQ ID NO: 329996 - RNA, 64 nt, Homo Sapiens; identical to SEQ ID NO: 40458

SEQ ID NO: 329997 - RNA, 64 nt, Homo Sapiens; identical to SEQ ID NO: 40459

SEQ ID NO: 329998 - RNA, 64 nt, Homo Sapiens; identical to SEQ ID NO: 40460

SEQ ID NO: 329999 - RNA, 64 nt, Homo Sapiens; identical to SEQ ID NO: 40461

SEQ ID NO: 330000 - RNA, 64 nt, Homo Sapiens; identical to SEQ ID NO: 40462

SEQ ID NO: 330001 - RNA, 64 nt, Homo Sapiens; identical to SEQ ID NO: 40463

SEQ ID NO: 330002 - RNA, 64 nt, Homo Sapiens; identical to SEQ ID NO: 40464

SEQ ID NO: 330003 - RNA, 64 nt, Homo Sapiens; identical to SEQ ID NO: 40465

SEQ ID NO: 330004 - RNA, 64 nt, Homo Sapiens; identical to SEQ ID NO: 40466

SEQ ID NO: 330005 - RNA, 64 nt, Homo Sapiens; identical to SEQ ID NO: 40467

SEQ ID NO: 330006 - RNA, 64 nt, Homo Sapiens; identical to SEQ ID NO: 40468

SEQ ID NO: 330007 - RNA, 64 nt, Homo Sapiens; identical to SEQ ID NO: 40469

SEQ ID NO: 330008 - RNA, 64 nt, Homo Sapiens; identical to SEQ ID NO: 40470

SEQ ID NO: 330009 - RNA, 64 nt, Homo Sapiens; identical to SEQ ID NO: 40471

SEQ ID NO: 330010 - RNA, 64 nt, Homo Sapiens; identical to SEQ ID NO: 40472

SEQ ID NO: 330011 - RNA, 64 nt, Homo Sapiens; identical to SEQ ID NO: 40473

SEQ ID NO: 330012 - RNA, 64 nt, Homo Sapiens; identical to SEQ ID NO: 40474

SEQ ID NO: 330013 - RNA, 64 nt, Homo Sapiens; identical to SEQ ID NO: 40475

SEQ ID NO: 330014 - RNA, 64 nt, Homo Sapiens; identical to SEQ ID NO: 40476

SEQ ID NO: 330015 - RNA, 64 nt, Homo Sapiens; identical to SEQ ID NO: 40477

SEQ ID NO: 330016 - RNA, 64 nt, Homo Sapiens; identical to SEQ ID NO: 40478

SEQ ID NO: 330017 - RNA, 64 nt, Homo Sapiens; identical to SEQ ID NO: 40479

SEQ ID NO: 330018 - RNA, 64 nt, Homo Sapiens; identical to SEQ ID NO: 40480

SEQ ID NO: 330019 - RNA, 64 nt, Homo Sapiens; identical to SEQ ID NO: 40481

SEQ ID NO: 330020 - RNA, 64 nt, Homo Sapiens; identical to SEQ ID NO: 40482

SEQ ID NO: 330021 - RNA, 64 nt, Homo Sapiens; identical to SEQ ID NO: 40483

SEQ ID NO: 330022 - RNA, 64 nt, Homo Sapiens; identical to SEQ ID NO: 40484

SEQ ID NO: 330023 - RNA, 64 nt, Homo Sapiens; identical to SEQ ID NO: 40485

SEQ ID NO: 330024 - RNA, 64 nt, Homo Sapiens; identical to SEQ ID NO: 40486

SEQ ID NO: 330025 - RNA, 64 nt, Homo Sapiens; identical to SEQ ID NO: 40487

SEQ ID NO: 330026 - RNA, 64 nt, Homo Sapiens; identical to SEQ ID NO: 40488

SEQ ID NO: 330027 - RNA, 64 nt, Homo Sapiens; identical to SEQ ID NO: 40489

SEQ ID NO: 330028 - RNA, 64 nt, Homo Sapiens; identical to SEQ ID NO: 40490

SEQ ID NO: 330029 - RNA, 64 nt, Homo Sapiens; identical to SEQ ID NO: 40491

SEQ ID NO: 330030 - RNA, 64 nt, Homo Sapiens; identical to SEQ ID NO: 40492

SEQ ID NO: 330031 - RNA, 64 nt, Homo Sapiens; identical to SEQ ID NO: 40493

SEQ ID NO: 330032 - RNA, 64 nt, Homo Sapiens; identical to SEQ ID NO: 40494

SEQ ID NO: 330033 - RNA, 64 nt, Homo Sapiens; identical to SEQ ID NO: 40495

SEQ ID NO: 330034 - RNA, 64 nt, Homo Sapiens; identical to SEQ ID NO: 40496

SEQ ID NO: 330035 - RNA, 64 nt, Homo Sapiens; identical to SEQ ID NO: 40497

SEQ ID NO: 330036 - RNA, 64 nt, Homo Sapiens; identical to SEQ ID NO: 40498

SEQ ID NO: 330037 - RNA, 64 nt, Homo Sapiens; identical to SEQ ID NO: 40499

SEQ ID NO: 330038 - RNA, 64 nt, Homo Sapiens; identical to SEQ ID NO: 40500

SEQ ID NO: 330039 - RNA, 64 nt, Homo Sapiens; identical to SEQ ID NO: 40501

SEQ ID NO: 330040 - RNA, 64 nt, Homo Sapiens; identical to SEQ ID NO: 40502

SEQ ID NO: 330041 - RNA, 64 nt, Homo Sapiens; identical to SEQ ID NO: 40503

SEQ ID NO: 330042 - RNA, 64 nt, Homo Sapiens; identical to SEQ ID NO: 40504

SEQ ID NO: 330043 - RNA, 64 nt, Homo Sapiens; identical to SEQ ID NO: 40505

SEQ ID NO: 330044 - RNA, 64 nt, Homo Sapiens; identical to SEQ ID NO: 40506

SEQ ID NO: 330045 - RNA, 64 nt, Homo Sapiens; identical to SEQ ID NO: 40507

SEQ ID NO: 330046 - RNA, 64 nt, Homo Sapiens; identical to SEQ ID NO: 40508

SEQ ID NO: 330047 - RNA, 64 nt, Homo Sapiens; identical to SEQ ID NO: 40509

SEQ ID NO: 330048 - RNA, 64 nt, Homo Sapiens; identical to SEQ ID NO: 40510

SEQ ID NO: 330049 - RNA, 64 nt, Homo Sapiens; identical to SEQ ID NO: 40511

SEQ ID NO: 330050 - RNA, 64 nt, Homo Sapiens; identical to SEQ ID NO: 40512

SEQ ID NO: 330051 - RNA, 64 nt, Homo Sapiens; identical to SEQ ID NO: 40513

SEQ ID NO: 330052 - RNA, 64 nt, Homo Sapiens; identical to SEQ ID NO: 40514

SEQ ID NO: 330053 - RNA, 64 nt, Homo Sapiens; identical to SEQ ID NO: 40515

SEQ ID NO: 330054 - RNA, 64 nt, Homo Sapiens; identical to SEQ ID NO: 40516

SEQ ID NO: 330055 - RNA, 64 nt, Homo Sapiens; identical to SEQ ID NO: 40517

SEQ ID NO: 330056 - RNA, 64 nt, Homo Sapiens; identical to SEQ ID NO: 40518

SEQ ID NO: 330057 - RNA, 64 nt, Homo Sapiens; identical to SEQ ID NO: 40519

SEQ ID NO: 330058 - RNA, 64 nt, Homo Sapiens; identical to SEQ ID NO: 40520

SEQ ID NO: 330059 - RNA, 64 nt, Homo Sapiens; identical to SEQ ID NO: 40521

SEQ ID NO: 330060 - RNA, 64 nt, Homo Sapiens; identical to SEQ ID NO: 40522

SEQ ID NO: 330061 - RNA, 64 nt, Homo Sapiens; identical to SEQ ID NO: 40523

SEQ ID NO: 330062 - RNA, 64 nt, Homo Sapiens; identical to SEQ ID NO: 40524

SEQ ID NO: 330063 - RNA, 64 nt, Homo Sapiens; identical to SEQ ID NO: 40525

SEQ ID NO: 330064 - RNA, 64 nt, Homo Sapiens; identical to SEQ ID NO: 40526

SEQ ID NO: 330065 - RNA, 64 nt, Homo Sapiens; identical to SEQ ID NO: 40527

SEQ ID NO: 330066 - RNA, 64 nt, Homo Sapiens; identical to SEQ ID NO: 40528

SEQ ID NO: 330067 - RNA, 64 nt, Homo Sapiens; identical to SEQ ID NO: 40529

SEQ ID NO: 330068 - RNA, 64 nt, Homo Sapiens; identical to SEQ ID NO: 40530

SEQ ID NO: 330069 - RNA, 64 nt, Homo Sapiens; identical to SEQ ID NO: 40531

SEQ ID NO: 330070 - RNA, 64 nt, Homo Sapiens; identical to SEQ ID NO: 40532

SEQ ID NO: 330071 - RNA, 64 nt, Homo Sapiens; identical to SEQ ID NO: 40533

SEQ ID NO: 330072 - RNA, 64 nt, Homo Sapiens; identical to SEQ ID NO: 40534

SEQ ID NO: 330073 - RNA, 64 nt, Homo Sapiens; identical to SEQ ID NO: 40535

SEQ ID NO: 330074 - RNA, 64 nt, Homo Sapiens; identical to SEQ ID NO: 40536

SEQ ID NO: 330075 - RNA, 64 nt, Homo Sapiens; identical to SEQ ID NO: 40537

SEQ ID NO: 330076 - RNA, 64 nt, Homo Sapiens; identical to SEQ ID NO: 40538

SEQ ID NO: 330077 - RNA, 64 nt, Homo Sapiens; identical to SEQ ID NO: 40539

SEQ ID NO: 330078 - RNA, 64 nt, Homo Sapiens; identical to SEQ ID NO: 40540

SEQ ID NO: 330079 - RNA, 64 nt, Homo Sapiens; identical to SEQ ID NO: 40541

SEQ ID NO: 330080 - RNA, 64 nt, Homo Sapiens; identical to SEQ ID NO: 40542

SEQ ID NO: 330081 - RNA, 64 nt, Homo Sapiens; identical to SEQ ID NO: 40543

SEQ ID NO: 330082 - RNA, 64 nt, Homo Sapiens; identical to SEQ ID NO: 40544

SEQ ID NO: 330083 - RNA, 64 nt, Homo Sapiens; identical to SEQ ID NO: 40545

SEQ ID NO: 330084 - RNA, 64 nt, Homo Sapiens; identical to SEQ ID NO: 40546

SEQ ID NO: 330085 - RNA, 64 nt, Homo Sapiens; identical to SEQ ID NO: 40547

SEQ ID NO: 330086 - RNA, 64 nt, Homo Sapiens; identical to SEQ ID NO: 40548

SEQ ID NO: 330087 - RNA, 64 nt, Homo Sapiens; identical to SEQ ID NO: 40549

SEQ ID NO: 330088 - RNA, 64 nt, Homo Sapiens; identical to SEQ ID NO: 40550

SEQ ID NO: 330089 - RNA, 64 nt, Homo Sapiens; identical to SEQ ID NO: 40551

SEQ ID NO: 330090 - RNA, 64 nt, Homo Sapiens; identical to SEQ ID NO: 40552

SEQ ID NO: 330091 - RNA, 64 nt, Homo Sapiens; identical to SEQ ID NO: 40553

SEQ ID NO: 330092 - RNA, 64 nt, Homo Sapiens; identical to SEQ ID NO: 40554

SEQ ID NO: 330093 - RNA, 64 nt, Homo Sapiens; identical to SEQ ID NO: 40555

SEQ ID NO: 330094 - RNA, 64 nt, Homo Sapiens; identical to SEQ ID NO: 40556

SEQ ID NO: 330095 - RNA, 64 nt, Homo Sapiens; identical to SEQ ID NO: 40557

SEQ ID NO: 330096 - RNA, 64 nt, Homo Sapiens; identical to SEQ ID NO: 40558

SEQ ID NO: 330097 - RNA, 64 nt, Homo Sapiens; identical to SEQ ID NO: 40559

SEQ ID NO: 330098 - RNA, 64 nt, Homo Sapiens; identical to SEQ ID NO: 40560

SEQ ID NO: 330099 - RNA, 64 nt, Homo Sapiens; identical to SEQ ID NO: 40561

SEQ ID NO: 330100 - RNA, 64 nt, Homo Sapiens; identical to SEQ ID NO: 40562

SEQ ID NO: 330101 - RNA, 64 nt, Homo Sapiens; identical to SEQ ID NO: 40563

SEQ ID NO: 330102 - RNA, 64 nt, Homo Sapiens; identical to SEQ ID NO: 40564

SEQ ID NO: 330103 - RNA, 64 nt, Homo Sapiens; identical to SEQ ID NO: 40565

SEQ ID NO: 330104 - RNA, 64 nt, Homo Sapiens; identical to SEQ ID NO: 40566

SEQ ID NO: 330105 - RNA, 64 nt, Homo Sapiens; identical to SEQ ID NO: 40567

SEQ ID NO: 330106 - RNA, 64 nt, Homo Sapiens; identical to SEQ ID NO: 40568

SEQ ID NO: 330107 - RNA, 64 nt, Homo Sapiens; identical to SEQ ID NO: 40569

SEQ ID NO: 330108 - RNA, 64 nt, Homo Sapiens; identical to SEQ ID NO: 40570

SEQ ID NO: 330109 - RNA, 64 nt, Homo Sapiens; identical to SEQ ID NO: 40571

SEQ ID NO: 330110 - RNA, 64 nt, Homo Sapiens; identical to SEQ ID NO: 40572

SEQ ID NO: 330111 - RNA, 64 nt, Homo Sapiens; identical to SEQ ID NO: 40573

SEQ ID NO: 330112 - RNA, 64 nt, Homo Sapiens; identical to SEQ ID NO: 40574

SEQ ID NO: 330113 - RNA, 64 nt, Homo Sapiens; identical to SEQ ID NO: 40575

SEQ ID NO: 330114 - RNA, 64 nt, Homo Sapiens; identical to SEQ ID NO: 40576

SEQ ID NO: 330115 - RNA, 64 nt, Homo Sapiens; identical to SEQ ID NO: 40577

SEQ ID NO: 330116 - RNA, 64 nt, Homo Sapiens; identical to SEQ ID NO: 40578

SEQ ID NO: 330117 - RNA, 64 nt, Homo Sapiens; identical to SEQ ID NO: 40579

SEQ ID NO: 330118 - RNA, 64 nt, Homo Sapiens; identical to SEQ ID NO: 40580

SEQ ID NO: 330119 - RNA, 64 nt, Homo Sapiens; identical to SEQ ID NO: 40581

SEQ ID NO: 330120 - RNA, 64 nt, Homo Sapiens; identical to SEQ ID NO: 40582

SEQ ID NO: 330121 - RNA, 64 nt, Homo Sapiens; identical to SEQ ID NO: 40583

SEQ ID NO: 330122 - RNA, 64 nt, Homo Sapiens; identical to SEQ ID NO: 40584

SEQ ID NO: 330123 - RNA, 64 nt, Homo Sapiens; identical to SEQ ID NO: 40585

SEQ ID NO: 330124 - RNA, 64 nt, Homo Sapiens; identical to SEQ ID NO: 40586

SEQ ID NO: 330125 - RNA, 64 nt, Homo Sapiens; identical to SEQ ID NO: 40587

SEQ ID NO: 330126 - RNA, 64 nt, Homo Sapiens; identical to SEQ ID NO: 40588

SEQ ID NO: 330127 - RNA, 64 nt, Homo Sapiens; identical to SEQ ID NO: 40589

SEQ ID NO: 330128 - RNA, 64 nt, Homo Sapiens; identical to SEQ ID NO: 40590

SEQ ID NO: 330129 - RNA, 64 nt, Homo Sapiens; identical to SEQ ID NO: 40591

SEQ ID NO: 330130 - RNA, 64 nt, Homo Sapiens; identical to SEQ ID NO: 40592

SEQ ID NO: 330131 - RNA, 64 nt, Homo Sapiens; identical to SEQ ID NO: 40593

SEQ ID NO: 330132 - RNA, 64 nt, Homo Sapiens; identical to SEQ ID NO: 40594

SEQ ID NO: 330133 - RNA, 64 nt, Homo Sapiens; identical to SEQ ID NO: 40595

SEQ ID NO: 330134 - RNA, 64 nt, Homo Sapiens; identical to SEQ ID NO: 40596

SEQ ID NO: 330135 - RNA, 64 nt, Homo Sapiens; identical to SEQ ID NO: 40597

SEQ ID NO: 330136 - RNA, 64 nt, Homo Sapiens; identical to SEQ ID NO: 40598

SEQ ID NO: 330137 - RNA, 64 nt, Homo Sapiens; identical to SEQ ID NO: 40599

SEQ ID NO: 330138 - RNA, 64 nt, Homo Sapiens; identical to SEQ ID NO: 40600

SEQ ID NO: 330139 - RNA, 64 nt, Homo Sapiens; identical to SEQ ID NO: 40601

SEQ ID NO: 330140 - RNA, 64 nt, Homo Sapiens; identical to SEQ ID NO: 40602

SEQ ID NO: 330141 - RNA, 64 nt, Homo Sapiens; identical to SEQ ID NO: 40603

SEQ ID NO: 330142 - RNA, 64 nt, Homo Sapiens; identical to SEQ ID NO: 40604

SEQ ID NO: 330143 - RNA, 64 nt, Homo Sapiens; identical to SEQ ID NO: 40605

SEQ ID NO: 330144 - RNA, 64 nt, Homo Sapiens; identical to SEQ ID NO: 40606

SEQ ID NO: 330145 - RNA, 64 nt, Homo Sapiens; identical to SEQ ID NO: 40607

SEQ ID NO: 330146 - RNA, 64 nt, Homo Sapiens; identical to SEQ ID NO: 40608

SEQ ID NO: 330147 - RNA, 64 nt, Homo Sapiens; identical to SEQ ID NO: 40609

SEQ ID NO: 330148 - RNA, 64 nt, Homo Sapiens; identical to SEQ ID NO: 40610

SEQ ID NO: 330149 - RNA, 64 nt, Homo Sapiens; identical to SEQ ID NO: 40611

SEQ ID NO: 330150 - RNA, 64 nt, Homo Sapiens; identical to SEQ ID NO: 40612

SEQ ID NO: 330151 - RNA, 64 nt, Homo Sapiens; identical to SEQ ID NO: 40613

SEQ ID NO: 330152 - RNA, 64 nt, Homo Sapiens; identical to SEQ ID NO: 40614

SEQ ID NO: 330153 - RNA, 64 nt, Homo Sapiens; identical to SEQ ID NO: 40615

SEQ ID NO: 330154 - RNA, 64 nt, Homo Sapiens; identical to SEQ ID NO: 40616

SEQ ID NO: 330155 - RNA, 64 nt, Homo Sapiens; identical to SEQ ID NO: 40617

SEQ ID NO: 330156 - RNA, 64 nt, Homo Sapiens; identical to SEQ ID NO: 40618

SEQ ID NO: 330157 - RNA, 64 nt, Homo Sapiens; identical to SEQ ID NO: 40619

SEQ ID NO: 330158 - RNA, 64 nt, Homo Sapiens; identical to SEQ ID NO: 40620

SEQ ID NO: 330159 - RNA, 64 nt, Homo Sapiens; identical to SEQ ID NO: 40621

SEQ ID NO: 330160 - RNA, 64 nt, Homo Sapiens; identical to SEQ ID NO: 40622

SEQ ID NO: 330161 - RNA, 64 nt, Homo Sapiens; identical to SEQ ID NO: 40623

SEQ ID NO: 330162 - RNA, 64 nt, Homo Sapiens; identical to SEQ ID NO: 40624

SEQ ID NO: 330163 - RNA, 64 nt, Homo Sapiens; identical to SEQ ID NO: 40625

SEQ ID NO: 330164 - RNA, 64 nt, Homo Sapiens; identical to SEQ ID NO: 40626

SEQ ID NO: 330165 - RNA, 64 nt, Homo Sapiens; identical to SEQ ID NO: 40627

SEQ ID NO: 330166 - RNA, 64 nt, Homo Sapiens; identical to SEQ ID NO: 40628

SEQ ID NO: 330167 - RNA, 64 nt, Homo Sapiens; identical to SEQ ID NO: 40629

SEQ ID NO: 330168 - RNA, 64 nt, Homo Sapiens; identical to SEQ ID NO: 40630

SEQ ID NO: 330169 - RNA, 64 nt, Homo Sapiens; identical to SEQ ID NO: 40631

SEQ ID NO: 330170 - RNA, 64 nt, Homo Sapiens; identical to SEQ ID NO: 40632

SEQ ID NO: 330171 - RNA, 64 nt, Homo Sapiens; identical to SEQ ID NO: 40633

SEQ ID NO: 330172 - RNA, 64 nt, Homo Sapiens; identical to SEQ ID NO: 40634

SEQ ID NO: 330173 - RNA, 64 nt, Homo Sapiens; identical to SEQ ID NO: 40635

SEQ ID NO: 330174 - RNA, 64 nt, Homo Sapiens; identical to SEQ ID NO: 40636

SEQ ID NO: 330175 - RNA, 64 nt, Homo Sapiens; identical to SEQ ID NO: 40637

SEQ ID NO: 330176 - RNA, 64 nt, Homo Sapiens; identical to SEQ ID NO: 40638

SEQ ID NO: 330177 - RNA, 64 nt, Homo Sapiens; identical to SEQ ID NO: 40639

SEQ ID NO: 330178 - RNA, 64 nt, Homo Sapiens; identical to SEQ ID NO: 40640

SEQ ID NO: 330179 - RNA, 64 nt, Homo Sapiens; identical to SEQ ID NO: 40641

SEQ ID NO: 330180 - RNA, 64 nt, Homo Sapiens; identical to SEQ ID NO: 40642

SEQ ID NO: 330181 - RNA, 64 nt, Homo Sapiens; identical to SEQ ID NO: 40643

SEQ ID NO: 330182 - RNA, 64 nt, Homo Sapiens; identical to SEQ ID NO: 40644

SEQ ID NO: 330183 - RNA, 64 nt, Homo Sapiens; identical to SEQ ID NO: 40645

SEQ ID NO: 330184 - RNA, 64 nt, Homo Sapiens; identical to SEQ ID NO: 40646

SEQ ID NO: 330185 - RNA, 64 nt, Homo Sapiens; identical to SEQ ID NO: 40647

SEQ ID NO: 330186 - RNA, 64 nt, Homo Sapiens; identical to SEQ ID NO: 40648

SEQ ID NO: 330187 - RNA, 64 nt, Homo Sapiens; identical to SEQ ID NO: 40649

SEQ ID NO: 330188 - RNA, 64 nt, Homo Sapiens; identical to SEQ ID NO: 40650

SEQ ID NO: 330189 - RNA, 64 nt, Homo Sapiens; identical to SEQ ID NO: 40651

SEQ ID NO: 330190 - RNA, 64 nt, Homo Sapiens; identical to SEQ ID NO: 40652

SEQ ID NO: 330191 - RNA, 64 nt, Homo Sapiens; identical to SEQ ID NO: 40653

SEQ ID NO: 330192 - RNA, 64 nt, Homo Sapiens; identical to SEQ ID NO: 40654

SEQ ID NO: 330193 - RNA, 64 nt, Homo Sapiens; identical to SEQ ID NO: 40655

SEQ ID NO: 330194 - RNA, 64 nt, Homo Sapiens; identical to SEQ ID NO: 40656

SEQ ID NO: 330195 - RNA, 64 nt, Homo Sapiens; identical to SEQ ID NO: 40657

SEQ ID NO: 330196 - RNA, 64 nt, Homo Sapiens; identical to SEQ ID NO: 40658

SEQ ID NO: 330197 - RNA, 64 nt, Homo Sapiens; identical to SEQ ID NO: 40659

SEQ ID NO: 330198 - RNA, 64 nt, Homo Sapiens; identical to SEQ ID NO: 40660

SEQ ID NO: 330199 - RNA, 64 nt, Homo Sapiens; identical to SEQ ID NO: 40661

SEQ ID NO: 330200 - RNA, 64 nt, Homo Sapiens; identical to SEQ ID NO: 40662

SEQ ID NO: 330201 - RNA, 64 nt, Homo Sapiens; identical to SEQ ID NO: 40663

SEQ ID NO: 330202 - RNA, 64 nt, Homo Sapiens; identical to SEQ ID NO: 40664

SEQ ID NO: 330203 - RNA, 64 nt, Homo Sapiens; identical to SEQ ID NO: 40665

SEQ ID NO: 330204 - RNA, 64 nt, Homo Sapiens; identical to SEQ ID NO: 40666

SEQ ID NO: 330205 - RNA, 64 nt, Homo Sapiens; identical to SEQ ID NO: 40667

SEQ ID NO: 330206 - RNA, 64 nt, Homo Sapiens; identical to SEQ ID NO: 40668

SEQ ID NO: 330207 - RNA, 64 nt, Homo Sapiens; identical to SEQ ID NO: 40669

SEQ ID NO: 330208 - RNA, 64 nt, Homo Sapiens; identical to SEQ ID NO: 40670

SEQ ID NO: 330209 - RNA, 64 nt, Homo Sapiens; identical to SEQ ID NO: 40671

SEQ ID NO: 330210 - RNA, 64 nt, Homo Sapiens; identical to SEQ ID NO: 40672

SEQ ID NO: 330211 - RNA, 64 nt, Homo Sapiens; identical to SEQ ID NO: 40673

SEQ ID NO: 330212 - RNA, 64 nt, Homo Sapiens; identical to SEQ ID NO: 40674

SEQ ID NO: 330213 - RNA, 64 nt, Homo Sapiens; identical to SEQ ID NO: 40675

SEQ ID NO: 330214 - RNA, 64 nt, Homo Sapiens; identical to SEQ ID NO: 40676

SEQ ID NO: 330215 - RNA, 64 nt, Homo Sapiens; identical to SEQ ID NO: 40677

SEQ ID NO: 330216 - RNA, 64 nt, Homo Sapiens; identical to SEQ ID NO: 40678

SEQ ID NO: 330217 - RNA, 64 nt, Homo Sapiens; identical to SEQ ID NO: 40679

SEQ ID NO: 330218 - RNA, 64 nt, Homo Sapiens; identical to SEQ ID NO: 40680

SEQ ID NO: 330219 - RNA, 64 nt, Homo Sapiens; identical to SEQ ID NO: 40681

SEQ ID NO: 330220 - RNA, 64 nt, Homo Sapiens; identical to SEQ ID NO: 40682

SEQ ID NO: 330221 - RNA, 64 nt, Homo Sapiens; identical to SEQ ID NO: 40683

SEQ ID NO: 330222 - RNA, 64 nt, Homo Sapiens; identical to SEQ ID NO: 40684

SEQ ID NO: 330223 - RNA, 64 nt, Homo Sapiens; identical to SEQ ID NO: 40685

SEQ ID NO: 330224 - RNA, 64 nt, Homo Sapiens; identical to SEQ ID NO: 40686

SEQ ID NO: 330225 - RNA, 64 nt, Homo Sapiens; identical to SEQ ID NO: 40687

SEQ ID NO: 330226 - RNA, 64 nt, Homo Sapiens; identical to SEQ ID NO: 40688

SEQ ID NO: 330227 - RNA, 64 nt, Homo Sapiens; identical to SEQ ID NO: 40689

SEQ ID NO: 330228 - RNA, 64 nt, Homo Sapiens; identical to SEQ ID NO: 40690

SEQ ID NO: 330229 - RNA, 64 nt, Homo Sapiens; identical to SEQ ID NO: 40691

SEQ ID NO: 330230 - RNA, 64 nt, Homo Sapiens; identical to SEQ ID NO: 40692

SEQ ID NO: 330231 - RNA, 64 nt, Homo Sapiens; identical to SEQ ID NO: 40693

SEQ ID NO: 330232 - RNA, 64 nt, Homo Sapiens; identical to SEQ ID NO: 40694

SEQ ID NO: 330233 - RNA, 64 nt, Homo Sapiens; identical to SEQ ID NO: 40695

SEQ ID NO: 330234 - RNA, 64 nt, Homo Sapiens; identical to SEQ ID NO: 40696

SEQ ID NO: 330235 - RNA, 64 nt, Homo Sapiens; identical to SEQ ID NO: 40697

SEQ ID NO: 330236 - RNA, 64 nt, Homo Sapiens; identical to SEQ ID NO: 40698

SEQ ID NO: 330237 - RNA, 64 nt, Homo Sapiens; identical to SEQ ID NO: 40699

SEQ ID NO: 330238 - RNA, 64 nt, Homo Sapiens; identical to SEQ ID NO: 40700

SEQ ID NO: 330239 - RNA, 64 nt, Homo Sapiens; identical to SEQ ID NO: 40701

SEQ ID NO: 330240 - RNA, 64 nt, Homo Sapiens; identical to SEQ ID NO: 40702

SEQ ID NO: 330241 - RNA, 64 nt, Homo Sapiens; identical to SEQ ID NO: 40703

SEQ ID NO: 330242 - RNA, 64 nt, Homo Sapiens; identical to SEQ ID NO: 40704

SEQ ID NO: 330243 - RNA, 64 nt, Homo Sapiens; identical to SEQ ID NO: 40705

SEQ ID NO: 330244 - RNA, 64 nt, Homo Sapiens; identical to SEQ ID NO: 40706

SEQ ID NO: 330245 - RNA, 64 nt, Homo Sapiens; identical to SEQ ID NO: 40707

SEQ ID NO: 330246 - RNA, 64 nt, Homo Sapiens; identical to SEQ ID NO: 40708

SEQ ID NO: 330247 - RNA, 64 nt, Homo Sapiens; identical to SEQ ID NO: 40709

SEQ ID NO: 330248 - RNA, 64 nt, Homo Sapiens; identical to SEQ ID NO: 40710

SEQ ID NO: 330249 - RNA, 64 nt, Homo Sapiens; identical to SEQ ID NO: 40711

SEQ ID NO: 330250 - RNA, 64 nt, Homo Sapiens; identical to SEQ ID NO: 40712

SEQ ID NO: 330251 - RNA, 64 nt, Homo Sapiens; identical to SEQ ID NO: 40713

SEQ ID NO: 330252 - RNA, 64 nt, Homo Sapiens; identical to SEQ ID NO: 40714

SEQ ID NO: 330253 - RNA, 64 nt, Homo Sapiens; identical to SEQ ID NO: 40715

SEQ ID NO: 330254 - RNA, 64 nt, Homo Sapiens; identical to SEQ ID NO: 40716

SEQ ID NO: 330255 - RNA, 64 nt, Homo Sapiens; identical to SEQ ID NO: 40717

SEQ ID NO: 330256 - RNA, 64 nt, Homo Sapiens; identical to SEQ ID NO: 40718

SEQ ID NO: 330257 - RNA, 64 nt, Homo Sapiens; identical to SEQ ID NO: 40719

SEQ ID NO: 330258 - RNA, 64 nt, Homo Sapiens; identical to SEQ ID NO: 40720

SEQ ID NO: 330259 - RNA, 64 nt, Homo Sapiens; identical to SEQ ID NO: 40721

SEQ ID NO: 330260 - RNA, 64 nt, Homo Sapiens; identical to SEQ ID NO: 40722

SEQ ID NO: 330261 - RNA, 64 nt, Homo Sapiens; identical to SEQ ID NO: 40723

SEQ ID NO: 330262 - RNA, 64 nt, Homo Sapiens; identical to SEQ ID NO: 40724

SEQ ID NO: 330263 - RNA, 64 nt, Homo Sapiens; identical to SEQ ID NO: 40725

SEQ ID NO: 330264 - RNA, 64 nt, Homo Sapiens; identical to SEQ ID NO: 40726

SEQ ID NO: 330265 - RNA, 64 nt, Homo Sapiens; identical to SEQ ID NO: 40727

SEQ ID NO: 330266 - RNA, 64 nt, Homo Sapiens; identical to SEQ ID NO: 40728

SEQ ID NO: 330267 - RNA, 64 nt, Homo Sapiens; identical to SEQ ID NO: 40729

SEQ ID NO: 330268 - RNA, 64 nt, Homo Sapiens; identical to SEQ ID NO: 40730

SEQ ID NO: 330269 - RNA, 64 nt, Homo Sapiens; identical to SEQ ID NO: 40731

SEQ ID NO: 330270 - RNA, 64 nt, Homo Sapiens; identical to SEQ ID NO: 40732

SEQ ID NO: 330271 - RNA, 64 nt, Homo Sapiens; identical to SEQ ID NO: 40733

SEQ ID NO: 330272 - RNA, 64 nt, Homo Sapiens; identical to SEQ ID NO: 40734

SEQ ID NO: 330273 - RNA, 64 nt, Homo Sapiens; identical to SEQ ID NO: 40735

SEQ ID NO: 330274 - RNA, 64 nt, Homo Sapiens; identical to SEQ ID NO: 40736

SEQ ID NO: 330275 - RNA, 64 nt, Homo Sapiens; identical to SEQ ID NO: 40737

SEQ ID NO: 330276 - RNA, 64 nt, Homo Sapiens; identical to SEQ ID NO: 40738

SEQ ID NO: 330277 - RNA, 64 nt, Homo Sapiens; identical to SEQ ID NO: 40739

SEQ ID NO: 330278 - RNA, 64 nt, Homo Sapiens; identical to SEQ ID NO: 40740

SEQ ID NO: 330279 - RNA, 64 nt, Homo Sapiens; identical to SEQ ID NO: 40741

SEQ ID NO: 330280 - RNA, 64 nt, Homo Sapiens; identical to SEQ ID NO: 40742

SEQ ID NO: 330281 - RNA, 64 nt, Homo Sapiens; identical to SEQ ID NO: 40743

SEQ ID NO: 330282 - RNA, 64 nt, Homo Sapiens; identical to SEQ ID NO: 40744

SEQ ID NO: 330283 - RNA, 64 nt, Homo Sapiens; identical to SEQ ID NO: 40745

SEQ ID NO: 330284 - RNA, 64 nt, Homo Sapiens; identical to SEQ ID NO: 40746

SEQ ID NO: 330285 - RNA, 64 nt, Homo Sapiens; identical to SEQ ID NO: 40747

SEQ ID NO: 330286 - RNA, 64 nt, Homo Sapiens; identical to SEQ ID NO: 40748

SEQ ID NO: 330287 - RNA, 64 nt, Homo Sapiens; identical to SEQ ID NO: 40749

SEQ ID NO: 330288 - RNA, 64 nt, Homo Sapiens; identical to SEQ ID NO: 40750

SEQ ID NO: 330289 - RNA, 64 nt, Homo Sapiens; identical to SEQ ID NO: 40751

SEQ ID NO: 330290 - RNA, 64 nt, Homo Sapiens; identical to SEQ ID NO: 40752

SEQ ID NO: 330291 - RNA, 64 nt, Homo Sapiens; identical to SEQ ID NO: 40753

SEQ ID NO: 330292 - RNA, 64 nt, Homo Sapiens; identical to SEQ ID NO: 40754

SEQ ID NO: 330293 - RNA, 64 nt, Homo Sapiens; identical to SEQ ID NO: 40755

SEQ ID NO: 330294 - RNA, 64 nt, Homo Sapiens; identical to SEQ ID NO: 40756

SEQ ID NO: 330295 - RNA, 64 nt, Homo Sapiens; identical to SEQ ID NO: 40757

SEQ ID NO: 330296 - RNA, 64 nt, Homo Sapiens; identical to SEQ ID NO: 40758

SEQ ID NO: 330297 - RNA, 64 nt, Homo Sapiens; identical to SEQ ID NO: 40759

SEQ ID NO: 330298 - RNA, 64 nt, Homo Sapiens; identical to SEQ ID NO: 40760

SEQ ID NO: 330299 - RNA, 64 nt, Homo Sapiens; identical to SEQ ID NO: 40761

SEQ ID NO: 330300 - RNA, 64 nt, Homo Sapiens; identical to SEQ ID NO: 40762

SEQ ID NO: 330301 - RNA, 64 nt, Homo Sapiens; identical to SEQ ID NO: 40763

SEQ ID NO: 330302 - RNA, 64 nt, Homo Sapiens; identical to SEQ ID NO: 40764

SEQ ID NO: 330303 - RNA, 64 nt, Homo Sapiens; identical to SEQ ID NO: 40765

SEQ ID NO: 330304 - RNA, 64 nt, Homo Sapiens; identical to SEQ ID NO: 40766

SEQ ID NO: 330305 - RNA, 64 nt, Homo Sapiens; identical to SEQ ID NO: 40767

SEQ ID NO: 330306 - RNA, 64 nt, Homo Sapiens; identical to SEQ ID NO: 40768

SEQ ID NO: 330307 - RNA, 64 nt, Homo Sapiens; identical to SEQ ID NO: 40769

SEQ ID NO: 330308 - RNA, 64 nt, Homo Sapiens; identical to SEQ ID NO: 40770

SEQ ID NO: 330309 - RNA, 64 nt, Homo Sapiens; identical to SEQ ID NO: 40771

SEQ ID NO: 330310 - RNA, 64 nt, Homo Sapiens; identical to SEQ ID NO: 40772

SEQ ID NO: 330311 - RNA, 64 nt, Homo Sapiens; identical to SEQ ID NO: 40773

SEQ ID NO: 330312 - RNA, 64 nt, Homo Sapiens; identical to SEQ ID NO: 40774

SEQ ID NO: 330313 - RNA, 64 nt, Homo Sapiens; identical to SEQ ID NO: 40775

SEQ ID NO: 330314 - RNA, 64 nt, Homo Sapiens; identical to SEQ ID NO: 40776

SEQ ID NO: 330315 - RNA, 64 nt, Homo Sapiens; identical to SEQ ID NO: 40777

SEQ ID NO: 330316 - RNA, 64 nt, Homo Sapiens; identical to SEQ ID NO: 40778

SEQ ID NO: 330317 - RNA, 64 nt, Homo Sapiens; identical to SEQ ID NO: 40779

SEQ ID NO: 330318 - RNA, 64 nt, Homo Sapiens; identical to SEQ ID NO: 40780

SEQ ID NO: 330319 - RNA, 64 nt, Homo Sapiens; identical to SEQ ID NO: 40781

SEQ ID NO: 330320 - RNA, 64 nt, Homo Sapiens; identical to SEQ ID NO: 40782

SEQ ID NO: 330321 - RNA, 64 nt, Homo Sapiens; identical to SEQ ID NO: 40783

SEQ ID NO: 330322 - RNA, 64 nt, Homo Sapiens; identical to SEQ ID NO: 40784

SEQ ID NO: 330323 - RNA, 64 nt, Homo Sapiens; identical to SEQ ID NO: 40785

SEQ ID NO: 330324 - RNA, 64 nt, Homo Sapiens; identical to SEQ ID NO: 40786

SEQ ID NO: 330325 - RNA, 64 nt, Homo Sapiens; identical to SEQ ID NO: 40787

SEQ ID NO: 330326 - RNA, 64 nt, Homo Sapiens; identical to SEQ ID NO: 40788

SEQ ID NO: 330327 - RNA, 64 nt, Homo Sapiens; identical to SEQ ID NO: 40789

SEQ ID NO: 330328 - RNA, 64 nt, Homo Sapiens; identical to SEQ ID NO: 40790

SEQ ID NO: 330329 - RNA, 64 nt, Homo Sapiens; identical to SEQ ID NO: 40791

SEQ ID NO: 330330 - RNA, 64 nt, Homo Sapiens; identical to SEQ ID NO: 40792

SEQ ID NO: 330331 - RNA, 64 nt, Homo Sapiens; identical to SEQ ID NO: 40793

SEQ ID NO: 330332 - RNA, 64 nt, Homo Sapiens; identical to SEQ ID NO: 40794

SEQ ID NO: 330333 - RNA, 64 nt, Homo Sapiens; identical to SEQ ID NO: 40795

SEQ ID NO: 330334 - RNA, 64 nt, Homo Sapiens; identical to SEQ ID NO: 40796

SEQ ID NO: 330335 - RNA, 64 nt, Homo Sapiens; identical to SEQ ID NO: 40797

SEQ ID NO: 330336 - RNA, 64 nt, Homo Sapiens; identical to SEQ ID NO: 40798

SEQ ID NO: 330337 - RNA, 64 nt, Homo Sapiens; identical to SEQ ID NO: 40799

SEQ ID NO: 330338 - RNA, 64 nt, Homo Sapiens; identical to SEQ ID NO: 40800

SEQ ID NO: 330339 - RNA, 64 nt, Homo Sapiens; identical to SEQ ID NO: 40801

SEQ ID NO: 330340 - RNA, 64 nt, Homo Sapiens; identical to SEQ ID NO: 40802

SEQ ID NO: 330341 - RNA, 64 nt, Homo Sapiens; identical to SEQ ID NO: 40803

SEQ ID NO: 330342 - RNA, 64 nt, Homo Sapiens; identical to SEQ ID NO: 40804

SEQ ID NO: 330343 - RNA, 64 nt, Homo Sapiens; identical to SEQ ID NO: 40805

SEQ ID NO: 330344 - RNA, 64 nt, Homo Sapiens; identical to SEQ ID NO: 40806

SEQ ID NO: 330345 - RNA, 64 nt, Homo Sapiens; identical to SEQ ID NO: 40807

SEQ ID NO: 330346 - RNA, 64 nt, Homo Sapiens; identical to SEQ ID NO: 40808

SEQ ID NO: 330347 - RNA, 64 nt, Homo Sapiens; identical to SEQ ID NO: 40809

SEQ ID NO: 330348 - RNA, 64 nt, Homo Sapiens; identical to SEQ ID NO: 40810

SEQ ID NO: 330349 - RNA, 64 nt, Homo Sapiens; identical to SEQ ID NO: 40811

SEQ ID NO: 330350 - RNA, 64 nt, Homo Sapiens; identical to SEQ ID NO: 40812

SEQ ID NO: 330351 - RNA, 64 nt, Homo Sapiens; identical to SEQ ID NO: 40813

SEQ ID NO: 330352 - RNA, 64 nt, Homo Sapiens; identical to SEQ ID NO: 40814

SEQ ID NO: 330353 - RNA, 64 nt, Homo Sapiens; identical to SEQ ID NO: 40815

SEQ ID NO: 330354 - RNA, 64 nt, Homo Sapiens; identical to SEQ ID NO: 40816

SEQ ID NO: 330355 - RNA, 64 nt, Homo Sapiens; identical to SEQ ID NO: 40817

SEQ ID NO: 330356 - RNA, 64 nt, Homo Sapiens; identical to SEQ ID NO: 40818

SEQ ID NO: 330357 - RNA, 64 nt, Homo Sapiens; identical to SEQ ID NO: 40819

SEQ ID NO: 330358 - RNA, 64 nt, Homo Sapiens; identical to SEQ ID NO: 40820

SEQ ID NO: 330359 - RNA, 64 nt, Homo Sapiens; identical to SEQ ID NO: 40821

SEQ ID NO: 330360 - RNA, 64 nt, Homo Sapiens; identical to SEQ ID NO: 40822

SEQ ID NO: 330361 - RNA, 64 nt, Homo Sapiens; identical to SEQ ID NO: 40823

SEQ ID NO: 330362 - RNA, 64 nt, Homo Sapiens; identical to SEQ ID NO: 40824

SEQ ID NO: 330363 - RNA, 64 nt, Homo Sapiens; identical to SEQ ID NO: 40825

SEQ ID NO: 330364 - RNA, 64 nt, Homo Sapiens; identical to SEQ ID NO: 40826

SEQ ID NO: 330365 - RNA, 64 nt, Homo Sapiens; identical to SEQ ID NO: 40827

SEQ ID NO: 330366 - RNA, 64 nt, Homo Sapiens; identical to SEQ ID NO: 40828

SEQ ID NO: 330367 - RNA, 64 nt, Homo Sapiens; identical to SEQ ID NO: 40829

SEQ ID NO: 330368 - RNA, 64 nt, Homo Sapiens; identical to SEQ ID NO: 40830

SEQ ID NO: 330369 - RNA, 64 nt, Homo Sapiens; identical to SEQ ID NO: 40831

SEQ ID NO: 330370 - RNA, 64 nt, Homo Sapiens; identical to SEQ ID NO: 40832

SEQ ID NO: 330371 - RNA, 64 nt, Homo Sapiens; identical to SEQ ID NO: 40833

SEQ ID NO: 330372 - RNA, 64 nt, Homo Sapiens; identical to SEQ ID NO: 40834

SEQ ID NO: 330373 - RNA, 64 nt, Homo Sapiens; identical to SEQ ID NO: 40835

SEQ ID NO: 330374 - RNA, 64 nt, Homo Sapiens; identical to SEQ ID NO: 40836

SEQ ID NO: 330375 - RNA, 64 nt, Homo Sapiens; identical to SEQ ID NO: 40837

SEQ ID NO: 330376 - RNA, 64 nt, Homo Sapiens; identical to SEQ ID NO: 40838

SEQ ID NO: 330377 - RNA, 64 nt, Homo Sapiens; identical to SEQ ID NO: 40839

SEQ ID NO: 330378 - RNA, 64 nt, Homo Sapiens; identical to SEQ ID NO: 40840

SEQ ID NO: 330379 - RNA, 64 nt, Homo Sapiens; identical to SEQ ID NO: 40841

SEQ ID NO: 330380 - RNA, 64 nt, Homo Sapiens; identical to SEQ ID NO: 40842

SEQ ID NO: 330381 - RNA, 64 nt, Homo Sapiens; identical to SEQ ID NO: 40843

SEQ ID NO: 330382 - RNA, 64 nt, Homo Sapiens; identical to SEQ ID NO: 40844

SEQ ID NO: 330383 - RNA, 64 nt, Homo Sapiens; identical to SEQ ID NO: 40845

SEQ ID NO: 330384 - RNA, 64 nt, Homo Sapiens; identical to SEQ ID NO: 40846

SEQ ID NO: 330385 - RNA, 64 nt, Homo Sapiens; identical to SEQ ID NO: 40847

SEQ ID NO: 330386 - RNA, 64 nt, Homo Sapiens; identical to SEQ ID NO: 40848

SEQ ID NO: 330387 - RNA, 64 nt, Homo Sapiens; identical to SEQ ID NO: 40849

SEQ ID NO: 330388 - RNA, 64 nt, Homo Sapiens; identical to SEQ ID NO: 40850

SEQ ID NO: 330389 - RNA, 64 nt, Homo Sapiens; identical to SEQ ID NO: 40851

SEQ ID NO: 330390 - RNA, 64 nt, Homo Sapiens; identical to SEQ ID NO: 40852

SEQ ID NO: 330391 - RNA, 64 nt, Homo Sapiens; identical to SEQ ID NO: 40853

SEQ ID NO: 330392 - RNA, 64 nt, Homo Sapiens; identical to SEQ ID NO: 40854

SEQ ID NO: 330393 - RNA, 64 nt, Homo Sapiens; identical to SEQ ID NO: 40855

SEQ ID NO: 330394 - RNA, 64 nt, Homo Sapiens; identical to SEQ ID NO: 40856

SEQ ID NO: 330395 - RNA, 64 nt, Homo Sapiens; identical to SEQ ID NO: 40857

SEQ ID NO: 330396 - RNA, 64 nt, Homo Sapiens; identical to SEQ ID NO: 40858

SEQ ID NO: 330397 - RNA, 64 nt, Homo Sapiens; identical to SEQ ID NO: 40859

SEQ ID NO: 330398 - RNA, 64 nt, Homo Sapiens; identical to SEQ ID NO: 40860

SEQ ID NO: 330399 - RNA, 64 nt, Homo Sapiens; identical to SEQ ID NO: 40861

SEQ ID NO: 330400 - RNA, 64 nt, Homo Sapiens; identical to SEQ ID NO: 40862

SEQ ID NO: 330401 - RNA, 64 nt, Homo Sapiens; identical to SEQ ID NO: 40863

SEQ ID NO: 330402 - RNA, 64 nt, Homo Sapiens; identical to SEQ ID NO: 40864

SEQ ID NO: 330403 - RNA, 64 nt, Homo Sapiens; identical to SEQ ID NO: 40865

SEQ ID NO: 330404 - RNA, 64 nt, Homo Sapiens; identical to SEQ ID NO: 40866

SEQ ID NO: 330405 - RNA, 64 nt, Homo Sapiens; identical to SEQ ID NO: 40867

SEQ ID NO: 330406 - RNA, 64 nt, Homo Sapiens; identical to SEQ ID NO: 40868

SEQ ID NO: 330407 - RNA, 64 nt, Homo Sapiens; identical to SEQ ID NO: 40869

SEQ ID NO: 330408 - RNA, 64 nt, Homo Sapiens; identical to SEQ ID NO: 40870

SEQ ID NO: 330409 - RNA, 64 nt, Homo Sapiens; identical to SEQ ID NO: 40871

SEQ ID NO: 330410 - RNA, 64 nt, Homo Sapiens; identical to SEQ ID NO: 40872

SEQ ID NO: 330411 - RNA, 64 nt, Homo Sapiens; identical to SEQ ID NO: 40873

SEQ ID NO: 330412 - RNA, 64 nt, Homo Sapiens; identical to SEQ ID NO: 40874

SEQ ID NO: 330413 - RNA, 64 nt, Homo Sapiens; identical to SEQ ID NO: 40875

SEQ ID NO: 330414 - RNA, 64 nt, Homo Sapiens; identical to SEQ ID NO: 40876

SEQ ID NO: 330415 - RNA, 64 nt, Homo Sapiens; identical to SEQ ID NO: 40877

SEQ ID NO: 330416 - RNA, 64 nt, Homo Sapiens; identical to SEQ ID NO: 40878

SEQ ID NO: 330417 - RNA, 64 nt, Homo Sapiens; identical to SEQ ID NO: 40879

SEQ ID NO: 330418 - RNA, 64 nt, Homo Sapiens; identical to SEQ ID NO: 40880

SEQ ID NO: 330419 - RNA, 64 nt, Homo Sapiens; identical to SEQ ID NO: 40881

SEQ ID NO: 330420 - RNA, 64 nt, Homo Sapiens; identical to SEQ ID NO: 40882

SEQ ID NO: 330421 - RNA, 64 nt, Homo Sapiens; identical to SEQ ID NO: 40883

SEQ ID NO: 330422 - RNA, 64 nt, Homo Sapiens; identical to SEQ ID NO: 40884

SEQ ID NO: 330423 - RNA, 64 nt, Homo Sapiens; identical to SEQ ID NO: 40885

SEQ ID NO: 330424 - RNA, 64 nt, Homo Sapiens; identical to SEQ ID NO: 40886

SEQ ID NO: 330425 - RNA, 64 nt, Homo Sapiens; identical to SEQ ID NO: 40887

SEQ ID NO: 330426 - RNA, 64 nt, Homo Sapiens; identical to SEQ ID NO: 40888

SEQ ID NO: 330427 - RNA, 64 nt, Homo Sapiens; identical to SEQ ID NO: 40889

SEQ ID NO: 330428 - RNA, 64 nt, Homo Sapiens; identical to SEQ ID NO: 40890

SEQ ID NO: 330429 - RNA, 64 nt, Homo Sapiens; identical to SEQ ID NO: 40891

SEQ ID NO: 330430 - RNA, 64 nt, Homo Sapiens; identical to SEQ ID NO: 40892

SEQ ID NO: 330431 - RNA, 64 nt, Homo Sapiens; identical to SEQ ID NO: 40893

SEQ ID NO: 330432 - RNA, 64 nt, Homo Sapiens; identical to SEQ ID NO: 40894

SEQ ID NO: 330433 - RNA, 64 nt, Homo Sapiens; identical to SEQ ID NO: 40895

SEQ ID NO: 330434 - RNA, 64 nt, Homo Sapiens; identical to SEQ ID NO: 40896

SEQ ID NO: 330435 - RNA, 64 nt, Homo Sapiens; identical to SEQ ID NO: 40897

SEQ ID NO: 330436 - RNA, 64 nt, Homo Sapiens; identical to SEQ ID NO: 40898

SEQ ID NO: 330437 - RNA, 64 nt, Homo Sapiens; identical to SEQ ID NO: 40899

SEQ ID NO: 330438 - RNA, 64 nt, Homo Sapiens; identical to SEQ ID NO: 40900

SEQ ID NO: 330439 - RNA, 64 nt, Homo Sapiens; identical to SEQ ID NO: 40901

SEQ ID NO: 330440 - RNA, 64 nt, Homo Sapiens; identical to SEQ ID NO: 40902

SEQ ID NO: 330441 - RNA, 64 nt, Homo Sapiens; identical to SEQ ID NO: 40903

SEQ ID NO: 330442 - RNA, 64 nt, Homo Sapiens; identical to SEQ ID NO: 40904

SEQ ID NO: 330443 - RNA, 64 nt, Homo Sapiens; identical to SEQ ID NO: 40905

SEQ ID NO: 330444 - RNA, 64 nt, Homo Sapiens; identical to SEQ ID NO: 40906

SEQ ID NO: 330445 - RNA, 64 nt, Homo Sapiens; identical to SEQ ID NO: 40907

SEQ ID NO: 330446 - RNA, 64 nt, Homo Sapiens; identical to SEQ ID NO: 40908

SEQ ID NO: 330447 - RNA, 64 nt, Homo Sapiens; identical to SEQ ID NO: 40909

SEQ ID NO: 330448 - RNA, 64 nt, Homo Sapiens; identical to SEQ ID NO: 40910

SEQ ID NO: 330449 - RNA, 64 nt, Homo Sapiens; identical to SEQ ID NO: 40911

SEQ ID NO: 330450 - RNA, 64 nt, Homo Sapiens; identical to SEQ ID NO: 40912

SEQ ID NO: 330451 - RNA, 64 nt, Homo Sapiens; identical to SEQ ID NO: 40913

SEQ ID NO: 330452 - RNA, 64 nt, Homo Sapiens; identical to SEQ ID NO: 40914

SEQ ID NO: 330453 - RNA, 64 nt, Homo Sapiens; identical to SEQ ID NO: 40915

SEQ ID NO: 330454 - RNA, 64 nt, Homo Sapiens; identical to SEQ ID NO: 40916

SEQ ID NO: 330455 - RNA, 64 nt, Homo Sapiens; identical to SEQ ID NO: 40917

SEQ ID NO: 330456 - RNA, 64 nt, Homo Sapiens; identical to SEQ ID NO: 40918

SEQ ID NO: 330457 - RNA, 64 nt, Homo Sapiens; identical to SEQ ID NO: 40919

SEQ ID NO: 330458 - RNA, 64 nt, Homo Sapiens; identical to SEQ ID NO: 40920

SEQ ID NO: 330459 - RNA, 64 nt, Homo Sapiens; identical to SEQ ID NO: 40921

SEQ ID NO: 330460 - RNA, 64 nt, Homo Sapiens; identical to SEQ ID NO: 40922

SEQ ID NO: 330461 - RNA, 64 nt, Homo Sapiens; identical to SEQ ID NO: 40923

SEQ ID NO: 330462 - RNA, 64 nt, Homo Sapiens; identical to SEQ ID NO: 40924

SEQ ID NO: 330463 - RNA, 64 nt, Homo Sapiens; identical to SEQ ID NO: 40925

SEQ ID NO: 330464 - RNA, 64 nt, Homo Sapiens; identical to SEQ ID NO: 40926

SEQ ID NO: 330465 - RNA, 64 nt, Homo Sapiens; identical to SEQ ID NO: 40927

SEQ ID NO: 330466 - RNA, 64 nt, Homo Sapiens; identical to SEQ ID NO: 40928

SEQ ID NO: 330467 - RNA, 64 nt, Homo Sapiens; identical to SEQ ID NO: 40929

SEQ ID NO: 330468 - RNA, 64 nt, Homo Sapiens; identical to SEQ ID NO: 40930

SEQ ID NO: 330469 - RNA, 64 nt, Homo Sapiens; identical to SEQ ID NO: 40931

SEQ ID NO: 330470 - RNA, 64 nt, Homo Sapiens; identical to SEQ ID NO: 40932

SEQ ID NO: 330471 - RNA, 64 nt, Homo Sapiens; identical to SEQ ID NO: 40933

SEQ ID NO: 330472 - RNA, 64 nt, Homo Sapiens; identical to SEQ ID NO: 40934

SEQ ID NO: 330473 - RNA, 64 nt, Homo Sapiens; identical to SEQ ID NO: 40935

SEQ ID NO: 330474 - RNA, 64 nt, Homo Sapiens; identical to SEQ ID NO: 40936

SEQ ID NO: 330475 - RNA, 64 nt, Homo Sapiens; identical to SEQ ID NO: 40937

SEQ ID NO: 330476 - RNA, 64 nt, Homo Sapiens; identical to SEQ ID NO: 40938

SEQ ID NO: 330477 - RNA, 64 nt, Homo Sapiens; identical to SEQ ID NO: 40939

SEQ ID NO: 330478 - RNA, 64 nt, Homo Sapiens; identical to SEQ ID NO: 40940

SEQ ID NO: 330479 - RNA, 64 nt, Homo Sapiens; identical to SEQ ID NO: 40941

SEQ ID NO: 330480 - RNA, 64 nt, Homo Sapiens; identical to SEQ ID NO: 40942

SEQ ID NO: 330481 - RNA, 64 nt, Homo Sapiens; identical to SEQ ID NO: 40943

SEQ ID NO: 330482 - RNA, 64 nt, Homo Sapiens; identical to SEQ ID NO: 40944

SEQ ID NO: 330483 - RNA, 64 nt, Homo Sapiens; identical to SEQ ID NO: 40945

SEQ ID NO: 330484 - RNA, 64 nt, Homo Sapiens; identical to SEQ ID NO: 40946

SEQ ID NO: 330485 - RNA, 64 nt, Homo Sapiens; identical to SEQ ID NO: 40947

SEQ ID NO: 330486 - RNA, 64 nt, Homo Sapiens; identical to SEQ ID NO: 40948

SEQ ID NO: 330487 - RNA, 64 nt, Homo Sapiens; identical to SEQ ID NO: 40949

SEQ ID NO: 330488 - RNA, 64 nt, Homo Sapiens; identical to SEQ ID NO: 40950

SEQ ID NO: 330489 - RNA, 64 nt, Homo Sapiens; identical to SEQ ID NO: 40951

SEQ ID NO: 330490 - RNA, 64 nt, Homo Sapiens; identical to SEQ ID NO: 40952

SEQ ID NO: 330491 - RNA, 64 nt, Homo Sapiens; identical to SEQ ID NO: 40953

SEQ ID NO: 330492 - RNA, 64 nt, Homo Sapiens; identical to SEQ ID NO: 40954

SEQ ID NO: 330493 - RNA, 64 nt, Homo Sapiens; identical to SEQ ID NO: 40955

SEQ ID NO: 330494 - RNA, 64 nt, Homo Sapiens; identical to SEQ ID NO: 40956

SEQ ID NO: 330495 - RNA, 64 nt, Homo Sapiens; identical to SEQ ID NO: 40957

SEQ ID NO: 330496 - RNA, 64 nt, Homo Sapiens; identical to SEQ ID NO: 40958

SEQ ID NO: 330497 - RNA, 64 nt, Homo Sapiens; identical to SEQ ID NO: 40959

SEQ ID NO: 330498 - RNA, 64 nt, Homo Sapiens; identical to SEQ ID NO: 40960

SEQ ID NO: 330499 - RNA, 64 nt, Homo Sapiens; identical to SEQ ID NO: 40961

SEQ ID NO: 330500 - RNA, 64 nt, Homo Sapiens; identical to SEQ ID NO: 40962

SEQ ID NO: 330501 - RNA, 64 nt, Homo Sapiens; identical to SEQ ID NO: 40963

SEQ ID NO: 330502 - RNA, 64 nt, Homo Sapiens; identical to SEQ ID NO: 40964

SEQ ID NO: 330503 - RNA, 64 nt, Homo Sapiens; identical to SEQ ID NO: 40965

SEQ ID NO: 330504 - RNA, 64 nt, Homo Sapiens; identical to SEQ ID NO: 40966

SEQ ID NO: 330505 - RNA, 64 nt, Homo Sapiens; identical to SEQ ID NO: 40967

SEQ ID NO: 330506 - RNA, 64 nt, Homo Sapiens; identical to SEQ ID NO: 40968

SEQ ID NO: 330507 - RNA, 64 nt, Homo Sapiens; identical to SEQ ID NO: 40969

SEQ ID NO: 330508 - RNA, 64 nt, Homo Sapiens; identical to SEQ ID NO: 40970

SEQ ID NO: 330509 - RNA, 64 nt, Homo Sapiens; identical to SEQ ID NO: 40971

SEQ ID NO: 330510 - RNA, 64 nt, Homo Sapiens; identical to SEQ ID NO: 40972

SEQ ID NO: 330511 - RNA, 64 nt, Homo Sapiens; identical to SEQ ID NO: 40973

SEQ ID NO: 330512 - RNA, 64 nt, Homo Sapiens; identical to SEQ ID NO: 40974

SEQ ID NO: 330513 - RNA, 64 nt, Homo Sapiens; identical to SEQ ID NO: 40975

SEQ ID NO: 330514 - RNA, 64 nt, Homo Sapiens; identical to SEQ ID NO: 40976

SEQ ID NO: 330515 - RNA, 64 nt, Homo Sapiens; identical to SEQ ID NO: 40977

SEQ ID NO: 330516 - RNA, 64 nt, Homo Sapiens; identical to SEQ ID NO: 40978

SEQ ID NO: 330517 - RNA, 64 nt, Homo Sapiens; identical to SEQ ID NO: 40979

SEQ ID NO: 330518 - RNA, 64 nt, Homo Sapiens; identical to SEQ ID NO: 40980

SEQ ID NO: 330519 - RNA, 64 nt, Homo Sapiens; identical to SEQ ID NO: 40981

SEQ ID NO: 330520 - RNA, 64 nt, Homo Sapiens; identical to SEQ ID NO: 40982

SEQ ID NO: 330521 - RNA, 64 nt, Homo Sapiens; identical to SEQ ID NO: 40983

SEQ ID NO: 330522 - RNA, 64 nt, Homo Sapiens; identical to SEQ ID NO: 40984

SEQ ID NO: 330523 - RNA, 64 nt, Homo Sapiens; identical to SEQ ID NO: 40985

SEQ ID NO: 330524 - RNA, 64 nt, Homo Sapiens; identical to SEQ ID NO: 40986

SEQ ID NO: 330525 - RNA, 64 nt, Homo Sapiens; identical to SEQ ID NO: 40987

SEQ ID NO: 330526 - RNA, 64 nt, Homo Sapiens; identical to SEQ ID NO: 40988

SEQ ID NO: 330527 - RNA, 64 nt, Homo Sapiens; identical to SEQ ID NO: 40989

SEQ ID NO: 330528 - RNA, 64 nt, Homo Sapiens; identical to SEQ ID NO: 40990

SEQ ID NO: 330529 - RNA, 64 nt, Homo Sapiens; identical to SEQ ID NO: 40991

SEQ ID NO: 330530 - RNA, 64 nt, Homo Sapiens; identical to SEQ ID NO: 40992

SEQ ID NO: 330531 - RNA, 64 nt, Homo Sapiens; identical to SEQ ID NO: 40993

SEQ ID NO: 330532 - RNA, 64 nt, Homo Sapiens; identical to SEQ ID NO: 40994

SEQ ID NO: 330533 - RNA, 64 nt, Homo Sapiens; identical to SEQ ID NO: 40995

SEQ ID NO: 330534 - RNA, 64 nt, Homo Sapiens; identical to SEQ ID NO: 40996

SEQ ID NO: 330535 - RNA, 64 nt, Homo Sapiens; identical to SEQ ID NO: 40997

SEQ ID NO: 330536 - RNA, 64 nt, Homo Sapiens; identical to SEQ ID NO: 40998

SEQ ID NO: 330537 - RNA, 64 nt, Homo Sapiens; identical to SEQ ID NO: 40999

SEQ ID NO: 330538 - RNA, 64 nt, Homo Sapiens; identical to SEQ ID NO: 41000

SEQ ID NO: 330539 - RNA, 64 nt, Homo Sapiens; identical to SEQ ID NO: 41001

SEQ ID NO: 330540 - RNA, 64 nt, Homo Sapiens; identical to SEQ ID NO: 41002

SEQ ID NO: 330541 - RNA, 64 nt, Homo Sapiens; identical to SEQ ID NO: 41003

SEQ ID NO: 330542 - RNA, 64 nt, Homo Sapiens; identical to SEQ ID NO: 41004

SEQ ID NO: 330543 - RNA, 64 nt, Homo Sapiens; identical to SEQ ID NO: 41005

SEQ ID NO: 330544 - RNA, 64 nt, Homo Sapiens; identical to SEQ ID NO: 41006

SEQ ID NO: 330545 - RNA, 63 nt, Homo Sapiens; identical to SEQ ID NO: 41007

SEQ ID NO: 330546 - RNA, 64 nt, Homo Sapiens; identical to SEQ ID NO: 41008

SEQ ID NO: 330547 - RNA, 64 nt, Homo Sapiens; identical to SEQ ID NO: 41009

SEQ ID NO: 330548 - RNA, 64 nt, Homo Sapiens; identical to SEQ ID NO: 41010

SEQ ID NO: 330549 - RNA, 64 nt, Homo Sapiens; identical to SEQ ID NO: 41011

SEQ ID NO: 330550 - RNA, 64 nt, Homo Sapiens; identical to SEQ ID NO: 41012

SEQ ID NO: 330551 - RNA, 64 nt, Homo Sapiens; identical to SEQ ID NO: 41013

SEQ ID NO: 330552 - RNA, 64 nt, Homo Sapiens; identical to SEQ ID NO: 41014

SEQ ID NO: 330553 - RNA, 64 nt, Homo Sapiens; identical to SEQ ID NO: 41015

SEQ ID NO: 330554 - RNA, 64 nt, Homo Sapiens; identical to SEQ ID NO: 41016

SEQ ID NO: 330555 - RNA, 64 nt, Homo Sapiens; identical to SEQ ID NO: 41017

SEQ ID NO: 330556 - RNA, 64 nt, Homo Sapiens; identical to SEQ ID NO: 41018

SEQ ID NO: 330557 - RNA, 64 nt, Homo Sapiens; identical to SEQ ID NO: 41019

SEQ ID NO: 330558 - RNA, 64 nt, Homo Sapiens; identical to SEQ ID NO: 41020

SEQ ID NO: 330559 - RNA, 64 nt, Homo Sapiens; identical to SEQ ID NO: 41021

SEQ ID NO: 330560 - RNA, 64 nt, Homo Sapiens; identical to SEQ ID NO: 41022

SEQ ID NO: 330561 - RNA, 64 nt, Homo Sapiens; identical to SEQ ID NO: 41023

SEQ ID NO: 330562 - RNA, 64 nt, Homo Sapiens; identical to SEQ ID NO: 41024

SEQ ID NO: 330563 - RNA, 64 nt, Homo Sapiens; identical to SEQ ID NO: 41025

SEQ ID NO: 330564 - RNA, 64 nt, Homo Sapiens; identical to SEQ ID NO: 41026

SEQ ID NO: 330565 - RNA, 64 nt, Homo Sapiens; identical to SEQ ID NO: 41027

SEQ ID NO: 330566 - RNA, 64 nt, Homo Sapiens; identical to SEQ ID NO: 41028

SEQ ID NO: 330567 - RNA, 64 nt, Homo Sapiens; identical to SEQ ID NO: 41029

SEQ ID NO: 330568 - RNA, 64 nt, Homo Sapiens; identical to SEQ ID NO: 41030

SEQ ID NO: 330569 - RNA, 64 nt, Homo Sapiens; identical to SEQ ID NO: 41031

SEQ ID NO: 330570 - RNA, 64 nt, Homo Sapiens; identical to SEQ ID NO: 41032

SEQ ID NO: 330571 - RNA, 64 nt, Homo Sapiens; identical to SEQ ID NO: 41033

SEQ ID NO: 330572 - RNA, 64 nt, Homo Sapiens; identical to SEQ ID NO: 41034

SEQ ID NO: 330573 - RNA, 64 nt, Homo Sapiens; identical to SEQ ID NO: 41035

SEQ ID NO: 330574 - RNA, 64 nt, Homo Sapiens; identical to SEQ ID NO: 41036

SEQ ID NO: 330575 - RNA, 64 nt, Homo Sapiens; identical to SEQ ID NO: 41037

SEQ ID NO: 330576 - RNA, 64 nt, Homo Sapiens; identical to SEQ ID NO: 41038

SEQ ID NO: 330577 - RNA, 64 nt, Homo Sapiens; identical to SEQ ID NO: 41039

SEQ ID NO: 330578 - RNA, 64 nt, Homo Sapiens; identical to SEQ ID NO: 41040

SEQ ID NO: 330579 - RNA, 64 nt, Homo Sapiens; identical to SEQ ID NO: 41041

SEQ ID NO: 330580 - RNA, 64 nt, Homo Sapiens; identical to SEQ ID NO: 41042

SEQ ID NO: 330581 - RNA, 64 nt, Homo Sapiens; identical to SEQ ID NO: 41043

SEQ ID NO: 330582 - RNA, 64 nt, Homo Sapiens; identical to SEQ ID NO: 41044

SEQ ID NO: 330583 - RNA, 64 nt, Homo Sapiens; identical to SEQ ID NO: 41045

SEQ ID NO: 330584 - RNA, 64 nt, Homo Sapiens; identical to SEQ ID NO: 41046

SEQ ID NO: 330585 - RNA, 64 nt, Homo Sapiens; identical to SEQ ID NO: 41047

SEQ ID NO: 330586 - RNA, 64 nt, Homo Sapiens; identical to SEQ ID NO: 41048

SEQ ID NO: 330587 - RNA, 64 nt, Homo Sapiens; identical to SEQ ID NO: 41049

SEQ ID NO: 330588 - RNA, 64 nt, Homo Sapiens; identical to SEQ ID NO: 41050

SEQ ID NO: 330589 - RNA, 64 nt, Homo Sapiens; identical to SEQ ID NO: 41051

SEQ ID NO: 330590 - RNA, 64 nt, Homo Sapiens; identical to SEQ ID NO: 41052

SEQ ID NO: 330591 - RNA, 64 nt, Homo Sapiens; identical to SEQ ID NO: 41053

SEQ ID NO: 330592 - RNA, 64 nt, Homo Sapiens; identical to SEQ ID NO: 41054

SEQ ID NO: 330593 - RNA, 64 nt, Homo Sapiens; identical to SEQ ID NO: 41055

SEQ ID NO: 330594 - RNA, 64 nt, Homo Sapiens; identical to SEQ ID NO: 41056

SEQ ID NO: 330595 - RNA, 64 nt, Homo Sapiens; identical to SEQ ID NO: 41057

SEQ ID NO: 330596 - RNA, 64 nt, Homo Sapiens; identical to SEQ ID NO: 41058

SEQ ID NO: 330597 - RNA, 64 nt, Homo Sapiens; identical to SEQ ID NO: 41059

SEQ ID NO: 330598 - RNA, 64 nt, Homo Sapiens; identical to SEQ ID NO: 41060

SEQ ID NO: 330599 - RNA, 64 nt, Homo Sapiens; identical to SEQ ID NO: 41061

SEQ ID NO: 330600 - RNA, 64 nt, Homo Sapiens; identical to SEQ ID NO: 41062

SEQ ID NO: 330601 - RNA, 64 nt, Homo Sapiens; identical to SEQ ID NO: 41063

SEQ ID NO: 330602 - RNA, 64 nt, Homo Sapiens; identical to SEQ ID NO: 41064

SEQ ID NO: 330603 - RNA, 64 nt, Homo Sapiens; identical to SEQ ID NO: 41065

SEQ ID NO: 330604 - RNA, 64 nt, Homo Sapiens; identical to SEQ ID NO: 41066

SEQ ID NO: 330605 - RNA, 64 nt, Homo Sapiens; identical to SEQ ID NO: 41067

SEQ ID NO: 330606 - RNA, 64 nt, Homo Sapiens; identical to SEQ ID NO: 41068

SEQ ID NO: 330607 - RNA, 64 nt, Homo Sapiens; identical to SEQ ID NO: 41069

SEQ ID NO: 330608 - RNA, 64 nt, Homo Sapiens; identical to SEQ ID NO: 41070

SEQ ID NO: 330609 - RNA, 64 nt, Homo Sapiens; identical to SEQ ID NO: 41071

SEQ ID NO: 330610 - RNA, 64 nt, Homo Sapiens; identical to SEQ ID NO: 41072

SEQ ID NO: 330611 - RNA, 64 nt, Homo Sapiens; identical to SEQ ID NO: 41073

SEQ ID NO: 330612 - RNA, 64 nt, Homo Sapiens; identical to SEQ ID NO: 41074

SEQ ID NO: 330613 - RNA, 64 nt, Homo Sapiens; identical to SEQ ID NO: 41075

SEQ ID NO: 330614 - RNA, 64 nt, Homo Sapiens; identical to SEQ ID NO: 41076

SEQ ID NO: 330615 - RNA, 64 nt, Homo Sapiens; identical to SEQ ID NO: 41077

SEQ ID NO: 330616 - RNA, 64 nt, Homo Sapiens; identical to SEQ ID NO: 41078

SEQ ID NO: 330617 - RNA, 64 nt, Homo Sapiens; identical to SEQ ID NO: 41079

SEQ ID NO: 330618 - RNA, 64 nt, Homo Sapiens; identical to SEQ ID NO: 41080

SEQ ID NO: 330619 - RNA, 64 nt, Homo Sapiens; identical to SEQ ID NO: 41081

SEQ ID NO: 330620 - RNA, 64 nt, Homo Sapiens; identical to SEQ ID NO: 41082

SEQ ID NO: 330621 - RNA, 64 nt, Homo Sapiens; identical to SEQ ID NO: 41083

SEQ ID NO: 330622 - RNA, 64 nt, Homo Sapiens; identical to SEQ ID NO: 41084

SEQ ID NO: 330623 - RNA, 64 nt, Homo Sapiens; identical to SEQ ID NO: 41085

SEQ ID NO: 330624 - RNA, 64 nt, Homo Sapiens; identical to SEQ ID NO: 41086

SEQ ID NO: 330625 - RNA, 64 nt, Homo Sapiens; identical to SEQ ID NO: 41087

SEQ ID NO: 330626 - RNA, 64 nt, Homo Sapiens; identical to SEQ ID NO: 41088

SEQ ID NO: 330627 - RNA, 64 nt, Homo Sapiens; identical to SEQ ID NO: 41089

SEQ ID NO: 330628 - RNA, 64 nt, Homo Sapiens; identical to SEQ ID NO: 41090

SEQ ID NO: 330629 - RNA, 64 nt, Homo Sapiens; identical to SEQ ID NO: 41091

SEQ ID NO: 330630 - RNA, 64 nt, Homo Sapiens; identical to SEQ ID NO: 41092

SEQ ID NO: 330631 - RNA, 64 nt, Homo Sapiens; identical to SEQ ID NO: 41093

SEQ ID NO: 330632 - RNA, 64 nt, Homo Sapiens; identical to SEQ ID NO: 41094

SEQ ID NO: 330633 - RNA, 64 nt, Homo Sapiens; identical to SEQ ID NO: 41095

SEQ ID NO: 330634 - RNA, 64 nt, Homo Sapiens; identical to SEQ ID NO: 41096

SEQ ID NO: 330635 - RNA, 64 nt, Homo Sapiens; identical to SEQ ID NO: 41097

SEQ ID NO: 330636 - RNA, 64 nt, Homo Sapiens; identical to SEQ ID NO: 41098

SEQ ID NO: 330637 - RNA, 64 nt, Homo Sapiens; identical to SEQ ID NO: 41099

SEQ ID NO: 330638 - RNA, 64 nt, Homo Sapiens; identical to SEQ ID NO: 41100

SEQ ID NO: 330639 - RNA, 64 nt, Homo Sapiens; identical to SEQ ID NO: 41101

SEQ ID NO: 330640 - RNA, 64 nt, Homo Sapiens; identical to SEQ ID NO: 41102

SEQ ID NO: 330641 - RNA, 64 nt, Homo Sapiens; identical to SEQ ID NO: 41103

SEQ ID NO: 330642 - RNA, 64 nt, Homo Sapiens; identical to SEQ ID NO: 41104

SEQ ID NO: 330643 - RNA, 64 nt, Homo Sapiens; identical to SEQ ID NO: 41105

SEQ ID NO: 330644 - RNA, 64 nt, Homo Sapiens; identical to SEQ ID NO: 41106

SEQ ID NO: 330645 - RNA, 64 nt, Homo Sapiens; identical to SEQ ID NO: 41107

SEQ ID NO: 330646 - RNA, 64 nt, Homo Sapiens; identical to SEQ ID NO: 41108

SEQ ID NO: 330647 - RNA, 64 nt, Homo Sapiens; identical to SEQ ID NO: 41109

SEQ ID NO: 330648 - RNA, 64 nt, Homo Sapiens; identical to SEQ ID NO: 41110

SEQ ID NO: 330649 - RNA, 64 nt, Homo Sapiens; identical to SEQ ID NO: 41111

SEQ ID NO: 330650 - RNA, 64 nt, Homo Sapiens; identical to SEQ ID NO: 41112

SEQ ID NO: 330651 - RNA, 64 nt, Homo Sapiens; identical to SEQ ID NO: 41113

SEQ ID NO: 330652 - RNA, 64 nt, Homo Sapiens; identical to SEQ ID NO: 41114

SEQ ID NO: 330653 - RNA, 64 nt, Homo Sapiens; identical to SEQ ID NO: 41115

SEQ ID NO: 330654 - RNA, 64 nt, Homo Sapiens; identical to SEQ ID NO: 41116

SEQ ID NO: 330655 - RNA, 64 nt, Homo Sapiens; identical to SEQ ID NO: 41117

SEQ ID NO: 330656 - RNA, 64 nt, Homo Sapiens; identical to SEQ ID NO: 41118

SEQ ID NO: 330657 - RNA, 64 nt, Homo Sapiens; identical to SEQ ID NO: 41119

SEQ ID NO: 330658 - RNA, 64 nt, Homo Sapiens; identical to SEQ ID NO: 41120

SEQ ID NO: 330659 - RNA, 64 nt, Homo Sapiens; identical to SEQ ID NO: 41121

SEQ ID NO: 330660 - RNA, 64 nt, Homo Sapiens; identical to SEQ ID NO: 41122

SEQ ID NO: 330661 - RNA, 64 nt, Homo Sapiens; identical to SEQ ID NO: 41123

SEQ ID NO: 330662 - RNA, 64 nt, Homo Sapiens; identical to SEQ ID NO: 41124

SEQ ID NO: 330663 - RNA, 64 nt, Homo Sapiens; identical to SEQ ID NO: 41125

SEQ ID NO: 330664 - RNA, 64 nt, Homo Sapiens; identical to SEQ ID NO: 41126

SEQ ID NO: 330665 - RNA, 64 nt, Homo Sapiens; identical to SEQ ID NO: 41127

SEQ ID NO: 330666 - RNA, 64 nt, Homo Sapiens; identical to SEQ ID NO: 41128

SEQ ID NO: 330667 - RNA, 64 nt, Homo Sapiens; identical to SEQ ID NO: 41129

SEQ ID NO: 330668 - RNA, 64 nt, Homo Sapiens; identical to SEQ ID NO: 41130

SEQ ID NO: 330669 - RNA, 64 nt, Homo Sapiens; identical to SEQ ID NO: 41131

SEQ ID NO: 330670 - RNA, 64 nt, Homo Sapiens; identical to SEQ ID NO: 41132

SEQ ID NO: 330671 - RNA, 64 nt, Homo Sapiens; identical to SEQ ID NO: 41133

SEQ ID NO: 330672 - RNA, 64 nt, Homo Sapiens; identical to SEQ ID NO: 41134

SEQ ID NO: 330673 - RNA, 64 nt, Homo Sapiens; identical to SEQ ID NO: 41135

SEQ ID NO: 330674 - RNA, 64 nt, Homo Sapiens; identical to SEQ ID NO: 41136

SEQ ID NO: 330675 - RNA, 64 nt, Homo Sapiens; identical to SEQ ID NO: 41137

SEQ ID NO: 330676 - RNA, 64 nt, Homo Sapiens; identical to SEQ ID NO: 41138

SEQ ID NO: 330677 - RNA, 64 nt, Homo Sapiens; identical to SEQ ID NO: 41139

SEQ ID NO: 330678 - RNA, 64 nt, Homo Sapiens; identical to SEQ ID NO: 41140

SEQ ID NO: 330679 - RNA, 64 nt, Homo Sapiens; identical to SEQ ID NO: 41141

SEQ ID NO: 330680 - RNA, 64 nt, Homo Sapiens; identical to SEQ ID NO: 41142

SEQ ID NO: 330681 - RNA, 64 nt, Homo Sapiens; identical to SEQ ID NO: 41143

SEQ ID NO: 330682 - RNA, 64 nt, Homo Sapiens; identical to SEQ ID NO: 41144

SEQ ID NO: 330683 - RNA, 64 nt, Homo Sapiens; identical to SEQ ID NO: 41145

SEQ ID NO: 330684 - RNA, 64 nt, Homo Sapiens; identical to SEQ ID NO: 41146

SEQ ID NO: 330685 - RNA, 64 nt, Homo Sapiens; identical to SEQ ID NO: 41147

SEQ ID NO: 330686 - RNA, 64 nt, Homo Sapiens; identical to SEQ ID NO: 41148

SEQ ID NO: 330687 - RNA, 64 nt, Homo Sapiens; identical to SEQ ID NO: 41149

SEQ ID NO: 330688 - RNA, 64 nt, Homo Sapiens; identical to SEQ ID NO: 41150

SEQ ID NO: 330689 - RNA, 64 nt, Homo Sapiens; identical to SEQ ID NO: 41151

SEQ ID NO: 330690 - RNA, 64 nt, Homo Sapiens; identical to SEQ ID NO: 41152

SEQ ID NO: 330691 - RNA, 64 nt, Homo Sapiens; identical to SEQ ID NO: 41153

SEQ ID NO: 330692 - RNA, 64 nt, Homo Sapiens; identical to SEQ ID NO: 41154

SEQ ID NO: 330693 - RNA, 64 nt, Homo Sapiens; identical to SEQ ID NO: 41155

SEQ ID NO: 330694 - RNA, 64 nt, Homo Sapiens; identical to SEQ ID NO: 41156

SEQ ID NO: 330695 - RNA, 64 nt, Homo Sapiens; identical to SEQ ID NO: 41157

SEQ ID NO: 330696 - RNA, 64 nt, Homo Sapiens; identical to SEQ ID NO: 41158

SEQ ID NO: 330697 - RNA, 64 nt, Homo Sapiens; identical to SEQ ID NO: 41159

SEQ ID NO: 330698 - RNA, 64 nt, Homo Sapiens; identical to SEQ ID NO: 41160

SEQ ID NO: 330699 - RNA, 64 nt, Homo Sapiens; identical to SEQ ID NO: 41161

SEQ ID NO: 330700 - RNA, 64 nt, Homo Sapiens; identical to SEQ ID NO: 41162

SEQ ID NO: 330701 - RNA, 64 nt, Homo Sapiens; identical to SEQ ID NO: 41163

SEQ ID NO: 330702 - RNA, 64 nt, Homo Sapiens; identical to SEQ ID NO: 41164

SEQ ID NO: 330703 - RNA, 64 nt, Homo Sapiens; identical to SEQ ID NO: 41165

SEQ ID NO: 330704 - RNA, 64 nt, Homo Sapiens; identical to SEQ ID NO: 41166

SEQ ID NO: 330705 - RNA, 64 nt, Homo Sapiens; identical to SEQ ID NO: 41167

SEQ ID NO: 330706 - RNA, 64 nt, Homo Sapiens; identical to SEQ ID NO: 41168

SEQ ID NO: 330707 - RNA, 64 nt, Homo Sapiens; identical to SEQ ID NO: 41169

SEQ ID NO: 330708 - RNA, 64 nt, Homo Sapiens; identical to SEQ ID NO: 41170

SEQ ID NO: 330709 - RNA, 64 nt, Homo Sapiens; identical to SEQ ID NO: 41171

SEQ ID NO: 330710 - RNA, 64 nt, Homo Sapiens; identical to SEQ ID NO: 41172

SEQ ID NO: 330711 - RNA, 64 nt, Homo Sapiens; identical to SEQ ID NO: 41173

SEQ ID NO: 330712 - RNA, 64 nt, Homo Sapiens; identical to SEQ ID NO: 41174

SEQ ID NO: 330713 - RNA, 64 nt, Homo Sapiens; identical to SEQ ID NO: 41175

SEQ ID NO: 330714 - RNA, 64 nt, Homo Sapiens; identical to SEQ ID NO: 41176

SEQ ID NO: 330715 - RNA, 64 nt, Homo Sapiens; identical to SEQ ID NO: 41177

SEQ ID NO: 330716 - RNA, 64 nt, Homo Sapiens; identical to SEQ ID NO: 41178

SEQ ID NO: 330717 - RNA, 64 nt, Homo Sapiens; identical to SEQ ID NO: 41179

SEQ ID NO: 330718 - RNA, 64 nt, Homo Sapiens; identical to SEQ ID NO: 41180

SEQ ID NO: 330719 - RNA, 64 nt, Homo Sapiens; identical to SEQ ID NO: 41181

SEQ ID NO: 330720 - RNA, 64 nt, Homo Sapiens; identical to SEQ ID NO: 41182

SEQ ID NO: 330721 - RNA, 64 nt, Homo Sapiens; identical to SEQ ID NO: 41183

SEQ ID NO: 330722 - RNA, 64 nt, Homo Sapiens; identical to SEQ ID NO: 41184

SEQ ID NO: 330723 - RNA, 64 nt, Homo Sapiens; identical to SEQ ID NO: 41185

SEQ ID NO: 330724 - RNA, 64 nt, Homo Sapiens; identical to SEQ ID NO: 41186

SEQ ID NO: 330725 - RNA, 64 nt, Homo Sapiens; identical to SEQ ID NO: 41187

SEQ ID NO: 330726 - RNA, 64 nt, Homo Sapiens; identical to SEQ ID NO: 41188

SEQ ID NO: 330727 - RNA, 64 nt, Homo Sapiens; identical to SEQ ID NO: 41189

SEQ ID NO: 330728 - RNA, 64 nt, Homo Sapiens; identical to SEQ ID NO: 41190

SEQ ID NO: 330729 - RNA, 64 nt, Homo Sapiens; identical to SEQ ID NO: 41191

SEQ ID NO: 330730 - RNA, 64 nt, Homo Sapiens; identical to SEQ ID NO: 41192

SEQ ID NO: 330731 - RNA, 64 nt, Homo Sapiens; identical to SEQ ID NO: 41193

SEQ ID NO: 330732 - RNA, 64 nt, Homo Sapiens; identical to SEQ ID NO: 41194

SEQ ID NO: 330733 - RNA, 64 nt, Homo Sapiens; identical to SEQ ID NO: 41195

SEQ ID NO: 330734 - RNA, 64 nt, Homo Sapiens; identical to SEQ ID NO: 41196

SEQ ID NO: 330735 - RNA, 64 nt, Homo Sapiens; identical to SEQ ID NO: 41197

SEQ ID NO: 330736 - RNA, 64 nt, Homo Sapiens; identical to SEQ ID NO: 41198

SEQ ID NO: 330737 - RNA, 64 nt, Homo Sapiens; identical to SEQ ID NO: 41199

SEQ ID NO: 330738 - RNA, 64 nt, Homo Sapiens; identical to SEQ ID NO: 41200

SEQ ID NO: 330739 - RNA, 64 nt, Homo Sapiens; identical to SEQ ID NO: 41201

SEQ ID NO: 330740 - RNA, 64 nt, Homo Sapiens; identical to SEQ ID NO: 41202

SEQ ID NO: 330741 - RNA, 64 nt, Homo Sapiens; identical to SEQ ID NO: 41203

SEQ ID NO: 330742 - RNA, 64 nt, Homo Sapiens; identical to SEQ ID NO: 41204

SEQ ID NO: 330743 - RNA, 64 nt, Homo Sapiens; identical to SEQ ID NO: 41205

SEQ ID NO: 330744 - RNA, 64 nt, Homo Sapiens; identical to SEQ ID NO: 41206

SEQ ID NO: 330745 - RNA, 64 nt, Homo Sapiens; identical to SEQ ID NO: 41207

SEQ ID NO: 330746 - RNA, 64 nt, Homo Sapiens; identical to SEQ ID NO: 41208

SEQ ID NO: 330747 - RNA, 64 nt, Homo Sapiens; identical to SEQ ID NO: 41209

SEQ ID NO: 330748 - RNA, 64 nt, Homo Sapiens; identical to SEQ ID NO: 41210

SEQ ID NO: 330749 - RNA, 64 nt, Homo Sapiens; identical to SEQ ID NO: 41211

SEQ ID NO: 330750 - RNA, 64 nt, Homo Sapiens; identical to SEQ ID NO: 41212

SEQ ID NO: 330751 - RNA, 64 nt, Homo Sapiens; identical to SEQ ID NO: 41213

SEQ ID NO: 330752 - RNA, 64 nt, Homo Sapiens; identical to SEQ ID NO: 41214

SEQ ID NO: 330753 - RNA, 64 nt, Homo Sapiens; identical to SEQ ID NO: 41215

SEQ ID NO: 330754 - RNA, 64 nt, Homo Sapiens; identical to SEQ ID NO: 41216

SEQ ID NO: 330755 - RNA, 64 nt, Homo Sapiens; identical to SEQ ID NO: 41217

SEQ ID NO: 330756 - RNA, 64 nt, Homo Sapiens; identical to SEQ ID NO: 41218

SEQ ID NO: 330757 - RNA, 64 nt, Homo Sapiens; identical to SEQ ID NO: 41219

SEQ ID NO: 330758 - RNA, 64 nt, Homo Sapiens; identical to SEQ ID NO: 41220

SEQ ID NO: 330759 - RNA, 64 nt, Homo Sapiens; identical to SEQ ID NO: 41221

SEQ ID NO: 330760 - RNA, 64 nt, Homo Sapiens; identical to SEQ ID NO: 41222

SEQ ID NO: 330761 - RNA, 64 nt, Homo Sapiens; identical to SEQ ID NO: 41223

SEQ ID NO: 330762 - RNA, 64 nt, Homo Sapiens; identical to SEQ ID NO: 41224

SEQ ID NO: 330763 - RNA, 64 nt, Homo Sapiens; identical to SEQ ID NO: 41225

SEQ ID NO: 330764 - RNA, 64 nt, Homo Sapiens; identical to SEQ ID NO: 41226

SEQ ID NO: 330765 - RNA, 64 nt, Homo Sapiens; identical to SEQ ID NO: 41227

SEQ ID NO: 330766 - RNA, 64 nt, Homo Sapiens; identical to SEQ ID NO: 41228

SEQ ID NO: 330767 - RNA, 64 nt, Homo Sapiens; identical to SEQ ID NO: 41229

SEQ ID NO: 330768 - RNA, 64 nt, Homo Sapiens; identical to SEQ ID NO: 41230

SEQ ID NO: 330769 - RNA, 64 nt, Homo Sapiens; identical to SEQ ID NO: 41231

SEQ ID NO: 330770 - RNA, 64 nt, Homo Sapiens; identical to SEQ ID NO: 41232

SEQ ID NO: 330771 - RNA, 64 nt, Homo Sapiens; identical to SEQ ID NO: 41233

SEQ ID NO: 330772 - RNA, 64 nt, Homo Sapiens; identical to SEQ ID NO: 41234

SEQ ID NO: 330773 - RNA, 64 nt, Homo Sapiens; identical to SEQ ID NO: 41235

SEQ ID NO: 330774 - RNA, 62 nt, Homo Sapiens; identical to SEQ ID NO: 41236

SEQ ID NO: 330775 - RNA, 60 nt, Homo Sapiens; identical to SEQ ID NO: 41237

SEQ ID NO: 330776 - RNA, 58 nt, Homo Sapiens; identical to SEQ ID NO: 41238

SEQ ID NO: 330777 - RNA, 56 nt, Homo Sapiens; identical to SEQ ID NO: 41239

SEQ ID NO: 330778 - RNA, 54 nt, Homo Sapiens; identical to SEQ ID NO: 41240

SEQ ID NO: 330779 - RNA, 64 nt, Homo Sapiens; identical to SEQ ID NO: 41241

SEQ ID NO: 330780 - RNA, 64 nt, Homo Sapiens; identical to SEQ ID NO: 41242

SEQ ID NO: 330781 - RNA, 64 nt, Homo Sapiens; identical to SEQ ID NO: 41243

SEQ ID NO: 330782 - RNA, 64 nt, Homo Sapiens; identical to SEQ ID NO: 41244

SEQ ID NO: 330783 - RNA, 64 nt, Homo Sapiens; identical to SEQ ID NO: 41245

SEQ ID NO: 330784 - RNA, 64 nt, Homo Sapiens; identical to SEQ ID NO: 41246

SEQ ID NO: 330785 - RNA, 64 nt, Homo Sapiens; identical to SEQ ID NO: 41247

SEQ ID NO: 330786 - RNA, 64 nt, Homo Sapiens; identical to SEQ ID NO: 41248

SEQ ID NO: 330787 - RNA, 64 nt, Homo Sapiens; identical to SEQ ID NO: 41249

SEQ ID NO: 330788 - RNA, 64 nt, Homo Sapiens; identical to SEQ ID NO: 41250

SEQ ID NO: 330789 - RNA, 64 nt, Homo Sapiens; identical to SEQ ID NO: 41251

SEQ ID NO: 330790 - RNA, 64 nt, Homo Sapiens; identical to SEQ ID NO: 41252

SEQ ID NO: 330791 - RNA, 64 nt, Homo Sapiens; identical to SEQ ID NO: 41253

SEQ ID NO: 330792 - RNA, 64 nt, Homo Sapiens; identical to SEQ ID NO: 41254

SEQ ID NO: 330793 - RNA, 64 nt, Homo Sapiens; identical to SEQ ID NO: 41255

SEQ ID NO: 330794 - RNA, 64 nt, Homo Sapiens; identical to SEQ ID NO: 41256

SEQ ID NO: 330795 - RNA, 64 nt, Homo Sapiens; identical to SEQ ID NO: 41257

SEQ ID NO: 330796 - RNA, 64 nt, Homo Sapiens; identical to SEQ ID NO: 41258

SEQ ID NO: 330797 - RNA, 64 nt, Homo Sapiens; identical to SEQ ID NO: 41259

SEQ ID NO: 330798 - RNA, 64 nt, Homo Sapiens; identical to SEQ ID NO: 41260

SEQ ID NO: 330799 - RNA, 64 nt, Homo Sapiens; identical to SEQ ID NO: 41261

SEQ ID NO: 330800 - RNA, 64 nt, Homo Sapiens; identical to SEQ ID NO: 41262

SEQ ID NO: 330801 - RNA, 64 nt, Homo Sapiens; identical to SEQ ID NO: 41263

SEQ ID NO: 330802 - RNA, 64 nt, Homo Sapiens; identical to SEQ ID NO: 41264

SEQ ID NO: 330803 - RNA, 64 nt, Homo Sapiens; identical to SEQ ID NO: 41265

SEQ ID NO: 330804 - RNA, 64 nt, Homo Sapiens; identical to SEQ ID NO: 41266

SEQ ID NO: 330805 - RNA, 64 nt, Homo Sapiens; identical to SEQ ID NO: 41267

SEQ ID NO: 330806 - RNA, 64 nt, Homo Sapiens; identical to SEQ ID NO: 41268

SEQ ID NO: 330807 - RNA, 64 nt, Homo Sapiens; identical to SEQ ID NO: 41269

SEQ ID NO: 330808 - RNA, 64 nt, Homo Sapiens; identical to SEQ ID NO: 41270

SEQ ID NO: 330809 - RNA, 64 nt, Homo Sapiens; identical to SEQ ID NO: 41271

SEQ ID NO: 330810 - RNA, 64 nt, Homo Sapiens; identical to SEQ ID NO: 41272

SEQ ID NO: 330811 - RNA, 64 nt, Homo Sapiens; identical to SEQ ID NO: 41273

SEQ ID NO: 330812 - RNA, 64 nt, Homo Sapiens; identical to SEQ ID NO: 41274

SEQ ID NO: 330813 - RNA, 64 nt, Homo Sapiens; identical to SEQ ID NO: 41275

SEQ ID NO: 330814 - RNA, 64 nt, Homo Sapiens; identical to SEQ ID NO: 41276

SEQ ID NO: 330815 - RNA, 64 nt, Homo Sapiens; identical to SEQ ID NO: 41277

SEQ ID NO: 330816 - RNA, 64 nt, Homo Sapiens; identical to SEQ ID NO: 41278

SEQ ID NO: 330817 - RNA, 64 nt, Homo Sapiens; identical to SEQ ID NO: 41279

SEQ ID NO: 330818 - RNA, 64 nt, Homo Sapiens; identical to SEQ ID NO: 41280

SEQ ID NO: 330819 - RNA, 64 nt, Homo Sapiens; identical to SEQ ID NO: 41281

SEQ ID NO: 330820 - RNA, 64 nt, Homo Sapiens; identical to SEQ ID NO: 41282

SEQ ID NO: 330821 - RNA, 64 nt, Homo Sapiens; identical to SEQ ID NO: 41283

SEQ ID NO: 330822 - RNA, 64 nt, Homo Sapiens; identical to SEQ ID NO: 41284

SEQ ID NO: 330823 - RNA, 64 nt, Homo Sapiens; identical to SEQ ID NO: 41285

SEQ ID NO: 330824 - RNA, 64 nt, Homo Sapiens; identical to SEQ ID NO: 41286

SEQ ID NO: 330825 - RNA, 64 nt, Homo Sapiens; identical to SEQ ID NO: 41287

SEQ ID NO: 330826 - RNA, 64 nt, Homo Sapiens; identical to SEQ ID NO: 41288

SEQ ID NO: 330827 - RNA, 64 nt, Homo Sapiens; identical to SEQ ID NO: 41289

SEQ ID NO: 330828 - RNA, 64 nt, Homo Sapiens; identical to SEQ ID NO: 41290

SEQ ID NO: 330829 - RNA, 64 nt, Homo Sapiens; identical to SEQ ID NO: 41291

SEQ ID NO: 330830 - RNA, 64 nt, Homo Sapiens; identical to SEQ ID NO: 41292

SEQ ID NO: 330831 - RNA, 64 nt, Homo Sapiens; identical to SEQ ID NO: 41293

SEQ ID NO: 330832 - RNA, 64 nt, Homo Sapiens; identical to SEQ ID NO: 41294

SEQ ID NO: 330833 - RNA, 64 nt, Homo Sapiens; identical to SEQ ID NO: 41295

SEQ ID NO: 330834 - RNA, 64 nt, Homo Sapiens; identical to SEQ ID NO: 41296

SEQ ID NO: 330835 - RNA, 64 nt, Homo Sapiens; identical to SEQ ID NO: 41297

SEQ ID NO: 330836 - RNA, 64 nt, Homo Sapiens; identical to SEQ ID NO: 41298

SEQ ID NO: 330837 - RNA, 64 nt, Homo Sapiens; identical to SEQ ID NO: 41299

SEQ ID NO: 330838 - RNA, 64 nt, Homo Sapiens; identical to SEQ ID NO: 41300

SEQ ID NO: 330839 - RNA, 64 nt, Homo Sapiens; identical to SEQ ID NO: 41301

SEQ ID NO: 330840 - RNA, 64 nt, Homo Sapiens; identical to SEQ ID NO: 41302

SEQ ID NO: 330841 - RNA, 64 nt, Homo Sapiens; identical to SEQ ID NO: 41303

SEQ ID NO: 330842 - RNA, 64 nt, Homo Sapiens; identical to SEQ ID NO: 41304

SEQ ID NO: 330843 - RNA, 64 nt, Homo Sapiens; identical to SEQ ID NO: 41305

SEQ ID NO: 330844 - RNA, 64 nt, Homo Sapiens; identical to SEQ ID NO: 41306

SEQ ID NO: 330845 - RNA, 64 nt, Homo Sapiens; identical to SEQ ID NO: 41307

SEQ ID NO: 330846 - RNA, 64 nt, Homo Sapiens; identical to SEQ ID NO: 41308

SEQ ID NO: 330847 - RNA, 64 nt, Homo Sapiens; identical to SEQ ID NO: 41309

SEQ ID NO: 330848 - RNA, 64 nt, Homo Sapiens; identical to SEQ ID NO: 41310

SEQ ID NO: 330849 - RNA, 64 nt, Homo Sapiens; identical to SEQ ID NO: 41311

SEQ ID NO: 330850 - RNA, 64 nt, Homo Sapiens; identical to SEQ ID NO: 41312

SEQ ID NO: 330851 - RNA, 64 nt, Homo Sapiens; identical to SEQ ID NO: 41313

SEQ ID NO: 330852 - RNA, 64 nt, Homo Sapiens; identical to SEQ ID NO: 41314

SEQ ID NO: 330853 - RNA, 64 nt, Homo Sapiens; identical to SEQ ID NO: 41315

SEQ ID NO: 330854 - RNA, 64 nt, Homo Sapiens; identical to SEQ ID NO: 41316

SEQ ID NO: 330855 - RNA, 64 nt, Homo Sapiens; identical to SEQ ID NO: 41317

SEQ ID NO: 330856 - RNA, 64 nt, Homo Sapiens; identical to SEQ ID NO: 41318

SEQ ID NO: 330857 - RNA, 64 nt, Homo Sapiens; identical to SEQ ID NO: 41319

SEQ ID NO: 330858 - RNA, 64 nt, Homo Sapiens; identical to SEQ ID NO: 41320

SEQ ID NO: 330859 - RNA, 64 nt, Homo Sapiens; identical to SEQ ID NO: 41321

SEQ ID NO: 330860 - RNA, 64 nt, Homo Sapiens; identical to SEQ ID NO: 41322

SEQ ID NO: 330861 - RNA, 64 nt, Homo Sapiens; identical to SEQ ID NO: 41323

SEQ ID NO: 330862 - RNA, 64 nt, Homo Sapiens; identical to SEQ ID NO: 41324

SEQ ID NO: 330863 - RNA, 64 nt, Homo Sapiens; identical to SEQ ID NO: 41325

SEQ ID NO: 330864 - RNA, 64 nt, Homo Sapiens; identical to SEQ ID NO: 41326

SEQ ID NO: 330865 - RNA, 64 nt, Homo Sapiens; identical to SEQ ID NO: 41327

SEQ ID NO: 330866 - RNA, 64 nt, Homo Sapiens; identical to SEQ ID NO: 41328

SEQ ID NO: 330867 - RNA, 64 nt, Homo Sapiens; identical to SEQ ID NO: 41329

SEQ ID NO: 330868 - RNA, 64 nt, Homo Sapiens; identical to SEQ ID NO: 41330

SEQ ID NO: 330869 - RNA, 64 nt, Homo Sapiens; identical to SEQ ID NO: 41331

SEQ ID NO: 330870 - RNA, 64 nt, Homo Sapiens; identical to SEQ ID NO: 41332

SEQ ID NO: 330871 - RNA, 64 nt, Homo Sapiens; identical to SEQ ID NO: 41333

SEQ ID NO: 330872 - RNA, 64 nt, Homo Sapiens; identical to SEQ ID NO: 41334

SEQ ID NO: 330873 - RNA, 64 nt, Homo Sapiens; identical to SEQ ID NO: 41335

SEQ ID NO: 330874 - RNA, 64 nt, Homo Sapiens; identical to SEQ ID NO: 41336

SEQ ID NO: 330875 - RNA, 64 nt, Homo Sapiens; identical to SEQ ID NO: 41337

SEQ ID NO: 330876 - RNA, 64 nt, Homo Sapiens; identical to SEQ ID NO: 41338

SEQ ID NO: 330877 - RNA, 64 nt, Homo Sapiens; identical to SEQ ID NO: 41339

SEQ ID NO: 330878 - RNA, 64 nt, Homo Sapiens; identical to SEQ ID NO: 41340

SEQ ID NO: 330879 - RNA, 64 nt, Homo Sapiens; identical to SEQ ID NO: 41341

SEQ ID NO: 330880 - RNA, 64 nt, Homo Sapiens; identical to SEQ ID NO: 41342

SEQ ID NO: 330881 - RNA, 64 nt, Homo Sapiens; identical to SEQ ID NO: 41343

SEQ ID NO: 330882 - RNA, 64 nt, Homo Sapiens; identical to SEQ ID NO: 41344

SEQ ID NO: 330883 - RNA, 64 nt, Homo Sapiens; identical to SEQ ID NO: 41345

SEQ ID NO: 330884 - RNA, 64 nt, Homo Sapiens; identical to SEQ ID NO: 41346

SEQ ID NO: 330885 - RNA, 64 nt, Homo Sapiens; identical to SEQ ID NO: 41347

SEQ ID NO: 330886 - RNA, 64 nt, Homo Sapiens; identical to SEQ ID NO: 41348

SEQ ID NO: 330887 - RNA, 64 nt, Homo Sapiens; identical to SEQ ID NO: 41349

SEQ ID NO: 330888 - RNA, 64 nt, Homo Sapiens; identical to SEQ ID NO: 41350

SEQ ID NO: 330889 - RNA, 64 nt, Homo Sapiens; identical to SEQ ID NO: 41351

SEQ ID NO: 330890 - RNA, 64 nt, Homo Sapiens; identical to SEQ ID NO: 41352

SEQ ID NO: 330891 - RNA, 64 nt, Homo Sapiens; identical to SEQ ID NO: 41353

SEQ ID NO: 330892 - RNA, 64 nt, Homo Sapiens; identical to SEQ ID NO: 41354

SEQ ID NO: 330893 - RNA, 64 nt, Homo Sapiens; identical to SEQ ID NO: 41355

SEQ ID NO: 330894 - RNA, 64 nt, Homo Sapiens; identical to SEQ ID NO: 41356

SEQ ID NO: 330895 - RNA, 64 nt, Homo Sapiens; identical to SEQ ID NO: 41357

SEQ ID NO: 330896 - RNA, 64 nt, Homo Sapiens; identical to SEQ ID NO: 41358

SEQ ID NO: 330897 - RNA, 64 nt, Homo Sapiens; identical to SEQ ID NO: 41359

SEQ ID NO: 330898 - RNA, 64 nt, Homo Sapiens; identical to SEQ ID NO: 41360

SEQ ID NO: 330899 - RNA, 64 nt, Homo Sapiens; identical to SEQ ID NO: 41361

SEQ ID NO: 330900 - RNA, 64 nt, Homo Sapiens; identical to SEQ ID NO: 41362

SEQ ID NO: 330901 - RNA, 64 nt, Homo Sapiens; identical to SEQ ID NO: 41363

SEQ ID NO: 330902 - RNA, 64 nt, Homo Sapiens; identical to SEQ ID NO: 41364

SEQ ID NO: 330903 - RNA, 64 nt, Homo Sapiens; identical to SEQ ID NO: 41365

SEQ ID NO: 330904 - RNA, 64 nt, Homo Sapiens; identical to SEQ ID NO: 41366

SEQ ID NO: 330905 - RNA, 64 nt, Homo Sapiens; identical to SEQ ID NO: 41367

SEQ ID NO: 330906 - RNA, 64 nt, Homo Sapiens; identical to SEQ ID NO: 41368

SEQ ID NO: 330907 - RNA, 64 nt, Homo Sapiens; identical to SEQ ID NO: 41369

SEQ ID NO: 330908 - RNA, 64 nt, Homo Sapiens; identical to SEQ ID NO: 41370

SEQ ID NO: 330909 - RNA, 64 nt, Homo Sapiens; identical to SEQ ID NO: 41371

SEQ ID NO: 330910 - RNA, 64 nt, Homo Sapiens; identical to SEQ ID NO: 41372

SEQ ID NO: 330911 - RNA, 64 nt, Homo Sapiens; identical to SEQ ID NO: 41373

SEQ ID NO: 330912 - RNA, 64 nt, Homo Sapiens; identical to SEQ ID NO: 41374

SEQ ID NO: 330913 - RNA, 64 nt, Homo Sapiens; identical to SEQ ID NO: 41375

SEQ ID NO: 330914 - RNA, 64 nt, Homo Sapiens; identical to SEQ ID NO: 41376

SEQ ID NO: 330915 - RNA, 64 nt, Homo Sapiens; identical to SEQ ID NO: 41377

SEQ ID NO: 330916 - RNA, 64 nt, Homo Sapiens; identical to SEQ ID NO: 41378

SEQ ID NO: 330917 - RNA, 64 nt, Homo Sapiens; identical to SEQ ID NO: 41379

SEQ ID NO: 330918 - RNA, 64 nt, Homo Sapiens; identical to SEQ ID NO: 41380

SEQ ID NO: 330919 - RNA, 64 nt, Homo Sapiens; identical to SEQ ID NO: 41381

SEQ ID NO: 330920 - RNA, 64 nt, Homo Sapiens; identical to SEQ ID NO: 41382

SEQ ID NO: 330921 - RNA, 64 nt, Homo Sapiens; identical to SEQ ID NO: 41383

SEQ ID NO: 330922 - RNA, 64 nt, Homo Sapiens; identical to SEQ ID NO: 41384

SEQ ID NO: 330923 - RNA, 64 nt, Homo Sapiens; identical to SEQ ID NO: 41385

SEQ ID NO: 330924 - RNA, 64 nt, Homo Sapiens; identical to SEQ ID NO: 41386

SEQ ID NO: 330925 - RNA, 64 nt, Homo Sapiens; identical to SEQ ID NO: 41387

SEQ ID NO: 330926 - RNA, 64 nt, Homo Sapiens; identical to SEQ ID NO: 41388

SEQ ID NO: 330927 - RNA, 64 nt, Homo Sapiens; identical to SEQ ID NO: 41389

SEQ ID NO: 330928 - RNA, 64 nt, Homo Sapiens; identical to SEQ ID NO: 41390

SEQ ID NO: 330929 - RNA, 64 nt, Homo Sapiens; identical to SEQ ID NO: 41391

SEQ ID NO: 330930 - RNA, 64 nt, Homo Sapiens; identical to SEQ ID NO: 41392

SEQ ID NO: 330931 - RNA, 64 nt, Homo Sapiens; identical to SEQ ID NO: 41393

SEQ ID NO: 330932 - RNA, 64 nt, Homo Sapiens; identical to SEQ ID NO: 41394

SEQ ID NO: 330933 - RNA, 64 nt, Homo Sapiens; identical to SEQ ID NO: 41395

SEQ ID NO: 330934 - RNA, 64 nt, Homo Sapiens; identical to SEQ ID NO: 41396

SEQ ID NO: 330935 - RNA, 64 nt, Homo Sapiens; identical to SEQ ID NO: 41397

SEQ ID NO: 330936 - RNA, 64 nt, Homo Sapiens; identical to SEQ ID NO: 41398

SEQ ID NO: 330937 - RNA, 64 nt, Homo Sapiens; identical to SEQ ID NO: 41399

SEQ ID NO: 330938 - RNA, 64 nt, Homo Sapiens; identical to SEQ ID NO: 41400

SEQ ID NO: 330939 - RNA, 64 nt, Homo Sapiens; identical to SEQ ID NO: 41401

SEQ ID NO: 330940 - RNA, 64 nt, Homo Sapiens; identical to SEQ ID NO: 41402

SEQ ID NO: 330941 - RNA, 64 nt, Homo Sapiens; identical to SEQ ID NO: 41403

SEQ ID NO: 330942 - RNA, 64 nt, Homo Sapiens; identical to SEQ ID NO: 41404

SEQ ID NO: 330943 - RNA, 64 nt, Homo Sapiens; identical to SEQ ID NO: 41405

SEQ ID NO: 330944 - RNA, 64 nt, Homo Sapiens; identical to SEQ ID NO: 41406

SEQ ID NO: 330945 - RNA, 64 nt, Homo Sapiens; identical to SEQ ID NO: 41407

SEQ ID NO: 330946 - RNA, 64 nt, Homo Sapiens; identical to SEQ ID NO: 41408

SEQ ID NO: 330947 - RNA, 64 nt, Homo Sapiens; identical to SEQ ID NO: 41409

SEQ ID NO: 330948 - RNA, 64 nt, Homo Sapiens; identical to SEQ ID NO: 41410

SEQ ID NO: 330949 - RNA, 64 nt, Homo Sapiens; identical to SEQ ID NO: 41411

SEQ ID NO: 330950 - RNA, 64 nt, Homo Sapiens; identical to SEQ ID NO: 41412

SEQ ID NO: 330951 - RNA, 64 nt, Homo Sapiens; identical to SEQ ID NO: 41413

SEQ ID NO: 330952 - RNA, 64 nt, Homo Sapiens; identical to SEQ ID NO: 41414

SEQ ID NO: 330953 - RNA, 64 nt, Homo Sapiens; identical to SEQ ID NO: 41415

SEQ ID NO: 330954 - RNA, 64 nt, Homo Sapiens; identical to SEQ ID NO: 41416

SEQ ID NO: 330955 - RNA, 64 nt, Homo Sapiens; identical to SEQ ID NO: 41417

SEQ ID NO: 330956 - RNA, 64 nt, Homo Sapiens; identical to SEQ ID NO: 41418

SEQ ID NO: 330957 - RNA, 64 nt, Homo Sapiens; identical to SEQ ID NO: 41419

SEQ ID NO: 330958 - RNA, 64 nt, Homo Sapiens; identical to SEQ ID NO: 41420

SEQ ID NO: 330959 - RNA, 64 nt, Homo Sapiens; identical to SEQ ID NO: 41421

SEQ ID NO: 330960 - RNA, 64 nt, Homo Sapiens; identical to SEQ ID NO: 41422

SEQ ID NO: 330961 - RNA, 64 nt, Homo Sapiens; identical to SEQ ID NO: 41423

SEQ ID NO: 330962 - RNA, 64 nt, Homo Sapiens; identical to SEQ ID NO: 41424

SEQ ID NO: 330963 - RNA, 64 nt, Homo Sapiens; identical to SEQ ID NO: 41425

SEQ ID NO: 330964 - RNA, 64 nt, Homo Sapiens; identical to SEQ ID NO: 41426

SEQ ID NO: 330965 - RNA, 64 nt, Homo Sapiens; identical to SEQ ID NO: 41427

SEQ ID NO: 330966 - RNA, 64 nt, Homo Sapiens; identical to SEQ ID NO: 41428

SEQ ID NO: 330967 - RNA, 64 nt, Homo Sapiens; identical to SEQ ID NO: 41429

SEQ ID NO: 330968 - RNA, 64 nt, Homo Sapiens; identical to SEQ ID NO: 41430

SEQ ID NO: 330969 - RNA, 64 nt, Homo Sapiens; identical to SEQ ID NO: 41431

SEQ ID NO: 330970 - RNA, 64 nt, Homo Sapiens; identical to SEQ ID NO: 41432

SEQ ID NO: 330971 - RNA, 64 nt, Homo Sapiens; identical to SEQ ID NO: 41433

SEQ ID NO: 330972 - RNA, 64 nt, Homo Sapiens; identical to SEQ ID NO: 41434

SEQ ID NO: 330973 - RNA, 64 nt, Homo Sapiens; identical to SEQ ID NO: 41435

SEQ ID NO: 330974 - RNA, 64 nt, Homo Sapiens; identical to SEQ ID NO: 41436

SEQ ID NO: 330975 - RNA, 64 nt, Homo Sapiens; identical to SEQ ID NO: 41437

SEQ ID NO: 330976 - RNA, 64 nt, Homo Sapiens; identical to SEQ ID NO: 41438

SEQ ID NO: 330977 - RNA, 64 nt, Homo Sapiens; identical to SEQ ID NO: 41439

SEQ ID NO: 330978 - RNA, 64 nt, Homo Sapiens; identical to SEQ ID NO: 41440

SEQ ID NO: 330979 - RNA, 64 nt, Homo Sapiens; identical to SEQ ID NO: 41441

SEQ ID NO: 330980 - RNA, 64 nt, Homo Sapiens; identical to SEQ ID NO: 41442

SEQ ID NO: 330981 - RNA, 64 nt, Homo Sapiens; identical to SEQ ID NO: 41443

SEQ ID NO: 330982 - RNA, 64 nt, Homo Sapiens; identical to SEQ ID NO: 41444

SEQ ID NO: 330983 - RNA, 64 nt, Homo Sapiens; identical to SEQ ID NO: 41445

SEQ ID NO: 330984 - RNA, 64 nt, Homo Sapiens; identical to SEQ ID NO: 41446

SEQ ID NO: 330985 - RNA, 64 nt, Homo Sapiens; identical to SEQ ID NO: 41447

SEQ ID NO: 330986 - RNA, 64 nt, Homo Sapiens; identical to SEQ ID NO: 41448

SEQ ID NO: 330987 - RNA, 64 nt, Homo Sapiens; identical to SEQ ID NO: 41449

SEQ ID NO: 330988 - RNA, 64 nt, Homo Sapiens; identical to SEQ ID NO: 41450

SEQ ID NO: 330989 - RNA, 64 nt, Homo Sapiens; identical to SEQ ID NO: 41451

SEQ ID NO: 330990 - RNA, 64 nt, Homo Sapiens; identical to SEQ ID NO: 41452

SEQ ID NO: 330991 - RNA, 64 nt, Homo Sapiens; identical to SEQ ID NO: 41453

SEQ ID NO: 330992 - RNA, 64 nt, Homo Sapiens; identical to SEQ ID NO: 41454

SEQ ID NO: 330993 - RNA, 64 nt, Homo Sapiens; identical to SEQ ID NO: 41455

SEQ ID NO: 330994 - RNA, 64 nt, Homo Sapiens; identical to SEQ ID NO: 41456

SEQ ID NO: 330995 - RNA, 64 nt, Homo Sapiens; identical to SEQ ID NO: 41457

SEQ ID NO: 330996 - RNA, 64 nt, Homo Sapiens; identical to SEQ ID NO: 41458

SEQ ID NO: 330997 - RNA, 64 nt, Homo Sapiens; identical to SEQ ID NO: 41459

SEQ ID NO: 330998 - RNA, 64 nt, Homo Sapiens; identical to SEQ ID NO: 41460

SEQ ID NO: 330999 - RNA, 64 nt, Homo Sapiens; identical to SEQ ID NO: 41461

SEQ ID NO: 331000 - RNA, 64 nt, Homo Sapiens; identical to SEQ ID NO: 41462

SEQ ID NO: 331001 - RNA, 64 nt, Homo Sapiens; identical to SEQ ID NO: 41463

SEQ ID NO: 331002 - RNA, 64 nt, Homo Sapiens; identical to SEQ ID NO: 41464

SEQ ID NO: 331003 - RNA, 64 nt, Homo Sapiens; identical to SEQ ID NO: 41465

SEQ ID NO: 331004 - RNA, 64 nt, Homo Sapiens; identical to SEQ ID NO: 41466

SEQ ID NO: 331005 - RNA, 64 nt, Homo Sapiens; identical to SEQ ID NO: 41467

SEQ ID NO: 331006 - RNA, 64 nt, Homo Sapiens; identical to SEQ ID NO: 41468

SEQ ID NO: 331007 - RNA, 64 nt, Homo Sapiens; identical to SEQ ID NO: 41469

SEQ ID NO: 331008 - RNA, 64 nt, Homo Sapiens; identical to SEQ ID NO: 41470

SEQ ID NO: 331009 - RNA, 64 nt, Homo Sapiens; identical to SEQ ID NO: 41471

SEQ ID NO: 331010 - RNA, 64 nt, Homo Sapiens; identical to SEQ ID NO: 41472

SEQ ID NO: 331011 - RNA, 64 nt, Homo Sapiens; identical to SEQ ID NO: 41473

SEQ ID NO: 331012 - RNA, 64 nt, Homo Sapiens; identical to SEQ ID NO: 41474

SEQ ID NO: 331013 - RNA, 64 nt, Homo Sapiens; identical to SEQ ID NO: 41475

SEQ ID NO: 331014 - RNA, 64 nt, Homo Sapiens; identical to SEQ ID NO: 41476

SEQ ID NO: 331015 - RNA, 64 nt, Homo Sapiens; identical to SEQ ID NO: 41477

SEQ ID NO: 331016 - RNA, 64 nt, Homo Sapiens; identical to SEQ ID NO: 41478

SEQ ID NO: 331017 - RNA, 64 nt, Homo Sapiens; identical to SEQ ID NO: 41479

SEQ ID NO: 331018 - RNA, 64 nt, Homo Sapiens; identical to SEQ ID NO: 41480

SEQ ID NO: 331019 - RNA, 64 nt, Homo Sapiens; identical to SEQ ID NO: 41481

SEQ ID NO: 331020 - RNA, 64 nt, Homo Sapiens; identical to SEQ ID NO: 41482

SEQ ID NO: 331021 - RNA, 64 nt, Homo Sapiens; identical to SEQ ID NO: 41483

SEQ ID NO: 331022 - RNA, 64 nt, Homo Sapiens; identical to SEQ ID NO: 41484

SEQ ID NO: 331023 - RNA, 64 nt, Homo Sapiens; identical to SEQ ID NO: 41485

SEQ ID NO: 331024 - RNA, 64 nt, Homo Sapiens; identical to SEQ ID NO: 41486

SEQ ID NO: 331025 - RNA, 64 nt, Homo Sapiens; identical to SEQ ID NO: 41487

SEQ ID NO: 331026 - RNA, 64 nt, Homo Sapiens; identical to SEQ ID NO: 41488

SEQ ID NO: 331027 - RNA, 64 nt, Homo Sapiens; identical to SEQ ID NO: 41489

SEQ ID NO: 331028 - RNA, 64 nt, Homo Sapiens; identical to SEQ ID NO: 41490

SEQ ID NO: 331029 - RNA, 64 nt, Homo Sapiens; identical to SEQ ID NO: 41491

SEQ ID NO: 331030 - RNA, 64 nt, Homo Sapiens; identical to SEQ ID NO: 41492

SEQ ID NO: 331031 - RNA, 64 nt, Homo Sapiens; identical to SEQ ID NO: 41493

SEQ ID NO: 331032 - RNA, 64 nt, Homo Sapiens; identical to SEQ ID NO: 41494

SEQ ID NO: 331033 - RNA, 64 nt, Homo Sapiens; identical to SEQ ID NO: 41495

SEQ ID NO: 331034 - RNA, 64 nt, Homo Sapiens; identical to SEQ ID NO: 41496

SEQ ID NO: 331035 - RNA, 64 nt, Homo Sapiens; identical to SEQ ID NO: 41497

SEQ ID NO: 331036 - RNA, 64 nt, Homo Sapiens; identical to SEQ ID NO: 41498

SEQ ID NO: 331037 - RNA, 64 nt, Homo Sapiens; identical to SEQ ID NO: 41499

SEQ ID NO: 331038 - RNA, 64 nt, Homo Sapiens; identical to SEQ ID NO: 41500

SEQ ID NO: 331039 - RNA, 64 nt, Homo Sapiens; identical to SEQ ID NO: 41501

SEQ ID NO: 331040 - RNA, 64 nt, Homo Sapiens; identical to SEQ ID NO: 41502

SEQ ID NO: 331041 - RNA, 64 nt, Homo Sapiens; identical to SEQ ID NO: 41503

SEQ ID NO: 331042 - RNA, 64 nt, Homo Sapiens; identical to SEQ ID NO: 41504

SEQ ID NO: 331043 - RNA, 64 nt, Homo Sapiens; identical to SEQ ID NO: 41505

SEQ ID NO: 331044 - RNA, 64 nt, Homo Sapiens; identical to SEQ ID NO: 41506

SEQ ID NO: 331045 - RNA, 64 nt, Homo Sapiens; identical to SEQ ID NO: 41507

SEQ ID NO: 331046 - RNA, 64 nt, Homo Sapiens; identical to SEQ ID NO: 41508

SEQ ID NO: 331047 - RNA, 64 nt, Homo Sapiens; identical to SEQ ID NO: 41509

SEQ ID NO: 331048 - RNA, 64 nt, Homo Sapiens; identical to SEQ ID NO: 41510

SEQ ID NO: 331049 - RNA, 64 nt, Homo Sapiens; identical to SEQ ID NO: 41511

SEQ ID NO: 331050 - RNA, 64 nt, Homo Sapiens; identical to SEQ ID NO: 41512

SEQ ID NO: 331051 - RNA, 64 nt, Homo Sapiens; identical to SEQ ID NO: 41513

SEQ ID NO: 331052 - RNA, 64 nt, Homo Sapiens; identical to SEQ ID NO: 41514

SEQ ID NO: 331053 - RNA, 64 nt, Homo Sapiens; identical to SEQ ID NO: 41515

SEQ ID NO: 331054 - RNA, 64 nt, Homo Sapiens; identical to SEQ ID NO: 41516

SEQ ID NO: 331055 - RNA, 64 nt, Homo Sapiens; identical to SEQ ID NO: 41517

SEQ ID NO: 331056 - RNA, 64 nt, Homo Sapiens; identical to SEQ ID NO: 41518

SEQ ID NO: 331057 - RNA, 64 nt, Homo Sapiens; identical to SEQ ID NO: 41519

SEQ ID NO: 331058 - RNA, 64 nt, Homo Sapiens; identical to SEQ ID NO: 41520

SEQ ID NO: 331059 - RNA, 64 nt, Homo Sapiens; identical to SEQ ID NO: 41521

SEQ ID NO: 331060 - RNA, 64 nt, Homo Sapiens; identical to SEQ ID NO: 41522

SEQ ID NO: 331061 - RNA, 64 nt, Homo Sapiens; identical to SEQ ID NO: 41523

SEQ ID NO: 331062 - RNA, 64 nt, Homo Sapiens; identical to SEQ ID NO: 41524

SEQ ID NO: 331063 - RNA, 64 nt, Homo Sapiens; identical to SEQ ID NO: 41525

SEQ ID NO: 331064 - RNA, 64 nt, Homo Sapiens; identical to SEQ ID NO: 41526

SEQ ID NO: 331065 - RNA, 64 nt, Homo Sapiens; identical to SEQ ID NO: 41527

SEQ ID NO: 331066 - RNA, 64 nt, Homo Sapiens; identical to SEQ ID NO: 41528

SEQ ID NO: 331067 - RNA, 64 nt, Homo Sapiens; identical to SEQ ID NO: 41529

SEQ ID NO: 331068 - RNA, 64 nt, Homo Sapiens; identical to SEQ ID NO: 41530

SEQ ID NO: 331069 - RNA, 64 nt, Homo Sapiens; identical to SEQ ID NO: 41531

SEQ ID NO: 331070 - RNA, 64 nt, Homo Sapiens; identical to SEQ ID NO: 41532

SEQ ID NO: 331071 - RNA, 64 nt, Homo Sapiens; identical to SEQ ID NO: 41533

SEQ ID NO: 331072 - RNA, 64 nt, Homo Sapiens; identical to SEQ ID NO: 41534

SEQ ID NO: 331073 - RNA, 64 nt, Homo Sapiens; identical to SEQ ID NO: 41535

SEQ ID NO: 331074 - RNA, 64 nt, Homo Sapiens; identical to SEQ ID NO: 41536

SEQ ID NO: 331075 - RNA, 64 nt, Homo Sapiens; identical to SEQ ID NO: 41537

SEQ ID NO: 331076 - RNA, 64 nt, Homo Sapiens; identical to SEQ ID NO: 41538

SEQ ID NO: 331077 - RNA, 64 nt, Homo Sapiens; identical to SEQ ID NO: 41539

SEQ ID NO: 331078 - RNA, 64 nt, Homo Sapiens; identical to SEQ ID NO: 41540

SEQ ID NO: 331079 - RNA, 64 nt, Homo Sapiens; identical to SEQ ID NO: 41541

SEQ ID NO: 331080 - RNA, 64 nt, Homo Sapiens; identical to SEQ ID NO: 41542

SEQ ID NO: 331081 - RNA, 64 nt, Homo Sapiens; identical to SEQ ID NO: 41543

SEQ ID NO: 331082 - RNA, 64 nt, Homo Sapiens; identical to SEQ ID NO: 41544

SEQ ID NO: 331083 - RNA, 64 nt, Homo Sapiens; identical to SEQ ID NO: 41545

SEQ ID NO: 331084 - RNA, 64 nt, Homo Sapiens; identical to SEQ ID NO: 41546

SEQ ID NO: 331085 - RNA, 64 nt, Homo Sapiens; identical to SEQ ID NO: 41547

SEQ ID NO: 331086 - RNA, 64 nt, Homo Sapiens; identical to SEQ ID NO: 41548

SEQ ID NO: 331087 - RNA, 64 nt, Homo Sapiens; identical to SEQ ID NO: 41549

SEQ ID NO: 331088 - RNA, 64 nt, Homo Sapiens; identical to SEQ ID NO: 41550

SEQ ID NO: 331089 - RNA, 64 nt, Homo Sapiens; identical to SEQ ID NO: 41551

SEQ ID NO: 331090 - RNA, 64 nt, Homo Sapiens; identical to SEQ ID NO: 41552

SEQ ID NO: 331091 - RNA, 64 nt, Homo Sapiens; identical to SEQ ID NO: 41553

SEQ ID NO: 331092 - RNA, 64 nt, Homo Sapiens; identical to SEQ ID NO: 41554

SEQ ID NO: 331093 - RNA, 64 nt, Homo Sapiens; identical to SEQ ID NO: 41555

SEQ ID NO: 331094 - RNA, 64 nt, Homo Sapiens; identical to SEQ ID NO: 41556

SEQ ID NO: 331095 - RNA, 64 nt, Homo Sapiens; identical to SEQ ID NO: 41557

SEQ ID NO: 331096 - RNA, 64 nt, Homo Sapiens; identical to SEQ ID NO: 41558

SEQ ID NO: 331097 - RNA, 64 nt, Homo Sapiens; identical to SEQ ID NO: 41559

SEQ ID NO: 331098 - RNA, 64 nt, Homo Sapiens; identical to SEQ ID NO: 41560

SEQ ID NO: 331099 - RNA, 64 nt, Homo Sapiens; identical to SEQ ID NO: 41561

SEQ ID NO: 331100 - RNA, 64 nt, Homo Sapiens; identical to SEQ ID NO: 41562

SEQ ID NO: 331101 - RNA, 64 nt, Homo Sapiens; identical to SEQ ID NO: 41563

SEQ ID NO: 331102 - RNA, 64 nt, Homo Sapiens; identical to SEQ ID NO: 41564

SEQ ID NO: 331103 - RNA, 64 nt, Homo Sapiens; identical to SEQ ID NO: 41565

SEQ ID NO: 331104 - RNA, 64 nt, Homo Sapiens; identical to SEQ ID NO: 41566

SEQ ID NO: 331105 - RNA, 64 nt, Homo Sapiens; identical to SEQ ID NO: 41567

SEQ ID NO: 331106 - RNA, 64 nt, Homo Sapiens; identical to SEQ ID NO: 41568

SEQ ID NO: 331107 - RNA, 64 nt, Homo Sapiens; identical to SEQ ID NO: 41569

SEQ ID NO: 331108 - RNA, 64 nt, Homo Sapiens; identical to SEQ ID NO: 41570

SEQ ID NO: 331109 - RNA, 64 nt, Homo Sapiens; identical to SEQ ID NO: 41571

SEQ ID NO: 331110 - RNA, 64 nt, Homo Sapiens; identical to SEQ ID NO: 41572

SEQ ID NO: 331111 - RNA, 64 nt, Homo Sapiens; identical to SEQ ID NO: 41573

SEQ ID NO: 331112 - RNA, 64 nt, Homo Sapiens; identical to SEQ ID NO: 41574

SEQ ID NO: 331113 - RNA, 64 nt, Homo Sapiens; identical to SEQ ID NO: 41575

SEQ ID NO: 331114 - RNA, 64 nt, Homo Sapiens; identical to SEQ ID NO: 41576

SEQ ID NO: 331115 - RNA, 64 nt, Homo Sapiens; identical to SEQ ID NO: 41577

SEQ ID NO: 331116 - RNA, 64 nt, Homo Sapiens; identical to SEQ ID NO: 41578

SEQ ID NO: 331117 - RNA, 64 nt, Homo Sapiens; identical to SEQ ID NO: 41579

SEQ ID NO: 331118 - RNA, 64 nt, Homo Sapiens; identical to SEQ ID NO: 41580

SEQ ID NO: 331119 - RNA, 64 nt, Homo Sapiens; identical to SEQ ID NO: 41581

SEQ ID NO: 331120 - RNA, 64 nt, Homo Sapiens; identical to SEQ ID NO: 41582

SEQ ID NO: 331121 - RNA, 64 nt, Homo Sapiens; identical to SEQ ID NO: 41583

SEQ ID NO: 331122 - RNA, 64 nt, Homo Sapiens; identical to SEQ ID NO: 41584

SEQ ID NO: 331123 - RNA, 64 nt, Homo Sapiens; identical to SEQ ID NO: 41585

SEQ ID NO: 331124 - RNA, 64 nt, Homo Sapiens; identical to SEQ ID NO: 41586

SEQ ID NO: 331125 - RNA, 64 nt, Homo Sapiens; identical to SEQ ID NO: 41587

SEQ ID NO: 331126 - RNA, 64 nt, Homo Sapiens; identical to SEQ ID NO: 41588

SEQ ID NO: 331127 - RNA, 64 nt, Homo Sapiens; identical to SEQ ID NO: 41589

SEQ ID NO: 331128 - RNA, 64 nt, Homo Sapiens; identical to SEQ ID NO: 41590

SEQ ID NO: 331129 - RNA, 64 nt, Homo Sapiens; identical to SEQ ID NO: 41591

SEQ ID NO: 331130 - RNA, 64 nt, Homo Sapiens; identical to SEQ ID NO: 41592

SEQ ID NO: 331131 - RNA, 64 nt, Homo Sapiens; identical to SEQ ID NO: 41593

SEQ ID NO: 331132 - RNA, 64 nt, Homo Sapiens; identical to SEQ ID NO: 41594

SEQ ID NO: 331133 - RNA, 64 nt, Homo Sapiens; identical to SEQ ID NO: 41595

SEQ ID NO: 331134 - RNA, 64 nt, Homo Sapiens; identical to SEQ ID NO: 41596

SEQ ID NO: 331135 - RNA, 64 nt, Homo Sapiens; identical to SEQ ID NO: 41597

SEQ ID NO: 331136 - RNA, 64 nt, Homo Sapiens; identical to SEQ ID NO: 41598

SEQ ID NO: 331137 - RNA, 64 nt, Homo Sapiens; identical to SEQ ID NO: 41599

SEQ ID NO: 331138 - RNA, 64 nt, Homo Sapiens; identical to SEQ ID NO: 41600

SEQ ID NO: 331139 - RNA, 64 nt, Homo Sapiens; identical to SEQ ID NO: 41601

SEQ ID NO: 331140 - RNA, 64 nt, Homo Sapiens; identical to SEQ ID NO: 41602

SEQ ID NO: 331141 - RNA, 64 nt, Homo Sapiens; identical to SEQ ID NO: 41603

SEQ ID NO: 331142 - RNA, 64 nt, Homo Sapiens; identical to SEQ ID NO: 41604

SEQ ID NO: 331143 - RNA, 64 nt, Homo Sapiens; identical to SEQ ID NO: 41605

SEQ ID NO: 331144 - RNA, 64 nt, Homo Sapiens; identical to SEQ ID NO: 41606

SEQ ID NO: 331145 - RNA, 64 nt, Homo Sapiens; identical to SEQ ID NO: 41607

SEQ ID NO: 331146 - RNA, 64 nt, Homo Sapiens; identical to SEQ ID NO: 41608

SEQ ID NO: 331147 - RNA, 64 nt, Homo Sapiens; identical to SEQ ID NO: 41609

SEQ ID NO: 331148 - RNA, 64 nt, Homo Sapiens; identical to SEQ ID NO: 41610

SEQ ID NO: 331149 - RNA, 64 nt, Homo Sapiens; identical to SEQ ID NO: 41611

SEQ ID NO: 331150 - RNA, 64 nt, Homo Sapiens; identical to SEQ ID NO: 41612

SEQ ID NO: 331151 - RNA, 64 nt, Homo Sapiens; identical to SEQ ID NO: 41613

SEQ ID NO: 331152 - RNA, 64 nt, Homo Sapiens; identical to SEQ ID NO: 41614

SEQ ID NO: 331153 - RNA, 64 nt, Homo Sapiens; identical to SEQ ID NO: 41615

SEQ ID NO: 331154 - RNA, 64 nt, Homo Sapiens; identical to SEQ ID NO: 41616

SEQ ID NO: 331155 - RNA, 64 nt, Homo Sapiens; identical to SEQ ID NO: 41617

SEQ ID NO: 331156 - RNA, 64 nt, Homo Sapiens; identical to SEQ ID NO: 41618

SEQ ID NO: 331157 - RNA, 64 nt, Homo Sapiens; identical to SEQ ID NO: 41619

SEQ ID NO: 331158 - RNA, 64 nt, Homo Sapiens; identical to SEQ ID NO: 41620

SEQ ID NO: 331159 - RNA, 64 nt, Homo Sapiens; identical to SEQ ID NO: 41621

SEQ ID NO: 331160 - RNA, 63 nt, Homo Sapiens; identical to SEQ ID NO: 41622

SEQ ID NO: 331161 - RNA, 64 nt, Homo Sapiens; identical to SEQ ID NO: 41623

SEQ ID NO: 331162 - RNA, 64 nt, Homo Sapiens; identical to SEQ ID NO: 41624

SEQ ID NO: 331163 - RNA, 64 nt, Homo Sapiens; identical to SEQ ID NO: 41625

SEQ ID NO: 331164 - RNA, 64 nt, Homo Sapiens; identical to SEQ ID NO: 41626

SEQ ID NO: 331165 - RNA, 64 nt, Homo Sapiens; identical to SEQ ID NO: 41627

SEQ ID NO: 331166 - RNA, 64 nt, Homo Sapiens; identical to SEQ ID NO: 41628

SEQ ID NO: 331167 - RNA, 64 nt, Homo Sapiens; identical to SEQ ID NO: 41629

SEQ ID NO: 331168 - RNA, 64 nt, Homo Sapiens; identical to SEQ ID NO: 41630

SEQ ID NO: 331169 - RNA, 64 nt, Homo Sapiens; identical to SEQ ID NO: 41631

SEQ ID NO: 331170 - RNA, 64 nt, Homo Sapiens; identical to SEQ ID NO: 41632

SEQ ID NO: 331171 - RNA, 64 nt, Homo Sapiens; identical to SEQ ID NO: 41633

SEQ ID NO: 331172 - RNA, 64 nt, Homo Sapiens; identical to SEQ ID NO: 41634

SEQ ID NO: 331173 - RNA, 64 nt, Homo Sapiens; identical to SEQ ID NO: 41635

SEQ ID NO: 331174 - RNA, 64 nt, Homo Sapiens; identical to SEQ ID NO: 41636

SEQ ID NO: 331175 - RNA, 64 nt, Homo Sapiens; identical to SEQ ID NO: 41637

SEQ ID NO: 331176 - RNA, 64 nt, Homo Sapiens; identical to SEQ ID NO: 41638

SEQ ID NO: 331177 - RNA, 64 nt, Homo Sapiens; identical to SEQ ID NO: 41639

SEQ ID NO: 331178 - RNA, 64 nt, Homo Sapiens; identical to SEQ ID NO: 41640

SEQ ID NO: 331179 - RNA, 64 nt, Homo Sapiens; identical to SEQ ID NO: 41641

SEQ ID NO: 331180 - RNA, 64 nt, Homo Sapiens; identical to SEQ ID NO: 41642

SEQ ID NO: 331181 - RNA, 64 nt, Homo Sapiens; identical to SEQ ID NO: 41643

SEQ ID NO: 331182 - RNA, 64 nt, Homo Sapiens; identical to SEQ ID NO: 41644

SEQ ID NO: 331183 - RNA, 64 nt, Homo Sapiens; identical to SEQ ID NO: 41645

SEQ ID NO: 331184 - RNA, 64 nt, Homo Sapiens; identical to SEQ ID NO: 41646

SEQ ID NO: 331185 - RNA, 64 nt, Homo Sapiens; identical to SEQ ID NO: 41647

SEQ ID NO: 331186 - RNA, 64 nt, Homo Sapiens; identical to SEQ ID NO: 41648

SEQ ID NO: 331187 - RNA, 64 nt, Homo Sapiens; identical to SEQ ID NO: 41649

SEQ ID NO: 331188 - RNA, 64 nt, Homo Sapiens; identical to SEQ ID NO: 41650

SEQ ID NO: 331189 - RNA, 64 nt, Homo Sapiens; identical to SEQ ID NO: 41651

SEQ ID NO: 331190 - RNA, 64 nt, Homo Sapiens; identical to SEQ ID NO: 41652

SEQ ID NO: 331191 - RNA, 64 nt, Homo Sapiens; identical to SEQ ID NO: 41653

SEQ ID NO: 331192 - RNA, 64 nt, Homo Sapiens; identical to SEQ ID NO: 41654

SEQ ID NO: 331193 - RNA, 64 nt, Homo Sapiens; identical to SEQ ID NO: 41655

SEQ ID NO: 331194 - RNA, 64 nt, Homo Sapiens; identical to SEQ ID NO: 41656

SEQ ID NO: 331195 - RNA, 64 nt, Homo Sapiens; identical to SEQ ID NO: 41657

SEQ ID NO: 331196 - RNA, 64 nt, Homo Sapiens; identical to SEQ ID NO: 41658

SEQ ID NO: 331197 - RNA, 64 nt, Homo Sapiens; identical to SEQ ID NO: 41659

SEQ ID NO: 331198 - RNA, 64 nt, Homo Sapiens; identical to SEQ ID NO: 41660

SEQ ID NO: 331199 - RNA, 64 nt, Homo Sapiens; identical to SEQ ID NO: 41661

SEQ ID NO: 331200 - RNA, 64 nt, Homo Sapiens; identical to SEQ ID NO: 41662

SEQ ID NO: 331201 - RNA, 64 nt, Homo Sapiens; identical to SEQ ID NO: 41663

SEQ ID NO: 331202 - RNA, 64 nt, Homo Sapiens; identical to SEQ ID NO: 41664

SEQ ID NO: 331203 - RNA, 64 nt, Homo Sapiens; identical to SEQ ID NO: 41665

SEQ ID NO: 331204 - RNA, 64 nt, Homo Sapiens; identical to SEQ ID NO: 41666

SEQ ID NO: 331205 - RNA, 64 nt, Homo Sapiens; identical to SEQ ID NO: 41667

SEQ ID NO: 331206 - RNA, 64 nt, Homo Sapiens; identical to SEQ ID NO: 41668

SEQ ID NO: 331207 - RNA, 64 nt, Homo Sapiens; identical to SEQ ID NO: 41669

SEQ ID NO: 331208 - RNA, 64 nt, Homo Sapiens; identical to SEQ ID NO: 41670

SEQ ID NO: 331209 - RNA, 64 nt, Homo Sapiens; identical to SEQ ID NO: 41671

SEQ ID NO: 331210 - RNA, 64 nt, Homo Sapiens; identical to SEQ ID NO: 41672

SEQ ID NO: 331211 - RNA, 64 nt, Homo Sapiens; identical to SEQ ID NO: 41673

SEQ ID NO: 331212 - RNA, 64 nt, Homo Sapiens; identical to SEQ ID NO: 41674

SEQ ID NO: 331213 - RNA, 64 nt, Homo Sapiens; identical to SEQ ID NO: 41675

SEQ ID NO: 331214 - RNA, 64 nt, Homo Sapiens; identical to SEQ ID NO: 41676

SEQ ID NO: 331215 - RNA, 64 nt, Homo Sapiens; identical to SEQ ID NO: 41677

SEQ ID NO: 331216 - RNA, 64 nt, Homo Sapiens; identical to SEQ ID NO: 41678

SEQ ID NO: 331217 - RNA, 64 nt, Homo Sapiens; identical to SEQ ID NO: 41679

SEQ ID NO: 331218 - RNA, 64 nt, Homo Sapiens; identical to SEQ ID NO: 41680

SEQ ID NO: 331219 - RNA, 64 nt, Homo Sapiens; identical to SEQ ID NO: 41681

SEQ ID NO: 331220 - RNA, 64 nt, Homo Sapiens; identical to SEQ ID NO: 41682

SEQ ID NO: 331221 - RNA, 64 nt, Homo Sapiens; identical to SEQ ID NO: 41683

SEQ ID NO: 331222 - RNA, 64 nt, Homo Sapiens; identical to SEQ ID NO: 41684

SEQ ID NO: 331223 - RNA, 64 nt, Homo Sapiens; identical to SEQ ID NO: 41685

SEQ ID NO: 331224 - RNA, 64 nt, Homo Sapiens; identical to SEQ ID NO: 41686

SEQ ID NO: 331225 - RNA, 64 nt, Homo Sapiens; identical to SEQ ID NO: 41687

SEQ ID NO: 331226 - RNA, 64 nt, Homo Sapiens; identical to SEQ ID NO: 41688

SEQ ID NO: 331227 - RNA, 64 nt, Homo Sapiens; identical to SEQ ID NO: 41689

SEQ ID NO: 331228 - RNA, 64 nt, Homo Sapiens; identical to SEQ ID NO: 41690

SEQ ID NO: 331229 - RNA, 64 nt, Homo Sapiens; identical to SEQ ID NO: 41691

SEQ ID NO: 331230 - RNA, 64 nt, Homo Sapiens; identical to SEQ ID NO: 41692

SEQ ID NO: 331231 - RNA, 64 nt, Homo Sapiens; identical to SEQ ID NO: 41693

SEQ ID NO: 331232 - RNA, 64 nt, Homo Sapiens; identical to SEQ ID NO: 41694

SEQ ID NO: 331233 - RNA, 64 nt, Homo Sapiens; identical to SEQ ID NO: 41695

SEQ ID NO: 331234 - RNA, 64 nt, Homo Sapiens; identical to SEQ ID NO: 41696

SEQ ID NO: 331235 - RNA, 64 nt, Homo Sapiens; identical to SEQ ID NO: 41697

SEQ ID NO: 331236 - RNA, 64 nt, Homo Sapiens; identical to SEQ ID NO: 41698

SEQ ID NO: 331237 - RNA, 64 nt, Homo Sapiens; identical to SEQ ID NO: 41699

SEQ ID NO: 331238 - RNA, 64 nt, Homo Sapiens; identical to SEQ ID NO: 41700

SEQ ID NO: 331239 - RNA, 64 nt, Homo Sapiens; identical to SEQ ID NO: 41701

SEQ ID NO: 331240 - RNA, 64 nt, Homo Sapiens; identical to SEQ ID NO: 41702

SEQ ID NO: 331241 - RNA, 64 nt, Homo Sapiens; identical to SEQ ID NO: 41703

SEQ ID NO: 331242 - RNA, 64 nt, Homo Sapiens; identical to SEQ ID NO: 41704

SEQ ID NO: 331243 - RNA, 64 nt, Homo Sapiens; identical to SEQ ID NO: 41705

SEQ ID NO: 331244 - RNA, 64 nt, Homo Sapiens; identical to SEQ ID NO: 41706

SEQ ID NO: 331245 - RNA, 64 nt, Homo Sapiens; identical to SEQ ID NO: 41707

SEQ ID NO: 331246 - RNA, 64 nt, Homo Sapiens; identical to SEQ ID NO: 41708

SEQ ID NO: 331247 - RNA, 64 nt, Homo Sapiens; identical to SEQ ID NO: 41709

SEQ ID NO: 331248 - RNA, 64 nt, Homo Sapiens; identical to SEQ ID NO: 41710

SEQ ID NO: 331249 - RNA, 64 nt, Homo Sapiens; identical to SEQ ID NO: 41711

SEQ ID NO: 331250 - RNA, 64 nt, Homo Sapiens; identical to SEQ ID NO: 41712

SEQ ID NO: 331251 - RNA, 64 nt, Homo Sapiens; identical to SEQ ID NO: 41713

SEQ ID NO: 331252 - RNA, 64 nt, Homo Sapiens; identical to SEQ ID NO: 41714

SEQ ID NO: 331253 - RNA, 64 nt, Homo Sapiens; identical to SEQ ID NO: 41715

SEQ ID NO: 331254 - RNA, 64 nt, Homo Sapiens; identical to SEQ ID NO: 41716

SEQ ID NO: 331255 - RNA, 64 nt, Homo Sapiens; identical to SEQ ID NO: 41717

SEQ ID NO: 331256 - RNA, 64 nt, Homo Sapiens; identical to SEQ ID NO: 41718

SEQ ID NO: 331257 - RNA, 64 nt, Homo Sapiens; identical to SEQ ID NO: 41719

SEQ ID NO: 331258 - RNA, 64 nt, Homo Sapiens; identical to SEQ ID NO: 41720

SEQ ID NO: 331259 - RNA, 64 nt, Homo Sapiens; identical to SEQ ID NO: 41721

SEQ ID NO: 331260 - RNA, 64 nt, Homo Sapiens; identical to SEQ ID NO: 41722

SEQ ID NO: 331261 - RNA, 64 nt, Homo Sapiens; identical to SEQ ID NO: 41723

SEQ ID NO: 331262 - RNA, 64 nt, Homo Sapiens; identical to SEQ ID NO: 41724

SEQ ID NO: 331263 - RNA, 64 nt, Homo Sapiens; identical to SEQ ID NO: 41725

SEQ ID NO: 331264 - RNA, 64 nt, Homo Sapiens; identical to SEQ ID NO: 41726

SEQ ID NO: 331265 - RNA, 64 nt, Homo Sapiens; identical to SEQ ID NO: 41727

SEQ ID NO: 331266 - RNA, 64 nt, Homo Sapiens; identical to SEQ ID NO: 41728

SEQ ID NO: 331267 - RNA, 64 nt, Homo Sapiens; identical to SEQ ID NO: 41729

SEQ ID NO: 331268 - RNA, 64 nt, Homo Sapiens; identical to SEQ ID NO: 41730

SEQ ID NO: 331269 - RNA, 64 nt, Homo Sapiens; identical to SEQ ID NO: 41731

SEQ ID NO: 331270 - RNA, 64 nt, Homo Sapiens; identical to SEQ ID NO: 41732

SEQ ID NO: 331271 - RNA, 64 nt, Homo Sapiens; identical to SEQ ID NO: 41733

SEQ ID NO: 331272 - RNA, 64 nt, Homo Sapiens; identical to SEQ ID NO: 41734

SEQ ID NO: 331273 - RNA, 64 nt, Homo Sapiens; identical to SEQ ID NO: 41735

SEQ ID NO: 331274 - RNA, 64 nt, Homo Sapiens; identical to SEQ ID NO: 41736

SEQ ID NO: 331275 - RNA, 64 nt, Homo Sapiens; identical to SEQ ID NO: 41737

SEQ ID NO: 331276 - RNA, 64 nt, Homo Sapiens; identical to SEQ ID NO: 41738

SEQ ID NO: 331277 - RNA, 64 nt, Homo Sapiens; identical to SEQ ID NO: 41739

SEQ ID NO: 331278 - RNA, 64 nt, Homo Sapiens; identical to SEQ ID NO: 41740

SEQ ID NO: 331279 - RNA, 64 nt, Homo Sapiens; identical to SEQ ID NO: 41741

SEQ ID NO: 331280 - RNA, 64 nt, Homo Sapiens; identical to SEQ ID NO: 41742

SEQ ID NO: 331281 - RNA, 64 nt, Homo Sapiens; identical to SEQ ID NO: 41743

SEQ ID NO: 331282 - RNA, 64 nt, Homo Sapiens; identical to SEQ ID NO: 41744

SEQ ID NO: 331283 - RNA, 64 nt, Homo Sapiens; identical to SEQ ID NO: 41745

SEQ ID NO: 331284 - RNA, 64 nt, Homo Sapiens; identical to SEQ ID NO: 41746

SEQ ID NO: 331285 - RNA, 64 nt, Homo Sapiens; identical to SEQ ID NO: 41747

SEQ ID NO: 331286 - RNA, 64 nt, Homo Sapiens; identical to SEQ ID NO: 41748

SEQ ID NO: 331287 - RNA, 64 nt, Homo Sapiens; identical to SEQ ID NO: 41749

SEQ ID NO: 331288 - RNA, 64 nt, Homo Sapiens; identical to SEQ ID NO: 41750

SEQ ID NO: 331289 - RNA, 64 nt, Homo Sapiens; identical to SEQ ID NO: 41751

SEQ ID NO: 331290 - RNA, 64 nt, Homo Sapiens; identical to SEQ ID NO: 41752

SEQ ID NO: 331291 - RNA, 64 nt, Homo Sapiens; identical to SEQ ID NO: 41753

SEQ ID NO: 331292 - RNA, 64 nt, Homo Sapiens; identical to SEQ ID NO: 41754

SEQ ID NO: 331293 - RNA, 64 nt, Homo Sapiens; identical to SEQ ID NO: 41755

SEQ ID NO: 331294 - RNA, 64 nt, Homo Sapiens; identical to SEQ ID NO: 41756

SEQ ID NO: 331295 - RNA, 64 nt, Homo Sapiens; identical to SEQ ID NO: 41757

SEQ ID NO: 331296 - RNA, 64 nt, Homo Sapiens; identical to SEQ ID NO: 41758

SEQ ID NO: 331297 - RNA, 64 nt, Homo Sapiens; identical to SEQ ID NO: 41759

SEQ ID NO: 331298 - RNA, 64 nt, Homo Sapiens; identical to SEQ ID NO: 41760

SEQ ID NO: 331299 - RNA, 64 nt, Homo Sapiens; identical to SEQ ID NO: 41761

SEQ ID NO: 331300 - RNA, 64 nt, Homo Sapiens; identical to SEQ ID NO: 41762

SEQ ID NO: 331301 - RNA, 64 nt, Homo Sapiens; identical to SEQ ID NO: 41763

SEQ ID NO: 331302 - RNA, 64 nt, Homo Sapiens; identical to SEQ ID NO: 41764

SEQ ID NO: 331303 - RNA, 64 nt, Homo Sapiens; identical to SEQ ID NO: 41765

SEQ ID NO: 331304 - RNA, 64 nt, Homo Sapiens; identical to SEQ ID NO: 41766

SEQ ID NO: 331305 - RNA, 64 nt, Homo Sapiens; identical to SEQ ID NO: 41767

SEQ ID NO: 331306 - RNA, 64 nt, Homo Sapiens; identical to SEQ ID NO: 41768

SEQ ID NO: 331307 - RNA, 64 nt, Homo Sapiens; identical to SEQ ID NO: 41769

SEQ ID NO: 331308 - RNA, 64 nt, Homo Sapiens; identical to SEQ ID NO: 41770

SEQ ID NO: 331309 - RNA, 64 nt, Homo Sapiens; identical to SEQ ID NO: 41771

SEQ ID NO: 331310 - RNA, 64 nt, Homo Sapiens; identical to SEQ ID NO: 41772

SEQ ID NO: 331311 - RNA, 64 nt, Homo Sapiens; identical to SEQ ID NO: 41773

SEQ ID NO: 331312 - RNA, 64 nt, Homo Sapiens; identical to SEQ ID NO: 41774

SEQ ID NO: 331313 - RNA, 64 nt, Homo Sapiens; identical to SEQ ID NO: 41775

SEQ ID NO: 331314 - RNA, 64 nt, Homo Sapiens; identical to SEQ ID NO: 41776

SEQ ID NO: 331315 - RNA, 64 nt, Homo Sapiens; identical to SEQ ID NO: 41777

SEQ ID NO: 331316 - RNA, 64 nt, Homo Sapiens; identical to SEQ ID NO: 41778

SEQ ID NO: 331317 - RNA, 64 nt, Homo Sapiens; identical to SEQ ID NO: 41779

SEQ ID NO: 331318 - RNA, 64 nt, Homo Sapiens; identical to SEQ ID NO: 41780

SEQ ID NO: 331319 - RNA, 64 nt, Homo Sapiens; identical to SEQ ID NO: 41781

SEQ ID NO: 331320 - RNA, 64 nt, Homo Sapiens; identical to SEQ ID NO: 41782

SEQ ID NO: 331321 - RNA, 64 nt, Homo Sapiens; identical to SEQ ID NO: 41783

SEQ ID NO: 331322 - RNA, 64 nt, Homo Sapiens; identical to SEQ ID NO: 41784

SEQ ID NO: 331323 - RNA, 64 nt, Homo Sapiens; identical to SEQ ID NO: 41785

SEQ ID NO: 331324 - RNA, 64 nt, Homo Sapiens; identical to SEQ ID NO: 41786

SEQ ID NO: 331325 - RNA, 64 nt, Homo Sapiens; identical to SEQ ID NO: 41787

SEQ ID NO: 331326 - RNA, 64 nt, Homo Sapiens; identical to SEQ ID NO: 41788

SEQ ID NO: 331327 - RNA, 64 nt, Homo Sapiens; identical to SEQ ID NO: 41789

SEQ ID NO: 331328 - RNA, 64 nt, Homo Sapiens; identical to SEQ ID NO: 41790

SEQ ID NO: 331329 - RNA, 64 nt, Homo Sapiens; identical to SEQ ID NO: 41791

SEQ ID NO: 331330 - RNA, 64 nt, Homo Sapiens; identical to SEQ ID NO: 41792

SEQ ID NO: 331331 - RNA, 64 nt, Homo Sapiens; identical to SEQ ID NO: 41793

SEQ ID NO: 331332 - RNA, 64 nt, Homo Sapiens; identical to SEQ ID NO: 41794

SEQ ID NO: 331333 - RNA, 64 nt, Homo Sapiens; identical to SEQ ID NO: 41795

SEQ ID NO: 331334 - RNA, 64 nt, Homo Sapiens; identical to SEQ ID NO: 41796

SEQ ID NO: 331335 - RNA, 64 nt, Homo Sapiens; identical to SEQ ID NO: 41797

SEQ ID NO: 331336 - RNA, 64 nt, Homo Sapiens; identical to SEQ ID NO: 41798

SEQ ID NO: 331337 - RNA, 64 nt, Homo Sapiens; identical to SEQ ID NO: 41799

SEQ ID NO: 331338 - RNA, 64 nt, Homo Sapiens; identical to SEQ ID NO: 41800

SEQ ID NO: 331339 - RNA, 64 nt, Homo Sapiens; identical to SEQ ID NO: 41801

SEQ ID NO: 331340 - RNA, 64 nt, Homo Sapiens; identical to SEQ ID NO: 41802

SEQ ID NO: 331341 - RNA, 64 nt, Homo Sapiens; identical to SEQ ID NO: 41803

SEQ ID NO: 331342 - RNA, 64 nt, Homo Sapiens; identical to SEQ ID NO: 41804

SEQ ID NO: 331343 - RNA, 64 nt, Homo Sapiens; identical to SEQ ID NO: 41805

SEQ ID NO: 331344 - RNA, 64 nt, Homo Sapiens; identical to SEQ ID NO: 41806

SEQ ID NO: 331345 - RNA, 64 nt, Homo Sapiens; identical to SEQ ID NO: 41807

SEQ ID NO: 331346 - RNA, 64 nt, Homo Sapiens; identical to SEQ ID NO: 41808

SEQ ID NO: 331347 - RNA, 64 nt, Homo Sapiens; identical to SEQ ID NO: 41809

SEQ ID NO: 331348 - RNA, 64 nt, Homo Sapiens; identical to SEQ ID NO: 41810

SEQ ID NO: 331349 - RNA, 64 nt, Homo Sapiens; identical to SEQ ID NO: 41811

SEQ ID NO: 331350 - RNA, 64 nt, Homo Sapiens; identical to SEQ ID NO: 41812

SEQ ID NO: 331351 - RNA, 64 nt, Homo Sapiens; identical to SEQ ID NO: 41813

SEQ ID NO: 331352 - RNA, 64 nt, Homo Sapiens; identical to SEQ ID NO: 41814

SEQ ID NO: 331353 - RNA, 64 nt, Homo Sapiens; identical to SEQ ID NO: 41815

SEQ ID NO: 331354 - RNA, 64 nt, Homo Sapiens; identical to SEQ ID NO: 41816

SEQ ID NO: 331355 - RNA, 64 nt, Homo Sapiens; identical to SEQ ID NO: 41817

SEQ ID NO: 331356 - RNA, 64 nt, Homo Sapiens; identical to SEQ ID NO: 41818

SEQ ID NO: 331357 - RNA, 64 nt, Homo Sapiens; identical to SEQ ID NO: 41819

SEQ ID NO: 331358 - RNA, 64 nt, Homo Sapiens; identical to SEQ ID NO: 41820

SEQ ID NO: 331359 - RNA, 64 nt, Homo Sapiens; identical to SEQ ID NO: 41821

SEQ ID NO: 331360 - RNA, 64 nt, Homo Sapiens; identical to SEQ ID NO: 41822

SEQ ID NO: 331361 - RNA, 64 nt, Homo Sapiens; identical to SEQ ID NO: 41823

SEQ ID NO: 331362 - RNA, 64 nt, Homo Sapiens; identical to SEQ ID NO: 41824

SEQ ID NO: 331363 - RNA, 64 nt, Homo Sapiens; identical to SEQ ID NO: 41825

SEQ ID NO: 331364 - RNA, 64 nt, Homo Sapiens; identical to SEQ ID NO: 41826

SEQ ID NO: 331365 - RNA, 64 nt, Homo Sapiens; identical to SEQ ID NO: 41827

SEQ ID NO: 331366 - RNA, 64 nt, Homo Sapiens; identical to SEQ ID NO: 41828

SEQ ID NO: 331367 - RNA, 64 nt, Homo Sapiens; identical to SEQ ID NO: 41829

SEQ ID NO: 331368 - RNA, 64 nt, Homo Sapiens; identical to SEQ ID NO: 41830

SEQ ID NO: 331369 - RNA, 64 nt, Homo Sapiens; identical to SEQ ID NO: 41831

SEQ ID NO: 331370 - RNA, 64 nt, Homo Sapiens; identical to SEQ ID NO: 41832

SEQ ID NO: 331371 - RNA, 64 nt, Homo Sapiens; identical to SEQ ID NO: 41833

SEQ ID NO: 331372 - RNA, 64 nt, Homo Sapiens; identical to SEQ ID NO: 41834

SEQ ID NO: 331373 - RNA, 64 nt, Homo Sapiens; identical to SEQ ID NO: 41835

SEQ ID NO: 331374 - RNA, 64 nt, Homo Sapiens; identical to SEQ ID NO: 41836

SEQ ID NO: 331375 - RNA, 64 nt, Homo Sapiens; identical to SEQ ID NO: 41837

SEQ ID NO: 331376 - RNA, 64 nt, Homo Sapiens; identical to SEQ ID NO: 41838

SEQ ID NO: 331377 - RNA, 64 nt, Homo Sapiens; identical to SEQ ID NO: 41839

SEQ ID NO: 331378 - RNA, 64 nt, Homo Sapiens; identical to SEQ ID NO: 41840

SEQ ID NO: 331379 - RNA, 64 nt, Homo Sapiens; identical to SEQ ID NO: 41841

SEQ ID NO: 331380 - RNA, 64 nt, Homo Sapiens; identical to SEQ ID NO: 41842

SEQ ID NO: 331381 - RNA, 64 nt, Homo Sapiens; identical to SEQ ID NO: 41843

SEQ ID NO: 331382 - RNA, 64 nt, Homo Sapiens; identical to SEQ ID NO: 41844

SEQ ID NO: 331383 - RNA, 64 nt, Homo Sapiens; identical to SEQ ID NO: 41845

SEQ ID NO: 331384 - RNA, 64 nt, Homo Sapiens; identical to SEQ ID NO: 41846

SEQ ID NO: 331385 - RNA, 64 nt, Homo Sapiens; identical to SEQ ID NO: 41847

SEQ ID NO: 331386 - RNA, 64 nt, Homo Sapiens; identical to SEQ ID NO: 41848

SEQ ID NO: 331387 - RNA, 64 nt, Homo Sapiens; identical to SEQ ID NO: 41849

SEQ ID NO: 331388 - RNA, 64 nt, Homo Sapiens; identical to SEQ ID NO: 41850

SEQ ID NO: 331389 - RNA, 64 nt, Homo Sapiens; identical to SEQ ID NO: 41851

SEQ ID NO: 331390 - RNA, 64 nt, Homo Sapiens; identical to SEQ ID NO: 41852

SEQ ID NO: 331391 - RNA, 64 nt, Homo Sapiens; identical to SEQ ID NO: 41853

SEQ ID NO: 331392 - RNA, 64 nt, Homo Sapiens; identical to SEQ ID NO: 41854

SEQ ID NO: 331393 - RNA, 64 nt, Homo Sapiens; identical to SEQ ID NO: 41855

SEQ ID NO: 331394 - RNA, 64 nt, Homo Sapiens; identical to SEQ ID NO: 41856

SEQ ID NO: 331395 - RNA, 64 nt, Homo Sapiens; identical to SEQ ID NO: 41857

SEQ ID NO: 331396 - RNA, 64 nt, Homo Sapiens; identical to SEQ ID NO: 41858

SEQ ID NO: 331397 - RNA, 64 nt, Homo Sapiens; identical to SEQ ID NO: 41859

SEQ ID NO: 331398 - RNA, 64 nt, Homo Sapiens; identical to SEQ ID NO: 41860

SEQ ID NO: 331399 - RNA, 64 nt, Homo Sapiens; identical to SEQ ID NO: 41861

SEQ ID NO: 331400 - RNA, 64 nt, Homo Sapiens; identical to SEQ ID NO: 41862

SEQ ID NO: 331401 - RNA, 64 nt, Homo Sapiens; identical to SEQ ID NO: 41863

SEQ ID NO: 331402 - RNA, 64 nt, Homo Sapiens; identical to SEQ ID NO: 41864

SEQ ID NO: 331403 - RNA, 64 nt, Homo Sapiens; identical to SEQ ID NO: 41865

SEQ ID NO: 331404 - RNA, 64 nt, Homo Sapiens; identical to SEQ ID NO: 41866

SEQ ID NO: 331405 - RNA, 64 nt, Homo Sapiens; identical to SEQ ID NO: 41867

SEQ ID NO: 331406 - RNA, 64 nt, Homo Sapiens; identical to SEQ ID NO: 41868

SEQ ID NO: 331407 - RNA, 64 nt, Homo Sapiens; identical to SEQ ID NO: 41869

SEQ ID NO: 331408 - RNA, 64 nt, Homo Sapiens; identical to SEQ ID NO: 41870

SEQ ID NO: 331409 - RNA, 64 nt, Homo Sapiens; identical to SEQ ID NO: 41871

SEQ ID NO: 331410 - RNA, 64 nt, Homo Sapiens; identical to SEQ ID NO: 41872

SEQ ID NO: 331411 - RNA, 64 nt, Homo Sapiens; identical to SEQ ID NO: 41873

SEQ ID NO: 331412 - RNA, 64 nt, Homo Sapiens; identical to SEQ ID NO: 41874

SEQ ID NO: 331413 - RNA, 64 nt, Homo Sapiens; identical to SEQ ID NO: 41875

SEQ ID NO: 331414 - RNA, 64 nt, Homo Sapiens; identical to SEQ ID NO: 41876

SEQ ID NO: 331415 - RNA, 64 nt, Homo Sapiens; identical to SEQ ID NO: 41877

SEQ ID NO: 331416 - RNA, 64 nt, Homo Sapiens; identical to SEQ ID NO: 41878

SEQ ID NO: 331417 - RNA, 64 nt, Homo Sapiens; identical to SEQ ID NO: 41879

SEQ ID NO: 331418 - RNA, 64 nt, Homo Sapiens; identical to SEQ ID NO: 41880

SEQ ID NO: 331419 - RNA, 64 nt, Homo Sapiens; identical to SEQ ID NO: 41881

SEQ ID NO: 331420 - RNA, 64 nt, Homo Sapiens; identical to SEQ ID NO: 41882

SEQ ID NO: 331421 - RNA, 64 nt, Homo Sapiens; identical to SEQ ID NO: 41883

SEQ ID NO: 331422 - RNA, 64 nt, Homo Sapiens; identical to SEQ ID NO: 41884

SEQ ID NO: 331423 - RNA, 64 nt, Homo Sapiens; identical to SEQ ID NO: 41885

SEQ ID NO: 331424 - RNA, 64 nt, Homo Sapiens; identical to SEQ ID NO: 41886

SEQ ID NO: 331425 - RNA, 64 nt, Homo Sapiens; identical to SEQ ID NO: 41887

SEQ ID NO: 331426 - RNA, 64 nt, Homo Sapiens; identical to SEQ ID NO: 41888

SEQ ID NO: 331427 - RNA, 64 nt, Homo Sapiens; identical to SEQ ID NO: 41889

SEQ ID NO: 331428 - RNA, 64 nt, Homo Sapiens; identical to SEQ ID NO: 41890

SEQ ID NO: 331429 - RNA, 64 nt, Homo Sapiens; identical to SEQ ID NO: 41891

SEQ ID NO: 331430 - RNA, 64 nt, Homo Sapiens; identical to SEQ ID NO: 41892

SEQ ID NO: 331431 - RNA, 64 nt, Homo Sapiens; identical to SEQ ID NO: 41893

SEQ ID NO: 331432 - RNA, 64 nt, Homo Sapiens; identical to SEQ ID NO: 41894

SEQ ID NO: 331433 - RNA, 64 nt, Homo Sapiens; identical to SEQ ID NO: 41895

SEQ ID NO: 331434 - RNA, 64 nt, Homo Sapiens; identical to SEQ ID NO: 41896

SEQ ID NO: 331435 - RNA, 64 nt, Homo Sapiens; identical to SEQ ID NO: 41897

SEQ ID NO: 331436 - RNA, 64 nt, Homo Sapiens; identical to SEQ ID NO: 41898

SEQ ID NO: 331437 - RNA, 64 nt, Homo Sapiens; identical to SEQ ID NO: 41899

SEQ ID NO: 331438 - RNA, 64 nt, Homo Sapiens; identical to SEQ ID NO: 41900

SEQ ID NO: 331439 - RNA, 64 nt, Homo Sapiens; identical to SEQ ID NO: 41901

SEQ ID NO: 331440 - RNA, 64 nt, Homo Sapiens; identical to SEQ ID NO: 41902

SEQ ID NO: 331441 - RNA, 64 nt, Homo Sapiens; identical to SEQ ID NO: 41903

SEQ ID NO: 331442 - RNA, 64 nt, Homo Sapiens; identical to SEQ ID NO: 41904

SEQ ID NO: 331443 - RNA, 64 nt, Homo Sapiens; identical to SEQ ID NO: 41905

SEQ ID NO: 331444 - RNA, 64 nt, Homo Sapiens; identical to SEQ ID NO: 41906

SEQ ID NO: 331445 - RNA, 64 nt, Homo Sapiens; identical to SEQ ID NO: 41907

SEQ ID NO: 331446 - RNA, 64 nt, Homo Sapiens; identical to SEQ ID NO: 41908

SEQ ID NO: 331447 - RNA, 64 nt, Homo Sapiens; identical to SEQ ID NO: 41909

SEQ ID NO: 331448 - RNA, 64 nt, Homo Sapiens; identical to SEQ ID NO: 41910

SEQ ID NO: 331449 - RNA, 64 nt, Homo Sapiens; identical to SEQ ID NO: 41911

SEQ ID NO: 331450 - RNA, 64 nt, Homo Sapiens; identical to SEQ ID NO: 41912

SEQ ID NO: 331451 - RNA, 64 nt, Homo Sapiens; identical to SEQ ID NO: 41913

SEQ ID NO: 331452 - RNA, 64 nt, Homo Sapiens; identical to SEQ ID NO: 41914

SEQ ID NO: 331453 - RNA, 64 nt, Homo Sapiens; identical to SEQ ID NO: 41915

SEQ ID NO: 331454 - RNA, 64 nt, Homo Sapiens; identical to SEQ ID NO: 41916

SEQ ID NO: 331455 - RNA, 64 nt, Homo Sapiens; identical to SEQ ID NO: 41917

SEQ ID NO: 331456 - RNA, 64 nt, Homo Sapiens; identical to SEQ ID NO: 41918

SEQ ID NO: 331457 - RNA, 64 nt, Homo Sapiens; identical to SEQ ID NO: 41919

SEQ ID NO: 331458 - RNA, 64 nt, Homo Sapiens; identical to SEQ ID NO: 41920

SEQ ID NO: 331459 - RNA, 64 nt, Homo Sapiens; identical to SEQ ID NO: 41921

SEQ ID NO: 331460 - RNA, 64 nt, Homo Sapiens; identical to SEQ ID NO: 41922

SEQ ID NO: 331461 - RNA, 64 nt, Homo Sapiens; identical to SEQ ID NO: 41923

SEQ ID NO: 331462 - RNA, 64 nt, Homo Sapiens; identical to SEQ ID NO: 41924

SEQ ID NO: 331463 - RNA, 64 nt, Homo Sapiens; identical to SEQ ID NO: 41925

SEQ ID NO: 331464 - RNA, 64 nt, Homo Sapiens; identical to SEQ ID NO: 41926

SEQ ID NO: 331465 - RNA, 64 nt, Homo Sapiens; identical to SEQ ID NO: 41927

SEQ ID NO: 331466 - RNA, 64 nt, Homo Sapiens; identical to SEQ ID NO: 41928

SEQ ID NO: 331467 - RNA, 64 nt, Homo Sapiens; identical to SEQ ID NO: 41929

SEQ ID NO: 331468 - RNA, 64 nt, Homo Sapiens; identical to SEQ ID NO: 41930

SEQ ID NO: 331469 - RNA, 64 nt, Homo Sapiens; identical to SEQ ID NO: 41931

SEQ ID NO: 331470 - RNA, 64 nt, Homo Sapiens; identical to SEQ ID NO: 41932

SEQ ID NO: 331471 - RNA, 64 nt, Homo Sapiens; identical to SEQ ID NO: 41933

SEQ ID NO: 331472 - RNA, 64 nt, Homo Sapiens; identical to SEQ ID NO: 41934

SEQ ID NO: 331473 - RNA, 64 nt, Homo Sapiens; identical to SEQ ID NO: 41935

SEQ ID NO: 331474 - RNA, 64 nt, Homo Sapiens; identical to SEQ ID NO: 41936

SEQ ID NO: 331475 - RNA, 64 nt, Homo Sapiens; identical to SEQ ID NO: 41937

SEQ ID NO: 331476 - RNA, 64 nt, Homo Sapiens; identical to SEQ ID NO: 41938

SEQ ID NO: 331477 - RNA, 64 nt, Homo Sapiens; identical to SEQ ID NO: 41939

SEQ ID NO: 331478 - RNA, 64 nt, Homo Sapiens; identical to SEQ ID NO: 41940

SEQ ID NO: 331479 - RNA, 64 nt, Homo Sapiens; identical to SEQ ID NO: 41941

SEQ ID NO: 331480 - RNA, 64 nt, Homo Sapiens; identical to SEQ ID NO: 41942

SEQ ID NO: 331481 - RNA, 64 nt, Homo Sapiens; identical to SEQ ID NO: 41943

SEQ ID NO: 331482 - RNA, 64 nt, Homo Sapiens; identical to SEQ ID NO: 41944

SEQ ID NO: 331483 - RNA, 64 nt, Homo Sapiens; identical to SEQ ID NO: 41945

SEQ ID NO: 331484 - RNA, 64 nt, Homo Sapiens; identical to SEQ ID NO: 41946

SEQ ID NO: 331485 - RNA, 64 nt, Homo Sapiens; identical to SEQ ID NO: 41947

SEQ ID NO: 331486 - RNA, 64 nt, Homo Sapiens; identical to SEQ ID NO: 41948

SEQ ID NO: 331487 - RNA, 64 nt, Homo Sapiens; identical to SEQ ID NO: 41949

SEQ ID NO: 331488 - RNA, 64 nt, Homo Sapiens; identical to SEQ ID NO: 41950

SEQ ID NO: 331489 - RNA, 64 nt, Homo Sapiens; identical to SEQ ID NO: 41951

SEQ ID NO: 331490 - RNA, 64 nt, Homo Sapiens; identical to SEQ ID NO: 41952

SEQ ID NO: 331491 - RNA, 64 nt, Homo Sapiens; identical to SEQ ID NO: 41953

SEQ ID NO: 331492 - RNA, 64 nt, Homo Sapiens; identical to SEQ ID NO: 41954

SEQ ID NO: 331493 - RNA, 64 nt, Homo Sapiens; identical to SEQ ID NO: 41955

SEQ ID NO: 331494 - RNA, 64 nt, Homo Sapiens; identical to SEQ ID NO: 41956

SEQ ID NO: 331495 - RNA, 64 nt, Homo Sapiens; identical to SEQ ID NO: 41957

SEQ ID NO: 331496 - RNA, 64 nt, Homo Sapiens; identical to SEQ ID NO: 41958

SEQ ID NO: 331497 - RNA, 64 nt, Homo Sapiens; identical to SEQ ID NO: 41959

SEQ ID NO: 331498 - RNA, 64 nt, Homo Sapiens; identical to SEQ ID NO: 41960

SEQ ID NO: 331499 - RNA, 64 nt, Homo Sapiens; identical to SEQ ID NO: 41961

SEQ ID NO: 331500 - RNA, 64 nt, Homo Sapiens; identical to SEQ ID NO: 41962

SEQ ID NO: 331501 - RNA, 64 nt, Homo Sapiens; identical to SEQ ID NO: 41963

SEQ ID NO: 331502 - RNA, 64 nt, Homo Sapiens; identical to SEQ ID NO: 41964

SEQ ID NO: 331503 - RNA, 64 nt, Homo Sapiens; identical to SEQ ID NO: 41965

SEQ ID NO: 331504 - RNA, 64 nt, Homo Sapiens; identical to SEQ ID NO: 41966

SEQ ID NO: 331505 - RNA, 64 nt, Homo Sapiens; identical to SEQ ID NO: 41967

SEQ ID NO: 331506 - RNA, 64 nt, Homo Sapiens; identical to SEQ ID NO: 41968

SEQ ID NO: 331507 - RNA, 64 nt, Homo Sapiens; identical to SEQ ID NO: 41969

SEQ ID NO: 331508 - RNA, 64 nt, Homo Sapiens; identical to SEQ ID NO: 41970

SEQ ID NO: 331509 - RNA, 64 nt, Homo Sapiens; identical to SEQ ID NO: 41971

SEQ ID NO: 331510 - RNA, 64 nt, Homo Sapiens; identical to SEQ ID NO: 41972

SEQ ID NO: 331511 - RNA, 64 nt, Homo Sapiens; identical to SEQ ID NO: 41973

SEQ ID NO: 331512 - RNA, 64 nt, Homo Sapiens; identical to SEQ ID NO: 41974

SEQ ID NO: 331513 - RNA, 64 nt, Homo Sapiens; identical to SEQ ID NO: 41975

SEQ ID NO: 331514 - RNA, 64 nt, Homo Sapiens; identical to SEQ ID NO: 41976

SEQ ID NO: 331515 - RNA, 64 nt, Homo Sapiens; identical to SEQ ID NO: 41977

SEQ ID NO: 331516 - RNA, 64 nt, Homo Sapiens; identical to SEQ ID NO: 41978

SEQ ID NO: 331517 - RNA, 64 nt, Homo Sapiens; identical to SEQ ID NO: 41979

SEQ ID NO: 331518 - RNA, 64 nt, Homo Sapiens; identical to SEQ ID NO: 41980

SEQ ID NO: 331519 - RNA, 64 nt, Homo Sapiens; identical to SEQ ID NO: 41981

SEQ ID NO: 331520 - RNA, 64 nt, Homo Sapiens; identical to SEQ ID NO: 41982

SEQ ID NO: 331521 - RNA, 64 nt, Homo Sapiens; identical to SEQ ID NO: 41983

SEQ ID NO: 331522 - RNA, 64 nt, Homo Sapiens; identical to SEQ ID NO: 41984

SEQ ID NO: 331523 - RNA, 64 nt, Homo Sapiens; identical to SEQ ID NO: 41985

SEQ ID NO: 331524 - RNA, 64 nt, Homo Sapiens; identical to SEQ ID NO: 41986

SEQ ID NO: 331525 - RNA, 64 nt, Homo Sapiens; identical to SEQ ID NO: 41987

SEQ ID NO: 331526 - RNA, 64 nt, Homo Sapiens; identical to SEQ ID NO: 41988

SEQ ID NO: 331527 - RNA, 64 nt, Homo Sapiens; identical to SEQ ID NO: 41989

SEQ ID NO: 331528 - RNA, 64 nt, Homo Sapiens; identical to SEQ ID NO: 41990

SEQ ID NO: 331529 - RNA, 64 nt, Homo Sapiens; identical to SEQ ID NO: 41991

SEQ ID NO: 331530 - RNA, 64 nt, Homo Sapiens; identical to SEQ ID NO: 41992

SEQ ID NO: 331531 - RNA, 64 nt, Homo Sapiens; identical to SEQ ID NO: 41993

SEQ ID NO: 331532 - RNA, 64 nt, Homo Sapiens; identical to SEQ ID NO: 41994

SEQ ID NO: 331533 - RNA, 64 nt, Homo Sapiens; identical to SEQ ID NO: 41995

SEQ ID NO: 331534 - RNA, 64 nt, Homo Sapiens; identical to SEQ ID NO: 41996

SEQ ID NO: 331535 - RNA, 64 nt, Homo Sapiens; identical to SEQ ID NO: 41997

SEQ ID NO: 331536 - RNA, 64 nt, Homo Sapiens; identical to SEQ ID NO: 41998

SEQ ID NO: 331537 - RNA, 64 nt, Homo Sapiens; identical to SEQ ID NO: 41999

SEQ ID NO: 331538 - RNA, 64 nt, Homo Sapiens; identical to SEQ ID NO: 42000

SEQ ID NO: 331539 - RNA, 64 nt, Homo Sapiens; identical to SEQ ID NO: 42001

SEQ ID NO: 331540 - RNA, 64 nt, Homo Sapiens; identical to SEQ ID NO: 42002

SEQ ID NO: 331541 - RNA, 64 nt, Homo Sapiens; identical to SEQ ID NO: 42003

SEQ ID NO: 331542 - RNA, 64 nt, Homo Sapiens; identical to SEQ ID NO: 42004

SEQ ID NO: 331543 - RNA, 64 nt, Homo Sapiens; identical to SEQ ID NO: 42005

SEQ ID NO: 331544 - RNA, 64 nt, Homo Sapiens; identical to SEQ ID NO: 42006

SEQ ID NO: 331545 - RNA, 64 nt, Homo Sapiens; identical to SEQ ID NO: 42007

SEQ ID NO: 331546 - RNA, 64 nt, Homo Sapiens; identical to SEQ ID NO: 42008

SEQ ID NO: 331547 - RNA, 64 nt, Homo Sapiens; identical to SEQ ID NO: 42009

SEQ ID NO: 331548 - RNA, 64 nt, Homo Sapiens; identical to SEQ ID NO: 42010

SEQ ID NO: 331549 - RNA, 64 nt, Homo Sapiens; identical to SEQ ID NO: 42011

SEQ ID NO: 331550 - RNA, 64 nt, Homo Sapiens; identical to SEQ ID NO: 42012

SEQ ID NO: 331551 - RNA, 64 nt, Homo Sapiens; identical to SEQ ID NO: 42013

SEQ ID NO: 331552 - RNA, 64 nt, Homo Sapiens; identical to SEQ ID NO: 42014

SEQ ID NO: 331553 - RNA, 64 nt, Homo Sapiens; identical to SEQ ID NO: 42015

SEQ ID NO: 331554 - RNA, 64 nt, Homo Sapiens; identical to SEQ ID NO: 42016

SEQ ID NO: 331555 - RNA, 64 nt, Homo Sapiens; identical to SEQ ID NO: 42017

SEQ ID NO: 331556 - RNA, 64 nt, Homo Sapiens; identical to SEQ ID NO: 42018

SEQ ID NO: 331557 - RNA, 64 nt, Homo Sapiens; identical to SEQ ID NO: 42019

SEQ ID NO: 331558 - RNA, 64 nt, Homo Sapiens; identical to SEQ ID NO: 42020

SEQ ID NO: 331559 - RNA, 64 nt, Homo Sapiens; identical to SEQ ID NO: 42021

SEQ ID NO: 331560 - RNA, 64 nt, Homo Sapiens; identical to SEQ ID NO: 42022

SEQ ID NO: 331561 - RNA, 64 nt, Homo Sapiens; identical to SEQ ID NO: 42023

SEQ ID NO: 331562 - RNA, 64 nt, Homo Sapiens; identical to SEQ ID NO: 42024

SEQ ID NO: 331563 - RNA, 64 nt, Homo Sapiens; identical to SEQ ID NO: 42025

SEQ ID NO: 331564 - RNA, 64 nt, Homo Sapiens; identical to SEQ ID NO: 42026

SEQ ID NO: 331565 - RNA, 64 nt, Homo Sapiens; identical to SEQ ID NO: 42027

SEQ ID NO: 331566 - RNA, 64 nt, Homo Sapiens; identical to SEQ ID NO: 42028

SEQ ID NO: 331567 - RNA, 64 nt, Homo Sapiens; identical to SEQ ID NO: 42029

SEQ ID NO: 331568 - RNA, 64 nt, Homo Sapiens; identical to SEQ ID NO: 42030

SEQ ID NO: 331569 - RNA, 64 nt, Homo Sapiens; identical to SEQ ID NO: 42031

SEQ ID NO: 331570 - RNA, 64 nt, Homo Sapiens; identical to SEQ ID NO: 42032

SEQ ID NO: 331571 - RNA, 64 nt, Homo Sapiens; identical to SEQ ID NO: 42033

SEQ ID NO: 331572 - RNA, 64 nt, Homo Sapiens; identical to SEQ ID NO: 42034

SEQ ID NO: 331573 - RNA, 64 nt, Homo Sapiens; identical to SEQ ID NO: 42035

SEQ ID NO: 331574 - RNA, 64 nt, Homo Sapiens; identical to SEQ ID NO: 42036

SEQ ID NO: 331575 - RNA, 64 nt, Homo Sapiens; identical to SEQ ID NO: 42037

SEQ ID NO: 331576 - RNA, 64 nt, Homo Sapiens; identical to SEQ ID NO: 42038

SEQ ID NO: 331577 - RNA, 64 nt, Homo Sapiens; identical to SEQ ID NO: 42039

SEQ ID NO: 331578 - RNA, 64 nt, Homo Sapiens; identical to SEQ ID NO: 42040

SEQ ID NO: 331579 - RNA, 64 nt, Homo Sapiens; identical to SEQ ID NO: 42041

SEQ ID NO: 331580 - RNA, 64 nt, Homo Sapiens; identical to SEQ ID NO: 42042

SEQ ID NO: 331581 - RNA, 64 nt, Homo Sapiens; identical to SEQ ID NO: 42043

SEQ ID NO: 331582 - RNA, 64 nt, Homo Sapiens; identical to SEQ ID NO: 42044

SEQ ID NO: 331583 - RNA, 64 nt, Homo Sapiens; identical to SEQ ID NO: 42045

SEQ ID NO: 331584 - RNA, 64 nt, Homo Sapiens; identical to SEQ ID NO: 42046

SEQ ID NO: 331585 - RNA, 64 nt, Homo Sapiens; identical to SEQ ID NO: 42047

SEQ ID NO: 331586 - RNA, 64 nt, Homo Sapiens; identical to SEQ ID NO: 42048

SEQ ID NO: 331587 - RNA, 64 nt, Homo Sapiens; identical to SEQ ID NO: 42049

SEQ ID NO: 331588 - RNA, 64 nt, Homo Sapiens; identical to SEQ ID NO: 42050

SEQ ID NO: 331589 - RNA, 64 nt, Homo Sapiens; identical to SEQ ID NO: 42051

SEQ ID NO: 331590 - RNA, 64 nt, Homo Sapiens; identical to SEQ ID NO: 42052

SEQ ID NO: 331591 - RNA, 64 nt, Homo Sapiens; identical to SEQ ID NO: 42053

SEQ ID NO: 331592 - RNA, 64 nt, Homo Sapiens; identical to SEQ ID NO: 42054

SEQ ID NO: 331593 - RNA, 64 nt, Homo Sapiens; identical to SEQ ID NO: 42055

SEQ ID NO: 331594 - RNA, 64 nt, Homo Sapiens; identical to SEQ ID NO: 42056

SEQ ID NO: 331595 - RNA, 64 nt, Homo Sapiens; identical to SEQ ID NO: 42057

SEQ ID NO: 331596 - RNA, 64 nt, Homo Sapiens; identical to SEQ ID NO: 42058

SEQ ID NO: 331597 - RNA, 64 nt, Homo Sapiens; identical to SEQ ID NO: 42059

SEQ ID NO: 331598 - RNA, 64 nt, Homo Sapiens; identical to SEQ ID NO: 42060

SEQ ID NO: 331599 - RNA, 64 nt, Homo Sapiens; identical to SEQ ID NO: 42061

SEQ ID NO: 331600 - RNA, 64 nt, Homo Sapiens; identical to SEQ ID NO: 42062

SEQ ID NO: 331601 - RNA, 64 nt, Homo Sapiens; identical to SEQ ID NO: 42063

SEQ ID NO: 331602 - RNA, 64 nt, Homo Sapiens; identical to SEQ ID NO: 42064

SEQ ID NO: 331603 - RNA, 64 nt, Homo Sapiens; identical to SEQ ID NO: 42065

SEQ ID NO: 331604 - RNA, 64 nt, Homo Sapiens; identical to SEQ ID NO: 42066

SEQ ID NO: 331605 - RNA, 64 nt, Homo Sapiens; identical to SEQ ID NO: 42067

SEQ ID NO: 331606 - RNA, 64 nt, Homo Sapiens; identical to SEQ ID NO: 42068

SEQ ID NO: 331607 - RNA, 64 nt, Homo Sapiens; identical to SEQ ID NO: 42069

SEQ ID NO: 331608 - RNA, 64 nt, Homo Sapiens; identical to SEQ ID NO: 42070

SEQ ID NO: 331609 - RNA, 64 nt, Homo Sapiens; identical to SEQ ID NO: 42071

SEQ ID NO: 331610 - RNA, 64 nt, Homo Sapiens; identical to SEQ ID NO: 42072

SEQ ID NO: 331611 - RNA, 64 nt, Homo Sapiens; identical to SEQ ID NO: 42073

SEQ ID NO: 331612 - RNA, 64 nt, Homo Sapiens; identical to SEQ ID NO: 42074

SEQ ID NO: 331613 - RNA, 64 nt, Homo Sapiens; identical to SEQ ID NO: 42075

SEQ ID NO: 331614 - RNA, 64 nt, Homo Sapiens; identical to SEQ ID NO: 42076

SEQ ID NO: 331615 - RNA, 64 nt, Homo Sapiens; identical to SEQ ID NO: 42077

SEQ ID NO: 331616 - RNA, 64 nt, Homo Sapiens; identical to SEQ ID NO: 42078

SEQ ID NO: 331617 - RNA, 64 nt, Homo Sapiens; identical to SEQ ID NO: 42079

SEQ ID NO: 331618 - RNA, 64 nt, Homo Sapiens; identical to SEQ ID NO: 42080

SEQ ID NO: 331619 - RNA, 64 nt, Homo Sapiens; identical to SEQ ID NO: 42081

SEQ ID NO: 331620 - RNA, 64 nt, Homo Sapiens; identical to SEQ ID NO: 42082

SEQ ID NO: 331621 - RNA, 64 nt, Homo Sapiens; identical to SEQ ID NO: 42083

SEQ ID NO: 331622 - RNA, 64 nt, Homo Sapiens; identical to SEQ ID NO: 42084

SEQ ID NO: 331623 - RNA, 64 nt, Homo Sapiens; identical to SEQ ID NO: 42085

SEQ ID NO: 331624 - RNA, 64 nt, Homo Sapiens; identical to SEQ ID NO: 42086

SEQ ID NO: 331625 - RNA, 64 nt, Homo Sapiens; identical to SEQ ID NO: 42087

SEQ ID NO: 331626 - RNA, 64 nt, Homo Sapiens; identical to SEQ ID NO: 42088

SEQ ID NO: 331627 - RNA, 64 nt, Homo Sapiens; identical to SEQ ID NO: 42089

SEQ ID NO: 331628 - RNA, 64 nt, Homo Sapiens; identical to SEQ ID NO: 42090

SEQ ID NO: 331629 - RNA, 64 nt, Homo Sapiens; identical to SEQ ID NO: 42091

SEQ ID NO: 331630 - RNA, 64 nt, Homo Sapiens; identical to SEQ ID NO: 42092

SEQ ID NO: 331631 - RNA, 64 nt, Homo Sapiens; identical to SEQ ID NO: 42093

SEQ ID NO: 331632 - RNA, 64 nt, Homo Sapiens; identical to SEQ ID NO: 42094

SEQ ID NO: 331633 - RNA, 64 nt, Homo Sapiens; identical to SEQ ID NO: 42095

SEQ ID NO: 331634 - RNA, 64 nt, Homo Sapiens; identical to SEQ ID NO: 42096

SEQ ID NO: 331635 - RNA, 64 nt, Homo Sapiens; identical to SEQ ID NO: 42097

SEQ ID NO: 331636 - RNA, 64 nt, Homo Sapiens; identical to SEQ ID NO: 42098

SEQ ID NO: 331637 - RNA, 64 nt, Homo Sapiens; identical to SEQ ID NO: 42099

SEQ ID NO: 331638 - RNA, 64 nt, Homo Sapiens; identical to SEQ ID NO: 42100

SEQ ID NO: 331639 - RNA, 64 nt, Homo Sapiens; identical to SEQ ID NO: 42101

SEQ ID NO: 331640 - RNA, 64 nt, Homo Sapiens; identical to SEQ ID NO: 42102

SEQ ID NO: 331641 - RNA, 64 nt, Homo Sapiens; identical to SEQ ID NO: 42103

SEQ ID NO: 331642 - RNA, 64 nt, Homo Sapiens; identical to SEQ ID NO: 42104

SEQ ID NO: 331643 - RNA, 64 nt, Homo Sapiens; identical to SEQ ID NO: 42105

SEQ ID NO: 331644 - RNA, 64 nt, Homo Sapiens; identical to SEQ ID NO: 42106

SEQ ID NO: 331645 - RNA, 64 nt, Homo Sapiens; identical to SEQ ID NO: 42107

SEQ ID NO: 331646 - RNA, 64 nt, Homo Sapiens; identical to SEQ ID NO: 42108

SEQ ID NO: 331647 - RNA, 64 nt, Homo Sapiens; identical to SEQ ID NO: 42109

SEQ ID NO: 331648 - RNA, 64 nt, Homo Sapiens; identical to SEQ ID NO: 42110

SEQ ID NO: 331649 - RNA, 64 nt, Homo Sapiens; identical to SEQ ID NO: 42111

SEQ ID NO: 331650 - RNA, 64 nt, Homo Sapiens; identical to SEQ ID NO: 42112

SEQ ID NO: 331651 - RNA, 64 nt, Homo Sapiens; identical to SEQ ID NO: 42113

SEQ ID NO: 331652 - RNA, 64 nt, Homo Sapiens; identical to SEQ ID NO: 42114

SEQ ID NO: 331653 - RNA, 64 nt, Homo Sapiens; identical to SEQ ID NO: 42115

SEQ ID NO: 331654 - RNA, 64 nt, Homo Sapiens; identical to SEQ ID NO: 42116

SEQ ID NO: 331655 - RNA, 64 nt, Homo Sapiens; identical to SEQ ID NO: 42117

SEQ ID NO: 331656 - RNA, 64 nt, Homo Sapiens; identical to SEQ ID NO: 42118

SEQ ID NO: 331657 - RNA, 64 nt, Homo Sapiens; identical to SEQ ID NO: 42119

SEQ ID NO: 331658 - RNA, 64 nt, Homo Sapiens; identical to SEQ ID NO: 42120

SEQ ID NO: 331659 - RNA, 64 nt, Homo Sapiens; identical to SEQ ID NO: 42121

SEQ ID NO: 331660 - RNA, 64 nt, Homo Sapiens; identical to SEQ ID NO: 42122

SEQ ID NO: 331661 - RNA, 64 nt, Homo Sapiens; identical to SEQ ID NO: 42123

SEQ ID NO: 331662 - RNA, 64 nt, Homo Sapiens; identical to SEQ ID NO: 42124

SEQ ID NO: 331663 - RNA, 64 nt, Homo Sapiens; identical to SEQ ID NO: 42125

SEQ ID NO: 331664 - RNA, 64 nt, Homo Sapiens; identical to SEQ ID NO: 42126

SEQ ID NO: 331665 - RNA, 64 nt, Homo Sapiens; identical to SEQ ID NO: 42127

SEQ ID NO: 331666 - RNA, 64 nt, Homo Sapiens; identical to SEQ ID NO: 42128

SEQ ID NO: 331667 - RNA, 64 nt, Homo Sapiens; identical to SEQ ID NO: 42129

SEQ ID NO: 331668 - RNA, 64 nt, Homo Sapiens; identical to SEQ ID NO: 42130

SEQ ID NO: 331669 - RNA, 64 nt, Homo Sapiens; identical to SEQ ID NO: 42131

SEQ ID NO: 331670 - RNA, 64 nt, Homo Sapiens; identical to SEQ ID NO: 42132

SEQ ID NO: 331671 - RNA, 64 nt, Homo Sapiens; identical to SEQ ID NO: 42133

SEQ ID NO: 331672 - RNA, 64 nt, Homo Sapiens; identical to SEQ ID NO: 42134

SEQ ID NO: 331673 - RNA, 64 nt, Homo Sapiens; identical to SEQ ID NO: 42135

SEQ ID NO: 331674 - RNA, 64 nt, Homo Sapiens; identical to SEQ ID NO: 42136

SEQ ID NO: 331675 - RNA, 64 nt, Homo Sapiens; identical to SEQ ID NO: 42137

SEQ ID NO: 331676 - RNA, 64 nt, Homo Sapiens; identical to SEQ ID NO: 42138

SEQ ID NO: 331677 - RNA, 64 nt, Homo Sapiens; identical to SEQ ID NO: 42139

SEQ ID NO: 331678 - RNA, 64 nt, Homo Sapiens; identical to SEQ ID NO: 42140

SEQ ID NO: 331679 - RNA, 64 nt, Homo Sapiens; identical to SEQ ID NO: 42141

SEQ ID NO: 331680 - RNA, 64 nt, Homo Sapiens; identical to SEQ ID NO: 42142

SEQ ID NO: 331681 - RNA, 64 nt, Homo Sapiens; identical to SEQ ID NO: 42143

SEQ ID NO: 331682 - RNA, 64 nt, Homo Sapiens; identical to SEQ ID NO: 42144

SEQ ID NO: 331683 - RNA, 64 nt, Homo Sapiens; identical to SEQ ID NO: 42145

SEQ ID NO: 331684 - RNA, 64 nt, Homo Sapiens; identical to SEQ ID NO: 42146

SEQ ID NO: 331685 - RNA, 64 nt, Homo Sapiens; identical to SEQ ID NO: 42147

SEQ ID NO: 331686 - RNA, 64 nt, Homo Sapiens; identical to SEQ ID NO: 42148

SEQ ID NO: 331687 - RNA, 64 nt, Homo Sapiens; identical to SEQ ID NO: 42149

SEQ ID NO: 331688 - RNA, 64 nt, Homo Sapiens; identical to SEQ ID NO: 42150

SEQ ID NO: 331689 - RNA, 64 nt, Homo Sapiens; identical to SEQ ID NO: 42151

SEQ ID NO: 331690 - RNA, 64 nt, Homo Sapiens; identical to SEQ ID NO: 42152

SEQ ID NO: 331691 - RNA, 64 nt, Homo Sapiens; identical to SEQ ID NO: 42153

SEQ ID NO: 331692 - RNA, 64 nt, Homo Sapiens; identical to SEQ ID NO: 42154

SEQ ID NO: 331693 - RNA, 64 nt, Homo Sapiens; identical to SEQ ID NO: 42155

SEQ ID NO: 331694 - RNA, 64 nt, Homo Sapiens; identical to SEQ ID NO: 42156

SEQ ID NO: 331695 - RNA, 64 nt, Homo Sapiens; identical to SEQ ID NO: 42157

SEQ ID NO: 331696 - RNA, 64 nt, Homo Sapiens; identical to SEQ ID NO: 42158

SEQ ID NO: 331697 - RNA, 64 nt, Homo Sapiens; identical to SEQ ID NO: 42159

SEQ ID NO: 331698 - RNA, 64 nt, Homo Sapiens; identical to SEQ ID NO: 42160

SEQ ID NO: 331699 - RNA, 64 nt, Homo Sapiens; identical to SEQ ID NO: 42161

SEQ ID NO: 331700 - RNA, 64 nt, Homo Sapiens; identical to SEQ ID NO: 42162

SEQ ID NO: 331701 - RNA, 64 nt, Homo Sapiens; identical to SEQ ID NO: 42163

SEQ ID NO: 331702 - RNA, 64 nt, Homo Sapiens; identical to SEQ ID NO: 42164

SEQ ID NO: 331703 - RNA, 64 nt, Homo Sapiens; identical to SEQ ID NO: 42165

SEQ ID NO: 331704 - RNA, 64 nt, Homo Sapiens; identical to SEQ ID NO: 42166

SEQ ID NO: 331705 - RNA, 64 nt, Homo Sapiens; identical to SEQ ID NO: 42167

SEQ ID NO: 331706 - RNA, 64 nt, Homo Sapiens; identical to SEQ ID NO: 42168

SEQ ID NO: 331707 - RNA, 64 nt, Homo Sapiens; identical to SEQ ID NO: 42169

SEQ ID NO: 331708 - RNA, 64 nt, Homo Sapiens; identical to SEQ ID NO: 42170

SEQ ID NO: 331709 - RNA, 64 nt, Homo Sapiens; identical to SEQ ID NO: 42171

SEQ ID NO: 331710 - RNA, 64 nt, Homo Sapiens; identical to SEQ ID NO: 42172

SEQ ID NO: 331711 - RNA, 64 nt, Homo Sapiens; identical to SEQ ID NO: 42173

SEQ ID NO: 331712 - RNA, 64 nt, Homo Sapiens; identical to SEQ ID NO: 42174

SEQ ID NO: 331713 - RNA, 64 nt, Homo Sapiens; identical to SEQ ID NO: 42175

SEQ ID NO: 331714 - RNA, 64 nt, Homo Sapiens; identical to SEQ ID NO: 42176

SEQ ID NO: 331715 - RNA, 64 nt, Homo Sapiens; identical to SEQ ID NO: 42177

SEQ ID NO: 331716 - RNA, 64 nt, Homo Sapiens; identical to SEQ ID NO: 42178

SEQ ID NO: 331717 - RNA, 64 nt, Homo Sapiens; identical to SEQ ID NO: 42179

SEQ ID NO: 331718 - RNA, 64 nt, Homo Sapiens; identical to SEQ ID NO: 42180

SEQ ID NO: 331719 - RNA, 64 nt, Homo Sapiens; identical to SEQ ID NO: 42181

SEQ ID NO: 331720 - RNA, 64 nt, Homo Sapiens; identical to SEQ ID NO: 42182

SEQ ID NO: 331721 - RNA, 64 nt, Homo Sapiens; identical to SEQ ID NO: 42183

SEQ ID NO: 331722 - RNA, 64 nt, Homo Sapiens; identical to SEQ ID NO: 42184

SEQ ID NO: 331723 - RNA, 64 nt, Homo Sapiens; identical to SEQ ID NO: 42185

SEQ ID NO: 331724 - RNA, 64 nt, Homo Sapiens; identical to SEQ ID NO: 42186

SEQ ID NO: 331725 - RNA, 64 nt, Homo Sapiens; identical to SEQ ID NO: 42187

SEQ ID NO: 331726 - RNA, 64 nt, Homo Sapiens; identical to SEQ ID NO: 42188

SEQ ID NO: 331727 - RNA, 64 nt, Homo Sapiens; identical to SEQ ID NO: 42189

SEQ ID NO: 331728 - RNA, 64 nt, Homo Sapiens; identical to SEQ ID NO: 42190

SEQ ID NO: 331729 - RNA, 64 nt, Homo Sapiens; identical to SEQ ID NO: 42191

SEQ ID NO: 331730 - RNA, 64 nt, Homo Sapiens; identical to SEQ ID NO: 42192

SEQ ID NO: 331731 - RNA, 64 nt, Homo Sapiens; identical to SEQ ID NO: 42193

SEQ ID NO: 331732 - RNA, 64 nt, Homo Sapiens; identical to SEQ ID NO: 42194

SEQ ID NO: 331733 - RNA, 64 nt, Homo Sapiens; identical to SEQ ID NO: 42195

SEQ ID NO: 331734 - RNA, 64 nt, Homo Sapiens; identical to SEQ ID NO: 42196

SEQ ID NO: 331735 - RNA, 64 nt, Homo Sapiens; identical to SEQ ID NO: 42197

SEQ ID NO: 331736 - RNA, 64 nt, Homo Sapiens; identical to SEQ ID NO: 42198

SEQ ID NO: 331737 - RNA, 64 nt, Homo Sapiens; identical to SEQ ID NO: 42199

SEQ ID NO: 331738 - RNA, 64 nt, Homo Sapiens; identical to SEQ ID NO: 42200

SEQ ID NO: 331739 - RNA, 64 nt, Homo Sapiens; identical to SEQ ID NO: 42201

SEQ ID NO: 331740 - RNA, 64 nt, Homo Sapiens; identical to SEQ ID NO: 42202

SEQ ID NO: 331741 - RNA, 64 nt, Homo Sapiens; identical to SEQ ID NO: 42203

SEQ ID NO: 331742 - RNA, 64 nt, Homo Sapiens; identical to SEQ ID NO: 42204

SEQ ID NO: 331743 - RNA, 64 nt, Homo Sapiens; identical to SEQ ID NO: 42205

SEQ ID NO: 331744 - RNA, 64 nt, Homo Sapiens; identical to SEQ ID NO: 42206

SEQ ID NO: 331745 - RNA, 64 nt, Homo Sapiens; identical to SEQ ID NO: 42207

SEQ ID NO: 331746 - RNA, 64 nt, Homo Sapiens; identical to SEQ ID NO: 42208

SEQ ID NO: 331747 - RNA, 64 nt, Homo Sapiens; identical to SEQ ID NO: 42209

SEQ ID NO: 331748 - RNA, 64 nt, Homo Sapiens; identical to SEQ ID NO: 42210

SEQ ID NO: 331749 - RNA, 64 nt, Homo Sapiens; identical to SEQ ID NO: 42211

SEQ ID NO: 331750 - RNA, 64 nt, Homo Sapiens; identical to SEQ ID NO: 42212

SEQ ID NO: 331751 - RNA, 64 nt, Homo Sapiens; identical to SEQ ID NO: 42213

SEQ ID NO: 331752 - RNA, 64 nt, Homo Sapiens; identical to SEQ ID NO: 42214

SEQ ID NO: 331753 - RNA, 64 nt, Homo Sapiens; identical to SEQ ID NO: 42215

SEQ ID NO: 331754 - RNA, 64 nt, Homo Sapiens; identical to SEQ ID NO: 42216

SEQ ID NO: 331755 - RNA, 64 nt, Homo Sapiens; identical to SEQ ID NO: 42217

SEQ ID NO: 331756 - RNA, 64 nt, Homo Sapiens; identical to SEQ ID NO: 42218

SEQ ID NO: 331757 - RNA, 64 nt, Homo Sapiens; identical to SEQ ID NO: 42219

SEQ ID NO: 331758 - RNA, 64 nt, Homo Sapiens; identical to SEQ ID NO: 42220

SEQ ID NO: 331759 - RNA, 64 nt, Homo Sapiens; identical to SEQ ID NO: 42221

SEQ ID NO: 331760 - RNA, 64 nt, Homo Sapiens; identical to SEQ ID NO: 42222

SEQ ID NO: 331761 - RNA, 64 nt, Homo Sapiens; identical to SEQ ID NO: 42223

SEQ ID NO: 331762 - RNA, 64 nt, Homo Sapiens; identical to SEQ ID NO: 42224

SEQ ID NO: 331763 - RNA, 64 nt, Homo Sapiens; identical to SEQ ID NO: 42225

SEQ ID NO: 331764 - RNA, 64 nt, Homo Sapiens; identical to SEQ ID NO: 42226

SEQ ID NO: 331765 - RNA, 64 nt, Homo Sapiens; identical to SEQ ID NO: 42227

SEQ ID NO: 331766 - RNA, 64 nt, Homo Sapiens; identical to SEQ ID NO: 42228

SEQ ID NO: 331767 - RNA, 64 nt, Homo Sapiens; identical to SEQ ID NO: 42229

SEQ ID NO: 331768 - RNA, 64 nt, Homo Sapiens; identical to SEQ ID NO: 42230

SEQ ID NO: 331769 - RNA, 64 nt, Homo Sapiens; identical to SEQ ID NO: 42231

SEQ ID NO: 331770 - RNA, 64 nt, Homo Sapiens; identical to SEQ ID NO: 42232

SEQ ID NO: 331771 - RNA, 64 nt, Homo Sapiens; identical to SEQ ID NO: 42233

SEQ ID NO: 331772 - RNA, 64 nt, Homo Sapiens; identical to SEQ ID NO: 42234

SEQ ID NO: 331773 - RNA, 64 nt, Homo Sapiens; identical to SEQ ID NO: 42235

SEQ ID NO: 331774 - RNA, 64 nt, Homo Sapiens; identical to SEQ ID NO: 297889

SEQ ID NO: 331775 - RNA, 64 nt, Homo Sapiens; identical to SEQ ID NO: 297890

SEQ ID NO: 331776 - RNA, 64 nt, Homo Sapiens; identical to SEQ ID NO: 297891

SEQ ID NO: 331777 - RNA, 64 nt, Homo Sapiens; identical to SEQ ID NO: 297892

SEQ ID NO: 331778 - RNA, 64 nt, Homo Sapiens; identical to SEQ ID NO: 297893

SEQ ID NO: 331779 - RNA, 64 nt, Homo Sapiens; identical to SEQ ID NO: 297894

SEQ ID NO: 331780 - RNA, 64 nt, Homo Sapiens; identical to SEQ ID NO: 297895

SEQ ID NO: 331781 - RNA, 64 nt, Homo Sapiens; identical to SEQ ID NO: 297896

SEQ ID NO: 331782 - RNA, 64 nt, Homo Sapiens; identical to SEQ ID NO: 297897

SEQ ID NO: 331783 - RNA, 64 nt, Homo Sapiens; identical to SEQ ID NO: 297898

SEQ ID NO: 331784 - RNA, 64 nt, Homo Sapiens; identical to SEQ ID NO: 297899

SEQ ID NO: 331785 - RNA, 64 nt, Homo Sapiens; identical to SEQ ID NO: 297900

SEQ ID NO: 331786 - RNA, 64 nt, Homo Sapiens; identical to SEQ ID NO: 297901

SEQ ID NO: 331787 - RNA, 64 nt, Homo Sapiens; identical to SEQ ID NO: 297902

SEQ ID NO: 331788 - RNA, 64 nt, Homo Sapiens; identical to SEQ ID NO: 297903

SEQ ID NO: 331789 - RNA, 64 nt, Homo Sapiens; identical to SEQ ID NO: 297904

SEQ ID NO: 331790 - RNA, 64 nt, Homo Sapiens; identical to SEQ ID NO: 297905

SEQ ID NO: 331791 - RNA, 64 nt, Homo Sapiens; identical to SEQ ID NO: 297906

SEQ ID NO: 331792 - RNA, 64 nt, Homo Sapiens; identical to SEQ ID NO: 297907

SEQ ID NO: 331793 - RNA, 64 nt, Homo Sapiens; identical to SEQ ID NO: 297908

SEQ ID NO: 331794 - RNA, 64 nt, Homo Sapiens; identical to SEQ ID NO: 297909

SEQ ID NO: 331795 - RNA, 64 nt, Homo Sapiens; identical to SEQ ID NO: 297910

SEQ ID NO: 331796 - RNA, 57 nt, Homo Sapiens; identical to SEQ ID NO: 50763

SEQ ID NO: 331797 - RNA, 64 nt, Homo Sapiens; identical to SEQ ID NO: 50764

SEQ ID NO: 331798 - RNA, 64 nt, Homo Sapiens; identical to SEQ ID NO: 50765

SEQ ID NO: 331799 - RNA, 64 nt, Homo Sapiens; identical to SEQ ID NO: 50766

SEQ ID NO: 331800 - RNA, 64 nt, Homo Sapiens; identical to SEQ ID NO: 50767

SEQ ID NO: 331801 - RNA, 64 nt, Homo Sapiens; identical to SEQ ID NO: 50768

SEQ ID NO: 331802 - RNA, 64 nt, Homo Sapiens; identical to SEQ ID NO: 50769

SEQ ID NO: 331803 - RNA, 64 nt, Homo Sapiens; identical to SEQ ID NO: 50770

SEQ ID NO: 331804 - RNA, 64 nt, Homo Sapiens; identical to SEQ ID NO: 50771

SEQ ID NO: 331805 - RNA, 64 nt, Homo Sapiens; identical to SEQ ID NO: 50772

SEQ ID NO: 331806 - RNA, 64 nt, Homo Sapiens; identical to SEQ ID NO: 50773

SEQ ID NO: 331807 - RNA, 64 nt, Homo Sapiens; identical to SEQ ID NO: 50774

SEQ ID NO: 331808 - RNA, 64 nt, Homo Sapiens; identical to SEQ ID NO: 50775

SEQ ID NO: 331809 - RNA, 64 nt, Homo Sapiens; identical to SEQ ID NO: 50776

SEQ ID NO: 331810 - RNA, 64 nt, Homo Sapiens; identical to SEQ ID NO: 50777

SEQ ID NO: 331811 - RNA, 64 nt, Homo Sapiens; identical to SEQ ID NO: 50778

SEQ ID NO: 331812 - RNA, 64 nt, Homo Sapiens; identical to SEQ ID NO: 50779

SEQ ID NO: 331813 - RNA, 64 nt, Homo Sapiens; identical to SEQ ID NO: 50780

SEQ ID NO: 331814 - RNA, 64 nt, Homo Sapiens; identical to SEQ ID NO: 50781

SEQ ID NO: 331815 - RNA, 64 nt, Homo Sapiens; identical to SEQ ID NO: 50782

SEQ ID NO: 331816 - RNA, 64 nt, Homo Sapiens; identical to SEQ ID NO: 50783

SEQ ID NO: 331817 - RNA, 64 nt, Homo Sapiens; identical to SEQ ID NO: 50784

SEQ ID NO: 331818 - RNA, 64 nt, Homo Sapiens; identical to SEQ ID NO: 50785

SEQ ID NO: 331819 - RNA, 64 nt, Homo Sapiens; identical to SEQ ID NO: 50786

SEQ ID NO: 331820 - RNA, 64 nt, Homo Sapiens; identical to SEQ ID NO: 50787

SEQ ID NO: 331821 - RNA, 64 nt, Homo Sapiens; identical to SEQ ID NO: 50788

SEQ ID NO: 331822 - RNA, 64 nt, Homo Sapiens; identical to SEQ ID NO: 50789

SEQ ID NO: 331823 - RNA, 64 nt, Homo Sapiens; identical to SEQ ID NO: 50790

SEQ ID NO: 331824 - RNA, 64 nt, Homo Sapiens; identical to SEQ ID NO: 50791

SEQ ID NO: 331825 - RNA, 64 nt, Homo Sapiens; identical to SEQ ID NO: 50792

SEQ ID NO: 331826 - RNA, 64 nt, Homo Sapiens; identical to SEQ ID NO: 50793

SEQ ID NO: 331827 - RNA, 64 nt, Homo Sapiens; identical to SEQ ID NO: 50794

SEQ ID NO: 331828 - RNA, 64 nt, Homo Sapiens; identical to SEQ ID NO: 50795

SEQ ID NO: 331829 - RNA, 64 nt, Homo Sapiens; identical to SEQ ID NO: 50796

SEQ ID NO: 331830 - RNA, 64 nt, Homo Sapiens; identical to SEQ ID NO: 50797

SEQ ID NO: 331831 - RNA, 64 nt, Homo Sapiens; identical to SEQ ID NO: 50798

SEQ ID NO: 331832 - RNA, 64 nt, Homo Sapiens; identical to SEQ ID NO: 50799

SEQ ID NO: 331833 - RNA, 64 nt, Homo Sapiens; identical to SEQ ID NO: 50800

SEQ ID NO: 331834 - RNA, 64 nt, Homo Sapiens; identical to SEQ ID NO: 50801

SEQ ID NO: 331835 - RNA, 64 nt, Homo Sapiens; identical to SEQ ID NO: 50802

SEQ ID NO: 331836 - RNA, 64 nt, Homo Sapiens; identical to SEQ ID NO: 50803

SEQ ID NO: 331837 - RNA, 64 nt, Homo Sapiens; identical to SEQ ID NO: 50804

SEQ ID NO: 331838 - RNA, 64 nt, Homo Sapiens; identical to SEQ ID NO: 50805

SEQ ID NO: 331839 - RNA, 64 nt, Homo Sapiens; identical to SEQ ID NO: 50806

SEQ ID NO: 331840 - RNA, 64 nt, Homo Sapiens; identical to SEQ ID NO: 50807

SEQ ID NO: 331841 - RNA, 64 nt, Homo Sapiens; identical to SEQ ID NO: 50808

SEQ ID NO: 331842 - RNA, 64 nt, Homo Sapiens; identical to SEQ ID NO: 50809

SEQ ID NO: 331843 - RNA, 64 nt, Homo Sapiens; identical to SEQ ID NO: 50810

SEQ ID NO: 331844 - RNA, 64 nt, Homo Sapiens; identical to SEQ ID NO: 50811

SEQ ID NO: 331845 - RNA, 64 nt, Homo Sapiens; identical to SEQ ID NO: 50812

SEQ ID NO: 331846 - RNA, 64 nt, Homo Sapiens; identical to SEQ ID NO: 50813

SEQ ID NO: 331847 - RNA, 64 nt, Homo Sapiens; identical to SEQ ID NO: 50814

SEQ ID NO: 331848 - RNA, 64 nt, Homo Sapiens; identical to SEQ ID NO: 50815

SEQ ID NO: 331849 - RNA, 64 nt, Homo Sapiens; identical to SEQ ID NO: 50816

SEQ ID NO: 331850 - RNA, 64 nt, Homo Sapiens; identical to SEQ ID NO: 50817

SEQ ID NO: 331851 - RNA, 64 nt, Homo Sapiens; identical to SEQ ID NO: 50818

SEQ ID NO: 331852 - RNA, 64 nt, Homo Sapiens; identical to SEQ ID NO: 50819

SEQ ID NO: 331853 - RNA, 64 nt, Homo Sapiens; identical to SEQ ID NO: 50820

SEQ ID NO: 331854 - RNA, 64 nt, Homo Sapiens; identical to SEQ ID NO: 50821

SEQ ID NO: 331855 - RNA, 64 nt, Homo Sapiens; identical to SEQ ID NO: 50822

SEQ ID NO: 331856 - RNA, 64 nt, Homo Sapiens; identical to SEQ ID NO: 50823

SEQ ID NO: 331857 - RNA, 64 nt, Homo Sapiens; identical to SEQ ID NO: 50824

SEQ ID NO: 331858 - RNA, 64 nt, Homo Sapiens; identical to SEQ ID NO: 50825

SEQ ID NO: 331859 - RNA, 64 nt, Homo Sapiens; identical to SEQ ID NO: 50826

SEQ ID NO: 331860 - RNA, 64 nt, Homo Sapiens; identical to SEQ ID NO: 50827

SEQ ID NO: 331861 - RNA, 64 nt, Homo Sapiens; identical to SEQ ID NO: 50828

SEQ ID NO: 331862 - RNA, 64 nt, Homo Sapiens; identical to SEQ ID NO: 50829

SEQ ID NO: 331863 - RNA, 64 nt, Homo Sapiens; identical to SEQ ID NO: 50830

SEQ ID NO: 331864 - RNA, 64 nt, Homo Sapiens; identical to SEQ ID NO: 50831

SEQ ID NO: 331865 - RNA, 64 nt, Homo Sapiens; identical to SEQ ID NO: 50832

SEQ ID NO: 331866 - RNA, 64 nt, Homo Sapiens; identical to SEQ ID NO: 50833

SEQ ID NO: 331867 - RNA, 64 nt, Homo Sapiens; identical to SEQ ID NO: 50834

SEQ ID NO: 331868 - RNA, 64 nt, Homo Sapiens; identical to SEQ ID NO: 50835

SEQ ID NO: 331869 - RNA, 64 nt, Homo Sapiens; identical to SEQ ID NO: 50836

SEQ ID NO: 331870 - RNA, 64 nt, Homo Sapiens; identical to SEQ ID NO: 50837

SEQ ID NO: 331871 - RNA, 64 nt, Homo Sapiens; identical to SEQ ID NO: 50838

SEQ ID NO: 331872 - RNA, 64 nt, Homo Sapiens; identical to SEQ ID NO: 50839

SEQ ID NO: 331873 - RNA, 64 nt, Homo Sapiens; identical to SEQ ID NO: 50840

SEQ ID NO: 331874 - RNA, 64 nt, Homo Sapiens; identical to SEQ ID NO: 50841

SEQ ID NO: 331875 - RNA, 64 nt, Homo Sapiens; identical to SEQ ID NO: 50842

SEQ ID NO: 331876 - RNA, 64 nt, Homo Sapiens; identical to SEQ ID NO: 50843

SEQ ID NO: 331877 - RNA, 64 nt, Homo Sapiens; identical to SEQ ID NO: 50844

SEQ ID NO: 331878 - RNA, 64 nt, Homo Sapiens; identical to SEQ ID NO: 50845

SEQ ID NO: 331879 - RNA, 64 nt, Homo Sapiens
auugacuuuuaggagccguucuccccacaagacaccacaugacaagggguauaagccccagccc

SEQ ID NO: 331880 - RNA, 64 nt, Homo Sapiens
uauuuuaauuugagaaauaaagauuuccuccaagccacaugaggacucuggcacccacccacaa

SEQ ID NO: 331881 - RNA, 64 nt, Homo Sapiens
cuauuuaaguaaauuuaguucaaugagccacuagccacaugaggacgucuacaacuacaauguc

SEQ ID NO: 331882 - RNA, 64 nt, Homo Sapiens
cgaaaacacucaucacaauuucucuuuuuauugaccacaugaaucaaaguuccagcuuguguag

SEQ ID NO: 331883 - RNA, 64 nt, Homo Sapiens
aacuauuugaccaugauaauucaguuuauauucaccacaugaaagaaaaauggguaacagaaga

SEQ ID NO: 331884 - RNA, 64 nt, Homo Sapiens
gaauagaugauaacaauuaauauuacuaaaagucccacaugagaguccugacgcccucuccaug

SEQ ID NO: 331885 - RNA, 64 nt, Homo Sapiens
uuagcccugaagcagggcugagggcggggauagcaugcccaauuuguuucccucauggccgacc

SEQ ID NO: 331886 - RNA, 64 nt, Homo Sapiens
gggcuccucugcaaugacuggcuucccccaucugaugcccaagaggccccuuccccuuuauggg

SEQ ID NO: 331887 - RNA, 64 nt, Homo Sapiens
acacacacucucucucucucucaaacacacacaaaugcccaaccagcucuaagagggcacugaa

SEQ ID NO: 331888 - RNA, 64 nt, Homo Sapiens
uuccaggauccccugcagaugccaaaauacauggaugcccaaguccucagcuaaaaauagcgua

SEQ ID NO: 331889 - RNA, 64 nt, Homo Sapiens
cauuucugcuaauagggagacauaaaccuggcucaugcccaacagugcaggacacaauccaaau

SEQ ID NO: 331890 - RNA, 64 nt, Homo Sapiens
cauuugcaccuuuaccucucaguagggagucaacaugcccaaguugaggggcccugccuuccuc

SEQ ID NO: 331891 - RNA, 64 nt, Homo Sapiens
ugaagaugccuuccuuugggaugggagggugaagaugcccaagcgggcaagggcuggggcuggg

SEQ ID NO: 331892 - RNA, 64 nt, Homo Sapiens
uagggagggcagaguccccaugcccaagaugaccaugcccaagcgauggaauuuggcuucaaga

SEQ ID NO: 331893 - RNA, 64 nt, Homo Sapiens
ugaccaugcccaagcuagggaauuuggcuucaagaugcccaagaagaacaggcagaagggaugg

SEQ ID NO: 331894 - RNA, 63 nt, Homo Sapiens; identical to SEQ ID NO: 57603

SEQ ID NO: 331895 - RNA, 64 nt, Homo Sapiens; identical to SEQ ID NO: 57604

SEQ ID NO: 331896 - RNA, 64 nt, Homo Sapiens; identical to SEQ ID NO: 57605

SEQ ID NO: 331897 - RNA, 64 nt, Homo Sapiens; identical to SEQ ID NO: 57606

SEQ ID NO: 331898 - RNA, 64 nt, Homo Sapiens; identical to SEQ ID NO: 57607

SEQ ID NO: 331899 - RNA, 64 nt, Homo Sapiens; identical to SEQ ID NO: 57608

SEQ ID NO: 331900 - RNA, 64 nt, Homo Sapiens; identical to SEQ ID NO: 57609

SEQ ID NO: 331901 - RNA, 64 nt, Homo Sapiens; identical to SEQ ID NO: 57610

SEQ ID NO: 331902 - RNA, 64 nt, Homo Sapiens; identical to SEQ ID NO: 57611

SEQ ID NO: 331903 - RNA, 64 nt, Homo Sapiens; identical to SEQ ID NO: 57612

SEQ ID NO: 331904 - RNA, 64 nt, Homo Sapiens; identical to SEQ ID NO: 57613

SEQ ID NO: 331905 - RNA, 64 nt, Homo Sapiens; identical to SEQ ID NO: 57614

SEQ ID NO: 331906 - RNA, 64 nt, Homo Sapiens; identical to SEQ ID NO: 97744

SEQ ID NO: 331907 - RNA, 64 nt, Homo Sapiens; identical to SEQ ID NO: 97745

SEQ ID NO: 331908 - RNA, 64 nt, Homo Sapiens; identical to SEQ ID NO: 97746

SEQ ID NO: 331909 - RNA, 64 nt, Homo Sapiens; identical to SEQ ID NO: 97747

SEQ ID NO: 331910 - RNA, 64 nt, Homo Sapiens; identical to SEQ ID NO: 97748

SEQ ID NO: 331911 - RNA, 64 nt, Homo Sapiens; identical to SEQ ID NO: 97749

SEQ ID NO: 331912 - RNA, 64 nt, Homo Sapiens; identical to SEQ ID NO: 97750

SEQ ID NO: 331913 - RNA, 64 nt, Homo Sapiens; identical to SEQ ID NO: 97751

SEQ ID NO: 331914 - RNA, 64 nt, Homo Sapiens; identical to SEQ ID NO: 97752

SEQ ID NO: 331915 - RNA, 64 nt, Homo Sapiens; identical to SEQ ID NO: 97753

SEQ ID NO: 331916 - RNA, 64 nt, Homo Sapiens; identical to SEQ ID NO: 97754

SEQ ID NO: 331917 - RNA, 64 nt, Homo Sapiens; identical to SEQ ID NO: 97755

SEQ ID NO: 331918 - RNA, 64 nt, Homo Sapiens; identical to SEQ ID NO: 97756

SEQ ID NO: 331919 - RNA, 64 nt, Homo Sapiens; identical to SEQ ID NO: 97757

SEQ ID NO: 331920 - RNA, 64 nt, Homo Sapiens; identical to SEQ ID NO: 97758

SEQ ID NO: 331921 - RNA, 64 nt, Homo Sapiens; identical to SEQ ID NO: 97759

SEQ ID NO: 331922 - RNA, 64 nt, Homo Sapiens; identical to SEQ ID NO: 97760

SEQ ID NO: 331923 - RNA, 64 nt, Homo Sapiens; identical to SEQ ID NO: 97761

SEQ ID NO: 331924 - RNA, 64 nt, Homo Sapiens; identical to SEQ ID NO: 97762

SEQ ID NO: 331925 - RNA, 64 nt, Homo Sapiens; identical to SEQ ID NO: 97763

SEQ ID NO: 331926 - RNA, 64 nt, Homo Sapiens; identical to SEQ ID NO: 97764

SEQ ID NO: 331927 - RNA, 64 nt, Homo Sapiens; identical to SEQ ID NO: 97765

SEQ ID NO: 331928 - RNA, 64 nt, Homo Sapiens; identical to SEQ ID NO: 97766

SEQ ID NO: 331929 - RNA, 64 nt, Homo Sapiens; identical to SEQ ID NO: 97767

SEQ ID NO: 331930 - RNA, 64 nt, Homo Sapiens; identical to SEQ ID NO: 97768

SEQ ID NO: 331931 - RNA, 64 nt, Homo Sapiens; identical to SEQ ID NO: 97769

SEQ ID NO: 331932 - RNA, 64 nt, Homo Sapiens; identical to SEQ ID NO: 97770

SEQ ID NO: 331933 - RNA, 64 nt, Homo Sapiens; identical to SEQ ID NO: 97771

SEQ ID NO: 331934 - RNA, 64 nt, Homo Sapiens; identical to SEQ ID NO: 97772

SEQ ID NO: 331935 - RNA, 64 nt, Homo Sapiens; identical to SEQ ID NO: 97773

SEQ ID NO: 331936 - RNA, 64 nt, Homo Sapiens; identical to SEQ ID NO: 97774

SEQ ID NO: 331937 - RNA, 64 nt, Homo Sapiens; identical to SEQ ID NO: 97775

SEQ ID NO: 331938 - RNA, 64 nt, Homo Sapiens; identical to SEQ ID NO: 97776

SEQ ID NO: 331939 - RNA, 64 nt, Homo Sapiens; identical to SEQ ID NO: 97777

SEQ ID NO: 331940 - RNA, 64 nt, Homo Sapiens; identical to SEQ ID NO: 97778

SEQ ID NO: 331941 - RNA, 64 nt, Homo Sapiens; identical to SEQ ID NO: 97779

SEQ ID NO: 331942 - RNA, 64 nt, Homo Sapiens; identical to SEQ ID NO: 97780

SEQ ID NO: 331943 - RNA, 64 nt, Homo Sapiens; identical to SEQ ID NO: 97781

SEQ ID NO: 331944 - RNA, 64 nt, Homo Sapiens; identical to SEQ ID NO: 97782

SEQ ID NO: 331945 - RNA, 64 nt, Homo Sapiens; identical to SEQ ID NO: 97783

SEQ ID NO: 331946 - RNA, 64 nt, Homo Sapiens; identical to SEQ ID NO: 97784

SEQ ID NO: 331947 - RNA, 64 nt, Homo Sapiens; identical to SEQ ID NO: 97785

SEQ ID NO: 331948 - RNA, 64 nt, Homo Sapiens
acaauucuuuugucaaaaaguguguauauauguuugcaucuacauauauuuguacaucuauaug

SEQ ID NO: 331949 - RNA, 64 nt, Homo Sapiens
gaacagaccuaacuagugaauguauuaaugaaaaugcaucuauuucagagcugacaugaagagu

SEQ ID NO: 331950 - RNA, 64 nt, Homo Sapiens
augucaaagugcuuacagugcagguagugauaugugcaucuacugcagugaaggcacuuguagc

SEQ ID NO: 331951 - RNA, 64 nt, Homo Sapiens
ggccugcugauguugagugcuuuuuguucuaaggugcaucuagugcagauagugaaguagauua

SEQ ID NO: 331952 - RNA, 64 nt, Homo Sapiens
ccaaggggcacucaguacacucagggucaggcccugcaucuauuagcccugugucuuuccauag

SEQ ID NO: 331953 - RNA, 64 nt, Homo Sapiens
guuuaagaagcuucugcuguccuuccguguaaccugcaucuagacccugaguuaacccguaagg

SEQ ID NO: 331954 - RNA, 64 nt, Homo Sapiens
caaaaagucuugguuuuaucaaacaaacaaaacuugcaucuaaccaaaacaaaacaaaacaaac

SEQ ID NO: 331955 - RNA, 64 nt, Homo Sapiens
cugggcguggcggcucacgccuuauaaaauaacuugcaucuagggauaacgaagugcacuuaca

SEQ ID NO: 331956 - RNA, 64 nt, Homo Sapiens; identical to SEQ ID NO: 221340

SEQ ID NO: 331957 - RNA, 64 nt, Homo Sapiens; identical to SEQ ID NO: 221341

SEQ ID NO: 331958 - RNA, 64 nt, Homo Sapiens; identical to SEQ ID NO: 221342

SEQ ID NO: 331959 - RNA, 64 nt, Homo Sapiens; identical to SEQ ID NO: 221343

SEQ ID NO: 331960 - RNA, 64 nt, Homo Sapiens; identical to SEQ ID NO: 221344

SEQ ID NO: 331961 - RNA, 64 nt, Homo Sapiens; identical to SEQ ID NO: 221345

SEQ ID NO: 331962 - RNA, 64 nt, Homo Sapiens; identical to SEQ ID NO: 221346

SEQ ID NO: 331963 - RNA, 64 nt, Homo Sapiens; identical to SEQ ID NO: 221347

SEQ ID NO: 331964 - RNA, 64 nt, Homo Sapiens; identical to SEQ ID NO: 221348

SEQ ID NO: 331965 - RNA, 64 nt, Homo Sapiens; identical to SEQ ID NO: 221349

SEQ ID NO: 331966 - RNA, 64 nt, Homo Sapiens; identical to SEQ ID NO: 221350

SEQ ID NO: 331967 - RNA, 64 nt, Homo Sapiens; identical to SEQ ID NO: 221351

SEQ ID NO: 331968 - RNA, 64 nt, Homo Sapiens; identical to SEQ ID NO: 221352

SEQ ID NO: 331969 - RNA, 64 nt, Homo Sapiens; identical to SEQ ID NO: 221353

SEQ ID NO: 331970 - RNA, 64 nt, Homo Sapiens; identical to SEQ ID NO: 221354

SEQ ID NO: 331971 - RNA, 64 nt, Homo Sapiens; identical to SEQ ID NO: 221355

SEQ ID NO: 331972 - RNA, 64 nt, Homo Sapiens; identical to SEQ ID NO: 221356

SEQ ID NO: 331973 - RNA, 64 nt, Homo Sapiens; identical to SEQ ID NO: 221357

SEQ ID NO: 331974 - RNA, 64 nt, Homo Sapiens; identical to SEQ ID NO: 221358

SEQ ID NO: 331975 - RNA, 64 nt, Homo Sapiens; identical to SEQ ID NO: 221359

SEQ ID NO: 331976 - RNA, 64 nt, Homo Sapiens; identical to SEQ ID NO: 221360

SEQ ID NO: 331977 - RNA, 64 nt, Homo Sapiens; identical to SEQ ID NO: 221361

SEQ ID NO: 331978 - RNA, 64 nt, Homo Sapiens; identical to SEQ ID NO: 221362

SEQ ID NO: 331979 - RNA, 64 nt, Homo Sapiens; identical to SEQ ID NO: 221363

SEQ ID NO: 331980 - RNA, 64 nt, Homo Sapiens; identical to SEQ ID NO: 221364

SEQ ID NO: 331981 - RNA, 64 nt, Homo Sapiens; identical to SEQ ID NO: 221365

SEQ ID NO: 331982 - RNA, 64 nt, Homo Sapiens; identical to SEQ ID NO: 221366

SEQ ID NO: 331983 - RNA, 64 nt, Homo Sapiens; identical to SEQ ID NO: 221367

SEQ ID NO: 331984 - RNA, 64 nt, Homo Sapiens; identical to SEQ ID NO: 221368

SEQ ID NO: 331985 - RNA, 64 nt, Homo Sapiens; identical to SEQ ID NO: 221369

SEQ ID NO: 331986 - RNA, 64 nt, Homo Sapiens; identical to SEQ ID NO: 221370

SEQ ID NO: 331987 - RNA, 64 nt, Homo Sapiens; identical to SEQ ID NO: 221371

SEQ ID NO: 331988 - RNA, 64 nt, Homo Sapiens; identical to SEQ ID NO: 221372

SEQ ID NO: 331989 - RNA, 64 nt, Homo Sapiens; identical to SEQ ID NO: 221373

SEQ ID NO: 331990 - RNA, 64 nt, Homo Sapiens; identical to SEQ ID NO: 221374

SEQ ID NO: 331991 - RNA, 64 nt, Homo Sapiens; identical to SEQ ID NO: 221375

SEQ ID NO: 331992 - RNA, 64 nt, Homo Sapiens; identical to SEQ ID NO: 221376

SEQ ID NO: 331993 - RNA, 64 nt, Homo Sapiens; identical to SEQ ID NO: 221377

SEQ ID NO: 331994 - RNA, 64 nt, Homo Sapiens; identical to SEQ ID NO: 221378

SEQ ID NO: 331995 - RNA, 64 nt, Homo Sapiens; identical to SEQ ID NO: 221379

SEQ ID NO: 331996 - RNA, 64 nt, Homo Sapiens; identical to SEQ ID NO: 221380

SEQ ID NO: 331997 - RNA, 64 nt, Homo Sapiens; identical to SEQ ID NO: 221381

SEQ ID NO: 331998 - RNA, 64 nt, Homo Sapiens; identical to SEQ ID NO: 221382

SEQ ID NO: 331999 - RNA, 64 nt, Homo Sapiens; identical to SEQ ID NO: 221383

SEQ ID NO: 332000 - RNA, 64 nt, Homo Sapiens; identical to SEQ ID NO: 221384

SEQ ID NO: 332001 - RNA, 64 nt, Homo Sapiens; identical to SEQ ID NO: 221385

SEQ ID NO: 332002 - RNA, 64 nt, Homo Sapiens; identical to SEQ ID NO: 221386

SEQ ID NO: 332003 - RNA, 64 nt, Homo Sapiens; identical to SEQ ID NO: 221387

SEQ ID NO: 332004 - RNA, 64 nt, Homo Sapiens
uggaacuuugccccguuuccucaccuguucauuccucgguuagcggccagagacugagcucugg

SEQ ID NO: 332005 - RNA, 64 nt, Homo Sapiens
cugugcuucagaugauuauaauggaauuuugcuucucgguuaucaauuggguguuuguaccaga

SEQ ID NO: 332006 - RNA, 64 nt, Homo Sapiens
aaaagccagugccuauugagcacaaaaaaagccacaucacaaaaaauaguguggaaagccacau

SEQ ID NO: 332007 - RNA, 64 nt, Homo Sapiens
aaagccacaucacaaaaaaaaguguggaaagccacaucacaaaaggauucuggacuucuacaau

SEQ ID NO: 332008 - RNA, 64 nt, Homo Sapiens
ccauuauucagagcgcguaugaauugguguaagacaucacaauccagcuggccgcccaguuuga

SEQ ID NO: 332009 - RNA, 64 nt, Homo Sapiens; identical to SEQ ID NO: 332008

SEQ ID NO: 332010 - RNA, 64 nt, Homo Sapiens
accaacccacuggcacauuuuucucuuguuuucucucuccgauuuugcucugucuccucaguua

SEQ ID NO: 332011 - RNA, 64 nt, Homo Sapiens
ugaaagaaaagcagugauaccugaauaaugcuggcucuccgauugauccugugaggaugaauuu

SEQ ID NO: 332012 - RNA, 64 nt, Homo Sapiens
ucuggugcuuuaguuaggucggcuucccuggaagcucuccgagcaaauuugcgccucgguaucu

SEQ ID NO: 332013 - RNA, 64 nt, Homo Sapiens
caugugagcccccugaugccaggccacucggcaccucuccgagccucagccagggcugccagcc

SEQ ID NO: 332014 - RNA, 64 nt, Homo Sapiens
uugagugguuacagucuagggcagugguucccaacucuccgaucagaaucaucugggaagcauu

SEQ ID NO: 332015 - RNA, 64 nt, Homo Sapiens
uuuuaccgccagugugcugucguucccccucccccucuccgaguccucguggggacacggcggg

SEQ ID NO: 332016 - RNA, 64 nt, Homo Sapiens
ccuacagcuuuguaauuuuuuggcaagucuagaacucuccgaauuuguucugccugaacauuaa

SEQ ID NO: 332017 - RNA, 64 nt, Homo Sapiens
gggagguaggaguggaagagaggugugaagaaaccucuccgaacaaaugaaccagcaguaaguu

SEQ ID NO: 332018 - RNA, 64 nt, Homo Sapiens
ugcuccaguuucaccucuuugcucccugaguucacucuccgaagucugaucccugccaaaaagu

SEQ ID NO: 332019 - RNA, 64 nt, Homo Sapiens
uccaacuauauccuucccuguaagcagaaagaugcucuccgagguuuauaaucucaaaugcuag

SEQ ID NO: 332020 - RNA, 64 nt, Homo Sapiens
uaggcccggccgagagcgcccaaaccaaguugcccucuccgagcuaggauuucccgaccccgua

SEQ ID NO: 332021 - RNA, 64 nt, Homo Sapiens
ucaaauggaagaaauaccuuagagcuuaccaagucucuccgaacaggaugccucuguagcaggc

SEQ ID NO: 332022 - RNA, 64 nt, Homo Sapiens
uuuuaauccucauucccuauguccacuugccuuccucuccgaggcaacuacucuaaugcauuug

SEQ ID NO: 332023 - RNA, 64 nt, Homo Sapiens
cugcacccgccucgaccuccgucaguggggcagccucuccgacuccgggacugcccucucgacu

SEQ ID NO: 332024 - RNA, 64 nt, Homo Sapiens
aacagacuugaucacgcacacacaauaagucuuucucuccgaaaccggaaguaaaucuauaucu

SEQ ID NO: 332025 - RNA, 64 nt, Homo Sapiens
cagcugggggaccccucagcuccgucucagagugcucuccgagacgcugaagagcuucugccug

SEQ ID NO: 332026 - RNA, 64 nt, Homo Sapiens
uuccugcuuggguggcucccccacaauaaagaugcucuccgaccuuugggggccgggccccucc

SEQ ID NO: 332027 - RNA, 64 nt, Homo Sapiens
gcuucugacggaucuuggugcucaggcugccuggcucuccgagugaggacgcagccuccauauu

SEQ ID NO: 332028 - RNA, 64 nt, Homo Sapiens
ugcuuuuuuuuuuuuuuuuuaggaccucuuuacucucuccgauucaggaagagaagaauccaca

SEQ ID NO: 332029 - RNA, 64 nt, Homo Sapiens
augucuuaacuuuugcuucacuucacagucaggccucuccgaguauuuuuuacacauauccugg

SEQ ID NO: 332030 - RNA, 64 nt, Homo Sapiens
gcccugcgggccuggcuuguauguaaccugcuagcucuccgaaggaagagggccaucugccuga

SEQ ID NO: 332031 - RNA, 64 nt, Homo Sapiens
acucagugccuaucggcaugucgaggugcccguccucuccgacggggguacaaacuccagauga

SEQ ID NO: 332032 - RNA, 64 nt, Homo Sapiens
aggaaagccacguagaguggagggagcccaccaccucuccgaagagggaggggcacagugaaga

SEQ ID NO: 332033 - RNA, 64 nt, Homo Sapiens
uccccacuggccacacuccaggggcaguuccggccucuccgacuagcccucugccagccucuug

SEQ ID NO: 332034 - RNA, 64 nt, Homo Sapiens
ggugacuugagcuugagcucugacaggcaugggccucuccgaccuucaucacuauucuuaggau

SEQ ID NO: 332035 - RNA, 64 nt, Homo Sapiens
ccugaaggaagcccuccuggacugcuucuuuuggcucuccgacaacuccggccaauaaacacuu

SEQ ID NO: 332036 - RNA, 64 nt, Homo Sapiens
cuuggacaccuccucugucugucuuuuuuuuuuucucuccgauccuugggacucagacaccgaa

SEQ ID NO: 332037 - RNA, 64 nt, Homo Sapiens
uagagcuggguauggaugcuucuagucuucccugcucuccgagguugccuauccucuccuggcc

SEQ ID NO: 332038 - RNA, 64 nt, Homo Sapiens
cgcaccccgccccacgggagacgcacccacucaccucuccgaucccgggcggaccgcuggacag

SEQ ID NO: 332039 - RNA, 64 nt, Homo Sapiens
gguugucagccucuguccccccgcguugcucauucucuccgacaccgugccaguggagugggcu

SEQ ID NO: 332040 - RNA, 64 nt, Homo Sapiens
gugccgcucucucugagggggugggggugcugcucucuccgagggguggaaugccgcugucucu

SEQ ID NO: 332041 - RNA, 60 nt, Homo Sapiens
ccuucacaauuccuuagguuccccagcccccucuccgaguaaaagcccggugaccuuuaa

SEQ ID NO: 332042 - RNA, 64 nt, Homo Sapiens
cgcgcugcuguuagacacuccgccauuccugguucucuccgaaccguucuuuguacaguaaaug

SEQ ID NO: 332043 - RNA, 53 nt, Homo Sapiens
ucauccucuccacaaaguagacccucuccgagcccaccagccacagaauauua

SEQ ID NO: 332044 - RNA, 64 nt, Homo Sapiens
caccgggccacagagaaaguacuucuccacccugcucuccgaccagacaccuugacagggcaca

SEQ ID NO: 332045 - RNA, 64 nt, Homo Sapiens
aacccucuguuccuucccugugccuccucccucccucuccgacucacaccacuagccucagggg

SEQ ID NO: 332046 - RNA, 64 nt, Homo Sapiens
ccuccugaaggcauuuccucuaaguauuauggcacucuccgaauacaccauggaaaaaacccug

SEQ ID NO: 332047 - RNA, 64 nt, Homo Sapiens
gaagacacagaaccaacaaaugcugcuacugccccucuccgaaaggagccgaccaauuagucac

SEQ ID NO: 332048 - RNA, 64 nt, Homo Sapiens
cgggcugcauccacagaguuuguguccacacuuucucuccgagcaugugggucucgcugagcag

SEQ ID NO: 332049 - RNA, 64 nt, Homo Sapiens
ggcggguccgcuccucuugucugcggcaucugugcucuccgagagaaaaccaaggugugucaaa

SEQ ID NO: 332050 - RNA, 64 nt, Homo Sapiens
gcaccacccuccccgacacaucagcucagcggcucucuccgagauacaccuucccccaggaccc

SEQ ID NO: 332051 - RNA, 64 nt, Homo Sapiens
uggcagucaguaaccauaggucucuagaucugugcucuccgauguccaacccgcugccuccauu

SEQ ID NO: 332052 - RNA, 64 nt, Homo Sapiens
uaaagucccuuuccuugcucucuugguuugcuggcucuccgaaaaggacauuaguccaccaucu

SEQ ID NO: 332053 - RNA, 64 nt, Homo Sapiens
ucucuccucugaaacccuccuucucaggccucugcucuccgaccucucuccaccugccucuggc

SEQ ID NO: 332054 - RNA, 64 nt, Homo Sapiens
gagaacuuucaggcagauccaagucucauacaagcucuccgauaguaguaaucauuuuauuuug

SEQ ID NO: 332055 - RNA, 64 nt, Homo Sapiens
ggaagaggacuagaaaaggcuuccccugccuauccucuccgaucaccaagguggaagggagcua

SEQ ID NO: 332056 - RNA, 64 nt, Homo Sapiens
cauguccacuuccuuucuccugaaaccuaauaaucucuccgagggagaaagggguucucugcgg

SEQ ID NO: 332057 - RNA, 64 nt, Homo Sapiens
uuggaacacugaauuacagagcuuuuuucuguugcucuccgagacuggggggggauuguuucuu

SEQ ID NO: 332058 - RNA, 64 nt, Homo Sapiens
gaggccucacugaagagcugcuuucgagacccggcucuccgaaccgugccccugauucauaccg

SEQ ID NO: 332059 - RNA, 64 nt, Homo Sapiens
agcaaccagacgggagauuugcauuucuuggagccucuccgagcuuuccaggcggguuuguuuu

SEQ ID NO: 332060 - RNA, 64 nt, Homo Sapiens
uccucaauucucccccacccgcucgccuaccugccucuccgagccgccgcgacucugggguggu

SEQ ID NO: 332061 - RNA, 64 nt, Homo Sapiens
uggcccaugugcuggaagaugacacaguugccuucucuccgaggaaccugcccccucuccuuuc

SEQ ID NO: 332062 - RNA, 64 nt, Homo Sapiens
cagccuauaucaaacaugcacacgggcgagcuuucucuccgacuuccccugggcaagagauggg

SEQ ID NO: 332063 - RNA, 64 nt, Homo Sapiens
ccccuggaccuguuuccuugggggcuuucucucucucuccgaaguaagccaccuccagggucca

SEQ ID NO: 332064 - RNA, 64 nt, Homo Sapiens
gaagaugcuggaagugcugguggugaagcucccucucuccgagcacugggcccugccuggggua

SEQ ID NO: 332065 - RNA, 64 nt, Homo Sapiens
ugggccauuuaugcaccccgccugcuauagcacacucuccgauuguguuagcgaaaccugucua

SEQ ID NO: 332066 - RNA, 64 nt, Homo Sapiens
gacccagccggcggcugaccacaggcaccccggccucuccgagacggccuccugccugcgcagc

SEQ ID NO: 332067 - RNA, 64 nt, Homo Sapiens
ugaaaaauacccuucugaacaaaacauguacuuacucuccgaaaggcaucuaucugugcuauug

SEQ ID NO: 332068 - RNA, 64 nt, Homo Sapiens
cucgcuucugagcuugguggccuguucccuccaucucuccgaaccuggcuucgccugucccuuu

SEQ ID NO: 332069 - RNA, 64 nt, Homo Sapiens
uagacagauuuguucauagacccucucaagugcccucuccgagcugguaggcauuccagcuccu

SEQ ID NO: 332070 - RNA, 64 nt, Homo Sapiens
guuuucuuaagaccugucgucaaacuuaaaagguuuugcagagggcaguaucaaaagaaagugg

SEQ ID NO: 332071 - RNA, 64 nt, Homo Sapiens
cuacagcagaggccaugcaguauuauauauucauuuugcagaaucugcaccuacagcucaauac

SEQ ID NO: 332072 - RNA, 64 nt, Homo Sapiens
uuucuggaaauacugucuucuguuuccuuuugccuuugcagaaugugcuuuagccuuugucuga

SEQ ID NO: 332073 - RNA, 64 nt, Homo Sapiens
aucugcauaugagugauaugugaucaugauucauuuugcagauuuacauuuugcuuguguggaa

SEQ ID NO: 332074 - RNA, 64 nt, Homo Sapiens
uagauuagcuggugaagaaauuuggcaaaacauauuugcagauguuaaaggggucuaaaaagau

SEQ ID NO: 332075 - RNA, 64 nt, Homo Sapiens
auugucuaggauuucagcaacccaucauggccccuuugcagaaaggagcucuuuugcuuggauu

SEQ ID NO: 332076 - RNA, 64 nt, Homo Sapiens
agacgaaggcagagugguguaguuugcagauguauuugcagagauuggccagaaaugaagaaga

SEQ ID NO: 332077 - RNA, 64 nt, Homo Sapiens
uauuugcagagaagacgaagaaaugaagaagaaguuugcagauggagcauggaugauuggccag

SEQ ID NO: 332078 - RNA, 64 nt, Homo Sapiens
acccaagagcgagcaaacauggcucugcuauuuguuugcagaacgaacaggcuuuuuugcuuug

SEQ ID NO: 332079 - RNA, 64 nt, Homo Sapiens
cauuugugcccggcguuugguuuacuuccaucuguuugcagacagcauuugggccagugcacug

SEQ ID NO: 332080 - RNA, 64 nt, Homo Sapiens
uuacccaaccuuggucauaagugugccuggcugguuugcagauauuuguucugcuuuguaaaaa

SEQ ID NO: 332081 - RNA, 64 nt, Homo Sapiens
ugacccgacucucagauggggucagucccgucgcuuugcagacugacccuggaaaucuacaaaa

SEQ ID NO: 332082 - RNA, 64 nt, Homo Sapiens
caauuaucuugccuuauccaggaauaauugccccuuugcagagaaaaaaaaaaacuuaaaaaaa

SEQ ID NO: 332083 - RNA, 64 nt, Homo Sapiens
uaguccucuacugcuaaauaaguuaauuuugcauuuugcagaaagaaacauugauugcuaaauc

SEQ ID NO: 332084 - RNA, 64 nt, Homo Sapiens
caggcagacuggcuaaggaccagcccagggcaauuuugcagaaaugaucauuugcacagaaugg

SEQ ID NO: 332085 - RNA, 64 nt, Homo Sapiens
aagaaaaggcccacuuuuuaaaaagugaaacaaguuugcagauacgguucucuuccuggacucc

SEQ ID NO: 332086 - RNA, 64 nt, Homo Sapiens
auuggaaaauauuugacccccuuggcugaauucuuuugcagaacuacugugugucuguucacua

SEQ ID NO: 332087 - RNA, 64 nt, Homo Sapiens
uuuauuuuugcaugaauuaagacguuuuaauuucuuugcagacaaggucuagaugcggagucag

SEQ ID NO: 332088 - RNA, 64 nt, Homo Sapiens
uaauuaguuaaguuaaggugagcuuaccagggucuuugcagaugcccagguacccaugaaugug

SEQ ID NO: 332089 - RNA, 64 nt, Homo Sapiens
cuuauucaguucuuacacauggaauauuccacuauuugcagagguccuccgugaaaauauguuu

SEQ ID NO: 332090 - RNA, 64 nt, Homo Sapiens
aguauaauuuuucuauuuuuguuuuugguuuuaauuugcagagauuugcugccaggaaucaauu

SEQ ID NO: 332091 - RNA, 64 nt, Homo Sapiens
auaaagguuuguuguaguugucuuaugugcugaauuugcagaugaucagaugcugugcagaauu

SEQ ID NO: 332092 - RNA, 64 nt, Homo Sapiens
cucaguugccaguucccauuaucgauacucuuucuuugcagaauaccuuagaaccguuauuucc

SEQ ID NO: 332093 - RNA, 64 nt, Homo Sapiens
gacaaauagugucuacuaucucaacccuccaaaauuugcagaguguugggacugucauuuguga

SEQ ID NO: 332094 - RNA, 64 nt, Homo Sapiens
guuucauaugcagauuuuauucucaccugggccauuugcagaugagacuguaguuugcagauga

SEQ ID NO: 332095 - RNA, 64 nt, Homo Sapiens
uucucaccugggccauuugcagaugagacuguaguuugcagaugagacuguaguuugcagaugg

SEQ ID NO: 332096 - RNA, 64 nt, Homo Sapiens
cagaugagacuguaguuugcagaugagacuguaguuugcagauggcguggaagcauucaucagg

SEQ ID NO: 332097 - RNA, 64 nt, Homo Sapiens
cguuaucauacuccauuuaccuuacagaauuuacuuugcagaagcuguaaaaccugcccaggaa

SEQ ID NO: 332098 - RNA, 64 nt, Homo Sapiens
cauaauuuagcaaccauuuauuuaugggauuacuuuugcagaauaaaauuuaccuagaugucua

SEQ ID NO: 332099 - RNA, 64 nt, Homo Sapiens
gugcauggcauguuuuguuacagguuguagaguauuugcagaaggaaaccauuucugguuauuu

SEQ ID NO: 332100 - RNA, 64 nt, Homo Sapiens
aaaugaaguaucuuguacauauaaauuuauuucuuuugcagagcauuauauuacuggauguuua

SEQ ID NO: 332101 - RNA, 64 nt, Homo Sapiens
gugaaaugaaguacccuuuuguaaauagcauuuuuuugcagaaggugaaaauuccacucucuac

SEQ ID NO: 332102 - RNA, 64 nt, Homo Sapiens
gugucugcaagauaaauuagaucgcccugugggguuugcagaauuagugaaggguccaggacga

SEQ ID NO: 332103 - RNA, 64 nt, Homo Sapiens
uccaaaugauauucaugauggaauguauauagucuuugcagaggcugagcguguacguuaaugu

SEQ ID NO: 332104 - RNA, 64 nt, Homo Sapiens
aaacaaaaaaacuacaaacacuuucuuccaaacuuuugcagaaagccccaccgcagcuacuccc

SEQ ID NO: 332105 - RNA, 64 nt, Homo Sapiens
gauccaacaaagaagccaugaccaguuaaagauauuugcagaguuacaccuuggucauaagucc

SEQ ID NO: 332106 - RNA, 64 nt, Homo Sapiens
ccacaggugcgugucaccaugcuuggcuaauuuuuuugcagaaacgaggccucacuauauuguc

SEQ ID NO: 332107 - RNA, 64 nt, Homo Sapiens
guccacgcugcuuucuucccaaaggacauguauauuugcagagcuccacauacagaaacacauu

SEQ ID NO: 332108 - RNA, 64 nt, Homo Sapiens
uauuugcagagcuccacauacagaaacacauuauuuugcagaaauagguguuuuuaagaaguuu

SEQ ID NO: 332109 - RNA, 64 nt, Homo Sapiens
caccuccaggaacugucauggauguccaaauggcuuugcagaaaggaaaugagaugacaguauu

SEQ ID NO: 332110 - RNA, 64 nt, Homo Sapiens
caguuacauguaugccugcccaguucccuuuuuauuugcagaagcugugaguuuuguucacaau

SEQ ID NO: 332111 - RNA, 64 nt, Homo Sapiens
gagacccagagugcacgugaugaggcagggcagguuugcagagagcaguugcauauucccagac

SEQ ID NO: 332112 - RNA, 64 nt, Homo Sapiens
aucuaguugagaugaggucaugggaaauagagucuuugcagauguaccuucaaugugaccuaau

SEQ ID NO: 332113 - RNA, 64 nt, Homo Sapiens
auggaggucaaaaaccacucaggguuuaggccacuuugcagaggccaggagugggcaccccaua

SEQ ID NO: 332114 - RNA, 64 nt, Homo Sapiens
uucaaauuggcuauuccucucuguuuuucuuaaauuugcagaacguagcccacccuccaccccg

SEQ ID NO: 332115 - RNA, 64 nt, Homo Sapiens
ccagaggcauaucgcggcuuccaagcgggaccgcuuugcagagagccugugguggucucccugu

SEQ ID NO: 332116 - RNA, 64 nt, Homo Sapiens
ucaaagaaucugcagagggucacaacgcgcuugguuugcagaugacaaugggacggaauccacc

SEQ ID NO: 332117 - RNA, 64 nt, Homo Sapiens; identical to SEQ ID NO: 246269

SEQ ID NO: 332118 - RNA, 64 nt, Homo Sapiens; identical to SEQ ID NO: 246270

SEQ ID NO: 332119 - RNA, 64 nt, Homo Sapiens; identical to SEQ ID NO: 246271

SEQ ID NO: 332120 - RNA, 64 nt, Homo Sapiens; identical to SEQ ID NO: 246272

SEQ ID NO: 332121 - RNA, 64 nt, Homo Sapiens; identical to SEQ ID NO: 246273

SEQ ID NO: 332122 - RNA, 64 nt, Homo Sapiens; identical to SEQ ID NO: 246274

SEQ ID NO: 332123 - RNA, 64 nt, Homo Sapiens; identical to SEQ ID NO: 246275

SEQ ID NO: 332124 - RNA, 64 nt, Homo Sapiens; identical to SEQ ID NO: 246276

SEQ ID NO: 332125 - RNA, 51 nt, Homo Sapiens; identical to SEQ ID NO: 246277

SEQ ID NO: 332126 - RNA, 64 nt, Homo Sapiens; identical to SEQ ID NO: 246278

SEQ ID NO: 332127 - RNA, 64 nt, Homo Sapiens; identical to SEQ ID NO: 246279

SEQ ID NO: 332128 - RNA, 56 nt, Homo Sapiens; identical to SEQ ID NO: 246280

SEQ ID NO: 332129 - RNA, 64 nt, Homo Sapiens; identical to SEQ ID NO: 246281

SEQ ID NO: 332130 - RNA, 64 nt, Homo Sapiens; identical to SEQ ID NO: 246282

SEQ ID NO: 332131 - RNA, 64 nt, Homo Sapiens; identical to SEQ ID NO: 246283

SEQ ID NO: 332132 - RNA, 64 nt, Homo Sapiens; identical to SEQ ID NO: 246284

SEQ ID NO: 332133 - RNA, 64 nt, Homo Sapiens; identical to SEQ ID NO: 246285

SEQ ID NO: 332134 - RNA, 64 nt, Homo Sapiens; identical to SEQ ID NO: 246286

SEQ ID NO: 332135 - RNA, 64 nt, Homo Sapiens; identical to SEQ ID NO: 246287

SEQ ID NO: 332136 - RNA, 64 nt, Homo Sapiens; identical to SEQ ID NO: 246288

SEQ ID NO: 332137 - RNA, 64 nt, Homo Sapiens; identical to SEQ ID NO: 246289

SEQ ID NO: 332138 - RNA, 64 nt, Homo Sapiens; identical to SEQ ID NO: 246290

SEQ ID NO: 332139 - RNA, 64 nt, Homo Sapiens; identical to SEQ ID NO: 246291

SEQ ID NO: 332140 - RNA, 64 nt, Homo Sapiens; identical to SEQ ID NO: 246292

SEQ ID NO: 332141 - RNA, 64 nt, Homo Sapiens; identical to SEQ ID NO: 246293

SEQ ID NO: 332142 - RNA, 64 nt, Homo Sapiens; identical to SEQ ID NO: 246294

SEQ ID NO: 332143 - RNA, 64 nt, Homo Sapiens; identical to SEQ ID NO: 246295

SEQ ID NO: 332144 - RNA, 64 nt, Homo Sapiens; identical to SEQ ID NO: 246296

SEQ ID NO: 332145 - RNA, 64 nt, Homo Sapiens; identical to SEQ ID NO: 246297

SEQ ID NO: 332146 - RNA, 64 nt, Homo Sapiens; identical to SEQ ID NO: 246298

SEQ ID NO: 332147 - RNA, 64 nt, Homo Sapiens; identical to SEQ ID NO: 246299

SEQ ID NO: 332148 - RNA, 64 nt, Homo Sapiens; identical to SEQ ID NO: 246300

SEQ ID NO: 332149 - RNA, 64 nt, Homo Sapiens; identical to SEQ ID NO: 246301

SEQ ID NO: 332150 - RNA, 61 nt, Homo Sapiens
caaaaugcuaaagacucacacugcagcaaucaucccagaugauuaaauucaaagaaauagg

SEQ ID NO: 332151 - RNA, 61 nt, Homo Sapiens
guuccuucaucaucgaaauagugauuaagugaucccagaacaaggaauacuagaguaaaaa

SEQ ID NO: 332152 - RNA, 61 nt, Homo Sapiens
uggcgagaggauggagcugggauguaaaaccaucccagagcgacaccugcugcacucaucu

SEQ ID NO: 332153 - RNA, 61 nt, Homo Sapiens
acuaacccuuccugauccuguuuguagucucaucccagauuggguucccagugcccagcac

SEQ ID NO: 332154 - RNA, 61 nt, Homo Sapiens
acaaaacaaaauaaugcuuuucuccucucccaucccagaaaaaacgcaaaucuguagauuc

SEQ ID NO: 332155 - RNA, 61 nt, Homo Sapiens
cuugucuucuaaaagggagggcuaagugguuaucccagaaaucucuucccuaaccaaugaa

SEQ ID NO: 332156 - RNA, 61 nt, Homo Sapiens
uugagaaucagcauaguaaauuacauuucuaaucccagaggacuuaauauuuucuuuuguc

SEQ ID NO: 332157 - RNA, 61 nt, Homo Sapiens
ugaacuucuaauuggggccaguguaaggucgaucccagaggcugaucugcaaaucaagcua

SEQ ID NO: 332158 - RNA, 61 nt, Homo Sapiens
aggacagugaauuacuccuauaagccaugacaucccagaagucuuuuuuuuuuuuuuuuuu

SEQ ID NO: 332159 - RNA, 61 nt, Homo Sapiens
cucugaauuuuagaaaacaacuacuuuuaaaaucccagauaguugaacuuuuuaaaaagug

SEQ ID NO: 332160 - RNA, 61 nt, Homo Sapiens
ccacauugcaacagcaaguugauuucuugugaucccagaauuuucuaagaggaugaguuga

SEQ ID NO: 332161 - RNA, 61 nt, Homo Sapiens
cagcaucacuugggagcuuauugaaaugcagaucccagagucaguaaaucugccugugaag

SEQ ID NO: 332162 - RNA, 61 nt, Homo Sapiens
gcucccuccaggccugcuucgacuugggggcaucccagaguugguuuguaaauggugaggg

SEQ ID NO: 332163 - RNA, 61 nt, Homo Sapiens
cccuguauuuauuuucccugucuguggggggaucccagagcaauaaauagcauuaguagcu

SEQ ID NO: 332164 - RNA, 61 nt, Homo Sapiens
aggggcaguagcugggcagaaucccugugugaucccagaggguggaguuggcuguuacgac

SEQ ID NO: 332165 - RNA, 61 nt, Homo Sapiens
auucaugaagucuucccgccgcuugguguccaucccagagcaaccauuuccccuuccagua

SEQ ID NO: 332166 - RNA, 61 nt, Homo Sapiens
agaagauccuaucaugaauaggcaucuccauaucccagaaaguaucccucaucccagaaga

SEQ ID NO: 332167 - RNA, 61 nt, Homo Sapiens
aggcaucuccauaucccagaugguaucccucaucccagaagcacauuuggcacuguuaucu

SEQ ID NO: 332168 - RNA, 61 nt, Homo Sapiens
gagguccgugagcuggaacugggcacacgccaucccagagggcucaggaugccccaggaag

SEQ ID NO: 332169 - RNA, 61 nt, Homo Sapiens
ugauggcagccucagaggcuuacucuaacccaucccagaauaaauggagacuucauguguu

SEQ ID NO: 332170 - RNA, 61 nt, Homo Sapiens
cccaagccuucacccaccagccaggcacuggaucccagauuaagcacuacgccuuccaccc

SEQ ID NO: 332171 - RNA, 61 nt, Homo Sapiens
cccucacuccacccacuggacccaucacuggaucccagaucaaugccuggauccuggggcc

SEQ ID NO: 332172 - RNA, 61 nt, Homo Sapiens
ccccuguaaccauaacugugucagccacuagaucccagaucggucaugcgauccccacccu

SEQ ID NO: 332173 - RNA, 64 nt, Homo Sapiens
gcuuguguaguagaaacuagacuaagagaaugugcucaugcauuggcuaagacuugcuuuucua

SEQ ID NO: 332174 - RNA, 64 nt, Homo Sapiens
gucccagcuacccaggaggcgcugugcgcaauugcucaugcauaccaaaaauuuuuuuuaauua

SEQ ID NO: 332175 - RNA, 64 nt, Homo Sapiens
auugcagagcugcagaguacaguguaacaguacucucaugcaauuuuuuucaggaugcaaaggc

SEQ ID NO: 332176 - RNA, 64 nt, Homo Sapiens
ugcugucuguaauucaguuugcguguauuuuaugcucaugcaccaacccauacagaguaaaucu

SEQ ID NO: 332177 - RNA, 64 nt, Homo Sapiens
gaggagaguggggugcagaaaugccucagcauggcucaugcacacagcauucucccguggggca

SEQ ID NO: 332178 - RNA, 64 nt, Homo Sapiens
augcacacagcauucucccguggggcaggguucccucaugcaacaggccucccuguggccagcc

SEQ ID NO: 332179 - RNA, 64 nt, Homo Sapiens
gaacugggcggguuuaguggccccaggcccacuccucaugcagcagugugcuggggcgacagcu

SEQ ID NO: 332180 - RNA, 64 nt, Homo Sapiens
aggacaggcccagccuuucuccacugccacgucccucaugcacaucacucaucuccugcugcag

SEQ ID NO: 332181 - RNA, 64 nt, Homo Sapiens
cuuuccucuuguguuggcaagucuuggccucacucucaugcaggguguuggauccauuucccug

SEQ ID NO: 332182 - RNA, 64 nt, Homo Sapiens
gaucuuuaugcaauuuuuuuaugacucuuauguacucaugcauguugacaugagugcauuagua

SEQ ID NO: 332183 - RNA, 64 nt, Homo Sapiens
uuucaaaauugguuuguucaguguggaguauauucagcaguauuuuugacauuuuucuuuagaa

SEQ ID NO: 332184 - RNA, 64 nt, Homo Sapiens
aauuuugcauuuuagcacuugcacuauuacucagcagcaguaacaugguaacacuuaaaauggu

SEQ ID NO: 332185 - RNA, 64 nt, Homo Sapiens
cacaggcaccacauuccuuuaaaaaaaucaacgacagcaguagagguuuauuucaaauuaaaac

SEQ ID NO: 332186 - RNA, 64 nt, Homo Sapiens
cacuugguuuccagagcuccccaucccucgggcccagcaguacagaggccaccagaagacacuu

SEQ ID NO: 332187 - RNA, 64 nt, Homo Sapiens
uaucaugaauguagaaauaaucaugagaaaauaccagcaguaucuacaaauccugcaaaagaca

SEQ ID NO: 332188 - RNA, 64 nt, Homo Sapiens
uauuauccuuuuuaaaaaugcaaugaaucccuaccagcaguaguacauaagcauaagugagugc

SEQ ID NO: 332189 - RNA, 64 nt, Homo Sapiens
aaacaaagcuggaauagaaacuacacacuagacacagcaguagucauagucuucacagguuuag

SEQ ID NO: 332190 - RNA, 64 nt, Homo Sapiens
auuacuuaucuuccuucucugcuuugugacucaccagcaguaacacacacaauccacaucuugu

SEQ ID NO: 332191 - RNA, 64 nt, Homo Sapiens
uggccucaaaacagaagcagcuucuuuugucucccagcaguagugagccacucagucucuucca

SEQ ID NO: 332192 - RNA, 64 nt, Homo Sapiens
caguaacuuauguacaaggaugaaagaaaggucgcagcaguagcuuuggggaaagggaggaaga

SEQ ID NO: 332193 - RNA, 64 nt, Homo Sapiens
acuauaagcaguugcuucaaaguagcgucuuaaacagcaguauugagguucuaaucauuucagc

SEQ ID NO: 332194 - RNA, 64 nt, Homo Sapiens
gucuuaaacagcaguauuacgguucuaaucauuucagcaguagcuuuauauugugcuuuuugga

SEQ ID NO: 332195 - RNA, 64 nt, Homo Sapiens; identical to SEQ ID NO: 277109

SEQ ID NO: 332196 - RNA, 64 nt, Homo Sapiens; identical to SEQ ID NO: 277110

SEQ ID NO: 332197 - RNA, 64 nt, Homo Sapiens; identical to SEQ ID NO: 277111

SEQ ID NO: 332198 - RNA, 64 nt, Homo Sapiens; identical to SEQ ID NO: 277112

SEQ ID NO: 332199 - RNA, 64 nt, Homo Sapiens; identical to SEQ ID NO: 277113

SEQ ID NO: 332200 - RNA, 64 nt, Homo Sapiens; identical to SEQ ID NO: 277114

SEQ ID NO: 332201 - RNA, 64 nt, Homo Sapiens; identical to SEQ ID NO: 277115

SEQ ID NO: 332202 - RNA, 64 nt, Homo Sapiens; identical to SEQ ID NO: 277116

SEQ ID NO: 332203 - RNA, 64 nt, Homo Sapiens; identical to SEQ ID NO: 277117

SEQ ID NO: 332204 - RNA, 64 nt, Homo Sapiens; identical to SEQ ID NO: 277118

SEQ ID NO: 332205 - RNA, 64 nt, Homo Sapiens; identical to SEQ ID NO: 277119

SEQ ID NO: 332206 - RNA, 64 nt, Homo Sapiens; identical to SEQ ID NO: 277120

SEQ ID NO: 332207 - RNA, 64 nt, Homo Sapiens; identical to SEQ ID NO: 277121

SEQ ID NO: 332208 - RNA, 64 nt, Homo Sapiens; identical to SEQ ID NO: 277122

SEQ ID NO: 332209 - RNA, 64 nt, Homo Sapiens; identical to SEQ ID NO: 277123

SEQ ID NO: 332210 - RNA, 64 nt, Homo Sapiens; identical to SEQ ID NO: 277124

SEQ ID NO: 332211 - RNA, 64 nt, Homo Sapiens; identical to SEQ ID NO: 277125

SEQ ID NO: 332212 - RNA, 64 nt, Homo Sapiens; identical to SEQ ID NO: 277126

SEQ ID NO: 332213 - RNA, 64 nt, Homo Sapiens; identical to SEQ ID NO: 277127

SEQ ID NO: 332214 - RNA, 65 nt, Homo Sapiens
agggucaaaacccaucauccccaugcugggucccagggaugcagagccaaccuacgugccaggcc

SEQ ID NO: 332215 - RNA, 65 nt, Homo Sapiens
uccauguggaugucaccaaaauguccagggcaccagggaugcaaugggcagucagguccacaccu

SEQ ID NO: 332216 - RNA, 65 nt, Homo Sapiens
ccgucccuguguuccccacgucugccgugccaucugggaugcaaagagcagugugauggagaguc

SEQ ID NO: 332217 - RNA, 65 nt, Homo Sapiens
caggcagacuccugccagauaagcccucaugggaagggaugcagcuuugccccugcacauuccag

SEQ ID NO: 332218 - RNA, 64 nt, Homo Sapiens; identical to SEQ ID NO: 236791

SEQ ID NO: 332219 - RNA, 64 nt, Homo Sapiens; identical to SEQ ID NO: 236792

SEQ ID NO: 332220 - RNA, 64 nt, Homo Sapiens; identical to SEQ ID NO: 236793

SEQ ID NO: 332221 - RNA, 64 nt, Homo Sapiens; identical to SEQ ID NO: 236794

SEQ ID NO: 332222 - RNA, 64 nt, Homo Sapiens; identical to SEQ ID NO: 236795

SEQ ID NO: 332223 - RNA, 64 nt, Homo Sapiens; identical to SEQ ID NO: 236796

SEQ ID NO: 332224 - RNA, 64 nt, Homo Sapiens; identical to SEQ ID NO: 236797

SEQ ID NO: 332225 - RNA, 64 nt, Homo Sapiens; identical to SEQ ID NO: 236798

SEQ ID NO: 332226 - RNA, 64 nt, Homo Sapiens; identical to SEQ ID NO: 236799

SEQ ID NO: 332227 - RNA, 64 nt, Homo Sapiens; identical to SEQ ID NO: 236800

SEQ ID NO: 332228 - RNA, 64 nt, Homo Sapiens; identical to SEQ ID NO: 236801

SEQ ID NO: 332229 - RNA, 64 nt, Homo Sapiens; identical to SEQ ID NO: 236802

SEQ ID NO: 332230 - RNA, 64 nt, Homo Sapiens; identical to SEQ ID NO: 236803

SEQ ID NO: 332231 - RNA, 64 nt, Homo Sapiens; identical to SEQ ID NO: 236804

SEQ ID NO: 332232 - RNA, 64 nt, Homo Sapiens; identical to SEQ ID NO: 236805

SEQ ID NO: 332233 - RNA, 64 nt, Homo Sapiens; identical to SEQ ID NO: 236806

SEQ ID NO: 332234 - RNA, 64 nt, Homo Sapiens; identical to SEQ ID NO: 236807

SEQ ID NO: 332235 - RNA, 64 nt, Homo Sapiens; identical to SEQ ID NO: 236808

SEQ ID NO: 332236 - RNA, 64 nt, Homo Sapiens; identical to SEQ ID NO: 236809

SEQ ID NO: 332237 - RNA, 64 nt, Homo Sapiens; identical to SEQ ID NO: 236810

SEQ ID NO: 332238 - RNA, 64 nt, Homo Sapiens; identical to SEQ ID NO: 236811

SEQ ID NO: 332239 - RNA, 64 nt, Homo Sapiens; identical to SEQ ID NO: 236812

SEQ ID NO: 332240 - RNA, 64 nt, Homo Sapiens; identical to SEQ ID NO: 236813

SEQ ID NO: 332241 - RNA, 64 nt, Homo Sapiens; identical to SEQ ID NO: 236814

SEQ ID NO: 332242 - RNA, 64 nt, Homo Sapiens; identical to SEQ ID NO: 236815

SEQ ID NO: 332243 - RNA, 64 nt, Homo Sapiens; identical to SEQ ID NO: 236816

SEQ ID NO: 332244 - RNA, 64 nt, Homo Sapiens; identical to SEQ ID NO: 236817

SEQ ID NO: 332245 - RNA, 64 nt, Homo Sapiens; identical to SEQ ID NO: 236818

SEQ ID NO: 332246 - RNA, 64 nt, Homo Sapiens; identical to SEQ ID NO: 236819

SEQ ID NO: 332247 - RNA, 64 nt, Homo Sapiens; identical to SEQ ID NO: 236820

SEQ ID NO: 332248 - RNA, 64 nt, Homo Sapiens; identical to SEQ ID NO: 236821

SEQ ID NO: 332249 - RNA, 64 nt, Homo Sapiens; identical to SEQ ID NO: 236822

SEQ ID NO: 332250 - RNA, 64 nt, Homo Sapiens; identical to SEQ ID NO: 236823

SEQ ID NO: 332251 - RNA, 64 nt, Homo Sapiens; identical to SEQ ID NO: 236824

SEQ ID NO: 332252 - RNA, 64 nt, Homo Sapiens; identical to SEQ ID NO: 236825

SEQ ID NO: 332253 - RNA, 64 nt, Homo Sapiens; identical to SEQ ID NO: 236826

SEQ ID NO: 332254 - RNA, 64 nt, Homo Sapiens; identical to SEQ ID NO: 236827

SEQ ID NO: 332255 - RNA, 64 nt, Homo Sapiens; identical to SEQ ID NO: 236828

SEQ ID NO: 332256 - RNA, 64 nt, Homo Sapiens; identical to SEQ ID NO: 236829

SEQ ID NO: 332257 - RNA, 64 nt, Homo Sapiens; identical to SEQ ID NO: 236830

SEQ ID NO: 332258 - RNA, 64 nt, Homo Sapiens; identical to SEQ ID NO: 236831

SEQ ID NO: 332259 - RNA, 64 nt, Homo Sapiens; identical to SEQ ID NO: 236832

SEQ ID NO: 332260 - RNA, 64 nt, Homo Sapiens; identical to SEQ ID NO: 236833

SEQ ID NO: 332261 - RNA, 64 nt, Homo Sapiens; identical to SEQ ID NO: 236834

SEQ ID NO: 332262 - RNA, 64 nt, Homo Sapiens; identical to SEQ ID NO: 236835

SEQ ID NO: 332263 - RNA, 64 nt, Homo Sapiens; identical to SEQ ID NO: 236836

SEQ ID NO: 332264 - RNA, 64 nt, Homo Sapiens; identical to SEQ ID NO: 236837

SEQ ID NO: 332265 - RNA, 64 nt, Homo Sapiens; identical to SEQ ID NO: 236838

SEQ ID NO: 332266 - RNA, 64 nt, Homo Sapiens; identical to SEQ ID NO: 236839

SEQ ID NO: 332267 - RNA, 64 nt, Homo Sapiens; identical to SEQ ID NO: 236840

SEQ ID NO: 332268 - RNA, 64 nt, Homo Sapiens; identical to SEQ ID NO: 236841

SEQ ID NO: 332269 - RNA, 64 nt, Homo Sapiens; identical to SEQ ID NO: 236842

SEQ ID NO: 332270 - RNA, 64 nt, Homo Sapiens; identical to SEQ ID NO: 236843

SEQ ID NO: 332271 - RNA, 64 nt, Homo Sapiens; identical to SEQ ID NO: 236844

SEQ ID NO: 332272 - RNA, 64 nt, Homo Sapiens; identical to SEQ ID NO: 236845

SEQ ID NO: 332273 - RNA, 64 nt, Homo Sapiens; identical to SEQ ID NO: 236846

SEQ ID NO: 332274 - RNA, 64 nt, Homo Sapiens; identical to SEQ ID NO: 236847

SEQ ID NO: 332275 - RNA, 64 nt, Homo Sapiens; identical to SEQ ID NO: 236848

SEQ ID NO: 332276 - RNA, 64 nt, Homo Sapiens; identical to SEQ ID NO: 236849

SEQ ID NO: 332277 - RNA, 64 nt, Homo Sapiens; identical to SEQ ID NO: 236850

SEQ ID NO: 332278 - RNA, 64 nt, Homo Sapiens; identical to SEQ ID NO: 236851

SEQ ID NO: 332279 - RNA, 64 nt, Homo Sapiens; identical to SEQ ID NO: 236852

SEQ ID NO: 332280 - RNA, 64 nt, Homo Sapiens; identical to SEQ ID NO: 236853

SEQ ID NO: 332281 - RNA, 64 nt, Homo Sapiens; identical to SEQ ID NO: 236854

SEQ ID NO: 332282 - RNA, 64 nt, Homo Sapiens; identical to SEQ ID NO: 236855

SEQ ID NO: 332283 - RNA, 64 nt, Homo Sapiens; identical to SEQ ID NO: 236856

SEQ ID NO: 332284 - RNA, 64 nt, Homo Sapiens; identical to SEQ ID NO: 236857

SEQ ID NO: 332285 - RNA, 64 nt, Homo Sapiens; identical to SEQ ID NO: 236858

SEQ ID NO: 332286 - RNA, 64 nt, Homo Sapiens; identical to SEQ ID NO: 236859

SEQ ID NO: 332287 - RNA, 64 nt, Homo Sapiens; identical to SEQ ID NO: 236860

SEQ ID NO: 332288 - RNA, 64 nt, Homo Sapiens; identical to SEQ ID NO: 236861

SEQ ID NO: 332289 - RNA, 64 nt, Homo Sapiens; identical to SEQ ID NO: 236862

SEQ ID NO: 332290 - RNA, 64 nt, Homo Sapiens; identical to SEQ ID NO: 236863

SEQ ID NO: 332291 - RNA, 64 nt, Homo Sapiens; identical to SEQ ID NO: 236864

SEQ ID NO: 332292 - RNA, 64 nt, Homo Sapiens; identical to SEQ ID NO: 236865

SEQ ID NO: 332293 - RNA, 64 nt, Homo Sapiens; identical to SEQ ID NO: 236866

SEQ ID NO: 332294 - RNA, 64 nt, Homo Sapiens; identical to SEQ ID NO: 236867

SEQ ID NO: 332295 - RNA, 64 nt, Homo Sapiens; identical to SEQ ID NO: 236868

SEQ ID NO: 332296 - RNA, 64 nt, Homo Sapiens; identical to SEQ ID NO: 236869

SEQ ID NO: 332297 - RNA, 64 nt, Homo Sapiens; identical to SEQ ID NO: 236870

SEQ ID NO: 332298 - RNA, 64 nt, Homo Sapiens; identical to SEQ ID NO: 236871

SEQ ID NO: 332299 - RNA, 64 nt, Homo Sapiens; identical to SEQ ID NO: 236872

SEQ ID NO: 332300 - RNA, 64 nt, Homo Sapiens; identical to SEQ ID NO: 236873

SEQ ID NO: 332301 - RNA, 64 nt, Homo Sapiens; identical to SEQ ID NO: 236874

SEQ ID NO: 332302 - RNA, 64 nt, Homo Sapiens; identical to SEQ ID NO: 236875

SEQ ID NO: 332303 - RNA, 64 nt, Homo Sapiens; identical to SEQ ID NO: 236876

SEQ ID NO: 332304 - RNA, 64 nt, Homo Sapiens; identical to SEQ ID NO: 236877

SEQ ID NO: 332305 - RNA, 64 nt, Homo Sapiens; identical to SEQ ID NO: 236878

SEQ ID NO: 332306 - RNA, 64 nt, Homo Sapiens; identical to SEQ ID NO: 236879

SEQ ID NO: 332307 - RNA, 64 nt, Homo Sapiens; identical to SEQ ID NO: 236880

SEQ ID NO: 332308 - RNA, 64 nt, Homo Sapiens; identical to SEQ ID NO: 236881

SEQ ID NO: 332309 - RNA, 64 nt, Homo Sapiens; identical to SEQ ID NO: 236882

SEQ ID NO: 332310 - RNA, 64 nt, Homo Sapiens; identical to SEQ ID NO: 236883

SEQ ID NO: 332311 - RNA, 64 nt, Homo Sapiens; identical to SEQ ID NO: 236884

SEQ ID NO: 332312 - RNA, 64 nt, Homo Sapiens; identical to SEQ ID NO: 236885

SEQ ID NO: 332313 - RNA, 64 nt, Homo Sapiens; identical to SEQ ID NO: 236886

SEQ ID NO: 332314 - RNA, 64 nt, Homo Sapiens; identical to SEQ ID NO: 236887

SEQ ID NO: 332315 - RNA, 64 nt, Homo Sapiens; identical to SEQ ID NO: 236888

SEQ ID NO: 332316 - RNA, 64 nt, Homo Sapiens; identical to SEQ ID NO: 236889

SEQ ID NO: 332317 - RNA, 64 nt, Homo Sapiens; identical to SEQ ID NO: 236890

SEQ ID NO: 332318 - RNA, 64 nt, Homo Sapiens; identical to SEQ ID NO: 236891

SEQ ID NO: 332319 - RNA, 64 nt, Homo Sapiens; identical to SEQ ID NO: 236892

SEQ ID NO: 332320 - RNA, 64 nt, Homo Sapiens; identical to SEQ ID NO: 236893

SEQ ID NO: 332321 - RNA, 64 nt, Homo Sapiens; identical to SEQ ID NO: 236894

SEQ ID NO: 332322 - RNA, 64 nt, Homo Sapiens; identical to SEQ ID NO: 236895

SEQ ID NO: 332323 - RNA, 64 nt, Homo Sapiens; identical to SEQ ID NO: 236896

SEQ ID NO: 332324 - RNA, 64 nt, Homo Sapiens; identical to SEQ ID NO: 236897

SEQ ID NO: 332325 - RNA, 64 nt, Homo Sapiens; identical to SEQ ID NO: 236898

SEQ ID NO: 332326 - RNA, 64 nt, Homo Sapiens; identical to SEQ ID NO: 236899

SEQ ID NO: 332327 - RNA, 64 nt, Homo Sapiens; identical to SEQ ID NO: 236900

SEQ ID NO: 332328 - RNA, 64 nt, Homo Sapiens; identical to SEQ ID NO: 236901

SEQ ID NO: 332329 - RNA, 64 nt, Homo Sapiens; identical to SEQ ID NO: 236902

SEQ ID NO: 332330 - RNA, 64 nt, Homo Sapiens; identical to SEQ ID NO: 236903

SEQ ID NO: 332331 - RNA, 64 nt, Homo Sapiens; identical to SEQ ID NO: 236904

SEQ ID NO: 332332 - RNA, 64 nt, Homo Sapiens; identical to SEQ ID NO: 236905

SEQ ID NO: 332333 - RNA, 64 nt, Homo Sapiens; identical to SEQ ID NO: 236906

SEQ ID NO: 332334 - RNA, 64 nt, Homo Sapiens; identical to SEQ ID NO: 236907

SEQ ID NO: 332335 - RNA, 64 nt, Homo Sapiens; identical to SEQ ID NO: 236908

SEQ ID NO: 332336 - RNA, 64 nt, Homo Sapiens; identical to SEQ ID NO: 236909

SEQ ID NO: 332337 - RNA, 64 nt, Homo Sapiens; identical to SEQ ID NO: 236910

SEQ ID NO: 332338 - RNA, 64 nt, Homo Sapiens; identical to SEQ ID NO: 236911

SEQ ID NO: 332339 - RNA, 64 nt, Homo Sapiens; identical to SEQ ID NO: 236912

SEQ ID NO: 332340 - RNA, 64 nt, Homo Sapiens; identical to SEQ ID NO: 236913

SEQ ID NO: 332341 - RNA, 64 nt, Homo Sapiens; identical to SEQ ID NO: 236914

SEQ ID NO: 332342 - RNA, 64 nt, Homo Sapiens; identical to SEQ ID NO: 236915

SEQ ID NO: 332343 - RNA, 64 nt, Homo Sapiens; identical to SEQ ID NO: 236916

SEQ ID NO: 332344 - RNA, 64 nt, Homo Sapiens; identical to SEQ ID NO: 236917

SEQ ID NO: 332345 - RNA, 64 nt, Homo Sapiens; identical to SEQ ID NO: 236918

SEQ ID NO: 332346 - RNA, 64 nt, Homo Sapiens; identical to SEQ ID NO: 236919

SEQ ID NO: 332347 - RNA, 64 nt, Homo Sapiens; identical to SEQ ID NO: 236920

SEQ ID NO: 332348 - RNA, 64 nt, Homo Sapiens; identical to SEQ ID NO: 236921

SEQ ID NO: 332349 - RNA, 64 nt, Homo Sapiens; identical to SEQ ID NO: 236922

SEQ ID NO: 332350 - RNA, 64 nt, Homo Sapiens; identical to SEQ ID NO: 236923

SEQ ID NO: 332351 - RNA, 64 nt, Homo Sapiens; identical to SEQ ID NO: 236924

SEQ ID NO: 332352 - RNA, 64 nt, Homo Sapiens; identical to SEQ ID NO: 236925

SEQ ID NO: 332353 - RNA, 64 nt, Homo Sapiens; identical to SEQ ID NO: 236926

SEQ ID NO: 332354 - RNA, 64 nt, Homo Sapiens; identical to SEQ ID NO: 236927

SEQ ID NO: 332355 - RNA, 64 nt, Homo Sapiens; identical to SEQ ID NO: 236928

SEQ ID NO: 332356 - RNA, 64 nt, Homo Sapiens; identical to SEQ ID NO: 236929

SEQ ID NO: 332357 - RNA, 64 nt, Homo Sapiens; identical to SEQ ID NO: 236930

SEQ ID NO: 332358 - RNA, 64 nt, Homo Sapiens; identical to SEQ ID NO: 236931

SEQ ID NO: 332359 - RNA, 64 nt, Homo Sapiens; identical to SEQ ID NO: 236932

SEQ ID NO: 332360 - RNA, 64 nt, Homo Sapiens; identical to SEQ ID NO: 236933

SEQ ID NO: 332361 - RNA, 64 nt, Homo Sapiens; identical to SEQ ID NO: 236934

SEQ ID NO: 332362 - RNA, 64 nt, Homo Sapiens; identical to SEQ ID NO: 244143

SEQ ID NO: 332363 - RNA, 64 nt, Homo Sapiens; identical to SEQ ID NO: 244144

SEQ ID NO: 332364 - RNA, 64 nt, Homo Sapiens; identical to SEQ ID NO: 244145

SEQ ID NO: 332365 - RNA, 64 nt, Homo Sapiens; identical to SEQ ID NO: 244146

SEQ ID NO: 332366 - RNA, 64 nt, Homo Sapiens; identical to SEQ ID NO: 244147

SEQ ID NO: 332367 - RNA, 64 nt, Homo Sapiens; identical to SEQ ID NO: 244148

SEQ ID NO: 332368 - RNA, 64 nt, Homo Sapiens; identical to SEQ ID NO: 244149

SEQ ID NO: 332369 - RNA, 64 nt, Homo Sapiens; identical to SEQ ID NO: 244150

SEQ ID NO: 332370 - RNA, 64 nt, Homo Sapiens; identical to SEQ ID NO: 244151

SEQ ID NO: 332371 - RNA, 64 nt, Homo Sapiens; identical to SEQ ID NO: 244152

SEQ ID NO: 332372 - RNA, 64 nt, Homo Sapiens; identical to SEQ ID NO: 244153

SEQ ID NO: 332373 - RNA, 64 nt, Homo Sapiens; identical to SEQ ID NO: 244154

SEQ ID NO: 332374 - RNA, 64 nt, Homo Sapiens; identical to SEQ ID NO: 244155

SEQ ID NO: 332375 - RNA, 64 nt, Homo Sapiens; identical to SEQ ID NO: 244156

SEQ ID NO: 332376 - RNA, 64 nt, Homo Sapiens; identical to SEQ ID NO: 244157

SEQ ID NO: 332377 - RNA, 64 nt, Homo Sapiens; identical to SEQ ID NO: 244158

SEQ ID NO: 332378 - RNA, 64 nt, Homo Sapiens; identical to SEQ ID NO: 244159

SEQ ID NO: 332379 - RNA, 64 nt, Homo Sapiens; identical to SEQ ID NO: 244160

SEQ ID NO: 332380 - RNA, 64 nt, Homo Sapiens; identical to SEQ ID NO: 244161

SEQ ID NO: 332381 - RNA, 64 nt, Homo Sapiens; identical to SEQ ID NO: 244162

SEQ ID NO: 332382 - RNA, 64 nt, Homo Sapiens; identical to SEQ ID NO: 244163

SEQ ID NO: 332383 - RNA, 64 nt, Homo Sapiens; identical to SEQ ID NO: 244164

SEQ ID NO: 332384 - RNA, 64 nt, Homo Sapiens; identical to SEQ ID NO: 244165

SEQ ID NO: 332385 - RNA, 64 nt, Homo Sapiens; identical to SEQ ID NO: 244166

SEQ ID NO: 332386 - RNA, 64 nt, Homo Sapiens; identical to SEQ ID NO: 244167

SEQ ID NO: 332387 - RNA, 64 nt, Homo Sapiens; identical to SEQ ID NO: 244168

SEQ ID NO: 332388 - RNA, 64 nt, Homo Sapiens; identical to SEQ ID NO: 244169

SEQ ID NO: 332389 - RNA, 64 nt, Homo Sapiens; identical to SEQ ID NO: 244170

SEQ ID NO: 332390 - RNA, 64 nt, Homo Sapiens; identical to SEQ ID NO: 244171

SEQ ID NO: 332391 - RNA, 64 nt, Homo Sapiens
ccaguuuauaauagaucccuaguaaaaagcuuugauucaacacaauuguucaucuucacauccc

SEQ ID NO: 332392 - RNA, 64 nt, Homo Sapiens
uuauuuuuaaaugaaaguguaagaaugcuuucugauucaacaaauuuguuaucaaacuguuucc

SEQ ID NO: 332393 - RNA, 64 nt, Homo Sapiens
ugauguugagugggagauugugccaaaaacuaaaauucaacaaagaacaaacagaaacgagauu

SEQ ID NO: 332394 - RNA, 64 nt, Homo Sapiens
uauuuucugaauucauaaaauccccauucuauaaauucaacacuguucugggucagcuugaaug

SEQ ID NO: 332395 - RNA, 64 nt, Homo Sapiens
gggaagcgaucacaucuggugaccaggcugcuucauucaacacuguguaaacaccaaagccuua

SEQ ID NO: 332396 - RNA, 64 nt, Homo Sapiens
auagccuugccuacugaagauagguucucuauguauucaacaauaaugcaacuuuagaaguauu

SEQ ID NO: 332397 - RNA, 64 nt, Homo Sapiens
aaacucuauaagccagaagagagugggggccaauauucaacauucuuaaagaaaagaauuuuca

SEQ ID NO: 332398 - RNA, 64 nt, Homo Sapiens
gagacaaggccauuauauaaugguaaauggaucaauucaacaagaagagauaacuauccuaaau

SEQ ID NO: 332399 - RNA, 64 nt, Homo Sapiens
ucaucucuuuagaugcagaaagguuuuuaauaaaauucaacaucccuucauuuuaaaaacccuc

SEQ ID NO: 332400 - RNA, 64 nt, Homo Sapiens
gaaaaugacagggaugaccacucucaccacuccgauucaacauaguacuggaaguccuaagcuu

SEQ ID NO: 332401 - RNA, 64 nt, Homo Sapiens
uugugugaaauccuuuagccagcguuucaaccucauucaacaccagaaaguucacaguggaaaa

SEQ ID NO: 332402 - RNA, 64 nt, Homo Sapiens
cagauggaaauccguuagccacaccuccagucucauucaacacuggacaguuuacaauguggac

SEQ ID NO: 332403 - RNA, 64 nt, Homo Sapiens
uauggaaaaagguuucagccaaaggccuaacccuauucaacaccagaaaguuuacacuggagaa

SEQ ID NO: 332404 - RNA, 64 nt, Homo Sapiens
auagaacucauacuaaugagguuauucaacauuuauucaacacuuuguaaaaaagcuuuucuuu

SEQ ID NO: 332405 - RNA, 64 nt, Homo Sapiens
uauucaacacuauagaacucagcuuuucuuuguuauucaacauugaauguaaagauuguaaaaa

SEQ ID NO: 332406 - RNA, 64 nt, Homo Sapiens
cacaagacucagaauccacagugucccauuuuccgacuaggagacaucuuccgagaaacaggcg

SEQ ID NO: 332407 - RNA, 64 nt, Homo Sapiens
cuacaugaaugcaaaacauuucauuaugaggucagacuaggauaauguccaacuaaaaacaaac

SEQ ID NO: 332408 - RNA, 64 nt, Homo Sapiens; identical to SEQ ID NO: 259559

SEQ ID NO: 332409 - RNA, 64 nt, Homo Sapiens; identical to SEQ ID NO: 259560

SEQ ID NO: 332410 - RNA, 64 nt, Homo Sapiens; identical to SEQ ID NO: 259561

SEQ ID NO: 332411 - RNA, 64 nt, Homo Sapiens; identical to SEQ ID NO: 259562

SEQ ID NO: 332412 - RNA, 64 nt, Homo Sapiens; identical to SEQ ID NO: 259563

SEQ ID NO: 332413 - RNA, 64 nt, Homo Sapiens; identical to SEQ ID NO: 259564

SEQ ID NO: 332414 - RNA, 64 nt, Homo Sapiens; identical to SEQ ID NO: 259565

SEQ ID NO: 332415 - RNA, 64 nt, Homo Sapiens; identical to SEQ ID NO: 259566

SEQ ID NO: 332416 - RNA, 64 nt, Homo Sapiens; identical to SEQ ID NO: 259567

SEQ ID NO: 332417 - RNA, 64 nt, Homo Sapiens; identical to SEQ ID NO: 259568

SEQ ID NO: 332418 - RNA, 64 nt, Homo Sapiens; identical to SEQ ID NO: 259569

SEQ ID NO: 332419 - RNA, 64 nt, Homo Sapiens; identical to SEQ ID NO: 259570

SEQ ID NO: 332420 - RNA, 64 nt, Homo Sapiens; identical to SEQ ID NO: 259571

SEQ ID NO: 332421 - RNA, 64 nt, Homo Sapiens; identical to SEQ ID NO: 259572

SEQ ID NO: 332422 - RNA, 64 nt, Homo Sapiens; identical to SEQ ID NO: 259573

SEQ ID NO: 332423 - RNA, 64 nt, Homo Sapiens; identical to SEQ ID NO: 259574

SEQ ID NO: 332424 - RNA, 64 nt, Homo Sapiens; identical to SEQ ID NO: 259575

SEQ ID NO: 332425 - RNA, 64 nt, Homo Sapiens; identical to SEQ ID NO: 259576

SEQ ID NO: 332426 - RNA, 64 nt, Homo Sapiens; identical to SEQ ID NO: 259577

SEQ ID NO: 332427 - RNA, 64 nt, Homo Sapiens; identical to SEQ ID NO: 259578

SEQ ID NO: 332428 - RNA, 64 nt, Homo Sapiens; identical to SEQ ID NO: 259579

SEQ ID NO: 332429 - RNA, 64 nt, Homo Sapiens; identical to SEQ ID NO: 259580

SEQ ID NO: 332430 - RNA, 64 nt, Homo Sapiens
uuaauuggugucuuccccccucauuugcucucuucccuaaaaugugucccagaugccuucauuu

SEQ ID NO: 332431 - RNA, 64 nt, Homo Sapiens
cugcuaugaaaauccacaaauuuuucagauagugcccuaaaaacaauuuuauaugccucacugg

SEQ ID NO: 332432 - RNA, 64 nt, Homo Sapiens
ugagacuaaacacaaaaacaguagauaaaucucucccuaaaagauggauucccccacauaccca

SEQ ID NO: 332433 - RNA, 64 nt, Homo Sapiens
auguccuucuagugguuugaaaauguuaaaacaucccuaaaaucuaaaucauauaaucagaauu

SEQ ID NO: 332434 - RNA, 64 nt, Homo Sapiens
auaaauaccuuucaagugugagcuuagacgucaacccuaaaauacuuaaccguaaugcuaauug

SEQ ID NO: 332435 - RNA, 64 nt, Homo Sapiens
uucugcaguuauuucucuuguucuggccaaacaacccuaaaaauccuuaccauuccacaaaguu

SEQ ID NO: 332436 - RNA, 64 nt, Homo Sapiens
ugagcucuuccuaucccucuccuaacugccagcccccuaaaagcacuccugcuuaaucuucaaa

SEQ ID NO: 332437 - RNA, 64 nt, Homo Sapiens
uaaauccuuuuaccuuuuuuuuuucuugguaauccccuaaaauaacaguaugugggauauugaa

SEQ ID NO: 332438 - RNA, 64 nt, Homo Sapiens
gcucgcucagagaauuaauuccuccuaggcuuaucccuaaaaauguuaccaucaccgaugaaua

SEQ ID NO: 332439 - RNA, 64 nt, Homo Sapiens
acuaaaaugauuuguauaccuauucaauaaaaagcccuaaaacaaacauuguuuauauuuuuuc

SEQ ID NO: 332440 - RNA, 64 nt, Homo Sapiens
aauagggaaaaacaucuaccuaaaagaugguugucccuaaaaaacuggaaacaucugaaaugcu

SEQ ID NO: 332441 - RNA, 64 nt, Homo Sapiens
auuuauauguauuuuuaccacaauaaacaaaaaacccuaaaaaaacuuuaaugaaagguggaaa

SEQ ID NO: 332442 - RNA, 64 nt, Homo Sapiens
uuacaaaauaagucccgcauuuuauuuuucaaaacccuaaaauaaaaaaaauugauuuccauau

SEQ ID NO: 332443 - RNA, 64 nt, Homo Sapiens
agaagaaucuuaaugaacacgagaaggggagaaacccuaaaaagcaaggaaggaaaagaaagaa

SEQ ID NO: 332444 - RNA, 64 nt, Homo Sapiens
uucucccugaguugauugauaggcuuaauggucacccuaaaaacacccacauaugcuuuucgau

SEQ ID NO: 332445 - RNA, 64 nt, Homo Sapiens
gcauucaucauaauaauuccagacauuuucaucacccuaaaaggaaacccugaaacccauuagc

SEQ ID NO: 332446 - RNA, 64 nt, Homo Sapiens
caaguuuacuuucauuccuuccuauguuuuaauccccuaaaauucucccuguagucaauguucc

SEQ ID NO: 332447 - RNA, 64 nt, Homo Sapiens
ggggaggaugcuacuuuacuggaguugagacacccccuaaaauucucacccucagcuauuuugu

SEQ ID NO: 332448 - RNA, 64 nt, Homo Sapiens
ccuagaaaacagcugcaaaugccagaaagaugaucccuaaaaauguugagggacuucuguucau

SEQ ID NO: 332449 - RNA, 64 nt, Homo Sapiens
auauauauauauaaaacuuagaguuuuuaucuuccccuaaaagaggccgugauauuugcagcag

SEQ ID NO: 332450 - RNA, 64 nt, Homo Sapiens
ucguguaugacagguagcuagggagcucuuggagauguagcaguugggauugugggagauuacu

SEQ ID NO: 332451 - RNA, 64 nt, Homo Sapiens
auuaagugaaaaaaguuuaaucccagaagaguaaauguagcaugaugcccuuucuaaaugaaag

SEQ ID NO: 332452 - RNA, 64 nt, Homo Sapiens
aucuuagccuacguuaccagucuuuggaaaugaaauguagcacauaaagaccuccaaggguacu

SEQ ID NO: 332453 - RNA, 64 nt, Homo Sapiens
gaguggugauacccagaccaauagauguuuguggauguagcacuuuagugacccacaggacagu

SEQ ID NO: 332454 - RNA, 64 nt, Homo Sapiens
cccaccuagcucccuggccaaugcguucugcagcauguagcauggcagcucuuccugccacuga

SEQ ID NO: 332455 - RNA, 64 nt, Homo Sapiens
cgcugcagcuggccacacugcuguuuucugagaaauguagcaucugacucucccggcucugcca

SEQ ID NO: 332456 - RNA, 64 nt, Homo Sapiens
aaugaaaauuguugagguuaucucccauucaaucauguagcaagaacuuaaagaaauucacuac

SEQ ID NO: 332457 - RNA, 64 nt, Homo Sapiens
gaaaauagagaauuuaauauauggugauugggauauguagcauucaaaaaaagugaauugccaa

SEQ ID NO: 332458 - RNA, 64 nt, Homo Sapiens
ucaauguguaagauauauguuuucaggguauaagauguagcauuuuggcucucuacacauggca

SEQ ID NO: 332459 - RNA, 64 nt, Homo Sapiens
aaaaauauauuuuaaugaaguuguggucguguuaauguagcacauucagcuuucuuuaacuuaa

SEQ ID NO: 332460 - RNA, 64 nt, Homo Sapiens
cacuuagaguaaauggacuugacauacagugccuauguagcaggaaugcuaugguuuccaugug

SEQ ID NO: 332461 - RNA, 64 nt, Homo Sapiens
uauggcuuaaucucuuagacuuuaaugaacuuaaauguagcacaauaaaagcaugcccucagcu

SEQ ID NO: 332462 - RNA, 64 nt, Homo Sapiens
aaaauguuacaacucuacuaaugcugaauuauacauguagcaccuuuuaaaaaggcuuuggcuu

SEQ ID NO: 332463 - RNA, 64 nt, Homo Sapiens
aucacacuguauuuaaauugcuacuuuaaaucaaauguagcauuuggcaauuuauaauuuauua

SEQ ID NO: 332464 - RNA, 64 nt, Homo Sapiens
gacagagcuagacuguaaagaaaauuugggauucauguagcagaccagaggggaacuugauuca

SEQ ID NO: 332465 - RNA, 64 nt, Homo Sapiens
auaccaggcagacagaaccuuuugauaugagacaauguagcagauuugaguuaaaaauggcacu

SEQ ID NO: 332466 - RNA, 64 nt, Homo Sapiens
gcacucuuaaaugaucugccucuaaaagcguuggauguagcauuaugcaauuagguuuuuccuu

SEQ ID NO: 332467 - RNA, 64 nt, Homo Sapiens
auuguacuaccuguguauauaguuuuuaccuuuuauguagcacauaaacuuuggggaagggagg

SEQ ID NO: 332468 - RNA, 64 nt, Homo Sapiens
uucaugagggagucaauauguaguggaaagaagcauguagcaaaaaagacaaccuugaucuuua

SEQ ID NO: 332469 - RNA, 64 nt, Homo Sapiens
aaaaagcagaacccacuggaguagaaaaggaagcauguagcauauacucaguagugaaauuuaa

SEQ ID NO: 332470 - RNA, 64 nt, Homo Sapiens
auugucuugguugccaguaguaccuuguuuugccauguagcagacaacacacaaaauaaugcag

SEQ ID NO: 332471 - RNA, 64 nt, Homo Sapiens
gccucagcucauagugaacacagcagaccuagaaauguagcagcagccuacugaguagcuuuca

SEQ ID NO: 332472 - RNA, 64 nt, Homo Sapiens; identical to SEQ ID NO: 311703

SEQ ID NO: 332473 - RNA, 64 nt, Homo Sapiens; identical to SEQ ID NO: 311704

SEQ ID NO: 332474 - RNA, 64 nt, Homo Sapiens; identical to SEQ ID NO: 311705

SEQ ID NO: 332475 - RNA, 64 nt, Homo Sapiens; identical to SEQ ID NO: 311706

SEQ ID NO: 332476 - RNA, 64 nt, Homo Sapiens; identical to SEQ ID NO: 311707

SEQ ID NO: 332477 - RNA, 64 nt, Homo Sapiens; identical to SEQ ID NO: 311708

SEQ ID NO: 332478 - RNA, 64 nt, Homo Sapiens; identical to SEQ ID NO: 311709

SEQ ID NO: 332479 - RNA, 64 nt, Homo Sapiens; identical to SEQ ID NO: 311710

SEQ ID NO: 332480 - RNA, 64 nt, Homo Sapiens; identical to SEQ ID NO: 311711

SEQ ID NO: 332481 - RNA, 64 nt, Homo Sapiens; identical to SEQ ID NO: 311712

SEQ ID NO: 332482 - RNA, 64 nt, Homo Sapiens; identical to SEQ ID NO: 311713

SEQ ID NO: 332483 - RNA, 64 nt, Homo Sapiens; identical to SEQ ID NO: 311714

SEQ ID NO: 332484 - RNA, 64 nt, Homo Sapiens; identical to SEQ ID NO: 311713

SEQ ID NO: 332485 - RNA, 64 nt, Homo Sapiens; identical to SEQ ID NO: 311714

SEQ ID NO: 332486 - RNA, 64 nt, Homo Sapiens; identical to SEQ ID NO: 189259

SEQ ID NO: 332487 - RNA, 64 nt, Homo Sapiens; identical to SEQ ID NO: 189260

SEQ ID NO: 332488 - RNA, 64 nt, Homo Sapiens; identical to SEQ ID NO: 189261

SEQ ID NO: 332489 - RNA, 64 nt, Homo Sapiens; identical to SEQ ID NO: 189262

SEQ ID NO: 332490 - RNA, 56 nt, Homo Sapiens; identical to SEQ ID NO: 189263

SEQ ID NO: 332491 - RNA, 64 nt, Homo Sapiens; identical to SEQ ID NO: 189264

SEQ ID NO: 332492 - RNA, 64 nt, Homo Sapiens; identical to SEQ ID NO: 189265

SEQ ID NO: 332493 - RNA, 64 nt, Homo Sapiens; identical to SEQ ID NO: 189266

SEQ ID NO: 332494 - RNA, 64 nt, Homo Sapiens; identical to SEQ ID NO: 189267

SEQ ID NO: 332495 - RNA, 64 nt, Homo Sapiens; identical to SEQ ID NO: 189268

SEQ ID NO: 332496 - RNA, 64 nt, Homo Sapiens; identical to SEQ ID NO: 189269

SEQ ID NO: 332497 - RNA, 64 nt, Homo Sapiens; identical to SEQ ID NO: 189270

SEQ ID NO: 332498 - RNA, 64 nt, Homo Sapiens; identical to SEQ ID NO: 189271

SEQ ID NO: 332499 - RNA, 64 nt, Homo Sapiens; identical to SEQ ID NO: 189272

SEQ ID NO: 332500 - RNA, 64 nt, Homo Sapiens; identical to SEQ ID NO: 189273

SEQ ID NO: 332501 - RNA, 64 nt, Homo Sapiens; identical to SEQ ID NO: 189274

SEQ ID NO: 332502 - RNA, 64 nt, Homo Sapiens; identical to SEQ ID NO: 189275

SEQ ID NO: 332503 - RNA, 64 nt, Homo Sapiens; identical to SEQ ID NO: 189276

SEQ ID NO: 332504 - RNA, 64 nt, Homo Sapiens; identical to SEQ ID NO: 189277

SEQ ID NO: 332505 - RNA, 64 nt, Homo Sapiens; identical to SEQ ID NO: 189278

SEQ ID NO: 332506 - RNA, 64 nt, Homo Sapiens; identical to SEQ ID NO: 189279

SEQ ID NO: 332507 - RNA, 64 nt, Homo Sapiens; identical to SEQ ID NO: 189280

SEQ ID NO: 332508 - RNA, 64 nt, Homo Sapiens; identical to SEQ ID NO: 52376

SEQ ID NO: 332509 - RNA, 64 nt, Homo Sapiens; identical to SEQ ID NO: 52377

SEQ ID NO: 332510 - RNA, 64 nt, Homo Sapiens; identical to SEQ ID NO: 52378

SEQ ID NO: 332511 - RNA, 64 nt, Homo Sapiens; identical to SEQ ID NO: 52379

SEQ ID NO: 332512 - RNA, 64 nt, Homo Sapiens; identical to SEQ ID NO: 52380

SEQ ID NO: 332513 - RNA, 64 nt, Homo Sapiens; identical to SEQ ID NO: 52381

SEQ ID NO: 332514 - RNA, 64 nt, Homo Sapiens; identical to SEQ ID NO: 52382

SEQ ID NO: 332515 - RNA, 64 nt, Homo Sapiens; identical to SEQ ID NO: 52383

SEQ ID NO: 332516 - RNA, 64 nt, Homo Sapiens; identical to SEQ ID NO: 52384

SEQ ID NO: 332517 - RNA, 64 nt, Homo Sapiens; identical to SEQ ID NO: 52385

SEQ ID NO: 332518 - RNA, 64 nt, Homo Sapiens; identical to SEQ ID NO: 52386

SEQ ID NO: 332519 - RNA, 64 nt, Homo Sapiens; identical to SEQ ID NO: 52387

SEQ ID NO: 332520 - RNA, 64 nt, Homo Sapiens; identical to SEQ ID NO: 52388

SEQ ID NO: 332521 - RNA, 64 nt, Homo Sapiens; identical to SEQ ID NO: 52389

SEQ ID NO: 332522 - RNA, 64 nt, Homo Sapiens; identical to SEQ ID NO: 52390

SEQ ID NO: 332523 - RNA, 64 nt, Homo Sapiens; identical to SEQ ID NO: 52391

SEQ ID NO: 332524 - RNA, 64 nt, Homo Sapiens; identical to SEQ ID NO: 52392

SEQ ID NO: 332525 - RNA, 64 nt, Homo Sapiens
uuaacuuucugccucggccuuaaaggcuagcagcaugcgguauuaaaaggcguaagggaacuca

SEQ ID NO: 332526 - RNA, 64 nt, Homo Sapiens
ucauugaccaaaacaucguugaccaccauuguauaugcgguacaaugguuuuauaaucuucugg

SEQ ID NO: 332527 - RNA, 64 nt, Homo Sapiens
gaaaccgguuagucaguguugggggugggggaagaugcgguaauuggugggacacacugggguu

SEQ ID NO: 332528 - RNA, 64 nt, Homo Sapiens
cuuuacuacacucaugagugcacauuugacauaaaugcgguacccugaaaucauauuaaauacc

SEQ ID NO: 332529 - RNA, 64 nt, Homo Sapiens
ccaagcugcucagaaguacgaguggagcugcuggaugcgguaagccugaagaccugccacggca

SEQ ID NO: 332530 - RNA, 64 nt, Homo Sapiens
ggcaggaauagcagaauaaucucuaccaugaaggaugcgguaauagaaacuuuuacuugugaua

SEQ ID NO: 332531 - RNA, 64 nt, Homo Sapiens
aagagcuggcaaguaaggcuugacucucucuggaaugcgguaaugggacaaacuccauccaggu

SEQ ID NO: 332532 - RNA, 64 nt, Homo Sapiens
gggauagcugggaguauggccacccugcuccacgaugcgguaaugaauccagcagaagguaaug

SEQ ID NO: 332533 - RNA, 64 nt, Homo Sapiens
ugcuuuugccaugaucccuuugcggaagaaaaggaugcgguauuccgaacucugacucuaguuc

SEQ ID NO: 332534 - RNA, 64 nt, Homo Sapiens
gggcaucccuccuucccauccagugguggccacgaugcgguacacucugggccuggcucccagu

SEQ ID NO: 332535 - RNA, 64 nt, Homo Sapiens
acaugaggccugucccuaacuuggccuucuuuggaugcgguaucaccccggagcuccuucuagc

SEQ ID NO: 332536 - RNA, 64 nt, Homo Sapiens
gaggugcagacaagggucucuugugcuccuggacaugcgguacucaggggggcaggggccaguc

SEQ ID NO: 332537 - RNA, 64 nt, Homo Sapiens
uccccuucaaggcagacguucaguacaaacauuuaugcgguaggcucagaugucguaauuugca

SEQ ID NO: 332538 - RNA, 64 nt, Homo Sapiens
uugugacuugagucuuuuucggcuuucuuacaugaugcgguaacaggugagcaagauaggacuu

SEQ ID NO: 332539 - RNA, 64 nt, Homo Sapiens
ccaccucaacaaccagcucuaugacaucauuaccaugcgguacgcagacaaacacaugaacauc

SEQ ID NO: 332540 - RNA, 64 nt, Homo Sapiens
gcgcuauccuacacucugagggaguuggcaacgcaugcgguauaguggagugggaagaguugag

SEQ ID NO: 332541 - RNA, 64 nt, Homo Sapiens
gaaauucuaagagagaaaguuuuacugguuuggcaugcgguauguauacauuuuuaaaagccau

SEQ ID NO: 332542 - RNA, 64 nt, Homo Sapiens
gaaaccgguuagucaauuuugggggcgggggaagaugcgguaauuggcggaacacacugggggu

SEQ ID NO: 332543 - RNA, 64 nt, Homo Sapiens
uccgagcaugugggucucgcugagcagucauggaaugcgguagagccaggggacccugucugcc

SEQ ID NO: 332544 - RNA, 64 nt, Homo Sapiens
uucaaacaaagaugcucugugugaccuucucuaaaugcgguagaacuguacaagugcguacaau

SEQ ID NO: 332545 - RNA, 64 nt, Homo Sapiens
ggccacaucaaagaggcugaggcuggcacaggacaugcgguagccagcacacagggcagugagg

SEQ ID NO: 332546 - RNA, 64 nt, Homo Sapiens
gaagggcuuuucagaaaucgguuugaaguuagaaaugcgguaaaacuccuccaggcagcugaca

SEQ ID NO: 332547 - RNA, 64 nt, Homo Sapiens
gaugggaggaaacccagcucuuggcacagcgcagaugcgguagagaguuugggugggguggcag

SEQ ID NO: 332548 - RNA, 64 nt, Homo Sapiens
ucgauucauccauaaauaauauaaggaaaaacuuaugcgguagccugcauuagggcuuuuugau

SEQ ID NO: 332549 - RNA, 64 nt, Homo Sapiens; identical to SEQ ID NO: 89025

SEQ ID NO: 332550 - RNA, 64 nt, Homo Sapiens; identical to SEQ ID NO: 89026

SEQ ID NO: 332551 - RNA, 64 nt, Homo Sapiens; identical to SEQ ID NO: 89027

SEQ ID NO: 332552 - RNA, 64 nt, Homo Sapiens; identical to SEQ ID NO: 89028

SEQ ID NO: 332553 - RNA, 64 nt, Homo Sapiens; identical to SEQ ID NO: 89029

SEQ ID NO: 332554 - RNA, 64 nt, Homo Sapiens; identical to SEQ ID NO: 89030

SEQ ID NO: 332555 - RNA, 64 nt, Homo Sapiens; identical to SEQ ID NO: 89031

SEQ ID NO: 332556 - RNA, 64 nt, Homo Sapiens; identical to SEQ ID NO: 89032

SEQ ID NO: 332557 - RNA, 64 nt, Homo Sapiens; identical to SEQ ID NO: 89033

SEQ ID NO: 332558 - RNA, 64 nt, Homo Sapiens; identical to SEQ ID NO: 89034

SEQ ID NO: 332559 - RNA, 64 nt, Homo Sapiens; identical to SEQ ID NO: 89035

SEQ ID NO: 332560 - RNA, 64 nt, Homo Sapiens; identical to SEQ ID NO: 89036

SEQ ID NO: 332561 - RNA, 64 nt, Homo Sapiens; identical to SEQ ID NO: 89037

SEQ ID NO: 332562 - RNA, 64 nt, Homo Sapiens; identical to SEQ ID NO: 89038

SEQ ID NO: 332563 - RNA, 64 nt, Homo Sapiens; identical to SEQ ID NO: 89039

SEQ ID NO: 332564 - RNA, 64 nt, Homo Sapiens; identical to SEQ ID NO: 89040

SEQ ID NO: 332565 - RNA, 64 nt, Homo Sapiens; identical to SEQ ID NO: 288407

SEQ ID NO: 332566 - RNA, 64 nt, Homo Sapiens; identical to SEQ ID NO: 288408

SEQ ID NO: 332567 - RNA, 64 nt, Homo Sapiens; identical to SEQ ID NO: 288409

SEQ ID NO: 332568 - RNA, 64 nt, Homo Sapiens; identical to SEQ ID NO: 288410

SEQ ID NO: 332569 - RNA, 64 nt, Homo Sapiens; identical to SEQ ID NO: 288411

SEQ ID NO: 332570 - RNA, 64 nt, Homo Sapiens; identical to SEQ ID NO: 288412

SEQ ID NO: 332571 - RNA, 64 nt, Homo Sapiens; identical to SEQ ID NO: 288413

SEQ ID NO: 332572 - RNA, 64 nt, Homo Sapiens; identical to SEQ ID NO: 288414

SEQ ID NO: 332573 - RNA, 64 nt, Homo Sapiens; identical to SEQ ID NO: 288415

SEQ ID NO: 332574 - RNA, 64 nt, Homo Sapiens; identical to SEQ ID NO: 288416

SEQ ID NO: 332575 - RNA, 64 nt, Homo Sapiens; identical to SEQ ID NO: 288417

SEQ ID NO: 332576 - RNA, 64 nt, Homo Sapiens; identical to SEQ ID NO: 288418

SEQ ID NO: 332577 - RNA, 64 nt, Homo Sapiens; identical to SEQ ID NO: 288419

SEQ ID NO: 332578 - RNA, 64 nt, Homo Sapiens; identical to SEQ ID NO: 288420

SEQ ID NO: 332579 - RNA, 64 nt, Homo Sapiens; identical to SEQ ID NO: 288421

SEQ ID NO: 332580 - RNA, 64 nt, Homo Sapiens; identical to SEQ ID NO: 288422

SEQ ID NO: 332581 - RNA, 64 nt, Homo Sapiens; identical to SEQ ID NO: 288423

SEQ ID NO: 332582 - RNA, 64 nt, Homo Sapiens; identical to SEQ ID NO: 288424

SEQ ID NO: 332583 - RNA, 64 nt, Homo Sapiens; identical to SEQ ID NO: 288425

SEQ ID NO: 332584 - RNA, 64 nt, Homo Sapiens; identical to SEQ ID NO: 288426

SEQ ID NO: 332585 - RNA, 64 nt, Homo Sapiens; identical to SEQ ID NO: 288427

SEQ ID NO: 332586 - RNA, 64 nt, Homo Sapiens; identical to SEQ ID NO: 288428

SEQ ID NO: 332587 - RNA, 64 nt, Homo Sapiens; identical to SEQ ID NO: 288429

SEQ ID NO: 332588 - RNA, 64 nt, Homo Sapiens; identical to SEQ ID NO: 288430

SEQ ID NO: 332589 - RNA, 64 nt, Homo Sapiens; identical to SEQ ID NO: 288431

SEQ ID NO: 332590 - RNA, 64 nt, Homo Sapiens; identical to SEQ ID NO: 288432

SEQ ID NO: 332591 - RNA, 64 nt, Homo Sapiens; identical to SEQ ID NO: 288433

SEQ ID NO: 332592 - RNA, 64 nt, Homo Sapiens; identical to SEQ ID NO: 288434

SEQ ID NO: 332593 - RNA, 64 nt, Homo Sapiens; identical to SEQ ID NO: 288435

SEQ ID NO: 332594 - RNA, 64 nt, Homo Sapiens; identical to SEQ ID NO: 288436

SEQ ID NO: 332595 - RNA, 64 nt, Homo Sapiens; identical to SEQ ID NO: 288437

SEQ ID NO: 332596 - RNA, 64 nt, Homo Sapiens; identical to SEQ ID NO: 288438

SEQ ID NO: 332597 - RNA, 64 nt, Homo Sapiens; identical to SEQ ID NO: 288439

SEQ ID NO: 332598 - RNA, 64 nt, Homo Sapiens; identical to SEQ ID NO: 288440

SEQ ID NO: 332599 - RNA, 64 nt, Homo Sapiens; identical to SEQ ID NO: 288441

SEQ ID NO: 332600 - RNA, 64 nt, Homo Sapiens; identical to SEQ ID NO: 288442

SEQ ID NO: 332601 - RNA, 64 nt, Homo Sapiens; identical to SEQ ID NO: 288443

SEQ ID NO: 332602 - RNA, 64 nt, Homo Sapiens; identical to SEQ ID NO: 288444

SEQ ID NO: 332603 - RNA, 64 nt, Homo Sapiens; identical to SEQ ID NO: 288445

SEQ ID NO: 332604 - RNA, 64 nt, Homo Sapiens; identical to SEQ ID NO: 288446

SEQ ID NO: 332605 - RNA, 64 nt, Homo Sapiens; identical to SEQ ID NO: 288447

SEQ ID NO: 332606 - RNA, 64 nt, Homo Sapiens; identical to SEQ ID NO: 288448

SEQ ID NO: 332607 - RNA, 64 nt, Homo Sapiens; identical to SEQ ID NO: 288449

SEQ ID NO: 332608 - RNA, 64 nt, Homo Sapiens; identical to SEQ ID NO: 288450

SEQ ID NO: 332609 - RNA, 64 nt, Homo Sapiens; identical to SEQ ID NO: 288451

SEQ ID NO: 332610 - RNA, 64 nt, Homo Sapiens
augaucaccauuuguacauaauaaguuuuuuaucaguaaggaccuuuuguaacagaaauugcuu

SEQ ID NO: 332611 - RNA, 64 nt, Homo Sapiens
aauuugggaaauggaguaucagaaaugugauugaaguaaggaguaggcacacuccuuggccugc

SEQ ID NO: 332612 - RNA, 64 nt, Homo Sapiens
aaaagauauagaauaguaaugugguauagaagggaguaaggaauauaaggaguugagucgcuuu

SEQ ID NO: 332613 - RNA, 64 nt, Homo Sapiens
acagcaggcccagaaggugugcagcaccauucggaguaaggaugacauguuuugacucuggcuu

SEQ ID NO: 332614 - RNA, 64 nt, Homo Sapiens
accuguugaaucuugacuauaaaaugaucugagaaguaaggaaggcugggcugauguguggcuc

SEQ ID NO: 332615 - RNA, 64 nt, Homo Sapiens
uggaggugaggcggaggaaaggcagguaggaaggaguaaggauggagaugcucagaaucaagag

SEQ ID NO: 332616 - RNA, 64 nt, Homo Sapiens
gcuuagaguauuucuuuaaucacagucacugggaaguaaggagauguauauauguguauauaug

SEQ ID NO: 332617 - RNA, 64 nt, Homo Sapiens
ggccuggcauugcacaugguguuacauggcuacaaguaaggaaaaaaucagaaagugaaagaac

SEQ ID NO: 332618 - RNA, 64 nt, Homo Sapiens
augaugggcuuucuacagccugcuuaccacuaacaguaaggaaucuuucauaaacacaccucag

SEQ ID NO: 332619 - RNA, 64 nt, Homo Sapiens
gucuuccaugaacugauuaugcuuaauuaagcaaaguaaggaaauuaguuucauggaagccuaa

SEQ ID NO: 332620 - RNA, 64 nt, Homo Sapiens
cauuuuggggagccaccugaagguugauguauaaaguaaggauuagagaaagaggucguuguga

SEQ ID NO: 332621 - RNA, 64 nt, Homo Sapiens
ggggaugucuguccuaaaagcugacugcuaggauaguaaggaucaucuugccugggcuaugcca

SEQ ID NO: 332622 - RNA, 64 nt, Homo Sapiens
gguaacuaguaggauagaaacacugugucccgagaguaaggagagaagcuacuauugauuagag

SEQ ID NO: 332623 - RNA, 64 nt, Homo Sapiens
gaugaggucccugguuuuucauggcaacuugaucaguaaggauuucaccucuguuuguaacuaa

SEQ ID NO: 332624 - RNA, 64 nt, Homo Sapiens; identical to SEQ ID NO: 75363

SEQ ID NO: 332625 - RNA, 64 nt, Homo Sapiens; identical to SEQ ID NO: 75364

SEQ ID NO: 332626 - RNA, 64 nt, Homo Sapiens; identical to SEQ ID NO: 75365

SEQ ID NO: 332627 - RNA, 53 nt, Homo Sapiens; identical to SEQ ID NO: 75366

SEQ ID NO: 332628 - RNA, 64 nt, Homo Sapiens; identical to SEQ ID NO: 75367

SEQ ID NO: 332629 - RNA, 64 nt, Homo Sapiens; identical to SEQ ID NO: 75368

SEQ ID NO: 332630 - RNA, 64 nt, Homo Sapiens; identical to SEQ ID NO: 75369

SEQ ID NO: 332631 - RNA, 64 nt, Homo Sapiens; identical to SEQ ID NO: 75370

SEQ ID NO: 332632 - RNA, 64 nt, Homo Sapiens; identical to SEQ ID NO: 75371

SEQ ID NO: 332633 - RNA, 64 nt, Homo Sapiens; identical to SEQ ID NO: 75372

SEQ ID NO: 332634 - RNA, 64 nt, Homo Sapiens; identical to SEQ ID NO: 75373

SEQ ID NO: 332635 - RNA, 64 nt, Homo Sapiens; identical to SEQ ID NO: 75374

SEQ ID NO: 332636 - RNA, 64 nt, Homo Sapiens; identical to SEQ ID NO: 75375

SEQ ID NO: 332637 - RNA, 64 nt, Homo Sapiens; identical to SEQ ID NO: 75376

SEQ ID NO: 332638 - RNA, 64 nt, Homo Sapiens; identical to SEQ ID NO: 75377

SEQ ID NO: 332639 - RNA, 64 nt, Homo Sapiens; identical to SEQ ID NO: 75378

SEQ ID NO: 332640 - RNA, 64 nt, Homo Sapiens; identical to SEQ ID NO: 75379

SEQ ID NO: 332641 - RNA, 64 nt, Homo Sapiens; identical to SEQ ID NO: 75380

SEQ ID NO: 332642 - RNA, 64 nt, Homo Sapiens; identical to SEQ ID NO: 75381

SEQ ID NO: 332643 - RNA, 64 nt, Homo Sapiens; identical to SEQ ID NO: 102070

SEQ ID NO: 332644 - RNA, 64 nt, Homo Sapiens; identical to SEQ ID NO: 102071

SEQ ID NO: 332645 - RNA, 64 nt, Homo Sapiens; identical to SEQ ID NO: 102072

SEQ ID NO: 332646 - RNA, 64 nt, Homo Sapiens; identical to SEQ ID NO: 102073

SEQ ID NO: 332647 - RNA, 64 nt, Homo Sapiens; identical to SEQ ID NO: 102074

SEQ ID NO: 332648 - RNA, 64 nt, Homo Sapiens; identical to SEQ ID NO: 102075

SEQ ID NO: 332649 - RNA, 64 nt, Homo Sapiens; identical to SEQ ID NO: 102076

SEQ ID NO: 332650 - RNA, 64 nt, Homo Sapiens; identical to SEQ ID NO: 102077

SEQ ID NO: 332651 - RNA, 64 nt, Homo Sapiens; identical to SEQ ID NO: 102078

SEQ ID NO: 332652 - RNA, 64 nt, Homo Sapiens; identical to SEQ ID NO: 102079

SEQ ID NO: 332653 - RNA, 64 nt, Homo Sapiens; identical to SEQ ID NO: 102080

SEQ ID NO: 332654 - RNA, 64 nt, Homo Sapiens; identical to SEQ ID NO: 102081

SEQ ID NO: 332655 - RNA, 64 nt, Homo Sapiens; identical to SEQ ID NO: 102082

SEQ ID NO: 332656 - RNA, 64 nt, Homo Sapiens
aaauaaaaaagguuugccaauuauaugaaagcauuuuuaucacaaaagguaguuaagaugaaau

SEQ ID NO: 332657 - RNA, 64 nt, Homo Sapiens
cuaaauggugacucucugccauagugugcaaacauuuuaucauuacauucugucagccucuuuc

SEQ ID NO: 332658 - RNA, 64 nt, Homo Sapiens
caggaaagaaaggagaguagaacauuuuuccucauuuuaucaaauccucucuugcccucccuca

SEQ ID NO: 332659 - RNA, 64 nt, Homo Sapiens
uaacauuccugaagcuguucccacucccagaugguuuuaucaauagccuagagguaaagaacug

SEQ ID NO: 332660 - RNA, 64 nt, Homo Sapiens
gugucuccuuaugguacacuccagcgguugccuuuuuuaucauuucuacugaaguugggaaauu

SEQ ID NO: 332661 - RNA, 64 nt, Homo Sapiens
uuacacagcaauuuuguauccauuuaaacuaaccuuuuaucaauaaagcacuauuguuuagaua

SEQ ID NO: 332662 - RNA, 64 nt, Homo Sapiens
gacaaaauuuuaguccaaauaacaaguaccaaaguuuuaucaaguuugggucugugcugcuguu

SEQ ID NO: 332663 - RNA, 64 nt, Homo Sapiens
aagacucuauucucaaaguuuccuaaucagaaauuuuuaucaguuuccagucucaaaaauacaa

SEQ ID NO: 332664 - RNA, 64 nt, Homo Sapiens
uuugaaucuaccauucauagauuucaaguggcaguuuuaucacggccugcugguacugugaugc

SEQ ID NO: 332665 - RNA, 64 nt, Homo Sapiens
augaacuagugucuaaauacaaacuaaauuuuaauuuuaucaucaguuucaauuuuuguuugua

SEQ ID NO: 332666 - RNA, 64 nt, Homo Sapiens
guaaaucugcaaaaggcaaugaaaaugccuuaaauuuuaucaauaacagaauuauuguauuuaa

SEQ ID NO: 332667 - RNA, 64 nt, Homo Sapiens
cuuuaaaauaguaaauaggauuuuaaacagagaauuuuaucaguaauaggugucaguuuuuaaa

SEQ ID NO: 332668 - RNA, 64 nt, Homo Sapiens
guggaucauucuaguaggaaaggacaauaagauuuuuuaucaaaaugugucaugccaguaagag

SEQ ID NO: 332669 - RNA, 64 nt, Homo Sapiens
uugagcacuuuuacuuaaacuugcuuguaguugcuuuuaucacugccgcaaaacagccaucaag

SEQ ID NO: 332670 - RNA, 64 nt, Homo Sapiens
ucugguauagacuuugggaguaugugugugaaguuuuuaucaaacuguaauauuugugaaugga

SEQ ID NO: 332671 - RNA, 64 nt, Homo Sapiens
agaaguuuagcauuaauaguuguucugaaacguguuuuaucagguuuagagcccauguugaguc

SEQ ID NO: 332672 - RNA, 64 nt, Homo Sapiens
ccugaauuuugcuguguuuccauuuuuuagagauuuuuaucauuuuuuucucucucggcauucu

SEQ ID NO: 332673 - RNA, 64 nt, Homo Sapiens
ugcuuucuugugaauuuuuuagucuuuuuaaucuuuuuaucauaaugcuucuagaugucauggc

SEQ ID NO: 332674 - RNA, 64 nt, Homo Sapiens
gugagaaaauuaaaauuauuuguugcuuucugauuuuuaucagaugugguagcaauuuuauaaa

SEQ ID NO: 332675 - RNA, 64 nt, Homo Sapiens
agccaacuuuggguauuuuuuuuugaaggauaauuuuuaucaaucuggucuuuucuauauaguc

SEQ ID NO: 332676 - RNA, 64 nt, Homo Sapiens
aauaaauauagagacaaaauauggaaaaaugacauuuuaucauauuccuuguagcugauaucuc

SEQ ID NO: 332677 - RNA, 64 nt, Homo Sapiens
agugcuguuguggagugcgucuguaaagugcuuguuuuaucauacuuccugccucuccccuccc

SEQ ID NO: 332678 - RNA, 64 nt, Homo Sapiens
uccauauuugcauuccucuuaugcuuuaccuguauuuuaucauuuguaagcagaacucuagcua

SEQ ID NO: 332679 - RNA, 64 nt, Homo Sapiens
uaguauccuaguuccagcauauauucaacaugaauuuuaucauucuccuccuaauggaaugucu

SEQ ID NO: 332680 - RNA, 64 nt, Homo Sapiens
aauuuaguuuucaaaaaaaaaaugcaggaaacuguuuuaucagggagcccaaacacccagcaua

SEQ ID NO: 332681 - RNA, 64 nt, Homo Sapiens
ucuuuuugccuguuugcuaauuuaaaaauauuuauuuuaucauuuuaauguuuucauggacuuu

SEQ ID NO: 332682 - RNA, 64 nt, Homo Sapiens
gcccaacauguggcaugcaaaaguuauaaaaccauuuuaucagguaguuaaagcccucccccaa

SEQ ID NO: 332683 - RNA, 64 nt, Homo Sapiens
uugcuaaaugaguucugcuugcauuuuuccuuccuuuuaucacauaaugacuuuuaaaacauau

SEQ ID NO: 332684 - RNA, 64 nt, Homo Sapiens
guaaaugaucacaauuuuaauauaggagauguauuuuuaucauaaaagauauuugaaguguuuu

SEQ ID NO: 332685 - RNA, 64 nt, Homo Sapiens
uuugccuuaaaauaaugaaacucaccacugacuauuuuaucaaaacaaacacacuauauacuuc

SEQ ID NO: 332686 - RNA, 64 nt, Homo Sapiens
uuaucacguuugucuuuauaauauuuggguuaguuuuuaucacagguguaucugagcaaaauau

SEQ ID NO: 332687 - RNA, 64 nt, Homo Sapiens
uguuuaaaaaucucugccuguaugucagaaaguauuuuaucagauuuguaauucuaagaaaaug

SEQ ID NO: 332688 - RNA, 64 nt, Homo Sapiens
cauaauguguuaaagcccucugacucugauuuuguuuuaucaauaugauuaaagaauaacuaaa

SEQ ID NO: 332689 - RNA, 64 nt, Homo Sapiens
gacacuccaugggguggcuuucccuaauaaauaguuuuaucagggccgaggcguccauagcauu

SEQ ID NO: 332690 - RNA, 64 nt, Homo Sapiens
ccucccuuaggagcauugguccucuguuguccauuuuuaucaccagauguuuuccacugaagca

SEQ ID NO: 332691 - RNA, 64 nt, Homo Sapiens
agccuagcagacuuaaaggacaagguaguaaauguuuuaucacucaaaaauccauuagaaguuu

SEQ ID NO: 332692 - RNA, 64 nt, Homo Sapiens
caaauagaaucauguuuauuuuuucagcucucccuuuuaucauuauucacacuccucugcccuc

SEQ ID NO: 332693 - RNA, 64 nt, Homo Sapiens
uugggaaugugauuuugcucccacccuaaggaauuuuuaucaccaaaaugaauguuaaugaauu

SEQ ID NO: 332694 - RNA, 64 nt, Homo Sapiens
ccuaacugugacagcugugaaugcuaacaauuaauuuuaucaaacagcugugccaguaauaagg

SEQ ID NO: 332695 - RNA, 64 nt, Homo Sapiens
uuuuccugcagcaggugcauagaucuaaaugacauuuuaucaugucuaacggucuuguaguuag

SEQ ID NO: 332696 - RNA, 64 nt, Homo Sapiens
agcauuuuaccccuggauuauagcacaucucauguuuuaucauuuggauggaguaauuuaaaau

SEQ ID NO: 332697 - RNA, 64 nt, Homo Sapiens
gaaucaugccuuccaauaaaggccuuuacacauguuuuaucaauaugauuaucaaaucacagca

SEQ ID NO: 332698 - RNA, 64 nt, Homo Sapiens
ucauaguucugaugcuuuuggucacagagcaucauuuuaucacuucuggaaaauguuuauucca

SEQ ID NO: 332699 - RNA, 64 nt, Homo Sapiens
uguuuaaaugcaaauguucauaucucauuucuuuuuuuaucauguuaaauaaauguugauguuc

SEQ ID NO: 332700 - RNA, 64 nt, Homo Sapiens
cacaaguaguguacuguucaaccaccuuucaacuuuuuaucacuauuaggucuaucuagccacc

SEQ ID NO: 332701 - RNA, 64 nt, Homo Sapiens
aauguucuauagaaaagaaagauugcuguugaucuuuuaucaauaaaugguccuggaguuggua

SEQ ID NO: 332702 - RNA, 64 nt, Homo Sapiens
aaauagugugguaagaguacccaugauuauaguuuuuuaucagaauuugauaagauuuucuguu

SEQ ID NO: 332703 - RNA, 64 nt, Homo Sapiens
aauuauuuuaaauauuuuucuuuuaaaaauaacuuuuuaucaguacagaaaaaccuaagggaug

SEQ ID NO: 332704 - RNA, 64 nt, Homo Sapiens
agcaaacuucagccguuucacuaccauucaaauguuuuaucaacucagggguucaaauuuccuu

SEQ ID NO: 332705 - RNA, 64 nt, Homo Sapiens
aaaaugaucuuuggcuaaacagucuacggauauuuuuuaucauauuuuaaaaaccagaauaugu

SEQ ID NO: 332706 - RNA, 64 nt, Homo Sapiens
ccuguuaaugcuuguccuuguuagucaguuuggguuuuaucaaucuuauauugugagaacacau

SEQ ID NO: 332707 - RNA, 64 nt, Homo Sapiens
gcaguuaugaucaucguuuucaugucuaggauccuuuuaucaaggauuuuugcgcagacuuaua

SEQ ID NO: 332708 - RNA, 64 nt, Homo Sapiens
gggcugaguugagaacacugaagcugagaaauuauuuuaucaaaauuucaaaaggacagugaac

SEQ ID NO: 332709 - RNA, 64 nt, Homo Sapiens
agaguaacucagauucauuuauuauuugaugcaauuuuaucauaucauuucaguuugguuugua

SEQ ID NO: 332710 - RNA, 64 nt, Homo Sapiens
uggcuauucugcuuccuuuguguuucuauguaaauuuuaucaucagugugucuauuucuacaaa

SEQ ID NO: 332711 - RNA, 64 nt, Homo Sapiens
uauaccccuguauuuauuuguuuucuugaauuucuuuuaucauuguuuuguaguuuucaccaug

SEQ ID NO: 332712 - RNA, 64 nt, Homo Sapiens
uagaaaaaaaaauguauuugaguacuaauuuucuuuuuaucaagauauauuuuugaaccuuuua

SEQ ID NO: 332713 - RNA, 64 nt, Homo Sapiens
auuacuaagugaguaguauaaaaauauuucccuauuuuaucaugcuggugcauauuuuugaguu

SEQ ID NO: 332714 - RNA, 64 nt, Homo Sapiens
gcguuuguaucuauuacuaaguuugacagucucauuuuaucacuugauuugauuauacuguaaa

SEQ ID NO: 332715 - RNA, 64 nt, Homo Sapiens
gaacugaagaugagaauacuaacauaguucaugguuuuaucaaaucacauaguguuguauuuga

SEQ ID NO: 332716 - RNA, 64 nt, Homo Sapiens
uuuauauuuauaagccuuaucgauuuuuaucaauuuuuaucagugagggacaugacuaauuuau

SEQ ID NO: 332717 - RNA, 64 nt, Homo Sapiens
uuuuaucaguuuuauauuuaacuaauuuaucgauuuuuaucaaucaguuccuuggagggacaug

SEQ ID NO: 332718 - RNA, 64 nt, Homo Sapiens
caaauaagaaacaaagcaccuaauuccagagaauuuuuaucaccacaauguuguguccacuguu

SEQ ID NO: 332719 - RNA, 64 nt, Homo Sapiens
aauuuuauaaacacagccuuauagagauaaauauuuuuaucaaaaccuucauguuguaaaguua

SEQ ID NO: 332720 - RNA, 64 nt, Homo Sapiens
cugaaaagugaguuugcagagcugcauugaggagacuccacagauggaaccacccuccccagag

SEQ ID NO: 332721 - RNA, 64 nt, Homo Sapiens
gcuggcucugcucagaagccuccuguucaccaggacuccacagaagugggucgagcgccugaga

SEQ ID NO: 332722 - RNA, 64 nt, Homo Sapiens
guuuggagaauagaaaugaaacgggaacugaaaaacuccacagggaccaagagcaggcaaagac

SEQ ID NO: 332723 - RNA, 64 nt, Homo Sapiens
agaggaccgguugcagcuuauuccugaacaugucacuccacagcggacauuccaucugaggucc

SEQ ID NO: 332724 - RNA, 64 nt, Homo Sapiens
aggccaggcugaccccaccagccagucagcuacaacuccacaucaacuccacaugcgcccagcu

SEQ ID NO: 332725 - RNA, 64 nt, Homo Sapiens
accccaccagccagucagcuacaacuccacaucaacuccacaugcgcccagcucgagacugaug

SEQ ID NO: 332726 - RNA, 64 nt, Homo Sapiens; identical to SEQ ID NO: 284671

SEQ ID NO: 332727 - RNA, 64 nt, Homo Sapiens; identical to SEQ ID NO: 284672

SEQ ID NO: 332728 - RNA, 64 nt, Homo Sapiens; identical to SEQ ID NO: 284673

SEQ ID NO: 332729 - RNA, 64 nt, Homo Sapiens; identical to SEQ ID NO: 284674

SEQ ID NO: 332730 - RNA, 64 nt, Homo Sapiens; identical to SEQ ID NO: 284675

SEQ ID NO: 332731 - RNA, 64 nt, Homo Sapiens; identical to SEQ ID NO: 284676

SEQ ID NO: 332732 - RNA, 64 nt, Homo Sapiens; identical to SEQ ID NO: 284677

SEQ ID NO: 332733 - RNA, 64 nt, Homo Sapiens; identical to SEQ ID NO: 284678

SEQ ID NO: 332734 - RNA, 64 nt, Homo Sapiens; identical to SEQ ID NO: 284679

SEQ ID NO: 332735 - RNA, 64 nt, Homo Sapiens; identical to SEQ ID NO: 284680

SEQ ID NO: 332736 - RNA, 64 nt, Homo Sapiens; identical to SEQ ID NO: 284681

SEQ ID NO: 332737 - RNA, 64 nt, Homo Sapiens; identical to SEQ ID NO: 284682

SEQ ID NO: 332738 - RNA, 64 nt, Homo Sapiens
uauauaggauuacaaaggaaaaucauguuuuuaaaugcauaaaagccuaugaaugccuucuuaa

SEQ ID NO: 332739 - RNA, 64 nt, Homo Sapiens
gacaagcacuuuggaagaauguuaaaguaaagaaaugcauaaaaaacacauauuuuuauauuau

SEQ ID NO: 332740 - RNA, 64 nt, Homo Sapiens
cuagcaaaacucccuuuuuucucuugccuuuuuuaugcauaaauggaggucaauuugauugucc

SEQ ID NO: 332741 - RNA, 64 nt, Homo Sapiens
aaaccagaagacuuugaaguuguauauucuugcaaugcauaaaaugacauuauaaucaacaaac

SEQ ID NO: 332742 - RNA, 64 nt, Homo Sapiens
uaaacccauuuuaaugugcaugugguacaguaauaugcauaaaagugauuuguaauaaauuuau

SEQ ID NO: 332743 - RNA, 64 nt, Homo Sapiens
agagugaccccccccagcacuguucugugugaauaugcauaaccgcuucccaauuguagcacca

SEQ ID NO: 332744 - RNA, 64 nt, Homo Sapiens
auauucaauguauugagaaccaaagcaaccacaaaugcauaaaugcauaauuuauggucuucaa

SEQ ID NO: 332745 - RNA, 64 nt, Homo Sapiens
uguauugagaaccaaagcaaccacaaaugcauaaaugcauaauuuauggucuucaaccaaggcc

SEQ ID NO: 332746 - RNA, 64 nt, Homo Sapiens
agccaauuaucugauuaagcauucuuuccacugaaugcauaauguuuaaauagcauaaaaugaa

SEQ ID NO: 332747 - RNA, 64 nt, Homo Sapiens
agauaauaaugauggucaacaauaagccacgucaaugcauaaguuguauaggcuaaauguugcu

SEQ ID NO: 332748 - RNA, 64 nt, Homo Sapiens
auuuuuaauggaaagagcauguuagagcaaacaaaugcauaagcaagacugagcagcauuauaa

SEQ ID NO: 332749 - RNA, 64 nt, Homo Sapiens
cagauaacacuguaguuccuaaaaaaaaaauuaaaugcauaagcauaagguagaaauuaaaaua

SEQ ID NO: 332750 - RNA, 64 nt, Homo Sapiens
guugcaguaacauugacuauguuucaaaacucagaugcauaaaacguaagguauauaaaaauac

SEQ ID NO: 332751 - RNA, 64 nt, Homo Sapiens
uuccuccauggaccagaguaauuggcacauuuuaaugcauaagcuggggguuucauuuucccag

SEQ ID NO: 332752 - RNA, 64 nt, Homo Sapiens
cacaccaaaaccagacucaaaaguaauccacauaaugcauaagccacagcaaugaauggcacac

SEQ ID NO: 332753 - RNA, 64 nt, Homo Sapiens
uucacuuugacucuggucuuaugcuugccucauaaugcauaacuaaccuuucucccuucucaaa

SEQ ID NO: 332754 - RNA, 64 nt, Homo Sapiens
ugagcuacacuaaaccacauauguuauaugauacaugcauaacuugacaaaagaacuugaaccu

SEQ ID NO: 332755 - RNA, 64 nt, Homo Sapiens
auagaagacaaucugcuuguauaaaauacaacacaugcauaaaaugguaacacaauacguucuu

SEQ ID NO: 332756 - RNA, 64 nt, Homo Sapiens; identical to SEQ ID NO: 22256

SEQ ID NO: 332757 - RNA, 64 nt, Homo Sapiens; identical to SEQ ID NO: 22257

SEQ ID NO: 332758 - RNA, 64 nt, Homo Sapiens; identical to SEQ ID NO: 22258

SEQ ID NO: 332759 - RNA, 64 nt, Homo Sapiens; identical to SEQ ID NO: 22259

SEQ ID NO: 332760 - RNA, 64 nt, Homo Sapiens; identical to SEQ ID NO: 22260

SEQ ID NO: 332761 - RNA, 64 nt, Homo Sapiens; identical to SEQ ID NO: 22261

SEQ ID NO: 332762 - RNA, 64 nt, Homo Sapiens; identical to SEQ ID NO: 22262

SEQ ID NO: 332763 - RNA, 64 nt, Homo Sapiens; identical to SEQ ID NO: 22263

SEQ ID NO: 332764 - RNA, 64 nt, Homo Sapiens; identical to SEQ ID NO: 22264

SEQ ID NO: 332765 - RNA, 64 nt, Homo Sapiens; identical to SEQ ID NO: 22265

SEQ ID NO: 332766 - RNA, 64 nt, Homo Sapiens; identical to SEQ ID NO: 22266

SEQ ID NO: 332767 - RNA, 64 nt, Homo Sapiens; identical to SEQ ID NO: 22267

SEQ ID NO: 332768 - RNA, 64 nt, Homo Sapiens; identical to SEQ ID NO: 22268

SEQ ID NO: 332769 - RNA, 64 nt, Homo Sapiens; identical to SEQ ID NO: 22269

SEQ ID NO: 332770 - RNA, 64 nt, Homo Sapiens; identical to SEQ ID NO: 22270

SEQ ID NO: 332771 - RNA, 64 nt, Homo Sapiens; identical to SEQ ID NO: 22271

SEQ ID NO: 332772 - RNA, 64 nt, Homo Sapiens; identical to SEQ ID NO: 22272

SEQ ID NO: 332773 - RNA, 64 nt, Homo Sapiens; identical to SEQ ID NO: 22273

SEQ ID NO: 332774 - RNA, 64 nt, Homo Sapiens; identical to SEQ ID NO: 22274

SEQ ID NO: 332775 - RNA, 64 nt, Homo Sapiens; identical to SEQ ID NO: 22275

SEQ ID NO: 332776 - RNA, 64 nt, Homo Sapiens; identical to SEQ ID NO: 22276

SEQ ID NO: 332777 - RNA, 64 nt, Homo Sapiens; identical to SEQ ID NO: 22277

SEQ ID NO: 332778 - RNA, 64 nt, Homo Sapiens; identical to SEQ ID NO: 166381

SEQ ID NO: 332779 - RNA, 64 nt, Homo Sapiens; identical to SEQ ID NO: 166382

SEQ ID NO: 332780 - RNA, 64 nt, Homo Sapiens; identical to SEQ ID NO: 166383

SEQ ID NO: 332781 - RNA, 64 nt, Homo Sapiens; identical to SEQ ID NO: 166384

SEQ ID NO: 332782 - RNA, 64 nt, Homo Sapiens; identical to SEQ ID NO: 166385

SEQ ID NO: 332783 - RNA, 64 nt, Homo Sapiens; identical to SEQ ID NO: 166386

SEQ ID NO: 332784 - RNA, 64 nt, Homo Sapiens; identical to SEQ ID NO: 166387

SEQ ID NO: 332785 - RNA, 64 nt, Homo Sapiens; identical to SEQ ID NO: 166388

SEQ ID NO: 332786 - RNA, 64 nt, Homo Sapiens; identical to SEQ ID NO: 166389

SEQ ID NO: 332787 - RNA, 64 nt, Homo Sapiens; identical to SEQ ID NO: 166390

SEQ ID NO: 332788 - RNA, 64 nt, Homo Sapiens; identical to SEQ ID NO: 166391

SEQ ID NO: 332789 - RNA, 64 nt, Homo Sapiens; identical to SEQ ID NO: 166392

SEQ ID NO: 332790 - RNA, 64 nt, Homo Sapiens; identical to SEQ ID NO: 166393

SEQ ID NO: 332791 - RNA, 64 nt, Homo Sapiens; identical to SEQ ID NO: 166394

SEQ ID NO: 332792 - RNA, 64 nt, Homo Sapiens; identical to SEQ ID NO: 166395

SEQ ID NO: 332793 - RNA, 64 nt, Homo Sapiens; identical to SEQ ID NO: 166396

SEQ ID NO: 332794 - RNA, 64 nt, Homo Sapiens; identical to SEQ ID NO: 166397

SEQ ID NO: 332795 - RNA, 64 nt, Homo Sapiens
aaggaaaaccaucuagagaguuuucuuuagaagugacucccauuagccuggugugguggugugu

SEQ ID NO: 332796 - RNA, 64 nt, Homo Sapiens
gacccugugucuaaguaaagaaaaagccagaagugacucccacugcuucuguugaucggccaua

SEQ ID NO: 332797 - RNA, 64 nt, Homo Sapiens
uaggcugaaaaccuagaagucaagguuuguacacgacucccauccuccuccaaccuuuuuuugc

SEQ ID NO: 332798 - RNA, 64 nt, Homo Sapiens
ugcuacccccucccuucccacagcuggaagagcagacucccagccaugggggugggagggcccc

SEQ ID NO: 332799 - RNA, 64 nt, Homo Sapiens; identical to SEQ ID NO: 58517

SEQ ID NO: 332800 - RNA, 64 nt, Homo Sapiens; identical to SEQ ID NO: 58518

SEQ ID NO: 332801 - RNA, 64 nt, Homo Sapiens; identical to SEQ ID NO: 58519

SEQ ID NO: 332802 - RNA, 64 nt, Homo Sapiens; identical to SEQ ID NO: 58520

SEQ ID NO: 332803 - RNA, 64 nt, Homo Sapiens; identical to SEQ ID NO: 58521

SEQ ID NO: 332804 - RNA, 64 nt, Homo Sapiens; identical to SEQ ID NO: 58522

SEQ ID NO: 332805 - RNA, 64 nt, Homo Sapiens; identical to SEQ ID NO: 58523

SEQ ID NO: 332806 - RNA, 64 nt, Homo Sapiens; identical to SEQ ID NO: 58524

SEQ ID NO: 332807 - RNA, 64 nt, Homo Sapiens; identical to SEQ ID NO: 58525

SEQ ID NO: 332808 - RNA, 64 nt, Homo Sapiens; identical to SEQ ID NO: 58526

SEQ ID NO: 332809 - RNA, 64 nt, Homo Sapiens; identical to SEQ ID NO: 58527

SEQ ID NO: 332810 - RNA, 64 nt, Homo Sapiens; identical to SEQ ID NO: 58528

SEQ ID NO: 332811 - RNA, 64 nt, Homo Sapiens; identical to SEQ ID NO: 58529

SEQ ID NO: 332812 - RNA, 64 nt, Homo Sapiens; identical to SEQ ID NO: 58530

SEQ ID NO: 332813 - RNA, 64 nt, Homo Sapiens; identical to SEQ ID NO: 58531

SEQ ID NO: 332814 - RNA, 64 nt, Homo Sapiens; identical to SEQ ID NO: 58532

SEQ ID NO: 332815 - RNA, 64 nt, Homo Sapiens
aauagcaugaacagucagaauaacgcugaacugcagcugcaaguuccagcacagacacuacagu

SEQ ID NO: 332816 - RNA, 64 nt, Homo Sapiens
ccccaaaguagaagaugugcagcacuauguuaggagcugcaaggaucuagcaccaacuaccauu

SEQ ID NO: 332817 - RNA, 64 nt, Homo Sapiens
uauagcuaaccacuuuccauuugaaaaugaacuuagcugcaaaaucaaagguuuuguaaaacuu

SEQ ID NO: 332818 - RNA, 64 nt, Homo Sapiens
acacuaauucacauuuuuauucacucauacuuuuagcugcaaccacgucgucauucuuguuaca

SEQ ID NO: 332819 - RNA, 64 nt, Homo Sapiens
aucugcagcaguuuguugugugcaguuugauggcagcugcaaacuggaggugaggcggaggaaa

SEQ ID NO: 332820 - RNA, 64 nt, Homo Sapiens
caaccacuacgagcauaccccaugcccaccguggagcugcaacuccucgacagcacugaguuug

SEQ ID NO: 332821 - RNA, 64 nt, Homo Sapiens
gugcugguuacugaugaauaugggccccuuauagagcugcaaaacacacacaugcguauagaca

SEQ ID NO: 332822 - RNA, 64 nt, Homo Sapiens
caggagcagaacucaguauccagagcuuacaaggagcugcaaggguuugccgagggcugcccag

SEQ ID NO: 332823 - RNA, 64 nt, Homo Sapiens
gagaaaaaucugacaggagaauguauuuuaaaugagcugcaagaaugaucaaauaacuuucagg

SEQ ID NO: 332824 - RNA, 64 nt, Homo Sapiens
uuagaaaagcuuuaacuuaaugccauauuuuacaagcugcaauuaaaacaagagaaaagaaacu

SEQ ID NO: 332825 - RNA, 64 nt, Homo Sapiens
uaccuaaagcuuccugccaauaaugcaagaagccagcugcaauuucccagaagcauuugucucu

SEQ ID NO: 332826 - RNA, 64 nt, Homo Sapiens
cucauggguuaaaaccuagacauuugccacaucuagcugcaaagaaggcuagggaaugucuuua

SEQ ID NO: 332827 - RNA, 64 nt, Homo Sapiens
cucccuccacuaccgcuauuucuccuuggauggcaccauccacccugcaggcuugggaacugua

SEQ ID NO: 332828 - RNA, 64 nt, Homo Sapiens
cagcuuuuucucucaggguucugagucagaggacaccauccaagaauguuguuagcuuuucagu

SEQ ID NO: 332829 - RNA, 64 nt, Homo Sapiens
auguccuuugcgccugugaccaccaccccaacaaaccauccagugacaaaccauccaguggagg

SEQ ID NO: 332830 - RNA, 64 nt, Homo Sapiens
gugaccaccaccccaacaaaccauccagugacaaaccauccaguggagguuugucgggcaccag

SEQ ID NO: 332831 - RNA, 64 nt, Homo Sapiens
cgucaccauuauaaauucuuaaaauaauauuuucaccauccagaaaaaccuuaaaugucaaaaa

SEQ ID NO: 332832 - RNA, 64 nt, Homo Sapiens
gagaaggucccuuuuuccaacucauaguaggugcaccauccaaguggugccauaaauuaugugg

SEQ ID NO: 332833 - RNA, 64 nt, Homo Sapiens
uguggucacccacgauuucauuugucuuauacccaggugaaaggggaagggugaaugggacugg

SEQ ID NO: 332834 - RNA, 64 nt, Homo Sapiens
ggcacucggcacucauuggcacagugguaguuagaggugaaaaguagagcugucaagcccaagg

SEQ ID NO: 332835 - RNA, 64 nt, Homo Sapiens
auaauaaagcugaucauguuuugcuacaguuugcaggugaaaaaaaauaaauauuauaaaauau

SEQ ID NO: 332836 - RNA, 64 nt, Homo Sapiens
uuauucuuuauuaugccucuagguaauuaaguaaaggugaaauugcauacacagauauguagua

SEQ ID NO: 332837 - RNA, 64 nt, Homo Sapiens
cuuaucaccuuucaaaaauugauuguggugccucaggugaaaugagaagcuaucaguaacagcu

SEQ ID NO: 332838 - RNA, 64 nt, Homo Sapiens
gggcuguauuacugaaggcuuuuuauuuuuugagaggugaaaaaaagagaaaacaaguuagacu

SEQ ID NO: 332839 - RNA, 64 nt, Homo Sapiens
ucauuaccaaaaauagcagguacuucuaccauuaaggugaaaucauggaucagauauuccuuac

SEQ ID NO: 332840 - RNA, 64 nt, Homo Sapiens
uuuuuuaauugcuguaggauccuguucuuucagcaggugaaaaauaaaacgcaguucaaauuuc

SEQ ID NO: 332841 - RNA, 64 nt, Homo Sapiens
gaaggcucugauauugugugggauugccaugagcaggugaaaauggaauaaucuuaccugcucu

SEQ ID NO: 332842 - RNA, 64 nt, Homo Sapiens
ugagcaaagacgugaaggaaggccucaacugagaaggugaaauguagauagucuggucagggag

SEQ ID NO: 332843 - RNA, 64 nt, Homo Sapiens
guaauacuguugguugaacuacuuuaagauuuguaggugaaaguacugcugauuugauggagcu

SEQ ID NO: 332844 - RNA, 64 nt, Homo Sapiens
auuauuguacacuaacauaucaaauguaauuaugaggugaaacauuuucuuaaucaagaauauu

SEQ ID NO: 332845 - RNA, 64 nt, Homo Sapiens
cuuuuggauaaacguaagccaacaguaaugugcaaggugaaaugguauguguuuaaaaaacaac

SEQ ID NO: 332846 - RNA, 64 nt, Homo Sapiens
uuggcuguugaaaguuucagucuagauucuaaaaaggugaaacuuaaaauuccaaaugaguugc

SEQ ID NO: 332847 - RNA, 64 nt, Homo Sapiens
aucuauuuuuuuuaccuguuuaucacauuugugaaggugaaauuauucauggagugaauaagaa

SEQ ID NO: 332848 - RNA, 64 nt, Homo Sapiens
ggcuagaggagagcuggauauaagcagagaucguaggugaaaaaagaugggccauuaaggauuc

SEQ ID NO: 332849 - RNA, 64 nt, Homo Sapiens
aaguugcacacauugugcccuaaagaaggcccucaggugaaagagcagagcugugaagaacuau

SEQ ID NO: 332850 - RNA, 64 nt, Homo Sapiens
guuacaggugaggaguguaauccuaggaagcaucaggugaaaagcaggagaccaaagaaguggu

SEQ ID NO: 332851 - RNA, 64 nt, Homo Sapiens
cauucauuauuuuuaagcugagauaacuguagucaggugaaaggcucuauauugaauaggugaa

SEQ ID NO: 332852 - RNA, 64 nt, Homo Sapiens
uaacuguagucaggugaaagucucuauauugaauaggugaaagagcuauaggcaucauucauua

SEQ ID NO: 332853 - RNA, 64 nt, Homo Sapiens
ugaacuaagaagaagucagcaagcaaacugagagaggugaaauccauguuaaugaugcuuaaga

SEQ ID NO: 332854 - RNA, 64 nt, Homo Sapiens
uugugguucuucugaaucuuaauauuucaaagccaggugaaaaucugaacuagauauucuuugu

SEQ ID NO: 332855 - RNA, 64 nt, Homo Sapiens
aaguacccuuuuguaaauagcauuuuuuugcagaaggugaaaauuccacucucuaccaccgggc

SEQ ID NO: 332856 - RNA, 64 nt, Homo Sapiens
augcuaguuucaaauuugauucaaaauauuucuuaggugaaagaacuagcagaaagucaaaaac

SEQ ID NO: 332857 - RNA, 64 nt, Homo Sapiens
ggaaaagcaaggaccguguuugacuuucuuggagaggugaaagaggugaaagaacaaguugugu

SEQ ID NO: 332858 - RNA, 64 nt, Homo Sapiens
aggaccguguuugacuuucuuggagaggugaaagaggugaaagaacaaguugugugcuagaaaa

SEQ ID NO: 332859 - RNA, 64 nt, Homo Sapiens
gggaaaaaggccucugucccggaagagucaugggaggugaaaggggcacguuugaagaugcgag

SEQ ID NO: 332860 - RNA, 64 nt, Homo Sapiens
gaugauucuggcugaaaaaggccaguggaaauucaggugaaaauguucaucaauucccauugca

SEQ ID NO: 332861 - RNA, 64 nt, Homo Sapiens
gcaguucaguaauaaacuguaauagucugugugaaggugaaagucacuuguuccagcucuuuga

SEQ ID NO: 332862 - RNA, 64 nt, Homo Sapiens
gagcuaucaggaacagcuaugggacucagcccugaggugaaagggcuccucaugguggguucag

SEQ ID NO: 332863 - RNA, 64 nt, Homo Sapiens
gaugcccuaaagaggacugaugguagagagaaucaggugaaagagagagaguuagaaaaauuuu

SEQ ID NO: 332864 - RNA, 64 nt, Homo Sapiens
cacaagcugcuggagaagggagaccuggggacagaggugaaaugcugacaggugggucacacuc

SEQ ID NO: 332865 - RNA, 64 nt, Homo Sapiens
guuaaaaugaguaaagcaguguuucucccaggauaggugaaaggugaaaaggugacaagccugg

SEQ ID NO: 332866 - RNA, 64 nt, Homo Sapiens
gcagaacacuccgcgcuucuggcuggggcugcguaggugaaaaguaggguccccaggggggccg

SEQ ID NO: 332867 - RNA, 64 nt, Homo Sapiens
uauuauuuuauuaauguugcucgcuuguucuuucaggugaaauuaauuuccuugucuauuuugc

SEQ ID NO: 332868 - RNA, 64 nt, Homo Sapiens
gcaauaaaauuaauagaaugguaucauugguuugaggugaaauaagacaucaaacagccgucau

SEQ ID NO: 332869 - RNA, 64 nt, Homo Sapiens; identical to SEQ ID NO: 131663

SEQ ID NO: 332870 - RNA, 64 nt, Homo Sapiens; identical to SEQ ID NO: 131664

SEQ ID NO: 332871 - RNA, 64 nt, Homo Sapiens; identical to SEQ ID NO: 131665

SEQ ID NO: 332872 - RNA, 64 nt, Homo Sapiens; identical to SEQ ID NO: 131666

SEQ ID NO: 332873 - RNA, 64 nt, Homo Sapiens; identical to SEQ ID NO: 131667

SEQ ID NO: 332874 - RNA, 64 nt, Homo Sapiens; identical to SEQ ID NO: 131668

SEQ ID NO: 332875 - RNA, 64 nt, Homo Sapiens; identical to SEQ ID NO: 131669

SEQ ID NO: 332876 - RNA, 64 nt, Homo Sapiens; identical to SEQ ID NO: 131670

SEQ ID NO: 332877 - RNA, 64 nt, Homo Sapiens; identical to SEQ ID NO: 131671

SEQ ID NO: 332878 - RNA, 64 nt, Homo Sapiens; identical to SEQ ID NO: 131672

SEQ ID NO: 332879 - RNA, 64 nt, Homo Sapiens; identical to SEQ ID NO: 131673

SEQ ID NO: 332880 - RNA, 64 nt, Homo Sapiens; identical to SEQ ID NO: 131674

SEQ ID NO: 332881 - RNA, 64 nt, Homo Sapiens; identical to SEQ ID NO: 131675

SEQ ID NO: 332882 - RNA, 64 nt, Homo Sapiens; identical to SEQ ID NO: 131676

SEQ ID NO: 332883 - RNA, 64 nt, Homo Sapiens; identical to SEQ ID NO: 131677

SEQ ID NO: 332884 - RNA, 64 nt, Homo Sapiens; identical to SEQ ID NO: 131678

SEQ ID NO: 332885 - RNA, 64 nt, Homo Sapiens; identical to SEQ ID NO: 131679

SEQ ID NO: 332886 - RNA, 63 nt, Homo Sapiens
uugcuagaagaaauagcaaaucaaccuuauuuuuacuugaaauauccaaaacaaauuccuccu

SEQ ID NO: 332887 - RNA, 63 nt, Homo Sapiens
aguaguuuucauguuuucaauuuuugaagaaauuacuugaauaacagucagaacaugcaaacu

SEQ ID NO: 332888 - RNA, 63 nt, Homo Sapiens
ggauuaagggacuuaaucugcuaggaacaccuguacuugaaguggaggaggcuagggggccac

SEQ ID NO: 332889 - RNA, 63 nt, Homo Sapiens
gucaacugucauuuugcuacuuuucaaauaaaauacuugaaaacugucauuuaaugguaaaca

SEQ ID NO: 332890 - RNA, 53 nt, Homo Sapiens; identical to SEQ ID NO: 55194

SEQ ID NO: 332891 - RNA, 63 nt, Homo Sapiens
uuaauuuuauaccaaaauguuaaauauuuguauuacuugaauuuugcucuuguauggcaaaau

SEQ ID NO: 332892 - RNA, 63 nt, Homo Sapiens
aguuaauaauguauaucagucuguacauaacauuacuugaaaaugcauauacuggcaauaaaa

SEQ ID NO: 332893 - RNA, 63 nt, Homo Sapiens
uauugauccugaugagagagcaugaaauugucuuacuugaaaaggaaccugguuuccuuuuac

SEQ ID NO: 332894 - RNA, 63 nt, Homo Sapiens
uguuuguagagauacuauuucaaaacaaauaauuacuugaauauuucauguuacauaauaacc

SEQ ID NO: 332895 - RNA, 63 nt, Homo Sapiens
auuuuggaauuuuaugucauuuauuagcucuacuacuugaaugacuaaaaauacaauucaaau

SEQ ID NO: 332896 - RNA, 63 nt, Homo Sapiens
accaauccaagugugugcccuggaaaaaauauauacuugaagaucuucacugaagcuaauguu

SEQ ID NO: 332897 - RNA, 63 nt, Homo Sapiens
gauguagaauguagcaaauuagaaauauuaauuuacuugaagaaucacuuuaccuagcguuuu

SEQ ID NO: 332898 - RNA, 63 nt, Homo Sapiens
guauggucauauuaguagcuauuuguugcaagauacuugaagccaaauguuugcaguauaggu

SEQ ID NO: 332899 - RNA, 63 nt, Homo Sapiens
uguuugauauuuaacaauaaguauauggugauauacuugaaauuuauguccagaaugucacug

SEQ ID NO: 332900 - RNA, 63 nt, Homo Sapiens
uuuaaauuaugucaaaacuuauuuguuuacaacuacuugaauugaauuguuuaacaaauuaga

SEQ ID NO: 332901 - RNA, 63 nt, Homo Sapiens
uauuuaaggaagagaugaaguguguucuuacaguacuugaaaaaaucaguuuuuucauggauu

SEQ ID NO: 332902 - RNA, 63 nt, Homo Sapiens
ggcuggaaaguagcccauaauaguuguguccuauacuugaagacucccuacugguaggaacca

SEQ ID NO: 332903 - RNA, 63 nt, Homo Sapiens
ucacauauauacaguagcagcuguaaauaagcuuacuugaacuaauuacuugaaaacuggugg

SEQ ID NO: 332904 - RNA, 63 nt, Homo Sapiens
guagcagcuguaaauaagcuuacuugaacuaauuacuugaaaacugguggaaaaaagagacca

SEQ ID NO: 332905 - RNA, 63 nt, Homo Sapiens
cagcccucgauuagcccugccugaaucaguagauacuugaacgaguccccagucugcgggagg

SEQ ID NO: 332906 - RNA, 63 nt, Homo Sapiens
caaaaauacacacacguguguuuuucuuugcaauacuugaaauauugccacugugcuuggacu

SEQ ID NO: 332907 - RNA, 63 nt, Homo Sapiens
aaauuucauuuagaaaccuauuaauauuauacauacuugaaaaauaaaaauaucuuuaccuua

SEQ ID NO: 332908 - RNA, 63 nt, Homo Sapiens
gcccaaaagcauuaaaaaucguaaagcugcacuuacuugaacaauaacuuaauguuagagaug

SEQ ID NO: 332909 - RNA, 63 nt, Homo Sapiens
gcgccccaacccccugcccgccucuccgcacaauacuugaacauucaucuguacugaaguguu

SEQ ID NO: 332910 - RNA, 63 nt, Homo Sapiens
acaauacuugaacauucaucuguacugaaguguuacuugaaccgggggaaucucggaccuggg

SEQ ID NO: 332911 - RNA, 63 nt, Homo Sapiens
cugauaaaauaaaggcagggaaacaagcugaauuacuugaaauuacuugaauuuucuugucuu

SEQ ID NO: 332912 - RNA, 63 nt, Homo Sapiens
aaaggcagggaaacaagcugaauuacuugaaauuacuugaauuuucuugucuuaaaacugaaa

SEQ ID NO: 332913 - RNA, 64 nt, Homo Sapiens; identical to SEQ ID NO: 23330

SEQ ID NO: 332914 - RNA, 64 nt, Homo Sapiens; identical to SEQ ID NO: 23331

SEQ ID NO: 332915 - RNA, 64 nt, Homo Sapiens; identical to SEQ ID NO: 23332

SEQ ID NO: 332916 - RNA, 64 nt, Homo Sapiens; identical to SEQ ID NO: 23333

SEQ ID NO: 332917 - RNA, 64 nt, Homo Sapiens; identical to SEQ ID NO: 23334

SEQ ID NO: 332918 - RNA, 64 nt, Homo Sapiens; identical to SEQ ID NO: 23335

SEQ ID NO: 332919 - RNA, 64 nt, Homo Sapiens; identical to SEQ ID NO: 23336

SEQ ID NO: 332920 - RNA, 64 nt, Homo Sapiens; identical to SEQ ID NO: 23337

SEQ ID NO: 332921 - RNA, 64 nt, Homo Sapiens; identical to SEQ ID NO: 23338

SEQ ID NO: 332922 - RNA, 64 nt, Homo Sapiens; identical to SEQ ID NO: 23339

SEQ ID NO: 332923 - RNA, 64 nt, Homo Sapiens
uaugaguucagaucuaucuuaaguauauuaaaaaagaagauagcaaauucacugagaauuccaa

SEQ ID NO: 332924 - RNA, 64 nt, Homo Sapiens
acuaugccaguuuuauaucauuugucaagaggaaagaagauaaagacguuuaaaguauauauau

SEQ ID NO: 332925 - RNA, 64 nt, Homo Sapiens
ggguccuccacuuucagcucucaguuaaggaaugagaagauagauuuuucuuaacaucgguggc

SEQ ID NO: 332926 - RNA, 64 nt, Homo Sapiens
augauugugacuucuaguucuggaacuauuguauagaagauaaucauguucuacuugucagggc

SEQ ID NO: 332927 - RNA, 64 nt, Homo Sapiens
uuuguuaaaguauuuuuuauuccccguaaaaaguagaagauaagguuuguugaucaagugacug

SEQ ID NO: 332928 - RNA, 64 nt, Homo Sapiens
cuauaucauaacucugaccuuugugguucuuggaagaagauauuuuaagaaccaguuauccuaa

SEQ ID NO: 332929 - RNA, 64 nt, Homo Sapiens
guccuaucuguaccaacaagcaaggccacuuuucagaagauaagaguucacugaaugcaccuau

SEQ ID NO: 332930 - RNA, 64 nt, Homo Sapiens
guacacucuucuucuuuuauagacuuucauacuuagaagauaagcgacauaggccuacagaauu

SEQ ID NO: 332931 - RNA, 64 nt, Homo Sapiens
ccuacugagaaaaugagcacaucauccuccuagcagaagauaguuacuuguugaugccacuguu

SEQ ID NO: 332932 - RNA, 64 nt, Homo Sapiens
ccccugggucccucccacaacaugugggaauuccagaagauaaauucaaguugcaauuucagug

SEQ ID NO: 332933 - RNA, 64 nt, Homo Sapiens
uuguuaauuugaggacugggcugucuuggggcucagaagauaaagaacuauuugagcagaugug

SEQ ID NO: 332934 - RNA, 64 nt, Homo Sapiens
uguuuuuauuaaacauuuugaaaguguuaaauggagaagauacuuuacuguacaguuagaaagc

SEQ ID NO: 332935 - RNA, 64 nt, Homo Sapiens
guuugaagacagaaguguacuuaauuccauccaaagaagauacauaaaacuauacaguuacauc

SEQ ID NO: 332936 - RNA, 64 nt, Homo Sapiens
cccuuaauccaauaugacugguguuccuuauaagagaagauagggcgggcaugguggcucacgc

SEQ ID NO: 332937 - RNA, 64 nt, Homo Sapiens
ucugucucaaaaaaaaaaaaaaaaaggaagaaagagaagauagagacacaggggagaaugccac

SEQ ID NO: 332938 - RNA, 64 nt, Homo Sapiens
gcagagauuggagugauacauugugggaacccucagaagauaggaaaaaagcauggaauagauu

SEQ ID NO: 332939 - RNA, 64 nt, Homo Sapiens
cagauggccaauaagcacguagacauuucuccaaagaagauaccauggaggaaaggacuugaau

SEQ ID NO: 332940 - RNA, 64 nt, Homo Sapiens
uaucuuugaaccgggaagcagagagggugcagugagaagauagccuagcuuugcccuucaccau

SEQ ID NO: 332941 - RNA, 64 nt, Homo Sapiens; identical to SEQ ID NO: 119429

SEQ ID NO: 332942 - RNA, 64 nt, Homo Sapiens; identical to SEQ ID NO: 119430

SEQ ID NO: 332943 - RNA, 64 nt, Homo Sapiens; identical to SEQ ID NO: 119431

SEQ ID NO: 332944 - RNA, 64 nt, Homo Sapiens; identical to SEQ ID NO: 119432

SEQ ID NO: 332945 - RNA, 64 nt, Homo Sapiens; identical to SEQ ID NO: 119433

SEQ ID NO: 332946 - RNA, 64 nt, Homo Sapiens; identical to SEQ ID NO: 119434

SEQ ID NO: 332947 - RNA, 64 nt, Homo Sapiens; identical to SEQ ID NO: 119435

SEQ ID NO: 332948 - RNA, 64 nt, Homo Sapiens; identical to SEQ ID NO: 119436

SEQ ID NO: 332949 - RNA, 64 nt, Homo Sapiens
gccacacuguacucugcacuggugugagggccccugccuggacugugggacccuccuggugcug

SEQ ID NO: 332950 - RNA, 64 nt, Homo Sapiens
uccuccccaugugaacauggggaacuucgggcccugccuggaguccuugaccgcucucuguggg

SEQ ID NO: 332951 - RNA, 64 nt, Homo Sapiens
ugcaggaucugccauaaaggacaauaugaacugaugccuggacuaucaguaaccccacugcaca

SEQ ID NO: 332952 - RNA, 64 nt, Homo Sapiens
ugcacaggcacacgaugcucugggacauaacuggugccuggaaaucaccaugguccucauaucu

SEQ ID NO: 332953 - RNA, 64 nt, Homo Sapiens
guaugacugcacaugacucgauacugcgacuuucugccuggagugaaccuguguccgguauucg

SEQ ID NO: 332954 - RNA, 64 nt, Homo Sapiens
cuuagggcaccagggguuucgcuucucugacuucugccuggagaugugcugggagcuccacucu

SEQ ID NO: 332955 - RNA, 64 nt, Homo Sapiens
uagccccuggacacacacacacagacacacacacugccuggaugcauguaugcacacacaugcg

SEQ ID NO: 332956 - RNA, 64 nt, Homo Sapiens
gaacauacacacgcacacccaugcgcagaugugcugccuggacacacacacacacacggauaug

SEQ ID NO: 332957 - RNA, 64 nt, Homo Sapiens
uaugguauccggacacacacgugcacagauaugcugccuggacacacagauaaugcugccuuga

SEQ ID NO: 332958 - RNA, 64 nt, Homo Sapiens
auaaugcugccuugacacacacaugcacggauauugccuggacacacacacacacacgugugca

SEQ ID NO: 332959 - RNA, 64 nt, Homo Sapiens
ugcugucuggacacgcacacacaugcagauaugcugccuggacacacacuuccagacacacgug

SEQ ID NO: 332960 - RNA, 64 nt, Homo Sapiens
acuuccagacacacgugcacaggcgcagauaugcugccuggacacacgcagauaugcugucuag

SEQ ID NO: 332961 - RNA, 64 nt, Homo Sapiens
ugcuguccggacacacacacgcacgcagauaugcugccuggacacacacacagauaaugcugcc

SEQ ID NO: 332962 - RNA, 64 nt, Homo Sapiens
aaugcugccucaacacucacacacgugcagauauugccuggacacacacaugugcacagauaug

SEQ ID NO: 332963 - RNA, 64 nt, Homo Sapiens
ccggacacacaugcacacacaggugcagauaugcugccuggacacacgcagacugacgugcuuu

SEQ ID NO: 332964 - RNA, 64 nt, Homo Sapiens
agcuccucacaccacagccaggagagaccuuuucugccuggagagaaacuuucagaccagcccc

SEQ ID NO: 332965 - RNA, 64 nt, Homo Sapiens
agccccacacaccacagccaggagaggccguuccugccuggagagaagcuuccagaccagcccu

SEQ ID NO: 332966 - RNA, 64 nt, Homo Sapiens
ugaggggcauccgaacgcguuguagggggcauggugccuggagcacagaaccugcccugcaggc

SEQ ID NO: 332967 - RNA, 64 nt, Homo Sapiens
ccccucuagcuccugcucaccagccccugggcugugccuggaucuucaggggucaucuggcaaa

SEQ ID NO: 332968 - RNA, 64 nt, Homo Sapiens
cccuccaggagcaggccuggugcagcccacucugugccuggacaucccccgcaggccgccgcgu

SEQ ID NO: 332969 - RNA, 64 nt, Homo Sapiens
uccauucccgcuccuggaacacuuccugcagcugugccuggaggcagucggccugcagugccag

SEQ ID NO: 332970 - RNA, 64 nt, Homo Sapiens
caaggaauuagcucagagaugugaaugcucauccugccuggauuuacagagagggguccaaaug

SEQ ID NO: 332971 - RNA, 64 nt, Homo Sapiens
ggguuaaaauagaccuuucuaguaaccugcuuuuugccuggauauugaucuuagggauuuccaa

SEQ ID NO: 332972 - RNA, 64 nt, Homo Sapiens
ugcaguggggggacucgacccccugacauggggcugccuggagcaggccgcgugacguggggcu

SEQ ID NO: 332973 - RNA, 64 nt, Homo Sapiens
cuaaaauaauggaaaauuuuaacaauuuguauagugccuggaucauuacuagugccauaacccu

SEQ ID NO: 332974 - RNA, 64 nt, Homo Sapiens
uccuuuucuuuuuuuacgcauagcuccgucaagcugccuggaugagcgcccaugcagcaaggcu

SEQ ID NO: 332975 - RNA, 64 nt, Homo Sapiens
gucccugugagaguucugcagagugcugggcaugugccuggaacuaccgaguaggagccauuuc

SEQ ID NO: 332976 - RNA, 64 nt, Homo Sapiens
gcuucgaucucacacacacagaaacauacauucgugccuggagacccugcaggccagaguccaa

SEQ ID NO: 332977 - RNA, 64 nt, Homo Sapiens
gagucagccaguugguugcugugguuacagccagugccuggaauuccuccuuagggcccuggga

SEQ ID NO: 332978 - RNA, 53 nt, Homo Sapiens
ucacccccucuucagguugauacugccuggauggucaccucuggugcgcagca

SEQ ID NO: 332979 - RNA, 64 nt, Homo Sapiens
caacugaauggcgucuguccugucauccauauggugccuggaaauauuuaccagucaaggucaa

SEQ ID NO: 332980 - RNA, 64 nt, Homo Sapiens
uguucuguaccucuuuguaggcagguucuuaguuugccuggaauugccuguccuccaggcuggg

SEQ ID NO: 332981 - RNA, 64 nt, Homo Sapiens
uuucccuccugccccaccaaccugcuguuuucccugccuggaacccuccaaccaccacacacuc

SEQ ID NO: 332982 - RNA, 64 nt, Homo Sapiens
aaggauggcagccucagggcuucaguaucaaggcugccuggagaauggcucuaacauuacugcc

SEQ ID NO: 332983 - RNA, 64 nt, Homo Sapiens
ucuuccuauuaggcuauaagugcccuauaaccccugccuggauuaacauucauucaacagcuga

SEQ ID NO: 332984 - RNA, 64 nt, Homo Sapiens
ucagcccgacuggaucgccaucugcuacaacaacugccuggagauacucagaguguaguguugg

SEQ ID NO: 332985 - RNA, 64 nt, Homo Sapiens
uccucccucuuugcaccuucuucucuucccucagugccuggagcugguacugggccccuggccc

SEQ ID NO: 332986 - RNA, 64 nt, Homo Sapiens
aaaauauaaaacugaaauaaauguaauaagcacuugccuggaauccgagacaugaauacuaucc

SEQ ID NO: 332987 - RNA, 64 nt, Homo Sapiens
guaacuggggggccaccaugaagaaggcagggaaugccuggaggguugguuccuuggggggcca

SEQ ID NO: 332988 - RNA, 64 nt, Homo Sapiens
cacggaaacccaacugagaaggaaacccaagagcugccuggacaaaaaaaagaaagaaagaaaa

SEQ ID NO: 332989 - RNA, 64 nt, Homo Sapiens
uugcuucuggccagggaggggacacccuugcccaugccuggaccggagccaagggaacccagau

SEQ ID NO: 332990 - RNA, 64 nt, Homo Sapiens
gcucugcagaucagaacaacggaggauagcuuugugccuggacccagagagugugggacucccc

SEQ ID NO: 332991 - RNA, 64 nt, Homo Sapiens
gcugacccucgucuuuguggcagcaaaaccaggaugccuggagcuguggccugagggccugcug

SEQ ID NO: 332992 - RNA, 64 nt, Homo Sapiens
cccgaguagcagggauuaccggugugcaccaccaugccuggauaacuuuuuuuuuuauuucuau

SEQ ID NO: 332993 - RNA, 64 nt, Homo Sapiens
cuaccacccuaacguggacacccaggguaacauaugccuggacauccugaaggagaaguggucu

SEQ ID NO: 332994 - RNA, 64 nt, Homo Sapiens
ccacugcuaccuuaugugagcccucauugccucuugccuggauuauagccggggucuccuuccu

SEQ ID NO: 332995 - RNA, 64 nt, Homo Sapiens
cauacauuuucccacuuaugugccuuuguaccugugccuggaacccuccucuucuuuuucuuuu

SEQ ID NO: 332996 - RNA, 64 nt, Homo Sapiens; identical to SEQ ID NO: 138992

SEQ ID NO: 332997 - RNA, 64 nt, Homo Sapiens; identical to SEQ ID NO: 138993

SEQ ID NO: 332998 - RNA, 64 nt, Homo Sapiens; identical to SEQ ID NO: 138994

SEQ ID NO: 332999 - RNA, 64 nt, Homo Sapiens; identical to SEQ ID NO: 138995

SEQ ID NO: 333000 - RNA, 64 nt, Homo Sapiens; identical to SEQ ID NO: 138996

SEQ ID NO: 333001 - RNA, 64 nt, Homo Sapiens; identical to SEQ ID NO: 138997

SEQ ID NO: 333002 - RNA, 64 nt, Homo Sapiens; identical to SEQ ID NO: 138998

SEQ ID NO: 333003 - RNA, 64 nt, Homo Sapiens; identical to SEQ ID NO: 138999

SEQ ID NO: 333004 - RNA, 64 nt, Homo Sapiens; identical to SEQ ID NO: 139000

SEQ ID NO: 333005 - RNA, 64 nt, Homo Sapiens; identical to SEQ ID NO: 139001

SEQ ID NO: 333006 - RNA, 64 nt, Homo Sapiens; identical to SEQ ID NO: 139002

SEQ ID NO: 333007 - RNA, 64 nt, Homo Sapiens; identical to SEQ ID NO: 139003

SEQ ID NO: 333008 - RNA, 64 nt, Homo Sapiens; identical to SEQ ID NO: 139004

SEQ ID NO: 333009 - RNA, 64 nt, Homo Sapiens; identical to SEQ ID NO: 139005

SEQ ID NO: 333010 - RNA, 64 nt, Homo Sapiens; identical to SEQ ID NO: 139006

SEQ ID NO: 333011 - RNA, 64 nt, Homo Sapiens; identical to SEQ ID NO: 139007

SEQ ID NO: 333012 - RNA, 64 nt, Homo Sapiens; identical to SEQ ID NO: 139008

SEQ ID NO: 333013 - RNA, 64 nt, Homo Sapiens; identical to SEQ ID NO: 139009

SEQ ID NO: 333014 - RNA, 64 nt, Homo Sapiens; identical to SEQ ID NO: 139010

SEQ ID NO: 333015 - RNA, 64 nt, Homo Sapiens; identical to SEQ ID NO: 139011

SEQ ID NO: 333016 - RNA, 64 nt, Homo Sapiens; identical to SEQ ID NO: 139012

SEQ ID NO: 333017 - RNA, 64 nt, Homo Sapiens; identical to SEQ ID NO: 139013

SEQ ID NO: 333018 - RNA, 64 nt, Homo Sapiens; identical to SEQ ID NO: 139014

SEQ ID NO: 333019 - RNA, 64 nt, Homo Sapiens; identical to SEQ ID NO: 139015

SEQ ID NO: 333020 - RNA, 64 nt, Homo Sapiens; identical to SEQ ID NO: 139016

SEQ ID NO: 333021 - RNA, 64 nt, Homo Sapiens; identical to SEQ ID NO: 139017

SEQ ID NO: 333022 - RNA, 64 nt, Homo Sapiens; identical to SEQ ID NO: 139018

SEQ ID NO: 333023 - RNA, 64 nt, Homo Sapiens; identical to SEQ ID NO: 139019

SEQ ID NO: 333024 - RNA, 64 nt, Homo Sapiens; identical to SEQ ID NO: 139020

SEQ ID NO: 333025 - RNA, 64 nt, Homo Sapiens; identical to SEQ ID NO: 139021

SEQ ID NO: 333026 - RNA, 64 nt, Homo Sapiens; identical to SEQ ID NO: 139022

SEQ ID NO: 333027 - RNA, 64 nt, Homo Sapiens; identical to SEQ ID NO: 139023

SEQ ID NO: 333028 - RNA, 64 nt, Homo Sapiens; identical to SEQ ID NO: 139024

SEQ ID NO: 333029 - RNA, 64 nt, Homo Sapiens; identical to SEQ ID NO: 139025

SEQ ID NO: 333030 - RNA, 64 nt, Homo Sapiens; identical to SEQ ID NO: 139026

SEQ ID NO: 333031 - RNA, 64 nt, Homo Sapiens; identical to SEQ ID NO: 139027

SEQ ID NO: 333032 - RNA, 64 nt, Homo Sapiens; identical to SEQ ID NO: 139028

SEQ ID NO: 333033 - RNA, 64 nt, Homo Sapiens
cauucuggugauucugaaccuugccucauagcuuaaaguauaaaaaagauucaagagcagugag

SEQ ID NO: 333034 - RNA, 64 nt, Homo Sapiens
cauccuuuauaaauagucaagguuugggccacacaaaguauauuuuuaucauggaaaaauuuca

SEQ ID NO: 333035 - RNA, 64 nt, Homo Sapiens
caguauauugcuggcagcuauuguauuaaaaaauaaaguauauuuucacuaucauaaaggauuc

SEQ ID NO: 333036 - RNA, 64 nt, Homo Sapiens
uccuguguaguuuacacccagagcagauacucauaaaguauaaaguaaaaacuuuuaaccauua

SEQ ID NO: 333037 - RNA, 64 nt, Homo Sapiens
auggacagcuuauugaaauaguauugauuuagaaaaaguauauugcauuucuaaaaaacaucua

SEQ ID NO: 333038 - RNA, 64 nt, Homo Sapiens
uccuauuuguuccaauacaaacucacuuuauucuaaaguauauuaaugaaaccaguuccuguga

SEQ ID NO: 333039 - RNA, 64 nt, Homo Sapiens
aaauguuucaagcgcuuaacucccccucauucacaaaguauaacaauuaaaaucucaacuauaa

SEQ ID NO: 333040 - RNA, 64 nt, Homo Sapiens
uuacuuuuaacuauuuuuuuaguuaauauuuuuaaaaguauacaugucaauggccucuuugucc

SEQ ID NO: 333041 - RNA, 64 nt, Homo Sapiens
agaaagagcaaauaaaaagcagugguaaugauccaaaguauaguacaaccacagcucagaauuc

SEQ ID NO: 333042 - RNA, 64 nt, Homo Sapiens
cagacauacugaccaaaaccacaaucuagacuacaaaguauauuguuuuagaguacucaaauug

SEQ ID NO: 333043 - RNA, 64 nt, Homo Sapiens
uuauucacauuuuuagugcuguuucugaaaaauaaaaguauaacaguugccacuugucauuuuu

SEQ ID NO: 333044 - RNA, 64 nt, Homo Sapiens
auugugagauuuauuuaauauguuuuguugaguuaaaguauauuguauaauuuuuugugguuuu

SEQ ID NO: 333045 - RNA, 64 nt, Homo Sapiens
aaaaaagaagauagcuaugacacugagaauuccaaaaguauauuuuugggcaagcaaacaaauu

SEQ ID NO: 333046 - RNA, 64 nt, Homo Sapiens
uauuuugucaagaggaaagaaugaaaggacguuuaaaguauauauuuguacuuugugaagggag

SEQ ID NO: 333047 - RNA, 64 nt, Homo Sapiens
cuccuaagucagugaggcaucacuuuguuugcauaaaguauacgguuuguuaaggccuuuguuc

SEQ ID NO: 333048 - RNA, 64 nt, Homo Sapiens
aauuacacaaggaccuagaguaccuauaggacaaaaaguauagaauaaaaauaugccuuuaguc

SEQ ID NO: 333049 - RNA, 64 nt, Homo Sapiens
guuuauuaaaugcuucauuucagguuauugcaauaaaguauaauuaaagucagaaguuuuacuc

SEQ ID NO: 333050 - RNA, 64 nt, Homo Sapiens
aaacaaaguuucagaguauagcagaaauagacaaaaaguauauuccaagauuggucucccauau

SEQ ID NO: 333051 - RNA, 64 nt, Homo Sapiens
aauaaaauuccucgguguauuaaucuaagguuucaaaguauaaaaguauaugggguaggccggg

SEQ ID NO: 333052 - RNA, 64 nt, Homo Sapiens
uccucgguguauuaaucuaagguuucaaaguauaaaaguauaugggguaggccgggugcagugg

SEQ ID NO: 333053 - RNA, 64 nt, Homo Sapiens
ucaaauaguguuuuacguuuuuuauccugcugaaaaaguauauauaaaauaucuaacauuacag

SEQ ID NO: 333054 - RNA, 64 nt, Homo Sapiens
uaauugaccuuuuuguggaacauguaguuuauagaaaguauacucuaaagggaauuugccgaag

SEQ ID NO: 333055 - RNA, 64 nt, Homo Sapiens
acucucaagcagacgugagugugacuuuuugaaaaaaguauaggauaaauuacauuaaaauagc

SEQ ID NO: 333056 - RNA, 64 nt, Homo Sapiens
uuucuucauuucucuugcucaccaagaaguaacaaaaguauaguuuugacagaguugguguuca

SEQ ID NO: 333057 - RNA, 64 nt, Homo Sapiens
uauugacuguaauaaaauaaugauuucauauauaaaaguauauuuuaaaauauguauucuauaa

SEQ ID NO: 333058 - RNA, 64 nt, Homo Sapiens
aggugccuucacuuuugagaucaaauuagagagcaaaguauaacaccucucauguuuuaaugug

SEQ ID NO: 333059 - RNA, 64 nt, Homo Sapiens
uacauaucuuuugaaguguuguuacuuguaaaaaaaaguauauaaagaugugaucauuugugau

SEQ ID NO: 333060 - RNA, 64 nt, Homo Sapiens
acugaggaucauuuguauuuagagaauagaggcaaaaguauagauguugacauauuucuuuaua

SEQ ID NO: 333061 - RNA, 64 nt, Homo Sapiens
auaaaauaaacuugguaacuguuuuacaaauauaaaaguauaauaaauaugcagcccaguuaaa

SEQ ID NO: 333062 - RNA, 64 nt, Homo Sapiens
auuaacucgaauuguaaauuaagcaaaaauuuaaaaaguauauguugaugggacaagaagaaua

SEQ ID NO: 333063 - RNA, 64 nt, Homo Sapiens
aacccacuggaagucuuuagagguauuuugauuuaaaguauacuuaaauuaggauuucuuaaag

SEQ ID NO: 333064 - RNA, 64 nt, Homo Sapiens
gucacuguuguuuucuuguaacaugauauggaauaaaguauagcagaaucuccguacauguucu

SEQ ID NO: 333065 - RNA, 64 nt, Homo Sapiens
uaaugguuucaaauaugcuaaauaaugaaaaagaaaaguauaguuuuuaucaaauuugccuuaa

SEQ ID NO: 333066 - RNA, 64 nt, Homo Sapiens
aauuauccuaaaaauaggggaaucuugcacaagcaaaguauaaggaaccaguuuuccaagaaca

SEQ ID NO: 333067 - RNA, 64 nt, Homo Sapiens
caaacaaaugccaaaugaauugccuaauugcugcaaaguauaacccagauaggaaaucauaugu

SEQ ID NO: 333068 - RNA, 64 nt, Homo Sapiens
aaccacuaauauuuaccugaagauaaccaugaguaaaguauacuuuugcauuaauuuuuugagc

SEQ ID NO: 333069 - RNA, 64 nt, Homo Sapiens
uuacuauaguuaauuuucuaggguucucuuaugaaaaguauauguaaacacauucauuuaaaaa

SEQ ID NO: 333070 - RNA, 64 nt, Homo Sapiens
ucauaguaccccaaguauuucaauuagacuuauaaaaguauaagucaaucuauggucagugucu

SEQ ID NO: 333071 - RNA, 64 nt, Homo Sapiens
aaguagauacuaaauacagaaauuuguaaaguauaaaguauauauuacugccaaauaauuguaa

SEQ ID NO: 333072 - RNA, 64 nt, Homo Sapiens
guauauaaaguagauacuaaauuguaaaauuuguaaaguauaaacagaaaauuacugccaaaua

SEQ ID NO: 333073 - RNA, 64 nt, Homo Sapiens
guuauauauaugggaugguuugguuggucccagcaaaguauaugaaaauuaaaguucugugaua

SEQ ID NO: 333074 - RNA, 64 nt, Homo Sapiens
gcuuccugauuuauauaaaugaaaucucauuuauaaaguauaauaaagaugacuguaagacaaa

SEQ ID NO: 333075 - RNA, 64 nt, Homo Sapiens
cuauuucccuuauaacucaauaguaccuuaacacaaaguauaacucuguagaguuggugaauau

SEQ ID NO: 333076 - RNA, 64 nt, Homo Sapiens
uaaauauuguaacuggggaguauagaguagaaaaaaaguauaguuaaaacauuuguucuacaaa

SEQ ID NO: 333077 - RNA, 64 nt, Homo Sapiens
aaaauaaaaaguggaaaaaguuucacucaucuaaaaaguauacaucuuuaggauauauuuacau

SEQ ID NO: 333078 - RNA, 64 nt, Homo Sapiens
ugcuaacacuacgaagaaauagugguucucuguaaaaguauaagggccauuuaauacaguguug

SEQ ID NO: 333079 - RNA, 64 nt, Homo Sapiens
uaccuaagaguauaguaaggucaagaagaguaucaaaguauaauaaaauaaaaauuguauacuc

SEQ ID NO: 333080 - RNA, 64 nt, Homo Sapiens
auuuuuuaagauaaauuaauauacuguauuuuuuaaaguauagguuuagguuuacagaauaaua

SEQ ID NO: 333081 - RNA, 64 nt, Homo Sapiens
uuuuauaauuuuucuuuuuauauaacuuaaaaugaaaguauacuagggggagacuaaaaucgaa

SEQ ID NO: 333082 - RNA, 64 nt, Homo Sapiens
acaaaacaaaaaaagccucguggggaguuugauaaaaguauaaaaaugcagucagcaaguuugc

SEQ ID NO: 333083 - RNA, 64 nt, Homo Sapiens
aaaaauaaauaaauaauuucguaucccagaacuuaaaguauaauaaccugcacauucagcacau

SEQ ID NO: 333084 - RNA, 64 nt, Homo Sapiens
uuaagacacccuauugacuuuuauuuuuuugauuaaaguauaaaaauauuaaauauuuucuuau

SEQ ID NO: 333085 - RNA, 64 nt, Homo Sapiens
uauaaaacuaauuuuucuuacuuugaagaguuauaaaguauaaccacuuagcuauauucugaga

SEQ ID NO: 333086 - RNA, 64 nt, Homo Sapiens
gcaguacauuaauauucaugagaaguggaauuugaaaguauaauuugauuaaauguuagaccac

SEQ ID NO: 333087 - RNA, 64 nt, Homo Sapiens
uacugaacugauucugagaacaacucaucuuuuuaaaguauagucaguuaucacuguagaugag

SEQ ID NO: 333088 - RNA, 64 nt, Homo Sapiens
aaguaaguuaguuuuuauuauuguacauguuaugaaaguauacuugcacaauuaugaaaccugg

SEQ ID NO: 333089 - RNA, 64 nt, Homo Sapiens
gugggauguuuugauauacauuauaaaaaaguauaaaguauacauuuuguaagaauauuuauuu

SEQ ID NO: 333090 - RNA, 64 nt, Homo Sapiens
guauacagugggauguuuuguuuauuuuuauaaaaaaguauaaaccuguccuuuuguaagaaua

SEQ ID NO: 333091 - RNA, 64 nt, Homo Sapiens
ucuagccauuugcaguuuuguuuuagaugauuggaaaguauaucaccaaaaaaaguauauagug

SEQ ID NO: 333092 - RNA, 64 nt, Homo Sapiens
uuguuuuagaugauuggaaaguauaucaccaaaaaaaguauauagugacauuuuuaguaugaaa

SEQ ID NO: 333093 - RNA, 64 nt, Homo Sapiens
acaguacagucgcuagucaagugguuuuuaaaguaaaguauauucauaagguaacaguuauucu

SEQ ID NO: 333094 - RNA, 64 nt, Homo Sapiens
gcuuaaguagacuauacaguuguaugaauuuguaaaaguauaugaacaccuagugagauuucaa

SEQ ID NO: 333095 - RNA, 64 nt, Homo Sapiens
auccuuagcacguuaucucauaaaguauagauuaaaaguauacagggguucaaauugaguggaa

SEQ ID NO: 333096 - RNA, 64 nt, Homo Sapiens
uuaaaaguauacaauccuuaaaauugaguggaauaaaguauagaagacuuauuaugugggguuc

SEQ ID NO: 333097 - RNA, 64 nt, Homo Sapiens
ggagcgcagauaaauauaaagaugagguugaagaaaaguauauugugagauuuaaaauaaauag

SEQ ID NO: 333098 - RNA, 64 nt, Homo Sapiens
guguuguuaaaaaguaguggaaagauucuuuccuaaaguauaacgauuuuauuuugugaaguuc

SEQ ID NO: 333099 - RNA, 64 nt, Homo Sapiens
acugcacuccggccuaggcaacgagagcaaaacuccaauacaaacaaacaaacaaacaccugug

SEQ ID NO: 333100 - RNA, 64 nt, Homo Sapiens
uaggucagucuggcacguaagaugaacaucccuaccaauacagagcucaccaucucuuauacuu

SEQ ID NO: 333101 - RNA, 64 nt, Homo Sapiens
gugcuccuguuggauggugaggucacuccauaugccaauacaaacaacaaugcgguggauugca

SEQ ID NO: 333102 - RNA, 64 nt, Homo Sapiens
aggugacuuaguauauuuguaauugguuuuaaaaccaauacaccauacuuucuuucugcaaaca

SEQ ID NO: 333103 - RNA, 64 nt, Homo Sapiens
gcucugcccuccagaacuucgagugaggcucuguccaauacaugacugccccuucgccauccua

SEQ ID NO: 333104 - RNA, 58 nt, Homo Sapiens
gcucugccccccagaacuuaggcuugguccaauacaugacuucucccucaaggaguga

SEQ ID NO: 333105 - RNA, 61 nt, Homo Sapiens
gaugguaaaacccagguuagucaucaguaaccuucucuauuauuauuauuuuuuagaaacu

SEQ ID NO: 333106 - RNA, 61 nt, Homo Sapiens
aacaaaucugauaaauuguguaaccuagucucuucucuacauggugaugcauuucagcaau

SEQ ID NO: 333107 - RNA, 61 nt, Homo Sapiens
cuuucauuuucuccucccagcccccugcugccuucucuaugcagccugcccuccaucaucc

SEQ ID NO: 333108 - RNA, 61 nt, Homo Sapiens
uuugcuuucuucugacugacauuuauucagccuucucuacaggaaucucuuauguuccccc

SEQ ID NO: 333109 - RNA, 61 nt, Homo Sapiens
auguuuaaucaauugcaagcaucaaagaacucuucucuauucuuuacuucuaucaucccaa

SEQ ID NO: 333110 - RNA, 61 nt, Homo Sapiens
cuuuaaauuacacaacuuuguaaacuucuuucuucucuagcauuuacugugggauccaauu

SEQ ID NO: 333111 - RNA, 61 nt, Homo Sapiens
aucacaagggaggagagaggaaaacaauuaucuucucuacuuggauuaugagauaaccuuu

SEQ ID NO: 333112 - RNA, 61 nt, Homo Sapiens
cccacuaaauguauguuauugaaugccaguacuucucuaguggaugcacacuuguuaaaua

SEQ ID NO: 333113 - RNA, 61 nt, Homo Sapiens
cucccugcaugucuuaaguaucuuucccuuccuucucuacccucaccuccauccugucuac

SEQ ID NO: 333114 - RNA, 61 nt, Homo Sapiens
cuucauauaaauugcucaggcccucccaccccuucucuaacacuagcuucaaggcagaagc

SEQ ID NO: 333115 - RNA, 61 nt, Homo Sapiens
ugggaaacaauacucucuuaaccaccauucccuucucuauuuucucuauuugagaaucucu

SEQ ID NO: 333116 - RNA, 61 nt, Homo Sapiens
ugagaaucucuaccaccauuaccaccauucccuucucuauuaauggaggcugagaaucucu

SEQ ID NO: 333117 - RNA, 61 nt, Homo Sapiens
cuguagagaacuuaaugaaccugaacccaggcuucucuagcucugguaacgugugauuguu

SEQ ID NO: 333118 - RNA, 61 nt, Homo Sapiens
cuugcagagguacuuuucuugauuaaauagccuucucuagcaacaucauuuucagacuaac

SEQ ID NO: 333119 - RNA, 61 nt, Homo Sapiens
uacuacuaauaguugggucaucggagacccgcuucucuacccaaagccagauuaccuaggu

SEQ ID NO: 333120 - RNA, 61 nt, Homo Sapiens
uguuucuacuagaccuagggguuagcauagacuucucuauaauaguccucuuuccaagugu

SEQ ID NO: 333121 - RNA, 61 nt, Homo Sapiens
uguagcuacuuucucugggcgguuuuccucucuucucuaucgcggggcuguggcagccagc

SEQ ID NO: 333122 - RNA, 61 nt, Homo Sapiens
ggaggccccgggaucucucgaggaccuugcucuucucuauuugucgggcaguguggaaguc

SEQ ID NO: 333123 - RNA, 61 nt, Homo Sapiens
cuuuuccccuacaaacuguuguugaacagugcuucucuaaaaugcaauaauaaugggccag

SEQ ID NO: 333124 - RNA, 61 nt, Homo Sapiens
caagaccagccuggccaacauggugaaaccccuucucuacuaaaauacacaaauuagcuag

SEQ ID NO: 333125 - RNA, 61 nt, Homo Sapiens
ccgguucaugacagacccuuaauuuucucaucuucucuaacuugagauggagucuucugaa

SEQ ID NO: 333126 - RNA, 61 nt, Homo Sapiens
aaaaauacauaaauuagcugggugaaaccaccuucucuacaaagaccagccugggcagaau

SEQ ID NO: 333127 - RNA, 61 nt, Homo Sapiens
ucuuuucucccauauuggcauggauuucugucuucucuaacaccuugugaccuucucuaua

SEQ ID NO: 333128 - RNA, 61 nt, Homo Sapiens
uggauuucugucuucucuaacaccuugugaccuucucuauaucaugcuuuaaaguguaaua

SEQ ID NO: 333129 - RNA, 61 nt, Homo Sapiens
cuuccccagcaccaugccaagugcccacucccuucucuacuccagcugccuucucugcccu

SEQ ID NO: 333130 - RNA, 61 nt, Homo Sapiens
aacccuggcuuuuaucuucuccauucccugccuucucuagggacugcuccuuuccgcucac

SEQ ID NO: 333131 - RNA, 64 nt, Homo Sapiens; identical to SEQ ID NO: 211620

SEQ ID NO: 333132 - RNA, 64 nt, Homo Sapiens; identical to SEQ ID NO: 211621

SEQ ID NO: 333133 - RNA, 64 nt, Homo Sapiens; identical to SEQ ID NO: 211622

SEQ ID NO: 333134 - RNA, 64 nt, Homo Sapiens; identical to SEQ ID NO: 211623

SEQ ID NO: 333135 - RNA, 64 nt, Homo Sapiens; identical to SEQ ID NO: 211624

SEQ ID NO: 333136 - RNA, 64 nt, Homo Sapiens; identical to SEQ ID NO: 211625

SEQ ID NO: 333137 - RNA, 64 nt, Homo Sapiens; identical to SEQ ID NO: 211626

SEQ ID NO: 333138 - RNA, 64 nt, Homo Sapiens; identical to SEQ ID NO: 211627

SEQ ID NO: 333139 - RNA, 64 nt, Homo Sapiens; identical to SEQ ID NO: 211628

SEQ ID NO: 333140 - RNA, 64 nt, Homo Sapiens; identical to SEQ ID NO: 211629

SEQ ID NO: 333141 - RNA, 64 nt, Homo Sapiens; identical to SEQ ID NO: 211630

SEQ ID NO: 333142 - RNA, 64 nt, Homo Sapiens; identical to SEQ ID NO: 211631

SEQ ID NO: 333143 - RNA, 64 nt, Homo Sapiens; identical to SEQ ID NO: 211632

SEQ ID NO: 333144 - RNA, 64 nt, Homo Sapiens; identical to SEQ ID NO: 211633

SEQ ID NO: 333145 - RNA, 64 nt, Homo Sapiens; identical to SEQ ID NO: 211634

SEQ ID NO: 333146 - RNA, 64 nt, Homo Sapiens; identical to SEQ ID NO: 211635

SEQ ID NO: 333147 - RNA, 64 nt, Homo Sapiens; identical to SEQ ID NO: 211636

SEQ ID NO: 333148 - RNA, 64 nt, Homo Sapiens; identical to SEQ ID NO: 211637

SEQ ID NO: 333149 - RNA, 64 nt, Homo Sapiens; identical to SEQ ID NO: 211638

SEQ ID NO: 333150 - RNA, 64 nt, Homo Sapiens
ugaaagagguuauaaaacucauucaggguugcucaguuaguaaguuauagaguugaaauuggag

SEQ ID NO: 333151 - RNA, 64 nt, Homo Sapiens
cucuuccucuucuacuuguaaucaguaccacccaaguuaguauuuaauuaugugccaucuuaua

SEQ ID NO: 333152 - RNA, 64 nt, Homo Sapiens
ggugauuauggagggaaucaaaaauacugcuuucaguuaguagcuagcuuuaagucaggaguua

SEQ ID NO: 333153 - RNA, 64 nt, Homo Sapiens
acugcuuucaguuaguagcuagcuuuaagucaggaguuaguaaugagaaauuuuauaaaugugu

SEQ ID NO: 333154 - RNA, 64 nt, Homo Sapiens
uccagauuguagucauuuugagagguacaaagcucauaauuaccaugacaacaugguaaugucc

SEQ ID NO: 333155 - RNA, 64 nt, Homo Sapiens
uuuuucagguaaacauuuuucauuuggcaaauggcauaauuauuugaaagugacaggaaucucc

SEQ ID NO: 333156 - RNA, 64 nt, Homo Sapiens
uaacucuaaauuuaaugcucuacaucuuaucagucauaauuauauauacuguggaacaguaucu

SEQ ID NO: 333157 - RNA, 64 nt, Homo Sapiens
cuuuaaagcauuaugugcaauuaaguuguuaugacauaauuauauugccuaauuguugggucuu

SEQ ID NO: 333158 - RNA, 64 nt, Homo Sapiens
ucaguguaauccuuuauaucaggaagaaggcauacauaauuacuucuuuaggggaggagggcug

SEQ ID NO: 333159 - RNA, 64 nt, Homo Sapiens
uaacaugcuucgaggcuguaugcuacuaccaaggcauaauuacucucuuuacauguuaacaccu

SEQ ID NO: 333160 - RNA, 64 nt, Homo Sapiens
uccaaagaccccaguauuuguuuauuuguagcagcauaauuauuuuccauuguaaugauuccuu

SEQ ID NO: 333161 - RNA, 64 nt, Homo Sapiens
cuaauaaaggaucaugaggaauuacaaagguauacauaauuaaucccuuuaaccauauaauuaa

SEQ ID NO: 333162 - RNA, 64 nt, Homo Sapiens
ccuauguuuguguauagacaugacucuacuagggcauaauuagaguuuguguauuauuuuucca

SEQ ID NO: 333163 - RNA, 64 nt, Homo Sapiens
uuguuaauuauuuuuauggaaauuauuacucugucauaauuaaaucauagcuaguauaacuuua

SEQ ID NO: 333164 - RNA, 64 nt, Homo Sapiens
gauggacccauaagagugacuuauuaauauuuaacauaauuaaaaucgcaguuacgcuguacuu

SEQ ID NO: 333165 - RNA, 64 nt, Homo Sapiens
acaagggauuuuucuuaugcuauuccacaccaaccauaauuacaauuuucaguacauauuuuac

SEQ ID NO: 333166 - RNA, 64 nt, Homo Sapiens
aacuuuguagccauauaugugaaucuuuauaacacauaauuacuuguacuaggcuuaguuauau

SEQ ID NO: 333167 - RNA, 64 nt, Homo Sapiens
ucaauacacuacuguuaaaagauggaauaauagacauaauuaauggaauuacagauugagaaau

SEQ ID NO: 333168 - RNA, 64 nt, Homo Sapiens
gcaguugaacuauagggaaaaacggauaaagccacauaauuaaaggggagcuggucuucuaaga

SEQ ID NO: 333169 - RNA, 64 nt, Homo Sapiens
uuuucuaaauagacccuuaugaguuuccauuuaucauaauuaguaacugccagcaacacaacug

SEQ ID NO: 333170 - RNA, 64 nt, Homo Sapiens
agugauuuuauauauggcauaaacuuuguuuuaacauaauuaguacuguuuucccccaaaagua

SEQ ID NO: 333171 - RNA, 64 nt, Homo Sapiens
auccuacuggcuccuuagcagcugauugguguuacauaauuaacuuaauuggagaugcauuagg

SEQ ID NO: 333172 - RNA, 64 nt, Homo Sapiens
cugaacuucagcuagugcuagagaacuauuuucuaugacuuaacucuaaccaaguuuuauuuua

SEQ ID NO: 333173 - RNA, 64 nt, Homo Sapiens
aagauagaaguugcugaaguuuucugaauuaauaaugacuuagauugugaccuuuuagauucgg

SEQ ID NO: 333174 - RNA, 64 nt, Homo Sapiens
uaaugaauggaugcccagccuuaguuuguagcuuaugacuuauuaagggaaaguuacccugauc

SEQ ID NO: 333175 - RNA, 64 nt, Homo Sapiens
uucaaaucuguauuuguuucaaacaauaauggcaaugacuuauauggaucaugagauguaaaga

SEQ ID NO: 333176 - RNA, 64 nt, Homo Sapiens
accaacaggugaucaauguuuggaaaauacaacaaugacuuauuuaaaaauuacccuuccugcu

SEQ ID NO: 333177 - RNA, 64 nt, Homo Sapiens
uuuacuuuagaacaugagaauagcaguuuugcucaugacuuaccauuccagcugcaugggaaag

SEQ ID NO: 333178 - RNA, 64 nt, Homo Sapiens
gugcuauuauuucugguucuuuuugguuagggauaugacuuaauagcuuaagaaaacauugcca

SEQ ID NO: 333179 - RNA, 64 nt, Homo Sapiens
gccucauccucccuaacuccauaaaaauaaacaaaugacuuacacacauacagcauuuccuagg

SEQ ID NO: 333180 - RNA, 64 nt, Homo Sapiens
auaaacauuuauuuucauucauuuguacucaauaaugacuuaggaacacauuguuaagcugugg

SEQ ID NO: 333181 - RNA, 64 nt, Homo Sapiens
uugaacaaagugaugauuugauugguaaauuaacaugacuuaauguugguuuguuuacuauuuu

SEQ ID NO: 333182 - RNA, 64 nt, Homo Sapiens
ggcacuggcuagggaggggcaggccuccuuccugccccucgagacacucuugggagaugcauuu

SEQ ID NO: 333183 - RNA, 64 nt, Homo Sapiens; identical to SEQ ID NO: 333182

SEQ ID NO: 333184 - RNA, 64 nt, Homo Sapiens
ugcgacccaacuucauuuguuuacuugaaaauucccccucgagguugagagaaccucugaggug

SEQ ID NO: 333185 - RNA, 64 nt, Homo Sapiens
cagcaccacauugccucauucugccaaucggcuaccccucgacucacuguugcugacuacuacu

SEQ ID NO: 333186 - RNA, 64 nt, Homo Sapiens
acccccgccccugccccccccucucugcccccauccccucgacgggcauccugcccgccgccug

SEQ ID NO: 333187 - RNA, 64 nt, Homo Sapiens
ugguaccuaagcuguggauucccccacccucccuccccucgagguugaauugcuucauucaaca

SEQ ID NO: 333188 - RNA, 64 nt, Homo Sapiens
cccagccuggguagagccaccucugggggccccuccccucgaccugccacaggcuggcaggggc

SEQ ID NO: 333189 - RNA, 64 nt, Homo Sapiens
cucgcucgauuccuuuucccgcgcuccaugccucccccucgacucccggugcugcggaagaacu

SEQ ID NO: 333190 - RNA, 64 nt, Homo Sapiens
gugcuucuaaagucagaacagguucuccaaggauccccucgagacuacucuguuaccagucaug

SEQ ID NO: 333191 - RNA, 64 nt, Homo Sapiens
gcuggauucaguccauggaccauagauugcugucccccucgacggacuuauaauguuucaggug

SEQ ID NO: 333192 - RNA, 64 nt, Homo Sapiens
ugcacaucagcaaaugucuuuagaucuccaucucccccucgagcuggaccauuugguuacccuc

SEQ ID NO: 333193 - RNA, 64 nt, Homo Sapiens
cuccccccagcucccugcaccgccgcagaagcagccccucgaggccuacagaggaggccucaaa

SEQ ID NO: 333194 - RNA, 64 nt, Homo Sapiens
caucuacaccuagcuucaccauaagaggccagauccccucgaguuagaccuugaggugaucagc

SEQ ID NO: 333195 - RNA, 64 nt, Homo Sapiens
gagacacugcuggugggagcaggaaggagcagugccccucgagcagccaggaagccugcggauc

SEQ ID NO: 333196 - RNA, 64 nt, Homo Sapiens
uauaaaucagcagucucuugggcagaggagcaagccccucgaacaugauuucaaacaagcaggu

SEQ ID NO: 333197 - RNA, 64 nt, Homo Sapiens
gcagugagauuagucuguguccacaagcagaggcccccucgaugggagggaguggcaggcagga

SEQ ID NO: 333198 - RNA, 64 nt, Homo Sapiens
ggccacagcccagcccagccaaccugccaaaggaccccucgacucgggguggcucacagcuuug

SEQ ID NO: 333199 - RNA, 64 nt, Homo Sapiens
caaagguaacucgagguggaggguagcccuggggccccucgacaucaccgucauugauggagcc

SEQ ID NO: 333200 - RNA, 64 nt, Homo Sapiens
gagacuugcaaaugcuccaugagagacacgggcuccccucgaggaaucuugccaagcuguccgu

SEQ ID NO: 333201 - RNA, 64 nt, Homo Sapiens
gcggggugucuucucuuuuccggugcaggggcaaccccucgaaacugcucaaaggagggguugg

SEQ ID NO: 333202 - RNA, 64 nt, Homo Sapiens
ugggcagaugguggagucaacuuccagggagcacccccucgauugacugggcuccuucccuuga

SEQ ID NO: 333203 - RNA, 64 nt, Homo Sapiens
gcacaggacugaggauccucuccuccagaaaagcccccucgaggaaauaaauuagugcgguucu

SEQ ID NO: 333204 - RNA, 64 nt, Homo Sapiens
ucccaggcucuuucugcaguggccccacucugcgccccucgaucccuaaaaacgccccuggucc

SEQ ID NO: 333205 - RNA, 64 nt, Homo Sapiens
gugcguguaucagggggucuggggaugggaggcgccccucgagucuguccuguguguuguggga

SEQ ID NO: 333206 - RNA, 64 nt, Homo Sapiens
augacuccacuagcgcccuggccugggagguggcccccucgaggauccccguuccccccaggug

SEQ ID NO: 333207 - RNA, 64 nt, Homo Sapiens
aaaacaagagcuggguaguuuagccaaacggcacccccucgaguucacugcagacccuucguuc

SEQ ID NO: 333208 - RNA, 64 nt, Homo Sapiens
cugcagacgacccccgcagccuuucccucggaccccccucgaagcccccuggacugauucccac

SEQ ID NO: 333209 - RNA, 64 nt, Homo Sapiens
acucgagagggggagggggugucucccucuauacccccucgaagcaccucauuguuucccccac

SEQ ID NO: 333210 - RNA, 64 nt, Homo Sapiens
cccuggugacgcuccucccauccacuugugacacccccucgacucccaacccacauaccuccau

SEQ ID NO: 333211 - RNA, 64 nt, Homo Sapiens
uccgggcggacucgcacacaguccagcugggugcccccucgagccuccugcaggggaagcccug

SEQ ID NO: 333212 - RNA, 64 nt, Homo Sapiens
ggagagaaggggagugcggagccccgucucccuaccccucgagcaccugggccagcggcugagc

SEQ ID NO: 333213 - RNA, 64 nt, Homo Sapiens
caguggagccgucaggccggcauccggagacuuuccccucgacccggcccuuugugacucuugg

SEQ ID NO: 333214 - RNA, 64 nt, Homo Sapiens
auuuaugaugccaccagcaacugaaugcuugaauccccucgacaguuuagccuccccacccccu

SEQ ID NO: 333215 - RNA, 64 nt, Homo Sapiens
ggggaagccccaauagcuggacagaccucggccuccccucgaagacaccucaauucacagacuc

SEQ ID NO: 333216 - RNA, 64 nt, Homo Sapiens
uuaagaaaauaaaugucaccagguacuugagaaaccccucgauugucuaccucgaucguacuuc

SEQ ID NO: 333217 - RNA, 64 nt, Homo Sapiens
ccaucccacgacccccgcaacccuucacaucaccccccucgaaggucggacaggacggguggag

SEQ ID NO: 333218 - RNA, 64 nt, Homo Sapiens
aauuuugcaaauggccccuucuaccucaccacugccccucgaagggagcaggcugccaccccuu

SEQ ID NO: 333219 - RNA, 64 nt, Homo Sapiens
ucggcgggcgcuggaaguagagaggccagaaaggccccucgaggcagagacccuccgcccucuu

SEQ ID NO: 333220 - RNA, 64 nt, Homo Sapiens
gagccccgucuugcuucucuuccaggugcucuauccccucgagacccucuggugccaggcuugc

SEQ ID NO: 333221 - RNA, 64 nt, Homo Sapiens
cccccuuugccacaaugguaugauggcuugguagccccucgaggcagaugcaccugacuugcug

SEQ ID NO: 333222 - RNA, 64 nt, Homo Sapiens
cgccaagcagaaaccggaccuugcacuggugccuccccucgaacggaacagguagagacaaacg

SEQ ID NO: 333223 - RNA, 64 nt, Homo Sapiens
cuuccuggaguacccgagugggcucaggaaggggccccucgagcugcucucuggguuacugagg

SEQ ID NO: 333224 - RNA, 64 nt, Homo Sapiens
cccugcuucucugguauuuauuuuagaggggagcccccucgaaaugcagaaaaggacuuguggu

SEQ ID NO: 333225 - RNA, 64 nt, Homo Sapiens
uacauagcuuuucucagcugcuacuuggugcuaaccccucgaugaagcaggagcuagcagccgc

SEQ ID NO: 333226 - RNA, 64 nt, Homo Sapiens
gucuccacucuccucugggccccucccaacggccccccucgaagcuggaagaaagcagucagua

SEQ ID NO: 333227 - RNA, 64 nt, Homo Sapiens
ccucuuuggccagguaaacaugaggccagcuuguccccucgaacuaacacugugcaucuuauug

SEQ ID NO: 333228 - RNA, 64 nt, Homo Sapiens
agccaagaaugagaauugggcucuaucucauccuccccucgacauuugagaucuuuggaaagga

SEQ ID NO: 333229 - RNA, 64 nt, Homo Sapiens
cccgcaaugagugggcaccagucugucccccuucccccucgaccggcuucaugguuucugcuca

SEQ ID NO: 333230 - RNA, 64 nt, Homo Sapiens
acuuugggaccaguuuccuaaguuucuucaaugaccccucgagagaaaaaaauuagcaaaccga

SEQ ID NO: 333231 - RNA, 64 nt, Homo Sapiens
cagaggacucuacgaaaugaaauguguaccuggaccccucgaaaucauacacaugaguuuccca

SEQ ID NO: 333232 - RNA, 64 nt, Homo Sapiens
acguugugccucacagcgagccccacuucaacuuccccucgaaggggaccagugaauaagaaga

SEQ ID NO: 333233 - RNA, 64 nt, Homo Sapiens
ucccauggaaugcucgcacgcuucuucuuugggaccccucgauagaauguggggaucgagcagc

SEQ ID NO: 333234 - RNA, 64 nt, Homo Sapiens
acuccugagguagcuucuggaaauggggacaaguccccucgaaggaaaggaaaugacuagagua

SEQ ID NO: 333235 - RNA, 64 nt, Homo Sapiens
uggaagagaacucgaggggcugugcugcaggccuccccucgaaagacacugggaggucagcaug

SEQ ID NO: 333236 - RNA, 64 nt, Homo Sapiens
cgucccguggccgccuguuuuguugcuccccgagccccucgacuugcagaauguuguugguuac

SEQ ID NO: 333237 - RNA, 64 nt, Homo Sapiens
cuggucuccccgcagucgucccaggcugccggcuccccucgacagcucucugggcacccggucc

SEQ ID NO: 333238 - RNA, 64 nt, Homo Sapiens
gcccagagcccuggaggagccaccaccccgccggccccucgaccccucggccccucggccccuc

SEQ ID NO: 333239 - RNA, 64 nt, Homo Sapiens
agcacccgcugcagggaugcccagaagucagggcccccucgaggcauccucucccacacacauu

SEQ ID NO: 333240 - RNA, 64 nt, Homo Sapiens
cgauggugucccgcaucuaccaaggggggcccugccccucgaguggguuaccauguccaucccc

SEQ ID NO: 333241 - RNA, 52 nt, Homo Sapiens
cacccagcacucccuccaaacaccccucgaguuggaggagauugccugcuga

SEQ ID NO: 333242 - RNA, 64 nt, Homo Sapiens
ggacucucuggccaccuccucacucucagcuucuccccucgaagagcauccccuguuccuguuu

SEQ ID NO: 333243 - RNA, 64 nt, Homo Sapiens
gagagggcgcuuccuugaguccucggccuggacaccccucgaagagaagcccggccuggacacc

SEQ ID NO: 333244 - RNA, 64 nt, Homo Sapiens
cccucacuguguugacacuugggucugagccaagccccucgacucucccuccugccccuugcua

SEQ ID NO: 333245 - RNA, 64 nt, Homo Sapiens
aauccuccacaaacuucaguaaaccugaaucccaccccucgaccugauaagugauaguacucaa

SEQ ID NO: 333246 - RNA, 64 nt, Homo Sapiens
gccaggggaggaagugaggcccaggcaccugcugccccucgagggggcccugccugccgcgggg

SEQ ID NO: 333247 - RNA, 64 nt, Homo Sapiens
acucgccccaaagaucccgagggcauaggccaccccccucgaaguucagguucagcuccuggau

SEQ ID NO: 333248 - RNA, 62 nt, Homo Sapiens
cgcgcugcaugacuugcugaacggcacagggaccccucgaggaacaagguugcacaccagcu

SEQ ID NO: 333249 - RNA, 64 nt, Homo Sapiens
uuggcagagggucauuuuaggagagcugccccagccccucgaacgccuggcuuggggugucauu

SEQ ID NO: 333250 - RNA, 64 nt, Homo Sapiens
ccccugccagcucaccgugcccagccuccugcauccccucgaagagccuggccagagagggaag

SEQ ID NO: 333251 - RNA, 64 nt, Homo Sapiens
ugugcacaagugagugagagauuucgaacgcccaccccucgacuuugaaaucugagcaaaacaa

SEQ ID NO: 333252 - RNA, 64 nt, Homo Sapiens
guggguagggcugggacugcccaugcucuucccuccccucgagucagccccugcuccgcacgcc

SEQ ID NO: 333253 - RNA, 64 nt, Homo Sapiens
aaaaaccucuggcgccuccaccaccucccaggugccccucgagcccgcaguggggcccugacgc

SEQ ID NO: 333254 - RNA, 64 nt, Homo Sapiens
ccccccaccggccccggccgcgaggacgacgcagccccucgagccuguguuucugcaccauuuc

SEQ ID NO: 333255 - RNA, 64 nt, Homo Sapiens
cuucugaccuuugauccgcucgcuucccaccuguccccucgaggguggccuaggcugcucccau

SEQ ID NO: 333256 - RNA, 64 nt, Homo Sapiens
ccccucccaugucccuuccuaagcccagccccucccccucgagagagggggagggaguugggag

SEQ ID NO: 333257 - RNA, 64 nt, Homo Sapiens
caagcccuuguccucauuauuuccuucaccagcuccccucgacugcuguggggagacggggguc

SEQ ID NO: 333258 - RNA, 64 nt, Homo Sapiens
cgaggggccaugcaugucugcuucccuggggcucccccucgaggcuccacugugucugucuuuu

SEQ ID NO: 333259 - RNA, 64 nt, Homo Sapiens
ggagcaagaauaccaagacaaauucaaaagacugccccucgagauuuuggaauucgugcaggaa

SEQ ID NO: 333260 - RNA, 64 nt, Homo Sapiens
gagcauccuaugccuuugacaaagauugcaguggccccucgagugcagaggucaucccaggugu

SEQ ID NO: 333261 - RNA, 64 nt, Homo Sapiens
uguaaaucugcccacacccagcuggccauauccaccccucgacgccgggaugagccggcucugc

SEQ ID NO: 333262 - RNA, 64 nt, Homo Sapiens
uacaggaguccuccuuucugagcuccagccccagccccucgaaccaccuguaaucuaggcaccu

SEQ ID NO: 333263 - RNA, 61 nt, Homo Sapiens
ugaaguugaugcguuggugaggaggaaugggccccucgaagugggccgggccggccccacc

SEQ ID NO: 333264 - RNA, 58 nt, Homo Sapiens
ccugagguuaggaguucgagaccagccuggccaacaugguaaaaccccaucucuacua

SEQ ID NO: 333265 - RNA, 58 nt, Homo Sapiens
aauuuuuuaaaaaaguaaguaccacucaggccaacaagccaacgacaaagccaaacuc

SEQ ID NO: 333266 - RNA, 58 nt, Homo Sapiens
gugaaaccccaucucuacagaccacccuggccaacaugccugaggucaggaguucgag

SEQ ID NO: 333267 - RNA, 58 nt, Homo Sapiens
gugaaaccuggccucuacuaaccagccuggccaacaugccugagguuagaaguuugag

SEQ ID NO: 333268 - RNA, 58 nt, Homo Sapiens
cacgaggucaggagaucaagaccauccuggccaacauggugaaaccccaucucuacug

SEQ ID NO: 333269 - RNA, 58 nt, Homo Sapiens
cuugaggucgggaguuugagaccagccuggccaacauggugaaacccugucuuuacua

SEQ ID NO: 333270 - RNA, 58 nt, Homo Sapiens
caugaggucaggaguuugagaucagccuggccaacauggugaaaccccaucucuacua

SEQ ID NO: 333271 - RNA, 58 nt, Homo Sapiens
caugaggucaagagaucaagaucauccuggccaacauggugaaacccugucucuacua

SEQ ID NO: 333272 - RNA, 58 nt, Homo Sapiens
cuugaggucagaaguuugagaccagccaggccaacauggugaaacuucaucucuacua

SEQ ID NO: 333273 - RNA, 58 nt, Homo Sapiens
cacaaggucaagagaucgagaccauccuggccaacauggugaaacccugucucuauua

SEQ ID NO: 333274 - RNA, 58 nt, Homo Sapiens
gcuacuugcugcaaacaagcccuacuuuggccaacauccugcuuauuucucaaaaaag

SEQ ID NO: 333275 - RNA, 58 nt, Homo Sapiens
cugaggucaggaguuuugagaccagccuggccaacaugguaaaaucccgucucuacua

SEQ ID NO: 333276 - RNA, 58 nt, Homo Sapiens
gugaaacccugucucuacuaaccagccuggccaacaugcuugaggccaggaguuggag

SEQ ID NO: 333277 - RNA, 58 nt, Homo Sapiens
cuuucuccuugguggaaacucuaccucgggccaacacuuucccacagaggcaggaguc

SEQ ID NO: 333278 - RNA, 58 nt, Homo Sapiens
gugaaaccccgucucuacuaaccauccuggccaacaugcacaagguccagagaucgag

SEQ ID NO: 333279 - RNA, 58 nt, Homo Sapiens
gcaaaaucccaucucuacuaaccagccuggccaacaugcuugaggccaggaguucaag

SEQ ID NO: 333280 - RNA, 58 nt, Homo Sapiens
ugggaggccaggaguucgagaccagccuggccaacauggugaaacccggucucuacua

SEQ ID NO: 333281 - RNA, 58 nt, Homo Sapiens
ccugaggucaggaguuugagaccagccuggccaacauggcaaaaccccgucucuacaa

SEQ ID NO: 333282 - RNA, 58 nt, Homo Sapiens
gugaaaccccaucucuacuaaccagccuggccaacacgcuugaggucaggagcucgag

SEQ ID NO: 333283 - RNA, 58 nt, Homo Sapiens
gugaaaccccaucucuacuaaccagccuggccaacaugcuugaggucaggagcucaag

SEQ ID NO: 333284 - RNA, 58 nt, Homo Sapiens
gugaaaccccgucucuauuaaccagccuggccaacauacucaaggucaggcauuugag

SEQ ID NO: 333285 - RNA, 58 nt, Homo Sapiens
gcaaaaccccgucucuacuaaccagccuggccaacaugccugaggcuaggaguugcag

SEQ ID NO: 333286 - RNA, 58 nt, Homo Sapiens
gcugaggucaggaguuggagaccagcguggccaacauggugaaaccccgucucuacua

SEQ ID NO: 333287 - RNA, 58 nt, Homo Sapiens
cacgaggucaggagaucgagaccauccuggccaacacggugaaaccucgucuccacua

SEQ ID NO: 333288 - RNA, 58 nt, Homo Sapiens
gugaaaccccaucucuacuaaccagccuggccaacaugcuugaggucaggaguucaag

SEQ ID NO: 333289 - RNA, 58 nt, Homo Sapiens
augagaccuccgucucuacuaccagccuggccaacaugcuugaggccaggaguucaag

SEQ ID NO: 333290 - RNA, 58 nt, Homo Sapiens
gcagcgggagccagcagggggcagcagaggccaacagggagcucgcaggccgggcccc

SEQ ID NO: 333291 - RNA, 58 nt, Homo Sapiens
cacaaggucaggaguucgagaccagccuggccaacacggugaaaccccgacucuacua

SEQ ID NO: 333292 - RNA, 58 nt, Homo Sapiens
gugaaaccccaucucuacuaaccacccuggccaacaugguggaucacuggaguuugag

SEQ ID NO: 333293 - RNA, 58 nt, Homo Sapiens
gugaaaccccaucucuacuaaccagccuggccaacauacacgaggucaggaguucgag

SEQ ID NO: 333294 - RNA, 58 nt, Homo Sapiens; identical to SEQ ID NO: 333288

SEQ ID NO: 333295 - RNA, 58 nt, Homo Sapiens
gcaaaaccucaucucuacuaacuggccuggccaacauauugagguuaggaguuugaga

SEQ ID NO: 333296 - RNA, 58 nt, Homo Sapiens
gugaaaccccgucucuacuaaccauccuggccaacaugcacgaggucaggaguucgag

SEQ ID NO: 333297 - RNA, 58 nt, Homo Sapiens
gcaaaaccccgucucuacuaaccagccuggccaacaagcuugaggccaggaguuagag

SEQ ID NO: 333298 - RNA, 64 nt, Homo Sapiens
gcgccucagaccucaggaccucaggacccuccuccucgcccacgcgcccacggcgccucagauu

SEQ ID NO: 333299 - RNA, 64 nt, Homo Sapiens
gcgccucagauuucaggaccgcuuggcccuccuccucgcccacgaggaccugacccuggcgugu

SEQ ID NO: 333300 - RNA, 64 nt, Homo Sapiens
acuccccgggccucgggcccggcgccaccgggcgcucgcccaggccguacgacacgcguccucg

SEQ ID NO: 333301 - RNA, 64 nt, Homo Sapiens
auggagaggcgggucccaggcacagcagcggccgcucgcccaggaucggccgcccacggggggc

SEQ ID NO: 333302 - RNA, 64 nt, Homo Sapiens
aacagccuuuuuacccuuaggaacagcuuuuugcccuuagcacuaugcuugggggccauuuuaa

SEQ ID NO: 333303 - RNA, 64 nt, Homo Sapiens
uauucucggcucuucuccugggguuggggggcugccuuagcagccaaaggucacuucucccaaa

SEQ ID NO: 333304 - RNA, 64 nt, Homo Sapiens
ccugcucgucccauuuagcugccaugcggccaccccuuagcacaaccccauugucagcacccca

SEQ ID NO: 333305 - RNA, 64 nt, Homo Sapiens
ccuagagggcagggaccauauacccagagaugccccuuagcacaucuucuugcuugacucaauc

SEQ ID NO: 333306 - RNA, 64 nt, Homo Sapiens
agggaugacucagcagagaugacucagcacugucccuuagcagggaugacacagcaaggaugac

SEQ ID NO: 333307 - RNA, 64 nt, Homo Sapiens
aggcaugacucugcagagaugacucagcacugucccuuagcagggaugacacagcaaggaugac

SEQ ID NO: 333308 - RNA, 64 nt, Homo Sapiens
agggaugacucagcagggaugacucagcacugucccuuagcagugaugacacagcaaggaugac

SEQ ID NO: 333309 - RNA, 64 nt, Homo Sapiens
agggaugacucagcagggaugacucagcagugucccuuagcagcgaugacacagcaaggaugac

SEQ ID NO: 333310 - RNA, 64 nt, Homo Sapiens; identical to SEQ ID NO: 45399

SEQ ID NO: 333311 - RNA, 64 nt, Homo Sapiens; identical to SEQ ID NO: 45400

SEQ ID NO: 333312 - RNA, 64 nt, Homo Sapiens; identical to SEQ ID NO: 45401

SEQ ID NO: 333313 - RNA, 64 nt, Homo Sapiens; identical to SEQ ID NO: 45402

SEQ ID NO: 333314 - RNA, 64 nt, Homo Sapiens; identical to SEQ ID NO: 45403

SEQ ID NO: 333315 - RNA, 64 nt, Homo Sapiens; identical to SEQ ID NO: 45404

SEQ ID NO: 333316 - RNA, 64 nt, Homo Sapiens; identical to SEQ ID NO: 45405

SEQ ID NO: 333317 - RNA, 64 nt, Homo Sapiens; identical to SEQ ID NO: 45406

SEQ ID NO: 333318 - RNA, 64 nt, Homo Sapiens; identical to SEQ ID NO: 45407

SEQ ID NO: 333319 - RNA, 64 nt, Homo Sapiens; identical to SEQ ID NO: 45408

SEQ ID NO: 333320 - RNA, 64 nt, Homo Sapiens; identical to SEQ ID NO: 45409

SEQ ID NO: 333321 - RNA, 64 nt, Homo Sapiens; identical to SEQ ID NO: 45410

SEQ ID NO: 333322 - RNA, 64 nt, Homo Sapiens; identical to SEQ ID NO: 45411

SEQ ID NO: 333323 - RNA, 64 nt, Homo Sapiens; identical to SEQ ID NO: 45412

SEQ ID NO: 333324 - RNA, 64 nt, Homo Sapiens; identical to SEQ ID NO: 45413

SEQ ID NO: 333325 - RNA, 64 nt, Homo Sapiens; identical to SEQ ID NO: 45414

SEQ ID NO: 333326 - RNA, 64 nt, Homo Sapiens; identical to SEQ ID NO: 45415

SEQ ID NO: 333327 - RNA, 64 nt, Homo Sapiens; identical to SEQ ID NO: 45416

SEQ ID NO: 333328 - RNA, 64 nt, Homo Sapiens; identical to SEQ ID NO: 45417

SEQ ID NO: 333329 - RNA, 64 nt, Homo Sapiens; identical to SEQ ID NO: 45418

SEQ ID NO: 333330 - RNA, 64 nt, Homo Sapiens; identical to SEQ ID NO: 45419

SEQ ID NO: 333331 - RNA, 64 nt, Homo Sapiens; identical to SEQ ID NO: 45420

SEQ ID NO: 333332 - RNA, 64 nt, Homo Sapiens; identical to SEQ ID NO: 45421

SEQ ID NO: 333333 - RNA, 64 nt, Homo Sapiens; identical to SEQ ID NO: 45422

SEQ ID NO: 333334 - RNA, 64 nt, Homo Sapiens; identical to SEQ ID NO: 45423

SEQ ID NO: 333335 - RNA, 64 nt, Homo Sapiens; identical to SEQ ID NO: 45424

SEQ ID NO: 333336 - RNA, 64 nt, Homo Sapiens
uaaccacaaacugcaaaaagcuagguaagcuauuuuguugcagcucauaagguggugaaaagga

SEQ ID NO: 333337 - RNA, 64 nt, Homo Sapiens
caaaggcccugcauucagaggucuuguaaucuacuuguugcaggagaaagaagguaaaaaauga

SEQ ID NO: 333338 - RNA, 64 nt, Homo Sapiens
aucuuaaggagugugguaaauaugugcuccgcuuuuguugcaucacuaugugaaguacuguguu

SEQ ID NO: 333339 - RNA, 64 nt, Homo Sapiens
gaaauacacuaaggagagguaguaaaugugaaccuuguugcaguguauaagguggaagccuaaa

SEQ ID NO: 333340 - RNA, 64 nt, Homo Sapiens
uccaaacaacugaauguaaaacacuccuagccaguuguugcauucccuauauuuauuuacuucc

SEQ ID NO: 333341 - RNA, 64 nt, Homo Sapiens
aaaccuaaggugcuuuucaaaagaguaacugaaauuguugcaggccaaaacagcaauaugauau

SEQ ID NO: 333342 - RNA, 64 nt, Homo Sapiens
auuagugaucucuucuacuauguucuuuaccaaauuguugcaucugguucugaaaaaguauagc

SEQ ID NO: 333343 - RNA, 64 nt, Homo Sapiens
aggaacaagugaacacgcaaaugacaugaaguauuuguugcagagcugaggaacagagcaaaug

SEQ ID NO: 333344 - RNA, 64 nt, Homo Sapiens
agucucacagaaaacuuuugacuguauuuauuuauuguugcaaaaaagacgcuuuuuuauugcu

SEQ ID NO: 333345 - RNA, 64 nt, Homo Sapiens
uauauaaauauauaugggcuuaaucauuuaaaauuuguugcagcaagaacuuuccuaccuguag

SEQ ID NO: 333346 - RNA, 64 nt, Homo Sapiens
uauaaauacuacuaaggugaccuaguuguucuccuuguugcaauaauuaauaacucuuugcaaa

SEQ ID NO: 333347 - RNA, 64 nt, Homo Sapiens
uuuuuguaaagacaaguuuauuccuuuacgcuucuuguugcauuaguucuccuguauguuccuu

SEQ ID NO: 333348 - RNA, 64 nt, Homo Sapiens
caugagcaguccagagcuucagggcugggcagguccuggggaggcugagacugcagaggagcca

SEQ ID NO: 333349 - RNA, 64 nt, Homo Sapiens
auuucugauauuugcuggagugcuggcuccacgcccuggggagugagcuuggugcgguaggugc

SEQ ID NO: 333350 - RNA, 64 nt, Homo Sapiens
uccaggauggggaggggcucugcguuggcuucucccuggggacggggcuccccuggacagaggc

SEQ ID NO: 333351 - RNA, 64 nt, Homo Sapiens
ugggguuugaccacccaccugaccaggggcccuaccuggggaaagccugaagggccucccagcc

SEQ ID NO: 333352 - RNA, 64 nt, Homo Sapiens
agcuuaaaacucaaccacucaugaggggaaagagccuggggaggacugaaguugggcucuaaga

SEQ ID NO: 333353 - RNA, 64 nt, Homo Sapiens
aucuaagcccuccgauguguggucagaaugagguccuggggagaggaucuuuaccucugauaga

SEQ ID NO: 333354 - RNA, 64 nt, Homo Sapiens
aacuuuccuucugugugugggugggaaaggcugcccuggggaucgauugggccugauuuuuuug

SEQ ID NO: 333355 - RNA, 64 nt, Homo Sapiens
uacuggcaaacucuccuggaagacacccuggaacccuggggagccgauuccuaggaaggcuggc

SEQ ID NO: 333356 - RNA, 64 nt, Homo Sapiens
gaagaaaaaacggcuuucaucuucuucacauaagccuggggaaguuguugagagugggcguggg

SEQ ID NO: 333357 - RNA, 64 nt, Homo Sapiens
uguagaaaacacuugcagagauaggcucuagucaccuggggagcgcccuguccucaaacugguc

SEQ ID NO: 333358 - RNA, 64 nt, Homo Sapiens
uggacuuugaucuugccaucauuccccaguaaaaccuggggaguucugcguugaguggacggac

SEQ ID NO: 333359 - RNA, 64 nt, Homo Sapiens
gcauauggcauguguucacuaagaggccuuuaauccuggggaguaaggggcgaaggcccuuaga

SEQ ID NO: 333360 - RNA, 64 nt, Homo Sapiens
ugaggcuugggcccaguagccccaauaugguggcccuggggaagaggccuugggggucugcucu

SEQ ID NO: 333361 - RNA, 64 nt, Homo Sapiens
ccagcccggcugaccaacauucaaaagcacaaacccuggggacucugcuuggcuguccccucca

SEQ ID NO: 333362 - RNA, 64 nt, Homo Sapiens
uucugggacuacaggcaugaaauacugugccuggccuggggaccaggugcauuuuaagguuccu

SEQ ID NO: 333363 - RNA, 64 nt, Homo Sapiens
uuaacgccuucauuuauagaugaggcagcugaggccuggggaugugaacaaccugcucacaguc

SEQ ID NO: 333364 - RNA, 64 nt, Homo Sapiens
gugcacucucuuccuuggguguuuggugcuggcuccuggggacuacaaaucccagagugcggug

SEQ ID NO: 333365 - RNA, 64 nt, Homo Sapiens
aacaucacagaugaacugccucuccuccucccugccuggggagcccaguggccagggaggggag

SEQ ID NO: 333366 - RNA, 64 nt, Homo Sapiens
uguuguuuucaugcugcuucccucuacugcgaggccuggggagagggcagcccuguucccuucg

SEQ ID NO: 333367 - RNA, 64 nt, Homo Sapiens
agugugacgacgguaacagcaugggcuccugcagccuggggaggccagcacggcaccugugggg

SEQ ID NO: 333368 - RNA, 64 nt, Homo Sapiens
cagggcccacguggcgguccgcuggcaggcugguccuggggagcauucugcggacccggucacg

SEQ ID NO: 333369 - RNA, 64 nt, Homo Sapiens
ggcaaagggccucgugcaguguguucagauugccccuggggaucuucugugucuucagcgccca

SEQ ID NO: 333370 - RNA, 64 nt, Homo Sapiens
ggaggcugggcuuggccaggggcccgaauuuccgccuggggaguguuggauccacaucccggug

SEQ ID NO: 333371 - RNA, 64 nt, Homo Sapiens
aggccgcggggagcacguggaaaguuggcugcugccuggggaagcuucuccuccccaaggcggc

SEQ ID NO: 333372 - RNA, 64 nt, Homo Sapiens
ccggggaaccccaacugggaugugccacagcugcccuggggaaaccacccaagagcugcacucu

SEQ ID NO: 333373 - RNA, 64 nt, Homo Sapiens
cacagcagacgucugcaagcagccucugcucccuccuggggacccagggccaggccugcccagc

SEQ ID NO: 333374 - RNA, 64 nt, Homo Sapiens
ucgccagcagagguccauuccguucccagcugcuccuggggaggccgcuuccugguaggaggga

SEQ ID NO: 333375 - RNA, 64 nt, Homo Sapiens
aggaggcugcaugccugaaggcugggccuucgacccuggggaugggccacagggcaccaaacac

SEQ ID NO: 333376 - RNA, 64 nt, Homo Sapiens
caaaggguagagcuggguaauaaaugucuauucuccuggggaggagggauucuaaacuuuccuu

SEQ ID NO: 333377 - RNA, 64 nt, Homo Sapiens
ccuuucacuccauuuggcaagcucugagggggagccuggggacggguuuggguccccaggagga

SEQ ID NO: 333378 - RNA, 64 nt, Homo Sapiens
gcggggggugcccaagcccaugucaccucaccggccuggggaaggcuucguggcuccuuuagga

SEQ ID NO: 333379 - RNA, 64 nt, Homo Sapiens
cuuuuccagagccuguuagcgagccugcggcaguccuggggaaaucuggagucuaccugcggau

SEQ ID NO: 333380 - RNA, 64 nt, Homo Sapiens
cugacggguguggccacccgcgcuccugcucccuccuggggaggugcaccuggggagaagccgg

SEQ ID NO: 333381 - RNA, 64 nt, Homo Sapiens
agccggcgcuccugcucccucuugccugucugcaccuggggagaacacacccaggcggcccgcc

SEQ ID NO: 333382 - RNA, 64 nt, Homo Sapiens
gccuucaaccaaaacacagcuaaaaugacuuguuccuggggaaugaaaccaagcguaucugcuc

SEQ ID NO: 333383 - RNA, 64 nt, Homo Sapiens
acauuugacaaauuucccuugaggaaaauacacaccuggggaguugggggaaaccuuauaccca

SEQ ID NO: 333384 - RNA, 64 nt, Homo Sapiens
aagaggcuugggcugcagauagcugagcgccaggccuggggagguacugggaaguccauuugca

SEQ ID NO: 333385 - RNA, 64 nt, Homo Sapiens
gggcaguguggaagaacguggucaacccccauaaccuggggauucgggagauuuccuccccuca

SEQ ID NO: 333386 - RNA, 64 nt, Homo Sapiens
ggcuaaggccagcccuggacauuguccaggaaggccuggggaggaggagugaagucugugcaua

SEQ ID NO: 333387 - RNA, 64 nt, Homo Sapiens
gaggcucacucaguaacguuguuuaauucucugcccuggggaaggaggauggauugagagaaug

SEQ ID NO: 333388 - RNA, 64 nt, Homo Sapiens
uuucucgucccccucccugcccaaacuccccuucccuggggagcccucaggcuccccagaacug

SEQ ID NO: 333389 - RNA, 64 nt, Homo Sapiens
gggagcccucaggcuccccagaacuggcugggccccuggggacagagccaccccaugagcucgg

SEQ ID NO: 333390 - RNA, 64 nt, Homo Sapiens
aaugugacaacugugcauugugacuggaauagcaccuggggauaaggugucuacugaccuggag

SEQ ID NO: 333391 - RNA, 64 nt, Homo Sapiens
ggcccagagcaaagggcauccuugggggcaggaaccuggggaggccccacagcccaguguucuc

SEQ ID NO: 333392 - RNA, 64 nt, Homo Sapiens
cacucaccauaaacacauccaggugacuaccaguccuggggacagggcggggacccggacagcc

SEQ ID NO: 333393 - RNA, 64 nt, Homo Sapiens
agcaggguacagcccauuccgggggacagucgugccuggggaggcacccggugauggagccccg

SEQ ID NO: 333394 - RNA, 64 nt, Homo Sapiens
caucuguuugccauguaccuggaugcgacgggccccuggggacaggcccuugccccauccaucc

SEQ ID NO: 333395 - RNA, 64 nt, Homo Sapiens
uuguggggugugacauacaagugacugaacacuuccuggggagcuacaggggcacuuaacccac

SEQ ID NO: 333396 - RNA, 64 nt, Homo Sapiens
cucgggcccaggcccuggcagagaaacagggaggccuggggagagcuacccgccagcuugggcu

SEQ ID NO: 333397 - RNA, 64 nt, Homo Sapiens
aggagcgcagcaccaugucccugccccccgggcuccuggggaacagcuggggcgaaggagcacc

SEQ ID NO: 333398 - RNA, 64 nt, Homo Sapiens
ugucuguacuuugggaagucuuuacccccuggggccuggggaaacagacuucacaccucauugc

SEQ ID NO: 333399 - RNA, 64 nt, Homo Sapiens
agcgcuaacccuggaggcagguggagcgcaggggccuggggagcuugcuucucaucggacacuu

SEQ ID NO: 333400 - RNA, 64 nt, Homo Sapiens
ugauguuccuuccagauuguccgccguggcuauaccuggggacuaccagaccaugggccaagag

SEQ ID NO: 333401 - RNA, 64 nt, Homo Sapiens
cugcgggcacccauccgcuccacaccguggccuaccuggggaaguccucgugggccguguggca

SEQ ID NO: 333402 - RNA, 64 nt, Homo Sapiens
acgucgggcagcuuuauucugagcgccacggaagccuggggaugccuagagcuccugugaccga

SEQ ID NO: 333403 - RNA, 64 nt, Homo Sapiens
uccacacuggaagucgaauuccuguuuucaguggccuggggaggcacacauuuugguuugacgc

SEQ ID NO: 333404 - RNA, 64 nt, Homo Sapiens
cugcugccaagagccccucaagagaagggcugaaccuggggagaugucacugccagggugaggu

SEQ ID NO: 333405 - RNA, 64 nt, Homo Sapiens
ugagcccaggcaccccagugcccgcugggcccagccuggggacagggaaccugccgggcucaca

SEQ ID NO: 333406 - RNA, 64 nt, Homo Sapiens
cgaugagaagauggccaccuuuuccucuccaccaccuggggauagacaugggagagaugguguu

SEQ ID NO: 333407 - RNA, 64 nt, Homo Sapiens
cauucaggcaguaaaaugacucauguuugccuucccuggggaaaugaguuaagaaaauucuuua

SEQ ID NO: 333408 - RNA, 64 nt, Homo Sapiens
acaaauggcugagcuuugauccgagcccucagccccuggggagaacccucugcuucaccaaagc

SEQ ID NO: 333409 - RNA, 64 nt, Homo Sapiens
gaaggaguucagaggaagggaggaugcuggggggccuggggaaggguggggguggggguuguua

SEQ ID NO: 333410 - RNA, 64 nt, Homo Sapiens
ugggggugggguggucagcuaauggacaggcucaccuggggauuuugacaacacacaggaaugg

SEQ ID NO: 333411 - RNA, 64 nt, Homo Sapiens
uagaggcacgggauaaggggcccucccaggucucccuggggagguucuucugcaggaucuucuu

SEQ ID NO: 333412 - RNA, 64 nt, Homo Sapiens
ccucccacacaagcucgguggugacucuucggccccuggggaaaaacaaaaagauauugcugag

SEQ ID NO: 333413 - RNA, 64 nt, Homo Sapiens
gacgaggccagugagggacggcguggcugugcuuccuggggaaaugaacccccuccccacagac

SEQ ID NO: 333414 - RNA, 64 nt, Homo Sapiens
agcuggguuuucugucuaggucaccacucccaauccuggggauuggagaggccuggggcugugg

SEQ ID NO: 333415 - RNA, 64 nt, Homo Sapiens
gcgggugcuggugggaggacagugccaaccuccuccuggggaucccauguuggagacucuaagg

SEQ ID NO: 333416 - RNA, 64 nt, Homo Sapiens
ggagaacggagaagaaguuguggaguauuaggggccuggggauuccaauaacugguucaguggc

SEQ ID NO: 333417 - RNA, 64 nt, Homo Sapiens
gcgucuggggccuccagaacggaagaccaagacaccuggggauucacgagagggcugggacggu

SEQ ID NO: 333418 - RNA, 64 nt, Homo Sapiens
ccccggaaucuuaguucuuccuccuucgguaucaccuggggaagauucccgggcacaccuaugg

SEQ ID NO: 333419 - RNA, 64 nt, Homo Sapiens
ucuuguccucagugccacccucaggcccugauguccuggggauugagcgcagagaggugggugg

SEQ ID NO: 333420 - RNA, 64 nt, Homo Sapiens
ccccuugcccaugccuccaguggggaguuuacuaccuggggaccgcccuagcccucagcccacc

SEQ ID NO: 333421 - RNA, 64 nt, Homo Sapiens
uuacuaccuggggaccccccuagcccucagcccaccuggggaguacccaccugaggcucagccc

SEQ ID NO: 333422 - RNA, 64 nt, Homo Sapiens
ugaaagucagccugccccucucacgagaaaagaaccuggggauaccucucagccuccagcguug

SEQ ID NO: 333423 - RNA, 64 nt, Homo Sapiens
uuggguguuaaugguggccuggguugugucuuccccuggggaugaggguuggguguccauggug

SEQ ID NO: 333424 - RNA, 64 nt, Homo Sapiens
uuggguguccaagaugcccugggcuguguccuucccuggggaugaggguuggauguccaagaug

SEQ ID NO: 333425 - RNA, 64 nt, Homo Sapiens
cuggguguccaagauacccugggcuguguccuccccuggggaugaggguuggguguccauggug

SEQ ID NO: 333426 - RNA, 64 nt, Homo Sapiens
uuggguguccauggugcccugggcuguguccuccccuggggaugacgguuggguguccauggug

SEQ ID NO: 333427 - RNA, 64 nt, Homo Sapiens
ggacuggcccagggaggaggaagccagcagcacaccuggggaauggggucccggccgggaggcu

SEQ ID NO: 333428 - RNA, 64 nt, Homo Sapiens
ucaccuggcucuggagggcugcccugcagcugggccuggggacaggucggcuguggggcagcuc

SEQ ID NO: 333429 - RNA, 64 nt, Homo Sapiens
ccacuucagaagguaggggcgugccccacuccagccuggggaccucugugauccuuggugcugu

SEQ ID NO: 333430 - RNA, 64 nt, Homo Sapiens
aauuccacucguccaagggaggaccugcauccuuccuggggacgcuucacagcgucugcucaua

SEQ ID NO: 333431 - RNA, 64 nt, Homo Sapiens
uuauuugcugcuucucccagcccuggggaagauuccuggggaauacuugcugggcugaguccag

SEQ ID NO: 333432 - RNA, 64 nt, Homo Sapiens
auuccuggggaauuuauuuggggcugaguccagcccuggggaagggcaccccagucuacuugcu

SEQ ID NO: 333433 - RNA, 64 nt, Homo Sapiens
uguggguugauggagcgucccugaagcccccagcccuggggauggggaaggacauggagccuga

SEQ ID NO: 333434 - RNA, 64 nt, Homo Sapiens
agagaaccagcucugaguccugaggagacacaggccuggggacaggaagggaugggggucccug

SEQ ID NO: 333435 - RNA, 64 nt, Homo Sapiens
ugccuguggcaggaaggaaucugcaucccgccucccuggggaccgcggcaccgcuccccuguga

SEQ ID NO: 333436 - RNA, 64 nt, Homo Sapiens
gaagaaugaggacagucccgaggggaggggaagaccuggggaagcugugcaaggccaacagggc

SEQ ID NO: 333437 - RNA, 64 nt, Homo Sapiens
uugccuacuggggaccucggugcuggggaugucuccuggggacuuccccugcggaagccuggcc

SEQ ID NO: 333438 - RNA, 64 nt, Homo Sapiens
caccuaccuggguccucacuugcagcuucaccugccuggggauuugccugggacggucaccugu

SEQ ID NO: 333439 - RNA, 64 nt, Homo Sapiens
gggagggaugggagucccugugaggagacacaggccuggggacaagagaaccagcucugagucc

SEQ ID NO: 333440 - RNA, 64 nt, Homo Sapiens
gggaaggacauggagccugaccaaagcucccagcccuggggacguguggguugauggagcgucc

SEQ ID NO: 333441 - RNA, 64 nt, Homo Sapiens
uuaaggucucucuccuuggucccccaguaaccauccuggggaguguccccuccccagggaacca

SEQ ID NO: 333442 - RNA, 64 nt, Homo Sapiens
uuuccaccccaguccccuccugaccgucuauaucccuggggaaaacuccagcccauccuguugg

SEQ ID NO: 333443 - RNA, 64 nt, Homo Sapiens
ucuccuagucuccgugugauggaggagggagaugccuggggaggggcuccuggaauccaggcca

SEQ ID NO: 333444 - RNA, 64 nt, Homo Sapiens
agggauaaaccaucccuucuuggggcuuuaagucccuggggagcuuucccuguaggucuccugg

SEQ ID NO: 333445 - RNA, 64 nt, Homo Sapiens
cuguguggcugugccgggcaggacggaauggccgccuggggagccagggccuuuaggggcugca

SEQ ID NO: 333446 - RNA, 64 nt, Homo Sapiens
ggcuacaaggaguaauugugcugaguguaagcugccuggggaggggucuuucucuuugacccug

SEQ ID NO: 333447 - RNA, 64 nt, Homo Sapiens
aacuuuugguucuuacuuugcugcucguuuagucccuggggauuucagaucuuaggcuguuguu

SEQ ID NO: 333448 - RNA, 64 nt, Homo Sapiens
cagggccgagggggcucccagaaggaccccaggcccuggggaggguggcugugggaggccaagu

SEQ ID NO: 333449 - RNA, 64 nt, Homo Sapiens
caagggccuguucugccccagcuguuccuccuccccuggggacagccccaccuccgggucccuc

SEQ ID NO: 333450 - RNA, 64 nt, Homo Sapiens
ggaaacucgcuccuucuguuggcagaggacagccccuggggaaccccaggcccaacucuguccg

SEQ ID NO: 333451 - RNA, 64 nt, Homo Sapiens
acacugcucugcuccaccaggcagcucaucccuuccuggggaccgagugcucuggaaagccaaa

SEQ ID NO: 333452 - RNA, 64 nt, Homo Sapiens
cucauauuccaaguucuucuagagggucaggagaccuggggagugggucucauuccaagaagga

SEQ ID NO: 333453 - RNA, 64 nt, Homo Sapiens
cugugaauuucuccugcagggauuucauguugacccuggggaugcaguggcggggacagggcca

SEQ ID NO: 333454 - RNA, 64 nt, Homo Sapiens
ccccaguggcggggacagggaucaggaacgcaggccuggggagcuggaaaaccugucccaguuu

SEQ ID NO: 333455 - RNA, 55 nt, Homo Sapiens
auaagagacugagccgcuagcagcgccuggggaccagacagacgcauguggcaaa

SEQ ID NO: 333456 - RNA, 64 nt, Homo Sapiens
uuugccuuuguggcccaugaaagucuuacugggcccuggggaagguauccuacccuggugaagc

SEQ ID NO: 333457 - RNA, 64 nt, Homo Sapiens
aggaggccaguucugaaaggcgagcagaacucccccuggggaggaagcucaccaaaaguuuuuc

SEQ ID NO: 333458 - RNA, 64 nt, Homo Sapiens
acugaaagcugccgaagcagccacuggaaagaacccuggggacccuaauguuggacucucggcg

SEQ ID NO: 333459 - RNA, 64 nt, Homo Sapiens
guuggggggcaaggugggggagccuggagccccugugugggagggcgaggcgggggagccugga

SEQ ID NO: 333460 - RNA, 64 nt, Homo Sapiens
gugggagggcgaggcgggggagccuggagccccugugugggagggcgaggcgggggauccugga

SEQ ID NO: 333461 - RNA, 64 nt, Homo Sapiens
uugcuuuggggagaaaaguauucaggaagugggugugugggaaaccugaagauggcgugcacag

SEQ ID NO: 333462 - RNA, 64 nt, Homo Sapiens
ggugcgccgcugugcugggagcugcagugguaaugugugggacaccuugaccaaaggggagcuu

SEQ ID NO: 333463 - RNA, 64 nt, Homo Sapiens
uggugagagcaggaggagaggugugggacugggggugugggagucagggugugcucggugggca

SEQ ID NO: 333464 - RNA, 64 nt, Homo Sapiens
gggggugugggaguuggugagugcucggugggcagugugggacuuuagggccuucucccagggu

SEQ ID NO: 333465 - RNA, 64 nt, Homo Sapiens
cgcccgccaccugcuccccgcaggaugugucugugugugggaauugguaucuugcacccguggg

SEQ ID NO: 333466 - RNA, 64 nt, Homo Sapiens
ucugccuuagcaggggccugcgugagugggcacggugugggaggucgccugcgugggguggugu

SEQ ID NO: 333467 - RNA, 64 nt, Homo Sapiens
cuggcucaagcaacuacucuggaugcacuuugcugugugggaugaacuaaaagugucugaauuu

SEQ ID NO: 333468 - RNA, 64 nt, Homo Sapiens
aauucuggucauuucaagaggauggaggccucaagugugggaacuuccccuacucccuggaugu

SEQ ID NO: 333469 - RNA, 64 nt, Homo Sapiens
gcucuucaguggcuccucugacaagaccaucaaggugugggacacauguaccaccuacaagugu

SEQ ID NO: 333470 - RNA, 64 nt, Homo Sapiens
acucuacagcggcucugcagacugcaccaucauugugugggacauccagaaccugcagaaggug

SEQ ID NO: 333471 - RNA, 64 nt, Homo Sapiens
cauugucuguggcaccuacgagaaccucauccacgugugggacauugaguccaaggagcaggug

SEQ ID NO: 333472 - RNA, 64 nt, Homo Sapiens
uggguuguguguauaucuggcauguguggggugugugugggaugucuggucacuuggagaaggg

SEQ ID NO: 333473 - RNA, 64 nt, Homo Sapiens
cguguguauaagggggugugguauaagggggugugugugggaugggugugugugggaugcgugu

SEQ ID NO: 333474 - RNA, 64 nt, Homo Sapiens
cguguguauaaggggguguguuggagaagggugugugugggauggugguguguguccuagucac

SEQ ID NO: 333475 - RNA, 64 nt, Homo Sapiens
gaacccuccaccccgcagaccaggcgucgugugugugugggagagaaggaggcccguguugagc

SEQ ID NO: 333476 - RNA, 64 nt, Homo Sapiens
ggaugcacugacugaccgucuggggcucaggcuggugugggaugcagccggccgaugagaaaau

SEQ ID NO: 333477 - RNA, 64 nt, Homo Sapiens
gcguuaucucauagcucaaguaugaaugcaagcagugugggaaaacacuggagagaagaaacuc

SEQ ID NO: 333478 - RNA, 64 nt, Homo Sapiens
gcauuuuucuggcccaguuuuauaaauguaaguugugugggaaaugcagcauggagauggaccu

SEQ ID NO: 333479 - RNA, 64 nt, Homo Sapiens
aggggaagugucgcuucagguguguccuacggacgugugggagguggcaggcgccagccuccga

SEQ ID NO: 333480 - RNA, 64 nt, Homo Sapiens
ucuucuguuccaugggugcccagccagccaggccgugugggauccagcgagaggccagggcuug

SEQ ID NO: 333481 - RNA, 64 nt, Homo Sapiens
aggguuuuaguagaaggguguauguucuuuucgagugugggaaacugcucucugcuggguuuuc

SEQ ID NO: 333482 - RNA, 64 nt, Homo Sapiens
ugcuaccuggcaguuucucgagccaggggcuggugugugggagcccucgacccguacaguugag

SEQ ID NO: 333483 - RNA, 64 nt, Homo Sapiens
cgugggguggggcggugugagcgggcaugggucugugugggagacucaggguguggacggggca

SEQ ID NO: 333484 - RNA, 64 nt, Homo Sapiens
auggacuccaacaagcaugugacugugagauugugugugggaaaauguauuuaacuacucugug

SEQ ID NO: 333485 - RNA, 64 nt, Homo Sapiens
uuauugugccagggauggggaaaugggggggguugugugggaagaguacuuauuauuguguuuu

SEQ ID NO: 333486 - RNA, 64 nt, Homo Sapiens; identical to SEQ ID NO: 102083

SEQ ID NO: 333487 - RNA, 64 nt, Homo Sapiens; identical to SEQ ID NO: 102084

SEQ ID NO: 333488 - RNA, 64 nt, Homo Sapiens
acaagcgauaggcuauugcaggcaaaagaauuuagaggcaaaugucuuauuguugaucaaagga

SEQ ID NO: 333489 - RNA, 64 nt, Homo Sapiens
aauuuagaggcaaaugacaaauuguugaucaaaggaggcaaaagaugaagccaaauauccucuu

SEQ ID NO: 333490 - RNA, 64 nt, Homo Sapiens
uuucugcaugaccaaagugaaaaucagaacuuuggaggcaaaucagccaagaagaauuuauuac

SEQ ID NO: 333491 - RNA, 54 nt, Homo Sapiens
gagaaaaucauguugaaacacacagaggcaaaaggcgggaaagacuacguguga

SEQ ID NO: 333492 - RNA, 64 nt, Homo Sapiens
aacaaaacaaaacaaaacaauucacaaguccugugaggcaaaaauacuuguuucuuaagacuau

SEQ ID NO: 333493 - RNA, 64 nt, Homo Sapiens
uuucacacaaaguuucugcaaugagauuaaggcagaggcaaaagaguuucauccuauccgaggg

SEQ ID NO: 333494 - RNA, 64 nt, Homo Sapiens
uggcucaccuuccgcacgcguccagaggcaaacggaggcaaagcgccuguuaggagaagcugca

SEQ ID NO: 333495 - RNA, 64 nt, Homo Sapiens
gaggcaaagcuggcucaccuagaagcugcauccagaggcaaacgagcaucaccugccuguuagg

SEQ ID NO: 333496 - RNA, 64 nt, Homo Sapiens
uggggagagggggguaucaggcagggagggggcagaggcaaaucaccgggcagagggaggggag

SEQ ID NO: 333497 - RNA, 64 nt, Homo Sapiens
gaggccuuuuggcaaacagugucuauuuuacagagaggcaaaccaagccuccuuagugcccugg

SEQ ID NO: 333498 - RNA, 64 nt, Homo Sapiens
cugaugccaagaaagugaggauuuaggcaacaaggaggcaaaagcaaaucucagagaagucauc

SEQ ID NO: 333499 - RNA, 64 nt, Homo Sapiens
aaccacccacaugcuuagccccagcuuuuuggaagaggcaaauggcuggucugaggaugacaca

SEQ ID NO: 333500 - RNA, 64 nt, Homo Sapiens
ugugguaucuuuugccacauccagggcgaggguugaggcaaaccagcccucccucugacuuccu

SEQ ID NO: 333501 - RNA, 64 nt, Homo Sapiens
agcagccuagacagaaccugcagcucuguggaaagaggcaaaguccugaaaaggcaaaggguug

SEQ ID NO: 333502 - RNA, 64 nt, Homo Sapiens; identical to SEQ ID NO: 76468

SEQ ID NO: 333503 - RNA, 64 nt, Homo Sapiens; identical to SEQ ID NO: 76469

SEQ ID NO: 333504 - RNA, 64 nt, Homo Sapiens; identical to SEQ ID NO: 76470

SEQ ID NO: 333505 - RNA, 64 nt, Homo Sapiens; identical to SEQ ID NO: 76471

SEQ ID NO: 333506 - RNA, 64 nt, Homo Sapiens; identical to SEQ ID NO: 76472

SEQ ID NO: 333507 - RNA, 64 nt, Homo Sapiens; identical to SEQ ID NO: 76473

SEQ ID NO: 333508 - RNA, 64 nt, Homo Sapiens; identical to SEQ ID NO: 126039

SEQ ID NO: 333509 - RNA, 64 nt, Homo Sapiens; identical to SEQ ID NO: 126040

SEQ ID NO: 333510 - RNA, 64 nt, Homo Sapiens; identical to SEQ ID NO: 126041

SEQ ID NO: 333511 - RNA, 64 nt, Homo Sapiens; identical to SEQ ID NO: 126042

SEQ ID NO: 333512 - RNA, 64 nt, Homo Sapiens; identical to SEQ ID NO: 111844

SEQ ID NO: 333513 - RNA, 64 nt, Homo Sapiens; identical to SEQ ID NO: 111845

SEQ ID NO: 333514 - RNA, 62 nt, Homo Sapiens; identical to SEQ ID NO: 111846

SEQ ID NO: 333515 - RNA, 64 nt, Homo Sapiens; identical to SEQ ID NO: 111847

SEQ ID NO: 333516 - RNA, 64 nt, Homo Sapiens; identical to SEQ ID NO: 111848

SEQ ID NO: 333517 - RNA, 64 nt, Homo Sapiens; identical to SEQ ID NO: 111849

SEQ ID NO: 333518 - RNA, 64 nt, Homo Sapiens; identical to SEQ ID NO: 111850

SEQ ID NO: 333519 - RNA, 64 nt, Homo Sapiens; identical to SEQ ID NO: 111851

SEQ ID NO: 333520 - RNA, 64 nt, Homo Sapiens; identical to SEQ ID NO: 111852

SEQ ID NO: 333521 - RNA, 64 nt, Homo Sapiens; identical to SEQ ID NO: 111853

SEQ ID NO: 333522 - RNA, 64 nt, Homo Sapiens; identical to SEQ ID NO: 111854

SEQ ID NO: 333523 - RNA, 64 nt, Homo Sapiens; identical to SEQ ID NO: 111855

SEQ ID NO: 333524 - RNA, 64 nt, Homo Sapiens; identical to SEQ ID NO: 111856

SEQ ID NO: 333525 - RNA, 64 nt, Homo Sapiens; identical to SEQ ID NO: 111857

SEQ ID NO: 333526 - RNA, 64 nt, Homo Sapiens; identical to SEQ ID NO: 111858

SEQ ID NO: 333527 - RNA, 64 nt, Homo Sapiens; identical to SEQ ID NO: 111859

SEQ ID NO: 333528 - RNA, 64 nt, Homo Sapiens
ccauuagccaggcuugggauuguugggacuuuuaaaccuugaauaguaaauaguaaaaagguaa

SEQ ID NO: 333529 - RNA, 64 nt, Homo Sapiens
aaaaacacaaaauuuuuccacuaaccaagucucaaaccuugaugguguguacauuuauaauguu

SEQ ID NO: 333530 - RNA, 64 nt, Homo Sapiens
uuugaaaguuuugaauauauccacauucuauugaaaccuugaaacuaaaaauuuagacucuuau

SEQ ID NO: 333531 - RNA, 64 nt, Homo Sapiens
ggacagggacaguuaaauugggagccuuucuuacaaccuugaugggauuuuuccccccaaguuu

SEQ ID NO: 333532 - RNA, 64 nt, Homo Sapiens
cuggccucccacaacuccccuucuggcugccuguaaccuugaggggcauucaggaggccagcgu

SEQ ID NO: 333533 - RNA, 64 nt, Homo Sapiens
agcccaggccaagcacagggucuggcucguggcaaaccuugaauaaauauuuguuggcugaaug

SEQ ID NO: 333534 - RNA, 64 nt, Homo Sapiens
guggcauaaugcagucugaguccaaaggccagguaaccuugaguucugacguccacgggcagga

SEQ ID NO: 333535 - RNA, 64 nt, Homo Sapiens
auugaucuuuugacugugccaccuuuuucaaggaaaccuugacuuauaccuagcugucauauga

SEQ ID NO: 333536 - RNA, 64 nt, Homo Sapiens
gccaggcaaaaacauuacaaggccaggauuacccuaauaccaaacuucccaaaucauuuuguga

SEQ ID NO: 333537 - RNA, 64 nt, Homo Sapiens
agugaaagaggccaucauagaagacaaauacugcuaauaccaaagcuagauuaagaaaaaacag

SEQ ID NO: 333538 - RNA, 64 nt, Homo Sapiens
uauucauuucaugauguaaagaaauuugggagguuaauaccaaguaguuauucuacauuuucuu

SEQ ID NO: 333539 - RNA, 64 nt, Homo Sapiens; identical to SEQ ID NO: 333538

SEQ ID NO: 333540 - RNA, 64 nt, Homo Sapiens
gccccccacucugccgugcucacacagacacacccagcugcacacaugaggcaucccacaugac

SEQ ID NO: 333541 - RNA, 64 nt, Homo Sapiens
ugauggggcugggcugagccagggaggaaggacccagcugcaccuaggagacaccuuuguucuu

SEQ ID NO: 333542 - RNA, 64 nt, Homo Sapiens
ucugcguagcccacagagggcccaggccccugcccagcugcagucucccagccuccacuuucag

SEQ ID NO: 333543 - RNA, 64 nt, Homo Sapiens
uacccaguuuguguguuugagcucugcauucaggcagcugcaacauuccaguguuugaacuguc

SEQ ID NO: 333544 - RNA, 64 nt, Homo Sapiens
uucugugcucuccaguuuguccuuagaaauuggacagcugcaugucacugucacagcagaguca

SEQ ID NO: 333545 - RNA, 64 nt, Homo Sapiens
ggacagacgccaaucacugugacaggggccugcgcagcugcagggccguuggcacaccagcuca

SEQ ID NO: 333546 - RNA, 54 nt, Homo Sapiens
gcugcagcgcuguggggguagggccagcugcaggaaggcuccucccagggcuga

SEQ ID NO: 333547 - RNA, 64 nt, Homo Sapiens
augacuacagccugaagggccuccaggucagcugcagcugcaaaaaggaagacaggaacuaaac

SEQ ID NO: 333548 - RNA, 60 nt, Homo Sapiens
ugcaaaaugacuacagccugaccuccaggucagcugcagcccaaggaagacaggaacuaa

SEQ ID NO: 333549 - RNA, 64 nt, Homo Sapiens
aguggggucgccguaccaggggcccuggcagggucagcugcaagaacaucaaaccagagugccc

SEQ ID NO: 333550 - RNA, 64 nt, Homo Sapiens
gccucgguugucucugcggcuccuuagggcagaacagcugcauguggcacuugugacacucacu

SEQ ID NO: 333551 - RNA, 64 nt, Homo Sapiens
uugcugguccaucuggggccggcugcugagagcucagcugcaaggaacugaaucagccuggaau

SEQ ID NO: 333552 - RNA, 64 nt, Homo Sapiens
ccucagcuagaguccaagacugagagcaaaggcccagcugcagcaggguuagaggguggggagg

SEQ ID NO: 333553 - RNA, 64 nt, Homo Sapiens
ucaggaauggugucccaaguuggaggcuuugugucagcugcaaauccuaccaguuauguccaag

SEQ ID NO: 333554 - RNA, 64 nt, Homo Sapiens
gccucugcuuccagcuuuguguaauucucuuugccagcugcacaaagcugauuuuuuccaaagu

SEQ ID NO: 333555 - RNA, 64 nt, Homo Sapiens
cccacagggcgggugggucagcguugacucuuuccagcugcacacucauaugccgugugucuua

SEQ ID NO: 333556 - RNA, 64 nt, Homo Sapiens
ccggcccacucagcggcccacauuggccagcauucagcugcacgugugugcugcgugcuucaca

SEQ ID NO: 333557 - RNA, 64 nt, Homo Sapiens
acugagccacuaccugggcaucagucuggaucugcagcugcaguuggagcagcuccgagggagg

SEQ ID NO: 333558 - RNA, 64 nt, Homo Sapiens
gugcuguggacuggacccaggagccccggcggcgcagcugcaagguugccaggacccacccuca

SEQ ID NO: 333559 - RNA, 64 nt, Homo Sapiens
acugcugcccaacaugagcagugaucuccaaggccagcugcagggccugcucguacacuugcuc

SEQ ID NO: 333560 - RNA, 64 nt, Homo Sapiens
cucuccacucgacacagccugcgguuugcagugccagcugcacguuggagucuccugggaagcu

SEQ ID NO: 333561 - RNA, 64 nt, Homo Sapiens
aggacggccggcugccccgcaccaucccucuccccagcugcaaacugagugugccggacccuga

SEQ ID NO: 333562 - RNA, 64 nt, Homo Sapiens
cccucuccugccacacagacccgcuggaccaaagcagcugcagccgccuccucguuccucuccu

SEQ ID NO: 333563 - RNA, 64 nt, Homo Sapiens
gggaggacgggacccugagccugugugugucgggcagcugcaggguaggcguguguggacauug

SEQ ID NO: 333564 - RNA, 64 nt, Homo Sapiens
gagcuaaucuguggccagggugcuggcaugguggcagcugcaaauguccaugcacccagguggc

SEQ ID NO: 333565 - RNA, 64 nt, Homo Sapiens
cuccuccccuuagugaccccaagucuguuucccucagcugcauaaggaggcgauauaguuugaa

SEQ ID NO: 333566 - RNA, 64 nt, Homo Sapiens
aggggggagcugaaaggaaugguggaaggagaaacagcugcagggcugggccugccuggggaaa

SEQ ID NO: 333567 - RNA, 64 nt, Homo Sapiens
uucaugccggcagcauuuuguuucuagagucuuccagcugcauccucugccuccuaaugcuagg

SEQ ID NO: 333568 - RNA, 64 nt, Homo Sapiens
ccucgcaaggguggagugggucccugucaaaaagcagcugcaaguggggucuaccucagagcuc

SEQ ID NO: 333569 - RNA, 64 nt, Homo Sapiens
gagcccccuuucugaugaugugcuucgggcugagcagcugcaggaccuucaaaagugugagccc

SEQ ID NO: 333570 - RNA, 64 nt, Homo Sapiens
guugcauugggcuucuuggcaaauaaaaggagcucagcugcagcugaguccuugcuucccucag

SEQ ID NO: 333571 - RNA, 64 nt, Homo Sapiens
agguuaagagacucuuccagagccuaaugagucccagcugcauuguguggucaagagccgucug

SEQ ID NO: 333572 - RNA, 64 nt, Homo Sapiens
agcaguuccgggagcggaugagcuccggcagaagcagcugcagccgaggccacgcaccagcgga

SEQ ID NO: 333573 - RNA, 64 nt, Homo Sapiens
aggugaccuccccuuccagacccugggacacccacagcugcagccagcugccgaccgaacaugg

SEQ ID NO: 333574 - RNA, 64 nt, Homo Sapiens
ucugcaccaggccggucccuacagaggggaacaucagcugcagcgaggcagaggguggggcugc

SEQ ID NO: 333575 - RNA, 64 nt, Homo Sapiens
ggcccagggagagguaaccuaggcuaugccauggcagcugcagacugcuuugggaggauuucuc

SEQ ID NO: 333576 - RNA, 64 nt, Homo Sapiens
accguguaaaugagcuccagacacggugcggauccagcugcaagugucaggugggaagaggagu

SEQ ID NO: 333577 - RNA, 64 nt, Homo Sapiens
cccuugcucucagcugccaaacacauucccccaccagcugcagcauucacauugaccgcaacuc

SEQ ID NO: 333578 - RNA, 64 nt, Homo Sapiens
ccagggaugaagaaagacucgggcuugauggugacagcugcaagaagaaugaacccaagagcaa

SEQ ID NO: 333579 - RNA, 64 nt, Homo Sapiens
ccccucacugaagaagcagauugccaagugccagcagcugcagcaagaauacagccgcaaggag

SEQ ID NO: 333580 - RNA, 64 nt, Homo Sapiens
gcuggaggaucugauuggcaagcuuaccagucuucagcugcaacaccuguuuaugauccuggcc

SEQ ID NO: 333581 - RNA, 64 nt, Homo Sapiens
cauuucugcaggaggagcaggccuggcucagcugcagcugcagaucuagaaauucuacugcacu

SEQ ID NO: 333582 - RNA, 64 nt, Homo Sapiens
ugcagacauuucugcaggagugcacugccuggcucagcugcagcagucuuucuagaaauucuac

SEQ ID NO: 333583 - RNA, 64 nt, Homo Sapiens
cugcuuagggacuucugugugggagaggcuggcccagcugcagacugggcugcucugcacccac

SEQ ID NO: 333584 - RNA, 64 nt, Homo Sapiens
aacugcagauacugcgggcuucuaccaagccacacagcugcagcaccucagugccugagacuuu

SEQ ID NO: 333585 - RNA, 64 nt, Homo Sapiens
ggcuucgugagcaccccaccccuaccuucugcgacagcugcaguaugaggucaccuuccgaaag

SEQ ID NO: 333586 - RNA, 64 nt, Homo Sapiens
auuucaacacgcugauggcaggcacaggcuccaccagcugcagacuggacaaguucauucacgu

SEQ ID NO: 333587 - RNA, 64 nt, Homo Sapiens
cgacaugaaguguaccuuuucuaaagacgguuuccagcugcaacggcuccacuuugcaggcuug

SEQ ID NO: 333588 - RNA, 64 nt, Homo Sapiens
gaacgugcuucuuauuccuggcaggcuucaagaacagcugcacaugugccgcuaacugaccgcg

SEQ ID NO: 333589 - RNA, 64 nt, Homo Sapiens
cucccuggcucaagugggcaaccaggugucugagcagcugcaugcccuccccugcuagucaccu

SEQ ID NO: 333590 - RNA, 64 nt, Homo Sapiens
uugcuugugagaaauggggacccaucuggcaccacagcugcaucuuaaagaugagaaaagccac

SEQ ID NO: 333591 - RNA, 64 nt, Homo Sapiens; identical to SEQ ID NO: 275773

SEQ ID NO: 333592 - RNA, 64 nt, Homo Sapiens; identical to SEQ ID NO: 275774

SEQ ID NO: 333593 - RNA, 64 nt, Homo Sapiens
cauucaagauuaauauuugauucucuaucucuuaacuguagauuuuauuggccuguuuuuuuuu

SEQ ID NO: 333594 - RNA, 64 nt, Homo Sapiens
uaucugggcggugaggguauugauuuacauaaaaacuguagacaaacacaguacgagucucagc

SEQ ID NO: 333595 - RNA, 64 nt, Homo Sapiens
acuaaaucauugagauagaaaaagauucccauugacuguagacuucuucccauuuugucuuccc

SEQ ID NO: 333596 - RNA, 64 nt, Homo Sapiens
uuaguguuacagagaagcagccgauagcaaaucgacuguagagacuuggcggcgguggcauugc

SEQ ID NO: 333597 - RNA, 64 nt, Homo Sapiens
cagcuugcugagccccuccguguagaaguggcuuacuguagaaguuuccuguuugaaggcuuac

SEQ ID NO: 333598 - RNA, 64 nt, Homo Sapiens
uggcuuacuguagaagcagccuguuugaaggcuuacuguagaaguucauuuuaugcuuuauuuc

SEQ ID NO: 333599 - RNA, 64 nt, Homo Sapiens
cuugaauguucuacuugcuacacuauuuauaaugacuguagauauagauauggcauguacuuua

SEQ ID NO: 333600 - RNA, 64 nt, Homo Sapiens
uggcauguacuuuacacuauuauacucuucccacacuguagauaagaacucauuuucccauguu

SEQ ID NO: 333601 - RNA, 64 nt, Homo Sapiens
cuuagaguuucggguguuuuucuccagucuuguuacuguagacuguagaaagcacgggccccag

SEQ ID NO: 333602 - RNA, 64 nt, Homo Sapiens
uuucggguguuuuucuccagucuuguuacuguagacuguagaaagcacgggccccaggcucuga

SEQ ID NO: 333603 - RNA, 64 nt, Homo Sapiens
gccccgccugcaggcgguguagauacauguagauacuguagauacuguagauaccgccccggcg

SEQ ID NO: 333604 - RNA, 64 nt, Homo Sapiens
gcaggcgguguagauacauguagauacuguagauacuguagauaccgccccggcgccgacuuga

SEQ ID NO: 333605 - RNA, 64 nt, Homo Sapiens; identical to SEQ ID NO: 245412

SEQ ID NO: 333606 - RNA, 64 nt, Homo Sapiens; identical to SEQ ID NO: 245413

SEQ ID NO: 333607 - RNA, 64 nt, Homo Sapiens; identical to SEQ ID NO: 245414

SEQ ID NO: 333608 - RNA, 64 nt, Homo Sapiens; identical to SEQ ID NO: 245415

SEQ ID NO: 333609 - RNA, 64 nt, Homo Sapiens; identical to SEQ ID NO: 245416

SEQ ID NO: 333610 - RNA, 64 nt, Homo Sapiens; identical to SEQ ID NO: 245417

SEQ ID NO: 333611 - RNA, 64 nt, Homo Sapiens; identical to SEQ ID NO: 245418

SEQ ID NO: 333612 - RNA, 64 nt, Homo Sapiens; identical to SEQ ID NO: 245419

SEQ ID NO: 333613 - RNA, 64 nt, Homo Sapiens; identical to SEQ ID NO: 245420

SEQ ID NO: 333614 - RNA, 64 nt, Homo Sapiens; identical to SEQ ID NO: 245421

SEQ ID NO: 333615 - RNA, 64 nt, Homo Sapiens; identical to SEQ ID NO: 245422

SEQ ID NO: 333616 - RNA, 64 nt, Homo Sapiens; identical to SEQ ID NO: 245423

SEQ ID NO: 333617 - RNA, 64 nt, Homo Sapiens; identical to SEQ ID NO: 245424

SEQ ID NO: 333618 - RNA, 50 nt, Homo Sapiens; identical to SEQ ID NO: 245425

SEQ ID NO: 333619 - RNA, 64 nt, Homo Sapiens; identical to SEQ ID NO: 245426

SEQ ID NO: 333620 - RNA, 64 nt, Homo Sapiens; identical to SEQ ID NO: 245427

SEQ ID NO: 333621 - RNA, 64 nt, Homo Sapiens; identical to SEQ ID NO: 245428

SEQ ID NO: 333622 - RNA, 64 nt, Homo Sapiens; identical to SEQ ID NO: 245429

SEQ ID NO: 333623 - RNA, 64 nt, Homo Sapiens; identical to SEQ ID NO: 245430

SEQ ID NO: 333624 - RNA, 64 nt, Homo Sapiens; identical to SEQ ID NO: 245431

SEQ ID NO: 333625 - RNA, 64 nt, Homo Sapiens; identical to SEQ ID NO: 245432

SEQ ID NO: 333626 - RNA, 64 nt, Homo Sapiens; identical to SEQ ID NO: 245433

SEQ ID NO: 333627 - RNA, 64 nt, Homo Sapiens; identical to SEQ ID NO: 245434

SEQ ID NO: 333628 - RNA, 64 nt, Homo Sapiens; identical to SEQ ID NO: 245435

SEQ ID NO: 333629 - RNA, 64 nt, Homo Sapiens; identical to SEQ ID NO: 245436

SEQ ID NO: 333630 - RNA, 64 nt, Homo Sapiens; identical to SEQ ID NO: 245437

SEQ ID NO: 333631 - RNA, 64 nt, Homo Sapiens; identical to SEQ ID NO: 245438

SEQ ID NO: 333632 - RNA, 64 nt, Homo Sapiens; identical to SEQ ID NO: 245439

SEQ ID NO: 333633 - RNA, 64 nt, Homo Sapiens; identical to SEQ ID NO: 245440

SEQ ID NO: 333634 - RNA, 53 nt, Homo Sapiens; identical to SEQ ID NO: 245441

SEQ ID NO: 333635 - RNA, 64 nt, Homo Sapiens; identical to SEQ ID NO: 245442

SEQ ID NO: 333636 - RNA, 64 nt, Homo Sapiens; identical to SEQ ID NO: 245443

SEQ ID NO: 333637 - RNA, 64 nt, Homo Sapiens; identical to SEQ ID NO: 245444

SEQ ID NO: 333638 - RNA, 64 nt, Homo Sapiens; identical to SEQ ID NO: 245445

SEQ ID NO: 333639 - RNA, 64 nt, Homo Sapiens; identical to SEQ ID NO: 245446

SEQ ID NO: 333640 - RNA, 64 nt, Homo Sapiens; identical to SEQ ID NO: 245447

SEQ ID NO: 333641 - RNA, 64 nt, Homo Sapiens; identical to SEQ ID NO: 245448

SEQ ID NO: 333642 - RNA, 64 nt, Homo Sapiens; identical to SEQ ID NO: 245449

SEQ ID NO: 333643 - RNA, 64 nt, Homo Sapiens; identical to SEQ ID NO: 245450

SEQ ID NO: 333644 - RNA, 64 nt, Homo Sapiens; identical to SEQ ID NO: 245451

SEQ ID NO: 333645 - RNA, 64 nt, Homo Sapiens; identical to SEQ ID NO: 245452

SEQ ID NO: 333646 - RNA, 64 nt, Homo Sapiens; identical to SEQ ID NO: 245453

SEQ ID NO: 333647 - RNA, 64 nt, Homo Sapiens; identical to SEQ ID NO: 245454

SEQ ID NO: 333648 - RNA, 64 nt, Homo Sapiens; identical to SEQ ID NO: 245455

SEQ ID NO: 333649 - RNA, 64 nt, Homo Sapiens; identical to SEQ ID NO: 245456

SEQ ID NO: 333650 - RNA, 64 nt, Homo Sapiens; identical to SEQ ID NO: 245457

SEQ ID NO: 333651 - RNA, 64 nt, Homo Sapiens; identical to SEQ ID NO: 245458

SEQ ID NO: 333652 - RNA, 64 nt, Homo Sapiens; identical to SEQ ID NO: 245459

SEQ ID NO: 333653 - RNA, 64 nt, Homo Sapiens; identical to SEQ ID NO: 245460

SEQ ID NO: 333654 - RNA, 64 nt, Homo Sapiens; identical to SEQ ID NO: 245461

SEQ ID NO: 333655 - RNA, 64 nt, Homo Sapiens; identical to SEQ ID NO: 245462

SEQ ID NO: 333656 - RNA, 64 nt, Homo Sapiens; identical to SEQ ID NO: 245463

SEQ ID NO: 333657 - RNA, 64 nt, Homo Sapiens; identical to SEQ ID NO: 245464

SEQ ID NO: 333658 - RNA, 64 nt, Homo Sapiens; identical to SEQ ID NO: 245465

SEQ ID NO: 333659 - RNA, 64 nt, Homo Sapiens; identical to SEQ ID NO: 245466

SEQ ID NO: 333660 - RNA, 64 nt, Homo Sapiens; identical to SEQ ID NO: 245467

SEQ ID NO: 333661 - RNA, 64 nt, Homo Sapiens; identical to SEQ ID NO: 245468

SEQ ID NO: 333662 - RNA, 64 nt, Homo Sapiens; identical to SEQ ID NO: 245469

SEQ ID NO: 333663 - RNA, 64 nt, Homo Sapiens; identical to SEQ ID NO: 245470

SEQ ID NO: 333664 - RNA, 64 nt, Homo Sapiens; identical to SEQ ID NO: 245471

SEQ ID NO: 333665 - RNA, 64 nt, Homo Sapiens; identical to SEQ ID NO: 245472

SEQ ID NO: 333666 - RNA, 64 nt, Homo Sapiens; identical to SEQ ID NO: 245473

SEQ ID NO: 333667 - RNA, 64 nt, Homo Sapiens; identical to SEQ ID NO: 245474

SEQ ID NO: 333668 - RNA, 64 nt, Homo Sapiens; identical to SEQ ID NO: 245475

SEQ ID NO: 333669 - RNA, 64 nt, Homo Sapiens; identical to SEQ ID NO: 245476

SEQ ID NO: 333670 - RNA, 64 nt, Homo Sapiens; identical to SEQ ID NO: 245477

SEQ ID NO: 333671 - RNA, 64 nt, Homo Sapiens; identical to SEQ ID NO: 245478

SEQ ID NO: 333672 - RNA, 64 nt, Homo Sapiens; identical to SEQ ID NO: 245479

SEQ ID NO: 333673 - RNA, 64 nt, Homo Sapiens; identical to SEQ ID NO: 245480

SEQ ID NO: 333674 - RNA, 64 nt, Homo Sapiens; identical to SEQ ID NO: 245481

SEQ ID NO: 333675 - RNA, 64 nt, Homo Sapiens; identical to SEQ ID NO: 245482

SEQ ID NO: 333676 - RNA, 64 nt, Homo Sapiens; identical to SEQ ID NO: 245483

SEQ ID NO: 333677 - RNA, 64 nt, Homo Sapiens; identical to SEQ ID NO: 245484

SEQ ID NO: 333678 - RNA, 64 nt, Homo Sapiens; identical to SEQ ID NO: 245485

SEQ ID NO: 333679 - RNA, 64 nt, Homo Sapiens; identical to SEQ ID NO: 245486

SEQ ID NO: 333680 - RNA, 64 nt, Homo Sapiens; identical to SEQ ID NO: 245487

SEQ ID NO: 333681 - RNA, 64 nt, Homo Sapiens; identical to SEQ ID NO: 245488

SEQ ID NO: 333682 - RNA, 64 nt, Homo Sapiens; identical to SEQ ID NO: 245489

SEQ ID NO: 333683 - RNA, 64 nt, Homo Sapiens; identical to SEQ ID NO: 245490

SEQ ID NO: 333684 - RNA, 64 nt, Homo Sapiens; identical to SEQ ID NO: 245491

SEQ ID NO: 333685 - RNA, 64 nt, Homo Sapiens; identical to SEQ ID NO: 245492

SEQ ID NO: 333686 - RNA, 64 nt, Homo Sapiens; identical to SEQ ID NO: 245493

SEQ ID NO: 333687 - RNA, 64 nt, Homo Sapiens; identical to SEQ ID NO: 245494

SEQ ID NO: 333688 - RNA, 64 nt, Homo Sapiens; identical to SEQ ID NO: 245495

SEQ ID NO: 333689 - RNA, 64 nt, Homo Sapiens; identical to SEQ ID NO: 245496

SEQ ID NO: 333690 - RNA, 64 nt, Homo Sapiens; identical to SEQ ID NO: 245497

SEQ ID NO: 333691 - RNA, 64 nt, Homo Sapiens; identical to SEQ ID NO: 245498

SEQ ID NO: 333692 - RNA, 64 nt, Homo Sapiens; identical to SEQ ID NO: 245499

SEQ ID NO: 333693 - RNA, 64 nt, Homo Sapiens; identical to SEQ ID NO: 245500

SEQ ID NO: 333694 - RNA, 64 nt, Homo Sapiens; identical to SEQ ID NO: 245501

SEQ ID NO: 333695 - RNA, 64 nt, Homo Sapiens; identical to SEQ ID NO: 245502

SEQ ID NO: 333696 - RNA, 64 nt, Homo Sapiens; identical to SEQ ID NO: 245503

SEQ ID NO: 333697 - RNA, 64 nt, Homo Sapiens; identical to SEQ ID NO: 245504

SEQ ID NO: 333698 - RNA, 64 nt, Homo Sapiens; identical to SEQ ID NO: 245505

SEQ ID NO: 333699 - RNA, 64 nt, Homo Sapiens; identical to SEQ ID NO: 245506

SEQ ID NO: 333700 - RNA, 64 nt, Homo Sapiens; identical to SEQ ID NO: 245507

SEQ ID NO: 333701 - RNA, 64 nt, Homo Sapiens; identical to SEQ ID NO: 245508

SEQ ID NO: 333702 - RNA, 64 nt, Homo Sapiens; identical to SEQ ID NO: 245509

SEQ ID NO: 333703 - RNA, 64 nt, Homo Sapiens; identical to SEQ ID NO: 245510

SEQ ID NO: 333704 - RNA, 64 nt, Homo Sapiens; identical to SEQ ID NO: 245511

SEQ ID NO: 333705 - RNA, 64 nt, Homo Sapiens; identical to SEQ ID NO: 245512

SEQ ID NO: 333706 - RNA, 64 nt, Homo Sapiens; identical to SEQ ID NO: 245513

SEQ ID NO: 333707 - RNA, 64 nt, Homo Sapiens; identical to SEQ ID NO: 245514

SEQ ID NO: 333708 - RNA, 64 nt, Homo Sapiens; identical to SEQ ID NO: 245515

SEQ ID NO: 333709 - RNA, 64 nt, Homo Sapiens; identical to SEQ ID NO: 245516

SEQ ID NO: 333710 - RNA, 64 nt, Homo Sapiens; identical to SEQ ID NO: 245517

SEQ ID NO: 333711 - RNA, 64 nt, Homo Sapiens; identical to SEQ ID NO: 245518

SEQ ID NO: 333712 - RNA, 64 nt, Homo Sapiens; identical to SEQ ID NO: 245519

SEQ ID NO: 333713 - RNA, 64 nt, Homo Sapiens; identical to SEQ ID NO: 245520

SEQ ID NO: 333714 - RNA, 64 nt, Homo Sapiens; identical to SEQ ID NO: 245521

SEQ ID NO: 333715 - RNA, 64 nt, Homo Sapiens; identical to SEQ ID NO: 245522

SEQ ID NO: 333716 - RNA, 64 nt, Homo Sapiens; identical to SEQ ID NO: 245523

SEQ ID NO: 333717 - RNA, 64 nt, Homo Sapiens; identical to SEQ ID NO: 245524

SEQ ID NO: 333718 - RNA, 64 nt, Homo Sapiens; identical to SEQ ID NO: 245525

SEQ ID NO: 333719 - RNA, 64 nt, Homo Sapiens; identical to SEQ ID NO: 245526

SEQ ID NO: 333720 - RNA, 64 nt, Homo Sapiens; identical to SEQ ID NO: 245527

SEQ ID NO: 333721 - RNA, 64 nt, Homo Sapiens; identical to SEQ ID NO: 245528

SEQ ID NO: 333722 - RNA, 64 nt, Homo Sapiens; identical to SEQ ID NO: 245529

SEQ ID NO: 333723 - RNA, 64 nt, Homo Sapiens; identical to SEQ ID NO: 245530

SEQ ID NO: 333724 - RNA, 64 nt, Homo Sapiens; identical to SEQ ID NO: 245531

SEQ ID NO: 333725 - RNA, 64 nt, Homo Sapiens; identical to SEQ ID NO: 245532

SEQ ID NO: 333726 - RNA, 64 nt, Homo Sapiens; identical to SEQ ID NO: 245533

SEQ ID NO: 333727 - RNA, 64 nt, Homo Sapiens; identical to SEQ ID NO: 245534

SEQ ID NO: 333728 - RNA, 64 nt, Homo Sapiens; identical to SEQ ID NO: 245535

SEQ ID NO: 333729 - RNA, 64 nt, Homo Sapiens; identical to SEQ ID NO: 245536

SEQ ID NO: 333730 - RNA, 64 nt, Homo Sapiens; identical to SEQ ID NO: 245537

SEQ ID NO: 333731 - RNA, 64 nt, Homo Sapiens; identical to SEQ ID NO: 245538

SEQ ID NO: 333732 - RNA, 64 nt, Homo Sapiens; identical to SEQ ID NO: 245539

SEQ ID NO: 333733 - RNA, 64 nt, Homo Sapiens; identical to SEQ ID NO: 245540

SEQ ID NO: 333734 - RNA, 64 nt, Homo Sapiens; identical to SEQ ID NO: 245541

SEQ ID NO: 333735 - RNA, 64 nt, Homo Sapiens; identical to SEQ ID NO: 245542

SEQ ID NO: 333736 - RNA, 64 nt, Homo Sapiens; identical to SEQ ID NO: 245543

SEQ ID NO: 333737 - RNA, 64 nt, Homo Sapiens; identical to SEQ ID NO: 245544

SEQ ID NO: 333738 - RNA, 64 nt, Homo Sapiens; identical to SEQ ID NO: 245545

SEQ ID NO: 333739 - RNA, 64 nt, Homo Sapiens; identical to SEQ ID NO: 245546

SEQ ID NO: 333740 - RNA, 64 nt, Homo Sapiens; identical to SEQ ID NO: 245547

SEQ ID NO: 333741 - RNA, 64 nt, Homo Sapiens; identical to SEQ ID NO: 245548

SEQ ID NO: 333742 - RNA, 64 nt, Homo Sapiens; identical to SEQ ID NO: 245549

SEQ ID NO: 333743 - RNA, 64 nt, Homo Sapiens; identical to SEQ ID NO: 245550

SEQ ID NO: 333744 - RNA, 64 nt, Homo Sapiens; identical to SEQ ID NO: 245551

SEQ ID NO: 333745 - RNA, 64 nt, Homo Sapiens; identical to SEQ ID NO: 245552

SEQ ID NO: 333746 - RNA, 64 nt, Homo Sapiens; identical to SEQ ID NO: 245553

SEQ ID NO: 333747 - RNA, 64 nt, Homo Sapiens; identical to SEQ ID NO: 245554

SEQ ID NO: 333748 - RNA, 64 nt, Homo Sapiens; identical to SEQ ID NO: 245555

SEQ ID NO: 333749 - RNA, 64 nt, Homo Sapiens; identical to SEQ ID NO: 245556

SEQ ID NO: 333750 - RNA, 64 nt, Homo Sapiens; identical to SEQ ID NO: 245557

SEQ ID NO: 333751 - RNA, 64 nt, Homo Sapiens; identical to SEQ ID NO: 245558

SEQ ID NO: 333752 - RNA, 64 nt, Homo Sapiens; identical to SEQ ID NO: 245559

SEQ ID NO: 333753 - RNA, 64 nt, Homo Sapiens; identical to SEQ ID NO: 245560

SEQ ID NO: 333754 - RNA, 64 nt, Homo Sapiens; identical to SEQ ID NO: 245561

SEQ ID NO: 333755 - RNA, 64 nt, Homo Sapiens; identical to SEQ ID NO: 245562

SEQ ID NO: 333756 - RNA, 64 nt, Homo Sapiens; identical to SEQ ID NO: 245563

SEQ ID NO: 333757 - RNA, 64 nt, Homo Sapiens; identical to SEQ ID NO: 245564

SEQ ID NO: 333758 - RNA, 64 nt, Homo Sapiens; identical to SEQ ID NO: 245565

SEQ ID NO: 333759 - RNA, 64 nt, Homo Sapiens; identical to SEQ ID NO: 245566

SEQ ID NO: 333760 - RNA, 64 nt, Homo Sapiens; identical to SEQ ID NO: 245567

SEQ ID NO: 333761 - RNA, 64 nt, Homo Sapiens; identical to SEQ ID NO: 245568

SEQ ID NO: 333762 - RNA, 64 nt, Homo Sapiens; identical to SEQ ID NO: 245569

SEQ ID NO: 333763 - RNA, 64 nt, Homo Sapiens; identical to SEQ ID NO: 245570

SEQ ID NO: 333764 - RNA, 64 nt, Homo Sapiens; identical to SEQ ID NO: 245571

SEQ ID NO: 333765 - RNA, 64 nt, Homo Sapiens; identical to SEQ ID NO: 245572

SEQ ID NO: 333766 - RNA, 64 nt, Homo Sapiens; identical to SEQ ID NO: 245573

SEQ ID NO: 333767 - RNA, 64 nt, Homo Sapiens; identical to SEQ ID NO: 245574

SEQ ID NO: 333768 - RNA, 64 nt, Homo Sapiens; identical to SEQ ID NO: 245575

SEQ ID NO: 333769 - RNA, 64 nt, Homo Sapiens; identical to SEQ ID NO: 245576

SEQ ID NO: 333770 - RNA, 64 nt, Homo Sapiens; identical to SEQ ID NO: 245577

SEQ ID NO: 333771 - RNA, 64 nt, Homo Sapiens; identical to SEQ ID NO: 245578

SEQ ID NO: 333772 - RNA, 50 nt, Homo Sapiens; identical to SEQ ID NO: 245579

SEQ ID NO: 333773 - RNA, 64 nt, Homo Sapiens; identical to SEQ ID NO: 245580

SEQ ID NO: 333774 - RNA, 64 nt, Homo Sapiens; identical to SEQ ID NO: 245581

SEQ ID NO: 333775 - RNA, 64 nt, Homo Sapiens; identical to SEQ ID NO: 245582

SEQ ID NO: 333776 - RNA, 64 nt, Homo Sapiens; identical to SEQ ID NO: 245583

SEQ ID NO: 333777 - RNA, 64 nt, Homo Sapiens; identical to SEQ ID NO: 245584

SEQ ID NO: 333778 - RNA, 64 nt, Homo Sapiens; identical to SEQ ID NO: 245585

SEQ ID NO: 333779 - RNA, 64 nt, Homo Sapiens; identical to SEQ ID NO: 245586

SEQ ID NO: 333780 - RNA, 64 nt, Homo Sapiens; identical to SEQ ID NO: 245587

SEQ ID NO: 333781 - RNA, 64 nt, Homo Sapiens; identical to SEQ ID NO: 245588

SEQ ID NO: 333782 - RNA, 64 nt, Homo Sapiens; identical to SEQ ID NO: 245589

SEQ ID NO: 333783 - RNA, 64 nt, Homo Sapiens; identical to SEQ ID NO: 245590

SEQ ID NO: 333784 - RNA, 64 nt, Homo Sapiens; identical to SEQ ID NO: 245591

SEQ ID NO: 333785 - RNA, 64 nt, Homo Sapiens; identical to SEQ ID NO: 245592

SEQ ID NO: 333786 - RNA, 64 nt, Homo Sapiens; identical to SEQ ID NO: 245593

SEQ ID NO: 333787 - RNA, 64 nt, Homo Sapiens; identical to SEQ ID NO: 245594

SEQ ID NO: 333788 - RNA, 64 nt, Homo Sapiens; identical to SEQ ID NO: 245595

SEQ ID NO: 333789 - RNA, 64 nt, Homo Sapiens; identical to SEQ ID NO: 245596

SEQ ID NO: 333790 - RNA, 64 nt, Homo Sapiens; identical to SEQ ID NO: 245597

SEQ ID NO: 333791 - RNA, 64 nt, Homo Sapiens; identical to SEQ ID NO: 245598

SEQ ID NO: 333792 - RNA, 64 nt, Homo Sapiens; identical to SEQ ID NO: 245599

SEQ ID NO: 333793 - RNA, 64 nt, Homo Sapiens; identical to SEQ ID NO: 245600

SEQ ID NO: 333794 - RNA, 64 nt, Homo Sapiens; identical to SEQ ID NO: 245601

SEQ ID NO: 333795 - RNA, 64 nt, Homo Sapiens; identical to SEQ ID NO: 245602

SEQ ID NO: 333796 - RNA, 64 nt, Homo Sapiens; identical to SEQ ID NO: 245603

SEQ ID NO: 333797 - RNA, 64 nt, Homo Sapiens; identical to SEQ ID NO: 245604

SEQ ID NO: 333798 - RNA, 64 nt, Homo Sapiens; identical to SEQ ID NO: 245605

SEQ ID NO: 333799 - RNA, 64 nt, Homo Sapiens; identical to SEQ ID NO: 245606

SEQ ID NO: 333800 - RNA, 64 nt, Homo Sapiens; identical to SEQ ID NO: 245607

SEQ ID NO: 333801 - RNA, 64 nt, Homo Sapiens; identical to SEQ ID NO: 245608

SEQ ID NO: 333802 - RNA, 64 nt, Homo Sapiens; identical to SEQ ID NO: 245609

SEQ ID NO: 333803 - RNA, 64 nt, Homo Sapiens; identical to SEQ ID NO: 245610

SEQ ID NO: 333804 - RNA, 64 nt, Homo Sapiens; identical to SEQ ID NO: 245611

SEQ ID NO: 333805 - RNA, 64 nt, Homo Sapiens; identical to SEQ ID NO: 245612

SEQ ID NO: 333806 - RNA, 64 nt, Homo Sapiens; identical to SEQ ID NO: 245613

SEQ ID NO: 333807 - RNA, 64 nt, Homo Sapiens; identical to SEQ ID NO: 245614

SEQ ID NO: 333808 - RNA, 64 nt, Homo Sapiens; identical to SEQ ID NO: 245615

SEQ ID NO: 333809 - RNA, 64 nt, Homo Sapiens; identical to SEQ ID NO: 245616

SEQ ID NO: 333810 - RNA, 64 nt, Homo Sapiens; identical to SEQ ID NO: 245617

SEQ ID NO: 333811 - RNA, 64 nt, Homo Sapiens; identical to SEQ ID NO: 245618

SEQ ID NO: 333812 - RNA, 64 nt, Homo Sapiens; identical to SEQ ID NO: 245619

SEQ ID NO: 333813 - RNA, 64 nt, Homo Sapiens; identical to SEQ ID NO: 245620

SEQ ID NO: 333814 - RNA, 64 nt, Homo Sapiens; identical to SEQ ID NO: 245621

SEQ ID NO: 333815 - RNA, 64 nt, Homo Sapiens; identical to SEQ ID NO: 245622

SEQ ID NO: 333816 - RNA, 64 nt, Homo Sapiens; identical to SEQ ID NO: 245623

SEQ ID NO: 333817 - RNA, 64 nt, Homo Sapiens; identical to SEQ ID NO: 245624

SEQ ID NO: 333818 - RNA, 64 nt, Homo Sapiens; identical to SEQ ID NO: 245625

SEQ ID NO: 333819 - RNA, 64 nt, Homo Sapiens; identical to SEQ ID NO: 245626

SEQ ID NO: 333820 - RNA, 64 nt, Homo Sapiens; identical to SEQ ID NO: 245627

SEQ ID NO: 333821 - RNA, 64 nt, Homo Sapiens; identical to SEQ ID NO: 245628

SEQ ID NO: 333822 - RNA, 64 nt, Homo Sapiens; identical to SEQ ID NO: 245629

SEQ ID NO: 333823 - RNA, 64 nt, Homo Sapiens; identical to SEQ ID NO: 245630

SEQ ID NO: 333824 - RNA, 64 nt, Homo Sapiens; identical to SEQ ID NO: 245631

SEQ ID NO: 333825 - RNA, 64 nt, Homo Sapiens; identical to SEQ ID NO: 245632

SEQ ID NO: 333826 - RNA, 64 nt, Homo Sapiens; identical to SEQ ID NO: 245633

SEQ ID NO: 333827 - RNA, 64 nt, Homo Sapiens; identical to SEQ ID NO: 245634

SEQ ID NO: 333828 - RNA, 64 nt, Homo Sapiens; identical to SEQ ID NO: 245635

SEQ ID NO: 333829 - RNA, 64 nt, Homo Sapiens; identical to SEQ ID NO: 245636

SEQ ID NO: 333830 - RNA, 64 nt, Homo Sapiens; identical to SEQ ID NO: 245637

SEQ ID NO: 333831 - RNA, 64 nt, Homo Sapiens; identical to SEQ ID NO: 134190

SEQ ID NO: 333832 - RNA, 64 nt, Homo Sapiens; identical to SEQ ID NO: 134191

SEQ ID NO: 333833 - RNA, 64 nt, Homo Sapiens; identical to SEQ ID NO: 134192

SEQ ID NO: 333834 - RNA, 64 nt, Homo Sapiens; identical to SEQ ID NO: 134193

SEQ ID NO: 333835 - RNA, 64 nt, Homo Sapiens; identical to SEQ ID NO: 134194

SEQ ID NO: 333836 - RNA, 64 nt, Homo Sapiens; identical to SEQ ID NO: 134195

SEQ ID NO: 333837 - RNA, 64 nt, Homo Sapiens; identical to SEQ ID NO: 134196

SEQ ID NO: 333838 - RNA, 64 nt, Homo Sapiens; identical to SEQ ID NO: 134197

SEQ ID NO: 333839 - RNA, 64 nt, Homo Sapiens; identical to SEQ ID NO: 134198

SEQ ID NO: 333840 - RNA, 64 nt, Homo Sapiens; identical to SEQ ID NO: 134199

SEQ ID NO: 333841 - RNA, 64 nt, Homo Sapiens; identical to SEQ ID NO: 134200

SEQ ID NO: 333842 - RNA, 64 nt, Homo Sapiens; identical to SEQ ID NO: 134201

SEQ ID NO: 333843 - RNA, 64 nt, Homo Sapiens; identical to SEQ ID NO: 134202

SEQ ID NO: 333844 - RNA, 64 nt, Homo Sapiens; identical to SEQ ID NO: 134203

SEQ ID NO: 333845 - RNA, 64 nt, Homo Sapiens; identical to SEQ ID NO: 134204

SEQ ID NO: 333846 - RNA, 64 nt, Homo Sapiens; identical to SEQ ID NO: 134205

SEQ ID NO: 333847 - RNA, 64 nt, Homo Sapiens; identical to SEQ ID NO: 134206

SEQ ID NO: 333848 - RNA, 64 nt, Homo Sapiens; identical to SEQ ID NO: 134207

SEQ ID NO: 333849 - RNA, 64 nt, Homo Sapiens; identical to SEQ ID NO: 134208

SEQ ID NO: 333850 - RNA, 64 nt, Homo Sapiens; identical to SEQ ID NO: 134209

SEQ ID NO: 333851 - RNA, 64 nt, Homo Sapiens; identical to SEQ ID NO: 134210

SEQ ID NO: 333852 - RNA, 64 nt, Homo Sapiens; identical to SEQ ID NO: 134211

SEQ ID NO: 333853 - RNA, 64 nt, Homo Sapiens; identical to SEQ ID NO: 134212

SEQ ID NO: 333854 - RNA, 64 nt, Homo Sapiens; identical to SEQ ID NO: 134213

SEQ ID NO: 333855 - RNA, 64 nt, Homo Sapiens; identical to SEQ ID NO: 134214

SEQ ID NO: 333856 - RNA, 64 nt, Homo Sapiens; identical to SEQ ID NO: 134215

SEQ ID NO: 333857 - RNA, 64 nt, Homo Sapiens; identical to SEQ ID NO: 134216

SEQ ID NO: 333858 - RNA, 64 nt, Homo Sapiens; identical to SEQ ID NO: 134217

SEQ ID NO: 333859 - RNA, 64 nt, Homo Sapiens; identical to SEQ ID NO: 134218

SEQ ID NO: 333860 - RNA, 64 nt, Homo Sapiens; identical to SEQ ID NO: 134219

SEQ ID NO: 333861 - RNA, 64 nt, Homo Sapiens; identical to SEQ ID NO: 134220

SEQ ID NO: 333862 - RNA, 64 nt, Homo Sapiens; identical to SEQ ID NO: 134221

SEQ ID NO: 333863 - RNA, 64 nt, Homo Sapiens; identical to SEQ ID NO: 134222

SEQ ID NO: 333864 - RNA, 64 nt, Homo Sapiens; identical to SEQ ID NO: 134223

SEQ ID NO: 333865 - RNA, 64 nt, Homo Sapiens; identical to SEQ ID NO: 134224

SEQ ID NO: 333866 - RNA, 64 nt, Homo Sapiens; identical to SEQ ID NO: 134225

SEQ ID NO: 333867 - RNA, 64 nt, Homo Sapiens; identical to SEQ ID NO: 134226

SEQ ID NO: 333868 - RNA, 64 nt, Homo Sapiens; identical to SEQ ID NO: 134227

SEQ ID NO: 333869 - RNA, 64 nt, Homo Sapiens; identical to SEQ ID NO: 134228

SEQ ID NO: 333870 - RNA, 64 nt, Homo Sapiens; identical to SEQ ID NO: 195094

SEQ ID NO: 333871 - RNA, 64 nt, Homo Sapiens; identical to SEQ ID NO: 195095

SEQ ID NO: 333872 - RNA, 64 nt, Homo Sapiens; identical to SEQ ID NO: 195096

SEQ ID NO: 333873 - RNA, 64 nt, Homo Sapiens; identical to SEQ ID NO: 195097

SEQ ID NO: 333874 - RNA, 64 nt, Homo Sapiens; identical to SEQ ID NO: 195098

SEQ ID NO: 333875 - RNA, 64 nt, Homo Sapiens; identical to SEQ ID NO: 195099

SEQ ID NO: 333876 - RNA, 64 nt, Homo Sapiens
uuucaccauguuggucaggcuggucucaaacuccugaccucaggugauccgcccaccucagccu

SEQ ID NO: 333877 - RNA, 64 nt, Homo Sapiens
uuucaccauguuggccaggcuguucucgaacuccugaccucaggugaucugcccgccucggucu

SEQ ID NO: 333878 - RNA, 64 nt, Homo Sapiens
uuuccccauguuggccgggcuagucucgaacuccugaccucaggugauccaccagccucggccu

SEQ ID NO: 333879 - RNA, 64 nt, Homo Sapiens
ucuguguagggaggggaggcuuauucaauucuucugaccucagaacuggcagaaggucagaugu

SEQ ID NO: 333880 - RNA, 64 nt, Homo Sapiens
aaccccuccuuuuuauuuuucugcaguuuagcagugaccucagcuaaacccccaguugugaaaa

SEQ ID NO: 333881 - RNA, 64 nt, Homo Sapiens
uugacguugaaaaaaugauuggugccuuugcggaugaccucauuguuauuuuuuuaaaaguuua

SEQ ID NO: 333882 - RNA, 64 nt, Homo Sapiens
uuuuaucauguuggccaggcuggucucgaacuccugaccucaggugaucugcccaccuuggccu

SEQ ID NO: 333883 - RNA, 64 nt, Homo Sapiens
uuucaccauguuggccaggcuggucuugaacuccugaccucaacugauccgcccaccuuggccu

SEQ ID NO: 333884 - RNA, 64 nt, Homo Sapiens
cacaucugaaauauaugccgaaaauugacgucuuugaccucagggagagcaccuguccaggucu

SEQ ID NO: 333885 - RNA, 64 nt, Homo Sapiens
cuucauuucuaaaaugggggugaugcuuucauauugaccucaccccauacuaccucacagaugu

SEQ ID NO: 333886 - RNA, 64 nt, Homo Sapiens
ugauccacccacuucagcuuuggucucaaacuccugaccucaaguuucaccauguuggccaggc

SEQ ID NO: 333887 - RNA, 64 nt, Homo Sapiens
aguccuaucccugggaaggcccugccuuuccuuuugaccucaguccaauucuucuguggcuuuu

SEQ ID NO: 333888 - RNA, 64 nt, Homo Sapiens
ugauccgccugccucggccuuagucucgaacuccugaccucagguuucacuauguuggucaggc

SEQ ID NO: 333889 - RNA, 64 nt, Homo Sapiens
aaauggacaggaaauaagucgagauucgcuccugugaccucagccagucgcagaaauaauuaau

SEQ ID NO: 333890 - RNA, 64 nt, Homo Sapiens
ugauguuagagauuugagaauauccggauuacagugaccucaucaugauuacaguaucucauuu

SEQ ID NO: 333891 - RNA, 64 nt, Homo Sapiens
ugaaccuggaacucugaucuuuuagaguagauuuugaccucagcgccuucugggugcaaggagc

SEQ ID NO: 333892 - RNA, 64 nt, Homo Sapiens
auccaccugccucagccuccggcuggucuugaacugaccucaugggguuucacuguguuggcca

SEQ ID NO: 333893 - RNA, 64 nt, Homo Sapiens
auccacccgccucgaccuccuggucucgaucucuugaccucauguuucaccauguuggccagga

SEQ ID NO: 333894 - RNA, 64 nt, Homo Sapiens
accaucacaaguuuuuacccucuuccuucaugccugaccucaaccccgcucuccucauccuauu

SEQ ID NO: 333895 - RNA, 64 nt, Homo Sapiens
uuccuuaaauguuauuuggaggaaacuaaguucuugaccucaguaauuuuauuuuuguuuuucc

SEQ ID NO: 333896 - RNA, 64 nt, Homo Sapiens
gacaauuugggcuagaggcaggaaggaagugggaugaccucaggaggucaccuuuucuugauuc

SEQ ID NO: 333897 - RNA, 64 nt, Homo Sapiens
gauuccagaaacauaugggcugauaaacccggggugaccucaugaaaugaguugcagcagaagu

SEQ ID NO: 333898 - RNA, 64 nt, Homo Sapiens
cagccuaggagggaggugcacuucugugucugcgugaccucaccauggggaguucuguccugcc

SEQ ID NO: 333899 - RNA, 64 nt, Homo Sapiens
ccccacccacacuccagauccuuccugggagccaugaccucagagggggaccugcuggcggccu

SEQ ID NO: 333900 - RNA, 64 nt, Homo Sapiens
aagucaaguggaccacucucucuucaggaacuucugaccucaccgccaacggggacgacaggga

SEQ ID NO: 333901 - RNA, 64 nt, Homo Sapiens
ugauccgcccgccucagccuuggucucaaacuccugaccucagguuucaccguguuggucaggc

SEQ ID NO: 333902 - RNA, 64 nt, Homo Sapiens
uuucaucgucccgucauuguuucugaugucuuucugaccucacaucauauuugguucuccuacu

SEQ ID NO: 333903 - RNA, 64 nt, Homo Sapiens
ccuuugaucuaguuugaccuuugaaauuugcaugugaccucaucuagcuaugaauucugggaag

SEQ ID NO: 333904 - RNA, 64 nt, Homo Sapiens
uuucaccauguugaccaggcuagucucgaacuucugaccucaggugauccaccugccucagccu

SEQ ID NO: 333905 - RNA, 64 nt, Homo Sapiens
aaauguuuaacacauucuaccugacgggagguggugaccucauucagucgguuaagagccugag

SEQ ID NO: 333906 - RNA, 64 nt, Homo Sapiens
cagccuugggaguuccuggugugcucugacaucaugaccucaaaucuaaauccuccaaucccaa

SEQ ID NO: 333907 - RNA, 64 nt, Homo Sapiens
uuucaccauguuggccaggcuagucucgaacuccugaccucaggugauccaccugccuuggccu

SEQ ID NO: 333908 - RNA, 64 nt, Homo Sapiens
uacaaagcaaaaagagaugccuggauuucauccuugaccucauucaaauacaaaggaagaacau

SEQ ID NO: 333909 - RNA, 64 nt, Homo Sapiens
uaauccgcccaucucggcuuuggucuugaacuccugaccucagguuucaccacauuggccgggc

SEQ ID NO: 333910 - RNA, 64 nt, Homo Sapiens
uugcaccauauuggucagccuggucucaaacuccugaccucaggugauccaccugccucagccu

SEQ ID NO: 333911 - RNA, 64 nt, Homo Sapiens
uuucaccacguuagccaugauggucucaaacuucugaccucauaauccacccaccuuggccucc

SEQ ID NO: 333912 - RNA, 64 nt, Homo Sapiens
agaggaggauagcucuuuccagaauccacacuucugaccucagccucggucucaugaacacccg

SEQ ID NO: 333913 - RNA, 64 nt, Homo Sapiens
uguuuacuagcuugccugugucugguacaucucaugaccucaauucccucaccugaaauaggaa

SEQ ID NO: 333914 - RNA, 64 nt, Homo Sapiens
caauggcuaugaaaaugcaaguaguuuccucgcgugaccucaccaugauucacauacgugccac

SEQ ID NO: 333915 - RNA, 64 nt, Homo Sapiens
ugguccacccgccucggccuuggucuugaacuccugaccucagguuucgccaugucggccaggc

SEQ ID NO: 333916 - RNA, 64 nt, Homo Sapiens
agcuacaccuaaccccaccgccuugccucugcucugaccucagcgccccuccuggggccagccu

SEQ ID NO: 333917 - RNA, 64 nt, Homo Sapiens
ugucugcaugagaaaggauggcaagucucugaggugaccucaggguggaauucucuguuaaguc

SEQ ID NO: 333918 - RNA, 64 nt, Homo Sapiens
aggagugcccauuggcagauuacacauguaaauaugaccucagacaaaaaggaaccagaggccc

SEQ ID NO: 333919 - RNA, 64 nt, Homo Sapiens
ugaugcacccaccucagccucggucucaaacuccugaccucagguuucaucauguuggccaggc

SEQ ID NO: 333920 - RNA, 64 nt, Homo Sapiens
ugauccacccgccucagccuuggucucgaacuccugaccucagguuucaccauguuagccaggc

SEQ ID NO: 333921 - RNA, 64 nt, Homo Sapiens
gcuggacugugcuucgggcuccucuguggggcucugaccucagggcucccagcucggggccugu

SEQ ID NO: 333922 - RNA, 64 nt, Homo Sapiens
uggacauagacacguggucccaggccguucagccugaccucaggcagcaggcaccaagcugcca

SEQ ID NO: 333923 - RNA, 64 nt, Homo Sapiens
ugaucugcccgccuuggccuuggucucgaacucuugaccucagguuucaccauguuggccaggc

SEQ ID NO: 333924 - RNA, 64 nt, Homo Sapiens
ugauccgcccaccucggccuuggucucgaacuccugaccucagguuucgccauguuggccaggc

SEQ ID NO: 333925 - RNA, 64 nt, Homo Sapiens
ugauccaccugccucggccuuggucucgaacuccugaccucagguuucaccauguuggccaggc

SEQ ID NO: 333926 - RNA, 64 nt, Homo Sapiens
ugauccgcccaccuuggccuucgucucgaacuccugaccucagguuuugccaugcuggccaggc

SEQ ID NO: 333927 - RNA, 64 nt, Homo Sapiens
guuuaccauguuggccaggcaggucuccaacuccugaccucaagugauauguucaccucagccu

SEQ ID NO: 333928 - RNA, 64 nt, Homo Sapiens
uuucaccacguuggccacacuggucucaaacuccugaccucaggcgauccaucugccucagccu

SEQ ID NO: 333929 - RNA, 64 nt, Homo Sapiens
uuuuaccauguuggccaggcuggucucaaacuccugaccucaagugauccacccaccuugacuc

SEQ ID NO: 333930 - RNA, 64 nt, Homo Sapiens
ggguuucaccaugcuggccaggcuuguuaugaacugaccucaagugaucugccugccucagcuu

SEQ ID NO: 333931 - RNA, 64 nt, Homo Sapiens
uaauccaccugccuuggccuuggucuugaacuccugaccucagguuucaccauguuggccaggc

SEQ ID NO: 333932 - RNA, 64 nt, Homo Sapiens
ugauccacccaccuuggccuugaucuuaaacucuugaccucaaauuucaccauguugaccaggc

SEQ ID NO: 333933 - RNA, 64 nt, Homo Sapiens
ugaucugccugccucggccuuggucucaaacuccugaccucagguuucuccauguuggucaggc

SEQ ID NO: 333934 - RNA, 64 nt, Homo Sapiens
ccagcccuugaucgccaucacaacuuugaccugaugaccucaucugacaacucuuaugccagca

SEQ ID NO: 333935 - RNA, 64 nt, Homo Sapiens
ccugccccuacccgaaggccggcccgccgaaccuugaccucaccaggcugcaccaccucauccu

SEQ ID NO: 333936 - RNA, 64 nt, Homo Sapiens
ugcaaagccaccaacagccagauaagcaguuaugugaccucacgucuugcaaaauuccugacga

SEQ ID NO: 333937 - RNA, 64 nt, Homo Sapiens
ugaugugccugcuucagccuugcucucaaaccccugaccucaaauuucaccauguuggccaggc

SEQ ID NO: 333938 - RNA, 64 nt, Homo Sapiens
uucaauuuugucuguacuugccaguuuuggggugugaccucaauucucaccagcuguguccggc

SEQ ID NO: 333939 - RNA, 64 nt, Homo Sapiens
cagaaguccagagucuagcgaugccagccgaccuugaccucacuaguggcccaacaggggcucc

SEQ ID NO: 333940 - RNA, 64 nt, Homo Sapiens; identical to SEQ ID NO: 275363

SEQ ID NO: 333941 - RNA, 64 nt, Homo Sapiens; identical to SEQ ID NO: 275364

SEQ ID NO: 333942 - RNA, 64 nt, Homo Sapiens; identical to SEQ ID NO: 275365

SEQ ID NO: 333943 - RNA, 64 nt, Homo Sapiens; identical to SEQ ID NO: 275366

SEQ ID NO: 333944 - RNA, 64 nt, Homo Sapiens; identical to SEQ ID NO: 275367

SEQ ID NO: 333945 - RNA, 64 nt, Homo Sapiens; identical to SEQ ID NO: 275368

SEQ ID NO: 333946 - RNA, 64 nt, Homo Sapiens
aacgaaauaccacccuuuccauuuuauagaccucauccccuauuucugucagacaguuauauga

SEQ ID NO: 333947 - RNA, 64 nt, Homo Sapiens
cagggaugugccugaaagagucaacaguccccugauccccuaccucugccugcccuccagcccc

SEQ ID NO: 333948 - RNA, 64 nt, Homo Sapiens
ccaugcccuugaggagccggccaccagaugcugaauccccuaucccauucugcguaugaguccc

SEQ ID NO: 333949 - RNA, 64 nt, Homo Sapiens
gaagagaggggauuucuuggaaaaggagagaggaauccccuagagcagggaaagcagugccugc

SEQ ID NO: 333950 - RNA, 64 nt, Homo Sapiens
auuggucauugguguuugcucuugccucuccuccauccccuagaaguacacccccgucuuauua

SEQ ID NO: 333951 - RNA, 64 nt, Homo Sapiens
gaccagaagccaaggaucucugggccagauugccauccccuaugagucuucagagauaggccug

SEQ ID NO: 333952 - RNA, 64 nt, Homo Sapiens
acaaguuuacuugucuuugagucuagggugaacaauccccuaacggcagugccugaacauggca

SEQ ID NO: 333953 - RNA, 64 nt, Homo Sapiens
aguccuuucugcuuucuucacuuucucaaaagauauccccuaaguagaaucccaggcggacacc

SEQ ID NO: 333954 - RNA, 64 nt, Homo Sapiens
ugcaugcagauguggaaaggcagggauccgcuacauccccuaacaggcaaagguggaaguccuc

SEQ ID NO: 333955 - RNA, 64 nt, Homo Sapiens
aacacucccagcccuugcugguggaaagugacaaauccccuaucagaagaggcuuccaaucagu

SEQ ID NO: 333956 - RNA, 64 nt, Homo Sapiens
uacuuaauccagauagccugaacuauaaaaacccauccccuaucccuauaguuacaaaaauaaa

SEQ ID NO: 333957 - RNA, 64 nt, Homo Sapiens
ggcacauuccuacgauugaagaaggggucuugagauccccuaaacuugcauacccaguuuuuug

SEQ ID NO: 333958 - RNA, 64 nt, Homo Sapiens
uguuuuaaguauuuaauguccucauaguguggaaauccccuaaauugauuagaaauuguauuuu

SEQ ID NO: 333959 - RNA, 64 nt, Homo Sapiens
aaaccacacgauuguuccacugucuggaagcaccauccccuaucgcaggacuccugggccacaa

SEQ ID NO: 333960 - RNA, 64 nt, Homo Sapiens
aaauuauacuauugagaaauaaaaugaaccagauauccccuagacaaaauuuuccagaauuccc

SEQ ID NO: 333961 - RNA, 64 nt, Homo Sapiens
acuguggcuauuucacgucuuaggcuucucuagcauccccuaagcaccaaccugaggaaucuuc

SEQ ID NO: 333962 - RNA, 64 nt, Homo Sapiens
aacaugguaguaacuaaagaacaacgcugagacaauccccuaacuuuaaauucaggcaaagccu

SEQ ID NO: 333963 - RNA, 64 nt, Homo Sapiens
uguaagcaauucuaagugagauguuuggcaagaaauccccuaacugauuuccauccaaaccuac

SEQ ID NO: 333964 - RNA, 64 nt, Homo Sapiens
caaaaaacauuaccauccccacccauaccacagcauccccuagagagagugaggugcagggacc

SEQ ID NO: 333965 - RNA, 64 nt, Homo Sapiens
aaaguagaugacaucauguguuagccuguuccuaauccccuagaauuguaaugugugggauaua

SEQ ID NO: 333966 - RNA, 64 nt, Homo Sapiens
ccuaggacucuguggccgacuauaggcgucucccauccccuacaccuucccccagccacagcca

SEQ ID NO: 333967 - RNA, 64 nt, Homo Sapiens
agucauucccagauaauagaacuggaaaugauaaauccccuaaugccaagggucuaguguguuc

SEQ ID NO: 333968 - RNA, 64 nt, Homo Sapiens
cauuaaauccuuuuaccuuuuuuuuuucuugguaauccccuaaaauaacaguaugugggauauu

SEQ ID NO: 333969 - RNA, 64 nt, Homo Sapiens
uuugcacaggggcagcagauaaaguuaaguuugaauccccuauuuuuauccaguucuugcuccu

SEQ ID NO: 333970 - RNA, 64 nt, Homo Sapiens
uucccccaacccucaaauuacuuucuacuguuucauccccuaacccucugccgauacuguuugu

SEQ ID NO: 333971 - RNA, 64 nt, Homo Sapiens
acccagauuucuuucuuuauguacaagauggaaaauccccuaccccucaaaaacagguugaguu

SEQ ID NO: 333972 - RNA, 64 nt, Homo Sapiens
aacaaggagugaaagaaaauauaagaagaaaaaaauccccuacauuuuauuggcacagaaaagu

SEQ ID NO: 333973 - RNA, 64 nt, Homo Sapiens
uuagaagggaucuuagagguagauuauccaggccauccccuacugcuuacauuccccucccccu

SEQ ID NO: 333974 - RNA, 64 nt, Homo Sapiens
aagaugguagcacuagucuuaaauuguauaaaauauccccuaacauguuuaaauguccauuuuu

SEQ ID NO: 333975 - RNA, 64 nt, Homo Sapiens
uacaauuuacagaucaugaguucaauaugcuugaauccccuagaccuaauuuuuccuugauccc

SEQ ID NO: 333976 - RNA, 64 nt, Homo Sapiens
uauuucucaaaaucauucuaucuaagccucaucuauccccuaccauuucacuggagugacuuau

SEQ ID NO: 333977 - RNA, 64 nt, Homo Sapiens
ucccaggcagucugaccccagaguggcccagcucauccccuacucuguuauuugcuuguuaaug

SEQ ID NO: 333978 - RNA, 64 nt, Homo Sapiens
agaacagggaggauacagaaguauugcagcccagauccccuaucagggggacagcuggugggca

SEQ ID NO: 333979 - RNA, 64 nt, Homo Sapiens
ggccaggcuuggguggagccugugucccagacagauccccuaggccuaucugagacccauacag

SEQ ID NO: 333980 - RNA, 64 nt, Homo Sapiens
aguaccgggaucugcacacauuccccacuuguauauccccuaccgcuuaauuucuuuuuucuua

SEQ ID NO: 333981 - RNA, 64 nt, Homo Sapiens
aucugauucacgacuuaaugccuuccaucuccacauccccuaacauugugaugucaccaauuuu

SEQ ID NO: 333982 - RNA, 64 nt, Homo Sapiens
augcuuuuugagcugucuuaaagccaguugcaauauccccuaagacuuaauucuaguucccgac

SEQ ID NO: 333983 - RNA, 64 nt, Homo Sapiens
cagguaaccccaggcugaaggggcccugcuccccauccccuaccaugggcacccaugugcuggc

SEQ ID NO: 333984 - RNA, 64 nt, Homo Sapiens
ccugguacacaaaggggucaagguggugauggacauccccuaugagcuguggaacgagacuucu

SEQ ID NO: 333985 - RNA, 64 nt, Homo Sapiens
cuauaggaauacaaggggcacacagggaaggcagauccccuaguuggcaagacuauuuuaacuu

SEQ ID NO: 333986 - RNA, 64 nt, Homo Sapiens
uuacuuauuuccaagaaauggaagggcaaaaaucauccccuauuuaugcaaaaguggguacuug

SEQ ID NO: 333987 - RNA, 64 nt, Homo Sapiens
aauccugggaggcaggauccccugucuucuuuccauccccuagaaaucaccucccaccauaauc

SEQ ID NO: 333988 - RNA, 64 nt, Homo Sapiens
gaugacggagagcuuacagaaaauuccaccuuucauccccuaugaagcugccugcgauggccug

SEQ ID NO: 333989 - RNA, 64 nt, Homo Sapiens
uaucacugcuauauuaaaauaucguaugggaagaauccccuauuuaccuuaucaagaacgaaaa

SEQ ID NO: 333990 - RNA, 64 nt, Homo Sapiens
auauuucugauggugcacuauuaaaagacacuguauccccuaaaaaauacuugaauauucaaau

SEQ ID NO: 333991 - RNA, 64 nt, Homo Sapiens
gcuacuauauugcuuuugucccaaagugaguaaaauccccuagagcagagagagagagagagag

SEQ ID NO: 333992 - RNA, 64 nt, Homo Sapiens
acugagccagaccuucggagaguaaugccaccagauccccuaggaaagaggaggcaaauggcac

SEQ ID NO: 333993 - RNA, 64 nt, Homo Sapiens
gcccccuccuugcccuccacgcccugcccccugcauccccuagagacagcugacuagcagcugc

SEQ ID NO: 333994 - RNA, 64 nt, Homo Sapiens
aaaccauucuuuucaaugcagaagaaaucuagauauccccuacugugaccaaauuucuguauua

SEQ ID NO: 333995 - RNA, 64 nt, Homo Sapiens
aagagaguucaacuguuacucuuuucuuucaucaauccccuaucaguuagaacugcaggccagu

SEQ ID NO: 333996 - RNA, 64 nt, Homo Sapiens
cgaagggggcugcuuaggguuucaccuuuuuuuaauccccuaagcuccauuauaugacauugga

SEQ ID NO: 333997 - RNA, 64 nt, Homo Sapiens
uuguaaacuuccuggaaagcugucuucacuaaguauccccuagucucuauauaugugguuagua

SEQ ID NO: 333998 - RNA, 64 nt, Homo Sapiens
caugguaaaucuuguguuguuggguuugccauucauccccuaggucaaugacauuagccaaagu

SEQ ID NO: 333999 - RNA, 64 nt, Homo Sapiens
cuacucugauguauagaccauguuaugggagagaauccccuacccuugacucucccacaugcuc

SEQ ID NO: 334000 - RNA, 64 nt, Homo Sapiens
gccaacagagauuuguagauuuguuauacugcccauccccuaaauuucuaaguggaaguuaaau

SEQ ID NO: 334001 - RNA, 64 nt, Homo Sapiens
caguccuuugggauuggaagugaaacagucugugauccccuaccuucuagggaacuaggaccua

SEQ ID NO: 334002 - RNA, 64 nt, Homo Sapiens
gccuucagcuauucuuucauuuauccauucuucaauccccuaaaguguuuuuaguugguugagu

SEQ ID NO: 334003 - RNA, 64 nt, Homo Sapiens
cauacaugcacauagacacacccuaauuacaccuauccccuacaauguuguucggucagcccuu

SEQ ID NO: 334004 - RNA, 64 nt, Homo Sapiens
augugcuggcagcuuuaccuagacacacucauucauccccuacuaugucccagccuuuuuaagg

SEQ ID NO: 334005 - RNA, 64 nt, Homo Sapiens
uaauaccguaaccgcgcagucgccagagggcagcauccccuaaccugcgcuuccuccugauggu

SEQ ID NO: 334006 - RNA, 64 nt, Homo Sapiens
ggaccccaucugugaauaagccauucugacucauauccccuauuuaacagggucucuagugcug

SEQ ID NO: 334007 - RNA, 64 nt, Homo Sapiens
aguaccuauuucuaaacaaugauuuaaagucuauauccccuaagcggaguuguuguuuuucucc

SEQ ID NO: 334008 - RNA, 64 nt, Homo Sapiens
gaucaggugcccugcagacccagagccaguuccuauccccuaaccuaaacacuuauaggugagg

SEQ ID NO: 334009 - RNA, 64 nt, Homo Sapiens
ugcccagguaacugauaggaguuuucuucaaaccauccccuaaggagaaaugaucuuagacacu

SEQ ID NO: 334010 - RNA, 64 nt, Homo Sapiens
cagaccacugauaaaaccaucuagaaacuuccaaauccccuaagccauuccugggaaauauucc

SEQ ID NO: 334011 - RNA, 64 nt, Homo Sapiens
cccacugcucagcgcgggcccccccgcccuccccauccccuacugaguggagaggggcaccugc

SEQ ID NO: 334012 - RNA, 64 nt, Homo Sapiens
gggugagaugagaucauggagagagaacacagccauccccuauagaaaggcacagcuuuugggc

SEQ ID NO: 334013 - RNA, 64 nt, Homo Sapiens
uguaaauaaugaaccuuauuuuuuauuauugccaauccccuaagauauuguauuuuacaaaucu

SEQ ID NO: 334014 - RNA, 64 nt, Homo Sapiens
gcuaaguguuuaauucaugaauauuguauacugcauccccuaccacaauuuacacaauccugug

SEQ ID NO: 334015 - RNA, 64 nt, Homo Sapiens
ccucccucccccaacacucccuaccaacccccuaauccccuacucccuccacccccccuccacu

SEQ ID NO: 334016 - RNA, 64 nt, Homo Sapiens
caucauuuuccuacggcguuagcacuuuaagcacauccccuaggggagggggugagugaggggc

SEQ ID NO: 334017 - RNA, 64 nt, Homo Sapiens
agaucucaagugucaaccuugaggucccagcuccauccccuaguugcagacucaucaccauggu

SEQ ID NO: 334018 - RNA, 64 nt, Homo Sapiens
ugagaacaggccaucucagcccuacacacuugccauccccuacagcacagaggaagagugaugg

SEQ ID NO: 334019 - RNA, 64 nt, Homo Sapiens
ccaaguggaaagaggcuggggagaaagaggcggcauccccuaggggaguaguacccccagcucu

SEQ ID NO: 334020 - RNA, 64 nt, Homo Sapiens
caaaaagaacaauagaacugaagauaaaaaacgaauccccuaaaagaggaaaucuuaagauuac

SEQ ID NO: 334021 - RNA, 64 nt, Homo Sapiens
ugauuucuuaccguuuuuggcucuguuuugcuauauccccuaauuuguugguugugcuaaucuu

SEQ ID NO: 334022 - RNA, 64 nt, Homo Sapiens
uacuaucacuacaagaaaacgucaggagcacagcauccccuacuccagcuguaagagaaaugca

SEQ ID NO: 334023 - RNA, 64 nt, Homo Sapiens
auuuucacguugugcuacuauguuggaggacaaaauccccuaccaaaaaagcaagugucuuugg

SEQ ID NO: 334024 - RNA, 64 nt, Homo Sapiens
cucacaaaacacaguugagaccuuaucucuccccauccccuagcgggaacuuaaguacacagau

SEQ ID NO: 334025 - RNA, 64 nt, Homo Sapiens
uuagauuuggcccccaacuccuccccuaacucagauccccuaacauuuucacuccugagaagug

SEQ ID NO: 334026 - RNA, 64 nt, Homo Sapiens
cccaaaggcccagacacgcauagaucauaguccaauccccuagauaguuguggaaagagucuca

SEQ ID NO: 334027 - RNA, 64 nt, Homo Sapiens
uacuccucuguucugaaucugccucuaaaaucagauccccuaguuccaugaacagaaaauuaag

SEQ ID NO: 334028 - RNA, 64 nt, Homo Sapiens
aagaggacggugcuucuuucuauuaaagugcuccauccccuaccaucuacacauuagcauuguc

SEQ ID NO: 334029 - RNA, 64 nt, Homo Sapiens
augauuuuuuuuaaauaccaaggauaaaaccuccauccccuaaaagaccuagaugauaccccug

SEQ ID NO: 334030 - RNA, 64 nt, Homo Sapiens
uugcaaguuuacuuucauuccuuccuauguuuuaauccccuaaaauucucccuguagucaaugu

SEQ ID NO: 334031 - RNA, 64 nt, Homo Sapiens
aaugccuccugucccuaaacugcugcuacaucuaauccccuacccaucuugaucccagccugac

SEQ ID NO: 334032 - RNA, 64 nt, Homo Sapiens
cccacccccuaaauucccaacgaggcaucuugacauccccuauccgagugcauuuaucccaaaa

SEQ ID NO: 334033 - RNA, 64 nt, Homo Sapiens
accugcuccaaacuagugacuaggauagaauuugauccccuaacucacugucugcggugcucau

SEQ ID NO: 334034 - RNA, 64 nt, Homo Sapiens
cucagugcccuuagcuagccugacuaagucccagauccccuacagcuuccuucggugugguauc

SEQ ID NO: 334035 - RNA, 64 nt, Homo Sapiens
ccaggcugucaacccuuucuuuuaauccagcagcauccccuaccgacgggccucauccuccuuu

SEQ ID NO: 334036 - RNA, 64 nt, Homo Sapiens
aauacaccuauuucacuaacagucaaauggaaagauccccuaaucauuucauuugaaaucuagg

SEQ ID NO: 334037 - RNA, 64 nt, Homo Sapiens
agcaccagacuuuuuuucuuuuuuuccuaaagaaauccccuaagccccccgccuguaggcggga

SEQ ID NO: 334038 - RNA, 64 nt, Homo Sapiens
cacaguucucaguggcaaaagagacaauguugaaauccccuaaaccuagugcuugucggaugca

SEQ ID NO: 334039 - RNA, 64 nt, Homo Sapiens
ccuaggggugucugucuccagaggggagggacaaauccccuacuggggccauuucaauggggua

SEQ ID NO: 334040 - RNA, 64 nt, Homo Sapiens
aaaugcccugagacgguucucuguucgauuuuucauccccuaugaaccugggucuuauucuguc

SEQ ID NO: 334041 - RNA, 64 nt, Homo Sapiens
ugcggccucuccaccucucacccacucucuccuaauccccuacuuaaguagggcuugccccacu

SEQ ID NO: 334042 - RNA, 64 nt, Homo Sapiens
uaaccugucuucccagccaauugguggugcuggaauccccuaggagccuucagucugggagaaa

SEQ ID NO: 334043 - RNA, 64 nt, Homo Sapiens
guagugcauguggccaagccuuuaguuaucaccaauccccuacuguuaaucagagaugucccac

SEQ ID NO: 334044 - RNA, 64 nt, Homo Sapiens
auuugcaggagcgugguucuuuucaaauacaguuauccccuaauuaauuuuaagccucaguuuc

SEQ ID NO: 334045 - RNA, 64 nt, Homo Sapiens
cauaugcaggggauugguucuuuugaauaugguuauccccuaacguaaagccuuaagauguuuc

SEQ ID NO: 334046 - RNA, 64 nt, Homo Sapiens
acuccuuucuaagccccuaagggaaaacagaauuauccccuagguuccuggggccauaacucau

SEQ ID NO: 334047 - RNA, 64 nt, Homo Sapiens
cccuccacaauaacagaaaccacccuguccccagauccccuauuccuguccccaugguacgucc

SEQ ID NO: 334048 - RNA, 64 nt, Homo Sapiens
cuuuggccaagcaagaggugauccggcuccugucauccccuacaucugccuggaggaucccucc

SEQ ID NO: 334049 - RNA, 64 nt, Homo Sapiens
cgcuggacagcucuuuuuuuacggcauuggcuccauccccuagugcgacaagggauuugcucgc

SEQ ID NO: 334050 - RNA, 64 nt, Homo Sapiens
acugaguuguauccgagagggugggaacagcagcauccccuaauugcaguacacgguuccuuuu

SEQ ID NO: 334051 - RNA, 64 nt, Homo Sapiens
gcaggucagagaccauccagcucuggagacccagauccccuagacacuuuuguagcugagaccu

SEQ ID NO: 334052 - RNA, 64 nt, Homo Sapiens
ccccaccuugaacaucaugauccgucaccuccccauccccuaguaaaugaaaggcaugcccacg

SEQ ID NO: 334053 - RNA, 64 nt, Homo Sapiens
aacacauugauaaagcaucauguucccuuugauuauccccuauaaccaacacucaacuacaaau

SEQ ID NO: 334054 - RNA, 64 nt, Homo Sapiens
aaaaaaaagcagcaccugugggccauacuaaaagauccccuacuuacguucugguugucauguu

SEQ ID NO: 334055 - RNA, 64 nt, Homo Sapiens
ugucucuagacauugccaaaugucccgugugaacauccccuauugagacccacugcuuuagcga

SEQ ID NO: 334056 - RNA, 64 nt, Homo Sapiens
cuauuuuaaguuuagaccaaaaaaauacagagucauccccuacccccaccccucuagagacccu

SEQ ID NO: 334057 - RNA, 64 nt, Homo Sapiens
gaggaggggaccuucgagggacuaucagaaugacauccccuacugaccuacaacaugauccagu

SEQ ID NO: 334058 - RNA, 64 nt, Homo Sapiens
gugacuugcuuuaggguguccuccacccccccccauccccuacuagugggaguggggggccuug

SEQ ID NO: 334059 - RNA, 64 nt, Homo Sapiens
cuuuguccucaccuacccuaaaauagcaaaaugaauccccuagcugggugucaugaaacucaau

SEQ ID NO: 334060 - RNA, 64 nt, Homo Sapiens
cacccucuguuuccuuuccccucugugucagcccauccccuagauagccaguccuaacuccgua

SEQ ID NO: 334061 - RNA, 64 nt, Homo Sapiens
uuuggaagaauccccaaucuccuucacaaggcacauccccuacagucaugcuuucuacucaugu

SEQ ID NO: 334062 - RNA, 64 nt, Homo Sapiens
aacccugccaccuuggggaauccagccuggaggcauccccuaagcagccagccauggccugggu

SEQ ID NO: 334063 - RNA, 64 nt, Homo Sapiens
aggagcccuuugaugucaucaggccuucaagcaaauccccuaaaugagggcaagaucccagugg

SEQ ID NO: 334064 - RNA, 64 nt, Homo Sapiens
ggccacuuccuaucugauuuuuccaaguaaaaguauccccuaaacuuguacuaguguuguaacu

SEQ ID NO: 334065 - RNA, 64 nt, Homo Sapiens
uguacaaagcuauguauuuugauuuacuuucauuucuugcuauguauauguacuuuucuuaaaa

SEQ ID NO: 334066 - RNA, 64 nt, Homo Sapiens
uauauguacuuuucuuaaaaugccaagaacuuucucuugcuaucauugcuccuuuugaaacaau

SEQ ID NO: 334067 - RNA, 64 nt, Homo Sapiens
ucuuaccauguaccugcuuuucaucuuguuuucuucuugcuaagauuucacuggucagucauuu

SEQ ID NO: 334068 - RNA, 64 nt, Homo Sapiens
guugauauucuauguaguugguuuauuuuauuguucuugcuauuaaccacaguuaggguguuuu

SEQ ID NO: 334069 - RNA, 64 nt, Homo Sapiens
auagcaguacuuugcugugaaacacauauucaauucuugcuaacccaaaauguauaauuacgua

SEQ ID NO: 334070 - RNA, 64 nt, Homo Sapiens
cuaaacugucuccaacacauaguaacacgugccuucuugcuacuaaguauuuugaacuggaaau

SEQ ID NO: 334071 - RNA, 64 nt, Homo Sapiens
guuuuauuacacauuuauguaauuuuauuuacauucuugcuaauucucagcagaaauuuaaaua

SEQ ID NO: 334072 - RNA, 64 nt, Homo Sapiens
aauuuuuaauuuuuaauuuuuugucaagacaaggucuugcuauguugcccaggcuggucuugaa

SEQ ID NO: 334073 - RNA, 64 nt, Homo Sapiens
cuccugcccuguuuauuucauccucgaugggaauucuugcuagguaagcacuaauaacucggca

SEQ ID NO: 334074 - RNA, 64 nt, Homo Sapiens
uaugagaaggccucccuuccuaagccaccucuggucuugcuaagucuugaucuugcuuccugcc

SEQ ID NO: 334075 - RNA, 64 nt, Homo Sapiens
gggccagggcagccucccuauaauuuucuucaucucuugcuaaucucuauaauaagguugcuuu

SEQ ID NO: 334076 - RNA, 64 nt, Homo Sapiens
caucaguuucccccucugagcaacagacugcuugucuugcuaggagaggaggauggggggcuga

SEQ ID NO: 334077 - RNA, 64 nt, Homo Sapiens
uuuguuuguucuugaaaauuugucuauuuugcagucuugcuaaagcagucuugcuauugcuguu

SEQ ID NO: 334078 - RNA, 64 nt, Homo Sapiens
gcuguuugucuauuuugcagugucuauuuugcagucuugcuauuacugggauaaccuugcuguu

SEQ ID NO: 334079 - RNA, 64 nt, Homo Sapiens; identical to SEQ ID NO: 82929

SEQ ID NO: 334080 - RNA, 64 nt, Homo Sapiens; identical to SEQ ID NO: 82930

SEQ ID NO: 334081 - RNA, 64 nt, Homo Sapiens; identical to SEQ ID NO: 82931

SEQ ID NO: 334082 - RNA, 64 nt, Homo Sapiens; identical to SEQ ID NO: 82932

SEQ ID NO: 334083 - RNA, 64 nt, Homo Sapiens; identical to SEQ ID NO: 82933

SEQ ID NO: 334084 - RNA, 64 nt, Homo Sapiens; identical to SEQ ID NO: 82934

SEQ ID NO: 334085 - RNA, 64 nt, Homo Sapiens; identical to SEQ ID NO: 82935

SEQ ID NO: 334086 - RNA, 64 nt, Homo Sapiens; identical to SEQ ID NO: 82936

SEQ ID NO: 334087 - RNA, 64 nt, Homo Sapiens; identical to SEQ ID NO: 82937

SEQ ID NO: 334088 - RNA, 64 nt, Homo Sapiens; identical to SEQ ID NO: 82938

SEQ ID NO: 334089 - RNA, 64 nt, Homo Sapiens; identical to SEQ ID NO: 82939

SEQ ID NO: 334090 - RNA, 64 nt, Homo Sapiens; identical to SEQ ID NO: 82940

SEQ ID NO: 334091 - RNA, 64 nt, Homo Sapiens; identical to SEQ ID NO: 82941

SEQ ID NO: 334092 - RNA, 64 nt, Homo Sapiens; identical to SEQ ID NO: 82942

SEQ ID NO: 334093 - RNA, 64 nt, Homo Sapiens; identical to SEQ ID NO: 82943

SEQ ID NO: 334094 - RNA, 64 nt, Homo Sapiens; identical to SEQ ID NO: 82944

SEQ ID NO: 334095 - RNA, 64 nt, Homo Sapiens; identical to SEQ ID NO: 82945

SEQ ID NO: 334096 - RNA, 64 nt, Homo Sapiens; identical to SEQ ID NO: 82946

SEQ ID NO: 334097 - RNA, 64 nt, Homo Sapiens; identical to SEQ ID NO: 82947

SEQ ID NO: 334098 - RNA, 64 nt, Homo Sapiens; identical to SEQ ID NO: 82948

SEQ ID NO: 334099 - RNA, 64 nt, Homo Sapiens; identical to SEQ ID NO: 82949

SEQ ID NO: 334100 - RNA, 64 nt, Homo Sapiens; identical to SEQ ID NO: 82950

SEQ ID NO: 334101 - RNA, 64 nt, Homo Sapiens; identical to SEQ ID NO: 82951

SEQ ID NO: 334102 - RNA, 64 nt, Homo Sapiens; identical to SEQ ID NO: 82952

SEQ ID NO: 334103 - RNA, 64 nt, Homo Sapiens; identical to SEQ ID NO: 82953

SEQ ID NO: 334104 - RNA, 64 nt, Homo Sapiens; identical to SEQ ID NO: 82954

SEQ ID NO: 334105 - RNA, 64 nt, Homo Sapiens; identical to SEQ ID NO: 82955

SEQ ID NO: 334106 - RNA, 64 nt, Homo Sapiens; identical to SEQ ID NO: 82956

SEQ ID NO: 334107 - RNA, 64 nt, Homo Sapiens; identical to SEQ ID NO: 82957

SEQ ID NO: 334108 - RNA, 64 nt, Homo Sapiens; identical to SEQ ID NO: 82958

SEQ ID NO: 334109 - RNA, 64 nt, Homo Sapiens; identical to SEQ ID NO: 82959

SEQ ID NO: 334110 - RNA, 64 nt, Homo Sapiens; identical to SEQ ID NO: 82960

SEQ ID NO: 334111 - RNA, 64 nt, Homo Sapiens; identical to SEQ ID NO: 82961

SEQ ID NO: 334112 - RNA, 64 nt, Homo Sapiens; identical to SEQ ID NO: 82962

SEQ ID NO: 334113 - RNA, 64 nt, Homo Sapiens; identical to SEQ ID NO: 82963

SEQ ID NO: 334114 - RNA, 64 nt, Homo Sapiens; identical to SEQ ID NO: 82964

SEQ ID NO: 334115 - RNA, 64 nt, Homo Sapiens; identical to SEQ ID NO: 82965

SEQ ID NO: 334116 - RNA, 64 nt, Homo Sapiens; identical to SEQ ID NO: 82966

SEQ ID NO: 334117 - RNA, 64 nt, Homo Sapiens; identical to SEQ ID NO: 82967

SEQ ID NO: 334118 - RNA, 64 nt, Homo Sapiens; identical to SEQ ID NO: 82968

SEQ ID NO: 334119 - RNA, 64 nt, Homo Sapiens; identical to SEQ ID NO: 82969

SEQ ID NO: 334120 - RNA, 64 nt, Homo Sapiens; identical to SEQ ID NO: 82970

SEQ ID NO: 334121 - RNA, 64 nt, Homo Sapiens; identical to SEQ ID NO: 82971

SEQ ID NO: 334122 - RNA, 64 nt, Homo Sapiens; identical to SEQ ID NO: 82972

SEQ ID NO: 334123 - RNA, 64 nt, Homo Sapiens; identical to SEQ ID NO: 82973

SEQ ID NO: 334124 - RNA, 64 nt, Homo Sapiens; identical to SEQ ID NO: 82974

SEQ ID NO: 334125 - RNA, 64 nt, Homo Sapiens; identical to SEQ ID NO: 82975

SEQ ID NO: 334126 - RNA, 64 nt, Homo Sapiens; identical to SEQ ID NO: 82976

SEQ ID NO: 334127 - RNA, 64 nt, Homo Sapiens; identical to SEQ ID NO: 82977

SEQ ID NO: 334128 - RNA, 64 nt, Homo Sapiens; identical to SEQ ID NO: 82978

SEQ ID NO: 334129 - RNA, 64 nt, Homo Sapiens; identical to SEQ ID NO: 82979

SEQ ID NO: 334130 - RNA, 64 nt, Homo Sapiens; identical to SEQ ID NO: 82980

SEQ ID NO: 334131 - RNA, 64 nt, Homo Sapiens; identical to SEQ ID NO: 82981

SEQ ID NO: 334132 - RNA, 64 nt, Homo Sapiens; identical to SEQ ID NO: 82982

SEQ ID NO: 334133 - RNA, 64 nt, Homo Sapiens
gccucguguccugcuagcugucucucuuguugauuuccgugaaaaugcaaguguuugaagucug

SEQ ID NO: 334134 - RNA, 64 nt, Homo Sapiens
uguuucucauccuucuugcucugccuuugaguuguuccgugaucacuucugaauaagcaguuug

SEQ ID NO: 334135 - RNA, 64 nt, Homo Sapiens
gccagggggccugggccagaccagggcucuguccuuccgugacuuuauuaaagcaacauuugcc

SEQ ID NO: 334136 - RNA, 64 nt, Homo Sapiens
cuaauauaccaaaauaaaaugaaaaauugaguuuuuccgugaacuuuauacuguccagcucugu

SEQ ID NO: 334137 - RNA, 64 nt, Homo Sapiens
ucgccugggugggauguacccucuucugcgucuguuccgugacuccgggucucggccgucuccc

SEQ ID NO: 334138 - RNA, 64 nt, Homo Sapiens
gcgaacuccgugguggugggccagcaggccuggguuccgugagcagcuuagcugcugcugacac

SEQ ID NO: 334139 - RNA, 64 nt, Homo Sapiens
augauagcucugugauuauaucuuacagguauaguuccgugauuacguuuucaaacacaagguc

SEQ ID NO: 334140 - RNA, 64 nt, Homo Sapiens
ccagugggccagugguagccggguggugucaggguuccgugacuucgggaaccuccccugcuga

SEQ ID NO: 334141 - RNA, 64 nt, Homo Sapiens
caucuagucagagcaauuauggcagacaacauguuuccgugacuaaugauguaaugacagagaa

SEQ ID NO: 334142 - RNA, 64 nt, Homo Sapiens
aaguugugcagcuugagcaaccucuccccucaaauuccgugaccacucaucauuaaccagaaca

SEQ ID NO: 334143 - RNA, 64 nt, Homo Sapiens
cauuaacauuuuauaacagauuuauauuuuugaguuccgugauugcaaauuaugaccucaaauu

SEQ ID NO: 334144 - RNA, 64 nt, Homo Sapiens
guuggaagaugggguucauuuauguuggugauaauuccgugacauuauuuuuuucucuuuugaa

SEQ ID NO: 334145 - RNA, 64 nt, Homo Sapiens
ucuuuuucuuccuugcacuccuugaucuuugggcuuccgugauguccucagggucccccccucc

SEQ ID NO: 334146 - RNA, 64 nt, Homo Sapiens
ccgcgcucuguuuugggaaugucuguguaaauuguuccgugaaggcccagcggcccucuuuccu

SEQ ID NO: 334147 - RNA, 64 nt, Homo Sapiens
gaaggugaacaggauggccuggcagcagggauguuuccgugagccacaaauaccagaaacugag

SEQ ID NO: 334148 - RNA, 64 nt, Homo Sapiens
uccucuaacucauucuucacggaugccguagcguuuccgugagcucaaacuggccuugguguaa

SEQ ID NO: 334149 - RNA, 64 nt, Homo Sapiens
cagggugauagcucagggaacaacaaaaaaggaauuccgugaaaacauuuuuuuuucuuugaug

SEQ ID NO: 334150 - RNA, 64 nt, Homo Sapiens
ccucaguccuucaccuugccaggugccguuucucuuccgugaaggccacugcccagguccccag

SEQ ID NO: 334151 - RNA, 64 nt, Homo Sapiens
uaugauaagauugaaauuccauugauaagaugguuuccgugagcugcuuuuaaaucugcagcac

SEQ ID NO: 334152 - RNA, 64 nt, Homo Sapiens
cccaauguaggagcugccuuggcucagacauguuuuccgugaaaacggagcugaacaauaggcu

SEQ ID NO: 334153 - RNA, 64 nt, Homo Sapiens
cuggggagcgaaaguuucuuggucucagcuucauuuccgugaagggcaccgagaacucgaagcc

SEQ ID NO: 334154 - RNA, 64 nt, Homo Sapiens
ugaucauuuucugccauaccaaggucauaauuccuuccgugagaaauauuuuagugggguaaca

SEQ ID NO: 334155 - RNA, 64 nt, Homo Sapiens
aaaauaccagugaaaagauuauaaaauagaaggcuuccgugauggucauuaggcaccguauugc

SEQ ID NO: 334156 - RNA, 64 nt, Homo Sapiens
ugcucagaaaaugucaggacugguuacauuugcuuuccgugaaaggaugacucuacugcgugga

SEQ ID NO: 334157 - RNA, 64 nt, Homo Sapiens
cuuaauguaggaagacaugggagugggugacacuuuccgugacaauagacaggagugagaggga

SEQ ID NO: 334158 - RNA, 64 nt, Homo Sapiens
ucgccguugcacuauggacaccugcggcacugccuuccgugacgagccugucgcggcccggccg

SEQ ID NO: 334159 - RNA, 64 nt, Homo Sapiens
gauuucuuaaaauauuacuuaugcagaguuuuuuuuccgugaaaucaagccaccacauuuugua

SEQ ID NO: 334160 - RNA, 64 nt, Homo Sapiens
gccagcaucgaacaugagaccagauggccagcccuuccgugacaaccagcuacacucagaccaa

SEQ ID NO: 334161 - RNA, 64 nt, Homo Sapiens
cuggcugcagaugacuggaaacaaggaaggacauuuccgugagagucaucucaaacacugcuua

SEQ ID NO: 334162 - RNA, 64 nt, Homo Sapiens
agaggggcaggcuuucugugugacucgggaguucuuccgugagggcugccaggggguggugugc

SEQ ID NO: 334163 - RNA, 64 nt, Homo Sapiens
acuuccugcagacuuuccgccgugggcugcuggguuccgugaugcuggaccucgacguccugcg

SEQ ID NO: 334164 - RNA, 64 nt, Homo Sapiens
uuuuuaacuaccucugaaucgaagccaaaaauauuuccgugaggugaaccacgucuucaagaaa

SEQ ID NO: 334165 - RNA, 64 nt, Homo Sapiens
uuaacaacucuaacccaggauucuagaugguauguuccgugauaugucaggcgggacuggaacg

SEQ ID NO: 334166 - RNA, 64 nt, Homo Sapiens
ccauuccuuuggcauggcacaugauaccgcaaaauuccgugaguauuaauuugucuuccauuug

SEQ ID NO: 334167 - RNA, 64 nt, Homo Sapiens
auuacccugaccuccaucauauaaauggccaauguuccgugauuuagcacagaucagucuguca

SEQ ID NO: 334168 - RNA, 64 nt, Homo Sapiens
gaccaugccuggucuguccuugagagaggauggcuuccgugaaacaccugagcaacaaugauua

SEQ ID NO: 334169 - RNA, 64 nt, Homo Sapiens
uaggguaaggugccuucuuaagaguguuuggggguuccgugaugucucggguggcuagucagag

SEQ ID NO: 334170 - RNA, 64 nt, Homo Sapiens
gcagggguuugcaugugcuauuccaagcaguccuuuccgugaaagcccuggacaggucccaaag

SEQ ID NO: 334171 - RNA, 64 nt, Homo Sapiens
caaugacagaaacccuaccucauuuagaacugauuuccgugagagaaugaucuuucucuaguuu

SEQ ID NO: 334172 - RNA, 64 nt, Homo Sapiens
acccccguccuccguaggggccaaacugaagcgcuuccgugaacugggacuccggcucccuacc

SEQ ID NO: 334173 - RNA, 64 nt, Homo Sapiens
gggaccgugaguaguggaaaggguucccaacccuuuccgugaaaccugcugcucaugggggugg

SEQ ID NO: 334174 - RNA, 64 nt, Homo Sapiens
caacauaucagguuccccuacuacugaaguagccuuccgugagaacacaccacauguuaggacu

SEQ ID NO: 334175 - RNA, 64 nt, Homo Sapiens
ccgugugucauugaucagcaccauuugugguauguuccgugaugagcguuuagugagccugcug

SEQ ID NO: 334176 - RNA, 64 nt, Homo Sapiens
gcaccuaaaccuugagggggagggugcucuggguuuccgugagguaaccaccuuaaaugggagg

SEQ ID NO: 334177 - RNA, 64 nt, Homo Sapiens
uauuccacaaagaagggcugccguuuggucccucuuccgugaggacuggcggcaccagcaccuu

SEQ ID NO: 334178 - RNA, 64 nt, Homo Sapiens
ggaaagggcucucaagggcucuucugcucaucucuuccgugagauuugcucccagacccucuga

SEQ ID NO: 334179 - RNA, 64 nt, Homo Sapiens
aaacagccacgccucucaggaacccaccuggcgguuccgugagcucaggcaggccugacccggc

SEQ ID NO: 334180 - RNA, 64 nt, Homo Sapiens
ucuggugcuccugcaucucaaaagccggcuugauuuccgugaacacuuuccgagccuccagucc

SEQ ID NO: 334181 - RNA, 64 nt, Homo Sapiens
agacacaaaacgguggcaggauagagagaucacguuccgugagcaaucaaacgucuuaacgcgu

SEQ ID NO: 334182 - RNA, 64 nt, Homo Sapiens
uuggccacucucucagauucccucuucauaaagcuuccgugacuucuaaaccaucaggucggug

SEQ ID NO: 334183 - RNA, 64 nt, Homo Sapiens
uggcugcccaauguccucugcgagucugcacagguuccgugagggagccccgcuguuaaccagc

SEQ ID NO: 334184 - RNA, 64 nt, Homo Sapiens
accuucuccaucgugucagcuguguuucucuugauuccgugacacccgguuuauuaguucaaaa

SEQ ID NO: 334185 - RNA, 64 nt, Homo Sapiens
cucucuguccgaucugugcauguuauuuuucuuuuuccgugagucaaagucugaccuuuauuuu

SEQ ID NO: 334186 - RNA, 50 nt, Homo Sapiens
aucaauauaucuuuucuugguuccgugagcccaguaagcuuccaccguag

SEQ ID NO: 334187 - RNA, 64 nt, Homo Sapiens
cauuacuuccauauaaagacgaauguuaguuucauuccgugaaagugauaucagagauuacuau

SEQ ID NO: 334188 - RNA, 64 nt, Homo Sapiens
acagauguguuuugaagaaguauuagaaaaaugauuccgugaacccucccaaauuugauuuugu

SEQ ID NO: 334189 - RNA, 64 nt, Homo Sapiens
uuguuucuuucccgucccacucuuuaaaaacugguuccgugaggaaaggcagaagccguuccgu

SEQ ID NO: 334190 - RNA, 64 nt, Homo Sapiens
ccccacaagccgcaaaaacccacaugucgguagguuccgugauguggguguccggggcagacau

SEQ ID NO: 334191 - RNA, 64 nt, Homo Sapiens
ccuguugcauugagauucucguuacccaauguauuuccgugaggacauccagacuaacauaguu

SEQ ID NO: 334192 - RNA, 64 nt, Homo Sapiens
ccuggggggcaucugugccuguuagagacaguccuuccgugaggcccgccauuaucucccccua

SEQ ID NO: 334193 - RNA, 64 nt, Homo Sapiens
gagcuguaaggcaugugccuucugccaccugacuuuccgugaggggacuaaaauuuacuaauug

SEQ ID NO: 334194 - RNA, 64 nt, Homo Sapiens
ucacuggaccacugggcaauugagccucggccucuuccgugacgggugauuagagggaggagaa

SEQ ID NO: 334195 - RNA, 64 nt, Homo Sapiens
cgccaccgugagaggccaggagcguggacagggcuuccgugagagaccggagcucaccgcccag

SEQ ID NO: 334196 - RNA, 64 nt, Homo Sapiens
ggccuccgcucccugcacacacacggacaggaauuuccgugacugugguguggagacuggagcc

SEQ ID NO: 334197 - RNA, 64 nt, Homo Sapiens
acaguuuuccuccauguuauuuaugaauuuuauauuccgugaauguauauugucuuguaauguu

SEQ ID NO: 334198 - RNA, 64 nt, Homo Sapiens
cuccuucugcuaggcagagagcgcacccuacucuuuccgugacgaugagggcggcaaaaacaga

SEQ ID NO: 334199 - RNA, 64 nt, Homo Sapiens
uagcugugucccuguagcucugaagcauggguguuuccgugacuuauguggcaugaucuugacg

SEQ ID NO: 334200 - RNA, 64 nt, Homo Sapiens
ggccaucaccagccauuccucgggaggcccuagcuuccgugaggcaggaauagcacccucuccc

SEQ ID NO: 334201 - RNA, 64 nt, Homo Sapiens
auacccugcaccaaagguguaugagcucuacuuauuccgugagaagcauaacuaaacaaagauu

SEQ ID NO: 334202 - RNA, 64 nt, Homo Sapiens; identical to SEQ ID NO: 70765

SEQ ID NO: 334203 - RNA, 64 nt, Homo Sapiens; identical to SEQ ID NO: 70766

SEQ ID NO: 334204 - RNA, 64 nt, Homo Sapiens; identical to SEQ ID NO: 70767

SEQ ID NO: 334205 - RNA, 64 nt, Homo Sapiens; identical to SEQ ID NO: 70768

SEQ ID NO: 334206 - RNA, 64 nt, Homo Sapiens; identical to SEQ ID NO: 70769

SEQ ID NO: 334207 - RNA, 64 nt, Homo Sapiens; identical to SEQ ID NO: 70770

SEQ ID NO: 334208 - RNA, 64 nt, Homo Sapiens; identical to SEQ ID NO: 70771

SEQ ID NO: 334209 - RNA, 64 nt, Homo Sapiens; identical to SEQ ID NO: 70772

SEQ ID NO: 334210 - RNA, 64 nt, Homo Sapiens; identical to SEQ ID NO: 70773

SEQ ID NO: 334211 - RNA, 64 nt, Homo Sapiens; identical to SEQ ID NO: 70774

SEQ ID NO: 334212 - RNA, 64 nt, Homo Sapiens; identical to SEQ ID NO: 70775

SEQ ID NO: 334213 - RNA, 64 nt, Homo Sapiens; identical to SEQ ID NO: 70776

SEQ ID NO: 334214 - RNA, 64 nt, Homo Sapiens; identical to SEQ ID NO: 70777

SEQ ID NO: 334215 - RNA, 64 nt, Homo Sapiens; identical to SEQ ID NO: 70778

SEQ ID NO: 334216 - RNA, 64 nt, Homo Sapiens; identical to SEQ ID NO: 70779

SEQ ID NO: 334217 - RNA, 64 nt, Homo Sapiens; identical to SEQ ID NO: 70780

SEQ ID NO: 334218 - RNA, 64 nt, Homo Sapiens; identical to SEQ ID NO: 70781

SEQ ID NO: 334219 - RNA, 64 nt, Homo Sapiens; identical to SEQ ID NO: 70782

SEQ ID NO: 334220 - RNA, 64 nt, Homo Sapiens; identical to SEQ ID NO: 70783

SEQ ID NO: 334221 - RNA, 64 nt, Homo Sapiens; identical to SEQ ID NO: 70784

SEQ ID NO: 334222 - RNA, 64 nt, Homo Sapiens; identical to SEQ ID NO: 70785

SEQ ID NO: 334223 - RNA, 64 nt, Homo Sapiens; identical to SEQ ID NO: 70786

SEQ ID NO: 334224 - RNA, 64 nt, Homo Sapiens; identical to SEQ ID NO: 70787

SEQ ID NO: 334225 - RNA, 64 nt, Homo Sapiens; identical to SEQ ID NO: 70788

SEQ ID NO: 334226 - RNA, 64 nt, Homo Sapiens; identical to SEQ ID NO: 70789

SEQ ID NO: 334227 - RNA, 64 nt, Homo Sapiens; identical to SEQ ID NO: 70790

SEQ ID NO: 334228 - RNA, 64 nt, Homo Sapiens; identical to SEQ ID NO: 70791

SEQ ID NO: 334229 - RNA, 64 nt, Homo Sapiens; identical to SEQ ID NO: 70792

SEQ ID NO: 334230 - RNA, 64 nt, Homo Sapiens; identical to SEQ ID NO: 70793

SEQ ID NO: 334231 - RNA, 64 nt, Homo Sapiens; identical to SEQ ID NO: 70794

SEQ ID NO: 334232 - RNA, 64 nt, Homo Sapiens; identical to SEQ ID NO: 70795

SEQ ID NO: 334233 - RNA, 64 nt, Homo Sapiens; identical to SEQ ID NO: 70796

SEQ ID NO: 334234 - RNA, 64 nt, Homo Sapiens; identical to SEQ ID NO: 70797

SEQ ID NO: 334235 - RNA, 64 nt, Homo Sapiens; identical to SEQ ID NO: 70798

SEQ ID NO: 334236 - RNA, 64 nt, Homo Sapiens; identical to SEQ ID NO: 70799

SEQ ID NO: 334237 - RNA, 64 nt, Homo Sapiens; identical to SEQ ID NO: 70800

SEQ ID NO: 334238 - RNA, 64 nt, Homo Sapiens; identical to SEQ ID NO: 70801

SEQ ID NO: 334239 - RNA, 64 nt, Homo Sapiens; identical to SEQ ID NO: 70802

SEQ ID NO: 334240 - RNA, 64 nt, Homo Sapiens; identical to SEQ ID NO: 70803

SEQ ID NO: 334241 - RNA, 64 nt, Homo Sapiens; identical to SEQ ID NO: 70804

SEQ ID NO: 334242 - RNA, 64 nt, Homo Sapiens; identical to SEQ ID NO: 70805

SEQ ID NO: 334243 - RNA, 64 nt, Homo Sapiens; identical to SEQ ID NO: 70806

SEQ ID NO: 334244 - RNA, 64 nt, Homo Sapiens; identical to SEQ ID NO: 70807

SEQ ID NO: 334245 - RNA, 64 nt, Homo Sapiens; identical to SEQ ID NO: 70808

SEQ ID NO: 334246 - RNA, 64 nt, Homo Sapiens; identical to SEQ ID NO: 70809

SEQ ID NO: 334247 - RNA, 64 nt, Homo Sapiens; identical to SEQ ID NO: 70810

SEQ ID NO: 334248 - RNA, 64 nt, Homo Sapiens; identical to SEQ ID NO: 70811

SEQ ID NO: 334249 - RNA, 64 nt, Homo Sapiens; identical to SEQ ID NO: 70812

SEQ ID NO: 334250 - RNA, 64 nt, Homo Sapiens; identical to SEQ ID NO: 70813

SEQ ID NO: 334251 - RNA, 64 nt, Homo Sapiens; identical to SEQ ID NO: 70814

SEQ ID NO: 334252 - RNA, 64 nt, Homo Sapiens; identical to SEQ ID NO: 70814

SEQ ID NO: 334253 - RNA, 64 nt, Homo Sapiens; identical to SEQ ID NO: 70816

SEQ ID NO: 334254 - RNA, 64 nt, Homo Sapiens; identical to SEQ ID NO: 70817

SEQ ID NO: 334255 - RNA, 64 nt, Homo Sapiens; identical to SEQ ID NO: 70818

SEQ ID NO: 334256 - RNA, 64 nt, Homo Sapiens; identical to SEQ ID NO: 70819

SEQ ID NO: 334257 - RNA, 64 nt, Homo Sapiens; identical to SEQ ID NO: 70820

SEQ ID NO: 334258 - RNA, 64 nt, Homo Sapiens; identical to SEQ ID NO: 70821

SEQ ID NO: 334259 - RNA, 64 nt, Homo Sapiens; identical to SEQ ID NO: 70822

SEQ ID NO: 334260 - RNA, 64 nt, Homo Sapiens; identical to SEQ ID NO: 70823

SEQ ID NO: 334261 - RNA, 64 nt, Homo Sapiens; identical to SEQ ID NO: 70824

SEQ ID NO: 334262 - RNA, 64 nt, Homo Sapiens; identical to SEQ ID NO: 70825

SEQ ID NO: 334263 - RNA, 64 nt, Homo Sapiens; identical to SEQ ID NO: 70826

SEQ ID NO: 334264 - RNA, 64 nt, Homo Sapiens; identical to SEQ ID NO: 70827

SEQ ID NO: 334265 - RNA, 64 nt, Homo Sapiens; identical to SEQ ID NO: 70828

SEQ ID NO: 334266 - RNA, 64 nt, Homo Sapiens; identical to SEQ ID NO: 70829

SEQ ID NO: 334267 - RNA, 64 nt, Homo Sapiens
cccaacccucagacagacuuaggacagaacccuccaccccuaccaaagucuccaccccuacaca

SEQ ID NO: 334268 - RNA, 64 nt, Homo Sapiens
caaggacagaacccuccaccaauagaaaagucuccaccccuacacaugcacccuggacuucucu

SEQ ID NO: 334269 - RNA, 64 nt, Homo Sapiens
cacacacucccugcuugcagcccuaucuccuucccaccccuacacacucaggccugugcccacu

SEQ ID NO: 334270 - RNA, 64 nt, Homo Sapiens
caccaguguccuccaagugcagaacccucugucccaccccuagcaaugcuggggcaggggguga

SEQ ID NO: 334271 - RNA, 64 nt, Homo Sapiens
caucuggaaugcuccaguuugaucucccuucugccaccccuaccucaccccuagucacucauau

SEQ ID NO: 334272 - RNA, 64 nt, Homo Sapiens
cuccaguuugaucucccuucugccaccccuaccucaccccuagucacucauaucggagccugga

SEQ ID NO: 334273 - RNA, 64 nt, Homo Sapiens
cacauacacacacaccuagcgugccaaucaauagcaccccuacuaacuccaggggggacaauau

SEQ ID NO: 334274 - RNA, 64 nt, Homo Sapiens
cuccaggggggacaauauguuaaaagcuuucugccaccccuaaauguuuacuuuuuugguacua

SEQ ID NO: 334275 - RNA, 64 nt, Homo Sapiens
uccccaccugggcuccugccagggucccuucagccaccccuaagcucccuaucccugcagccug

SEQ ID NO: 334276 - RNA, 64 nt, Homo Sapiens
uucccucccuaucccugcagaccugcccaagccacaccccuagcggcgcccgcggucccccagc

SEQ ID NO: 334277 - RNA, 64 nt, Homo Sapiens
agcuucggcaguaucacaagauuuccuaaugcaucugagagauaguugcugagagaaacaaaaa

SEQ ID NO: 334278 - RNA, 64 nt, Homo Sapiens
caaaaaauuuccuaaugcauuguuuucaguguugcugagagaaauaucaaagucuagaaacaga

SEQ ID NO: 334279 - RNA, 64 nt, Homo Sapiens
gcauucuccuguuuuuacagauuguauccugaggcugagagaguuaagugaaugucuaagguca

SEQ ID NO: 334280 - RNA, 64 nt, Homo Sapiens
ggcacagagagagucaacugaggccaaaagaggccugagagaaacugaggucaagauuucagga

SEQ ID NO: 334281 - RNA, 64 nt, Homo Sapiens
cugccaggaaguguuuauuugccucuaauugggccugagagaccauagggagguuggggcucac

SEQ ID NO: 334282 - RNA, 64 nt, Homo Sapiens
cuaguuaccacuaggcuaccaggucucuaggggccugagagaggcccucuagagaauccaggga

SEQ ID NO: 334283 - RNA, 64 nt, Homo Sapiens
aagacuauucucccagucccaggugggugggcaccugagagauuuuccucccaguaagaaggga

SEQ ID NO: 334284 - RNA, 64 nt, Homo Sapiens
gcucuacccuuccucccaguugagagguuauaaccugagagacaugagggcucaggccuccacc

SEQ ID NO: 334285 - RNA, 64 nt, Homo Sapiens
aaggaagaaucagcccagcaaugaaggauagaggcugagagaagggguguggguaaagacaggg

SEQ ID NO: 334286 - RNA, 64 nt, Homo Sapiens
uugcccaucaggggcugggagcaugacugcuucucugagagaacgcucugccccaucacagcca

SEQ ID NO: 334287 - RNA, 64 nt, Homo Sapiens
cagcccauugguucccacuggcagcaugguagagcugagagaaacaggcucucaggguaccuga

SEQ ID NO: 334288 - RNA, 64 nt, Homo Sapiens
uaggugaaaauuccuuauaaauccaggauuggcucugagagaacuggcuaagauucaggaagaa

SEQ ID NO: 334289 - RNA, 64 nt, Homo Sapiens
uaucuuggcugacagcaggcaagcuucaguuugggcuguggacgcugccacacaagccugagua

SEQ ID NO: 334290 - RNA, 64 nt, Homo Sapiens
gacaccugagauuagaggcuggggcucacugcaggcuguggagaggucaugcugguccacagga

SEQ ID NO: 334291 - RNA, 64 nt, Homo Sapiens
aacccagggccagcuggaaguguggagcacacaugcuguggagcacacaugcuguggagauugc

SEQ ID NO: 334292 - RNA, 64 nt, Homo Sapiens
gaaguguggagcacacaugcuguggagcacacaugcuguggagauugcagugugucugagguuu

SEQ ID NO: 334293 - RNA, 64 nt, Homo Sapiens
gaacacaaugacuaucauuacugaugcagaccuggcuguggagagcagcuaauguguggcccag

SEQ ID NO: 334294 - RNA, 64 nt, Homo Sapiens
cugggaggagcugccagagagaagcaaaaaggcggcuguggaucgcccugggcugggcaccagu

SEQ ID NO: 334295 - RNA, 64 nt, Homo Sapiens
caccaccacguccugcagaacgagcccugccuuggcuguggagaagcacuccaggccgcuagca

SEQ ID NO: 334296 - RNA, 64 nt, Homo Sapiens
cccucuggacuagaguagaaaugcaggggaaacugcuguggauuugagaggcaaaguuggcuca

SEQ ID NO: 334297 - RNA, 64 nt, Homo Sapiens
acuaaccugugagaggggcccgagagaaggaacagcuguggaacaggcuuuuuacaccccaagu

SEQ ID NO: 334298 - RNA, 64 nt, Homo Sapiens
ggugagagacuuuggcccccucccucccuauaaggcuguggaaccugaggaaguagauacuuga

SEQ ID NO: 334299 - RNA, 64 nt, Homo Sapiens
gugucuugcacccaaacaaguuauagauuucaaugcuguggauauauaagaaucuuuuaugaga

SEQ ID NO: 334300 - RNA, 64 nt, Homo Sapiens
aaaauaacuuacuagagaaugcauauuuauauaugcuguggauggauuuuuaccaccuguguuu

SEQ ID NO: 334301 - RNA, 64 nt, Homo Sapiens
cccgggcccccugcugcgggagcaagcuucccuagcuguggaaccugggugugcugccugucug

SEQ ID NO: 334302 - RNA, 64 nt, Homo Sapiens
uggcugagucacagccaccugcaggaagggacaagcuguggagccuccccauucaggccuggug

SEQ ID NO: 334303 - RNA, 64 nt, Homo Sapiens
ggcuggggacugcgggacagaaggcagcaguggugcuguggaugucccagcccuucucgcugcc

SEQ ID NO: 334304 - RNA, 64 nt, Homo Sapiens
aggcuuggcaugccacccugugccuggcaaaggugcuguggaaugagaaggaguguucucuguc

SEQ ID NO: 334305 - RNA, 64 nt, Homo Sapiens
aguugcugcagucccaugaaagguugcugaggcugcuguggacccagaaauguggccuuugaag

SEQ ID NO: 334306 - RNA, 64 nt, Homo Sapiens
uggccaucgcaugggaggagacagcaucauggaugcuguggacacagggaauuuuggagaaacu

SEQ ID NO: 334307 - RNA, 64 nt, Homo Sapiens
aauguaugcuacacaucuugggcucacaagugaggcuguggaggccaggagguucaaguaugga

SEQ ID NO: 334308 - RNA, 64 nt, Homo Sapiens
ggagcaauugagaccccucaggaguuuccacacugcuguggacgggauagccagggcagaccug

SEQ ID NO: 334309 - RNA, 64 nt, Homo Sapiens
agccaggcuggaggcggcaggcggcaggcagcaggcuguggaggaggccccucggucagggagc

SEQ ID NO: 334310 - RNA, 64 nt, Homo Sapiens
ccagugaaacaacagcagagaaucauguuccuuugcuguggaacacauaagccccacaguuuuc

SEQ ID NO: 334311 - RNA, 64 nt, Homo Sapiens
gugcccagcagggggcugagcgaggcuuggaccugcuguggaggggugugagagggacagcuca

SEQ ID NO: 334312 - RNA, 64 nt, Homo Sapiens
gugcccagcagacguggugucgaggcuuggaccugcuguggaggggcgugagagggacggcuca

SEQ ID NO: 334313 - RNA, 64 nt, Homo Sapiens
cccacccacgguccucaccuggagcuguggccuggcuguggagggccgggugguggcucugagg

SEQ ID NO: 334314 - RNA, 64 nt, Homo Sapiens
cuugggcagcagcucagcaugggcagacaugggggcuguggauucuuccagggcggggauggca

SEQ ID NO: 334315 - RNA, 64 nt, Homo Sapiens
ccuguggaggggaaggggaaaccacccaucuccagcuguggagcgacaaggagcggcaggaauc

SEQ ID NO: 334316 - RNA, 64 nt, Homo Sapiens
cugguuuugaccaaaagugauggcuuugcggugggcuguggagguuaccuugaacucuccucuc

SEQ ID NO: 334317 - RNA, 64 nt, Homo Sapiens
gggucuccguucuuggugcuucaggagggucgcugcuguggaaggaaagcacccaaaguggugg

SEQ ID NO: 334318 - RNA, 64 nt, Homo Sapiens
gacaucuucaccgucuccauccaggaagaguugggcuguggaagucuugauuccaaauccuaaa

SEQ ID NO: 334319 - RNA, 64 nt, Homo Sapiens
uguacucgagcggcuccgggcggagaacaagucggcuguggagaugcggaaagcccugacggac

SEQ ID NO: 334320 - RNA, 64 nt, Homo Sapiens
accaguuggcuaggggagcagggggcccaccagagcuguggagaggggacccuaagacuccucg

SEQ ID NO: 334321 - RNA, 64 nt, Homo Sapiens
auacccaccgguggugugaucucugucucaguuuuaggauuaaagccuuaaauguuuaaguaaa

SEQ ID NO: 334322 - RNA, 64 nt, Homo Sapiens
uuucuuaaucaccuccacacaaaaaucuucauguuaggauuaauuuucuuuuuuuaacuggaug

SEQ ID NO: 334323 - RNA, 64 nt, Homo Sapiens
ccuaguuugucauaucacagcaacaauuccgagauaggauuauguaguacauaaauuuucuacu

SEQ ID NO: 334324 - RNA, 64 nt, Homo Sapiens
uaggggcagaucuugaauucgguacugggagaaguaggauuaguuaggguaggagugcuguaag

SEQ ID NO: 334325 - RNA, 64 nt, Homo Sapiens
ggcgugccaccaugccuggcacaucccagguagcuaggauuacacaagcaguucucaugucuca

SEQ ID NO: 334326 - RNA, 64 nt, Homo Sapiens
acaaccagaaacaaugugucuauuucugaaagaauaggauuaaugaucauacaaauggguuaau

SEQ ID NO: 334327 - RNA, 64 nt, Homo Sapiens
ugaauucugguuguaaaucugguuacagcauaacuaggauuauaaugcugccucauuuucacag

SEQ ID NO: 334328 - RNA, 64 nt, Homo Sapiens
cauuucuaguuccuuugacauuccauauaauuuuuaggauuaguuuguacuuauuuacaaaaca

SEQ ID NO: 334329 - RNA, 64 nt, Homo Sapiens
gcgcucccuggugcuugcccagcuuuuugaucuguaggauuaugccuuuugcaaaauuugggga

SEQ ID NO: 334330 - RNA, 64 nt, Homo Sapiens
uuucuuuuugugaaauuuccuguacagccuuuuguaggauuacuacagguuaaugugaguugag

SEQ ID NO: 334331 - RNA, 64 nt, Homo Sapiens
guuuuauauccuagagucaaggaacaaauuuccuuaggauuauaguauuacaugccauaaaaua

SEQ ID NO: 334332 - RNA, 64 nt, Homo Sapiens
aagaaacucaggaguaagcuaaguaaagauuugaagacagaagggcugggucuuuggccauaag

SEQ ID NO: 334333 - RNA, 64 nt, Homo Sapiens
uuuagcauuggcccaguaguuuuuuuaggcuuagagacagaaacaagggcccuacuacacuggc

SEQ ID NO: 334334 - RNA, 64 nt, Homo Sapiens
agaauauacucuuuaaaaugcauugaguaguuccagacagaagagaaaauguuuucuuugugcu

SEQ ID NO: 334335 - RNA, 64 nt, Homo Sapiens
uguuuucuuugugcucauugaaaucuguuaaggaagacagaaaaccccacacccaccaauaccu

SEQ ID NO: 334336 - RNA, 64 nt, Homo Sapiens
accugucuguucuuaaagauuucaugguuggcucagacagaacaaucaucuguuugacuucuuu

SEQ ID NO: 334337 - RNA, 64 nt, Homo Sapiens
uuugacuucuuugguuccucaugcagcagaaggaagacagaaagauagaaauugauuauuuuua

SEQ ID NO: 334338 - RNA, 64 nt, Homo Sapiens
ucagugacgaaggugcguuguucgugccgaaaugagacagaaaugauacaggguugguucucau

SEQ ID NO: 334339 - RNA, 64 nt, Homo Sapiens
agacaaaagguccagucucacaaagucaguuuggagacagaaaauacagcaguuucaaaaauga

SEQ ID NO: 334340 - RNA, 64 nt, Homo Sapiens
ucaguuuacagcacacgaaaugacauaaacuccaagacagaacccagcacaggaccuggugaca

SEQ ID NO: 334341 - RNA, 64 nt, Homo Sapiens
augcaggacagcauuucauaagcugcuaucuuugagacagaaagggggggacugggggaggggu

SEQ ID NO: 334342 - RNA, 64 nt, Homo Sapiens
acaguagaugagaauagaagauuaagagcuaaggagacagaaaguuaaauggcacuauguagua

SEQ ID NO: 334343 - RNA, 64 nt, Homo Sapiens
uauuuuguuguaugacagaaaggaaucauucaugagacagaaugaggcguuguggugaauaugc

SEQ ID NO: 334344 - RNA, 64 nt, Homo Sapiens
agagggaauaaggaucuuuuuccaucucuagugaagacagaaccaauacuaugccauaguguuc

SEQ ID NO: 334345 - RNA, 64 nt, Homo Sapiens
gcuggcuaggaggucucagcaagcuggucaggagagacagaagugauaaauucagugauagccc

SEQ ID NO: 334346 - RNA, 64 nt, Homo Sapiens
aaagacaaacagaaauagacacacacaccagcagagacagaaacagcaauagccaggacuccug

SEQ ID NO: 334347 - RNA, 64 nt, Homo Sapiens
agacugcucuaccaauagaucuuuguuuguuuugagacagaaucuugaucuguuacccaggcug

SEQ ID NO: 334348 - RNA, 64 nt, Homo Sapiens
gaccagccggagcagccggagcugaagcggaucaagacagaagacggcgagggcaucgucauug

SEQ ID NO: 334349 - RNA, 64 nt, Homo Sapiens
aacccaaaacccagcuggccuuaacacuccuuaaagacagaagucacacuugaacaaaacccac

SEQ ID NO: 334350 - RNA, 64 nt, Homo Sapiens
acuuaaacaccccacugucaacauuagaucaaugagacagaaaguuaacaaggauauccaggaa

SEQ ID NO: 334351 - RNA, 64 nt, Homo Sapiens
caauaaauguaauccagcauauaaacagaaccaaagacagaaaccacaugauuaucucaauaga

SEQ ID NO: 334352 - RNA, 64 nt, Homo Sapiens
uggggcuacguccauguggaggauagacagaaagagacagaagcaaacucagacacguggacag

SEQ ID NO: 334353 - RNA, 64 nt, Homo Sapiens
agacagaagcuggggcuacgacguggacagggauagacagaaagcugguuggccaaacucagac

SEQ ID NO: 334354 - RNA, 64 nt, Homo Sapiens
cugucaguuuggguccuccaaaugaaaaaugucaagacagaauuggacaugcaaaagauugacu

SEQ ID NO: 334355 - RNA, 64 nt, Homo Sapiens
ugagguauuuauuuauucauuugaguaacaaagcagacagaauacauagccaccauugguagua

SEQ ID NO: 334356 - RNA, 64 nt, Homo Sapiens
ccuagguuuugagauuuagagcaaugcauucuggagacagaaccagcagaacagccauuuuuca

SEQ ID NO: 334357 - RNA, 64 nt, Homo Sapiens
acugcuguauucaugaaucuugagaguguuccugagacagaauuaauggucauuugggaaaacu

SEQ ID NO: 334358 - RNA, 64 nt, Homo Sapiens
uuuuaaauaguggcaacuugggauucauucuggugauucugaaccuugccucauagcuuaaagu

SEQ ID NO: 334359 - RNA, 64 nt, Homo Sapiens
gagauuggagucugaauggaucuguuuuccaagagauucugagaaauuuuuguauucagcaguu

SEQ ID NO: 334360 - RNA, 64 nt, Homo Sapiens
ucuuaacugccagcagaaaaguaagauugauucugauucugaaguaaaauagaguuaaauguau

SEQ ID NO: 334361 - RNA, 64 nt, Homo Sapiens
cugaagucuuaacugccagcauguauguaagauugauucugauucaucuguaaaauagaguuaa

SEQ ID NO: 334362 - RNA, 64 nt, Homo Sapiens
gauaagccggcugggcaggagugccacaccuuuugauucugagcauuugauucugacuucugua

SEQ ID NO: 334363 - RNA, 64 nt, Homo Sapiens
gcaggagugccacaccuuuugauucugagcauuugauucugacuucuguacucugguggccacu

SEQ ID NO: 334364 - RNA, 64 nt, Homo Sapiens
aaaaguccagaacccauaaaaauggagccauucugauucugacagaguucuagggaggacagca

SEQ ID NO: 334365 - RNA, 64 nt, Homo Sapiens
agaaggacaagucuaagaagggcauaacaacagugauucugaagaaagaaaaacaaguguucag

SEQ ID NO: 334366 - RNA, 64 nt, Homo Sapiens
cauuucgccugagauauaagccaaugagcaggaagauucugagauggugaagcugaguuucugu

SEQ ID NO: 334367 - RNA, 64 nt, Homo Sapiens
cacugucaaugcuggguugcgccagcucuagguggauucugauucacccccugccugggccaug

SEQ ID NO: 334368 - RNA, 64 nt, Homo Sapiens
aaugagggaguuguaccacaaacaguacuacaaugauucugaagcacaguguauucagacagau

SEQ ID NO: 334369 - RNA, 64 nt, Homo Sapiens
aaugcauaugauuuugcaucagcuagacugaguugauucugaccagacuugaugguuuuaaguc

SEQ ID NO: 334370 - RNA, 64 nt, Homo Sapiens
uaguauuucacaguuuuugcuaauagaaaaugcugauucugauucugagaucaauuugugggaa

SEQ ID NO: 334371 - RNA, 64 nt, Homo Sapiens
uucacaguuuuugcuaauagaaaaugcugauucugauucugagaucaauuugugggaauuuuac

SEQ ID NO: 334372 - RNA, 64 nt, Homo Sapiens
gugucagccaaagccaugucacucugagagaacugauucugaggacaaguuagccaucuaccac

SEQ ID NO: 334373 - RNA, 64 nt, Homo Sapiens
aaaacauuagauaaaauaaaagauucaccggauggauucugaugaaaacgaaaacaaaguaaaa

SEQ ID NO: 334374 - RNA, 64 nt, Homo Sapiens
uuaggauguccauguccucaccacugucccauaggauucugauuguccuguggggagauucuga

SEQ ID NO: 334375 - RNA, 64 nt, Homo Sapiens
acugucccauaggauucugaaaguccuguggggagauucugacccaaagccaggauucugagga

SEQ ID NO: 334376 - RNA, 64 nt, Homo Sapiens
aaaguccuguggggagauucgucuccaaagccaggauucugaggcagaccucagaaucagaaac

SEQ ID NO: 334377 - RNA, 64 nt, Homo Sapiens
ugacugguuuauguuaagcuauguaaucaccagagauucugaaacacucuaauggcauuugaac

SEQ ID NO: 334378 - RNA, 64 nt, Homo Sapiens
aaugucugggcuucccauuggcauucuuuguuuggauucugagacaaaaauaaaacaaaauauu

SEQ ID NO: 334379 - RNA, 64 nt, Homo Sapiens
ucccuucucaaaucugcucauggcaaggcucggcgauucugauuagaccaaaaccacugacaga

SEQ ID NO: 334380 - RNA, 64 nt, Homo Sapiens
cuggaauuaggaccccauggaaggcuggauggaagauucugagcuuuugaagguagaguuuuag

SEQ ID NO: 334381 - RNA, 64 nt, Homo Sapiens
cccugccuugacaacaugaauuugcccucagaaagauucugauauuuuuauuuguuaauaauac

SEQ ID NO: 334382 - RNA, 64 nt, Homo Sapiens
uugaugcuucguggaaugcuauuucccagcacaugauucugaacgcugagcagaggugucucau

SEQ ID NO: 334383 - RNA, 64 nt, Homo Sapiens
gaggaggggauucuggaacugaauggcgcuucgggauucugaguagcaggggcagcaugcccag

SEQ ID NO: 334384 - RNA, 64 nt, Homo Sapiens
cccgggagggauuccggaauugaggggcacgcaggauucugagcaccaggggcagaggcggcca

SEQ ID NO: 334385 - RNA, 64 nt, Homo Sapiens
cuuacaucucccuuaaaaaauuaguucagauggugauucugaaguagacauuggacagauauuu

SEQ ID NO: 334386 - RNA, 64 nt, Homo Sapiens
aaagagcaauuuaucaaaauuccccaucaaugcugauucugagagucauaaggauaauauauuu

SEQ ID NO: 334387 - RNA, 64 nt, Homo Sapiens
gauggguucguguccagucccgggggucugauauggccaucacaggcuggguguucccagcagc

SEQ ID NO: 334388 - RNA, 64 nt, Homo Sapiens
ggcuugggggcuugacgcccuuccccuugccccaggccaucaucuccccaccucuccuccccuc

SEQ ID NO: 334389 - RNA, 64 nt, Homo Sapiens
uguggccucugagaccgcccugguuggcagcgggggccaucaccccacaugacaguguccugcc

SEQ ID NO: 334390 - RNA, 64 nt, Homo Sapiens
aggacgaggugcuguuggcacuggcagagcaagaggccaucagaguucucugugcccucaggga

SEQ ID NO: 334391 - RNA, 64 nt, Homo Sapiens
agcugggagaggcugaggauggcagggcuggaagggccaucagcgugacccucauuuucaagaa

SEQ ID NO: 334392 - RNA, 64 nt, Homo Sapiens
ugauguucagguagaccugggcgccugggaacgaggccaucagcugccaugcacauaacaaaga

SEQ ID NO: 334393 - RNA, 64 nt, Homo Sapiens
ggcugaccccaugcucagccucuaggggacggcaggccaucaggcugggggcugugcuaugugg

SEQ ID NO: 334394 - RNA, 64 nt, Homo Sapiens
ccggacacaggcuucugggggaagggucucccuuggccaucacgggaauggaguccaugcuaga

SEQ ID NO: 334395 - RNA, 64 nt, Homo Sapiens
cagagacuucaaaugcugaugagacaguggugauggccaucagacagaaaaaggacaaggacau

SEQ ID NO: 334396 - RNA, 64 nt, Homo Sapiens
uuagcagggacgggguguagccccagguuugaaaggccaucagagagccaucuuggacucuccu

SEQ ID NO: 334397 - RNA, 64 nt, Homo Sapiens
uguuauaauaaauauaaauuuguggccaucauuuggccaucauuuauuuacaagcaauggcuuu

SEQ ID NO: 334398 - RNA, 64 nt, Homo Sapiens
uggccaucauuuguuauaaugcaauggcuuuuguggccaucauuugaauuauaauuauuuacaa

SEQ ID NO: 334399 - RNA, 64 nt, Homo Sapiens
aagggaaguugacuaagucaaauaucucucaugacagugacaccgucacuguuccacccggugu

SEQ ID NO: 334400 - RNA, 57 nt, Homo Sapiens
uggauuagggugugucauacuaugcuccagugacagauuuaucucugcccaguauag

SEQ ID NO: 334401 - RNA, 64 nt, Homo Sapiens
aucucggcucacugaaaccucccagacuggaaugcagugacacagacaaagucucacuguguca

SEQ ID NO: 334402 - RNA, 64 nt, Homo Sapiens
aaagccuggccuaauuguucgcugguccccuccucagugacaucccuacuguccucagaggcgu

SEQ ID NO: 334403 - RNA, 64 nt, Homo Sapiens
ggaagccaguacagaucuuugagaggucuguguacagugacagguauaucuuugcaaagaaucu

SEQ ID NO: 334404 - RNA, 64 nt, Homo Sapiens
ucuuugcaaagaaucuuuuugaaaaugguucccucagugacaucgaguggcauaucuaucagga

SEQ ID NO: 334405 - RNA, 64 nt, Homo Sapiens
gccaacuuaagacacacaaaaugcuggucuggaacagugacauuuggacuggagaccaggauuc

SEQ ID NO: 334406 - RNA, 64 nt, Homo Sapiens
cacacacugaaggccugaggcacagagguccacucagugacaaagccugaggaagacgagaugu

SEQ ID NO: 334407 - RNA, 64 nt, Homo Sapiens
ugaugcccugugugacuugguuucuauuacaaagcagugacaaaaaguuaaaaauacuuauaua

SEQ ID NO: 334408 - RNA, 64 nt, Homo Sapiens
auuuuagucucuuacuaugacaaggggaauuuugcagugacaggucaacgucaaugccaaaagc

SEQ ID NO: 334409 - RNA, 64 nt, Homo Sapiens
uacggggucuugcucugucucccaggcuggagugcagugacacaaucucagcucacugugaccu

SEQ ID NO: 334410 - RNA, 64 nt, Homo Sapiens
ugaggagaauugcggcgagacaagcauggaaaaucagugacaucugauuggcagaugagcuuau

SEQ ID NO: 334411 - RNA, 64 nt, Homo Sapiens
acucagauuuugugagcagugaaguuuaacagagcagugacauuuaacaaagcagugaaguuua

SEQ ID NO: 334412 - RNA, 64 nt, Homo Sapiens
augagaaacugagccaaggccacauagcuaccuacagugacagaaucaaaauucaaacucaggu

SEQ ID NO: 334413 - RNA, 64 nt, Homo Sapiens
gaaacaguagaguaggaguccagguaaaaugggucagugacacugacuugaguagucuuugguc

SEQ ID NO: 334414 - RNA, 64 nt, Homo Sapiens
acagcaacuucagggaucugccaucacuuaaauacagugacaggagaauaauucaauugaauau

SEQ ID NO: 334415 - RNA, 64 nt, Homo Sapiens
gaacacagagagggacaaacugcugguuacuagucagugacagaggucuguugaugcaugccag

SEQ ID NO: 334416 - RNA, 64 nt, Homo Sapiens
aaugcugaagagacaggcaucgggccugggagcucagugacauaagacgagaaccgucuuuacc

SEQ ID NO: 334417 - RNA, 64 nt, Homo Sapiens
ugauauuuguuuugaaaguggcagggcuauauuucagugacagccccuuuaccugccaagacaa

SEQ ID NO: 334418 - RNA, 64 nt, Homo Sapiens
aaacuaacuccaggauucagaagcuaguuaaugucagugacauugaauaaaaugacaauaacua

SEQ ID NO: 334419 - RNA, 64 nt, Homo Sapiens
gaaggaaguuaucugcuggggguccagccuugaucagugacagccaccacaguaauaggcacug

SEQ ID NO: 334420 - RNA, 64 nt, Homo Sapiens
ucaaucacugaaaaugugcugugacacguuuggccagugacauucacugucaugugcgaacaca

SEQ ID NO: 334421 - RNA, 64 nt, Homo Sapiens
uuuggccagugacauuucaagucaugugcgaacacagugacacgggaguggauccagcuucacu

SEQ ID NO: 334422 - RNA, 64 nt, Homo Sapiens
gguuaaagcugugugucccucccaguggcuguggcagugacagugacacccacacccacaguaa

SEQ ID NO: 334423 - RNA, 64 nt, Homo Sapiens
agcugugugucccucccaguggcuguggcagugacagugacacccacacccacaguaaagagga

SEQ ID NO: 334424 - RNA, 64 nt, Homo Sapiens
gggaaauaguuauagaaaaugaaaacuuagcagucagugacaugacucagccuaguaaggaagu

SEQ ID NO: 334425 - RNA, 64 nt, Homo Sapiens
ucacauccgguguaaaaaaagacauuagcauguccagugacaagcuucauaaggaguaacgacu

SEQ ID NO: 334426 - RNA, 64 nt, Homo Sapiens
ccccaggcaccucacaggccccaggaaaggcccagccaccgaagccgccuguggacagccugag

SEQ ID NO: 334427 - RNA, 64 nt, Homo Sapiens
ucagccucccaaaaugcugggauuacaggcgugagccaccgagccuggccgguuaacaucuuuu

SEQ ID NO: 334428 - RNA, 64 nt, Homo Sapiens
gcagccagccccuccccaggggccguccuccggggccaccgaccagaccugugggugugagccu

SEQ ID NO: 334429 - RNA, 64 nt, Homo Sapiens
gcucccccaccuguaccacccuggggugcugccugccaccgagacggcaggagucccacuccuc

SEQ ID NO: 334430 - RNA, 64 nt, Homo Sapiens
gccccgccuccagcagccgguggccgccaccaccgccaccgagaagcaguauagccacccggcc

SEQ ID NO: 334431 - RNA, 64 nt, Homo Sapiens
gucuucucauuuuauuucagcugcccagcaggucgccaccgagugggcccuaggguacagggug

SEQ ID NO: 334432 - RNA, 64 nt, Homo Sapiens
ugcucagagauaauauaagcguaaaugaggaauagccaccgagagaaugacuaaaacaucuuaa

SEQ ID NO: 334433 - RNA, 64 nt, Homo Sapiens
aggggcagcuucaugaccgagugagcccccugaugccaccgagcgaagcaccucuccgagccau

SEQ ID NO: 334434 - RNA, 64 nt, Homo Sapiens
caagauggcuaaggagaacaggggggaugauggggccaccgagaggccgaagaaggccaaggag

SEQ ID NO: 334435 - RNA, 64 nt, Homo Sapiens
ucauuuucauuaaaaaugaaagccaaauuuauaugccaccgauugcaggacacaagcacaguuu

SEQ ID NO: 334436 - RNA, 64 nt, Homo Sapiens
ccgggcuccgcgugccccgcccgcuggagcaccugccaccgaggcgcgcguggggccacugccg

SEQ ID NO: 334437 - RNA, 64 nt, Homo Sapiens
ccacgugagugagaugagccguaccucauccucggccaccgaaaaucucgcuucaggaagaaaa

SEQ ID NO: 334438 - RNA, 64 nt, Homo Sapiens
gugaguacucauaaaggacacuggaucaaguucagccaccgaauugcuuuuaucaguguuaaag

SEQ ID NO: 334439 - RNA, 64 nt, Homo Sapiens
uugaccucccaaagugcugggauuacagacaugagccaccgagccuggccaauuuuuguguuuu

SEQ ID NO: 334440 - RNA, 64 nt, Homo Sapiens
cucucccacugcagaacauggccucuagauuaaugccaccgauucaggaacaccuccgacaguc

SEQ ID NO: 334441 - RNA, 64 nt, Homo Sapiens
gggcaagaggagcucaagucggucugggcccguugccaccgacucccaccuccagcacccaugc

SEQ ID NO: 334442 - RNA, 64 nt, Homo Sapiens
gccugcagaagaucaugugaaguguuuccugucagccaccgaguguacucccuggucagggaca

SEQ ID NO: 334443 - RNA, 64 nt, Homo Sapiens
cuucuccucugagaaggcucccggcugccuccccgccaccgagcuuguagccugaaugccuggc

SEQ ID NO: 334444 - RNA, 64 nt, Homo Sapiens
gccccggguggugagcgggcaggaaccuggcgccgccaccgagacugagccuccugcagacggg

SEQ ID NO: 334445 - RNA, 64 nt, Homo Sapiens
uacaaaguaaaauaaauaaaauaauaacugacaugccaccgaaguggagcugagagacaguaaa

SEQ ID NO: 334446 - RNA, 64 nt, Homo Sapiens
uccuuaucgaaacucauuuugaucuaacaagauagccaccgagaaauaagccucagcuuucuaa

SEQ ID NO: 334447 - RNA, 64 nt, Homo Sapiens
ucggccuaccgaagugcuaggauuacagacguaagccaccgagccuggucuaguuugcauuuuu

SEQ ID NO: 334448 - RNA, 64 nt, Homo Sapiens
ucugccucccaaagugcugggaucacaggcaugagccaccgaacccagccuuauucugcuuaaa

SEQ ID NO: 334449 - RNA, 64 nt, Homo Sapiens
guugccaucgugcugggacgacaccagcucuauugccaccgaugaguagcugaggucagugugc

SEQ ID NO: 334450 - RNA, 64 nt, Homo Sapiens
agguucuagcucuagaaaggcauggugggaaacagccaccgagacacagaccagacucgcuucc

SEQ ID NO: 334451 - RNA, 55 nt, Homo Sapiens
agaacugcauuagccgcugaggagagccaccgaaggccccaacaggggaugcuca

SEQ ID NO: 334452 - RNA, 64 nt, Homo Sapiens
ggcuggggcuggggcugaccaugcugaccuggaggccaccgagagggacuguguuucuuuaagg

SEQ ID NO: 334453 - RNA, 64 nt, Homo Sapiens
cuccuggucugucuccaggcccccagagauaucagccaccgaguuucccugugcuggcuggagu

SEQ ID NO: 334454 - RNA, 52 nt, Homo Sapiens
agaugcccaugccuguguagccgccaccgagggacagccgagggaccgaugg

SEQ ID NO: 334455 - RNA, 64 nt, Homo Sapiens
caugguggaggagaugcaggucacaacacuccuggccaccgagcgaccgggcggugcggcuguu

SEQ ID NO: 334456 - RNA, 64 nt, Homo Sapiens
ucaccacagacacaguggagcuugucccauucaagccaccgagccacagacagguugucaucag

SEQ ID NO: 334457 - RNA, 64 nt, Homo Sapiens
gccccucagcagaggaaggggaguccccuccuccgccaccgagaguccugugcuucggaaugaa

SEQ ID NO: 334458 - RNA, 64 nt, Homo Sapiens
uccuaauuuucuuuguucaauaugaaaguccucugccaccgagugaggagagcaaauaucauua

SEQ ID NO: 334459 - RNA, 64 nt, Homo Sapiens
ugcuucucaaauucacuucaccggagcuggccaagccaccgacuuguucuggaaaccaggcucg

SEQ ID NO: 334460 - RNA, 64 nt, Homo Sapiens
auguuacaguguauaaaugagggcacuaaugucugccaccgacuacuugucuggaggcccagcu

SEQ ID NO: 334461 - RNA, 64 nt, Homo Sapiens
cagcugccagggucccuggagauugggccucacagccaccgauucgugccuuugauuucggaca

SEQ ID NO: 334462 - RNA, 64 nt, Homo Sapiens
ggguaagggcaggccccuccaacaggugcucacagccaccgaggcaggggcugcagccacccac

SEQ ID NO: 334463 - RNA, 64 nt, Homo Sapiens
aaagugugggcagaauuacaauuacaaagugccagccaccgaauaaagauaaaaguucaguucu

SEQ ID NO: 334464 - RNA, 64 nt, Homo Sapiens
aggacauuucuaccuaggcaaauguaucacugaggccaccgaaaaaaugaccauaaacaguauc

SEQ ID NO: 334465 - RNA, 64 nt, Homo Sapiens
cauaguguagaacagucccgaucaucaggucuuugccaccgagggucauuuuuagcucgaccac

SEQ ID NO: 334466 - RNA, 64 nt, Homo Sapiens
gggcugggccuaucaggaggccaggaacacggaggccaccgaggcagcuccuuccuuccuuccc

SEQ ID NO: 334467 - RNA, 64 nt, Homo Sapiens
cugcucucugcgggugacagguggcuucugagcggccaccgaugugaaggguuacuuguagguc

SEQ ID NO: 334468 - RNA, 64 nt, Homo Sapiens
cauuggaguguuagaaacuagaauagaccucuccgccaccgagcugcugugucacgcccucagc

SEQ ID NO: 334469 - RNA, 64 nt, Homo Sapiens
gacuccaaucccagaauugcucacugagcgcuaugccaccgaagcguugaccugaacauauuag

SEQ ID NO: 334470 - RNA, 64 nt, Homo Sapiens
cuggaggccgcugagguccugguggaacacacgugccaccgaggagcugucaccggccugaccg

SEQ ID NO: 334471 - RNA, 64 nt, Homo Sapiens
cagaucuuggggagcugccccacaagccccgcuggccaccgagggcugcagccgcugcgcugcc

SEQ ID NO: 334472 - RNA, 64 nt, Homo Sapiens
gccuucaacacagcuugucuugucaauuguacgcgccaccgagugcagaggccugcagggccuc

SEQ ID NO: 334473 - RNA, 61 nt, Homo Sapiens
ccuugcuucuccagauuuagcauccugcagagccaccgagaaaauaaaaaagcugggcuug

SEQ ID NO: 334474 - RNA, 64 nt, Homo Sapiens
cugcuccuaaggguagaaaacuccaggguccccugccaccgacugcccagccacuccaagcccc

SEQ ID NO: 334475 - RNA, 64 nt, Homo Sapiens
uuguuuuaucacucuggacugugcagagccaccugccaccgagaucugcauuccgacugccuau

SEQ ID NO: 334476 - RNA, 64 nt, Homo Sapiens
gugguucuggagccauugugggugagggucgagggccaccgaggucccgcgcaccgcugccugc

SEQ ID NO: 334477 - RNA, 64 nt, Homo Sapiens
ugcccuggaugggcugcuggccucgggccgcugggccaccgagcggccaaacugcaggcaacca

SEQ ID NO: 334478 - RNA, 64 nt, Homo Sapiens
ugggacuucuggcaucacuuuguggucaucaugugccaccgagccagcucugagccaucggcuu

SEQ ID NO: 334479 - RNA, 64 nt, Homo Sapiens
gcaguaucgguuugagaucauccuugggaacccggccaccgaacucaguguugcaacucacuuu

SEQ ID NO: 334480 - RNA, 64 nt, Homo Sapiens
aggacugcggguugcuggcuuguacaccgcagcugccaccgagacaccagccucugauggcuca

SEQ ID NO: 334481 - RNA, 64 nt, Homo Sapiens
agaacuuugaugacgagugaugccaggaagccaggccaccgaagcccccacccuacccuuauuc

SEQ ID NO: 334482 - RNA, 64 nt, Homo Sapiens
cagcuguccccgauaccacgagcugcugcgggaggccaccgaggccgccgaguaccaggaggcc

SEQ ID NO: 334483 - RNA, 64 nt, Homo Sapiens
gagcagcucgguccagugacgaccuggcaguggagccaccgagccgcuguggggagcgcgcccg

SEQ ID NO: 334484 - RNA, 64 nt, Homo Sapiens
ccaaucaugguaaaaauguguaagauuccuagaagccaccgaauagaagauugcuuaauucaca

SEQ ID NO: 334485 - RNA, 64 nt, Homo Sapiens
gcuggaacccagccaguggggcgccugcccaccugccaccgacuugauccccgcccagaaguag

SEQ ID NO: 334486 - RNA, 64 nt, Homo Sapiens
gcagccugcagagccacagucagccugcccacaugccaccgagcaaacgcaucuugcuuuucac

SEQ ID NO: 334487 - RNA, 64 nt, Homo Sapiens
agcugagacuagaauucaggguccucacucccaggccaccgaaccaugcagccccuucuuuggg

SEQ ID NO: 334488 - RNA, 64 nt, Homo Sapiens
uguucacuagugaugugugguaaacagucaaaaugccaccgagcggguaucuugcccuauaaga

SEQ ID NO: 334489 - RNA, 64 nt, Homo Sapiens
caggagccuggacccggccucccggggcugcggcgccaccgagcccggcaaaugcgcacgaccu

SEQ ID NO: 334490 - RNA, 64 nt, Homo Sapiens
gcagguguuuccuggguaguaauuuacacugcuggccaccgaagugagcagagagggaaagauu

SEQ ID NO: 334491 - RNA, 64 nt, Homo Sapiens
gaccccgauuaaacccacacccugcagcugcccugccaccgacaggcaucaccaacacggccuc

SEQ ID NO: 334492 - RNA, 64 nt, Homo Sapiens
auaugcuguguaucucaccagguagcugucaggggccaccgagagugucguuaaaaaugggcau

SEQ ID NO: 334493 - RNA, 64 nt, Homo Sapiens
uucuaugauaaacauguauuuuuguauuacuuagguucuuaaauuaaagguaauccuuacuuuc

SEQ ID NO: 334494 - RNA, 64 nt, Homo Sapiens
aaagguaauccuuacuuucuuuuguauuacuuagguucuuaauuuaaagguaauccuuacuuuc

SEQ ID NO: 334495 - RNA, 64 nt, Homo Sapiens
gccagggucugcugcacugcuguucugauaauagguucuuaacauuguauguauauguguuugc

SEQ ID NO: 334496 - RNA, 64 nt, Homo Sapiens
uucugcucagccacugggcucuuucacuuuuuuaguucuuaaaaauuuauuuuuaaguucuaaa

SEQ ID NO: 334497 - RNA, 64 nt, Homo Sapiens
uuuauuuuuaaguucuaaaauaaaauaaaaauaaguucuuaaaauuuauuuuuuuccugaauaa

SEQ ID NO: 334498 - RNA, 64 nt, Homo Sapiens
ugcccugaaagaauaauagggauuauaccugucuguucuuaaagauuucaugguuggcucagac

SEQ ID NO: 334499 - RNA, 64 nt, Homo Sapiens
uucuuuauuggaaugugguuguaauccuuguucaguucuuaaguuucgguuuuuuuuaaaaaca

SEQ ID NO: 334500 - RNA, 64 nt, Homo Sapiens
ccucucuggcauuucagagccagaugcuuccagaguucuuaaugguaaaaugucuaccaguagc

SEQ ID NO: 334501 - RNA, 64 nt, Homo Sapiens
caguauccucuggauaguugcaguuuacaauaauguucuuaaaauguaaaugaauagagaguau

SEQ ID NO: 334502 - RNA, 64 nt, Homo Sapiens
aguucaugugaaaaucaugaaaacuagguaacagguucuuaaaugugaugagucuugaagcugg

SEQ ID NO: 334503 - RNA, 64 nt, Homo Sapiens
uggccuuggaaggguaucacgaauaacaucugagguucuuaaccauaauucuccacuguguuua

SEQ ID NO: 334504 - RNA, 64 nt, Homo Sapiens
ugggguaaaacccaugguuauguggaacauaacuguucuuaaaaagucaauuauaauuuguaac

SEQ ID NO: 334505 - RNA, 64 nt, Homo Sapiens
caaaauaagagucugaggauuucuucuuacuggcguucuuaaaggucucuaaaauuaaagaaca

SEQ ID NO: 334506 - RNA, 64 nt, Homo Sapiens
gcuacaugcaacucccagauuggaagccaaaccaguucuuaaauucuugaugauauauaaaaau

SEQ ID NO: 334507 - RNA, 64 nt, Homo Sapiens
acuagaguuaaacuugucuauguuucuuccacauguucuuaaguuccuggucuguaacuugaau

SEQ ID NO: 334508 - RNA, 64 nt, Homo Sapiens
uuggcaugucacauuuuucuuucuuaagaaaccuguucuuaaugcauugauaauuuuuauuuag

SEQ ID NO: 334509 - RNA, 64 nt, Homo Sapiens
aaccuguucuuaauguuggcauaauuuuuauuuaguucuuaagagcauauaguguuuuucauug

SEQ ID NO: 334510 - RNA, 64 nt, Homo Sapiens
uugaagaggguauuuuauuguuuuuuaaaaaaagguucuuaaacauuauuugaaauaguuaaua

SEQ ID NO: 334511 - RNA, 64 nt, Homo Sapiens
auuauuuauaaguauagauugugaauuuuuccauguucuuaaaauuauuuuuaucuuuuuucau

SEQ ID NO: 334512 - RNA, 64 nt, Homo Sapiens
uuauaaaauggaaaucaaauuguacauuagcagaguucuuaagcuuuuugaauugaaggagacc

SEQ ID NO: 334513 - RNA, 64 nt, Homo Sapiens
aucucugaccugagaaaaaacaacuuugacccuuguucuuaaaaugcuuuaaccuugaaguugc

SEQ ID NO: 334514 - RNA, 64 nt, Homo Sapiens
gucccagcuccagguggcguuuugucauugucugguucuuaagacguaggcuggggcuuguguc

SEQ ID NO: 334515 - RNA, 64 nt, Homo Sapiens
uguuaugucccuaguggcuugucuuuuucucuaaguucuuaacagaguuaugagcccugauuuu

SEQ ID NO: 334516 - RNA, 64 nt, Homo Sapiens
aaaguauacugaccuaagauucucauuaguuuuaguucuuaaaacgaauaguaaaugauuucac

SEQ ID NO: 334517 - RNA, 64 nt, Homo Sapiens
ugcuuggagaauuugcucuuuuuuuggcauauaaguucuuaagaauguccguccuuugucauau

SEQ ID NO: 334518 - RNA, 64 nt, Homo Sapiens
uucugacaguauaauuuauugaguuacuagggagguucuuaaauccucauaucuggaaacuugu

SEQ ID NO: 334519 - RNA, 64 nt, Homo Sapiens
aaaaaaauagacuaaacaaaucacaaauuguucaguucuuaaaauguaauuaugucacacacac

SEQ ID NO: 334520 - RNA, 64 nt, Homo Sapiens
cccauggauccuuucucagacuuaaaguucugaaguucuuaaagacuuaagaacuucugaaguu

SEQ ID NO: 334521 - RNA, 64 nt, Homo Sapiens
uucugaaguucuuaaagcccuaagaacuucugaaguucuuaaaguuacuugagcuucagcaacu

SEQ ID NO: 334522 - RNA, 64 nt, Homo Sapiens
uuugaauuuuauggugagaucaaagugaacucuuguucuuaaaugauuccugagcaaauucccu

SEQ ID NO: 334523 - RNA, 64 nt, Homo Sapiens
uuugucuuucugaauaauagauacacacuuucuaguucuuaauaaauugaauucaaauaaaauc

SEQ ID NO: 334524 - RNA, 64 nt, Homo Sapiens; identical to SEQ ID NO: 334518

SEQ ID NO: 334525 - RNA, 64 nt, Homo Sapiens; identical to SEQ ID NO: 334519

SEQ ID NO: 334526 - RNA, 64 nt, Homo Sapiens
acgggccuugcucuuguggauagguuuccagggaggagccaaacccaggcucuggacuaggugc

SEQ ID NO: 334527 - RNA, 64 nt, Homo Sapiens
uugaggacugcuggugaccucacuguggcagaugggagccaagcgcugcugggaucggaccagc

SEQ ID NO: 334528 - RNA, 64 nt, Homo Sapiens
ucaacucugggccucuggaggacgggggcguuggggagccaaaggugaucuggaaggcaggcag

SEQ ID NO: 334529 - RNA, 64 nt, Homo Sapiens
gaaggcugaagccagcuuggccaggccagacccaggagccaagagguauggaaaccugccggcu

SEQ ID NO: 334530 - RNA, 64 nt, Homo Sapiens
caggacccugcgugugagcgccccugcugggucaggagccaacaguacauccgcccaccauguc

SEQ ID NO: 334531 - RNA, 64 nt, Homo Sapiens
ccucaccccacaaggggcagugugcccugggggaggagccaagccacccugcugaagaucacuc

SEQ ID NO: 334532 - RNA, 64 nt, Homo Sapiens
auggauuugaggcgugugaauacugcagcuugaaggagccaaccauucuuuaacaggacaaacu

SEQ ID NO: 334533 - RNA, 64 nt, Homo Sapiens
ccucggcgcucaccuaagccgcagcagcuggggaggagccaaagcccggcgcagugggaagcuc

SEQ ID NO: 334534 - RNA, 64 nt, Homo Sapiens
gucccuggaccagccuccuguuugcaggcccagaggagccaagucauuaaaauggaaguggauu

SEQ ID NO: 334535 - RNA, 64 nt, Homo Sapiens
ccaucuucauggagggggucauuucagagcccucggagccaaugaacagcuccuccucuuggag

SEQ ID NO: 334536 - RNA, 64 nt, Homo Sapiens
uggucuucccgagggucaguggaucccugugccaggagccaacccaggugcccaagaagaugga

SEQ ID NO: 334537 - RNA, 64 nt, Homo Sapiens
ccgccagccacccccucuggccuugggucagacuggagccaacagaggggggacccggcuggcc

SEQ ID NO: 334538 - RNA, 64 nt, Homo Sapiens
gcugugauuaccaucaguccauuuuaccgaggaaggagccaagguccaggcccacugaaggacu

SEQ ID NO: 334539 - RNA, 64 nt, Homo Sapiens
uuuaaagcuuuauaugccucaaauaucagggaaaggagccaaguccuugguauuuaguuuggug

SEQ ID NO: 334540 - RNA, 64 nt, Homo Sapiens
uugcgccacugcacuccagcgcggagcuugcaguggagccaagagaauggugugaacccgggag

SEQ ID NO: 334541 - RNA, 64 nt, Homo Sapiens
cuuuguccuuuagccagcacucccagccucaguuggagccaaaguuugaaggcccagucuucuc

SEQ ID NO: 334542 - RNA, 64 nt, Homo Sapiens
acuggcggguggugugugugauuugaagagaaaaggagccaagaaguuuuguuccaucuuggau

SEQ ID NO: 334543 - RNA, 64 nt, Homo Sapiens
cacccagacccgcguccaccgaagugggagcuggggagccaaucccugcccuggggcucccagg

SEQ ID NO: 334544 - RNA, 64 nt, Homo Sapiens
aagccggacacggcuucacuagugucccaagccgggagccaacguggccuguggcacagcccug

SEQ ID NO: 334545 - RNA, 64 nt, Homo Sapiens
gguccagcgucacuccagugccccagccagagguggagccaaguaggccccgggcuucccuucu

SEQ ID NO: 334546 - RNA, 64 nt, Homo Sapiens
agaguaacaagccaaaugaaaagaaccugcaacuggagccaagaccuacaacucauggaaggua

SEQ ID NO: 334547 - RNA, 64 nt, Homo Sapiens
uaacagaugggcuggaaguagccuggcuuagcaaggagccaacauucuguaauaaaagcaaaca

SEQ ID NO: 334548 - RNA, 64 nt, Homo Sapiens
ccggcccuuuggagccggcaccgugcugcuguugggagccaagacccagccuccagggacugaa

SEQ ID NO: 334549 - RNA, 64 nt, Homo Sapiens
cccuucugauggaaggcgggucugauggaaggugggagccaacaaaggugggagccaacacccu

SEQ ID NO: 334550 - RNA, 64 nt, Homo Sapiens
cccuucugauggaaggugggucugauggaaggugggagccaacaaaggugggagccaacacccu

SEQ ID NO: 334551 - RNA, 64 nt, Homo Sapiens; identical to SEQ ID NO: 334550

SEQ ID NO: 334552 - RNA, 64 nt, Homo Sapiens; identical to SEQ ID NO: 334550

SEQ ID NO: 334553 - RNA, 64 nt, Homo Sapiens
cccuucugauggaaggugggucugauggaaggugggagccaacaguuucccugggccagcaucu

SEQ ID NO: 334554 - RNA, 64 nt, Homo Sapiens
agacgguguuauugugaagguggcauucaucugcggagccaaaacccagccaucggggaagggu

SEQ ID NO: 334555 - RNA, 64 nt, Homo Sapiens
gacuuuuguuuagucuuucuaagaaauagaucauggagccaagugaagugcacuuugucaaaug

SEQ ID NO: 334556 - RNA, 64 nt, Homo Sapiens
aguuuggugauacugucaagcccuauccuucucugccucuuaacuccuucacgaggaaucuggg

SEQ ID NO: 334557 - RNA, 64 nt, Homo Sapiens
ucucugccucuuaacuccuucacgaggaaucugggccucuuauuucguuucuggggacugcauu

SEQ ID NO: 334558 - RNA, 64 nt, Homo Sapiens
accgccccucaccaacccagagaaccugcuuuacuuugcccagggacuuccuccccaugugaac

SEQ ID NO: 334559 - RNA, 64 nt, Homo Sapiens
auuggccagaagaagcuuaagugggcagacacuguuugcccaguguuugugcaaggauggagug

SEQ ID NO: 334560 - RNA, 64 nt, Homo Sapiens
uucuuuuuuuuuuuucaagacagggucucgcucuuuugcccaggauggaguacaguggcauggu

SEQ ID NO: 334561 - RNA, 64 nt, Homo Sapiens
aagaggccaagauccugauucagaggaggcauccuuugcccagagcugcuuagcuaaucugacc

SEQ ID NO: 334562 - RNA, 64 nt, Homo Sapiens
uuccuucuuugugccuccuuccaaaccacaguuauuugcccaaacuaccucucguggcugguuu

SEQ ID NO: 334563 - RNA, 64 nt, Homo Sapiens
aaacccuugaaccaguguccuagaccagaugauuuuugcccauguguauccccauuuaaauucc

SEQ ID NO: 334564 - RNA, 64 nt, Homo Sapiens
agggcaggugggcagggagcagacagggucuggcuuugcccagagggcacgggcuuucccaccu

SEQ ID NO: 334565 - RNA, 64 nt, Homo Sapiens
ccacucgggacaccuggaugguuucucuuaggacuuugcccaccuccuucucauggcacuugcu

SEQ ID NO: 334566 - RNA, 64 nt, Homo Sapiens
ccuauucuaagauuugcagauuauacaaaaaguauuugcccauuuuugagaagcuuguuauuca

SEQ ID NO: 334567 - RNA, 64 nt, Homo Sapiens
uacauggagcacaaaauuuauguuucauuuauaauuugcccaaaauaauuugauuugauaugau

SEQ ID NO: 334568 - RNA, 64 nt, Homo Sapiens
gcaaaccuaaauuuaugaccuugggaccaaguaguuugcccaugauugauugucauauuucaug

SEQ ID NO: 334569 - RNA, 64 nt, Homo Sapiens
ugagauccaguuuuuuguuguaugaucuauguuguuugcccaauaauuuaguuaauaaaauaau

SEQ ID NO: 334570 - RNA, 64 nt, Homo Sapiens
cauguagaggacaagauuuauuuucuuuccucccuuugcccaguagccacaucugguuuacuca

SEQ ID NO: 334571 - RNA, 64 nt, Homo Sapiens
auaaaaagaaauuguagaaauaaacacauuaaaauuugcccagcugucgucuaagcccucuuga

SEQ ID NO: 334572 - RNA, 64 nt, Homo Sapiens
uuuuuuuuuuuuuuuugagauggaauuuugcucuuuugcccagucuggagugcaguggcaugau

SEQ ID NO: 334573 - RNA, 64 nt, Homo Sapiens
auguguguguguguguguguguguguuuuuccuguuugcccagcagugcauuguggguuccaag

SEQ ID NO: 334574 - RNA, 64 nt, Homo Sapiens
aagugagccuguuuggaugauggaugccauuccuuuugcccaguuaaauguucaccaaucauuu

SEQ ID NO: 334575 - RNA, 64 nt, Homo Sapiens
aauauggagaucuuccuuuaccccucaacuuuaauuugcccaguuauaccucaguguuguagca

SEQ ID NO: 334576 - RNA, 64 nt, Homo Sapiens
auucagcaaauauuaguuuguccuccuuuaauuguuugcccaaaucuuccacccaucuuuuuuc

SEQ ID NO: 334577 - RNA, 64 nt, Homo Sapiens
aaggagaauuucucuuagaggguggcaaaaugccuuugcccagugucccuauuuuaggcaucuu

SEQ ID NO: 334578 - RNA, 64 nt, Homo Sapiens
uuuaauaucaacucucacuccugaauucaguugcuuugcccaagauaggaguucucugaugcag

SEQ ID NO: 334579 - RNA, 64 nt, Homo Sapiens
augucuacagaaaaugcuggcugagcugaacacauuugcccaauuccaggugugcacagaaaac

SEQ ID NO: 334580 - RNA, 64 nt, Homo Sapiens
aauccgggacaccugggccgggcuguagaucagguuugcccacuugauugagaaagauguucca

SEQ ID NO: 334581 - RNA, 64 nt, Homo Sapiens
cuuggauuaggcaaggcuccacucauuguugauauuugcccagcaggaaaaucauguaaguuau

SEQ ID NO: 334582 - RNA, 64 nt, Homo Sapiens
acauguucauuugauucauauaaaugaggacaaaucaccuuaaaugacuuaccccagcuaccgu

SEQ ID NO: 334583 - RNA, 64 nt, Homo Sapiens
uaucuuucaauuccauacuuuguauaugauguagucaccuuaacauuucaaacuauguuuuacu

SEQ ID NO: 334584 - RNA, 64 nt, Homo Sapiens
cugaguccuuuuucuaauguugggaauuuuguuuucaccuuauauuuguucaugucuagcccac

SEQ ID NO: 334585 - RNA, 64 nt, Homo Sapiens
gaguggguuccacuuuauuucugcuuacagaaucucaccuuauuaagaacaucaagcuucaucu

SEQ ID NO: 334586 - RNA, 64 nt, Homo Sapiens
uggaucucuggaggcuuccacccuuccugauuauucaccuuaagcgauuucaauuuguaaauga

SEQ ID NO: 334587 - RNA, 64 nt, Homo Sapiens
uguaguuucuuaauauauacuugaaggaaauguuucaccuuauuuuuggucuuuguuuauucau

SEQ ID NO: 334588 - RNA, 64 nt, Homo Sapiens
uauuucacuaacucuggcucauauauccuaaauuaaccuaaacgugugugggauaaugucauua

SEQ ID NO: 334589 - RNA, 64 nt, Homo Sapiens
aaucuguaauugcuuauuguuacaaaaauuguucaaccuaaaacauguacuauagauauaacug

SEQ ID NO: 334590 - RNA, 64 nt, Homo Sapiens
uaacuugagccccagucucauauccuaaacccuuaaccuaaauucugggcuaucuuagcuaacu

SEQ ID NO: 334591 - RNA, 64 nt, Homo Sapiens
auuagaaucccauuagagguaugaggaaaaguuuaaccuaaauaauuccaugugaaaauaaaau

SEQ ID NO: 334592 - RNA, 64 nt, Homo Sapiens
caguaucuguuauuuagcuggcauuguauaaaaaaaccuaaaaguucgaaccuaaaguuuagau

SEQ ID NO: 334593 - RNA, 64 nt, Homo Sapiens
uuagaugcauuguauaaaaagcacuuaaauuucgaaccuaaagugccauucacaguguaaggca

SEQ ID NO: 334594 - RNA, 64 nt, Homo Sapiens
auguuauagaauuauuuuuguagaaacuuucuauaaccuaaaugaagaauguaagggcuauaag

SEQ ID NO: 334595 - RNA, 64 nt, Homo Sapiens
uucaaguuuaauaaaauagcucccuuugcuucccaaccuaaaauaaaggggaugcccagugguu

SEQ ID NO: 334596 - RNA, 64 nt, Homo Sapiens
gauuauaaagagauaucaaagcacgauuuuagauaaccuaaacggcccagccuauacgaaguug

SEQ ID NO: 334597 - RNA, 64 nt, Homo Sapiens
gugagcuucuaucauauuccuguuuuauuagcagaaccuaaaggaauuuauuuaaugauguugu

SEQ ID NO: 334598 - RNA, 64 nt, Homo Sapiens
auaccaguuuugaaugaguuuaugaaaauucaagaaccuaaaaaagccaccaagaauguggaca

SEQ ID NO: 334599 - RNA, 64 nt, Homo Sapiens
ugccagcaacacaacuggaguuaaaauuaagccuaaccuaaaaccauuucaguagguucucaac

SEQ ID NO: 334600 - RNA, 64 nt, Homo Sapiens
uuauuuucaguuuuccaaaauucuaucaucuuuaaaccuaaauaauucaauuucauggaugcac

SEQ ID NO: 334601 - RNA, 64 nt, Homo Sapiens
gagcucucugugcuaucugcucaauuuuucucuaaaccuaaaacuguucuaaaauagaaagucu

SEQ ID NO: 334602 - RNA, 64 nt, Homo Sapiens
acauucugaaauuuauuuggaaccagaaaagcccaaccuaaauagcaaaagcaauccuaagcaa

SEQ ID NO: 334603 - RNA, 64 nt, Homo Sapiens
aucaacucaagauggauuaaagacuuaaauauaaaaccuaaaaguauuaaauuccuagaagaaa

SEQ ID NO: 334604 - RNA, 64 nt, Homo Sapiens
aacaugcaguugacccauguacacauacuccuugaaccuaaaauaaaacaugaaaaaaagcaaa

SEQ ID NO: 334605 - RNA, 64 nt, Homo Sapiens
gcaagcaaaaacaaaaugggaugugaagaauugaggcaugcaacccaauagcauaaauguccuu

SEQ ID NO: 334606 - RNA, 64 nt, Homo Sapiens
uccugccucagccucccaaguagcugggauuacaggcaugcaccaccacgcccagcuaauuuuu

SEQ ID NO: 334607 - RNA, 64 nt, Homo Sapiens
acuagauauuaaugucaaucauuuaagauuaaugggcaugcaauuaagucuccauuuaagauua

SEQ ID NO: 334608 - RNA, 64 nt, Homo Sapiens
gggcaugcaauuaagucuccauuuaagauuaaugggcaugcaaugaagucuccagcagacaauc

SEQ ID NO: 334609 - RNA, 64 nt, Homo Sapiens
ugagagcuuccugagcuuucggagccaaugaacaggcaugcaagugccuggagggcagggagug

SEQ ID NO: 334610 - RNA, 64 nt, Homo Sapiens
gcccucacagagacccaccugaugcgggacugcuggcaugcaguuccugccgcagguacaugau

SEQ ID NO: 334611 - RNA, 64 nt, Homo Sapiens
ugaagacauguuucaagaaccgcauuucgggaagggcaugcacgggcaugcacacggcugguca

SEQ ID NO: 334612 - RNA, 64 nt, Homo Sapiens
uuucaagaaccgcauuucgggaagggcaugcacgggcaugcacacggcuggucacucugcccuc

SEQ ID NO: 334613 - RNA, 64 nt, Homo Sapiens
cuucugagcccaccucccaggguaggcaccugggggcaugcaggugcccaccucccaggguagg

SEQ ID NO: 334614 - RNA, 64 nt, Homo Sapiens
ugcaggugcccaccucccaggguaggcaccugggggcaugcagguacccaccucuuucucuugg

SEQ ID NO: 334615 - RNA, 64 nt, Homo Sapiens
accauacccagcuaauuucuuagcugggauuacaggcaugcaccuccugccucagccucccuag

SEQ ID NO: 334616 - RNA, 64 nt, Homo Sapiens
aucacaccuggcuaauuuuguagcugggauugcaggcaugcaccuccugccucagccucccgag

SEQ ID NO: 334617 - RNA, 64 nt, Homo Sapiens
uccggaacauucauucccccaccggugaggaccuggcaugcagcgaagcagcccagcccggcgg

SEQ ID NO: 334618 - RNA, 64 nt, Homo Sapiens
uccugccucagccucccaaguagcugggacuacaggcaugcaccaccacacuuggccaauguuc

SEQ ID NO: 334619 - RNA, 64 nt, Homo Sapiens
ccaaggaauaucaaaauucuaucuuccucuagcaggcaugcaguauuuuggcugcuguucuuua

SEQ ID NO: 334620 - RNA, 64 nt, Homo Sapiens
ccaaggaauaucaaaauucuauuuuccucuagcaggcaugcaguauuuuggcugcugcucuuua

SEQ ID NO: 334621 - RNA, 64 nt, Homo Sapiens; identical to SEQ ID NO: 206809

SEQ ID NO: 334622 - RNA, 64 nt, Homo Sapiens; identical to SEQ ID NO: 206810

SEQ ID NO: 334623 - RNA, 64 nt, Homo Sapiens; identical to SEQ ID NO: 206811

SEQ ID NO: 334624 - RNA, 64 nt, Homo Sapiens; identical to SEQ ID NO: 206812

SEQ ID NO: 334625 - RNA, 64 nt, Homo Sapiens; identical to SEQ ID NO: 206813

SEQ ID NO: 334626 - RNA, 64 nt, Homo Sapiens; identical to SEQ ID NO: 206814

SEQ ID NO: 334627 - RNA, 64 nt, Homo Sapiens; identical to SEQ ID NO: 206815

SEQ ID NO: 334628 - RNA, 64 nt, Homo Sapiens; identical to SEQ ID NO: 206816

SEQ ID NO: 334629 - RNA, 64 nt, Homo Sapiens; identical to SEQ ID NO: 206817

SEQ ID NO: 334630 - RNA, 64 nt, Homo Sapiens; identical to SEQ ID NO: 206818

SEQ ID NO: 334631 - RNA, 64 nt, Homo Sapiens; identical to SEQ ID NO: 206819

SEQ ID NO: 334632 - RNA, 64 nt, Homo Sapiens; identical to SEQ ID NO: 206820

SEQ ID NO: 334633 - RNA, 64 nt, Homo Sapiens; identical to SEQ ID NO: 206821

SEQ ID NO: 334634 - RNA, 64 nt, Homo Sapiens; identical to SEQ ID NO: 206822

SEQ ID NO: 334635 - RNA, 64 nt, Homo Sapiens; identical to SEQ ID NO: 206823

SEQ ID NO: 334636 - RNA, 64 nt, Homo Sapiens; identical to SEQ ID NO: 206824

SEQ ID NO: 334637 - RNA, 64 nt, Homo Sapiens; identical to SEQ ID NO: 206825

SEQ ID NO: 334638 - RNA, 64 nt, Homo Sapiens; identical to SEQ ID NO: 206826

SEQ ID NO: 334639 - RNA, 64 nt, Homo Sapiens; identical to SEQ ID NO: 206827

SEQ ID NO: 334640 - RNA, 64 nt, Homo Sapiens; identical to SEQ ID NO: 206828

SEQ ID NO: 334641 - RNA, 64 nt, Homo Sapiens; identical to SEQ ID NO: 206829

SEQ ID NO: 334642 - RNA, 56 nt, Homo Sapiens; identical to SEQ ID NO: 206830

SEQ ID NO: 334643 - RNA, 64 nt, Homo Sapiens; identical to SEQ ID NO: 206831

SEQ ID NO: 334644 - RNA, 64 nt, Homo Sapiens; identical to SEQ ID NO: 206832

SEQ ID NO: 334645 - RNA, 64 nt, Homo Sapiens; identical to SEQ ID NO: 206833

SEQ ID NO: 334646 - RNA, 64 nt, Homo Sapiens; identical to SEQ ID NO: 284724

SEQ ID NO: 334647 - RNA, 64 nt, Homo Sapiens; identical to SEQ ID NO: 284725

SEQ ID NO: 334648 - RNA, 64 nt, Homo Sapiens; identical to SEQ ID NO: 284726

SEQ ID NO: 334649 - RNA, 64 nt, Homo Sapiens; identical to SEQ ID NO: 284727

SEQ ID NO: 334650 - RNA, 64 nt, Homo Sapiens; identical to SEQ ID NO: 284728

SEQ ID NO: 334651 - RNA, 64 nt, Homo Sapiens; identical to SEQ ID NO: 284729

SEQ ID NO: 334652 - RNA, 64 nt, Homo Sapiens; identical to SEQ ID NO: 284730

SEQ ID NO: 334653 - RNA, 64 nt, Homo Sapiens; identical to SEQ ID NO: 284731

SEQ ID NO: 334654 - RNA, 64 nt, Homo Sapiens; identical to SEQ ID NO: 284732

SEQ ID NO: 334655 - RNA, 64 nt, Homo Sapiens; identical to SEQ ID NO: 284733

SEQ ID NO: 334656 - RNA, 64 nt, Homo Sapiens; identical to SEQ ID NO: 284734

SEQ ID NO: 334657 - RNA, 64 nt, Homo Sapiens; identical to SEQ ID NO: 284735

SEQ ID NO: 334658 - RNA, 64 nt, Homo Sapiens; identical to SEQ ID NO: 284736

SEQ ID NO: 334659 - RNA, 64 nt, Homo Sapiens; identical to SEQ ID NO: 284737

SEQ ID NO: 334660 - RNA, 64 nt, Homo Sapiens; identical to SEQ ID NO: 284738

SEQ ID NO: 334661 - RNA, 64 nt, Homo Sapiens; identical to SEQ ID NO: 284739

SEQ ID NO: 334662 - RNA, 64 nt, Homo Sapiens; identical to SEQ ID NO: 284740

SEQ ID NO: 334663 - RNA, 64 nt, Homo Sapiens; identical to SEQ ID NO: 284741

SEQ ID NO: 334664 - RNA, 64 nt, Homo Sapiens; identical to SEQ ID NO: 284742

SEQ ID NO: 334665 - RNA, 64 nt, Homo Sapiens; identical to SEQ ID NO: 284743

SEQ ID NO: 334666 - RNA, 64 nt, Homo Sapiens; identical to SEQ ID NO: 284744

SEQ ID NO: 334667 - RNA, 64 nt, Homo Sapiens; identical to SEQ ID NO: 284745

SEQ ID NO: 334668 - RNA, 64 nt, Homo Sapiens; identical to SEQ ID NO: 284746

SEQ ID NO: 334669 - RNA, 64 nt, Homo Sapiens; identical to SEQ ID NO: 284747

SEQ ID NO: 334670 - RNA, 64 nt, Homo Sapiens; identical to SEQ ID NO: 272932

SEQ ID NO: 334671 - RNA, 64 nt, Homo Sapiens; identical to SEQ ID NO: 272933

SEQ ID NO: 334672 - RNA, 64 nt, Homo Sapiens; identical to SEQ ID NO: 272934

SEQ ID NO: 334673 - RNA, 64 nt, Homo Sapiens; identical to SEQ ID NO: 272935

SEQ ID NO: 334674 - RNA, 64 nt, Homo Sapiens; identical to SEQ ID NO: 272936

SEQ ID NO: 334675 - RNA, 64 nt, Homo Sapiens; identical to SEQ ID NO: 272937

SEQ ID NO: 334676 - RNA, 64 nt, Homo Sapiens; identical to SEQ ID NO: 272938

SEQ ID NO: 334677 - RNA, 64 nt, Homo Sapiens; identical to SEQ ID NO: 272939

SEQ ID NO: 334678 - RNA, 64 nt, Homo Sapiens; identical to SEQ ID NO: 272940

SEQ ID NO: 334679 - RNA, 64 nt, Homo Sapiens; identical to SEQ ID NO: 272941

SEQ ID NO: 334680 - RNA, 64 nt, Homo Sapiens; identical to SEQ ID NO: 272942

SEQ ID NO: 334681 - RNA, 64 nt, Homo Sapiens; identical to SEQ ID NO: 272943

SEQ ID NO: 334682 - RNA, 64 nt, Homo Sapiens; identical to SEQ ID NO: 272944

SEQ ID NO: 334683 - RNA, 64 nt, Homo Sapiens; identical to SEQ ID NO: 272945

SEQ ID NO: 334684 - RNA, 64 nt, Homo Sapiens; identical to SEQ ID NO: 272946

SEQ ID NO: 334685 - RNA, 64 nt, Homo Sapiens; identical to SEQ ID NO: 272947

SEQ ID NO: 334686 - RNA, 64 nt, Homo Sapiens; identical to SEQ ID NO: 272948

SEQ ID NO: 334687 - RNA, 64 nt, Homo Sapiens; identical to SEQ ID NO: 272949

SEQ ID NO: 334688 - RNA, 64 nt, Homo Sapiens; identical to SEQ ID NO: 272950

SEQ ID NO: 334689 - RNA, 64 nt, Homo Sapiens; identical to SEQ ID NO: 272951

SEQ ID NO: 334690 - RNA, 64 nt, Homo Sapiens; identical to SEQ ID NO: 272952

SEQ ID NO: 334691 - RNA, 64 nt, Homo Sapiens; identical to SEQ ID NO: 272953

SEQ ID NO: 334692 - RNA, 64 nt, Homo Sapiens
aaaucaauuaaaugaaauaucucagaccuaauccaguuauaauagugaugucuguuucccaggg

SEQ ID NO: 334693 - RNA, 64 nt, Homo Sapiens
ucacuaggcuguaaaaacaaaaaggguguuacugaguuauaagccuguagacuagaauuucuua

SEQ ID NO: 334694 - RNA, 64 nt, Homo Sapiens
uaaauauaugcuaauaaaauuguuauaaaugugaaguuauaaaauggcgguauacaaaguaaaa

SEQ ID NO: 334695 - RNA, 64 nt, Homo Sapiens
cuacaaaaugggcccugcccaccugcaguugagcaguuauaaacguuacaagacuacagcuaua

SEQ ID NO: 334696 - RNA, 64 nt, Homo Sapiens
gaauuauauauaaagaaggguguuuaauaaugauaguuauaauaauaaauaauugaaacaaucu

SEQ ID NO: 334697 - RNA, 64 nt, Homo Sapiens
ugaaucccuugcaauuggagguaaauuaugucuuaguuauaauuagauugugaaucagccaacu

SEQ ID NO: 334698 - RNA, 64 nt, Homo Sapiens
cuguacccuuaugcagagcaagcauuccauccuaaguuauaaacuacagugauguuuaauuuug

SEQ ID NO: 334699 - RNA, 64 nt, Homo Sapiens
aggcugggaaaggcuaaaugacuuauccuccaucaguuauaacagccccuggucuucuuaaauu

SEQ ID NO: 334700 - RNA, 64 nt, Homo Sapiens
cacuugcccuaggaacaaguugcacuguuccaguaguuauaaucaagccccacucuuaaaaagu

SEQ ID NO: 334701 - RNA, 64 nt, Homo Sapiens
agugagguccuaaaguguuaauuuaaauauuuucaguuauaagcaccccucagggauuauucac

SEQ ID NO: 334702 - RNA, 64 nt, Homo Sapiens
aguuuuuuuccuuaaugugaaaguaauuugaccaaguuauaaugcauuuuuguuuuuaacaaau

SEQ ID NO: 334703 - RNA, 64 nt, Homo Sapiens
gguggccaaaucugagaacaauuaaauucauuuuaguuauaauaaauuuaauauuuguaaaugu

SEQ ID NO: 334704 - RNA, 64 nt, Homo Sapiens
aaagauuguaaacuaaaguguaaaaauuuauaacaguuauaaagggaacgcauuuuggguuguu

SEQ ID NO: 334705 - RNA, 64 nt, Homo Sapiens
aaacuacauguaaaaucuugcaauuguacaaaaaaguuauaagagcagguuuuacacgucuaug

SEQ ID NO: 334706 - RNA, 64 nt, Homo Sapiens
auuuaggccaaucagaagcugaugugccuaaauaaguuauaaagcaggguacaaaaaauucagu

SEQ ID NO: 334707 - RNA, 64 nt, Homo Sapiens
gaaucuagccagugaacauagucuagaggccuuuaguuauaaagguaggguaggcagccugaga

SEQ ID NO: 334708 - RNA, 64 nt, Homo Sapiens
gugugggguuuguuuuuuagucuuguuuuuuuaauucauuaaccagugguuagcccuuaagggg

SEQ ID NO: 334709 - RNA, 64 nt, Homo Sapiens
cacauccucucaaguuaggaggauggaggccugcuucauuaagaagcuggggguaggguggggg

SEQ ID NO: 334710 - RNA, 64 nt, Homo Sapiens
cacacagacaucagaaaauucuguugagagcagguucauuaaauuuguaagauggcauauucua

SEQ ID NO: 334711 - RNA, 64 nt, Homo Sapiens
aggaaaauguauuucuguauaagaguucuuugcuuucauuaacuuggauucauuuaaaaauuaa

SEQ ID NO: 334712 - RNA, 64 nt, Homo Sapiens
accagcaucuguccagcuguucaguauauugugauucauuaaaaaaucucuucuaucccagaca

SEQ ID NO: 334713 - RNA, 64 nt, Homo Sapiens
uaaaagcaaaacuagaaaucuuuuaaugacaauuuucauuaauuucaggguuaucauuuuugag

SEQ ID NO: 334714 - RNA, 64 nt, Homo Sapiens
gcaccauugcuuucuguacugauuugaaagaaguuucauuaaaaucacagcuagcauguucaca

SEQ ID NO: 334715 - RNA, 64 nt, Homo Sapiens
guaacuacuaaggaaagguuuaauucuucuucaguucauuaaaaacacuaggccuuugaugcuu

SEQ ID NO: 334716 - RNA, 64 nt, Homo Sapiens
gugacgggcaaggguuuucucugccugugggucuuucauuaaagcagacauccccaaagcuugu

SEQ ID NO: 334717 - RNA, 64 nt, Homo Sapiens
acccaguuuccuggucauuuggcaucacaccuucuucauuaaaaauguguguacaguguccaca

SEQ ID NO: 334718 - RNA, 64 nt, Homo Sapiens
cugaaggauuauuaagcaaccuuaaagcaauaaguucauuaaacagaagguaauaggaagaaca

SEQ ID NO: 334719 - RNA, 64 nt, Homo Sapiens
uuagaaaaaaacaaacucuacuaauuuuuagauauucauuaauaggaaagauuuaauguuacag

SEQ ID NO: 334720 - RNA, 64 nt, Homo Sapiens
gguauugauugaaaaaagagaaaggggcaagaaauucauuaaagaaaaaccacagauacugaaa

SEQ ID NO: 334721 - RNA, 64 nt, Homo Sapiens
uauaaacaugguguuuuucagaaauaaaaauuauuucauuaaccuuuacuauuacugugauaau

SEQ ID NO: 334722 - RNA, 64 nt, Homo Sapiens
ucuguuguaaagacaccuuauuuaauauaaucgauucauuaacauugaagucaugaccaacaac

SEQ ID NO: 334723 - RNA, 64 nt, Homo Sapiens
uuuggaaaacuauaggcuggaaacuccuaucuguuucauuaacuauguauggagcuuuguaucu

SEQ ID NO: 334724 - RNA, 64 nt, Homo Sapiens
gcuuuuaauuuuauuuguaugaauuuuccaggauuucauuaaaaauuauuauuguauuuuuuac

SEQ ID NO: 334725 - RNA, 64 nt, Homo Sapiens
aauaagccugccgccaaaauuucagagauuuguuuucauuaaaaugucaaacuggccauuugac

SEQ ID NO: 334726 - RNA, 64 nt, Homo Sapiens
uuucucuacaacuuuaugagaaaauuacuuucuauucauuaauuuuuuggcugacagaucagau

SEQ ID NO: 334727 - RNA, 64 nt, Homo Sapiens
acaugauaacugguaccuuaucuacuguaaauauuucauuaaaaaugaugcacacauagauaua

SEQ ID NO: 334728 - RNA, 64 nt, Homo Sapiens
auuuuaauguuuuauuggcaacguaugcugcuuuuucauuaaaauaugcuauuaaaauuaaaug

SEQ ID NO: 334729 - RNA, 64 nt, Homo Sapiens
aaaaaccacuuuauauaaaaaugcaaugaaauguuucauuaauacauguuuauuucuacccuua

SEQ ID NO: 334730 - RNA, 64 nt, Homo Sapiens
ucucaaauuuucuauagaauucuugaagaggcaauucauuaaacaauaugugauauauuucccc

SEQ ID NO: 334731 - RNA, 64 nt, Homo Sapiens
aggcuaaauucacagcgcuaugcaauucuuaauuuucauuaaguuguuauuucaguuuuaaaug

SEQ ID NO: 334732 - RNA, 64 nt, Homo Sapiens
uauuucuaaaauauaagaucugagauugaauauuuucauuaaaagcuacaguuuugugaaucuu

SEQ ID NO: 334733 - RNA, 64 nt, Homo Sapiens
aacaaaaaccagagaugugccuauacaauuuguguucauuaaugugccucacuuuuuuucucag

SEQ ID NO: 334734 - RNA, 64 nt, Homo Sapiens
gucuuccaagauuuuguaaauauuuuugauuuuuuucauuaaauguaaauuuuacauaaaaguu

SEQ ID NO: 334735 - RNA, 64 nt, Homo Sapiens
ucacaauggcgaauggugacuuuucuuucacgauuucauuaauuugaaagcacacaggaaaguu

SEQ ID NO: 334736 - RNA, 64 nt, Homo Sapiens
uuuguacagagguuacugcaauaaaggaaguggauucauuaaaccuauuuaauguccauucuua

SEQ ID NO: 334737 - RNA, 64 nt, Homo Sapiens
aaaguagacugucuuugcauuuugccaucugaaguucauuaaucuuuagaugacaaaaaagcaa

SEQ ID NO: 334738 - RNA, 64 nt, Homo Sapiens
aucuguuuccuguaggcucuuucugcugucuauauucauuaaaguuuuccacuucacccuccca

SEQ ID NO: 334739 - RNA, 64 nt, Homo Sapiens
guagcgacugucaacagcguaagcguugggauacuucauuaaaucuguauucccgagaccaacg

SEQ ID NO: 334740 - RNA, 64 nt, Homo Sapiens
uuccaguuauaaauauuuugauuugaugauacauuucauuaaggggacaaguugcuuuuaccug

SEQ ID NO: 334741 - RNA, 64 nt, Homo Sapiens
ugugguuguccagugguauacaacugacaggcauuucauuaagcacauagaccagacuuuguga

SEQ ID NO: 334742 - RNA, 64 nt, Homo Sapiens
auagaccagacuuugugaaugguucagauauuuuuucauuaaaaaacaagguauggcagaugga

SEQ ID NO: 334743 - RNA, 64 nt, Homo Sapiens
agggagguagauuugaaaaauuaaugaauaugcuuucauuaaauauguaugcauaguuucauau

SEQ ID NO: 334744 - RNA, 64 nt, Homo Sapiens
acaucaagcuucaucucugccuacacugacacuauucauuaagauauuaccacucauguucuuu

SEQ ID NO: 334745 - RNA, 64 nt, Homo Sapiens
agcuaaggcacagaagacugaaugaaugcaaggauucauuaacucuuugaauuuguuaaauacu

SEQ ID NO: 334746 - RNA, 64 nt, Homo Sapiens
auucuuauaguuaucuuuuuaacaucuuauuuuuuucauuaauuacauaucaacauuaauuuug

SEQ ID NO: 334747 - RNA, 64 nt, Homo Sapiens
aaaauaaguuuaagaaauuuaagagaauuguguuuucauuaaguuuugcauaucuuuuguuaug

SEQ ID NO: 334748 - RNA, 64 nt, Homo Sapiens
uugcauagaauaaugaagaucuuuguuuuuuguuuucauuaaagagccauucuggcacuuuaau

SEQ ID NO: 334749 - RNA, 64 nt, Homo Sapiens
cauuuugagaacauucccuggaauugccacauaauucauuaaaaacauuuuuuuaagcaacacu

SEQ ID NO: 334750 - RNA, 64 nt, Homo Sapiens
ucaaaauacuuuaauaagugauuuuaaaagcugauucauuaauaaaagugauaagauagccuug

SEQ ID NO: 334751 - RNA, 64 nt, Homo Sapiens
guuuaaaucagugaccaucaugacaugacauauuuucauuaauauauauucuucuuuauaucuc

SEQ ID NO: 334752 - RNA, 64 nt, Homo Sapiens
aaguugggagaacaaauaggucagauuaacuuauuucauuaaagacaagcuacuggaugcacug

SEQ ID NO: 334753 - RNA, 64 nt, Homo Sapiens
guauacagauuuaguuaaguuaccagccaaucccuucauuaaauagacugacaguugguauaug

SEQ ID NO: 334754 - RNA, 64 nt, Homo Sapiens
ggaaaaaagaaaaaaaauuuuaaguuaaaucauuuucauuaaaaaaaguuucacaacagauuuc

SEQ ID NO: 334755 - RNA, 64 nt, Homo Sapiens
cuguguuaccuuuuaaaauauauaguuauacaucuucauuaauauucugaagcuagaaacaauc

SEQ ID NO: 334756 - RNA, 64 nt, Homo Sapiens
aauguggauuuauugaugugcuagaacggaugguuucauuaaaggaccuaacauaugucucuac

SEQ ID NO: 334757 - RNA, 64 nt, Homo Sapiens
caucuaugggcauuaugagcguuuugaauggcauuucauuaaggauaauuuaaacagugaggua

SEQ ID NO: 334758 - RNA, 64 nt, Homo Sapiens
uuuggugcuucuucagggauugaacucaguaucuuucauuaaaaaacacagcaguuuuccuugc

SEQ ID NO: 334759 - RNA, 64 nt, Homo Sapiens
gaguuucaauacuuuuuauauuuuaauauuuccauucauuaauauuaugguuauugucagcaau

SEQ ID NO: 334760 - RNA, 64 nt, Homo Sapiens
uggcacuuuggcauaccgaaaaaacaugaaauuuuucauuaaaaugccaugaaucaagccaggg

SEQ ID NO: 334761 - RNA, 64 nt, Homo Sapiens
gacuccuccagaauuuuaguagauacaggguggguucauuaagagugauaaaagugggaagaca

SEQ ID NO: 334762 - RNA, 64 nt, Homo Sapiens
auuucauguaauuuacccuuugcaauaaaaaugauucauuaaauauauaacuaaaugugauuug

SEQ ID NO: 334763 - RNA, 64 nt, Homo Sapiens
acacuuuaaaauuggaaaguuuauaaagggguaauucauuaauuaaagauauuuuagaaucaau

SEQ ID NO: 334764 - RNA, 64 nt, Homo Sapiens
uuuaugaauuaaaaagaaagucgggcacucuauauucauuaaggaaggauccauuuaguuaaaa

SEQ ID NO: 334765 - RNA, 64 nt, Homo Sapiens
guauucuaaauuaaugcagaaccauauggaaaauuucauuaaaaucuauccccaaaugugcuuu

SEQ ID NO: 334766 - RNA, 64 nt, Homo Sapiens
uugcuaaguaauucccaauagaaagcugcuuauuuucauuaaugaaaaauaaccaugguuugua

SEQ ID NO: 334767 - RNA, 64 nt, Homo Sapiens
aaaauguauugugguuuauguuugggaauaaucauucauuaaaaaguuucuuuucugguuuuag

SEQ ID NO: 334768 - RNA, 64 nt, Homo Sapiens
aggcaacuacagccaaaaucagagcccccauuuguucauuaaagaucauaauacaaggaaccuc

SEQ ID NO: 334769 - RNA, 64 nt, Homo Sapiens
uuaaaccaguacuugucaguccaucuuaauacuguucauuaaggcacucucugucucuaauccu

SEQ ID NO: 334770 - RNA, 64 nt, Homo Sapiens
uaguaaaaaauguaggguuauuuaccauaaccuguucauuaauaucagaaauuuacaauagcau

SEQ ID NO: 334771 - RNA, 64 nt, Homo Sapiens
ucugaaauguacucagugaaaauuuguuuugaguuucauuaaugcuauuucaccaguuagacau

SEQ ID NO: 334772 - RNA, 64 nt, Homo Sapiens
acaaucuucccugucaugacuuuaaguucuacuuuucauuaaccauggccugauauuaguucuu

SEQ ID NO: 334773 - RNA, 64 nt, Homo Sapiens; identical to SEQ ID NO: 110524

SEQ ID NO: 334774 - RNA, 64 nt, Homo Sapiens; identical to SEQ ID NO: 110525

SEQ ID NO: 334775 - RNA, 64 nt, Homo Sapiens; identical to SEQ ID NO: 110526

SEQ ID NO: 334776 - RNA, 64 nt, Homo Sapiens; identical to SEQ ID NO: 110527

SEQ ID NO: 334777 - RNA, 64 nt, Homo Sapiens; identical to SEQ ID NO: 110528

SEQ ID NO: 334778 - RNA, 64 nt, Homo Sapiens; identical to SEQ ID NO: 110529

SEQ ID NO: 334779 - RNA, 64 nt, Homo Sapiens; identical to SEQ ID NO: 110530

SEQ ID NO: 334780 - RNA, 64 nt, Homo Sapiens; identical to SEQ ID NO: 110531

SEQ ID NO: 334781 - RNA, 64 nt, Homo Sapiens; identical to SEQ ID NO: 110532

SEQ ID NO: 334782 - RNA, 64 nt, Homo Sapiens; identical to SEQ ID NO: 110533

SEQ ID NO: 334783 - RNA, 64 nt, Homo Sapiens; identical to SEQ ID NO: 110534

SEQ ID NO: 334784 - RNA, 64 nt, Homo Sapiens; identical to SEQ ID NO: 110535

SEQ ID NO: 334785 - RNA, 64 nt, Homo Sapiens; identical to SEQ ID NO: 110536

SEQ ID NO: 334786 - RNA, 64 nt, Homo Sapiens; identical to SEQ ID NO: 110537

SEQ ID NO: 334787 - RNA, 64 nt, Homo Sapiens; identical to SEQ ID NO: 110538

SEQ ID NO: 334788 - RNA, 64 nt, Homo Sapiens; identical to SEQ ID NO: 110539

SEQ ID NO: 334789 - RNA, 64 nt, Homo Sapiens; identical to SEQ ID NO: 110540

SEQ ID NO: 334790 - RNA, 64 nt, Homo Sapiens; identical to SEQ ID NO: 110541

SEQ ID NO: 334791 - RNA, 64 nt, Homo Sapiens; identical to SEQ ID NO: 110542

SEQ ID NO: 334792 - RNA, 64 nt, Homo Sapiens; identical to SEQ ID NO: 110543

SEQ ID NO: 334793 - RNA, 64 nt, Homo Sapiens; identical to SEQ ID NO: 110544

SEQ ID NO: 334794 - RNA, 64 nt, Homo Sapiens; identical to SEQ ID NO: 110545

SEQ ID NO: 334795 - RNA, 64 nt, Homo Sapiens; identical to SEQ ID NO: 110546

SEQ ID NO: 334796 - RNA, 64 nt, Homo Sapiens; identical to SEQ ID NO: 110547

SEQ ID NO: 334797 - RNA, 64 nt, Homo Sapiens; identical to SEQ ID NO: 110548

SEQ ID NO: 334798 - RNA, 64 nt, Homo Sapiens; identical to SEQ ID NO: 110549

SEQ ID NO: 334799 - RNA, 64 nt, Homo Sapiens; identical to SEQ ID NO: 110550

SEQ ID NO: 334800 - RNA, 64 nt, Homo Sapiens; identical to SEQ ID NO: 110551

SEQ ID NO: 334801 - RNA, 64 nt, Homo Sapiens; identical to SEQ ID NO: 110552

SEQ ID NO: 334802 - RNA, 64 nt, Homo Sapiens; identical to SEQ ID NO: 110553

SEQ ID NO: 334803 - RNA, 64 nt, Homo Sapiens; identical to SEQ ID NO: 110554

SEQ ID NO: 334804 - RNA, 64 nt, Homo Sapiens; identical to SEQ ID NO: 110555

SEQ ID NO: 334805 - RNA, 64 nt, Homo Sapiens; identical to SEQ ID NO: 110556

SEQ ID NO: 334806 - RNA, 64 nt, Homo Sapiens; identical to SEQ ID NO: 110557

SEQ ID NO: 334807 - RNA, 64 nt, Homo Sapiens; identical to SEQ ID NO: 110558

SEQ ID NO: 334808 - RNA, 64 nt, Homo Sapiens; identical to SEQ ID NO: 110559

SEQ ID NO: 334809 - RNA, 64 nt, Homo Sapiens; identical to SEQ ID NO: 110560

SEQ ID NO: 334810 - RNA, 64 nt, Homo Sapiens; identical to SEQ ID NO: 110561

SEQ ID NO: 334811 - RNA, 64 nt, Homo Sapiens; identical to SEQ ID NO: 110562

SEQ ID NO: 334812 - RNA, 64 nt, Homo Sapiens; identical to SEQ ID NO: 110563

SEQ ID NO: 334813 - RNA, 64 nt, Homo Sapiens; identical to SEQ ID NO: 110564

SEQ ID NO: 334814 - RNA, 64 nt, Homo Sapiens; identical to SEQ ID NO: 110565

SEQ ID NO: 334815 - RNA, 64 nt, Homo Sapiens; identical to SEQ ID NO: 110566

SEQ ID NO: 334816 - RNA, 64 nt, Homo Sapiens; identical to SEQ ID NO: 110567

SEQ ID NO: 334817 - RNA, 64 nt, Homo Sapiens; identical to SEQ ID NO: 110568

SEQ ID NO: 334818 - RNA, 64 nt, Homo Sapiens; identical to SEQ ID NO: 110569

SEQ ID NO: 334819 - RNA, 64 nt, Homo Sapiens; identical to SEQ ID NO: 110570

SEQ ID NO: 334820 - RNA, 64 nt, Homo Sapiens; identical to SEQ ID NO: 110571

SEQ ID NO: 334821 - RNA, 64 nt, Homo Sapiens; identical to SEQ ID NO: 110572

SEQ ID NO: 334822 - RNA, 64 nt, Homo Sapiens; identical to SEQ ID NO: 110573

SEQ ID NO: 334823 - RNA, 64 nt, Homo Sapiens; identical to SEQ ID NO: 110574

SEQ ID NO: 334824 - RNA, 64 nt, Homo Sapiens; identical to SEQ ID NO: 110575

SEQ ID NO: 334825 - RNA, 64 nt, Homo Sapiens; identical to SEQ ID NO: 110576

SEQ ID NO: 334826 - RNA, 64 nt, Homo Sapiens; identical to SEQ ID NO: 110577

SEQ ID NO: 334827 - RNA, 64 nt, Homo Sapiens; identical to SEQ ID NO: 110578

SEQ ID NO: 334828 - RNA, 64 nt, Homo Sapiens; identical to SEQ ID NO: 110579

SEQ ID NO: 334829 - RNA, 64 nt, Homo Sapiens; identical to SEQ ID NO: 110580

SEQ ID NO: 334830 - RNA, 64 nt, Homo Sapiens; identical to SEQ ID NO: 110581

SEQ ID NO: 334831 - RNA, 64 nt, Homo Sapiens; identical to SEQ ID NO: 110582

SEQ ID NO: 334832 - RNA, 64 nt, Homo Sapiens; identical to SEQ ID NO: 110583

SEQ ID NO: 334833 - RNA, 64 nt, Homo Sapiens; identical to SEQ ID NO: 110584

SEQ ID NO: 334834 - RNA, 64 nt, Homo Sapiens; identical to SEQ ID NO: 110585

SEQ ID NO: 334835 - RNA, 64 nt, Homo Sapiens; identical to SEQ ID NO: 110586

SEQ ID NO: 334836 - RNA, 64 nt, Homo Sapiens; identical to SEQ ID NO: 110587

SEQ ID NO: 334837 - RNA, 64 nt, Homo Sapiens; identical to SEQ ID NO: 110588

SEQ ID NO: 334838 - RNA, 64 nt, Homo Sapiens; identical to SEQ ID NO: 110589

SEQ ID NO: 334839 - RNA, 64 nt, Homo Sapiens; identical to SEQ ID NO: 110590

SEQ ID NO: 334840 - RNA, 64 nt, Homo Sapiens; identical to SEQ ID NO: 110591

SEQ ID NO: 334841 - RNA, 64 nt, Homo Sapiens; identical to SEQ ID NO: 110592

SEQ ID NO: 334842 - RNA, 64 nt, Homo Sapiens; identical to SEQ ID NO: 110593

SEQ ID NO: 334843 - RNA, 64 nt, Homo Sapiens; identical to SEQ ID NO: 110594

SEQ ID NO: 334844 - RNA, 64 nt, Homo Sapiens; identical to SEQ ID NO: 110595

SEQ ID NO: 334845 - RNA, 64 nt, Homo Sapiens; identical to SEQ ID NO: 110596

SEQ ID NO: 334846 - RNA, 64 nt, Homo Sapiens; identical to SEQ ID NO: 110597

SEQ ID NO: 334847 - RNA, 64 nt, Homo Sapiens; identical to SEQ ID NO: 110598

SEQ ID NO: 334848 - RNA, 64 nt, Homo Sapiens; identical to SEQ ID NO: 110599

SEQ ID NO: 334849 - RNA, 64 nt, Homo Sapiens; identical to SEQ ID NO: 110600

SEQ ID NO: 334850 - RNA, 64 nt, Homo Sapiens; identical to SEQ ID NO: 110601

SEQ ID NO: 334851 - RNA, 64 nt, Homo Sapiens; identical to SEQ ID NO: 110602

SEQ ID NO: 334852 - RNA, 64 nt, Homo Sapiens; identical to SEQ ID NO: 110603

SEQ ID NO: 334853 - RNA, 64 nt, Homo Sapiens; identical to SEQ ID NO: 110604

SEQ ID NO: 334854 - RNA, 64 nt, Homo Sapiens; identical to SEQ ID NO: 110605

SEQ ID NO: 334855 - RNA, 64 nt, Homo Sapiens; identical to SEQ ID NO: 110606

SEQ ID NO: 334856 - RNA, 64 nt, Homo Sapiens; identical to SEQ ID NO: 110607

SEQ ID NO: 334857 - RNA, 64 nt, Homo Sapiens; identical to SEQ ID NO: 110608

SEQ ID NO: 334858 - RNA, 64 nt, Homo Sapiens; identical to SEQ ID NO: 110609

SEQ ID NO: 334859 - RNA, 64 nt, Homo Sapiens; identical to SEQ ID NO: 110610

SEQ ID NO: 334860 - RNA, 64 nt, Homo Sapiens; identical to SEQ ID NO: 110611

SEQ ID NO: 334861 - RNA, 64 nt, Homo Sapiens; identical to SEQ ID NO: 110612

SEQ ID NO: 334862 - RNA, 64 nt, Homo Sapiens; identical to SEQ ID NO: 110613

SEQ ID NO: 334863 - RNA, 64 nt, Homo Sapiens; identical to SEQ ID NO: 110614

SEQ ID NO: 334864 - RNA, 64 nt, Homo Sapiens; identical to SEQ ID NO: 110615

SEQ ID NO: 334865 - RNA, 64 nt, Homo Sapiens; identical to SEQ ID NO: 110616

SEQ ID NO: 334866 - RNA, 64 nt, Homo Sapiens; identical to SEQ ID NO: 110617

SEQ ID NO: 334867 - RNA, 64 nt, Homo Sapiens; identical to SEQ ID NO: 110618

SEQ ID NO: 334868 - RNA, 64 nt, Homo Sapiens; identical to SEQ ID NO: 110619

SEQ ID NO: 334869 - RNA, 64 nt, Homo Sapiens; identical to SEQ ID NO: 110620

SEQ ID NO: 334870 - RNA, 64 nt, Homo Sapiens; identical to SEQ ID NO: 110621

SEQ ID NO: 334871 - RNA, 64 nt, Homo Sapiens; identical to SEQ ID NO: 110622

SEQ ID NO: 334872 - RNA, 64 nt, Homo Sapiens; identical to SEQ ID NO: 110623

SEQ ID NO: 334873 - RNA, 64 nt, Homo Sapiens; identical to SEQ ID NO: 110624

SEQ ID NO: 334874 - RNA, 64 nt, Homo Sapiens; identical to SEQ ID NO: 110625

SEQ ID NO: 334875 - RNA, 64 nt, Homo Sapiens; identical to SEQ ID NO: 110626

SEQ ID NO: 334876 - RNA, 64 nt, Homo Sapiens; identical to SEQ ID NO: 110627

SEQ ID NO: 334877 - RNA, 64 nt, Homo Sapiens; identical to SEQ ID NO: 110628

SEQ ID NO: 334878 - RNA, 64 nt, Homo Sapiens; identical to SEQ ID NO: 110629

SEQ ID NO: 334879 - RNA, 64 nt, Homo Sapiens; identical to SEQ ID NO: 110630

SEQ ID NO: 334880 - RNA, 64 nt, Homo Sapiens; identical to SEQ ID NO: 110631

SEQ ID NO: 334881 - RNA, 64 nt, Homo Sapiens; identical to SEQ ID NO: 110632

SEQ ID NO: 334882 - RNA, 64 nt, Homo Sapiens; identical to SEQ ID NO: 110633

SEQ ID NO: 334883 - RNA, 64 nt, Homo Sapiens; identical to SEQ ID NO: 110634

SEQ ID NO: 334884 - RNA, 64 nt, Homo Sapiens; identical to SEQ ID NO: 110635

SEQ ID NO: 334885 - RNA, 64 nt, Homo Sapiens; identical to SEQ ID NO: 110636

SEQ ID NO: 334886 - RNA, 64 nt, Homo Sapiens; identical to SEQ ID NO: 110637

SEQ ID NO: 334887 - RNA, 64 nt, Homo Sapiens; identical to SEQ ID NO: 110638

SEQ ID NO: 334888 - RNA, 64 nt, Homo Sapiens; identical to SEQ ID NO: 110639

SEQ ID NO: 334889 - RNA, 64 nt, Homo Sapiens; identical to SEQ ID NO: 110640

SEQ ID NO: 334890 - RNA, 64 nt, Homo Sapiens; identical to SEQ ID NO: 110641

SEQ ID NO: 334891 - RNA, 64 nt, Homo Sapiens; identical to SEQ ID NO: 110642

SEQ ID NO: 334892 - RNA, 64 nt, Homo Sapiens; identical to SEQ ID NO: 110643

SEQ ID NO: 334893 - RNA, 64 nt, Homo Sapiens; identical to SEQ ID NO: 110644

SEQ ID NO: 334894 - RNA, 64 nt, Homo Sapiens; identical to SEQ ID NO: 110645

SEQ ID NO: 334895 - RNA, 64 nt, Homo Sapiens; identical to SEQ ID NO: 110646

SEQ ID NO: 334896 - RNA, 64 nt, Homo Sapiens; identical to SEQ ID NO: 110647

SEQ ID NO: 334897 - RNA, 64 nt, Homo Sapiens; identical to SEQ ID NO: 110648

SEQ ID NO: 334898 - RNA, 64 nt, Homo Sapiens; identical to SEQ ID NO: 110649

SEQ ID NO: 334899 - RNA, 64 nt, Homo Sapiens; identical to SEQ ID NO: 110650

SEQ ID NO: 334900 - RNA, 64 nt, Homo Sapiens; identical to SEQ ID NO: 110651

SEQ ID NO: 334901 - RNA, 64 nt, Homo Sapiens; identical to SEQ ID NO: 110652

SEQ ID NO: 334902 - RNA, 64 nt, Homo Sapiens; identical to SEQ ID NO: 110653

SEQ ID NO: 334903 - RNA, 64 nt, Homo Sapiens; identical to SEQ ID NO: 110654

SEQ ID NO: 334904 - RNA, 64 nt, Homo Sapiens; identical to SEQ ID NO: 110655

SEQ ID NO: 334905 - RNA, 64 nt, Homo Sapiens; identical to SEQ ID NO: 110656

SEQ ID NO: 334906 - RNA, 64 nt, Homo Sapiens; identical to SEQ ID NO: 110657

SEQ ID NO: 334907 - RNA, 64 nt, Homo Sapiens; identical to SEQ ID NO: 110658

SEQ ID NO: 334908 - RNA, 64 nt, Homo Sapiens; identical to SEQ ID NO: 110659

SEQ ID NO: 334909 - RNA, 64 nt, Homo Sapiens; identical to SEQ ID NO: 110660

SEQ ID NO: 334910 - RNA, 64 nt, Homo Sapiens; identical to SEQ ID NO: 110661

SEQ ID NO: 334911 - RNA, 64 nt, Homo Sapiens; identical to SEQ ID NO: 110662

SEQ ID NO: 334912 - RNA, 64 nt, Homo Sapiens; identical to SEQ ID NO: 110663

SEQ ID NO: 334913 - RNA, 64 nt, Homo Sapiens; identical to SEQ ID NO: 110664

SEQ ID NO: 334914 - RNA, 64 nt, Homo Sapiens; identical to SEQ ID NO: 110665

SEQ ID NO: 334915 - RNA, 64 nt, Homo Sapiens; identical to SEQ ID NO: 110666

SEQ ID NO: 334916 - RNA, 64 nt, Homo Sapiens; identical to SEQ ID NO: 110667

SEQ ID NO: 334917 - RNA, 64 nt, Homo Sapiens; identical to SEQ ID NO: 110668

SEQ ID NO: 334918 - RNA, 64 nt, Homo Sapiens; identical to SEQ ID NO: 110669

SEQ ID NO: 334919 - RNA, 64 nt, Homo Sapiens; identical to SEQ ID NO: 110670

SEQ ID NO: 334920 - RNA, 64 nt, Homo Sapiens; identical to SEQ ID NO: 110671

SEQ ID NO: 334921 - RNA, 64 nt, Homo Sapiens; identical to SEQ ID NO: 110672

SEQ ID NO: 334922 - RNA, 64 nt, Homo Sapiens; identical to SEQ ID NO: 110673

SEQ ID NO: 334923 - RNA, 64 nt, Homo Sapiens; identical to SEQ ID NO: 110674

SEQ ID NO: 334924 - RNA, 64 nt, Homo Sapiens; identical to SEQ ID NO: 110675

SEQ ID NO: 334925 - RNA, 64 nt, Homo Sapiens; identical to SEQ ID NO: 110676

SEQ ID NO: 334926 - RNA, 64 nt, Homo Sapiens; identical to SEQ ID NO: 110677

SEQ ID NO: 334927 - RNA, 64 nt, Homo Sapiens; identical to SEQ ID NO: 110678

SEQ ID NO: 334928 - RNA, 64 nt, Homo Sapiens; identical to SEQ ID NO: 110679

SEQ ID NO: 334929 - RNA, 64 nt, Homo Sapiens; identical to SEQ ID NO: 110680

SEQ ID NO: 334930 - RNA, 64 nt, Homo Sapiens; identical to SEQ ID NO: 110681

SEQ ID NO: 334931 - RNA, 64 nt, Homo Sapiens; identical to SEQ ID NO: 110682

SEQ ID NO: 334932 - RNA, 64 nt, Homo Sapiens; identical to SEQ ID NO: 110683

SEQ ID NO: 334933 - RNA, 64 nt, Homo Sapiens; identical to SEQ ID NO: 110684

SEQ ID NO: 334934 - RNA, 64 nt, Homo Sapiens; identical to SEQ ID NO: 110685

SEQ ID NO: 334935 - RNA, 64 nt, Homo Sapiens; identical to SEQ ID NO: 110686

SEQ ID NO: 334936 - RNA, 64 nt, Homo Sapiens; identical to SEQ ID NO: 110687

SEQ ID NO: 334937 - RNA, 64 nt, Homo Sapiens; identical to SEQ ID NO: 110688

SEQ ID NO: 334938 - RNA, 64 nt, Homo Sapiens; identical to SEQ ID NO: 110689

SEQ ID NO: 334939 - RNA, 64 nt, Homo Sapiens; identical to SEQ ID NO: 110690

SEQ ID NO: 334940 - RNA, 64 nt, Homo Sapiens; identical to SEQ ID NO: 110691

SEQ ID NO: 334941 - RNA, 64 nt, Homo Sapiens; identical to SEQ ID NO: 110692

SEQ ID NO: 334942 - RNA, 64 nt, Homo Sapiens; identical to SEQ ID NO: 110693

SEQ ID NO: 334943 - RNA, 51 nt, Homo Sapiens; identical to SEQ ID NO: 110694

SEQ ID NO: 334944 - RNA, 64 nt, Homo Sapiens; identical to SEQ ID NO: 110695

SEQ ID NO: 334945 - RNA, 64 nt, Homo Sapiens; identical to SEQ ID NO: 110696

SEQ ID NO: 334946 - RNA, 64 nt, Homo Sapiens; identical to SEQ ID NO: 110697

SEQ ID NO: 334947 - RNA, 64 nt, Homo Sapiens; identical to SEQ ID NO: 110698

SEQ ID NO: 334948 - RNA, 64 nt, Homo Sapiens; identical to SEQ ID NO: 110699

SEQ ID NO: 334949 - RNA, 64 nt, Homo Sapiens; identical to SEQ ID NO: 110700

SEQ ID NO: 334950 - RNA, 64 nt, Homo Sapiens; identical to SEQ ID NO: 110701

SEQ ID NO: 334951 - RNA, 64 nt, Homo Sapiens; identical to SEQ ID NO: 110702

SEQ ID NO: 334952 - RNA, 64 nt, Homo Sapiens; identical to SEQ ID NO: 110703

SEQ ID NO: 334953 - RNA, 64 nt, Homo Sapiens; identical to SEQ ID NO: 110704

SEQ ID NO: 334954 - RNA, 64 nt, Homo Sapiens; identical to SEQ ID NO: 110705

SEQ ID NO: 334955 - RNA, 64 nt, Homo Sapiens; identical to SEQ ID NO: 110706

SEQ ID NO: 334956 - RNA, 64 nt, Homo Sapiens; identical to SEQ ID NO: 110707

SEQ ID NO: 334957 - RNA, 64 nt, Homo Sapiens; identical to SEQ ID NO: 110708

SEQ ID NO: 334958 - RNA, 64 nt, Homo Sapiens; identical to SEQ ID NO: 110709

SEQ ID NO: 334959 - RNA, 64 nt, Homo Sapiens; identical to SEQ ID NO: 110710

SEQ ID NO: 334960 - RNA, 64 nt, Homo Sapiens; identical to SEQ ID NO: 110711

SEQ ID NO: 334961 - RNA, 64 nt, Homo Sapiens; identical to SEQ ID NO: 110712

SEQ ID NO: 334962 - RNA, 64 nt, Homo Sapiens; identical to SEQ ID NO: 110713

SEQ ID NO: 334963 - RNA, 64 nt, Homo Sapiens; identical to SEQ ID NO: 110714

SEQ ID NO: 334964 - RNA, 64 nt, Homo Sapiens; identical to SEQ ID NO: 110715

SEQ ID NO: 334965 - RNA, 64 nt, Homo Sapiens; identical to SEQ ID NO: 110716

SEQ ID NO: 334966 - RNA, 64 nt, Homo Sapiens; identical to SEQ ID NO: 110717

SEQ ID NO: 334967 - RNA, 64 nt, Homo Sapiens; identical to SEQ ID NO: 110718

SEQ ID NO: 334968 - RNA, 64 nt, Homo Sapiens; identical to SEQ ID NO: 110719

SEQ ID NO: 334969 - RNA, 64 nt, Homo Sapiens; identical to SEQ ID NO: 110720

SEQ ID NO: 334970 - RNA, 64 nt, Homo Sapiens; identical to SEQ ID NO: 110721

SEQ ID NO: 334971 - RNA, 64 nt, Homo Sapiens; identical to SEQ ID NO: 110722

SEQ ID NO: 334972 - RNA, 64 nt, Homo Sapiens; identical to SEQ ID NO: 110723

SEQ ID NO: 334973 - RNA, 64 nt, Homo Sapiens; identical to SEQ ID NO: 110724

SEQ ID NO: 334974 - RNA, 64 nt, Homo Sapiens; identical to SEQ ID NO: 110725

SEQ ID NO: 334975 - RNA, 64 nt, Homo Sapiens; identical to SEQ ID NO: 110726

SEQ ID NO: 334976 - RNA, 64 nt, Homo Sapiens; identical to SEQ ID NO: 110727

SEQ ID NO: 334977 - RNA, 64 nt, Homo Sapiens; identical to SEQ ID NO: 110728

SEQ ID NO: 334978 - RNA, 64 nt, Homo Sapiens; identical to SEQ ID NO: 110729

SEQ ID NO: 334979 - RNA, 64 nt, Homo Sapiens; identical to SEQ ID NO: 110730

SEQ ID NO: 334980 - RNA, 64 nt, Homo Sapiens; identical to SEQ ID NO: 110731

SEQ ID NO: 334981 - RNA, 64 nt, Homo Sapiens; identical to SEQ ID NO: 110732

SEQ ID NO: 334982 - RNA, 64 nt, Homo Sapiens; identical to SEQ ID NO: 110733

SEQ ID NO: 334983 - RNA, 64 nt, Homo Sapiens; identical to SEQ ID NO: 110734

SEQ ID NO: 334984 - RNA, 64 nt, Homo Sapiens; identical to SEQ ID NO: 110735

SEQ ID NO: 334985 - RNA, 64 nt, Homo Sapiens; identical to SEQ ID NO: 110736

SEQ ID NO: 334986 - RNA, 64 nt, Homo Sapiens; identical to SEQ ID NO: 110737

SEQ ID NO: 334987 - RNA, 64 nt, Homo Sapiens; identical to SEQ ID NO: 110738

SEQ ID NO: 334988 - RNA, 64 nt, Homo Sapiens; identical to SEQ ID NO: 110739

SEQ ID NO: 334989 - RNA, 64 nt, Homo Sapiens; identical to SEQ ID NO: 110740

SEQ ID NO: 334990 - RNA, 64 nt, Homo Sapiens; identical to SEQ ID NO: 110741

SEQ ID NO: 334991 - RNA, 64 nt, Homo Sapiens; identical to SEQ ID NO: 110742

SEQ ID NO: 334992 - RNA, 64 nt, Homo Sapiens; identical to SEQ ID NO: 110741

SEQ ID NO: 334993 - RNA, 64 nt, Homo Sapiens; identical to SEQ ID NO: 110744

SEQ ID NO: 334994 - RNA, 64 nt, Homo Sapiens; identical to SEQ ID NO: 110745

SEQ ID NO: 334995 - RNA, 64 nt, Homo Sapiens; identical to SEQ ID NO: 110746

SEQ ID NO: 334996 - RNA, 64 nt, Homo Sapiens; identical to SEQ ID NO: 110747

SEQ ID NO: 334997 - RNA, 64 nt, Homo Sapiens; identical to SEQ ID NO: 110748

SEQ ID NO: 334998 - RNA, 64 nt, Homo Sapiens; identical to SEQ ID NO: 110749

SEQ ID NO: 334999 - RNA, 64 nt, Homo Sapiens; identical to SEQ ID NO: 110750

SEQ ID NO: 335000 - RNA, 64 nt, Homo Sapiens; identical to SEQ ID NO: 110751

SEQ ID NO: 335001 - RNA, 64 nt, Homo Sapiens; identical to SEQ ID NO: 110752

SEQ ID NO: 335002 - RNA, 64 nt, Homo Sapiens; identical to SEQ ID NO: 110753

SEQ ID NO: 335003 - RNA, 64 nt, Homo Sapiens; identical to SEQ ID NO: 110754

SEQ ID NO: 335004 - RNA, 64 nt, Homo Sapiens; identical to SEQ ID NO: 110755

SEQ ID NO: 335005 - RNA, 64 nt, Homo Sapiens; identical to SEQ ID NO: 110756

SEQ ID NO: 335006 - RNA, 64 nt, Homo Sapiens; identical to SEQ ID NO: 110757

SEQ ID NO: 335007 - RNA, 64 nt, Homo Sapiens; identical to SEQ ID NO: 110758

SEQ ID NO: 335008 - RNA, 64 nt, Homo Sapiens; identical to SEQ ID NO: 110759

SEQ ID NO: 335009 - RNA, 64 nt, Homo Sapiens; identical to SEQ ID NO: 110760

SEQ ID NO: 335010 - RNA, 64 nt, Homo Sapiens; identical to SEQ ID NO: 110761

SEQ ID NO: 335011 - RNA, 64 nt, Homo Sapiens; identical to SEQ ID NO: 110762

SEQ ID NO: 335012 - RNA, 64 nt, Homo Sapiens; identical to SEQ ID NO: 110763

SEQ ID NO: 335013 - RNA, 64 nt, Homo Sapiens; identical to SEQ ID NO: 110764

SEQ ID NO: 335014 - RNA, 64 nt, Homo Sapiens; identical to SEQ ID NO: 110765

SEQ ID NO: 335015 - RNA, 64 nt, Homo Sapiens; identical to SEQ ID NO: 110766

SEQ ID NO: 335016 - RNA, 64 nt, Homo Sapiens; identical to SEQ ID NO: 110767

SEQ ID NO: 335017 - RNA, 64 nt, Homo Sapiens; identical to SEQ ID NO: 110768

SEQ ID NO: 335018 - RNA, 64 nt, Homo Sapiens; identical to SEQ ID NO: 110769

SEQ ID NO: 335019 - RNA, 64 nt, Homo Sapiens; identical to SEQ ID NO: 110770

SEQ ID NO: 335020 - RNA, 64 nt, Homo Sapiens; identical to SEQ ID NO: 110771

SEQ ID NO: 335021 - RNA, 64 nt, Homo Sapiens; identical to SEQ ID NO: 110772

SEQ ID NO: 335022 - RNA, 64 nt, Homo Sapiens; identical to SEQ ID NO: 110773

SEQ ID NO: 335023 - RNA, 64 nt, Homo Sapiens; identical to SEQ ID NO: 110774

SEQ ID NO: 335024 - RNA, 64 nt, Homo Sapiens; identical to SEQ ID NO: 110775

SEQ ID NO: 335025 - RNA, 64 nt, Homo Sapiens; identical to SEQ ID NO: 110776

SEQ ID NO: 335026 - RNA, 64 nt, Homo Sapiens; identical to SEQ ID NO: 110777

SEQ ID NO: 335027 - RNA, 64 nt, Homo Sapiens; identical to SEQ ID NO: 110778

SEQ ID NO: 335028 - RNA, 64 nt, Homo Sapiens; identical to SEQ ID NO: 110779

SEQ ID NO: 335029 - RNA, 64 nt, Homo Sapiens
cuuuccacacaggauuccguuggugaaccuguaaaaacaaaacaaacaaaacaaaacaaaaaag

SEQ ID NO: 335030 - RNA, 64 nt, Homo Sapiens
caggauuccguuggugaaccuguaaaaacaaaacaaacaaaacaaaacaaaaaagacaaaaccu

SEQ ID NO: 335031 - RNA, 64 nt, Homo Sapiens
uuccguuggugaaccuguaaaaacaaaacaaacaaaacaaaacaaaaaagacaaaaccuaaaac

SEQ ID NO: 335032 - RNA, 64 nt, Homo Sapiens
uuggugaaccuguaaaaacaaaacaaacaaaacaaaacaaaaaagacaaaaccuaaaacugagc

SEQ ID NO: 335033 - RNA, 64 nt, Homo Sapiens
cuugcacugcuguggauuuuuuuaagagaagcaaaaacaaaaguaaacuccuuucccuggcccu

SEQ ID NO: 335034 - RNA, 64 nt, Homo Sapiens
cuuuugaaaugucccuuuaagauuuuuuuauucuaaacaaaauaaagaaaauccugcugcucug

SEQ ID NO: 335035 - RNA, 64 nt, Homo Sapiens
acuccagccugguuacagagcaagacucugucucaaacaaaacaaaacaaaacaaaaacacacu

SEQ ID NO: 335036 - RNA, 64 nt, Homo Sapiens
agccugguuacagagcaagacucugucucaaacaaaacaaaacaaaacaaaaacacacuacugu

SEQ ID NO: 335037 - RNA, 64 nt, Homo Sapiens
gguuacagagcaagacucugucucaaacaaaacaaaacaaaacaaaaacacacuacuguauuuu

SEQ ID NO: 335038 - RNA, 64 nt, Homo Sapiens
cagagcaagacucugucucaaacaaaacaaaacaaaacaaaaacacacuacuguauuuuggaug

SEQ ID NO: 335039 - RNA, 64 nt, Homo Sapiens
gcauuccucaucaccaucguguuugcaaagguuaaaacaaaaacaaaaaaccacaaaaauaaaa

SEQ ID NO: 335040 - RNA, 64 nt, Homo Sapiens
cucaucaccaucguguuugcaaagguuaaaacaaaaacaaaaaaccacaaaaauaaaaaacaaa

SEQ ID NO: 335041 - RNA, 64 nt, Homo Sapiens
gguuaaaacaaaaacaaaaaaccacaaaaauaaaaaacaaaaaaaacaaaaaacccaagaaaaa

SEQ ID NO: 335042 - RNA, 64 nt, Homo Sapiens
aaaaacaaaaaaccacaaaaauaaaaaacaaaaaaaacaaaaaacccaagaaaaaaaaaaagag

SEQ ID NO: 335043 - RNA, 64 nt, Homo Sapiens
aagcaaaccaauaccauugauaagaagaagauaaaaacaaaauauuuuggaguguuuuccaacu

SEQ ID NO: 335044 - RNA, 64 nt, Homo Sapiens
gcugguuuuaguacucugaaggacaaaaacaagcaaacaaaaaccccugcugcagcauuucagg

SEQ ID NO: 335045 - RNA, 64 nt, Homo Sapiens
cucugcauguauauuugauaacaugucuuuuguaaaacaaaaauuacaaaaaaauuuguuuaca

SEQ ID NO: 335046 - RNA, 64 nt, Homo Sapiens
cagccuggcgacacagugagacucugucucaaaaaaacaaaacaaacaaacaaaaauacaaaaa

SEQ ID NO: 335047 - RNA, 64 nt, Homo Sapiens
cagugagacucugucucaaaaaaacaaaacaaacaaacaaaaauacaaaaaauuagccgggcgu

SEQ ID NO: 335048 - RNA, 64 nt, Homo Sapiens
aggcaggagcccuggggugagaaaagcaaaaaacaaacaaaaaacaaaacccuggaguguuagg

SEQ ID NO: 335049 - RNA, 64 nt, Homo Sapiens
agcccuggggugagaaaagcaaaaaacaaacaaaaaacaaaacccuggaguguuaggaggagag

SEQ ID NO: 335050 - RNA, 64 nt, Homo Sapiens
gagacaaacuuuuuuuagaauugaagucugaaacaaacaaaagcaauucaaugucaauagacau

SEQ ID NO: 335051 - RNA, 64 nt, Homo Sapiens
acacuuguucuuuacagaaaaauaaagauauuuuaaacaaaauacuagggccaugguauguaau

SEQ ID NO: 335052 - RNA, 64 nt, Homo Sapiens
agauuaagaaaaagaaccagcugaaccaugaaacaaacaaaaauccuaaaagugauucuuguca

SEQ ID NO: 335053 - RNA, 64 nt, Homo Sapiens
guaggaaauguucuuuuuuaaaaaaaaauaacaaaaacaaaacaaaacuauuuauuuugugauu

SEQ ID NO: 335054 - RNA, 64 nt, Homo Sapiens
aaauguucuuuuuuaaaaaaaaauaacaaaaacaaaacaaaacuauuuauuuugugauuguuuu

SEQ ID NO: 335055 - RNA, 64 nt, Homo Sapiens
cuuaaugaacuugcaaaggaauauugcuaaaaacaaacaaaaaaaacuguuaucgaacuuucuu

SEQ ID NO: 335056 - RNA, 64 nt, Homo Sapiens
uacuuuauuuuuuugugccuucugaaaggaucuaaaacaaaaauauuuugccuuuuuuucccca

SEQ ID NO: 335057 - RNA, 64 nt, Homo Sapiens
aaauaugucaugugaaauuauuuuaaaaauguaaaaacaaaacuuucugcuaacaaaauacaua

SEQ ID NO: 335058 - RNA, 64 nt, Homo Sapiens
aaaaguuaagcuuuugcaaaguugucaaaaguucaaacaaaagucuaguugggauuuuuuacca

SEQ ID NO: 335059 - RNA, 64 nt, Homo Sapiens
gcauaaguuacaaccccuaggagcucugcuuucaaaacaaaaagagauugggggaguggggagg

SEQ ID NO: 335060 - RNA, 64 nt, Homo Sapiens
aggaugucaaauagucacaguucuaaguaguuggaaacaaaauugacgcauguuaaucuaugca

SEQ ID NO: 335061 - RNA, 64 nt, Homo Sapiens
auguuuaaaucaaucuguaaaagguaaaaaugaaaaacaaaaacaagcaaacaaacaaaaaaca

SEQ ID NO: 335062 - RNA, 64 nt, Homo Sapiens
aaaagguaaaaaugaaaaacaaaaacaagcaaacaaacaaaaaacaauggaaaagaugaagcug

SEQ ID NO: 335063 - RNA, 64 nt, Homo Sapiens
uauauguucagcaauguugaucucauaaaaggaaaaacaaaagauuuaaguauucuauauacca

SEQ ID NO: 335064 - RNA, 64 nt, Homo Sapiens
uuaacuaaaaaugcugagaccccuuuuuauagaaaaacaaaaagacaucaagucuucuuaauuc

SEQ ID NO: 335065 - RNA, 63 nt, Homo Sapiens
aaaaacggcuucuuggcguuugugaaagaaaacaaaacaaaacugagaucgcgguauuaaauc

SEQ ID NO: 335066 - RNA, 64 nt, Homo Sapiens
aaacaaaaacggcuucuuggaaaucugugaaagaaaacaaaacauuggcugagaucgcgguauu

SEQ ID NO: 335067 - RNA, 64 nt, Homo Sapiens
acuggggccccauggcacacuccacuaaacauaaaaacaaaauuaaacaaagcgagacccuguc

SEQ ID NO: 335068 - RNA, 64 nt, Homo Sapiens
ugguauauuuauacaacagaaugaauaaauggauaaacaaaauaaacaacccaaauguccaaga

SEQ ID NO: 335069 - RNA, 64 nt, Homo Sapiens
aaauugacucaguacuauuuacaaauauuuaaaaaaacaaaaagaaggcuuguaaauacauaga

SEQ ID NO: 335070 - RNA, 64 nt, Homo Sapiens
aacaauuuaaguauuuuuuuaaauacacaaaaugaaacaaaagacugaggauaacuaaaacuuc

SEQ ID NO: 335071 - RNA, 64 nt, Homo Sapiens
guuuuuaaaacugauuuuagaaaaaacaaaaaaaaaacaaaacagcaaaaaaaaaaaaaaaaca

SEQ ID NO: 335072 - RNA, 64 nt, Homo Sapiens
aaaacaaaacaguuuuuaaaaaaaaaaaacaaaaaaacaaaaaaaauaguccugagcaaaaaaa

SEQ ID NO: 335073 - RNA, 64 nt, Homo Sapiens
acaaaaaaaaaacaaaacagcaaaaaaaaaaaaaaaacaaaaaaugaaagcaaauaguccugag

SEQ ID NO: 335074 - RNA, 64 nt, Homo Sapiens
accugagaaguuugaauuguuaaaaaacaaacaaaaacaaaaaauccccaccuccucauuuuag

SEQ ID NO: 335075 - RNA, 64 nt, Homo Sapiens
aaaaaaaccugagaaguuuguuuuaguaaaaaacaaacaaaaacagcucuuccccaccuccuca

SEQ ID NO: 335076 - RNA, 64 nt, Homo Sapiens
augcuuuucgaaauuguuuccaucccagaaaacaaaacaaaauacuguagauucucuccucucc

SEQ ID NO: 335077 - RNA, 64 nt, Homo Sapiens
aaauaaugcuuuucgaaauuucucccaucccagaaaacaaaacacaaaucuguagauucucucc

SEQ ID NO: 335078 - RNA, 64 nt, Homo Sapiens
caacaccaaaaaaacagcaguaaaaaaaaaaaaaaaacaaaaaacccaccugggcacuuuuaga

SEQ ID NO: 335079 - RNA, 64 nt, Homo Sapiens
gaaaucucucuauaaaaugaauuggaacaaaagcaaacaaaaaaccucaaccacucuccuaaug

SEQ ID NO: 335080 - RNA, 64 nt, Homo Sapiens
aacaacaaaaaaagcuaaguuggaaaaaaacaaaaaacaaaaaacauuuuaaggaacuauucuu

SEQ ID NO: 335081 - RNA, 64 nt, Homo Sapiens
caaaaaaaacaacaaaaaaauauucuuuggaaaaaaacaaaaaagagcauccauuuuaaggaac

SEQ ID NO: 335082 - RNA, 64 nt, Homo Sapiens
agagauugggucuuucccagaacaaaacaaaacaaaacaaaauuagcgacacucggucucaaaa

SEQ ID NO: 335083 - RNA, 64 nt, Homo Sapiens
aaauuagagauugggucuuucaaaaaacaaaacaaaacaaaacagacagagcgacacucggucu

SEQ ID NO: 335084 - RNA, 64 nt, Homo Sapiens
aaacaaaauuagagauugggggucucaaaaaacaaaacaaaacaugggugacagagcgacacuc

SEQ ID NO: 335085 - RNA, 64 nt, Homo Sapiens
aaacaaaacaaaauuagagacacucggucucaaaaaacaaaacacagccugggugacagagcga

SEQ ID NO: 335086 - RNA, 64 nt, Homo Sapiens
acauuuugagaacaaagaugauaaagguaaaacaaaacaaaacacuguacaaaggggaaagaac

SEQ ID NO: 335087 - RNA, 64 nt, Homo Sapiens
aaacaacauuuugagaacaaagaacauaaagguaaaacaaaacaagcaucuguacaaaggggaa

SEQ ID NO: 335088 - RNA, 64 nt, Homo Sapiens
aacccaccuauuuguguuguuucauauuauuaaaaaacaaaaaacuguuuguggcuauuuuaaa

SEQ ID NO: 335089 - RNA, 64 nt, Homo Sapiens
acuagacugaguuuccucuuagauguuuggauggaaacaaaagccugugaauaaaggaauguau

SEQ ID NO: 335090 - RNA, 64 nt, Homo Sapiens
aagaguggaaacuauucuauaucccaguucaaagaaacaaaaaaaaacaaaacuuuggaccaaa

SEQ ID NO: 335091 - RNA, 54 nt, Homo Sapiens
uuggaccaaaaucccaguucaaacaaacaaaacugaggcagaagcagauacuag

SEQ ID NO: 335092 - RNA, 64 nt, Homo Sapiens
cauguuacuaaaagacagguucucaaaaacaaaaaaacaaaauuggcgacagagcaagacgcca

SEQ ID NO: 335093 - RNA, 64 nt, Homo Sapiens
acaaaauucauguuacuaaaagacgccaucucaaaaacaaaaaaccagccugggcgacagagca

SEQ ID NO: 335094 - RNA, 64 nt, Homo Sapiens
aaagaaacuaagaaucuuacagucagauuguaaaaaacaaaaacgaguauaugugucuuaaugc

SEQ ID NO: 335095 - RNA, 59 nt, Homo Sapiens
aaaccugaaaacugcuuggcaaguaaaacaaacaaaaacacuacaaaagaaaaauauaa

SEQ ID NO: 335096 - RNA, 64 nt, Homo Sapiens
uugaaagaaacacaucgcauacuaaugucauuggaaacaaaagccuaaacaaaagaaaaccuaa

SEQ ID NO: 335097 - RNA, 64 nt, Homo Sapiens
aaaccuaaacuaaugucauuaucaagugagagcuaaacaaaagacugaaagaaagaagacugca

SEQ ID NO: 335098 - RNA, 64 nt, Homo Sapiens
aaauaaaaaaguugugccugcugauuuaaaaacaaaacaaaaaacuaggacccgguuucuuuua

SEQ ID NO: 335099 - RNA, 64 nt, Homo Sapiens
aaaaaaaauaaaaaaguuguuuuuacugauuuaaaaacaaaacaagcuucuaggacccgguuuc

SEQ ID NO: 335100 - RNA, 64 nt, Homo Sapiens
aaugaaugcacaaacuugcuacauauuuaaacaaaaacaaaaaaccagcagugugauaauuuaa

SEQ ID NO: 335101 - RNA, 64 nt, Homo Sapiens
aaaaaaaaugaaugcacaaaauuuaaacauauuuaaacaaaaacggagugccagcagugugaua

SEQ ID NO: 335102 - RNA, 64 nt, Homo Sapiens
aaaccuuguuccuuuauaggagaaaaaaaacaaaaaacaaaaaacuucacuugccuagucuuga

SEQ ID NO: 335103 - RNA, 64 nt, Homo Sapiens
caaaaaaaaaccuuguuccugucuugaagaaaaaaaacaaaaaacccacugcuucacuugccua

SEQ ID NO: 335104 - RNA, 64 nt, Homo Sapiens
cuuguaaugcaauuaauuaauaaaaccaaagucaaaacaaaacuauaaagccccucuuugcauu

SEQ ID NO: 335105 - RNA, 64 nt, Homo Sapiens
aagccccucuuugcauuuaagugcucuguguacuaaacaaaauaacaggaaauaugacuuggaa

SEQ ID NO: 335106 - RNA, 64 nt, Homo Sapiens
ggacugucuggaaagcuaaaugaauuuguaaacaaaacaaaauucuucaccuuguacugcaaga

SEQ ID NO: 335107 - RNA, 64 nt, Homo Sapiens
aaauuggacugucuggaaagcaagaugaauuuguaaacaaaacauuuggcuucaccuuguacug

SEQ ID NO: 335108 - RNA, 64 nt, Homo Sapiens
acacuaggaguccacucaacaaaaaaacaaaacaaaacaaaaaaacaucgugcagucgugucau

SEQ ID NO: 335109 - RNA, 64 nt, Homo Sapiens
aaaaaacacuaggaguccacgucauaaaaaaacaaaacaaaacagauccacaucgugcagucgu

SEQ ID NO: 335110 - RNA, 64 nt, Homo Sapiens
aaacaaaaaaacacuaggaggucgugucauaaaaaaacaaaacagaccagauccacaucgugca

SEQ ID NO: 335111 - RNA, 64 nt, Homo Sapiens
aaaugauaucuaaguaguucccuuucuuauuuaaaaacaaaaccguucccauucuaauuaaugc

SEQ ID NO: 335112 - RNA, 64 nt, Homo Sapiens
agguaucagugcauuauuaaauuuuucugucaucaaacaaaaacauuuuaaaguacuuuugguu

SEQ ID NO: 335113 - RNA, 64 nt, Homo Sapiens
aaacuaaucugcugccucuaaacaacaacaacaaaaacaaaaugaguuucaguggaugauugaa

SEQ ID NO: 335114 - RNA, 64 nt, Homo Sapiens
aauauugaaaacugaggcaguacuagcggagguaaaacaaaagacuuuacagcaacauucgcca

SEQ ID NO: 335115 - RNA, 64 nt, Homo Sapiens
caacuguugcuauaucuuuucacugaauuaaacaaaacaaaauaugacauaacucauacaucgg

SEQ ID NO: 335116 - RNA, 64 nt, Homo Sapiens
aaauacaacuguugcuauauaucggcacugaauuaaacaaaacaaaaugugacauaacucauac

SEQ ID NO: 335117 - RNA, 64 nt, Homo Sapiens
aacuuccaaacaguguguugcuggaauuaaaacaaaacaaaacauucuauguugguuucagugg

SEQ ID NO: 335118 - RNA, 64 nt, Homo Sapiens
aaacaaacuuccaaacagugaguggcuggaauuaaaacaaaacaauaacuucuauguugguuuc

SEQ ID NO: 335119 - RNA, 64 nt, Homo Sapiens
caaagaugagucgcacaucuaaaaacaaaaaaaaaaacaaaaaaagcgagacucuaucucaaaa

SEQ ID NO: 335120 - RNA, 64 nt, Homo Sapiens
aaaaacaaaaaacaaagaugucuaucucaaaaaaaaacaaaaaaccugggcaacagagcgagac

SEQ ID NO: 335121 - RNA, 64 nt, Homo Sapiens
ccuuggguugaugaaacaucacuuugugugcuuuaaacaaaauaucguuuccaaaacuauugcu

SEQ ID NO: 335122 - RNA, 64 nt, Homo Sapiens
aauguaguucagcuuuucaaauuguaauccuaacaaacaaaagauguacacagauguaauuaaa

SEQ ID NO: 335123 - RNA, 64 nt, Homo Sapiens
uuaaaaaucuuguuaaacauucuauaaagaaguaaaacaaaauccuuuuaucucaguuauuugc

SEQ ID NO: 335124 - RNA, 64 nt, Homo Sapiens
auuucugauaauuaaccuaagcccuuaugaaaauaaacaaaaugaagggauuaugacagguauu

SEQ ID NO: 335125 - RNA, 64 nt, Homo Sapiens
gugacugcuugcugacuuuaucauaauuuucuucaaacaaaaaaauguauagaaaaaucauguc

SEQ ID NO: 335126 - RNA, 64 nt, Homo Sapiens
cuauaaucuauagacaugugauagcaaaagaaacaaacaaaagccaggaaaacacucauuuucg

SEQ ID NO: 335127 - RNA, 64 nt, Homo Sapiens
ugguugcugcaaagcucaggccugaaugagcaggaaacaaaaaaggccuugcgacccagcugcc

SEQ ID NO: 335128 - RNA, 64 nt, Homo Sapiens
uaggaguauuuauguaacuaucuuaugcuucaaaaaacaaaaguauuugugugcauguguauau

SEQ ID NO: 335129 - RNA, 64 nt, Homo Sapiens
aaaaagauuccucguuauuguuguugccaaagagaaacaaaaaugauuuugcuuuccaagcuug

SEQ ID NO: 335130 - RNA, 64 nt, Homo Sapiens
acuauuuaguaagcccggauagacuuauugccaaaaacaaaaaauagcuuucaaaagaaauuua

SEQ ID NO: 335131 - RNA, 64 nt, Homo Sapiens
uuauagguaaugaagcaguucaaaacuugaaagaaaacaaaaccuguccucagaauucuauaaa

SEQ ID NO: 335132 - RNA, 64 nt, Homo Sapiens
gcgacaacuuauauacacaccuagaauguaaguuaaacaaaauaccggcuuccagagaccccuu

SEQ ID NO: 335133 - RNA, 64 nt, Homo Sapiens
uuuagaagucuuaguaauguaacuugaagauguuaaacaaaaaucucaaguaaaaugaaaagca

SEQ ID NO: 335134 - RNA, 64 nt, Homo Sapiens
uggcaacagagcgagacucugucucagaaaaaaaaaacaaaaaccaguuuaggcuggguauggu

SEQ ID NO: 335135 - RNA, 64 nt, Homo Sapiens
uguaaccaguagcugaucuuaaggcuuuuuuaaaaaacaaaacaaaacaacaaaaaaaaaucuu

SEQ ID NO: 335136 - RNA, 64 nt, Homo Sapiens
ccaguagcugaucuuaaggcuuuuuuaaaaaacaaaacaaaacaacaaaaaaaaaucuuuauaa

SEQ ID NO: 335137 - RNA, 64 nt, Homo Sapiens
aaggaacauugaacuguuagaggagugcucuuccaaacaaaacaaaaaugucucuagguuuagu

SEQ ID NO: 335138 - RNA, 64 nt, Homo Sapiens
acauugaacuguuagaggagugcucuuccaaacaaaacaaaaaugucucuagguuuagucagag

SEQ ID NO: 335139 - RNA, 64 nt, Homo Sapiens
accaacuuuuauuuggaauaauaauuuuccuccuaaacaaaaacacauugaguuuaagucucug

SEQ ID NO: 335140 - RNA, 64 nt, Homo Sapiens
cccgugaacuuccuuugacuuauuguccccacuaaaacaaaacaaaaaacuuuuaaugccuucc

SEQ ID NO: 335141 - RNA, 64 nt, Homo Sapiens
gaacuuccuuugacuuauuguccccacuaaaacaaaacaaaaaacuuuuaaugccuuccacauu

SEQ ID NO: 335142 - RNA, 64 nt, Homo Sapiens
uccaguuuggacuacagagugagacuccaucucaaaacaaaacaaaacaacaacagcaaaaaac

SEQ ID NO: 335143 - RNA, 64 nt, Homo Sapiens
uuuggacuacagagugagacuccaucucaaaacaaaacaaaacaacaacagcaaaaaacaacaa

SEQ ID NO: 335144 - RNA, 64 nt, Homo Sapiens
aaacaaaacaaaacaacaacagcaaaaaacaacaaaacaaaacacaaauacucucacagggcau

SEQ ID NO: 335145 - RNA, 64 nt, Homo Sapiens
aaaugcaguuccuuucauaauaucucagcaccagaaacaaaaauuaagauuaucaaagcauuuu

SEQ ID NO: 335146 - RNA, 64 nt, Homo Sapiens
uaaaucaagaaggccaucacuuagaacgaaccccaaacaaaaaugccauaauauaaauguguga

SEQ ID NO: 335147 - RNA, 64 nt, Homo Sapiens
cgccgaccuucagcuuugugggacuaucaggaaaaaacaaaacaaaaacaaaauguagaaaaag

SEQ ID NO: 335148 - RNA, 64 nt, Homo Sapiens
accuucagcuuugugggacuaucaggaaaaaacaaaacaaaaacaaaauguagaaaaagcaaaa

SEQ ID NO: 335149 - RNA, 64 nt, Homo Sapiens
agcuuugugggacuaucaggaaaaaacaaaacaaaaacaaaauguagaaaaagcaaaagcucuu

SEQ ID NO: 335150 - RNA, 64 nt, Homo Sapiens
aguacucuucuuuccuccuacucuaugaacuucaaaacaaaaacaaaacuuugagagcagcaca

SEQ ID NO: 335151 - RNA, 64 nt, Homo Sapiens
cuucuuuccuccuacucuaugaacuucaaaacaaaaacaaaacuuugagagcagcacaugcauc

SEQ ID NO: 335152 - RNA, 64 nt, Homo Sapiens
uccagccugggcaacagagcaagacugucucaaaaaacaaaacgaaacaaaaaaagaaaguuau

SEQ ID NO: 335153 - RNA, 64 nt, Homo Sapiens
gcaacagagcaagacugucucaaaaaacaaaacgaaacaaaaaaagaaaguuauucuuaguaag

SEQ ID NO: 335154 - RNA, 64 nt, Homo Sapiens
auuagaaaaaaugaaguuugguuggugaugcaugaaacaaaauagcaagagaggguuauaguuu

SEQ ID NO: 335155 - RNA, 64 nt, Homo Sapiens
guaggcaucaaaaggcaaaaaucaaaaaaaaaaaaaacaaaaacaaaaaaaaagaugaaccuag

SEQ ID NO: 335156 - RNA, 64 nt, Homo Sapiens
aucaaaaggcaaaaaucaaaaaaaaaaaaaacaaaaacaaaaaaaaagaugaaccuaggucugu

SEQ ID NO: 335157 - RNA, 64 nt, Homo Sapiens
acuuaaaagaaagagaaguuuucuugacuuuugaaaacaaaauaugaaaagaaucggcaauguu

SEQ ID NO: 335158 - RNA, 64 nt, Homo Sapiens
gaaaacaaaauaugaaaagaaucggcaauguuucaaacaaaaagucauaaaagucacuuuauuc

SEQ ID NO: 335159 - RNA, 64 nt, Homo Sapiens
ggccaccucccucccgcccacccacucucaccccaaacaaaaucacaaaaccuggacaucccuc

SEQ ID NO: 335160 - RNA, 64 nt, Homo Sapiens
ugaguauuauuugacuccggucuccuuggugcaaaaacaaaaugggaaaaauaaauaagaauaa

SEQ ID NO: 335161 - RNA, 64 nt, Homo Sapiens
aagcucccuucccuuccuccucaguccuauuuaaaaacaaaaccugauuuuucaauguuauucu

SEQ ID NO: 335162 - RNA, 64 nt, Homo Sapiens
cacagaggcggaaauaccgggaaaaaggaauuuaaaacaaaaacaaguaucagcacccagaaga

SEQ ID NO: 335163 - RNA, 64 nt, Homo Sapiens
cacaaaacauaauaaaacacaaaguuaaacaaacaaacaaaaaagcaaacugagguagcgacac

SEQ ID NO: 335164 - RNA, 64 nt, Homo Sapiens
augucucagguuuguuuuguauugcuuuuuuccaaaacaaaaagagcuuugacucuauaagcaa

SEQ ID NO: 335165 - RNA, 64 nt, Homo Sapiens
cgaaugaaaauaacugaauuaagaaaggaaaagaaaacaaaaaaauaugcuuauaaccuaguua

SEQ ID NO: 335166 - RNA, 64 nt, Homo Sapiens
aagagggcauagaugcaauccacacaaaauuucaaaacaaaaacugaaauauaaggcacguuuu

SEQ ID NO: 335167 - RNA, 64 nt, Homo Sapiens
caggggccaauaaauucccuaaaagaaaaacaaaaaacaaaaaacucaugcucuuguuucucaa

SEQ ID NO: 335168 - RNA, 64 nt, Homo Sapiens
caaaaaacaggggccaauaauucucaaaaaagaaaaacaaaaaacaaguaucucaugcucuugu

SEQ ID NO: 335169 - RNA, 64 nt, Homo Sapiens
gugugacauuacagaugagaaaaaaaaaagagagaaacaaaaaauuauuuguaugcuucaaaaa

SEQ ID NO: 335170 - RNA, 64 nt, Homo Sapiens
gauuauaccaguauaaaagcuaguuuaauuuuauaaacaaaacuguuaaucaucauuuuuccuu

SEQ ID NO: 335171 - RNA, 64 nt, Homo Sapiens
guuugauugagacaaugaagauuuaaaaaaauaaaaacaaaaaagagagaaaaggguguuuuaa

SEQ ID NO: 335172 - RNA, 64 nt, Homo Sapiens
ccaaacaagccuuagcuuuuaaaaaccuaaaaauaaacaaaaaggguuaggucaugaggacacc

SEQ ID NO: 335173 - RNA, 64 nt, Homo Sapiens
aaaaugauaaaaacucucaguucaaaacaaaaugaaacaaaaaauuugaaaauaaaucuuagug

SEQ ID NO: 335174 - RNA, 64 nt, Homo Sapiens
aaacaaaaaaaaaaugauaaaaucuuaguguucaaaacaaaaugcugugugcuguuugaaaaua

SEQ ID NO: 335175 - RNA, 64 nt, Homo Sapiens
ugcaugcagcagcuuuugacuguugucuaaagcuaaacaaaacuaguuuauaucuugauuauuu

SEQ ID NO: 335176 - RNA, 64 nt, Homo Sapiens
uguugcuauuuccuaaccuggaaaacaaacaaacaaacaaaaacuagcccccuugaucccuaaa

SEQ ID NO: 335177 - RNA, 64 nt, Homo Sapiens
uuuuuaucaaauguuaugauaaaacaaaaaacaaaaacaaaagauuuauuuuaguaaaaaaaaa

SEQ ID NO: 335178 - RNA, 64 nt, Homo Sapiens
aaaagauuuuuaucaaauguaaaaaaaaaacaaaaaacaaaaacaacagguuuauuuuaguaaa

SEQ ID NO: 335179 - RNA, 64 nt, Homo Sapiens
caaaaacaaaagauuuuuauuaguaaaaaaaaaaaaacaaaaaaucccccgaacagguuuauuu

SEQ ID NO: 335180 - RNA, 64 nt, Homo Sapiens
ggcaagaucacuaaaaaauaaauacaaugaugacaaacaaaacucuucuauaaaccaggcuguu

SEQ ID NO: 335181 - RNA, 64 nt, Homo Sapiens
uuaugcagaacaucucugugggaacucuuucuucaaacaaaagccaaccccguuuuuaagcaau

SEQ ID NO: 335182 - RNA, 64 nt, Homo Sapiens
aaacaacaacaacaaaauuaaaaaaaaacccaaaaaacaaaaacacagagugagacugcaucuc

SEQ ID NO: 335183 - RNA, 64 nt, Homo Sapiens
acaaauuagucggguguggucugaaaaacaacaaaaacaaaaacaugguaaaacccugucucua

SEQ ID NO: 335184 - RNA, 64 nt, Homo Sapiens
aacacaaaccaucaucacagaaaaacgaaaacaaaaacaaaaaaugagacuccaucucauuaaa

SEQ ID NO: 335185 - RNA, 64 nt, Homo Sapiens
aaaaaaaacacaaaccaucaauuaaaaaaaacgaaaacaaaaacacagagugagacuccaucuc

SEQ ID NO: 335186 - RNA, 64 nt, Homo Sapiens
aacaauccaugaacuuagaucaauugagaaaacaaaacaaaagguauggaccccugagaaugag

SEQ ID NO: 335187 - RNA, 64 nt, Homo Sapiens
aaaggaacaauccaugaacuaugagcaauugagaaaacaaaacauuguauauggaccccugaga

SEQ ID NO: 335188 - RNA, 64 nt, Homo Sapiens
caaaaaagucacccuaucagcuguccuuaaaacaaaacaaaaacuucaauaaaaaaaagagaaa

SEQ ID NO: 335189 - RNA, 64 nt, Homo Sapiens
aaaaccaaaaaagucacccuagaaacuguccuuaaaacaaaacauucauuucaauaaaaaaaag

SEQ ID NO: 335190 - RNA, 64 nt, Homo Sapiens
uugaaggagaggagggcggggaaauuuuucuguaaaacaaaaccauuugcagauacaaaagaug

SEQ ID NO: 335191 - RNA, 64 nt, Homo Sapiens
ggacagaaacaggaaugugagggaccuuuaaagaaaacaaaacugcacccgggugggggacaga

SEQ ID NO: 335192 - RNA, 64 nt, Homo Sapiens
ugguuuucuccuucccaaggcagcuggauugaaaaaacaaaacaaaacaaaaaaacccaggggc

SEQ ID NO: 335193 - RNA, 64 nt, Homo Sapiens
uucuccuucccaaggcagcuggauugaaaaaacaaaacaaaacaaaaaaacccaggggcgucag

SEQ ID NO: 335194 - RNA, 64 nt, Homo Sapiens
cuucccaaggcagcuggauugaaaaaacaaaacaaaacaaaaaaacccaggggcgucagucgau

SEQ ID NO: 335195 - RNA, 64 nt, Homo Sapiens
accccaagaggaaguuuucugaaauaagauuuaaaaacaaaacaaaaaaaacacuuaauauuuc

SEQ ID NO: 335196 - RNA, 64 nt, Homo Sapiens
aagaggaaguuuucugaaauaagauuuaaaaacaaaacaaaaaaaacacuuaauauuucagacu

SEQ ID NO: 335197 - RNA, 64 nt, Homo Sapiens
aaaaauuuccagaagaggaaaaaaaaacuacaaaaaacaaaacauugaagguugauauuuuaug

SEQ ID NO: 335198 - RNA, 64 nt, Homo Sapiens
aggcucucgaggcaagcugucaacgucuuguugaaaacaaaaaucaagaaagaauugaaauacu

SEQ ID NO: 335199 - RNA, 64 nt, Homo Sapiens
gauaggagcuuauggucaaaaagugcaaaaaaaaaaacaaaaaaaaagcaauagauagagaaau

SEQ ID NO: 335200 - RNA, 64 nt, Homo Sapiens
uuguucuguuggugugauucaaagcaaaacaaacaaacaaaaacaaauuuuaagaacacaacaa

SEQ ID NO: 335201 - RNA, 64 nt, Homo Sapiens
ucuuugacaaaaauguguacuguguaagccuugcaaacaaaaaacaacaaaaaagaagcagcag

SEQ ID NO: 335202 - RNA, 64 nt, Homo Sapiens
aagacacaagaaaagcauuucagaggcuaauuuaaaacaaaaaguaagcaccuaaaggcaagga

SEQ ID NO: 335203 - RNA, 64 nt, Homo Sapiens
uccauuuccuagguaauuuuuuaaaagccagucaaaacaaaaacuuuacugaaaauggacagaa

SEQ ID NO: 335204 - RNA, 50 nt, Homo Sapiens
auuuauuguaucccauguaaaaacaaaaaaacaaaaaacaaagaaaagaa

SEQ ID NO: 335205 - RNA, 58 nt, Homo Sapiens
auuuauuguaucccauguaaaaacaaaaaaacaaaaaacaaagaaaagaaagagauuu

SEQ ID NO: 335206 - RNA, 64 nt, Homo Sapiens
aacuaguuucauauauuaccuaguuauucuuucaaaacaaaacaaaaaaaaaacaaaaacugac

SEQ ID NO: 335207 - RNA, 64 nt, Homo Sapiens
guuucauauauuaccuaguuauucuuucaaaacaaaacaaaaaaaaaacaaaaacugacgcacu

SEQ ID NO: 335208 - RNA, 64 nt, Homo Sapiens
augaguaaaauuggaaaacacuuuuaacugaaaaaaacaaaagcacaacaaaccaaaacauggg

SEQ ID NO: 335209 - RNA, 64 nt, Homo Sapiens
cacccccucaaaagacucaaauuacuagaaucagaaacaaaagucaagauuuuauuaccaaacu

SEQ ID NO: 335210 - RNA, 64 nt, Homo Sapiens
ccuugguccuggaacauuuauguuccuuuuaaagaaacaaaaaucaaacuuuacagaaagauuu

SEQ ID NO: 335211 - RNA, 64 nt, Homo Sapiens
caaaaaaaggaaggaagggacacauaucaaacugaaacaaaauuagaaauguaauuauguucua

SEQ ID NO: 335212 - RNA, 64 nt, Homo Sapiens
uuagccugggcaacagugagugagacucggucucaaacaaaaaccaaauugggaaauucuucuu

SEQ ID NO: 335213 - RNA, 64 nt, Homo Sapiens
aauauguuucucuuaacaccugaaacuuguuuuaaaacaaaaagcaguauucacuucaaaucau

SEQ ID NO: 335214 - RNA, 64 nt, Homo Sapiens
uaaacuuugaagauuguuuguaucuuuuuuuaaaaaacaaaacaaaacaaaaauccccaaaaua

SEQ ID NO: 335215 - RNA, 64 nt, Homo Sapiens
uuugaagauuguuuguaucuuuuuuuaaaaaacaaaacaaaacaaaaauccccaaaauauauag

SEQ ID NO: 335216 - RNA, 64 nt, Homo Sapiens
agauuguuuguaucuuuuuuuaaaaaacaaaacaaaacaaaaauccccaaaauauauagaaaug

SEQ ID NO: 335217 - RNA, 64 nt, Homo Sapiens
auuuguauuuagaaaagguuuauauuauuagugaaaacaaaacuaaagggaaguucaaguucuc

SEQ ID NO: 335218 - RNA, 64 nt, Homo Sapiens
gucucauauaauaaggugaugucggaaacacgcaaaacaaaacgaaaaaagauuucucaguaua

SEQ ID NO: 335219 - RNA, 64 nt, Homo Sapiens
gaagauugcuaaauuaaauaauuuauagcuccaaaaacaaaaauauacuuguauaugucacaga

SEQ ID NO: 335220 - RNA, 64 nt, Homo Sapiens
aaauuaaaacucuugguggucacauauuguauauaaacaaaacaauaugcuuuguugaaggaaa

SEQ ID NO: 335221 - RNA, 64 nt, Homo Sapiens
ggagcucacauggauauauuuaagugagcaugucaaacaaaauaucggcagaacugaugugagg

SEQ ID NO: 335222 - RNA, 64 nt, Homo Sapiens
uaugcaaugaaugaauuuuggaauccaagcuauuaaacaaaaagucaaucaaaucuguaacacu

SEQ ID NO: 335223 - RNA, 63 nt, Homo Sapiens
aaacaaaagagaacuaugcauuucaaaaaacaaaaaacaaaacguaauuguacugcaauaauu

SEQ ID NO: 335224 - RNA, 64 nt, Homo Sapiens
caaaacaaacaaaagagaacaauaauuuuucaaaaaacaaaaaaaauaggaguaauuguacugc

SEQ ID NO: 335225 - RNA, 64 nt, Homo Sapiens
cacauuaaaauuuuaaguugcaaaaaagaauaagaaacaaaaaaugguucaaauuauaucuaaa

SEQ ID NO: 335226 - RNA, 64 nt, Homo Sapiens
gaauaagaaacaaaaaacacuucaaauuauaucuaaacaaaaaaagaaaagaaaagaaacaugg

SEQ ID NO: 335227 - RNA, 64 nt, Homo Sapiens
aaccucccuuccccagcagggggaaaacaaaacaaaacaaaacaggugcaagauaaaaggucuu

SEQ ID NO: 335228 - RNA, 64 nt, Homo Sapiens
aaacaaaccucccuuccccagucuugggaaaacaaaacaaaacaucucuggugcaagauaaaag

SEQ ID NO: 335229 - RNA, 64 nt, Homo Sapiens
aaacaaaacaaaccucccuuaaaaggucuugggaaaacaaaacauaaauucucuggugcaagau

SEQ ID NO: 335230 - RNA, 64 nt, Homo Sapiens
cagcuuaucuaaucuaaugaagcuaagacaaacaaaacaaaacauuuucuagaaguuaaacaag

SEQ ID NO: 335231 - RNA, 64 nt, Homo Sapiens
aaacacagcuuaucuaaucuacaagagcuaagacaaacaaaacaacuaguuuucuagaaguuaa

SEQ ID NO: 335232 - RNA, 64 nt, Homo Sapiens
gcuauggcacuagaauuuaaaacaaaaaacaaacaaacaaaaaauaugaacaaaacaaaacaac

SEQ ID NO: 335233 - RNA, 64 nt, Homo Sapiens
acaacaaaaaacaaacaaaccuuucuuaugaacaaaacaaaacagauaaguaguaucuuucucu

SEQ ID NO: 335234 - RNA, 64 nt, Homo Sapiens
ccagugucacaugggccugauucaaacaaaacuaaaacaaaaauuaagaacuauuuuuaaaaua

SEQ ID NO: 335235 - RNA, 64 nt, Homo Sapiens
aaaacaaaaauccagugucauuuuuaaaauauucaaacaaaacuuagaaaauaaguaagaacua

SEQ ID NO: 335236 - RNA, 64 nt, Homo Sapiens
aaugccuagacaucagggucucuugcuaagggauaaacaaaagcuacauaacuuuaggucuaag

SEQ ID NO: 335237 - RNA, 64 nt, Homo Sapiens
cacgcgaaugggcacuuguaauuuaauuuccgguaaacaaaaccacgcggacuaaaucauuuuc

SEQ ID NO: 335238 - RNA, 64 nt, Homo Sapiens
ugagaauuccuuaaauugauuuaauguauuuauuaaacaaaaacucuaaguagauuuuuugaca

SEQ ID NO: 335239 - RNA, 64 nt, Homo Sapiens
cauguuaucaaaaacugucaaaacacaaauccuuaaacaaaaauacuuucagccuguguagggc

SEQ ID NO: 335240 - RNA, 64 nt, Homo Sapiens
cuugcuucaagguguuuuuauaaaaaacaaucucaaacaaaagaaaauguuugcuaccuuaguu

SEQ ID NO: 335241 - RNA, 64 nt, Homo Sapiens
uucuuuaaaauauuuuaauguuuuuucaccuuuuaaacaaaaaaaaucaguuucuuguuuauau

SEQ ID NO: 335242 - RNA, 64 nt, Homo Sapiens
gcacccugaagaugacagagcauacaguguauauaaacaaaauuaaaucuaaaagaaauauaua

SEQ ID NO: 335243 - RNA, 64 nt, Homo Sapiens
uuuacuagggcugaaaagagggcaucuuagaauuaaacaaaacuuuaagguuguucacuaugau

SEQ ID NO: 335244 - RNA, 64 nt, Homo Sapiens
acauaaagcuuugaauauaauacuguguaauuauaaacaaaaauugguacuaaacauuuauaau

SEQ ID NO: 335245 - RNA, 64 nt, Homo Sapiens
aaaccuuuugguaacugugcaaacgaaaaacaaaaaacaaaaacuuuugguauuuaaagcaaaa

SEQ ID NO: 335246 - RNA, 64 nt, Homo Sapiens
caaaaacaaaccuuuugguaagcaaaaaaacgaaaaacaaaaaauuuguaguuuugguauuuaa

SEQ ID NO: 335247 - RNA, 64 nt, Homo Sapiens
aauguuaagaaauggguuucuuucaaauguuugaaaacaaaaaagcauacguuuugguguugcu

SEQ ID NO: 335248 - RNA, 64 nt, Homo Sapiens
cccauguguuaaaauacucacaaaacaaacaaacaaacaaaaaauaaucugaaguaugguauua

SEQ ID NO: 335249 - RNA, 64 nt, Homo Sapiens
cagauaacaaaauacacuuuacugguaaaauuuaaaacaaaaaaggcaaaacaaaacaaacuca

SEQ ID NO: 335250 - RNA, 64 nt, Homo Sapiens
cacuuuacugguaaaauuuaaaacaaaaaaggcaaaacaaaacaaacucauuuuccccuuaguu

SEQ ID NO: 335251 - RNA, 64 nt, Homo Sapiens
gccuggauauuauucuuguaguuuaccucuuuaaaaacaaaacaaaacaaaacaaaaaacuccc

SEQ ID NO: 335252 - RNA, 64 nt, Homo Sapiens
gauauuauucuuguaguuuaccucuuuaaaaacaaaacaaaacaaaacaaaaaacuccccuucc

SEQ ID NO: 335253 - RNA, 64 nt, Homo Sapiens
uauucuuguaguuuaccucuuuaaaaacaaaacaaaacaaaacaaaaaacuccccuuccucacu

SEQ ID NO: 335254 - RNA, 64 nt, Homo Sapiens
uuguaguuuaccucuuuaaaaacaaaacaaaacaaaacaaaaaacuccccuuccucacugccca

SEQ ID NO: 335255 - RNA, 64 nt, Homo Sapiens
aaccugaauucaccacagcuggaauagcuguggaaaacaaaauaaaacaacaaaauuaauaaug

SEQ ID NO: 335256 - RNA, 64 nt, Homo Sapiens
uucuaguaaugcaaacaaauuauuuuuuacaaaaaaacaaaauaaauaaaauuagacuuccuuc

SEQ ID NO: 335257 - RNA, 64 nt, Homo Sapiens
uggggagaggacuuaacugacuuaagaaguaggaaaacaaaaaccucucuccucagccuuccac

SEQ ID NO: 335258 - RNA, 64 nt, Homo Sapiens
acuugaaauguauugacugcugacuauauuuuaaaaacaaaaugaaauaauuugaguuguauua

SEQ ID NO: 335259 - RNA, 64 nt, Homo Sapiens
acugucuguuggauaauggcuguaaaauguuuaaaaacaaaacaaaacaaaaaagaggcacuag

SEQ ID NO: 335260 - RNA, 64 nt, Homo Sapiens
cuguuggauaauggcuguaaaauguuuaaaaacaaaacaaaacaaaaaagaggcacuagucuau

SEQ ID NO: 335261 - RNA, 64 nt, Homo Sapiens
ggauaauggcuguaaaauguuuaaaaacaaaacaaaacaaaaaagaggcacuagucuaucugca

SEQ ID NO: 335262 - RNA, 64 nt, Homo Sapiens
aguuauucucuaagaggaaacuaguguuuguuaaaaacaaaaauaaaaacaaaaccacacaagg

SEQ ID NO: 335263 - RNA, 64 nt, Homo Sapiens
agaggaaacuaguguuuguuaaaaacaaaaauaaaaacaaaaccacacaaggagaacccaauuu

SEQ ID NO: 335264 - RNA, 64 nt, Homo Sapiens
ugacagagucagacuccgucccaaaaaaacaaacaaacaaaacaaaacaaaaaaaaacagaagu

SEQ ID NO: 335265 - RNA, 64 nt, Homo Sapiens
gagucagacuccgucccaaaaaaacaaacaaacaaaacaaaacaaaaaaaaacagaaguuacaa

SEQ ID NO: 335266 - RNA, 64 nt, Homo Sapiens
agacuccgucccaaaaaaacaaacaaacaaaacaaaacaaaaaaaaacagaaguuacaaaugaa

SEQ ID NO: 335267 - RNA, 64 nt, Homo Sapiens
cuccagccuggaugacagagugagaccuugucucaaacaaaacaaaacaaaaaugaaauguucu

SEQ ID NO: 335268 - RNA, 64 nt, Homo Sapiens
gccuggaugacagagugagaccuugucucaaacaaaacaaaacaaaaaugaaauguucuaguuu

SEQ ID NO: 335269 - RNA, 64 nt, Homo Sapiens
gaugacagagugagaccuugucucaaacaaaacaaaacaaaaaugaaauguucuaguuuugguu

SEQ ID NO: 335270 - RNA, 64 nt, Homo Sapiens
gaaugguagcuuuugcacagaacuuccaaaagcaaaacaaaaacaaaaucuauuguaguuauau

SEQ ID NO: 335271 - RNA, 64 nt, Homo Sapiens
uagcuuuugcacagaacuuccaaaagcaaaacaaaaacaaaaucuauuguaguuauauacuuca

SEQ ID NO: 335272 - RNA, 64 nt, Homo Sapiens
gucagaaaauggccuucugugcuuucaaaaaaaaaaacaaaaaaaaaaccacacacacacauaa

SEQ ID NO: 335273 - RNA, 64 nt, Homo Sapiens
acagugugugugucuguugaauauuugauuguaaaaacaaaaaggcugaacuuacugcuuauau

SEQ ID NO: 335274 - RNA, 64 nt, Homo Sapiens
acaacaauacaacaagaacaucuguacaaaaacaaaacaaaacaauuucuccuacuuuacacuc

SEQ ID NO: 335275 - RNA, 64 nt, Homo Sapiens
aaacaacaacaauacaacaacacucucuguacaaaaacaaaacauaggaauuucuccuacuuua

SEQ ID NO: 335276 - RNA, 64 nt, Homo Sapiens
caagucuagcaauugaacucauuguugauaauaaaaacaaaaagaagaguguaccauuaacuug

SEQ ID NO: 335277 - RNA, 64 nt, Homo Sapiens
ccaacaacccagaaagguuucagaaaccauuaaaaaacaaaaagaaaacaaaaaaguuggaagg

SEQ ID NO: 335278 - RNA, 64 nt, Homo Sapiens
guuggaaggcagaaaccauuaaaaguaaaaauaaaaacaaaaaauguuuagaaaaaaaagacaa

SEQ ID NO: 335279 - RNA, 64 nt, Homo Sapiens
aacaaacuucccuggcuucgcuuccucaacccccaaacaaaacauucaaccccacuccuacccc

SEQ ID NO: 335280 - RNA, 64 nt, Homo Sapiens
aauuuugugugauaauuuuguugcauugugaaaaaaacaaaauauauacuuauuugucuucuuu

SEQ ID NO: 335281 - RNA, 64 nt, Homo Sapiens
gauaugcuuacucuaguuaaagaagaugagaaucaaacaaaacagguuaauuuaaacuuaccua

SEQ ID NO: 335282 - RNA, 64 nt, Homo Sapiens
aguguccucuaagucucuauauguagauaaguugaaacaaaaccuucuuguagauaacacaggg

SEQ ID NO: 335283 - RNA, 64 nt, Homo Sapiens
aagcaaaugcacaagcaaaaacugagaauaauuaaaacaaaauuaaauccauauuucauaaaua

SEQ ID NO: 335284 - RNA, 64 nt, Homo Sapiens
uaauuuugugcaauuaacaauauuuaaauggcaaaaacaaaacaagaauaggauucugugauaa

SEQ ID NO: 335285 - RNA, 64 nt, Homo Sapiens
aaacaaggagaaguuguccauuaaaaacaaaacaaaacaaaaaaaccagagagagcuuggaaug

SEQ ID NO: 335286 - RNA, 64 nt, Homo Sapiens
aaaaaaaacaaggagaaguugaauguuaaaaacaaaacaaaacaaggggaccagagagagcuug

SEQ ID NO: 335287 - RNA, 64 nt, Homo Sapiens
aaacaaaaaaaaacaaggaggcuuggaauguuaaaaacaaaacauggauaggggaccagagaga

SEQ ID NO: 335288 - RNA, 64 nt, Homo Sapiens
guuguuucucuuucuugcuuagcagaaaaaaacaaaacaaaacuuagaaacacauuuucuggcu

SEQ ID NO: 335289 - RNA, 64 nt, Homo Sapiens
aaacuguuguuucucuuucuuggcuagcagaaaaaaacaaaacaaugaauagaaacacauuuuc

SEQ ID NO: 335290 - RNA, 64 nt, Homo Sapiens
ugagcaaacacaaaacccaagugcagcuaaaacaaaacaaaacaggcacaaggaaucacacgug

SEQ ID NO: 335291 - RNA, 64 nt, Homo Sapiens
aaacaugagcaaacacaaaaacguggugcagcuaaaacaaaacaaaaauggcacaaggaaucac

SEQ ID NO: 335292 - RNA, 64 nt, Homo Sapiens
acaaaaacaacccuuccucugaagcaaaaaagaaaaacaaaauaagaagccuauuuuuaaagca

SEQ ID NO: 335293 - RNA, 64 nt, Homo Sapiens
ggaaauguccuagguuuucuaauuucccaguuuaaaacaaaaaggucuuccuccaaggaguuag

SEQ ID NO: 335294 - RNA, 64 nt, Homo Sapiens
gaccuuccugugauacuuuaaaagcaaaaacaaaaaacaaaaaaucauuuguaguaaaacuuaa

SEQ ID NO: 335295 - RNA, 64 nt, Homo Sapiens
caaaaaagaccuuccugugaaacuuaaaaagcaaaaacaaaaaacugucacucauuuguaguaa

SEQ ID NO: 335296 - RNA, 64 nt, Homo Sapiens
cuguauuucucuucuuacgcauaaacaaaauaaaaaacaaaauguuauccuucccugugauuag

SEQ ID NO: 335297 - RNA, 64 nt, Homo Sapiens
aaaaacaaaaugcuguauuucccugugauuagauaaacaaaauauuugcccuuuguuuauccuu

SEQ ID NO: 335298 - RNA, 64 nt, Homo Sapiens
uucccagugucuaauucccuguuauaauuugcacaaacaaaacaaaauguuaugauaaucuuuc

SEQ ID NO: 335299 - RNA, 64 nt, Homo Sapiens
agugucuaauucccuguuauaauuugcacaaacaaaacaaaauguuaugauaaucuuucuccac

SEQ ID NO: 335300 - RNA, 64 nt, Homo Sapiens
accaacacaccacucauuggaaaauggaaaaaaaaaacaaaaaaaaaacaaaaaaauguacaau

SEQ ID NO: 335301 - RNA, 64 nt, Homo Sapiens
acucauuggaaaauggaaaaaaaaaacaaaaaaaaaacaaaaaaauguacaauggaugcauuga

SEQ ID NO: 335302 - RNA, 64 nt, Homo Sapiens
uggagaaagugggaaauuauaaugucgaacucugaaacaaaaguauuuaacgacccagucaaug

SEQ ID NO: 335303 - RNA, 64 nt, Homo Sapiens
agacaaucaugggauuuuacuagaauuaaacaacaaacaaaacgcaaaacccaguauaugcuau

SEQ ID NO: 335304 - RNA, 64 nt, Homo Sapiens
gaaagcauuuucauuucacugcacaucuagagaaaaacaaaaauagaaaauuuucuaguccauc

SEQ ID NO: 335305 - RNA, 64 nt, Homo Sapiens
auagaaagugccagaaaguguuuaacuugucaaaaaacaaaaacccagcaacagaaaaauggag

SEQ ID NO: 335306 - RNA, 64 nt, Homo Sapiens
auaugcacauauauauauguauuuaaaaaaaucaaaacaaaaaaaaacucauuuauaccugugu

SEQ ID NO: 335307 - RNA, 64 nt, Homo Sapiens
uuauaucccaaguccauuuuuuccuguacacuacaaacaaaagauauauuagagacuuuugaaa

SEQ ID NO: 335308 - RNA, 64 nt, Homo Sapiens
uuuuuaaaauauguguauaagucugucaugugcuaaacaaaauaauaugaaagaccuaguuaaa

SEQ ID NO: 335309 - RNA, 64 nt, Homo Sapiens
cuacaguguaauaauuuacacuauuuugugcuccaaacaaaacaaaaaucuguguaacuguaaa

SEQ ID NO: 335310 - RNA, 64 nt, Homo Sapiens
guguaauaauuuacacuauuuugugcuccaaacaaaacaaaaaucuguguaacuguaaaacauu

SEQ ID NO: 335311 - RNA, 64 nt, Homo Sapiens
aggaauacuuuuguuagaaugagaauuaaagagaaaacaaaagaaucuuggcaaaauuuucccu

SEQ ID NO: 335312 - RNA, 64 nt, Homo Sapiens
aaaauacauuaggguuuacuugguuguggcaaacaaacaaaaaaugcuuucaguguugaaauau

SEQ ID NO: 335313 - RNA, 64 nt, Homo Sapiens
ucaacuguuuuuauuucuagucucuuccacuuuaaaacaaaaugaacacugcuugucuucuucc

SEQ ID NO: 335314 - RNA, 64 nt, Homo Sapiens
cuauauaccaugcuuaaaaaucacgucauucuuuaaacaaaaauacucaagaucauuuauauuu

SEQ ID NO: 335315 - RNA, 64 nt, Homo Sapiens
cucuucuaaggaaauggagaagcucuguuuauaaaaacaaaaacaaaaccagcugcuacucaua

SEQ ID NO: 335316 - RNA, 64 nt, Homo Sapiens
uaaggaaauggagaagcucuguuuauaaaaacaaaaacaaaaccagcugcuacucauaaguugg

SEQ ID NO: 335317 - RNA, 64 nt, Homo Sapiens
uguaucuuugguuuuuguguuuugcugcacacaaaaacaaaagauauaaaaauggaucauaaac

SEQ ID NO: 335318 - RNA, 64 nt, Homo Sapiens
gaucuuaucacauuuaagucauugcuaauuuuauaaacaaaaacaaugguuuuacuuugcaucu

SEQ ID NO: 335319 - RNA, 64 nt, Homo Sapiens
cagccugggcgacagagcgagacucugccucaaaaaacaaaacaaaacaaaacacucacccauc

SEQ ID NO: 335320 - RNA, 64 nt, Homo Sapiens
ugggcgacagagcgagacucugccucaaaaaacaaaacaaaacaaaacacucacccaucaacga

SEQ ID NO: 335321 - RNA, 64 nt, Homo Sapiens
gacagagcgagacucugccucaaaaaacaaaacaaaacaaaacacucacccaucaacgaauaua

SEQ ID NO: 335322 - RNA, 64 nt, Homo Sapiens
gcugagcugagcuucgguucuccagaauguaagaaaacaaaaucuaaaacaaaaucugaacucu

SEQ ID NO: 335323 - RNA, 64 nt, Homo Sapiens
uucgguucuccagaauguaagaaaacaaaaucuaaaacaaaaucugaacucucaaaagucuauu

SEQ ID NO: 335324 - RNA, 64 nt, Homo Sapiens
ggaagaaccuguuugaugcaaaaaagaaaaugaaaaacaaaacaaaaaauccccaaaaccuuau

SEQ ID NO: 335325 - RNA, 64 nt, Homo Sapiens
aaccuguuugaugcaaaaaagaaaaugaaaaacaaaacaaaaaauccccaaaaccuuauuaugg

SEQ ID NO: 335326 - RNA, 64 nt, Homo Sapiens
ugggugacagagcgagacuccgucucaaacaaacaaacaaaaaacuguuuucauuugcucucuu

SEQ ID NO: 335327 - RNA, 64 nt, Homo Sapiens
uuagacucuuuuaaugcuaauggcuaguacguuuaaacaaaacagcaguucucugcugcaauau

SEQ ID NO: 335328 - RNA, 64 nt, Homo Sapiens
uuggguccuacuguuguuauuaaaaacagaacaaaaacaaaacacacacacacacaaaaacaga

SEQ ID NO: 335329 - RNA, 64 nt, Homo Sapiens
aacaaaaacaaaacacacacacacacaaaaacagaaacaaaaaaaaccagcauuaaaauaauaa

SEQ ID NO: 335330 - RNA, 64 nt, Homo Sapiens
ggugaaacccugccucuacuaaaaauacaaaaaaaaacaaaauuagccgggcgugguugcgggc

SEQ ID NO: 335331 - RNA, 64 nt, Homo Sapiens
gucugggcgacagagugagacuccaucucaaaacaaacaaaaaaaggauggggcugggcuggag

SEQ ID NO: 335332 - RNA, 64 nt, Homo Sapiens
auaauuuagagucucaaaguuuuacagacuccaaaaacaaaaagugguggaaaccauuugugaa

SEQ ID NO: 335333 - RNA, 64 nt, Homo Sapiens
agcaguggaucuugcauuggcaaauuuucaaaugaaacaaaauaaaauccuugaacuaaugacu

SEQ ID NO: 335334 - RNA, 64 nt, Homo Sapiens
accaaacaaauacaaucuaaaaaaaaacaaaacaaaacaaaacauuucacaaguccugugaggc

SEQ ID NO: 335335 - RNA, 64 nt, Homo Sapiens
aaacaaccaaacaaauacaagaggcaaaaaaacaaaacaaaacagacuauuucacaaguccugu

SEQ ID NO: 335336 - RNA, 64 nt, Homo Sapiens
aaacaaaacaaccaaacaaaccugugaggcaaaaaaacaaaacacuuaagacuauuucacaagu

SEQ ID NO: 335337 - RNA, 64 nt, Homo Sapiens
aaaucuaguuuagcacuaaauauuuuucuauuuaaaacaaaaauuuuuacuuucgugccugcau

SEQ ID NO: 335338 - RNA, 64 nt, Homo Sapiens
acuuauauugcuagcuacauugucucaaaacaaaaaacaaaacccaacagagcaagacccuguc

SEQ ID NO: 335339 - RNA, 64 nt, Homo Sapiens
caaaaccacuuauauugcuacccugucugucucaaaacaaaaaagccugggcaacagagcaaga

SEQ ID NO: 335340 - RNA, 64 nt, Homo Sapiens
caguccugcauacucaccacuaaaaaacaaaacaaaacaaaacaagaaaauguguaaggcuugc

SEQ ID NO: 335341 - RNA, 64 nt, Homo Sapiens
aaacacaguccugcauacuccuugcuaaaaaacaaaacaaaacaacaaaagaaaauguguaagg

SEQ ID NO: 335342 - RNA, 64 nt, Homo Sapiens
aaacaaaacacaguccugcauaaggcuugcuaaaaaacaaaacaugcauacaaaagaaaaugug

SEQ ID NO: 335343 - RNA, 64 nt, Homo Sapiens
guaucaauaaagauuuuaaaauagauuaguucauaaacaaaaugcaauuuggaaggguauguaa

SEQ ID NO: 335344 - RNA, 64 nt, Homo Sapiens
aaagcgauuuuucucaaugcaagggaauucucucaaacaaaaggaauaauacauaguuucuguu

SEQ ID NO: 335345 - RNA, 64 nt, Homo Sapiens
cuuguguguuauccugauaugagaagccuaaaacaaacaaaaaccucgauguuuucuuucaacu

SEQ ID NO: 335346 - RNA, 64 nt, Homo Sapiens
auccaagaauagggauauaaauagucagaguuggaaacaaaacauggaaggaugaacuuguuag

SEQ ID NO: 335347 - RNA, 64 nt, Homo Sapiens
ccaaagugguaaggauucagcaaaaacaggaaaaaaacaaaaaaaaaaacaaaacaaaacaaaa

SEQ ID NO: 335348 - RNA, 64 nt, Homo Sapiens
aggaaaaaaacaaaaaaccaaacaaaacaaaacaaaacaaaaacagccucggguaacacugaaa

SEQ ID NO: 335349 - RNA, 64 nt, Homo Sapiens
aaaacaggaaaaaaacaaaaugaaaaacaaaacaaaacaaaacaagagaagccucggguaacac

SEQ ID NO: 335350 - RNA, 64 nt, Homo Sapiens
aaacaaaaacaggaaaaaaaaacacugaaaaacaaaacaaaacaucuucagagaagccucgggu

SEQ ID NO: 335351 - RNA, 64 nt, Homo Sapiens
aaacaaaacaaaaacaggaacggguaacacugaaaaacaaaacacuagcucuucagagaagccu

SEQ ID NO: 335352 - RNA, 64 nt, Homo Sapiens
acaccaaaaaaacccccaaagucucaaaaaaacaaaacaaaaaagggugacagagcgagacucu

SEQ ID NO: 335353 - RNA, 64 nt, Homo Sapiens
aaaaaacaccaaaaaaacccacucugucucaaaaaaacaaaacaagccugggugacagagcgag

SEQ ID NO: 335354 - RNA, 64 nt, Homo Sapiens
guuuuuacagcucaucauucaaauaacgcacaaaaaacaaaagccgcuaugaccggcguugccu

SEQ ID NO: 335355 - RNA, 64 nt, Homo Sapiens
gaaaauucuaugaaauucagauuucaguguccauaaacaaaauguuauuagagcauagccacac

SEQ ID NO: 335356 - RNA, 64 nt, Homo Sapiens
aaagaaagcugcaauuauccgccaacugcauuuaaaacaaaacaaaacagaaaaaucaaaauaa

SEQ ID NO: 335357 - RNA, 64 nt, Homo Sapiens
aagcugcaauuauccgccaacugcauuuaaaacaaaacaaaacagaaaaaucaaaauaacauug

SEQ ID NO: 335358 - RNA, 64 nt, Homo Sapiens
aucuaagaauacgcggucuccugagaacuucaaaaaacaaaaacaaaaaaacccaaaggcccuu

SEQ ID NO: 335359 - RNA, 64 nt, Homo Sapiens
gaauacgcggucuccugagaacuucaaaaaacaaaaacaaaaaaacccaaaggcccuuuucagg

SEQ ID NO: 335360 - RNA, 64 nt, Homo Sapiens
uuauuuggguuaauauuuaugacauuugacauugaaacaaaaauuuaaaauguuaucuuuuaau

SEQ ID NO: 335361 - RNA, 64 nt, Homo Sapiens
uugugaaaaagcaaucuauuguguccaaauaaaaaaacaaaaagugugacacugguuaacuuuu

SEQ ID NO: 335362 - RNA, 64 nt, Homo Sapiens
ccgggcaacaagagcgaaaccccaucucgaaaaaaaacaaaacaaaacuagacaagugagugcc

SEQ ID NO: 335363 - RNA, 64 nt, Homo Sapiens
caacaagagcgaaaccccaucucgaaaaaaaacaaaacaaaacuagacaagugagugccuacgu

SEQ ID NO: 335364 - RNA, 64 nt, Homo Sapiens
uuucuccuucugacuuuuaauaaugguaauaggaaaacaaaacccaaagcuuuucagaacuuca

SEQ ID NO: 335365 - RNA, 64 nt, Homo Sapiens
aaucuuacuuucuuuuaaugaccaaccuuagguaaaacaaaaauauuguaauccuagaaauuau

SEQ ID NO: 335366 - RNA, 64 nt, Homo Sapiens
ccaaaucucuacccuuccccaacccuccauaaaaaaacaaaaauggaaaugaaaaaugaaacaa

SEQ ID NO: 335367 - RNA, 64 nt, Homo Sapiens
cuccauaaaaaaacaaaaauggaaaugaaaaaugaaacaaaaaaggacaaaaccaaaaaaaaaa

SEQ ID NO: 335368 - RNA, 64 nt, Homo Sapiens
aagcucgcaagcccggggagagauuuauaaaaguaaacaaaagaaaaccuuccagcaacaaauu

SEQ ID NO: 335369 - RNA, 64 nt, Homo Sapiens
cauucuccucucccugacuggugucagauucaucaaacaaaaaauaaaucucgaagaaaaaaaa

SEQ ID NO: 335370 - RNA, 64 nt, Homo Sapiens
ccauaucuccaaaaaaagaaagaaaaaauacaaaaaacaaaaacaaaaaaaaaagaggguaaug

SEQ ID NO: 335371 - RNA, 64 nt, Homo Sapiens
cuccaaaaaaagaaagaaaaaauacaaaaaacaaaaacaaaaaaaaaagaggguaauguacaag

SEQ ID NO: 335372 - RNA, 64 nt, Homo Sapiens
aacuaaguugcuuucuuuuuuggggaaaaaacaaaaacaaaaaaguaucucacuuuaaacucuu

SEQ ID NO: 335373 - RNA, 64 nt, Homo Sapiens
aaaaaaaacuaaguugcuuuacucuuuggggaaaaaacaaaaacaguacuguaucucacuuuaa

SEQ ID NO: 335374 - RNA, 64 nt, Homo Sapiens
uggagaugcugaauuuuguuuccaaaacaaaacaaaacaaaaucaaggaaacuaaggacuuggc

SEQ ID NO: 335375 - RNA, 64 nt, Homo Sapiens
aaaucuggagaugcugaauuuuggcuccaaaacaaaacaaaacacugagaaggaaacuaaggac

SEQ ID NO: 335376 - RNA, 64 nt, Homo Sapiens
aaacaaaaucuggagaugcuaggacuuggcuccaaaacaaaacauguuacugagaaggaaacua

SEQ ID NO: 335377 - RNA, 64 nt, Homo Sapiens
auuuuauuaaagauauuuugaaaacaaaacaaacaaacaaaaaggggugacagacucugucucc

SEQ ID NO: 335378 - RNA, 64 nt, Homo Sapiens
aacaaacaaaaagauuuuauagacucugucuccaaaacaaaacaugcacuccaaccugggugac

SEQ ID NO: 335379 - RNA, 64 nt, Homo Sapiens
aaacccugagaccaugagugaaaaaaaaaaaaaaaaacaaaaaagcuaaggguuuauuuuaugu

SEQ ID NO: 335380 - RNA, 64 nt, Homo Sapiens
cccaauuaagaaccuccgaaaauucugucuaaaaaaacaaaaguagccuggacaacaagagcga

SEQ ID NO: 335381 - RNA, 64 nt, Homo Sapiens
uguaaauguuccuuuguaaacaaacaaauaacagaaacaaaaucugugggcauccacaaacaaa

SEQ ID NO: 335382 - RNA, 64 nt, Homo Sapiens
ucuuuuguuugugaacacuguucaaaacaaaacaaaacaaaaagacagaauaucaccauugcag

SEQ ID NO: 335383 - RNA, 64 nt, Homo Sapiens
aaaagucuuuuguuugugaaugcaguucaaaacaaaacaaaacagcugcacagaauaucaccau

SEQ ID NO: 335384 - RNA, 64 nt, Homo Sapiens
aaacaaaaagucuuuuguuuaccauugcaguucaaaacaaaacaaauuugcugcacagaauauc

SEQ ID NO: 335385 - RNA, 64 nt, Homo Sapiens
uaagucgauguuuucucucacaguagauuuuuguaaacaaaauguccuaaguccuugaauucac

SEQ ID NO: 335386 - RNA, 64 nt, Homo Sapiens
ggcaaagcaggcuuuuuguuagcuuauuaacagaaaacaaaacuuuucacucugaagcaguuuu

SEQ ID NO: 335387 - RNA, 64 nt, Homo Sapiens
aagcaaaauauugaugaucaccauuaauaaaacaaaacaaaacauagggacugggacuccagaa

SEQ ID NO: 335388 - RNA, 64 nt, Homo Sapiens
aaacaaagcaaaauauugaucagaaccauuaauaaaacaaaacaagggguagggacugggacuc

SEQ ID NO: 335389 - RNA, 64 nt, Homo Sapiens
cucuaguacucauccaggaaagaaaaauggauagaaacaaaauucuugaaaguugaacucaagu

SEQ ID NO: 335390 - RNA, 64 nt, Homo Sapiens
accaauggauuuuaaccaaaaggccagaaguacaaaacaaaaaaugccaugaggauuucucuuu

SEQ ID NO: 335391 - RNA, 64 nt, Homo Sapiens
caagaagcaaguuguacugcgcauuaagaaauaaaaacaaaaaaacaaacaaaaaacaaccuua

SEQ ID NO: 335392 - RNA, 64 nt, Homo Sapiens
caaccuuagcauuaagaaauguaaacaaacaaacaaacaaaaaacuaagaagccuuaauacucu

SEQ ID NO: 335393 - RNA, 64 nt, Homo Sapiens
gaaauaguuguugaauaguuugaauuauaucugcaaacaaaauguucaaauggaaggaaccacc

SEQ ID NO: 335394 - RNA, 64 nt, Homo Sapiens
ccauggaagcaacaaaagagucaaaaaaacaaaaaaacaaaaacaauuguuuuaauaucuuuac

SEQ ID NO: 335395 - RNA, 64 nt, Homo Sapiens
acaaaaacccauggaagcaaaucuuuacucaaaaaaacaaaaaaggcaucugaauuguuuuaau

SEQ ID NO: 335396 - RNA, 64 nt, Homo Sapiens
ucccuuggaaccuuuguacgcuuugcucaaaaaaaaacaaaaaaaaaaaacaaaaaaaaaaaac

SEQ ID NO: 335397 - RNA, 64 nt, Homo Sapiens
uuguacgcuuugcucaaaaaaaaacaaaaaaaaaaaacaaaaaaaaaaaacaacgguggagccu

SEQ ID NO: 335398 - RNA, 64 nt, Homo Sapiens
auguaaauuuuuuuuuguuuuuaagcauucacccaaacaaaaaaaucacagguaaacccauguu

SEQ ID NO: 335399 - RNA, 64 nt, Homo Sapiens
aaacuagacaaaugcuaguguguuuuaacuagcuaaacaaaacuaaguuaaaugaacauuuaaa

SEQ ID NO: 335400 - RNA, 64 nt, Homo Sapiens
aaacuuaugacuuggauauaugguugaagaaucaaaacaaaagcaaaaaaaaaaagcaaaaaaa

SEQ ID NO: 335401 - RNA, 64 nt, Homo Sapiens
uaauuuuuauguuauguuuugcuuuguuuuaaguaaacaaaaauuuuucuuucuuuacugcaug

SEQ ID NO: 335402 - RNA, 64 nt, Homo Sapiens
gagcaaauacucuucagauccuauguagucagugaaacaaaauggagagcguauucugauagaa

SEQ ID NO: 335403 - RNA, 64 nt, Homo Sapiens
agccaaagcaacaagagcaaaaacuucgucucaaaaacaaaacaaaaaaagaguauucauugug

SEQ ID NO: 335404 - RNA, 64 nt, Homo Sapiens
aagcaacaagagcaaaaacuucgucucaaaaacaaaacaaaaaaagaguauucauugugaggac

SEQ ID NO: 335405 - RNA, 64 nt, Homo Sapiens
uggugacagggucugacauggucagucuacuaaaaaacaaaaaaaaaaaacaaaaaaaaaaaaa

SEQ ID NO: 335406 - RNA, 64 nt, Homo Sapiens
ugacauggucagucuacuaaaaaacaaaaaaaaaaaacaaaaaaaaaaaaacaaaagaaaaaaa

SEQ ID NO: 335407 - RNA, 64 nt, Homo Sapiens
uacuaaaaaacaaaaaaaaaaaacaaaaaaaaaaaaacaaaagaaaaaaauaaaaauacggugg

SEQ ID NO: 335408 - RNA, 64 nt, Homo Sapiens
acagagcaggacucucucucaaaaaaacacaaaaaaacaaaaacaaaaaaccauacacacacac

SEQ ID NO: 335409 - RNA, 64 nt, Homo Sapiens
caggacucucucucaaaaaaacacaaaaaaacaaaaacaaaaaaccauacacacacacacacac

SEQ ID NO: 335410 - RNA, 64 nt, Homo Sapiens
gagggaaaaagaaauacagccucaacagauuaaaaaacaaaagucacacuuaaggauccuucua

SEQ ID NO: 335411 - RNA, 64 nt, Homo Sapiens
auccugcuuauuucucaaaaaagagggacagugaaaacaaaaacgacauugggacaugcugcuc

SEQ ID NO: 335412 - RNA, 64 nt, Homo Sapiens
aaaaaaaaaaagcgaaagacugcaguugugcuaaaaacaaaacaaaacaaacaaacaaacaaaa

SEQ ID NO: 335413 - RNA, 64 nt, Homo Sapiens
aaaaaagcgaaagacugcaguugugcuaaaaacaaaacaaaacaaacaaacaaacaaaaaagua

SEQ ID NO: 335414 - RNA, 64 nt, Homo Sapiens
caguugugcuaaaaacaaaacaaaacaaacaaacaaacaaaaaaguaaaaaaagauuacuuucg

SEQ ID NO: 335415 - RNA, 64 nt, Homo Sapiens
cuauaaacaaucccauuuuuauauuuuauuauuaaaacaaaaauaccucucuuugcuagagagu

SEQ ID NO: 335416 - RNA, 64 nt, Homo Sapiens
agccugggaacaagagugaaacucucaaaagcagaaacaaaaacccaacauauaugggcuguua

SEQ ID NO: 335417 - RNA, 64 nt, Homo Sapiens
gcaacccaguccccaaccugaaaaacaaaaacaaaaacaaaaaagaaaaauaaaagaaaaugua

SEQ ID NO: 335418 - RNA, 64 nt, Homo Sapiens
aaaaaagcaacccaguccccaauguaaaaaacaaaaacaaaaacaaaugggaaaaauaaaagaa

SEQ ID NO: 335419 - RNA, 64 nt, Homo Sapiens
aaaaacaaaaaagcaacccaaaagaaaauguaaaaaacaaaaacuuacaaaaaugggaaaaaua

SEQ ID NO: 335420 - RNA, 64 nt, Homo Sapiens
aaauugagggcauguugcaugcacauuucccccaaaacaaaauaaaaaagcucuagguucuuca

SEQ ID NO: 335421 - RNA, 64 nt, Homo Sapiens
agcucuagguucuucagcacugauauaaggugcuaaacaaaaaacauacccauuuucauuacuu

SEQ ID NO: 335422 - RNA, 64 nt, Homo Sapiens
augaacuuugauuugaacagacaaaaguuguuccaaacaaaaugcgugaccauuugauucucaa

SEQ ID NO: 335423 - RNA, 64 nt, Homo Sapiens
uguuccaaacaaaaugaugaaccauuugauucucaaacaaaaguuuuguuuugucauuuacgug

SEQ ID NO: 335424 - RNA, 64 nt, Homo Sapiens
aauaauaaagaaaaauaaaugcuagaaacucuaaaaacaaaaauugacuucagcucuguuuuua

SEQ ID NO: 335425 - RNA, 64 nt, Homo Sapiens
cguaauuuuuuuacaguaugaaaugccauauuucaaacaaaacauaauaugugcauuguaaaau

SEQ ID NO: 335426 - RNA, 64 nt, Homo Sapiens
ugaugaaacagaugaaggaacaaaaguaaauuaaaaacaaaaccaaaaaaaaaacaaaaaaaaa

SEQ ID NO: 335427 - RNA, 64 nt, Homo Sapiens
aaauuaaaaacaaaaccugaaaaaaaacaaaaaaaaacaaaaguaaauuaaaaacaaaacaaaa

SEQ ID NO: 335428 - RNA, 64 nt, Homo Sapiens
aaacaaaaguaaauuaaaaacaaaacaaaaaaaaaaacaaaaaaagaaaaauagaaauuaaaaa

SEQ ID NO: 335429 - RNA, 64 nt, Homo Sapiens
aaaaacaaaaaaaaacaaaaagaaauuaaaaacaaaacaaaaaaucugaguuaaccagaaaaau

SEQ ID NO: 335430 - RNA, 64 nt, Homo Sapiens
aaaaaaaaaacaaaaaaaaaaaaauagaaauuaaaaacaaaacaagguuucugaguuaaccaga

SEQ ID NO: 335431 - RNA, 64 nt, Homo Sapiens
auuauccugucuuaucugaacuucaguuuucucaaaacaaaacaggucuuuuaagagauuuaag

SEQ ID NO: 335432 - RNA, 64 nt, Homo Sapiens
uaacacaguuaagagaaauagccgcagagggaaaaaacaaaacgguggagagggagcaagggag

SEQ ID NO: 335433 - RNA, 64 nt, Homo Sapiens
aaggcacuucacuuagagaccacaaaaaacaaaaaaacaaaacucccccaaaaaauaaaaaaac

SEQ ID NO: 335434 - RNA, 64 nt, Homo Sapiens
acaaaacuaaggcacuucacaaaaaaaccacaaaaaacaaaaaacucccacccccccaaaaaau

SEQ ID NO: 335435 - RNA, 64 nt, Homo Sapiens
gaggcacaaaaccccaggcuucucaaaaaaaacaaaacaaaaagggcaacagagcaagacucug

SEQ ID NO: 335436 - RNA, 64 nt, Homo Sapiens
aaaaggaggcacaaaacccccucugucucaaaaaaaacaaaacagccuaggcaacagagcaaga

SEQ ID NO: 335437 - RNA, 64 nt, Homo Sapiens
uuaucugaaugauccugucuaucucuuuaaaaacaaacaaaaaagagugacagagcgagacucc

SEQ ID NO: 335438 - RNA, 64 nt, Homo Sapiens
agccgggcaugauggugcaucuacuaaaauucaaaaacaaaauuaucauagcaagaccucaucu

SEQ ID NO: 335439 - RNA, 64 nt, Homo Sapiens
aaugugauuuguuucugucucauuuagaaaacaaaaacaaaaaaugaaauuuucucuuguaaaa

SEQ ID NO: 335440 - RNA, 64 nt, Homo Sapiens
aaaaaaaaugugauuuguuuguaaaacauuuagaaaacaaaaacugcuuuugaaauuuucucuu

SEQ ID NO: 335441 - RNA, 64 nt, Homo Sapiens
uucuaauggauuuaucaaacgaaagcugauuaaaaaacaaaaaugcugccaaaaccauuaagug

SEQ ID NO: 335442 - RNA, 64 nt, Homo Sapiens
gauauugcaguuguguuguaaaaaacaaacaaacaaacaaaaaaggcgaaauccccgucuuuac

SEQ ID NO: 335443 - RNA, 64 nt, Homo Sapiens
uuaagaaaugaucuuuuuauaaccaauugcaacaaaacaaaaugauauuuaggugacuuacagc

SEQ ID NO: 335444 - RNA, 64 nt, Homo Sapiens
uuuacuuagggauaauguggacaagcuuucugugaaacaaaauaguacacagaaaaacaaaagg

SEQ ID NO: 335445 - RNA, 64 nt, Homo Sapiens
acaagcuuucugugaaacaaacguguacacagaaaaacaaaaggacgcacaagcgccagugcgc

SEQ ID NO: 335446 - RNA, 64 nt, Homo Sapiens
cagacugugucccacaaucaagaagacaggaagaaaacaaaaaccaggaaugucuuuuuuaauu

SEQ ID NO: 335447 - RNA, 64 nt, Homo Sapiens
gcaauaaaacauaaucacucgaaaaauauauacuaaacaaaauauagauuuuuuucccaauuga

SEQ ID NO: 335448 - RNA, 64 nt, Homo Sapiens
aaaagaaaauuuuuguaguauacacaauaagcaaaaacaaaaagaaaaauuaucuauagcuaag

SEQ ID NO: 335449 - RNA, 64 nt, Homo Sapiens
caaacacccagaggucucaugggugcaucaaacaaaacaaaaacgaacuugcucucauuuuccu

SEQ ID NO: 335450 - RNA, 64 nt, Homo Sapiens
aaaaccaaacacccagagguuuccugggugcaucaaacaaaacauccuggaacuugcucucauu

SEQ ID NO: 335451 - RNA, 64 nt, Homo Sapiens
uuucaggguauccuuaaaaaaaaacacacacgaaaaacaaaaguuugcuuguuuaaaaugacag

SEQ ID NO: 335452 - RNA, 64 nt, Homo Sapiens
uuuuuaaagcugaguaguuaagaauucccuguaaaaacaaaacccuguaaauugagccucaugu

SEQ ID NO: 335453 - RNA, 64 nt, Homo Sapiens
uucccuaaguuugaguugauaguuauuaaaaagaaaacaaaacaaaaaaaaaaggcaaggcaca

SEQ ID NO: 335454 - RNA, 64 nt, Homo Sapiens
uaaguuugaguugauaguuauuaaaaagaaaacaaaacaaaaaaaaaaggcaaggcacaacaaa

SEQ ID NO: 335455 - RNA, 64 nt, Homo Sapiens
uugauguguuauaguggaaaauaacauauagauuaaacaaaauuuuuaucuuuuuucaagaaua

SEQ ID NO: 335456 - RNA, 64 nt, Homo Sapiens
ccagcaugugacuaguuacaaaagcaauaaauugaaacaaaacaaaacaaaacaaaacuuguuu

SEQ ID NO: 335457 - RNA, 64 nt, Homo Sapiens
augugacuaguuacaaaagcaauaaauugaaacaaaacaaaacaaaacaaaacuuguuucuuaa

SEQ ID NO: 335458 - RNA, 64 nt, Homo Sapiens
acuaguuacaaaagcaauaaauugaaacaaaacaaaacaaaacaaaacuuguuucuuaaaaaug

SEQ ID NO: 335459 - RNA, 64 nt, Homo Sapiens
uuacaaaagcaauaaauugaaacaaaacaaaacaaaacaaaacuuguuucuuaaaaaugcgguu

SEQ ID NO: 335460 - RNA, 64 nt, Homo Sapiens
ccaccgcaauaauucgguaaagcaaaccagaacaaaacaaaaagacauucguuucccagugaaa

SEQ ID NO: 335461 - RNA, 64 nt, Homo Sapiens
caaccaacaaauacaacacacaaaucuaaaagugaaacaaaaacaauuaaacaauuaaaugaaa

SEQ ID NO: 335462 - RNA, 64 nt, Homo Sapiens
ccuucaacugccuuaugcccaaacaaacacaaacaaacaaaaaaugaaagaacaaaacaaaaca

SEQ ID NO: 335463 - RNA, 64 nt, Homo Sapiens
aacacaaacaaacaaaaaacgaaagaacaaaacaaaacaaaacauuaugggauuggugcugauu

SEQ ID NO: 335464 - RNA, 64 nt, Homo Sapiens
aaacaaacacaaacaaacaaugauugaaagaacaaaacaaaacaaucauuuaugggauuggugc

SEQ ID NO: 335465 - RNA, 64 nt, Homo Sapiens
aaaaccuuucuuuuguuuuuuguuuuguaaguaaaaacaaaaagguauacaaagauauucucua

SEQ ID NO: 335466 - RNA, 64 nt, Homo Sapiens
gagaauucuuaagauuuuguggagggaagaugggaaacaaaauauuggaggaugggagagaaca

SEQ ID NO: 335467 - RNA, 64 nt, Homo Sapiens
ugaaaaccaaaguggauuuaauugacgcaauauaaaacaaaaugcccccugagaaaacacuuga

SEQ ID NO: 335468 - RNA, 64 nt, Homo Sapiens
caggccgagcgcgguggcucguuccuccaaacaaaaacaaaaugguuuuuucuuucccuuuuuu

SEQ ID NO: 335469 - RNA, 64 nt, Homo Sapiens
aaaaugcaggccgagcgcgguuuuuuguuccuccaaacaaaaacgguuuuguuuuuucuuuccc

SEQ ID NO: 335470 - RNA, 64 nt, Homo Sapiens
auucauuuauuguguugugcaaacuuuucauuuuaaacaaaaacauuugguguacucagcaaau

SEQ ID NO: 335471 - RNA, 64 nt, Homo Sapiens
caacaguaaucuauguguuuauauauguauuuaaaaacaaaaagaguauaccuggcuuuuuaaa

SEQ ID NO: 335472 - RNA, 64 nt, Homo Sapiens
gcaaugauguaugcauuuuuauugggucuuuuguaaacaaaaagguuaaugaucaauacuguaa

SEQ ID NO: 335473 - RNA, 64 nt, Homo Sapiens
uucuauuacaguuguguacuauaaaugggacaccaaacaaaauuuaccauaugugcugucuauu

SEQ ID NO: 335474 - RNA, 64 nt, Homo Sapiens
guuuauuuuuuauuaaccucauuuucugugcuauaaacaaaaguaugaacuucaugugggcuua

SEQ ID NO: 335475 - RNA, 64 nt, Homo Sapiens
ucugccuucagacauuuggugcucugucuuccacaaacaaaaauuuaggugcaucuaucucuuc

SEQ ID NO: 335476 - RNA, 64 nt, Homo Sapiens
auucauuagccucagauucuaaagcaaaaacaaaaaacaaaacaaggcuuucagguaugaauua

SEQ ID NO: 335477 - RNA, 61 nt, Homo Sapiens
caaaacaauucauuagccucauuaaaagcaaaaacaaaaaauucaaggcuuucagguauga

SEQ ID NO: 335478 - RNA, 64 nt, Homo Sapiens
acguguaauaaaguuaguggacaaaaaaaacaaaaaacaaaaaaccaacaauaagcuagaaaag

SEQ ID NO: 335479 - RNA, 64 nt, Homo Sapiens
caaaaaaacguguaauaaagagaaaagacaaaaaaaacaaaaaauuuucuaccaacaauaagcu

SEQ ID NO: 335480 - RNA, 64 nt, Homo Sapiens
augaaggacuccaacuagaauuucucugaguuggaaacaaaaacaguaucuucauuauucucau

SEQ ID NO: 335481 - RNA, 64 nt, Homo Sapiens
uuacauucguugggcuuuuugcuuuguaccuagaaaacaaaaaaaccuggggcuaguuuuuuau

SEQ ID NO: 335482 - RNA, 64 nt, Homo Sapiens
gccauuuuaaaaaagguguauugcagaaaacaccaaacaaaaaucaaaauauuuccucaguacu

SEQ ID NO: 335483 - RNA, 64 nt, Homo Sapiens
ccauguauuuaacuuuuuuucaagcacagcaguaaaacaaaaacauucauuacuucauguauau

SEQ ID NO: 335484 - RNA, 64 nt, Homo Sapiens
uuuaauuaaaaaaaauccuucuuggacccuuggaaaacaaaaguguagauuucugacaucaaaa

SEQ ID NO: 335485 - RNA, 64 nt, Homo Sapiens
acauugcuuaaaauauauaguauacacaguggcaaaacaaaaguuucuguuauauaguggauga

SEQ ID NO: 335486 - RNA, 64 nt, Homo Sapiens
aaaacacaaaagcugcauguaaaaaaaaaaacaaaaacaaaaaaaaacugguuuuuuucaaaaa

SEQ ID NO: 335487 - RNA, 64 nt, Homo Sapiens
aaaaaaaaaacacaaaagcucaaaaaaaaaaaaaaaacaaaaaccaaaauaaacugguuuuuuu

SEQ ID NO: 335488 - RNA, 64 nt, Homo Sapiens
aggaguauaggaacugcugguucuacaagcaaacaaacaaaaauacuuacaucucucuaugcug

SEQ ID NO: 335489 - RNA, 64 nt, Homo Sapiens
augauuucaaguacccuguauucuggaugcuaaaaaacaaaaacaaacaaaaaaacaaaaacaa

SEQ ID NO: 335490 - RNA, 64 nt, Homo Sapiens
guacccuguauucuggaugcuaaaaaacaaaaacaaacaaaaaaacaaaaacaaaaaaacaaaa

SEQ ID NO: 335491 - RNA, 64 nt, Homo Sapiens
uauucuggaugcuaaaaaacaaaaacaaacaaaaaaacaaaaacaaaaaaacaaaaccagaauc

SEQ ID NO: 335492 - RNA, 64 nt, Homo Sapiens
ggaugcuaaaaaacaaaaacaaacaaaaaaacaaaaacaaaaaaacaaaaccagaaucagguaa

SEQ ID NO: 335493 - RNA, 64 nt, Homo Sapiens
aaaaacaaaaacaaacaaaaaaacaaaaacaaaaaaacaaaaccagaaucagguaaaacagcua

SEQ ID NO: 335494 - RNA, 64 nt, Homo Sapiens
uguuaaggauugucuuaaaguuccuuagccagcaaaacaaaacaaaacaaaacaaacaaaugaa

SEQ ID NO: 335495 - RNA, 64 nt, Homo Sapiens
aggauugucuuaaaguuccuuagccagcaaaacaaaacaaaacaaaacaaacaaaugaaaaacg

SEQ ID NO: 335496 - RNA, 64 nt, Homo Sapiens
ugucuuaaaguuccuuagccagcaaaacaaaacaaaacaaaacaaacaaaugaaaaacguuuaa

SEQ ID NO: 335497 - RNA, 64 nt, Homo Sapiens
aguuuuaaccaguuguagucaaaaugcuacaauaaaacaaaaaagagaaagaaaaugaagagca

SEQ ID NO: 335498 - RNA, 64 nt, Homo Sapiens
uucuuccauucuuaacaguaugugcccauuugcaaaacaaaaaugcuaauaaucaguaauaguc

SEQ ID NO: 335499 - RNA, 64 nt, Homo Sapiens
uucaagaccuaacugcagccgcuuugggaaaaaaaaacaaaaaacaaaaaacagaaaacaaaaa

SEQ ID NO: 335500 - RNA, 64 nt, Homo Sapiens
ccuaacugcagccgcuuugggaaaaaaaaacaaaaaacaaaaaacagaaaacaaaaaaaaaaaa

SEQ ID NO: 335501 - RNA, 64 nt, Homo Sapiens
guauuccauuuaaaaauauguuuaaauuguccuaaaacaaaauaauuuucucccuaggaguaug

SEQ ID NO: 335502 - RNA, 64 nt, Homo Sapiens
aguuaucugcaagcaaagagagaggcuucagaagaaacaaaaucaccagcaccuugaucuuuga

SEQ ID NO: 335503 - RNA, 64 nt, Homo Sapiens
gggaccacauuuuucaaguauuucuaaguauaaaaaacaaaacaaaaaucucuuaggaaauguc

SEQ ID NO: 335504 - RNA, 64 nt, Homo Sapiens
cacauuuuucaaguauuucuaaguauaaaaaacaaaacaaaaaucucuuaggaaaugucuagac

SEQ ID NO: 335505 - RNA, 64 nt, Homo Sapiens
ccuugacaaaauuuaagcugagcuuaaaagcaaaaaacaaaaaguacacagaaauauuuauuaa

SEQ ID NO: 335506 - RNA, 64 nt, Homo Sapiens
auguggugugaaacagccaaguuacauaaaaggaaaacaaaauuccuucuugcuuauacguuaa

SEQ ID NO: 335507 - RNA, 64 nt, Homo Sapiens
gaacuucuuauaguugucuuaaaaaagaaaaaagaaacaaaaagccugcaaaaauaaaagggaa

SEQ ID NO: 335508 - RNA, 64 nt, Homo Sapiens
auuggacugucggaggugagcauagcaggaaaacaaacaaaagucuguagaaauauuauuccag

SEQ ID NO: 335509 - RNA, 64 nt, Homo Sapiens
acuagacaaggagagaggcaaaaaaaaaaaaaaaaaacaaaaaauaucaaacuugcaaaaaaaa

SEQ ID NO: 335510 - RNA, 64 nt, Homo Sapiens
acccacaaaaauuuguaaaaaaugaagcaaaacaaaacaaaaaaguacacacacaacagaacaa

SEQ ID NO: 335511 - RNA, 64 nt, Homo Sapiens
aaaaaacccacaaaaauuugaacaaaaugaagcaaaacaaaacauuguuguacacacacaacag

SEQ ID NO: 335512 - RNA, 64 nt, Homo Sapiens
uguaaauacaaaagaaaucauuugcuaagacuugaaacaaaaaauaggccaggccuuuuagcau

SEQ ID NO: 335513 - RNA, 64 nt, Homo Sapiens
aacaaaccacccauugggauguguauauuuacaaaaacaaaacaaccaugaccugcuggugugu

SEQ ID NO: 335514 - RNA, 64 nt, Homo Sapiens
guguuuuguauaaaucccuaauauuuaaaaaaaaaaacaaaacaaaaaaagguuacaaaguuug

SEQ ID NO: 335515 - RNA, 64 nt, Homo Sapiens
uuguauaaaucccuaauauuuaaaaaaaaaaacaaaacaaaaaaagguuacaaaguuuguuaac

SEQ ID NO: 335516 - RNA, 64 nt, Homo Sapiens
gggauggaaaggacuagccucuacugaugcaaaaaaacaaaaagcaacacaaacguuuccuucu

SEQ ID NO: 335517 - RNA, 64 nt, Homo Sapiens
aaaaugaggaagauguguucauuguggacucuaaaaacaaaacaaaacacaaaauccccuguuc

SEQ ID NO: 335518 - RNA, 64 nt, Homo Sapiens
gaggaagauguguucauuguggacucuaaaaacaaaacaaaacacaaaauccccuguucaaaua

SEQ ID NO: 335519 - RNA, 64 nt, Homo Sapiens
aaacaaaacaaaacacaaaauccccuguucaaauaaacaaaaaauccaagauugauucaugaaa

SEQ ID NO: 335520 - RNA, 64 nt, Homo Sapiens
ucuuccuauuacuuuauugacucauuuuauugcaaaacaaaaaggauuacccaaacaacauguu

SEQ ID NO: 335521 - RNA, 64 nt, Homo Sapiens
uaauccaaguaaaggaauaugaagggauuguaaaaaacaaaauguccauugauagaccaucgug

SEQ ID NO: 335522 - RNA, 64 nt, Homo Sapiens
acucaaugacaaagaccgagucuucuuuuuuuuuaaacaaaaacaaaaaaagcaaccagggcua

SEQ ID NO: 335523 - RNA, 64 nt, Homo Sapiens
ugacaaagaccgagucuucuuuuuuuuuaaacaaaaacaaaaaaagcaaccagggcuauuugua

SEQ ID NO: 335524 - RNA, 64 nt, Homo Sapiens
uuucucuuggaauguguauuguuuuuauuuugcgaaacaaaacaaaacaaaaaaaaaagcuugg

SEQ ID NO: 335525 - RNA, 64 nt, Homo Sapiens
cuuggaauguguauuguuuuuauuuugcgaaacaaaacaaaacaaaaaaaaaagcuuggaacuc

SEQ ID NO: 335526 - RNA, 64 nt, Homo Sapiens
aauguguauuguuuuuauuuugcgaaacaaaacaaaacaaaaaaaaaagcuuggaacuccauca

SEQ ID NO: 335527 - RNA, 64 nt, Homo Sapiens
ugcaauucccuauuauauucugcaucagaaaaacaaacaaaacaaaaacaacuuuaaaugcuug

SEQ ID NO: 335528 - RNA, 64 nt, Homo Sapiens
uucccuauuauauucugcaucagaaaaacaaacaaaacaaaaacaacuuuaaaugcuuguagca

SEQ ID NO: 335529 - RNA, 64 nt, Homo Sapiens
cuucaggucuuaagugcaaaucaaagcaaaaaacaaacaaaacuuacauggaaaaacuguaagu

SEQ ID NO: 335530 - RNA, 64 nt, Homo Sapiens
gucucagaccuacaaagaguuaaaacaaacagacaaacaaaaaaaaacacuacuauuuuaaaua

SEQ ID NO: 335531 - RNA, 64 nt, Homo Sapiens
cuuaaauuggguucaugaugcagucuccucuuuaaaacaaaacaaaacaaaacaaaacuauacu

SEQ ID NO: 335532 - RNA, 64 nt, Homo Sapiens
auuggguucaugaugcagucuccucuuuaaaacaaaacaaaacaaaacaaaacuauacuugaac

SEQ ID NO: 335533 - RNA, 64 nt, Homo Sapiens
guucaugaugcagucuccucuuuaaaacaaaacaaaacaaaacaaaacuauacuugaacaaaag

SEQ ID NO: 335534 - RNA, 64 nt, Homo Sapiens
ugaugcagucuccucuuuaaaacaaaacaaaacaaaacaaaacuauacuugaacaaaaggguca

SEQ ID NO: 335535 - RNA, 64 nt, Homo Sapiens
gacagggagagguggagaaggaaaaaacccuacaaaacaaaaacaaaccgcauacacguucacc

SEQ ID NO: 335536 - RNA, 64 nt, Homo Sapiens
uucccccccaucuuuaaaaauaauuaguaauaaaaaacaaaaauuccauaucuagccccauccc

SEQ ID NO: 335537 - RNA, 64 nt, Homo Sapiens
cauuuuuuaaagucccaccuuucaauguuuaauaaaacaaaaagagaaauccuuaaucuaaaag

SEQ ID NO: 335538 - RNA, 64 nt, Homo Sapiens
uggccauuagguaccuagcagaugugcacaauauaaacaaaaagauaucuggccuaccuuacua

SEQ ID NO: 335539 - RNA, 64 nt, Homo Sapiens
aagacaugggagagauggugaaaaaaacaaaacaaaacaaaaaaacagagccaaacuccgucaa

SEQ ID NO: 335540 - RNA, 64 nt, Homo Sapiens
aaaaaaagacaugggagagagucaaaaaaaaacaaaacaaaacagagugacagagccaaacucc

SEQ ID NO: 335541 - RNA, 64 nt, Homo Sapiens
aaacaaaaaaaagacaugggacuccgucaaaaaaaaacaaaacaagcuggagugacagagccaa

SEQ ID NO: 335542 - RNA, 64 nt, Homo Sapiens
uguaaaguuguaacauuucauagauuuaaauaaaaaacaaaacucauguuucaguuucugcaug

SEQ ID NO: 335543 - RNA, 64 nt, Homo Sapiens
ugcccgucaacaugucacagguaaguaucauugaaaacaaaacagggaucuaggugagcccauu

SEQ ID NO: 335544 - RNA, 64 nt, Homo Sapiens
ucacagcucgguuuuucuuauauggcuacauuuaaaacaaaauccaacuuuuuaccuuuugaaa

SEQ ID NO: 335545 - RNA, 64 nt, Homo Sapiens
uuuaaaaguaguuuuaacaauuuauuucuuggugaaacaaaaguaugcuacuguauuuuacauc

SEQ ID NO: 335546 - RNA, 64 nt, Homo Sapiens
auguuuuaaaugcuuugaagcacugauaaaacaaaaacaaaagugcgucuucaaaaacaaauug

SEQ ID NO: 335547 - RNA, 64 nt, Homo Sapiens
aaaaguauguuuuaaaugcuaaauugcacugauaaaacaaaaacuuuccggcgucuucaaaaac

SEQ ID NO: 335548 - RNA, 64 nt, Homo Sapiens
cuuuuuaaagcccucuugccaagcucccauuuaaaaacaaaauacugaaaaaggcagaguuuga

SEQ ID NO: 335549 - RNA, 64 nt, Homo Sapiens
aagugagggguuuuuuuaacuguaaggacuugcaaaacaaaagaagaguugcuguggacagacc

SEQ ID NO: 335550 - RNA, 64 nt, Homo Sapiens
cuguucagcagaggccccuuucagagaaagagggaaacaaaagcggguaaucaugaaagaaggc

SEQ ID NO: 335551 - RNA, 64 nt, Homo Sapiens
uaaaauauaaacaaucaaaacaaaaacaaaaacaaaacaaaacaggaggacgccaguaaaaaaa

SEQ ID NO: 335552 - RNA, 64 nt, Homo Sapiens
aaacauaaaauauaaacaauaaaaacaaaaacaaaaacaaaacaugaauggaggacgccaguaa

SEQ ID NO: 335553 - RNA, 64 nt, Homo Sapiens
aaaacaaaacauaaaauauacaguaaaaaaacaaaaacaaaaacaauguuugaauggaggacgc

SEQ ID NO: 335554 - RNA, 64 nt, Homo Sapiens
aaaaacaaaacaaaacauaaggacgccaguaaaaaaacaaaaacuauguaaauguuugaaugga

SEQ ID NO: 335555 - RNA, 64 nt, Homo Sapiens
acgaaagcaucuucacaaugugacugaaaacaaaaaacaaaaaaacucauucuucagugccuca

SEQ ID NO: 335556 - RNA, 64 nt, Homo Sapiens
caaaaaaacgaaagcaucuuugccucaugacugaaaacaaaaaacagcacaacucauucuucag

SEQ ID NO: 335557 - RNA, 64 nt, Homo Sapiens
cuguugucuaauauaucuacgaaucuaaaaaaaaaaacaaaaaaugcuuauucuuuaacaaaga

SEQ ID NO: 335558 - RNA, 64 nt, Homo Sapiens
uaaaaauuaguucccaaguaaauaauaaaacuaaaaacaaaaagauauuuucauaaucagucaa

SEQ ID NO: 335559 - RNA, 64 nt, Homo Sapiens
ccgauauaauaguuuggguucuccauugaaaguuaaacaaaaagaauacuuaucucuguuaaga

SEQ ID NO: 335560 - RNA, 64 nt, Homo Sapiens
uccagcuugggcaacagagugagacuccaucucaaaacaaaacaaaacaaaacaaaacaaaaaa

SEQ ID NO: 335561 - RNA, 64 nt, Homo Sapiens
cuugggcaacagagugagacuccaucucaaaacaaaacaaaacaaaacaaaacaaaaaaacccg

SEQ ID NO: 335562 - RNA, 64 nt, Homo Sapiens
gcaacagagugagacuccaucucaaaacaaaacaaaacaaaacaaaacaaaaaaacccggcuuu

SEQ ID NO: 335563 - RNA, 64 nt, Homo Sapiens
agagugagacuccaucucaaaacaaaacaaaacaaaacaaaacaaaaaaacccggcuuugcugc

SEQ ID NO: 335564 - RNA, 64 nt, Homo Sapiens
gagacuccaucucaaaacaaaacaaaacaaaacaaaacaaaaaaacccggcuuugcugcuuuua

SEQ ID NO: 335565 - RNA, 64 nt, Homo Sapiens
cuucuggcuuuuaauuuugccagcuaaggacauaaaacaaaaauaaacaaacaaaaacaaauag

SEQ ID NO: 335566 - RNA, 64 nt, Homo Sapiens
uuuugccagcuaaggacauaaaacaaaaauaaacaaacaaaaacaaauagccaucugcuaucag

SEQ ID NO: 335567 - RNA, 64 nt, Homo Sapiens
ggcccccaucagggaccagacuguuccaaaaaaaaaacaaaaaacaaaaacaaacaaaaaaaca

SEQ ID NO: 335568 - RNA, 64 nt, Homo Sapiens
aucagggaccagacuguuccaaaaaaaaaacaaaaaacaaaaacaaacaaaaaaacacuuaaaa

SEQ ID NO: 335569 - RNA, 64 nt, Homo Sapiens
agacuguuccaaaaaaaaaacaaaaaacaaaaacaaacaaaaaaacacuuaaaagcccaaggag

SEQ ID NO: 335570 - RNA, 64 nt, Homo Sapiens
aacaugaaaguggaagccguaugcccaaggguauaaacaaaagcacgcuaaaagauuaaguaaa

SEQ ID NO: 335571 - RNA, 64 nt, Homo Sapiens
cccuuuuucuuuuaguauggagcuuuaaagugacaaacaaaauaguaccguuuaaagaaaaagc

SEQ ID NO: 335572 - RNA, 64 nt, Homo Sapiens
gacaguaauaccaaggaaucugcuagguaaaacaaaacaaaaacugagaauaaguuuauauucu

SEQ ID NO: 335573 - RNA, 64 nt, Homo Sapiens
aaaacgacaguaauaccaagauucuugcuagguaaaacaaaacagauuuugagaauaaguuuau

SEQ ID NO: 335574 - RNA, 64 nt, Homo Sapiens
cugcccgacuugcaaucuaaacacugucugaauuaaacaaaaagugauugcaaacaaacaguga

SEQ ID NO: 335575 - RNA, 64 nt, Homo Sapiens
cacaccacacacacgcgcuuuucuccaaaaacaaaaacaaaacaacaauucauaaugcagcagu

SEQ ID NO: 335576 - RNA, 64 nt, Homo Sapiens
aaaacacacaccacacacacagcaguuucuccaaaaacaaaaacgugguuacaauucauaaugc

SEQ ID NO: 335577 - RNA, 64 nt, Homo Sapiens
gaagcuaaaaugaaucaacguuucagugacugauaaacaaaaauauauuugguuuaguucugug

SEQ ID NO: 335578 - RNA, 64 nt, Homo Sapiens
uauuacacuaaaaguauuauuuuuuucauaauucaaacaaaagucuagagggaaaugauucaaa

SEQ ID NO: 335579 - RNA, 64 nt, Homo Sapiens
gacugauaucgcaccuaaauaaaaacaaaaacaaaaacaaaaaaagcaaggcucugucucaaaa

SEQ ID NO: 335580 - RNA, 64 nt, Homo Sapiens
aaaaaagacugauaucgcacucaaaaaaaaacaaaaacaaaaacugacagagcaaggcucuguc

SEQ ID NO: 335581 - RNA, 64 nt, Homo Sapiens
aaaaacaaaaaagacugauaucugucucaaaaaaaaacaaaaacccugggugacagagcaaggc

SEQ ID NO: 335582 - RNA, 64 nt, Homo Sapiens
acagugcuuuuuucaaaccugaaagaaaaaaacaaaacaaaacaaagggagaagauauucucgu

SEQ ID NO: 335583 - RNA, 64 nt, Homo Sapiens
aaacaacagugcuuuuuucacucgugaaagaaaaaaacaaaacacuuccaagggagaagauauu

SEQ ID NO: 335584 - RNA, 64 nt, Homo Sapiens
auauuagguuugcuaaauucuuucacagacuauaaaacaaaaaauuuugaggaacaccucucau

SEQ ID NO: 335585 - RNA, 64 nt, Homo Sapiens
aauaaugacaaaaagcacaugcagaguaauacacaaacaaaaaaagugacaguuacuuuuuugu

SEQ ID NO: 335586 - RNA, 64 nt, Homo Sapiens
guaucauuuuaguuaagugggucaaacagaaucaaaacaaaacccaaagaaauaaauaaaaaac

SEQ ID NO: 335587 - RNA, 64 nt, Homo Sapiens
cagaaucaaaacaaaacccaaagaaauaaauaaaaaacaaaauggcuaaauaguuuaaaauagg

SEQ ID NO: 335588 - RNA, 64 nt, Homo Sapiens
uauucacuuugagaaucgguuugacuuugcuuucaaacaaaacaaaaaccucuugcuuuuaggg

SEQ ID NO: 335589 - RNA, 64 nt, Homo Sapiens
acuuugagaaucgguuugacuuugcuuucaaacaaaacaaaaaccucuugcuuuuagggguucu

SEQ ID NO: 335590 - RNA, 64 nt, Homo Sapiens
gagaaaguagcacauggaguagcugagguuaaacaaacaaaaaaaaauuuuaaacaaagaaagg

SEQ ID NO: 335591 - RNA, 64 nt, Homo Sapiens
cacucuucuaauugaauauuuuuauauuuuuaugaaacaaaagagcauuucuucagguuucuau

SEQ ID NO: 335592 - RNA, 64 nt, Homo Sapiens
aauuauuaauagcucagguuaaaaacacccauuuaaacaaaaacaagagcauuuguaauaggaa

SEQ ID NO: 335593 - RNA, 64 nt, Homo Sapiens
gauauauucauauuacucguuuauaaaaaaucaaaaacaaaaggaaagaaaacaaaaaaaacuu

SEQ ID NO: 335594 - RNA, 64 nt, Homo Sapiens
cucguuuauaaaaaaucaaaaacaaaaggaaagaaaacaaaaaaaacuugcacaaaaauacuga

SEQ ID NO: 335595 - RNA, 64 nt, Homo Sapiens
gacaguauuguaaucccaucaaaagaugaaagaaaaacaaaaacaaaaaccaacaacaauuagc

SEQ ID NO: 335596 - RNA, 64 nt, Homo Sapiens
auuguaaucccaucaaaagaugaaagaaaaacaaaaacaaaaaccaacaacaauuagccauagu

SEQ ID NO: 335597 - RNA, 64 nt, Homo Sapiens
gcucugaaaugaaaguuugucuucacaaauaucaaaacaaaauggaggaaaacuaagcauuggc

SEQ ID NO: 335598 - RNA, 64 nt, Homo Sapiens
uggguggcaaagugagacucuggcucaaaaaaaaaaacaaaaaacaaaaccaucugcccuccuc

SEQ ID NO: 335599 - RNA, 64 nt, Homo Sapiens
caaagugagacucuggcucaaaaaaaaaaacaaaaaacaaaaccaucugcccuccuccccuagc

SEQ ID NO: 335600 - RNA, 64 nt, Homo Sapiens
cagaaucaucuugguagauaggggcacugugcuuaaacaaaaugccauuaaugggauuauaaua

SEQ ID NO: 335601 - RNA, 64 nt, Homo Sapiens
acuuucauaucaauaauugauuauguauuaacugaaacaaaagacuagagaaagacacaguggg

SEQ ID NO: 335602 - RNA, 64 nt, Homo Sapiens
cgcaagagauucagcacugggaaagauauaauugaaacaaaauaguguaaucauuuuauuaaaa

SEQ ID NO: 335603 - RNA, 64 nt, Homo Sapiens
auaguaggauuuuaaagggcauugauagcauaccaaacaaaaggcaaaauaaagugaccuuuuu

SEQ ID NO: 335604 - RNA, 64 nt, Homo Sapiens
caacaacaacaaaaaacaagugaacuucaaaacaaaacaaaaaauacuguaaaaaaaagugcac

SEQ ID NO: 335605 - RNA, 64 nt, Homo Sapiens
aaaaacaacaacaacaaaaaugcacugaacuucaaaacaaaacaaaucuuacuguaaaaaaaag

SEQ ID NO: 335606 - RNA, 64 nt, Homo Sapiens
cacguacauuagguccugggauuuaaaaaacaaaaaacaaaacagccauguuauaaauauuguu

SEQ ID NO: 335607 - RNA, 64 nt, Homo Sapiens
caaaacacacguacauuagguauuguuauuuaaaaaacaaaaaagucacuggccauguuauaaa

SEQ ID NO: 335608 - RNA, 64 nt, Homo Sapiens
acacaaaaaacacauucuaauaaaaucaaaaacaaaacaaaaaauuuggaaaagaauuccuucu

SEQ ID NO: 335609 - RNA, 64 nt, Homo Sapiens
aaaaaacacaaaaaacacaucuucuuaaaaucaaaaacaaaacaguaacuuuggaaaagaauuc

SEQ ID NO: 335610 - RNA, 64 nt, Homo Sapiens
caacaacugguuguaguucaaggggagccacuugaaacaaaagucguccacacagcacugggga

SEQ ID NO: 335611 - RNA, 64 nt, Homo Sapiens
aacaccucaccaugagugcuaaacaaaaacaaacaaacaaaaaaacucugucucaaaaaaaaaa

SEQ ID NO: 335612 - RNA, 64 nt, Homo Sapiens
aaacaaacaaaaaaaacaccucucaaaaaaaaaaaaacaaaaacggcaacagaguaagacucug

SEQ ID NO: 335613 - RNA, 64 nt, Homo Sapiens
acaugagcagugguguucuaaaaaaaacaaaacaaaacaaaaaaaugcuuuguuuaaaaaaacg

SEQ ID NO: 335614 - RNA, 64 nt, Homo Sapiens
aaaaaacaugagcaguggugaaacgaaaaaaacaaaacaaaacacacuaaugcuuuguuuaaaa

SEQ ID NO: 335615 - RNA, 64 nt, Homo Sapiens
aaacaaaaaaacaugagcaguaaaaaaacgaaaaaaacaaaacagauaacacuaaugcuuuguu

SEQ ID NO: 335616 - RNA, 64 nt, Homo Sapiens
ccuguccacccuugagaaucaaaaacaaacaaacaaacaaaaagcuuccuugaaaauuuuauua

SEQ ID NO: 335617 - RNA, 64 nt, Homo Sapiens
aacaucuucaguuuuucuccaaagucuauaugaaaaacaaaaauucuauauuuuacauucuugg

SEQ ID NO: 335618 - RNA, 64 nt, Homo Sapiens
cuagauauguaauuucuaaaaacaaaacaaaacaaaacaaaaaauuaucuuaaaaaguaaacaa

SEQ ID NO: 335619 - RNA, 64 nt, Homo Sapiens
aaaaacuagauauguaauuuaacaaaacaaaacaaaacaaaacagacucuuaucuuaaaaagua

SEQ ID NO: 335620 - RNA, 64 nt, Homo Sapiens
aaacaaaaaacuagauauguaaguaaacaaaacaaaacaaaacaggcaggacucuuaucuuaaa

SEQ ID NO: 335621 - RNA, 64 nt, Homo Sapiens
aaacaaaacaaaaaacuagauuaaaaaguaaacaaaacaaaacaggugcggcaggacucuuauc

SEQ ID NO: 335622 - RNA, 64 nt, Homo Sapiens
aaacaaaacaaaacaaaaaauuaucuuaaaaaguaaacaaaacaaaagaggugcggcaggacuc

SEQ ID NO: 335623 - RNA, 64 nt, Homo Sapiens
uuucaaaaaaaaaaucgggaucaaguggaaacaaaaacaaaaucuauauuuuuccuucacugug

SEQ ID NO: 335624 - RNA, 64 nt, Homo Sapiens
aaaaucuuucaaaaaaaaaaacugugucaaguggaaacaaaaacuauauauauauuuuuccuuc

SEQ ID NO: 335625 - RNA, 64 nt, Homo Sapiens
ugccuuaggaaaauuuaauaaagacaccucauucaaacaaaaccuggcauguaguuaucuaauc

SEQ ID NO: 335626 - RNA, 64 nt, Homo Sapiens
agcuccuuaaaaguacuguuucaacucuacugcgaaacaaaaauauuggauuaaucagcugguu

SEQ ID NO: 335627 - RNA, 64 nt, Homo Sapiens
uuuuucagguuccaaggaaggcacuuuaaaaacaaaacaaaacaaggcuuuacuucuuuugcau

SEQ ID NO: 335628 - RNA, 64 nt, Homo Sapiens
aaacauuuuucagguuccaaugcaugcacuuuaaaaacaaaacaaaaaaaggcuuuacuucuuu

SEQ ID NO: 335629 - RNA, 64 nt, Homo Sapiens
cucaagccuuacgaccagagacugaacaaacaaaaaacaaaacgcacaagcugcagucuguagc

SEQ ID NO: 335630 - RNA, 64 nt, Homo Sapiens
caaaacgcucaagccuuacgcuguagcacugaacaaacaaaaaauggccaccacaagcugcagu

SEQ ID NO: 335631 - RNA, 64 nt, Homo Sapiens
uauaaugcuaguccuagauuacuuauugauuuaaaaacaaaaaaaagauuacuuaauuuugauu

SEQ ID NO: 335632 - RNA, 64 nt, Homo Sapiens
aaaacaaaaaaaagauuacuuaauuuugauuuaaaaacaaaaaaucguaaaauacaaaaaccag

SEQ ID NO: 335633 - RNA, 64 nt, Homo Sapiens
gcagaagguguauguuggggagaacugaaagggaaaacaaaauacuugacauagucuuaaguag

SEQ ID NO: 335634 - RNA, 64 nt, Homo Sapiens
uuagcagagacagggaggaaguuuuuauuuuuauaaacaaaaucugauguucagaggccccguu

SEQ ID NO: 335635 - RNA, 64 nt, Homo Sapiens
auaaacacaaggaacauuccauaucauuagucgaaaacaaaaacaaaaaaaaaaccuuugguca

SEQ ID NO: 335636 - RNA, 64 nt, Homo Sapiens
acaaggaacauuccauaucauuagucgaaaacaaaaacaaaaaaaaaaccuuuggucauuugua

SEQ ID NO: 335637 - RNA, 64 nt, Homo Sapiens
aauuugacugugacuuuaaucuaaauuacuauguaaacaaaaaguagauaguuucacuuuuuaa

SEQ ID NO: 335638 - RNA, 64 nt, Homo Sapiens
caguaccuacauaguuuuuaaauuauuguuuaaaaaacaaaacagcuguuauaaaugaauauua

SEQ ID NO: 335639 - RNA, 64 nt, Homo Sapiens
gaugaauaaaucuuaaaugcuuuguuuaauuaaaaaacaaaaaucaccaauauccaagacauga

SEQ ID NO: 335640 - RNA, 64 nt, Homo Sapiens
cuuugcuguaucacugugugaaaaacaaaaacaaaaacaaaaccucuuuccuuuccaguuaaaa

SEQ ID NO: 335641 - RNA, 64 nt, Homo Sapiens
aaaacccuuugcuguaucacuuaaaaaaaaacaaaaacaaaaaccuuuccucuuuccuuuccag

SEQ ID NO: 335642 - RNA, 64 nt, Homo Sapiens
aaaaacaaaacccuuugcuguuccaguuaaaaaaaaacaaaaacucccuucuuuccucuuuccu

SEQ ID NO: 335643 - RNA, 64 nt, Homo Sapiens
uaaaaaccccaaaacuaucauaccaaaaaacaagaaacaaaacaacuaguacauaucuuuaaau

SEQ ID NO: 335644 - RNA, 64 nt, Homo Sapiens
ugacaacauaguuucuuaauauuuaacuucaagaaaacaaaauuaauaaccuuccuuaaguaca

SEQ ID NO: 335645 - RNA, 64 nt, Homo Sapiens
aaacugcaaaagucuaaaaugcaaaacaaaaagcaaacaaaaaacugaguauaaaggaaaaaca

SEQ ID NO: 335646 - RNA, 64 nt, Homo Sapiens
caaacaaaaaaaaacugcaaaaggaaaaacagcaaaacaaaaagagcaagagucccugaguaua

SEQ ID NO: 335647 - RNA, 64 nt, Homo Sapiens
uguuggaauuacuuaauugagucuguaagacaaaaaacaaaacaaaguuauugccaaaggaacu

SEQ ID NO: 335648 - RNA, 64 nt, Homo Sapiens
guaguuaauguaauuuuuauuguuugguauuugcaaacaaaaauauuuccaaucacauugguac

SEQ ID NO: 335649 - RNA, 64 nt, Homo Sapiens
uuuaaaaaaaagguuugcuaaaaaaacaaaaaaaaaacaaaaaacaccaucaauuuaaaaguaa

SEQ ID NO: 335650 - RNA, 64 nt, Homo Sapiens
aaaacaaaaaauuuaaaaaauuuaaaaguaaaaaaaacaaaaaaaugccacgguucaccaucaa

SEQ ID NO: 335651 - RNA, 64 nt, Homo Sapiens
uaaagagauaagcauuaaacugacauuauacugcaaacaaaacuugugcugggacugcuauacu

SEQ ID NO: 335652 - RNA, 64 nt, Homo Sapiens
cuauguauuugcacagcacacauuugccaaaacaaaacaaaaaagucauuaaaacaaaaugaaa

SEQ ID NO: 335653 - RNA, 64 nt, Homo Sapiens
aaaaacuauguauuugcacaugaaacauuugccaaaacaaaacaccgaagucauuaaaacaaaa

SEQ ID NO: 335654 - RNA, 64 nt, Homo Sapiens
aaacauuugccaaaacaaaagaccgaagucauuaaaacaaaaugauuucauuuucuuuauauug

SEQ ID NO: 335655 - RNA, 64 nt, Homo Sapiens
acacauauugauggagucugaagcuacaaaaagcaaacaaaaccgggauuucuaaacagcaguu

SEQ ID NO: 335656 - RNA, 64 nt, Homo Sapiens
caguauaaucagaaagugccaucaaacuuucuauaaacaaaauauaccugauaaguuccaucgu

SEQ ID NO: 335657 - RNA, 64 nt, Homo Sapiens
ugcugcauggcucgcauggaugacuucugacaaaaaacaaaaagguauuguaaauaaguaacuu

SEQ ID NO: 335658 - RNA, 64 nt, Homo Sapiens
gaaauuguuccuuggagaaaugaaaacaguguguaaacaaaaugaagcugcccuaauaaaaagg

SEQ ID NO: 335659 - RNA, 64 nt, Homo Sapiens
aaacucaucugaaauguuacaaaaauaaacuauaaaacaaaaauuugaaaauggaguaguauuu

SEQ ID NO: 335660 - RNA, 64 nt, Homo Sapiens
gaaauuuauuuguaugauauaaaguuauuacuuuaaacaaaaugcaaguauggggggauuguuu

SEQ ID NO: 335661 - RNA, 64 nt, Homo Sapiens
uaacuuuuuauaguugaugacuuuaggguagcacaaacaaaacuccuuuguaucuaacuuuucu

SEQ ID NO: 335662 - RNA, 64 nt, Homo Sapiens
uucugagaccuaaauuuaaagggucaggcauuagaaacaaaaguguuucuucauaucuaggaga

SEQ ID NO: 335663 - RNA, 64 nt, Homo Sapiens
acauggugcaaccucgucuuuacuaaaaauacaaaaacaaaaauuagccagggguggugguaug

SEQ ID NO: 335664 - RNA, 64 nt, Homo Sapiens
ccagccugggagacagagcaagacuccaucucaaaaacaaaaacaaaacaaaacaacaacaaaa

SEQ ID NO: 335665 - RNA, 64 nt, Homo Sapiens
ugggagacagagcaagacuccaucucaaaaacaaaaacaaaacaaaacaacaacaaaaaaagaa

SEQ ID NO: 335666 - RNA, 64 nt, Homo Sapiens
gacagagcaagacuccaucucaaaaacaaaaacaaaacaaaacaacaacaaaaaaagaaguuaa

SEQ ID NO: 335667 - RNA, 64 nt, Homo Sapiens
caucagagauacuuuccuaaaaaggaaaaauaaaaaacaaaauggugccacuuuggguugaagc

SEQ ID NO: 335668 - RNA, 64 nt, Homo Sapiens
uugaauucauuuauaugucuuuugauucuuaaaaaaacaaaaaacauuccauuagaagcaccag

SEQ ID NO: 335669 - RNA, 64 nt, Homo Sapiens
ucauaccaaaaaguguaagugaaaacccccuuuaaaacaaaacaaaaaaaugaaauaaaauuag

SEQ ID NO: 335670 - RNA, 64 nt, Homo Sapiens
ccaaaaaguguaagugaaaacccccuuuaaaacaaaacaaaaaaaugaaauaaaauuaggcaaa

SEQ ID NO: 335671 - RNA, 64 nt, Homo Sapiens
cuguaaccauguuuuuucuguuuaauuauguaaaaaacaaaacuacaacaacaaaaaaagaaaa

SEQ ID NO: 335672 - RNA, 64 nt, Homo Sapiens
aaagaaaaaaguuaaaaaagaaaaaaacaccaaaaaacaaaaacaaacaaaaaaaaaaacccac

SEQ ID NO: 335673 - RNA, 64 nt, Homo Sapiens
guuaaaaaagaaaaaaacaccaaaaaacaaaaacaaacaaaaaaaaaaacccacaacccuuauc

SEQ ID NO: 335674 - RNA, 64 nt, Homo Sapiens
uaaugacuggacaucagaagaggaaaaaaacucaaaacaaaagcgagagagacuauugccauau

SEQ ID NO: 335675 - RNA, 64 nt, Homo Sapiens
cuuuugccuucaaucuguugucuucaaaacaaacaaacaaaaaaagcuucuugcgccuuucccu

SEQ ID NO: 335676 - RNA, 64 nt, Homo Sapiens
gcuuguaugcacaagguaggacuuacuucguaagaaacaaaaugccaguauuuucuuaagccau

SEQ ID NO: 335677 - RNA, 64 nt, Homo Sapiens
ggaagauggucaaguuuguaaggguuauuuaaaaaaacaaaaaaccagacauucuaguuugugg

SEQ ID NO: 335678 - RNA, 64 nt, Homo Sapiens
acacaaaccaaaccgucaacaaaaaaucaacagcaaacaaaaccccaugcugguagcaagagag

SEQ ID NO: 335679 - RNA, 64 nt, Homo Sapiens
aaaaaaaaaagaaaaaaaaaacucugaaaaaacaaaacaaaaaagcucagucagcaaccucaga

SEQ ID NO: 335680 - RNA, 64 nt, Homo Sapiens
aaaaaaaaaaaaaaagaaaaucagaacucugaaaaaacaaaacacuguggcucagucagcaacc

SEQ ID NO: 335681 - RNA, 64 nt, Homo Sapiens
aauuagccuacuuaaaggcauccaucucaaaacaaaacaaaaaagccuggcgacagagagagac

SEQ ID NO: 335682 - RNA, 64 nt, Homo Sapiens
aaaaaaauuagccuacuuaagagacuccaucucaaaacaaaacacuccagccuggcgacagaga

SEQ ID NO: 335683 - RNA, 64 nt, Homo Sapiens
uagggcuguauuuuauauauaaaaaaaacaaaaaaaacaaaauccgugaccaaauuguuuaaga

SEQ ID NO: 335684 - RNA, 64 nt, Homo Sapiens
aacaaaaucuagggcuguauuguuuaagaaaaaaaaacaaaaaaaaggugcaucgugaccaaau

SEQ ID NO: 335685 - RNA, 64 nt, Homo Sapiens
aggacuucaauccaaaguuucuaaguaaaggaaaaaacaaaauaagcacuguauauaccugucu

SEQ ID NO: 335686 - RNA, 64 nt, Homo Sapiens
uaucaauguguauguggcugauuguugagaacaaaaacaaaaagguguuuaacuuuguauuuug

SEQ ID NO: 335687 - RNA, 64 nt, Homo Sapiens
acccaguacuguggcucaggggagggaaacuuuaaaacaaaaacauaugaucuuccauccaagu

SEQ ID NO: 335688 - RNA, 64 nt, Homo Sapiens
gaaugccgucauguuccuugcugucugucuucagaaacaaaaguugucuuuugaagcccagucu

SEQ ID NO: 335689 - RNA, 64 nt, Homo Sapiens
gcuucagucucauggauguuucucuaugggaaaaaaacaaaagggcugccuuuaauugucuugc

SEQ ID NO: 335690 - RNA, 64 nt, Homo Sapiens
aauuaaggggaaaauuauuucaaaacaagaaacaaaacaaaaaaugaaaccgcuuuuuaaaauu

SEQ ID NO: 335691 - RNA, 64 nt, Homo Sapiens
aaaaaaauuaaggggaaaauaaauucaaaacaagaaacaaaacaauagcugaaaccgcuuuuua

SEQ ID NO: 335692 - RNA, 64 nt, Homo Sapiens
aaguaguuaaaugcuuugguccuuugagaaaaagaaacaaaagggaaaaaggguuguuugacaa

SEQ ID NO: 335693 - RNA, 64 nt, Homo Sapiens
aaacaggcugccauaauauauaaaaagaaaaaaaaaacaaaaacuuuguuagugaauuuggaaa

SEQ ID NO: 335694 - RNA, 64 nt, Homo Sapiens
aauucaggaacaacggcuaauugaaugaaaagcaaaacaaaaaccaaguuacaaguugauaucg

SEQ ID NO: 335695 - RNA, 64 nt, Homo Sapiens
cuaaauccuuuccaauaauugacugguggaaggaaaacaaaaaacaaaaacuaaaaaccucuua

SEQ ID NO: 335696 - RNA, 64 nt, Homo Sapiens
cuuuccaauaauugacugguggaaggaaaacaaaaaacaaaaacuaaaaaccucuuagcuuuuc

SEQ ID NO: 335697 - RNA, 64 nt, Homo Sapiens
auuuguguuuauauuuccuguaagugaauaaauaaaacaaaacaaaacaaaaaaaacuugugcc

SEQ ID NO: 335698 - RNA, 64 nt, Homo Sapiens
uguuuauauuuccuguaagugaauaaauaaaacaaaacaaaacaaaaaaaacuugugccugaua

SEQ ID NO: 335699 - RNA, 64 nt, Homo Sapiens
auauuuccuguaagugaauaaauaaaacaaaacaaaacaaaaaaaacuugugccugauaagcua

SEQ ID NO: 335700 - RNA, 64 nt, Homo Sapiens
uccuccuuuaacuccuccuaccccccaagguaagaaacaaaaaacaaacaaacaaacaaaaaua

SEQ ID NO: 335701 - RNA, 64 nt, Homo Sapiens
accccccaagguaagaaacaaaaaacaaacaaacaaacaaaaauagaagacaaaagaaagacau

SEQ ID NO: 335702 - RNA, 64 nt, Homo Sapiens
uguucagggagauaauucugccuuuaauugucuaaaacaaaaacaaaaccagccaaccuauguu

SEQ ID NO: 335703 - RNA, 64 nt, Homo Sapiens
gggagauaauucugccuuuaauugucuaaaacaaaaacaaaaccagccaaccuauguuacacgu

SEQ ID NO: 335704 - RNA, 64 nt, Homo Sapiens
cuccagccugggugacagagcgagacuaucucagaaacaaaacaaaacaaaacaacaaaaaaag

SEQ ID NO: 335705 - RNA, 64 nt, Homo Sapiens
gccugggugacagagcgagacuaucucagaaacaaaacaaaacaaaacaacaaaaaaagaaaag

SEQ ID NO: 335706 - RNA, 64 nt, Homo Sapiens
ggugacagagcgagacuaucucagaaacaaaacaaaacaaaacaacaaaaaaagaaaaggcaga

SEQ ID NO: 335707 - RNA, 64 nt, Homo Sapiens
gggugcaugggaaagggcuguugauauuaaaaacaaacaaaacaaaaaagccccacacauaacu

SEQ ID NO: 335708 - RNA, 64 nt, Homo Sapiens
caugggaaagggcuguugauauuaaaaacaaacaaaacaaaaaagccccacacauaacuguuuu

SEQ ID NO: 335709 - RNA, 64 nt, Homo Sapiens
ugguuuaacucuuuaguuuuauuuuaagaggggaaaacaaaaauaucuugcaagcagaaccuug

SEQ ID NO: 335710 - RNA, 64 nt, Homo Sapiens
caugugaaagugcacuuaaguguuuguuuauuauaaacaaaaagaacaaaguuaggaaguuugu

SEQ ID NO: 335711 - RNA, 64 nt, Homo Sapiens
aacucaugccacaguaugucgcacaacaaauuaaaaacaaaaaccccucagaacuuuaguaaca

SEQ ID NO: 335712 - RNA, 64 nt, Homo Sapiens
aaggaaggaaaaaaaaagaaaacaaaacaaaauaaaacaaaaaauuuggcaugcuguaaaacaa

SEQ ID NO: 335713 - RNA, 59 nt, Homo Sapiens
aaacaaaaaaaaggaaggaaaacaaaacaaaacaaaauaaaggauuuggcaugcuguaa

SEQ ID NO: 335714 - RNA, 54 nt, Homo Sapiens
aaauaaaacaaaaaaaaggaaacaaaacaaaacaaaggauuuggcaugcuguaa

SEQ ID NO: 335715 - RNA, 64 nt, Homo Sapiens
uaaaaaccucuuagcuuuucggaaggaaaacaaaaaacaaaaaccuuuccaauaauugacuggu

SEQ ID NO: 335716 - RNA, 64 nt, Homo Sapiens
caaaaacuaaaaaccucuuagacugguggaaggaaaacaaaaaacuaaauccuuuccaauaauu

SEQ ID NO: 335717 - RNA, 64 nt, Homo Sapiens
gaaaagaaaauauacaugauagacccuaucucaaaaacaaaaaggcagccugaguaacaaaaug

SEQ ID NO: 335718 - RNA, 64 nt, Homo Sapiens
aaagagcgaggauggggguuuauaugaugauuuaaaacaaaauauagucuuaaacucaaauuac

SEQ ID NO: 335719 - RNA, 64 nt, Homo Sapiens
uuauguaacuguuccuuuaaaccagagagaaguuaaacaaaagguauuuauucucagaaacaga

SEQ ID NO: 335720 - RNA, 64 nt, Homo Sapiens
uguuuucuacuugagucuaauuaaucucugaggaaaacaaaacccgggggagggggaacguuca

SEQ ID NO: 335721 - RNA, 64 nt, Homo Sapiens
aguauucuucauauuuacuaauuuaaaagagggcaaacaaaaccaaaaccucaugagugcaugg

SEQ ID NO: 335722 - RNA, 64 nt, Homo Sapiens
aaccucaugagugcauggauacaaaaaacaaaaaaaacaaaaaauccugcuaaaaagacaaaaa

SEQ ID NO: 335723 - RNA, 64 nt, Homo Sapiens
aacaaaaaaaaccucaugagagacaaaaaacaaaaaacaaaaaaucccccucuuccugcuaaaa

SEQ ID NO: 335724 - RNA, 64 nt, Homo Sapiens
caaaaaaaacaaaaaaaaccgcuaaaaagacaaaaaacaaaaaauauauucucccccucuuccu

SEQ ID NO: 335725 - RNA, 64 nt, Homo Sapiens
ccuuuacucuguaggucauuccagaaaaaaacaaaaacaaaacccacagaaaugaugaaaguga

SEQ ID NO: 335726 - RNA, 64 nt, Homo Sapiens
aaaaccccuuuacucuguagaagugaccagaaaaaaacaaaaacuucucccacagaaaugauga

SEQ ID NO: 335727 - RNA, 64 nt, Homo Sapiens
auggcagaugcauauuguguuuuaaaaaaaacaaaaacaaaaacuuuguugcacuuuuaguuuu

SEQ ID NO: 335728 - RNA, 64 nt, Homo Sapiens
aaaaacauggcagaugcauaaguuuuuuuaaaaaaaacaaaaacacugacuuuguugcacuuuu

SEQ ID NO: 335729 - RNA, 64 nt, Homo Sapiens
agcugagcaugguggugugucucaaaacaaaacaaaacaaaauugcgacacagcgagacuccau

SEQ ID NO: 335730 - RNA, 64 nt, Homo Sapiens
aaauuagcugagcauggugguccaucucaaaacaaaacaaaacaccugggcgacacagcgagac

SEQ ID NO: 335731 - RNA, 64 nt, Homo Sapiens
aaacaaaauuagcugagcaugagacuccaucucaaaacaaaacauugagccugggcgacacagc

SEQ ID NO: 335732 - RNA, 64 nt, Homo Sapiens
ugucuuauuucuaaauuuccuucuuccaagaugaaaacaaaagaaaaacuuaaaacagaaggua

SEQ ID NO: 335733 - RNA, 64 nt, Homo Sapiens
aagagauucccaccauuauuuagguucaccugcaaaacaaaaaucuuacuccagccccucaaug

SEQ ID NO: 335734 - RNA, 64 nt, Homo Sapiens
gaaccugccaauccgcuguaacaacucugcuuuaaaacaaaaccaaacaaaacuuuaaaaaaaa

SEQ ID NO: 335735 - RNA, 64 nt, Homo Sapiens
auccgcuguaacaacucugcuuuaaaacaaaaccaaacaaaacuuuaaaaaaaaaugugugauc

SEQ ID NO: 335736 - RNA, 64 nt, Homo Sapiens
agaucuugugguuccaugagaauuauuacuuuaaaaacaaaacaaaauauaaaaaacuguguuu

SEQ ID NO: 335737 - RNA, 64 nt, Homo Sapiens
uugugguuccaugagaauuauuacuuuaaaaacaaaacaaaauauaaaaaacuguguuugagua

SEQ ID NO: 335738 - RNA, 64 nt, Homo Sapiens
ugacugcuguauucaaauacguagcuuugguaacaaacaaaauccguauaugcaaaucaacaua

SEQ ID NO: 335739 - RNA, 64 nt, Homo Sapiens
aaauaauaaaggucugcuguggcuaaaaaagcaaaaacaaaaaagcuauccagacaaaauacau

SEQ ID NO: 335740 - RNA, 64 nt, Homo Sapiens
uaauaaaugcagaaucugaagguaaauagguuuaaaacaaaacaaaaacccaccccuuuaagga

SEQ ID NO: 335741 - RNA, 64 nt, Homo Sapiens
aaugcagaaucugaagguaaauagguuuaaaacaaaacaaaaacccaccccuuuaaggaguugg

SEQ ID NO: 335742 - RNA, 64 nt, Homo Sapiens
aaguuuguacuuuguuuuuugugccuuuguaaagaaacaaaauaaaaaaaaccaagaggccacc

SEQ ID NO: 335743 - RNA, 64 nt, Homo Sapiens
ccagguuauuucuucccugcgaacagggaaaauuaaacaaaaccccuuuaaauauguuuuuuaa

SEQ ID NO: 335744 - RNA, 64 nt, Homo Sapiens
aacuuuuuuuaaucguuguauaaaaaaaacaaaaaaacaaaaaacucuccucauccuaguucuu

SEQ ID NO: 335745 - RNA, 61 nt, Homo Sapiens
acaaaaaaaacuuuuuuuaauucuuuaaaaaaaacaaaaaacggcucucuccucauccuag

SEQ ID NO: 335746 - RNA, 64 nt, Homo Sapiens
agcccucugccuccuccccaaacaaaaaaacuacaaacaaaagcuuccaaacuuuugcagaaaa

SEQ ID NO: 335747 - RNA, 64 nt, Homo Sapiens
acuacaaacaaaagcagcccaacuuuugcagaaaaaacaaaaaaagcuacuccccuuucuucca

SEQ ID NO: 335748 - RNA, 64 nt, Homo Sapiens
gugacaaucuuuuggguugaagagcauaauuccgaaacaaaacucuaaaguuuucuucccagag

SEQ ID NO: 335749 - RNA, 64 nt, Homo Sapiens
gagaacuuucaggcagaucccaccauuagccuguaaacaaaagguguggcaccagccaccuggg

SEQ ID NO: 335750 - RNA, 64 nt, Homo Sapiens
uguguauuugauggcucuaagggcuauaaauuacaaacaaaacacaucccagacauuaggaguu

SEQ ID NO: 335751 - RNA, 64 nt, Homo Sapiens
uccaucucuucagaccccuuugccuuuaaaaaaaaaacaaaaacaaaaacaaaaaaacccauaa

SEQ ID NO: 335752 - RNA, 64 nt, Homo Sapiens
ucuucagaccccuuugccuuuaaaaaaaaaacaaaaacaaaaacaaaaaaacccauaaugccca

SEQ ID NO: 335753 - RNA, 64 nt, Homo Sapiens
gaccccuuugccuuuaaaaaaaaaacaaaaacaaaaacaaaaaaacccauaaugcccacagaau

SEQ ID NO: 335754 - RNA, 64 nt, Homo Sapiens
auuggaauucuacuggaaaaaaauacaaaaagcaaaacaaaacccucagcacuguuacaagagg

SEQ ID NO: 335755 - RNA, 64 nt, Homo Sapiens
agggcaaggaguuuauuacaauguaucuuuauuaaaacaaaaggguguauaguguucacaaacu

SEQ ID NO: 335756 - RNA, 64 nt, Homo Sapiens
ugggcaaaaagagugagacucugucucaaaaaaaaaacaaaacaaaaaaaaccucuuugcuggu

SEQ ID NO: 335757 - RNA, 64 nt, Homo Sapiens
aaaaagagugagacucugucucaaaaaaaaaacaaaacaaaaaaaaccucuuugcugguauauu

SEQ ID NO: 335758 - RNA, 64 nt, Homo Sapiens
gacuuggaggguugguccucuugccuccuggaaaaaacaaaaacaaaaaacugcagugaaagac

SEQ ID NO: 335759 - RNA, 64 nt, Homo Sapiens
gaggguugguccucuugccuccuggaaaaaacaaaaacaaaaaacugcagugaaagacaagcug

SEQ ID NO: 335760 - RNA, 64 nt, Homo Sapiens
ucccuucugugugaccgaccccuuggccaaaaaaaaacaaaaagcaaaaaacaaaaaccuaccc

SEQ ID NO: 335761 - RNA, 64 nt, Homo Sapiens
ccgaccccuuggccaaaaaaaaacaaaaagcaaaaaacaaaaaccuacccuguucugguuuuuu

SEQ ID NO: 335762 - RNA, 64 nt, Homo Sapiens
aacaacaaaaaacaaaagaacaaaaaacaaaacaaaacaaaaacacaagaguaaaacuucaucu

SEQ ID NO: 335763 - RNA, 64 nt, Homo Sapiens
aaaacaacaacaaaaaacaacaucucaaaaaacaaaacaaaacaggucaacaagaguaaaacuu

SEQ ID NO: 335764 - RNA, 64 nt, Homo Sapiens
aaacaaaaacaacaacaaaaaacuucaucucaaaaaacaaaacaagccuggucaacaagaguaa

SEQ ID NO: 335765 - RNA, 64 nt, Homo Sapiens
ccagcacauacaagaaacauagaaaagaaaacaaaaacaaaaacuccccuuauucccgaggccc

SEQ ID NO: 335766 - RNA, 64 nt, Homo Sapiens
aaaaacccagcacauacaagaggcccagaaaagaaaacaaaaaccucuccuccccuuauucccg

SEQ ID NO: 335767 - RNA, 64 nt, Homo Sapiens
caucccagacauuaggaguugggcuauaaauuacaaacaaaacauguguauuugauggcuccaa

SEQ ID NO: 335768 - RNA, 64 nt, Homo Sapiens
uuguaauguugucuagggauggagucaaaguaaaaaacaaaaaacaaauauuaaagauuuccuu

SEQ ID NO: 335769 - RNA, 64 nt, Homo Sapiens
uuuggcaccagccaccugggcaccauuagccuguaaacaaaaaggagaacuuucaggcagaucc

SEQ ID NO: 335770 - RNA, 64 nt, Homo Sapiens
caaacccagaccccaccugaauuugaaaaggaaaaaacaaaaaaagagguugaauugaguauau

SEQ ID NO: 335771 - RNA, 64 nt, Homo Sapiens
uuuuuuuauacauaauauauauuccacuugauguaaacaaaacuaguauaagcauggauugcca

SEQ ID NO: 335772 - RNA, 64 nt, Homo Sapiens
agccucgguauaauuuuguuaaaaguauaaaacaaaacaaaaaaaguuugcuggggaguuugau

SEQ ID NO: 335773 - RNA, 64 nt, Homo Sapiens
aaaaaagccucgguauaauuuugauaaaaguauaaaacaaaacacagcaaguuugcuggggagu

SEQ ID NO: 335774 - RNA, 64 nt, Homo Sapiens
uucugcuagcuuguuuucuuucaccuuagugaggaaacaaaauggcaaaggcaucucaggaaca

SEQ ID NO: 335775 - RNA, 64 nt, Homo Sapiens
ugauucuauucagaaugagauggucaugagaauaaaacaaaagggugaugaauauuacuaauag

SEQ ID NO: 335776 - RNA, 64 nt, Homo Sapiens
uggaaaaaaaaaaccuuguagaaaaaaaaaacaaaaacaaaaaaugaauaacccuuuuagcauu

SEQ ID NO: 335777 - RNA, 64 nt, Homo Sapiens
aaaaaauggaaaaaaaaaacagcauugaaaaaaaaaacaaaaacaaauucugaauaacccuuuu

SEQ ID NO: 335778 - RNA, 64 nt, Homo Sapiens
aaaacccuauuuaaaugaaaacaaaaaacaaaaaaaacaaaaaauagggaaguaaaaaaacaaa

SEQ ID NO: 335779 - RNA, 64 nt, Homo Sapiens
aacaaaaaaaaaacccuauuaaaaacaaaacaaaaaacaaaaaacaaaucgaauagggaaguaa

SEQ ID NO: 335780 - RNA, 64 nt, Homo Sapiens
caaaaaaaacaaaaaaaaaagaaguaaaaaaacaaaacaaaaaaggaaacucaaaucgaauagg

SEQ ID NO: 335781 - RNA, 64 nt, Homo Sapiens
aaaaacaaaaaaaacaaaaaauagggaaguaaaaaaacaaaacaaaucaggaaacucaaaucga

SEQ ID NO: 335782 - RNA, 64 nt, Homo Sapiens
agaacaaaagaagagagaagaaaaaaaacacacaaaacaaaaacuuuucuaaaaaacaaacaaa

SEQ ID NO: 335783 - RNA, 64 nt, Homo Sapiens
aaaaacacacaaaacaaaaauuuuucuaaaaaacaaacaaaaaauauuucuucucccccacccc

SEQ ID NO: 335784 - RNA, 64 nt, Homo Sapiens
caucccagacauuaggaguugggcuauaaauuacaaacaaaacauguguauuugauggcucuaa

SEQ ID NO: 335785 - RNA, 64 nt, Homo Sapiens
uuuggcaccagccaccugggcaccauuagccuguaaacaaaagggagaacuuucaggcagaucc

SEQ ID NO: 335786 - RNA, 64 nt, Homo Sapiens
cuaaagggugagaauuugcuggaagaaaaacaaaaaacaaaaaaauuugguuuauuuagaaaaa

SEQ ID NO: 335787 - RNA, 64 nt, Homo Sapiens
caaaaaacuaaagggugagaagaaaaaggaagaaaaacaaaaaaaccaagcauuugguuuauuu

SEQ ID NO: 335788 - RNA, 64 nt, Homo Sapiens
accaagaaaccaagucaacucacugccugccagaaaacaaaaacuccuccuucaccccuccucu

SEQ ID NO: 335789 - RNA, 64 nt, Homo Sapiens
cuauaguuagaaaaauggaacugggaaaaaacaaaaacaaaaaaaguuguuuuuuuuuuaacaa

SEQ ID NO: 335790 - RNA, 64 nt, Homo Sapiens
aaaaaacuauaguuagaaaauaacaacugggaaaaaacaaaaacacugugaguuguuuuuuuuu

SEQ ID NO: 335791 - RNA, 64 nt, Homo Sapiens
gauaagcaauguucuuuauguagccaaugcuacgaaacaaaagaggugaaagagacccuuuuuu

SEQ ID NO: 335792 - RNA, 64 nt, Homo Sapiens
uuaauaaauucauaaaaaagacucauaucuuugcaaacaaaagaagggcagauacugggcuucu

SEQ ID NO: 335793 - RNA, 64 nt, Homo Sapiens
agagcaaaugcuagagcgauuucagcugauagaaaaacaaaaaugaaaaaaaaaacacaaaaaa

SEQ ID NO: 335794 - RNA, 64 nt, Homo Sapiens
gauagaaaaacaaaaaugaaaaaaaaaacacaaaaaacaaaaaacauggcacguugcuaguuua

SEQ ID NO: 335795 - RNA, 64 nt, Homo Sapiens
ccuugaaucaaguuuguuuguaaaaaaacaaaacaaacaaaacacuuucuuuuuccuuuuuuuu

SEQ ID NO: 335796 - RNA, 64 nt, Homo Sapiens
aacaaaacaccuugaaucaacuuuuuuuuuaaaaaaacaaaacauuccuuugucuuucuuuuuc

SEQ ID NO: 335797 - RNA, 64 nt, Homo Sapiens
gggacauuuaugugcaguugacaaccaauaacucaaacaaaaaaaugcaaaaaggaaaacacac

SEQ ID NO: 335798 - RNA, 64 nt, Homo Sapiens
uauuagaaguaaagcagaaaaugucaauuucacuaaacaaaagcacuuagacaaagaagugcaa

SEQ ID NO: 335799 - RNA, 64 nt, Homo Sapiens
gagaucuguauucggguauccauacaaaaaucacaaacaaaaagggcagaggcaaaguuaucau

SEQ ID NO: 335800 - RNA, 64 nt, Homo Sapiens
uuuucauauuuauuucuuaguguguuaugauaccaaacaaaauauugagaaaauggauagcuuc

SEQ ID NO: 335801 - RNA, 64 nt, Homo Sapiens
uuaaauaucuauaaagugaauuuucacaaauuuuaaacaaaaaauuguuuaaaauaucuugaua

SEQ ID NO: 335802 - RNA, 64 nt, Homo Sapiens
cuugggggaagaaauuggcagcaucaaugaauuaaaacaaaaauauucuuugauuuauuuuauu

SEQ ID NO: 335803 - RNA, 64 nt, Homo Sapiens
ccagaaucuuccuuuuuuugcucuuuaaaaaagaaaacaaaaagaagauuaugaaaggaacagg

SEQ ID NO: 335804 - RNA, 64 nt, Homo Sapiens
cugauuuuuuuuuuuuuuuuagcccaccaaaccaaaacaaaauaacuucgagcuauuuagcuaa

SEQ ID NO: 335805 - RNA, 64 nt, Homo Sapiens
aaggggcauuuccucuccaagaugagccaggaagaaacaaaagcuaucugcuuaaagaccuuga

SEQ ID NO: 335806 - RNA, 64 nt, Homo Sapiens
auaauggcuagaauacaaagauuaaugugaaauaaaacaaaaauaugcauauaaaagugaugga

SEQ ID NO: 335807 - RNA, 64 nt, Homo Sapiens
agucaaaauggacagucauuuuugaauggcaccaaaacaaaauaugcuaaggcuuuuaauacau

SEQ ID NO: 335808 - RNA, 64 nt, Homo Sapiens
uaucuguuuaucaaaguaaagacgagaccaaacuaaacaaaaaguaccuguauguuuuguuuua

SEQ ID NO: 335809 - RNA, 64 nt, Homo Sapiens
uuaaaauaccuguauguuuugauaagaccaaacaaaacaaaacagagaaaauauagaauuccug

SEQ ID NO: 335810 - RNA, 64 nt, Homo Sapiens
aaacauuaaaauaccuguauuccuggauaagaccaaacaaaacagaggagagaaaauauagaau

SEQ ID NO: 335811 - RNA, 64 nt, Homo Sapiens
aacuguccuuucugcgcucacgacauuagaaacaaaacaaaaagauaucucuuucuuuuucuuc

SEQ ID NO: 335812 - RNA, 64 nt, Homo Sapiens
aaaagaacuguccuuucugcucuuccgacauuagaaacaaaacauuaauauaucucuuucuuuu

SEQ ID NO: 335813 - RNA, 64 nt, Homo Sapiens
ccaaaguuguuuucuagauuuguggcuuuaagaaaaacaaaacaaaacaaacacauuguuuuuc

SEQ ID NO: 335814 - RNA, 64 nt, Homo Sapiens
guuguuuucuagauuuguggcuuuaagaaaaacaaaacaaaacaaacacauuguuuuucucaga

SEQ ID NO: 335815 - RNA, 64 nt, Homo Sapiens
gggagggauggaggagauaauuugcuuauauuaaaaacaaaaaauggcugaggcaggaguuugg

SEQ ID NO: 335816 - RNA, 64 nt, Homo Sapiens
ugcaugcaaaucaaguggacaagaaaaaauaacaaaacaaaaaacaagaaaaaaaaaacacaaa

SEQ ID NO: 335817 - RNA, 64 nt, Homo Sapiens
ccucaggccgccagugucgcccugccccuuuuuaaaacaaaaugcccucguuuguaaacccuua

SEQ ID NO: 335818 - RNA, 64 nt, Homo Sapiens
caaccccaagcuauauauuaccagaugaaaggauaaacaaaauaugguccauccauacaaugga

SEQ ID NO: 335819 - RNA, 64 nt, Homo Sapiens
ugggggagggggacauagcgagacucggucucaaaaacaaaacaaaacaaaacaaaacaaaaca

SEQ ID NO: 335820 - RNA, 64 nt, Homo Sapiens
gagggggacauagcgagacucggucucaaaaacaaaacaaaacaaaacaaaacaaaacaaaaac

SEQ ID NO: 335821 - RNA, 64 nt, Homo Sapiens
ggacauagcgagacucggucucaaaaacaaaacaaaacaaaacaaaacaaaacaaaaacaaaac

SEQ ID NO: 335822 - RNA, 64 nt, Homo Sapiens
uagcgagacucggucucaaaaacaaaacaaaacaaaacaaaacaaaacaaaaacaaaacaaaac

SEQ ID NO: 335823 - RNA, 64 nt, Homo Sapiens
agacucggucucaaaaacaaaacaaaacaaaacaaaacaaaacaaaacaaaacaaaacaaaaca

SEQ ID NO: 335824 - RNA, 64 nt, Homo Sapiens
cggucucaaaaacaaaacaaaacaaaacaaaacaaaacaaaacaaaacaaaacaaaacacugcc

SEQ ID NO: 335825 - RNA, 64 nt, Homo Sapiens
ucaaaaacaaaacaaaacaaaacaaaacaaaacaaaacaaaacaaaacaaaacacugccaaacu

SEQ ID NO: 335826 - RNA, 64 nt, Homo Sapiens
aacaaaacaaaacaaaacaaaacaaaacaaaacaaaacaaaacaaaacacugccaaacuguuuc

SEQ ID NO: 335827 - RNA, 64 nt, Homo Sapiens
acaaaacaaaacaaaacaaaaacaaaacaaaacaaaacaaaacacugccaaacuguuuccaaag

SEQ ID NO: 335828 - RNA, 64 nt, Homo Sapiens
gaccgagggaggcucugucucaaaagcaaagcaaaaacaaaaacaaaaacaccuaaaaaaccug

SEQ ID NO: 335829 - RNA, 64 nt, Homo Sapiens
gggaggcucugucucaaaagcaaagcaaaaacaaaaacaaaaacaccuaaaaaaccugcaguuu

SEQ ID NO: 335830 - RNA, 64 nt, Homo Sapiens
gauuccccaaaucugcauccuuuucaaaaccuaaaaacaaaaagaaaaacaaauaaaacaaaac

SEQ ID NO: 335831 - RNA, 64 nt, Homo Sapiens
uuucaaaaccuaaaaacaaaaagaaaaacaaauaaaacaaaaccaacucagaccagaacuguuu

SEQ ID NO: 335832 - RNA, 64 nt, Homo Sapiens
guuccaaaauuuaaucacuaauuaaaaaucuaucaaacaaaacucuggaccagacagauuuaua

SEQ ID NO: 335833 - RNA, 64 nt, Homo Sapiens
caauaaaugugauuuaucacauacacagaacuaaaaacaaaaaccacaugaccaugaucaucuc

SEQ ID NO: 335834 - RNA, 64 nt, Homo Sapiens
cuuaaugaugaacaccccaaagcaauugcaacaaaaacaaaaauugacaagugggaccuaauua

SEQ ID NO: 335835 - RNA, 64 nt, Homo Sapiens
gcagaccucucaauucacaaugaguuaacugauaaaacaaaacagaagucagacaauguuuuaa

SEQ ID NO: 335836 - RNA, 64 nt, Homo Sapiens
augacaugggaaaaugggagcuucuaaugaggacaaacaaaaaauagagaaaaauuaauaaagu

SEQ ID NO: 335837 - RNA, 64 nt, Homo Sapiens
aaaccaccaaauccccaaaugaugcaaaaaacaaaaacaaaaaaccuaaacccaagcacccaau

SEQ ID NO: 335838 - RNA, 64 nt, Homo Sapiens
aaaaaaaaaccaccaaaucccccaaugaugcaaaaaacaaaaaccccuucccuaaacccaagca

SEQ ID NO: 335839 - RNA, 64 nt, Homo Sapiens
aaagcugauuggaaacaauuguaaauugcagagaaaacaaaaccuagauagaugguguuugcau

SEQ ID NO: 335840 - RNA, 64 nt, Homo Sapiens
gggcuuggcuggucaaaggaagggaauguacguaaaacaaaauacuugcuuugauuuuuaguga

SEQ ID NO: 335841 - RNA, 64 nt, Homo Sapiens
caaaaaaaaaaaaaaaacccaaaaaaaaaagacaaaacaaaagaaaaaacuguaaaaaaaaaaa

SEQ ID NO: 335842 - RNA, 64 nt, Homo Sapiens
aaaaaaaaaggggggugggaggggcuggaagcagaaacaaaaugaaugcgggggagcaggcagu

SEQ ID NO: 335843 - RNA, 64 nt, Homo Sapiens
uuuuaaaaaaauuguugaguaacguuucagaaaaaaacaaaaagaaaaggcucauaacaacaag

SEQ ID NO: 335844 - RNA, 64 nt, Homo Sapiens
cucauaacaacaagaacguuauuuaacgagaacaaaacaaaaggaccaauuuugggucgagugc

SEQ ID NO: 335845 - RNA, 64 nt, Homo Sapiens
uagaugcaacagcgaaacaaaauccagagacagaaaacaaaaucccgccagagcagcuuuuuac

SEQ ID NO: 335846 - RNA, 64 nt, Homo Sapiens
uagccaggcaugguggcaccccccaucucuacuaaaacaaaaaucccuggccaacauggugaaa

SEQ ID NO: 335847 - RNA, 64 nt, Homo Sapiens
aaguucccacuggugaugcccaaaaaaaaaaacaaaacaaaaccaacagagcgagacuccaucu

SEQ ID NO: 335848 - RNA, 64 nt, Homo Sapiens
aaaccaaguucccacuggugcaucucaaaaaaaaaaacaaaacauggguaacagagcgagacuc

SEQ ID NO: 335849 - RNA, 64 nt, Homo Sapiens
ccacacacacauuuuguacgaaacaaaaaacaaaaaacaaaaaagcccccuuuuucuuguuaaa

SEQ ID NO: 335850 - RNA, 64 nt, Homo Sapiens
caaaaaaccacacacacauuuguuaaaaaacaaaaaacaaaaaaggcuuuugcccccuuuuucu

SEQ ID NO: 335851 - RNA, 64 nt, Homo Sapiens
caaaaaacaaaaaaccacacuuuuucuuguuaaaaaacaaaaaacauuccuggcuuuugccccc

SEQ ID NO: 335852 - RNA, 64 nt, Homo Sapiens
aaaaccggauagaauaaugaacaacaacaaaacaaaacaaaaaacagcaaguucuuguuuccaa

SEQ ID NO: 335853 - RNA, 64 nt, Homo Sapiens
aaaaaaaaaccggauagaauuccaaacaacaacaaaacaaaacacgacacagcaaguucuuguu

SEQ ID NO: 335854 - RNA, 64 nt, Homo Sapiens
aaugaaaaggacuguaggagccucuauuauaaaaaaacaaaauacaacauauagcaagacucug

SEQ ID NO: 335855 - RNA, 64 nt, Homo Sapiens
aaaacuguucuugggacugucucaacugugcaaaaaacaaaagauggaguguuuacaaguagac

SEQ ID NO: 335856 - RNA, 64 nt, Homo Sapiens
agugacugagauguaaaaauagauuuuagaauuaaaacaaaauccaaguccucacaccccuguc

SEQ ID NO: 335857 - RNA, 64 nt, Homo Sapiens
uauuuaacagcuugaguauugcauuuccuuggccaaacaaaaauagcuacaaauccacaaaaau

SEQ ID NO: 335858 - RNA, 64 nt, Homo Sapiens
gugaugccuuaggacauguuugaacugcagcaaaaaacaaaaacaaaaaacagugcauuagcaa

SEQ ID NO: 335859 - RNA, 64 nt, Homo Sapiens
ccuuaggacauguuugaacugcagcaaaaaacaaaaacaaaaaacagugcauuagcaauuucau

SEQ ID NO: 335860 - RNA, 64 nt, Homo Sapiens
gggcaacauagcgagaccucaucuccaaaaaagaaaacaaaaaacaaaaaaaggaaugauguuc

SEQ ID NO: 335861 - RNA, 64 nt, Homo Sapiens
auagcgagaccucaucuccaaaaaagaaaacaaaaaacaaaaaaaggaaugauguucuguagag

SEQ ID NO: 335862 - RNA, 64 nt, Homo Sapiens
gcacugauuuaaaacaaaccaaaaaaaaagaaaaaaacaaaaaaaaaaaucccuccuuucuagc

SEQ ID NO: 335863 - RNA, 64 nt, Homo Sapiens
augauuuaaauuuauaauuaaguaaauuacauuaaaacaaaaaaauuauacucaaaauucauua

SEQ ID NO: 335864 - RNA, 64 nt, Homo Sapiens
uucauuguuuuacuuuugucuuccucacuaguguaaacaaaaauuucaaccagcauucaugccg

SEQ ID NO: 335865 - RNA, 64 nt, Homo Sapiens
gcuggucugucuuuucuccauuuguuuaaaaaaaaaacaaaaacaaaaaacaacacuuuggugu

SEQ ID NO: 335866 - RNA, 64 nt, Homo Sapiens
cugucuuuucuccauuuguuuaaaaaaaaaacaaaaacaaaaaacaacacuuuggugugguggu

SEQ ID NO: 335867 - RNA, 64 nt, Homo Sapiens
uucuaaguacagucauucucuuuucucuuaaacaaaacaaaacucauaaauucauguaaagcca

SEQ ID NO: 335868 - RNA, 64 nt, Homo Sapiens
aaacuuucuaaguacagucaagccauuuucucuuaaacaaaacaaggaacauaaauucauguaa

SEQ ID NO: 335869 - RNA, 64 nt, Homo Sapiens
ccaggccucugcucugaagagcacaggaagguggaaacaaaauguuaauuacuggacucucuua

SEQ ID NO: 335870 - RNA, 64 nt, Homo Sapiens
gggacuuauuuugcauucucagugcuucugcaaaaaacaaaaaauuuuagacacgcuuucuugu

SEQ ID NO: 335871 - RNA, 64 nt, Homo Sapiens
uuuuuuagaagaugaauuugaauggguaaaaacaaaacaaaacuucuaauuuuuuuuccuguug

SEQ ID NO: 335872 - RNA, 64 nt, Homo Sapiens
aaacuuuuuuuagaagaugauguugaauggguaaaaacaaaacagugugucuaauuuuuuuucc

SEQ ID NO: 335873 - RNA, 64 nt, Homo Sapiens
agcaucuguuacuggaacaguaaaaaaaaaaacaaaacaaaaccgacagagcgagacccugucu

SEQ ID NO: 335874 - RNA, 64 nt, Homo Sapiens
aaaccagcaucuguuacuggugucuuaaaaaaaaaaacaaaacaugggugacagagcgagaccc

SEQ ID NO: 335875 - RNA, 64 nt, Homo Sapiens
cagucuggucggcaagagugagacuccgucucaaaaacaaaacaaaacaaaaaaaccacauaac

SEQ ID NO: 335876 - RNA, 64 nt, Homo Sapiens
uggucggcaagagugagacuccgucucaaaaacaaaacaaaacaaaaaaaccacauaacauaaa

SEQ ID NO: 335877 - RNA, 64 nt, Homo Sapiens
ggcaagagugagacuccgucucaaaaacaaaacaaaacaaaaaaaccacauaacauaaauuuau

SEQ ID NO: 335878 - RNA, 64 nt, Homo Sapiens
cuaugugaugccucuauuuuagacuguaaaacaaaaacaaaaaaaugacuuuccucagaacaug

SEQ ID NO: 335879 - RNA, 64 nt, Homo Sapiens
aaaaaacuaugugaugccucaacaugagacuguaaaacaaaaacugacuuaugacuuuccucag

SEQ ID NO: 335880 - RNA, 64 nt, Homo Sapiens
cuucugucaguuaacaaucucaaaaaauaaacaaaaacaaaaugggcagagcgagacccugucu

SEQ ID NO: 335881 - RNA, 64 nt, Homo Sapiens
aaaaugcuucugucaguuaacugucucaaaaaauaaacaaaaaccuggguggcagagcgagacc

SEQ ID NO: 335882 - RNA, 64 nt, Homo Sapiens
uaguuggagccacaaggcccuugucuuuuuaaaaaaacaaaauauuuugaagauggugaaagug

SEQ ID NO: 335883 - RNA, 64 nt, Homo Sapiens
guagaagggaaauuuuaaacauaacacucaacccaaacaaaacuacuucgugaggcuuucagca

SEQ ID NO: 335884 - RNA, 64 nt, Homo Sapiens
ucuucgugauaauauaaucucuauuuuuuuaggaaaacaaaaaugaaaaacuacuccauuugag

SEQ ID NO: 335885 - RNA, 64 nt, Homo Sapiens
agacaaacauuauaaaaaucugauggcaaaagcaaaacaaaauggaaaguaggggagguggaug

SEQ ID NO: 335886 - RNA, 64 nt, Homo Sapiens
aguguucugcauuccacauguaagugaauugcaaaaacaaaacaaaacucacucucuuguaggu

SEQ ID NO: 335887 - RNA, 64 nt, Homo Sapiens
ucugcauuccacauguaagugaauugcaaaaacaaaacaaaacucacucucuuguagguuuauu

SEQ ID NO: 335888 - RNA, 64 nt, Homo Sapiens
acaacuguucuuugccuaauaaaaaaaaacaaaaaaacaaaaaaccuuaaaggaaauguuaaaa

SEQ ID NO: 335889 - RNA, 64 nt, Homo Sapiens
acaaaaaaacaacuguucuuuguuaaaaaaaaaaaaacaaaaaagccaccuuccuuaaaggaaa

SEQ ID NO: 335890 - RNA, 64 nt, Homo Sapiens
acacacacacacaaaaaaagaacaaaaaaacaaaaaacaaaaaacaaaaacaaaaaacaaaaaa

SEQ ID NO: 335891 - RNA, 64 nt, Homo Sapiens
caaaaaaacacacacacacacaaaaaaaacaaaaaaacaaaaaaccaaaagcaaaaacaaaaaa

SEQ ID NO: 335892 - RNA, 64 nt, Homo Sapiens
acaaaaaacaaaaaaacacaacaaaaaacaaaaaaaacaaaaaagagaccuuccaaaagcaaaa

SEQ ID NO: 335893 - RNA, 64 nt, Homo Sapiens
aacaaaaaaacaaaaaacaaaaagcaaaaacaaaaaacaaaaaacuccgcugggagaccuucca

SEQ ID NO: 335894 - RNA, 64 nt, Homo Sapiens
caaaaaaaacaaaaaaacaaccuuccaaaagcaaaaacaaaaaaccagacccuccgcugggaga

SEQ ID NO: 335895 - RNA, 64 nt, Homo Sapiens
auugaucaaaucuguacaguuuaguuuaaaaacaaaacaaaaagcauugguguguuuagagauu

SEQ ID NO: 335896 - RNA, 64 nt, Homo Sapiens
aaaagauugaucaaaucuguagauuuuaguuuaaaaacaaaacaugggacauugguguguuuag

SEQ ID NO: 335897 - RNA, 64 nt, Homo Sapiens
aaucaaaaaaucaaaaaaauuuuaaaaaaacaaaaaacaaaaaacuguuucacaaacaguuuua

SEQ ID NO: 335898 - RNA, 64 nt, Homo Sapiens
caaaaaaaaucaaaaaaucaaguuuuauuuaaaaaaacaaaaaaaaaauagcuguuucacaaac

SEQ ID NO: 335899 - RNA, 64 nt, Homo Sapiens
uuucaaucuguccaucuaccaggccucgcgauaaaaacaaaacaaaaaaacgcugccagguuuu

SEQ ID NO: 335900 - RNA, 64 nt, Homo Sapiens
aucuguccaucuaccaggccucgcgauaaaaacaaaacaaaaaaacgcugccagguuuuagaag

SEQ ID NO: 335901 - RNA, 64 nt, Homo Sapiens
aucccaaugaaagaucaugcauuggggacagcagaaacaaaagcuuuuuuggaaaggcggggaa

SEQ ID NO: 335902 - RNA, 64 nt, Homo Sapiens
uuggaaaggcggggaagaaggaugaaaccuuuaaaaacaaaaacaaaaacaucaaugaguaggc

SEQ ID NO: 335903 - RNA, 64 nt, Homo Sapiens
aggcggggaagaaggaugaaaccuuuaaaaacaaaaacaaaaacaucaaugaguaggcauuuua

SEQ ID NO: 335904 - RNA, 64 nt, Homo Sapiens
auauauauaaauauaaauauauauaaaaacaacaaaacaaaacaaaaaaagaaaaaaaaacaaa

SEQ ID NO: 335905 - RNA, 64 nt, Homo Sapiens
uauaaauauaaauauauauaaaaacaacaaaacaaaacaaaaaaagaaaaaaaaacaaaaaaca

SEQ ID NO: 335906 - RNA, 64 nt, Homo Sapiens
acacaaugccaagauagaauuaauuuaaagccuuaaacaaaauuuaucuaaagaaauaacuucu

SEQ ID NO: 335907 - RNA, 64 nt, Homo Sapiens
uaucaucaucaucauccuaaaauuaacaacccagaaacaaaaaucucuauacagagaucaaauu

SEQ ID NO: 335908 - RNA, 64 nt, Homo Sapiens
ccugaugccaaagaauaugaaaauauuuaaguaaaaacaaaaugaugcauuuugagaagaacaa

SEQ ID NO: 335909 - RNA, 64 nt, Homo Sapiens
uuaaaaucuuaaauguguaagucacccccaccaaaaacaaaagagaagaaaaagaauagaaaga

SEQ ID NO: 335910 - RNA, 64 nt, Homo Sapiens
caaagcuauauaaagaaccaaagguuuagucaagaaacaaaaaucuuaaagauuauuauaaccc

SEQ ID NO: 335911 - RNA, 64 nt, Homo Sapiens
agauuagacuacacaaaagcuuccuuccaguauuaaacaaaaagaauuaaacauaacuaugaaa

SEQ ID NO: 335912 - RNA, 64 nt, Homo Sapiens
ugggcuuuguuagcacuuuuuaaaacaaacaaacaaacaaaacaaaaaagcaaaccacauuugu

SEQ ID NO: 335913 - RNA, 64 nt, Homo Sapiens
uuuguuagcacuuuuuaaaacaaacaaacaaacaaaacaaaaaagcaaaccacauuuguuaucu

SEQ ID NO: 335914 - RNA, 64 nt, Homo Sapiens
ccaaccugggugacagagugagauuccaucugaaaaacaaaaacaaaaacagaaaacaaacaaa

SEQ ID NO: 335915 - RNA, 64 nt, Homo Sapiens
ugggugacagagugagauuccaucugaaaaacaaaaacaaaaacagaaaacaaacaaacaaaaa

SEQ ID NO: 335916 - RNA, 64 nt, Homo Sapiens
aucugaaaaacaaaaacaaaaacagaaaacaaacaaacaaaaaacaaaaaauccccacaacuuu

SEQ ID NO: 335917 - RNA, 64 nt, Homo Sapiens
aaacaaaaacaaaaacagaaaacaaacaaacaaaaaacaaaaaauccccacaacuuugucaaau

SEQ ID NO: 335918 - RNA, 64 nt, Homo Sapiens
caaucaugacugagccaaucacuguuucucagaaaaacaaaacaaaacaaaacaaaugacagua

SEQ ID NO: 335919 - RNA, 64 nt, Homo Sapiens
augacugagccaaucacuguuucucagaaaaacaaaacaaaacaaaacaaaugacaguaacccu

SEQ ID NO: 335920 - RNA, 64 nt, Homo Sapiens
ugagccaaucacuguuucucagaaaaacaaaacaaaacaaaacaaaugacaguaacccuucccc

SEQ ID NO: 335921 - RNA, 64 nt, Homo Sapiens
gauuacagaaacacggaguuuccauuuggauuuuaaacaaaauuuaugucauuuucagauccuu

SEQ ID NO: 335922 - RNA, 64 nt, Homo Sapiens
aucagggcaagcucauagcacauguuuuacaaagaaacaaaauauaaaucacagauuuccaaaa

SEQ ID NO: 335923 - RNA, 64 nt, Homo Sapiens
uaaugucaaacuugagucacaaagaacauguagaaaacaaaauggauaaaaucugauauguauu

SEQ ID NO: 335924 - RNA, 64 nt, Homo Sapiens
cuagccugggugacagagcaagacucugucuaaaaaacaaaacaaaacaaaacaaaacaaaaaa

SEQ ID NO: 335925 - RNA, 64 nt, Homo Sapiens
cugggugacagagcaagacucugucuaaaaaacaaaacaaaacaaaacaaaacaaaaaaaccuc

SEQ ID NO: 335926 - RNA, 64 nt, Homo Sapiens
ugacagagcaagacucugucuaaaaaacaaaacaaaacaaaacaaaacaaaaaaaccucuuaau

SEQ ID NO: 335927 - RNA, 64 nt, Homo Sapiens
gagcaagacucugucuaaaaaacaaaacaaaacaaaacaaaacaaaaaaaccucuuaauauucu

SEQ ID NO: 335928 - RNA, 64 nt, Homo Sapiens
agacucugucuaaaaaacaaaacaaaacaaaacaaaacaaaaaaaccucuuaauauucuggagu

SEQ ID NO: 335929 - RNA, 64 nt, Homo Sapiens
cgauuauuucaugcuuuuuuuuaaaaaaaaaaaaaaacaaaauaacaaucugaagaggcauuug

SEQ ID NO: 335930 - RNA, 64 nt, Homo Sapiens
gaagcuuauuguaguauguuugcagaaaaauucuaaacaaaaauuauacagcuuauuagagugu

SEQ ID NO: 335931 - RNA, 64 nt, Homo Sapiens
auuuugcgaggcuuaggcagcuagacaucguuuaaaacaaaauauuaacuuauauuacaugugu

SEQ ID NO: 335932 - RNA, 64 nt, Homo Sapiens
accuguuccaccaaaaccuauggaaauuuaaaaaaaacaaaaauaaaaagcaaaacaaaaaucc

SEQ ID NO: 335933 - RNA, 64 nt, Homo Sapiens
uauggaaauuuaaaaaaaacaaaaauaaaaagcaaaacaaaaaucccaaaaugaauuccauuca

SEQ ID NO: 335934 - RNA, 64 nt, Homo Sapiens
auuuuuuaaauccccucuguuuaaaagguuuguaaaacaaaaacaaaaaacuaagucugcucag

SEQ ID NO: 335935 - RNA, 64 nt, Homo Sapiens
uaaauccccucuguuuaaaagguuuguaaaacaaaaacaaaaaacuaagucugcucagugaaau

SEQ ID NO: 335936 - RNA, 64 nt, Homo Sapiens
acaagucccguucuguagcugaaucaguagggagaaacaaaaauuagagacaugcacacacaaa

SEQ ID NO: 335937 - RNA, 64 nt, Homo Sapiens
cacaaacagacaaacaagaaauagcugugaguuuaaacaaaaacuguaaaaaagaaaaauguau

SEQ ID NO: 335938 - RNA, 64 nt, Homo Sapiens
ugcucaaaaaagaggagaaaauauauaaacaaacaaacaaaaauugguggauuagacagguuaa

SEQ ID NO: 335939 - RNA, 64 nt, Homo Sapiens
aacacacacacacacacauaauaaaaaccccuaaaaacaaaacauuuauaaaaaaaaguuguuu

SEQ ID NO: 335940 - RNA, 64 nt, Homo Sapiens
gugacacucacuuguguguacuaggucaaaaacaaaacaaaacaggaagcaauauuuaauaaaa

SEQ ID NO: 335941 - RNA, 64 nt, Homo Sapiens
aaacagugacacucacuuguuaaaacuaggucaaaaacaaaacacccaaggaagcaauauuuaa

SEQ ID NO: 335942 - RNA, 64 nt, Homo Sapiens
accuuaaaugucaaaaaaaauaaaaaaaaaacaaaaacaaaaaagguaaaacuccgacucuauu

SEQ ID NO: 335943 - RNA, 64 nt, Homo Sapiens
aaaaaaaccuuaaaugucaaucuauuuaaaaaaaaaacaaaaacaaaugugguaaaacuccgac

SEQ ID NO: 335944 - RNA, 64 nt, Homo Sapiens
ugcaucuaaccaaaaagucucaaaacaaacaaacaaacaaaacucaucucaaaacaaaacaaaa

SEQ ID NO: 335945 - RNA, 64 nt, Homo Sapiens
aacaaacaaacaaaacuugccucaaaacaaaacaaaacaaaacacgacaaaaacgaaacuccau

SEQ ID NO: 335946 - RNA, 64 nt, Homo Sapiens
aaacaaacaaacaaacaaaauccaucucaaaacaaaacaaaacacugggcgacaaaaacgaaac

SEQ ID NO: 335947 - RNA, 64 nt, Homo Sapiens
aaacaaaacaaacaaacaaagaaacuccaucucaaaacaaaacaccagccugggcgacaaaaac

SEQ ID NO: 335948 - RNA, 64 nt, Homo Sapiens
cuaucaacuacaaauuaguugggauuucaaacuuaaacaaaaaacuuuagaaugggugguaugg

SEQ ID NO: 335949 - RNA, 64 nt, Homo Sapiens
uggaaacuauucuaucauaaaucccaguucaaagaaacaaaaagaaacaaaacuuuggaccaaa

SEQ ID NO: 335950 - RNA, 54 nt, Homo Sapiens; identical to SEQ ID NO: 335091

SEQ ID NO: 335951 - RNA, 64 nt, Homo Sapiens
augugaauuguguuguuuucuguuuugucggggcaaacaaaauuaacaaaauuaacugcuuaaa

SEQ ID NO: 335952 - RNA, 64 nt, Homo Sapiens
aacugcuuaaauguuuugucaacaaaacaaaacaaaacaaaauuacaauuguucuucaaaaaca

SEQ ID NO: 335953 - RNA, 64 nt, Homo Sapiens
aaauuaacugcuuaaauguuaaacaaacaaaacaaaacaaaacaagaccacaauuguucuucaa

SEQ ID NO: 335954 - RNA, 64 nt, Homo Sapiens
aaacaaaauuaacugcuuaauucaaaaacaaacaaaacaaaacaguaaaagaccacaauuguuc

SEQ ID NO: 335955 - RNA, 64 nt, Homo Sapiens
aaacaaaacaaaauuaacuguguucuucaaaaacaaacaaaacaaaaauguaaaagaccacaau

SEQ ID NO: 335956 - RNA, 64 nt, Homo Sapiens
ucccuacaauuuucuucacuucaaaaaaggaaagaaacaaaacugucgacuggauucugucagu

SEQ ID NO: 335957 - RNA, 64 nt, Homo Sapiens
uggcaaauuucauuaacacaugguuguaaaagacaaacaaaacauaauuaaauugccaccuucg

SEQ ID NO: 335958 - RNA, 64 nt, Homo Sapiens
uguaaaaaauaaaaauguauauagcugugagcucaaacaaaaacugcagacaaacaaaaaagag

SEQ ID NO: 335959 - RNA, 64 nt, Homo Sapiens
uauauagcugugagcucaaacaaaaacugcagacaaacaaaaaagagaaaagcuuuuauuugug

SEQ ID NO: 335960 - RNA, 64 nt, Homo Sapiens
acacacacagacacacacaaagaaucagcagagaaaacaaaauacaaguccuguucuguaguuc

SEQ ID NO: 335961 - RNA, 64 nt, Homo Sapiens
ggguggcucacggguccggauccgucucaaaacaaaacaaaaguccuggaggccagagugagac

SEQ ID NO: 335962 - RNA, 64 nt, Homo Sapiens
aaaguggguggcucacgggugagacuccgucucaaaacaaaacauccagccuggaggccagagu

SEQ ID NO: 335963 - RNA, 64 nt, Homo Sapiens
uuaaauguguuagauaaauuaggaguugcuccuuuguuccaaaaaugcgacucucaaacuuuaa

SEQ ID NO: 335964 - RNA, 64 nt, Homo Sapiens
acuuuuggaauuauuccaggcucaggucacacuuuguuccaaaauugaaugugagcagguugac

SEQ ID NO: 335965 - RNA, 64 nt, Homo Sapiens
aaauggauggaugucuuuuuaagucacauaaaaguguuccaauaaacaaccuaacaccagauuc

SEQ ID NO: 335966 - RNA, 64 nt, Homo Sapiens
ugguagagugguagaaaacgcuuauuguaaugaauguuccaaaaccuaccaucuaccuauauac

SEQ ID NO: 335967 - RNA, 64 nt, Homo Sapiens
ggcaugcuaaaccucuagggucugaugcuguuuuuguuccaaauauaaacgaaaggcacuaguc

SEQ ID NO: 335968 - RNA, 64 nt, Homo Sapiens
cauugcuucagacagaaaaugaauuccgucgguauguuccaaucgugaugaauuugagaaacau

SEQ ID NO: 335969 - RNA, 64 nt, Homo Sapiens
cagaaaccgcaccccgagagaaaaucccauccucuguuccaaggccccugucugcucuaugcuc

SEQ ID NO: 335970 - RNA, 64 nt, Homo Sapiens
cugggaaugauuugagggcucuugaaagcccauguguuccaaagcgucuuuaacucugggauag

SEQ ID NO: 335971 - RNA, 64 nt, Homo Sapiens
ugaguaauugaaugagaugaaccagggcgaggguuguuccaaaauuuuccuugagcauuuauaa

SEQ ID NO: 335972 - RNA, 64 nt, Homo Sapiens
agcuaagggcuuuucauacagcuauucuccaauuuguuccaauaaccacuugacuuugcuaaug

SEQ ID NO: 335973 - RNA, 64 nt, Homo Sapiens
gauuccauccaccuuucccagcucugguuguuucuguuccaaaugaggggggaaauacaguucu

SEQ ID NO: 335974 - RNA, 64 nt, Homo Sapiens
ucaguuucauaaaaggagaaugguaacugcuuucuguuccaaauuuuacuuuuguuuauuuuua

SEQ ID NO: 335975 - RNA, 64 nt, Homo Sapiens
ccagacccugguugaauuguuucucucuccugcuuguuccaacccuuuucacucugggcuucuc

SEQ ID NO: 335976 - RNA, 64 nt, Homo Sapiens
uccuggcaugaccugcaacuccaggugguggauuuguuccaaagccucaaucccuacccccucc

SEQ ID NO: 335977 - RNA, 64 nt, Homo Sapiens
agaagcauucuggcaucccagguuaaucccucuuuguuccaagcaaguggugucugccuucaag

SEQ ID NO: 335978 - RNA, 64 nt, Homo Sapiens
caguuguuccagcuguucacuuccugggcugcaauguuccaaccccuugucuuuaaagaucacu

SEQ ID NO: 335979 - RNA, 64 nt, Homo Sapiens; identical to SEQ ID NO: 105042

SEQ ID NO: 335980 - RNA, 64 nt, Homo Sapiens; identical to SEQ ID NO: 105043

SEQ ID NO: 335981 - RNA, 64 nt, Homo Sapiens; identical to SEQ ID NO: 105044

SEQ ID NO: 335982 - RNA, 64 nt, Homo Sapiens; identical to SEQ ID NO: 105045

SEQ ID NO: 335983 - RNA, 64 nt, Homo Sapiens; identical to SEQ ID NO: 105046

SEQ ID NO: 335984 - RNA, 64 nt, Homo Sapiens; identical to SEQ ID NO: 105047

SEQ ID NO: 335985 - RNA, 64 nt, Homo Sapiens; identical to SEQ ID NO: 105048

SEQ ID NO: 335986 - RNA, 64 nt, Homo Sapiens; identical to SEQ ID NO: 105049

SEQ ID NO: 335987 - RNA, 64 nt, Homo Sapiens; identical to SEQ ID NO: 105050

SEQ ID NO: 335988 - RNA, 64 nt, Homo Sapiens; identical to SEQ ID NO: 105051

SEQ ID NO: 335989 - RNA, 64 nt, Homo Sapiens
uagucaauacuacuuuauguaaacagcaguguaaaauccaaaaacuuccaguccuggaggcagg

SEQ ID NO: 335990 - RNA, 64 nt, Homo Sapiens
cucacauuacagcugaugugaaagagauucuggaaauccaaauguuccccagaaauucugauau

SEQ ID NO: 335991 - RNA, 64 nt, Homo Sapiens
ucaaaaugcuccaauaagcauauccaaauccaaaaauccaaaaucauuauauuuagcgguugag

SEQ ID NO: 335992 - RNA, 64 nt, Homo Sapiens
uccaaaauucaaaaugcucccgguugaguauccaaauccaaaaaaauauuugcauuauauuuag

SEQ ID NO: 335993 - RNA, 64 nt, Homo Sapiens
uaauaaguauacucuguuauagucaacaaaguuaaauccaaauucaaaauuauccauuaaaguu

SEQ ID NO: 335994 - RNA, 64 nt, Homo Sapiens
uuuuucagguuagugauuuuuuuguauacaauuuaauccaaauguuaugacauucagaaaucau

SEQ ID NO: 335995 - RNA, 64 nt, Homo Sapiens
aaaacaaauccugcauuuagauacaccucaacuaaauccaaaguccccauucaguauauuccau

SEQ ID NO: 335996 - RNA, 64 nt, Homo Sapiens
augaguuccuagagaacuguccaaggguugggaaaauccaaauucucuuccugguuccagcacu

SEQ ID NO: 335997 - RNA, 62 nt, Homo Sapiens
auucaacuuuccaaauaaaaguucuacuucauguaauccaaaaauguuuguauucuguucua

SEQ ID NO: 335998 - RNA, 64 nt, Homo Sapiens
uaaacuacuggucuguuugacagacuuugguaacaauccaaagacccugagggucugagcagcu

SEQ ID NO: 335999 - RNA, 64 nt, Homo Sapiens
ucucuccucuagguaucguauuuuguugcucaagaauccaaaaugggucuguggacauagggca

SEQ ID NO: 336000 - RNA, 64 nt, Homo Sapiens
acaagucuuuaauuuaauuuuuguuuuuugccuaaauccaaagaaaaagggcugccgggccagg

SEQ ID NO: 336001 - RNA, 64 nt, Homo Sapiens
ccuuuaguuccuacuuuagccacugguuucucagaauccaaagaucacauauucuaguguaaca

SEQ ID NO: 336002 - RNA, 64 nt, Homo Sapiens
uaccauauuauuguuuuuaauuuaaguuccacaaaauccaaauucuguguuugacaugagauag

SEQ ID NO: 336003 - RNA, 64 nt, Homo Sapiens
ugcacuguguuugacaugagugucauaauccugaaauccaaaauuagccuguuucuaacacaac

SEQ ID NO: 336004 - RNA, 64 nt, Homo Sapiens
ccgagcugcuagcugacaaauacaauucugaaggaauccaaaugugacuuugaaaauuguuaga

SEQ ID NO: 336005 - RNA, 64 nt, Homo Sapiens
agcacgaauagauauugauguuauggagugcuguaauccaaaguuuuuaauugugaggcauguu

SEQ ID NO: 336006 - RNA, 64 nt, Homo Sapiens
cgguaucagugcaucuacagaaguguuauuugguaauccaaauauuagaguuuucccaaaucca

SEQ ID NO: 336007 - RNA, 64 nt, Homo Sapiens
guuauuugguaauccaaauauuagaguuuucccaaauccaaaaacggucagaaauaaguccauu

SEQ ID NO: 336008 - RNA, 64 nt, Homo Sapiens
uguaugguagaccaaaaagauaauuggcagcagaaauccaaauuuauaugacuugagucugcug

SEQ ID NO: 336009 - RNA, 64 nt, Homo Sapiens
uauuuuccauugccgugcucgccccccuauggagaauccaaaaggugugucugugguuuccaag

SEQ ID NO: 336010 - RNA, 64 nt, Homo Sapiens
uuuuucauagguaaugacagauuccuuuguuuugaauccaaaucaaaaaaauuguacaguguau

SEQ ID NO: 336011 - RNA, 64 nt, Homo Sapiens
cuauucuaaacaauuugcauuuugcucaaaaggaaauccaaaacauccuuuaaaggacuggggg

SEQ ID NO: 336012 - RNA, 64 nt, Homo Sapiens
gcauguagaguugacauguuaggacuagccugaaaauccaaaauauauacaauuucuugaacuc

SEQ ID NO: 336013 - RNA, 64 nt, Homo Sapiens
cucugagaugagggugcuuagucaugguuuauagaauccaaauuagcggagggaugcugagaca

SEQ ID NO: 336014 - RNA, 64 nt, Homo Sapiens
aaugucuugaauccuuugaaaucaguuuauggugaauccaaaucagggaauaucggauucaugc

SEQ ID NO: 336015 - RNA, 64 nt, Homo Sapiens
uuggacaguagauggacuucaaaauaaggacuucaauccaaagucucuaaguaaaggaaaaaac

SEQ ID NO: 336016 - RNA, 64 nt, Homo Sapiens
ugagaacuuuauuuuggaaaauuuauaagaaaguaauccaaauaagaaacacgauaguugaaaa

SEQ ID NO: 336017 - RNA, 64 nt, Homo Sapiens
uaguaaauaauuguuuugggcugauuuuucaguaaauccaaagugacuuagguuagaaguuaca

SEQ ID NO: 336018 - RNA, 64 nt, Homo Sapiens
cacucggcaggacauuucuuuccagcaaugcucaaauccaaaagcaacaagacacaagcaaaaa

SEQ ID NO: 336019 - RNA, 64 nt, Homo Sapiens
agagaagaguuuuugcauucaaaaagaaaaaaaaaauccaaaagaaaaaaaaaaaaaaaaaaga

SEQ ID NO: 336020 - RNA, 64 nt, Homo Sapiens
uuguuugucacugccaaaguacacaagaaaucaaaauccaaaauaaggaaauccaaaaaagcaa

SEQ ID NO: 336021 - RNA, 64 nt, Homo Sapiens
agcaaacacaagaaaucaaaucugcuccaaaggaaauccaaaaaccaaggauaccggacacacc

SEQ ID NO: 336022 - RNA, 64 nt, Homo Sapiens
guuuuuuuaaaaaagcaaaguggcuuuaaguaaaaauccaaaaauccuguaauguuaaacucuu

SEQ ID NO: 336023 - RNA, 64 nt, Homo Sapiens
aagcuggcaggggucaaacaagaagugauaaaggaauccaaaguugaagagcccaggaaacggg

SEQ ID NO: 336024 - RNA, 64 nt, Homo Sapiens
ggagaagagguucagcucuauuucaucauucccaaauccaaagagagucauuuugucuucagca

SEQ ID NO: 336025 - RNA, 64 nt, Homo Sapiens
agcaugaaguuggggcacugguggugagaggcggaauccaaaaaaauucagaaaugacuuggcc

SEQ ID NO: 336026 - RNA, 64 nt, Homo Sapiens
aaaauugauaaauaucugucaccaaaccacaagaaauccaaaaucauuuuagguuuaccaaaca

SEQ ID NO: 336027 - RNA, 64 nt, Homo Sapiens
aaccaaauucaggguugaauuuuuugcgucacuuaauccaaaucaauucaaugguucuauugac

SEQ ID NO: 336028 - RNA, 64 nt, Homo Sapiens
uauuucacagcacuaaugcuacuuuggggaugauaauccaaaaguuucucaugaucucaccuau

SEQ ID NO: 336029 - RNA, 64 nt, Homo Sapiens
ccagagagcaagccaagauuaggugaggguugucuaauccuauggcacaggacgugcuuuacau

SEQ ID NO: 336030 - RNA, 64 nt, Homo Sapiens
uuuggauggaucaaaccuccuuaauuuuaauuucuaauccuaaaguaaagagaugcaauugggg

SEQ ID NO: 336031 - RNA, 64 nt, Homo Sapiens
ugccaaaauggcuuagacacaugcauauauuuacuaauccuaucaugugcguguguguauacac

SEQ ID NO: 336032 - RNA, 64 nt, Homo Sapiens
acauuuuuuucugucccuucacaaaacauuuucuuaauccuaguacucacaucccacucaagac

SEQ ID NO: 336033 - RNA, 64 nt, Homo Sapiens
aacucggggcugaggugggaguggcucaugccuguaauccuagcguugacaguugcugggugua

SEQ ID NO: 336034 - RNA, 64 nt, Homo Sapiens
acuuugggaggccgaggcagguggcucacgccuguaauccuagcaaaaaugcaggcugggcgcg

SEQ ID NO: 336035 - RNA, 64 nt, Homo Sapiens
uacuugggaggcugaggcagguggugggugccuguaauccuagcccaaaaguuaaccgggcgug

SEQ ID NO: 336036 - RNA, 64 nt, Homo Sapiens
accuugggaggccgaggcggguggcucacgccuguaauccuagcaaacggugcggcugggagcg

SEQ ID NO: 336037 - RNA, 64 nt, Homo Sapiens
cagauaagaaggcacugggccaggcucacaccuguaauccuaaguaacacuuugggaggcuggg

SEQ ID NO: 336038 - RNA, 64 nt, Homo Sapiens
aagacagugaagcugguuguagggcucacuuuuauaauccuaggauuuggggaagcugaagcag

SEQ ID NO: 336039 - RNA, 62 nt, Homo Sapiens
augccauuaauaaaacccaagaucuuuuaaaucaaaaccauucagcaaaugcuguaagaccu

SEQ ID NO: 336040 - RNA, 62 nt, Homo Sapiens
auguaaaucuucauagugucagacauacugaccaaaaccacaaucuagacuacaaaguauau

SEQ ID NO: 336041 - RNA, 62 nt, Homo Sapiens
uuccuuggaaccacauuauuuauuuaccuuaucaaaaccacgugggaaacagaagccuaagu

SEQ ID NO: 336042 - RNA, 62 nt, Homo Sapiens
uacuuaaucuuuuacaucauguaaauauguuacaaaaccaagauauuuugugacuuuaauug

SEQ ID NO: 336043 - RNA, 62 nt, Homo Sapiens
cucuuauucucaguggaaaauuuaugugaggucaaaaccaaauuuuuucaagaacccuugga

SEQ ID NO: 336044 - RNA, 62 nt, Homo Sapiens
aaaagaauuguaauggcuacaaaauuuuugcucaaaaccagaagguguuuugccagagagau

SEQ ID NO: 336045 - RNA, 62 nt, Homo Sapiens
guuacaguacacuuguagccaaaacuggaagacaaaaccaauauauaauuuggcugcugauu

SEQ ID NO: 336046 - RNA, 62 nt, Homo Sapiens
ugcgcuaccuaacaguaccaucuuggauccuucaaaaccaaagacuugccccagcacugcug

SEQ ID NO: 336047 - RNA, 62 nt, Homo Sapiens
uguccccuuuugagcugccauuaucccaggggcaaaaccaccaguaaggcccagugauccca

SEQ ID NO: 336048 - RNA, 62 nt, Homo Sapiens
cuacauguuuuggacuaaaagaaaacacucaacaaaaccaauuugaaaacaaacaaaaagaa

SEQ ID NO: 336049 - RNA, 62 nt, Homo Sapiens
gacauccagacuuguauauuucaguggaaauacaaaaccacuucagagaccaggguaucucc

SEQ ID NO: 336050 - RNA, 62 nt, Homo Sapiens
aagcaaccuggagaacagcuaucaaucauauucaaaaccaguacaagaacugcugccuggua

SEQ ID NO: 336051 - RNA, 62 nt, Homo Sapiens
cugaccucaggugauccaccgccuaggccucccaaaaccauuagggcucagaggaagguauc

SEQ ID NO: 336052 - RNA, 61 nt, Homo Sapiens
gauagucuagcagguaauuaaacuuauauguccaaaaccauauucuucccugucucuucaa

SEQ ID NO: 336053 - RNA, 62 nt, Homo Sapiens
gcaaauuggagcauuucucagagccugccauucaaaaccaaacguucugggcggugguucuc

SEQ ID NO: 336054 - RNA, 62 nt, Homo Sapiens
uucugcauuuaaccaguccuaugcguuuaaaacaaaaccacuauguuuaacauagaaaauga

SEQ ID NO: 336055 - RNA, 62 nt, Homo Sapiens
aaaccaacaacaaaaaaaguagacaguuuuaacaaaaccaauuguuucagugaaaacuuugg

SEQ ID NO: 336056 - RNA, 62 nt, Homo Sapiens
uuccccauuuuaacgggcguauucagacccugcaaaaccacaaaaaaagaaaacagaaaaaa

SEQ ID NO: 336057 - RNA, 62 nt, Homo Sapiens
aaaaauuuaaguuuuuuuaauuauuauguaagcaaaaccaauuggcuauaguuacugauuuu

SEQ ID NO: 336058 - RNA, 62 nt, Homo Sapiens
auagaaaaaggugcuaucguucuuuacauacucaaaaccaagaguaagaaacaauuauaauu

SEQ ID NO: 336059 - RNA, 62 nt, Homo Sapiens
gggauacaaccguuuugcuccauacuaaaugacaaaaccauaaaaaccuuccaaugugggga

SEQ ID NO: 336060 - RNA, 62 nt, Homo Sapiens
ugccaauccgcuguaacaacucugcuuuaaaacaaaaccaaacaaaacuuuaaaaaaaaaug

SEQ ID NO: 336061 - RNA, 62 nt, Homo Sapiens
cuccugcagugccauucugccuucucaaugagcaaaaccauuuucuaaguaugaggauauua

SEQ ID NO: 336062 - RNA, 62 nt, Homo Sapiens
ucauguaauucaaucauguuuaauaugucagucaaaaccaaauucagaauuguuuuguguac

SEQ ID NO: 336063 - RNA, 62 nt, Homo Sapiens
uuaaguuuuaaguauauuaauuuucauuuguccaaaaccaccacugaggaaggaaauguuca

SEQ ID NO: 336064 - RNA, 62 nt, Homo Sapiens
acauccucuucuuucugccacuucucuucuaucaaaaccaacugaaaauaaucuauuuguag

SEQ ID NO: 336065 - RNA, 62 nt, Homo Sapiens
ccucacuucacagggucuguaaagguuaaucacaaaaccaacuuuuaaaaagaaaaacagaa

SEQ ID NO: 336066 - RNA, 62 nt, Homo Sapiens
cucucucugacgggguggcauuuggccuugaacaaaaccaaguccacuggggacagaggcag

SEQ ID NO: 336067 - RNA, 62 nt, Homo Sapiens
acagguggagcugacccucgucuuuguggcagcaaaaccaggaugccuggagcuguggccug

SEQ ID NO: 336068 - RNA, 62 nt, Homo Sapiens
ccugaucccuuaugaccaaccaagucugaguucaaaaccagcacuuuauuuucgucaaguuu

SEQ ID NO: 336069 - RNA, 62 nt, Homo Sapiens
auuauaggauuuuuuucuuuaaaaaccgguaucaaaaccaaaaggauuuuuucuuuuuuagu

SEQ ID NO: 336070 - RNA, 62 nt, Homo Sapiens
uuuucaacaucuaaaauuuuuguuuuagccuucaaaaccaacuuaccaaccucaguccagcu

SEQ ID NO: 336071 - RNA, 62 nt, Homo Sapiens
aggaaaucaggcauuccuauuucuuuaaauaacaaaaccacuaauugccacucaaugcugga

SEQ ID NO: 336072 - RNA, 64 nt, Homo Sapiens; identical to SEQ ID NO: 68758

SEQ ID NO: 336073 - RNA, 64 nt, Homo Sapiens; identical to SEQ ID NO: 68759

SEQ ID NO: 336074 - RNA, 64 nt, Homo Sapiens; identical to SEQ ID NO: 68760

SEQ ID NO: 336075 - RNA, 64 nt, Homo Sapiens; identical to SEQ ID NO: 68761

SEQ ID NO: 336076 - RNA, 64 nt, Homo Sapiens; identical to SEQ ID NO: 68762

SEQ ID NO: 336077 - RNA, 64 nt, Homo Sapiens; identical to SEQ ID NO: 68763

SEQ ID NO: 336078 - RNA, 64 nt, Homo Sapiens; identical to SEQ ID NO: 68764

SEQ ID NO: 336079 - RNA, 64 nt, Homo Sapiens; identical to SEQ ID NO: 68765

SEQ ID NO: 336080 - RNA, 64 nt, Homo Sapiens; identical to SEQ ID NO: 68766

SEQ ID NO: 336081 - RNA, 64 nt, Homo Sapiens; identical to SEQ ID NO: 68767

SEQ ID NO: 336082 - RNA, 64 nt, Homo Sapiens; identical to SEQ ID NO: 225698

SEQ ID NO: 336083 - RNA, 64 nt, Homo Sapiens; identical to SEQ ID NO: 225699

SEQ ID NO: 336084 - RNA, 64 nt, Homo Sapiens; identical to SEQ ID NO: 225700

SEQ ID NO: 336085 - RNA, 64 nt, Homo Sapiens; identical to SEQ ID NO: 225701

SEQ ID NO: 336086 - RNA, 64 nt, Homo Sapiens; identical to SEQ ID NO: 225702

SEQ ID NO: 336087 - RNA, 64 nt, Homo Sapiens; identical to SEQ ID NO: 225703

SEQ ID NO: 336088 - RNA, 64 nt, Homo Sapiens; identical to SEQ ID NO: 225704

SEQ ID NO: 336089 - RNA, 64 nt, Homo Sapiens; identical to SEQ ID NO: 225705

SEQ ID NO: 336090 - RNA, 64 nt, Homo Sapiens; identical to SEQ ID NO: 225706

SEQ ID NO: 336091 - RNA, 64 nt, Homo Sapiens; identical to SEQ ID NO: 225707

SEQ ID NO: 336092 - RNA, 64 nt, Homo Sapiens; identical to SEQ ID NO: 225708

SEQ ID NO: 336093 - RNA, 64 nt, Homo Sapiens; identical to SEQ ID NO: 225709

SEQ ID NO: 336094 - RNA, 64 nt, Homo Sapiens; identical to SEQ ID NO: 225710

SEQ ID NO: 336095 - RNA, 64 nt, Homo Sapiens; identical to SEQ ID NO: 225711

SEQ ID NO: 336096 - RNA, 64 nt, Homo Sapiens; identical to SEQ ID NO: 225712

SEQ ID NO: 336097 - RNA, 64 nt, Homo Sapiens; identical to SEQ ID NO: 225713

SEQ ID NO: 336098 - RNA, 64 nt, Homo Sapiens; identical to SEQ ID NO: 225714

SEQ ID NO: 336099 - RNA, 64 nt, Homo Sapiens; identical to SEQ ID NO: 225715

SEQ ID NO: 336100 - RNA, 64 nt, Homo Sapiens; identical to SEQ ID NO: 225716

SEQ ID NO: 336101 - RNA, 64 nt, Homo Sapiens; identical to SEQ ID NO: 225717

SEQ ID NO: 336102 - RNA, 64 nt, Homo Sapiens; identical to SEQ ID NO: 225718

SEQ ID NO: 336103 - RNA, 64 nt, Homo Sapiens; identical to SEQ ID NO: 225719

SEQ ID NO: 336104 - RNA, 64 nt, Homo Sapiens; identical to SEQ ID NO: 225720

SEQ ID NO: 336105 - RNA, 64 nt, Homo Sapiens; identical to SEQ ID NO: 225721

SEQ ID NO: 336106 - RNA, 64 nt, Homo Sapiens; identical to SEQ ID NO: 225722

SEQ ID NO: 336107 - RNA, 64 nt, Homo Sapiens; identical to SEQ ID NO: 225723

SEQ ID NO: 336108 - RNA, 64 nt, Homo Sapiens; identical to SEQ ID NO: 225724

SEQ ID NO: 336109 - RNA, 64 nt, Homo Sapiens; identical to SEQ ID NO: 225725

SEQ ID NO: 336110 - RNA, 64 nt, Homo Sapiens; identical to SEQ ID NO: 225726

SEQ ID NO: 336111 - RNA, 64 nt, Homo Sapiens; identical to SEQ ID NO: 225727

SEQ ID NO: 336112 - RNA, 64 nt, Homo Sapiens; identical to SEQ ID NO: 225728

SEQ ID NO: 336113 - RNA, 64 nt, Homo Sapiens; identical to SEQ ID NO: 225729

SEQ ID NO: 336114 - RNA, 64 nt, Homo Sapiens; identical to SEQ ID NO: 225730

SEQ ID NO: 336115 - RNA, 64 nt, Homo Sapiens; identical to SEQ ID NO: 225731

SEQ ID NO: 336116 - RNA, 64 nt, Homo Sapiens; identical to SEQ ID NO: 225732

SEQ ID NO: 336117 - RNA, 64 nt, Homo Sapiens; identical to SEQ ID NO: 225733

SEQ ID NO: 336118 - RNA, 64 nt, Homo Sapiens; identical to SEQ ID NO: 225734

SEQ ID NO: 336119 - RNA, 64 nt, Homo Sapiens; identical to SEQ ID NO: 225735

SEQ ID NO: 336120 - RNA, 64 nt, Homo Sapiens; identical to SEQ ID NO: 225736

SEQ ID NO: 336121 - RNA, 64 nt, Homo Sapiens; identical to SEQ ID NO: 225737

SEQ ID NO: 336122 - RNA, 64 nt, Homo Sapiens; identical to SEQ ID NO: 225738

SEQ ID NO: 336123 - RNA, 64 nt, Homo Sapiens; identical to SEQ ID NO: 225739

SEQ ID NO: 336124 - RNA, 64 nt, Homo Sapiens; identical to SEQ ID NO: 225740

SEQ ID NO: 336125 - RNA, 64 nt, Homo Sapiens; identical to SEQ ID NO: 225741

SEQ ID NO: 336126 - RNA, 64 nt, Homo Sapiens; identical to SEQ ID NO: 225742

SEQ ID NO: 336127 - RNA, 64 nt, Homo Sapiens; identical to SEQ ID NO: 225743

SEQ ID NO: 336128 - RNA, 64 nt, Homo Sapiens; identical to SEQ ID NO: 225744

SEQ ID NO: 336129 - RNA, 64 nt, Homo Sapiens; identical to SEQ ID NO: 225745

SEQ ID NO: 336130 - RNA, 64 nt, Homo Sapiens; identical to SEQ ID NO: 225746

SEQ ID NO: 336131 - RNA, 64 nt, Homo Sapiens; identical to SEQ ID NO: 225747

SEQ ID NO: 336132 - RNA, 64 nt, Homo Sapiens; identical to SEQ ID NO: 190207

SEQ ID NO: 336133 - RNA, 64 nt, Homo Sapiens; identical to SEQ ID NO: 190208

SEQ ID NO: 336134 - RNA, 64 nt, Homo Sapiens; identical to SEQ ID NO: 190211

SEQ ID NO: 336135 - RNA, 64 nt, Homo Sapiens; identical to SEQ ID NO: 190212

SEQ ID NO: 336136 - RNA, 64 nt, Homo Sapiens; identical to SEQ ID NO: 190223

SEQ ID NO: 336137 - RNA, 64 nt, Homo Sapiens; identical to SEQ ID NO: 190224

SEQ ID NO: 336138 - RNA, 64 nt, Homo Sapiens; identical to SEQ ID NO: 190242

SEQ ID NO: 336139 - RNA, 64 nt, Homo Sapiens; identical to SEQ ID NO: 190243

SEQ ID NO: 336140 - RNA, 64 nt, Homo Sapiens; identical to SEQ ID NO: 190289

SEQ ID NO: 336141 - RNA, 64 nt, Homo Sapiens; identical to SEQ ID NO: 190290

SEQ ID NO: 336142 - RNA, 64 nt, Homo Sapiens; identical to SEQ ID NO: 190311

SEQ ID NO: 336143 - RNA, 64 nt, Homo Sapiens; identical to SEQ ID NO: 190312

SEQ ID NO: 336144 - RNA, 64 nt, Homo Sapiens; identical to SEQ ID NO: 190388

SEQ ID NO: 336145 - RNA, 64 nt, Homo Sapiens; identical to SEQ ID NO: 190389

SEQ ID NO: 336146 - RNA, 64 nt, Homo Sapiens
ggcagguuguuugauuuaauagguaucuuaaucaagaauuaagcuugcaacauuggcuuugcuc

SEQ ID NO: 336147 - RNA, 64 nt, Homo Sapiens
gaccuuuuccgggauuucuuguucuuaucaagcaagaauuaagcacaugcuaaacgucuuccau

SEQ ID NO: 336148 - RNA, 64 nt, Homo Sapiens
uucagccauguggaccauauuaauauugugucauagaauuaauuaaauaaggaugacuuuagaa

SEQ ID NO: 336149 - RNA, 64 nt, Homo Sapiens
ugucuagcuuggugguauuuuuguauaucucaacagaauuaaaaggcugcugugguaauucuau

SEQ ID NO: 336150 - RNA, 64 nt, Homo Sapiens
uucugaagcagaaguuaaaauggacagcauuucuagaauuaacauuuuaaaaucuagucuuagc

SEQ ID NO: 336151 - RNA, 64 nt, Homo Sapiens
uaagaccuuaaguaaaaggcacaauggguacuacagaauuaaaauguaggucuaacauaaugcc

SEQ ID NO: 336152 - RNA, 64 nt, Homo Sapiens
aaaacuuuuacuagggcugauaugauggcaucuuagaauuaaacuaaaaguuaagguuguucac

SEQ ID NO: 336153 - RNA, 64 nt, Homo Sapiens
auaugaacaucacaaaacaaaaacaguuggcauaagaauuaaacacaaugcugucuucaucaga

SEQ ID NO: 336154 - RNA, 64 nt, Homo Sapiens
aaacauugagcucaccuuuuauauauuaaccucuagaauuaaugggccuaugugguuuuuuuuc

SEQ ID NO: 336155 - RNA, 64 nt, Homo Sapiens
uguguuuuuuuauugcuagcuaucauuaccaguuagaauuaacauuaauuacaauuaacaauaa

SEQ ID NO: 336156 - RNA, 64 nt, Homo Sapiens
uucuugaacaaagguaucagauggauuucugauaagaauuaacauuuuuccagacuagugugcc

SEQ ID NO: 336157 - RNA, 64 nt, Homo Sapiens
auuuuaaaaauuuaaauuaaauuuuaaauuuuaaagaauuaaaauaaaacaggacaauuuaaaa

SEQ ID NO: 336158 - RNA, 64 nt, Homo Sapiens
uuuuuauguugaauaaauuuccugaaaagaaaucagaauuaacagaacuuuauucccuuauauu

SEQ ID NO: 336159 - RNA, 64 nt, Homo Sapiens
uccaauguuuaugagucuugacucuuauuccucaagaauuaauaucaccuagaaaaguagccuc

SEQ ID NO: 336160 - RNA, 64 nt, Homo Sapiens
uuaaauuuguccuccaacugacuaaauuuuugauagaauuaaauaaauuuaaauuuauccucca

SEQ ID NO: 336161 - RNA, 64 nt, Homo Sapiens
uuaaauuuauccuccaacuagauaaauuuuugauagaauuaaauuguuugcacaauuuaaauuu

SEQ ID NO: 336162 - RNA, 64 nt, Homo Sapiens
cucaacacuuucccuuuuuucccaaaaugaguagagaauuaaagccacccaaaacagcuucugc

SEQ ID NO: 336163 - RNA, 64 nt, Homo Sapiens
uuaaaugguaaauaaucuguuuaugugaagaaaaagaauuaagucuuucuuccaacucucuccu

SEQ ID NO: 336164 - RNA, 64 nt, Homo Sapiens
uucauaaagucucaucauucacaacaguaguggaagaauuaaaauuuaguaauuugcaaaagcc

SEQ ID NO: 336165 - RNA, 64 nt, Homo Sapiens
aaaugacauuucuggggaguuauauaacacacagagaauuaagagagugaauaggagaaaacaa

SEQ ID NO: 336166 - RNA, 64 nt, Homo Sapiens
uaguuacagugcuuggaaugagaaggggaaggaaagaauuaacaaaugccaagauuucuggagc

SEQ ID NO: 336167 - RNA, 64 nt, Homo Sapiens
aauguuuaauaaaugcuuauaugaauggauuuuuagaauuaacuaagaagccaaaaauggcaac

SEQ ID NO: 336168 - RNA, 64 nt, Homo Sapiens
ccauaucaucaaaagacugaaaaauuauaauuuuagaauuaaacugauggauuucauuauagaa

SEQ ID NO: 336169 - RNA, 64 nt, Homo Sapiens
gcuggcagcugcugauggugcuucgaucuccuugagaauuaagacagggcucuccuuccugucc

SEQ ID NO: 336170 - RNA, 64 nt, Homo Sapiens
acccuccguuucccacauccgaaccagugaccaaagaauuaauugaccaaggcuauucagcagu

SEQ ID NO: 336171 - RNA, 64 nt, Homo Sapiens
acaauagaagacauuuucacuggaauuacaaagcagaauuaaaauuauauuguagaaggaaaca

SEQ ID NO: 336172 - RNA, 64 nt, Homo Sapiens
uguuuguaauauauucaugaggcuggaaguaagaagaauuaaaaauuuguccuaauuacaauga

SEQ ID NO: 336173 - RNA, 64 nt, Homo Sapiens
gauagaagaaacuguuguuugagguaauaagaccagaauuaagucauaaugagaaagucagacu

SEQ ID NO: 336174 - RNA, 64 nt, Homo Sapiens
auuuucuaaauauuaauacucauccaagugaaugagaauuaaaaagcuguaauucugaaauaca

SEQ ID NO: 336175 - RNA, 64 nt, Homo Sapiens
gugucaucugagcaugcuacucagauaguguaugagaauuaaaucaucuggaguugaguuggug

SEQ ID NO: 336176 - RNA, 64 nt, Homo Sapiens
gucgcacauagacguuucaggcaggcgcaaaaucagaauuaaagaguuccagggaugaucauga

SEQ ID NO: 336177 - RNA, 64 nt, Homo Sapiens
gaugacugagaaucuauuugaguuuccagcuggcagaauuaauuguuauuauuuuccuaggcgc

SEQ ID NO: 336178 - RNA, 64 nt, Homo Sapiens
ggcuuuacaggguuguaucauugacuuaaaaugaagaauuaacuuguguuacaucuauaaagag

SEQ ID NO: 336179 - RNA, 64 nt, Homo Sapiens
agagaauaucucuuggugucauaucuaggggaagagaauuaacuagaauuaaauuuaauguuug

SEQ ID NO: 336180 - RNA, 64 nt, Homo Sapiens
ucuuggugucauaucuaggggaagagaauuaacuagaauuaaauuuaauguuugaaucuaaauc

SEQ ID NO: 336181 - RNA, 64 nt, Homo Sapiens
ucucucuuccagggaguaccuuuuuuucuaguugagaauuaauaaugguccaucucuuuugauc

SEQ ID NO: 336182 - RNA, 64 nt, Homo Sapiens
cuaggguagugacugagauguaaaaauagauuuuagaauuaaaacaaaauccaaguccucacac

SEQ ID NO: 336183 - RNA, 64 nt, Homo Sapiens
aaugaaugaauuuagaaccacacaaugccaagauagaauuaauuuaaagccuuaaacaaaauuu

SEQ ID NO: 336184 - RNA, 64 nt, Homo Sapiens
uauuugaagcaugaaaaaagaggguuggagguggagaauuaaccuccugccaugacucuggcuc

SEQ ID NO: 336185 - RNA, 64 nt, Homo Sapiens
ucucaucugaagaacaaauuagauuuagcuaauuagaauuaauccuggcuuucauugccauagu

SEQ ID NO: 336186 - RNA, 64 nt, Homo Sapiens
gguauuuuguauugucaaggcaugcauauucuaaagaauuaaaugcuaacuuaacagcacuggc

SEQ ID NO: 336187 - RNA, 64 nt, Homo Sapiens
uauuaguaauuuauuauuuugaguauaugguuuaagaauuaaauuaaagaauuaaagcuucuau

SEQ ID NO: 336188 - RNA, 64 nt, Homo Sapiens
cuucuaugaguauaugguuuauuggagcuuuuaaagaauuaaaguuacauuccccaagggucaa

SEQ ID NO: 336189 - RNA, 64 nt, Homo Sapiens
uuuggcuuuagaauacagauuggcaugaagccauagaauuaaaucuguacuuuuuuugaucagu

SEQ ID NO: 336190 - RNA, 64 nt, Homo Sapiens
ugcuuuuggacaauguugcaagaacucuauuuuugacaugcauuaaucuuuuauuuugcacuuu

SEQ ID NO: 336191 - RNA, 64 nt, Homo Sapiens
acagucaccugagccuuaaauguaaguauuacaugacaugcauucuguuucuuccagaguucug

SEQ ID NO: 336192 - RNA, 64 nt, Homo Sapiens
ggccucaccuguuuguuuaggccaagaugccauggacaugcagcguuagugaucccacuagcug

SEQ ID NO: 336193 - RNA, 64 nt, Homo Sapiens
agaggguuccugggggaaguauggugaauaaacugacaugcaugcuucagaaccugccuguguu

SEQ ID NO: 336194 - RNA, 64 nt, Homo Sapiens
caugccucagcugggacccaccguguagacacacgacaugcaagaguugcagcggcugcuccaa

SEQ ID NO: 336195 - RNA, 64 nt, Homo Sapiens
cacccucuucugugagcaggaaaagaacccuacugacaugcaugguuuaacuuccucaucagaa

SEQ ID NO: 336196 - RNA, 61 nt, Homo Sapiens
augucuuugugaaauacacuggugguguccuucuuacaaaacuuuugaaauaaaaaaaaaa

SEQ ID NO: 336197 - RNA, 61 nt, Homo Sapiens
ugauucagagaaggaccaaauuauaugaaugucuuacaauggaauuuacuuguuacugauu

SEQ ID NO: 336198 - RNA, 61 nt, Homo Sapiens
uaauuuacauauuuucuuucgaacucuuugcucuuacaaggugaaagcagagucuauaaau

SEQ ID NO: 336199 - RNA, 61 nt, Homo Sapiens
aauuccacuaggcaugggaagacagugcgcgucuuacaacuugcuuguugccuuugacagu

SEQ ID NO: 336200 - RNA, 61 nt, Homo Sapiens
ugaugucccaacagggaacauugcauccuauucuuacaaagaucuaggguucuaauugcuu

SEQ ID NO: 336201 - RNA, 61 nt, Homo Sapiens
ugugugacucuugaaccuggccgggaugcacucuuacaacacuuggcucgccucggccggc

SEQ ID NO: 336202 - RNA, 61 nt, Homo Sapiens
ucagcauaagaaaauucacaccagagccaaaucuuacaaauguagcaguugugaaagaguc

SEQ ID NO: 336203 - RNA, 61 nt, Homo Sapiens
ucgacuccugcaaaucuauaccagugagaaaucuuacaaauguauugaauguggcaaauuu

SEQ ID NO: 336204 - RNA, 61 nt, Homo Sapiens
uuuuuuuugacaauuuuggguucccaacuuaucuuacaagugaaaacuuaaauuguaaaac

SEQ ID NO: 336205 - RNA, 61 nt, Homo Sapiens
uuguaauuauuugcaauuaauuguucuuuuaucuuacaauuguuuaagccugugaucuuuc

SEQ ID NO: 336206 - RNA, 61 nt, Homo Sapiens
gucaucaguguggcaagguccuggacagaaaucuuacaaauuagacaucagagaaucuaua

SEQ ID NO: 336207 - RNA, 61 nt, Homo Sapiens
guaauaaauguggcaaauuuaugaagagagaucuuacaaguaaaucauuggagaauccaua

SEQ ID NO: 336208 - RNA, 61 nt, Homo Sapiens
gucaucagugugguaagguccuggacagaaaucuuacaaauuagacaucagagaauccaug

SEQ ID NO: 336209 - RNA, 61 nt, Homo Sapiens
guaauaaaugugacagauuuauaaugagagaucuuacaaguugcaaaucauuggagaaucc

SEQ ID NO: 336210 - RNA, 61 nt, Homo Sapiens
gugaagacugugacaaaguucugcagagaaaucuuacaaauaagucaucauagucuucaua

SEQ ID NO: 336211 - RNA, 61 nt, Homo Sapiens
gucaucaguguggaaggguccuggacagaaaucuuacaaauuagacaucagagaauccaug

SEQ ID NO: 336212 - RNA, 61 nt, Homo Sapiens
guaauaaauguggcaaauuucagugaagagaucuuacaagugcacaucauuggagaaucca

SEQ ID NO: 336213 - RNA, 61 nt, Homo Sapiens
gugaacaaugugacaaaguucugcauagaaaucuuacaaacaagucaucauagacuucaua

SEQ ID NO: 336214 - RNA, 60 nt, Homo Sapiens
aaucucaguuuuuguuucuuuaaagagaccaucuuacaauaguaacagaaaaugaugaaa

SEQ ID NO: 336215 - RNA, 61 nt, Homo Sapiens
uaaaaaaacagccagauuauaguuauaguuuucuuacaaguguaauuuuaucaagagcaaa

SEQ ID NO: 336216 - RNA, 61 nt, Homo Sapiens
aagaguugaaugagguaaaaaaagacacauuucuuacaaaagaagucuuauaaaaauuuaa

SEQ ID NO: 336217 - RNA, 61 nt, Homo Sapiens
aacguguugcucucuucacaucauaacaguaucuuacaaaagguaauuugccaggaauucu

SEQ ID NO: 336218 - RNA, 64 nt, Homo Sapiens
gaacuacauucuucagaauacagugaugaaaauucauuuugaaacucaaauauuuucauuuugg

SEQ ID NO: 336219 - RNA, 64 nt, Homo Sapiens
auguagaggaaauagaaauguauuuuuucaugaacauuuugauacaaauuucaucauuuaauga

SEQ ID NO: 336220 - RNA, 64 nt, Homo Sapiens
gagguaaaaacuauaguuuuauuacagcauaauucauuuugagcuccacuaugacauuucaaag

SEQ ID NO: 336221 - RNA, 64 nt, Homo Sapiens
uaauguauuauacguuugaagccuagugacuuuucauuuugacauucuugugauuucauaugcu

SEQ ID NO: 336222 - RNA, 64 nt, Homo Sapiens
augcucuauugggggaagacaaaugaagagaaugcauuuugagcauuucaaaucaguaguuugg

SEQ ID NO: 336223 - RNA, 64 nt, Homo Sapiens
gcccacaauguaaacaggguugguaguuguuacucauuuugaauauaccuuuuccuuauuguau

SEQ ID NO: 336224 - RNA, 64 nt, Homo Sapiens
cugucaugaguuagaccaguuuuucuuaaauauucauuuugagaauuuuuagaugccacuacuu

SEQ ID NO: 336225 - RNA, 64 nt, Homo Sapiens
ugucauuuccuaucucccauauuguacccagcgucauuuugacauguuuugcucaucuaacuuc

SEQ ID NO: 336226 - RNA, 64 nt, Homo Sapiens
ccauagcuuagggcagacagagcugaaucauuuacauuuugacuaauuagacaugaacucaguu

SEQ ID NO: 336227 - RNA, 64 nt, Homo Sapiens
agaaaacaaaguguuucacuacagcuuauuuauacauuuugagguccaaaaaucuaaggaguaa

SEQ ID NO: 336228 - RNA, 64 nt, Homo Sapiens
cugccagauuuucacauuuuuaaaauguucuagucauuuugagaaaucauauaucuuacacagu

SEQ ID NO: 336229 - RNA, 64 nt, Homo Sapiens
cugacuuuuuguaugaagcaugccucaguuuccucauuuugaucuagauauaaaauuaaaauug

SEQ ID NO: 336230 - RNA, 64 nt, Homo Sapiens
aggccagucacuguuggaagucauccaagaagcccauuuugaggccauuuugagccuuacucuu

SEQ ID NO: 336231 - RNA, 64 nt, Homo Sapiens
uguuggaagucauccaagaagcccauuuugaggccauuuugagccuuacucuuaaguucucuau

SEQ ID NO: 336232 - RNA, 64 nt, Homo Sapiens
gauauagccaauuaaguguguuauggaguacacccauuuugacacacuuguaauaagagaaucu

SEQ ID NO: 336233 - RNA, 64 nt, Homo Sapiens
gagaaucuuauaaucggaauggagugaaaugaaacauuuugaguacugauggcauguuaucaua

SEQ ID NO: 336234 - RNA, 64 nt, Homo Sapiens
ucagcaccagaaacaaaaauuaagauuaucaaagcauuuugaauagugcacugccauguguccu

SEQ ID NO: 336235 - RNA, 64 nt, Homo Sapiens
cuaaauagguuugcuuucuuuuaguuacagugcccauuuugaaauugccuauacagucuuagug

SEQ ID NO: 336236 - RNA, 64 nt, Homo Sapiens
auuuuuuaugggaagacuuuguguuaaaagugaacauuuugaagguuuuuaacuggugaaacua

SEQ ID NO: 336237 - RNA, 64 nt, Homo Sapiens
uucuuaugagccaaaaguuugucauuuaaaaguucauuuugagggaauaacauguaauauaauu

SEQ ID NO: 336238 - RNA, 64 nt, Homo Sapiens
auuuuucucgagugacuagaccaaauaucaagaucauuuugagacucugaaaugaaguaaaaga

SEQ ID NO: 336239 - RNA, 64 nt, Homo Sapiens
acauugucuuuuaugaauucugaucauauuuagucauuuugaccaaaugagggauuuggucaaa

SEQ ID NO: 336240 - RNA, 64 nt, Homo Sapiens
ccauuugauaauuuuacaguaaguaggucucauucauuuugacaguuaucaaagauguacuuuc

SEQ ID NO: 336241 - RNA, 64 nt, Homo Sapiens
gcagacuuaaaguagcuuuguacgccuuaauguucauuuugauuuauuuuaaaucuuuacauuc

SEQ ID NO: 336242 - RNA, 64 nt, Homo Sapiens
aaagaucucauaacuuuauacagcauguuguaagcauuuugauaacuaaaauccuguucuagug

SEQ ID NO: 336243 - RNA, 64 nt, Homo Sapiens
caauguugcacugaaaacccaagcuuauuuagcacauuuugacaaaguaagcagaguucuuugc

SEQ ID NO: 336244 - RNA, 64 nt, Homo Sapiens
guguaaccaguagucaccucuguuugaagaaccgcauuuugaggccucuauuucuuuaaucugu

SEQ ID NO: 336245 - RNA, 64 nt, Homo Sapiens
gugaucaucuuugcugaauguguugggaugcgggcauuuugaauagugacagauccuccauuuu

SEQ ID NO: 336246 - RNA, 64 nt, Homo Sapiens
uaaacuaaaaauuaggguugauuuuuuugcucuccauuuugacuugcaagaaauaauaccucaa

SEQ ID NO: 336247 - RNA, 64 nt, Homo Sapiens
ucuuuucuaaccuuaacccugccaaaccuugauccauuuugacauuuguuaugcacuauuuuua

SEQ ID NO: 336248 - RNA, 64 nt, Homo Sapiens
aucaggauuucaucugaguguucagaaaaaccuccauuuugauccugcuaaauuuaauaaaaac

SEQ ID NO: 336249 - RNA, 64 nt, Homo Sapiens
uuucuguaguucauccuuaacuaaaguuuccuaacauuuugaagauacugcgggcaccagaaug

SEQ ID NO: 336250 - RNA, 64 nt, Homo Sapiens
auuuuggaagacuuucaccuuguguauacugucacauuuugacugaaguguauauacuuuaaug

SEQ ID NO: 336251 - RNA, 64 nt, Homo Sapiens
ucuguaaauuguguuagucagaauucaguauuaucauuuugaagcuguuaugcugugaaauuug

SEQ ID NO: 336252 - RNA, 64 nt, Homo Sapiens
caaacaccagauuugaaaguuuuaaugaaaaucacauuuugauaguaggacuagcuuaccugau

SEQ ID NO: 336253 - RNA, 64 nt, Homo Sapiens
auaaucugcaucaguuagaaauguagaugcuaugcauuuugaaaauggugccuacucgaaagaa

SEQ ID NO: 336254 - RNA, 64 nt, Homo Sapiens
uaguaauacaugcuguaauauagaauuaguggaacauuuugauuaaucuuucccuagaagugac

SEQ ID NO: 336255 - RNA, 64 nt, Homo Sapiens
cacacuuagaacacucacugcacugguggcuguucauuuugaggaacuccaaagucaauucaag

SEQ ID NO: 336256 - RNA, 64 nt, Homo Sapiens
cugcuuaugcuaguucaguauuuggucuaggcuucauuuugauaugacugaauugcaaucuaua

SEQ ID NO: 336257 - RNA, 64 nt, Homo Sapiens
gcuuaauuggauucaaaaaccacagcuaaucaggcauuuugaaagaaguuauuuauaauuaauu

SEQ ID NO: 336258 - RNA, 64 nt, Homo Sapiens
ugcugggcaaacuacaugaaugauaguccauaaccauuuugaaaauacuuugacauuuuaaaca

SEQ ID NO: 336259 - RNA, 64 nt, Homo Sapiens
caaacauuuuuguggcagauugccagcaaaacaucauuuugagagcacuugcaguagugaucua

SEQ ID NO: 336260 - RNA, 64 nt, Homo Sapiens
cucuuguggguugauaauguuuaccuaaacaauacauuuugauuuuguuugcucuuuuuguuuu

SEQ ID NO: 336261 - RNA, 64 nt, Homo Sapiens
uguucagugucugucuuccagauacaugaguuugcauuuugacccaagauuuagguugaugaaa

SEQ ID NO: 336262 - RNA, 64 nt, Homo Sapiens
gggcuuauuucacacaaagagaaauacaugaacacauuuugauaaguauagaucaguugguaca

SEQ ID NO: 336263 - RNA, 64 nt, Homo Sapiens
uugaguuucaccuuucuccaguccagcagaauuacauuuugaugaccuccauuuugauacuugu

SEQ ID NO: 336264 - RNA, 64 nt, Homo Sapiens
cuccaguccagcagaauuacauuuugaugaccuccauuuugauacuuguagaccagaucuaauc

SEQ ID NO: 336265 - RNA, 64 nt, Homo Sapiens
auugguauguaacacaggauaaaguuauucuugucauuuugaacuguagaguccuauuucagug

SEQ ID NO: 336266 - RNA, 64 nt, Homo Sapiens
ggacgcauaaucauuaccuuaaagcaucaccacucauuuugaccauauagauuuuauuauguua

SEQ ID NO: 336267 - RNA, 64 nt, Homo Sapiens
ccaguugaaugcaaaacaaaaaaaauauggaaaacauuuugauaaaauuuuuuccuguuaaaac

SEQ ID NO: 336268 - RNA, 64 nt, Homo Sapiens
gaugcauuauuuauuuugcuuuagaucuugaauacauuuugagaauaacuaauguggauugaaa

SEQ ID NO: 336269 - RNA, 64 nt, Homo Sapiens
uuuaaauuauguauuuaaaguaaauaguaccaaacauuuugaaccaucuugaugagaaaacucu

SEQ ID NO: 336270 - RNA, 64 nt, Homo Sapiens
cagauaguagaguaagaacuucuugccguuagggcauuuugaaguccagauccaacacaagcag

SEQ ID NO: 336271 - RNA, 64 nt, Homo Sapiens
uuucagacucaaugcucugaccucuuuucucuagcauuuugacauggguaguuaaaaauuacuc

SEQ ID NO: 336272 - RNA, 64 nt, Homo Sapiens
gguuuaugugcaaagugaaaucauuuguuaucuacauuuugaagaguggguuccacuuuauuuu

SEQ ID NO: 336273 - RNA, 64 nt, Homo Sapiens
aagauccuacacuuuuaccuucuuuaaggguguacauuuugauguugaacaucaguuuucaugu

SEQ ID NO: 336274 - RNA, 64 nt, Homo Sapiens
agaggaaauauaaccggugugagaucuagcaaugcauuuugaaucuucacucccuaccaggcuc

SEQ ID NO: 336275 - RNA, 64 nt, Homo Sapiens
uuaccauaauuuacucacuuuuuucuguguuagacauuuugauuaucugcaguuuauuacuaca

SEQ ID NO: 336276 - RNA, 64 nt, Homo Sapiens
uacuacaagcaguggcagagugaauguccuuguacauuuugaguuacaugcuuaauuauguccu

SEQ ID NO: 336277 - RNA, 64 nt, Homo Sapiens
uucccucacucuacucuccucacuaucggaaauucauuuugauucagaauaaaaaccaaaugua

SEQ ID NO: 336278 - RNA, 64 nt, Homo Sapiens
aacuuuauuaauaaucauguauuuuuacugaucacauuuugaaaugccuaaaagacuuuauugu

SEQ ID NO: 336279 - RNA, 64 nt, Homo Sapiens
gacucuagacuauguuaacuaguuaaggauguuacauuuugaaaggauguauguuagauauauu

SEQ ID NO: 336280 - RNA, 64 nt, Homo Sapiens
uuaggucacuuagaaaaauaugucauguauuuuacauuuugagaaacaaaucaaucaugguuuc

SEQ ID NO: 336281 - RNA, 64 nt, Homo Sapiens
ugagauacaacuuuuuguguugcauaugucuguccauuuugauugcacuuauugauuaagaccu

SEQ ID NO: 336282 - RNA, 64 nt, Homo Sapiens
gagaguugucuguuauguucacagaaaugagauacauuuugaaggaccucacuuagcagggauu

SEQ ID NO: 336283 - RNA, 64 nt, Homo Sapiens
cauauagaacaacaaaugcuuggcugucacccaucauuuugaaggggauggcuucaugggagag

SEQ ID NO: 336284 - RNA, 64 nt, Homo Sapiens
auagaaccucuauuuuaaaaaaaaaagggggaggcauuuugaagauuuugcaagucaaguaacc

SEQ ID NO: 336285 - RNA, 64 nt, Homo Sapiens
ucauuuaccaucauguauccaguaguggauaauucauuuugauggcuucuauuuuuggccaaau

SEQ ID NO: 336286 - RNA, 64 nt, Homo Sapiens
uauccuuuaaaaggaauacguuuuaggaugucaucauuuugaugugaaucauguaaauguugau

SEQ ID NO: 336287 - RNA, 64 nt, Homo Sapiens
ugggccuagugaaaaugggggcaggugagaaguccauuuugagaaucagcauaguaaauuacau

SEQ ID NO: 336288 - RNA, 64 nt, Homo Sapiens
gcaggugauuacuuugaaaaagguugguccagaccauuuugaucaagaaccuguauauguguug

SEQ ID NO: 336289 - RNA, 64 nt, Homo Sapiens
uaauuguaaaaagaaugaaaagauccagcuuucacauuuugagacuaaauguagcauuucaauu

SEQ ID NO: 336290 - RNA, 64 nt, Homo Sapiens
uucuuagauucauaauuugagcauuuugucccuucauuuugacuucuguguacgcaaaguaauu

SEQ ID NO: 336291 - RNA, 64 nt, Homo Sapiens
gucuguccuugaaggacuaauuauuagaaucaaacauuuugaaaaaucuacucaaagcauggga

SEQ ID NO: 336292 - RNA, 64 nt, Homo Sapiens
cacaugaauuauuacagugucuuuugcuuuugcccauuuugaaucuucuugaggggaagcuagu

SEQ ID NO: 336293 - RNA, 64 nt, Homo Sapiens
uaacccaucauaauccaaacaaaugaugccucaacauuuugagcugcucugucggacaaauaaa

SEQ ID NO: 336294 - RNA, 64 nt, Homo Sapiens
uggaguagaccugaccuuguuauuuauuagauaacauuuugaauguauccauuggauuucuaaa

SEQ ID NO: 336295 - RNA, 64 nt, Homo Sapiens
aucgauauuugaaucacaauugauaugguacagucauuuugacaaacacaaggcaaaacaacuu

SEQ ID NO: 336296 - RNA, 64 nt, Homo Sapiens
gccauguauaucacaugaacgguuguaacgacagcauuuugaguacaucacaaaucacugaugu

SEQ ID NO: 336297 - RNA, 64 nt, Homo Sapiens
auaaacuauuugacuuuuuaaguuaaacacaauucauuuugauuguuauuccauauaaguauca

SEQ ID NO: 336298 - RNA, 64 nt, Homo Sapiens
uggaaaacugaaauuuggaaugaaaaguuugaugcauuuugagauuugugauacgugucaugug

SEQ ID NO: 336299 - RNA, 64 nt, Homo Sapiens
cuugagagcaucaaauuuuggcuguugguauuuccauuuugauauggacaucccuggaaaccuu

SEQ ID NO: 336300 - RNA, 64 nt, Homo Sapiens
cuggcuuguagguccuugcucggcagcccucucacauuuugagggcuaaccacaggaagacugu

SEQ ID NO: 336301 - RNA, 64 nt, Homo Sapiens
uucggguuuuuguguuaaguccuccacacaccuucauuuugaugggagacccagcagcaccuuu

SEQ ID NO: 336302 - RNA, 64 nt, Homo Sapiens
gaaaauuaaaccaaugaagacaacugcgacaaaacauuuugaagugaacugucuuggcugugag

SEQ ID NO: 336303 - RNA, 64 nt, Homo Sapiens
aaaguuacuuagcuaaaauuuuagcaauuuauugcauuuugaaauaaucauuaacaugcugcaa

SEQ ID NO: 336304 - RNA, 64 nt, Homo Sapiens
uuucagccuguuuuuuagcuuagugccauuaugucauuuugauuuguauucaaguacucuucaa

SEQ ID NO: 336305 - RNA, 64 nt, Homo Sapiens
agucacuuugcuaaauucuucaccugugguaacucauuuugauuguuauaacaucucagcaccg

SEQ ID NO: 336306 - RNA, 64 nt, Homo Sapiens
uaauagguccucuugucagauuugcaagaauacucauuuugacauuuuggggggugggggggua

SEQ ID NO: 336307 - RNA, 64 nt, Homo Sapiens
ucauauuauuuuuuguuuugcacacccccaccugcauuuugaagaagagcccaggugcacugcu

SEQ ID NO: 336308 - RNA, 64 nt, Homo Sapiens
cuuuaaacacacacacaaaaucguucuuuacuuucauuuugauucuuuuaaaucugucuaguug

SEQ ID NO: 336309 - RNA, 64 nt, Homo Sapiens
uucucagcuucucccauaaagagacccuaauaugcauuuugauuuguaauuggaaauguaacuu

SEQ ID NO: 336310 - RNA, 63 nt, Homo Sapiens
aauuuucugaguuugucuuaaaagaccagaaugacauuuugaucaugcuacauguccaaaaau

SEQ ID NO: 336311 - RNA, 64 nt, Homo Sapiens
cccugcucuguguagaauguaucaguuaccagcacauuuugaacuuccuugaguaagauagucc

SEQ ID NO: 336312 - RNA, 64 nt, Homo Sapiens
ugaacaauuugguugcauucaacauagaauuaaccauuuugaagaaucgacgugaaauucacgu

SEQ ID NO: 336313 - RNA, 64 nt, Homo Sapiens
gugauuucuggcaugagauccaaaguuucgacugcauuuugacuaaauaauuuugugcaugaaa

SEQ ID NO: 336314 - RNA, 64 nt, Homo Sapiens
aaccugacacaaucucucuuaucaugcaguuccagagacacaugcacauacagacucaacagca

SEQ ID NO: 336315 - RNA, 64 nt, Homo Sapiens
uccauacacaggugaaacaccacaaaucugaucagagacacauaagauagacuuuaggggcugg

SEQ ID NO: 336316 - RNA, 64 nt, Homo Sapiens
cauuuaaauauuuaacuuaucuguugccaucacagagacacagggauguggccuguugguccuu

SEQ ID NO: 336317 - RNA, 64 nt, Homo Sapiens
uagagaaggguuuuugggagcuagccuccuaguugagacacacccccaggcucaggguuaacag

SEQ ID NO: 336318 - RNA, 64 nt, Homo Sapiens
caggaguuauguuuaaguaagggcuacuguuuaugagacacauccauuaaagaagaguuucuag

SEQ ID NO: 336319 - RNA, 64 nt, Homo Sapiens
auagggauuuuuacuucauuaaucugcccaaggggagacacaaaaauggacuugagaucuuggc

SEQ ID NO: 336320 - RNA, 64 nt, Homo Sapiens
ccgacagauccacaaaggaacaauaaagcuauuugagacacaaaccucacgaguggaaaugugg

SEQ ID NO: 336321 - RNA, 64 nt, Homo Sapiens
aucaagcacgugagaguuuuuguuuaaaagauaagagacacagcauguauuaugcacuucauuu

SEQ ID NO: 336322 - RNA, 64 nt, Homo Sapiens
auuacauacacagacacacacccuccccgccacagagacacaccgacacacaaucacacgcagc

SEQ ID NO: 336323 - RNA, 64 nt, Homo Sapiens
auuacauacacagacacgcacccuccccgccacagagacacaccgacacaaaaucacacacaca

SEQ ID NO: 336324 - RNA, 64 nt, Homo Sapiens
cacacacacacacacacacaugccuuauaggcgugagacacacauauugcagaagacagugugu

SEQ ID NO: 336325 - RNA, 64 nt, Homo Sapiens
uuauaagaugccagaucauauugcccuucuuucugagacacagauauucaucugaugcuguaaa

SEQ ID NO: 336326 - RNA, 64 nt, Homo Sapiens
ucgggcuugagugagaagagcuugcacagccaacgagacacauugccuucuggagcugggagac

SEQ ID NO: 336327 - RNA, 64 nt, Homo Sapiens
cgaugugguaggugauaaagaggcaucuuuucuagagacacauuggaccagaugaggauccgaa

SEQ ID NO: 336328 - RNA, 64 nt, Homo Sapiens
cuuccagggagaccuccccgcccagcagcccccagagacacaacaaccuaccuuccagccuuaa

SEQ ID NO: 336329 - RNA, 64 nt, Homo Sapiens
agggaaagaaugguggggaccccuguacuugggggagacacaccugcaucuuccuccugccaca

SEQ ID NO: 336330 - RNA, 64 nt, Homo Sapiens
gggugcuguauucaggaaacccaucucacgugcagagacacacauaggcucaaaauaaaaggau

SEQ ID NO: 336331 - RNA, 64 nt, Homo Sapiens
gaaauaacuaaaaucagcagaacucaaggaaauagagacacaaaaaaaccuucaaaaaauuaau

SEQ ID NO: 336332 - RNA, 64 nt, Homo Sapiens
cacagagcaggaggacacguaagagacagaagaggagacacagagccaugacagguguccuucc

SEQ ID NO: 336333 - RNA, 64 nt, Homo Sapiens
cacaaagcaggaggccacaugagagacggaagaggagacacagagcccaauccagugucccuau

SEQ ID NO: 336334 - RNA, 64 nt, Homo Sapiens
gagauccagguaagaagauccaagacuggcaguccaaauugaaagcgaguggauaauuccaaca

SEQ ID NO: 336335 - RNA, 64 nt, Homo Sapiens
ugcuguuuuuuggugguucucuuaucuuuuggagcaaauugacagcaaaucaacacuuucugca

SEQ ID NO: 336336 - RNA, 64 nt, Homo Sapiens
cuguuuagggaaauccuuauucugguuagucucucaaauugaggaauuugcauagagaaggucc

SEQ ID NO: 336337 - RNA, 64 nt, Homo Sapiens
ggccaaaacauuugacuccaacccauacauuuagcaaauugaaugacuauucauuggagaguuu

SEQ ID NO: 336338 - RNA, 64 nt, Homo Sapiens
aucugaguguaguuaggacagauuuaugcugucacaaauugaaagcacauauuucauuuccucu

SEQ ID NO: 336339 - RNA, 64 nt, Homo Sapiens
auuacuuaguaauguccuuaaauuaaguuggaggcaaauugauauuggagauuguuacgcuuga

SEQ ID NO: 336340 - RNA, 64 nt, Homo Sapiens
uauuuaagaauugcuaagggaaacaggucuuacacaaauugacacuaacucaaaaaaaaucuua

SEQ ID NO: 336341 - RNA, 64 nt, Homo Sapiens
ggucaacauaugaugcugcuauaagucuggggcucaaauugauaucccaguagcaauaaacaua

SEQ ID NO: 336342 - RNA, 64 nt, Homo Sapiens
uguagauugauuuaaaaaaagaaacagagccuuucaaauugaagagagacaagguucugauugu

SEQ ID NO: 336343 - RNA, 64 nt, Homo Sapiens
agucaguaguguaagaauaauuaaaaaugugccccaaauugaucuguuaaagauagggagccuu

SEQ ID NO: 336344 - RNA, 64 nt, Homo Sapiens; identical to SEQ ID NO: 286623

SEQ ID NO: 336345 - RNA, 64 nt, Homo Sapiens; identical to SEQ ID NO: 286624

SEQ ID NO: 336346 - RNA, 64 nt, Homo Sapiens; identical to SEQ ID NO: 286625

SEQ ID NO: 336347 - RNA, 64 nt, Homo Sapiens; identical to SEQ ID NO: 286626

SEQ ID NO: 336348 - RNA, 64 nt, Homo Sapiens
gaagacuuuauuguuguuauaaauuuauuuuuaugaaacagagggggauagggggaggguugga

SEQ ID NO: 336349 - RNA, 64 nt, Homo Sapiens
gagcucuugggcccagccaggccuguacuuuggggaaacagaugcacucaauggccuagaagcu

SEQ ID NO: 336350 - RNA, 64 nt, Homo Sapiens
uaauauauauauagaaagauuaucuaagaagaaagaaacagagauaugacauauaugaaagguu

SEQ ID NO: 336351 - RNA, 64 nt, Homo Sapiens
acagaaggccaagagccagcaacuugaaaaaucugaaacagagaauaaaaacaagaaccacaaa

SEQ ID NO: 336352 - RNA, 64 nt, Homo Sapiens
cuuaauggaucagacuuugccagauuugguuagggaaacagaaauuuagaauggugcauuauuu

SEQ ID NO: 336353 - RNA, 64 nt, Homo Sapiens
ggagaguaaauagcccuucagcaugcucauucaugaaacagaagaggcuguacaagugaagaca

SEQ ID NO: 336354 - RNA, 64 nt, Homo Sapiens
uacuuuaauugaaauacucugaauuccccucauggaaacagagagcauugagagcacuuucuuu

SEQ ID NO: 336355 - RNA, 64 nt, Homo Sapiens
agcaaguggccgugcuaccuuuuuagagaauaaagaaacagacuuuugaguuuauaugcaaugc

SEQ ID NO: 336356 - RNA, 64 nt, Homo Sapiens
uucauggccaaaguagaccuguuaaauggaagaagaaacagaacaaguuuuaauuuggguauag

SEQ ID NO: 336357 - RNA, 64 nt, Homo Sapiens
uuauucacuguguuuuugauuaaugaaauacuuugaaacagaagauaugccacacuuugcaccu

SEQ ID NO: 336358 - RNA, 64 nt, Homo Sapiens
aggucucuuugcagauauaugaaaggcaggugaggaaacagaaacaccaaaaaaugguagacau

SEQ ID NO: 336359 - RNA, 64 nt, Homo Sapiens
gaagucauuugcugagucuggcaaaauagagguggaaacagaagauggagaugaaauaaacaag

SEQ ID NO: 336360 - RNA, 64 nt, Homo Sapiens
uuuccaauugcucuuuugucguaugacgaaacaagaaacagagagcaucacgucgccuuccuau

SEQ ID NO: 336361 - RNA, 64 nt, Homo Sapiens
caaaacugaggcaccugauggagguguggauggggaaacagaggaaucccucacucaaccugcu

SEQ ID NO: 336362 - RNA, 64 nt, Homo Sapiens
aacacacacacaaaagcaaaaaccaguccaaaaugaaacagaccacuggcuaugcauuaccuaa

SEQ ID NO: 336363 - RNA, 64 nt, Homo Sapiens
aaaagguaagguguuguguccaacugugcuccacgaaacagaagugcgcauggcuguucugcug

SEQ ID NO: 336364 - RNA, 64 nt, Homo Sapiens
cacugccauugccgagaguccuguuauugagguagaaacagaaaagaaagacguucuugauuuu

SEQ ID NO: 336365 - RNA, 64 nt, Homo Sapiens
uucugaugauuuggguucuuuuccauaguccaaagaaacagaucagcucuucagguaucauguu

SEQ ID NO: 336366 - RNA, 55 nt, Homo Sapiens; identical to SEQ ID NO: 248228

SEQ ID NO: 336367 - RNA, 61 nt, Homo Sapiens; identical to SEQ ID NO: 248229

SEQ ID NO: 336368 - RNA, 64 nt, Homo Sapiens
uccuaaggggauugacucucagaccccugccuuagaaacagaauuaugcaugugauggugccug

SEQ ID NO: 336369 - RNA, 64 nt, Homo Sapiens
uggaaaacugccugacuuaugucuuuuuaaacuggaaacagaaucaaaguagugccacugcagu

SEQ ID NO: 336370 - RNA, 64 nt, Homo Sapiens
gagcagaagcaaagagcagacacacauacagccugaaacagaccuggacagacagacacagccu

SEQ ID NO: 336371 - RNA, 64 nt, Homo Sapiens
gccugaaacagaccuggacagacagacacagccugaaacagacccggacagacagacacagccu

SEQ ID NO: 336372 - RNA, 64 nt, Homo Sapiens
gccugaaacagacccggacagacagacacagccugaaacagacccagacaaacagacagacaga

SEQ ID NO: 336373 - RNA, 64 nt, Homo Sapiens
cagacccagacaaacagacagacagacacagccugaaacagacccagacagacagacagacagc

SEQ ID NO: 336374 - RNA, 64 nt, Homo Sapiens
cugaaacagacccagacagacagacagacagccugaaacagacccagacacagccugaaacaga

SEQ ID NO: 336375 - RNA, 64 nt, Homo Sapiens
gacagacagccugaaacagacccagacacagccugaaacagauccggacagacagacagaaaca

SEQ ID NO: 336376 - RNA, 64 nt, Homo Sapiens
gaaacagauccggacagacagacagaaacagccugaaacagacccagacagacagacagacaca

SEQ ID NO: 336377 - RNA, 64 nt, Homo Sapiens
gaaacagacccagacagacagacagacacagccugaaacagacccggacagacagacagacaca

SEQ ID NO: 336378 - RNA, 64 nt, Homo Sapiens
gaaacagacccggacagacagacagacacagccugaaacagacccggacagacagacagacaca

SEQ ID NO: 336379 - RNA, 64 nt, Homo Sapiens; identical to SEQ ID NO: 336378

SEQ ID NO: 336380 - RNA, 64 nt, Homo Sapiens
gaaacagacccggacagacagacagacacagccugaaacagaccuagacagacagacacagauu

SEQ ID NO: 336381 - RNA, 64 nt, Homo Sapiens
gccugaaacagaccuagacagacagacacagauugaaacagacccagacaaacagacagacaca

SEQ ID NO: 336382 - RNA, 64 nt, Homo Sapiens
gaaacagacccagacaaacagacagacacagccugaaacagacccagacacagccugaaacaga

SEQ ID NO: 336383 - RNA, 64 nt, Homo Sapiens
cagacacagccugaaacagacccagacacagccugaaacagacccggacagacagacagacaca

SEQ ID NO: 336384 - RNA, 64 nt, Homo Sapiens
gaaacagacccggacagacagacagacacagccugaaacagacccagacagacagacagacaca

SEQ ID NO: 336385 - RNA, 64 nt, Homo Sapiens
gaaacagacccagacagacagacagacacagccugaaacagacccagacagacagaccgacgca

SEQ ID NO: 336386 - RNA, 64 nt, Homo Sapiens
aaaacagaccuggacagacaggcagacguagucugaaacagaccugaacagacagacagacgca

SEQ ID NO: 336387 - RNA, 64 nt, Homo Sapiens
cgccugcuuuagagacacaggaugauucagaccggaaacagaccucguggguguaagaggaagc

SEQ ID NO: 336388 - RNA, 64 nt, Homo Sapiens
gugaauacgggauugcacuuacucuuucaucacggaaacagaccccccgagagaagccccaacg

SEQ ID NO: 336389 - RNA, 64 nt, Homo Sapiens
cuucucucugccauggcccuguuggccauuaaaagaaacagagagcuuucagccaugggguuga

SEQ ID NO: 336390 - RNA, 64 nt, Homo Sapiens
caguaccuggacuccaugaaguagaguaugugaggaaacagauacucgacaucuugaauugcug

SEQ ID NO: 336391 - RNA, 64 nt, Homo Sapiens
uuauauuaauuuuauuaagcaaggguucgccagagaaacagaaccaauaggauauauaagccca

SEQ ID NO: 336392 - RNA, 64 nt, Homo Sapiens
agacaguauuauuacauucaguauuacaauggcagaaacagacagaaaggguggaguaauuugu

SEQ ID NO: 336393 - RNA, 64 nt, Homo Sapiens
uuaguauuuguaucuucaguucauuccacuuuaggaaacagagcugccaauugaaacagaagaa

SEQ ID NO: 336394 - RNA, 64 nt, Homo Sapiens
guucauuccacuuuaggaaacagagcugccaauugaaacagaagaagaaaaaaaaaaaaagcag

SEQ ID NO: 336395 - RNA, 64 nt, Homo Sapiens
gauuuuauuucaccuuuaguuuugggaaaagcgagaaacagaugaucuauaggaugugaguggg

SEQ ID NO: 336396 - RNA, 64 nt, Homo Sapiens
auaaaaaaaaagauguuaaaacagugaaauuacagaaacagaacauagccacccuguuucauca

SEQ ID NO: 336397 - RNA, 64 nt, Homo Sapiens; identical to SEQ ID NO: 169446

SEQ ID NO: 336398 - RNA, 64 nt, Homo Sapiens; identical to SEQ ID NO: 169447

SEQ ID NO: 336399 - RNA, 64 nt, Homo Sapiens; identical to SEQ ID NO: 169448

SEQ ID NO: 336400 - RNA, 64 nt, Homo Sapiens; identical to SEQ ID NO: 169449

SEQ ID NO: 336401 - RNA, 64 nt, Homo Sapiens; identical to SEQ ID NO: 169450

SEQ ID NO: 336402 - RNA, 64 nt, Homo Sapiens; identical to SEQ ID NO: 169451

SEQ ID NO: 336403 - RNA, 64 nt, Homo Sapiens; identical to SEQ ID NO: 169452

SEQ ID NO: 336404 - RNA, 64 nt, Homo Sapiens; identical to SEQ ID NO: 169453

SEQ ID NO: 336405 - RNA, 64 nt, Homo Sapiens; identical to SEQ ID NO: 169454

SEQ ID NO: 336406 - RNA, 64 nt, Homo Sapiens; identical to SEQ ID NO: 169455

SEQ ID NO: 336407 - RNA, 64 nt, Homo Sapiens; identical to SEQ ID NO: 38325

SEQ ID NO: 336408 - RNA, 64 nt, Homo Sapiens; identical to SEQ ID NO: 38326

SEQ ID NO: 336409 - RNA, 64 nt, Homo Sapiens; identical to SEQ ID NO: 38327

SEQ ID NO: 336410 - RNA, 64 nt, Homo Sapiens; identical to SEQ ID NO: 38328

SEQ ID NO: 336411 - RNA, 64 nt, Homo Sapiens; identical to SEQ ID NO: 38329

SEQ ID NO: 336412 - RNA, 64 nt, Homo Sapiens; identical to SEQ ID NO: 38330

SEQ ID NO: 336413 - RNA, 64 nt, Homo Sapiens; identical to SEQ ID NO: 38331

SEQ ID NO: 336414 - RNA, 64 nt, Homo Sapiens; identical to SEQ ID NO: 38332

SEQ ID NO: 336415 - RNA, 64 nt, Homo Sapiens; identical to SEQ ID NO: 38333

SEQ ID NO: 336416 - RNA, 64 nt, Homo Sapiens; identical to SEQ ID NO: 38334

SEQ ID NO: 336417 - RNA, 64 nt, Homo Sapiens; identical to SEQ ID NO: 38335

SEQ ID NO: 336418 - RNA, 64 nt, Homo Sapiens; identical to SEQ ID NO: 38336

SEQ ID NO: 336419 - RNA, 64 nt, Homo Sapiens; identical to SEQ ID NO: 38337

SEQ ID NO: 336420 - RNA, 64 nt, Homo Sapiens; identical to SEQ ID NO: 38338

SEQ ID NO: 336421 - RNA, 64 nt, Homo Sapiens; identical to SEQ ID NO: 38339

SEQ ID NO: 336422 - RNA, 64 nt, Homo Sapiens; identical to SEQ ID NO: 38340

SEQ ID NO: 336423 - RNA, 64 nt, Homo Sapiens; identical to SEQ ID NO: 38341

SEQ ID NO: 336424 - RNA, 64 nt, Homo Sapiens; identical to SEQ ID NO: 38342

SEQ ID NO: 336425 - RNA, 64 nt, Homo Sapiens; identical to SEQ ID NO: 38343

SEQ ID NO: 336426 - RNA, 64 nt, Homo Sapiens; identical to SEQ ID NO: 38344

SEQ ID NO: 336427 - RNA, 64 nt, Homo Sapiens; identical to SEQ ID NO: 38345

SEQ ID NO: 336428 - RNA, 64 nt, Homo Sapiens; identical to SEQ ID NO: 38346

SEQ ID NO: 336429 - RNA, 64 nt, Homo Sapiens; identical to SEQ ID NO: 38347

SEQ ID NO: 336430 - RNA, 64 nt, Homo Sapiens; identical to SEQ ID NO: 38348

SEQ ID NO: 336431 - RNA, 64 nt, Homo Sapiens; identical to SEQ ID NO: 38349

SEQ ID NO: 336432 - RNA, 64 nt, Homo Sapiens; identical to SEQ ID NO: 38350

SEQ ID NO: 336433 - RNA, 64 nt, Homo Sapiens; identical to SEQ ID NO: 38351

SEQ ID NO: 336434 - RNA, 64 nt, Homo Sapiens; identical to SEQ ID NO: 38352

SEQ ID NO: 336435 - RNA, 64 nt, Homo Sapiens; identical to SEQ ID NO: 38353

SEQ ID NO: 336436 - RNA, 64 nt, Homo Sapiens; identical to SEQ ID NO: 38354

SEQ ID NO: 336437 - RNA, 64 nt, Homo Sapiens; identical to SEQ ID NO: 38355

SEQ ID NO: 336438 - RNA, 64 nt, Homo Sapiens; identical to SEQ ID NO: 38356

SEQ ID NO: 336439 - RNA, 64 nt, Homo Sapiens; identical to SEQ ID NO: 38357

SEQ ID NO: 336440 - RNA, 64 nt, Homo Sapiens; identical to SEQ ID NO: 38358

SEQ ID NO: 336441 - RNA, 64 nt, Homo Sapiens; identical to SEQ ID NO: 38359

SEQ ID NO: 336442 - RNA, 64 nt, Homo Sapiens; identical to SEQ ID NO: 38360

SEQ ID NO: 336443 - RNA, 64 nt, Homo Sapiens; identical to SEQ ID NO: 38361

SEQ ID NO: 336444 - RNA, 64 nt, Homo Sapiens; identical to SEQ ID NO: 38362

SEQ ID NO: 336445 - RNA, 64 nt, Homo Sapiens; identical to SEQ ID NO: 38363

SEQ ID NO: 336446 - RNA, 64 nt, Homo Sapiens; identical to SEQ ID NO: 38364

SEQ ID NO: 336447 - RNA, 64 nt, Homo Sapiens; identical to SEQ ID NO: 38365

SEQ ID NO: 336448 - RNA, 64 nt, Homo Sapiens; identical to SEQ ID NO: 38366

SEQ ID NO: 336449 - RNA, 64 nt, Homo Sapiens; identical to SEQ ID NO: 38367

SEQ ID NO: 336450 - RNA, 64 nt, Homo Sapiens; identical to SEQ ID NO: 38368

SEQ ID NO: 336451 - RNA, 64 nt, Homo Sapiens; identical to SEQ ID NO: 38369

SEQ ID NO: 336452 - RNA, 64 nt, Homo Sapiens; identical to SEQ ID NO: 38370

SEQ ID NO: 336453 - RNA, 64 nt, Homo Sapiens; identical to SEQ ID NO: 38371

SEQ ID NO: 336454 - RNA, 64 nt, Homo Sapiens; identical to SEQ ID NO: 38372

SEQ ID NO: 336455 - RNA, 64 nt, Homo Sapiens; identical to SEQ ID NO: 38373

SEQ ID NO: 336456 - RNA, 64 nt, Homo Sapiens; identical to SEQ ID NO: 38374

SEQ ID NO: 336457 - RNA, 64 nt, Homo Sapiens; identical to SEQ ID NO: 38375

SEQ ID NO: 336458 - RNA, 64 nt, Homo Sapiens; identical to SEQ ID NO: 38376

SEQ ID NO: 336459 - RNA, 64 nt, Homo Sapiens; identical to SEQ ID NO: 38377

SEQ ID NO: 336460 - RNA, 64 nt, Homo Sapiens; identical to SEQ ID NO: 38378

SEQ ID NO: 336461 - RNA, 64 nt, Homo Sapiens; identical to SEQ ID NO: 38379

SEQ ID NO: 336462 - RNA, 64 nt, Homo Sapiens; identical to SEQ ID NO: 38380

SEQ ID NO: 336463 - RNA, 64 nt, Homo Sapiens; identical to SEQ ID NO: 38381

SEQ ID NO: 336464 - RNA, 64 nt, Homo Sapiens; identical to SEQ ID NO: 38382

SEQ ID NO: 336465 - RNA, 64 nt, Homo Sapiens; identical to SEQ ID NO: 38383

SEQ ID NO: 336466 - RNA, 64 nt, Homo Sapiens; identical to SEQ ID NO: 38384

SEQ ID NO: 336467 - RNA, 64 nt, Homo Sapiens; identical to SEQ ID NO: 153734

SEQ ID NO: 336468 - RNA, 64 nt, Homo Sapiens; identical to SEQ ID NO: 153735

SEQ ID NO: 336469 - RNA, 64 nt, Homo Sapiens; identical to SEQ ID NO: 153736

SEQ ID NO: 336470 - RNA, 64 nt, Homo Sapiens; identical to SEQ ID NO: 153737

SEQ ID NO: 336471 - RNA, 64 nt, Homo Sapiens; identical to SEQ ID NO: 153738

SEQ ID NO: 336472 - RNA, 64 nt, Homo Sapiens; identical to SEQ ID NO: 153739

SEQ ID NO: 336473 - RNA, 64 nt, Homo Sapiens; identical to SEQ ID NO: 153740

SEQ ID NO: 336474 - RNA, 64 nt, Homo Sapiens; identical to SEQ ID NO: 153741

SEQ ID NO: 336475 - RNA, 64 nt, Homo Sapiens; identical to SEQ ID NO: 153742

SEQ ID NO: 336476 - RNA, 64 nt, Homo Sapiens; identical to SEQ ID NO: 153743

SEQ ID NO: 336477 - RNA, 64 nt, Homo Sapiens; identical to SEQ ID NO: 153744

SEQ ID NO: 336478 - RNA, 64 nt, Homo Sapiens; identical to SEQ ID NO: 153745

SEQ ID NO: 336479 - RNA, 64 nt, Homo Sapiens; identical to SEQ ID NO: 153746

SEQ ID NO: 336480 - RNA, 64 nt, Homo Sapiens; identical to SEQ ID NO: 153747

SEQ ID NO: 336481 - RNA, 64 nt, Homo Sapiens; identical to SEQ ID NO: 153748

SEQ ID NO: 336482 - RNA, 64 nt, Homo Sapiens; identical to SEQ ID NO: 153749

SEQ ID NO: 336483 - RNA, 64 nt, Homo Sapiens; identical to SEQ ID NO: 153750

SEQ ID NO: 336484 - RNA, 64 nt, Homo Sapiens; identical to SEQ ID NO: 153751

SEQ ID NO: 336485 - RNA, 64 nt, Homo Sapiens; identical to SEQ ID NO: 153752

SEQ ID NO: 336486 - RNA, 64 nt, Homo Sapiens; identical to SEQ ID NO: 153753

SEQ ID NO: 336487 - RNA, 64 nt, Homo Sapiens; identical to SEQ ID NO: 153754

SEQ ID NO: 336488 - RNA, 64 nt, Homo Sapiens; identical to SEQ ID NO: 153755

SEQ ID NO: 336489 - RNA, 64 nt, Homo Sapiens; identical to SEQ ID NO: 153756

SEQ ID NO: 336490 - RNA, 64 nt, Homo Sapiens; identical to SEQ ID NO: 153757

SEQ ID NO: 336491 - RNA, 64 nt, Homo Sapiens; identical to SEQ ID NO: 153758

SEQ ID NO: 336492 - RNA, 64 nt, Homo Sapiens; identical to SEQ ID NO: 153759

SEQ ID NO: 336493 - RNA, 64 nt, Homo Sapiens; identical to SEQ ID NO: 153760

SEQ ID NO: 336494 - RNA, 64 nt, Homo Sapiens; identical to SEQ ID NO: 153761

SEQ ID NO: 336495 - RNA, 64 nt, Homo Sapiens; identical to SEQ ID NO: 153762

SEQ ID NO: 336496 - RNA, 64 nt, Homo Sapiens; identical to SEQ ID NO: 153763

SEQ ID NO: 336497 - RNA, 64 nt, Homo Sapiens; identical to SEQ ID NO: 153764

SEQ ID NO: 336498 - RNA, 64 nt, Homo Sapiens; identical to SEQ ID NO: 153765

SEQ ID NO: 336499 - RNA, 64 nt, Homo Sapiens; identical to SEQ ID NO: 153766

SEQ ID NO: 336500 - RNA, 64 nt, Homo Sapiens; identical to SEQ ID NO: 153767

SEQ ID NO: 336501 - RNA, 64 nt, Homo Sapiens; identical to SEQ ID NO: 153768

SEQ ID NO: 336502 - RNA, 64 nt, Homo Sapiens; identical to SEQ ID NO: 153769

SEQ ID NO: 336503 - RNA, 64 nt, Homo Sapiens; identical to SEQ ID NO: 153770

SEQ ID NO: 336504 - RNA, 64 nt, Homo Sapiens; identical to SEQ ID NO: 153771

SEQ ID NO: 336505 - RNA, 64 nt, Homo Sapiens; identical to SEQ ID NO: 153772

SEQ ID NO: 336506 - RNA, 64 nt, Homo Sapiens; identical to SEQ ID NO: 153773

SEQ ID NO: 336507 - RNA, 64 nt, Homo Sapiens; identical to SEQ ID NO: 153774

SEQ ID NO: 336508 - RNA, 64 nt, Homo Sapiens; identical to SEQ ID NO: 153775

SEQ ID NO: 336509 - RNA, 64 nt, Homo Sapiens; identical to SEQ ID NO: 153776

SEQ ID NO: 336510 - RNA, 64 nt, Homo Sapiens; identical to SEQ ID NO: 153777

SEQ ID NO: 336511 - RNA, 64 nt, Homo Sapiens; identical to SEQ ID NO: 153778

SEQ ID NO: 336512 - RNA, 64 nt, Homo Sapiens; identical to SEQ ID NO: 153779

SEQ ID NO: 336513 - RNA, 64 nt, Homo Sapiens; identical to SEQ ID NO: 153780

SEQ ID NO: 336514 - RNA, 64 nt, Homo Sapiens; identical to SEQ ID NO: 153781

SEQ ID NO: 336515 - RNA, 64 nt, Homo Sapiens; identical to SEQ ID NO: 153782

SEQ ID NO: 336516 - RNA, 64 nt, Homo Sapiens; identical to SEQ ID NO: 153783

SEQ ID NO: 336517 - RNA, 64 nt, Homo Sapiens; identical to SEQ ID NO: 153784

SEQ ID NO: 336518 - RNA, 64 nt, Homo Sapiens; identical to SEQ ID NO: 153785

SEQ ID NO: 336519 - RNA, 64 nt, Homo Sapiens; identical to SEQ ID NO: 153786

SEQ ID NO: 336520 - RNA, 64 nt, Homo Sapiens; identical to SEQ ID NO: 153787

SEQ ID NO: 336521 - RNA, 64 nt, Homo Sapiens; identical to SEQ ID NO: 153788

SEQ ID NO: 336522 - RNA, 64 nt, Homo Sapiens; identical to SEQ ID NO: 153789

SEQ ID NO: 336523 - RNA, 64 nt, Homo Sapiens; identical to SEQ ID NO: 153790

SEQ ID NO: 336524 - RNA, 64 nt, Homo Sapiens; identical to SEQ ID NO: 153791

SEQ ID NO: 336525 - RNA, 64 nt, Homo Sapiens; identical to SEQ ID NO: 153792

SEQ ID NO: 336526 - RNA, 64 nt, Homo Sapiens; identical to SEQ ID NO: 153793

SEQ ID NO: 336527 - RNA, 64 nt, Homo Sapiens; identical to SEQ ID NO: 153794

SEQ ID NO: 336528 - RNA, 64 nt, Homo Sapiens; identical to SEQ ID NO: 153795

SEQ ID NO: 336529 - RNA, 64 nt, Homo Sapiens; identical to SEQ ID NO: 153796

SEQ ID NO: 336530 - RNA, 64 nt, Homo Sapiens; identical to SEQ ID NO: 153797

SEQ ID NO: 336531 - RNA, 64 nt, Homo Sapiens; identical to SEQ ID NO: 153798

SEQ ID NO: 336532 - RNA, 64 nt, Homo Sapiens; identical to SEQ ID NO: 153799

SEQ ID NO: 336533 - RNA, 64 nt, Homo Sapiens; identical to SEQ ID NO: 153800

SEQ ID NO: 336534 - RNA, 64 nt, Homo Sapiens; identical to SEQ ID NO: 153801

SEQ ID NO: 336535 - RNA, 64 nt, Homo Sapiens; identical to SEQ ID NO: 153802

SEQ ID NO: 336536 - RNA, 64 nt, Homo Sapiens; identical to SEQ ID NO: 153803

SEQ ID NO: 336537 - RNA, 64 nt, Homo Sapiens; identical to SEQ ID NO: 153804

SEQ ID NO: 336538 - RNA, 64 nt, Homo Sapiens; identical to SEQ ID NO: 153805

SEQ ID NO: 336539 - RNA, 64 nt, Homo Sapiens; identical to SEQ ID NO: 153806

SEQ ID NO: 336540 - RNA, 64 nt, Homo Sapiens; identical to SEQ ID NO: 153807

SEQ ID NO: 336541 - RNA, 64 nt, Homo Sapiens; identical to SEQ ID NO: 153808

SEQ ID NO: 336542 - RNA, 64 nt, Homo Sapiens; identical to SEQ ID NO: 153809

SEQ ID NO: 336543 - RNA, 64 nt, Homo Sapiens; identical to SEQ ID NO: 153810

SEQ ID NO: 336544 - RNA, 64 nt, Homo Sapiens; identical to SEQ ID NO: 153811

SEQ ID NO: 336545 - RNA, 64 nt, Homo Sapiens; identical to SEQ ID NO: 153812

SEQ ID NO: 336546 - RNA, 64 nt, Homo Sapiens; identical to SEQ ID NO: 153813

SEQ ID NO: 336547 - RNA, 64 nt, Homo Sapiens; identical to SEQ ID NO: 153814

SEQ ID NO: 336548 - RNA, 64 nt, Homo Sapiens; identical to SEQ ID NO: 153815

SEQ ID NO: 336549 - RNA, 64 nt, Homo Sapiens; identical to SEQ ID NO: 153816

SEQ ID NO: 336550 - RNA, 64 nt, Homo Sapiens; identical to SEQ ID NO: 153817

SEQ ID NO: 336551 - RNA, 64 nt, Homo Sapiens; identical to SEQ ID NO: 153818

SEQ ID NO: 336552 - RNA, 64 nt, Homo Sapiens; identical to SEQ ID NO: 153819

SEQ ID NO: 336553 - RNA, 64 nt, Homo Sapiens; identical to SEQ ID NO: 153820

SEQ ID NO: 336554 - RNA, 64 nt, Homo Sapiens; identical to SEQ ID NO: 153821

SEQ ID NO: 336555 - RNA, 64 nt, Homo Sapiens; identical to SEQ ID NO: 153822

SEQ ID NO: 336556 - RNA, 64 nt, Homo Sapiens; identical to SEQ ID NO: 153823

SEQ ID NO: 336557 - RNA, 64 nt, Homo Sapiens; identical to SEQ ID NO: 153824

SEQ ID NO: 336558 - RNA, 64 nt, Homo Sapiens; identical to SEQ ID NO: 153825

SEQ ID NO: 336559 - RNA, 64 nt, Homo Sapiens; identical to SEQ ID NO: 153826

SEQ ID NO: 336560 - RNA, 64 nt, Homo Sapiens; identical to SEQ ID NO: 153827

SEQ ID NO: 336561 - RNA, 64 nt, Homo Sapiens; identical to SEQ ID NO: 153828

SEQ ID NO: 336562 - RNA, 64 nt, Homo Sapiens; identical to SEQ ID NO: 153829

SEQ ID NO: 336563 - RNA, 64 nt, Homo Sapiens; identical to SEQ ID NO: 153830

SEQ ID NO: 336564 - RNA, 64 nt, Homo Sapiens; identical to SEQ ID NO: 153831

SEQ ID NO: 336565 - RNA, 64 nt, Homo Sapiens; identical to SEQ ID NO: 153832

SEQ ID NO: 336566 - RNA, 64 nt, Homo Sapiens; identical to SEQ ID NO: 153833

SEQ ID NO: 336567 - RNA, 64 nt, Homo Sapiens; identical to SEQ ID NO: 153834

SEQ ID NO: 336568 - RNA, 64 nt, Homo Sapiens; identical to SEQ ID NO: 153835

SEQ ID NO: 336569 - RNA, 64 nt, Homo Sapiens; identical to SEQ ID NO: 153836

SEQ ID NO: 336570 - RNA, 64 nt, Homo Sapiens; identical to SEQ ID NO: 153837

SEQ ID NO: 336571 - RNA, 64 nt, Homo Sapiens; identical to SEQ ID NO: 153838

SEQ ID NO: 336572 - RNA, 64 nt, Homo Sapiens; identical to SEQ ID NO: 153839

SEQ ID NO: 336573 - RNA, 64 nt, Homo Sapiens; identical to SEQ ID NO: 153840

SEQ ID NO: 336574 - RNA, 64 nt, Homo Sapiens; identical to SEQ ID NO: 153841

SEQ ID NO: 336575 - RNA, 64 nt, Homo Sapiens; identical to SEQ ID NO: 153842

SEQ ID NO: 336576 - RNA, 64 nt, Homo Sapiens; identical to SEQ ID NO: 153843

SEQ ID NO: 336577 - RNA, 64 nt, Homo Sapiens; identical to SEQ ID NO: 153844

SEQ ID NO: 336578 - RNA, 64 nt, Homo Sapiens; identical to SEQ ID NO: 153845

SEQ ID NO: 336579 - RNA, 64 nt, Homo Sapiens; identical to SEQ ID NO: 153846

SEQ ID NO: 336580 - RNA, 64 nt, Homo Sapiens; identical to SEQ ID NO: 108382

SEQ ID NO: 336581 - RNA, 64 nt, Homo Sapiens; identical to SEQ ID NO: 108383

SEQ ID NO: 336582 - RNA, 64 nt, Homo Sapiens; identical to SEQ ID NO: 108384

SEQ ID NO: 336583 - RNA, 64 nt, Homo Sapiens; identical to SEQ ID NO: 108385

SEQ ID NO: 336584 - RNA, 64 nt, Homo Sapiens; identical to SEQ ID NO: 108386

SEQ ID NO: 336585 - RNA, 64 nt, Homo Sapiens; identical to SEQ ID NO: 108387

SEQ ID NO: 336586 - RNA, 64 nt, Homo Sapiens; identical to SEQ ID NO: 108388

SEQ ID NO: 336587 - RNA, 64 nt, Homo Sapiens; identical to SEQ ID NO: 108389

SEQ ID NO: 336588 - RNA, 64 nt, Homo Sapiens; identical to SEQ ID NO: 108390

SEQ ID NO: 336589 - RNA, 64 nt, Homo Sapiens; identical to SEQ ID NO: 108391

SEQ ID NO: 336590 - RNA, 64 nt, Homo Sapiens; identical to SEQ ID NO: 108392

SEQ ID NO: 336591 - RNA, 64 nt, Homo Sapiens; identical to SEQ ID NO: 108393

SEQ ID NO: 336592 - RNA, 64 nt, Homo Sapiens; identical to SEQ ID NO: 108394

SEQ ID NO: 336593 - RNA, 64 nt, Homo Sapiens; identical to SEQ ID NO: 108395

SEQ ID NO: 336594 - RNA, 63 nt, Homo Sapiens
uugagaaucgggaaaacuagaccccugccacuaacaggcuaggagacuuugggcaguaauggg

SEQ ID NO: 336595 - RNA, 63 nt, Homo Sapiens
ugaaugguuggccugcauauucuuuuuuaggccacaggcuacagcugagcaauggcuuagucu

SEQ ID NO: 336596 - RNA, 64 nt, Homo Sapiens; identical to SEQ ID NO: 239676

SEQ ID NO: 336597 - RNA, 64 nt, Homo Sapiens; identical to SEQ ID NO: 239677

SEQ ID NO: 336598 - RNA, 64 nt, Homo Sapiens; identical to SEQ ID NO: 239678

SEQ ID NO: 336599 - RNA, 64 nt, Homo Sapiens; identical to SEQ ID NO: 239679

SEQ ID NO: 336600 - RNA, 64 nt, Homo Sapiens; identical to SEQ ID NO: 239680

SEQ ID NO: 336601 - RNA, 64 nt, Homo Sapiens; identical to SEQ ID NO: 239681

SEQ ID NO: 336602 - RNA, 64 nt, Homo Sapiens; identical to SEQ ID NO: 239682

SEQ ID NO: 336603 - RNA, 64 nt, Homo Sapiens; identical to SEQ ID NO: 239683

SEQ ID NO: 336604 - RNA, 64 nt, Homo Sapiens; identical to SEQ ID NO: 239684

SEQ ID NO: 336605 - RNA, 64 nt, Homo Sapiens; identical to SEQ ID NO: 239685

SEQ ID NO: 336606 - RNA, 64 nt, Homo Sapiens; identical to SEQ ID NO: 239686

SEQ ID NO: 336607 - RNA, 64 nt, Homo Sapiens; identical to SEQ ID NO: 239687

SEQ ID NO: 336608 - RNA, 64 nt, Homo Sapiens; identical to SEQ ID NO: 239688

SEQ ID NO: 336609 - RNA, 64 nt, Homo Sapiens; identical to SEQ ID NO: 239689

SEQ ID NO: 336610 - RNA, 64 nt, Homo Sapiens; identical to SEQ ID NO: 239690

SEQ ID NO: 336611 - RNA, 64 nt, Homo Sapiens; identical to SEQ ID NO: 239691

SEQ ID NO: 336612 - RNA, 64 nt, Homo Sapiens; identical to SEQ ID NO: 239692

SEQ ID NO: 336613 - RNA, 64 nt, Homo Sapiens; identical to SEQ ID NO: 239693

SEQ ID NO: 336614 - RNA, 64 nt, Homo Sapiens; identical to SEQ ID NO: 239694

SEQ ID NO: 336615 - RNA, 64 nt, Homo Sapiens; identical to SEQ ID NO: 239695

SEQ ID NO: 336616 - RNA, 64 nt, Homo Sapiens; identical to SEQ ID NO: 239696

SEQ ID NO: 336617 - RNA, 64 nt, Homo Sapiens; identical to SEQ ID NO: 239697

SEQ ID NO: 336618 - RNA, 64 nt, Homo Sapiens; identical to SEQ ID NO: 239698

SEQ ID NO: 336619 - RNA, 64 nt, Homo Sapiens; identical to SEQ ID NO: 239699

SEQ ID NO: 336620 - RNA, 64 nt, Homo Sapiens; identical to SEQ ID NO: 239700

SEQ ID NO: 336621 - RNA, 64 nt, Homo Sapiens; identical to SEQ ID NO: 239701

SEQ ID NO: 336622 - RNA, 64 nt, Homo Sapiens; identical to SEQ ID NO: 239702

SEQ ID NO: 336623 - RNA, 64 nt, Homo Sapiens; identical to SEQ ID NO: 239703

SEQ ID NO: 336624 - RNA, 64 nt, Homo Sapiens; identical to SEQ ID NO: 239704

SEQ ID NO: 336625 - RNA, 64 nt, Homo Sapiens; identical to SEQ ID NO: 239705

SEQ ID NO: 336626 - RNA, 64 nt, Homo Sapiens; identical to SEQ ID NO: 239706

SEQ ID NO: 336627 - RNA, 64 nt, Homo Sapiens; identical to SEQ ID NO: 239707

SEQ ID NO: 336628 - RNA, 64 nt, Homo Sapiens; identical to SEQ ID NO: 239708

SEQ ID NO: 336629 - RNA, 64 nt, Homo Sapiens; identical to SEQ ID NO: 239709

SEQ ID NO: 336630 - RNA, 64 nt, Homo Sapiens; identical to SEQ ID NO: 239710

SEQ ID NO: 336631 - RNA, 64 nt, Homo Sapiens; identical to SEQ ID NO: 239711

SEQ ID NO: 336632 - RNA, 64 nt, Homo Sapiens; identical to SEQ ID NO: 239712

SEQ ID NO: 336633 - RNA, 64 nt, Homo Sapiens; identical to SEQ ID NO: 239713

SEQ ID NO: 336634 - RNA, 64 nt, Homo Sapiens; identical to SEQ ID NO: 239714

SEQ ID NO: 336635 - RNA, 64 nt, Homo Sapiens; identical to SEQ ID NO: 239715

SEQ ID NO: 336636 - RNA, 64 nt, Homo Sapiens; identical to SEQ ID NO: 239716

SEQ ID NO: 336637 - RNA, 64 nt, Homo Sapiens; identical to SEQ ID NO: 239717

SEQ ID NO: 336638 - RNA, 64 nt, Homo Sapiens; identical to SEQ ID NO: 239718

SEQ ID NO: 336639 - RNA, 64 nt, Homo Sapiens; identical to SEQ ID NO: 239719

SEQ ID NO: 336640 - RNA, 64 nt, Homo Sapiens; identical to SEQ ID NO: 239720

SEQ ID NO: 336641 - RNA, 64 nt, Homo Sapiens; identical to SEQ ID NO: 239721

SEQ ID NO: 336642 - RNA, 64 nt, Homo Sapiens; identical to SEQ ID NO: 239722

SEQ ID NO: 336643 - RNA, 64 nt, Homo Sapiens; identical to SEQ ID NO: 239723

SEQ ID NO: 336644 - RNA, 64 nt, Homo Sapiens; identical to SEQ ID NO: 239724

SEQ ID NO: 336645 - RNA, 64 nt, Homo Sapiens; identical to SEQ ID NO: 239725

SEQ ID NO: 336646 - RNA, 64 nt, Homo Sapiens; identical to SEQ ID NO: 239726

SEQ ID NO: 336647 - RNA, 64 nt, Homo Sapiens; identical to SEQ ID NO: 239727

SEQ ID NO: 336648 - RNA, 64 nt, Homo Sapiens; identical to SEQ ID NO: 239728

SEQ ID NO: 336649 - RNA, 64 nt, Homo Sapiens; identical to SEQ ID NO: 239729

SEQ ID NO: 336650 - RNA, 64 nt, Homo Sapiens; identical to SEQ ID NO: 239730

SEQ ID NO: 336651 - RNA, 64 nt, Homo Sapiens; identical to SEQ ID NO: 239731

SEQ ID NO: 336652 - RNA, 64 nt, Homo Sapiens; identical to SEQ ID NO: 239732

SEQ ID NO: 336653 - RNA, 64 nt, Homo Sapiens; identical to SEQ ID NO: 239733

SEQ ID NO: 336654 - RNA, 64 nt, Homo Sapiens; identical to SEQ ID NO: 239734

SEQ ID NO: 336655 - RNA, 64 nt, Homo Sapiens; identical to SEQ ID NO: 239735

SEQ ID NO: 336656 - RNA, 64 nt, Homo Sapiens; identical to SEQ ID NO: 239736

SEQ ID NO: 336657 - RNA, 64 nt, Homo Sapiens; identical to SEQ ID NO: 239737

SEQ ID NO: 336658 - RNA, 64 nt, Homo Sapiens; identical to SEQ ID NO: 239738

SEQ ID NO: 336659 - RNA, 64 nt, Homo Sapiens; identical to SEQ ID NO: 239739

SEQ ID NO: 336660 - RNA, 64 nt, Homo Sapiens; identical to SEQ ID NO: 239740

SEQ ID NO: 336661 - RNA, 64 nt, Homo Sapiens; identical to SEQ ID NO: 239741

SEQ ID NO: 336662 - RNA, 64 nt, Homo Sapiens; identical to SEQ ID NO: 239742

SEQ ID NO: 336663 - RNA, 64 nt, Homo Sapiens; identical to SEQ ID NO: 239743

SEQ ID NO: 336664 - RNA, 64 nt, Homo Sapiens; identical to SEQ ID NO: 239744

SEQ ID NO: 336665 - RNA, 64 nt, Homo Sapiens; identical to SEQ ID NO: 239745

SEQ ID NO: 336666 - RNA, 64 nt, Homo Sapiens; identical to SEQ ID NO: 239746

SEQ ID NO: 336667 - RNA, 62 nt, Homo Sapiens
ugacagaccaggucaucuggcuuccgagaucaucagagaagauaagucugucucuuucagcu

SEQ ID NO: 336668 - RNA, 62 nt, Homo Sapiens
uaaaaggcaggaaagagaauucuuaggcaaauucagagaaauaagugcuaguuaauacuaau

SEQ ID NO: 336669 - RNA, 62 nt, Homo Sapiens
ccauagcuaugauguaaagacaauacuguccuucagagaacugguauuaagauaaacuuaag

SEQ ID NO: 336670 - RNA, 62 nt, Homo Sapiens
aacaucccuaaaaacucagucucuucuaguucucagagaaggguuucaucuucuaagauauc

SEQ ID NO: 336671 - RNA, 62 nt, Homo Sapiens
agauucugggguuacuugacaacagcaaauccucagagaaaaaagcagugucuuugaucugc

SEQ ID NO: 336672 - RNA, 62 nt, Homo Sapiens
gggagguucacauguuugcacagcauccuugaucagagaaggagugaauaucaucaaaacca

SEQ ID NO: 336673 - RNA, 62 nt, Homo Sapiens
acucuaagauguugcuuugccuuguauuuauuucagagaagacugcuacaugucuaaguuua

SEQ ID NO: 336674 - RNA, 62 nt, Homo Sapiens
cugacaucuucaaccuagcaauucacugaauaucagagaauauuucucauaaaauucuguca

SEQ ID NO: 336675 - RNA, 62 nt, Homo Sapiens
gguucaaaugucuuacagaacuaagaucuuuuucagagaaauugcucacaaaaguuagugac

SEQ ID NO: 336676 - RNA, 62 nt, Homo Sapiens
cuuaaacuugugauaaggaagaugaagggucuucagagaagaaccucuuaaaaggcccacgg

SEQ ID NO: 336677 - RNA, 62 nt, Homo Sapiens
aagcauugauguuacaucagaauaaauagcacucagagaauguaagcaaugaagauugagac

SEQ ID NO: 336678 - RNA, 62 nt, Homo Sapiens
uaaagugaaugccuuuagggagcugguucucuucagagaauaaguggauguuccgccugguu

SEQ ID NO: 336679 - RNA, 62 nt, Homo Sapiens
acaacacaaaagugcagacugguauucacaucucagagaacuuuaaaaucccuuaggaauuu

SEQ ID NO: 336680 - RNA, 62 nt, Homo Sapiens
cccucaagcaaucaguagguuaugcauaaguaucagagaaguacaugcugaaaaagaguauc

SEQ ID NO: 336681 - RNA, 62 nt, Homo Sapiens
cauacuggugaaaaauuguacugacuuacccaucagagaagcaaaaagcuucuaacaaaacu

SEQ ID NO: 336682 - RNA, 62 nt, Homo Sapiens
cauuaagaugaggacaaaucauuauuuauguaucagagaacucuguaauaccaauauuaaaa

SEQ ID NO: 336683 - RNA, 62 nt, Homo Sapiens
uuuguacaauuccccaugaaaggagauacauaucagagaacauuaagguugucuuucuagug

SEQ ID NO: 336684 - RNA, 62 nt, Homo Sapiens
gaagagagauguguggaaauagacagaagaagucagagaagugaaauauaucagcccauguu

SEQ ID NO: 336685 - RNA, 62 nt, Homo Sapiens
auuuuccaucagagcucagcccuuacuagacaucagagaauccauacuagagagaagcccua

SEQ ID NO: 336686 - RNA, 62 nt, Homo Sapiens
guuggccuauauuaaacaacaaggaauucauuucagagaaaagcccuauacguguagugaau

SEQ ID NO: 336687 - RNA, 62 nt, Homo Sapiens
aaagcaggauuuaaccucuaguucucuuguucucagagaacagcagguugauaguagauuau

SEQ ID NO: 336688 - RNA, 62 nt, Homo Sapiens
uuucuuagccccagcuuuaaaagcuagagaucucagagaaauagcuggcuuaacaaugacag

SEQ ID NO: 336689 - RNA, 62 nt, Homo Sapiens
cagaaauuagaagcauaguaagauugccaaaaucagagaaucuugcaaaguucuguaauucu

SEQ ID NO: 336690 - RNA, 62 nt, Homo Sapiens
cuuucccuugagguuaggaaacagguuaaaacucagagaacuccaauaauaaugguuuaaaa

SEQ ID NO: 336691 - RNA, 62 nt, Homo Sapiens
uugauccucuguucuggaagcuuugaaauuuaucagagaaugaagucauucaguacaucuga

SEQ ID NO: 336692 - RNA, 62 nt, Homo Sapiens
uuuaauugggcaacccucagaacugaagagguucagagaacuuuccagguuuauacuauacc

SEQ ID NO: 336693 - RNA, 62 nt, Homo Sapiens
uugaauugcuaaagaaggccgaagcuagccacucagagaaacaaaccucuaaguuggaaauu

SEQ ID NO: 336694 - RNA, 62 nt, Homo Sapiens
ugugugaguuaauuacuuuaugaucaucuccuucagagaacauuucucaugauuauucugau

SEQ ID NO: 336695 - RNA, 62 nt, Homo Sapiens
uuaacaaagucaccuaguuauacaaacaauugucagagaauucuggauuuggaggguauugg

SEQ ID NO: 336696 - RNA, 62 nt, Homo Sapiens
aguuugcacaguauuauuuuacagaaaaggaaucagagaaucuacaacauagggccccagaa

SEQ ID NO: 336697 - RNA, 62 nt, Homo Sapiens
guggaaaagacauccuuucaccucaaauaugaucagagaauuggcuagagagucaaggagaa

SEQ ID NO: 336698 - RNA, 62 nt, Homo Sapiens
cacauaggaaagaaaccagaccucacugugaaucagagaauuagacagucccagaaguaaac

SEQ ID NO: 336699 - RNA, 62 nt, Homo Sapiens; identical to SEQ ID NO: 336681

SEQ ID NO: 336700 - RNA, 62 nt, Homo Sapiens; identical to SEQ ID NO: 336682

SEQ ID NO: 336701 - RNA, 62 nt, Homo Sapiens
ugcugucaaauauuuacagcguuuuaauuuucucagagaaccuugacaaacuauaaaucagg

SEQ ID NO: 336702 - RNA, 62 nt, Homo Sapiens
ccaaagaaugucagaaauuucaaaaaaggagaucagagaaagugaaauugguuauacaguuu

SEQ ID NO: 336703 - RNA, 62 nt, Homo Sapiens
gucuuaggacaacaggcuaaaauaguuuuaguucagagaauuggaugacagugaguugcaag

SEQ ID NO: 336704 - RNA, 62 nt, Homo Sapiens
gcaugggaauauuuuuuccuuacaaagaaaggucagagaaaugggagcaaaaacuagaauga

SEQ ID NO: 336705 - RNA, 62 nt, Homo Sapiens
gacacacagcccguucgaaggucuuucugccaucagagaagggccgucuuucugcugguguu

SEQ ID NO: 336706 - RNA, 62 nt, Homo Sapiens
agaggauuuuaauuuuuaguuuuacaagaucaucagagaaacuaauucaagcccucaucagg

SEQ ID NO: 336707 - RNA, 62 nt, Homo Sapiens
uccuacacacauuccuuccucgguuauuucauucagagaauauuuaugaaaugccuacugug

SEQ ID NO: 336708 - RNA, 62 nt, Homo Sapiens
uuuugcauuuucuccucuccuuccccacuuacucagagaauuuaaagucuguagagucagca

SEQ ID NO: 336709 - RNA, 62 nt, Homo Sapiens
gaauuuuuuaaaaagaaguauaaugccuuacuucagagaacucuuggaaagaagccuuaugu

SEQ ID NO: 336710 - RNA, 62 nt, Homo Sapiens
agagugacuuucugcaauauuucaaaccuauaucagagaauuacacugugggaaaacuacca

SEQ ID NO: 336711 - RNA, 62 nt, Homo Sapiens
uauguuuucauccauuaaaaucagagaaaacuucagagaaaucucaucaucagucuuaauau

SEQ ID NO: 336712 - RNA, 62 nt, Homo Sapiens
cuucagagaaauuauguuuucagucuuaauauucagagaaaagaacaaagagagcucaucau

SEQ ID NO: 336713 - RNA, 62 nt, Homo Sapiens
uagaauagaggauugcucagcaugaguccaauucagagaacgguguuugagucagcuugucu

SEQ ID NO: 336714 - RNA, 62 nt, Homo Sapiens
uaaauucauguguuuccacuucucagauauagucagagaauuauucauuugcccaaaaggac

SEQ ID NO: 336715 - RNA, 62 nt, Homo Sapiens
uagacuuacuggccagugauuauucugguucuucagagaaaauucuaaaugagguagaugaa

SEQ ID NO: 336716 - RNA, 62 nt, Homo Sapiens
cuagagauacugaagauguuaaacugccaugcucagagaaucgaaaagaauggaauaagcag

SEQ ID NO: 336717 - RNA, 62 nt, Homo Sapiens
uauuucacuagaacuguguacuugauugauuuucagagaaauaucacaaauuagaaauauua

SEQ ID NO: 336718 - RNA, 62 nt, Homo Sapiens
auaugacuggugauacuggcuuuacagaaauuucagagaacuaauuuuuaaaaucuuuagca

SEQ ID NO: 336719 - RNA, 62 nt, Homo Sapiens
cacacuagugagaaaccguaccuuaauagaaaucagagaauuaggccuuugcuuguuuccua

SEQ ID NO: 336720 - RNA, 62 nt, Homo Sapiens
cacaaaggagagaaacccuauuuuaauagacaucagagaauugccuucauuuguuuuuuuga

SEQ ID NO: 336721 - RNA, 57 nt, Homo Sapiens
cacaguggggagaaacccuaugagacaucagagaauucaagcauaaugcacaucuaa

SEQ ID NO: 336722 - RNA, 62 nt, Homo Sapiens
uaaugaaggaaagaagccuuuuuaggaaaauaucagagaauuaacauucaauguagaagacu

SEQ ID NO: 336723 - RNA, 62 nt, Homo Sapiens
cauguacaaaacauuugagaucauguuuugugucagagaaaauuauuuagugaucaguuacu

SEQ ID NO: 336724 - RNA, 62 nt, Homo Sapiens
uuuuuuuccuaugugcaacagaauuguacguuucagagaaauuccucauuggucgucccuau

SEQ ID NO: 336725 - RNA, 62 nt, Homo Sapiens
ccgagcguggcuuucucuaguuccauccugguucagagaagguucguuucaggggucugccg

SEQ ID NO: 336726 - RNA, 62 nt, Homo Sapiens
gucggaucugagagaauggguacgggugaagcucagagaaggguuacaaguggaauaagccu

SEQ ID NO: 336727 - RNA, 62 nt, Homo Sapiens
ugggcauaggaacaaucugguuuugaggaugaucagagaacuugggauggaaggcugucuuc

SEQ ID NO: 336728 - RNA, 64 nt, Homo Sapiens; identical to SEQ ID NO: 145537

SEQ ID NO: 336729 - RNA, 64 nt, Homo Sapiens; identical to SEQ ID NO: 145538

SEQ ID NO: 336730 - RNA, 64 nt, Homo Sapiens; identical to SEQ ID NO: 145539

SEQ ID NO: 336731 - RNA, 64 nt, Homo Sapiens; identical to SEQ ID NO: 145540

SEQ ID NO: 336732 - RNA, 64 nt, Homo Sapiens; identical to SEQ ID NO: 145541

SEQ ID NO: 336733 - RNA, 64 nt, Homo Sapiens; identical to SEQ ID NO: 145542

SEQ ID NO: 336734 - RNA, 64 nt, Homo Sapiens; identical to SEQ ID NO: 145543

SEQ ID NO: 336735 - RNA, 64 nt, Homo Sapiens; identical to SEQ ID NO: 145544

SEQ ID NO: 336736 - RNA, 64 nt, Homo Sapiens; identical to SEQ ID NO: 145545

SEQ ID NO: 336737 - RNA, 64 nt, Homo Sapiens; identical to SEQ ID NO: 145546

SEQ ID NO: 336738 - RNA, 64 nt, Homo Sapiens; identical to SEQ ID NO: 145547

SEQ ID NO: 336739 - RNA, 64 nt, Homo Sapiens; identical to SEQ ID NO: 145548

SEQ ID NO: 336740 - RNA, 64 nt, Homo Sapiens; identical to SEQ ID NO: 145549

SEQ ID NO: 336741 - RNA, 64 nt, Homo Sapiens; identical to SEQ ID NO: 145550

SEQ ID NO: 336742 - RNA, 64 nt, Homo Sapiens; identical to SEQ ID NO: 145551

SEQ ID NO: 336743 - RNA, 64 nt, Homo Sapiens; identical to SEQ ID NO: 145552

SEQ ID NO: 336744 - RNA, 64 nt, Homo Sapiens; identical to SEQ ID NO: 145553

SEQ ID NO: 336745 - RNA, 64 nt, Homo Sapiens; identical to SEQ ID NO: 145554

SEQ ID NO: 336746 - RNA, 64 nt, Homo Sapiens; identical to SEQ ID NO: 145555

SEQ ID NO: 336747 - RNA, 64 nt, Homo Sapiens; identical to SEQ ID NO: 145556

SEQ ID NO: 336748 - RNA, 64 nt, Homo Sapiens; identical to SEQ ID NO: 145557

SEQ ID NO: 336749 - RNA, 64 nt, Homo Sapiens; identical to SEQ ID NO: 145558

SEQ ID NO: 336750 - RNA, 64 nt, Homo Sapiens; identical to SEQ ID NO: 145559

SEQ ID NO: 336751 - RNA, 64 nt, Homo Sapiens; identical to SEQ ID NO: 145560

SEQ ID NO: 336752 - RNA, 64 nt, Homo Sapiens; identical to SEQ ID NO: 145561

SEQ ID NO: 336753 - RNA, 64 nt, Homo Sapiens; identical to SEQ ID NO: 145562

SEQ ID NO: 336754 - RNA, 64 nt, Homo Sapiens; identical to SEQ ID NO: 145563

SEQ ID NO: 336755 - RNA, 64 nt, Homo Sapiens; identical to SEQ ID NO: 145564

SEQ ID NO: 336756 - RNA, 64 nt, Homo Sapiens; identical to SEQ ID NO: 145565

SEQ ID NO: 336757 - RNA, 64 nt, Homo Sapiens; identical to SEQ ID NO: 145566

SEQ ID NO: 336758 - RNA, 64 nt, Homo Sapiens; identical to SEQ ID NO: 145567

SEQ ID NO: 336759 - RNA, 64 nt, Homo Sapiens; identical to SEQ ID NO: 145568

SEQ ID NO: 336760 - RNA, 64 nt, Homo Sapiens; identical to SEQ ID NO: 145569

SEQ ID NO: 336761 - RNA, 64 nt, Homo Sapiens; identical to SEQ ID NO: 145570

SEQ ID NO: 336762 - RNA, 64 nt, Homo Sapiens; identical to SEQ ID NO: 145571

SEQ ID NO: 336763 - RNA, 64 nt, Homo Sapiens; identical to SEQ ID NO: 145572

SEQ ID NO: 336764 - RNA, 64 nt, Homo Sapiens; identical to SEQ ID NO: 145573

SEQ ID NO: 336765 - RNA, 64 nt, Homo Sapiens; identical to SEQ ID NO: 145574

SEQ ID NO: 336766 - RNA, 64 nt, Homo Sapiens; identical to SEQ ID NO: 145575

SEQ ID NO: 336767 - RNA, 64 nt, Homo Sapiens; identical to SEQ ID NO: 145576

SEQ ID NO: 336768 - RNA, 64 nt, Homo Sapiens; identical to SEQ ID NO: 145577

SEQ ID NO: 336769 - RNA, 64 nt, Homo Sapiens; identical to SEQ ID NO: 145578

SEQ ID NO: 336770 - RNA, 64 nt, Homo Sapiens; identical to SEQ ID NO: 145579

SEQ ID NO: 336771 - RNA, 64 nt, Homo Sapiens; identical to SEQ ID NO: 145580

SEQ ID NO: 336772 - RNA, 64 nt, Homo Sapiens; identical to SEQ ID NO: 145581

SEQ ID NO: 336773 - RNA, 64 nt, Homo Sapiens; identical to SEQ ID NO: 145582

SEQ ID NO: 336774 - RNA, 64 nt, Homo Sapiens; identical to SEQ ID NO: 145583

SEQ ID NO: 336775 - RNA, 64 nt, Homo Sapiens; identical to SEQ ID NO: 145584

SEQ ID NO: 336776 - RNA, 64 nt, Homo Sapiens; identical to SEQ ID NO: 145585

SEQ ID NO: 336777 - RNA, 64 nt, Homo Sapiens; identical to SEQ ID NO: 145586

SEQ ID NO: 336778 - RNA, 64 nt, Homo Sapiens; identical to SEQ ID NO: 145587

SEQ ID NO: 336779 - RNA, 64 nt, Homo Sapiens; identical to SEQ ID NO: 145588

SEQ ID NO: 336780 - RNA, 64 nt, Homo Sapiens; identical to SEQ ID NO: 145589

SEQ ID NO: 336781 - RNA, 64 nt, Homo Sapiens; identical to SEQ ID NO: 145590

SEQ ID NO: 336782 - RNA, 64 nt, Homo Sapiens; identical to SEQ ID NO: 145591

SEQ ID NO: 336783 - RNA, 64 nt, Homo Sapiens; identical to SEQ ID NO: 145592

SEQ ID NO: 336784 - RNA, 64 nt, Homo Sapiens; identical to SEQ ID NO: 145593

SEQ ID NO: 336785 - RNA, 64 nt, Homo Sapiens; identical to SEQ ID NO: 145594

SEQ ID NO: 336786 - RNA, 64 nt, Homo Sapiens; identical to SEQ ID NO: 145595

SEQ ID NO: 336787 - RNA, 64 nt, Homo Sapiens; identical to SEQ ID NO: 145596

SEQ ID NO: 336788 - RNA, 64 nt, Homo Sapiens; identical to SEQ ID NO: 145597

SEQ ID NO: 336789 - RNA, 64 nt, Homo Sapiens; identical to SEQ ID NO: 145598

SEQ ID NO: 336790 - RNA, 64 nt, Homo Sapiens; identical to SEQ ID NO: 145599

SEQ ID NO: 336791 - RNA, 64 nt, Homo Sapiens; identical to SEQ ID NO: 145600

SEQ ID NO: 336792 - RNA, 64 nt, Homo Sapiens; identical to SEQ ID NO: 145601

SEQ ID NO: 336793 - RNA, 64 nt, Homo Sapiens; identical to SEQ ID NO: 145602

SEQ ID NO: 336794 - RNA, 64 nt, Homo Sapiens; identical to SEQ ID NO: 145603

SEQ ID NO: 336795 - RNA, 64 nt, Homo Sapiens; identical to SEQ ID NO: 145604

SEQ ID NO: 336796 - RNA, 64 nt, Homo Sapiens; identical to SEQ ID NO: 145605

SEQ ID NO: 336797 - RNA, 64 nt, Homo Sapiens; identical to SEQ ID NO: 145606

SEQ ID NO: 336798 - RNA, 64 nt, Homo Sapiens; identical to SEQ ID NO: 145607

SEQ ID NO: 336799 - RNA, 64 nt, Homo Sapiens; identical to SEQ ID NO: 145608

SEQ ID NO: 336800 - RNA, 64 nt, Homo Sapiens; identical to SEQ ID NO: 145609

SEQ ID NO: 336801 - RNA, 64 nt, Homo Sapiens; identical to SEQ ID NO: 145610

SEQ ID NO: 336802 - RNA, 64 nt, Homo Sapiens; identical to SEQ ID NO: 145611

SEQ ID NO: 336803 - RNA, 64 nt, Homo Sapiens; identical to SEQ ID NO: 145612

SEQ ID NO: 336804 - RNA, 64 nt, Homo Sapiens; identical to SEQ ID NO: 145613

SEQ ID NO: 336805 - RNA, 63 nt, Homo Sapiens
augccuaccaucagcuccugaaucagggauuuucagcacuaccucugagccaugggguuggcu

SEQ ID NO: 336806 - RNA, 63 nt, Homo Sapiens
aaaauguauagagugugauguccaauugguauucagcacuauaaauguguuuuuaaccucccg

SEQ ID NO: 336807 - RNA, 63 nt, Homo Sapiens
uggaaaccaucagguacugccugcagacuucuccagcacuaaauauauuuguucccucuauaa

SEQ ID NO: 336808 - RNA, 63 nt, Homo Sapiens
cauauaaaacuaucagaaguuaguaaaucauaccagcacuaaaaauaagacaauuggaauaua

SEQ ID NO: 336809 - RNA, 63 nt, Homo Sapiens
ucuuuuccuccagagguggggcugcaccagacucagcacuagcacuccaucagcacuagcacc

SEQ ID NO: 336810 - RNA, 63 nt, Homo Sapiens
ggggcugcaccagacucagcacuagcacuccaucagcacuagcaccucacuccaucagcacua

SEQ ID NO: 336811 - RNA, 63 nt, Homo Sapiens
uagcacuccaucagcacuagcaccucacuccaucagcacuagcaccucacuccaucggccccg

SEQ ID NO: 336812 - RNA, 63 nt, Homo Sapiens
ggcacuaaugccccacucggcgccccacuccaucagcacuaaugcuccacuccauuggcacua

SEQ ID NO: 336813 - RNA, 63 nt, Homo Sapiens
acccgcuccuuugacauuggugccccacuccaucagcacuaacgcccugcuccaucggcacug

SEQ ID NO: 336814 - RNA, 63 nt, Homo Sapiens
uggcugcuuggucuuggccacagugcucucagccagcacuaagggcugaggucaauaccgcag

SEQ ID NO: 336815 - RNA, 63 nt, Homo Sapiens
ugggggaaguggcuccuggcaggagauuucucccagcacuaauauccugguguucuauaaaau

SEQ ID NO: 336816 - RNA, 64 nt, Homo Sapiens
gucccaaguucaauauuucuauuauguuauagcuugucagcacaucugaucuggaaggagaggg

SEQ ID NO: 336817 - RNA, 64 nt, Homo Sapiens
gcugugcuccuucugaaggcaaugaaaaucaaggugucagcagauuccaaaauggaugucccug

SEQ ID NO: 336818 - RNA, 64 nt, Homo Sapiens
agguauaaaaggugacucagaguagagaguaagaugucagcaaauagacaauaagaugucagca

SEQ ID NO: 336819 - RNA, 64 nt, Homo Sapiens
uagagaguaagaugucagcaaauagacaauaagaugucagcaaaagugccucaaauuuuaacug

SEQ ID NO: 336820 - RNA, 64 nt, Homo Sapiens
cucaggaaacugaaccuuuuucugaaccaagcacugucagcaaaucucagguauuagagcaacu

SEQ ID NO: 336821 - RNA, 64 nt, Homo Sapiens
uguaaacugaaagaaaaauaguugcuuuuuaaaaugucagcaagaaggccugccucaucuuaac

SEQ ID NO: 336822 - RNA, 64 nt, Homo Sapiens
gagagucucuguacacagccgcguguggccaucgugucagcagaaguggagucauacacgaagg

SEQ ID NO: 336823 - RNA, 64 nt, Homo Sapiens
gagagucucuguacacagccccauauggccaucgugucagcagaaguggagucauacgcgaagg

SEQ ID NO: 336824 - RNA, 64 nt, Homo Sapiens
gucuccaagccccacgaaccugucugugguaucaugucagcagagccgcggggagguaaugaau

SEQ ID NO: 336825 - RNA, 64 nt, Homo Sapiens
caaccuauuuggauacuuggcaaaagauucuugcugucagcauauaaaaugugcuugucauuug

SEQ ID NO: 336826 - RNA, 64 nt, Homo Sapiens
aucuuuuuacaaauaaaugaaggauuauaaaugaugucagcauuuuaguaaacuuuuagacaaa

SEQ ID NO: 336827 - RNA, 64 nt, Homo Sapiens
aggcagagcugugugcuccaccguguuugucuggugucagcacggcuguccgccucagcuccca

SEQ ID NO: 336828 - RNA, 64 nt, Homo Sapiens
agaaagcaguuuuaggagguucgcaugugucuaaugucagcacuaguugagacuugcauguucc

SEQ ID NO: 336829 - RNA, 64 nt, Homo Sapiens
gccuggagaaguggggccggaaaaagcaggccacugucagcaaaaaagucaggauaaaaauuuu

SEQ ID NO: 336830 - RNA, 61 nt, Homo Sapiens
gccugaagaaguggggcuggaagccggcuacugucagcaaaugaagaucacugucaucuaa

SEQ ID NO: 336831 - RNA, 64 nt, Homo Sapiens
augauuguguuccuucccuaucucuguucgcugcugucagcauagcucaccuuuuuucuucccc

SEQ ID NO: 336832 - RNA, 64 nt, Homo Sapiens
ugagucacagcccaggugccugcugauguauucaugucagcacccuguggcugaauugagaccu

SEQ ID NO: 336833 - RNA, 64 nt, Homo Sapiens
gcugaaacuaaauuucuuuaauauuuucuauuccugucagcaccuuuucuagcagcugccaguu

SEQ ID NO: 336834 - RNA, 64 nt, Homo Sapiens
aaaauaaaaucuuuuuauaauauuaucuaugggaugucagcacaauauaacacucugggaagaa

SEQ ID NO: 336835 - RNA, 64 nt, Homo Sapiens; identical to SEQ ID NO: 48356

SEQ ID NO: 336836 - RNA, 64 nt, Homo Sapiens; identical to SEQ ID NO: 48357

SEQ ID NO: 336837 - RNA, 64 nt, Homo Sapiens; identical to SEQ ID NO: 48358

SEQ ID NO: 336838 - RNA, 64 nt, Homo Sapiens; identical to SEQ ID NO: 48359

SEQ ID NO: 336839 - RNA, 64 nt, Homo Sapiens
auuauaaauuugcuuaaagauuuugauuuuuucuucagaauaugguauacuuaaaauuaauuaa

SEQ ID NO: 336840 - RNA, 64 nt, Homo Sapiens
uucuccaaguagucauaaauguagcaaguauaaaucagaauaucaucuuauaaucuuacagagu

SEQ ID NO: 336841 - RNA, 64 nt, Homo Sapiens
uaauguuaauacauauuacacuacaguuuacuuuucagaauacuaaagacuuuauaacugcaug

SEQ ID NO: 336842 - RNA, 64 nt, Homo Sapiens
uaagcaagguaauguguaaaaucagucucggcugucagaauaacuucuaaaagguauuuuuaua

SEQ ID NO: 336843 - RNA, 64 nt, Homo Sapiens
guauuaaaauuuuacuauuuuauucuacuuguauucagaauacuauacaauucuuaucuagugg

SEQ ID NO: 336844 - RNA, 64 nt, Homo Sapiens
aaaagauacacaaucauucuuuauagcacuauuuucagaauacgaagcuaggaauaauugaguu

SEQ ID NO: 336845 - RNA, 64 nt, Homo Sapiens
cuuucaaaacaauuugcauuuagaguguuucgcaucagaauaacaugaguaagaugaacuggaa

SEQ ID NO: 336846 - RNA, 64 nt, Homo Sapiens
auuuaaacaacuaaugcucuuugaagaaucauaaucagaauaaagauaaauucuugaucagcua

SEQ ID NO: 336847 - RNA, 64 nt, Homo Sapiens
uauuugaacaucauaguuguuugaacauaauggcucagaauacaaauuucccagauauuuaugu

SEQ ID NO: 336848 - RNA, 64 nt, Homo Sapiens
agcauauuaccacaaauaauugccucucaaaacuucagaauauuuagugcacucauuuaaucug

SEQ ID NO: 336849 - RNA, 64 nt, Homo Sapiens
aaaaaguucauacauuugcgcuuuuuggcagaauucagaauauuuuggaauucuaugagucaau

SEQ ID NO: 336850 - RNA, 64 nt, Homo Sapiens
gaguguaaauguguuauguuuaauuauaagaaacucagaauaauaaguauuuuaaacagccugu

SEQ ID NO: 336851 - RNA, 64 nt, Homo Sapiens
uccauagguucaacuacugcugaaagucuggauuucagaauaaagcagaauguaaguuucaguu

SEQ ID NO: 336852 - RNA, 64 nt, Homo Sapiens
ccuuaauuuuggcaaccacuagcaaaaaaacuugucagaauaauuuaaccaagccccucuccac

SEQ ID NO: 336853 - RNA, 64 nt, Homo Sapiens
auucacuauuuaaacuaugauauuaaucagaauaucagaauaugauugucaaaauuaauaugau

SEQ ID NO: 336854 - RNA, 64 nt, Homo Sapiens
agaauaugauucacuauuuaaauaugauuauuaaucagaauauccuaaaaucauugucaaaauu

SEQ ID NO: 336855 - RNA, 64 nt, Homo Sapiens
uucuuuuaaaaguucauguaauauuucugauuuuucagaauauuugcaauaagagucuggauuu

SEQ ID NO: 336856 - RNA, 64 nt, Homo Sapiens
caaauagaugagagagcaaaucaugugagaaaauucagaauaccaucuguuucauagccgcaca

SEQ ID NO: 336857 - RNA, 64 nt, Homo Sapiens
agucagccaacucugucucaucaucuguggaguaucagaauagcgguaguuacuuuauuagugu

SEQ ID NO: 336858 - RNA, 64 nt, Homo Sapiens
aagcaaaauaacuuuguuagaaauuauuccagcaucagaauaaucuauuuaugaauauuugacc

SEQ ID NO: 336859 - RNA, 64 nt, Homo Sapiens
ugggaaaauccacaccacacucuaaguggacagcucagaauaauuuagcauauuuccuuucaca

SEQ ID NO: 336860 - RNA, 64 nt, Homo Sapiens
agauucaccacaaauuuucaugggcguugagugcucagaauaaugcuugaacaccucaccuuga

SEQ ID NO: 336861 - RNA, 64 nt, Homo Sapiens
agccaguaccagcuuugguacacagauuugcauuucagaauauuugagcaguauauauauaaag

SEQ ID NO: 336862 - RNA, 64 nt, Homo Sapiens
aucuuuuagacacagcccgaugcuaugagaccauucagaauaucuauuugugcgaagugccuua

SEQ ID NO: 336863 - RNA, 64 nt, Homo Sapiens
uguuacugucauucccauuccuuuucguuuagaaucagaauaaaguuguauuucaaauaucuaa

SEQ ID NO: 336864 - RNA, 64 nt, Homo Sapiens
ccuagggaagcacuugcucaaaaucugugaccugucagaauaaaaaugugguuuguacauauca

SEQ ID NO: 336865 - RNA, 64 nt, Homo Sapiens
aggauacacaucaaccacuuugcuguugaagcugucagaauaaauuccugguggucagaugaaa

SEQ ID NO: 336866 - RNA, 64 nt, Homo Sapiens
agcccaacuuauauguuuuaaucucccuugucccucagaauaagcagaaaauauaacugcagcu

SEQ ID NO: 336867 - RNA, 64 nt, Homo Sapiens
gauuaaguguccaucaccugccugucagccguggucagaauaaguuuuacacgaagcaggugaa

SEQ ID NO: 336868 - RNA, 64 nt, Homo Sapiens
uacagaauucuuuuugguacuuucacuuauucuuucagaauacaucaaggaugugauuuauggg

SEQ ID NO: 336869 - RNA, 64 nt, Homo Sapiens
gaauaauaacucuaguaauaacucuuccugcuauucagaauaaguaggagaaugaaaacugcag

SEQ ID NO: 336870 - RNA, 64 nt, Homo Sapiens
ggcauuuuugucccuuuggaagaagaaauaggacucagaauacaguggcaugagugauuacacu

SEQ ID NO: 336871 - RNA, 64 nt, Homo Sapiens
ccagaccugagucggcugcucuuggggugggcaccaggucaacccuucuccuccugcuguccag

SEQ ID NO: 336872 - RNA, 64 nt, Homo Sapiens
guuaaaaaguuuucuguaugucauguuauaauuacaggucaauucuguuaauaucuuuuuguua

SEQ ID NO: 336873 - RNA, 64 nt, Homo Sapiens
auaauuuguuucugaagaaauuugccgagaguuacaggucaaaaagccuuguuacuaguacaga

SEQ ID NO: 336874 - RNA, 64 nt, Homo Sapiens
aucugacuuuaauaaaaacauggcucagaaucuacaggucaaauuaauuugaacaguucuuguc

SEQ ID NO: 336875 - RNA, 64 nt, Homo Sapiens
uuuggcaagaaucccaggcuugaccaacugguaccaggucaaagauuuuuguauucuugugaau

SEQ ID NO: 336876 - RNA, 64 nt, Homo Sapiens
gaaaaugcuuccaaaaguagacccuguccccacacaggucaagacuacagagaaggcuuuguag

SEQ ID NO: 336877 - RNA, 64 nt, Homo Sapiens
auggggacauuugaacauguuuaauggguaugcucaggucaacugaccugaccccauuccugau

SEQ ID NO: 336878 - RNA, 64 nt, Homo Sapiens
gagcugccuaguaggcugaagcuucaggacucugcaggucaaggauaugugaugagcaccggcc

SEQ ID NO: 336879 - RNA, 64 nt, Homo Sapiens
ugaaaaacacccugcgugaacucaacggugugaacaggucaagaauaacacuucaaagucaucu

SEQ ID NO: 336880 - RNA, 64 nt, Homo Sapiens
uaagggcuacuuaaugcacagugcauuauguacacaggucaaccaugguaacaauaguucuuag

SEQ ID NO: 336881 - RNA, 64 nt, Homo Sapiens
ccuucauuggccucuccggauguugaaacaaccacaggucaagaaggaaugugaaucuguuguu

SEQ ID NO: 336882 - RNA, 64 nt, Homo Sapiens
ugaccaaccuuccuugcuuaccucacccauaacucaggucaacgcccaccucccaccuaucacc

SEQ ID NO: 336883 - RNA, 64 nt, Homo Sapiens
uaaaaugugaguugacagcucuuucuugcccaaccaggucaaagacuagggaaguuugucucuc

SEQ ID NO: 336884 - RNA, 64 nt, Homo Sapiens
uucaaugaacauuccuaucuuccaauugacaguucaggucaaugaaaugagaaaaagcuuuagu

SEQ ID NO: 336885 - RNA, 64 nt, Homo Sapiens
gugcauuguugugagauuuaucuucccaucaguucaggucaaaacuaaaaauggauuuggcaug

SEQ ID NO: 336886 - RNA, 64 nt, Homo Sapiens
auaaaacaaugaaggaaaaccucacuugaaggcccaggucaacaucuaagccuguugagacuua

SEQ ID NO: 336887 - RNA, 64 nt, Homo Sapiens
cuguaucccauugucuggcuuuuguaaauucauccaggucaagacuaaguauguugguuaauag

SEQ ID NO: 336888 - RNA, 64 nt, Homo Sapiens
gggagaaggacagagcucucuucaauaaauucgucaggucaaagcagcagcuuugcuucugcug

SEQ ID NO: 336889 - RNA, 64 nt, Homo Sapiens
uggcuucuagucugguguucugaguacuugauuucaggucaauaacgguccccccucacuccac

SEQ ID NO: 336890 - RNA, 64 nt, Homo Sapiens
uaggccaugcacccaaugggugcacaauaaauaacaggucaacaaagagggaggugugucagug

SEQ ID NO: 336891 - RNA, 64 nt, Homo Sapiens
ucucaguuaaugcaacuucaaccuuccagaugcucaggucaaaaacugaaaguugcuuuugacu

SEQ ID NO: 336892 - RNA, 64 nt, Homo Sapiens
gggggaaaguagaaaaucgaguagaauuuggccucaggucaauaaaugauauaaaaacaugugu

SEQ ID NO: 336893 - RNA, 64 nt, Homo Sapiens
ugucagacuauacccauggugccucugggcuugacaggucaaaaugguccccaucagccuggag

SEQ ID NO: 336894 - RNA, 64 nt, Homo Sapiens
aaugaaacuagaaagcagaguaggaaaaaauaaacaggucaauggggcuucuggauggauuuua

SEQ ID NO: 336895 - RNA, 64 nt, Homo Sapiens
ugaugacuuauaugagggcagauucaagagccagcaggucaaaaaggccaacacaaccauaagc

SEQ ID NO: 336896 - RNA, 64 nt, Homo Sapiens
auucuggauccagaacucauuaugggauguaauccaggucaacacuaauaccacuuggaagguu

SEQ ID NO: 336897 - RNA, 64 nt, Homo Sapiens
uuuguuuuugcuccagucaauuccugauuauccacaggucaacccacauuuuuucauuccuucu

SEQ ID NO: 336898 - RNA, 64 nt, Homo Sapiens
guagaaguuaaaggagaaucuugaaaacagaaggcaggucaagguggagaaggaacaaggcuau

SEQ ID NO: 336899 - RNA, 64 nt, Homo Sapiens
gguuugugcauuuuacuauuuugaguggaauugucaggucaaagauaucuguaggauaacuuuc

SEQ ID NO: 336900 - RNA, 64 nt, Homo Sapiens
ucagagacuaucugauuuccaauuuguccaauaacaggucaacucaaagugcugcuggaaguag

SEQ ID NO: 336901 - RNA, 64 nt, Homo Sapiens
uaauacugccagagacagaaagauguuuuuauugcaggucaauaguauccuguucuguaagauc

SEQ ID NO: 336902 - RNA, 64 nt, Homo Sapiens
gacguucugugggcaguagccaggggaggaggaccaggucaagggccagcaggcccagaguccc

SEQ ID NO: 336903 - RNA, 64 nt, Homo Sapiens
ucuuuagcauucuuugacuucauuaaugcaguaacaggucaagcaucugcauaaugucugaagu

SEQ ID NO: 336904 - RNA, 64 nt, Homo Sapiens
uuuuuuuuccccugaauuaccaccaagcaugacccaggucaacucuuggucuuguucuggcugu

SEQ ID NO: 336905 - RNA, 64 nt, Homo Sapiens
cuaugcugggaaagugaggauucgagcccaucagcaggucaaccgauaagacccauaggcaaac

SEQ ID NO: 336906 - RNA, 64 nt, Homo Sapiens
guucuuccuggaaguugacuuuccuuagacccgccaggucaaguuagccgcgugacggacaucc

SEQ ID NO: 336907 - RNA, 64 nt, Homo Sapiens
guccuguguaaacugcuggaaguucuuccacagucaggucaauuuugucaaacccuucucugua

SEQ ID NO: 336908 - RNA, 64 nt, Homo Sapiens
aauuauguauugguggggcuggguaccaaugcugcaggucaacagcuaugcugguaggcuccug

SEQ ID NO: 336909 - RNA, 64 nt, Homo Sapiens
cuccacaggucuuuccaccucugugaguccaagucaggucaaucagcaaggacccaucucugcc

SEQ ID NO: 336910 - RNA, 64 nt, Homo Sapiens
aaaaaaaaaccacacacacacauaaaaaacccaacaggucaaaauaaaaguugaacuugaguua

SEQ ID NO: 336911 - RNA, 64 nt, Homo Sapiens
uuugugaaaaauacacaaaagugaaauuauauuccaggucaaaaagggccccauaguuauaaau

SEQ ID NO: 336912 - RNA, 64 nt, Homo Sapiens
gagaauacuagcugcuccuuugaaacauggugugcaggucaacguguaaauccuugccgccugc

SEQ ID NO: 336913 - RNA, 64 nt, Homo Sapiens
uggccagcaucucaccaccagcaaguaguagggccaggucaaucccaggcagucugaccccaga

SEQ ID NO: 336914 - RNA, 64 nt, Homo Sapiens
uacugggggcagagcagacuuugccagugccccucaggucaaaccaagccaagagcacccuguc

SEQ ID NO: 336915 - RNA, 64 nt, Homo Sapiens
ugacuuuaaccaaaagauuucaacccacaaugaucaggucaaucaaaaucccuaagagcagaac

SEQ ID NO: 336916 - RNA, 64 nt, Homo Sapiens
gggcguuuuaaagcagcugggggcacgugguuugcaggucaaagcucgcggaucacaccacacu

SEQ ID NO: 336917 - RNA, 64 nt, Homo Sapiens
aaagagggagcuaggcaaagaucuuacguggagacaggucaacccuaaaaaugcaauuuaggua

SEQ ID NO: 336918 - RNA, 64 nt, Homo Sapiens
gcaaaaugccugcaccaugacccauuuuguuguucaggucaacaucucaucacagagcauaagg

SEQ ID NO: 336919 - RNA, 64 nt, Homo Sapiens
uuuuuuuuuuugugaacauaguuugauuugaucacaggucaaaaacgccuuauauuuucgaaag

SEQ ID NO: 336920 - RNA, 64 nt, Homo Sapiens
ggauauuacugguuaguugucauuaaguaagauccaggucaaauuccauuugacaaaucccagg

SEQ ID NO: 336921 - RNA, 64 nt, Homo Sapiens
aguggcagacgcaaggcuuuuguguucccugucucaggucaagcacucaggcccagcccagagc

SEQ ID NO: 336922 - RNA, 64 nt, Homo Sapiens
aagcuuucuuugcaguagcaugaggcacgucaugcaggucaagacaauugguggagagaagcuc

SEQ ID NO: 336923 - RNA, 64 nt, Homo Sapiens
ucuuacuccagcccuuccugggguaaagcaggcccaggucaagggagcagagagcaugggccuu

SEQ ID NO: 336924 - RNA, 64 nt, Homo Sapiens
guauuuuuuucuuuuuucucaguccuaauuugaacaggucaaagauguguucaggcauuccagg

SEQ ID NO: 336925 - RNA, 64 nt, Homo Sapiens
acccuucaguauuaauauauacgguauuauauaacaggucaacaagugcucuuugaugauaaaa

SEQ ID NO: 336926 - RNA, 64 nt, Homo Sapiens
guacaggaucuucaguuauucgaggggaaugaggcaggucaagccgaugcuagccacuaguuug

SEQ ID NO: 336927 - RNA, 64 nt, Homo Sapiens
acugcuaaauaagcgaagaguuaauuuugaaguucaggucaacaaauuccuguuuggagacggg

SEQ ID NO: 336928 - RNA, 64 nt, Homo Sapiens
ucugguuccagaaccgcaggaccucaccgagaggcaggucaagacgagguggcucgacugcuca

SEQ ID NO: 336929 - RNA, 64 nt, Homo Sapiens
aggaagcaguugacaagacauaacuuggcauuugcaggucaagcuauuuaagccuacuccugac

SEQ ID NO: 336930 - RNA, 64 nt, Homo Sapiens
cucaacgacaauugaaaguuugugauguguaaaucaggucaaacauagauggagauauauagug

SEQ ID NO: 336931 - RNA, 64 nt, Homo Sapiens
uagugccacuaacgguugaggaagcaaaaucuaccaggucaaaauacccuuuucugaccaaaga

SEQ ID NO: 336932 - RNA, 64 nt, Homo Sapiens
cauccacuucaucaccuaugaguuccugcaggagcaggucaacccccaccggaccuacaacccg

SEQ ID NO: 336933 - RNA, 64 nt, Homo Sapiens
guuaauuuuaaaacuagcaaucuauaaagugcaccaggucaacuugaauaaaaacacuaugaca

SEQ ID NO: 336934 - RNA, 64 nt, Homo Sapiens
auguuuauguaacauaguccagagaacugacaugcaggucaaaagucagauacgcaaccuccuu

SEQ ID NO: 336935 - RNA, 64 nt, Homo Sapiens
gccauaggauucugagcaaggacagcccaaggcucaggucaacuugcuaaagaaaugucccuga

SEQ ID NO: 336936 - RNA, 64 nt, Homo Sapiens
auuuggaacuuguuucuuauaaauucucuuuguccaggucaaaaauguaugauaugcuugguuu

SEQ ID NO: 336937 - RNA, 64 nt, Homo Sapiens
gaaugaaaaaugaaagaugagaaauaauaauauccaggucaacauuuuuuccuguuucugaaaa

SEQ ID NO: 336938 - RNA, 51 nt, Homo Sapiens
gggcauccacggcccuguaaacaggucaacggcccaagggccuccugcccu

SEQ ID NO: 336939 - RNA, 62 nt, Homo Sapiens
agggggaggcgagugugugaauaaaggcucccaucaggucaagugucugcuuguccuccuuu

SEQ ID NO: 336940 - RNA, 64 nt, Homo Sapiens
ggcuuugggcugagaggaugagggaggucuuucccaggucaaauuacuuuccuuuggccucugc

SEQ ID NO: 336941 - RNA, 64 nt, Homo Sapiens
ugaagucauucucuguuuagauguuaacacaucacaggucaaguuagcuuuuagggaaaaaaaa

SEQ ID NO: 336942 - RNA, 64 nt, Homo Sapiens
aguuuucccucuuuugugguuguggaagcccugccaggucaagacuuuuugaucgccacuucuu

SEQ ID NO: 336943 - RNA, 64 nt, Homo Sapiens
agauguguuuauccucagcuuauaggaaucucuccaggucaacagguucaaauauucaagaagg

SEQ ID NO: 336944 - RNA, 64 nt, Homo Sapiens
cuacauuauuugucacacauggaucuguuaccaucaggucaauuccuaguaugcauaaauuuuu

SEQ ID NO: 336945 - RNA, 64 nt, Homo Sapiens
cccuaaggcccccagcucagacucagcaggcauucaggucaacucaggcagacuggcuaaggac

SEQ ID NO: 336946 - RNA, 57 nt, Homo Sapiens
uuuuacaguacaaauggugaugaucaucaggucaaggauagucuggagcaauugaga

SEQ ID NO: 336947 - RNA, 64 nt, Homo Sapiens
uccaugaaaugagauccccccaaauacaaauugacaggucaaaauuuuaaaauacauucacaca

SEQ ID NO: 336948 - RNA, 64 nt, Homo Sapiens
ggugggucacccccccagauccaaggagaaacugcaggucaagggcugauaacggccaugcagg

SEQ ID NO: 336949 - RNA, 64 nt, Homo Sapiens
ugacauaaggaaaguaagugcucagaaaaaugugcaggucaauaaguugcaaaaguuggggcug

SEQ ID NO: 336950 - RNA, 56 nt, Homo Sapiens
gcaggaguuccgauaagugaagugagcaggucaacaguaggacuggggcagaagcu

SEQ ID NO: 336951 - RNA, 64 nt, Homo Sapiens
gaauuuucuuuuuaauaaaaaggcaccuauaaaacaggucaauacaguacaggcagcacagaga

SEQ ID NO: 336952 - RNA, 64 nt, Homo Sapiens
uuuguauuugaaaugauccauccaaaaccuuuugcaggucaauccaaguuuuuggaccuucugu

SEQ ID NO: 336953 - RNA, 64 nt, Homo Sapiens
aauagcgcaguguccuggauauggaaucccucuacaggucaagauaauuauaaauugagcacug

SEQ ID NO: 336954 - RNA, 64 nt, Homo Sapiens
uuugucucagccccaaaggccaucaccuccacaccaggucaaguauuccaaggccccaguuacc

SEQ ID NO: 336955 - RNA, 64 nt, Homo Sapiens
agagcaacugaauauaauauggaauaaguuugaccaggucaaguuuuaggauauaguugaauuu

SEQ ID NO: 336956 - RNA, 64 nt, Homo Sapiens
cccucugaccacaagcuucugccugaagauuccucaggucaacaccaucauuaaaugcgaguuu

SEQ ID NO: 336957 - RNA, 64 nt, Homo Sapiens
ugcugcucauccccagggaggcaucaugggcauccaggucaacugggacugcaaccuggacaga

SEQ ID NO: 336958 - RNA, 64 nt, Homo Sapiens
acagaaggaguuugggccaacccuggggaacugccaggucaacuuccaaccuuguaugacuuuc

SEQ ID NO: 336959 - RNA, 64 nt, Homo Sapiens
ucuggcgucccaaaugaaagagugaccucacuuccaggucaaggcucacacuccacugcccaau

SEQ ID NO: 336960 - RNA, 64 nt, Homo Sapiens
uuugcuacauuuuguaugugucagaaaugccaaucaggucaaggcucucgugggucucuucauc

SEQ ID NO: 336961 - RNA, 64 nt, Homo Sapiens
uauuuugucccauuuucaggacuuucuuuuaagucaggucaacaaaguguuuuuacaagacaga

SEQ ID NO: 336962 - RNA, 64 nt, Homo Sapiens
ugggggcaggcugggcccugccccguccuugugccaggucaaggggugugugcuagccucugug

SEQ ID NO: 336963 - RNA, 64 nt, Homo Sapiens
aagaaagccccucucucuccagcuucaaagcauacaggucaauuauaagauugugucucuauag

SEQ ID NO: 336964 - RNA, 64 nt, Homo Sapiens
cauuuugugggaaauauccuaucauacuuccuuucaggucaaaauuaagaccagaaguacugga

SEQ ID NO: 336965 - RNA, 64 nt, Homo Sapiens
uauggcuucacaaauaugugaguguaaugauuuucaggucaaauuuuuuaaaacauuaagcaac

SEQ ID NO: 336966 - RNA, 64 nt, Homo Sapiens
uauuuaacugacuguugacauuuguagaaacugucaggucaaaaauauguaguggaaaucacua

SEQ ID NO: 336967 - RNA, 64 nt, Homo Sapiens
cccccugacuuucccugagaagaaucaucucugccaggucaacuggagucccuggugacuccau

SEQ ID NO: 336968 - RNA, 64 nt, Homo Sapiens
acaucaguuuuguuuacucauccuccaggaacugcaggucaaguugucagguuauuuauuuuau

SEQ ID NO: 336969 - RNA, 64 nt, Homo Sapiens
uauuaggaaggagccagaaagaaugcgcguaugacaggucaacggugcaaaagaaauucuaagu

SEQ ID NO: 336970 - RNA, 64 nt, Homo Sapiens
ucgcgcuugcuggccaguccuggcccaaggcuggcaggucaaccggggccugaggucaucggcg

SEQ ID NO: 336971 - RNA, 64 nt, Homo Sapiens
gcucuguuccccaaccccacugaggccugcugcacaggucaaugccuucguuaucguuauugua

SEQ ID NO: 336972 - RNA, 64 nt, Homo Sapiens
uugcaauggggaaaugacuuauaaagucacccagcaggucaacaaugggcccacgaccaagacc

SEQ ID NO: 336973 - RNA, 64 nt, Homo Sapiens
uauaguuguagccuuacaacacguuauccaauugcaggucaacuuuagaggccuauuaaacaug

SEQ ID NO: 336974 - RNA, 64 nt, Homo Sapiens
cauagaauguuucaacauuuguuuuaccaccacccaggucaagauaauaaauaaucauguacau

SEQ ID NO: 336975 - RNA, 64 nt, Homo Sapiens
uuuuucagaaauguauuuauguuaaauuugaugucaggucaacacccaauuuauuaauacuucu

SEQ ID NO: 336976 - RNA, 64 nt, Homo Sapiens
gcaagauuucuacugucauggcggggcccauucucaggucaaaaggcuccagaggguggacgga

SEQ ID NO: 336977 - RNA, 64 nt, Homo Sapiens
ugagggaaucucgcugggaaaauacuugaaggagcaggucaagagaaccucauggcccgagcug

SEQ ID NO: 336978 - RNA, 64 nt, Homo Sapiens
agagggucaguggaaacaaggcaauuggggguuucaggucaaagguuuuguuuugccuguggag

SEQ ID NO: 336979 - RNA, 64 nt, Homo Sapiens
uggccaacgcccgagugucuguuuucaggagccccaggucaagccuugucccuuccuccuccca

SEQ ID NO: 336980 - RNA, 64 nt, Homo Sapiens
auuuuuaccugcuuuuuuuuuuuuuuuuaauuuucaggucaaguuuuuuauacugcacuuauuu

SEQ ID NO: 336981 - RNA, 64 nt, Homo Sapiens
caggaucagccaacaaccugaaagggaaggucagcaggucaaaguccuggccauagaaugaugg

SEQ ID NO: 336982 - RNA, 64 nt, Homo Sapiens
acugagacucagaacuuucaguccuuuaugacuucaggucaaagaagacaucuguuuuaaaaag

SEQ ID NO: 336983 - RNA, 64 nt, Homo Sapiens
acauaaaaucccugccuucugcuaagcccuagagcaggucaaaauuuacugaacaccacucugu

SEQ ID NO: 336984 - RNA, 64 nt, Homo Sapiens
cauuuauuucauuuuggucuuaaugcuuuguaaacaggucaaaaaauacugucauacucuaagc

SEQ ID NO: 336985 - RNA, 64 nt, Homo Sapiens
acauugcaaaucuucuagaaguucucccccaaaucaggucaaugugugcccuccugagcuccca

SEQ ID NO: 336986 - RNA, 64 nt, Homo Sapiens
ugucagaauucagugacgugguaggaaagaaagucaggucaagugaugcuuuugagcuuacaca

SEQ ID NO: 336987 - RNA, 64 nt, Homo Sapiens
ccacccauacuaggacaaacacagcucagaucaccaggucaagcaccuaggccuggcuucuccu

SEQ ID NO: 336988 - RNA, 64 nt, Homo Sapiens
ugauggcaucaccguggaggucauuguggucaaccaggucaaugccgggcaccuguucgugcag

SEQ ID NO: 336989 - RNA, 64 nt, Homo Sapiens
uuauuccucuuguuuuauggauaagagauuuguucaggucaaaaguugcaaaacuguucugaag

SEQ ID NO: 336990 - RNA, 64 nt, Homo Sapiens
agguuugggggaggguugccggccucucccaagccaggucaagguauuccuggacuucggagau

SEQ ID NO: 336991 - RNA, 64 nt, Homo Sapiens
accugcccuccugugacuuauuaauuuuuaguagcaggucaaaaggaucucuaguuuuuguggu

SEQ ID NO: 336992 - RNA, 64 nt, Homo Sapiens
cagagcaccuggacagguguggaugccccguggccaggucaaguauggugccuuuaguuggugc

SEQ ID NO: 336993 - RNA, 64 nt, Homo Sapiens
aagaugccaugucaccccugaggguucccaaaaccaggucaagccaagcuaguagaaauauugc

SEQ ID NO: 336994 - RNA, 64 nt, Homo Sapiens
augagguggaucggagauuuaggauuucagaaagcaggucaacuuacuuuccugguugcacaaa

SEQ ID NO: 336995 - RNA, 64 nt, Homo Sapiens
ccagagaucucagaucagaaugucuggaauacaccaggucaacaguugcauuauuccuccaucc

SEQ ID NO: 336996 - RNA, 64 nt, Homo Sapiens
ccuuaagacaucugaagcugccugaaacgggcuucaggucaaacggcugguaauuuauauaauc

SEQ ID NO: 336997 - RNA, 64 nt, Homo Sapiens
gcaaacacacacgcuccagcaucagacagcaguccaggucaaagucgguggaguguucagcaag

SEQ ID NO: 336998 - RNA, 64 nt, Homo Sapiens
uuaugaaaauaauuuuuauacauuccaauggggucaggucaauacccauauucuugaaugucuu

SEQ ID NO: 336999 - RNA, 64 nt, Homo Sapiens
agcucugcugucccauagggacugcgacugggaccaggucaaccacgccaggggggugucacca

SEQ ID NO: 337000 - RNA, 64 nt, Homo Sapiens
caauccugccucaggccccccaaccucugccucccaggucaaagaggcuggagugaaaguggcg

SEQ ID NO: 337001 - RNA, 64 nt, Homo Sapiens
gagagaggugggauugugggacaaugacugucuccaggucaaagggaaauacgccaaaauguug

SEQ ID NO: 337002 - RNA, 64 nt, Homo Sapiens
ucacuugaaagauuuuauuguauaaaaaguuucacaggucaauaaacuuagaggaaaaugagua

SEQ ID NO: 337003 - RNA, 64 nt, Homo Sapiens
aacauuuuuagccacuucauuucuauuuauugaacaggucaaauuugucuuguuauuugugagu

SEQ ID NO: 337004 - RNA, 64 nt, Homo Sapiens
cggucccagaggaggaccuagugacaucaugggacaggucaaagcauuagggccaccuccaugg

SEQ ID NO: 337005 - RNA, 64 nt, Homo Sapiens
acuccagacaguugacaagcaucgcagccccugucaggucaaggaauuuuaaccugggagacuc

SEQ ID NO: 337006 - RNA, 64 nt, Homo Sapiens
acagcuucaaaagagauucuccagucuugagaaacaggucaaggccacggcacccagcagaauu

SEQ ID NO: 337007 - RNA, 64 nt, Homo Sapiens
cugaaaaguggaaucggagccgagguggccgaggcaggucaaaggaggugcaggacugucgggg

SEQ ID NO: 337008 - RNA, 64 nt, Homo Sapiens
cugaagaguauuugaaagcacguugaaacgauuucaggucaacuuuaacguaccucuuaaaauu

SEQ ID NO: 337009 - RNA, 64 nt, Homo Sapiens
ggaacacugcuucagaguauucuagucuuggggccaggucaaaaaaggauaggcacacauucau

SEQ ID NO: 337010 - RNA, 64 nt, Homo Sapiens
gauggcauugaaaaaauauaugguuaagguaaagcaggucaaggguggcauacacuguuauuca

SEQ ID NO: 337011 - RNA, 64 nt, Homo Sapiens
guucugugaggagaggaccccagggggccuuggccaggucaaggcucaucguuacagcaaaccc

SEQ ID NO: 337012 - RNA, 64 nt, Homo Sapiens
uucccaccccaccgugugggauuuguaaaaugggcaggucaaucgaguucucccaccuuugcuc

SEQ ID NO: 337013 - RNA, 64 nt, Homo Sapiens
gugcccggcccauucuaaggguuuucuuugaagacaggucaaaugcuguuaguaaguuucagga

SEQ ID NO: 337014 - RNA, 64 nt, Homo Sapiens
cuagacccaggauguaucuuuaauucuugucauccaggucaacauaugaugcugcuauaagucu

SEQ ID NO: 337015 - RNA, 64 nt, Homo Sapiens
cauugccaaaucuugaacucccuaccuuccaacccaggucaagaaaagcuuuuccagaccccac

SEQ ID NO: 337016 - RNA, 64 nt, Homo Sapiens
ccaagagagaauguguaguuacugauggucaacacaggucaaaauuuuuguccacuaaaaacac

SEQ ID NO: 337017 - RNA, 64 nt, Homo Sapiens; identical to SEQ ID NO: 76961

SEQ ID NO: 337018 - RNA, 64 nt, Homo Sapiens; identical to SEQ ID NO: 76962

SEQ ID NO: 337019 - RNA, 64 nt, Homo Sapiens; identical to SEQ ID NO: 76963

SEQ ID NO: 337020 - RNA, 64 nt, Homo Sapiens; identical to SEQ ID NO: 76964

SEQ ID NO: 337021 - RNA, 64 nt, Homo Sapiens; identical to SEQ ID NO: 76965

SEQ ID NO: 337022 - RNA, 64 nt, Homo Sapiens; identical to SEQ ID NO: 76966

SEQ ID NO: 337023 - RNA, 64 nt, Homo Sapiens; identical to SEQ ID NO: 76967

SEQ ID NO: 337024 - RNA, 64 nt, Homo Sapiens; identical to SEQ ID NO: 76968

SEQ ID NO: 337025 - RNA, 64 nt, Homo Sapiens; identical to SEQ ID NO: 76969

SEQ ID NO: 337026 - RNA, 64 nt, Homo Sapiens; identical to SEQ ID NO: 76970

SEQ ID NO: 337027 - RNA, 64 nt, Homo Sapiens; identical to SEQ ID NO: 76971

SEQ ID NO: 337028 - RNA, 64 nt, Homo Sapiens; identical to SEQ ID NO: 76972

SEQ ID NO: 337029 - RNA, 64 nt, Homo Sapiens; identical to SEQ ID NO: 76973

SEQ ID NO: 337030 - RNA, 64 nt, Homo Sapiens; identical to SEQ ID NO: 76974

SEQ ID NO: 337031 - RNA, 64 nt, Homo Sapiens; identical to SEQ ID NO: 76975

SEQ ID NO: 337032 - RNA, 64 nt, Homo Sapiens; identical to SEQ ID NO: 76976

SEQ ID NO: 337033 - RNA, 64 nt, Homo Sapiens; identical to SEQ ID NO: 76977

SEQ ID NO: 337034 - RNA, 64 nt, Homo Sapiens; identical to SEQ ID NO: 76978

SEQ ID NO: 337035 - RNA, 64 nt, Homo Sapiens; identical to SEQ ID NO: 76979

SEQ ID NO: 337036 - RNA, 64 nt, Homo Sapiens; identical to SEQ ID NO: 76980

SEQ ID NO: 337037 - RNA, 64 nt, Homo Sapiens; identical to SEQ ID NO: 76981

SEQ ID NO: 337038 - RNA, 64 nt, Homo Sapiens; identical to SEQ ID NO: 76982

SEQ ID NO: 337039 - RNA, 64 nt, Homo Sapiens; identical to SEQ ID NO: 76983

SEQ ID NO: 337040 - RNA, 64 nt, Homo Sapiens; identical to SEQ ID NO: 76984

SEQ ID NO: 337041 - RNA, 64 nt, Homo Sapiens; identical to SEQ ID NO: 76985

SEQ ID NO: 337042 - RNA, 64 nt, Homo Sapiens; identical to SEQ ID NO: 76986

SEQ ID NO: 337043 - RNA, 64 nt, Homo Sapiens; identical to SEQ ID NO: 76987

SEQ ID NO: 337044 - RNA, 64 nt, Homo Sapiens; identical to SEQ ID NO: 76988

SEQ ID NO: 337045 - RNA, 64 nt, Homo Sapiens; identical to SEQ ID NO: 76989

SEQ ID NO: 337046 - RNA, 64 nt, Homo Sapiens; identical to SEQ ID NO: 76990

SEQ ID NO: 337047 - RNA, 64 nt, Homo Sapiens; identical to SEQ ID NO: 76991

SEQ ID NO: 337048 - RNA, 64 nt, Homo Sapiens; identical to SEQ ID NO: 76992

SEQ ID NO: 337049 - RNA, 64 nt, Homo Sapiens; identical to SEQ ID NO: 76993

SEQ ID NO: 337050 - RNA, 64 nt, Homo Sapiens; identical to SEQ ID NO: 76994

SEQ ID NO: 337051 - RNA, 64 nt, Homo Sapiens; identical to SEQ ID NO: 76995

SEQ ID NO: 337052 - RNA, 64 nt, Homo Sapiens; identical to SEQ ID NO: 76996

SEQ ID NO: 337053 - RNA, 64 nt, Homo Sapiens; identical to SEQ ID NO: 76997

SEQ ID NO: 337054 - RNA, 64 nt, Homo Sapiens; identical to SEQ ID NO: 76998

SEQ ID NO: 337055 - RNA, 64 nt, Homo Sapiens; identical to SEQ ID NO: 76999

SEQ ID NO: 337056 - RNA, 64 nt, Homo Sapiens; identical to SEQ ID NO: 77000

SEQ ID NO: 337057 - RNA, 64 nt, Homo Sapiens; identical to SEQ ID NO: 77001

SEQ ID NO: 337058 - RNA, 64 nt, Homo Sapiens; identical to SEQ ID NO: 77002

SEQ ID NO: 337059 - RNA, 64 nt, Homo Sapiens; identical to SEQ ID NO: 77003

SEQ ID NO: 337060 - RNA, 64 nt, Homo Sapiens; identical to SEQ ID NO: 77004

SEQ ID NO: 337061 - RNA, 64 nt, Homo Sapiens; identical to SEQ ID NO: 77005

SEQ ID NO: 337062 - RNA, 64 nt, Homo Sapiens; identical to SEQ ID NO: 77006

SEQ ID NO: 337063 - RNA, 64 nt, Homo Sapiens; identical to SEQ ID NO: 77007

SEQ ID NO: 337064 - RNA, 64 nt, Homo Sapiens; identical to SEQ ID NO: 77008

SEQ ID NO: 337065 - RNA, 64 nt, Homo Sapiens; identical to SEQ ID NO: 77009

SEQ ID NO: 337066 - RNA, 64 nt, Homo Sapiens; identical to SEQ ID NO: 77010

SEQ ID NO: 337067 - RNA, 64 nt, Homo Sapiens; identical to SEQ ID NO: 77011

SEQ ID NO: 337068 - RNA, 64 nt, Homo Sapiens; identical to SEQ ID NO: 77012

SEQ ID NO: 337069 - RNA, 64 nt, Homo Sapiens; identical to SEQ ID NO: 77013

SEQ ID NO: 337070 - RNA, 64 nt, Homo Sapiens; identical to SEQ ID NO: 77014

SEQ ID NO: 337071 - RNA, 64 nt, Homo Sapiens; identical to SEQ ID NO: 77015

SEQ ID NO: 337072 - RNA, 64 nt, Homo Sapiens; identical to SEQ ID NO: 77016

SEQ ID NO: 337073 - RNA, 64 nt, Homo Sapiens; identical to SEQ ID NO: 77017

SEQ ID NO: 337074 - RNA, 64 nt, Homo Sapiens; identical to SEQ ID NO: 77018

SEQ ID NO: 337075 - RNA, 64 nt, Homo Sapiens; identical to SEQ ID NO: 77019

SEQ ID NO: 337076 - RNA, 64 nt, Homo Sapiens
cccaagcugauaucagcaaugaggcaaacucaaaugcugagaacucuuagaugccacaggagaa

SEQ ID NO: 337077 - RNA, 64 nt, Homo Sapiens
uccauaaccaucgaugauguauuuccaccaacauugcugagacacaggaguaacuaagauuaua

SEQ ID NO: 337078 - RNA, 64 nt, Homo Sapiens
gcuagaaggagauacagcuccaccacgggagugcugcugagaaggccaccagacuguuauacug

SEQ ID NO: 337079 - RNA, 64 nt, Homo Sapiens
cuugggaacacuguugucauucuuucaucuuuacugcugagauccacagaagauaaagaagaag

SEQ ID NO: 337080 - RNA, 64 nt, Homo Sapiens
gcgaaacccuguguguggggugucuuguacagccugcugagaugaaaagagccauacugaaaca

SEQ ID NO: 337081 - RNA, 64 nt, Homo Sapiens
guggaugcagccucacagauucacuguauacucuugcugagaaugagcagauacaaccaaugca

SEQ ID NO: 337082 - RNA, 64 nt, Homo Sapiens
ucaguggugcaaugucuuuacaggaagguugagcugcugagauuaccagaguaucuggauuacc

SEQ ID NO: 337083 - RNA, 64 nt, Homo Sapiens
ggucugggugugaauuccaccuucccuccugcagugcugagaggcagcgaggacggagaggaca

SEQ ID NO: 337084 - RNA, 64 nt, Homo Sapiens
agaugucaugggggcaccugcucucccugauagaugcugagagcauccagaaacuuccagacca

SEQ ID NO: 337085 - RNA, 64 nt, Homo Sapiens
accucaucguccaccugccucggccuccccaaagugcugagauuaggcguuagccaccgcgccc

SEQ ID NO: 337086 - RNA, 64 nt, Homo Sapiens
aggccauucgacgccuucuccaaggggucugauuugcugagacaccagcuucaccuucuuaaca

SEQ ID NO: 337087 - RNA, 64 nt, Homo Sapiens
guggucaacuuuaguaauauaaaaggcugcuggaugcugagauuccacauaacacaugguuguc

SEQ ID NO: 337088 - RNA, 64 nt, Homo Sapiens
aggaggggagcgucugggaacugcgccugcugccugcugagaugcagcaucccuucccacaugc

SEQ ID NO: 337089 - RNA, 64 nt, Homo Sapiens
gcagaugugagccaccgugcuuggccucccaaagugcugagauuccucaagcaauccaccugcc

SEQ ID NO: 337090 - RNA, 64 nt, Homo Sapiens
uugucugcacagaaagucccaguacaacuuccauugcugagaaaauccucagaggacuuuccca

SEQ ID NO: 337091 - RNA, 64 nt, Homo Sapiens
cugaaucugagguuuuauaaaucccucaaacgauugcugagagccugauuguggaaagaaguga

SEQ ID NO: 337092 - RNA, 64 nt, Homo Sapiens
ggucugauauucgugcuaccuauuuauugcuggaugcugagaaugagaguguuuauaauuaugu

SEQ ID NO: 337093 - RNA, 64 nt, Homo Sapiens
uagagaaaagagaccauguucaggugauggggcaugcugagaaaagguggguggaccaguacuc

SEQ ID NO: 337094 - RNA, 64 nt, Homo Sapiens
ggggcugccccaacccacccccguucuuuguacgugcugagacagccacuagaagaucuuccuc

SEQ ID NO: 337095 - RNA, 64 nt, Homo Sapiens
agccaagccccagugacccggagagcuggccugaugcugagaguguguccuccuggggcuuuag

SEQ ID NO: 337096 - RNA, 64 nt, Homo Sapiens
uauuucuuaugcuuuuuacuucuuuuacauaauaugcugagaauacaagguuuucacugcuuuu

SEQ ID NO: 337097 - RNA, 64 nt, Homo Sapiens
uagugauuauauauuuuucuagggauugauaaaaugcugagaacuucuagaagaagagaaacaa

SEQ ID NO: 337098 - RNA, 64 nt, Homo Sapiens
ccucaggugauccaccugccucagccucccaaagugcugagauuacaggcaugagccaccacgc

SEQ ID NO: 337099 - RNA, 64 nt, Homo Sapiens
gcuucucccaucguuagacaucugccaguaagccugcugagagaagccucagcccacucauacc

SEQ ID NO: 337100 - RNA, 64 nt, Homo Sapiens
gugagaaggaauucagggagagcaaaggagccagugcugagaugcugcuguguugguugaggaa

SEQ ID NO: 337101 - RNA, 64 nt, Homo Sapiens
uuccagagugugcacuuccagcccacccgggcagugcugagagggaggaggagaacaaggaugg

SEQ ID NO: 337102 - RNA, 64 nt, Homo Sapiens
aagcacaaagaauugauucauguucaucaauaccugcugagaguacugucccaggaauauccag

SEQ ID NO: 337103 - RNA, 64 nt, Homo Sapiens
aacugacugaacuagagcuugcagugaaguguucugcugagacugagcaccuuacagauauuuu

SEQ ID NO: 337104 - RNA, 64 nt, Homo Sapiens
agggaggguacgccaggcgagcccagggcacagaugcugagacagccucuccuucucagugcag

SEQ ID NO: 337105 - RNA, 64 nt, Homo Sapiens
gcuucaccccugccaggcaagcccagggcauagaugcugagacagccucucccucucagugcag

SEQ ID NO: 337106 - RNA, 64 nt, Homo Sapiens
uagcauguuucaaagcugaacucuacagagcgagugcugagacaguauuuaggguuucugggag

SEQ ID NO: 337107 - RNA, 64 nt, Homo Sapiens
cauccuccccccaaccuccugacccauucauaaaugcugagaaugucucucaugggaacacugu

SEQ ID NO: 337108 - RNA, 64 nt, Homo Sapiens
gugggcauuuccuacauuccuccuuguuugccgcugcugagauugcaguauuuauugcaaugua

SEQ ID NO: 337109 - RNA, 64 nt, Homo Sapiens
aacgcgagcccaaagugccaguagaaucaggguccucgggcaugggguuugguuuuugcugcug

SEQ ID NO: 337110 - RNA, 64 nt, Homo Sapiens
caggaaagccuggccagggcucugccugguuagacucgggcaccucgccagggcucccuucucc

SEQ ID NO: 337111 - RNA, 64 nt, Homo Sapiens
cgugucugcugagagcaaccagaccuuccauguccucgggcagcugcaacuccccgcgagaccc

SEQ ID NO: 337112 - RNA, 64 nt, Homo Sapiens
gcggucucugucuucagggauugugccugcgucccucgggcaccugggcccccccgcuuggcuc

SEQ ID NO: 337113 - RNA, 64 nt, Homo Sapiens; identical to SEQ ID NO: 163552

SEQ ID NO: 337114 - RNA, 64 nt, Homo Sapiens; identical to SEQ ID NO: 163553

SEQ ID NO: 337115 - RNA, 64 nt, Homo Sapiens; identical to SEQ ID NO: 163554

SEQ ID NO: 337116 - RNA, 64 nt, Homo Sapiens; identical to SEQ ID NO: 163555

SEQ ID NO: 337117 - RNA, 64 nt, Homo Sapiens; identical to SEQ ID NO: 163556

SEQ ID NO: 337118 - RNA, 64 nt, Homo Sapiens; identical to SEQ ID NO: 163557

SEQ ID NO: 337119 - RNA, 64 nt, Homo Sapiens; identical to SEQ ID NO: 163558

SEQ ID NO: 337120 - RNA, 64 nt, Homo Sapiens; identical to SEQ ID NO: 163559

SEQ ID NO: 337121 - RNA, 64 nt, Homo Sapiens; identical to SEQ ID NO: 163560

SEQ ID NO: 337122 - RNA, 64 nt, Homo Sapiens; identical to SEQ ID NO: 163561

SEQ ID NO: 337123 - RNA, 64 nt, Homo Sapiens; identical to SEQ ID NO: 163562

SEQ ID NO: 337124 - RNA, 64 nt, Homo Sapiens; identical to SEQ ID NO: 163563

SEQ ID NO: 337125 - RNA, 64 nt, Homo Sapiens; identical to SEQ ID NO: 163564

SEQ ID NO: 337126 - RNA, 64 nt, Homo Sapiens; identical to SEQ ID NO: 163565

SEQ ID NO: 337127 - RNA, 64 nt, Homo Sapiens; identical to SEQ ID NO: 163566

SEQ ID NO: 337128 - RNA, 64 nt, Homo Sapiens; identical to SEQ ID NO: 163567

SEQ ID NO: 337129 - RNA, 64 nt, Homo Sapiens; identical to SEQ ID NO: 163568

SEQ ID NO: 337130 - RNA, 64 nt, Homo Sapiens; identical to SEQ ID NO: 163569

SEQ ID NO: 337131 - RNA, 64 nt, Homo Sapiens; identical to SEQ ID NO: 163570

SEQ ID NO: 337132 - RNA, 64 nt, Homo Sapiens; identical to SEQ ID NO: 163571

SEQ ID NO: 337133 - RNA, 64 nt, Homo Sapiens; identical to SEQ ID NO: 163572

SEQ ID NO: 337134 - RNA, 64 nt, Homo Sapiens; identical to SEQ ID NO: 163573

SEQ ID NO: 337135 - RNA, 64 nt, Homo Sapiens; identical to SEQ ID NO: 163574

SEQ ID NO: 337136 - RNA, 64 nt, Homo Sapiens; identical to SEQ ID NO: 163575

SEQ ID NO: 337137 - RNA, 64 nt, Homo Sapiens; identical to SEQ ID NO: 163576

SEQ ID NO: 337138 - RNA, 64 nt, Homo Sapiens; identical to SEQ ID NO: 163577

SEQ ID NO: 337139 - RNA, 64 nt, Homo Sapiens; identical to SEQ ID NO: 99898

SEQ ID NO: 337140 - RNA, 64 nt, Homo Sapiens; identical to SEQ ID NO: 99899

SEQ ID NO: 337141 - RNA, 64 nt, Homo Sapiens; identical to SEQ ID NO: 99900

SEQ ID NO: 337142 - RNA, 64 nt, Homo Sapiens; identical to SEQ ID NO: 99901

SEQ ID NO: 337143 - RNA, 64 nt, Homo Sapiens; identical to SEQ ID NO: 99902

SEQ ID NO: 337144 - RNA, 64 nt, Homo Sapiens; identical to SEQ ID NO: 99903

SEQ ID NO: 337145 - RNA, 64 nt, Homo Sapiens; identical to SEQ ID NO: 99904

SEQ ID NO: 337146 - RNA, 64 nt, Homo Sapiens; identical to SEQ ID NO: 99905

SEQ ID NO: 337147 - RNA, 64 nt, Homo Sapiens; identical to SEQ ID NO: 99906

SEQ ID NO: 337148 - RNA, 64 nt, Homo Sapiens; identical to SEQ ID NO: 99907

SEQ ID NO: 337149 - RNA, 64 nt, Homo Sapiens; identical to SEQ ID NO: 99908

SEQ ID NO: 337150 - RNA, 64 nt, Homo Sapiens; identical to SEQ ID NO: 99909

SEQ ID NO: 337151 - RNA, 64 nt, Homo Sapiens; identical to SEQ ID NO: 99910

SEQ ID NO: 337152 - RNA, 64 nt, Homo Sapiens; identical to SEQ ID NO: 99911

SEQ ID NO: 337153 - RNA, 64 nt, Homo Sapiens; identical to SEQ ID NO: 99912

SEQ ID NO: 337154 - RNA, 64 nt, Homo Sapiens; identical to SEQ ID NO: 99913

SEQ ID NO: 337155 - RNA, 64 nt, Homo Sapiens; identical to SEQ ID NO: 99914

SEQ ID NO: 337156 - RNA, 64 nt, Homo Sapiens; identical to SEQ ID NO: 99915

SEQ ID NO: 337157 - RNA, 64 nt, Homo Sapiens; identical to SEQ ID NO: 99916

SEQ ID NO: 337158 - RNA, 64 nt, Homo Sapiens; identical to SEQ ID NO: 99917

SEQ ID NO: 337159 - RNA, 64 nt, Homo Sapiens; identical to SEQ ID NO: 99918

SEQ ID NO: 337160 - RNA, 64 nt, Homo Sapiens; identical to SEQ ID NO: 99919

SEQ ID NO: 337161 - RNA, 64 nt, Homo Sapiens; identical to SEQ ID NO: 99920

SEQ ID NO: 337162 - RNA, 64 nt, Homo Sapiens; identical to SEQ ID NO: 99921

SEQ ID NO: 337163 - RNA, 64 nt, Homo Sapiens; identical to SEQ ID NO: 99922

SEQ ID NO: 337164 - RNA, 64 nt, Homo Sapiens; identical to SEQ ID NO: 99923

SEQ ID NO: 337165 - RNA, 64 nt, Homo Sapiens; identical to SEQ ID NO: 99924

SEQ ID NO: 337166 - RNA, 64 nt, Homo Sapiens; identical to SEQ ID NO: 99925

SEQ ID NO: 337167 - RNA, 64 nt, Homo Sapiens; identical to SEQ ID NO: 99926

SEQ ID NO: 337168 - RNA, 64 nt, Homo Sapiens; identical to SEQ ID NO: 99927

SEQ ID NO: 337169 - RNA, 64 nt, Homo Sapiens; identical to SEQ ID NO: 99928

SEQ ID NO: 337170 - RNA, 64 nt, Homo Sapiens; identical to SEQ ID NO: 99929

SEQ ID NO: 337171 - RNA, 64 nt, Homo Sapiens; identical to SEQ ID NO: 99930

SEQ ID NO: 337172 - RNA, 64 nt, Homo Sapiens; identical to SEQ ID NO: 99931

SEQ ID NO: 337173 - RNA, 64 nt, Homo Sapiens; identical to SEQ ID NO: 99932

SEQ ID NO: 337174 - RNA, 64 nt, Homo Sapiens; identical to SEQ ID NO: 99933

SEQ ID NO: 337175 - RNA, 64 nt, Homo Sapiens; identical to SEQ ID NO: 99934

SEQ ID NO: 337176 - RNA, 64 nt, Homo Sapiens; identical to SEQ ID NO: 99935

SEQ ID NO: 337177 - RNA, 64 nt, Homo Sapiens; identical to SEQ ID NO: 99936

SEQ ID NO: 337178 - RNA, 64 nt, Homo Sapiens; identical to SEQ ID NO: 99937

SEQ ID NO: 337179 - RNA, 64 nt, Homo Sapiens; identical to SEQ ID NO: 99938

SEQ ID NO: 337180 - RNA, 64 nt, Homo Sapiens; identical to SEQ ID NO: 99939

SEQ ID NO: 337181 - RNA, 64 nt, Homo Sapiens; identical to SEQ ID NO: 99940

SEQ ID NO: 337182 - RNA, 64 nt, Homo Sapiens; identical to SEQ ID NO: 99941

SEQ ID NO: 337183 - RNA, 64 nt, Homo Sapiens; identical to SEQ ID NO: 99942

SEQ ID NO: 337184 - RNA, 64 nt, Homo Sapiens; identical to SEQ ID NO: 99943

SEQ ID NO: 337185 - RNA, 64 nt, Homo Sapiens; identical to SEQ ID NO: 99944

SEQ ID NO: 337186 - RNA, 64 nt, Homo Sapiens; identical to SEQ ID NO: 99945

SEQ ID NO: 337187 - RNA, 64 nt, Homo Sapiens; identical to SEQ ID NO: 99946

SEQ ID NO: 337188 - RNA, 64 nt, Homo Sapiens
gcaucucacucccaagugcccccccuuucugugacuccuugaagccuuuacuuuuuuuuuuuuu

SEQ ID NO: 337189 - RNA, 64 nt, Homo Sapiens
uccugcuuuacuguagcucuuuuucuuccuugcacuccuugaucuuugggcuuccgugaugucc

SEQ ID NO: 337190 - RNA, 64 nt, Homo Sapiens
uacaaagcagauagucccugaaccacagucgugccuccuugaaacaagccauucuacugugcua

SEQ ID NO: 337191 - RNA, 64 nt, Homo Sapiens
cacuuaaauggagguguccacaucuuaauuguuucuccuugacacauuucucaauccacgaagc

SEQ ID NO: 337192 - RNA, 64 nt, Homo Sapiens
aaacuuuuauuuuugucuaaccaucauaaccuuucuccuugagacaaagcagaaaauaucauca

SEQ ID NO: 337193 - RNA, 64 nt, Homo Sapiens
cauaagcaccucccccccaaccuauagcaaagggcuccuugauucauaauaguuaggauaguuu

SEQ ID NO: 337194 - RNA, 64 nt, Homo Sapiens
uuccaucuugacgaaggcauguuucucuuucuuccuccuugauucccuaagccuggccccaaag

SEQ ID NO: 337195 - RNA, 64 nt, Homo Sapiens
cccagugcuguaaguaauagcccaaggacccccucuccuugacccccacauucucccagccccc

SEQ ID NO: 337196 - RNA, 64 nt, Homo Sapiens
ccucuauuaaaaaucacugcccuaacuacacuuccuccuugagggaauagaaauggaccuuucu

SEQ ID NO: 337197 - RNA, 64 nt, Homo Sapiens
cuugguaagccuggaugugacagacaccucggcucuccuugaauaagaaagccagcagaacucu

SEQ ID NO: 337198 - RNA, 64 nt, Homo Sapiens
gaucucccucuaggaugugauagaucuggucccucuccuugaacuaccccuccacacgcucuag

SEQ ID NO: 337199 - RNA, 64 nt, Homo Sapiens
auuggcagggagaagcauuguggggcaauuguuccuccuugacaauguagcaauaaauagaugc

SEQ ID NO: 337200 - RNA, 64 nt, Homo Sapiens
agaacaagugcccuuggggaacccucccagagaacuccuugaggcuagcucccugcacggccgc

SEQ ID NO: 337201 - RNA, 64 nt, Homo Sapiens
ugaccacuccaguuaggauggccagugcccagcucuccuugagcuucaggaaaacuccuguagc

SEQ ID NO: 337202 - RNA, 64 nt, Homo Sapiens
cuuuucaguguagaccaccagcuccccuccccaucuccuugagucagcagacuguccaaugugc

SEQ ID NO: 337203 - RNA, 64 nt, Homo Sapiens
cuguuuccuucucuuguguuaucugauagcgucccuccuugagcucaucagaaagguuuuauga

SEQ ID NO: 337204 - RNA, 64 nt, Homo Sapiens
uuuauaaacagauuuguacccucgugccuuuucucuccuugagcucagaguugucucaccccuu

SEQ ID NO: 337205 - RNA, 64 nt, Homo Sapiens
uuucaagaugaaauaaggaguuuuuuaauguuugcuccuugaguauauauauaaauagggaauu

SEQ ID NO: 337206 - RNA, 64 nt, Homo Sapiens
agcauggcagugcugaccauuucacccacuuggccuccuugaggaauagggauggggagcccuc

SEQ ID NO: 337207 - RNA, 64 nt, Homo Sapiens
uucuuaucuggaaagagcacggaaaugcagcggccuccuugaagauccugagugagucaccugc

SEQ ID NO: 337208 - RNA, 64 nt, Homo Sapiens; identical to SEQ ID NO: 94067

SEQ ID NO: 337209 - RNA, 64 nt, Homo Sapiens; identical to SEQ ID NO: 94068

SEQ ID NO: 337210 - RNA, 64 nt, Homo Sapiens; identical to SEQ ID NO: 94069

SEQ ID NO: 337211 - RNA, 64 nt, Homo Sapiens; identical to SEQ ID NO: 94070

SEQ ID NO: 337212 - RNA, 64 nt, Homo Sapiens; identical to SEQ ID NO: 94071

SEQ ID NO: 337213 - RNA, 64 nt, Homo Sapiens; identical to SEQ ID NO: 94072

SEQ ID NO: 337214 - RNA, 64 nt, Homo Sapiens; identical to SEQ ID NO: 94073

SEQ ID NO: 337215 - RNA, 64 nt, Homo Sapiens; identical to SEQ ID NO: 94074

SEQ ID NO: 337216 - RNA, 64 nt, Homo Sapiens; identical to SEQ ID NO: 94075

SEQ ID NO: 337217 - RNA, 64 nt, Homo Sapiens; identical to SEQ ID NO: 94076

SEQ ID NO: 337218 - RNA, 64 nt, Homo Sapiens; identical to SEQ ID NO: 94077

SEQ ID NO: 337219 - RNA, 64 nt, Homo Sapiens; identical to SEQ ID NO: 94078

SEQ ID NO: 337220 - RNA, 64 nt, Homo Sapiens; identical to SEQ ID NO: 94079

SEQ ID NO: 337221 - RNA, 64 nt, Homo Sapiens; identical to SEQ ID NO: 94080

SEQ ID NO: 337222 - RNA, 64 nt, Homo Sapiens; identical to SEQ ID NO: 94081

SEQ ID NO: 337223 - RNA, 64 nt, Homo Sapiens; identical to SEQ ID NO: 94082

SEQ ID NO: 337224 - RNA, 64 nt, Homo Sapiens; identical to SEQ ID NO: 94083

SEQ ID NO: 337225 - RNA, 64 nt, Homo Sapiens; identical to SEQ ID NO: 94084

SEQ ID NO: 337226 - RNA, 64 nt, Homo Sapiens; identical to SEQ ID NO: 94085

SEQ ID NO: 337227 - RNA, 64 nt, Homo Sapiens; identical to SEQ ID NO: 94086

SEQ ID NO: 337228 - RNA, 64 nt, Homo Sapiens; identical to SEQ ID NO: 94087

SEQ ID NO: 337229 - RNA, 64 nt, Homo Sapiens; identical to SEQ ID NO: 94088

SEQ ID NO: 337230 - RNA, 64 nt, Homo Sapiens; identical to SEQ ID NO: 94089

SEQ ID NO: 337231 - RNA, 53 nt, Homo Sapiens; identical to SEQ ID NO: 94090

SEQ ID NO: 337232 - RNA, 64 nt, Homo Sapiens; identical to SEQ ID NO: 94091

SEQ ID NO: 337233 - RNA, 64 nt, Homo Sapiens; identical to SEQ ID NO: 94092

SEQ ID NO: 337234 - RNA, 64 nt, Homo Sapiens; identical to SEQ ID NO: 94093

SEQ ID NO: 337235 - RNA, 64 nt, Homo Sapiens; identical to SEQ ID NO: 94094

SEQ ID NO: 337236 - RNA, 64 nt, Homo Sapiens; identical to SEQ ID NO: 94095

SEQ ID NO: 337237 - RNA, 64 nt, Homo Sapiens; identical to SEQ ID NO: 94096

SEQ ID NO: 337238 - RNA, 64 nt, Homo Sapiens; identical to SEQ ID NO: 94097

SEQ ID NO: 337239 - RNA, 64 nt, Homo Sapiens; identical to SEQ ID NO: 94098

SEQ ID NO: 337240 - RNA, 64 nt, Homo Sapiens; identical to SEQ ID NO: 94099

SEQ ID NO: 337241 - RNA, 64 nt, Homo Sapiens; identical to SEQ ID NO: 94100

SEQ ID NO: 337242 - RNA, 64 nt, Homo Sapiens; identical to SEQ ID NO: 94101

SEQ ID NO: 337243 - RNA, 64 nt, Homo Sapiens; identical to SEQ ID NO: 94102

SEQ ID NO: 337244 - RNA, 64 nt, Homo Sapiens; identical to SEQ ID NO: 81735

SEQ ID NO: 337245 - RNA, 64 nt, Homo Sapiens; identical to SEQ ID NO: 81736

SEQ ID NO: 337246 - RNA, 64 nt, Homo Sapiens; identical to SEQ ID NO: 81737

SEQ ID NO: 337247 - RNA, 64 nt, Homo Sapiens; identical to SEQ ID NO: 81738

SEQ ID NO: 337248 - RNA, 64 nt, Homo Sapiens; identical to SEQ ID NO: 81739

SEQ ID NO: 337249 - RNA, 64 nt, Homo Sapiens; identical to SEQ ID NO: 81740

SEQ ID NO: 337250 - RNA, 64 nt, Homo Sapiens; identical to SEQ ID NO: 81741

SEQ ID NO: 337251 - RNA, 64 nt, Homo Sapiens; identical to SEQ ID NO: 81742

SEQ ID NO: 337252 - RNA, 63 nt, Homo Sapiens
ucaggcucagcaugaauuuucaguucugcugucacuuggaaguuugugcagacauaccauuuu

SEQ ID NO: 337253 - RNA, 63 nt, Homo Sapiens
cuaacauucuguaagagguuaaguuacacuaagacuuggaacaaagcagcucacuacgauauc

SEQ ID NO: 337254 - RNA, 63 nt, Homo Sapiens
aaugcauuaaucucauguuuuaauguguuaauuacuuggaauagacaaguuuaacuuuauuuu

SEQ ID NO: 337255 - RNA, 63 nt, Homo Sapiens
auuguucaucucuuaggcuugcugaaauggaaaacuuggaagaggaaaaacaccagaaagcuu

SEQ ID NO: 337256 - RNA, 63 nt, Homo Sapiens
guuucaagacuugauacugcgaugggucuccgcacuuggaaagccauaguuauuuacuugaaa

SEQ ID NO: 337257 - RNA, 63 nt, Homo Sapiens
agaaagaaacacucaacaaugguuccuuuuucaacuuggaaaagguucaagagacacugcuug

SEQ ID NO: 337258 - RNA, 63 nt, Homo Sapiens
aaguuaucuugguacaacaccguguguauauacacuuggaagcuuaaaaagguguuuugucug

SEQ ID NO: 337259 - RNA, 63 nt, Homo Sapiens
auugcucauaacuuaccaagaggcuaauacuaaacuuggaaaauuguuuaaguauguuuuauc

SEQ ID NO: 337260 - RNA, 63 nt, Homo Sapiens
agcugaaagcuguaauauguuucaauaacauucacuuggaaucuucauuugggggcuaugugu

SEQ ID NO: 337261 - RNA, 63 nt, Homo Sapiens
uccguuugucuacacuguccuuucuuuugguggacuuggaauccucagaacugaaggcaauua

SEQ ID NO: 337262 - RNA, 63 nt, Homo Sapiens
guguaccugaaagugagggggagaauggaaccaacuuggaaaacacucugcaggauauuaucc

SEQ ID NO: 337263 - RNA, 63 nt, Homo Sapiens
aggauuaagaaacucacucaaaaccgcucaacuacuuggaaacugaacaaccugcuccugaau

SEQ ID NO: 337264 - RNA, 63 nt, Homo Sapiens
ggccugucacccugcuuucccugccucuacuugacuuggaauuggcugaagacuacacaggaa

SEQ ID NO: 337265 - RNA, 63 nt, Homo Sapiens
acacaggaaugcaucguucccacuccccaucccacuuggaaaacuccaaggggguguggcuuc

SEQ ID NO: 337266 - RNA, 63 nt, Homo Sapiens
ucuccuuuuaguguuuauauucagagaacagacacuuggaauuuggcgagugauugcuuuccu

SEQ ID NO: 337267 - RNA, 63 nt, Homo Sapiens
aagaacucuacuuuagccuauuuauguccccaaacuuggaaacgaugcuuuuaaaguuuuaua

SEQ ID NO: 337268 - RNA, 64 nt, Homo Sapiens; identical to SEQ ID NO: 175864

SEQ ID NO: 337269 - RNA, 64 nt, Homo Sapiens; identical to SEQ ID NO: 175865

SEQ ID NO: 337270 - RNA, 64 nt, Homo Sapiens; identical to SEQ ID NO: 175866

SEQ ID NO: 337271 - RNA, 64 nt, Homo Sapiens; identical to SEQ ID NO: 175867

SEQ ID NO: 337272 - RNA, 64 nt, Homo Sapiens; identical to SEQ ID NO: 175868

SEQ ID NO: 337273 - RNA, 64 nt, Homo Sapiens; identical to SEQ ID NO: 175869

SEQ ID NO: 337274 - RNA, 64 nt, Homo Sapiens; identical to SEQ ID NO: 175870

SEQ ID NO: 337275 - RNA, 64 nt, Homo Sapiens; identical to SEQ ID NO: 175871

SEQ ID NO: 337276 - RNA, 64 nt, Homo Sapiens; identical to SEQ ID NO: 175872

SEQ ID NO: 337277 - RNA, 64 nt, Homo Sapiens; identical to SEQ ID NO: 175873

SEQ ID NO: 337278 - RNA, 64 nt, Homo Sapiens; identical to SEQ ID NO: 175874

SEQ ID NO: 337279 - RNA, 64 nt, Homo Sapiens; identical to SEQ ID NO: 175875

SEQ ID NO: 337280 - RNA, 64 nt, Homo Sapiens; identical to SEQ ID NO: 175876

SEQ ID NO: 337281 - RNA, 64 nt, Homo Sapiens; identical to SEQ ID NO: 175877

SEQ ID NO: 337282 - RNA, 64 nt, Homo Sapiens; identical to SEQ ID NO: 175878

SEQ ID NO: 337283 - RNA, 64 nt, Homo Sapiens; identical to SEQ ID NO: 175879

SEQ ID NO: 337284 - RNA, 64 nt, Homo Sapiens; identical to SEQ ID NO: 175880

SEQ ID NO: 337285 - RNA, 55 nt, Homo Sapiens; identical to SEQ ID NO: 175881

SEQ ID NO: 337286 - RNA, 64 nt, Homo Sapiens; identical to SEQ ID NO: 175882

SEQ ID NO: 337287 - RNA, 64 nt, Homo Sapiens; identical to SEQ ID NO: 175883

SEQ ID NO: 337288 - RNA, 64 nt, Homo Sapiens; identical to SEQ ID NO: 175884

SEQ ID NO: 337289 - RNA, 64 nt, Homo Sapiens; identical to SEQ ID NO: 175885

SEQ ID NO: 337290 - RNA, 64 nt, Homo Sapiens; identical to SEQ ID NO: 175886

SEQ ID NO: 337291 - RNA, 64 nt, Homo Sapiens; identical to SEQ ID NO: 175887

SEQ ID NO: 337292 - RNA, 64 nt, Homo Sapiens; identical to SEQ ID NO: 175888

SEQ ID NO: 337293 - RNA, 64 nt, Homo Sapiens; identical to SEQ ID NO: 175889

SEQ ID NO: 337294 - RNA, 64 nt, Homo Sapiens; identical to SEQ ID NO: 175890

SEQ ID NO: 337295 - RNA, 64 nt, Homo Sapiens; identical to SEQ ID NO: 175891

SEQ ID NO: 337296 - RNA, 64 nt, Homo Sapiens; identical to SEQ ID NO: 175892

SEQ ID NO: 337297 - RNA, 64 nt, Homo Sapiens; identical to SEQ ID NO: 175893

SEQ ID NO: 337298 - RNA, 64 nt, Homo Sapiens; identical to SEQ ID NO: 175894

SEQ ID NO: 337299 - RNA, 64 nt, Homo Sapiens; identical to SEQ ID NO: 173405

SEQ ID NO: 337300 - RNA, 64 nt, Homo Sapiens; identical to SEQ ID NO: 173406

SEQ ID NO: 337301 - RNA, 64 nt, Homo Sapiens; identical to SEQ ID NO: 173407

SEQ ID NO: 337302 - RNA, 64 nt, Homo Sapiens; identical to SEQ ID NO: 173408

SEQ ID NO: 337303 - RNA, 64 nt, Homo Sapiens; identical to SEQ ID NO: 173409

SEQ ID NO: 337304 - RNA, 64 nt, Homo Sapiens; identical to SEQ ID NO: 173410

SEQ ID NO: 337305 - RNA, 64 nt, Homo Sapiens
cagggcagugcugcugcagagcuagaaggcccugcagcuacagcugcuucauucccugcauuag

SEQ ID NO: 337306 - RNA, 64 nt, Homo Sapiens
uacacugagcgggcuacagagcuagaaggcccugcagcuacagcugcuucauucccugcauuag

SEQ ID NO: 337307 - RNA, 64 nt, Homo Sapiens
ggcagcugaaggagcaaaggaagaggagcaggcacagcuacaugcuuggcuuuagccagugccg

SEQ ID NO: 337308 - RNA, 64 nt, Homo Sapiens
cagaggcugaacaccugcggccgagguggagcagcagcuacaagggagcccccagcagggcccu

SEQ ID NO: 337309 - RNA, 64 nt, Homo Sapiens
cagaggcugaacaccugcggccgagguggaacagcagcuacaagggagcccccagcagggcccu

SEQ ID NO: 337310 - RNA, 64 nt, Homo Sapiens
guuuccacaggguaauucacuccacacuucacgucagcuacauacccccuuucuaccacccccc

SEQ ID NO: 337311 - RNA, 64 nt, Homo Sapiens
uuucauaacuuuguaguacaagcucauggguuuucagcuacauuacgcugcagaaaugagcugg

SEQ ID NO: 337312 - RNA, 64 nt, Homo Sapiens
caaucagccgauuuccugagcuguucuaaaggcccagcuacagcacccagcuaaagucaccugc

SEQ ID NO: 337313 - RNA, 64 nt, Homo Sapiens
ucccuggcuguuucuagagauauuuccagagacccagcuacaguuggacagacuguuucucagu

SEQ ID NO: 337314 - RNA, 64 nt, Homo Sapiens
acauacccgagacugggaaguccguuuucacgcugcugauaaagguaccaauuuacuguauuag

SEQ ID NO: 337315 - RNA, 64 nt, Homo Sapiens
acguacccgagacugggaagucuguauuaaugcugcugauaaaggcuucaagcaucuguauuag

SEQ ID NO: 337316 - RNA, 64 nt, Homo Sapiens
gguucuuuuucuuuucuaugauacacacagccacgcugauaauaugcaaaugaacauuuuccuu

SEQ ID NO: 337317 - RNA, 64 nt, Homo Sapiens
aguagaaugugugguuuuugcaaaugcuuuaacagcugauaaaaauuuuacauuuguaaaauua

SEQ ID NO: 337318 - RNA, 64 nt, Homo Sapiens
gauuccuucaacuggcuacugagucaugauccuugcugauaaauauaaccaucaauaaagaagc

SEQ ID NO: 337319 - RNA, 64 nt, Homo Sapiens
uaucaauucaccagccuccuuguucccuguggcugcugauaacccaacauuccaucucuacccu

SEQ ID NO: 337320 - RNA, 64 nt, Homo Sapiens
uauauaucugguuguauuagucuguuuucacgcugcugauaaagacauaccugagaccaggaag

SEQ ID NO: 337321 - RNA, 64 nt, Homo Sapiens
uuagcaguuuacuguauuagucuguuuucacacugcugauaaagacauuccucaagauugugaa

SEQ ID NO: 337322 - RNA, 64 nt, Homo Sapiens
uaggaugugacuugcguuuugaguagaggggaaggcugauaacggcguaagaugaaguggcccu

SEQ ID NO: 337323 - RNA, 64 nt, Homo Sapiens
uaggccacacucuauuucaaggcauuuucuuucagcugauaagguguccuccugaagccaagua

SEQ ID NO: 337324 - RNA, 64 nt, Homo Sapiens
ugggauuacaggcaugagccaccgugccgagccuuccuugaaguuuuuuguuugguuuugauuu

SEQ ID NO: 337325 - RNA, 64 nt, Homo Sapiens
cugagauagcaggugugagucaucaugcccagccuccuugaaguuuacuaacaauugggauaac

SEQ ID NO: 337326 - RNA, 64 nt, Homo Sapiens
aguacucuggauguaaaagcucaaaaauugugauuccuugaacguucacuaaaucuucaagcaa

SEQ ID NO: 337327 - RNA, 64 nt, Homo Sapiens
auuaaucagauuugaaugaggaaugcuucccacauccuugaaagaaaaacuguggcuuacguuu

SEQ ID NO: 337328 - RNA, 64 nt, Homo Sapiens
ggaauaauauaauugguauggccauuagguucaguccuugaagauaagaaacuuguucucuguu

SEQ ID NO: 337329 - RNA, 64 nt, Homo Sapiens
uuuagcugaucucauccuaagcaugcuuuauuuuuccuugaaagcuagguauuuaucaacugca

SEQ ID NO: 337330 - RNA, 64 nt, Homo Sapiens
uuuccaagcaauuucucuguaaacugcuuugaccuccuugaacuuuagugaauaauuaaaguac

SEQ ID NO: 337331 - RNA, 64 nt, Homo Sapiens
cuugcuuuuguguguuagcaaaagaacaaauguuuccuugaauggcucauuaauauuucaagau

SEQ ID NO: 337332 - RNA, 64 nt, Homo Sapiens
aaugacucaaauuuucaaauaaaaaaaaaaaaaauccuugaacucacagugagacuccaccuca

SEQ ID NO: 337333 - RNA, 64 nt, Homo Sapiens
agagggcacuggaagacaaucagaauuccaggaguccuugaagcuaaaggcaaugagaaacaag

SEQ ID NO: 337334 - RNA, 64 nt, Homo Sapiens
uaucaucguguguacuuggcaaagucaguuguauuccuugaagcuccuugaaaauucauaucau

SEQ ID NO: 337335 - RNA, 57 nt, Homo Sapiens
uucauaucauaaagucaguugauacguuccuugaaaaauucuucaaaauccauauaa

SEQ ID NO: 337336 - RNA, 64 nt, Homo Sapiens
uaguuuuugauguuuugugaguaaauggaaauaauccuugaaaauaaauggaaaaaccuauuag

SEQ ID NO: 337337 - RNA, 64 nt, Homo Sapiens
gcucaagacuguagcaugguucaaauugcagacuuccuugaaagugagguaaagaaaauaauuu

SEQ ID NO: 337338 - RNA, 64 nt, Homo Sapiens
ugugagauuuaaaaauuuuugcuguagaaaauauuccuugaagaucuacuuuuucaaaugauau

SEQ ID NO: 337339 - RNA, 64 nt, Homo Sapiens
cuucucaagcucuuaugacuaugugcggaagauuuccuugaaauaccugauuggaccgugucca

SEQ ID NO: 337340 - RNA, 64 nt, Homo Sapiens
cuuuaaugggagaauuuucaauuugccaauuuuuuccuugaauggguuuaaguaugcuacaaua

SEQ ID NO: 337341 - RNA, 64 nt, Homo Sapiens
gagaagguucaagagauucauaagauugucaaacuccuugaagguucagaaccucugcagggaa

SEQ ID NO: 337342 - RNA, 64 nt, Homo Sapiens
auaccuuuucuuuaccuagaagugccauccauuguccuugaauuauuaugauuaaaguuacugu

SEQ ID NO: 337343 - RNA, 64 nt, Homo Sapiens
auuaugauuaaaguuacuguugcauuuaggaggcuccuugaaaguaacaccuuuuccaaggaca

SEQ ID NO: 337344 - RNA, 64 nt, Homo Sapiens
gcccagauucuaccacacagccuaccccacccgcuccuugaagggggaggcuuccccucacuau

SEQ ID NO: 337345 - RNA, 59 nt, Homo Sapiens
ugaacuuacacaaauuugccgauggagaguccuugaaccacucuuuggagaugagcuag

SEQ ID NO: 337346 - RNA, 64 nt, Homo Sapiens
gauacuggacuucuuaccaauccggagguuuccuuccuugaaugucaguguguaaaccuggcug

SEQ ID NO: 337347 - RNA, 64 nt, Homo Sapiens
uccuaauuauaaaagcugcuuuuuugcagaacauuccuugaaaauauaagguuuugaaaagaca

SEQ ID NO: 337348 - RNA, 64 nt, Homo Sapiens
cacaaacuagaaaaccuagaaaaaauuaauaaauuccuugaaagauauaaccccccaagauuga

SEQ ID NO: 337349 - RNA, 64 nt, Homo Sapiens
uccugcaacaugcaguugacccauguacacauacuccuugaaccuaaaauaaaacaugaaaaaa

SEQ ID NO: 337350 - RNA, 64 nt, Homo Sapiens
uauguugacaguugccagugagaaacagugcucaugucauaagcaagaaaaaaauaauuaaaaa

SEQ ID NO: 337351 - RNA, 64 nt, Homo Sapiens
ccuuggagccuggguuuuugagaggaaucuuaguugucauaaucggguaguucuugcuccagua

SEQ ID NO: 337352 - RNA, 64 nt, Homo Sapiens
aagcaaauuuguaaacuuuuaaucuacaaauguaugucauaaauuugauuuaaaggauuagaga

SEQ ID NO: 337353 - RNA, 64 nt, Homo Sapiens
ggcucuaauuaugguuacuuacaaauuuucucacugucauaaaauaggugagaugauaugaaaa

SEQ ID NO: 337354 - RNA, 64 nt, Homo Sapiens; identical to SEQ ID NO: 194715

SEQ ID NO: 337355 - RNA, 64 nt, Homo Sapiens; identical to SEQ ID NO: 194716

SEQ ID NO: 337356 - RNA, 64 nt, Homo Sapiens; identical to SEQ ID NO: 194717

SEQ ID NO: 337357 - RNA, 64 nt, Homo Sapiens; identical to SEQ ID NO: 194718

SEQ ID NO: 337358 - RNA, 64 nt, Homo Sapiens; identical to SEQ ID NO: 194719

SEQ ID NO: 337359 - RNA, 64 nt, Homo Sapiens; identical to SEQ ID NO: 194720

SEQ ID NO: 337360 - RNA, 64 nt, Homo Sapiens; identical to SEQ ID NO: 194721

SEQ ID NO: 337361 - RNA, 64 nt, Homo Sapiens; identical to SEQ ID NO: 194722

SEQ ID NO: 337362 - RNA, 64 nt, Homo Sapiens; identical to SEQ ID NO: 194723

SEQ ID NO: 337363 - RNA, 64 nt, Homo Sapiens; identical to SEQ ID NO: 194724

SEQ ID NO: 337364 - RNA, 64 nt, Homo Sapiens; identical to SEQ ID NO: 194725

SEQ ID NO: 337365 - RNA, 64 nt, Homo Sapiens; identical to SEQ ID NO: 194726

SEQ ID NO: 337366 - RNA, 64 nt, Homo Sapiens; identical to SEQ ID NO: 194727

SEQ ID NO: 337367 - RNA, 64 nt, Homo Sapiens; identical to SEQ ID NO: 194728

SEQ ID NO: 337368 - RNA, 64 nt, Homo Sapiens; identical to SEQ ID NO: 194729

SEQ ID NO: 337369 - RNA, 64 nt, Homo Sapiens; identical to SEQ ID NO: 194730

SEQ ID NO: 337370 - RNA, 64 nt, Homo Sapiens; identical to SEQ ID NO: 194731

SEQ ID NO: 337371 - RNA, 64 nt, Homo Sapiens; identical to SEQ ID NO: 194732

SEQ ID NO: 337372 - RNA, 64 nt, Homo Sapiens; identical to SEQ ID NO: 194733

SEQ ID NO: 337373 - RNA, 64 nt, Homo Sapiens; identical to SEQ ID NO: 194734

SEQ ID NO: 337374 - RNA, 64 nt, Homo Sapiens; identical to SEQ ID NO: 194735

SEQ ID NO: 337375 - RNA, 64 nt, Homo Sapiens; identical to SEQ ID NO: 194736

SEQ ID NO: 337376 - RNA, 64 nt, Homo Sapiens; identical to SEQ ID NO: 194737

SEQ ID NO: 337377 - RNA, 64 nt, Homo Sapiens; identical to SEQ ID NO: 194738

SEQ ID NO: 337378 - RNA, 64 nt, Homo Sapiens; identical to SEQ ID NO: 194739

SEQ ID NO: 337379 - RNA, 64 nt, Homo Sapiens; identical to SEQ ID NO: 194740

SEQ ID NO: 337380 - RNA, 64 nt, Homo Sapiens; identical to SEQ ID NO: 194741

SEQ ID NO: 337381 - RNA, 64 nt, Homo Sapiens; identical to SEQ ID NO: 194742

SEQ ID NO: 337382 - RNA, 64 nt, Homo Sapiens; identical to SEQ ID NO: 194743

SEQ ID NO: 337383 - RNA, 64 nt, Homo Sapiens; identical to SEQ ID NO: 194744

SEQ ID NO: 337384 - RNA, 64 nt, Homo Sapiens; identical to SEQ ID NO: 194745

SEQ ID NO: 337385 - RNA, 64 nt, Homo Sapiens; identical to SEQ ID NO: 194746

SEQ ID NO: 337386 - RNA, 64 nt, Homo Sapiens; identical to SEQ ID NO: 194747

SEQ ID NO: 337387 - RNA, 64 nt, Homo Sapiens; identical to SEQ ID NO: 46031

SEQ ID NO: 337388 - RNA, 64 nt, Homo Sapiens; identical to SEQ ID NO: 46032

SEQ ID NO: 337389 - RNA, 64 nt, Homo Sapiens; identical to SEQ ID NO: 46033

SEQ ID NO: 337390 - RNA, 64 nt, Homo Sapiens; identical to SEQ ID NO: 46034

SEQ ID NO: 337391 - RNA, 64 nt, Homo Sapiens
gccuguaacaaaucucauuuuuguuaccaagaacuguaugaaagaaguaaauccaccccgauuc

SEQ ID NO: 337392 - RNA, 64 nt, Homo Sapiens
uuguauaaacacuaacauuuuccccuucuguaguuguaugaaaaaacaaauauuguuagcauag

SEQ ID NO: 337393 - RNA, 64 nt, Homo Sapiens
ucaaccauguuuucucucacgauuuucauauaaauguaugaaaaaacugugaaauaauaaggcc

SEQ ID NO: 337394 - RNA, 64 nt, Homo Sapiens
ucagccucauuauuuauaguauuucugugaguuuuguaugaaaacuguauauguaauaagguuu

SEQ ID NO: 337395 - RNA, 64 nt, Homo Sapiens
gugugaauuagaaagucacauaaguuuuaguacuuguaugaaagagccuucauucuguugcaau

SEQ ID NO: 337396 - RNA, 64 nt, Homo Sapiens
uauauacaaagacucagcuauucuaaggaagauauguaugaaugaaauuacaguguaguguuua

SEQ ID NO: 337397 - RNA, 64 nt, Homo Sapiens
auuguguggcagugauuggucuguuuguggagaauguaugaaagcuauuaauauucuagaauag

SEQ ID NO: 337398 - RNA, 64 nt, Homo Sapiens
auaucguucucaauucuauagacuuucaagccuauguaugaauaugaagggguuuuuuuuuuuu

SEQ ID NO: 337399 - RNA, 64 nt, Homo Sapiens
auauguuccagugaaaaugggcccuugaauuauuuguaugaauuaagguuuugucccauuuguu

SEQ ID NO: 337400 - RNA, 64 nt, Homo Sapiens
cugagaucagugagcucugauagggcucuucuccuguaugaacuguuccacccucgugauugua

SEQ ID NO: 337401 - RNA, 64 nt, Homo Sapiens
auaaaguauauauauacauauauauauauauauauguaugaaacccgcauggaauuaucuguau

SEQ ID NO: 337402 - RNA, 64 nt, Homo Sapiens
auauauauauguaugaaacccgcauggaauuaucuguaugaaaucaaggugcgcuguggaaaca

SEQ ID NO: 337403 - RNA, 64 nt, Homo Sapiens
aucucauaaaacaguaucaccgcaguccagagcauguaugaauagaugauaugauugacugaug

SEQ ID NO: 337404 - RNA, 64 nt, Homo Sapiens
auguuuuauauaaucuccuaagcauauuauuuccuguaugaaauguuguugguuuuuugauuuu

SEQ ID NO: 337405 - RNA, 64 nt, Homo Sapiens
guuucuuccuuuuuuucuuuuccaaguuguugcauguaugaauacauaauucccuugaaaucca

SEQ ID NO: 337406 - RNA, 64 nt, Homo Sapiens
gaaucauacagaauguaauccauuucaagaauguuguaugaaugcuccaucucuguaauuuugu

SEQ ID NO: 337407 - RNA, 64 nt, Homo Sapiens
uaacauggaaaauguuaaggugaucauaucuacauguaugaacucccccuaaaaaugguaaauc

SEQ ID NO: 337408 - RNA, 64 nt, Homo Sapiens
uuagauaauaauggcuguuucugcagaaaggauguguaugaagcguaauacugaagagaggggu

SEQ ID NO: 337409 - RNA, 64 nt, Homo Sapiens
uaggugagacucuguuucuguuauuuuuaauugcuguaugaaaugugaucagauuauuuuacua

SEQ ID NO: 337410 - RNA, 64 nt, Homo Sapiens
uucccuuaaaaaaaaaugacacuuggaagaaaaauguaugaaauucagaaauuccgaucaaaga

SEQ ID NO: 337411 - RNA, 64 nt, Homo Sapiens
agcucauaauaaugaaaaaaauagaauuauauuuuguaugaauuguuucuaacaaaccuugauc

SEQ ID NO: 337412 - RNA, 64 nt, Homo Sapiens
aauuuacaagcaaaagaugacaugacgugacaccuguaugaaaaugugaugauugaacucccug

SEQ ID NO: 337413 - RNA, 64 nt, Homo Sapiens
agcaaacauauuugaaaguugaagggcauguauauguaugaauguuuccugcauauauauguau

SEQ ID NO: 337414 - RNA, 64 nt, Homo Sapiens
gcauguauauguaugaaugauuccugcauauauauguaugaaggguguaugaaugaacauacau

SEQ ID NO: 337415 - RNA, 64 nt, Homo Sapiens
aacauacauuuccugcauauggagaguguauauguguaugaauguuuaagaguauaaauagaag

SEQ ID NO: 337416 - RNA, 64 nt, Homo Sapiens
uuuaacaucagaaaaauguauacuggggaaaaguuguaugaagguggugaacaugggagacuuu

SEQ ID NO: 337417 - RNA, 64 nt, Homo Sapiens
aggaaucuccugcaaacuccuacaggagaaaaguuguaugaauguggaaacuuuagaaauugaa

SEQ ID NO: 337418 - RNA, 64 nt, Homo Sapiens
aacaauaaaagaauuacacacuaggaaauagaacauaaccaauacuuucgaguccucccugugu

SEQ ID NO: 337419 - RNA, 64 nt, Homo Sapiens
guauggauuuuuaaaaauucuugucucuacuauuauaaccaaaaaauauuucuuguauguccca

SEQ ID NO: 337420 - RNA, 64 nt, Homo Sapiens
uggacuaaugaaaugguguuguugauaaucuaaaauaaccaauaauccaaaaaaguucauuuua

SEQ ID NO: 337421 - RNA, 64 nt, Homo Sapiens
uaaugaucauauauuaccuuuguaauaaaacauuauaaccaaaacauucuguuuaccuuuucag

SEQ ID NO: 337422 - RNA, 64 nt, Homo Sapiens
aauacuaagauuuguagguuauaaucuaguucacauaaccaauagaaaguguccuauuuuauau

SEQ ID NO: 337423 - RNA, 64 nt, Homo Sapiens
uuguaggggcauggaggcaguggggccuccauucauaaccaaaggucuuggggucugaaugacu

SEQ ID NO: 337424 - RNA, 64 nt, Homo Sapiens
augaagcuggucaaauauuuagcugcaauaagaaauaaccaaagggaacagucuguccuuacag

SEQ ID NO: 337425 - RNA, 64 nt, Homo Sapiens
gggggccaauggcacaguaccuaacaugaugcacauaaccaaaucguggaauggcuacugcuga

SEQ ID NO: 337426 - RNA, 64 nt, Homo Sapiens
uccagaccuuauccacaaccucgcccuuagucauauaaccaaaaagagaugccagcagccucug

SEQ ID NO: 337427 - RNA, 64 nt, Homo Sapiens
aagcaaaacuuguaaacagagauauuuaagaggcauaaccaaaaauagacaaaguaaaaagaca

SEQ ID NO: 337428 - RNA, 64 nt, Homo Sapiens
acauuucaguguaacauauuuuuuugagauuuuuauaaccaaauagcuuugaaauacaauuagg

SEQ ID NO: 337429 - RNA, 64 nt, Homo Sapiens
aauuuaauuacaauuguuaaucuuaacucuuauuauaaccaagcaaaaaaauucauuaauugcu

SEQ ID NO: 337430 - RNA, 64 nt, Homo Sapiens
auuguccauuacuccccaaaaucagcaaauaaauauaaccaaagccucuguaauuucaacagag

SEQ ID NO: 337431 - RNA, 64 nt, Homo Sapiens
cagaaaacaaaauggaaaaauuucaaaaguguaaauaaccaauucuugggaguugucuuugugg

SEQ ID NO: 337432 - RNA, 64 nt, Homo Sapiens
uggagucccuuuggcaaaacggcacucauggguaauaaccaagaacccccauggguuuugcuua

SEQ ID NO: 337433 - RNA, 64 nt, Homo Sapiens
cucaggauuuacagccuucaggccagauccuauuauaaccaacugugugccauuuaaaaaucca

SEQ ID NO: 337434 - RNA, 64 nt, Homo Sapiens
cuccacugcucauauuuuuaccaaccagaauaaaauaaccaauauuauuuggcaaauaacugag

SEQ ID NO: 337435 - RNA, 64 nt, Homo Sapiens
gccaaccacggcuauaagaugcuuauauccuuuaauaaccaauuacuaggcuuucuucacacau

SEQ ID NO: 337436 - RNA, 64 nt, Homo Sapiens
aacuaccaaacaacagaaacccagauagagggaaauaaccaaaaggagcccucccaccccaccc

SEQ ID NO: 337437 - RNA, 64 nt, Homo Sapiens
cuaaauguacuacugagcuuuaaacaaauguuguauaaccaauagcuuuguucauugcauuuau

SEQ ID NO: 337438 - RNA, 64 nt, Homo Sapiens
uuucuauuaaaagugggaauuuucuuaaaaaguuauaaccaacuuugcccucgugguggaaacu

SEQ ID NO: 337439 - RNA, 64 nt, Homo Sapiens
uuucagguauccuccugucaaggaaguuuauuauauaaccaaggaaaugacucacugucguaga

SEQ ID NO: 337440 - RNA, 64 nt, Homo Sapiens
ggcugcagucaaauacugcuuaccuccaugaucaauaaccaagaggccuucucaaugagcacau

SEQ ID NO: 337441 - RNA, 64 nt, Homo Sapiens
aacaguaaccuccaucaaauucuacagucgcugaauaaccaauaaucaauuagaugccccgaaa

SEQ ID NO: 337442 - RNA, 64 nt, Homo Sapiens
uauguugguaguagagaagcucggauucagacccauaaccaaacuucaaauaaaauuuuuauaa

SEQ ID NO: 337443 - RNA, 64 nt, Homo Sapiens
augauauugugauguuucauacaaugcagugaacauaaccaacuuguuaccuaaauaaagaauu

SEQ ID NO: 337444 - RNA, 64 nt, Homo Sapiens
uuuauauagcagcaaaagauaagaauaaaaucacauaaccaaguugaagcuuccuuggcaaagc

SEQ ID NO: 337445 - RNA, 64 nt, Homo Sapiens
uuauuuuucaaaugaguauuuaaugaaaguauacauaaccaauguuggguauacagaugcuucu

SEQ ID NO: 337446 - RNA, 64 nt, Homo Sapiens
uguuaucugagcucuccuauauuaucauacucagauaaccaaauuaaaagaauuagaauaugau

SEQ ID NO: 337447 - RNA, 64 nt, Homo Sapiens
uuaaaauuugggggaaaaagaaugcaggagugaaauaaccaagucaaaaccauguacuaucucc

SEQ ID NO: 337448 - RNA, 64 nt, Homo Sapiens
uaccuuuugcuguuugcuguggcagauuccccagauaaccaaggaaaaggggccacccauaccu

SEQ ID NO: 337449 - RNA, 64 nt, Homo Sapiens
uuacugcgacuaaacuuaauuuaauauuuacucuauaaccaaaugaaauauauuuaaaauauau

SEQ ID NO: 337450 - RNA, 64 nt, Homo Sapiens
uggaguuuuccuucccagaaucccuagaggugaaauaaccaacgacucaaaugcaaacagacuu

SEQ ID NO: 337451 - RNA, 64 nt, Homo Sapiens
uucacucaucugggacauucuguggucaugcaucauaaccaacaugaccaggagcacacuaagg

SEQ ID NO: 337452 - RNA, 64 nt, Homo Sapiens
ccuuuguuuucauguguaagaauguguagucucuauaaccaauacagugaaguuggaaccaaau

SEQ ID NO: 337453 - RNA, 64 nt, Homo Sapiens
cccaaagugguauagaaaugagaagauggcacuuauaaccaaaguuaagacgugauuuugcugu

SEQ ID NO: 337454 - RNA, 64 nt, Homo Sapiens
aaagccuuuucucuuauuccagaauuuaaaacugauaaccaaugguguauggucucuuuuguuc

SEQ ID NO: 337455 - RNA, 64 nt, Homo Sapiens
uuuaaaaaaguuuaaaaugucgaaguugggcaauauaaccaauguguuaauauucuuucaauaa

SEQ ID NO: 337456 - RNA, 64 nt, Homo Sapiens
cccugagguuguguguggaacucagaaggaaagaauaaccaacaucgaugaaggaauaucucuu

SEQ ID NO: 337457 - RNA, 64 nt, Homo Sapiens
aguauagaacuuaauaaguguugggauuaugaaaauaaccaaaguucauuuauuuuuuuuagaa

SEQ ID NO: 337458 - RNA, 64 nt, Homo Sapiens
auauagcuuuucauuaguggggauuuugucaauuauaaccaaaaacaaugugacggauacccaa

SEQ ID NO: 337459 - RNA, 64 nt, Homo Sapiens
ggcuggaugaggaagucauuuaggaaauguucaaauaaccaauauguggaaauggacacaggga

SEQ ID NO: 337460 - RNA, 64 nt, Homo Sapiens
uauaugcacauagaagggggacuucuaggaauuuauaaccaaaauuuuaaaacuauuuuuauau

SEQ ID NO: 337461 - RNA, 64 nt, Homo Sapiens
auuguaauuuuaaugucugcuuagcaccccacugauaaccaaaucacaguuuauuuaaauaauu

SEQ ID NO: 337462 - RNA, 64 nt, Homo Sapiens
gaggucccaacaggagucaggaagagguuugauuauaaccaagaaaacucacuaugcuaggaau

SEQ ID NO: 337463 - RNA, 64 nt, Homo Sapiens
guacaaggggaagugguguuuaguagucuucaauauaaccaauugggaaauguaguaaccuagu

SEQ ID NO: 337464 - RNA, 64 nt, Homo Sapiens
gggugaccagcccucagaugaggagaggaacugcauaaccaaagaaguaucucugaauguaucc

SEQ ID NO: 337465 - RNA, 64 nt, Homo Sapiens
guaggagaaacagugagaugauauuaggggaaaaauaaccaaaauuuacuuucuaaauacaauc

SEQ ID NO: 337466 - RNA, 51 nt, Homo Sapiens
guauucaagaagcaaccagcaauaaccaacaguuggagauccaagcuauga

SEQ ID NO: 337467 - RNA, 64 nt, Homo Sapiens
uuauuugugaacugauucauaucuuauuggucugauaaccaaucggaccaguugaucagaacug

SEQ ID NO: 337468 - RNA, 64 nt, Homo Sapiens
cucuaucagaacauauuuauaauuccaauauuuuauaaccaaaggagugcuaaggaagcauauc

SEQ ID NO: 337469 - RNA, 64 nt, Homo Sapiens
cggcagcguuuagaguugggacgauuuaauacauauaaccaaacaccacccaacccggugguua

SEQ ID NO: 337470 - RNA, 64 nt, Homo Sapiens
gcuuuuauuuauaaaaaggcuuuuuucuaacacaauaaccaaaauccaauuuuuaaugucgaau

SEQ ID NO: 337471 - RNA, 64 nt, Homo Sapiens
aaguauuauaauacaaaauaaauguugauuuuagauaaccaaguuauaaccguuuaaaaucaac

SEQ ID NO: 337472 - RNA, 64 nt, Homo Sapiens
acuguaauauuccacuguaugguccacaguguauauaaccaacaacucaccguugcgcauguag

SEQ ID NO: 337473 - RNA, 64 nt, Homo Sapiens
aauguaauaagaacaagggaacauguaaacuaacauaaccaauugucaguucuccauguauucc

SEQ ID NO: 337474 - RNA, 64 nt, Homo Sapiens
aaauaaagaaaagcauuaaggacuuaaagcaacaauaaccaaauaaaaacuugauaggaucuuu

SEQ ID NO: 337475 - RNA, 64 nt, Homo Sapiens
ccuuuuguucuuaaacuuucagauguguccuuugauaaccaaauucugucacucaagacacaga

SEQ ID NO: 337476 - RNA, 64 nt, Homo Sapiens
uaguuguagauccuugucauuuugcuguuugaaaauaaccaauguguuuucuaaaacugucgug

SEQ ID NO: 337477 - RNA, 64 nt, Homo Sapiens
uugcauaugaauuguaaaauguaaauacauuuuuauaaccaauguuuugaucuuauugaauguu

SEQ ID NO: 337478 - RNA, 64 nt, Homo Sapiens
uaguagcaccagucuuaauuagugcacauauuucauaaccaaaucgcuaugggauacuggcaaa

SEQ ID NO: 337479 - RNA, 64 nt, Homo Sapiens
cauuaaauguaauucauaaaauuugguuuguuuuauaaccaauugggagacauucuuaugcauc

SEQ ID NO: 337480 - RNA, 64 nt, Homo Sapiens
aaauguuuucuauuuugcauuuuauuauugugugauaaccaaguaauaaaaaucuauaugacuu

SEQ ID NO: 337481 - RNA, 64 nt, Homo Sapiens
gagaacugaacccuuacaaacuuuguuuucccucauaaccaaagcuucagguuagaaguuuaga

SEQ ID NO: 337482 - RNA, 64 nt, Homo Sapiens
gaauggguaacucuucuugauuaaaaguuauguaauaaccaaaugcaaugugaaauauuuuacu

SEQ ID NO: 337483 - RNA, 64 nt, Homo Sapiens; identical to SEQ ID NO: 337482

SEQ ID NO: 337484 - RNA, 50 nt, Homo Sapiens
ucuguuugucuggucuuugaauaaccaacccagugauuuacaugcugaua

SEQ ID NO: 337485 - RNA, 64 nt, Homo Sapiens
uaaaagaacauauuuuaagagacagaacuuagacauaaccaaguaguuguauaccugauuguaa

SEQ ID NO: 337486 - RNA, 64 nt, Homo Sapiens
caaaucaauucuagucauauauuaaacauccacaauaaccaagauauuuuuaucccaagaaugc

SEQ ID NO: 337487 - RNA, 64 nt, Homo Sapiens
uauuuuuuguaugcuuaaauaaaaauaaaaauucauaaccaaagagaaucccacauuagcuugu

SEQ ID NO: 337488 - RNA, 64 nt, Homo Sapiens
acuuacuuagcguuuggauaagccagucuguaaaauaaccaaccuccauagugacguccugaag

SEQ ID NO: 337489 - RNA, 64 nt, Homo Sapiens
aauucaugaaaaagaaagcccucaaaaccuguuuauaaccaaagacuucauagaacaaaaauca

SEQ ID NO: 337490 - RNA, 64 nt, Homo Sapiens
aagaaaauuucaugaagacuguaggcaagggauaauaaccaaagcuauuucugugaguuuuaaa

SEQ ID NO: 337491 - RNA, 64 nt, Homo Sapiens
gugcucuuuuuuuaaaagguuuuaaaagccauguauaaccaaguuagcauaacuguagcucaag

SEQ ID NO: 337492 - RNA, 64 nt, Homo Sapiens
auaaguuccaaauguguuuuuuuaacuuacacuaauaaccaauuacuuggacuugguugcuaaa

SEQ ID NO: 337493 - RNA, 64 nt, Homo Sapiens
cuagaguuaguuuuaaaagaacugugaaccuuuuauaaccaacaauacagcucucuucagagua

SEQ ID NO: 337494 - RNA, 64 nt, Homo Sapiens
uacuuguaccuauauuaauuaugcuuacgccaugauaaccaauauacagauauauuaauuggaa

SEQ ID NO: 337495 - RNA, 64 nt, Homo Sapiens
aacaaauguguugucauuguuggcaacauacaagauaaccaagaagcuggagucuguucugugu

SEQ ID NO: 337496 - RNA, 64 nt, Homo Sapiens
uugucugaauuauaaacacuuugagguaccaaacauaaccaaucugugcaacaacauagacuga

SEQ ID NO: 337497 - RNA, 64 nt, Homo Sapiens
ugaaauguucuguaauucccagagucuuccauaaauaaccaaauggucucauacacguacaaua

SEQ ID NO: 337498 - RNA, 64 nt, Homo Sapiens
aagacugcuugcuaguaggaaaaaauuucaaauaauaaccaaagcugaaaaauggucugucaua

SEQ ID NO: 337499 - RNA, 64 nt, Homo Sapiens
cauuuauuguccucaaaauugcuuauggccauguauaaccaauuaauucugaguuuccaaaauc

SEQ ID NO: 337500 - RNA, 64 nt, Homo Sapiens
auacagaggauaaagaaguuaauggcaugguggaauaaccaaaauguguaucauucuacaaaaa

SEQ ID NO: 337501 - RNA, 64 nt, Homo Sapiens
gacuuuuugagggaagugugauauauuaacaaauauaaccaauucuaaauuuguuuuagcucua

SEQ ID NO: 337502 - RNA, 64 nt, Homo Sapiens
gcguaaguacauaugucagggauggaggccccaaauaaccaaacucaaacauaaaguuuaaugu

SEQ ID NO: 337503 - RNA, 64 nt, Homo Sapiens
uggauaccuguguauagcuuggaacuggugucuuauaaccaagucugagaaauccagcccugug

SEQ ID NO: 337504 - RNA, 64 nt, Homo Sapiens
guaaucccuugaaaagaaacugcaucucaggaagauaaccaacagugcuuuuucuguggucuuu

SEQ ID NO: 337505 - RNA, 64 nt, Homo Sapiens
aauaaccauuugucuuucccauuguguuuauaaaauaaccaacuuacuaauuuaaguuuuaaau

SEQ ID NO: 337506 - RNA, 64 nt, Homo Sapiens
uuaaaacucauaauuauuuuacuaauaaauugacauaaccaacacuaaugggaagaccaaaauu

SEQ ID NO: 337507 - RNA, 64 nt, Homo Sapiens
agcaguguuuaaaaggagagauaauucuuagcuuauaaccaaaguauugcugucaauuccaaua

SEQ ID NO: 337508 - RNA, 64 nt, Homo Sapiens
uccaaaaugacggcugcuaucugcaaauauugucauaaccaacaacgcguguucuguaaucaaa

SEQ ID NO: 337509 - RNA, 64 nt, Homo Sapiens
aaauaaaaacugaugaggcaugucaacuauagccauaaccaauauuuguuuuuauauggaaaga

SEQ ID NO: 337510 - RNA, 64 nt, Homo Sapiens
uucugagcagagccaccauuuuuuauaauuucuaauaaccaacuccagaacuaggagcugauca

SEQ ID NO: 337511 - RNA, 64 nt, Homo Sapiens
uucucccaccuuaguugguuacagggugagugagauaaccaaugccaaacuuuuugaagucuaa

SEQ ID NO: 337512 - RNA, 64 nt, Homo Sapiens
uaaauuggaauccuaaccuuauauagacuuguuaauaaccaauucauaaacaaauaaauggcuu

SEQ ID NO: 337513 - RNA, 64 nt, Homo Sapiens
uaugucuguugaagacgagcagagauauuaaauuauaaccaacuuucaauuuccugugcuaauu

SEQ ID NO: 337514 - RNA, 64 nt, Homo Sapiens
ugugguguguugcagauuuauuuggccauuuagaauaaccaaaucaaucuggcuaacuaggaau

SEQ ID NO: 337515 - RNA, 64 nt, Homo Sapiens
aacuagguaucuuauggugagauggugggaugugauaaccaagauguaaguauuacauuuuucu

SEQ ID NO: 337516 - RNA, 64 nt, Homo Sapiens
uaauucagcaaguaccaacuuguguagcugcagaauaaccaaguggcuauccagucaaguaaau

SEQ ID NO: 337517 - RNA, 64 nt, Homo Sapiens
uggguuuuauccucaaauaugcacagccuaacugauaaccaagaguuuuuuuuuccugaugaaa

SEQ ID NO: 337518 - RNA, 64 nt, Homo Sapiens
acucucuuaucuugccuuaucaaaguaaaaaggcauaaccaagcacagaaucucaguguauucu

SEQ ID NO: 337519 - RNA, 64 nt, Homo Sapiens
auaagcuagcuagucuuguccacucccuugccccauaaccaaacaaaggacagaaucucucccc

SEQ ID NO: 337520 - RNA, 64 nt, Homo Sapiens
ugauucaggauuugaucaaacugacaugucugagauaaccaagguaugaaaugucucaucagac

SEQ ID NO: 337521 - RNA, 64 nt, Homo Sapiens
cugaagucuuaauuuaccuucagaaaaguuggaaauaaccaaaauuaauggauauacauccuca

SEQ ID NO: 337522 - RNA, 64 nt, Homo Sapiens
auauuucaguauauauuuucuagacauuuuauuuauaaccaaugcugaagaaucauaggaagag

SEQ ID NO: 337523 - RNA, 64 nt, Homo Sapiens
ccuccuauggguacauaaacugucuuucccauccauaaccaaguauuuuuguacaaggcuaaaa

SEQ ID NO: 337524 - RNA, 64 nt, Homo Sapiens
uuuuguugcuuuuuuuuuuauaaagaauguauuuauaaccaacacacuauucaauuuuuuuuug

SEQ ID NO: 337525 - RNA, 64 nt, Homo Sapiens
guuuuuuuuuucuuguuuccuuauaaaacagguaauaaccaaucauuuuguguuuguauuucca

SEQ ID NO: 337526 - RNA, 64 nt, Homo Sapiens
auaagggaaacuuuagcuugaggguuuaaggaacauaaccaaaguucacaaacauaacgaguga

SEQ ID NO: 337527 - RNA, 64 nt, Homo Sapiens
ggcagauacugagugccuuguuguggcuuuguacauaaccaacaaauuugaaaagaccucccau

SEQ ID NO: 337528 - RNA, 64 nt, Homo Sapiens
gguagacucacagccguccaucucaccacacauaauaaccaagucauuuuuucauauucugaag

SEQ ID NO: 337529 - RNA, 64 nt, Homo Sapiens
uuuaacacaucagcauucacauucaaaugggcugauaaccaaauucucuaguaaaugcagcuag

SEQ ID NO: 337530 - RNA, 64 nt, Homo Sapiens
auggaaguguacaccaguccauaacauuccuguuauaaccaaggcauccuguucugacagcuug

SEQ ID NO: 337531 - RNA, 64 nt, Homo Sapiens
acaugacuauagcaugguuauccauaugguuuucauaaccaaauuaaauaucauccuuugucuu

SEQ ID NO: 337532 - RNA, 64 nt, Homo Sapiens
auuuuuagucugucaaagugucacuuuuuaccaaauaaccaaaaccuuugaaguaaaaaggaga

SEQ ID NO: 337533 - RNA, 64 nt, Homo Sapiens
aaugugagcuauaauguuuccugaauucauaaaaauaaccaaaaauaaauucaacacuuauuuu

SEQ ID NO: 337534 - RNA, 64 nt, Homo Sapiens
acauaguuuuaucaguguauuuuacaaccaauugauaaccaaucuacagugaaaauguugucuc

SEQ ID NO: 337535 - RNA, 64 nt, Homo Sapiens
aaaguuuuuugaaggccaugucagagcuuggcucauaaccaaauucguaggugggcuuuuccua

SEQ ID NO: 337536 - RNA, 64 nt, Homo Sapiens
uuuugaacgcugcuaugaaucuucaagucaauucauaaccaagucagucuuaagcucuguccac

SEQ ID NO: 337537 - RNA, 64 nt, Homo Sapiens
cucaaggcuggcacaggcuuuuugcacauaagccauaaccaaucccagccccacagauuuuauu

SEQ ID NO: 337538 - RNA, 64 nt, Homo Sapiens
aaagucaagcuuaaauugaaguuuaaauucaucuauaaccaaaucaaaugaucagaggaaauuc

SEQ ID NO: 337539 - RNA, 64 nt, Homo Sapiens
uuuuucauucucauuuaaaauauauugugcuaugauaaccaaccuucuuccaaggagugaccau

SEQ ID NO: 337540 - RNA, 64 nt, Homo Sapiens
auuuguaaagcaacaugaaaaccuuugauaaaugauaaccaacagucuucuguccuaauuugca

SEQ ID NO: 337541 - RNA, 64 nt, Homo Sapiens
uggcugcaguagacuucuuacugcauggaaaaucauaaccaacacuuaauguaacuguacccuu

SEQ ID NO: 337542 - RNA, 64 nt, Homo Sapiens
auauguuuauuuuuuauuauaagauggucuuuaaauaaccaaaauauuuuaguuacagguuagg

SEQ ID NO: 337543 - RNA, 64 nt, Homo Sapiens
aauuaaauuuuaacagaaaucuuuuaaguauguuauaaccaaaguguucaauuauccuugcaag

SEQ ID NO: 337544 - RNA, 64 nt, Homo Sapiens
uuuguggaauacacuuuguuugcuucaugugcagauaaccaaaaaucauuuuaaaagauaucaa

SEQ ID NO: 337545 - RNA, 64 nt, Homo Sapiens
uuaauauccacauguaaggccauuacacaaauaaauaaccaauguuaaaauucaaaugguuugu

SEQ ID NO: 337546 - RNA, 64 nt, Homo Sapiens
auuuucaaauguuacuauauauuaaagcagaaauauaaccaaagguuaagcugucucggaucug

SEQ ID NO: 337547 - RNA, 64 nt, Homo Sapiens
augaggaaauguaaauuaaauuaguuauaaauaaauaaccaaaaauguauguaaacauucaaau

SEQ ID NO: 337548 - RNA, 64 nt, Homo Sapiens
aaaaaaaagacauuucaucucaaaggguuaucugauaaccaaaaugcaaaggaaaauauuuuca

SEQ ID NO: 337549 - RNA, 64 nt, Homo Sapiens
uuaccugaguccaaguuuuagugcuuuuuccagaauaaccaagaaaaugaucucugcaaacaag

SEQ ID NO: 337550 - RNA, 64 nt, Homo Sapiens
aacccugaggaacaucuuguaaauaaauaaguaaauaaccaaccaaaaaugaaguguauuaagu

SEQ ID NO: 337551 - RNA, 64 nt, Homo Sapiens
cuggacaugaagauucuuucacccaguccacaaaauaaccaaucacuuguuuuugguuuuuaaa

SEQ ID NO: 337552 - RNA, 64 nt, Homo Sapiens
uuuuauauuuuuguaaauuagggaauacuaaaaaauaaccaagaaauaacacauauaguaacgu

SEQ ID NO: 337553 - RNA, 64 nt, Homo Sapiens
uuugagaacugggaacuucaugaggcauauucauauaaccaaagaauguuucuuuuguggugcu

SEQ ID NO: 337554 - RNA, 64 nt, Homo Sapiens
aauuuaaaguauugccauuuaacugacauuauauauaaccaauuuuauauucugaaagaaaaau

SEQ ID NO: 337555 - RNA, 64 nt, Homo Sapiens
acauguucuaugaacccaauccccucuucccugaauaaccaagaucugauuacucagaaacaug

SEQ ID NO: 337556 - RNA, 64 nt, Homo Sapiens
cuaaaauucagcuuuaaaaaagcaguauuauuuuauaaccaauuauuucugcuauuauuuuuaa

SEQ ID NO: 337557 - RNA, 64 nt, Homo Sapiens
aaggguccuuucuuugucaccagccaaggcauugauaaccaaguagccauuuuccucuuaaggu

SEQ ID NO: 337558 - RNA, 64 nt, Homo Sapiens
aucauugugcuuaauaauaccaagacuaagcaccauaaccaagaaauacuaauguaaagauugu

SEQ ID NO: 337559 - RNA, 64 nt, Homo Sapiens
aucuuuuaucauguuauccuaaaagugagaagacauaaccaagacauggaaauaaaugugaaag

SEQ ID NO: 337560 - RNA, 64 nt, Homo Sapiens
guaagaugaaaauaaaagauuugcaugucucaugauaaccaaaucucauuaaaauuggaggagu

SEQ ID NO: 337561 - RNA, 64 nt, Homo Sapiens
aagcucagcucugugggggcagcagcagucccagauaaccaagcacccuccccuacucagacug

SEQ ID NO: 337562 - RNA, 64 nt, Homo Sapiens
uucagaacagucuaaucaauuuuuuugacuaagcauaaccaaaucugaagaacaauaaacagaa

SEQ ID NO: 337563 - RNA, 64 nt, Homo Sapiens
agauuaaacaaaaaauacuauucuauuuuuuucaauaaccaaaacucugcuggacaguggacug

SEQ ID NO: 337564 - RNA, 64 nt, Homo Sapiens
auugcuaucuaauggggaaauguagcuaugggccauaaccaaaacucacaugaaacggaggcag

SEQ ID NO: 337565 - RNA, 64 nt, Homo Sapiens
gcugggaaguuaugaaugaagauaacauucacccauaaccaagagaacucagguagcugcauca

SEQ ID NO: 337566 - RNA, 64 nt, Homo Sapiens
cuguucuuugacugcccacccacagaaaagcaaaauaaccaacuaccuacucaauuguguguuu

SEQ ID NO: 337567 - RNA, 64 nt, Homo Sapiens
aagaaaugaacuuucagcagucuaaauuuucuaaauaaccaauaguugccaaucuaaaauggca

SEQ ID NO: 337568 - RNA, 64 nt, Homo Sapiens
acggguaucucuuuucucucuucuaauuuucaguauaaccaaaaauuaucccagcaugagcacg

SEQ ID NO: 337569 - RNA, 64 nt, Homo Sapiens
uuguuuaaauaaguaauauuuucaaaagaauaaaauaaccaaugauaucucuuggaauaaucug

SEQ ID NO: 337570 - RNA, 64 nt, Homo Sapiens
uaaacaaagcaagacaaauugagaaaggacuugcauaaccaaaaccuuacacuuguuucaugaa

SEQ ID NO: 337571 - RNA, 64 nt, Homo Sapiens
aaauacuuuucauuucugagauauaucuuuuuuaauaaccaaguaaaaauuugggggaauccau

SEQ ID NO: 337572 - RNA, 64 nt, Homo Sapiens
gugguguuuuagugacuuuuaagggacuuuuuauauaaccaaaucuguguuccuuuuacagcaa

SEQ ID NO: 337573 - RNA, 64 nt, Homo Sapiens
aaaacucauaauaaucugaaagcagcaauagaugauaaccaaaaugaaaucugguaauuugugc

SEQ ID NO: 337574 - RNA, 64 nt, Homo Sapiens
uacaaucucccuucacaaguuauaaaacaccuaaauaaccaaucgucaauuaacaauaagccag

SEQ ID NO: 337575 - RNA, 64 nt, Homo Sapiens
aguuucaaauacaacaaaauuaucaggauuuuauauaaccaaauccaggaaugcacuuuaacaa

SEQ ID NO: 337576 - RNA, 64 nt, Homo Sapiens
augucaccauaaugaacaauugcuauuuaaauagauaaccaauuuucagacacauuuuuggauu

SEQ ID NO: 337577 - RNA, 64 nt, Homo Sapiens
cugguuuuccagugugguucugacagcacuacugauaaccaaacuggagucagguauuuuguac

SEQ ID NO: 337578 - RNA, 64 nt, Homo Sapiens
cuuagcaguuuguuagauaagaacugcacuuuauauaaccaaaggauugggaugauacaucauu

SEQ ID NO: 337579 - RNA, 64 nt, Homo Sapiens
ggaauuugucuaauaacaaugauggucuguaagcauaaccaaaaaagaaaaggauuauugugag

SEQ ID NO: 337580 - RNA, 64 nt, Homo Sapiens
gcaggggaaaaucauuuuacauacucauuuuuuaauaaccaaagggcaauugguaucaucaaug

SEQ ID NO: 337581 - RNA, 64 nt, Homo Sapiens
ccaugaaugaauauacuuuaguacugccacugucauaaccaauaaaagccaguaacaacagcgu

SEQ ID NO: 337582 - RNA, 64 nt, Homo Sapiens
ugaucuuauuuuugauuucauuuaaggaauuucuauaaccaaauauaauuaaguggugguguuc

SEQ ID NO: 337583 - RNA, 64 nt, Homo Sapiens
uaugaacagacagauuuauguuaauguaaaagucauaaccaacaucauucguuuaaaugauauu

SEQ ID NO: 337584 - RNA, 64 nt, Homo Sapiens
ccuccgaaggcaucucacgggagcaaaugcaaaaauaaccaaguuccaaaaagaacaauaauga

SEQ ID NO: 337585 - RNA, 64 nt, Homo Sapiens
auuaaauugaaacaaaauguuaauuuuuguuaacauaaccaaaauuuaacauccucuuuagagg

SEQ ID NO: 337586 - RNA, 64 nt, Homo Sapiens
gguuaagaugugugaauaauuucuguauauauguauaaccaaguacaaacauugauguauaaug

SEQ ID NO: 337587 - RNA, 64 nt, Homo Sapiens
ccucauuuguucauuaaacguccacagaguauaaauaaccaauuugccagagccuuaauaaacg

SEQ ID NO: 337588 - RNA, 64 nt, Homo Sapiens
auugugaacuguaagugccacaaucuuaaaccacauaaccaagcguaaaaugcaaaaauuaaaa

SEQ ID NO: 337589 - RNA, 64 nt, Homo Sapiens
acaaaguuauauuccauccuugcgacauaggaaaauaaccaagcaccgaaaugucuuguuuugu

SEQ ID NO: 337590 - RNA, 64 nt, Homo Sapiens
caauggcucaauuguguuuacauacacauuaugcauaaccaaaauuuucuucuguuuuuggagg

SEQ ID NO: 337591 - RNA, 64 nt, Homo Sapiens
auccuuuugggcaauuccuucagguuaugaaaguauaaccaagcaauguaagaaaccauuauuu

SEQ ID NO: 337592 - RNA, 64 nt, Homo Sapiens
caagauacuguuuuaggaguuuacccucucauuuauaaccaaaguugcucuaaaacacuuucca

SEQ ID NO: 337593 - RNA, 64 nt, Homo Sapiens
uuucccccaaauaaacauugcuuuauuucuaauaauaaccaagacuuuucaagcuucuagaucu

SEQ ID NO: 337594 - RNA, 64 nt, Homo Sapiens
uaauaacaacaacuuaaugugcugcugcuuuuccauaaccaacauuuuaaaaauaaaugaaaaa

SEQ ID NO: 337595 - RNA, 64 nt, Homo Sapiens
aacaaaaauugaauauuuaaugaauugacauuuuauaaccaaccuguuuuuaucuacgguggga

SEQ ID NO: 337596 - RNA, 64 nt, Homo Sapiens
aguuguuauaaugcauaauuauaauuuguuuaaaauaaccaaagcacucuaguaaaaaaaccaa

SEQ ID NO: 337597 - RNA, 64 nt, Homo Sapiens
ucuugacuuaaaauuuuccgacugccauaguuuuauaaccaaaauaacaaucuguaguguuuuu

SEQ ID NO: 337598 - RNA, 64 nt, Homo Sapiens
uaaagcauauuucuuggccuaugcugaagaucaaauaaccaauaucugcaauagugauaaucug

SEQ ID NO: 337599 - RNA, 64 nt, Homo Sapiens
augucuccauuguuaaaugucuucaccaguuaugauaaccaagagccaaugacauaccuugcuu

SEQ ID NO: 337600 - RNA, 64 nt, Homo Sapiens
guccaccaacuaccugcuaaggcacccagcugcuauaaccaaguucagugagaugcaggcaucu

SEQ ID NO: 337601 - RNA, 64 nt, Homo Sapiens
uauaaaauaaauuugccacauaauaugggaugcaauaaccaacaaagcugcuaagugccaaacu

SEQ ID NO: 337602 - RNA, 64 nt, Homo Sapiens
aaacaaaaugcuggaguuucauugaucuguuagaauaaccaagaaaaucauauuauauguuuca

SEQ ID NO: 337603 - RNA, 64 nt, Homo Sapiens
aaaggcuaauuuauaaaugcacccuuuucucaauauaaccaaacugccauuuaugcaggaaacu

SEQ ID NO: 337604 - RNA, 64 nt, Homo Sapiens
aagucaagucagauggcuaauauguaauuauuugauaaccaaggguccuucugaagggucagaa

SEQ ID NO: 337605 - RNA, 64 nt, Homo Sapiens
uccgacugggcucaagaggcuacuaucauggcauauaaccaaaauuuuaacugauucuuaugau

SEQ ID NO: 337606 - RNA, 64 nt, Homo Sapiens
augauguaacgguuuaauaccuuugaauguuuuaauaaccaaguugcugcugaacuuauacuaa

SEQ ID NO: 337607 - RNA, 64 nt, Homo Sapiens
guauucgaagacaagucauuccuauuauuauagaauaaccaaaaccuuauuuauguuuuaccuu

SEQ ID NO: 337608 - RNA, 64 nt, Homo Sapiens
ugaagacaucugaaaucucagcuggucacccaugauaaccaacuuccaccugcccaaccauaua

SEQ ID NO: 337609 - RNA, 64 nt, Homo Sapiens
ucuuuaggauauauuuuuaaauucuuugaaacacauaaccaaaaugguuugauucacugacuga

SEQ ID NO: 337610 - RNA, 64 nt, Homo Sapiens
cuuuaauuuccucaccaaauuauugacuuagagcauaaccaaagaccucauucauucaccccag

SEQ ID NO: 337611 - RNA, 64 nt, Homo Sapiens
ccaaacacguggaucaacagccccaucuuaauguauaaccaacaagagauuguucucacucccg

SEQ ID NO: 337612 - RNA, 64 nt, Homo Sapiens
cccucccguaaucaggaagccugcuccaccugagauaaccaacuugagaaucaaccaggcuuuc

SEQ ID NO: 337613 - RNA, 64 nt, Homo Sapiens
agagucuaucuuccuaucagauaugagcuucgccauaaccaaguauugccucccauuugccauc

SEQ ID NO: 337614 - RNA, 64 nt, Homo Sapiens
gcaguuugaaucaguggaugaugaccauucagcuauaaccaacuaagagaccaagaaacuuuca

SEQ ID NO: 337615 - RNA, 64 nt, Homo Sapiens
gguauauaauuugguaaugauauguaagaaugauauaaccaaaaagggccuucacaguguccuu

SEQ ID NO: 337616 - RNA, 64 nt, Homo Sapiens
uccaagugauaaccagacccagaaaggcauauguauaaccaaacaaagugccccaaacagcaau

SEQ ID NO: 337617 - RNA, 64 nt, Homo Sapiens
ggaaaccugcaguuuggggugucucuggcacaucauaaccaauucaucccucuggcauuuccug

SEQ ID NO: 337618 - RNA, 64 nt, Homo Sapiens
cugugaggaagguuaucggggagcuaaauaccuaauaaccaaaaagaaagucagcauuuuccuu

SEQ ID NO: 337619 - RNA, 64 nt, Homo Sapiens
cucaguagccaucagccuggcagcugcccaucccauaaccaaagagcucaaugggcuggagggu

SEQ ID NO: 337620 - RNA, 64 nt, Homo Sapiens
acguaugauuacucacagcgaucuauuguuccauauaaccaaaaagcaugguuuauucauugaa

SEQ ID NO: 337621 - RNA, 64 nt, Homo Sapiens
uuauucaguaaacaacuugugauuagaugugccaauaaccaaguggugugucagauuuuccuca

SEQ ID NO: 337622 - RNA, 64 nt, Homo Sapiens
auauaaaccguggucucaugauaccugcacguucauaaccaacaaaaugucucaguuuucagcu

SEQ ID NO: 337623 - RNA, 64 nt, Homo Sapiens
uguaaugauuuuggaacugugaaaaugcaaugacauaaccaauucuagauggcaacauuggaca

SEQ ID NO: 337624 - RNA, 64 nt, Homo Sapiens
cgcuaccugacuucaaacuaugcuacaaggcuacauaaccaaaauagcaugguacugguaccaa

SEQ ID NO: 337625 - RNA, 64 nt, Homo Sapiens
auauuaauuuaguuauauuuagcagaagaggaauauaaccaaaugugacuaaaauauagcagaa

SEQ ID NO: 337626 - RNA, 64 nt, Homo Sapiens
acaugagaaagcucaugggcaagaaacucuaugaauaaccaagauggagccgggugcaguugcc

SEQ ID NO: 337627 - RNA, 64 nt, Homo Sapiens
gccuugugagagauugagacacucuaaauaaauaauaaccaagaugggaaauuucccugccaga

SEQ ID NO: 337628 - RNA, 64 nt, Homo Sapiens
cagaugccagcagccugucauccaugccaauaaaauaaccaauccaacacccuccaccuucccc

SEQ ID NO: 337629 - RNA, 64 nt, Homo Sapiens
gugaaaugccacaccuuuguagaaaaucaaauauauaaccaauagugugaacucaccaaacaca

SEQ ID NO: 337630 - RNA, 64 nt, Homo Sapiens
gaaauugaagaagaaugaacuaauaauagcauucauaaccaaacacaaugaugauuauugcaga

SEQ ID NO: 337631 - RNA, 64 nt, Homo Sapiens
agacagacagaaucaccugaggcguucaaaagauauaaccaaauaaacaagucauccacaauca

SEQ ID NO: 337632 - RNA, 64 nt, Homo Sapiens
uugccacauucugcccuucccugaccccauuguaauaaccaacuccauauccaaagggaggugg

SEQ ID NO: 337633 - RNA, 64 nt, Homo Sapiens
uuuccucagucugcuguuuaccucuccgggcgccauaaccaaacggggaaggcaggcagagccc

SEQ ID NO: 337634 - RNA, 64 nt, Homo Sapiens
ugaacauaaugucaaaggacgagaaaagacuaagauaaccaagagauaauugucugugaagucu

SEQ ID NO: 337635 - RNA, 64 nt, Homo Sapiens
acugcugaguuuuucuucauaucaaaaacacugaauaaccaagggcgcuccagcuagcugccuc

SEQ ID NO: 337636 - RNA, 64 nt, Homo Sapiens
ugauaaagcaucauguucccuuugauuauccccuauaaccaacacucaacuacaaauaggcugg

SEQ ID NO: 337637 - RNA, 64 nt, Homo Sapiens
cgccuccuuucuguuuuauuuuugaggaaauaaaauaaccaagugcuaaaucuuguagcucugg

SEQ ID NO: 337638 - RNA, 64 nt, Homo Sapiens
gugccccuaaccuggcuuuucccaucuccccagcauaaccaaaucuuacuaaacucauccuagg

SEQ ID NO: 337639 - RNA, 64 nt, Homo Sapiens
gagaugucugcgaguggcuaugcuuaccugccagauaaccaaguccucugccuacccacgugcc

SEQ ID NO: 337640 - RNA, 64 nt, Homo Sapiens
gaagacuucuaaaaagacaagaaacauggccuaaauaaccaacauagauuuacauaguaaguuu

SEQ ID NO: 337641 - RNA, 64 nt, Homo Sapiens
ccuuguguuuuguuuugauuuaauaacauaacaaauaaccaacccuucccugaaaaccucacau

SEQ ID NO: 337642 - RNA, 51 nt, Homo Sapiens
ggggaaugaagagaguguaaaauaaccaaucugaauaaaacagccaugcuc

SEQ ID NO: 337643 - RNA, 64 nt, Homo Sapiens
ucguccucccagaggaucugagcagcaucauaagauaaccaaacucggaaguguuuuggaaucc

SEQ ID NO: 337644 - RNA, 64 nt, Homo Sapiens
auuuguguaaaaaaaaaaaaacuaguguggcuaaauaaccaaacgaauaugaauauguuuuauc

SEQ ID NO: 337645 - RNA, 64 nt, Homo Sapiens
gucuggcuguuugcuuuuuguuguaguggcaaagauaaccaaauauacaguucagaaugacaca

SEQ ID NO: 337646 - RNA, 64 nt, Homo Sapiens
auuuaugauauauuacuacuaguaguuuuuccucauaaccaagcucuccgugaaucuuaugcug

SEQ ID NO: 337647 - RNA, 64 nt, Homo Sapiens
auaacauuauacacaaagaagaagaccauacauaauaaccaaacuaugucauaccuuuggauac

SEQ ID NO: 337648 - RNA, 64 nt, Homo Sapiens
cuucucugcccuuacauuuugcuuucuuccuccccauuuggacccggacagccuggcugucauu

SEQ ID NO: 337649 - RNA, 64 nt, Homo Sapiens
acaagugcuuuaguaguagugggauuucucaggucauuuggagaugucccagagcugaggcaag

SEQ ID NO: 337650 - RNA, 64 nt, Homo Sapiens
ccucccguacugcuuucaggucuuguaaaauaagcauuuggaagucuugggaggccugccugcu

SEQ ID NO: 337651 - RNA, 64 nt, Homo Sapiens
ccuauauuuagguuucuuuucuauuuuuuucucccauuuggauccuuugagguaaaaaaacaua

SEQ ID NO: 337652 - RNA, 64 nt, Homo Sapiens
ugcacuuuaauugauuaaucuuuggaaggcucaacauuuggaauagagcaauacccaagccuca

SEQ ID NO: 337653 - RNA, 64 nt, Homo Sapiens
gcucaacauuuggaauugcacaauacccaagccucauuuggaagugccucugguggcugcagag

SEQ ID NO: 337654 - RNA, 64 nt, Homo Sapiens
aacuauauuuuaaagaacaauugagccucagaaucauuuggagacauguaucuuguaaucauga

SEQ ID NO: 337655 - RNA, 64 nt, Homo Sapiens
aaaaggugugggcuuuggggaguugucauaauuacauuuggaaccuuuuuacugcuuuuguugu

SEQ ID NO: 337656 - RNA, 64 nt, Homo Sapiens
gacaacuugcaccacuaagaaaaaaauguagaaccauuuggaaaaaugaaauuuaguaguucca

SEQ ID NO: 337657 - RNA, 64 nt, Homo Sapiens
cauuccauguuuuaaucugagccuugcagacuuucauuuggaguuugaacccguuuugguugca

SEQ ID NO: 337658 - RNA, 64 nt, Homo Sapiens
ugaacucaucacuggcuuagacaguccuggaugccauuuggaaaguaguggcccugcaagccua

SEQ ID NO: 337659 - RNA, 64 nt, Homo Sapiens
gccuaaaugaaguaguauuuguaggccuggguggcauuuggauuuuucuuuucccucaacaagg

SEQ ID NO: 337660 - RNA, 64 nt, Homo Sapiens
ucaauaaaaaaugugaacaauaaugauuuugcuacauuuggaaugucccuuuuauaauuuguuu

SEQ ID NO: 337661 - RNA, 64 nt, Homo Sapiens
uaacauuggugauuauacaggauaauuucacggacauuuggaaaagcaaggagauaggauuaua

SEQ ID NO: 337662 - RNA, 64 nt, Homo Sapiens
uuagaguccaggaggaauacacaaagcauuuguucauuuggagcacacaguuauggcaaaguag

SEQ ID NO: 337663 - RNA, 64 nt, Homo Sapiens
auugucauaagguuuuuagcuuguucuuuccucacauuuggaugaaguggaguuggugaaucgg

SEQ ID NO: 337664 - RNA, 64 nt, Homo Sapiens
auuucuucaaaaagcaaaagcaauauaccuaauucauuuggaucaaacuuacauaggucucagg

SEQ ID NO: 337665 - RNA, 64 nt, Homo Sapiens
auguauacaguccauauacacauuaaguguuugucauuuggacaaauugaaaacuuuuaauaaa

SEQ ID NO: 337666 - RNA, 64 nt, Homo Sapiens
gggaaggcaucuccaugccauaguuaaauuuccacauuuggaauauggaucuuguuugauucug

SEQ ID NO: 337667 - RNA, 64 nt, Homo Sapiens
guuagucuugggucuccugacuacaggaggcagccauuuggaagggacuuugugaccaaauagu

SEQ ID NO: 337668 - RNA, 64 nt, Homo Sapiens
gugcaauuuggggaauaucaaacuuagcauuauacauuuggauauucuaguuguauuguaaauu

SEQ ID NO: 337669 - RNA, 64 nt, Homo Sapiens
aggauugccuugaucuggcacuuacugauacaagcauuuggagaagagaaaauucaaauauaag

SEQ ID NO: 337670 - RNA, 64 nt, Homo Sapiens
auucauaugcuuuuccugcauacauuauuuugaucauuuggauaacaucaaugaacacuggcuu

SEQ ID NO: 337671 - RNA, 64 nt, Homo Sapiens
uguuuucucugcaauuuauuuaaaaccuugcacgcauuuggauaccuugugauuuccaagaacu

SEQ ID NO: 337672 - RNA, 64 nt, Homo Sapiens
aaauggacuuuccugugauuuguuuuuaaucauucauuuggagaagaggcaugaccuuuguauu

SEQ ID NO: 337673 - RNA, 64 nt, Homo Sapiens
ugauuuacuggaauuacaaaguuuuuccuuguagcauuuggaaauguccagugagcaguguugc

SEQ ID NO: 337674 - RNA, 64 nt, Homo Sapiens
ugacggaaacaacguugcuaacgcagccagugcacauuuggaauauuggagauuggcuugucuc

SEQ ID NO: 337675 - RNA, 64 nt, Homo Sapiens
uuggccucaccuucucuggcccuuaggaucuccccauuuggagacagagccauuuggauauuuu

SEQ ID NO: 337676 - RNA, 64 nt, Homo Sapiens
uggcccuuaggaucuccccauuuggagacagagccauuuggauauuuuccccuugaacuucucc

SEQ ID NO: 337677 - RNA, 64 nt, Homo Sapiens
agcauguuucuuuuugaaaaacuagugguggacacauuuggaucacauuuauacaguuauaaaa

SEQ ID NO: 337678 - RNA, 64 nt, Homo Sapiens
uccccucuugcaguuuguucuguaaugccuuuuacauuuggacacauaguuuaugcuuuuuaga

SEQ ID NO: 337679 - RNA, 64 nt, Homo Sapiens
auaguaacauugauauuucuaggaaaggaaaaaacauuuggaaaugggacuauacuaguaggag

SEQ ID NO: 337680 - RNA, 64 nt, Homo Sapiens
ugugaagauacacugcuuuacuuaaaaggaaggucauuuggagaagacagggaagggaauuuca

SEQ ID NO: 337681 - RNA, 64 nt, Homo Sapiens
guaaaaaacuuaaacacgaugaagaauuguauuacauuuggagaucauuauuccuguuuuagcu

SEQ ID NO: 337682 - RNA, 64 nt, Homo Sapiens
aauaaaccagugaacaauauaauagccugaugcucauuuggaaauggagggcugcguauuugua

SEQ ID NO: 337683 - RNA, 64 nt, Homo Sapiens
ccuuuccuccugcugcacaugagccuucgccgugcauuuggagccaugacagcugauagcucca

SEQ ID NO: 337684 - RNA, 64 nt, Homo Sapiens
auugccuagccaaaguggguguucaauaaagaaccauuuggagauggucuucugucuggaacug

SEQ ID NO: 337685 - RNA, 64 nt, Homo Sapiens
acaacacacauuauugugugggauuuaaagucagcauuuggauuggagauggucucgaugucau

SEQ ID NO: 337686 - RNA, 54 nt, Homo Sapiens
auagaauuaggaugggaaaacucccauuuggaaucaccuauaaccaagcuuuaa

SEQ ID NO: 337687 - RNA, 64 nt, Homo Sapiens
uucuuucuuaggaucuugaaaauauuugugcagccauuuggaccucaguaugagguaguguuaa

SEQ ID NO: 337688 - RNA, 64 nt, Homo Sapiens
caaguggaacuuuuaacucguuugaccuccaaaccauuuggaauucuuuccccaguaucugagc

SEQ ID NO: 337689 - RNA, 64 nt, Homo Sapiens
ggugccuguucuuguagggagaaaugagaaaucgcauuuggauccaggccccaggugggcacca

SEQ ID NO: 337690 - RNA, 64 nt, Homo Sapiens
uucaugugguggucuguggaaagaaaagaagacucauuuggaaaugaagcugucccuuuccaag

SEQ ID NO: 337691 - RNA, 64 nt, Homo Sapiens
uaccgaacucgggauuacagaaacacggaguuuccauuuggauuuuaaacaaaauuuaugucau

SEQ ID NO: 337692 - RNA, 64 nt, Homo Sapiens
aguucugugcaguuugguaugaaacaaauauacucauuuggauauaaaucuuacccuucaaugu

SEQ ID NO: 337693 - RNA, 59 nt, Homo Sapiens
auuuauuuuaucaauaccaauuuuuguggccauggcagacauugcuaaucaaucacagc

SEQ ID NO: 337694 - RNA, 59 nt, Homo Sapiens
ugcuggcagucuaaaacaguccacccaccccauggcacugccgcgugauucccgcggcc

SEQ ID NO: 337695 - RNA, 59 nt, Homo Sapiens
uuugagagagggggcacugugggaaugaaccauggcacccaguucucgugcccuuagag

SEQ ID NO: 337696 - RNA, 59 nt, Homo Sapiens
ccuaaaugcagucagucacaccuuuuucaccauggcaaacaggacacacugaaaagcag

SEQ ID NO: 337697 - RNA, 59 nt, Homo Sapiens
acaaacuuaguaucagggguccaugaagcccauggcaucauuuuugaaaauauuucuag

SEQ ID NO: 337698 - RNA, 59 nt, Homo Sapiens
uuugaaugucauaguacauugugugcuaaccauggcaagcaaacauuuacauuuguuuu

SEQ ID NO: 337699 - RNA, 59 nt, Homo Sapiens
uguguggcucagugccuggacaaaugaugccauggcagacaguagacagaacaacacuu

SEQ ID NO: 337700 - RNA, 59 nt, Homo Sapiens
aggguucuuggugaugcuggcagccauggccauggcagcggguggcauccaggcugccc

SEQ ID NO: 337701 - RNA, 59 nt, Homo Sapiens
ggccaaaaugaauaagcuggacuuucuccccauggcacuggggaaccauggaaguucag

SEQ ID NO: 337702 - RNA, 59 nt, Homo Sapiens
ugggcuuucuuccaagggcacugggggagccauggcaagguuguagguaggguagagau

SEQ ID NO: 337703 - RNA, 59 nt, Homo Sapiens
gagucucccaggacccccuuuggagaugcccauggcaugggcacugcccacaggcucag

SEQ ID NO: 337704 - RNA, 59 nt, Homo Sapiens
aaagccuuuccuugggaaucugccucccuccauggcagggguggauucgggagcuggga

SEQ ID NO: 337705 - RNA, 59 nt, Homo Sapiens
uuugaaaccaugcuuggcuggaccgggacccauggcaagagcaccugggcaccaguguu

SEQ ID NO: 337706 - RNA, 59 nt, Homo Sapiens
ugcuuuuugagguuggguuaaaaugccgaccauggcagaggggucacagcucagguucc

SEQ ID NO: 337707 - RNA, 64 nt, Homo Sapiens
gugagcgacaucaggcgcuuccucagugcauuucacgagccacagguggggcucauccaggccg

SEQ ID NO: 337708 - RNA, 64 nt, Homo Sapiens
gccucacccugcggugcccuaaaggagggggggcacgagccaacaccccaccccucugccaacc

SEQ ID NO: 337709 - RNA, 64 nt, Homo Sapiens
acccacccucauugcauuccgcuguagugaaaggacgagccauuucugggcacguggcagcagu

SEQ ID NO: 337710 - RNA, 64 nt, Homo Sapiens
uccuggggguaugggggcugacccagacgcacucacgagccaggcacagagaggucucuuccug

SEQ ID NO: 337711 - RNA, 64 nt, Homo Sapiens
aggcccagccugagugguauuugagaugacaggcacgagccacccaccucggccucccaaagug

SEQ ID NO: 337712 - RNA, 64 nt, Homo Sapiens
ucaccuagccugaugagauucugggauuacagacacgagccacccagcguggccucccaaagug

SEQ ID NO: 337713 - RNA, 64 nt, Homo Sapiens
guucacuccuuccuccuggcuuuuauacaagagaacgagccagaaguccaggacacuggugcuu

SEQ ID NO: 337714 - RNA, 64 nt, Homo Sapiens
gugauguggaggaagagccaccugcaagauggacacgagccacaagcugcacugugaaccuggg

SEQ ID NO: 337715 - RNA, 64 nt, Homo Sapiens
ggcauuucaggccaaauccaauagaacauuagccacgagccauacucgguaaguauguuuagaa

SEQ ID NO: 337716 - RNA, 64 nt, Homo Sapiens
auuuacuauguauuuucuccaauaaaaugcaauaacgagccagcauggaugagagaagggagag

SEQ ID NO: 337717 - RNA, 64 nt, Homo Sapiens
cagggguucuuuugguuauaaugaugagucucaaacgagccagcgaucagggcuccagggacag

SEQ ID NO: 337718 - RNA, 64 nt, Homo Sapiens
ugccucugcuucccaaagugcugggauuacaggcacgagccaccacaccuggccaaaaaaauuu

SEQ ID NO: 337719 - RNA, 64 nt, Homo Sapiens
accgcggguaugcgagugccagauauuggcugagacgagccagcuuagacuaauugguacaagg

SEQ ID NO: 337720 - RNA, 64 nt, Homo Sapiens
gggcauggaccugaguucugguuuugauucugccacgagccagcugugugaauuuggucaaggg

SEQ ID NO: 337721 - RNA, 64 nt, Homo Sapiens
acaccccaccuauugucuaucugggauuacagggacgagccacccaucuuggccucccaaagug

SEQ ID NO: 337722 - RNA, 64 nt, Homo Sapiens
uccugagccccagggcugaaagacagacggugucacgagccauugguggcacugccaggugcgu

SEQ ID NO: 337723 - RNA, 64 nt, Homo Sapiens
uguuuuggguauuuuuuuuauaugcaaaggucuuacgagccaauaaaacuauuucaaaguacuc

SEQ ID NO: 337724 - RNA, 64 nt, Homo Sapiens
aucaugcaaccaguucauccacuuuaucuugguaacgagccaagagcuuuacacaccuuguguc

SEQ ID NO: 337725 - RNA, 64 nt, Homo Sapiens
ugucucuucggaggagcuagagaacugcggguucacgagccauugucuacacccaguuuguuga

SEQ ID NO: 337726 - RNA, 64 nt, Homo Sapiens
guuuagagaauccuaaugucuacacuggcauagcacgagccauguaagcuucuuuuuuuucuau

SEQ ID NO: 337727 - RNA, 64 nt, Homo Sapiens
guuccugacuugagcagguguacaguggaguagaacgagccagauuuuuaccaucgguuugacu

SEQ ID NO: 337728 - RNA, 64 nt, Homo Sapiens
uggggucugcacaagagacccagcucuagggggcacgagccauaccaggccggcugccucaucu

SEQ ID NO: 337729 - RNA, 64 nt, Homo Sapiens
ugggacagcucaguguuggagggccaccugaaccacgagccagggcuggggcuugcaugucauu

SEQ ID NO: 337730 - RNA, 64 nt, Homo Sapiens
cgggccacacggugacugcuuccaccuugcagacacgagccacagugccccaacgucagcccaa

SEQ ID NO: 337731 - RNA, 64 nt, Homo Sapiens
ggaccucuaaugugggcaugucguccaccccaggacgagccaucagggacagaccccccacccc

SEQ ID NO: 337732 - RNA, 64 nt, Homo Sapiens
acugccucccgcugcugcccgcccuggucuggccacgagccaccagcugccucccugcugccga

SEQ ID NO: 337733 - RNA, 64 nt, Homo Sapiens
uuccuggcugcucagaaggagcuuuccagaaggaacgagccaucucaguucagaagagcuugca

SEQ ID NO: 337734 - RNA, 64 nt, Homo Sapiens
ccuaggcugccuccgggagcuuucugacuccgggacgagccagucuuggguaguugaccugccu

SEQ ID NO: 337735 - RNA, 64 nt, Homo Sapiens
ugccucagccucccaaguagcugagacuacaggcacgagccaccacacccagcuaauuuuuaag

SEQ ID NO: 337736 - RNA, 64 nt, Homo Sapiens
uaccucagccuccugagaagcucggacuacaggcacgagccaccaugcccagcuaauuuucuuu

SEQ ID NO: 337737 - RNA, 64 nt, Homo Sapiens
ucauuucuuuuuaaaguagacucuuugugaagaaacgagccagugacugaaacacccuggugga

SEQ ID NO: 337738 - RNA, 64 nt, Homo Sapiens
cagguggcugcuagcuguuauuucuaggcuccucacgagccagcgaaaaauguccccccaggca

SEQ ID NO: 337739 - RNA, 64 nt, Homo Sapiens
gcacaggaggcuaucuguagccccacucccugccacgagccacuuggugcacaugcccuucuuu

SEQ ID NO: 337740 - RNA, 64 nt, Homo Sapiens
uccaugaucuccaaagaaacaaauuggcaauuuaacgagccacuugaaggacuugauuaauagc

SEQ ID NO: 337741 - RNA, 64 nt, Homo Sapiens
cagcaagacucagucaucucccuuugggauuggaacgagccacaccuacccggcagaccccucu

SEQ ID NO: 337742 - RNA, 64 nt, Homo Sapiens
gaagcagcagaaggagcaggagcaagugagagccacgagccaaggugggcacuugaugucggau

SEQ ID NO: 337743 - RNA, 64 nt, Homo Sapiens
gauuguauucaaugacauuaucaucauuuuuagaacgagccacuaaccuauuagagaagaggca

SEQ ID NO: 337744 - RNA, 64 nt, Homo Sapiens
auuucuacuguauaaauguuuuacauuaaguguuacgagccacaaauuucauguacauuuauua

SEQ ID NO: 337745 - RNA, 64 nt, Homo Sapiens
aagacaugacaauggaugaaguccgagaauuugaacgagccacucaggaagccaccaacaagaa

SEQ ID NO: 337746 - RNA, 64 nt, Homo Sapiens
cgcuguggccgcauggaaccuugagaacccagggacgagccagugccgggaaggaacugccggg

SEQ ID NO: 337747 - RNA, 64 nt, Homo Sapiens
caaaacauuuugaaaagcauuuacuuuuuugaccacgagccaugaguuuucaaaaaaaucgggg

SEQ ID NO: 337748 - RNA, 64 nt, Homo Sapiens
ccuuggaccaaaccacgugguuugcagcuuuucuacgagccaggggggagguucccuuggauua

SEQ ID NO: 337749 - RNA, 64 nt, Homo Sapiens
cgcuuucagcccugugcucuuaugccuccgugggacgagccacccgccgggcacaugugaaagg

SEQ ID NO: 337750 - RNA, 64 nt, Homo Sapiens
gguuauuggauuuuuuuucucagucaaugagaucacgagccacuggacugcugacuugguuaug

SEQ ID NO: 337751 - RNA, 64 nt, Homo Sapiens
caguagaugaccuggcuguaaagagauucccuggacgagccagaucauucaguuucagcgaguc

SEQ ID NO: 337752 - RNA, 64 nt, Homo Sapiens
agggccuacagcuguguuguccaguacaggagccacgagccaaauguggcauuugaauuugaau

SEQ ID NO: 337753 - RNA, 64 nt, Homo Sapiens
ugcuguauuuaacaucugccaguacuguauccacacgagccaaccagaguggaucuuucucugc

SEQ ID NO: 337754 - RNA, 64 nt, Homo Sapiens
uaaagggaauguuuuuuucugagauaaaauaaaaacgagccacaucguguuuuaagcuugucca

SEQ ID NO: 337755 - RNA, 64 nt, Homo Sapiens
cacucccugaucccguagguggaggcgaugggucacgagccauguuaagcacaaccggcuccuu

SEQ ID NO: 337756 - RNA, 64 nt, Homo Sapiens
guggaauacaagacagugaacucugucugccugaacgagccauguaaauuaaguucuagagcag

SEQ ID NO: 337757 - RNA, 63 nt, Homo Sapiens
cuugggaguuauuuacuguguuccucuggcagccaauaaaaucaucauaagcccuuuguaaua

SEQ ID NO: 337758 - RNA, 63 nt, Homo Sapiens
uucuguaugcuucuauuccaaaucauucauuaccaauaaaaacgaaauaccacccuuuccauu

SEQ ID NO: 337759 - RNA, 63 nt, Homo Sapiens
uuaaaucacauuuagugcuguauaauuugcaugcaauaaaauucaauaaaauuaaauguaaaa

SEQ ID NO: 337760 - RNA, 63 nt, Homo Sapiens
uuuagugcuguauaauuugcaugcaauaaaauucaauaaaauuaaauguaaaauuaaaugagu

SEQ ID NO: 337761 - RNA, 63 nt, Homo Sapiens
ggcauuuaaaucagcccuguacuaugaccaagccaauaaaaagagccuuggcaccuguuggag

SEQ ID NO: 337762 - RNA, 63 nt, Homo Sapiens
ucaauauaacuuucuuugggcacauagaaucaucaauaaaaaccuaucacacucuguuaaaaa

SEQ ID NO: 337763 - RNA, 63 nt, Homo Sapiens
cagcauucacaaaaugaggaagaccugucauugcaauaaaagcauuuuuauauaugguuaaag

SEQ ID NO: 337764 - RNA, 63 nt, Homo Sapiens
cauuuaaaaauuuaggggauugagaaguuauaccaauaaaaagaauacaaaauaagugggaaa

SEQ ID NO: 337765 - RNA, 63 nt, Homo Sapiens
uuuauauuuucccucucuugccuuucuuauuugcaauaaaagguauugagccauuuuuuaaau

SEQ ID NO: 337766 - RNA, 63 nt, Homo Sapiens
ugcaucacggaucaauagacuguacuuauuuuccaauaaaauuuucaaacuuuguacuguuau

SEQ ID NO: 337767 - RNA, 63 nt, Homo Sapiens
uuguaaccagauacauaaagagcucuuacaacucaauaaaaggcaaguaauuuaaaaauaggc

SEQ ID NO: 337768 - RNA, 63 nt, Homo Sapiens
uaacaaaauaucacaugcauaaauauuauguaucaauaaaauuuuuuaaugggcaaaggauuu

SEQ ID NO: 337769 - RNA, 63 nt, Homo Sapiens
ucagguuuuuuuccugauuuagagagcuguuugcaauaaaaaggcacaguuugaugaagggcu

SEQ ID NO: 337770 - RNA, 63 nt, Homo Sapiens
caaauauaaguuuccaugcuauccaauuuaguucaauaaaauuauaucaucucuagcacugcc

SEQ ID NO: 337771 - RNA, 63 nt, Homo Sapiens
ugcacagaacagaugcaaauauuuuuauuuauucaauaaaauauuaaaaaccaaaccaauaaa

SEQ ID NO: 337772 - RNA, 63 nt, Homo Sapiens
uuuauuuauucaauaaaauauuaaaaaccaaaccaauaaaauuaagaauauuguuuauagguu

SEQ ID NO: 337773 - RNA, 63 nt, Homo Sapiens
uuaagaucauuuuuaagaaguaaguauagacagcaauaaaauguauuugcacuacauauauga

SEQ ID NO: 337774 - RNA, 63 nt, Homo Sapiens
uaaggcuguucaugagaagggcauuuauuuugacaauaaaacuaacuguuucccaaaauaagu

SEQ ID NO: 337775 - RNA, 63 nt, Homo Sapiens
uaugcacaaaugugaacaccccugucagccuuucaauaaaaguccuccguuccgcuagccuac

SEQ ID NO: 337776 - RNA, 63 nt, Homo Sapiens
cugguccaacgaagacacugccaccucaaaugacaauaaaaaacuggucaugaucucugaucu

SEQ ID NO: 337777 - RNA, 63 nt, Homo Sapiens
auuauuggcaaauaaauuggauaaaaaaaguaucaauaaaauacuuacuuucccauuguaaca

SEQ ID NO: 337778 - RNA, 63 nt, Homo Sapiens
aguaucaauaaaauaauuauuuucccauuguaacaauaaaaaacuauauccuugacaccuuac

SEQ ID NO: 337779 - RNA, 63 nt, Homo Sapiens
ucacaaguaauaacugcuguaauugucauacgccaauaaaaugaugcaacagggacccuugua

SEQ ID NO: 337780 - RNA, 63 nt, Homo Sapiens
gaaccaaaggauauuuccaggccuagagaggggcaauaaaaaugcguuaacauacuuuguuuu

SEQ ID NO: 337781 - RNA, 63 nt, Homo Sapiens
uuuggcaggaagcuuguugcuuucaaaugucaccaauaaaaguaguauuuuaaaaaaauuguu

SEQ ID NO: 337782 - RNA, 63 nt, Homo Sapiens
uuauguggaagguaaauauacucaucuugguaucaauaaaaaccacaccagaguucuauuuac

SEQ ID NO: 337783 - RNA, 63 nt, Homo Sapiens
uguguuaaacucaauugcuuacugucuauagggcaauaaaaucuauccacuggucacaucaua

SEQ ID NO: 337784 - RNA, 63 nt, Homo Sapiens
gcauggggguuaagcugauguuaaaacaguuugcaauaaaaaaaaaugaaucagcuuaaguca

SEQ ID NO: 337785 - RNA, 63 nt, Homo Sapiens
caccauuugguccucuuuaaucuuugaggguuucaauaaaaauuguucacucauaucuguguu

SEQ ID NO: 337786 - RNA, 63 nt, Homo Sapiens
ccaaacuuuguauguacguuccuaacaagauuucaauaaaaauaaagcagaauuuguuugaua

SEQ ID NO: 337787 - RNA, 63 nt, Homo Sapiens
aagacauugaaggaccaauucauuucacgaggacaauaaaaauacaucuuaacuguauaugaa

SEQ ID NO: 337788 - RNA, 63 nt, Homo Sapiens
aauuuacaugauagguuaacuaaacagguguaccaauaaaaaguagcaaucaaucauaauuag

SEQ ID NO: 337789 - RNA, 63 nt, Homo Sapiens
gagaagaaaaaagagaaaccccaucucccccgccaauaaaaaaauaaauaacaaguuauagua

SEQ ID NO: 337790 - RNA, 63 nt, Homo Sapiens
caucagugcuauuuggauguugacacgaaucugcaauaaaagcuucccagauuauccuuguaa

SEQ ID NO: 337791 - RNA, 63 nt, Homo Sapiens
acaacugcaaaguaccuucaaauuaagucucuacaauaaaaacgacaacucuuucuuuaaaua

SEQ ID NO: 337792 - RNA, 63 nt, Homo Sapiens
ucccauucuaugugucaucaauaguguccuaugcaauaaaauuauuugcaggucuuuaaauca

SEQ ID NO: 337793 - RNA, 63 nt, Homo Sapiens
aaaggaugaucaaaaauaaugcauccagcaguacaauaaaaguaaaccacaaaaaaauaccuc

SEQ ID NO: 337794 - RNA, 63 nt, Homo Sapiens
aauaauaauaaaaccuuccaugagacuccaucucaauaaaauucuccagccugggugacagag

SEQ ID NO: 337795 - RNA, 63 nt, Homo Sapiens
caaaacuguucuuugaaaaggaaaagagaaaaucaauaaaaccgaguaaaaaucagugaaauu

SEQ ID NO: 337796 - RNA, 63 nt, Homo Sapiens
ugaauauguacuuuuaacacaagagagacuauucaauaaaaacucacugggucuuucaugucu

SEQ ID NO: 337797 - RNA, 63 nt, Homo Sapiens
cuuuuuuauauuguccuccaccuccaucauuuucaauaaaagauagggcuuuugcucccuugu

SEQ ID NO: 337798 - RNA, 63 nt, Homo Sapiens
gucucagcaacaguggaauuauauaaccuaugccaauaaaaauacacacacacacacacaaac

SEQ ID NO: 337799 - RNA, 63 nt, Homo Sapiens
guguucaauggaugaauuuccauaauaggugcucaauaaaaaucuggaacagugucuggugca

SEQ ID NO: 337800 - RNA, 63 nt, Homo Sapiens
acauaaugugaucaugcucuaacuucaauauaccaauaaaauaaucagcuugcaauuucugau

SEQ ID NO: 337801 - RNA, 63 nt, Homo Sapiens
uuuugaacuaacaguaauaacuucuugaaaauccaauaaaauuggcaaaagauugugaaaauu

SEQ ID NO: 337802 - RNA, 63 nt, Homo Sapiens
guugucuucaaaggcaggagaaaauaauguucacaauaaaaugugcuaacaauguuuuguuuc

SEQ ID NO: 337803 - RNA, 63 nt, Homo Sapiens
aauaaaagaaaagcugacaguauauucugguuucaauaaaaugaccuaucagaaaguagaauu

SEQ ID NO: 337804 - RNA, 63 nt, Homo Sapiens
guuacaugcaccuucaguguccuuguugugccucaauaaaaaaaguccaggcaaguuacaaug

SEQ ID NO: 337805 - RNA, 63 nt, Homo Sapiens
augguguucuaauuagugggaguacaguauugacaauaaaaggcuuuaucaagauugaaaguc

SEQ ID NO: 337806 - RNA, 63 nt, Homo Sapiens
uuuuuaugacuacagauuuuuauguaaaauuaccaauaaaauaaaguauagccccacuuauac

SEQ ID NO: 337807 - RNA, 63 nt, Homo Sapiens
uugauuauuuagcuuuauaagcggacuaguaaacaauaaaacaauuuauuguaauguuuacua

SEQ ID NO: 337808 - RNA, 63 nt, Homo Sapiens
uaauucauuuaagaagagaucuuuauaaaauagcaauaaaaaaauuuuuaggaaaauauuaag

SEQ ID NO: 337809 - RNA, 63 nt, Homo Sapiens
uuauaugaaagaaugaaaauuuauuuuuugacccaauaaaauguguaggguuuuauuuuauuu

SEQ ID NO: 337810 - RNA, 63 nt, Homo Sapiens
uauucuguuucuuucguuaguaaauuaaccuagcaauaaaaaagacuauuauuaucuuuguaa

SEQ ID NO: 337811 - RNA, 63 nt, Homo Sapiens
augaauaccacaaaagauguuccagacaucaagcaauaaaaaaggucuaguuucgguaacugu

SEQ ID NO: 337812 - RNA, 63 nt, Homo Sapiens
uggcauuaauacaaaccucacauuugucuaauacaauaaaaacagucuucgauucucagagag

SEQ ID NO: 337813 - RNA, 63 nt, Homo Sapiens
gaaugagcugguucuuuccaacauacauacauacaauaaaaccgauucugucucaaaauaaau

SEQ ID NO: 337814 - RNA, 63 nt, Homo Sapiens
uacuaaauguacagauaugcaaauuccauagcucaauaaaagaaucugauacuuagaccaaaa

SEQ ID NO: 337815 - RNA, 63 nt, Homo Sapiens
ugcagaaaaaauauuguaguuugaauauuuaagcaauaaaacugcuagugaguuauuguaagc

SEQ ID NO: 337816 - RNA, 63 nt, Homo Sapiens
auucuuaucacuuccuauccguauuuaauaauacaauaaaaauugggggggaaagaugacaug

SEQ ID NO: 337817 - RNA, 63 nt, Homo Sapiens
cucaaaauaaauggucuuuauuauuuguuaugacaauaaaacaauacacagaauguguacaga

SEQ ID NO: 337818 - RNA, 63 nt, Homo Sapiens
aaugucugcaugcuauuuuaaagcaaaaggaaacaauaaaaggaaauaccacagacacaguua

SEQ ID NO: 337819 - RNA, 63 nt, Homo Sapiens
agcuaaaugggcuaggugaaccaguuuccuuggcaauaaaauguugcugaaucuguuuggguu

SEQ ID NO: 337820 - RNA, 63 nt, Homo Sapiens
uaaaauauaaauuaaaaaaggggccaccuauuucaauaaaaaaaguucuguuucacaaguuuu

SEQ ID NO: 337821 - RNA, 63 nt, Homo Sapiens
acauaaguggacauguuuauaguauauagauagcaauaaaauaguaauacaguaaacugaaag

SEQ ID NO: 337822 - RNA, 63 nt, Homo Sapiens
uaccucaauacauguucuuuuacguucuuauaccaauaaaagggacaugguuaaucuggaacu

SEQ ID NO: 337823 - RNA, 63 nt, Homo Sapiens
ccauagggaagagagagaggggacuucagagaccaauaaaagccuggcacugaagaucuccag

SEQ ID NO: 337824 - RNA, 63 nt, Homo Sapiens
gccaugcugcuaugaagacuacuuuuagaucaacaauaaaaaaaaaccuacaaaaaaaccuuu

SEQ ID NO: 337825 - RNA, 63 nt, Homo Sapiens
cuuauuuuuauuuauuuuuguacugugcugauucaauaaaaugcacugaccauccauuacaga

SEQ ID NO: 337826 - RNA, 63 nt, Homo Sapiens
uaaugaagaaaagagagaagaaucaaauagaugcaauaaaaaaugauaaagggaauaucauca

SEQ ID NO: 337827 - RNA, 63 nt, Homo Sapiens
aauauccuugaugaacauugaugugaaaauccucaauaaaauacuggcaaaccgaauccagca

SEQ ID NO: 337828 - RNA, 63 nt, Homo Sapiens
gggccccaccacgcucucaagagaacgcaccugcaauaaaacagucuugucggccagcugccc

SEQ ID NO: 337829 - RNA, 63 nt, Homo Sapiens
aagcugugaagaaaaauauauaucaauguuuuccaauaaaauacagugacuaccugauuuggc

SEQ ID NO: 337830 - RNA, 63 nt, Homo Sapiens
aacucuaaaaucacagcuguaugcacccccucgcaauaaaacccuuuccaccuuccccuaucc

SEQ ID NO: 337831 - RNA, 63 nt, Homo Sapiens
aacuagaaaaaaaaaagguuaaugucacaaaagcaauaaaacaagagaaaauccacaaauucc

SEQ ID NO: 337832 - RNA, 63 nt, Homo Sapiens
uagacuugguuuuuuugugugcgcuggcauaaacaauaaaaagcucacguauuucuauuguca

SEQ ID NO: 337833 - RNA, 63 nt, Homo Sapiens
gcauuuuaagaaauaaggugcugguuucccaaccaauaaaaugaauucuacaagaggaaucac

SEQ ID NO: 337834 - RNA, 63 nt, Homo Sapiens
uguuacuguuuaccauggcaguaauggggcaaacaauaaaaugcaaugugaaaugauuugaug

SEQ ID NO: 337835 - RNA, 63 nt, Homo Sapiens
aaaucauucuggagguggcauguccuugacucacaauaaaaauuuuagaaaacuauugaaaga

SEQ ID NO: 337836 - RNA, 64 nt, Homo Sapiens; identical to SEQ ID NO: 189745

SEQ ID NO: 337837 - RNA, 64 nt, Homo Sapiens; identical to SEQ ID NO: 189746

SEQ ID NO: 337838 - RNA, 64 nt, Homo Sapiens; identical to SEQ ID NO: 189747

SEQ ID NO: 337839 - RNA, 64 nt, Homo Sapiens; identical to SEQ ID NO: 189748

SEQ ID NO: 337840 - RNA, 64 nt, Homo Sapiens; identical to SEQ ID NO: 189749

SEQ ID NO: 337841 - RNA, 55 nt, Homo Sapiens; identical to SEQ ID NO: 189750

SEQ ID NO: 337842 - RNA, 64 nt, Homo Sapiens; identical to SEQ ID NO: 189751

SEQ ID NO: 337843 - RNA, 64 nt, Homo Sapiens; identical to SEQ ID NO: 189752

SEQ ID NO: 337844 - RNA, 64 nt, Homo Sapiens; identical to SEQ ID NO: 189753

SEQ ID NO: 337845 - RNA, 64 nt, Homo Sapiens; identical to SEQ ID NO: 189754

SEQ ID NO: 337846 - RNA, 64 nt, Homo Sapiens; identical to SEQ ID NO: 189755

SEQ ID NO: 337847 - RNA, 64 nt, Homo Sapiens; identical to SEQ ID NO: 189756

SEQ ID NO: 337848 - RNA, 64 nt, Homo Sapiens; identical to SEQ ID NO: 303425

SEQ ID NO: 337849 - RNA, 64 nt, Homo Sapiens; identical to SEQ ID NO: 303426

SEQ ID NO: 337850 - RNA, 64 nt, Homo Sapiens; identical to SEQ ID NO: 303427

SEQ ID NO: 337851 - RNA, 64 nt, Homo Sapiens; identical to SEQ ID NO: 303428

SEQ ID NO: 337852 - RNA, 64 nt, Homo Sapiens; identical to SEQ ID NO: 303429

SEQ ID NO: 337853 - RNA, 64 nt, Homo Sapiens; identical to SEQ ID NO: 303430

SEQ ID NO: 337854 - RNA, 64 nt, Homo Sapiens; identical to SEQ ID NO: 303431

SEQ ID NO: 337855 - RNA, 64 nt, Homo Sapiens; identical to SEQ ID NO: 303432

SEQ ID NO: 337856 - RNA, 64 nt, Homo Sapiens; identical to SEQ ID NO: 303433

SEQ ID NO: 337857 - RNA, 64 nt, Homo Sapiens; identical to SEQ ID NO: 303434

SEQ ID NO: 337858 - RNA, 64 nt, Homo Sapiens; identical to SEQ ID NO: 303435

SEQ ID NO: 337859 - RNA, 64 nt, Homo Sapiens; identical to SEQ ID NO: 303436

SEQ ID NO: 337860 - RNA, 64 nt, Homo Sapiens; identical to SEQ ID NO: 303437

SEQ ID NO: 337861 - RNA, 64 nt, Homo Sapiens; identical to SEQ ID NO: 303438

SEQ ID NO: 337862 - RNA, 64 nt, Homo Sapiens; identical to SEQ ID NO: 303439

SEQ ID NO: 337863 - RNA, 64 nt, Homo Sapiens; identical to SEQ ID NO: 303440

SEQ ID NO: 337864 - RNA, 64 nt, Homo Sapiens; identical to SEQ ID NO: 303441

SEQ ID NO: 337865 - RNA, 64 nt, Homo Sapiens; identical to SEQ ID NO: 303442

SEQ ID NO: 337866 - RNA, 64 nt, Homo Sapiens; identical to SEQ ID NO: 303443

SEQ ID NO: 337867 - RNA, 64 nt, Homo Sapiens; identical to SEQ ID NO: 303444

SEQ ID NO: 337868 - RNA, 64 nt, Homo Sapiens
auuuucugcaugucauaacauauccuaacugcuauuucagaagaggcagcuuguaggugauugu

SEQ ID NO: 337869 - RNA, 64 nt, Homo Sapiens
caggaauaauaagcaauacuacacaacuugcuacuuucagaaaacuuuuuuuuagcuucaccga

SEQ ID NO: 337870 - RNA, 64 nt, Homo Sapiens
guaaauucucuauuuuuuguaauguguucggugauuucagaaagcuagaaaguguauguguggc

SEQ ID NO: 337871 - RNA, 64 nt, Homo Sapiens
uaaaacaucccuaacugaucgaauauaucaguaauuucagaaucagaugcauccuuucauaaga

SEQ ID NO: 337872 - RNA, 64 nt, Homo Sapiens
gcugccuaggaaacuauaaaguuuuaguuggugcuuucagaacuguuuuaguagaaguguugug

SEQ ID NO: 337873 - RNA, 64 nt, Homo Sapiens
gucucaccaauuacaacacacugcaggcauuuguuuucagaacaguggcaccuuggccacaugc

SEQ ID NO: 337874 - RNA, 64 nt, Homo Sapiens
aucgaaggagccaaaaauauucuaaauuaaucuuuuucagaaauuuuuagacacuccccaaauu

SEQ ID NO: 337875 - RNA, 64 nt, Homo Sapiens
auuaaauggaagaaaucaaucuuuaaacgcuauauuucagaaauuauuuuuauuguguaaugau

SEQ ID NO: 337876 - RNA, 64 nt, Homo Sapiens
aaagaggcauucaugaaggcggguagaaguuccuuuucagaaauucuggaaaugggaaagggag

SEQ ID NO: 337877 - RNA, 64 nt, Homo Sapiens
cgggcgaaacaacugaugggguaaaaaggggagauuucagaagaagauuucgguaggcacaggu

SEQ ID NO: 337878 - RNA, 64 nt, Homo Sapiens
acaggaaucugauaucaacauuuguggucugugcuuucagaaauagacucucucugauggucac

SEQ ID NO: 337879 - RNA, 64 nt, Homo Sapiens
gagugagaggccuuccugcaggucucucauuuuguuucagaaauauggccagagcuugaagucu

SEQ ID NO: 337880 - RNA, 64 nt, Homo Sapiens
uccauguagugcuaauaaccaaacucuuggagccuuucagaaauuuugagcauaguagcucccu

SEQ ID NO: 337881 - RNA, 64 nt, Homo Sapiens
ugcuuuguuuuuauuuuuuaaguaccaaaauugguuucagaacacugauaacacucagaaaacc

SEQ ID NO: 337882 - RNA, 64 nt, Homo Sapiens
caugauaaggagcauacgugcauguuuuccguacuuucagaauagagugccuuagcuaggccag

SEQ ID NO: 337883 - RNA, 64 nt, Homo Sapiens
cuuaauguuaauacauauuacacuacaguuuacuuuucagaauacuaaagacuuuauaacugca

SEQ ID NO: 337884 - RNA, 64 nt, Homo Sapiens
uugauacugauauugauuuuuauauagguauuuauuucagaauugauauuuugagaaaaauaca

SEQ ID NO: 337885 - RNA, 64 nt, Homo Sapiens
agggcaguauauuaagagcaugaaauugaacuauuuucagaaaaaauaaauauuagaauaaaua

SEQ ID NO: 337886 - RNA, 64 nt, Homo Sapiens
aaaauuuuguacauauauacuuuuauagguucuuuuucagaaguguuuuuuuaauacgaucuau

SEQ ID NO: 337887 - RNA, 64 nt, Homo Sapiens
aaacaauugggcaaaacuacaucugaaaaucacauuucagaauauggcaugaaauuuugguaaa

SEQ ID NO: 337888 - RNA, 64 nt, Homo Sapiens
augaaccagcuuucuuuuuauuaucuuuauaugguuucagaaguagugauuuuuuaaaaauuuu

SEQ ID NO: 337889 - RNA, 64 nt, Homo Sapiens
caagagggucggcaguggacggaagaaagguugguuucagaaacugcucuuaaagaggagagca

SEQ ID NO: 337890 - RNA, 64 nt, Homo Sapiens
ugagcaaaacagggcagucacaucaugccacucauuucagaacuccucagcuccaccagcucuu

SEQ ID NO: 337891 - RNA, 64 nt, Homo Sapiens
uuuuguucuguaaguaaaaagucccacaaugaaauuucagaaguuaggaauguaaauagauuaa

SEQ ID NO: 337892 - RNA, 64 nt, Homo Sapiens
ugaauaguauuuauacuucugcgucugccaugguuuucagaaucguuacuccuuauuuaauuuu

SEQ ID NO: 337893 - RNA, 64 nt, Homo Sapiens
aacuugucuuugauacaaaagagugcugacaguauuucagaaagcugagagaguuuuauacaug

SEQ ID NO: 337894 - RNA, 64 nt, Homo Sapiens
gaaaacauugccucuuugcaucacauaccucguuuuucagaaacuuuccaaacugcuuuacaua

SEQ ID NO: 337895 - RNA, 64 nt, Homo Sapiens
ccaggcugaaugcuggagaaaacuggcuaucaucuuucagaagucauuucuaccaucgucugcu

SEQ ID NO: 337896 - RNA, 64 nt, Homo Sapiens
aaagaaaaaggacgaugucagucaagcagcacuuuuucagaauauacagaacauaaauaauaug

SEQ ID NO: 337897 - RNA, 64 nt, Homo Sapiens
agcagcaguaaaagucacccuaaaucaaggggcuuuucagaaggucauucugaagaaauaaaga

SEQ ID NO: 337898 - RNA, 64 nt, Homo Sapiens
uuucugauuucuucuacagcuguagaauaccaucuuucagaaaguuggcuggcuuuauuucuaa

SEQ ID NO: 337899 - RNA, 64 nt, Homo Sapiens
ugucuuucauuucaaucaauugguaauuguagcauuucagaaaagucuuucugaagcccugaaa

SEQ ID NO: 337900 - RNA, 64 nt, Homo Sapiens
caguugucuagccaagccauauaacauguaugcuuuucagaauauuaucacugucacacagcuu

SEQ ID NO: 337901 - RNA, 64 nt, Homo Sapiens
auuguuucaaaagauuuugacuuuuagaaauaaauuucagaaaauucuaaaguuuugucucuga

SEQ ID NO: 337902 - RNA, 64 nt, Homo Sapiens
cgaaaagauacacaaucauuuuuuauagcacuauuuucagaauaagaagcuaggaauaauugag

SEQ ID NO: 337903 - RNA, 64 nt, Homo Sapiens
uguuucuuaucaagaaguuauuuaaucauuuaucuuucagaacuuaacauuugguuuacuaauu

SEQ ID NO: 337904 - RNA, 64 nt, Homo Sapiens
cauaaacuuugacgugugccccauuaaagauggguuucagaaauaaagagcacuuuuuaaacug

SEQ ID NO: 337905 - RNA, 64 nt, Homo Sapiens
auucuaagagcacaugacauguggcugccuccccuuucagaaacaagcugaguaacccagccug

SEQ ID NO: 337906 - RNA, 64 nt, Homo Sapiens
uguggaacccaaacuguauggggauauuugauguuuucagaaagaggaagaaaauaugguccaa

SEQ ID NO: 337907 - RNA, 64 nt, Homo Sapiens
gaaaaguagucccccaaauuaacaucagugucuguuucagaaucucucuacucagaugacccca

SEQ ID NO: 337908 - RNA, 64 nt, Homo Sapiens
augaccccagaaacugaaccaacagaagcagacuuuucagaagauggugaagacagaaacccag

SEQ ID NO: 337909 - RNA, 64 nt, Homo Sapiens
uuaagaagcucucuucaucuaagagcuguuacuuuuucagaaggggggguauuauugguauucu

SEQ ID NO: 337910 - RNA, 64 nt, Homo Sapiens
ucggugucccuguaaaacaauccccacagauuacuuucagaaauagauguauuucucuacguaa

SEQ ID NO: 337911 - RNA, 64 nt, Homo Sapiens
uugcuuuacugcaugaaugaaacugaugguucaauuucagaaguaaugauuaacaguuaugugg

SEQ ID NO: 337912 - RNA, 64 nt, Homo Sapiens
caugaauugugucucaacagaaacuaaaugaacauuucagaauaaauuauugcuguauguaaac

SEQ ID NO: 337913 - RNA, 64 nt, Homo Sapiens
ggcugccucuucuuuccucuuggugugcgaaguauuucagaaggccauugaugaauucccccuc

SEQ ID NO: 337914 - RNA, 64 nt, Homo Sapiens
cuccugcuacacugacagacugauugcguggcucuuucagaagacccaggaagggcagcuccag

SEQ ID NO: 337915 - RNA, 64 nt, Homo Sapiens
ccaaaugaaggcuaaaauuuuuaaaauuagaacuuuucagaauguucagaaaguccauuuuugu

SEQ ID NO: 337916 - RNA, 64 nt, Homo Sapiens
uccauuuuuguuuaaaauuauaugcugagaaauuuuucagaaaguaucauaaccucuugguuca

SEQ ID NO: 337917 - RNA, 64 nt, Homo Sapiens
agugguagaaaaaaacacacgauguucuugaacauuucagaaggacaguugugacggauguaug

SEQ ID NO: 337918 - RNA, 64 nt, Homo Sapiens
cagaacacagauguggacacgggaaauuuuucuuuuucagaagaggggcagggugugguuuggg

SEQ ID NO: 337919 - RNA, 64 nt, Homo Sapiens
ccauagcaauucagugauuuuaauuuuuuggauauuucagaaacuuuuucccccugcuucaggu

SEQ ID NO: 337920 - RNA, 62 nt, Homo Sapiens
uguaguuuacaagaauaaagugcaggaauuuauuucagaaaaauuuccuccaaacaaaauaa

SEQ ID NO: 337921 - RNA, 64 nt, Homo Sapiens
uaaugacucacaugggaauucagaguuuucccauuuucagaagauucuguccacugcuauggag

SEQ ID NO: 337922 - RNA, 64 nt, Homo Sapiens
uaugagcugugucaccugacugguguuuugucuuuuucagaaacaaccaccuuauuuuugagcu

SEQ ID NO: 337923 - RNA, 64 nt, Homo Sapiens
caugccauccauuauuuuaaauaaacuaauagguuuucagaauuaugaauuuuucagaacucau

SEQ ID NO: 337924 - RNA, 64 nt, Homo Sapiens
uaaauaaacuaauagguuuucagaauuaugaauuuuucagaacucauccaguccuuguaaucuu

SEQ ID NO: 337925 - RNA, 64 nt, Homo Sapiens
gacccccaaagacaagacaagcacuuauuuuuauuuucagaagacaaaagaaccaagaugccaa

SEQ ID NO: 337926 - RNA, 64 nt, Homo Sapiens
ucauguuugcaaaaggucacugugaggcugcauauuucagaaagauguccuuaauaagggaagu

SEQ ID NO: 337927 - RNA, 64 nt, Homo Sapiens
ccaagucacugcugccauguguguacuguauuauuuucagaaaaaaauauaauagucugagucc

SEQ ID NO: 337928 - RNA, 64 nt, Homo Sapiens
uguaaaaugacuuuaaggauuuugaacaacuugguuucagaauauauguuuucagaauucaucu

SEQ ID NO: 337929 - RNA, 64 nt, Homo Sapiens
caucuuuugaacaacuugguuacaccaacuauguuuucagaauuguuuugauauauucauuugc

SEQ ID NO: 337930 - RNA, 64 nt, Homo Sapiens
uauauguggauccaagcucuucuugcggagcaaauuucagaauaggccaagugcccaaaagccc

SEQ ID NO: 337931 - RNA, 64 nt, Homo Sapiens
ucagggagcuggagagggaaaugggucagucaacuuucagaaauaugaaauauuuuaacauuuu

SEQ ID NO: 337932 - RNA, 64 nt, Homo Sapiens
uauagucuaugccaauuuugauuccauauuuugcuuucagaacucugucauuuaaaauucaugc

SEQ ID NO: 337933 - RNA, 64 nt, Homo Sapiens
gaaggcuuuugagguuuauauuuggaaaaaaacauuucagaaguccucaaagagccguaagcuu

SEQ ID NO: 337934 - RNA, 64 nt, Homo Sapiens
guucacaguuuuauuucuuagaaaaaacacuccguuucagaauuuauguuuguauuagccuuua

SEQ ID NO: 337935 - RNA, 64 nt, Homo Sapiens
aagauaaacugugauuugacaagacacaacuugguuucagaaagaucacgugaaugaauggugg

SEQ ID NO: 337936 - RNA, 64 nt, Homo Sapiens
gguuuuugagcagaacucuuuugacaaguuccuuuuucagaauauuuuuuaaggugaaaauguu

SEQ ID NO: 337937 - RNA, 64 nt, Homo Sapiens
aauugaguagagcaaaaaugauaauaauaaacuuuuucagaaaguuccacacuuuauuuccuua

SEQ ID NO: 337938 - RNA, 64 nt, Homo Sapiens
guuucuccggcagaaccaacccuccaggacgaaguuucagaauuggcugauggucgugagugca

SEQ ID NO: 337939 - RNA, 64 nt, Homo Sapiens
caacagcuguaacccuuuccugagggccccgacuuuucagaauaggagcagagagaagcccaga

SEQ ID NO: 337940 - RNA, 64 nt, Homo Sapiens
ucucuaauugcuaguuguaaaacuguauccaaauuuucagaaaagacagcuucagcuugcaaau

SEQ ID NO: 337941 - RNA, 64 nt, Homo Sapiens
aagaugaaacuauuguaucucacaaaaaaucuuauuucagaauggaaauauuuuugagaaaagu

SEQ ID NO: 337942 - RNA, 64 nt, Homo Sapiens
uagaauacuaaaaggaaaaugucauguuaagcaauuucagaacauuaacugaacuauuuucaaa

SEQ ID NO: 337943 - RNA, 64 nt, Homo Sapiens
ccuuuuacagcguauuacuuagugaacauuacauuuucagaauagauccuaauauuuuauugag

SEQ ID NO: 337944 - RNA, 64 nt, Homo Sapiens
augcuuggaaacagcauagauauguugcugugguuuucagaauuuucucuuuuaaucacaagaa

SEQ ID NO: 337945 - RNA, 64 nt, Homo Sapiens
uaagaaaggccaugaaauagcuaugaagccucccuuucagaaaucuugaauugcuaaagaaggc

SEQ ID NO: 337946 - RNA, 64 nt, Homo Sapiens
guuccucaggauccuuuuaucuccaaaaccagcauuucagaaugcaucaaauaugaggagaaac

SEQ ID NO: 337947 - RNA, 64 nt, Homo Sapiens
gcaaaacaaacaggauaguuuaacuaaguuuauguuucagaacuccuuguuuggguaaaggcag

SEQ ID NO: 337948 - RNA, 64 nt, Homo Sapiens
aauuauguaucccuucucuuggaggggaucgugauuucagaaugaugcaccuuuucugugagga

SEQ ID NO: 337949 - RNA, 64 nt, Homo Sapiens
uauuuaauuucuucauaaaaauaaaauaauucuuuuucagaaaauuuguugcuagagaacaaua

SEQ ID NO: 337950 - RNA, 64 nt, Homo Sapiens
aaagauauucauugcacauuaauucaugguugaguuucagaacaaaucauauugaugaaaucgu

SEQ ID NO: 337951 - RNA, 64 nt, Homo Sapiens
ucaauacaguuuugucuucagcauaaaguguuuauuucagaauaaacuggucaauauaguggca

SEQ ID NO: 337952 - RNA, 64 nt, Homo Sapiens
cauaagaguuuauuuguuggaauuuuuuuuuuuuuuucagaaucuuuaugccccuuugagccaa

SEQ ID NO: 337953 - RNA, 64 nt, Homo Sapiens
ggauaauuagguauucgaauuauucuuuuaauuguuucagaauauuauggcaauuuaacaugug

SEQ ID NO: 337954 - RNA, 64 nt, Homo Sapiens
agaaaugaacauaaucaaguauuuuugauacaguuuucagaaaaaaacaaacuccauuacucug

SEQ ID NO: 337955 - RNA, 64 nt, Homo Sapiens
cuaauuccaguaucauacuuuaaauguuaauggauuucagaagcgcauuguccucugaguuggu

SEQ ID NO: 337956 - RNA, 64 nt, Homo Sapiens
aucaagcuacccucaagaguuucugggcuggauguuucagaacaacaucuacaccaguaaagug

SEQ ID NO: 337957 - RNA, 64 nt, Homo Sapiens
gguaauuuucuaucccuuauaaguuugucuuuucuuucagaaacaucucuuagccuaauuugaa

SEQ ID NO: 337958 - RNA, 64 nt, Homo Sapiens
ucucaaaauacguguucaaauguaccuaugugaguuucagaaauucuguauauucccuguggaa

SEQ ID NO: 337959 - RNA, 64 nt, Homo Sapiens
uuugaagcaccaugguguguauuagugccaaguuuuucagaaaggcaaugagugugccagaguu

SEQ ID NO: 337960 - RNA, 64 nt, Homo Sapiens
ugacuucuaugaagcuuuuuuuuuaaugugaaauuuucagaauguuguuuuuuucauguagaua

SEQ ID NO: 337961 - RNA, 64 nt, Homo Sapiens
aagaacaaggaagggaaugaucuuuacucaagaauuucagaaagucagcacugaaguccugacc

SEQ ID NO: 337962 - RNA, 64 nt, Homo Sapiens
gaugcauacagcaauuuguaauaaguauuucauguuucagaaaucaauguagaguuacgcuuuu

SEQ ID NO: 337963 - RNA, 64 nt, Homo Sapiens
cauacuuuuguuuugcaacaacaggaaggaaaccuuucagaagugaagucaugcaaauuguaaa

SEQ ID NO: 337964 - RNA, 64 nt, Homo Sapiens
uuggaaaccugaagcagcagagcuugacaggguguuucagaaacuaagacagggacucagcagg

SEQ ID NO: 337965 - RNA, 59 nt, Homo Sapiens
cagggucugguccuggcuccgagcgagccuuucagaagcuggugguauguacaagauga

SEQ ID NO: 337966 - RNA, 64 nt, Homo Sapiens
augcaaaacgucaaaaucugauacgugcauguuauuucagaauuuauucucaauuuaucaaugg

SEQ ID NO: 337967 - RNA, 64 nt, Homo Sapiens
agcucagcccaucucuaauuugguuuuauuauuauuucagaacuauacucgaaugucagguuuu

SEQ ID NO: 337968 - RNA, 64 nt, Homo Sapiens
gcuaccaugaagugaaaaugcuguguaaauaaacuuucagaacucacuucuagcucggaacuua

SEQ ID NO: 337969 - RNA, 64 nt, Homo Sapiens
acuggcaucacacgcagguuucuucuuuucuuaguuucagaaguaauucuccaacccaaaguau

SEQ ID NO: 337970 - RNA, 64 nt, Homo Sapiens
auagcaaugacauaaaaacucaguuucucaguuguuucagaaacucucagcuuucuccaccuuu

SEQ ID NO: 337971 - RNA, 64 nt, Homo Sapiens
cagcagagcugucaacucuucacucucccaaguuuuucagaaacugugcauaugugugcauugc

SEQ ID NO: 337972 - RNA, 64 nt, Homo Sapiens
uggcuuucuuccauuguuguuuuuguagcauuuauuucagaaauguguauuuccauaauccaga

SEQ ID NO: 337973 - RNA, 64 nt, Homo Sapiens
gguuuucuuaaugccagugugaauuugcagauguuuucagaaaaucaagucacaguaacaauuu

SEQ ID NO: 337974 - RNA, 64 nt, Homo Sapiens
agagaccaaccauauuugggaugaguguaaaagcuuucagaaauaaguuacaaaucuuuguaga

SEQ ID NO: 337975 - RNA, 64 nt, Homo Sapiens
cauuuuacccauuguuggauaaugguaaucucuuuuucagaauuuugagucuguaauucauuug

SEQ ID NO: 337976 - RNA, 64 nt, Homo Sapiens
aauuguauaaccagaauuguuccugccuuuagcuuuucagaacuugagauguggcagcacugga

SEQ ID NO: 337977 - RNA, 64 nt, Homo Sapiens
ugcuguacauuuuggcccuuacgaaauacgucuuuuucagaacuguuaaaguuuugauguacau

SEQ ID NO: 337978 - RNA, 64 nt, Homo Sapiens
uggaaaaaagugaaugagaccucugauaggggguuuucagaaccuuguucacaccaaaauguga

SEQ ID NO: 337979 - RNA, 64 nt, Homo Sapiens
cacuaaaguuuuguuucagcaguggcucaaaaaauuucagaaauuacuuuuguaauuauuugca

SEQ ID NO: 337980 - RNA, 64 nt, Homo Sapiens
cuacaguacaauauauuaugaaucagagaauguauuucagaauacuguaauaaaugguauugau

SEQ ID NO: 337981 - RNA, 64 nt, Homo Sapiens
cagacuuaguuguuaaaauguugugaguuuauauuuucagaauuaaacagucuuccacuaaccu

SEQ ID NO: 337982 - RNA, 64 nt, Homo Sapiens
aggauaguauaaaagcaucauauggcugacccuguuucagaagcaaaauuggaggugcuggugg

SEQ ID NO: 337983 - RNA, 64 nt, Homo Sapiens
caaucgugaaggaacaggcauuguuaucuaaauguuucagaauugaaaacucaacuguuucucu

SEQ ID NO: 337984 - RNA, 64 nt, Homo Sapiens
cugguaauuuuagugaucuuauuugauuagacuuuuucagaaguacuaaauaaggaauuuuaac

SEQ ID NO: 337985 - RNA, 64 nt, Homo Sapiens
ucacaaggggaaauuuaagauuguuaacccuguuuuucagaagggcuacuguuaauugcacaua

SEQ ID NO: 337986 - RNA, 64 nt, Homo Sapiens
gcuuucauaauauguaacuuuuggguucugccuuuuucagaaaauggaaacuugggccaugugu

SEQ ID NO: 337987 - RNA, 64 nt, Homo Sapiens
gaaauuuuucucugccuuucaguuuuaugaauuuuuucagaaguaacaauauuauuauugacuu

SEQ ID NO: 337988 - RNA, 64 nt, Homo Sapiens
ugauuauguaguucaguaagaugugcccaagucauuucagaaagaaagacccuucaguuuugau

SEQ ID NO: 337989 - RNA, 64 nt, Homo Sapiens
uuuuagcaauaauucguuaaugauuccacuugauuuucagaauauuguccugguugauuuugau

SEQ ID NO: 337990 - RNA, 64 nt, Homo Sapiens
aagaauauuuuucauaauauuuuccugacauuguuuucagaauauuuagagaacucagguauuc

SEQ ID NO: 337991 - RNA, 64 nt, Homo Sapiens
caauucuucucauuugucaguaugucaagcugaauuucagaagcuguggaugauauuuguucaa

SEQ ID NO: 337992 - RNA, 64 nt, Homo Sapiens
caaagggcauuuagaggaagcauuuucagaaaucuuucagaacucccaaggucacaaggccgaa

SEQ ID NO: 337993 - RNA, 64 nt, Homo Sapiens
cuuucagaacucaaagggcaacaaggccgaacauuuucagaaauagcagguguuacccaagguc

SEQ ID NO: 337994 - RNA, 64 nt, Homo Sapiens
aaaaggccgggcgcgguggccaacagcaccugaauuucagaaacucuuugucuaagagcugugg

SEQ ID NO: 337995 - RNA, 64 nt, Homo Sapiens
uuccuggaaauuccaauguccaacauuuaaaagauuucagaaggugcauguaaauauauacucu

SEQ ID NO: 337996 - RNA, 64 nt, Homo Sapiens
uuaaauaucuaaagggaaaggaaaccaacuuuaauuucagaacuucucuuuacgucuuguaugu

SEQ ID NO: 337997 - RNA, 64 nt, Homo Sapiens
guuacagaauucuuuuugguacuuucacuuauucuuucagaauacaucaaggaugugauuuaug

SEQ ID NO: 337998 - RNA, 64 nt, Homo Sapiens
ggcaaugccuggcccacuccucuuccuuuucacauuucagaaucagggcauucaucuuugaugu

SEQ ID NO: 337999 - RNA, 64 nt, Homo Sapiens
aaaaucauuugggauuccuacuucuugagucucguuucagaaggcaggaaccuugcacuucaca

SEQ ID NO: 338000 - RNA, 64 nt, Homo Sapiens
caucccuuguaaagcuaaaauaguuacuucaaauuuucagaaaagauguauauagucaaaauuu

SEQ ID NO: 338001 - RNA, 64 nt, Homo Sapiens
uuucuuuucaugugcccagcagguuaaguagcguuuucagaauauacauuauucccauccauug

SEQ ID NO: 338002 - RNA, 64 nt, Homo Sapiens
cagccuucaaaagaauuggcacugggauaagauuuuucagaaaaagaaaaacaucggcaaacug

SEQ ID NO: 338003 - RNA, 64 nt, Homo Sapiens
caucgcugagcaaauggagcuugcuauguuuuaauuucagaaaauuuccucauauacguagugu

SEQ ID NO: 338004 - RNA, 64 nt, Homo Sapiens
agauauuuuuaaaauccaagagcuucucuauacuuuucagaaauauccagaugcagugaacugc

SEQ ID NO: 338005 - RNA, 64 nt, Homo Sapiens
ucuuacuuuuaaauuccaacuuaaaauuaugagguuucagaaauauauugaaaguuuaacaaug

SEQ ID NO: 338006 - RNA, 64 nt, Homo Sapiens
cauauacauguaagcuacaaagugugauuuuuauuuucagaaguagcagaaagauuauguuaga

SEQ ID NO: 338007 - RNA, 64 nt, Homo Sapiens
uggguuuuaauagcaguauuuuccaaaaugccguuuucagaaccauaaaaaaaaaaaaaaagau

SEQ ID NO: 338008 - RNA, 64 nt, Homo Sapiens
agaagaaaagugagagcuucauguauaaaaguacuuucagaauuugcugaaaugccauuucaga

SEQ ID NO: 338009 - RNA, 64 nt, Homo Sapiens
uauaaaaguacuuucagaaucugcugaaaugccauuucagaaugugccaccuucauuuuuccau

SEQ ID NO: 338010 - RNA, 64 nt, Homo Sapiens
gcaguuuugauuauaugugaaauacaaauguuuauuucagaaggguauucccauuuuuaaaaua

SEQ ID NO: 338011 - RNA, 64 nt, Homo Sapiens
ucuucauauugauuauuagcuagcauugauuuaauuucagaacauuauaaacacagccuuucuu

SEQ ID NO: 338012 - RNA, 64 nt, Homo Sapiens
auaggagauagcucuguagagagccaaaaacuuguuucagaaagugcagaaagccagaggacua

SEQ ID NO: 338013 - RNA, 64 nt, Homo Sapiens
augagagagaacucuguggagauccaaagacuuguuucagaaaguacagaaagccagaggacua

SEQ ID NO: 338014 - RNA, 64 nt, Homo Sapiens
auggaagagaguucuuuggagaggccaagacuuguuucagaaagugcagaaagccagaggacua

SEQ ID NO: 338015 - RNA, 64 nt, Homo Sapiens
acagauaaaugauucaaaaaauaauugugugauauuucagaaauuuuuucucuagaguagaggu

SEQ ID NO: 338016 - RNA, 64 nt, Homo Sapiens
ccuuucauuuugcuuuaauuaucaguaguuugcauuucagaaaguguugcugauuuuauucuug

SEQ ID NO: 338017 - RNA, 64 nt, Homo Sapiens
uuaaauauuaagcaugacagcucuugucuuccuauuucagaaguaaauuugcagcuuccaaugc

SEQ ID NO: 338018 - RNA, 64 nt, Homo Sapiens
aaauguacuguauacuuuucuagauugucucauauuucagaauaaccacaacugcauguuggau

SEQ ID NO: 338019 - RNA, 64 nt, Homo Sapiens
ugaacacccuugugauagaacaguuauuagcacauuucagaaaaggaaaggaaggcaaucgaca

SEQ ID NO: 338020 - RNA, 64 nt, Homo Sapiens; identical to SEQ ID NO: 338000

SEQ ID NO: 338021 - RNA, 64 nt, Homo Sapiens; identical to SEQ ID NO: 338001

SEQ ID NO: 338022 - RNA, 64 nt, Homo Sapiens
ggccucagugacuguguugcuaaacccaguggucaguucucaguucucagccaucagcagcauu

SEQ ID NO: 338023 - RNA, 64 nt, Homo Sapiens
gugacuguguugcuaaacccaguggucaguucucaguucucagccaucagcagcauuugcucgc

SEQ ID NO: 338024 - RNA, 64 nt, Homo Sapiens
ggauuagaaacaaacaaaacucuuaaguccuaaaaguucucaauguagaggcauaaaccugugc

SEQ ID NO: 338025 - RNA, 64 nt, Homo Sapiens
aguggaggcuggaugugcauuagccuggauccucaguucucaaauguguguggcagccaggaug

SEQ ID NO: 338026 - RNA, 64 nt, Homo Sapiens
gccuguccgauuuuuccauggguuccaguuucagaguucucauuauuacucaaaguaaaagcgg

SEQ ID NO: 338027 - RNA, 64 nt, Homo Sapiens
cuguccguguuacauaaucaagugcaauauacucaguucucaugcaggugacauucuaccauga

SEQ ID NO: 338028 - RNA, 64 nt, Homo Sapiens
uuuucuuauaggagaaauauugccuucaugguacaguucucagugagaguaggcaaacaaauuu

SEQ ID NO: 338029 - RNA, 64 nt, Homo Sapiens
ugcagggaagaaguuuggcacauaaucauaauacaguucucagauauaauguauguguaauaua

SEQ ID NO: 338030 - RNA, 64 nt, Homo Sapiens
caccccaguuuuuccuccagccuuggaaaacuuaaguucucauucagaggauuugaaccauaau

SEQ ID NO: 338031 - RNA, 64 nt, Homo Sapiens
uuuuuaaccuguuauagauugcucuagaaaguugaguucucauuugcccucgagaagaguuauu

SEQ ID NO: 338032 - RNA, 64 nt, Homo Sapiens
gguaaaggcaucagaugucuuaaaguccuagcugaguucucaauacugcaaauggcauaaaaau

SEQ ID NO: 338033 - RNA, 64 nt, Homo Sapiens
cuuuagcaugugaagagucaggcagucacccggcaguucucaaacaaucaagcucaccaugcag

SEQ ID NO: 338034 - RNA, 64 nt, Homo Sapiens
uuuacagcuuuuuuuugucaauacaaaucacuacaguucucagaagauaucuauaacuauaggg

SEQ ID NO: 338035 - RNA, 64 nt, Homo Sapiens
gcugcccugccuguuuuagguguuauguagagcuaguucucaaagacauggaacagcagguagu

SEQ ID NO: 338036 - RNA, 64 nt, Homo Sapiens
cgagcuaaucuugucauuaaacucucggccugccaguucucaaggcagcucuggagcuccacca

SEQ ID NO: 338037 - RNA, 64 nt, Homo Sapiens
aacugagcccagaguaacuguggcuccuuuccgaaguucucaguaccguguguucggacggcac

SEQ ID NO: 338038 - RNA, 64 nt, Homo Sapiens
cuuuaaaagaaaggagagaacauuuuagaacaauaguucucaaaguguguuccccggacaagca

SEQ ID NO: 338039 - RNA, 64 nt, Homo Sapiens
agcacaggcugacaccaaaguggcacaacugcacaguucucagauuucuuugcacagauugauu

SEQ ID NO: 338040 - RNA, 64 nt, Homo Sapiens
uuuaacuauaagaagucacggaauggucacuggcaguucucacucaugcuaauuuucauuucua

SEQ ID NO: 338041 - RNA, 64 nt, Homo Sapiens
uuuguuuucugaaacagacggucauuugcacgugaguucucaucgcaaugucuuugagaaugca

SEQ ID NO: 338042 - RNA, 64 nt, Homo Sapiens
caaauauaaagaaugugacaaagcuuuuuaaggaaguucucaacccuuauuacacauaauucau

SEQ ID NO: 338043 - RNA, 64 nt, Homo Sapiens
ugaagaauguggcaaaaccuauaaaccuauaacaaguucucaauuccuuuuuuuuugagaugga

SEQ ID NO: 338044 - RNA, 64 nt, Homo Sapiens
uugaaaugugaugaauguggcauagccucuucccaguucucaacucuuacuaaacaugagaaca

SEQ ID NO: 338045 - RNA, 64 nt, Homo Sapiens
cuacaaauaugaagaaugugacaaggccuuuaaaaguucucaacccuuauuacacauaauuuau

SEQ ID NO: 338046 - RNA, 64 nt, Homo Sapiens
cuugggaucuuguuuagagaauccacuuucuggaaguucucagcauaauuaguguugagagugg

SEQ ID NO: 338047 - RNA, 64 nt, Homo Sapiens
aauuuauuaacagucagggccuauccuugccuguaguucucagucacuggaugcacaaaaucac

SEQ ID NO: 338048 - RNA, 64 nt, Homo Sapiens
agaucugguuuuuugaaaguauaagaucucagugaguucucaugucuugugauagugaguucuc

SEQ ID NO: 338049 - RNA, 64 nt, Homo Sapiens
agaucucagugaguucucauuucuugugauagugaguucucauaggcggacuucccccuugcug

SEQ ID NO: 338050 - RNA, 64 nt, Homo Sapiens
gugcacgaguccucagcacuuucucauggucagaaguucucaugcccaaauccggaagucaaag

SEQ ID NO: 338051 - RNA, 64 nt, Homo Sapiens
gucagaaguucucauggugcaauccggaagucaaaguucucaugucaccugggcagauccccca

SEQ ID NO: 338052 - RNA, 64 nt, Homo Sapiens; identical to SEQ ID NO: 193119

SEQ ID NO: 338053 - RNA, 64 nt, Homo Sapiens; identical to SEQ ID NO: 193120

SEQ ID NO: 338054 - RNA, 64 nt, Homo Sapiens; identical to SEQ ID NO: 193121

SEQ ID NO: 338055 - RNA, 64 nt, Homo Sapiens; identical to SEQ ID NO: 193122

SEQ ID NO: 338056 - RNA, 64 nt, Homo Sapiens; identical to SEQ ID NO: 193123

SEQ ID NO: 338057 - RNA, 64 nt, Homo Sapiens; identical to SEQ ID NO: 193124

SEQ ID NO: 338058 - RNA, 64 nt, Homo Sapiens; identical to SEQ ID NO: 193125

SEQ ID NO: 338059 - RNA, 64 nt, Homo Sapiens; identical to SEQ ID NO: 193126

SEQ ID NO: 338060 - RNA, 64 nt, Homo Sapiens; identical to SEQ ID NO: 193127

SEQ ID NO: 338061 - RNA, 64 nt, Homo Sapiens; identical to SEQ ID NO: 193128

SEQ ID NO: 338062 - RNA, 64 nt, Homo Sapiens; identical to SEQ ID NO: 193129

SEQ ID NO: 338063 - RNA, 64 nt, Homo Sapiens; identical to SEQ ID NO: 193130

SEQ ID NO: 338064 - RNA, 64 nt, Homo Sapiens; identical to SEQ ID NO: 193131

SEQ ID NO: 338065 - RNA, 64 nt, Homo Sapiens; identical to SEQ ID NO: 193132

SEQ ID NO: 338066 - RNA, 60 nt, Homo Sapiens
uucaauuaagguacuucucccucagggacguagaacaauggaaugucagucagucucugu

SEQ ID NO: 338067 - RNA, 60 nt, Homo Sapiens; identical to SEQ ID NO: 338066

SEQ ID NO: 338068 - RNA, 60 nt, Homo Sapiens
acagcauuuuacuacauaguuuuuauuguauagaacaaguuuuuacaaaagaaguaucug

SEQ ID NO: 338069 - RNA, 60 nt, Homo Sapiens
gcaugagugguauuucaguuuuuggcacuuuagaacaaauguuaauaaguuagacagaac

SEQ ID NO: 338070 - RNA, 60 nt, Homo Sapiens
uauuuaguaaagcuuuauaagauguuucucuagaacaaaauauuuucacauaagucaaua

SEQ ID NO: 338071 - RNA, 60 nt, Homo Sapiens
ucacuaucucagaaauaccugagcaaaacauagaacaaaacagugacaaucaucauauug

SEQ ID NO: 338072 - RNA, 60 nt, Homo Sapiens
aauccuaggaacuguauacuaguuccuacuuagaacaaaaguaucaaguuugcacacaag

SEQ ID NO: 338073 - RNA, 60 nt, Homo Sapiens
uacuuuacuuguauuaucccauuuaauacuuagaacaaccccgugagauaaguaguuauu

SEQ ID NO: 338074 - RNA, 60 nt, Homo Sapiens
auguauuaaauauuuuaaaaucauucuuuguagaacaaaauuguaauauuuaagaaaugc

SEQ ID NO: 338075 - RNA, 60 nt, Homo Sapiens
ccgcccugacuuuacaggggcaugaucuccuagaacaaaacuuugagaacugcuugacuc

SEQ ID NO: 338076 - RNA, 60 nt, Homo Sapiens
gaaagaaauuugacucauaaacuuccaaguuagaacaaauauuucuucauuauuguugcu

SEQ ID NO: 338077 - RNA, 60 nt, Homo Sapiens
ugucucaguaauuagaaaucccuuaauaaguagaacaaauguggcaaguaggacuccuau

SEQ ID NO: 338078 - RNA, 64 nt, Homo Sapiens; identical to SEQ ID NO: 23640

SEQ ID NO: 338079 - RNA, 64 nt, Homo Sapiens; identical to SEQ ID NO: 23641

SEQ ID NO: 338080 - RNA, 64 nt, Homo Sapiens; identical to SEQ ID NO: 23642

SEQ ID NO: 338081 - RNA, 64 nt, Homo Sapiens; identical to SEQ ID NO: 23643

SEQ ID NO: 338082 - RNA, 64 nt, Homo Sapiens; identical to SEQ ID NO: 23644

SEQ ID NO: 338083 - RNA, 64 nt, Homo Sapiens; identical to SEQ ID NO: 23645

SEQ ID NO: 338084 - RNA, 64 nt, Homo Sapiens; identical to SEQ ID NO: 23646

SEQ ID NO: 338085 - RNA, 64 nt, Homo Sapiens; identical to SEQ ID NO: 23647

SEQ ID NO: 338086 - RNA, 64 nt, Homo Sapiens; identical to SEQ ID NO: 23648

SEQ ID NO: 338087 - RNA, 64 nt, Homo Sapiens; identical to SEQ ID NO: 23649

SEQ ID NO: 338088 - RNA, 64 nt, Homo Sapiens; identical to SEQ ID NO: 23650

SEQ ID NO: 338089 - RNA, 64 nt, Homo Sapiens; identical to SEQ ID NO: 23651

SEQ ID NO: 338090 - RNA, 64 nt, Homo Sapiens; identical to SEQ ID NO: 23652

SEQ ID NO: 338091 - RNA, 64 nt, Homo Sapiens; identical to SEQ ID NO: 23653

SEQ ID NO: 338092 - RNA, 64 nt, Homo Sapiens; identical to SEQ ID NO: 23654

SEQ ID NO: 338093 - RNA, 64 nt, Homo Sapiens; identical to SEQ ID NO: 23655

SEQ ID NO: 338094 - RNA, 64 nt, Homo Sapiens; identical to SEQ ID NO: 23656

SEQ ID NO: 338095 - RNA, 64 nt, Homo Sapiens; identical to SEQ ID NO: 23657

SEQ ID NO: 338096 - RNA, 64 nt, Homo Sapiens; identical to SEQ ID NO: 23658

SEQ ID NO: 338097 - RNA, 64 nt, Homo Sapiens; identical to SEQ ID NO: 23659

SEQ ID NO: 338098 - RNA, 64 nt, Homo Sapiens; identical to SEQ ID NO: 23660

SEQ ID NO: 338099 - RNA, 64 nt, Homo Sapiens; identical to SEQ ID NO: 23661

SEQ ID NO: 338100 - RNA, 64 nt, Homo Sapiens; identical to SEQ ID NO: 23662

SEQ ID NO: 338101 - RNA, 64 nt, Homo Sapiens; identical to SEQ ID NO: 23663

SEQ ID NO: 338102 - RNA, 64 nt, Homo Sapiens; identical to SEQ ID NO: 23664

SEQ ID NO: 338103 - RNA, 64 nt, Homo Sapiens; identical to SEQ ID NO: 23665

SEQ ID NO: 338104 - RNA, 64 nt, Homo Sapiens; identical to SEQ ID NO: 23666

SEQ ID NO: 338105 - RNA, 64 nt, Homo Sapiens; identical to SEQ ID NO: 23667

SEQ ID NO: 338106 - RNA, 64 nt, Homo Sapiens; identical to SEQ ID NO: 23668

SEQ ID NO: 338107 - RNA, 64 nt, Homo Sapiens; identical to SEQ ID NO: 23669

SEQ ID NO: 338108 - RNA, 64 nt, Homo Sapiens; identical to SEQ ID NO: 23670

SEQ ID NO: 338109 - RNA, 64 nt, Homo Sapiens
ucccuggaccucagaggugacacccauugggcccuuccggcaugcccccaguuacuguaaaugu

SEQ ID NO: 338110 - RNA, 64 nt, Homo Sapiens
uaucuccaggagagcagggcagccuaugcaaguguuccggcaggaccagaaguggccacucaac

SEQ ID NO: 338111 - RNA, 64 nt, Homo Sapiens
gaaaacccagaugguguuaacuggccgccccacuuuccggcauaacuuuuuagaaaacagaaau

SEQ ID NO: 338112 - RNA, 64 nt, Homo Sapiens
cuuggguggaucaggacaccugaagaagagaagcuuccggcaacccugcaacccacccaaggag

SEQ ID NO: 338113 - RNA, 64 nt, Homo Sapiens
gugacacaagcugcuuuagcuaaagucccgcggguuccggcauggcuaggcugagagcagggau

SEQ ID NO: 338114 - RNA, 64 nt, Homo Sapiens
accacauucaugggacacuugcacugaccaguguuuccggcaaaguuguccacacuccccagcu

SEQ ID NO: 338115 - RNA, 64 nt, Homo Sapiens
uuuccccaggaaagggugaggacuccaagaagaguuccggcagcugggcggccaccugaggagu

SEQ ID NO: 338116 - RNA, 64 nt, Homo Sapiens
cacggaguggcuuugacagauaugccagaucauuuuccggcacacuccacugagaggacugguu

SEQ ID NO: 338117 - RNA, 64 nt, Homo Sapiens
uggaaaguaauccaguuugaaaugugaagauguauuccggcagaauagugaguagaaugacaug

SEQ ID NO: 338118 - RNA, 64 nt, Homo Sapiens
uuuaaauaaaaaccaagcaauuuuuuguuaaucuuuccggcauucguguuaccacucuuacuag

SEQ ID NO: 338119 - RNA, 64 nt, Homo Sapiens
gagaagcugcccuuugaguugcuuucuucaucccuuccggcaggguuguucuuaagagaauugg

SEQ ID NO: 338120 - RNA, 64 nt, Homo Sapiens
aggaccgagcccugggguaggaccccucccuuucuuccggcaaagccucgcccacagacggaca

SEQ ID NO: 338121 - RNA, 64 nt, Homo Sapiens
gcccugugcaugccauggucaagauuugcugcauuuccggcaaucuuuuuguagauauuuaaac

SEQ ID NO: 338122 - RNA, 64 nt, Homo Sapiens
uccaaggcugaggaccccaguggggaguguucuguuccggcauauccuggccguaacgauuuuu

SEQ ID NO: 338123 - RNA, 64 nt, Homo Sapiens
cuucuaaugcucaggguucuggagggcucuguccuuccggcaaggagaggcacacaugugugcc

SEQ ID NO: 338124 - RNA, 64 nt, Homo Sapiens
aggggaugcugcugaugugcagagacaucccuuuuuccggcacaugaauugggacgaccuucug

SEQ ID NO: 338125 - RNA, 64 nt, Homo Sapiens
auuuguagcuuaugucuugguguauggacaguuuuuccggcaaaaaugaagaaguaguuaaaaa

SEQ ID NO: 338126 - RNA, 64 nt, Homo Sapiens
cauugcgggggguaccaugcagccggugucugacuuccggcagcagcugcuggccugugccggg

SEQ ID NO: 338127 - RNA, 64 nt, Homo Sapiens
ccccaccugacacccacuggggugcacuuuaauguuccggcagcaagacuggggaacuucaggc

SEQ ID NO: 338128 - RNA, 64 nt, Homo Sapiens
cuuacuaauagucuuucuaugcaugagacugaccuuccggcauuuuguuuuauuucaccaggcu

SEQ ID NO: 338129 - RNA, 64 nt, Homo Sapiens
ccugggucuuccuacacuugcagugacuggaugauuccggcauuauggaugaagugaacccaug

SEQ ID NO: 338130 - RNA, 64 nt, Homo Sapiens
uggugucgucugugaaugcuaaguccaucacccuuuccggcacacugccaaauaaacagcuauu

SEQ ID NO: 338131 - RNA, 64 nt, Homo Sapiens
uucagaacaaccugaugagagcacaguaauagaguuccggcaugaccauuagcaugacuuuuaa

SEQ ID NO: 338132 - RNA, 64 nt, Homo Sapiens
cuccccgcugccccggaagaacagugaagguggcuuccggcacagcaaaagaucugugcacuga

SEQ ID NO: 338133 - RNA, 64 nt, Homo Sapiens
ccuuuuuggaaugcgagcucccaccagaagaagguuccggcacgaaucccauccccacgucugg

SEQ ID NO: 338134 - RNA, 64 nt, Homo Sapiens
cagcaggugcuucuggagacaagagcaaagccuuuuccggcagcccggaaccugggaugagaaa

SEQ ID NO: 338135 - RNA, 64 nt, Homo Sapiens
gacagagccagcagcugcgcuuggggcuggaguguuccggcaaacagcagcaaagagaagagca

SEQ ID NO: 338136 - RNA, 64 nt, Homo Sapiens
gacaauggaccggagagugguucugcacuugcgguuccggcauggccuggcccaccccacccac

SEQ ID NO: 338137 - RNA, 64 nt, Homo Sapiens
cacaucauucauguuuucuucccuuacucugaaguuccggcauuguuguccuccaccagcauuu

SEQ ID NO: 338138 - RNA, 64 nt, Homo Sapiens
ugcucccucagagcuacucuucacuugucccugcuuccggcaccaaguucauaauagagaucuu

SEQ ID NO: 338139 - RNA, 64 nt, Homo Sapiens
gaggcucugggacaaggcgggagguucgggggccuuccggcaggugaacgcagggcuggagagu

SEQ ID NO: 338140 - RNA, 64 nt, Homo Sapiens
gagcugaguuggccucgcccaggcgcuggcgggcuuccggcauuggcuugggcugucggggcgg

SEQ ID NO: 338141 - RNA, 56 nt, Homo Sapiens
ccaucggcccggggcccuagcgccuguuccggcagacccccgccgguggcugcugu

SEQ ID NO: 338142 - RNA, 64 nt, Homo Sapiens
aguagcaggcccgaaagaggcuuggagcucugaguuccggcaccccugcacacgagcagacacc

SEQ ID NO: 338143 - RNA, 64 nt, Homo Sapiens
uuaaaaaauacaugucuauuugucaaacauaagugggaaccaaagaaaaaaugugacaaguuug

SEQ ID NO: 338144 - RNA, 64 nt, Homo Sapiens
caucccauugccacuuuaccauucuauuucccaagggaaccaucagcaccaaccugcuaaaugc

SEQ ID NO: 338145 - RNA, 64 nt, Homo Sapiens
accucccaccaaccaaccacaugccccccgguaugggaaccagcaggcaggaaccucucagccg

SEQ ID NO: 338146 - RNA, 64 nt, Homo Sapiens
accucccaccaaccagccacaugccccccaguaugggaaccagcagccaggaaccucucagccg

SEQ ID NO: 338147 - RNA, 64 nt, Homo Sapiens
accucccaccaaccagccacaugccccccggugugggaaccagcagccaggaaccucucagccg

SEQ ID NO: 338148 - RNA, 64 nt, Homo Sapiens
gccugagucacagcugucaggguucuagaucucugggaaccaguuaggccucggugcuggccug

SEQ ID NO: 338149 - RNA, 64 nt, Homo Sapiens
accugagucacagcugucuagguucuagaccucugggaaccagcaguggugagugacuggccug

SEQ ID NO: 338150 - RNA, 64 nt, Homo Sapiens
guuacuuucuuguuuuuggaauucugguuguauugggaaccaaggcaguccaaggaauaucaaa

SEQ ID NO: 338151 - RNA, 64 nt, Homo Sapiens
guuacuuucuuguucuuggaaauucugauuguaugggaaccaagugcaguccaaggaauaucaa

SEQ ID NO: 338152 - RNA, 64 nt, Homo Sapiens; identical to SEQ ID NO: 99218

SEQ ID NO: 338153 - RNA, 64 nt, Homo Sapiens; identical to SEQ ID NO: 99219

SEQ ID NO: 338154 - RNA, 64 nt, Homo Sapiens; identical to SEQ ID NO: 99220

SEQ ID NO: 338155 - RNA, 64 nt, Homo Sapiens; identical to SEQ ID NO: 99221

SEQ ID NO: 338156 - RNA, 64 nt, Homo Sapiens; identical to SEQ ID NO: 99222

SEQ ID NO: 338157 - RNA, 64 nt, Homo Sapiens; identical to SEQ ID NO: 99223

SEQ ID NO: 338158 - RNA, 64 nt, Homo Sapiens; identical to SEQ ID NO: 99224

SEQ ID NO: 338159 - RNA, 64 nt, Homo Sapiens; identical to SEQ ID NO: 99225

SEQ ID NO: 338160 - RNA, 64 nt, Homo Sapiens; identical to SEQ ID NO: 99226

SEQ ID NO: 338161 - RNA, 64 nt, Homo Sapiens; identical to SEQ ID NO: 99227

SEQ ID NO: 338162 - RNA, 64 nt, Homo Sapiens; identical to SEQ ID NO: 99228

SEQ ID NO: 338163 - RNA, 64 nt, Homo Sapiens; identical to SEQ ID NO: 99229

SEQ ID NO: 338164 - RNA, 64 nt, Homo Sapiens; identical to SEQ ID NO: 99230

SEQ ID NO: 338165 - RNA, 64 nt, Homo Sapiens; identical to SEQ ID NO: 99231

SEQ ID NO: 338166 - RNA, 64 nt, Homo Sapiens; identical to SEQ ID NO: 99232

SEQ ID NO: 338167 - RNA, 64 nt, Homo Sapiens; identical to SEQ ID NO: 99233

SEQ ID NO: 338168 - RNA, 64 nt, Homo Sapiens; identical to SEQ ID NO: 99234

SEQ ID NO: 338169 - RNA, 64 nt, Homo Sapiens; identical to SEQ ID NO: 99235

SEQ ID NO: 338170 - RNA, 64 nt, Homo Sapiens; identical to SEQ ID NO: 99236

SEQ ID NO: 338171 - RNA, 64 nt, Homo Sapiens; identical to SEQ ID NO: 99237

SEQ ID NO: 338172 - RNA, 64 nt, Homo Sapiens; identical to SEQ ID NO: 99238

SEQ ID NO: 338173 - RNA, 64 nt, Homo Sapiens; identical to SEQ ID NO: 99239

SEQ ID NO: 338174 - RNA, 64 nt, Homo Sapiens; identical to SEQ ID NO: 99240

SEQ ID NO: 338175 - RNA, 64 nt, Homo Sapiens; identical to SEQ ID NO: 99241

SEQ ID NO: 338176 - RNA, 64 nt, Homo Sapiens; identical to SEQ ID NO: 193776

SEQ ID NO: 338177 - RNA, 64 nt, Homo Sapiens; identical to SEQ ID NO: 193777

SEQ ID NO: 338178 - RNA, 64 nt, Homo Sapiens; identical to SEQ ID NO: 193778

SEQ ID NO: 338179 - RNA, 64 nt, Homo Sapiens; identical to SEQ ID NO: 193779

SEQ ID NO: 338180 - RNA, 64 nt, Homo Sapiens; identical to SEQ ID NO: 193780

SEQ ID NO: 338181 - RNA, 64 nt, Homo Sapiens; identical to SEQ ID NO: 193781

SEQ ID NO: 338182 - RNA, 64 nt, Homo Sapiens; identical to SEQ ID NO: 193782

SEQ ID NO: 338183 - RNA, 64 nt, Homo Sapiens; identical to SEQ ID NO: 193783

SEQ ID NO: 338184 - RNA, 64 nt, Homo Sapiens; identical to SEQ ID NO: 193784

SEQ ID NO: 338185 - RNA, 64 nt, Homo Sapiens; identical to SEQ ID NO: 193785

SEQ ID NO: 338186 - RNA, 64 nt, Homo Sapiens; identical to SEQ ID NO: 193786

SEQ ID NO: 338187 - RNA, 64 nt, Homo Sapiens; identical to SEQ ID NO: 193787

SEQ ID NO: 338188 - RNA, 64 nt, Homo Sapiens; identical to SEQ ID NO: 193788

SEQ ID NO: 338189 - RNA, 64 nt, Homo Sapiens; identical to SEQ ID NO: 193789

SEQ ID NO: 338190 - RNA, 64 nt, Homo Sapiens; identical to SEQ ID NO: 193790

SEQ ID NO: 338191 - RNA, 64 nt, Homo Sapiens
guggguuggggagggguggauacaauuuggagcauaacuggaggaaacaugaaaauuuuugagu

SEQ ID NO: 338192 - RNA, 64 nt, Homo Sapiens
ugaaggaaaggggcgagggaccuuguaaaugcucuaacuggacacucgaauaaaaucugcugca

SEQ ID NO: 338193 - RNA, 64 nt, Homo Sapiens
ucaaaauacuuuuuaaggauggcacaguaccauauaacuggaguaauaaaacaugagcuuacau

SEQ ID NO: 338194 - RNA, 64 nt, Homo Sapiens
gaaaaggaaauagguuuuagguggcauaguggcuuaacuggacugaauucaaauauucuuucaa

SEQ ID NO: 338195 - RNA, 64 nt, Homo Sapiens
uuuggguuaaaagaaucacagcacuugaaagaucuaacuggauaagagccuguaucuggauuua

SEQ ID NO: 338196 - RNA, 64 nt, Homo Sapiens
uuaguguacagcccauguccacccacucuaaaauuaacuggacacuuacuuaguucuuagcuac

SEQ ID NO: 338197 - RNA, 64 nt, Homo Sapiens
cacugauccauaacuuuccuuaguuuugugcuuauaacuggagaucuuuuggcuuuucuauguu

SEQ ID NO: 338198 - RNA, 64 nt, Homo Sapiens
aacacgggcauuuguauuuuguaauuuuuuuaaauaacuggacauaugucauuuuaaggacaau

SEQ ID NO: 338199 - RNA, 64 nt, Homo Sapiens
ugucacuaacccugguuaucauuuuacaggcuuguaacuggauauucuaccagagcucucacua

SEQ ID NO: 338200 - RNA, 64 nt, Homo Sapiens
gccacagaauuagcccaaaauuaucaaagaacauuaacuggaaggucagguuuuucaaggaaca

SEQ ID NO: 338201 - RNA, 64 nt, Homo Sapiens
gugagaagucuccaccuggugacaauagguuuuuuacuuugacgucagcuuugcccuugacaug

SEQ ID NO: 338202 - RNA, 64 nt, Homo Sapiens
uaccugacucauuccagcaccgacuccaucaauguacuuugaaccucacuggauagauauuauu

SEQ ID NO: 338203 - RNA, 64 nt, Homo Sapiens
uagcauuugcaucauaaacagaucauaucauugcuacuuugacuaccuuauuugcuacaacaua

SEQ ID NO: 338204 - RNA, 64 nt, Homo Sapiens
ggcaaacgcuauuuaugcaucaucucuaucuucauacuuugaauguguacaaauuauaauaaug

SEQ ID NO: 338205 - RNA, 64 nt, Homo Sapiens
cacaaauaaguguuuauggaagaaaaacacugaauacuuugaacaauacaagcauacucuugua

SEQ ID NO: 338206 - RNA, 64 nt, Homo Sapiens
aauguauauuuuaaauuggagugcauauacauaguacuuugaauuuuuaaaaugacuugcacuu

SEQ ID NO: 338207 - RNA, 64 nt, Homo Sapiens
gccaaccaucuacaaaaacaaugaguaauuuuucuacuuugaagauacacagauggggacaaaa

SEQ ID NO: 338208 - RNA, 64 nt, Homo Sapiens
ugcacuguaagaacugaccucaggugugcagaucuacuuugauuugggguuuugauuaauucuu

SEQ ID NO: 338209 - RNA, 64 nt, Homo Sapiens
uauaugauauuugaacauacggggcaagaagaguuacuuugaguuaugcugaaaacugucagag

SEQ ID NO: 338210 - RNA, 64 nt, Homo Sapiens
ugugaguauacugugacauuaaucaaaguuuuuuuacuuugauuccuuugaguuugucaaaagc

SEQ ID NO: 338211 - RNA, 64 nt, Homo Sapiens
ucuguuguguaauguuuguauuuuugagcugucuuacuuugauaugcaauauccccuaagaugc

SEQ ID NO: 338212 - RNA, 64 nt, Homo Sapiens
auccaccuacaggaagccaaugggacacccucccuacuuugagauagucucauaccuugcaguc

SEQ ID NO: 338213 - RNA, 64 nt, Homo Sapiens
guucagaaagguauuaagggcuuaggccaaaucuuacuuugaguauguuaaaaaaaaaaaaaug

SEQ ID NO: 338214 - RNA, 64 nt, Homo Sapiens
auucauugagcagcauagaaguuuguuuacauguuacuuugagaugcuagguauuuguggaauu

SEQ ID NO: 338215 - RNA, 64 nt, Homo Sapiens
caauacuggaacugguaucuagcuacugaugucuuacuuugaguuuauuuaugcuucagaauac

SEQ ID NO: 338216 - RNA, 64 nt, Homo Sapiens
aagaauuaaguuuuuacuucuaauuauuuugcauuacuuugaguuaaauuugaauagaguauua

SEQ ID NO: 338217 - RNA, 64 nt, Homo Sapiens
ucuaggaaauaaaagauagaggugagagaugauuuacuuugagaaaagacauugugucaccuau

SEQ ID NO: 338218 - RNA, 64 nt, Homo Sapiens
auuugguuuaguuuucccacugguauuuauaguuuacuuugaauauuuauauuaauaauuagcu

SEQ ID NO: 338219 - RNA, 64 nt, Homo Sapiens
auuuauauuaauaauuagcuugguauuuauaguuuacuuugaauauuugguuuaguuuucccac

SEQ ID NO: 338220 - RNA, 64 nt, Homo Sapiens
aaagacauugugucaccuauggugagagaugauuuacuuugagaucuaggaaauaaaagauaga

SEQ ID NO: 338221 - RNA, 64 nt, Homo Sapiens
acuuuguuaagcugccuuuuuuuuuuuaacuuccuacuuugaugauaagcacucagauauauau

SEQ ID NO: 338222 - RNA, 64 nt, Homo Sapiens
auuuuagauuuguuaaaacuauuuuuuccauaaauacuuugaaacauauuuauauauuucaauu

SEQ ID NO: 338223 - RNA, 64 nt, Homo Sapiens
ggggggcuauuuuaaaugucaaggucagcaguguuacuuugaauguaaacugguauaauaggua

SEQ ID NO: 338224 - RNA, 64 nt, Homo Sapiens
accauaaaacacuaucugaugcacagaacaccucuacuuugagacucaccucucauaaagcuuc

SEQ ID NO: 338225 - RNA, 61 nt, Homo Sapiens
cacacaggauuccguuggugaaccuguaaaaacaaaacaaacaaaacaaaacaaaaaagac

SEQ ID NO: 338226 - RNA, 61 nt, Homo Sapiens
uuccguuggugaaccuguaaaaacaaaacaaacaaaacaaaacaaaaaagacaaaaccuaa

SEQ ID NO: 338227 - RNA, 61 nt, Homo Sapiens
uuggugaaccuguaaaaacaaaacaaacaaaacaaaacaaaaaagacaaaaccuaaaacug

SEQ ID NO: 338228 - RNA, 61 nt, Homo Sapiens
agccugguuacagagcaagacucugucucaaacaaaacaaaacaaaacaaaaacacacuac

SEQ ID NO: 338229 - RNA, 61 nt, Homo Sapiens
gguuacagagcaagacucugucucaaacaaaacaaaacaaaacaaaaacacacuacuguau

SEQ ID NO: 338230 - RNA, 61 nt, Homo Sapiens
cagagcaagacucugucucaaacaaaacaaaacaaaacaaaaacacacuacuguauuuugg

SEQ ID NO: 338231 - RNA, 61 nt, Homo Sapiens
auuacuguagugcugagguuauugaaguuauacaaaacacaucucagucucuguuucuugg

SEQ ID NO: 338232 - RNA, 61 nt, Homo Sapiens
uugaauauugaacucuaacaguuuucuacauacaaaacacagugucaugaagguuauucau

SEQ ID NO: 338233 - RNA, 61 nt, Homo Sapiens
ucuuuaaacagaacaagaauuuaaaauacagacaaaacacucauuauuuucuaauccauuu

SEQ ID NO: 338234 - RNA, 61 nt, Homo Sapiens
guauagaugccaagaugucuaaguuuauuagacaaaacagauaaggagagaaauaacuuua

SEQ ID NO: 338235 - RNA, 61 nt, Homo Sapiens
auuagagauugggucuuuccaacaaaacaaaacaaaacaaaagcgacacucggucucaaaa

SEQ ID NO: 338236 - RNA, 61 nt, Homo Sapiens
acaaaauuagagauuggguccaaaaaacaaaacaaaacaaagacagagcgacacucggucu

SEQ ID NO: 338237 - RNA, 61 nt, Homo Sapiens
acaaaacaaaauuagagauuggucucaaaaaacaaaacaaaugggugacagagcgacacuc

SEQ ID NO: 338238 - RNA, 61 nt, Homo Sapiens
auuaaacucaucaguugcaauuauauagaggacaaaacagccucagaaaaggcuaacaauu

SEQ ID NO: 338239 - RNA, 61 nt, Homo Sapiens
auuuugagaacaaagaugacgguaaaacaaaacaaaacaaccaaaggggaaagaacauaaa

SEQ ID NO: 338240 - RNA, 61 nt, Homo Sapiens
acaacauuuugagaacaaagauaaagguaaaacaaaacaaacuguacaaaggggaaagaac

SEQ ID NO: 338241 - RNA, 61 nt, Homo Sapiens
aaaacacuaggaguccacucaaaaaaacaaaacaaaacaaaacaucgugcagucgugucau

SEQ ID NO: 338242 - RNA, 61 nt, Homo Sapiens
acaaaaaaacacuaggagucgucauaaaaaaacaaaacaaagauccacaucgugcagucgu

SEQ ID NO: 338243 - RNA, 61 nt, Homo Sapiens
cuuccaaacaguguguugguauuaaaacaaaacaaaacaaauguugguuucaguggcugga

SEQ ID NO: 338244 - RNA, 61 nt, Homo Sapiens
acaaacuuccaaacagugugcuggaauuaaaacaaaacaaauucuauguugguuucagugg

SEQ ID NO: 338245 - RNA, 61 nt, Homo Sapiens
ccaguagcugaucuuaaggcuuuuuuaaaaaacaaaacaaaacaacaaaaaaaaaucuuua

SEQ ID NO: 338246 - RNA, 61 nt, Homo Sapiens
agcugaucuuaaggcuuuuuuaaaaaacaaaacaaaacaacaaaaaaaaaucuuuauaaga

SEQ ID NO: 338247 - RNA, 61 nt, Homo Sapiens
uuuggacuacagagugagacuccaucucaaaacaaaacaaaacaacaacagcaaaaaacaa

SEQ ID NO: 338248 - RNA, 61 nt, Homo Sapiens
acuacagagugagacuccaucucaaaacaaaacaaaacaacaacagcaaaaaacaacaaaa

SEQ ID NO: 338249 - RNA, 61 nt, Homo Sapiens
aaacaaaacaaaacaacaacagcaaaaaacaacaaaacaaaacacaaauacucucacaggg

SEQ ID NO: 338250 - RNA, 61 nt, Homo Sapiens
aaacaaaacaacaacagcaaaaaacaacaaaacaaaacacaaauacucucacagggcaugg

SEQ ID NO: 338251 - RNA, 61 nt, Homo Sapiens
uuagagcuuucaaacuggaaaaaaaaaugaaacaaaacaaauacaccaagaccaaaauagg

SEQ ID NO: 338252 - RNA, 61 nt, Homo Sapiens
gggagcuguagugauuggaacccacguuugcacaaaacauuuuugcagaaggaaagucaac

SEQ ID NO: 338253 - RNA, 61 nt, Homo Sapiens
gacuuaguacaaaguuucaauuuguuuccccacaaaacaaagcaauucuuucaagucaguu

SEQ ID NO: 338254 - RNA, 61 nt, Homo Sapiens
ggucugaauaauagcagaaaaaccaacaucuacaaaacauuaaacuaguguuauacuugau

SEQ ID NO: 338255 - RNA, 61 nt, Homo Sapiens
aaccaaaagauuuucuguccuaucugugguaacaaaacauuuuauucagauuuuauuuuug

SEQ ID NO: 338256 - RNA, 61 nt, Homo Sapiens
aucgcuuuaacuuuucuaaaaaacuuguaccacaaaacaauuaggaggugagcuaguuaac

SEQ ID NO: 338257 - RNA, 61 nt, Homo Sapiens
uucuccuucccaaggcagcuggauugaaaaaacaaaacaaaacaaaaaaacccaggggcgu

SEQ ID NO: 338258 - RNA, 61 nt, Homo Sapiens
cuucccaaggcagcuggauugaaaaaacaaaacaaaacaaaaaaacccaggggcgucaguc

SEQ ID NO: 338259 - RNA, 61 nt, Homo Sapiens
uuugaagauuguuuguaucuuuuuuuaaaaaacaaaacaaaacaaaaauccccaaaauaua

SEQ ID NO: 338260 - RNA, 61 nt, Homo Sapiens
agauuguuuguaucuuuuuuuaaaaaacaaaacaaaacaaaaauccccaaaauauauagaa

SEQ ID NO: 338261 - RNA, 61 nt, Homo Sapiens
ugccacacaucacccuuaccauucugauuacacaaaacaaaaaguuggauggguggguacu

SEQ ID NO: 338262 - RNA, 61 nt, Homo Sapiens
ccuagaguguuguugagaauacccaaugcacacaaaacaacuuacaggcacaaaaugaugg

SEQ ID NO: 338263 - RNA, 61 nt, Homo Sapiens
uaccaagaaagcacuuuguacauucuuguuuacaaaacacuacaaagaccaucgagacggc

SEQ ID NO: 338264 - RNA, 61 nt, Homo Sapiens
uuggcauauuuaagaguggcucucugcagcuacaaaacaucuaagcucaaguuugcugugc

SEQ ID NO: 338265 - RNA, 61 nt, Homo Sapiens
auucaagccacuagaauuauaauuuguuuuuacaaaacauuuuuugccaauaccaaguuuc

SEQ ID NO: 338266 - RNA, 61 nt, Homo Sapiens
ccucccuuccccagcagggcaacaaaacaaaacaaaacaaaaagauaaaaggucuugggaa

SEQ ID NO: 338267 - RNA, 61 nt, Homo Sapiens
acaaaccucccuuccccagcgggaaaacaaaacaaaacaaaggugcaagauaaaaggucuu

SEQ ID NO: 338268 - RNA, 61 nt, Homo Sapiens
acaaaacaaaccucccuuccgucuugggaaaacaaaacaaaucucuggugcaagauaaaag

SEQ ID NO: 338269 - RNA, 61 nt, Homo Sapiens
caauaaagucaccagcaguacggggcacuaaacaaaacaaccgaacucaaggcuuaauuaa

SEQ ID NO: 338270 - RNA, 61 nt, Homo Sapiens
gccacucuugaaaucacaagccagaccauguacaaaacacacacuucauauaaagguuacu

SEQ ID NO: 338271 - RNA, 61 nt, Homo Sapiens
gcuuaucuaaucuaaugagaagacaaacaaaacaaaacacauagaaguuaaacaagagcua

SEQ ID NO: 338272 - RNA, 61 nt, Homo Sapiens
acacagcuuaucuaaucuaaagcuaagacaaacaaaacaaauuuucuagaaguuaaacaag

SEQ ID NO: 338273 - RNA, 61 nt, Homo Sapiens
aacaaaaaacaaacaaacaauuaugaacaaaacaaaacaacguaguaucuuucucucuuuc

SEQ ID NO: 338274 - RNA, 61 nt, Homo Sapiens
acaacaacaaaaaacaaacacuuucuuaugaacaaaacaaagauaaguaguaucuuucucu

SEQ ID NO: 338275 - RNA, 61 nt, Homo Sapiens
gauauuauucuuguaguuuaccucuuuaaaaacaaaacaaaacaaaacaaaaaacuccccu

SEQ ID NO: 338276 - RNA, 61 nt, Homo Sapiens
uauucuuguaguuuaccucuuuaaaaacaaaacaaaacaaaacaaaaaacuccccuuccuc

SEQ ID NO: 338277 - RNA, 61 nt, Homo Sapiens
uuguaguuuaccucuuuaaaaacaaaacaaaacaaaacaaaaaacuccccuuccucacugc

SEQ ID NO: 338278 - RNA, 61 nt, Homo Sapiens
cuguuggauaauggcuguaaaauguuuaaaaacaaaacaaaacaaaaaagaggcacuaguc

SEQ ID NO: 338279 - RNA, 61 nt, Homo Sapiens
ggauaauggcuguaaaauguuuaaaaacaaaacaaaacaaaaaagaggcacuagucuaucu

SEQ ID NO: 338280 - RNA, 61 nt, Homo Sapiens
gagucagacuccgucccaaaaaaacaaacaaacaaaacaaaacaaaaaaaaacagaaguua

SEQ ID NO: 338281 - RNA, 61 nt, Homo Sapiens
agacuccgucccaaaaaaacaaacaaacaaaacaaaacaaaaaaaaacagaaguuacaaau

SEQ ID NO: 338282 - RNA, 61 nt, Homo Sapiens
gccuggaugacagagugagaccuugucucaaacaaaacaaaacaaaaaugaaauguucuag

SEQ ID NO: 338283 - RNA, 61 nt, Homo Sapiens
gaugacagagugagaccuugucucaaacaaaacaaaacaaaaaugaaauguucuaguuuug

SEQ ID NO: 338284 - RNA, 61 nt, Homo Sapiens
agccuaagaaguuauauauuuaaucagguagacaaaacaguucaaagcauaagguccaugg

SEQ ID NO: 338285 - RNA, 61 nt, Homo Sapiens
aacaauacaacaagaacaacacaaaaacaaaacaaaacaacuccuacuuuacacucucugu

SEQ ID NO: 338286 - RNA, 61 nt, Homo Sapiens
acaacaacaauacaacaagaucuguacaaaaacaaaacaaaauuucuccuacuuuacacuc

SEQ ID NO: 338287 - RNA, 61 nt, Homo Sapiens
auuuugugcaauuaacaaagaaauggcaaaaacaaaacauaaggauucugugauaauauuu

SEQ ID NO: 338288 - RNA, 61 nt, Homo Sapiens
aaaaaacaaggagaaguuguuuaaaaacaaaacaaaacaaaaccagagagagcuuggaaug

SEQ ID NO: 338289 - RNA, 61 nt, Homo Sapiens
acaaaaaaaaacaaggagaagaauguuaaaaacaaaacaaaaggggaccagagagagcuug

SEQ ID NO: 338290 - RNA, 61 nt, Homo Sapiens
acaauguuacaagaguaagauauaagacaaaacaaaacaggggauaggaguuauauauucu

SEQ ID NO: 338291 - RNA, 61 nt, Homo Sapiens
acaggacaauguuacaagagauucuuauaagacaaaacaaaugugaggauaggaguuauau

SEQ ID NO: 338292 - RNA, 61 nt, Homo Sapiens
gacgauguauguauuauaaugggucgcuaucacaaaacauuuacaaauuaaaucuucugga

SEQ ID NO: 338293 - RNA, 61 nt, Homo Sapiens
uagccaugaugggagacaggaaacaaggaccacaaaacaacacaacacgaagaugauacca

SEQ ID NO: 338294 - RNA, 61 nt, Homo Sapiens
acuguuguuucucuuucuugagcagaaaaaaacaaaacaaauagaaacacauuuucuggcu

SEQ ID NO: 338295 - RNA, 61 nt, Homo Sapiens
agcaaacacaaaacccaagggcuaaaacaaaacaaaacaugaaggaaucacacguggugca

SEQ ID NO: 338296 - RNA, 61 nt, Homo Sapiens
acaugagcaaacacaaaaccgugcagcuaaaacaaaacaaaggcacaaggaaucacacgug

SEQ ID NO: 338297 - RNA, 61 nt, Homo Sapiens
ugggcgacagagcgagacucugccucaaaaaacaaaacaaaacaaaacacucacccaucaa

SEQ ID NO: 338298 - RNA, 61 nt, Homo Sapiens
gacagagcgagacucugccucaaaaaacaaaacaaaacaaaacacucacccaucaacgaau

SEQ ID NO: 338299 - RNA, 61 nt, Homo Sapiens
agcgagacucugccucaaaaaacaaaacaaaacaaaacacucacccaucaacgaauauaga

SEQ ID NO: 338300 - RNA, 61 nt, Homo Sapiens
caaacaaauacaaucuaacuaacaaaacaaaacaaaacaaccaaguccugugaggcaaaaa

SEQ ID NO: 338301 - RNA, 61 nt, Homo Sapiens
acaaccaaacaaauacaaucaaaaaaacaaaacaaaacaaauuucacaaguccugugaggc

SEQ ID NO: 338302 - RNA, 61 nt, Homo Sapiens
acaaaacaaccaaacaaauagaggcaaaaaaacaaaacaaagacuauuucacaaguccugu

SEQ ID NO: 338303 - RNA, 61 nt, Homo Sapiens
guccugcauacucaccaccaaacaaaacaaaacaaaacacaauguguaaggcuugcuaaaa

SEQ ID NO: 338304 - RNA, 61 nt, Homo Sapiens
acacaguccugcauacucacuaaaaaacaaaacaaaacaaaagaaaauguguaaggcuugc

SEQ ID NO: 338305 - RNA, 61 nt, Homo Sapiens
acaaaacacaguccugcauacuugcuaaaaaacaaaacaaaacaaaagaaaauguguaagg

SEQ ID NO: 338306 - RNA, 61 nt, Homo Sapiens
uaggcuuuuccauaaguggcuuaaagcucauacaaaacaaaugaccugguuaaauacuguc

SEQ ID NO: 338307 - RNA, 61 nt, Homo Sapiens
gcuuugaaaaaacuuuaacacacaacaaggaacaaaacaaauaaaacuuguuuguggucag

SEQ ID NO: 338308 - RNA, 61 nt, Homo Sapiens
aacaggaaaaaaacaaaaaaaacaaaacaaaacaaaacaaaagccucggguaacacugaaa

SEQ ID NO: 338309 - RNA, 61 nt, Homo Sapiens
acaaaaacaggaaaaaaacaugaaaaacaaaacaaaacaaaagagaagccucggguaacac

SEQ ID NO: 338310 - RNA, 61 nt, Homo Sapiens
acaaaacaaaaacaggaaaaaacacugaaaaacaaaacaaaucuucagagaagccucgggu

SEQ ID NO: 338311 - RNA, 61 nt, Homo Sapiens
aagcugcaauuauccgccaacugcauuuaaaacaaaacaaaacagaaaaaucaaaauaaca

SEQ ID NO: 338312 - RNA, 61 nt, Homo Sapiens
gcaauuauccgccaacugcauuuaaaacaaaacaaaacagaaaaaucaaaauaacauugac

SEQ ID NO: 338313 - RNA, 61 nt, Homo Sapiens
uuguuuuaaauuuuucauaggggaguuuuggacaaaacagucacuggggagaucacugcca

SEQ ID NO: 338314 - RNA, 61 nt, Homo Sapiens
gggacaugagccagaguuuaaaagggaaccaacaaaacacuauaacuuaaaaggauggggu

SEQ ID NO: 338315 - RNA, 61 nt, Homo Sapiens
acauaagguauagcauuugguuuuuaagaaaacaaaacauuaagacgcaacucauuuuaua

SEQ ID NO: 338316 - RNA, 61 nt, Homo Sapiens
ucaccacagaauccauuuuuuucccaguuccacaaaacacucuguuugccuucaguuuuua

SEQ ID NO: 338317 - RNA, 61 nt, Homo Sapiens
aucuggagaugcugaauuuuuccaaaacaaaacaaaacaaaaaggaaacuaaggacuuggc

SEQ ID NO: 338318 - RNA, 61 nt, Homo Sapiens
acaaaaucuggagaugcugauuggcuccaaaacaaaacaaacugagaaggaaacuaaggac

SEQ ID NO: 338319 - RNA, 61 nt, Homo Sapiens
aagucuuuuguuugugaacauucaaaacaaaacaaaacaaaacagaauaucaccauugcag

SEQ ID NO: 338320 - RNA, 61 nt, Homo Sapiens
acaaaaagucuuuuguuuguugcaguucaaaacaaaacaaagcugcacagaauaucaccau

SEQ ID NO: 338321 - RNA, 61 nt, Homo Sapiens
gcaaaauauugaugaucaggaauaaaacaaaacaaaacaaaacugggacuccagaaccauu

SEQ ID NO: 338322 - RNA, 61 nt, Homo Sapiens
acaaagcaaaauauugaugaccauuaauaaaacaaaacaaauagggacugggacuccagaa

SEQ ID NO: 338323 - RNA, 61 nt, Homo Sapiens
aaaaccaauggauuuuaaccaggccagaaguacaaaacaaaugccaugaggauuucucuuu

SEQ ID NO: 338324 - RNA, 61 nt, Homo Sapiens
cagauagcaaauuuauauuccccaaagggcaacaaaacauacugguugacaguauaauuuu

SEQ ID NO: 338325 - RNA, 61 nt, Homo Sapiens
agccagaaguaaggacugaaggccucacaagacaaaacaggcguuaggccaauaaaagaag

SEQ ID NO: 338326 - RNA, 61 nt, Homo Sapiens
aaggagaaaaaguaauaaugaaucuacuuuaacaaaacaaaagagaaaucaucaguuaaga

SEQ ID NO: 338327 - RNA, 61 nt, Homo Sapiens
aaaaaagcgaaagacugcaguugugcuaaaaacaaaacaaaacaaacaaacaaacaaaaaa

SEQ ID NO: 338328 - RNA, 61 nt, Homo Sapiens
agcgaaagacugcaguugugcuaaaaacaaaacaaaacaaacaaacaaacaaaaaaguaaa

SEQ ID NO: 338329 - RNA, 61 nt, Homo Sapiens
uuuuaaaagauuugaaauaauuuuuaauaugacaaaacaaaaccaaaucuucuccuaugca

SEQ ID NO: 338330 - RNA, 61 nt, Homo Sapiens
aaugaaacacuuauacugacuuuaugggaagacaaaacaagauauaacuaagacauaugca

SEQ ID NO: 338331 - RNA, 61 nt, Homo Sapiens
ugugaagaaugaaguggaggaaguaacuuuuacaaaacauacccaguguuugggguguuuc

SEQ ID NO: 338332 - RNA, 61 nt, Homo Sapiens
gagccaacucacucuuaugaaaugggcuuuaacaaaacaagaaagaaacguacuuaacugu

SEQ ID NO: 338333 - RNA, 61 nt, Homo Sapiens
aaaagccuuucuguugcaacuaugaaugaaaacaaaacaccacaaaacagacuucacuaac

SEQ ID NO: 338334 - RNA, 61 nt, Homo Sapiens
cuguugcaacuaugaaugaaaacaaaacaccacaaaacagacuucacuaacacagaaaaac

SEQ ID NO: 338335 - RNA, 61 nt, Homo Sapiens
augugacuaguuacaaaagcaauaaauugaaacaaaacaaaacaaaacaaaacuuguuucu

SEQ ID NO: 338336 - RNA, 61 nt, Homo Sapiens
acuaguuacaaaagcaauaaauugaaacaaaacaaaacaaaacaaaacuuguuucuuaaaa

SEQ ID NO: 338337 - RNA, 61 nt, Homo Sapiens
uuacaaaagcaauaaauugaaacaaaacaaaacaaaacaaaacuuguuucuuaaaaaugcg

SEQ ID NO: 338338 - RNA, 61 nt, Homo Sapiens
gaacucccccaaacauggcuguggagagacaacaaaacaaaacaaagcacaaaagucucug

SEQ ID NO: 338339 - RNA, 61 nt, Homo Sapiens
cccccaaacauggcuguggagagacaacaaaacaaaacaaagcacaaaagucucugccaac

SEQ ID NO: 338340 - RNA, 61 nt, Homo Sapiens
aagccaccgcaauaauucggagcaaaccagaacaaaacaaaacauucguuucccagugaaa

SEQ ID NO: 338341 - RNA, 61 nt, Homo Sapiens
cacaaacaaacaaaaaaccuaacaaaacaaaacaaaacaaaggauuggugcugauugaaag

SEQ ID NO: 338342 - RNA, 61 nt, Homo Sapiens
acaaacacaaacaaacaaaagaaagaacaaaacaaaacaaauuaugggauuggugcugauu

SEQ ID NO: 338343 - RNA, 61 nt, Homo Sapiens
acaaaacaaacacaaacaaaugauugaaagaacaaaacaaaaucauuuaugggauuggugc

SEQ ID NO: 338344 - RNA, 61 nt, Homo Sapiens
acagaaucucucccugaguuaacagaacaaaacaaaacaaucaauacaugguuuuuaacaa

SEQ ID NO: 338345 - RNA, 61 nt, Homo Sapiens
acaauacagaaucucucccuaacaaaacagaacaaaacaaaaaauucaauacaugguuuuu

SEQ ID NO: 338346 - RNA, 61 nt, Homo Sapiens
acaaaacaaaacaauacagacaugguuuuuaacaaaacagaacuaaaauuuaaauucaaua

SEQ ID NO: 338347 - RNA, 61 nt, Homo Sapiens
auuugcaaaacagaggguauguccuuuuuaaacaaaacauuuacagugcuguaacugggug

SEQ ID NO: 338348 - RNA, 61 nt, Homo Sapiens
aaaauauauauauauucucaagagauuugguacaaaacaacgcuacaaagguaaauaaugg

SEQ ID NO: 338349 - RNA, 61 nt, Homo Sapiens
aggauugucuuaaaguuccuuagccagcaaaacaaaacaaaacaaaacaaacaaaugaaaa

SEQ ID NO: 338350 - RNA, 61 nt, Homo Sapiens
ugucuuaaaguuccuuagccagcaaaacaaaacaaaacaaaacaaacaaaugaaaaacguu

SEQ ID NO: 338351 - RNA, 61 nt, Homo Sapiens
uaaaguuccuuagccagcaaaacaaaacaaaacaaaacaaacaaaugaaaaacguuuaaaa

SEQ ID NO: 338352 - RNA, 61 nt, Homo Sapiens
gaggaagauguguucauuguggacucuaaaaacaaaacaaaacacaaaauccccuguucaa

SEQ ID NO: 338353 - RNA, 61 nt, Homo Sapiens
agauguguucauuguggacucuaaaaacaaaacaaaacacaaaauccccuguucaaauaaa

SEQ ID NO: 338354 - RNA, 61 nt, Homo Sapiens
aaccauuguuaaggguugggggaaagcauggacaaaacaucacuggaaacaaaggcuguaa

SEQ ID NO: 338355 - RNA, 61 nt, Homo Sapiens
cuuggaauguguauuguuuuuauuuugcgaaacaaaacaaaacaaaaaaaaaagcuuggaa

SEQ ID NO: 338356 - RNA, 61 nt, Homo Sapiens
aauguguauuguuuuuauuuugcgaaacaaaacaaaacaaaaaaaaaagcuuggaacucca

SEQ ID NO: 338357 - RNA, 61 nt, Homo Sapiens
auuggguucaugaugcagucuccucuuuaaaacaaaacaaaacaaaacaaaacuauacuug

SEQ ID NO: 338358 - RNA, 61 nt, Homo Sapiens
guucaugaugcagucuccucuuuaaaacaaaacaaaacaaaacaaaacuauacuugaacaa

SEQ ID NO: 338359 - RNA, 61 nt, Homo Sapiens
ugaugcagucuccucuuuaaaacaaaacaaaacaaaacaaaacuauacuugaacaaaaggg

SEQ ID NO: 338360 - RNA, 61 nt, Homo Sapiens
uucaggugcuagggacuuaaugaaaaacaggacaaaacaauuccuuuuuguggcccaggua

SEQ ID NO: 338361 - RNA, 61 nt, Homo Sapiens
aaaaagacaugggagagaugaaaaaaacaaaacaaaacaaaacagagccaaacuccgucaa

SEQ ID NO: 338362 - RNA, 61 nt, Homo Sapiens
acaaaaaaaagacaugggaggucaaaaaaaaacaaaacaaagagugacagagccaaacucc

SEQ ID NO: 338363 - RNA, 61 nt, Homo Sapiens
aaauauaaacaaucaaaaucacaaaaacaaaacaaaacauaacgccaguaaaaaaacaaaa

SEQ ID NO: 338364 - RNA, 61 nt, Homo Sapiens
acauaaaauauaaacaaucacaaaaacaaaaacaaaacaaaggaggacgccaguaaaaaaa

SEQ ID NO: 338365 - RNA, 61 nt, Homo Sapiens
cuugggcaacagagugagacuccaucucaaaacaaaacaaaacaaaacaaaacaaaaaaac

SEQ ID NO: 338366 - RNA, 61 nt, Homo Sapiens
gcaacagagugagacuccaucucaaaacaaaacaaaacaaaacaaaacaaaaaaacccggc

SEQ ID NO: 338367 - RNA, 61 nt, Homo Sapiens
agagugagacuccaucucaaaacaaaacaaaacaaaacaaaacaaaaaaacccggcuuugc

SEQ ID NO: 338368 - RNA, 61 nt, Homo Sapiens
gagacuccaucucaaaacaaaacaaaacaaaacaaaacaaaaaaacccggcuuugcugcuu

SEQ ID NO: 338369 - RNA, 61 nt, Homo Sapiens
agugcuuuuuucaaaccugaaaaaaaacaaaacaaaacaacagaagauauucucgugaaag

SEQ ID NO: 338370 - RNA, 61 nt, Homo Sapiens
acaacagugcuuuuuucaaagaaagaaaaaaacaaaacaaaaagggagaagauauucucgu

SEQ ID NO: 338371 - RNA, 61 nt, Homo Sapiens
cugcuuaaauauaccagucaaaacaaggguaacaaaacaagaugacaacuuuauuccacau

SEQ ID NO: 338372 - RNA, 61 nt, Homo Sapiens
ccuuucaaacaaucauuguccuggcuuccuuacaaaacaagaucaaacucauauauuccuc

SEQ ID NO: 338373 - RNA, 61 nt, Homo Sapiens
gauuaaaagaagacaauuauucaaagccaucacaaaacacuauaagacugaccaaaauuua

SEQ ID NO: 338374 - RNA, 61 nt, Homo Sapiens
cccaggcugcagucuccacaccaaacagucaacaaaacacaaacccugaaggaaaaccuuu

SEQ ID NO: 338375 - RNA, 61 nt, Homo Sapiens
ggaacacagcgagacccucucauuaaaaacaacaaaacaaaacaauuccagucuuggagua

SEQ ID NO: 338376 - RNA, 61 nt, Homo Sapiens
acagcgagacccucucauuaaaaacaacaaaacaaaacaauuccagucuuggaguagucua

SEQ ID NO: 338377 - RNA, 61 nt, Homo Sapiens
aaacaacaacaacaaaaaacugaacuucaaaacaaaacaaauacuguaaaaaaaagugcac

SEQ ID NO: 338378 - RNA, 61 nt, Homo Sapiens
uguuauguguacauucggagaaacaagaacaacaaaacaggaauagaugcacgacaggcau

SEQ ID NO: 338379 - RNA, 61 nt, Homo Sapiens
aaaacaugagcagugguguuaaaaaaacaaaacaaaacaaaaugcuuuguuuaaaaaaacg

SEQ ID NO: 338380 - RNA, 61 nt, Homo Sapiens
acaaaaaaacaugagcagugaaacgaaaaaaacaaaacaaacacuaaugcuuuguuuaaaa

SEQ ID NO: 338381 - RNA, 61 nt, Homo Sapiens
aacacagugccauaugaauauacuugaauauacaaaacaugacuauacauaguuucuuuug

SEQ ID NO: 338382 - RNA, 61 nt, Homo Sapiens
aacuuuagagcaagaagacccuugucuauguacaaaacacaauggauagcacauaauggca

SEQ ID NO: 338383 - RNA, 61 nt, Homo Sapiens
aaacuagauauguaauuucuaacaaaacaaaacaaaacaaauuaucuuaaaaaguaaacaa

SEQ ID NO: 338384 - RNA, 61 nt, Homo Sapiens
acaaaaaacuagauauguaaaacaaaacaaaacaaaacaaagacucuuaucuuaaaaagua

SEQ ID NO: 338385 - RNA, 61 nt, Homo Sapiens
acaaaacaaaaaacuagauaaaguaaacaaaacaaaacaaaggcaggacucuuaucuuaaa

SEQ ID NO: 338386 - RNA, 61 nt, Homo Sapiens
acaaaacaaaacaaaaaacuuuaaaaaguaaacaaaacaaaggugcggcaggacucuuauc

SEQ ID NO: 338387 - RNA, 61 nt, Homo Sapiens
uuucagguuccaaggaagaguuaaaaacaaaacaaaacauuuuacuucuuuugcaugcacu

SEQ ID NO: 338388 - RNA, 61 nt, Homo Sapiens
acauuuuucagguuccaagggcacuuuaaaaacaaaacaaaaggcuuuacuucuuuugcau

SEQ ID NO: 338389 - RNA, 61 nt, Homo Sapiens
gacagagcaagacuccaucucaaaaacaaaaacaaaacaaaacaacaacaaaaaaagaagu

SEQ ID NO: 338390 - RNA, 61 nt, Homo Sapiens
agcaagacuccaucucaaaaacaaaaacaaaacaaaacaacaacaaaaaaagaaguuaaau

SEQ ID NO: 338391 - RNA, 61 nt, Homo Sapiens
gccccaaauggaaaaaagauacucacacagaacaaaacaguucuuggucuuguucuugguc

SEQ ID NO: 338392 - RNA, 61 nt, Homo Sapiens
aguuuuguauaugucugauaccguuguuauaacaaaacaaauuuuuuuacuauaguuuuuu

SEQ ID NO: 338393 - RNA, 61 nt, Homo Sapiens
uguuuauauuuccuguaagugaauaaauaaaacaaaacaaaacaaaaaaaacuugugccug

SEQ ID NO: 338394 - RNA, 61 nt, Homo Sapiens
auauuuccuguaagugaauaaauaaaacaaaacaaaacaaaaaaaacuugugccugauaag

SEQ ID NO: 338395 - RNA, 61 nt, Homo Sapiens
gccugggugacagagcgagacuaucucagaaacaaaacaaaacaaaacaacaaaaaaagaa

SEQ ID NO: 338396 - RNA, 61 nt, Homo Sapiens
ggugacagagcgagacuaucucagaaacaaaacaaaacaaaacaacaaaaaaagaaaaggc

SEQ ID NO: 338397 - RNA, 61 nt, Homo Sapiens
cagagcgagacuaucucagaaacaaaacaaaacaaaacaacaaaaaaagaaaaggcagagu

SEQ ID NO: 338398 - RNA, 61 nt, Homo Sapiens
acugcaauuuuauuuuugaguugggacuuuuacaaaacacuuuuuucccuggagucuucuc

SEQ ID NO: 338399 - RNA, 61 nt, Homo Sapiens
aaccagucuuuuuguauuuauuguuacugagacaaaacaguacucacugaguguuuuucag

SEQ ID NO: 338400 - RNA, 61 nt, Homo Sapiens
aagauugucuguaaucacauaaguauacaaaacaaaacaguaaacauucacaaauauagaa

SEQ ID NO: 338401 - RNA, 61 nt, Homo Sapiens
acaguaagauugucuguaauuagaaaaguauacaaaacaaauucaaaaacauucacaaaua

SEQ ID NO: 338402 - RNA, 56 nt, Homo Sapiens; identical to SEQ ID NO: 223403

SEQ ID NO: 338403 - RNA, 51 nt, Homo Sapiens; identical to SEQ ID NO: 223404

SEQ ID NO: 338404 - RNA, 61 nt, Homo Sapiens
auuagcugagcaugguggugcucaaaacaaaacaaaacaaagcgacacagcgagacuccau

SEQ ID NO: 338405 - RNA, 61 nt, Homo Sapiens
acaaaauuagcugagcaugguccaucucaaaacaaaacaaaccugggcgacacagcgagac

SEQ ID NO: 338406 - RNA, 61 nt, Homo Sapiens
aacaacaacaaaaaacaaaacaaaaaacaaaacaaaacaaaacaagaguaaaacuucaucu

SEQ ID NO: 338407 - RNA, 61 nt, Homo Sapiens
acaaaaacaacaacaaaaaacaucucaaaaaacaaaacaaaggucaacaagaguaaaacuu

SEQ ID NO: 338408 - RNA, 61 nt, Homo Sapiens
caagcaaaaaacacaaaaacuuuucaacaaaacaaaacaaaccccauucugugcccuacua

SEQ ID NO: 338409 - RNA, 61 nt, Homo Sapiens
acaaacaagcaaaaaacacauacuauuuucaacaaaacaaaccucuccccauucugugccc

SEQ ID NO: 338410 - RNA, 61 nt, Homo Sapiens
aaaagccucgguauaauuuuaaaaguauaaaacaaaacaaaaguuugcuggggaguuugau

SEQ ID NO: 338411 - RNA, 61 nt, Homo Sapiens
uagcucaucuuauucucucugguggcuuuucacaaaacauuucacaagcuuucggaugggc

SEQ ID NO: 338412 - RNA, 61 nt, Homo Sapiens
uugaaucaaguuuguuuguaaaacaaaacaaacaaaacaccuuuuuccuuuuuuuuuaaaa

SEQ ID NO: 338413 - RNA, 61 nt, Homo Sapiens
caaaacaccuugaaucaaguuuuuuaaaaaaacaaaacaaauugucuuucuuuuuccuuuu

SEQ ID NO: 338414 - RNA, 61 nt, Homo Sapiens
auacuaguggguuuuucuacgcauugaaaggacaaaacauuauguucccaaaucugugcug

SEQ ID NO: 338415 - RNA, 61 nt, Homo Sapiens
uuuguuuuuuauuuuacaacugccaguuuugacaaaacaggcagugcugccuucuuuacac

SEQ ID NO: 338416 - RNA, 61 nt, Homo Sapiens
aaaauaccuguauguuuugugaccaaacaaaacaaaacauuaauauagaauuccuggauaa

SEQ ID NO: 338417 - RNA, 61 nt, Homo Sapiens
acauuaaaauaccuguaugugauaagaccaaacaaaacaaagagaaaauauagaauuccug

SEQ ID NO: 338418 - RNA, 61 nt, Homo Sapiens
guuguuuucuagauuuguggcuuuaagaaaaacaaaacaaaacaaacacauuguuuuucuc

SEQ ID NO: 338419 - RNA, 61 nt, Homo Sapiens
uuucuagauuuguggcuuuaagaaaaacaaaacaaaacaaacacauuguuuuucucagaac

SEQ ID NO: 338420 - RNA, 61 nt, Homo Sapiens
gagggggacauagcgagacucggucucaaaaacaaaacaaaacaaaacaaaacaaaacaaa

SEQ ID NO: 338421 - RNA, 61 nt, Homo Sapiens
ggacauagcgagacucggucucaaaaacaaaacaaaacaaaacaaaacaaaacaaaaacaa

SEQ ID NO: 338422 - RNA, 61 nt, Homo Sapiens
uagcgagacucggucucaaaaacaaaacaaaacaaaacaaaacaaaacaaaaacaaaacaa

SEQ ID NO: 338423 - RNA, 61 nt, Homo Sapiens
agacucggucucaaaaacaaaacaaaacaaaacaaaacaaaacaaaacaaaacaaaacaaa

SEQ ID NO: 338424 - RNA, 61 nt, Homo Sapiens
cggucucaaaaacaaaacaaaacaaaacaaaacaaaacaaaacaaaacaaaacaaaacacu

SEQ ID NO: 338425 - RNA, 61 nt, Homo Sapiens
ucaaaaacaaaacaaaacaaaacaaaacaaaacaaaacaaaacaaaacaaaacacugccaa

SEQ ID NO: 338426 - RNA, 61 nt, Homo Sapiens
aacaaaacaaaacaaaacaaaacaaaacaaaacaaaacaaaacaaaacacugccaaacugu

SEQ ID NO: 338427 - RNA, 61 nt, Homo Sapiens
acaaaacaaaacaaaacaaaaacaaaacaaaacaaaacaaaacacugccaaacuguuucca

SEQ ID NO: 338428 - RNA, 61 nt, Homo Sapiens
acaaaacaaaacaaaaacaaaacaaaacaaaacaaaacacugccaaacuguuuccaaagca

SEQ ID NO: 338429 - RNA, 61 nt, Homo Sapiens
uuuccugaguucaggugacugaggaagagccacaaaacaaaacacaacaaaaccaaaccac

SEQ ID NO: 338430 - RNA, 61 nt, Homo Sapiens
ugaguucaggugacugaggaagagccacaaaacaaaacacaacaaaaccaaaccacagaau

SEQ ID NO: 338431 - RNA, 61 nt, Homo Sapiens
gagagaaaaagcaaaccgcguagguuacaaaacaaaacaggucucagaggcucugcuuccu

SEQ ID NO: 338432 - RNA, 61 nt, Homo Sapiens
acagggagagaaaaagcaaauuccuuagguuacaaaacaaauguggucucagaggcucugc

SEQ ID NO: 338433 - RNA, 61 nt, Homo Sapiens
aaaagccauuuuggagacagaccugguuugaacaaaacauaaguauguuggcauuacuugg

SEQ ID NO: 338434 - RNA, 61 nt, Homo Sapiens
auucuauaagucaguauacugugggaaagaaacaaaacaucuguguguguauaaaacuccu

SEQ ID NO: 338435 - RNA, 61 nt, Homo Sapiens
aaaaaaaccggauagaauaaacaacaacaaaacaaaacaaacagcaaguucuuguuuccaa

SEQ ID NO: 338436 - RNA, 61 nt, Homo Sapiens
acaaaaaaaaaaccggauaguccaaacaacaacaaaacaaacgacacagcaaguucuuguu

SEQ ID NO: 338437 - RNA, 61 nt, Homo Sapiens
uggucggcaagagugagacuccgucucaaaaacaaaacaaaacaaaaaaaccacauaacau

SEQ ID NO: 338438 - RNA, 61 nt, Homo Sapiens
ggcaagagugagacuccgucucaaaaacaaaacaaaacaaaaaaaccacauaacauaaauu

SEQ ID NO: 338439 - RNA, 61 nt, Homo Sapiens
cugaaaauucgugcgugggcuggguuuggucacaaaacaucucuauuuguguggcaguuau

SEQ ID NO: 338440 - RNA, 61 nt, Homo Sapiens
uuuuacaucugaacaaaaugacaauaaucucacaaaacauauauacaugaaaauuuguuug

SEQ ID NO: 338441 - RNA, 61 nt, Homo Sapiens
auauauauaaauauaaauauauauaaaaacaacaaaacaaaacaaaaaaagaaaaaaaaac

SEQ ID NO: 338442 - RNA, 61 nt, Homo Sapiens
uauaaauauaaauauauauaaaaacaacaaaacaaaacaaaaaaagaaaaaaaaacaaaaa

SEQ ID NO: 338443 - RNA, 61 nt, Homo Sapiens
augacugagccaaucacuguuucucagaaaaacaaaacaaaacaaaacaaaugacaguaac

SEQ ID NO: 338444 - RNA, 61 nt, Homo Sapiens
ugagccaaucacuguuucucagaaaaacaaaacaaaacaaaacaaaugacaguaacccuuc

SEQ ID NO: 338445 - RNA, 61 nt, Homo Sapiens
caaucacuguuucucagaaaaacaaaacaaaacaaaacaaaugacaguaacccuuccccgg

SEQ ID NO: 338446 - RNA, 61 nt, Homo Sapiens
cugggugacagagcaagacucugucuaaaaaacaaaacaaaacaaaacaaaacaaaaaaac

SEQ ID NO: 338447 - RNA, 61 nt, Homo Sapiens
ugacagagcaagacucugucuaaaaaacaaaacaaaacaaaacaaaacaaaaaaaccucuu

SEQ ID NO: 338448 - RNA, 61 nt, Homo Sapiens
gagcaagacucugucuaaaaaacaaaacaaaacaaaacaaaacaaaaaaaccucuuaauau

SEQ ID NO: 338449 - RNA, 61 nt, Homo Sapiens
agacucugucuaaaaaacaaaacaaaacaaaacaaaacaaaaaaaccucuuaauauucugg

SEQ ID NO: 338450 - RNA, 61 nt, Homo Sapiens
gacacucacuuguguguauaucaaaaacaaaacaaaacagucaauauuuaauaaaacuagg

SEQ ID NO: 338451 - RNA, 61 nt, Homo Sapiens
acagugacacucacuugugucuaggucaaaaacaaaacaaaggaagcaauauuuaauaaaa

SEQ ID NO: 338452 - RNA, 61 nt, Homo Sapiens
caaacaaacaaaacuugcauaacaaaacaaaacaaaacaaaaaaacgaaacuccaucucaa

SEQ ID NO: 338453 - RNA, 61 nt, Homo Sapiens
acaaacaaacaaacaaaacucucaaaacaaaacaaaacaaacgacaaaaacgaaacuccau

SEQ ID NO: 338454 - RNA, 61 nt, Homo Sapiens
acaaaacaaacaaacaaacauccaucucaaaacaaaacaaacugggcgacaaaaacgaaac

SEQ ID NO: 338455 - RNA, 61 nt, Homo Sapiens
auuaacugcuuaaauguuuuaacaaaacaaaacaaaacaaaacaauuguucuucaaaaaca

SEQ ID NO: 338456 - RNA, 61 nt, Homo Sapiens
acaaaauuaacugcuuaaauaaacaaacaaaacaaaacaaaagaccacaauuguucuucaa

SEQ ID NO: 338457 - RNA, 61 nt, Homo Sapiens
acaaaacaaaauuaacugcuuucaaaaacaaacaaaacaaaguaaaagaccacaauuguuc

SEQ ID NO: 338458 - RNA, 62 nt, Homo Sapiens; identical to SEQ ID NO: 64857

SEQ ID NO: 338459 - RNA, 62 nt, Homo Sapiens; identical to SEQ ID NO: 64858

SEQ ID NO: 338460 - RNA, 62 nt, Homo Sapiens; identical to SEQ ID NO: 64859

SEQ ID NO: 338461 - RNA, 62 nt, Homo Sapiens; identical to SEQ ID NO: 64860

SEQ ID NO: 338462 - RNA, 62 nt, Homo Sapiens; identical to SEQ ID NO: 64861

SEQ ID NO: 338463 - RNA, 62 nt, Homo Sapiens; identical to SEQ ID NO: 64862

SEQ ID NO: 338464 - RNA, 62 nt, Homo Sapiens; identical to SEQ ID NO: 64863

SEQ ID NO: 338465 - RNA, 62 nt, Homo Sapiens; identical to SEQ ID NO: 64864

SEQ ID NO: 338466 - RNA, 62 nt, Homo Sapiens; identical to SEQ ID NO: 64865

SEQ ID NO: 338467 - RNA, 62 nt, Homo Sapiens; identical to SEQ ID NO: 64866

SEQ ID NO: 338468 - RNA, 62 nt, Homo Sapiens; identical to SEQ ID NO: 64867

SEQ ID NO: 338469 - RNA, 62 nt, Homo Sapiens; identical to SEQ ID NO: 64868

SEQ ID NO: 338470 - RNA, 62 nt, Homo Sapiens; identical to SEQ ID NO: 64869

SEQ ID NO: 338471 - RNA, 62 nt, Homo Sapiens; identical to SEQ ID NO: 64870

SEQ ID NO: 338472 - RNA, 62 nt, Homo Sapiens; identical to SEQ ID NO: 64871

SEQ ID NO: 338473 - RNA, 62 nt, Homo Sapiens; identical to SEQ ID NO: 64872

SEQ ID NO: 338474 - RNA, 62 nt, Homo Sapiens; identical to SEQ ID NO: 64873

SEQ ID NO: 338475 - RNA, 62 nt, Homo Sapiens; identical to SEQ ID NO: 64874

SEQ ID NO: 338476 - RNA, 62 nt, Homo Sapiens; identical to SEQ ID NO: 64875

SEQ ID NO: 338477 - RNA, 62 nt, Homo Sapiens; identical to SEQ ID NO: 64876

SEQ ID NO: 338478 - RNA, 62 nt, Homo Sapiens; identical to SEQ ID NO: 64877

SEQ ID NO: 338479 - RNA, 62 nt, Homo Sapiens; identical to SEQ ID NO: 64878

SEQ ID NO: 338480 - RNA, 62 nt, Homo Sapiens; identical to SEQ ID NO: 64879

SEQ ID NO: 338481 - RNA, 62 nt, Homo Sapiens; identical to SEQ ID NO: 64880

SEQ ID NO: 338482 - RNA, 62 nt, Homo Sapiens; identical to SEQ ID NO: 64881

SEQ ID NO: 338483 - RNA, 62 nt, Homo Sapiens; identical to SEQ ID NO: 64882

SEQ ID NO: 338484 - RNA, 62 nt, Homo Sapiens; identical to SEQ ID NO: 64883

SEQ ID NO: 338485 - RNA, 62 nt, Homo Sapiens; identical to SEQ ID NO: 64884

SEQ ID NO: 338486 - RNA, 62 nt, Homo Sapiens; identical to SEQ ID NO: 64885

SEQ ID NO: 338487 - RNA, 62 nt, Homo Sapiens; identical to SEQ ID NO: 64886

SEQ ID NO: 338488 - RNA, 62 nt, Homo Sapiens; identical to SEQ ID NO: 64887

SEQ ID NO: 338489 - RNA, 62 nt, Homo Sapiens; identical to SEQ ID NO: 64888

SEQ ID NO: 338490 - RNA, 62 nt, Homo Sapiens; identical to SEQ ID NO: 64889

SEQ ID NO: 338491 - RNA, 62 nt, Homo Sapiens; identical to SEQ ID NO: 64890

SEQ ID NO: 338492 - RNA, 62 nt, Homo Sapiens; identical to SEQ ID NO: 64891

SEQ ID NO: 338493 - RNA, 62 nt, Homo Sapiens; identical to SEQ ID NO: 64892

SEQ ID NO: 338494 - RNA, 62 nt, Homo Sapiens; identical to SEQ ID NO: 64893

SEQ ID NO: 338495 - RNA, 62 nt, Homo Sapiens; identical to SEQ ID NO: 64894

SEQ ID NO: 338496 - RNA, 62 nt, Homo Sapiens; identical to SEQ ID NO: 64895

SEQ ID NO: 338497 - RNA, 62 nt, Homo Sapiens; identical to SEQ ID NO: 64896

SEQ ID NO: 338498 - RNA, 62 nt, Homo Sapiens; identical to SEQ ID NO: 64897

SEQ ID NO: 338499 - RNA, 62 nt, Homo Sapiens; identical to SEQ ID NO: 64898

SEQ ID NO: 338500 - RNA, 62 nt, Homo Sapiens; identical to SEQ ID NO: 64899

SEQ ID NO: 338501 - RNA, 62 nt, Homo Sapiens; identical to SEQ ID NO: 64900

SEQ ID NO: 338502 - RNA, 62 nt, Homo Sapiens; identical to SEQ ID NO: 64901

SEQ ID NO: 338503 - RNA, 62 nt, Homo Sapiens; identical to SEQ ID NO: 64902

SEQ ID NO: 338504 - RNA, 62 nt, Homo Sapiens; identical to SEQ ID NO: 64903

SEQ ID NO: 338505 - RNA, 62 nt, Homo Sapiens; identical to SEQ ID NO: 64904

SEQ ID NO: 338506 - RNA, 62 nt, Homo Sapiens; identical to SEQ ID NO: 64905

SEQ ID NO: 338507 - RNA, 62 nt, Homo Sapiens; identical to SEQ ID NO: 64906

SEQ ID NO: 338508 - RNA, 62 nt, Homo Sapiens; identical to SEQ ID NO: 64907

SEQ ID NO: 338509 - RNA, 62 nt, Homo Sapiens; identical to SEQ ID NO: 64908

SEQ ID NO: 338510 - RNA, 62 nt, Homo Sapiens; identical to SEQ ID NO: 64909

SEQ ID NO: 338511 - RNA, 62 nt, Homo Sapiens; identical to SEQ ID NO: 64910

SEQ ID NO: 338512 - RNA, 62 nt, Homo Sapiens; identical to SEQ ID NO: 64911

SEQ ID NO: 338513 - RNA, 62 nt, Homo Sapiens; identical to SEQ ID NO: 64912

SEQ ID NO: 338514 - RNA, 62 nt, Homo Sapiens; identical to SEQ ID NO: 64913

SEQ ID NO: 338515 - RNA, 62 nt, Homo Sapiens; identical to SEQ ID NO: 64914

SEQ ID NO: 338516 - RNA, 62 nt, Homo Sapiens; identical to SEQ ID NO: 64915

SEQ ID NO: 338517 - RNA, 62 nt, Homo Sapiens; identical to SEQ ID NO: 64916

SEQ ID NO: 338518 - RNA, 62 nt, Homo Sapiens; identical to SEQ ID NO: 64917

SEQ ID NO: 338519 - RNA, 62 nt, Homo Sapiens; identical to SEQ ID NO: 64918

SEQ ID NO: 338520 - RNA, 62 nt, Homo Sapiens; identical to SEQ ID NO: 64919

SEQ ID NO: 338521 - RNA, 62 nt, Homo Sapiens; identical to SEQ ID NO: 64920

SEQ ID NO: 338522 - RNA, 62 nt, Homo Sapiens; identical to SEQ ID NO: 64921

SEQ ID NO: 338523 - RNA, 62 nt, Homo Sapiens; identical to SEQ ID NO: 64922

SEQ ID NO: 338524 - RNA, 62 nt, Homo Sapiens; identical to SEQ ID NO: 64923

SEQ ID NO: 338525 - RNA, 62 nt, Homo Sapiens; identical to SEQ ID NO: 64924

SEQ ID NO: 338526 - RNA, 62 nt, Homo Sapiens; identical to SEQ ID NO: 64925

SEQ ID NO: 338527 - RNA, 62 nt, Homo Sapiens; identical to SEQ ID NO: 64926

SEQ ID NO: 338528 - RNA, 62 nt, Homo Sapiens; identical to SEQ ID NO: 64927

SEQ ID NO: 338529 - RNA, 62 nt, Homo Sapiens; identical to SEQ ID NO: 64928

SEQ ID NO: 338530 - RNA, 62 nt, Homo Sapiens; identical to SEQ ID NO: 64929

SEQ ID NO: 338531 - RNA, 62 nt, Homo Sapiens; identical to SEQ ID NO: 64930

SEQ ID NO: 338532 - RNA, 62 nt, Homo Sapiens; identical to SEQ ID NO: 64931

SEQ ID NO: 338533 - RNA, 62 nt, Homo Sapiens; identical to SEQ ID NO: 64932

SEQ ID NO: 338534 - RNA, 62 nt, Homo Sapiens; identical to SEQ ID NO: 64933

SEQ ID NO: 338535 - RNA, 62 nt, Homo Sapiens; identical to SEQ ID NO: 64934

SEQ ID NO: 338536 - RNA, 62 nt, Homo Sapiens; identical to SEQ ID NO: 64935

SEQ ID NO: 338537 - RNA, 62 nt, Homo Sapiens; identical to SEQ ID NO: 64936

SEQ ID NO: 338538 - RNA, 62 nt, Homo Sapiens; identical to SEQ ID NO: 64937

SEQ ID NO: 338539 - RNA, 62 nt, Homo Sapiens; identical to SEQ ID NO: 64938

SEQ ID NO: 338540 - RNA, 62 nt, Homo Sapiens; identical to SEQ ID NO: 64939

SEQ ID NO: 338541 - RNA, 62 nt, Homo Sapiens; identical to SEQ ID NO: 64940

SEQ ID NO: 338542 - RNA, 62 nt, Homo Sapiens; identical to SEQ ID NO: 64941

SEQ ID NO: 338543 - RNA, 62 nt, Homo Sapiens; identical to SEQ ID NO: 64942

SEQ ID NO: 338544 - RNA, 62 nt, Homo Sapiens; identical to SEQ ID NO: 64943

SEQ ID NO: 338545 - RNA, 62 nt, Homo Sapiens; identical to SEQ ID NO: 64944

SEQ ID NO: 338546 - RNA, 62 nt, Homo Sapiens; identical to SEQ ID NO: 64945

SEQ ID NO: 338547 - RNA, 62 nt, Homo Sapiens; identical to SEQ ID NO: 64946

SEQ ID NO: 338548 - RNA, 62 nt, Homo Sapiens; identical to SEQ ID NO: 64947

SEQ ID NO: 338549 - RNA, 62 nt, Homo Sapiens; identical to SEQ ID NO: 64948

SEQ ID NO: 338550 - RNA, 62 nt, Homo Sapiens; identical to SEQ ID NO: 64949

SEQ ID NO: 338551 - RNA, 62 nt, Homo Sapiens; identical to SEQ ID NO: 64950

SEQ ID NO: 338552 - RNA, 62 nt, Homo Sapiens; identical to SEQ ID NO: 64951

SEQ ID NO: 338553 - RNA, 62 nt, Homo Sapiens; identical to SEQ ID NO: 64952

SEQ ID NO: 338554 - RNA, 62 nt, Homo Sapiens; identical to SEQ ID NO: 64953

SEQ ID NO: 338555 - RNA, 62 nt, Homo Sapiens; identical to SEQ ID NO: 64954

SEQ ID NO: 338556 - RNA, 62 nt, Homo Sapiens; identical to SEQ ID NO: 64955

SEQ ID NO: 338557 - RNA, 62 nt, Homo Sapiens; identical to SEQ ID NO: 64956

SEQ ID NO: 338558 - RNA, 62 nt, Homo Sapiens; identical to SEQ ID NO: 64957

SEQ ID NO: 338559 - RNA, 62 nt, Homo Sapiens; identical to SEQ ID NO: 64958

SEQ ID NO: 338560 - RNA, 62 nt, Homo Sapiens; identical to SEQ ID NO: 64959

SEQ ID NO: 338561 - RNA, 62 nt, Homo Sapiens; identical to SEQ ID NO: 64960

SEQ ID NO: 338562 - RNA, 62 nt, Homo Sapiens; identical to SEQ ID NO: 64961

SEQ ID NO: 338563 - RNA, 62 nt, Homo Sapiens; identical to SEQ ID NO: 64962

SEQ ID NO: 338564 - RNA, 62 nt, Homo Sapiens; identical to SEQ ID NO: 64963

SEQ ID NO: 338565 - RNA, 62 nt, Homo Sapiens; identical to SEQ ID NO: 64964

SEQ ID NO: 338566 - RNA, 62 nt, Homo Sapiens; identical to SEQ ID NO: 64965

SEQ ID NO: 338567 - RNA, 62 nt, Homo Sapiens; identical to SEQ ID NO: 64966

SEQ ID NO: 338568 - RNA, 62 nt, Homo Sapiens; identical to SEQ ID NO: 64967

SEQ ID NO: 338569 - RNA, 62 nt, Homo Sapiens; identical to SEQ ID NO: 64968

SEQ ID NO: 338570 - RNA, 62 nt, Homo Sapiens; identical to SEQ ID NO: 64969

SEQ ID NO: 338571 - RNA, 62 nt, Homo Sapiens; identical to SEQ ID NO: 64970

SEQ ID NO: 338572 - RNA, 62 nt, Homo Sapiens; identical to SEQ ID NO: 64971

SEQ ID NO: 338573 - RNA, 62 nt, Homo Sapiens; identical to SEQ ID NO: 64972

SEQ ID NO: 338574 - RNA, 62 nt, Homo Sapiens; identical to SEQ ID NO: 64973

SEQ ID NO: 338575 - RNA, 62 nt, Homo Sapiens; identical to SEQ ID NO: 64974

SEQ ID NO: 338576 - RNA, 62 nt, Homo Sapiens; identical to SEQ ID NO: 64975

SEQ ID NO: 338577 - RNA, 62 nt, Homo Sapiens; identical to SEQ ID NO: 64976

SEQ ID NO: 338578 - RNA, 62 nt, Homo Sapiens; identical to SEQ ID NO: 64977

SEQ ID NO: 338579 - RNA, 62 nt, Homo Sapiens; identical to SEQ ID NO: 64978

SEQ ID NO: 338580 - RNA, 62 nt, Homo Sapiens; identical to SEQ ID NO: 64979

SEQ ID NO: 338581 - RNA, 62 nt, Homo Sapiens; identical to SEQ ID NO: 64980

SEQ ID NO: 338582 - RNA, 62 nt, Homo Sapiens; identical to SEQ ID NO: 64981

SEQ ID NO: 338583 - RNA, 62 nt, Homo Sapiens; identical to SEQ ID NO: 64982

SEQ ID NO: 338584 - RNA, 62 nt, Homo Sapiens; identical to SEQ ID NO: 64983

SEQ ID NO: 338585 - RNA, 62 nt, Homo Sapiens; identical to SEQ ID NO: 64984

SEQ ID NO: 338586 - RNA, 62 nt, Homo Sapiens; identical to SEQ ID NO: 64985

SEQ ID NO: 338587 - RNA, 62 nt, Homo Sapiens; identical to SEQ ID NO: 64986

SEQ ID NO: 338588 - RNA, 62 nt, Homo Sapiens; identical to SEQ ID NO: 64987

SEQ ID NO: 338589 - RNA, 62 nt, Homo Sapiens; identical to SEQ ID NO: 64988

SEQ ID NO: 338590 - RNA, 62 nt, Homo Sapiens; identical to SEQ ID NO: 64989

SEQ ID NO: 338591 - RNA, 62 nt, Homo Sapiens; identical to SEQ ID NO: 64990

SEQ ID NO: 338592 - RNA, 62 nt, Homo Sapiens; identical to SEQ ID NO: 64991

SEQ ID NO: 338593 - RNA, 62 nt, Homo Sapiens; identical to SEQ ID NO: 64992

SEQ ID NO: 338594 - RNA, 62 nt, Homo Sapiens; identical to SEQ ID NO: 64993

SEQ ID NO: 338595 - RNA, 62 nt, Homo Sapiens; identical to SEQ ID NO: 64994

SEQ ID NO: 338596 - RNA, 56 nt, Homo Sapiens; identical to SEQ ID NO: 61369

SEQ ID NO: 338597 - RNA, 62 nt, Homo Sapiens; identical to SEQ ID NO: 64996

SEQ ID NO: 338598 - RNA, 62 nt, Homo Sapiens; identical to SEQ ID NO: 64997

SEQ ID NO: 338599 - RNA, 62 nt, Homo Sapiens; identical to SEQ ID NO: 64998

SEQ ID NO: 338600 - RNA, 62 nt, Homo Sapiens; identical to SEQ ID NO: 64999

SEQ ID NO: 338601 - RNA, 62 nt, Homo Sapiens; identical to SEQ ID NO: 65000

SEQ ID NO: 338602 - RNA, 62 nt, Homo Sapiens; identical to SEQ ID NO: 65001

SEQ ID NO: 338603 - RNA, 62 nt, Homo Sapiens; identical to SEQ ID NO: 65002

SEQ ID NO: 338604 - RNA, 62 nt, Homo Sapiens; identical to SEQ ID NO: 65003

SEQ ID NO: 338605 - RNA, 62 nt, Homo Sapiens; identical to SEQ ID NO: 65004

SEQ ID NO: 338606 - RNA, 62 nt, Homo Sapiens; identical to SEQ ID NO: 65005

SEQ ID NO: 338607 - RNA, 62 nt, Homo Sapiens; identical to SEQ ID NO: 65006

SEQ ID NO: 338608 - RNA, 62 nt, Homo Sapiens; identical to SEQ ID NO: 65007

SEQ ID NO: 338609 - RNA, 62 nt, Homo Sapiens; identical to SEQ ID NO: 65008

SEQ ID NO: 338610 - RNA, 62 nt, Homo Sapiens; identical to SEQ ID NO: 65009

SEQ ID NO: 338611 - RNA, 62 nt, Homo Sapiens; identical to SEQ ID NO: 65010

SEQ ID NO: 338612 - RNA, 62 nt, Homo Sapiens; identical to SEQ ID NO: 65011

SEQ ID NO: 338613 - RNA, 62 nt, Homo Sapiens; identical to SEQ ID NO: 65012

SEQ ID NO: 338614 - RNA, 62 nt, Homo Sapiens; identical to SEQ ID NO: 65013

SEQ ID NO: 338615 - RNA, 62 nt, Homo Sapiens; identical to SEQ ID NO: 65014

SEQ ID NO: 338616 - RNA, 62 nt, Homo Sapiens; identical to SEQ ID NO: 65015

SEQ ID NO: 338617 - RNA, 62 nt, Homo Sapiens; identical to SEQ ID NO: 65016

SEQ ID NO: 338618 - RNA, 62 nt, Homo Sapiens; identical to SEQ ID NO: 65017

SEQ ID NO: 338619 - RNA, 62 nt, Homo Sapiens; identical to SEQ ID NO: 65018

SEQ ID NO: 338620 - RNA, 62 nt, Homo Sapiens; identical to SEQ ID NO: 65019

SEQ ID NO: 338621 - RNA, 62 nt, Homo Sapiens; identical to SEQ ID NO: 65020

SEQ ID NO: 338622 - RNA, 62 nt, Homo Sapiens; identical to SEQ ID NO: 65021

SEQ ID NO: 338623 - RNA, 62 nt, Homo Sapiens; identical to SEQ ID NO: 65022

SEQ ID NO: 338624 - RNA, 62 nt, Homo Sapiens; identical to SEQ ID NO: 65023

SEQ ID NO: 338625 - RNA, 62 nt, Homo Sapiens; identical to SEQ ID NO: 65024

SEQ ID NO: 338626 - RNA, 62 nt, Homo Sapiens; identical to SEQ ID NO: 65025

SEQ ID NO: 338627 - RNA, 62 nt, Homo Sapiens; identical to SEQ ID NO: 65026

SEQ ID NO: 338628 - RNA, 62 nt, Homo Sapiens; identical to SEQ ID NO: 65027

SEQ ID NO: 338629 - RNA, 62 nt, Homo Sapiens; identical to SEQ ID NO: 65028

SEQ ID NO: 338630 - RNA, 62 nt, Homo Sapiens; identical to SEQ ID NO: 65029

SEQ ID NO: 338631 - RNA, 62 nt, Homo Sapiens; identical to SEQ ID NO: 65030

SEQ ID NO: 338632 - RNA, 62 nt, Homo Sapiens; identical to SEQ ID NO: 65031

SEQ ID NO: 338633 - RNA, 62 nt, Homo Sapiens; identical to SEQ ID NO: 65032

SEQ ID NO: 338634 - RNA, 62 nt, Homo Sapiens; identical to SEQ ID NO: 65033

SEQ ID NO: 338635 - RNA, 62 nt, Homo Sapiens; identical to SEQ ID NO: 65034

SEQ ID NO: 338636 - RNA, 62 nt, Homo Sapiens; identical to SEQ ID NO: 65035

SEQ ID NO: 338637 - RNA, 62 nt, Homo Sapiens; identical to SEQ ID NO: 65036

SEQ ID NO: 338638 - RNA, 62 nt, Homo Sapiens; identical to SEQ ID NO: 65037

SEQ ID NO: 338639 - RNA, 62 nt, Homo Sapiens; identical to SEQ ID NO: 65038

SEQ ID NO: 338640 - RNA, 62 nt, Homo Sapiens; identical to SEQ ID NO: 65039

SEQ ID NO: 338641 - RNA, 62 nt, Homo Sapiens; identical to SEQ ID NO: 65040

SEQ ID NO: 338642 - RNA, 62 nt, Homo Sapiens; identical to SEQ ID NO: 65041

SEQ ID NO: 338643 - RNA, 62 nt, Homo Sapiens; identical to SEQ ID NO: 65042

SEQ ID NO: 338644 - RNA, 62 nt, Homo Sapiens; identical to SEQ ID NO: 65043

SEQ ID NO: 338645 - RNA, 62 nt, Homo Sapiens; identical to SEQ ID NO: 65044

SEQ ID NO: 338646 - RNA, 62 nt, Homo Sapiens; identical to SEQ ID NO: 65045

SEQ ID NO: 338647 - RNA, 62 nt, Homo Sapiens; identical to SEQ ID NO: 65046

SEQ ID NO: 338648 - RNA, 62 nt, Homo Sapiens; identical to SEQ ID NO: 65047

SEQ ID NO: 338649 - RNA, 62 nt, Homo Sapiens; identical to SEQ ID NO: 65048

SEQ ID NO: 338650 - RNA, 62 nt, Homo Sapiens; identical to SEQ ID NO: 65049

SEQ ID NO: 338651 - RNA, 62 nt, Homo Sapiens; identical to SEQ ID NO: 65050

SEQ ID NO: 338652 - RNA, 62 nt, Homo Sapiens; identical to SEQ ID NO: 65051

SEQ ID NO: 338653 - RNA, 62 nt, Homo Sapiens; identical to SEQ ID NO: 65052

SEQ ID NO: 338654 - RNA, 62 nt, Homo Sapiens; identical to SEQ ID NO: 65053

SEQ ID NO: 338655 - RNA, 62 nt, Homo Sapiens; identical to SEQ ID NO: 65054

SEQ ID NO: 338656 - RNA, 62 nt, Homo Sapiens; identical to SEQ ID NO: 65055

SEQ ID NO: 338657 - RNA, 62 nt, Homo Sapiens; identical to SEQ ID NO: 65056

SEQ ID NO: 338658 - RNA, 62 nt, Homo Sapiens; identical to SEQ ID NO: 65057

SEQ ID NO: 338659 - RNA, 62 nt, Homo Sapiens; identical to SEQ ID NO: 65058

SEQ ID NO: 338660 - RNA, 62 nt, Homo Sapiens; identical to SEQ ID NO: 65059

SEQ ID NO: 338661 - RNA, 62 nt, Homo Sapiens; identical to SEQ ID NO: 65060

SEQ ID NO: 338662 - RNA, 62 nt, Homo Sapiens; identical to SEQ ID NO: 65061

SEQ ID NO: 338663 - RNA, 62 nt, Homo Sapiens; identical to SEQ ID NO: 65062

SEQ ID NO: 338664 - RNA, 62 nt, Homo Sapiens; identical to SEQ ID NO: 65063

SEQ ID NO: 338665 - RNA, 62 nt, Homo Sapiens; identical to SEQ ID NO: 65064

SEQ ID NO: 338666 - RNA, 62 nt, Homo Sapiens; identical to SEQ ID NO: 65065

SEQ ID NO: 338667 - RNA, 62 nt, Homo Sapiens; identical to SEQ ID NO: 65066

SEQ ID NO: 338668 - RNA, 62 nt, Homo Sapiens; identical to SEQ ID NO: 65067

SEQ ID NO: 338669 - RNA, 62 nt, Homo Sapiens; identical to SEQ ID NO: 65068

SEQ ID NO: 338670 - RNA, 62 nt, Homo Sapiens; identical to SEQ ID NO: 65069

SEQ ID NO: 338671 - RNA, 62 nt, Homo Sapiens; identical to SEQ ID NO: 65070

SEQ ID NO: 338672 - RNA, 62 nt, Homo Sapiens; identical to SEQ ID NO: 65071

SEQ ID NO: 338673 - RNA, 62 nt, Homo Sapiens; identical to SEQ ID NO: 65072

SEQ ID NO: 338674 - RNA, 62 nt, Homo Sapiens; identical to SEQ ID NO: 65073

SEQ ID NO: 338675 - RNA, 62 nt, Homo Sapiens; identical to SEQ ID NO: 65074

SEQ ID NO: 338676 - RNA, 62 nt, Homo Sapiens; identical to SEQ ID NO: 65075

SEQ ID NO: 338677 - RNA, 62 nt, Homo Sapiens; identical to SEQ ID NO: 65076

SEQ ID NO: 338678 - RNA, 62 nt, Homo Sapiens; identical to SEQ ID NO: 65077

SEQ ID NO: 338679 - RNA, 62 nt, Homo Sapiens; identical to SEQ ID NO: 65078

SEQ ID NO: 338680 - RNA, 62 nt, Homo Sapiens; identical to SEQ ID NO: 65079

SEQ ID NO: 338681 - RNA, 62 nt, Homo Sapiens; identical to SEQ ID NO: 65080

SEQ ID NO: 338682 - RNA, 62 nt, Homo Sapiens; identical to SEQ ID NO: 65081

SEQ ID NO: 338683 - RNA, 62 nt, Homo Sapiens; identical to SEQ ID NO: 65082

SEQ ID NO: 338684 - RNA, 62 nt, Homo Sapiens; identical to SEQ ID NO: 65083

SEQ ID NO: 338685 - RNA, 62 nt, Homo Sapiens; identical to SEQ ID NO: 65084

SEQ ID NO: 338686 - RNA, 62 nt, Homo Sapiens; identical to SEQ ID NO: 65085

SEQ ID NO: 338687 - RNA, 62 nt, Homo Sapiens; identical to SEQ ID NO: 65086

SEQ ID NO: 338688 - RNA, 60 nt, Homo Sapiens; identical to SEQ ID NO: 65087

SEQ ID NO: 338689 - RNA, 62 nt, Homo Sapiens; identical to SEQ ID NO: 65088

SEQ ID NO: 338690 - RNA, 62 nt, Homo Sapiens; identical to SEQ ID NO: 65089

SEQ ID NO: 338691 - RNA, 62 nt, Homo Sapiens; identical to SEQ ID NO: 65090

SEQ ID NO: 338692 - RNA, 62 nt, Homo Sapiens; identical to SEQ ID NO: 65091

SEQ ID NO: 338693 - RNA, 62 nt, Homo Sapiens; identical to SEQ ID NO: 65092

SEQ ID NO: 338694 - RNA, 62 nt, Homo Sapiens; identical to SEQ ID NO: 65093

SEQ ID NO: 338695 - RNA, 51 nt, Homo Sapiens; identical to SEQ ID NO: 65094

SEQ ID NO: 338696 - RNA, 62 nt, Homo Sapiens; identical to SEQ ID NO: 65095

SEQ ID NO: 338697 - RNA, 62 nt, Homo Sapiens; identical to SEQ ID NO: 65096

SEQ ID NO: 338698 - RNA, 62 nt, Homo Sapiens; identical to SEQ ID NO: 65097

SEQ ID NO: 338699 - RNA, 62 nt, Homo Sapiens; identical to SEQ ID NO: 65098

SEQ ID NO: 338700 - RNA, 62 nt, Homo Sapiens; identical to SEQ ID NO: 65099

SEQ ID NO: 338701 - RNA, 62 nt, Homo Sapiens; identical to SEQ ID NO: 65100

SEQ ID NO: 338702 - RNA, 62 nt, Homo Sapiens; identical to SEQ ID NO: 65101

SEQ ID NO: 338703 - RNA, 62 nt, Homo Sapiens; identical to SEQ ID NO: 65102

SEQ ID NO: 338704 - RNA, 62 nt, Homo Sapiens; identical to SEQ ID NO: 65103

SEQ ID NO: 338705 - RNA, 62 nt, Homo Sapiens; identical to SEQ ID NO: 65104

SEQ ID NO: 338706 - RNA, 62 nt, Homo Sapiens; identical to SEQ ID NO: 65105

SEQ ID NO: 338707 - RNA, 62 nt, Homo Sapiens; identical to SEQ ID NO: 65106

SEQ ID NO: 338708 - RNA, 62 nt, Homo Sapiens; identical to SEQ ID NO: 65107

SEQ ID NO: 338709 - RNA, 62 nt, Homo Sapiens; identical to SEQ ID NO: 65108

SEQ ID NO: 338710 - RNA, 62 nt, Homo Sapiens; identical to SEQ ID NO: 65109

SEQ ID NO: 338711 - RNA, 62 nt, Homo Sapiens; identical to SEQ ID NO: 65110

SEQ ID NO: 338712 - RNA, 62 nt, Homo Sapiens; identical to SEQ ID NO: 65111

SEQ ID NO: 338713 - RNA, 62 nt, Homo Sapiens; identical to SEQ ID NO: 65112

SEQ ID NO: 338714 - RNA, 62 nt, Homo Sapiens; identical to SEQ ID NO: 65113

SEQ ID NO: 338715 - RNA, 62 nt, Homo Sapiens; identical to SEQ ID NO: 65114

SEQ ID NO: 338716 - RNA, 62 nt, Homo Sapiens; identical to SEQ ID NO: 65115

SEQ ID NO: 338717 - RNA, 62 nt, Homo Sapiens; identical to SEQ ID NO: 65116

SEQ ID NO: 338718 - RNA, 62 nt, Homo Sapiens; identical to SEQ ID NO: 65117

SEQ ID NO: 338719 - RNA, 62 nt, Homo Sapiens; identical to SEQ ID NO: 65118

SEQ ID NO: 338720 - RNA, 62 nt, Homo Sapiens; identical to SEQ ID NO: 65119

SEQ ID NO: 338721 - RNA, 62 nt, Homo Sapiens; identical to SEQ ID NO: 65120

SEQ ID NO: 338722 - RNA, 62 nt, Homo Sapiens; identical to SEQ ID NO: 65121

SEQ ID NO: 338723 - RNA, 62 nt, Homo Sapiens; identical to SEQ ID NO: 65122

SEQ ID NO: 338724 - RNA, 62 nt, Homo Sapiens; identical to SEQ ID NO: 65123

SEQ ID NO: 338725 - RNA, 62 nt, Homo Sapiens; identical to SEQ ID NO: 65124

SEQ ID NO: 338726 - RNA, 62 nt, Homo Sapiens; identical to SEQ ID NO: 65125

SEQ ID NO: 338727 - RNA, 62 nt, Homo Sapiens; identical to SEQ ID NO: 65126

SEQ ID NO: 338728 - RNA, 62 nt, Homo Sapiens; identical to SEQ ID NO: 65127

SEQ ID NO: 338729 - RNA, 62 nt, Homo Sapiens; identical to SEQ ID NO: 65128

SEQ ID NO: 338730 - RNA, 62 nt, Homo Sapiens; identical to SEQ ID NO: 65129

SEQ ID NO: 338731 - RNA, 62 nt, Homo Sapiens; identical to SEQ ID NO: 65130

SEQ ID NO: 338732 - RNA, 62 nt, Homo Sapiens; identical to SEQ ID NO: 65131

SEQ ID NO: 338733 - RNA, 62 nt, Homo Sapiens; identical to SEQ ID NO: 65132

SEQ ID NO: 338734 - RNA, 62 nt, Homo Sapiens; identical to SEQ ID NO: 65133

SEQ ID NO: 338735 - RNA, 62 nt, Homo Sapiens; identical to SEQ ID NO: 65134

SEQ ID NO: 338736 - RNA, 62 nt, Homo Sapiens; identical to SEQ ID NO: 65135

SEQ ID NO: 338737 - RNA, 63 nt, Homo Sapiens; identical to SEQ ID NO: 65136

SEQ ID NO: 338738 - RNA, 63 nt, Homo Sapiens; identical to SEQ ID NO: 65137

SEQ ID NO: 338739 - RNA, 63 nt, Homo Sapiens; identical to SEQ ID NO: 65138

SEQ ID NO: 338740 - RNA, 63 nt, Homo Sapiens; identical to SEQ ID NO: 65139

SEQ ID NO: 338741 - RNA, 63 nt, Homo Sapiens; identical to SEQ ID NO: 65140

SEQ ID NO: 338742 - RNA, 63 nt, Homo Sapiens; identical to SEQ ID NO: 65141

SEQ ID NO: 338743 - RNA, 63 nt, Homo Sapiens; identical to SEQ ID NO: 65142

SEQ ID NO: 338744 - RNA, 63 nt, Homo Sapiens; identical to SEQ ID NO: 65143

SEQ ID NO: 338745 - RNA, 63 nt, Homo Sapiens; identical to SEQ ID NO: 65144

SEQ ID NO: 338746 - RNA, 63 nt, Homo Sapiens; identical to SEQ ID NO: 65145

SEQ ID NO: 338747 - RNA, 63 nt, Homo Sapiens; identical to SEQ ID NO: 65146

SEQ ID NO: 338748 - RNA, 63 nt, Homo Sapiens; identical to SEQ ID NO: 65147

SEQ ID NO: 338749 - RNA, 63 nt, Homo Sapiens; identical to SEQ ID NO: 65148

SEQ ID NO: 338750 - RNA, 63 nt, Homo Sapiens; identical to SEQ ID NO: 65149

SEQ ID NO: 338751 - RNA, 63 nt, Homo Sapiens; identical to SEQ ID NO: 65150

SEQ ID NO: 338752 - RNA, 63 nt, Homo Sapiens; identical to SEQ ID NO: 65151

SEQ ID NO: 338753 - RNA, 63 nt, Homo Sapiens; identical to SEQ ID NO: 65152

SEQ ID NO: 338754 - RNA, 63 nt, Homo Sapiens; identical to SEQ ID NO: 65153

SEQ ID NO: 338755 - RNA, 63 nt, Homo Sapiens; identical to SEQ ID NO: 65154

SEQ ID NO: 338756 - RNA, 63 nt, Homo Sapiens; identical to SEQ ID NO: 65155

SEQ ID NO: 338757 - RNA, 63 nt, Homo Sapiens; identical to SEQ ID NO: 65156

SEQ ID NO: 338758 - RNA, 63 nt, Homo Sapiens; identical to SEQ ID NO: 65157

SEQ ID NO: 338759 - RNA, 63 nt, Homo Sapiens; identical to SEQ ID NO: 65158

SEQ ID NO: 338760 - RNA, 63 nt, Homo Sapiens; identical to SEQ ID NO: 65159

SEQ ID NO: 338761 - RNA, 63 nt, Homo Sapiens; identical to SEQ ID NO: 65160

SEQ ID NO: 338762 - RNA, 63 nt, Homo Sapiens; identical to SEQ ID NO: 65161

SEQ ID NO: 338763 - RNA, 63 nt, Homo Sapiens; identical to SEQ ID NO: 65162

SEQ ID NO: 338764 - RNA, 63 nt, Homo Sapiens; identical to SEQ ID NO: 65163

SEQ ID NO: 338765 - RNA, 63 nt, Homo Sapiens; identical to SEQ ID NO: 65164

SEQ ID NO: 338766 - RNA, 63 nt, Homo Sapiens; identical to SEQ ID NO: 65165

SEQ ID NO: 338767 - RNA, 63 nt, Homo Sapiens; identical to SEQ ID NO: 65166

SEQ ID NO: 338768 - RNA, 63 nt, Homo Sapiens; identical to SEQ ID NO: 65167

SEQ ID NO: 338769 - RNA, 63 nt, Homo Sapiens; identical to SEQ ID NO: 65168

SEQ ID NO: 338770 - RNA, 63 nt, Homo Sapiens; identical to SEQ ID NO: 65169

SEQ ID NO: 338771 - RNA, 63 nt, Homo Sapiens; identical to SEQ ID NO: 65170

SEQ ID NO: 338772 - RNA, 63 nt, Homo Sapiens; identical to SEQ ID NO: 65171

SEQ ID NO: 338773 - RNA, 63 nt, Homo Sapiens; identical to SEQ ID NO: 65172

SEQ ID NO: 338774 - RNA, 63 nt, Homo Sapiens; identical to SEQ ID NO: 65173

SEQ ID NO: 338775 - RNA, 63 nt, Homo Sapiens; identical to SEQ ID NO: 65174

SEQ ID NO: 338776 - RNA, 63 nt, Homo Sapiens; identical to SEQ ID NO: 65175

SEQ ID NO: 338777 - RNA, 63 nt, Homo Sapiens; identical to SEQ ID NO: 65176

SEQ ID NO: 338778 - RNA, 63 nt, Homo Sapiens; identical to SEQ ID NO: 65177

SEQ ID NO: 338779 - RNA, 63 nt, Homo Sapiens; identical to SEQ ID NO: 65178

SEQ ID NO: 338780 - RNA, 63 nt, Homo Sapiens; identical to SEQ ID NO: 65179

SEQ ID NO: 338781 - RNA, 63 nt, Homo Sapiens; identical to SEQ ID NO: 65180

SEQ ID NO: 338782 - RNA, 63 nt, Homo Sapiens; identical to SEQ ID NO: 65181

SEQ ID NO: 338783 - RNA, 63 nt, Homo Sapiens; identical to SEQ ID NO: 65182

SEQ ID NO: 338784 - RNA, 63 nt, Homo Sapiens; identical to SEQ ID NO: 65183

SEQ ID NO: 338785 - RNA, 63 nt, Homo Sapiens; identical to SEQ ID NO: 65184

SEQ ID NO: 338786 - RNA, 63 nt, Homo Sapiens; identical to SEQ ID NO: 65185

SEQ ID NO: 338787 - RNA, 63 nt, Homo Sapiens; identical to SEQ ID NO: 65186

SEQ ID NO: 338788 - RNA, 63 nt, Homo Sapiens; identical to SEQ ID NO: 65187

SEQ ID NO: 338789 - RNA, 63 nt, Homo Sapiens; identical to SEQ ID NO: 65188

SEQ ID NO: 338790 - RNA, 63 nt, Homo Sapiens; identical to SEQ ID NO: 65189

SEQ ID NO: 338791 - RNA, 63 nt, Homo Sapiens; identical to SEQ ID NO: 65190

SEQ ID NO: 338792 - RNA, 63 nt, Homo Sapiens; identical to SEQ ID NO: 65191

SEQ ID NO: 338793 - RNA, 63 nt, Homo Sapiens; identical to SEQ ID NO: 65192

SEQ ID NO: 338794 - RNA, 63 nt, Homo Sapiens; identical to SEQ ID NO: 65193

SEQ ID NO: 338795 - RNA, 63 nt, Homo Sapiens; identical to SEQ ID NO: 65194

SEQ ID NO: 338796 - RNA, 63 nt, Homo Sapiens; identical to SEQ ID NO: 65195

SEQ ID NO: 338797 - RNA, 63 nt, Homo Sapiens; identical to SEQ ID NO: 65196

SEQ ID NO: 338798 - RNA, 63 nt, Homo Sapiens; identical to SEQ ID NO: 65197

SEQ ID NO: 338799 - RNA, 63 nt, Homo Sapiens; identical to SEQ ID NO: 65198

SEQ ID NO: 338800 - RNA, 63 nt, Homo Sapiens; identical to SEQ ID NO: 65199

SEQ ID NO: 338801 - RNA, 63 nt, Homo Sapiens; identical to SEQ ID NO: 65200

SEQ ID NO: 338802 - RNA, 63 nt, Homo Sapiens; identical to SEQ ID NO: 65201

SEQ ID NO: 338803 - RNA, 63 nt, Homo Sapiens; identical to SEQ ID NO: 65202

SEQ ID NO: 338804 - RNA, 63 nt, Homo Sapiens; identical to SEQ ID NO: 65203

SEQ ID NO: 338805 - RNA, 63 nt, Homo Sapiens; identical to SEQ ID NO: 65204

SEQ ID NO: 338806 - RNA, 63 nt, Homo Sapiens; identical to SEQ ID NO: 65205

SEQ ID NO: 338807 - RNA, 63 nt, Homo Sapiens; identical to SEQ ID NO: 65206

SEQ ID NO: 338808 - RNA, 63 nt, Homo Sapiens; identical to SEQ ID NO: 65207

SEQ ID NO: 338809 - RNA, 63 nt, Homo Sapiens; identical to SEQ ID NO: 65208

SEQ ID NO: 338810 - RNA, 63 nt, Homo Sapiens; identical to SEQ ID NO: 65209

SEQ ID NO: 338811 - RNA, 63 nt, Homo Sapiens; identical to SEQ ID NO: 65210

SEQ ID NO: 338812 - RNA, 63 nt, Homo Sapiens; identical to SEQ ID NO: 65211

SEQ ID NO: 338813 - RNA, 63 nt, Homo Sapiens; identical to SEQ ID NO: 65212

SEQ ID NO: 338814 - RNA, 63 nt, Homo Sapiens; identical to SEQ ID NO: 65213

SEQ ID NO: 338815 - RNA, 63 nt, Homo Sapiens; identical to SEQ ID NO: 65214

SEQ ID NO: 338816 - RNA, 63 nt, Homo Sapiens; identical to SEQ ID NO: 65215

SEQ ID NO: 338817 - RNA, 63 nt, Homo Sapiens; identical to SEQ ID NO: 65216

SEQ ID NO: 338818 - RNA, 63 nt, Homo Sapiens; identical to SEQ ID NO: 65217

SEQ ID NO: 338819 - RNA, 63 nt, Homo Sapiens; identical to SEQ ID NO: 65218

SEQ ID NO: 338820 - RNA, 63 nt, Homo Sapiens; identical to SEQ ID NO: 65219

SEQ ID NO: 338821 - RNA, 63 nt, Homo Sapiens; identical to SEQ ID NO: 65220

SEQ ID NO: 338822 - RNA, 63 nt, Homo Sapiens; identical to SEQ ID NO: 65221

SEQ ID NO: 338823 - RNA, 63 nt, Homo Sapiens; identical to SEQ ID NO: 65222

SEQ ID NO: 338824 - RNA, 63 nt, Homo Sapiens; identical to SEQ ID NO: 65223

SEQ ID NO: 338825 - RNA, 63 nt, Homo Sapiens; identical to SEQ ID NO: 65224

SEQ ID NO: 338826 - RNA, 63 nt, Homo Sapiens; identical to SEQ ID NO: 65225

SEQ ID NO: 338827 - RNA, 63 nt, Homo Sapiens; identical to SEQ ID NO: 65226

SEQ ID NO: 338828 - RNA, 63 nt, Homo Sapiens; identical to SEQ ID NO: 65227

SEQ ID NO: 338829 - RNA, 63 nt, Homo Sapiens; identical to SEQ ID NO: 65228

SEQ ID NO: 338830 - RNA, 63 nt, Homo Sapiens; identical to SEQ ID NO: 65229

SEQ ID NO: 338831 - RNA, 63 nt, Homo Sapiens; identical to SEQ ID NO: 65230

SEQ ID NO: 338832 - RNA, 63 nt, Homo Sapiens; identical to SEQ ID NO: 65231

SEQ ID NO: 338833 - RNA, 63 nt, Homo Sapiens; identical to SEQ ID NO: 65232

SEQ ID NO: 338834 - RNA, 63 nt, Homo Sapiens; identical to SEQ ID NO: 65233

SEQ ID NO: 338835 - RNA, 63 nt, Homo Sapiens; identical to SEQ ID NO: 65234

SEQ ID NO: 338836 - RNA, 63 nt, Homo Sapiens; identical to SEQ ID NO: 65235

SEQ ID NO: 338837 - RNA, 63 nt, Homo Sapiens; identical to SEQ ID NO: 65236

SEQ ID NO: 338838 - RNA, 63 nt, Homo Sapiens; identical to SEQ ID NO: 65237

SEQ ID NO: 338839 - RNA, 63 nt, Homo Sapiens; identical to SEQ ID NO: 65238

SEQ ID NO: 338840 - RNA, 63 nt, Homo Sapiens; identical to SEQ ID NO: 65239

SEQ ID NO: 338841 - RNA, 63 nt, Homo Sapiens; identical to SEQ ID NO: 65240

SEQ ID NO: 338842 - RNA, 63 nt, Homo Sapiens; identical to SEQ ID NO: 65241

SEQ ID NO: 338843 - RNA, 63 nt, Homo Sapiens; identical to SEQ ID NO: 65242

SEQ ID NO: 338844 - RNA, 63 nt, Homo Sapiens; identical to SEQ ID NO: 65243

SEQ ID NO: 338845 - RNA, 63 nt, Homo Sapiens; identical to SEQ ID NO: 65244

SEQ ID NO: 338846 - RNA, 63 nt, Homo Sapiens; identical to SEQ ID NO: 65245

SEQ ID NO: 338847 - RNA, 63 nt, Homo Sapiens; identical to SEQ ID NO: 65246

SEQ ID NO: 338848 - RNA, 63 nt, Homo Sapiens; identical to SEQ ID NO: 65247

SEQ ID NO: 338849 - RNA, 63 nt, Homo Sapiens; identical to SEQ ID NO: 65248

SEQ ID NO: 338850 - RNA, 63 nt, Homo Sapiens; identical to SEQ ID NO: 65249

SEQ ID NO: 338851 - RNA, 63 nt, Homo Sapiens; identical to SEQ ID NO: 65250

SEQ ID NO: 338852 - RNA, 63 nt, Homo Sapiens; identical to SEQ ID NO: 65251

SEQ ID NO: 338853 - RNA, 63 nt, Homo Sapiens; identical to SEQ ID NO: 65252

SEQ ID NO: 338854 - RNA, 63 nt, Homo Sapiens; identical to SEQ ID NO: 65253

SEQ ID NO: 338855 - RNA, 63 nt, Homo Sapiens; identical to SEQ ID NO: 65254

SEQ ID NO: 338856 - RNA, 63 nt, Homo Sapiens; identical to SEQ ID NO: 65255

SEQ ID NO: 338857 - RNA, 63 nt, Homo Sapiens; identical to SEQ ID NO: 65256

SEQ ID NO: 338858 - RNA, 63 nt, Homo Sapiens; identical to SEQ ID NO: 65257

SEQ ID NO: 338859 - RNA, 63 nt, Homo Sapiens; identical to SEQ ID NO: 65258

SEQ ID NO: 338860 - RNA, 63 nt, Homo Sapiens; identical to SEQ ID NO: 65259

SEQ ID NO: 338861 - RNA, 63 nt, Homo Sapiens; identical to SEQ ID NO: 65260

SEQ ID NO: 338862 - RNA, 63 nt, Homo Sapiens; identical to SEQ ID NO: 65261

SEQ ID NO: 338863 - RNA, 63 nt, Homo Sapiens; identical to SEQ ID NO: 65262

SEQ ID NO: 338864 - RNA, 63 nt, Homo Sapiens; identical to SEQ ID NO: 65263

SEQ ID NO: 338865 - RNA, 63 nt, Homo Sapiens; identical to SEQ ID NO: 65264

SEQ ID NO: 338866 - RNA, 63 nt, Homo Sapiens; identical to SEQ ID NO: 65265

SEQ ID NO: 338867 - RNA, 63 nt, Homo Sapiens; identical to SEQ ID NO: 65266

SEQ ID NO: 338868 - RNA, 63 nt, Homo Sapiens; identical to SEQ ID NO: 65267

SEQ ID NO: 338869 - RNA, 63 nt, Homo Sapiens; identical to SEQ ID NO: 65268

SEQ ID NO: 338870 - RNA, 63 nt, Homo Sapiens; identical to SEQ ID NO: 65269

SEQ ID NO: 338871 - RNA, 63 nt, Homo Sapiens; identical to SEQ ID NO: 65270

SEQ ID NO: 338872 - RNA, 63 nt, Homo Sapiens; identical to SEQ ID NO: 65271

SEQ ID NO: 338873 - RNA, 63 nt, Homo Sapiens; identical to SEQ ID NO: 65272

SEQ ID NO: 338874 - RNA, 63 nt, Homo Sapiens; identical to SEQ ID NO: 65273

SEQ ID NO: 338875 - RNA, 56 nt, Homo Sapiens; identical to SEQ ID NO: 61369

SEQ ID NO: 338876 - RNA, 63 nt, Homo Sapiens; identical to SEQ ID NO: 65275

SEQ ID NO: 338877 - RNA, 63 nt, Homo Sapiens; identical to SEQ ID NO: 65276

SEQ ID NO: 338878 - RNA, 63 nt, Homo Sapiens; identical to SEQ ID NO: 65277

SEQ ID NO: 338879 - RNA, 63 nt, Homo Sapiens; identical to SEQ ID NO: 65278

SEQ ID NO: 338880 - RNA, 63 nt, Homo Sapiens; identical to SEQ ID NO: 65279

SEQ ID NO: 338881 - RNA, 63 nt, Homo Sapiens; identical to SEQ ID NO: 65280

SEQ ID NO: 338882 - RNA, 63 nt, Homo Sapiens; identical to SEQ ID NO: 65281

SEQ ID NO: 338883 - RNA, 63 nt, Homo Sapiens; identical to SEQ ID NO: 65282

SEQ ID NO: 338884 - RNA, 63 nt, Homo Sapiens; identical to SEQ ID NO: 65283

SEQ ID NO: 338885 - RNA, 63 nt, Homo Sapiens; identical to SEQ ID NO: 65284

SEQ ID NO: 338886 - RNA, 63 nt, Homo Sapiens; identical to SEQ ID NO: 65285

SEQ ID NO: 338887 - RNA, 63 nt, Homo Sapiens; identical to SEQ ID NO: 65286

SEQ ID NO: 338888 - RNA, 63 nt, Homo Sapiens; identical to SEQ ID NO: 65287

SEQ ID NO: 338889 - RNA, 63 nt, Homo Sapiens; identical to SEQ ID NO: 65288

SEQ ID NO: 338890 - RNA, 63 nt, Homo Sapiens; identical to SEQ ID NO: 65289

SEQ ID NO: 338891 - RNA, 63 nt, Homo Sapiens; identical to SEQ ID NO: 65290

SEQ ID NO: 338892 - RNA, 63 nt, Homo Sapiens; identical to SEQ ID NO: 65291

SEQ ID NO: 338893 - RNA, 63 nt, Homo Sapiens; identical to SEQ ID NO: 65292

SEQ ID NO: 338894 - RNA, 63 nt, Homo Sapiens; identical to SEQ ID NO: 65293

SEQ ID NO: 338895 - RNA, 63 nt, Homo Sapiens; identical to SEQ ID NO: 65294

SEQ ID NO: 338896 - RNA, 63 nt, Homo Sapiens; identical to SEQ ID NO: 65295

SEQ ID NO: 338897 - RNA, 63 nt, Homo Sapiens; identical to SEQ ID NO: 65296

SEQ ID NO: 338898 - RNA, 63 nt, Homo Sapiens; identical to SEQ ID NO: 65297

SEQ ID NO: 338899 - RNA, 63 nt, Homo Sapiens; identical to SEQ ID NO: 65298

SEQ ID NO: 338900 - RNA, 63 nt, Homo Sapiens; identical to SEQ ID NO: 65299

SEQ ID NO: 338901 - RNA, 63 nt, Homo Sapiens; identical to SEQ ID NO: 65300

SEQ ID NO: 338902 - RNA, 63 nt, Homo Sapiens; identical to SEQ ID NO: 65301

SEQ ID NO: 338903 - RNA, 63 nt, Homo Sapiens; identical to SEQ ID NO: 65302

SEQ ID NO: 338904 - RNA, 63 nt, Homo Sapiens; identical to SEQ ID NO: 65303

SEQ ID NO: 338905 - RNA, 63 nt, Homo Sapiens; identical to SEQ ID NO: 65304

SEQ ID NO: 338906 - RNA, 63 nt, Homo Sapiens; identical to SEQ ID NO: 65305

SEQ ID NO: 338907 - RNA, 63 nt, Homo Sapiens; identical to SEQ ID NO: 65306

SEQ ID NO: 338908 - RNA, 63 nt, Homo Sapiens; identical to SEQ ID NO: 65307

SEQ ID NO: 338909 - RNA, 63 nt, Homo Sapiens; identical to SEQ ID NO: 65308

SEQ ID NO: 338910 - RNA, 63 nt, Homo Sapiens; identical to SEQ ID NO: 65309

SEQ ID NO: 338911 - RNA, 63 nt, Homo Sapiens; identical to SEQ ID NO: 65310

SEQ ID NO: 338912 - RNA, 63 nt, Homo Sapiens; identical to SEQ ID NO: 65311

SEQ ID NO: 338913 - RNA, 63 nt, Homo Sapiens; identical to SEQ ID NO: 65312

SEQ ID NO: 338914 - RNA, 63 nt, Homo Sapiens; identical to SEQ ID NO: 65313

SEQ ID NO: 338915 - RNA, 63 nt, Homo Sapiens; identical to SEQ ID NO: 65314

SEQ ID NO: 338916 - RNA, 63 nt, Homo Sapiens; identical to SEQ ID NO: 65315

SEQ ID NO: 338917 - RNA, 63 nt, Homo Sapiens; identical to SEQ ID NO: 65316

SEQ ID NO: 338918 - RNA, 63 nt, Homo Sapiens; identical to SEQ ID NO: 65317

SEQ ID NO: 338919 - RNA, 63 nt, Homo Sapiens; identical to SEQ ID NO: 65318

SEQ ID NO: 338920 - RNA, 63 nt, Homo Sapiens; identical to SEQ ID NO: 65319

SEQ ID NO: 338921 - RNA, 63 nt, Homo Sapiens; identical to SEQ ID NO: 65320

SEQ ID NO: 338922 - RNA, 63 nt, Homo Sapiens; identical to SEQ ID NO: 65321

SEQ ID NO: 338923 - RNA, 63 nt, Homo Sapiens; identical to SEQ ID NO: 65322

SEQ ID NO: 338924 - RNA, 63 nt, Homo Sapiens; identical to SEQ ID NO: 65323

SEQ ID NO: 338925 - RNA, 63 nt, Homo Sapiens; identical to SEQ ID NO: 65324

SEQ ID NO: 338926 - RNA, 63 nt, Homo Sapiens; identical to SEQ ID NO: 65325

SEQ ID NO: 338927 - RNA, 63 nt, Homo Sapiens; identical to SEQ ID NO: 65326

SEQ ID NO: 338928 - RNA, 63 nt, Homo Sapiens; identical to SEQ ID NO: 65327

SEQ ID NO: 338929 - RNA, 63 nt, Homo Sapiens; identical to SEQ ID NO: 65328

SEQ ID NO: 338930 - RNA, 63 nt, Homo Sapiens; identical to SEQ ID NO: 65329

SEQ ID NO: 338931 - RNA, 63 nt, Homo Sapiens; identical to SEQ ID NO: 65330

SEQ ID NO: 338932 - RNA, 63 nt, Homo Sapiens; identical to SEQ ID NO: 65331

SEQ ID NO: 338933 - RNA, 63 nt, Homo Sapiens; identical to SEQ ID NO: 65332

SEQ ID NO: 338934 - RNA, 63 nt, Homo Sapiens; identical to SEQ ID NO: 65333

SEQ ID NO: 338935 - RNA, 63 nt, Homo Sapiens; identical to SEQ ID NO: 65334

SEQ ID NO: 338936 - RNA, 63 nt, Homo Sapiens; identical to SEQ ID NO: 65335

SEQ ID NO: 338937 - RNA, 63 nt, Homo Sapiens; identical to SEQ ID NO: 65336

SEQ ID NO: 338938 - RNA, 63 nt, Homo Sapiens; identical to SEQ ID NO: 65337

SEQ ID NO: 338939 - RNA, 63 nt, Homo Sapiens; identical to SEQ ID NO: 65338

SEQ ID NO: 338940 - RNA, 63 nt, Homo Sapiens; identical to SEQ ID NO: 65339

SEQ ID NO: 338941 - RNA, 63 nt, Homo Sapiens; identical to SEQ ID NO: 65340

SEQ ID NO: 338942 - RNA, 63 nt, Homo Sapiens; identical to SEQ ID NO: 65341

SEQ ID NO: 338943 - RNA, 63 nt, Homo Sapiens; identical to SEQ ID NO: 65342

SEQ ID NO: 338944 - RNA, 63 nt, Homo Sapiens; identical to SEQ ID NO: 65343

SEQ ID NO: 338945 - RNA, 63 nt, Homo Sapiens; identical to SEQ ID NO: 65344

SEQ ID NO: 338946 - RNA, 63 nt, Homo Sapiens; identical to SEQ ID NO: 65345

SEQ ID NO: 338947 - RNA, 63 nt, Homo Sapiens; identical to SEQ ID NO: 65346

SEQ ID NO: 338948 - RNA, 63 nt, Homo Sapiens; identical to SEQ ID NO: 65347

SEQ ID NO: 338949 - RNA, 63 nt, Homo Sapiens; identical to SEQ ID NO: 65348

SEQ ID NO: 338950 - RNA, 63 nt, Homo Sapiens; identical to SEQ ID NO: 65349

SEQ ID NO: 338951 - RNA, 63 nt, Homo Sapiens; identical to SEQ ID NO: 65350

SEQ ID NO: 338952 - RNA, 63 nt, Homo Sapiens; identical to SEQ ID NO: 65351

SEQ ID NO: 338953 - RNA, 63 nt, Homo Sapiens; identical to SEQ ID NO: 65352

SEQ ID NO: 338954 - RNA, 63 nt, Homo Sapiens; identical to SEQ ID NO: 65353

SEQ ID NO: 338955 - RNA, 63 nt, Homo Sapiens; identical to SEQ ID NO: 65354

SEQ ID NO: 338956 - RNA, 63 nt, Homo Sapiens; identical to SEQ ID NO: 65355

SEQ ID NO: 338957 - RNA, 63 nt, Homo Sapiens; identical to SEQ ID NO: 65356

SEQ ID NO: 338958 - RNA, 63 nt, Homo Sapiens; identical to SEQ ID NO: 65357

SEQ ID NO: 338959 - RNA, 63 nt, Homo Sapiens; identical to SEQ ID NO: 65358

SEQ ID NO: 338960 - RNA, 63 nt, Homo Sapiens; identical to SEQ ID NO: 65359

SEQ ID NO: 338961 - RNA, 63 nt, Homo Sapiens; identical to SEQ ID NO: 65360

SEQ ID NO: 338962 - RNA, 63 nt, Homo Sapiens; identical to SEQ ID NO: 65361

SEQ ID NO: 338963 - RNA, 63 nt, Homo Sapiens; identical to SEQ ID NO: 65362

SEQ ID NO: 338964 - RNA, 63 nt, Homo Sapiens; identical to SEQ ID NO: 65363

SEQ ID NO: 338965 - RNA, 63 nt, Homo Sapiens; identical to SEQ ID NO: 65364

SEQ ID NO: 338966 - RNA, 63 nt, Homo Sapiens; identical to SEQ ID NO: 65365

SEQ ID NO: 338967 - RNA, 60 nt, Homo Sapiens; identical to SEQ ID NO: 65087

SEQ ID NO: 338968 - RNA, 63 nt, Homo Sapiens; identical to SEQ ID NO: 65367

SEQ ID NO: 338969 - RNA, 63 nt, Homo Sapiens; identical to SEQ ID NO: 65368

SEQ ID NO: 338970 - RNA, 63 nt, Homo Sapiens; identical to SEQ ID NO: 65369

SEQ ID NO: 338971 - RNA, 63 nt, Homo Sapiens; identical to SEQ ID NO: 65370

SEQ ID NO: 338972 - RNA, 63 nt, Homo Sapiens; identical to SEQ ID NO: 65371

SEQ ID NO: 338973 - RNA, 63 nt, Homo Sapiens; identical to SEQ ID NO: 65372

SEQ ID NO: 338974 - RNA, 51 nt, Homo Sapiens; identical to SEQ ID NO: 65094

SEQ ID NO: 338975 - RNA, 63 nt, Homo Sapiens; identical to SEQ ID NO: 65374

SEQ ID NO: 338976 - RNA, 63 nt, Homo Sapiens; identical to SEQ ID NO: 65375

SEQ ID NO: 338977 - RNA, 63 nt, Homo Sapiens; identical to SEQ ID NO: 65376

SEQ ID NO: 338978 - RNA, 63 nt, Homo Sapiens; identical to SEQ ID NO: 65377

SEQ ID NO: 338979 - RNA, 63 nt, Homo Sapiens; identical to SEQ ID NO: 65378

SEQ ID NO: 338980 - RNA, 63 nt, Homo Sapiens; identical to SEQ ID NO: 65379

SEQ ID NO: 338981 - RNA, 63 nt, Homo Sapiens; identical to SEQ ID NO: 65380

SEQ ID NO: 338982 - RNA, 63 nt, Homo Sapiens; identical to SEQ ID NO: 65381

SEQ ID NO: 338983 - RNA, 63 nt, Homo Sapiens; identical to SEQ ID NO: 65382

SEQ ID NO: 338984 - RNA, 63 nt, Homo Sapiens; identical to SEQ ID NO: 65383

SEQ ID NO: 338985 - RNA, 63 nt, Homo Sapiens; identical to SEQ ID NO: 65384

SEQ ID NO: 338986 - RNA, 63 nt, Homo Sapiens; identical to SEQ ID NO: 65385

SEQ ID NO: 338987 - RNA, 63 nt, Homo Sapiens; identical to SEQ ID NO: 65386

SEQ ID NO: 338988 - RNA, 63 nt, Homo Sapiens; identical to SEQ ID NO: 65387

SEQ ID NO: 338989 - RNA, 63 nt, Homo Sapiens; identical to SEQ ID NO: 65388

SEQ ID NO: 338990 - RNA, 63 nt, Homo Sapiens; identical to SEQ ID NO: 65389

SEQ ID NO: 338991 - RNA, 63 nt, Homo Sapiens; identical to SEQ ID NO: 65390

SEQ ID NO: 338992 - RNA, 63 nt, Homo Sapiens; identical to SEQ ID NO: 65391

SEQ ID NO: 338993 - RNA, 63 nt, Homo Sapiens; identical to SEQ ID NO: 65392

SEQ ID NO: 338994 - RNA, 63 nt, Homo Sapiens; identical to SEQ ID NO: 65393

SEQ ID NO: 338995 - RNA, 63 nt, Homo Sapiens; identical to SEQ ID NO: 65394

SEQ ID NO: 338996 - RNA, 63 nt, Homo Sapiens; identical to SEQ ID NO: 65395

SEQ ID NO: 338997 - RNA, 63 nt, Homo Sapiens; identical to SEQ ID NO: 65396

SEQ ID NO: 338998 - RNA, 63 nt, Homo Sapiens; identical to SEQ ID NO: 65397

SEQ ID NO: 338999 - RNA, 63 nt, Homo Sapiens; identical to SEQ ID NO: 65398

SEQ ID NO: 339000 - RNA, 63 nt, Homo Sapiens; identical to SEQ ID NO: 65399

SEQ ID NO: 339001 - RNA, 63 nt, Homo Sapiens; identical to SEQ ID NO: 65400

SEQ ID NO: 339002 - RNA, 63 nt, Homo Sapiens; identical to SEQ ID NO: 65401

SEQ ID NO: 339003 - RNA, 63 nt, Homo Sapiens; identical to SEQ ID NO: 65402

SEQ ID NO: 339004 - RNA, 63 nt, Homo Sapiens; identical to SEQ ID NO: 65403

SEQ ID NO: 339005 - RNA, 63 nt, Homo Sapiens; identical to SEQ ID NO: 65404

SEQ ID NO: 339006 - RNA, 63 nt, Homo Sapiens; identical to SEQ ID NO: 65405

SEQ ID NO: 339007 - RNA, 63 nt, Homo Sapiens; identical to SEQ ID NO: 65406

SEQ ID NO: 339008 - RNA, 63 nt, Homo Sapiens; identical to SEQ ID NO: 65407

SEQ ID NO: 339009 - RNA, 63 nt, Homo Sapiens; identical to SEQ ID NO: 65408

SEQ ID NO: 339010 - RNA, 63 nt, Homo Sapiens; identical to SEQ ID NO: 65409

SEQ ID NO: 339011 - RNA, 63 nt, Homo Sapiens; identical to SEQ ID NO: 65410

SEQ ID NO: 339012 - RNA, 63 nt, Homo Sapiens; identical to SEQ ID NO: 65411

SEQ ID NO: 339013 - RNA, 63 nt, Homo Sapiens; identical to SEQ ID NO: 65412

SEQ ID NO: 339014 - RNA, 63 nt, Homo Sapiens; identical to SEQ ID NO: 65413

SEQ ID NO: 339015 - RNA, 63 nt, Homo Sapiens; identical to SEQ ID NO: 65414

SEQ ID NO: 339016 - RNA, 61 nt, Homo Sapiens
gugauuugugcaagccagguucaacccuugccucaagaaaucagaugggaccaauuuagug

SEQ ID NO: 339017 - RNA, 61 nt, Homo Sapiens
agauggcuggugaggagcuuaacagaggaaccucaagaagauucugaaaauccuaccccca

SEQ ID NO: 339018 - RNA, 61 nt, Homo Sapiens
aauacugaagggguuaaacagguuuuugcuccucaagaauuuguuugccugggcccaggau

SEQ ID NO: 339019 - RNA, 61 nt, Homo Sapiens
aacacuuaccaaaagaucacugcaaaccugccucaagaagcugaugguggcacuucaauuu

SEQ ID NO: 339020 - RNA, 61 nt, Homo Sapiens
guccuuuuuuuuuuuuuuuuuuuuuuaauugcucaagaaaugauucucucacaggcuuggg

SEQ ID NO: 339021 - RNA, 61 nt, Homo Sapiens
ugaugacaucugacuuuugucgaugggacuucucaagaagccauuccuuggagcuucuguu

SEQ ID NO: 339022 - RNA, 61 nt, Homo Sapiens
acugccaugaagacggucucuguguccucagcucaagaauccuguagcuugucccaucaua

SEQ ID NO: 339023 - RNA, 58 nt, Homo Sapiens
caaaccccaaaaacaacugauauaauuacucaagaaauauuugcaacauuaguuuuuu

SEQ ID NO: 339024 - RNA, 61 nt, Homo Sapiens
uccuccaugguaaagcugaacugaaacaauucucaagaaugcaucagcuguaccuacaaua

SEQ ID NO: 339025 - RNA, 61 nt, Homo Sapiens
ucugaagauguaagacuuccugaaacaaguucucaagaagucuuuacauuauauuuauaac

SEQ ID NO: 339026 - RNA, 61 nt, Homo Sapiens
gaauauuggggaaggaagaugauacuucuuucucaagaaaagaaaauuggauuauuaggaa

SEQ ID NO: 339027 - RNA, 61 nt, Homo Sapiens
cauaagcgaucacuuccuauaugcacuuauucucaagaagaacaucuuuaugguaaagaug

SEQ ID NO: 339028 - RNA, 61 nt, Homo Sapiens
gaaugcugaacugaaggcucagauugaggagcucaagaacgagaagcagcauuugauauac

SEQ ID NO: 339029 - RNA, 61 nt, Homo Sapiens
guauuucaccaccuaaauguaauguugauuccucaagaaugaaaugaaggcacuacauuga

SEQ ID NO: 339030 - RNA, 61 nt, Homo Sapiens
acuuaugaguaagcagucuggcugacaaguucucaagaagaaagacaaaacagauugcguc

SEQ ID NO: 339031 - RNA, 61 nt, Homo Sapiens
aguuagcaaaccacuccuuugggauccacuacucaagaaaacacgugagguuuuguuuaga

SEQ ID NO: 339032 - RNA, 61 nt, Homo Sapiens
uauucaccaguuccucugcagaagaagaaggcucaagaauucaaaagcuugauaugacaga

SEQ ID NO: 339033 - RNA, 61 nt, Homo Sapiens
agcugagugaacagcaugauuguggagucaacucaagaaaaccacuggucacagguagaca

SEQ ID NO: 339034 - RNA, 61 nt, Homo Sapiens
cagcucagcuucuccuucgacguccccagaucucaagaacgugugaccacaucucccacca

SEQ ID NO: 339035 - RNA, 61 nt, Homo Sapiens
cauggagacuccugcccugucaaacucacugcucaagaagaagagggccugugggagccug

SEQ ID NO: 339036 - RNA, 61 nt, Homo Sapiens
auuuuucuaaaaauaugaguaaaaaaauaaacucaagaauggagauccugucucuuaaaga

SEQ ID NO: 339037 - RNA, 61 nt, Homo Sapiens
gagcuuuguauguguccuuucauaagcacagcucaagaacuuacugaucacuauaguauug

SEQ ID NO: 339038 - RNA, 61 nt, Homo Sapiens
caugccagcucagcccuacaagcccugagcccucaagaacuagugggcuacauacaaugag

SEQ ID NO: 339039 - RNA, 61 nt, Homo Sapiens
aguuccaaaccuagcagaauuaaaggguugacucaagaacuugacaauggcagagaacaau

SEQ ID NO: 339040 - RNA, 61 nt, Homo Sapiens
agaggccuccucuggagugacuccuucccuccucaagaagcgggcauccgacaaggcccau

SEQ ID NO: 339041 - RNA, 61 nt, Homo Sapiens
uccuuaaaaacuuugaaguuguguuaaguuccucaagaaucuauggcaguauguauauauu

SEQ ID NO: 339042 - RNA, 61 nt, Homo Sapiens
caggggcauccagggcucccaccaagacauccucaagaaaagauuuaaggacuucuggggg

SEQ ID NO: 339043 - RNA, 61 nt, Homo Sapiens
ugaugggccugaacucggacucaaaaacgcccucaagaacagucccccagcagaaccagcc

SEQ ID NO: 339044 - RNA, 51 nt, Homo Sapiens
cuuuauuuucuaucauucuuacucaagaacucuucugggaaguucucuuga

SEQ ID NO: 339045 - RNA, 61 nt, Homo Sapiens
ccagagucaccugucucaucgcacggcgccccucaagaacuugcucacauccacagucagg

SEQ ID NO: 339046 - RNA, 61 nt, Homo Sapiens
ugggcuguaacaauucagggaccacguuuugcucaagaagcaggcccucucuuccucucau

SEQ ID NO: 339047 - RNA, 61 nt, Homo Sapiens
agugcuuuuucuccauggauuuugcuguugccucaagaaaauuuuguaucagugcuguuaa

SEQ ID NO: 339048 - RNA, 61 nt, Homo Sapiens
uucacuaugugaaugagaugauaguacaauucucaagaaaaaaaccuuauggaaaauaauu

SEQ ID NO: 339049 - RNA, 61 nt, Homo Sapiens
acccugauuugaccccucuucuuauaaggaucucaagaaucucuucagaagcacugaugac

SEQ ID NO: 339050 - RNA, 61 nt, Homo Sapiens
aaggcaaagcaaggaacaucuugagauaugucucaagaauauaaagauguauuauuuuaag

SEQ ID NO: 339051 - RNA, 61 nt, Homo Sapiens
ucacaugggaguuguccucacccuuguuaaucucaagaaacucuuauuuauaauagguugc

SEQ ID NO: 339052 - RNA, 61 nt, Homo Sapiens
cuguuuggaaacaaccccuugagcugccaggcucaagaaaucauggacucacaggguccug

SEQ ID NO: 339053 - RNA, 61 nt, Homo Sapiens
uggccuguguguuacaaugauaugaucauuucucaagaauaagucccuuuuuguauguguu

SEQ ID NO: 339054 - RNA, 61 nt, Homo Sapiens
cuucugugucacaaacagcacuccaggccagcucaagaagcaaagcaggccaauagaaaug

SEQ ID NO: 339055 - RNA, 61 nt, Homo Sapiens
uaugugugcuccauuccucauuucuacuuggcucaagaaaacauuucugcagucaggugag

SEQ ID NO: 339056 - RNA, 61 nt, Homo Sapiens
ggcagugaaaauggccagccagagaaaagaucucaagaaccagaaauaaauaaggauggug

SEQ ID NO: 339057 - RNA, 61 nt, Homo Sapiens
aagacauacucauuaaguguuauuuauuuuacucaagaacuggaaaccaacuaaaugccuu

SEQ ID NO: 339058 - RNA, 61 nt, Homo Sapiens
uauguucccaggcuaguguugaacuccugagcucaagaaauccuccugccugagucucuga

SEQ ID NO: 339059 - RNA, 61 nt, Homo Sapiens
guuucugauuacauaaaauuugaauagaacacucaagaaguauguagauuuuugaaaaacc

SEQ ID NO: 339060 - RNA, 61 nt, Homo Sapiens
gaauguuccaacaccugccuccacuucuccccucaagaaauuuucaacgccaggaaucaug

SEQ ID NO: 339061 - RNA, 61 nt, Homo Sapiens
aagagacuucugcuuuucaacccccacccuccucaagaaguaauaauuuguuuacuuguaa

SEQ ID NO: 339062 - RNA, 61 nt, Homo Sapiens
uuggaugcggccauucaaggggagccaaaaucucaagaaauucccagcagguuaccuggag

SEQ ID NO: 339063 - RNA, 61 nt, Homo Sapiens
ccccagacaucuggacacugggcauagauuucucaagaaggaagacuccccugccucccca

SEQ ID NO: 339064 - RNA, 61 nt, Homo Sapiens
cauugaaaaauucuaugaauaacuuuugcaucucaagaaaauugaaaacacugcaacagug

SEQ ID NO: 339065 - RNA, 61 nt, Homo Sapiens
uggcucucauucuaagaggccccagugaucacucaagaaucgucuuucucuaggacaagcu

SEQ ID NO: 339066 - RNA, 61 nt, Homo Sapiens
uccuguuggauuuguuuaaaugagaaggugccucaagaauucauucaucuuguguuuuaua

SEQ ID NO: 339067 - RNA, 61 nt, Homo Sapiens
guacagauguguggaauacgaagcgaucauacucaagaauagguucucaauuugacacccu

SEQ ID NO: 339068 - RNA, 61 nt, Homo Sapiens
auaauaaaagaccauaaauaaaggaaaaggacucaagaaaaagugacuuauuaaacuauug

SEQ ID NO: 339069 - RNA, 61 nt, Homo Sapiens
cuauugauauuggucauguucuuauaguagccucaagaaguuugaaccuuauuucucaaaa

SEQ ID NO: 339070 - RNA, 58 nt, Homo Sapiens
agcauuguuuaggaagacugauggagcucucaagaacaagcacaucaugucuaucuga

SEQ ID NO: 339071 - RNA, 61 nt, Homo Sapiens
gcuucagauccucuuguguaugaaagucucccucaagaauaugugcucugaguuuugcugu

SEQ ID NO: 339072 - RNA, 61 nt, Homo Sapiens
uaucauuuuaauguaauugauuguauauagucucaagaaugguuggugggcaugaguuccu

SEQ ID NO: 339073 - RNA, 61 nt, Homo Sapiens
uuuuguagcaaucuggucuauagacuuuuaacucaagaagcuaaggcuagacuuguuaccu

SEQ ID NO: 339074 - RNA, 61 nt, Homo Sapiens
augucucuccucuagguaucguauuuuguugcucaagaauccaaaaugggucuguggacau

SEQ ID NO: 339075 - RNA, 61 nt, Homo Sapiens
gcuuaguuuuuggacugaaaagauauuaaaacucaagaaggaccaagaaguuuucauaugu

SEQ ID NO: 339076 - RNA, 61 nt, Homo Sapiens
gaguaacaauacaaauggauuuugggagugacucaagaagugaagaaugcacaagaaugga

SEQ ID NO: 339077 - RNA, 61 nt, Homo Sapiens
gacacagaacaaggucugucuccuauagucacucaagaagucgaucgagaaguuccacauc

SEQ ID NO: 339078 - RNA, 61 nt, Homo Sapiens
uaauuagacuuuuguauaagagaugucaugccucaagaaagccauaaaccugguaggaaca

SEQ ID NO: 339079 - RNA, 61 nt, Homo Sapiens
ccugaagcagacugcugaggaauuacauuugcucaagaauuuuuuccgucaaauugugaac

SEQ ID NO: 339080 - RNA, 61 nt, Homo Sapiens
uuaauuauuuaucuuuaguuccuuauuaguucucaagaaacaaaugcuagcuucauaugua

SEQ ID NO: 339081 - RNA, 61 nt, Homo Sapiens
ggucccuuccuuucuccuuuccucucuacugcucaagaacagauuugaggccaggugcggu

SEQ ID NO: 339082 - RNA, 61 nt, Homo Sapiens
uaagcaauguaauuaugcuauucacaggggccucaagaauugguauguaugaugugaucug

SEQ ID NO: 339083 - RNA, 61 nt, Homo Sapiens
cuuauguagaaaggacuuugaaauuuuucuucucaagaaaugguuuguauaagaauaacaa

SEQ ID NO: 339084 - RNA, 61 nt, Homo Sapiens
auacugacugauuaauuauuccugauaacaucucaagaaaaggagaaggaaaguguuucug

SEQ ID NO: 339085 - RNA, 61 nt, Homo Sapiens
uaaaauugucagcguauuuuuacacuauuggcucaagaauguuauaaugcuaagggacaua

SEQ ID NO: 339086 - RNA, 61 nt, Homo Sapiens
gaaaagauuaauaccuuaaaagaagaaaacacucaagaagcagcaguccugaaugguguuu

SEQ ID NO: 339087 - RNA, 61 nt, Homo Sapiens
aaaauuuuuuaaauaaguuuagcaagacugucucaagaaaacacuccagccugggccacag

SEQ ID NO: 339088 - RNA, 61 nt, Homo Sapiens
auaagagaaaugaacucacauuagaaugguucucaagaauuauuuuauacaaauagauugc

SEQ ID NO: 339089 - RNA, 61 nt, Homo Sapiens
gaauuaacuacauaauggaagcaggcaggcacucaagaaauuaagcaccuggcaucuaaug

SEQ ID NO: 339090 - RNA, 61 nt, Homo Sapiens
cucuugagccaguaaucaaugcagaacauuucucaagaaucuucugugaauuucaugaaga

SEQ ID NO: 339091 - RNA, 61 nt, Homo Sapiens
aaugguguuuuggaaauuuuacgucauauaacucaagaauagagaauagaaaugaaaagcc

SEQ ID NO: 339092 - RNA, 61 nt, Homo Sapiens
gccagggccagggcuguaugaaccccacucccucaagaaggccugcugggcacaccccaca

SEQ ID NO: 339093 - RNA, 61 nt, Homo Sapiens
aacugaagaaggagcaagugaaccaaauuuccucaagaaaugcaggacaguaaauaaugaa

SEQ ID NO: 339094 - RNA, 61 nt, Homo Sapiens
acugcaacacuacuuuauggccaugcccaagcucaagaacggauguggucaguagggagcu

SEQ ID NO: 339095 - RNA, 61 nt, Homo Sapiens
gauugguacugcaacuguagauuuaaaacuccucaagaaagauuuaauugcucaaccaugc

SEQ ID NO: 339096 - RNA, 61 nt, Homo Sapiens
agcauuaguaauuucuaguauuuuuagguuacucaagaaccuaaauuugaguaaauacaau

SEQ ID NO: 339097 - RNA, 61 nt, Homo Sapiens
ugguacaaaacacaaccgagacaacguuuuccucaagaaaagggaacacacaaagaauuac

SEQ ID NO: 339098 - RNA, 61 nt, Homo Sapiens
gaugucuauugaguagaaccuaauggugaagcucaagaacaauaauggguuugggggauaa

SEQ ID NO: 339099 - RNA, 61 nt, Homo Sapiens
agggauuccuaauaauggcauguagcugacacucaagaaaugugaauuguggaaaauguca

SEQ ID NO: 339100 - RNA, 61 nt, Homo Sapiens
uaggcucauggcaacguguguucacauggcgcucaagaagugcuuuccugcuauacacaua

SEQ ID NO: 339101 - RNA, 61 nt, Homo Sapiens
uguguuuucuuuagcuucccguccugccugccucaagaauaucaucaaguggaagccaacu

SEQ ID NO: 339102 - RNA, 61 nt, Homo Sapiens
aaauuugcucuguuuuaagacuuugaacuaccucaagaagaggaaucuaauacaauauuug

SEQ ID NO: 339103 - RNA, 61 nt, Homo Sapiens
aaguuuucacugaaugagcauggcagugccacucaagaaaaugaaucuccaaaguaucuuc

SEQ ID NO: 339104 - RNA, 61 nt, Homo Sapiens
ugcuuagaaguaagcaauucccaggucauagcucaagaauuguuagcaaaugacagauuuc

SEQ ID NO: 339105 - RNA, 61 nt, Homo Sapiens
gugccaggucacuauuguaagauguuaaaaucucaagaaaauuucacagagcuaaagaaau

SEQ ID NO: 339106 - RNA, 61 nt, Homo Sapiens
uaagaaaggacuacagcauuugauguguguccucaagaacuugucuugggucugaaaaagc

SEQ ID NO: 339107 - RNA, 61 nt, Homo Sapiens
uauggccuucuugucaaaaccuucacuggagcucaagaaaagcauuucuguuguguuauuu

SEQ ID NO: 339108 - RNA, 61 nt, Homo Sapiens
cuuaugggaauccugagcugcuuuucaccaucucaagaagccuaagaaguuauauauuuaa

SEQ ID NO: 339109 - RNA, 61 nt, Homo Sapiens
uagauaaaaguguuccaguaaucagaaaauccucaagaaaauugacuucauuauuuggaag

SEQ ID NO: 339110 - RNA, 61 nt, Homo Sapiens
ccauuaccuuuccucugccugaaagacgugucucaagaaaaauaaauucuauuuuagaugc

SEQ ID NO: 339111 - RNA, 61 nt, Homo Sapiens
agaauaaaauugaaaucugcaauguuuuugucucaagaacauauaucaucauaaaauagac

SEQ ID NO: 339112 - RNA, 61 nt, Homo Sapiens
caaauacagcuuuuuuucaauagacuucuuucucaagaaauuaaaaagguaaaacuacauu

SEQ ID NO: 339113 - RNA, 61 nt, Homo Sapiens
uuuacguaguuuuucauaggucuuccuguuucucaagaauacgaacaagauuaauuaccug

SEQ ID NO: 339114 - RNA, 61 nt, Homo Sapiens
ggccccuuuuuccaacuuauuuauccaugugcucaagaaaguuuagacuacaauaauacuu

SEQ ID NO: 339115 - RNA, 61 nt, Homo Sapiens
aucaagggacuccugugucaguacagaucuccucaagaaacuauguauuugcuacucaagu

SEQ ID NO: 339116 - RNA, 61 nt, Homo Sapiens
auaaccgauuauugauuacuguauuuuuuuucucaagaacagugauagguagaaacuaauu

SEQ ID NO: 339117 - RNA, 61 nt, Homo Sapiens
gucaucauugcuguuuagcuugacuguuuuccucaagaacaucgaucugaaggauucauaa

SEQ ID NO: 339118 - RNA, 61 nt, Homo Sapiens
ugcucuguagagaauuugcuaccgaaguuggcucaagaauuuguuuuuaguguuauuuacc

SEQ ID NO: 339119 - RNA, 61 nt, Homo Sapiens
gcaaaggccuuccugcauuuaugaauucucucucaagaagcaagagaacaccugcaggaag

SEQ ID NO: 339120 - RNA, 61 nt, Homo Sapiens
agaauuaagaauggacaggaccaagacagaacucaagaaagccacuggggaaaacucgaga

SEQ ID NO: 339121 - RNA, 61 nt, Homo Sapiens
auguucaacauuuacuucuauuugauaucugcucaagaagucauagaagucuugggaaacu

SEQ ID NO: 339122 - RNA, 61 nt, Homo Sapiens
ugccacguauguucaaggguaaaccacaagucucaagaauuaacauugucagaaauaaaua

SEQ ID NO: 339123 - RNA, 61 nt, Homo Sapiens
uagucagacugacacuacuauacgugaaaugcucaagaaugcuucagguaacacuacagag

SEQ ID NO: 339124 - RNA, 61 nt, Homo Sapiens
aaaucaucaccaauaccuuuucaccaccaagcucaagaaaucaaaacacaguccugcauac

SEQ ID NO: 339125 - RNA, 61 nt, Homo Sapiens
uuuaauauuuaaauaaaaucaaagguucacucucaagaagccaacucauuggguuguagcc

SEQ ID NO: 339126 - RNA, 61 nt, Homo Sapiens
aauauccaauguuuaugagucacucuuauuccucaagaauuaucaccuagaaaaguagccu

SEQ ID NO: 339127 - RNA, 61 nt, Homo Sapiens
ccaggagguaauuuguugauuuucacuuuaacucaagaauuucagcauuguauacacauau

SEQ ID NO: 339128 - RNA, 61 nt, Homo Sapiens
guguaccacuaaaaguaauacaagacauuuucucaagaacuacaaauggcaauguaaaaau

SEQ ID NO: 339129 - RNA, 61 nt, Homo Sapiens
augggagcugcaaacgcggugguuuguuggccucaagaagagaagcaugcagagaagaauu

SEQ ID NO: 339130 - RNA, 61 nt, Homo Sapiens
cagcugcacaggccuugacuccccagcaagucucaagaacaaccaugccccuuccccaggc

SEQ ID NO: 339131 - RNA, 61 nt, Homo Sapiens
uuuucaacgacagugauaguaaauaaacuaucucaagaaagaaauacaguuuguuuguaua

SEQ ID NO: 339132 - RNA, 61 nt, Homo Sapiens
uacaguggcuccccaaugccgucauugccugcucaagaauguugagaaauccuuuugugaa

SEQ ID NO: 339133 - RNA, 61 nt, Homo Sapiens
ugauaccuggguugauguggcaugggcugggcucaagaaccagaguguguucgcacuuagc

SEQ ID NO: 339134 - RNA, 61 nt, Homo Sapiens
aacugccuaacugaagggaaugggggcccugcucaagaagggggccaggcagcuggaauca

SEQ ID NO: 339135 - RNA, 61 nt, Homo Sapiens
gguaugagcugccaagucuauuuuaaagacgcucaagaauccucugggguucaucuaggga

SEQ ID NO: 339136 - RNA, 61 nt, Homo Sapiens
uucagccaacccagaggauguagacccuguccucaagaagugcagggcgaguucugccgug

SEQ ID NO: 339137 - RNA, 61 nt, Homo Sapiens
guggaacgagacuucugcagagguggcugaccucaagaagcagguacaggcccuucagccc

SEQ ID NO: 339138 - RNA, 61 nt, Homo Sapiens
cuagauuauauuuaguaggggaaaaauugggcucaagaaccauucaucaguacgugagaca

SEQ ID NO: 339139 - RNA, 61 nt, Homo Sapiens
cuuguaagcaguucauagaagcugcucaauacucaagaaucuugcaagacaguuauuaaac

SEQ ID NO: 339140 - RNA, 61 nt, Homo Sapiens
gcgaaaggacagacuguugggcacauuucuccucaagaaaauuguuuugaucauuuccacu

SEQ ID NO: 339141 - RNA, 61 nt, Homo Sapiens
acuccgaagucagucugcaguccccuccuggcucaagaauugcaauuugaacacuaaccuc

SEQ ID NO: 339142 - RNA, 61 nt, Homo Sapiens
cacuucacguauucuuguaugcccauuaccacucaagaagaugagcaaauaacuacagggu

SEQ ID NO: 339143 - RNA, 61 nt, Homo Sapiens
gagaugcccuagugguggccagcagaaccagcucaagaaaggguagccuucaagcuugucc

SEQ ID NO: 339144 - RNA, 61 nt, Homo Sapiens
guaauuaugaagaguggagauuuggccuguccucaagaauguuacuccgugccuuacugga

SEQ ID NO: 339145 - RNA, 61 nt, Homo Sapiens
acuuuauucuuguaucucauagagguggaaccucaagaaugagcguccauuuuuucauauu

SEQ ID NO: 339146 - RNA, 61 nt, Homo Sapiens
agccagcaaguauucucagcaggaguugcuucucaagaaaguugucuugcccuauagacuc

SEQ ID NO: 339147 - RNA, 61 nt, Homo Sapiens
gauuuggugugauaccuuguggaaugguuuucucaagaauauaaacauuaaguuugaaaua

SEQ ID NO: 339148 - RNA, 61 nt, Homo Sapiens
uguuauguguguuugcugcgagggucuaagucucaagaaucgugaugagcagacauguuua

SEQ ID NO: 339149 - RNA, 61 nt, Homo Sapiens
acuggcuuuaaaagaagccaugcauuuauuucucaagaauuuuuaaucuauuuaaucuucu

SEQ ID NO: 339150 - RNA, 61 nt, Homo Sapiens
augugcuaucuggcuuugaaauuuaaagugacucaagaagcccucaauauuugguaaugcu

SEQ ID NO: 339151 - RNA, 61 nt, Homo Sapiens
gaaauauuguugcucaguguuguuaauauagcucaagaauugaguuuauauuugcaguaug

SEQ ID NO: 339152 - RNA, 61 nt, Homo Sapiens
cgagaagacucagccugagggccugcggagccucaagaagccagaccgcaagaagcgcuac

SEQ ID NO: 339153 - RNA, 61 nt, Homo Sapiens
ggaacuuccucuuucauuggaaacuuucuuacucaagaaugacggcaguauuguuuucuua

SEQ ID NO: 339154 - RNA, 61 nt, Homo Sapiens
ugucuucaucaaguauuucccuacagaacuccucaagaaaacagagaucauuuggcuagag

SEQ ID NO: 339155 - RNA, 61 nt, Homo Sapiens
cucugggccccuccccagcuccacucccuaccucaagaaugugaccauuuggaaaaggcaa

SEQ ID NO: 339156 - RNA, 61 nt, Homo Sapiens
auguugccaaggcugguuucaaacuccuggacucaagaaauccacccaccucagccuccca

SEQ ID NO: 339157 - RNA, 61 nt, Homo Sapiens
gacaguuccaggucuugaagcuaaucagcaucucaagaaaguauccagaaagaacaucugc

SEQ ID NO: 339158 - RNA, 61 nt, Homo Sapiens
cuaagcucucaaaauagcauauucccuagagcucaagaaagcugguccaggagguugaaaa

SEQ ID NO: 339159 - RNA, 61 nt, Homo Sapiens
aaacgaacugggaaaauuucagaagucuugucucaagaagaugugcuccagccugggcgac

SEQ ID NO: 339160 - RNA, 61 nt, Homo Sapiens
ugaagauuccaguggucaguccuuggaacuccucaagaacccaugcccguucugaccucag

SEQ ID NO: 339161 - RNA, 61 nt, Homo Sapiens
agaauccauuuagcaccucccccaggcaauacucaagaaggauugggaaacuuaaccguua

SEQ ID NO: 339162 - RNA, 61 nt, Homo Sapiens
augcagcuguucugaacuggucauaaguucacucaagaaaauugcuguuguaaaaguguuu

SEQ ID NO: 339163 - RNA, 61 nt, Homo Sapiens
uuagaauuuaaguaccuuuuuucucaaauggcucaagaacagucuguuuaaaaauuacuaa

SEQ ID NO: 339164 - RNA, 61 nt, Homo Sapiens
ccuaaaguuucaauacaagccagcaccacagcucaagaaaauagugucuucuuccugcccu

SEQ ID NO: 339165 - RNA, 61 nt, Homo Sapiens
cacccacgcacccccccacacacuaugcucucucaagaauguaauuuauuggggccccccc

SEQ ID NO: 339166 - RNA, 61 nt, Homo Sapiens
gaguccugccguggcucagguggaucuaaaacucaagaacaaauucuauuuauuuauuauu

SEQ ID NO: 339167 - RNA, 61 nt, Homo Sapiens
uacuaucuaucucaccaguauuugcucucgacucaagaagguuaacauuuucugauucaug

SEQ ID NO: 339168 - RNA, 61 nt, Homo Sapiens
acagcugucuguuguuuuaugaaguuuauuucucaagaaaaugggaauaaauuugggauuu

SEQ ID NO: 339169 - RNA, 61 nt, Homo Sapiens
cucuagcuugggcaauagagcaaggcuccgucucaagaaaagaaggucauuucccaagacu

SEQ ID NO: 339170 - RNA, 61 nt, Homo Sapiens
ggaagcauguguguuucuaaaaaguaaaaaucucaagaaaacagaaauggcaugcuuuacc

SEQ ID NO: 339171 - RNA, 61 nt, Homo Sapiens
aaugcagagauaauuagacaugguucccgcccucaagaagcucacaaaaguauucaggaaa

SEQ ID NO: 339172 - RNA, 61 nt, Homo Sapiens
uucuuuuggaacuuguuucaagccaaaaacucucaagaaagcaaauugcaccucagcugga

SEQ ID NO: 339173 - RNA, 57 nt, Homo Sapiens
cuaccagagggaaaauguaaccugucacucaagaagcacaccuacagagcaccugua

SEQ ID NO: 339174 - RNA, 61 nt, Homo Sapiens
uaaauuaucccauuauguaauucuuggucagcucaagaacuggguucuuuuucuaauaauu

SEQ ID NO: 339175 - RNA, 61 nt, Homo Sapiens
cuggaacaguaggggcagggagaagacaggucucaagaaaagguuuuuaagaaguuucauc

SEQ ID NO: 339176 - RNA, 61 nt, Homo Sapiens
ccucuacucucccgugcacugccggccagagcucaagaagcugcugcacgggcugggccuu

SEQ ID NO: 339177 - RNA, 61 nt, Homo Sapiens
gcauccucugaccuacuucaaugcuggaauacucaagaauuuuacucugaucaaauaaaua

SEQ ID NO: 339178 - RNA, 61 nt, Homo Sapiens
uguuaaccuccggggagagccaaaacccuaucucaagaacugaggaagcacugaaacaaca

SEQ ID NO: 339179 - RNA, 61 nt, Homo Sapiens
ccaugcgcuggcaguacaugugcuuuaugggcucaagaaugccacagggccugagaagucu

SEQ ID NO: 339180 - RNA, 61 nt, Homo Sapiens
aaaaaaaaguuuguuuuuucuacucuuuucucucaagaaaacugauauuauuucuauuuaa

SEQ ID NO: 339181 - RNA, 61 nt, Homo Sapiens
guucauauuaauugaggauuauuucccauuucucaagaaaugugggagggaauguuuucaa

SEQ ID NO: 339182 - RNA, 61 nt, Homo Sapiens
cagcccugcuucugacauaaacuuguccuuccucaagaacauuugaugauucugagaagaa

SEQ ID NO: 339183 - RNA, 61 nt, Homo Sapiens
aacagaaacgagauuugccaauaauguuucccucaagaacaauaaccaaaaaaugugagcu

SEQ ID NO: 339184 - RNA, 61 nt, Homo Sapiens
gccuguggaccgaggcccccucaacaaggaccucaagaacuagccccaguuggcuuccugg

SEQ ID NO: 339185 - RNA, 61 nt, Homo Sapiens
cagagguaacucucaggcagcuaagcagcaccucaagaaaacauguuaaauuaaugcuucu

SEQ ID NO: 339186 - RNA, 61 nt, Homo Sapiens
agaguagcugcugcuuucccugacuuccuuccucaagaauacagucuauucugggggguug

SEQ ID NO: 339187 - RNA, 61 nt, Homo Sapiens
uuuuccucugacaccagagaacaauaguagucucaagaauggaaaccugaaugucugaggg

SEQ ID NO: 339188 - RNA, 61 nt, Homo Sapiens
aacuucaguuacugaccagucaagagaauuucucaagaaaaaucccagcaacguucccucu

SEQ ID NO: 339189 - RNA, 61 nt, Homo Sapiens
agcacaaagugaugaaugacugccuucaagucucaagaaaacacuuuucccuaacuuuuag

SEQ ID NO: 339190 - RNA, 61 nt, Homo Sapiens
ugggugagcugcaccugauuaguugaaaggccucaagaacaaacacugcaguuuccuggaa

SEQ ID NO: 339191 - RNA, 61 nt, Homo Sapiens
cuguggaguugguagcugguaacauuguugucucaagaacaacucaccucucucccuagga

SEQ ID NO: 339192 - RNA, 61 nt, Homo Sapiens
cagcccuaaaauucucuccagccacagaaggcucaagaaucacuaaaccuucuuaauaucc

SEQ ID NO: 339193 - RNA, 61 nt, Homo Sapiens
guacucgggcgacaccuuacccaauggcagucucaagaaauuaccucauaugcaggaugag

SEQ ID NO: 339194 - RNA, 61 nt, Homo Sapiens
gccugaaugacaauguccaguucauucuuugcucaagaaaguucugacauuccuagacagg

SEQ ID NO: 339195 - RNA, 61 nt, Homo Sapiens
aagguaccccaauauaucucaauucaacugucucaagaaucacaacaagaucaacuagaag

SEQ ID NO: 339196 - RNA, 61 nt, Homo Sapiens
ucuuaguucaguggaggaaaugcacucuggacucaagaaacgaagggagaaaggcaagaug

SEQ ID NO: 339197 - RNA, 61 nt, Homo Sapiens
agaggggcauaaacuuuccugccagaggcaccucaagaagaacugugagcucccaggugca

SEQ ID NO: 339198 - RNA, 61 nt, Homo Sapiens
uauucuuucacccugucucuuaucccuuccucucaagaaaacagaugaguuagaagcuuuu

SEQ ID NO: 339199 - RNA, 61 nt, Homo Sapiens
ugacauaauuuacaugcaauauguuuaucaacucaagaauuuaauauaguugguacacaac

SEQ ID NO: 339200 - RNA, 61 nt, Homo Sapiens
auacauuaggagcuucaaacacauauaauuucucaagaaauuuccagaugucucaugcugc

SEQ ID NO: 339201 - RNA, 61 nt, Homo Sapiens
uaaggaagaacaaggaagggaaugaucuuuacucaagaauuucagaaagucagcacugaag

SEQ ID NO: 339202 - RNA, 57 nt, Homo Sapiens
guccugaauguuuguuuuaaaguggagcucaagaauagcuuuuaaaaguucuuauuu

SEQ ID NO: 339203 - RNA, 61 nt, Homo Sapiens
aggcugcuaauuggauuuugguaguucuuaccucaagaaaacuugaauuauuugggggaaa

SEQ ID NO: 339204 - RNA, 61 nt, Homo Sapiens
gcuuaugaaggaaugccuccuuuguuacacacucaagaauuugucagcacacaauuaauug

SEQ ID NO: 339205 - RNA, 61 nt, Homo Sapiens
aauucagaaauuggguuuugguucagugauucucaagaaaaagaucucuugcccauuaaga

SEQ ID NO: 339206 - RNA, 61 nt, Homo Sapiens
uuuuuuucugaauaacauuuaaacaagcacacucaagaaagaaaauccaaggugcuacagg

SEQ ID NO: 339207 - RNA, 61 nt, Homo Sapiens
cuacuggaacuggaugaccuaugguguuuuccucaagaagaagaaaacugaacugaggaaa

SEQ ID NO: 339208 - RNA, 61 nt, Homo Sapiens
gcccagauguagaaauucaugcccucucucccucaagaaauuuccaucuccaaauagccag

SEQ ID NO: 339209 - RNA, 61 nt, Homo Sapiens
aaacugugcuguuacaacucaaauaugucuucucaagaacaaguucauuucaucacuuaga

SEQ ID NO: 339210 - RNA, 61 nt, Homo Sapiens
ucaguuuauaauuggaagagucauacguuuucucaagaacugcucucucucugcugccucu

SEQ ID NO: 339211 - RNA, 61 nt, Homo Sapiens
cagcucugcucugagcguccgaccccaguuucucaagaauucucuauccgaggccauugga

SEQ ID NO: 339212 - RNA, 61 nt, Homo Sapiens
augcuuuuugggaaacguugccuucuuucuccucaagaaaguugaguccagaugcuucuca

SEQ ID NO: 339213 - RNA, 61 nt, Homo Sapiens
cacagacagaugaggcaggagugauggggcacucaagaaaguucagaggaggcauaagcua

SEQ ID NO: 339214 - RNA, 61 nt, Homo Sapiens
gaucuuggcaugcacccaccuaacccacuuucucaagaacaagaaccuagaaugaauaucc

SEQ ID NO: 339215 - RNA, 61 nt, Homo Sapiens
cccagaagaccaaacugccuuccccucagggcucaagaauguguacagucuguggggccgg

SEQ ID NO: 339216 - RNA, 61 nt, Homo Sapiens
uccuuuuguguuuuucccacuuuccaauguacucaagaaaauugaacaaauguaauggauc

SEQ ID NO: 339217 - RNA, 61 nt, Homo Sapiens
gacuaaggagcugcagcgauacaucgaagggcucaagaagcgccggagcaagaggcuguac

SEQ ID NO: 339218 - RNA, 61 nt, Homo Sapiens
ccagagggcuuuguggaggacaggccuugcccucaagaacgucguaccugacgcugagccu

SEQ ID NO: 339219 - RNA, 61 nt, Homo Sapiens
agcuuuuuggaaggauaauucugauaaggcacucaagaaacguacaaccacagugcuuucu

SEQ ID NO: 339220 - RNA, 61 nt, Homo Sapiens
acccgccaccguggaggcagggggcaagaaacucaagaacgcaucaagagcaccagcccug

SEQ ID NO: 339221 - RNA, 54 nt, Homo Sapiens
cuaucacuauguuguuguaacuaacucaagaauuucuaaacucucccaggucac

SEQ ID NO: 339222 - RNA, 61 nt, Homo Sapiens
cucacgcaccucccauccuaaucauccaaugcucaagaaacaacuucuacuucugcccuug

SEQ ID NO: 339223 - RNA, 61 nt, Homo Sapiens
uuuucagagucaucuacaaaauuuuucuuuccucaagaaaagaguuccuuuugccuuauuc

SEQ ID NO: 339224 - RNA, 61 nt, Homo Sapiens
gucagcaacagaaaaugagaggaagccaagucucaagaacugacuuaggaucaugcuggaa

SEQ ID NO: 339225 - RNA, 61 nt, Homo Sapiens
aaugucuggggacaggccuuaggaggguggccucaagaaaccccuggaucuuugggguaaa

SEQ ID NO: 339226 - RNA, 61 nt, Homo Sapiens
ggccucauuccagggcacaguuuauaugagacucaagaacaaugccuaacaguggucuguu

SEQ ID NO: 339227 - RNA, 61 nt, Homo Sapiens
ccuuuguuuugcacugacaacacugccaugccucaagaacaggaggagggauucuggucuu

SEQ ID NO: 339228 - RNA, 61 nt, Homo Sapiens
ucccagucugguaggagagaacauucccgcccucaagaaucggaaugcugggaaaugagau

SEQ ID NO: 339229 - RNA, 61 nt, Homo Sapiens
caugugcagucacuggugucaggaaaagcagcucaagaacagagacaugagucuuugccgg

SEQ ID NO: 339230 - RNA, 61 nt, Homo Sapiens
uaagucuuagugcacaguauuuuagcaucagcucaagaaacuuccuauugaucucauuuua

SEQ ID NO: 339231 - RNA, 61 nt, Homo Sapiens
uggaagaggcagcaggacuugggaaaaguuucucaagaagguaaugagauaaugcauguag

SEQ ID NO: 339232 - RNA, 61 nt, Homo Sapiens
uuauggcaugauuagauugcaaagcaaugaacucaagaaggaauugaaauaaggagggaca

SEQ ID NO: 339233 - RNA, 61 nt, Homo Sapiens
guuuggauaucuuuaggguuuagaaucuaaccucaagaauaagaaauacaaguacaaauug

SEQ ID NO: 339234 - RNA, 61 nt, Homo Sapiens
caucuuuuuucuucccucauuuucugggauucucaagaaagaaaaaguaacccauuaucac

SEQ ID NO: 339235 - RNA, 61 nt, Homo Sapiens
uuuuggacuaauguuacuguccaaguucuuucucaagaaaccacaucugguucagaagagu

SEQ ID NO: 339236 - RNA, 61 nt, Homo Sapiens
uuaaauuuuuuuauaggcccauaugcucuaucucaagaaacaagaugauuguaacaugucc

SEQ ID NO: 339237 - RNA, 61 nt, Homo Sapiens
cuuuccuuuauuucacuuguacccaguuucacucaagaaaucuugaugaauauuuauguug

SEQ ID NO: 339238 - RNA, 61 nt, Homo Sapiens
cccucucuauagccaugagacuccuuguggccucaagaaauuuagacgcccacgacagcac

SEQ ID NO: 339239 - RNA, 61 nt, Homo Sapiens
ccgcacccgugugcacuguaacuuuugugugcucaagaaauuauacagaaaccuacagcug

SEQ ID NO: 339240 - RNA, 61 nt, Homo Sapiens
aaucaguaaauaccuugaaaugcaggagugacucaagaauucuccuggagaaagacuuccu

SEQ ID NO: 339241 - RNA, 51 nt, Homo Sapiens
caacacaucuuggccucccagcucaagaaauggcuggucuugaacuccuga

SEQ ID NO: 339242 - RNA, 61 nt, Homo Sapiens
uagaccuagaaauaccauuuccaucugauuccucaagaaucuccuucauaaagaaugccac

SEQ ID NO: 339243 - RNA, 61 nt, Homo Sapiens
ugccacauuucaauuacauauguauugaauacucaagaaaaggaaaaaaaaauccaagaaa

SEQ ID NO: 339244 - RNA, 61 nt, Homo Sapiens
cucuagagaagaaaagugaacauuauuuuaacucaagaaaaucauaugaucuucuucaagc

SEQ ID NO: 339245 - RNA, 61 nt, Homo Sapiens
cagcuuggagccucuagguucuuaagcuagacucaagaaagcuccacugcagcaggaggga

SEQ ID NO: 339246 - RNA, 61 nt, Homo Sapiens
ugccuccuuauuuaucaacaucguccccugccucaagaaauaaaauaguaagccucccucc

SEQ ID NO: 339247 - RNA, 61 nt, Homo Sapiens
agcaugagcuggccacacaugacagccccugcucaagaaaaugguaugagcacaggucaug

SEQ ID NO: 339248 - RNA, 61 nt, Homo Sapiens
gauaauucauuauaucaucaguauauacuuccucaagaacuuugaaaaauagucaccaacu

SEQ ID NO: 339249 - RNA, 61 nt, Homo Sapiens
cccucauuuuuauaaccugguauaaguaauucucaagaaagcugccauucaacucggaaac

SEQ ID NO: 339250 - RNA, 61 nt, Homo Sapiens
gguaccuacuacaugcuguacuugaaugugccucaagaaaauuuuacuguuugccaaaaca

SEQ ID NO: 339251 - RNA, 61 nt, Homo Sapiens
ccuuacagguaaguauugcucucuaauaauccucaagaaaucuauacuggauccuuucuuu

SEQ ID NO: 339252 - RNA, 61 nt, Homo Sapiens
cugcugggaguccccugaguuagauacagggcucaagaagucuggagagaugggauccuuc

SEQ ID NO: 339253 - RNA, 61 nt, Homo Sapiens
aggguccucagugcagagcaacuuacgcauccucaagaauccacugcuuuucaggcaagga

SEQ ID NO: 339254 - RNA, 61 nt, Homo Sapiens
acgugggcaauaccagggacccauggggaaacucaagaaugacagcuucuauauuuuguaa

SEQ ID NO: 339255 - RNA, 61 nt, Homo Sapiens
cuaagaaggccugucuacacugcaggggaaccucaagaacuuuucauugcacuucuaaaau

SEQ ID NO: 339256 - RNA, 61 nt, Homo Sapiens
aaggaagagccuuuuaaaaacauuugccaaccucaagaauaaauacugaaagucuugaaag

SEQ ID NO: 339257 - RNA, 61 nt, Homo Sapiens
ggauucugacuaagaggcaaaagagaaaagacucaagaaacugauccuggagaucgagacc

SEQ ID NO: 339258 - RNA, 61 nt, Homo Sapiens
auacucucccagauuuuuacggauuuggggccucaagaaauagccaggaguaagacaagug

SEQ ID NO: 339259 - RNA, 61 nt, Homo Sapiens
uuggauguuuucauuggccuaagaaguuauucucaagaaaauguuuuaacaaaauuagcug

SEQ ID NO: 339260 - RNA, 61 nt, Homo Sapiens
auaugacaucauccugaagaacuucgagaagcucaagaagcccaggggagaaacaaaggga

SEQ ID NO: 339261 - RNA, 61 nt, Homo Sapiens
gauuacauacauuugagaauaagaaauuacucucaagaacuucagaaaucugcaacauaau

SEQ ID NO: 339262 - RNA, 61 nt, Homo Sapiens
auuucccauaaaugggaaguuugcccauugucucaagaaauguguauuucagugacaauuu

SEQ ID NO: 339263 - RNA, 61 nt, Homo Sapiens
cauuuugggaaguaacugccucugacuucaacucaagaaaacacuuuuuuguugcuaaugu

SEQ ID NO: 339264 - RNA, 61 nt, Homo Sapiens
gaagacugacuggguggaggcucugccuugccucaagaaccauccccugcagagcauccag

SEQ ID NO: 339265 - RNA, 61 nt, Homo Sapiens
ggccuugcaucucgccaccuccacuucuguccucaagaacaaguccuaggucaagggaaac

SEQ ID NO: 339266 - RNA, 61 nt, Homo Sapiens
agaaauaaauaaggguggugagaggaaaugucucaagaaccggaagugaaaauagccagcc

SEQ ID NO: 339267 - RNA, 61 nt, Homo Sapiens
cccuggaauaucccugagaaacgcacucagccucaagaacuuuagugcuggauuugaagcu

SEQ ID NO: 339268 - RNA, 61 nt, Homo Sapiens
cugcuucuugcuuugcagagcaggaauugcccucaagaacuggcccugggaaucaauuccu

SEQ ID NO: 339269 - RNA, 61 nt, Homo Sapiens
cagggaacaauacuguaaaccuugagguugccucaagaacuucuuagaguucauaaauuua

SEQ ID NO: 339270 - RNA, 61 nt, Homo Sapiens
auaugggagcccaugaggaggguggcugcgacucaagaauagaagaauggaaauggaaaag

SEQ ID NO: 339271 - RNA, 61 nt, Homo Sapiens
ggagauaaacaugaccaucgucaaagaccugcucaagaaauuuuuaaaaaagaaacaaagu

SEQ ID NO: 339272 - RNA, 61 nt, Homo Sapiens
uucuuauuugcuagggaacugguaaucuaggcucaagaaguguguggagaagguuuauuuu

SEQ ID NO: 339273 - RNA, 61 nt, Homo Sapiens
ucaguguggacuccuagaacgugcgaccugccucaagaaaaugcaguuuucaaaaacagac

SEQ ID NO: 339274 - RNA, 61 nt, Homo Sapiens
uccucaggacauggagaucugugcagaugagcucaagaagguccuuaacacagucgugaac

SEQ ID NO: 339275 - RNA, 61 nt, Homo Sapiens
acaccuguagauauuacuguacuuuuauguucucaagaaauaaguuguugccuauucagug

SEQ ID NO: 339276 - RNA, 61 nt, Homo Sapiens
ugauucauacauuaucucacuugugccaacacucaagaagcaggcuacacugacacuggua

SEQ ID NO: 339277 - RNA, 56 nt, Homo Sapiens
cuuuugaccugcugaguugauaaacacucaagaaccucaggagcgcugccagcuug

SEQ ID NO: 339278 - RNA, 61 nt, Homo Sapiens
auucacaguugagugcauccgaaaggaagaccucaagaaaauccacuucauccagaugaag

SEQ ID NO: 339279 - RNA, 61 nt, Homo Sapiens
uuuuaaaaacgaaacaaaguucaaagagcugcucaagaaauggagauaaacaccaccauca

SEQ ID NO: 339280 - RNA, 61 nt, Homo Sapiens
uaugucaagaugagcugaaucggaauacuggcucaagaaccaacuuuauaaugaaacgguu

SEQ ID NO: 339281 - RNA, 61 nt, Homo Sapiens
gggcuuccaaugcugugagagccuugcagagcucaagaagggugagcugcuaaauugacug

SEQ ID NO: 339282 - RNA, 61 nt, Homo Sapiens
gcccggaagcgccaggcuggcccaugguggccucaagaaagccucucucacacaucacauu

SEQ ID NO: 339283 - RNA, 61 nt, Homo Sapiens
uucuuagugauucacauccacgggacaaaaacucaagaagaaauaagagcugacgccacac

SEQ ID NO: 339284 - RNA, 61 nt, Homo Sapiens
gggagugugcgaaucuacccugaccaaugggcucaagaauaaaguaugauuuuugagucag

SEQ ID NO: 339285 - RNA, 61 nt, Homo Sapiens
gagggcuaaaucccaagugucucuugacuggcucaagaauuagggccccaacuacacaccc

SEQ ID NO: 339286 - RNA, 61 nt, Homo Sapiens
uacuuguggcgaucugaguacucuacucuugcucaagaaguaauacgacaaucagaauaca

SEQ ID NO: 339287 - RNA, 61 nt, Homo Sapiens
aaauaugaauugagggcccgugaccaagcggcucaagaauagggagugugcgaaucaaacc

SEQ ID NO: 339288 - RNA, 61 nt, Homo Sapiens
uagaagauguguaaacagguugucuggcguucucaagaaucaaauuuggccuuaagaacug

SEQ ID NO: 339289 - RNA, 61 nt, Homo Sapiens
ggauuagcucugauuuugagacuuacgcuuccucaagaagagaaugcccgcagugagcuau

SEQ ID NO: 339290 - RNA, 61 nt, Homo Sapiens
gucuuaacuaggaaacuaaagugaauccauucucaagaaaaacaaaauuaugucugcacca

SEQ ID NO: 339291 - RNA, 61 nt, Homo Sapiens
gcgaaagucaaauauggagagggguaggaaucucaagaauuacacaggcaaauuauuugug

SEQ ID NO: 339292 - RNA, 61 nt, Homo Sapiens
caccaagcucauuacaucugccagggccugccucaagaagcccagcccagccuuuuccugg

SEQ ID NO: 339293 - RNA, 61 nt, Homo Sapiens
gguauauuuauguaagaaaaugacuguaaaucucaagaaaaaucucagcagcuaauagcaa

SEQ ID NO: 339294 - RNA, 61 nt, Homo Sapiens
aaccauuuguuaacuguacugaagguguguccucaagaagaaaguguucaaauuaaaaaag

SEQ ID NO: 339295 - RNA, 61 nt, Homo Sapiens
cuaccaaaaguuaaaaaaaaaaaaaaaaaagcucaagaaccugcacgagggccuaaaacag

SEQ ID NO: 339296 - RNA, 61 nt, Homo Sapiens
cucuguuuaguaguugguuggggaaguggggcucaagaaggauuuugggguucaccagaug

SEQ ID NO: 339297 - RNA, 61 nt, Homo Sapiens
aaggggcuggaaaggggggaauggcccacaucucaagaagcaagauauuguuugugguggu

SEQ ID NO: 339298 - RNA, 61 nt, Homo Sapiens
cagcauggauuccguggauagcuguugcagucucaagaagacugagagcuuccaaaaugcc

SEQ ID NO: 339299 - RNA, 61 nt, Homo Sapiens
ccaacauuuugcugccuaccuuguuauccuucucaagaagcugaaguguacgcccucuccc

SEQ ID NO: 339300 - RNA, 61 nt, Homo Sapiens
ugugcccuuccccgccugcggccaccaagcccucaagaaguuauaccaccuaggaggagau

SEQ ID NO: 339301 - RNA, 61 nt, Homo Sapiens
cccgaacgaauguucggaugcaguggugccucucaagaaacacgugucccagcccagcguc

SEQ ID NO: 339302 - RNA, 61 nt, Homo Sapiens
ugcugagauuucucuggaaauaacaggcagccucaagaaugcaucauuauuaauauaaaaa

SEQ ID NO: 339303 - RNA, 61 nt, Homo Sapiens
gggcucccugggaucuccagcgauacucuuucucaagaaggugaagcuggauucuuucaua

SEQ ID NO: 339304 - RNA, 61 nt, Homo Sapiens
gaagcgugaaccccagggaagaggacacaaccucaagaaaggccugcaggguguggggaag

SEQ ID NO: 339305 - RNA, 61 nt, Homo Sapiens
acgggcugcucuacugcuucaugacgcacugcucaagaacuugacacaaacucacacaacc

SEQ ID NO: 339306 - RNA, 61 nt, Homo Sapiens
acgggcugcucuacugcuucaugacgcacugcucaagaacuugacacaaaaucgcacaacg

SEQ ID NO: 339307 - RNA, 61 nt, Homo Sapiens
acgggcugcucuacugcuucaugacgcacugcucaagaacuugacacaaacucgcacaacc

SEQ ID NO: 339308 - RNA, 57 nt, Homo Sapiens
acgggcugcucuacugcuuccgcacuacucaagaacuacaaacucacacaacgauga

SEQ ID NO: 339309 - RNA, 61 nt, Homo Sapiens
uuacuuuucuauguugcucaugauuguauaacucaagaagaugagugcuuuggaauuuaaa

SEQ ID NO: 339310 - RNA, 61 nt, Homo Sapiens
agacgaugcauuucuuggccaaaguggcuuccucaagaaagcagcacuuaccuuugaaaaa

SEQ ID NO: 339311 - RNA, 61 nt, Homo Sapiens
auggcuucacaguccuuacuucucuaccugccucaagaaggggcucagagcagagacuugu

SEQ ID NO: 339312 - RNA, 61 nt, Homo Sapiens
gggauuaguuggggguauuagacuucauuuucucaagaaauaacauucuuccuaaaaggaa

SEQ ID NO: 339313 - RNA, 61 nt, Homo Sapiens
caauauucguuaauguucagagcucuaauagcucaagaacaacuuuaaaaauaauacuuuu

SEQ ID NO: 339314 - RNA, 61 nt, Homo Sapiens
auuauucauucuaucucagaacacuaguaaucucaagaaagggcacugaagaccugaaucu

SEQ ID NO: 339315 - RNA, 61 nt, Homo Sapiens
gacgagcucuagcuggaugggcgcagagaaccucaagaaggcaugaagccagccccugcag

SEQ ID NO: 339316 - RNA, 61 nt, Homo Sapiens
cuccagccuggucgacagagugagacuccaucucaagaaaaaauaaaaauaaaguuguucu

SEQ ID NO: 339317 - RNA, 61 nt, Homo Sapiens
uugggaggcugaggcaggaggaucacucgagcucaagaauucaagaccugggcaagagaga

SEQ ID NO: 339318 - RNA, 61 nt, Homo Sapiens
cuccagccugggcgacagagcaagacucugucucaagaagaaaaaaaaaauacauauacac

SEQ ID NO: 339319 - RNA, 61 nt, Homo Sapiens
uauaugcaugaaguuaaaacaacugacguuacucaagaauuagaaaacuuugcaagauuug

SEQ ID NO: 339320 - RNA, 61 nt, Homo Sapiens
aaaagaaaaagagacaaauucgagacccugucucaagaaagcuucagccugggcgacacag

SEQ ID NO: 339321 - RNA, 61 nt, Homo Sapiens
gggcacugcccggcccggcuuugcccccaagcucaagaaggcuccagcgcugggcccuccc

SEQ ID NO: 339322 - RNA, 61 nt, Homo Sapiens
agacugugcagagggcauugcccaccgcaaccucaagaaccccuacgccacuggaaacaca

SEQ ID NO: 339323 - RNA, 61 nt, Homo Sapiens
aauaaaagugggaaaaucuuugagacacugucucaagaaaauuccagccugugcgacagaa

SEQ ID NO: 339324 - RNA, 61 nt, Homo Sapiens
ccccagugccuuguaugaagcccucugcacccucaagaaacggaccccccaagucuuccua

SEQ ID NO: 339325 - RNA, 61 nt, Homo Sapiens
aacccaccauaaccagcccauguucuuaucccucaagaagaccuucauuaacaaagacccu

SEQ ID NO: 339326 - RNA, 61 nt, Homo Sapiens
ucugaagaagguaguaauaucaugcauuuuccucaagaaugguaccuauugacuguauccu

SEQ ID NO: 339327 - RNA, 61 nt, Homo Sapiens
ccgggcuacgaugacauguaccugugaaggccucaagaauguaacaucccaggcuucccuc

SEQ ID NO: 339328 - RNA, 59 nt, Homo Sapiens
cuccagcccgggcaacagaguaagacccugccucaagaaaaaaaaaaaaaaaaaaaauc

SEQ ID NO: 339329 - RNA, 61 nt, Homo Sapiens
ccaggugccggcacagugccucucccagagccucaagaagggccauuuaggagcuugcuuc

SEQ ID NO: 339330 - RNA, 61 nt, Homo Sapiens
ccgugccugacucauccaguggggaaggugacucaagaaguuguuuaagccuaggccuagg

SEQ ID NO: 339331 - RNA, 61 nt, Homo Sapiens
agcuguugcuggaaacuugcuuuaggaacagcucaagaaccuuggaguucauauuucacaa

SEQ ID NO: 339332 - RNA, 61 nt, Homo Sapiens
uucaugagggucucuuacuaugcggguuugccucaagaaacagaagaggaguggaugagcc

SEQ ID NO: 339333 - RNA, 61 nt, Homo Sapiens
aaagaucucgcuggugcguagaaggaaaugucucaagaaaccuauggcgcuuccuugagug

SEQ ID NO: 339334 - RNA, 52 nt, Homo Sapiens
aagaugggggaccagcaaccgacucaagaaccaggucaucuugaaaggauga

SEQ ID NO: 339335 - RNA, 61 nt, Homo Sapiens
agggccuugugcgugggccuccccccucgcccucaagaacaaaucuugcuuuuauggucuu

SEQ ID NO: 339336 - RNA, 61 nt, Homo Sapiens
uguuuauuuucuaguagcuuuuauaaguacacucaagaauuugucagggagaauaauucug

SEQ ID NO: 339337 - RNA, 61 nt, Homo Sapiens
ccagguuuacuuucuaucagcugagcaaccucucaagaaaaaauaaauaaauaaauaaacc

SEQ ID NO: 339338 - RNA, 61 nt, Homo Sapiens
uguucuguauaaacaaaugcagcuggaaucgcucaagaaucuuauuuuucuaaauccaaca

SEQ ID NO: 339339 - RNA, 61 nt, Homo Sapiens
ccugaagacuccggccaagaggcacaagcagcucaagaacaagcuggagaagaacgaggag

SEQ ID NO: 339340 - RNA, 61 nt, Homo Sapiens
cuuuccuguauaguucacguuucauguaauccucaagaaauaaaaggaagccaaagagugu

SEQ ID NO: 339341 - RNA, 61 nt, Homo Sapiens
accugauguuuucuuauucuuuguaguaguacucaagaaucacuguaggugaaggcuguau

SEQ ID NO: 339342 - RNA, 61 nt, Homo Sapiens
gccauaaaaucucacgcugcguuucugaagucucaagaacugauuuggcuggugccgaagu

SEQ ID NO: 339343 - RNA, 61 nt, Homo Sapiens
agcacagcugauguaaaauugaucccagacacucaagaauuucgggacauauauuuacaua

SEQ ID NO: 339344 - RNA, 61 nt, Homo Sapiens
guccauuucggggagaggagcaggugggacccucaagaaaaugacggagaacaucccagac

SEQ ID NO: 339345 - RNA, 61 nt, Homo Sapiens
uuuuuuuaagagacagauuuauauuuuuccccucaagaacuuuuugaaacuuagguauuuu

SEQ ID NO: 339346 - RNA, 61 nt, Homo Sapiens
aaaagaaggacugaacuccauugcccagcagcucaagaagaucccagcggccuccggcguc

SEQ ID NO: 339347 - RNA, 61 nt, Homo Sapiens
guuucuucuggauuccuuauacuuggcuuaacucaagaacaucucgaaauugccagugugu

SEQ ID NO: 339348 - RNA, 61 nt, Homo Sapiens
gcagguaugugggccagaggagacuaccccacucaagaacauucuacaaagcaaggcccac

SEQ ID NO: 339349 - RNA, 61 nt, Homo Sapiens
ggcucccuguacuggagucgucccacuauuccucaagaaaucuuagaaccagcuugugagg

SEQ ID NO: 339350 - RNA, 61 nt, Homo Sapiens
ucuguacaaguauguggagcaugaaugcugacucaagaaacuuuuacuccuucugcucaag

SEQ ID NO: 339351 - RNA, 61 nt, Homo Sapiens
gagcgaauuagcaauaacauacaugagauaacucaagaaaucaaaagauaguugauucuug

SEQ ID NO: 339352 - RNA, 61 nt, Homo Sapiens
caaagaaacacuugugcaguacacagcacuacucaagaagcuaaaaauguauaggcaguau

SEQ ID NO: 339353 - RNA, 61 nt, Homo Sapiens
uaaacauuuguuucuguguguguucugcuuccucaagaaauaccccucucugaagggcugu

SEQ ID NO: 339354 - RNA, 61 nt, Homo Sapiens
aaaaaaaaaaaaaagaauguugagacucugucucaagaaggcuccagccugggugacagag

SEQ ID NO: 339355 - RNA, 61 nt, Homo Sapiens
accgccuuccccacccccuggcuaaguggggcucaagaagccagaggaugagugaccaguu

SEQ ID NO: 339356 - RNA, 61 nt, Homo Sapiens
ucaaauucaggacauaaacucaccacagcuacucaagaagagucacaaauguuccugaaag

SEQ ID NO: 339357 - RNA, 61 nt, Homo Sapiens
gaagcagauucauacagccuaaucuuaaaaucucaagaaguaaucugaaagauuuuucaag

SEQ ID NO: 339358 - RNA, 61 nt, Homo Sapiens
agcauuucuuuaaaauguuuuuuaaagcagucucaagaauagaugcagacuuguucuucuu

SEQ ID NO: 339359 - RNA, 61 nt, Homo Sapiens
gacagaagagacagugauuuaaagaaaccuacucaagaaaaaacacaagaacuuaagagaa

SEQ ID NO: 339360 - RNA, 61 nt, Homo Sapiens
guggaggacccuggaaggacuuucucuggaucucaagaaugugacaaacacaagugccccu

SEQ ID NO: 339361 - RNA, 61 nt, Homo Sapiens
auguucguauuagagacaaauuuaguuauuucucaagaagcuugcacuaucacaauugcuu

SEQ ID NO: 339362 - RNA, 61 nt, Homo Sapiens
cugguacaccuguaccagcuuguaaagcaaacucaagaaaaaccuucgucucuuugugcuu

SEQ ID NO: 339363 - RNA, 61 nt, Homo Sapiens
uaaaagauacuuaauucuuggagauaaagaccucaagaagugaauuagcaguaaaauacau

SEQ ID NO: 339364 - RNA, 61 nt, Homo Sapiens
caaaagauaguugauucuugacaugagauaacucaagaaaugagcgaauuagcaauaacau

SEQ ID NO: 339365 - RNA, 61 nt, Homo Sapiens
aagcaagcugccuuuguacuccccccugcaucucaagaauaacagacugcaccaccccuuc

SEQ ID NO: 339366 - RNA, 61 nt, Homo Sapiens
acacagaagcacacaucccuaauauuuaaagcucaagaagauuuagguauuaagacugaga

SEQ ID NO: 339367 - RNA, 61 nt, Homo Sapiens
uaacgagagacaucaguuucucaggaugauccucaagaacguuauggaguccauguugcaa

SEQ ID NO: 339368 - RNA, 61 nt, Homo Sapiens
ugcucugaaaaauuccuuuuuccuucuguuacucaagaaaaagagcgucagguggcaaaag

SEQ ID NO: 339369 - RNA, 63 nt, Homo Sapiens
gugugauuugugcaagccagguucaacccuugccucaagaaaucagaugggaccaauuuagug

SEQ ID NO: 339370 - RNA, 63 nt, Homo Sapiens
gaagauggcuggugaggagcuuaacagaggaaccucaagaagauucugaaaauccuaccccca

SEQ ID NO: 339371 - RNA, 63 nt, Homo Sapiens
gcaauacugaagggguuaaacagguuuuugcuccucaagaauuuguuugccugggcccaggau

SEQ ID NO: 339372 - RNA, 63 nt, Homo Sapiens
auaacacuuaccaaaagaucacugcaaaccugccucaagaagcugaugguggcacuucaauuu

SEQ ID NO: 339373 - RNA, 63 nt, Homo Sapiens
aaguccuuuuuuuuuuuuuuuuuuuuuuaauugcucaagaaaugauucucucacaggcuuggg

SEQ ID NO: 339374 - RNA, 63 nt, Homo Sapiens
acugaugacaucugacuuuugucgaugggacuucucaagaagccauuccuuggagcuucuguu

SEQ ID NO: 339375 - RNA, 63 nt, Homo Sapiens
auacugccaugaagacggucucuguguccucagcucaagaauccuguagcuugucccaucaua

SEQ ID NO: 339376 - RNA, 58 nt, Homo Sapiens; identical to SEQ ID NO: 339023

SEQ ID NO: 339377 - RNA, 63 nt, Homo Sapiens
auuccuccaugguaaagcugaacugaaacaauucucaagaaugcaucagcuguaccuacaaua

SEQ ID NO: 339378 - RNA, 63 nt, Homo Sapiens
aaucugaagauguaagacuuccugaaacaaguucucaagaagucuuuacauuauauuuauaac

SEQ ID NO: 339379 - RNA, 63 nt, Homo Sapiens
uugaauauuggggaaggaagaugauacuucuuucucaagaaaagaaaauuggauuauuaggaa

SEQ ID NO: 339380 - RNA, 63 nt, Homo Sapiens
gucauaagcgaucacuuccuauaugcacuuauucucaagaagaacaucuuuaugguaaagaug

SEQ ID NO: 339381 - RNA, 63 nt, Homo Sapiens
gugaaugcugaacugaaggcucagauugaggagcucaagaacgagaagcagcauuugauauac

SEQ ID NO: 339382 - RNA, 63 nt, Homo Sapiens
uuguauuucaccaccuaaauguaauguugauuccucaagaaugaaaugaaggcacuacauuga

SEQ ID NO: 339383 - RNA, 63 nt, Homo Sapiens
acuuaugaguaagcagucugucgcugacaaguucucaagaagaucaagacaaaacagauugcg

SEQ ID NO: 339384 - RNA, 63 nt, Homo Sapiens
aguuagcaaaccacuccuuugagggauccacuacucaagaaaauccacgugagguuuuguuua

SEQ ID NO: 339385 - RNA, 63 nt, Homo Sapiens
uauucaccaguuccucugcagagaagaagaaggcucaagaauuaccaaaagcuugauaugaca

SEQ ID NO: 339386 - RNA, 63 nt, Homo Sapiens
agcugagugaacagcaugaucauguggagucaacucaagaaaaauccacuggucacagguaga

SEQ ID NO: 339387 - RNA, 63 nt, Homo Sapiens
cagcucagcuucuccuucgacacguccccagaucucaagaacgcuugugaccacaucucccac

SEQ ID NO: 339388 - RNA, 63 nt, Homo Sapiens
cauggagacuccugcccuguugcaaacucacugcucaagaagagaagagggccugugggagcc

SEQ ID NO: 339389 - RNA, 63 nt, Homo Sapiens
auuuuucuaaaaauaugagugaaaaaaaauaaacucaagaaugaugagauccugucucuuaaa

SEQ ID NO: 339390 - RNA, 63 nt, Homo Sapiens
gagcuuuguauguguccuuuugcauaagcacagcucaagaacucuuacugaucacuauaguau

SEQ ID NO: 339391 - RNA, 63 nt, Homo Sapiens
caugccagcucagcccuacaagagcccugagcccucaagaacugcagugggcuacauacaaug

SEQ ID NO: 339392 - RNA, 63 nt, Homo Sapiens
aguuccaaaccuagcagaauauuaaaggguugacucaagaacuauugacaauggcagagaaca

SEQ ID NO: 339393 - RNA, 63 nt, Homo Sapiens
agaggccuccucuggagugaaucuccuucccuccucaagaagcgagggcauccgacaaggccc

SEQ ID NO: 339394 - RNA, 63 nt, Homo Sapiens
uccuuaaaaacuuugaaguuuuguguuaaguuccucaagaaucuguauggcaguauguauaua

SEQ ID NO: 339395 - RNA, 63 nt, Homo Sapiens
caggggcauccagggcucccggaccaagacauccucaagaaaagggauuuaaggacuucuggg

SEQ ID NO: 339396 - RNA, 63 nt, Homo Sapiens
ugaugggccugaacucggacccucaaaaacgcccucaagaacaaagucccccagcagaaccag

SEQ ID NO: 339397 - RNA, 51 nt, Homo Sapiens; identical to SEQ ID NO: 339044

SEQ ID NO: 339398 - RNA, 63 nt, Homo Sapiens
ccagagucaccugucucaucgggcacggcgccccucaagaacuccugcucacauccacaguca

SEQ ID NO: 339399 - RNA, 63 nt, Homo Sapiens
ugggcuguaacaauucagggauaccacguuuugcucaagaagcgaaggcccucucuuccucuc

SEQ ID NO: 339400 - RNA, 63 nt, Homo Sapiens
agugcuuuuucuccauggauaauuugcuguugccucaagaaaauauuuuguaucagugcuguu

SEQ ID NO: 339401 - RNA, 63 nt, Homo Sapiens
uucacuaugugaaugagauguuauaguacaauucucaagaaaagaaaaccuuauggaaaauaa

SEQ ID NO: 339402 - RNA, 63 nt, Homo Sapiens
ugacccugauuugaccccucuucuuauaaggaucucaagaaucucuucagaagcacugaugac

SEQ ID NO: 339403 - RNA, 63 nt, Homo Sapiens
ucaaggcaaagcaaggaacaucuugagauaugucucaagaauauaaagauguauuauuuuaag

SEQ ID NO: 339404 - RNA, 63 nt, Homo Sapiens
gcucacaugggaguuguccucacccuuguuaaucucaagaaacucuuauuuauaauagguugc

SEQ ID NO: 339405 - RNA, 63 nt, Homo Sapiens
aucuguuuggaaacaaccccuugagcugccaggcucaagaaaucauggacucacaggguccug

SEQ ID NO: 339406 - RNA, 63 nt, Homo Sapiens
aauggccuguguguuacaaugauaugaucauuucucaagaauaagucccuuuuuguauguguu

SEQ ID NO: 339407 - RNA, 63 nt, Homo Sapiens
gucuucugugucacaaacagcacuccaggccagcucaagaagcaaagcaggccaauagaaaug

SEQ ID NO: 339408 - RNA, 63 nt, Homo Sapiens
ccuaugugugcuccauuccucauuucuacuuggcucaagaaaacauuucugcagucaggugag

SEQ ID NO: 339409 - RNA, 63 nt, Homo Sapiens
aaggcagugaaaauggccagccagagaaaagaucucaagaaccagaaauaaauaaggauggug

SEQ ID NO: 339410 - RNA, 63 nt, Homo Sapiens
uaaagacauacucauuaaguguuauuuauuuuacucaagaacuggaaaccaacuaaaugccuu

SEQ ID NO: 339411 - RNA, 63 nt, Homo Sapiens
aguauguucccaggcuaguguugaacuccugagcucaagaaauccuccugccugagucucuga

SEQ ID NO: 339412 - RNA, 63 nt, Homo Sapiens
agguuucugauuacauaaaauuugaauagaacacucaagaaguauguagauuuuugaaaaacc

SEQ ID NO: 339413 - RNA, 63 nt, Homo Sapiens
gugaauguuccaacaccugccuccacuucuccccucaagaaauuuucaacgccaggaaucaug

SEQ ID NO: 339414 - RNA, 63 nt, Homo Sapiens
ugaagagacuucugcuuuucaacccccacccuccucaagaaguaauaauuuguuuacuuguaa

SEQ ID NO: 339415 - RNA, 63 nt, Homo Sapiens
aguuggaugcggccauucaaggggagccaaaaucucaagaaauucccagcagguuaccuggag

SEQ ID NO: 339416 - RNA, 63 nt, Homo Sapiens
cuccccagacaucuggacacugggcauagauuucucaagaaggaagacuccccugccucccca

SEQ ID NO: 339417 - RNA, 63 nt, Homo Sapiens
cauugaaaaauucuaugaauugaacuuuugcaucucaagaaaaauuugaaaacacugcaacag

SEQ ID NO: 339418 - RNA, 63 nt, Homo Sapiens
uggcucucauucuaagaggccucccagugaucacucaagaaucgugucuuucucuaggacaag

SEQ ID NO: 339419 - RNA, 63 nt, Homo Sapiens
uccuguuggauuuguuuaaauaugagaaggugccucaagaauuugcauucaucuuguguuuua

SEQ ID NO: 339420 - RNA, 63 nt, Homo Sapiens
guacagauguguggaauacgcuaagcgaucauacucaagaauacugguucucaauuugacacc

SEQ ID NO: 339421 - RNA, 63 nt, Homo Sapiens
auaauaaaagaccauaaauaugaaggaaaaggacucaagaaaagaagugacuuauuaaacuau

SEQ ID NO: 339422 - RNA, 63 nt, Homo Sapiens
cuauugauauuggucauguuaacuuauaguagccucaagaaguuuuugaaccuuauuucucaa

SEQ ID NO: 339423 - RNA, 58 nt, Homo Sapiens; identical to SEQ ID NO: 339070

SEQ ID NO: 339424 - RNA, 63 nt, Homo Sapiens
gcuucagauccucuuguguaguugaaagucucccucaagaauauuugugcucugaguuuugcu

SEQ ID NO: 339425 - RNA, 63 nt, Homo Sapiens
aauaucauuuuaauguaauugauuguauauagucucaagaaugguuggugggcaugaguuccu

SEQ ID NO: 339426 - RNA, 63 nt, Homo Sapiens
acuuuuguagcaaucuggucuauagacuuuuaacucaagaagcuaaggcuagacuuguuaccu

SEQ ID NO: 339427 - RNA, 63 nt, Homo Sapiens
aaaugucucuccucuagguaucguauuuuguugcucaagaauccaaaaugggucuguggacau

SEQ ID NO: 339428 - RNA, 63 nt, Homo Sapiens
cugcuuaguuuuuggacugaaaagauauuaaaacucaagaaggaccaagaaguuuucauaugu

SEQ ID NO: 339429 - RNA, 63 nt, Homo Sapiens
aggaguaacaauacaaauggauuuugggagugacucaagaagugaagaaugcacaagaaugga

SEQ ID NO: 339430 - RNA, 63 nt, Homo Sapiens
aagacacagaacaaggucugucuccuauagucacucaagaagucgaucgagaaguuccacauc

SEQ ID NO: 339431 - RNA, 63 nt, Homo Sapiens
auuaauuagacuuuuguauaagagaugucaugccucaagaaagccauaaaccugguaggaaca

SEQ ID NO: 339432 - RNA, 63 nt, Homo Sapiens
ucccugaagcagacugcugaggaauuacauuugcucaagaauuuuuuccgucaaauugugaac

SEQ ID NO: 339433 - RNA, 63 nt, Homo Sapiens
ccuuaauuauuuaucuuuaguuccuuauuaguucucaagaaacaaaugcuagcuucauaugua

SEQ ID NO: 339434 - RNA, 63 nt, Homo Sapiens
ugggucccuuccuuucuccuuuccucucuacugcucaagaacagauuugaggccaggugcggu

SEQ ID NO: 339435 - RNA, 63 nt, Homo Sapiens
uauaagcaauguaauuaugcuauucacaggggccucaagaauugguauguaugaugugaucug

SEQ ID NO: 339436 - RNA, 63 nt, Homo Sapiens
uccuuauguagaaaggacuuugaaauuuuucuucucaagaaaugguuuguauaagaauaacaa

SEQ ID NO: 339437 - RNA, 63 nt, Homo Sapiens
ugauacugacugauuaauuauuccugauaacaucucaagaaaaggagaaggaaaguguuucug

SEQ ID NO: 339438 - RNA, 63 nt, Homo Sapiens
uauaaaauugucagcguauuuuuacacuauuggcucaagaauguuauaaugcuaagggacaua

SEQ ID NO: 339439 - RNA, 63 nt, Homo Sapiens
aagaaaagauuaauaccuuaaaagaagaaaacacucaagaagcagcaguccugaaugguguuu

SEQ ID NO: 339440 - RNA, 63 nt, Homo Sapiens
aaaauuuuuuaaauaaguuuagagcaagacugucucaagaaaaugcacuccagccugggccac

SEQ ID NO: 339441 - RNA, 63 nt, Homo Sapiens
auaagagaaaugaacucacagcuuagaaugguucucaagaauuauauuuuauacaaauagauu

SEQ ID NO: 339442 - RNA, 63 nt, Homo Sapiens
gaauuaacuacauaauggaauggcaggcaggcacucaagaaaugauaagcaccuggcaucuaa

SEQ ID NO: 339443 - RNA, 63 nt, Homo Sapiens
cucuugagccaguaaucaaugagcagaacauuucucaagaaucguuucugugaauuucaugaa

SEQ ID NO: 339444 - RNA, 63 nt, Homo Sapiens
aaugguguuuuggaaauuuuccacgucauauaacucaagaauauggagaauagaaaugaaaag

SEQ ID NO: 339445 - RNA, 63 nt, Homo Sapiens
gccagggccagggcuguaugcaaaccccacucccucaagaaggucccugcugggcacacccca

SEQ ID NO: 339446 - RNA, 63 nt, Homo Sapiens
aacugaagaaggagcaagugaaaaccaaauuuccucaagaaaugugcaggacaguaaauaaug

SEQ ID NO: 339447 - RNA, 63 nt, Homo Sapiens
acugcaacacuacuuuauggcuccaugcccaagcucaagaacgcagauguggucaguagggag

SEQ ID NO: 339448 - RNA, 63 nt, Homo Sapiens
gauugguacugcaacuguaggcauuuaaaacuccucaagaaagcaauuuaauugcucaaccau

SEQ ID NO: 339449 - RNA, 63 nt, Homo Sapiens
agcauuaguaauuucuaguaauuuuuuagguuacucaagaaccucuaaauuugaguaaauaca

SEQ ID NO: 339450 - RNA, 63 nt, Homo Sapiens
ugguacaaaacacaaccgagacacaacguuuuccucaagaaaaaagggaacacacaaagaauu

SEQ ID NO: 339451 - RNA, 63 nt, Homo Sapiens
gaugucuauugaguagaaccaauaauggugaagcucaagaacacuauaauggguuugggggau

SEQ ID NO: 339452 - RNA, 63 nt, Homo Sapiens
agggauuccuaauaauggcacauguagcugacacucaagaaauaggugaauuguggaaaaugu

SEQ ID NO: 339453 - RNA, 63 nt, Homo Sapiens
uaggcucauggcaacguguguauucacauggcgcucaagaaguuggcuuuccugcuauacaca

SEQ ID NO: 339454 - RNA, 63 nt, Homo Sapiens
uguguuuucuuuagcuuccccuguccugccugccucaagaauacuucaucaaguggaagccaa

SEQ ID NO: 339455 - RNA, 63 nt, Homo Sapiens
guaaauuugcucuguuuuaagacuuugaacuaccucaagaagaggaaucuaauacaauauuug

SEQ ID NO: 339456 - RNA, 63 nt, Homo Sapiens
acaaguuuucacugaaugagcauggcagugccacucaagaaaaugaaucuccaaaguaucuuc

SEQ ID NO: 339457 - RNA, 63 nt, Homo Sapiens
agugcuuagaaguaagcaauucccaggucauagcucaagaauuguuagcaaaugacagauuuc

SEQ ID NO: 339458 - RNA, 63 nt, Homo Sapiens
uagugccaggucacuauuguaagauguuaaaaucucaagaaaauuucacagagcuaaagaaau

SEQ ID NO: 339459 - RNA, 63 nt, Homo Sapiens
gauaagaaaggacuacagcauuugauguguguccucaagaacuugucuugggucugaaaaagc

SEQ ID NO: 339460 - RNA, 63 nt, Homo Sapiens
ccuauggccuucuugucaaaaccuucacuggagcucaagaaaagcauuucuguuguguuauuu

SEQ ID NO: 339461 - RNA, 63 nt, Homo Sapiens
ugcuuaugggaauccugagcugcuuuucaccaucucaagaagccuaagaaguuauauauuuaa

SEQ ID NO: 339462 - RNA, 63 nt, Homo Sapiens
uguagauaaaaguguuccaguaaucagaaaauccucaagaaaauugacuucauuauuuggaag

SEQ ID NO: 339463 - RNA, 63 nt, Homo Sapiens
gcccauuaccuuuccucugccugaaagacgugucucaagaaaaauaaauucuauuuuagaugc

SEQ ID NO: 339464 - RNA, 63 nt, Homo Sapiens
agaauaaaauugaaaucugcacaauguuuuugucucaagaacaaguauaucaucauaaaauag

SEQ ID NO: 339465 - RNA, 63 nt, Homo Sapiens
caaauacagcuuuuuuucaauuuagacuucuuucucaagaaauaauaaaaagguaaaacuaca

SEQ ID NO: 339466 - RNA, 63 nt, Homo Sapiens
uuuacguaguuuuucauaggugucuuccuguuucucaagaauaaacgaacaagauuaauuacc

SEQ ID NO: 339467 - RNA, 63 nt, Homo Sapiens
ggccccuuuuuccaacuuauuuuuauccaugugcucaagaaagucuuuagacuacaauaauac

SEQ ID NO: 339468 - RNA, 63 nt, Homo Sapiens
aucaagggacuccugugucaguguacagaucuccucaagaaacgauauguauuugcuacucaa

SEQ ID NO: 339469 - RNA, 63 nt, Homo Sapiens
aaauaaccgauuauugauuacuguauuuuuuuucucaagaacagugauagguagaaacuaauu

SEQ ID NO: 339470 - RNA, 63 nt, Homo Sapiens
aagucaucauugcuguuuagcuugacuguuuuccucaagaacaucgaucugaaggauucauaa

SEQ ID NO: 339471 - RNA, 63 nt, Homo Sapiens
gaugcucuguagagaauuugcuaccgaaguuggcucaagaauuuguuuuuaguguuauuuacc

SEQ ID NO: 339472 - RNA, 63 nt, Homo Sapiens
uggcaaaggccuuccugcauuuaugaauucucucucaagaagcaagagaacaccugcaggaag

SEQ ID NO: 339473 - RNA, 63 nt, Homo Sapiens
ugagaauuaagaauggacaggaccaagacagaacucaagaaagccacuggggaaaacucgaga

SEQ ID NO: 339474 - RNA, 63 nt, Homo Sapiens
auauguucaacauuuacuucuauuugauaucugcucaagaagucauagaagucuugggaaacu

SEQ ID NO: 339475 - RNA, 63 nt, Homo Sapiens
ugccacguauguucaaggguuaaaaccacaagucucaagaauuguaacauugucagaaauaaa

SEQ ID NO: 339476 - RNA, 63 nt, Homo Sapiens
uagucagacugacacuacuaaguacgugaaaugcucaagaauguucuucagguaacacuacag

SEQ ID NO: 339477 - RNA, 63 nt, Homo Sapiens
aaaucaucaccaauaccuuuacucaccaccaagcucaagaaauaacaaaacacaguccugcau

SEQ ID NO: 339478 - RNA, 63 nt, Homo Sapiens
uuuaauauuuaaauaaaaucccaaagguucacucucaagaagcgccaacucauuggguuguag

SEQ ID NO: 339479 - RNA, 63 nt, Homo Sapiens
aauauccaauguuuaugagucucacucuuauuccucaagaauuauaucaccuagaaaaguagc

SEQ ID NO: 339480 - RNA, 63 nt, Homo Sapiens
ccaggagguaauuuguugauauuuucacuuuaacucaagaauucaucagcauuguauacacau

SEQ ID NO: 339481 - RNA, 63 nt, Homo Sapiens
guguaccacuaaaaguaauaaucaagacauuuucucaagaacuucacaaauggcaauguaaaa

SEQ ID NO: 339482 - RNA, 63 nt, Homo Sapiens
augggagcugcaaacgcgguuugguuuguuggccucaagaagaaagaagcaugcagagaagaa

SEQ ID NO: 339483 - RNA, 63 nt, Homo Sapiens
cagcugcacaggccuugacugcccccagcaagucucaagaacagaaccaugccccuuccccag

SEQ ID NO: 339484 - RNA, 63 nt, Homo Sapiens
uuuucaacgacagugauaguuaaaauaaacuaucucaagaaagagaaauacaguuuguuugua

SEQ ID NO: 339485 - RNA, 63 nt, Homo Sapiens
uacaguggcuccccaaugccaagucauugccugcucaagaaugcuuugagaaauccuuuugug

SEQ ID NO: 339486 - RNA, 63 nt, Homo Sapiens
ugauaccuggguugaugugggccaugggcugggcucaagaaccacagaguguguucgcacuua

SEQ ID NO: 339487 - RNA, 63 nt, Homo Sapiens
aaaacugccuaacugaagggaaugggggcccugcucaagaagggggccaggcagcuggaauca

SEQ ID NO: 339488 - RNA, 63 nt, Homo Sapiens
gggguaugagcugccaagucuauuuuaaagacgcucaagaauccucugggguucaucuaggga

SEQ ID NO: 339489 - RNA, 63 nt, Homo Sapiens
cauucagccaacccagaggauguagacccuguccucaagaagugcagggcgaguucugccgug

SEQ ID NO: 339490 - RNA, 63 nt, Homo Sapiens
cuguggaacgagacuucugcagagguggcugaccucaagaagcagguacaggcccuucagccc

SEQ ID NO: 339491 - RNA, 63 nt, Homo Sapiens
gacuagauuauauuuaguaggggaaaaauugggcucaagaaccauucaucaguacgugagaca

SEQ ID NO: 339492 - RNA, 63 nt, Homo Sapiens
gacuuguaagcaguucauagaagcugcucaauacucaagaaucuugcaagacaguuauuaaac

SEQ ID NO: 339493 - RNA, 63 nt, Homo Sapiens
gcgaaaggacagacuguuggcugcacauuucuccucaagaaaaucuuguuuugaucauuucca

SEQ ID NO: 339494 - RNA, 63 nt, Homo Sapiens
acuccgaagucagucugcagucuccccuccuggcucaagaauucagcaauuugaacacuaacc

SEQ ID NO: 339495 - RNA, 63 nt, Homo Sapiens
cacuucacguauucuuguaugugcccauuaccacucaagaagaucugagcaaauaacuacagg

SEQ ID NO: 339496 - RNA, 63 nt, Homo Sapiens
gagaugcccuagugguggccccagcagaaccagcucaagaaagccgguagccuucaagcuugu

SEQ ID NO: 339497 - RNA, 63 nt, Homo Sapiens
guaauuaugaagaguggagagauuuggccuguccucaagaauguuuuacuccgugccuuacug

SEQ ID NO: 339498 - RNA, 63 nt, Homo Sapiens
acuuuauucuuguaucucauuuagagguggaaccucaagaaugacagcguccauuuuuucaua

SEQ ID NO: 339499 - RNA, 63 nt, Homo Sapiens
agccagcaaguauucucagcucaggaguugcuucucaagaaagcauugucuugcccuauagac

SEQ ID NO: 339500 - RNA, 63 nt, Homo Sapiens
gauuuggugugauaccuuguuaggaaugguuuucucaagaauauuuaaacauuaaguuugaaa

SEQ ID NO: 339501 - RNA, 63 nt, Homo Sapiens
uguuauguguguuugcugcguaagggucuaagucucaagaaucgagugaugagcagacauguu

SEQ ID NO: 339502 - RNA, 63 nt, Homo Sapiens
acuggcuuuaaaagaagccacuugcauuuauuucucaagaauuuauuuaaucuauuuaaucuu

SEQ ID NO: 339503 - RNA, 63 nt, Homo Sapiens
augugcuaucuggcuuugaacuauuuaaagugacucaagaagcgcccucaauauuugguaaug

SEQ ID NO: 339504 - RNA, 63 nt, Homo Sapiens
aagaaauauuguugcucaguguuguuaauauagcucaagaauugaguuuauauuugcaguaug

SEQ ID NO: 339505 - RNA, 63 nt, Homo Sapiens
gacgagaagacucagccugagggccugcggagccucaagaagccagaccgcaagaagcgcuac

SEQ ID NO: 339506 - RNA, 63 nt, Homo Sapiens
guggaacuuccucuuucauuggaaacuuucuuacucaagaaugacggcaguauuguuuucuua

SEQ ID NO: 339507 - RNA, 63 nt, Homo Sapiens
acugucuucaucaaguauuucccuacagaacuccucaagaaaacagagaucauuuggcuagag

SEQ ID NO: 339508 - RNA, 63 nt, Homo Sapiens
gacucugggccccuccccagcuccacucccuaccucaagaaugugaccauuuggaaaaggcaa

SEQ ID NO: 339509 - RNA, 63 nt, Homo Sapiens
ccauguugccaaggcugguuucaaacuccuggacucaagaaauccacccaccucagccuccca

SEQ ID NO: 339510 - RNA, 63 nt, Homo Sapiens
gugacaguuccaggucuugaagcuaaucagcaucucaagaaaguauccagaaagaacaucugc

SEQ ID NO: 339511 - RNA, 63 nt, Homo Sapiens
uccuaagcucucaaaauagcauauucccuagagcucaagaaagcugguccaggagguugaaaa

SEQ ID NO: 339512 - RNA, 63 nt, Homo Sapiens
aaacgaacugggaaaauuucacagaagucuugucucaagaagaguugugcuccagccugggcg

SEQ ID NO: 339513 - RNA, 63 nt, Homo Sapiens
ugaagauuccaguggucaguagccuuggaacuccucaagaacccccaugcccguucugaccuc

SEQ ID NO: 339514 - RNA, 63 nt, Homo Sapiens
agaauccauuuagcaccuccuacccaggcaauacucaagaaggagauugggaaacuuaaccgu

SEQ ID NO: 339515 - RNA, 63 nt, Homo Sapiens
augcagcuguucugaacugguuucauaaguucacucaagaaaauuuugcuguuguaaaagugu

SEQ ID NO: 339516 - RNA, 63 nt, Homo Sapiens
uuagaauuuaaguaccuuuuaauucucaaauggcucaagaacaaugucuguuuaaaaauuacu

SEQ ID NO: 339517 - RNA, 63 nt, Homo Sapiens
ccuaaaguuucaauacaagccucagcaccacagcucaagaaaaguuagugucuucuuccugcc

SEQ ID NO: 339518 - RNA, 63 nt, Homo Sapiens
uacacccacgcacccccccacacacuaugcucucucaagaauguaauuuauuggggccccccc

SEQ ID NO: 339519 - RNA, 63 nt, Homo Sapiens
uagaguccugccguggcucagguggaucuaaaacucaagaacaaauucuauuuauuuauuauu

SEQ ID NO: 339520 - RNA, 63 nt, Homo Sapiens
uauacuaucuaucucaccaguauuugcucucgacucaagaagguuaacauuuucugauucaug

SEQ ID NO: 339521 - RNA, 63 nt, Homo Sapiens
ugacagcugucuguuguuuuaugaaguuuauuucucaagaaaaugggaauaaauuugggauuu

SEQ ID NO: 339522 - RNA, 63 nt, Homo Sapiens
cacucuagcuugggcaauagagcaaggcuccgucucaagaaaagaaggucauuucccaagacu

SEQ ID NO: 339523 - RNA, 63 nt, Homo Sapiens
guggaagcauguguguuucuaaaaaguaaaaaucucaagaaaacagaaauggcaugcuuuacc

SEQ ID NO: 339524 - RNA, 63 nt, Homo Sapiens
auaaugcagagauaauuagacaugguucccgcccucaagaagcucacaaaaguauucaggaaa

SEQ ID NO: 339525 - RNA, 63 nt, Homo Sapiens
aguucuuuuggaacuuguuucaagccaaaaacucucaagaaagcaaauugcaccucagcugga

SEQ ID NO: 339526 - RNA, 57 nt, Homo Sapiens; identical to SEQ ID NO: 339173

SEQ ID NO: 339527 - RNA, 63 nt, Homo Sapiens
ccuaaauuaucccauuauguaauucuuggucagcucaagaacuggguucuuuuucuaauaauu

SEQ ID NO: 339528 - RNA, 63 nt, Homo Sapiens
agcuggaacaguaggggcagggagaagacaggucucaagaaaagguuuuuaagaaguuucauc

SEQ ID NO: 339529 - RNA, 63 nt, Homo Sapiens
uuccucuacucucccgugcacugccggccagagcucaagaagcugcugcacgggcugggccuu

SEQ ID NO: 339530 - RNA, 63 nt, Homo Sapiens
gcauccucugaccuacuucauaaugcuggaauacucaagaauuuuuuacucugaucaaauaaa

SEQ ID NO: 339531 - RNA, 63 nt, Homo Sapiens
uguuaaccuccggggagagccacaaaacccuaucucaagaacugggaggaagcacugaaacaa

SEQ ID NO: 339532 - RNA, 63 nt, Homo Sapiens
ccaugcgcuggcaguacaugcuugcuuuaugggcucaagaaugaaccacagggccugagaagu

SEQ ID NO: 339533 - RNA, 63 nt, Homo Sapiens
aaaaaaaaguuuguuuuuucaauacucuuuucucucaagaaaacccugauauuauuucuauuu

SEQ ID NO: 339534 - RNA, 63 nt, Homo Sapiens
guucauauuaauugaggauuaaauuucccauuucucaagaaauuggugggagggaauguuuuc

SEQ ID NO: 339535 - RNA, 63 nt, Homo Sapiens
cagcccugcuucugacauaaaaacuuguccuuccucaagaacaauuuugaugauucugagaag

SEQ ID NO: 339536 - RNA, 63 nt, Homo Sapiens
aacagaaacgagauuugccacuauaauguuucccucaagaacaaaauaaccaaaaaaugugag

SEQ ID NO: 339537 - RNA, 63 nt, Homo Sapiens
gccuguggaccgaggcccccggucaacaaggaccucaagaacuucagccccaguuggcuuccu

SEQ ID NO: 339538 - RNA, 63 nt, Homo Sapiens
ugcagagguaacucucaggcagcuaagcagcaccucaagaaaacauguuaaauuaaugcuucu

SEQ ID NO: 339539 - RNA, 63 nt, Homo Sapiens
ugagaguagcugcugcuuucccugacuuccuuccucaagaauacagucuauucugggggguug

SEQ ID NO: 339540 - RNA, 63 nt, Homo Sapiens
gauuuuccucugacaccagagaacaauaguagucucaagaauggaaaccugaaugucugaggg

SEQ ID NO: 339541 - RNA, 63 nt, Homo Sapiens
aaaacuucaguuacugaccagucaagagaauuucucaagaaaaaucccagcaacguucccucu

SEQ ID NO: 339542 - RNA, 63 nt, Homo Sapiens
caagcacaaagugaugaaugacugccuucaagucucaagaaaacacuuuucccuaacuuuuag

SEQ ID NO: 339543 - RNA, 63 nt, Homo Sapiens
uuugggugagcugcaccugauuaguugaaaggccucaagaacaaacacugcaguuuccuggaa

SEQ ID NO: 339544 - RNA, 63 nt, Homo Sapiens
aacuguggaguugguagcugguaacauuguugucucaagaacaacucaccucucucccuagga

SEQ ID NO: 339545 - RNA, 63 nt, Homo Sapiens
cagcccuaaaauucucuccaccgccacagaaggcucaagaauccaacuaaaccuucuuaauau

SEQ ID NO: 339546 - RNA, 63 nt, Homo Sapiens
guacucgggcgacaccuuacagccaauggcagucucaagaaauacuaccucauaugcaggaug

SEQ ID NO: 339547 - RNA, 63 nt, Homo Sapiens
gccugaaugacaauguccaggguucauucuuugcucaagaaaguuuucugacauuccuagaca

SEQ ID NO: 339548 - RNA, 63 nt, Homo Sapiens
aagguaccccaauauaucucagaauucaacugucucaagaaucauacaacaagaucaacuaga

SEQ ID NO: 339549 - RNA, 63 nt, Homo Sapiens
ucuuaguucaguggaggaaaugugcacucuggacucaagaaacuugaagggagaaaggcaaga

SEQ ID NO: 339550 - RNA, 63 nt, Homo Sapiens
agaggggcauaaacuuuccucagccagaggcaccucaagaagaucacugugagcucccaggug

SEQ ID NO: 339551 - RNA, 63 nt, Homo Sapiens
uauucuuucacccugucucuuuuaucccuuccucucaagaaaauucagaugaguuagaagcuu

SEQ ID NO: 339552 - RNA, 63 nt, Homo Sapiens
agugacauaauuuacaugcaauauguuuaucaacucaagaauuuaauauaguugguacacaac

SEQ ID NO: 339553 - RNA, 63 nt, Homo Sapiens
ggauacauuaggagcuucaaacacauauaauuucucaagaaauuuccagaugucucaugcugc

SEQ ID NO: 339554 - RNA, 63 nt, Homo Sapiens
auuaaggaagaacaaggaagggaaugaucuuuacucaagaauuucagaaagucagcacugaag

SEQ ID NO: 339555 - RNA, 57 nt, Homo Sapiens; identical to SEQ ID NO: 339202

SEQ ID NO: 339556 - RNA, 63 nt, Homo Sapiens
gaaggcugcuaauuggauuuugguaguucuuaccucaagaaaacuugaauuauuugggggaaa

SEQ ID NO: 339557 - RNA, 63 nt, Homo Sapiens
aagcuuaugaaggaaugccuccuuuguuacacacucaagaauuugucagcacacaauuaauug

SEQ ID NO: 339558 - RNA, 63 nt, Homo Sapiens
auaauucagaaauuggguuuugguucagugauucucaagaaaaagaucucuugcccauuaaga

SEQ ID NO: 339559 - RNA, 63 nt, Homo Sapiens
uuuuuuucugaauaacauuuggaaacaagcacacucaagaaagacaaaauccaaggugcuaca

SEQ ID NO: 339560 - RNA, 63 nt, Homo Sapiens
cuacuggaacuggaugaccuaaaugguguuuuccucaagaagaaaagaaaacugaacugagga

SEQ ID NO: 339561 - RNA, 63 nt, Homo Sapiens
gcccagauguagaaauucauaggcccucucucccucaagaaauuuuuccaucuccaaauagcc

SEQ ID NO: 339562 - RNA, 63 nt, Homo Sapiens
aaacugugcuguuacaacucgaaaauaugucuucucaagaacaaaaguucauuucaucacuua

SEQ ID NO: 339563 - RNA, 63 nt, Homo Sapiens
ucaguuuauaauuggaagagcuucauacguuuucucaagaacuuggcucucucucugcugccu

SEQ ID NO: 339564 - RNA, 63 nt, Homo Sapiens
cagcucugcucugagcguccgagaccccaguuucucaagaauuuccucuauccgaggccauug

SEQ ID NO: 339565 - RNA, 63 nt, Homo Sapiens
augcuuuuugggaaacguugcaccuucuuucuccucaagaaaggguugaguccagaugcuucu

SEQ ID NO: 339566 - RNA, 63 nt, Homo Sapiens
uccacagacagaugaggcaggagugauggggcacucaagaaaguucagaggaggcauaagcua

SEQ ID NO: 339567 - RNA, 63 nt, Homo Sapiens
uggaucuuggcaugcacccaccuaacccacuuucucaagaacaagaaccuagaaugaauaucc

SEQ ID NO: 339568 - RNA, 63 nt, Homo Sapiens
cucccagaagaccaaacugccuuccccucagggcucaagaauguguacagucuguggggccgg

SEQ ID NO: 339569 - RNA, 63 nt, Homo Sapiens
ucuccuuuuguguuuuucccacuuuccaauguacucaagaaaauugaacaaauguaauggauc

SEQ ID NO: 339570 - RNA, 63 nt, Homo Sapiens
cugacuaaggagcugcagcgauacaucgaagggcucaagaagcgccggagcaagaggcuguac

SEQ ID NO: 339571 - RNA, 63 nt, Homo Sapiens
ccccagagggcuuuguggaggacaggccuugcccucaagaacgucguaccugacgcugagccu

SEQ ID NO: 339572 - RNA, 63 nt, Homo Sapiens
ugagcuuuuuggaaggauaauucugauaaggcacucaagaaacguacaaccacagugcuuucu

SEQ ID NO: 339573 - RNA, 63 nt, Homo Sapiens
agacccgccaccguggaggcagggggcaagaaacucaagaacgcaucaagagcaccagcccug

SEQ ID NO: 339574 - RNA, 54 nt, Homo Sapiens; identical to SEQ ID NO: 339221

SEQ ID NO: 339575 - RNA, 63 nt, Homo Sapiens
accucacgcaccucccauccuaaucauccaaugcucaagaaacaacuucuacuucugcccuug

SEQ ID NO: 339576 - RNA, 63 nt, Homo Sapiens
acuuuucagagucaucuacaaaauuuuucuuuccucaagaaaagaguuccuuuugccuuauuc

SEQ ID NO: 339577 - RNA, 63 nt, Homo Sapiens
gucagcaacagaaaaugagaaaggaagccaagucucaagaacucugacuuaggaucaugcugg

SEQ ID NO: 339578 - RNA, 63 nt, Homo Sapiens
aaugucuggggacaggccuuaaaggaggguggccucaagaaacgccccuggaucuuuggggua

SEQ ID NO: 339579 - RNA, 63 nt, Homo Sapiens
ggccucauuccagggcacaguuuuuauaugagacucaagaacaucaugccuaacaguggucug

SEQ ID NO: 339580 - RNA, 63 nt, Homo Sapiens
ccuuuguuuugcacugacaauucacugccaugccucaagaacagaggaggagggauucugguc

SEQ ID NO: 339581 - RNA, 63 nt, Homo Sapiens
ucccagucugguaggagagaauacauucccgcccucaagaaucugggaaugcugggaaaugag

SEQ ID NO: 339582 - RNA, 63 nt, Homo Sapiens
caugugcagucacuggugucggaggaaaagcagcucaagaacaaggagacaugagucuuugcc

SEQ ID NO: 339583 - RNA, 63 nt, Homo Sapiens
uaagucuuagugcacaguauuauuuagcaucagcucaagaaacuauuccuauugaucucauuu

SEQ ID NO: 339584 - RNA, 63 nt, Homo Sapiens
uggaagaggcagcaggacuuaggggaaaaguuucucaagaaggcauaaugagauaaugcaugu

SEQ ID NO: 339585 - RNA, 63 nt, Homo Sapiens
auuuauggcaugauuagauugcaaagcaaugaacucaagaaggaauugaaauaaggagggaca

SEQ ID NO: 339586 - RNA, 63 nt, Homo Sapiens
uaguuuggauaucuuuaggguuuagaaucuaaccucaagaauaagaaauacaaguacaaauug

SEQ ID NO: 339587 - RNA, 63 nt, Homo Sapiens
cccaucuuuuuucuucccucauuuucugggauucucaagaaagaaaaaguaacccauuaucac

SEQ ID NO: 339588 - RNA, 63 nt, Homo Sapiens
ccuuuuggacuaauguuacuguccaaguucuuucucaagaaaccacaucugguucagaagagu

SEQ ID NO: 339589 - RNA, 63 nt, Homo Sapiens
uuuuaaauuuuuuuauaggcccauaugcucuaucucaagaaacaagaugauuguaacaugucc

SEQ ID NO: 339590 - RNA, 63 nt, Homo Sapiens
aacuuuccuuuauuucacuuguacccaguuucacucaagaaaucuugaugaauauuuauguug

SEQ ID NO: 339591 - RNA, 63 nt, Homo Sapiens
gacccucucuauagccaugagacuccuuguggccucaagaaauuuagacgcccacgacagcac

SEQ ID NO: 339592 - RNA, 63 nt, Homo Sapiens
agccgcacccgugugcacuguaacuuuugugugcucaagaaauuauacagaaaccuacagcug

SEQ ID NO: 339593 - RNA, 63 nt, Homo Sapiens
aaucaguaaauaccuugaaacuugcaggagugacucaagaauucacuccuggagaaagacuuc

SEQ ID NO: 339594 - RNA, 51 nt, Homo Sapiens; identical to SEQ ID NO: 339241

SEQ ID NO: 339595 - RNA, 63 nt, Homo Sapiens
uagaccuagaaauaccauuuacccaucugauuccucaagaaucuuuccuucauaaagaaugcc

SEQ ID NO: 339596 - RNA, 63 nt, Homo Sapiens
ugccacauuucaauuacauaaauguauugaauacucaagaaaauaggaaaaaaaaauccaaga

SEQ ID NO: 339597 - RNA, 63 nt, Homo Sapiens
cucuagagaagaaaagugaagccauuauuuuaacucaagaaaaucucauaugaucuucuucaa

SEQ ID NO: 339598 - RNA, 63 nt, Homo Sapiens
cagcuuggagccucuagguugacuuaagcuagacucaagaaagcacuccacugcagcaggagg

SEQ ID NO: 339599 - RNA, 63 nt, Homo Sapiens
ugccuccuuauuuaucaacaccucguccccugccucaagaaauuaaaaauaguaagccucccu

SEQ ID NO: 339600 - RNA, 63 nt, Homo Sapiens
agcaugagcuggccacacauuggacagccccugcucaagaaaacaugguaugagcacagguca

SEQ ID NO: 339601 - RNA, 63 nt, Homo Sapiens
gauaauucauuauaucaucacuguauauacuuccucaagaacuuuuugaaaaauagucaccaa

SEQ ID NO: 339602 - RNA, 63 nt, Homo Sapiens
cccucauuuuuauaaccuggacuauaaguaauucucaagaaagcucugccauucaacucggaa

SEQ ID NO: 339603 - RNA, 63 nt, Homo Sapiens
gguaccuacuacaugcuguacacuugaaugugccucaagaaaacuuuuuacuguuugccaaaa

SEQ ID NO: 339604 - RNA, 63 nt, Homo Sapiens
ccuuacagguaaguauugcuuucucuaauaauccucaagaaauuucuauacuggauccuuucu

SEQ ID NO: 339605 - RNA, 63 nt, Homo Sapiens
cugcugggaguccccugaguucuagauacagggcucaagaaguuacuggagagaugggauccu

SEQ ID NO: 339606 - RNA, 63 nt, Homo Sapiens
ucaggguccucagugcagagcaacuuacgcauccucaagaauccacugcuuuucaggcaagga

SEQ ID NO: 339607 - RNA, 63 nt, Homo Sapiens
ccacgugggcaauaccagggacccauggggaaacucaagaaugacagcuucuauauuuuguaa

SEQ ID NO: 339608 - RNA, 63 nt, Homo Sapiens
cacuaagaaggccugucuacacugcaggggaaccucaagaacuuuucauugcacuucuaaaau

SEQ ID NO: 339609 - RNA, 63 nt, Homo Sapiens
aaaaggaagagccuuuuaaaaacauuugccaaccucaagaauaaauacugaaagucuugaaag

SEQ ID NO: 339610 - RNA, 63 nt, Homo Sapiens
uaggauucugacuaagaggcaaaagagaaaagacucaagaaacugauccuggagaucgagacc

SEQ ID NO: 339611 - RNA, 63 nt, Homo Sapiens
auacucucccagauuuuuacugggauuuggggccucaagaaauggagccaggaguaagacaag

SEQ ID NO: 339612 - RNA, 63 nt, Homo Sapiens
uuggauguuuucauuggccuugaagaaguuauucucaagaaaauuuguuuuaacaaaauuagc

SEQ ID NO: 339613 - RNA, 63 nt, Homo Sapiens
uuauaugacaucauccugaagaacuucgagaagcucaagaagcccaggggagaaacaaaggga

SEQ ID NO: 339614 - RNA, 63 nt, Homo Sapiens
aagauuacauacauuugagaauaagaaauuacucucaagaacuucagaaaucugcaacauaau

SEQ ID NO: 339615 - RNA, 63 nt, Homo Sapiens
auauuucccauaaaugggaaguuugcccauugucucaagaaauguguauuucagugacaauuu

SEQ ID NO: 339616 - RNA, 63 nt, Homo Sapiens
aacauuuugggaaguaacugccucugacuucaacucaagaaaacacuuuuuuguugcuaaugu

SEQ ID NO: 339617 - RNA, 63 nt, Homo Sapiens
aagaagacugacuggguggaggcucugccuugccucaagaaccauccccugcagagcauccag

SEQ ID NO: 339618 - RNA, 63 nt, Homo Sapiens
uaggccuugcaucucgccaccuccacuucuguccucaagaacaaguccuaggucaagggaaac

SEQ ID NO: 339619 - RNA, 63 nt, Homo Sapiens
agaaauaaauaaggguggugccagaggaaaugucucaagaaccaaggaagugaaaauagccag

SEQ ID NO: 339620 - RNA, 63 nt, Homo Sapiens
cccuggaauaucccugagaacuacgcacucagccucaagaacuaauuagugcuggauuugaag

SEQ ID NO: 339621 - RNA, 63 nt, Homo Sapiens
cugcuucuugcuuugcagagcucaggaauugcccucaagaacuauggcccugggaaucaauuc

SEQ ID NO: 339622 - RNA, 63 nt, Homo Sapiens
cagggaacaauacuguaaacuacuugagguugccucaagaacuaaucuuagaguucauaaauu

SEQ ID NO: 339623 - RNA, 63 nt, Homo Sapiens
auaugggagcccaugaggagaggguggcugcgacucaagaauaaugaagaauggaaauggaaa

SEQ ID NO: 339624 - RNA, 63 nt, Homo Sapiens
aaggagauaaacaugaccaucgucaaagaccugcucaagaaauuuuuaaaaaagaaacaaagu

SEQ ID NO: 339625 - RNA, 63 nt, Homo Sapiens
auuucuuauuugcuagggaacugguaaucuaggcucaagaaguguguggagaagguuuauuuu

SEQ ID NO: 339626 - RNA, 63 nt, Homo Sapiens
caucaguguggacuccuagaacgugcgaccugccucaagaaaaugcaguuuucaaaaacagac

SEQ ID NO: 339627 - RNA, 63 nt, Homo Sapiens
ccuccucaggacauggagaucugugcagaugagcucaagaagguccuuaacacagucgugaac

SEQ ID NO: 339628 - RNA, 63 nt, Homo Sapiens
guacaccuguagauauuacuguacuuuuauguucucaagaaauaaguuguugccuauucagug

SEQ ID NO: 339629 - RNA, 63 nt, Homo Sapiens
acugauucauacauuaucucacuugugccaacacucaagaagcaggcuacacugacacuggua

SEQ ID NO: 339630 - RNA, 56 nt, Homo Sapiens; identical to SEQ ID NO: 339277

SEQ ID NO: 339631 - RNA, 63 nt, Homo Sapiens
auucacaguugagugcauccaggaaaggaagaccucaagaaaagcuccacuucauccagauga

SEQ ID NO: 339632 - RNA, 63 nt, Homo Sapiens
uuuuaaaaacgaaacaaagucaucaaagagcugcucaagaaauaaggagauaaacaccaccau

SEQ ID NO: 339633 - RNA, 63 nt, Homo Sapiens
uaugucaagaugagcugaauuucggaauacuggcucaagaaccggaacuuuauaaugaaacgg

SEQ ID NO: 339634 - RNA, 63 nt, Homo Sapiens
gggcuuccaaugcugugagauggccuugcagagcucaagaaggaugugagcugcuaaauugac

SEQ ID NO: 339635 - RNA, 63 nt, Homo Sapiens
gcccggaagcgccaggcugguucccaugguggccucaagaaagccccucucucacacaucaca

SEQ ID NO: 339636 - RNA, 63 nt, Homo Sapiens
uguucuuagugauucacauccacgggacaaaaacucaagaagaaauaagagcugacgccacac

SEQ ID NO: 339637 - RNA, 63 nt, Homo Sapiens
gagggagugugcgaaucuacccugaccaaugggcucaagaauaaaguaugauuuuugagucag

SEQ ID NO: 339638 - RNA, 63 nt, Homo Sapiens
uugagggcuaaaucccaagugucucuugacuggcucaagaauuagggccccaacuacacaccc

SEQ ID NO: 339639 - RNA, 63 nt, Homo Sapiens
ccuacuuguggcgaucugaguacucuacucuugcucaagaaguaauacgacaaucagaauaca

SEQ ID NO: 339640 - RNA, 63 nt, Homo Sapiens
aaauaugaauugagggcccgccugaccaagcggcucaagaauagagggagugugcgaaucaaa

SEQ ID NO: 339641 - RNA, 63 nt, Homo Sapiens
uagaagauguguaaacagguugugucuggcguucucaagaaucacaaauuuggccuuaagaac

SEQ ID NO: 339642 - RNA, 63 nt, Homo Sapiens
ggauuagcucugauuuugagauacuuacgcuuccucaagaagaaugaaugcccgcagugagcu

SEQ ID NO: 339643 - RNA, 63 nt, Homo Sapiens
gucuuaacuaggaaacuaaacagugaauccauucucaagaaaacuacaaaauuaugucugcac

SEQ ID NO: 339644 - RNA, 63 nt, Homo Sapiens
gcgaaagucaaauauggagauggggguaggaaucucaagaauugaacacaggcaaauuauuug

SEQ ID NO: 339645 - RNA, 63 nt, Homo Sapiens
cucaccaagcucauuacaucugccagggccugccucaagaagcccagcccagccuuuuccugg

SEQ ID NO: 339646 - RNA, 63 nt, Homo Sapiens
gugguauauuuauguaagaaaaugacuguaaaucucaagaaaaaucucagcagcuaauagcaa

SEQ ID NO: 339647 - RNA, 63 nt, Homo Sapiens
guaaccauuuguuaacuguacugaagguguguccucaagaagaaaguguucaaauuaaaaaag

SEQ ID NO: 339648 - RNA, 63 nt, Homo Sapiens
cucuaccaaaaguuaaaaaaaaaaaaaaaaaagcucaagaaccugcacgagggccuaaaacag

SEQ ID NO: 339649 - RNA, 63 nt, Homo Sapiens
uucucuguuuaguaguugguuggggaaguggggcucaagaaggauuuugggguucaccagaug

SEQ ID NO: 339650 - RNA, 63 nt, Homo Sapiens
aaaaggggcuggaaaggggggaauggcccacaucucaagaagcaagauauuguuugugguggu

SEQ ID NO: 339651 - RNA, 63 nt, Homo Sapiens
aacagcauggauuccguggauagcuguugcagucucaagaagacugagagcuuccaaaaugcc

SEQ ID NO: 339652 - RNA, 63 nt, Homo Sapiens
caccaacauuuugcugccuaccuuguuauccuucucaagaagcugaaguguacgcccucuccc

SEQ ID NO: 339653 - RNA, 63 nt, Homo Sapiens
ugugcccuuccccgccugcgaugccaccaagcccucaagaaguuauauaccaccuaggaggag

SEQ ID NO: 339654 - RNA, 63 nt, Homo Sapiens
cccgaacgaauguucggauguccaguggugccucucaagaaacccacgugucccagcccagcg

SEQ ID NO: 339655 - RNA, 63 nt, Homo Sapiens
ugcugagauuucucuggaaaaauaacaggcagccucaagaauguacaucauuauuaauauaaa

SEQ ID NO: 339656 - RNA, 63 nt, Homo Sapiens
gggcucccugggaucuccaguacgauacucuuucucaagaaggccugaagcuggauucuuuca

SEQ ID NO: 339657 - RNA, 63 nt, Homo Sapiens
gaagcgugaaccccagggaaaggaggacacaaccucaagaaagaggccugcagggugugggga

SEQ ID NO: 339658 - RNA, 63 nt, Homo Sapiens
acgggcugcucuacugcuucccaugacgcacugcucaagaacuuuugacacaaacucacacaa

SEQ ID NO: 339659 - RNA, 63 nt, Homo Sapiens
acgggcugcucuacugcuuccgaugacgcacugcucaagaacuuuugacacaaaaucgcacaa

SEQ ID NO: 339660 - RNA, 63 nt, Homo Sapiens
acgggcugcucuacugcuucccaugacgcacugcucaagaacuuuugacacaaacucgcacaa

SEQ ID NO: 339661 - RNA, 57 nt, Homo Sapiens; identical to SEQ ID NO: 339308

SEQ ID NO: 339662 - RNA, 63 nt, Homo Sapiens
uuacuuuucuauguugcucaaaugauuguauaacucaagaagaugugagugcuuuggaauuua

SEQ ID NO: 339663 - RNA, 63 nt, Homo Sapiens
ccagacgaugcauuucuuggccaaaguggcuuccucaagaaagcagcacuuaccuuugaaaaa

SEQ ID NO: 339664 - RNA, 63 nt, Homo Sapiens
aaauggcuucacaguccuuacuucucuaccugccucaagaaggggcucagagcagagacuugu

SEQ ID NO: 339665 - RNA, 63 nt, Homo Sapiens
gggauuaguuggggguauuaaagacuucauuuucucaagaaaucaaacauucuuccuaaaagg

SEQ ID NO: 339666 - RNA, 63 nt, Homo Sapiens
caauauucguuaauguucaguuagcucuaauagcucaagaacauaacuuuaaaaauaauacuu

SEQ ID NO: 339667 - RNA, 63 nt, Homo Sapiens
auuauucauucuaucucagacuacacuaguaaucucaagaaagagggcacugaagaccugaau

SEQ ID NO: 339668 - RNA, 63 nt, Homo Sapiens
augacgagcucuagcuggaugggcgcagagaaccucaagaaggcaugaagccagccccugcag

SEQ ID NO: 339669 - RNA, 63 nt, Homo Sapiens
cgcuccagccuggucgacagagugagacuccaucucaagaaaaaauaaaaauaaaguuguucu

SEQ ID NO: 339670 - RNA, 63 nt, Homo Sapiens
cuuugggaggcugaggcaggaggaucacucgagcucaagaauucaagaccugggcaagagaga

SEQ ID NO: 339671 - RNA, 63 nt, Homo Sapiens
cacuccagccugggcgacagagcaagacucugucucaagaagaaaaaaaaaauacauauacac

SEQ ID NO: 339672 - RNA, 63 nt, Homo Sapiens
uuuauaugcaugaaguuaaaacaacugacguuacucaagaauuagaaaacuuugcaagauuug

SEQ ID NO: 339673 - RNA, 63 nt, Homo Sapiens
aaaagaaaaagagacaaauuagcgagacccugucucaagaaagcacuucagccugggcgacac

SEQ ID NO: 339674 - RNA, 63 nt, Homo Sapiens
gggcacugcccggcccggcuccuugcccccaagcucaagaagguucuccagcgcugggcccuc

SEQ ID NO: 339675 - RNA, 63 nt, Homo Sapiens
agacugugcagagggcauugcacccaccgcaaccucaagaaccgaccuacgccacuggaaaca

SEQ ID NO: 339676 - RNA, 63 nt, Homo Sapiens
aauaaaagugggaaaaucuuaaugagacacugucucaagaaaacauuccagccugugcgacag

SEQ ID NO: 339677 - RNA, 63 nt, Homo Sapiens
ccccagugccuuguaugaaguacccucugcacccucaagaaaccaggaccccccaagucuucc

SEQ ID NO: 339678 - RNA, 63 nt, Homo Sapiens
aacccaccauaaccagcccacuuguucuuaucccucaagaagauuccuucauuaacaaagacc

SEQ ID NO: 339679 - RNA, 63 nt, Homo Sapiens
ucugaagaagguaguaauaucucaugcauuuuccucaagaaugauguaccuauugacuguauc

SEQ ID NO: 339680 - RNA, 63 nt, Homo Sapiens
cgccgggcuacgaugacauguaccugugaaggccucaagaauguaacaucccaggcuucccuc

SEQ ID NO: 339681 - RNA, 61 nt, Homo Sapiens
cacuccagcccgggcaacagaguaagacccugccucaagaaaaaaaaaaaaaaaaaaaauc

SEQ ID NO: 339682 - RNA, 63 nt, Homo Sapiens
ggccaggugccggcacagugccucucccagagccucaagaagggccauuuaggagcuugcuuc

SEQ ID NO: 339683 - RNA, 63 nt, Homo Sapiens
caccgugccugacucauccaguggggaaggugacucaagaaguuguuuaagccuaggccuagg

SEQ ID NO: 339684 - RNA, 63 nt, Homo Sapiens
aaagcuguugcuggaaacuugcuuuaggaacagcucaagaaccuuggaguucauauuucacaa

SEQ ID NO: 339685 - RNA, 63 nt, Homo Sapiens
uucaugagggucucuuacuaccugcggguuugccucaagaaacagagaagaggaguggaugag

SEQ ID NO: 339686 - RNA, 63 nt, Homo Sapiens
aaagaucucgcuggugcguauggaaggaaaugucucaagaaaccucuauggcgcuuccuugag

SEQ ID NO: 339687 - RNA, 52 nt, Homo Sapiens; identical to SEQ ID NO: 339334

SEQ ID NO: 339688 - RNA, 63 nt, Homo Sapiens
agggccuugugcgugggccuuuccccccucgcccucaagaacaaaaaucuugcuuuuaugguc

SEQ ID NO: 339689 - RNA, 63 nt, Homo Sapiens
cuuguuuauuuucuaguagcuuuuauaaguacacucaagaauuugucagggagaauaauucug

SEQ ID NO: 339690 - RNA, 63 nt, Homo Sapiens
auccagguuuacuuucuaucagcugagcaaccucucaagaaaaaauaaauaaauaaauaaacc

SEQ ID NO: 339691 - RNA, 63 nt, Homo Sapiens
uguguucuguauaaacaaaugcagcuggaaucgcucaagaaucuuauuuuucuaaauccaaca

SEQ ID NO: 339692 - RNA, 63 nt, Homo Sapiens
guccugaagacuccggccaagaggcacaagcagcucaagaacaagcuggagaagaacgaggag

SEQ ID NO: 339693 - RNA, 63 nt, Homo Sapiens
uacuuuccuguauaguucacguuucauguaauccucaagaaauaaaaggaagccaaagagugu

SEQ ID NO: 339694 - RNA, 63 nt, Homo Sapiens
accugauguuuucuuauucuauuuguaguaguacucaagaaucuuacuguaggugaaggcugu

SEQ ID NO: 339695 - RNA, 63 nt, Homo Sapiens
gccauaaaaucucacgcugcguguuucugaagucucaagaacugggauuuggcuggugccgaa

SEQ ID NO: 339696 - RNA, 63 nt, Homo Sapiens
agcacagcugauguaaaauuuagaucccagacacucaagaauuggucgggacauauauuuaca

SEQ ID NO: 339697 - RNA, 63 nt, Homo Sapiens
auguccauuucggggagaggagcaggugggacccucaagaaaaugacggagaacaucccagac

SEQ ID NO: 339698 - RNA, 63 nt, Homo Sapiens
uuuuuuuaagagacagauuuuuauauuuuuccccucaagaacugcuuuugaaacuuagguauu

SEQ ID NO: 339699 - RNA, 63 nt, Homo Sapiens
aaaagaaggacugaacuccaucuugcccagcagcucaagaagaccucccagcggccuccggcg

SEQ ID NO: 339700 - RNA, 63 nt, Homo Sapiens
guuucuucuggauuccuuauguacuuggcuuaacucaagaacauuucucgaaauugccagugu

SEQ ID NO: 339701 - RNA, 63 nt, Homo Sapiens
gcagguaugugggccagaggacagacuaccccacucaagaacacuuucuacaaagcaaggccc

SEQ ID NO: 339702 - RNA, 63 nt, Homo Sapiens
gaggcucccuguacuggagucgucccacuauuccucaagaaaucuuagaaccagcuugugagg

SEQ ID NO: 339703 - RNA, 63 nt, Homo Sapiens
gaucuguacaaguauguggagcaugaaugcugacucaagaaacuuuuacuccuucugcucaag

SEQ ID NO: 339704 - RNA, 63 nt, Homo Sapiens
gugagcgaauuagcaauaacauacaugagauaacucaagaaaucaaaagauaguugauucuug

SEQ ID NO: 339705 - RNA, 63 nt, Homo Sapiens
caaagaaacacuugugcaguauacacagcacuacucaagaagcuauaaaaauguauaggcagu

SEQ ID NO: 339706 - RNA, 63 nt, Homo Sapiens
uaaacauuuguuucugugugguuguucugcuuccucaagaaauucaccccucucugaagggcu

SEQ ID NO: 339707 - RNA, 63 nt, Homo Sapiens
aaaaaaaaaaaaaagaauguagugagacucugucucaagaaggcacuccagccugggugacag

SEQ ID NO: 339708 - RNA, 63 nt, Homo Sapiens
accgccuuccccacccccuguugcuaaguggggcucaagaagcgccagaggaugagugaccag

SEQ ID NO: 339709 - RNA, 63 nt, Homo Sapiens
ucaaauucaggacauaaacuagcaccacagcuacucaagaagacugucacaaauguuccugaa

SEQ ID NO: 339710 - RNA, 63 nt, Homo Sapiens
gaagcagauucauacagccuagaaucuuaaaaucucaagaaguucaaucugaaagauuuuuca

SEQ ID NO: 339711 - RNA, 63 nt, Homo Sapiens
agcauuucuuuaaaauguuuuuuuuaaagcagucucaagaauagugaugcagacuuguucuuc

SEQ ID NO: 339712 - RNA, 63 nt, Homo Sapiens
gacagaagagacagugauuuaaaaagaaaccuacucaagaaaaagaacacaagaacuuaagag

SEQ ID NO: 339713 - RNA, 63 nt, Homo Sapiens
guggaggacccuggaaggaccuuuucucuggaucucaagaaugaaugacaaacacaagugccc

SEQ ID NO: 339714 - RNA, 63 nt, Homo Sapiens
auguucguauuagagacaaauuuuuaguuauuucucaagaagcucuugcacuaucacaauugc

SEQ ID NO: 339715 - RNA, 63 nt, Homo Sapiens
cugguacaccuguaccagcuuuuguaaagcaaacucaagaaaaaaaccuucgucucuuugugc

SEQ ID NO: 339716 - RNA, 63 nt, Homo Sapiens
uaaaagauacuuaauucuugaugagauaaagaccucaagaaguaagaauuagcaguaaaauac

SEQ ID NO: 339717 - RNA, 63 nt, Homo Sapiens
caaaagauaguugauucuugauacaugagauaacucaagaaaugugagcgaauuagcaauaac

SEQ ID NO: 339718 - RNA, 63 nt, Homo Sapiens
aagcaagcugccuuuguacuucccccccugcaucucaagaauaagacagacugcaccaccccu

SEQ ID NO: 339719 - RNA, 63 nt, Homo Sapiens
acacagaagcacacaucccugaaauauuuaaagcucaagaagaauuuuagguauuaagacuga

SEQ ID NO: 339720 - RNA, 63 nt, Homo Sapiens
ucuaacgagagacaucaguuucucaggaugauccucaagaacguuauggaguccauguugcaa

SEQ ID NO: 339721 - RNA, 63 nt, Homo Sapiens
ugcucugaaaaauuccuuuuaguccuucuguuacucaagaaaacaagagcgucagguggcaaa

SEQ ID NO: 339722 - RNA, 64 nt, Homo Sapiens
ggugugauuugugcaagccagguucaacccuugccucaagaaaucagaugggaccaauuuagug

SEQ ID NO: 339723 - RNA, 64 nt, Homo Sapiens
ggaagauggcuggugaggagcuuaacagaggaaccucaagaagauucugaaaauccuaccccca

SEQ ID NO: 339724 - RNA, 64 nt, Homo Sapiens
ggcaauacugaagggguuaaacagguuuuugcuccucaagaauuuguuugccugggcccaggau

SEQ ID NO: 339725 - RNA, 64 nt, Homo Sapiens
gauaacacuuaccaaaagaucacugcaaaccugccucaagaagcugaugguggcacuucaauuu

SEQ ID NO: 339726 - RNA, 64 nt, Homo Sapiens
gaaguccuuuuuuuuuuuuuuuuuuuuuuaauugcucaagaaaugauucucucacaggcuuggg

SEQ ID NO: 339727 - RNA, 64 nt, Homo Sapiens
gacugaugacaucugacuuuugucgaugggacuucucaagaagccauuccuuggagcuucuguu

SEQ ID NO: 339728 - RNA, 64 nt, Homo Sapiens
cauacugccaugaagacggucucuguguccucagcucaagaauccuguagcuugucccaucaua

SEQ ID NO: 339729 - RNA, 58 nt, Homo Sapiens; identical to SEQ ID NO: 339023

SEQ ID NO: 339730 - RNA, 64 nt, Homo Sapiens
gauuccuccaugguaaagcugaacugaaacaauucucaagaaugcaucagcuguaccuacaaua

SEQ ID NO: 339731 - RNA, 64 nt, Homo Sapiens
caaucugaagauguaagacuuccugaaacaaguucucaagaagucuuuacauuauauuuauaac

SEQ ID NO: 339732 - RNA, 64 nt, Homo Sapiens
uuugaauauuggggaaggaagaugauacuucuuucucaagaaaagaaaauuggauuauuaggaa

SEQ ID NO: 339733 - RNA, 64 nt, Homo Sapiens
ugucauaagcgaucacuuccuauaugcacuuauucucaagaagaacaucuuuaugguaaagaug

SEQ ID NO: 339734 - RNA, 64 nt, Homo Sapiens
ugugaaugcugaacugaaggcucagauugaggagcucaagaacgagaagcagcauuugauauac

SEQ ID NO: 339735 - RNA, 64 nt, Homo Sapiens
uuuguauuucaccaccuaaauguaauguugauuccucaagaaugaaaugaaggcacuacauuga

SEQ ID NO: 339736 - RNA, 64 nt, Homo Sapiens
acuuaugaguaagcagucuggucgcugacaaguucucaagaagauucaagacaaaacagauugc

SEQ ID NO: 339737 - RNA, 64 nt, Homo Sapiens
aguuagcaaaccacuccuuuagagggauccacuacucaagaaaauuccacgugagguuuuguuu

SEQ ID NO: 339738 - RNA, 64 nt, Homo Sapiens
uauucaccaguuccucugcaagagaagaagaaggcucaagaauucaccaaaagcuugauaugac

SEQ ID NO: 339739 - RNA, 64 nt, Homo Sapiens
agcugagugaacagcaugauacauguggagucaacucaagaaaagauccacuggucacagguag

SEQ ID NO: 339740 - RNA, 64 nt, Homo Sapiens
cagcucagcuucuccuucgaccacguccccagaucucaagaacgccuugugaccacaucuccca

SEQ ID NO: 339741 - RNA, 64 nt, Homo Sapiens
cauggagacuccugcccugucugcaaacucacugcucaagaagaagaagagggccugugggagc

SEQ ID NO: 339742 - RNA, 64 nt, Homo Sapiens
auuuuucuaaaaauaugaguagaaaaaaaauaaacucaagaaugaaugagauccugucucuuaa

SEQ ID NO: 339743 - RNA, 64 nt, Homo Sapiens
gagcuuuguauguguccuuuuugcauaagcacagcucaagaacugcuuacugaucacuauagua

SEQ ID NO: 339744 - RNA, 64 nt, Homo Sapiens
caugccagcucagcccuacagagagcccugagcccucaagaacuagcagugggcuacauacaau

SEQ ID NO: 339745 - RNA, 64 nt, Homo Sapiens
aguuccaaaccuagcagaauaauuaaaggguugacucaagaacuuauugacaauggcagagaac

SEQ ID NO: 339746 - RNA, 64 nt, Homo Sapiens
agaggccuccucuggagugacaucuccuucccuccucaagaagcugagggcauccgacaaggcc

SEQ ID NO: 339747 - RNA, 64 nt, Homo Sapiens
uccuuaaaaacuuugaaguuauuguguuaaguuccucaagaaucuuguauggcaguauguauau

SEQ ID NO: 339748 - RNA, 64 nt, Homo Sapiens
caggggcauccagggcucccgggaccaagacauccucaagaaaaugggauuuaaggacuucugg

SEQ ID NO: 339749 - RNA, 64 nt, Homo Sapiens
ugaugggccugaacucggacgccucaaaaacgcccucaagaacacaagucccccagcagaacca

SEQ ID NO: 339750 - RNA, 51 nt, Homo Sapiens; identical to SEQ ID NO: 339044

SEQ ID NO: 339751 - RNA, 64 nt, Homo Sapiens
ccagagucaccugucucaucagggcacggcgccccucaagaacuuccugcucacauccacaguc

SEQ ID NO: 339752 - RNA, 64 nt, Homo Sapiens
ugggcuguaacaauucagggcauaccacguuuugcucaagaagccgaaggcccucucuuccucu

SEQ ID NO: 339753 - RNA, 64 nt, Homo Sapiens
agugcuuuuucuccauggauuaauuugcuguugccucaagaaaaauauuuuguaucagugcugu

SEQ ID NO: 339754 - RNA, 64 nt, Homo Sapiens
uucacuaugugaaugagaugauuauaguacaauucucaagaaaaggaaaaccuuauggaaaaua

SEQ ID NO: 339755 - RNA, 64 nt, Homo Sapiens
uugacccugauuugaccccucuucuuauaaggaucucaagaaucucuucagaagcacugaugac

SEQ ID NO: 339756 - RNA, 64 nt, Homo Sapiens
uucaaggcaaagcaaggaacaucuugagauaugucucaagaauauaaagauguauuauuuuaag

SEQ ID NO: 339757 - RNA, 64 nt, Homo Sapiens
ggcucacaugggaguuguccucacccuuguuaaucucaagaaacucuuauuuauaauagguugc

SEQ ID NO: 339758 - RNA, 64 nt, Homo Sapiens
gaucuguuuggaaacaaccccuugagcugccaggcucaagaaaucauggacucacaggguccug

SEQ ID NO: 339759 - RNA, 64 nt, Homo Sapiens
caauggccuguguguuacaaugauaugaucauuucucaagaauaagucccuuuuuguauguguu

SEQ ID NO: 339760 - RNA, 64 nt, Homo Sapiens
ugucuucugugucacaaacagcacuccaggccagcucaagaagcaaagcaggccaauagaaaug

SEQ ID NO: 339761 - RNA, 64 nt, Homo Sapiens
gccuaugugugcuccauuccucauuucuacuuggcucaagaaaacauuucugcagucaggugag

SEQ ID NO: 339762 - RNA, 64 nt, Homo Sapiens
aaaggcagugaaaauggccagccagagaaaagaucucaagaaccagaaauaaauaaggauggug

SEQ ID NO: 339763 - RNA, 64 nt, Homo Sapiens
guaaagacauacucauuaaguguuauuuauuuuacucaagaacuggaaaccaacuaaaugccuu

SEQ ID NO: 339764 - RNA, 64 nt, Homo Sapiens
caguauguucccaggcuaguguugaacuccugagcucaagaaauccuccugccugagucucuga

SEQ ID NO: 339765 - RNA, 64 nt, Homo Sapiens
uagguuucugauuacauaaaauuugaauagaacacucaagaaguauguagauuuuugaaaaacc

SEQ ID NO: 339766 - RNA, 64 nt, Homo Sapiens
ugugaauguuccaacaccugccuccacuucuccccucaagaaauuuucaacgccaggaaucaug

SEQ ID NO: 339767 - RNA, 64 nt, Homo Sapiens
augaagagacuucugcuuuucaacccccacccuccucaagaaguaauaauuuguuuacuuguaa

SEQ ID NO: 339768 - RNA, 64 nt, Homo Sapiens
aaguuggaugcggccauucaaggggagccaaaaucucaagaaauucccagcagguuaccuggag

SEQ ID NO: 339769 - RNA, 64 nt, Homo Sapiens
ccuccccagacaucuggacacugggcauagauuucucaagaaggaagacuccccugccucccca

SEQ ID NO: 339770 - RNA, 64 nt, Homo Sapiens
cauugaaaaauucuaugaaugugaacuuuugcaucucaagaaaacauuugaaaacacugcaaca

SEQ ID NO: 339771 - RNA, 64 nt, Homo Sapiens
uggcucucauucuaagaggcgcucccagugaucacucaagaauccgugucuuucucuaggacaa

SEQ ID NO: 339772 - RNA, 64 nt, Homo Sapiens
uccuguuggauuuguuuaaaauaugagaaggugccucaagaauuuugcauucaucuuguguuuu

SEQ ID NO: 339773 - RNA, 64 nt, Homo Sapiens
guacagauguguggaauacgccuaagcgaucauacucaagaauaccugguucucaauuugacac

SEQ ID NO: 339774 - RNA, 64 nt, Homo Sapiens
auaauaaaagaccauaaauauugaaggaaaaggacucaagaaaaagaagugacuuauuaaacua

SEQ ID NO: 339775 - RNA, 64 nt, Homo Sapiens
cuauugauauuggucauguuaaacuuauaguagccucaagaaguuuuuugaaccuuauuucuca

SEQ ID NO: 339776 - RNA, 58 nt, Homo Sapiens; identical to SEQ ID NO: 339070

SEQ ID NO: 339777 - RNA, 64 nt, Homo Sapiens
gcuucagauccucuuguguauguugaaagucucccucaagaauauuuugugcucugaguuuugc

SEQ ID NO: 339778 - RNA, 64 nt, Homo Sapiens
caauaucauuuuaauguaauugauuguauauagucucaagaaugguuggugggcaugaguuccu

SEQ ID NO: 339779 - RNA, 64 nt, Homo Sapiens
aacuuuuguagcaaucuggucuauagacuuuuaacucaagaagcuaaggcuagacuuguuaccu

SEQ ID NO: 339780 - RNA, 64 nt, Homo Sapiens
gaaaugucucuccucuagguaucguauuuuguugcucaagaauccaaaaugggucuguggacau

SEQ ID NO: 339781 - RNA, 64 nt, Homo Sapiens
gcugcuuaguuuuuggacugaaaagauauuaaaacucaagaaggaccaagaaguuuucauaugu

SEQ ID NO: 339782 - RNA, 64 nt, Homo Sapiens
gaggaguaacaauacaaauggauuuugggagugacucaagaagugaagaaugcacaagaaugga

SEQ ID NO: 339783 - RNA, 64 nt, Homo Sapiens
caagacacagaacaaggucugucuccuauagucacucaagaagucgaucgagaaguuccacauc

SEQ ID NO: 339784 - RNA, 64 nt, Homo Sapiens
aauuaauuagacuuuuguauaagagaugucaugccucaagaaagccauaaaccugguaggaaca

SEQ ID NO: 339785 - RNA, 64 nt, Homo Sapiens
cucccugaagcagacugcugaggaauuacauuugcucaagaauuuuuuccgucaaauugugaac

SEQ ID NO: 339786 - RNA, 64 nt, Homo Sapiens
gccuuaauuauuuaucuuuaguuccuuauuaguucucaagaaacaaaugcuagcuucauaugua

SEQ ID NO: 339787 - RNA, 64 nt, Homo Sapiens
gugggucccuuccuuucuccuuuccucucuacugcucaagaacagauuugaggccaggugcggu

SEQ ID NO: 339788 - RNA, 64 nt, Homo Sapiens
uuauaagcaauguaauuaugcuauucacaggggccucaagaauugguauguaugaugugaucug

SEQ ID NO: 339789 - RNA, 64 nt, Homo Sapiens
auccuuauguagaaaggacuuugaaauuuuucuucucaagaaaugguuuguauaagaauaacaa

SEQ ID NO: 339790 - RNA, 64 nt, Homo Sapiens
augauacugacugauuaauuauuccugauaacaucucaagaaaaggagaaggaaaguguuucug

SEQ ID NO: 339791 - RNA, 64 nt, Homo Sapiens
cuauaaaauugucagcguauuuuuacacuauuggcucaagaauguuauaaugcuaagggacaua

SEQ ID NO: 339792 - RNA, 64 nt, Homo Sapiens
gaagaaaagauuaauaccuuaaaagaagaaaacacucaagaagcagcaguccugaaugguguuu

SEQ ID NO: 339793 - RNA, 64 nt, Homo Sapiens
aaaauuuuuuaaauaaguuucagagcaagacugucucaagaaaacugcacuccagccugggcca

SEQ ID NO: 339794 - RNA, 64 nt, Homo Sapiens
auaagagaaaugaacucacaugcuuagaaugguucucaagaauuuauauuuuauacaaauagau

SEQ ID NO: 339795 - RNA, 64 nt, Homo Sapiens
gaauuaacuacauaauggaaauggcaggcaggcacucaagaaauagauaagcaccuggcaucua

SEQ ID NO: 339796 - RNA, 64 nt, Homo Sapiens
cucuugagccaguaaucaauagagcagaacauuucucaagaauccguuucugugaauuucauga

SEQ ID NO: 339797 - RNA, 64 nt, Homo Sapiens
aaugguguuuuggaaauuuugccacgucauauaacucaagaauauuggagaauagaaaugaaaa

SEQ ID NO: 339798 - RNA, 64 nt, Homo Sapiens
gccagggccagggcuguaugacaaaccccacucccucaagaaggaucccugcugggcacacccc

SEQ ID NO: 339799 - RNA, 64 nt, Homo Sapiens
aacugaagaaggagcaaguggaaaaccaaauuuccucaagaaauugugcaggacaguaaauaau

SEQ ID NO: 339800 - RNA, 64 nt, Homo Sapiens
acugcaacacuacuuuaugggcuccaugcccaagcucaagaacgucagauguggucaguaggga

SEQ ID NO: 339801 - RNA, 64 nt, Homo Sapiens
gauugguacugcaacuguagugcauuuaaaacuccucaagaaagacaauuuaauugcucaacca

SEQ ID NO: 339802 - RNA, 64 nt, Homo Sapiens
agcauuaguaauuucuaguaaauuuuuuagguuacucaagaaccuucuaaauuugaguaaauac

SEQ ID NO: 339803 - RNA, 64 nt, Homo Sapiens
ugguacaaaacacaaccgaguacacaacguuuuccucaagaaaauaagggaacacacaaagaau

SEQ ID NO: 339804 - RNA, 64 nt, Homo Sapiens
gaugucuauugaguagaaccuaauaauggugaagcucaagaacaucuauaauggguuuggggga

SEQ ID NO: 339805 - RNA, 64 nt, Homo Sapiens
agggauuccuaauaauggcaucauguagcugacacucaagaaaucaggugaauuguggaaaaug

SEQ ID NO: 339806 - RNA, 64 nt, Homo Sapiens
uaggcucauggcaacgugugauauucacauggcgcucaagaagucuggcuuuccugcuauacac

SEQ ID NO: 339807 - RNA, 64 nt, Homo Sapiens
uguguuuucuuuagcuucccacuguccugccugccucaagaauaucuucaucaaguggaagcca

SEQ ID NO: 339808 - RNA, 64 nt, Homo Sapiens
uguaaauuugcucuguuuuaagacuuugaacuaccucaagaagaggaaucuaauacaauauuug

SEQ ID NO: 339809 - RNA, 64 nt, Homo Sapiens
cacaaguuuucacugaaugagcauggcagugccacucaagaaaaugaaucuccaaaguaucuuc

SEQ ID NO: 339810 - RNA, 64 nt, Homo Sapiens
cagugcuuagaaguaagcaauucccaggucauagcucaagaauuguuagcaaaugacagauuuc

SEQ ID NO: 339811 - RNA, 64 nt, Homo Sapiens
cuagugccaggucacuauuguaagauguuaaaaucucaagaaaauuucacagagcuaaagaaau

SEQ ID NO: 339812 - RNA, 64 nt, Homo Sapiens
agauaagaaaggacuacagcauuugauguguguccucaagaacuugucuugggucugaaaaagc

SEQ ID NO: 339813 - RNA, 64 nt, Homo Sapiens
cccuauggccuucuugucaaaaccuucacuggagcucaagaaaagcauuucuguuguguuauuu

SEQ ID NO: 339814 - RNA, 64 nt, Homo Sapiens
uugcuuaugggaauccugagcugcuuuucaccaucucaagaagccuaagaaguuauauauuuaa

SEQ ID NO: 339815 - RNA, 64 nt, Homo Sapiens
uuguagauaaaaguguuccaguaaucagaaaauccucaagaaaauugacuucauuauuuggaag

SEQ ID NO: 339816 - RNA, 64 nt, Homo Sapiens
ugcccauuaccuuuccucugccugaaagacgugucucaagaaaaauaaauucuauuuuagaugc

SEQ ID NO: 339817 - RNA, 64 nt, Homo Sapiens
agaauaaaauugaaaucugcgacaauguuuuugucucaagaacauaguauaucaucauaaaaua

SEQ ID NO: 339818 - RNA, 64 nt, Homo Sapiens
caaauacagcuuuuuuucaaauuuagacuucuuucucaagaaaugaauaaaaagguaaaacuac

SEQ ID NO: 339819 - RNA, 64 nt, Homo Sapiens
uuuacguaguuuuucauaggcugucuuccuguuucucaagaauaaaacgaacaagauuaauuac

SEQ ID NO: 339820 - RNA, 64 nt, Homo Sapiens
ggccccuuuuuccaacuuaucuuuuauccaugugcucaagaaagaucuuuagacuacaauaaua

SEQ ID NO: 339821 - RNA, 64 nt, Homo Sapiens
aucaagggacuccugugucaaguguacagaucuccucaagaaacagauauguauuugcuacuca

SEQ ID NO: 339822 - RNA, 64 nt, Homo Sapiens
uaaauaaccgauuauugauuacuguauuuuuuuucucaagaacagugauagguagaaacuaauu

SEQ ID NO: 339823 - RNA, 64 nt, Homo Sapiens
aaagucaucauugcuguuuagcuugacuguuuuccucaagaacaucgaucugaaggauucauaa

SEQ ID NO: 339824 - RNA, 64 nt, Homo Sapiens
agaugcucuguagagaauuugcuaccgaaguuggcucaagaauuuguuuuuaguguuauuuacc

SEQ ID NO: 339825 - RNA, 64 nt, Homo Sapiens
cuggcaaaggccuuccugcauuuaugaauucucucucaagaagcaagagaacaccugcaggaag

SEQ ID NO: 339826 - RNA, 64 nt, Homo Sapiens
augagaauuaagaauggacaggaccaagacagaacucaagaaagccacuggggaaaacucgaga

SEQ ID NO: 339827 - RNA, 64 nt, Homo Sapiens
aauauguucaacauuuacuucuauuugauaucugcucaagaagucauagaagucuugggaaacu

SEQ ID NO: 339828 - RNA, 64 nt, Homo Sapiens
ugccacguauguucaaggguauaaaaccacaagucucaagaauuaguaacauugucagaaauaa

SEQ ID NO: 339829 - RNA, 64 nt, Homo Sapiens
uagucagacugacacuacuagaguacgugaaaugcucaagaauguuucuucagguaacacuaca

SEQ ID NO: 339830 - RNA, 64 nt, Homo Sapiens
aaaucaucaccaauaccuuuuacucaccaccaagcucaagaaauaaacaaaacacaguccugca

SEQ ID NO: 339831 - RNA, 64 nt, Homo Sapiens
uuuaauauuuaaauaaaaucgccaaagguucacucucaagaagcagccaacucauuggguugua

SEQ ID NO: 339832 - RNA, 64 nt, Homo Sapiens
aauauccaauguuuaugaguccucacucuuauuccucaagaauuaauaucaccuagaaaaguag

SEQ ID NO: 339833 - RNA, 64 nt, Homo Sapiens
ccaggagguaauuuguugauuauuuucacuuuaacucaagaauuacaucagcauuguauacaca

SEQ ID NO: 339834 - RNA, 64 nt, Homo Sapiens
guguaccacuaaaaguaauaaaucaagacauuuucucaagaacuaucacaaauggcaauguaaa

SEQ ID NO: 339835 - RNA, 64 nt, Homo Sapiens
augggagcugcaaacgcgguauugguuuguuggccucaagaagacaagaagcaugcagagaaga

SEQ ID NO: 339836 - RNA, 64 nt, Homo Sapiens
cagcugcacaggccuugacuggcccccagcaagucucaagaacaggaaccaugccccuucccca

SEQ ID NO: 339837 - RNA, 64 nt, Homo Sapiens
uuuucaacgacagugauaguauaaaauaaacuaucucaagaaagaagaaauacaguuuguuugu

SEQ ID NO: 339838 - RNA, 64 nt, Homo Sapiens
uacaguggcuccccaaugccgaagucauugccugcucaagaaugccuuugagaaauccuuuugu

SEQ ID NO: 339839 - RNA, 64 nt, Homo Sapiens
ugauaccuggguugauguggagccaugggcugggcucaagaaccuacagaguguguucgcacuu

SEQ ID NO: 339840 - RNA, 64 nt, Homo Sapiens
gaaaacugccuaacugaagggaaugggggcccugcucaagaagggggccaggcagcuggaauca

SEQ ID NO: 339841 - RNA, 64 nt, Homo Sapiens
ugggguaugagcugccaagucuauuuuaaagacgcucaagaauccucugggguucaucuaggga

SEQ ID NO: 339842 - RNA, 64 nt, Homo Sapiens
ucauucagccaacccagaggauguagacccuguccucaagaagugcagggcgaguucugccgug

SEQ ID NO: 339843 - RNA, 64 nt, Homo Sapiens
gcuguggaacgagacuucugcagagguggcugaccucaagaagcagguacaggcccuucagccc

SEQ ID NO: 339844 - RNA, 64 nt, Homo Sapiens
agacuagauuauauuuaguaggggaaaaauugggcucaagaaccauucaucaguacgugagaca

SEQ ID NO: 339845 - RNA, 64 nt, Homo Sapiens
ugacuuguaagcaguucauagaagcugcucaauacucaagaaucuugcaagacaguuauuaaac

SEQ ID NO: 339846 - RNA, 64 nt, Homo Sapiens
gcgaaaggacagacuguuggacugcacauuucuccucaagaaaaaucuuguuuugaucauuucc

SEQ ID NO: 339847 - RNA, 64 nt, Homo Sapiens
acuccgaagucagucugcagcucuccccuccuggcucaagaauuucagcaauuugaacacuaac

SEQ ID NO: 339848 - RNA, 64 nt, Homo Sapiens
cacuucacguauucuuguauggugcccauuaccacucaagaagauucugagcaaauaacuacag

SEQ ID NO: 339849 - RNA, 64 nt, Homo Sapiens
gagaugcccuagugguggccuccagcagaaccagcucaagaaagaccgguagccuucaagcuug

SEQ ID NO: 339850 - RNA, 64 nt, Homo Sapiens
guaauuaugaagaguggagaggauuuggccuguccucaagaaugguuuuacuccgugccuuacu

SEQ ID NO: 339851 - RNA, 64 nt, Homo Sapiens
acuuuauucuuguaucucauauuagagguggaaccucaagaaugaacagcguccauuuuuucau

SEQ ID NO: 339852 - RNA, 64 nt, Homo Sapiens
agccagcaaguauucucagccucaggaguugcuucucaagaaaggcauugucuugcccuauaga

SEQ ID NO: 339853 - RNA, 64 nt, Homo Sapiens
gauuuggugugauaccuuguauaggaaugguuuucucaagaauauuuuaaacauuaaguuugaa

SEQ ID NO: 339854 - RNA, 64 nt, Homo Sapiens
uguuauguguguuugcugcguuaagggucuaagucucaagaaucugagugaugagcagacaugu

SEQ ID NO: 339855 - RNA, 64 nt, Homo Sapiens
acuggcuuuaaaagaagccaucuugcauuuauuucucaagaauuauauuuaaucuauuuaaucu

SEQ ID NO: 339856 - RNA, 64 nt, Homo Sapiens
augugcuaucuggcuuugaagcuauuuaaagugacucaagaagcagcccucaauauuugguaau

SEQ ID NO: 339857 - RNA, 64 nt, Homo Sapiens
aaagaaauauuguugcucaguguuguuaauauagcucaagaauugaguuuauauuugcaguaug

SEQ ID NO: 339858 - RNA, 64 nt, Homo Sapiens
ggacgagaagacucagccugagggccugcggagccucaagaagccagaccgcaagaagcgcuac

SEQ ID NO: 339859 - RNA, 64 nt, Homo Sapiens
uguggaacuuccucuuucauuggaaacuuucuuacucaagaaugacggcaguauuguuuucuua

SEQ ID NO: 339860 - RNA, 64 nt, Homo Sapiens
gacugucuucaucaaguauuucccuacagaacuccucaagaaaacagagaucauuuggcuagag

SEQ ID NO: 339861 - RNA, 64 nt, Homo Sapiens
ggacucugggccccuccccagcuccacucccuaccucaagaaugugaccauuuggaaaaggcaa

SEQ ID NO: 339862 - RNA, 64 nt, Homo Sapiens
gccauguugccaaggcugguuucaaacuccuggacucaagaaauccacccaccucagccuccca

SEQ ID NO: 339863 - RNA, 64 nt, Homo Sapiens
ugugacaguuccaggucuugaagcuaaucagcaucucaagaaaguauccagaaagaacaucugc

SEQ ID NO: 339864 - RNA, 64 nt, Homo Sapiens
auccuaagcucucaaaauagcauauucccuagagcucaagaaagcugguccaggagguugaaaa

SEQ ID NO: 339865 - RNA, 64 nt, Homo Sapiens
aaacgaacugggaaaauuucgacagaagucuugucucaagaagacguugugcuccagccugggc

SEQ ID NO: 339866 - RNA, 64 nt, Homo Sapiens
ugaagauuccaguggucagucagccuuggaacuccucaagaaccucccaugcccguucugaccu

SEQ ID NO: 339867 - RNA, 64 nt, Homo Sapiens
agaauccauuuagcaccuccuuacccaggcaauacucaagaagggagauugggaaacuuaaccg

SEQ ID NO: 339868 - RNA, 64 nt, Homo Sapiens
augcagcuguucugaacugguuuucauaaguucacucaagaaaauuuuugcuguuguaaaagug

SEQ ID NO: 339869 - RNA, 64 nt, Homo Sapiens
uuagaauuuaaguaccuuuuuaauucucaaauggcucaagaacauaugucuguuuaaaaauuac

SEQ ID NO: 339870 - RNA, 64 nt, Homo Sapiens
ccuaaaguuucaauacaagcccucagcaccacagcucaagaaaauguuagugucuucuuccugc

SEQ ID NO: 339871 - RNA, 64 nt, Homo Sapiens
cuacacccacgcacccccccacacacuaugcucucucaagaauguaauuuauuggggccccccc

SEQ ID NO: 339872 - RNA, 64 nt, Homo Sapiens
uuagaguccugccguggcucagguggaucuaaaacucaagaacaaauucuauuuauuuauuauu

SEQ ID NO: 339873 - RNA, 64 nt, Homo Sapiens
auauacuaucuaucucaccaguauuugcucucgacucaagaagguuaacauuuucugauucaug

SEQ ID NO: 339874 - RNA, 64 nt, Homo Sapiens
augacagcugucuguuguuuuaugaaguuuauuucucaagaaaaugggaauaaauuugggauuu

SEQ ID NO: 339875 - RNA, 64 nt, Homo Sapiens
ccacucuagcuugggcaauagagcaaggcuccgucucaagaaaagaaggucauuucccaagacu

SEQ ID NO: 339876 - RNA, 64 nt, Homo Sapiens
aguggaagcauguguguuucuaaaaaguaaaaaucucaagaaaacagaaauggcaugcuuuacc

SEQ ID NO: 339877 - RNA, 64 nt, Homo Sapiens
aauaaugcagagauaauuagacaugguucccgcccucaagaagcucacaaaaguauucaggaaa

SEQ ID NO: 339878 - RNA, 64 nt, Homo Sapiens
aaguucuuuuggaacuuguuucaagccaaaaacucucaagaaagcaaauugcaccucagcugga

SEQ ID NO: 339879 - RNA, 57 nt, Homo Sapiens; identical to SEQ ID NO: 339173

SEQ ID NO: 339880 - RNA, 64 nt, Homo Sapiens
cccuaaauuaucccauuauguaauucuuggucagcucaagaacuggguucuuuuucuaauaauu

SEQ ID NO: 339881 - RNA, 64 nt, Homo Sapiens
gagcuggaacaguaggggcagggagaagacaggucucaagaaaagguuuuuaagaaguuucauc

SEQ ID NO: 339882 - RNA, 64 nt, Homo Sapiens
cuuccucuacucucccgugcacugccggccagagcucaagaagcugcugcacgggcugggccuu

SEQ ID NO: 339883 - RNA, 64 nt, Homo Sapiens
gcauccucugaccuacuucaauaaugcuggaauacucaagaauuauuuuacucugaucaaauaa

SEQ ID NO: 339884 - RNA, 64 nt, Homo Sapiens
uguuaaccuccggggagagcacacaaaacccuaucucaagaacucgggaggaagcacugaaaca

SEQ ID NO: 339885 - RNA, 64 nt, Homo Sapiens
ccaugcgcuggcaguacaugucuugcuuuaugggcucaagaauguaaccacagggccugagaag

SEQ ID NO: 339886 - RNA, 64 nt, Homo Sapiens
aaaaaaaaguuuguuuuuucuaauacucuuuucucucaagaaaaucccugauauuauuucuauu

SEQ ID NO: 339887 - RNA, 64 nt, Homo Sapiens
guucauauuaauugaggauucaaauuucccauuucucaagaaauauggugggagggaauguuuu

SEQ ID NO: 339888 - RNA, 64 nt, Homo Sapiens
cagcccugcuucugacauaagaaacuuguccuuccucaagaacacauuuugaugauucugagaa

SEQ ID NO: 339889 - RNA, 64 nt, Homo Sapiens
aacagaaacgagauuugccagcuauaauguuucccucaagaacaaaaauaaccaaaaaauguga

SEQ ID NO: 339890 - RNA, 64 nt, Homo Sapiens
gccuguggaccgaggcccccuggucaacaaggaccucaagaacugucagccccaguuggcuucc

SEQ ID NO: 339891 - RNA, 64 nt, Homo Sapiens
augcagagguaacucucaggcagcuaagcagcaccucaagaaaacauguuaaauuaaugcuucu

SEQ ID NO: 339892 - RNA, 64 nt, Homo Sapiens
cugagaguagcugcugcuuucccugacuuccuuccucaagaauacagucuauucugggggguug

SEQ ID NO: 339893 - RNA, 64 nt, Homo Sapiens
agauuuuccucugacaccagagaacaauaguagucucaagaauggaaaccugaaugucugaggg

SEQ ID NO: 339894 - RNA, 64 nt, Homo Sapiens
aaaaacuucaguuacugaccagucaagagaauuucucaagaaaaaucccagcaacguucccucu

SEQ ID NO: 339895 - RNA, 64 nt, Homo Sapiens
ucaagcacaaagugaugaaugacugccuucaagucucaagaaaacacuuuucccuaacuuuuag

SEQ ID NO: 339896 - RNA, 64 nt, Homo Sapiens
auuugggugagcugcaccugauuaguugaaaggccucaagaacaaacacugcaguuuccuggaa

SEQ ID NO: 339897 - RNA, 64 nt, Homo Sapiens
caacuguggaguugguagcugguaacauuguugucucaagaacaacucaccucucucccuagga

SEQ ID NO: 339898 - RNA, 64 nt, Homo Sapiens
cagcccuaaaauucucuccauccgccacagaaggcucaagaaucacaacuaaaccuucuuaaua

SEQ ID NO: 339899 - RNA, 64 nt, Homo Sapiens
guacucgggcgacaccuuacgagccaauggcagucucaagaaauaacuaccucauaugcaggau

SEQ ID NO: 339900 - RNA, 64 nt, Homo Sapiens
gccugaaugacaauguccagagguucauucuuugcucaagaaagcuuuucugacauuccuagac

SEQ ID NO: 339901 - RNA, 64 nt, Homo Sapiens
aagguaccccaauauaucucaagaauucaacugucucaagaaucaauacaacaagaucaacuag

SEQ ID NO: 339902 - RNA, 64 nt, Homo Sapiens
ucuuaguucaguggaggaaaaugugcacucuggacucaagaaacauugaagggagaaaggcaag

SEQ ID NO: 339903 - RNA, 64 nt, Homo Sapiens
agaggggcauaaacuuuccugcagccagaggcaccucaagaagagucacugugagcucccaggu

SEQ ID NO: 339904 - RNA, 64 nt, Homo Sapiens
uauucuuucacccugucucuuuuuaucccuuccucucaagaaaaauucagaugaguuagaagcu

SEQ ID NO: 339905 - RNA, 64 nt, Homo Sapiens
aagugacauaauuuacaugcaauauguuuaucaacucaagaauuuaauauaguugguacacaac

SEQ ID NO: 339906 - RNA, 64 nt, Homo Sapiens
uggauacauuaggagcuucaaacacauauaauuucucaagaaauuuccagaugucucaugcugc

SEQ ID NO: 339907 - RNA, 64 nt, Homo Sapiens
uauuaaggaagaacaaggaagggaaugaucuuuacucaagaauuucagaaagucagcacugaag

SEQ ID NO: 339908 - RNA, 57 nt, Homo Sapiens; identical to SEQ ID NO: 339202

SEQ ID NO: 339909 - RNA, 64 nt, Homo Sapiens
agaaggcugcuaauuggauuuugguaguucuuaccucaagaaaacuugaauuauuugggggaaa

SEQ ID NO: 339910 - RNA, 64 nt, Homo Sapiens
uaagcuuaugaaggaaugccuccuuuguuacacacucaagaauuugucagcacacaauuaauug

SEQ ID NO: 339911 - RNA, 64 nt, Homo Sapiens
aauaauucagaaauuggguuuugguucagugauucucaagaaaaagaucucuugcccauuaaga

SEQ ID NO: 339912 - RNA, 64 nt, Homo Sapiens
uuuuuuucugaauaacauuuaggaaacaagcacacucaagaaagcacaaaauccaaggugcuac

SEQ ID NO: 339913 - RNA, 64 nt, Homo Sapiens
cuacuggaacuggaugaccuaaaaugguguuuuccucaagaagauaaagaaaacugaacugagg

SEQ ID NO: 339914 - RNA, 64 nt, Homo Sapiens
gcccagauguagaaauucaucaggcccucucucccucaagaaauauuuuccaucuccaaauagc

SEQ ID NO: 339915 - RNA, 64 nt, Homo Sapiens
aaacugugcuguuacaacucagaaaauaugucuucucaagaacagaaaguucauuucaucacuu

SEQ ID NO: 339916 - RNA, 64 nt, Homo Sapiens
ucaguuuauaauuggaagagucuucauacguuuucucaagaacucuggcucucucucugcugcc

SEQ ID NO: 339917 - RNA, 64 nt, Homo Sapiens
cagcucugcucugagcguccggagaccccaguuucucaagaauucuccucuauccgaggccauu

SEQ ID NO: 339918 - RNA, 64 nt, Homo Sapiens
augcuuuuugggaaacguugucaccuucuuucuccucaagaaagagguugaguccagaugcuuc

SEQ ID NO: 339919 - RNA, 64 nt, Homo Sapiens
uuccacagacagaugaggcaggagugauggggcacucaagaaaguucagaggaggcauaagcua

SEQ ID NO: 339920 - RNA, 64 nt, Homo Sapiens
uuggaucuuggcaugcacccaccuaacccacuuucucaagaacaagaaccuagaaugaauaucc

SEQ ID NO: 339921 - RNA, 64 nt, Homo Sapiens
acucccagaagaccaaacugccuuccccucagggcucaagaauguguacagucuguggggccgg

SEQ ID NO: 339922 - RNA, 64 nt, Homo Sapiens
uucuccuuuuguguuuuucccacuuuccaauguacucaagaaaauugaacaaauguaauggauc

SEQ ID NO: 339923 - RNA, 64 nt, Homo Sapiens
ccugacuaaggagcugcagcgauacaucgaagggcucaagaagcgccggagcaagaggcuguac

SEQ ID NO: 339924 - RNA, 64 nt, Homo Sapiens
gccccagagggcuuuguggaggacaggccuugcccucaagaacgucguaccugacgcugagccu

SEQ ID NO: 339925 - RNA, 64 nt, Homo Sapiens
uugagcuuuuuggaaggauaauucugauaaggcacucaagaaacguacaaccacagugcuuucu

SEQ ID NO: 339926 - RNA, 64 nt, Homo Sapiens
gagacccgccaccguggaggcagggggcaagaaacucaagaacgcaucaagagcaccagcccug

SEQ ID NO: 339927 - RNA, 54 nt, Homo Sapiens; identical to SEQ ID NO: 339221

SEQ ID NO: 339928 - RNA, 64 nt, Homo Sapiens
aaccucacgcaccucccauccuaaucauccaaugcucaagaaacaacuucuacuucugcccuug

SEQ ID NO: 339929 - RNA, 64 nt, Homo Sapiens
cacuuuucagagucaucuacaaaauuuuucuuuccucaagaaaagaguuccuuuugccuuauuc

SEQ ID NO: 339930 - RNA, 64 nt, Homo Sapiens
gucagcaacagaaaaugagagaaggaagccaagucucaagaacugcugacuuaggaucaugcug

SEQ ID NO: 339931 - RNA, 64 nt, Homo Sapiens
aaugucuggggacaggccuuaaaaggaggguggccucaagaaacagccccuggaucuuuggggu

SEQ ID NO: 339932 - RNA, 64 nt, Homo Sapiens
ggccucauuccagggcacagguuuuuauaugagacucaagaacacucaugccuaacaguggucu

SEQ ID NO: 339933 - RNA, 64 nt, Homo Sapiens
ccuuuguuuugcacugacaacuucacugccaugccucaagaacaagaggaggagggauucuggu

SEQ ID NO: 339934 - RNA, 64 nt, Homo Sapiens
ucccagucugguaggagagagauacauucccgcccucaagaauccugggaaugcugggaaauga

SEQ ID NO: 339935 - RNA, 64 nt, Homo Sapiens
caugugcagucacugguguccggaggaaaagcagcucaagaacacaggagacaugagucuuugc

SEQ ID NO: 339936 - RNA, 64 nt, Homo Sapiens
uaagucuuagugcacaguauuuauuuagcaucagcucaagaaacauauuccuauugaucucauu

SEQ ID NO: 339937 - RNA, 64 nt, Homo Sapiens
uggaagaggcagcaggacuuuaggggaaaaguuucucaagaaggccauaaugagauaaugcaug

SEQ ID NO: 339938 - RNA, 64 nt, Homo Sapiens
cauuuauggcaugauuagauugcaaagcaaugaacucaagaaggaauugaaauaaggagggaca

SEQ ID NO: 339939 - RNA, 64 nt, Homo Sapiens
cuaguuuggauaucuuuaggguuuagaaucuaaccucaagaauaagaaauacaaguacaaauug

SEQ ID NO: 339940 - RNA, 64 nt, Homo Sapiens
acccaucuuuuuucuucccucauuuucugggauucucaagaaagaaaaaguaacccauuaucac

SEQ ID NO: 339941 - RNA, 64 nt, Homo Sapiens
cccuuuuggacuaauguuacuguccaaguucuuucucaagaaaccacaucugguucagaagagu

SEQ ID NO: 339942 - RNA, 64 nt, Homo Sapiens
uuuuuaaauuuuuuuauaggcccauaugcucuaucucaagaaacaagaugauuguaacaugucc

SEQ ID NO: 339943 - RNA, 64 nt, Homo Sapiens
uaacuuuccuuuauuucacuuguacccaguuucacucaagaaaucuugaugaauauuuauguug

SEQ ID NO: 339944 - RNA, 64 nt, Homo Sapiens
agacccucucuauagccaugagacuccuuguggccucaagaaauuuagacgcccacgacagcac

SEQ ID NO: 339945 - RNA, 64 nt, Homo Sapiens
cagccgcacccgugugcacuguaacuuuugugugcucaagaaauuauacagaaaccuacagcug

SEQ ID NO: 339946 - RNA, 64 nt, Homo Sapiens
aaucaguaaauaccuugaaaccuugcaggagugacucaagaauuccacuccuggagaaagacuu

SEQ ID NO: 339947 - RNA, 51 nt, Homo Sapiens; identical to SEQ ID NO: 339241

SEQ ID NO: 339948 - RNA, 64 nt, Homo Sapiens
uagaccuagaaauaccauuucacccaucugauuccucaagaaucauuuccuucauaaagaaugc

SEQ ID NO: 339949 - RNA, 64 nt, Homo Sapiens
ugccacauuucaauuacauaaaauguauugaauacucaagaaaauuaggaaaaaaaaauccaag

SEQ ID NO: 339950 - RNA, 64 nt, Homo Sapiens
cucuagagaagaaaagugaaagccauuauuuuaacucaagaaaaaucucauaugaucuucuuca

SEQ ID NO: 339951 - RNA, 64 nt, Homo Sapiens
cagcuuggagccucuagguuggacuuaagcuagacucaagaaaggcacuccacugcagcaggag

SEQ ID NO: 339952 - RNA, 64 nt, Homo Sapiens
ugccuccuuauuuaucaacauccucguccccugccucaagaaauuuaaaaauaguaagccuccc

SEQ ID NO: 339953 - RNA, 64 nt, Homo Sapiens
agcaugagcuggccacacauauggacagccccugcucaagaaaagcaugguaugagcacagguc

SEQ ID NO: 339954 - RNA, 64 nt, Homo Sapiens
gauaauucauuauaucaucaacuguauauacuuccucaagaacuuuuuugaaaaauagucacca

SEQ ID NO: 339955 - RNA, 64 nt, Homo Sapiens
cccucauuuuuauaaccuggaacuauaaguaauucucaagaaaggcucugccauucaacucgga

SEQ ID NO: 339956 - RNA, 64 nt, Homo Sapiens
gguaccuacuacaugcuguaacacuugaaugugccucaagaaaaacuuuuuacuguuugccaaa

SEQ ID NO: 339957 - RNA, 64 nt, Homo Sapiens
ccuuacagguaaguauugcuuuucucuaauaauccucaagaaauguucuauacuggauccuuuc

SEQ ID NO: 339958 - RNA, 64 nt, Homo Sapiens
cugcugggaguccccugaguuucuagauacagggcucaagaaguguacuggagagaugggaucc

SEQ ID NO: 339959 - RNA, 64 nt, Homo Sapiens
aucaggguccucagugcagagcaacuuacgcauccucaagaauccacugcuuuucaggcaagga

SEQ ID NO: 339960 - RNA, 64 nt, Homo Sapiens
cccacgugggcaauaccagggacccauggggaaacucaagaaugacagcuucuauauuuuguaa

SEQ ID NO: 339961 - RNA, 64 nt, Homo Sapiens
ccacuaagaaggccugucuacacugcaggggaaccucaagaacuuuucauugcacuucuaaaau

SEQ ID NO: 339962 - RNA, 64 nt, Homo Sapiens
caaaaggaagagccuuuuaaaaacauuugccaaccucaagaauaaauacugaaagucuugaaag

SEQ ID NO: 339963 - RNA, 64 nt, Homo Sapiens
uuaggauucugacuaagaggcaaaagagaaaagacucaagaaacugauccuggagaucgagacc

SEQ ID NO: 339964 - RNA, 64 nt, Homo Sapiens
auacucucccagauuuuuacgugggauuuggggccucaagaaaugggagccaggaguaagacaa

SEQ ID NO: 339965 - RNA, 64 nt, Homo Sapiens
uuggauguuuucauuggccucugaagaaguuauucucaagaaaauuuuguuuuaacaaaauuag

SEQ ID NO: 339966 - RNA, 64 nt, Homo Sapiens
guuauaugacaucauccugaagaacuucgagaagcucaagaagcccaggggagaaacaaaggga

SEQ ID NO: 339967 - RNA, 64 nt, Homo Sapiens
aaagauuacauacauuugagaauaagaaauuacucucaagaacuucagaaaucugcaacauaau

SEQ ID NO: 339968 - RNA, 64 nt, Homo Sapiens
gauauuucccauaaaugggaaguuugcccauugucucaagaaauguguauuucagugacaauuu

SEQ ID NO: 339969 - RNA, 64 nt, Homo Sapiens
uaacauuuugggaaguaacugccucugacuucaacucaagaaaacacuuuuuuguugcuaaugu

SEQ ID NO: 339970 - RNA, 64 nt, Homo Sapiens
aaagaagacugacuggguggaggcucugccuugccucaagaaccauccccugcagagcauccag

SEQ ID NO: 339971 - RNA, 64 nt, Homo Sapiens
guaggccuugcaucucgccaccuccacuucuguccucaagaacaaguccuaggucaagggaaac

SEQ ID NO: 339972 - RNA, 64 nt, Homo Sapiens
agaaauaaauaagggugguggccagaggaaaugucucaagaaccaaaggaagugaaaauagcca

SEQ ID NO: 339973 - RNA, 64 nt, Homo Sapiens
cccuggaauaucccugagaagcuacgcacucagccucaagaacugaauuagugcuggauuugaa

SEQ ID NO: 339974 - RNA, 64 nt, Homo Sapiens
cugcuucuugcuuugcagagccucaggaauugcccucaagaacugauggcccugggaaucaauu

SEQ ID NO: 339975 - RNA, 64 nt, Homo Sapiens
cagggaacaauacuguaaacuuacuugagguugccucaagaacuaaaucuuagaguucauaaau

SEQ ID NO: 339976 - RNA, 64 nt, Homo Sapiens
auaugggagcccaugaggagaaggguggcugcgacucaagaauaaaugaagaauggaaauggaa

SEQ ID NO: 339977 - RNA, 64 nt, Homo Sapiens
gaaggagauaaacaugaccaucgucaaagaccugcucaagaaauuuuuaaaaaagaaacaaagu

SEQ ID NO: 339978 - RNA, 64 nt, Homo Sapiens
aauuucuuauuugcuagggaacugguaaucuaggcucaagaaguguguggagaagguuuauuuu

SEQ ID NO: 339979 - RNA, 64 nt, Homo Sapiens
gcaucaguguggacuccuagaacgugcgaccugccucaagaaaaugcaguuuucaaaaacagac

SEQ ID NO: 339980 - RNA, 64 nt, Homo Sapiens
uccuccucaggacauggagaucugugcagaugagcucaagaagguccuuaacacagucgugaac

SEQ ID NO: 339981 - RNA, 64 nt, Homo Sapiens
aguacaccuguagauauuacuguacuuuuauguucucaagaaauaaguuguugccuauucagug

SEQ ID NO: 339982 - RNA, 64 nt, Homo Sapiens
uacugauucauacauuaucucacuugugccaacacucaagaagcaggcuacacugacacuggua

SEQ ID NO: 339983 - RNA, 56 nt, Homo Sapiens; identical to SEQ ID NO: 339277

SEQ ID NO: 339984 - RNA, 64 nt, Homo Sapiens
auucacaguugagugcauccaaggaaaggaagaccucaagaaaaggcuccacuucauccagaug

SEQ ID NO: 339985 - RNA, 64 nt, Homo Sapiens
uuuuaaaaacgaaacaaaguucaucaaagagcugcucaagaaaugaaggagauaaacaccacca

SEQ ID NO: 339986 - RNA, 64 nt, Homo Sapiens
uaugucaagaugagcugaauguucggaauacuggcucaagaaccaggaacuuuauaaugaaacg

SEQ ID NO: 339987 - RNA, 64 nt, Homo Sapiens
gggcuuccaaugcugugagacuggccuugcagagcucaagaagggaugugagcugcuaaauuga

SEQ ID NO: 339988 - RNA, 64 nt, Homo Sapiens
gcccggaagcgccaggcuggauucccaugguggccucaagaaaggccccucucucacacaucac

SEQ ID NO: 339989 - RNA, 64 nt, Homo Sapiens
guguucuuagugauucacauccacgggacaaaaacucaagaagaaauaagagcugacgccacac

SEQ ID NO: 339990 - RNA, 64 nt, Homo Sapiens
agagggagugugcgaaucuacccugaccaaugggcucaagaauaaaguaugauuuuugagucag

SEQ ID NO: 339991 - RNA, 64 nt, Homo Sapiens
auugagggcuaaaucccaagugucucuugacuggcucaagaauuagggccccaacuacacaccc

SEQ ID NO: 339992 - RNA, 64 nt, Homo Sapiens
accuacuuguggcgaucugaguacucuacucuugcucaagaaguaauacgacaaucagaauaca

SEQ ID NO: 339993 - RNA, 64 nt, Homo Sapiens
aaauaugaauugagggcccgaccugaccaagcggcucaagaauaagagggagugugcgaaucaa

SEQ ID NO: 339994 - RNA, 64 nt, Homo Sapiens
uagaagauguguaaacaggucugugucuggcguucucaagaaucuacaaauuuggccuuaagaa

SEQ ID NO: 339995 - RNA, 64 nt, Homo Sapiens
ggauuagcucugauuuugaguauacuuacgcuuccucaagaagagaugaaugcccgcagugagc

SEQ ID NO: 339996 - RNA, 64 nt, Homo Sapiens
gucuuaacuaggaaacuaaaccagugaauccauucucaagaaaaacuacaaaauuaugucugca

SEQ ID NO: 339997 - RNA, 64 nt, Homo Sapiens
gcgaaagucaaauauggagaguggggguaggaaucucaagaauuggaacacaggcaaauuauuu

SEQ ID NO: 339998 - RNA, 64 nt, Homo Sapiens
ccucaccaagcucauuacaucugccagggccugccucaagaagcccagcccagccuuuuccugg

SEQ ID NO: 339999 - RNA, 64 nt, Homo Sapiens
agugguauauuuauguaagaaaaugacuguaaaucucaagaaaaaucucagcagcuaauagcaa

SEQ ID NO: 340000 - RNA, 64 nt, Homo Sapiens
uguaaccauuuguuaacuguacugaagguguguccucaagaagaaaguguucaaauuaaaaaag

SEQ ID NO: 340001 - RNA, 64 nt, Homo Sapiens
ucucuaccaaaaguuaaaaaaaaaaaaaaaaaagcucaagaaccugcacgagggccuaaaacag

SEQ ID NO: 340002 - RNA, 64 nt, Homo Sapiens
cuucucuguuuaguaguugguuggggaaguggggcucaagaaggauuuugggguucaccagaug

SEQ ID NO: 340003 - RNA, 64 nt, Homo Sapiens
gaaaaggggcuggaaaggggggaauggcccacaucucaagaagcaagauauuguuugugguggu

SEQ ID NO: 340004 - RNA, 64 nt, Homo Sapiens
gaacagcauggauuccguggauagcuguugcagucucaagaagacugagagcuuccaaaaugcc

SEQ ID NO: 340005 - RNA, 64 nt, Homo Sapiens
acaccaacauuuugcugccuaccuuguuauccuucucaagaagcugaaguguacgcccucuccc

SEQ ID NO: 340006 - RNA, 64 nt, Homo Sapiens
ugugcccuuccccgccugcggaugccaccaagcccucaagaaguguauauaccaccuaggagga

SEQ ID NO: 340007 - RNA, 64 nt, Homo Sapiens
cccgaacgaauguucggaugguccaguggugccucucaagaaacgccacgugucccagcccagc

SEQ ID NO: 340008 - RNA, 64 nt, Homo Sapiens
ugcugagauuucucuggaaaaaauaacaggcagccucaagaaugguacaucauuauuaauauaa

SEQ ID NO: 340009 - RNA, 64 nt, Homo Sapiens
gggcucccugggaucuccagauacgauacucuuucucaagaaggcccugaagcuggauucuuuc

SEQ ID NO: 340010 - RNA, 64 nt, Homo Sapiens
gaagcgugaaccccagggaaaaggaggacacaaccucaagaaagcaggccugcagggugugggg

SEQ ID NO: 340011 - RNA, 64 nt, Homo Sapiens
acgggcugcucuacugcuucaccaugacgcacugcucaagaacuguuugacacaaacucacaca

SEQ ID NO: 340012 - RNA, 64 nt, Homo Sapiens
acgggcugcucuacugcuucacgaugacgcacugcucaagaacuguuugacacaaaaucgcaca

SEQ ID NO: 340013 - RNA, 64 nt, Homo Sapiens
acgggcugcucuacugcuucaccaugacgcacugcucaagaacuguuugacacaaacucgcaca

SEQ ID NO: 340014 - RNA, 57 nt, Homo Sapiens; identical to SEQ ID NO: 339308

SEQ ID NO: 340015 - RNA, 64 nt, Homo Sapiens
uuacuuuucuauguugcucaaaaugauuguauaacucaagaagauugugagugcuuuggaauuu

SEQ ID NO: 340016 - RNA, 64 nt, Homo Sapiens
uccagacgaugcauuucuuggccaaaguggcuuccucaagaaagcagcacuuaccuuugaaaaa

SEQ ID NO: 340017 - RNA, 64 nt, Homo Sapiens
caaauggcuucacaguccuuacuucucuaccugccucaagaaggggcucagagcagagacuugu

SEQ ID NO: 340018 - RNA, 64 nt, Homo Sapiens
gggauuaguuggggguauuagaagacuucauuuucucaagaaaugcaaacauucuuccuaaaag

SEQ ID NO: 340019 - RNA, 64 nt, Homo Sapiens
caauauucguuaauguucaguuuagcucuaauagcucaagaacaauaacuuuaaaaauaauacu

SEQ ID NO: 340020 - RNA, 64 nt, Homo Sapiens
auuauucauucuaucucagaucuacacuaguaaucucaagaaaggagggcacugaagaccugaa

SEQ ID NO: 340021 - RNA, 64 nt, Homo Sapiens
caugacgagcucuagcuggaugggcgcagagaaccucaagaaggcaugaagccagccccugcag

SEQ ID NO: 340022 - RNA, 64 nt, Homo Sapiens
gcgcuccagccuggucgacagagugagacuccaucucaagaaaaaauaaaaauaaaguuguucu

SEQ ID NO: 340023 - RNA, 64 nt, Homo Sapiens
gcuuugggaggcugaggcaggaggaucacucgagcucaagaauucaagaccugggcaagagaga

SEQ ID NO: 340024 - RNA, 64 nt, Homo Sapiens
gcacuccagccugggcgacagagcaagacucugucucaagaagaaaaaaaaaauacauauacac

SEQ ID NO: 340025 - RNA, 64 nt, Homo Sapiens
auuuauaugcaugaaguuaaaacaacugacguuacucaagaauuagaaaacuuugcaagauuug

SEQ ID NO: 340026 - RNA, 64 nt, Homo Sapiens
aaaagaaaaagagacaaauucagcgagacccugucucaagaaaggcacuucagccugggcgaca

SEQ ID NO: 340027 - RNA, 64 nt, Homo Sapiens
gggcacugcccggcccggcucccuugcccccaagcucaagaaggcuucuccagcgcugggcccu

SEQ ID NO: 340028 - RNA, 64 nt, Homo Sapiens
agacugugcagagggcauugacacccaccgcaaccucaagaacccgaccuacgccacuggaaac

SEQ ID NO: 340029 - RNA, 64 nt, Homo Sapiens
aauaaaagugggaaaaucuugaaugagacacugucucaagaaaagcauuccagccugugcgaca

SEQ ID NO: 340030 - RNA, 64 nt, Homo Sapiens
ccccagugccuuguaugaagcuacccucugcacccucaagaaacacaggaccccccaagucuuc

SEQ ID NO: 340031 - RNA, 64 nt, Homo Sapiens
aacccaccauaaccagcccaccuuguucuuaucccucaagaagacuuccuucauuaacaaagac

SEQ ID NO: 340032 - RNA, 64 nt, Homo Sapiens
ucugaagaagguaguaauauccucaugcauuuuccucaagaaugcauguaccuauugacuguau

SEQ ID NO: 340033 - RNA, 64 nt, Homo Sapiens
ccgccgggcuacgaugacauguaccugugaaggccucaagaauguaacaucccaggcuucccuc

SEQ ID NO: 340034 - RNA, 62 nt, Homo Sapiens
gcacuccagcccgggcaacagaguaagacccugccucaagaaaaaaaaaaaaaaaaaaaauc

SEQ ID NO: 340035 - RNA, 64 nt, Homo Sapiens
uggccaggugccggcacagugccucucccagagccucaagaagggccauuuaggagcuugcuuc

SEQ ID NO: 340036 - RNA, 64 nt, Homo Sapiens
gcaccgugccugacucauccaguggggaaggugacucaagaaguuguuuaagccuaggccuagg

SEQ ID NO: 340037 - RNA, 64 nt, Homo Sapiens
aaaagcuguugcuggaaacuugcuuuaggaacagcucaagaaccuuggaguucauauuucacaa

SEQ ID NO: 340038 - RNA, 64 nt, Homo Sapiens
uucaugagggucucuuacuagccugcggguuugccucaagaaacgagagaagaggaguggauga

SEQ ID NO: 340039 - RNA, 64 nt, Homo Sapiens
aaagaucucgcuggugcguaguggaaggaaaugucucaagaaacucucuauggcgcuuccuuga

SEQ ID NO: 340040 - RNA, 52 nt, Homo Sapiens; identical to SEQ ID NO: 339334

SEQ ID NO: 340041 - RNA, 64 nt, Homo Sapiens
agggccuugugcgugggccucuuccccccucgcccucaagaacagaaaaucuugcuuuuauggu

SEQ ID NO: 340042 - RNA, 64 nt, Homo Sapiens
acuuguuuauuuucuaguagcuuuuauaaguacacucaagaauuugucagggagaauaauucug

SEQ ID NO: 340043 - RNA, 64 nt, Homo Sapiens
gauccagguuuacuuucuaucagcugagcaaccucucaagaaaaaauaaauaaauaaauaaacc

SEQ ID NO: 340044 - RNA, 64 nt, Homo Sapiens
auguguucuguauaaacaaaugcagcuggaaucgcucaagaaucuuauuuuucuaaauccaaca

SEQ ID NO: 340045 - RNA, 64 nt, Homo Sapiens
gguccugaagacuccggccaagaggcacaagcagcucaagaacaagcuggagaagaacgaggag

SEQ ID NO: 340046 - RNA, 64 nt, Homo Sapiens
auacuuuccuguauaguucacguuucauguaauccucaagaaauaaaaggaagccaaagagugu

SEQ ID NO: 340047 - RNA, 64 nt, Homo Sapiens
accugauguuuucuuauucuuauuuguaguaguacucaagaaucuuuacuguaggugaaggcug

SEQ ID NO: 340048 - RNA, 64 nt, Homo Sapiens
gccauaaaaucucacgcugcaguguuucugaagucucaagaacuggggauuuggcuggugccga

SEQ ID NO: 340049 - RNA, 64 nt, Homo Sapiens
agcacagcugauguaaaauuauagaucccagacacucaagaauuaggucgggacauauauuuac

SEQ ID NO: 340050 - RNA, 64 nt, Homo Sapiens
gauguccauuucggggagaggagcaggugggacccucaagaaaaugacggagaacaucccagac

SEQ ID NO: 340051 - RNA, 64 nt, Homo Sapiens
uuuuuuuaagagacagauuuuuuauauuuuuccccucaagaacuggcuuuugaaacuuagguau

SEQ ID NO: 340052 - RNA, 64 nt, Homo Sapiens
aaaagaaggacugaacuccagucuugcccagcagcucaagaagauccucccagcggccuccggc

SEQ ID NO: 340053 - RNA, 64 nt, Homo Sapiens
guuucuucuggauuccuuauuguacuuggcuuaacucaagaacacuuucucgaaauugccagug

SEQ ID NO: 340054 - RNA, 64 nt, Homo Sapiens
gcagguaugugggccagaggcacagacuaccccacucaagaacaccuuucuacaaagcaaggcc

SEQ ID NO: 340055 - RNA, 64 nt, Homo Sapiens
ggaggcucccuguacuggagucgucccacuauuccucaagaaaucuuagaaccagcuugugagg

SEQ ID NO: 340056 - RNA, 64 nt, Homo Sapiens
ugaucuguacaaguauguggagcaugaaugcugacucaagaaacuuuuacuccuucugcucaag

SEQ ID NO: 340057 - RNA, 64 nt, Homo Sapiens
ugugagcgaauuagcaauaacauacaugagauaacucaagaaaucaaaagauaguugauucuug

SEQ ID NO: 340058 - RNA, 64 nt, Homo Sapiens
caaagaaacacuugugcaguuauacacagcacuacucaagaagcuuauaaaaauguauaggcag

SEQ ID NO: 340059 - RNA, 64 nt, Homo Sapiens
uaaacauuuguuucuguguguguuguucugcuuccucaagaaaucucaccccucucugaagggc

SEQ ID NO: 340060 - RNA, 64 nt, Homo Sapiens
aaaaaaaaaaaaaagaaugugagugagacucugucucaagaagggcacuccagccugggugaca

SEQ ID NO: 340061 - RNA, 64 nt, Homo Sapiens
accgccuuccccacccccugguugcuaaguggggcucaagaagcugccagaggaugagugacca

SEQ ID NO: 340062 - RNA, 64 nt, Homo Sapiens
ucaaauucaggacauaaacuaagcaccacagcuacucaagaagaucugucacaaauguuccuga

SEQ ID NO: 340063 - RNA, 64 nt, Homo Sapiens
gaagcagauucauacagccuaagaaucuuaaaaucucaagaagugucaaucugaaagauuuuuc

SEQ ID NO: 340064 - RNA, 64 nt, Homo Sapiens
agcauuucuuuaaaauguuucuuuuuaaagcagucucaagaauaagugaugcagacuuguucuu

SEQ ID NO: 340065 - RNA, 64 nt, Homo Sapiens
gacagaagagacagugauuugaaaaagaaaccuacucaagaaaagagaacacaagaacuuaaga

SEQ ID NO: 340066 - RNA, 64 nt, Homo Sapiens
guggaggacccuggaaggacccuuuucucuggaucucaagaauggaaugacaaacacaagugcc

SEQ ID NO: 340067 - RNA, 64 nt, Homo Sapiens
auguucguauuagagacaaacuuuuuaguuauuucucaagaagcuucuugcacuaucacaauug

SEQ ID NO: 340068 - RNA, 64 nt, Homo Sapiens
cugguacaccuguaccagcucuuuguaaagcaaacucaagaaaaaaaaccuucgucucuuugug

SEQ ID NO: 340069 - RNA, 64 nt, Homo Sapiens
uaaaagauacuuaauucuugcaugagauaaagaccucaagaaguaaagaauuagcaguaaaaua

SEQ ID NO: 340070 - RNA, 64 nt, Homo Sapiens
caaaagauaguugauucuugcauacaugagauaacucaagaaauugugagcgaauuagcaauaa

SEQ ID NO: 340071 - RNA, 64 nt, Homo Sapiens
aagcaagcugccuuuguacuuucccccccugcaucucaagaauacagacagacugcaccacccc

SEQ ID NO: 340072 - RNA, 64 nt, Homo Sapiens
acacagaagcacacaucccuagaaauauuuaaagcucaagaagauauuuuagguauuaagacug

SEQ ID NO: 340073 - RNA, 64 nt, Homo Sapiens
gucuaacgagagacaucaguuucucaggaugauccucaagaacguuauggaguccauguugcaa

SEQ ID NO: 340074 - RNA, 64 nt, Homo Sapiens
ugcucugaaaaauuccuuuuaaguccuucuguuacucaagaaaaccaagagcgucagguggcaa

SEQ ID NO: 340075 - RNA, 65 nt, Homo Sapiens
aggugugauuugugcaagccagguucaacccuugccucaagaaaucagaugggaccaauuuagug

SEQ ID NO: 340076 - RNA, 65 nt, Homo Sapiens
gggaagauggcuggugaggagcuuaacagaggaaccucaagaagauucugaaaauccuaccccca

SEQ ID NO: 340077 - RNA, 65 nt, Homo Sapiens
gggcaauacugaagggguuaaacagguuuuugcuccucaagaauuuguuugccugggcccaggau

SEQ ID NO: 340078 - RNA, 65 nt, Homo Sapiens
ugauaacacuuaccaaaagaucacugcaaaccugccucaagaagcugaugguggcacuucaauuu

SEQ ID NO: 340079 - RNA, 65 nt, Homo Sapiens
ggaaguccuuuuuuuuuuuuuuuuuuuuuuaauugcucaagaaaugauucucucacaggcuuggg

SEQ ID NO: 340080 - RNA, 65 nt, Homo Sapiens
ugacugaugacaucugacuuuugucgaugggacuucucaagaagccauuccuuggagcuucuguu

SEQ ID NO: 340081 - RNA, 65 nt, Homo Sapiens
gcauacugccaugaagacggucucuguguccucagcucaagaauccuguagcuugucccaucaua

SEQ ID NO: 340082 - RNA, 58 nt, Homo Sapiens; identical to SEQ ID NO: 339023

SEQ ID NO: 340083 - RNA, 65 nt, Homo Sapiens
ggauuccuccaugguaaagcugaacugaaacaauucucaagaaugcaucagcuguaccuacaaua

SEQ ID NO: 340084 - RNA, 65 nt, Homo Sapiens
ucaaucugaagauguaagacuuccugaaacaaguucucaagaagucuuuacauuauauuuauaac

SEQ ID NO: 340085 - RNA, 65 nt, Homo Sapiens
uuuugaauauuggggaaggaagaugauacuucuuucucaagaaaagaaaauuggauuauuaggaa

SEQ ID NO: 340086 - RNA, 65 nt, Homo Sapiens
augucauaagcgaucacuuccuauaugcacuuauucucaagaagaacaucuuuaugguaaagaug

SEQ ID NO: 340087 - RNA, 65 nt, Homo Sapiens
gugugaaugcugaacugaaggcucagauugaggagcucaagaacgagaagcagcauuugauauac

SEQ ID NO: 340088 - RNA, 65 nt, Homo Sapiens
auuuguauuucaccaccuaaauguaauguugauuccucaagaaugaaaugaaggcacuacauuga

SEQ ID NO: 340089 - RNA, 65 nt, Homo Sapiens
acuuaugaguaagcagucugcgucgcugacaaguucucaagaagacuucaagacaaaacagauug

SEQ ID NO: 340090 - RNA, 65 nt, Homo Sapiens
aguuagcaaaccacuccuuuuagagggauccacuacucaagaaaauuuccacgugagguuuuguu

SEQ ID NO: 340091 - RNA, 65 nt, Homo Sapiens
uauucaccaguuccucugcacagagaagaagaaggcucaagaauuucaccaaaagcuugauauga

SEQ ID NO: 340092 - RNA, 65 nt, Homo Sapiens
agcugagugaacagcaugaugacauguggagucaacucaagaaaaugauccacuggucacaggua

SEQ ID NO: 340093 - RNA, 65 nt, Homo Sapiens
cagcucagcuucuccuucgaaccacguccccagaucucaagaacggccuugugaccacaucuccc

SEQ ID NO: 340094 - RNA, 65 nt, Homo Sapiens
cauggagacuccugcccuguccugcaaacucacugcucaagaagagagaagagggccugugggag

SEQ ID NO: 340095 - RNA, 65 nt, Homo Sapiens
auuuuucuaaaaauaugaguaagaaaaaaaauaaacucaagaauggaaugagauccugucucuua

SEQ ID NO: 340096 - RNA, 65 nt, Homo Sapiens
gagcuuuguauguguccuuuauugcauaagcacagcucaagaacuagcuuacugaucacuauagu

SEQ ID NO: 340097 - RNA, 65 nt, Homo Sapiens
caugccagcucagcccuacaugagagcccugagcccucaagaacucagcagugggcuacauacaa

SEQ ID NO: 340098 - RNA, 65 nt, Homo Sapiens
aguuccaaaccuagcagaaucaauuaaaggguugacucaagaacuuuauugacaauggcagagaa

SEQ ID NO: 340099 - RNA, 65 nt, Homo Sapiens
agaggccuccucuggagugaccaucuccuucccuccucaagaagccugagggcauccgacaaggc

SEQ ID NO: 340100 - RNA, 65 nt, Homo Sapiens
uccuuaaaaacuuugaaguuuauuguguuaaguuccucaagaaucuuuguauggcaguauguaua

SEQ ID NO: 340101 - RNA, 65 nt, Homo Sapiens
caggggcauccagggcucccggggaccaagacauccucaagaaaacugggauuuaaggacuucug

SEQ ID NO: 340102 - RNA, 65 nt, Homo Sapiens
ugaugggccugaacucggacagccucaaaaacgcccucaagaacaucaagucccccagcagaacc

SEQ ID NO: 340103 - RNA, 51 nt, Homo Sapiens; identical to SEQ ID NO: 339044

SEQ ID NO: 340104 - RNA, 65 nt, Homo Sapiens
ccagagucaccugucucauccagggcacggcgccccucaagaacuuuccugcucacauccacagu

SEQ ID NO: 340105 - RNA, 65 nt, Homo Sapiens
ugggcuguaacaauucagggucauaccacguuuugcucaagaagcacgaaggcccucucuuccuc

SEQ ID NO: 340106 - RNA, 65 nt, Homo Sapiens
agugcuuuuucuccauggauuuaauuugcuguugccucaagaaaacauauuuuguaucagugcug

SEQ ID NO: 340107 - RNA, 65 nt, Homo Sapiens
uucacuaugugaaugagaugaauuauaguacaauucucaagaaaauggaaaaccuuauggaaaau

SEQ ID NO: 340108 - RNA, 65 nt, Homo Sapiens
auugacccugauuugaccccucuucuuauaaggaucucaagaaucucuucagaagcacugaugac

SEQ ID NO: 340109 - RNA, 65 nt, Homo Sapiens
auucaaggcaaagcaaggaacaucuugagauaugucucaagaauauaaagauguauuauuuuaag

SEQ ID NO: 340110 - RNA, 65 nt, Homo Sapiens
aggcucacaugggaguuguccucacccuuguuaaucucaagaaacucuuauuuauaauagguugc

SEQ ID NO: 340111 - RNA, 65 nt, Homo Sapiens
ggaucuguuuggaaacaaccccuugagcugccaggcucaagaaaucauggacucacaggguccug

SEQ ID NO: 340112 - RNA, 65 nt, Homo Sapiens
ccaauggccuguguguuacaaugauaugaucauuucucaagaauaagucccuuuuuguauguguu

SEQ ID NO: 340113 - RNA, 65 nt, Homo Sapiens
gugucuucugugucacaaacagcacuccaggccagcucaagaagcaaagcaggccaauagaaaug

SEQ ID NO: 340114 - RNA, 65 nt, Homo Sapiens
ugccuaugugugcuccauuccucauuucuacuuggcucaagaaaacauuucugcagucaggugag

SEQ ID NO: 340115 - RNA, 65 nt, Homo Sapiens
uaaaggcagugaaaauggccagccagagaaaagaucucaagaaccagaaauaaauaaggauggug

SEQ ID NO: 340116 - RNA, 65 nt, Homo Sapiens
gguaaagacauacucauuaaguguuauuuauuuuacucaagaacuggaaaccaacuaaaugccuu

SEQ ID NO: 340117 - RNA, 65 nt, Homo Sapiens
ucaguauguucccaggcuaguguugaacuccugagcucaagaaauccuccugccugagucucuga

SEQ ID NO: 340118 - RNA, 65 nt, Homo Sapiens
auagguuucugauuacauaaaauuugaauagaacacucaagaaguauguagauuuuugaaaaacc

SEQ ID NO: 340119 - RNA, 65 nt, Homo Sapiens
cugugaauguuccaacaccugccuccacuucuccccucaagaaauuuucaacgccaggaaucaug

SEQ ID NO: 340120 - RNA, 65 nt, Homo Sapiens
caugaagagacuucugcuuuucaacccccacccuccucaagaaguaauaauuuguuuacuuguaa

SEQ ID NO: 340121 - RNA, 65 nt, Homo Sapiens
caaguuggaugcggccauucaaggggagccaaaaucucaagaaauucccagcagguuaccuggag

SEQ ID NO: 340122 - RNA, 65 nt, Homo Sapiens
cccuccccagacaucuggacacugggcauagauuucucaagaaggaagacuccccugccucccca

SEQ ID NO: 340123 - RNA, 65 nt, Homo Sapiens
cauugaaaaauucuaugaauagugaacuuuugcaucucaagaaaaucauuugaaaacacugcaac

SEQ ID NO: 340124 - RNA, 65 nt, Homo Sapiens
uggcucucauucuaagaggcagcucccagugaucacucaagaaucccgugucuuucucuaggaca

SEQ ID NO: 340125 - RNA, 65 nt, Homo Sapiens
uccuguuggauuuguuuaaauauaugagaaggugccucaagaauuauugcauucaucuuguguuu

SEQ ID NO: 340126 - RNA, 65 nt, Homo Sapiens
guacagauguguggaauacgcccuaagcgaucauacucaagaauagccugguucucaauuugaca

SEQ ID NO: 340127 - RNA, 65 nt, Homo Sapiens
auaauaaaagaccauaaauaauugaaggaaaaggacucaagaaaacagaagugacuuauuaaacu

SEQ ID NO: 340128 - RNA, 65 nt, Homo Sapiens
cuauugauauuggucauguuaaaacuuauaguagccucaagaaguuuuuuugaaccuuauuucuc

SEQ ID NO: 340129 - RNA, 58 nt, Homo Sapiens; identical to SEQ ID NO: 339070

SEQ ID NO: 340130 - RNA, 65 nt, Homo Sapiens
gcuucagauccucuuguguacuguugaaagucucccucaagaauaauuuugugcucugaguuuug

SEQ ID NO: 340131 - RNA, 65 nt, Homo Sapiens
ucaauaucauuuuaauguaauugauuguauauagucucaagaaugguuggugggcaugaguuccu

SEQ ID NO: 340132 - RNA, 65 nt, Homo Sapiens
aaacuuuuguagcaaucuggucuauagacuuuuaacucaagaagcuaaggcuagacuuguuaccu

SEQ ID NO: 340133 - RNA, 65 nt, Homo Sapiens
agaaaugucucuccucuagguaucguauuuuguugcucaagaauccaaaaugggucuguggacau

SEQ ID NO: 340134 - RNA, 65 nt, Homo Sapiens
ugcugcuuaguuuuuggacugaaaagauauuaaaacucaagaaggaccaagaaguuuucauaugu

SEQ ID NO: 340135 - RNA, 65 nt, Homo Sapiens
cgaggaguaacaauacaaauggauuuugggagugacucaagaagugaagaaugcacaagaaugga

SEQ ID NO: 340136 - RNA, 65 nt, Homo Sapiens
ucaagacacagaacaaggucugucuccuauagucacucaagaagucgaucgagaaguuccacauc

SEQ ID NO: 340137 - RNA, 65 nt, Homo Sapiens
caauuaauuagacuuuuguauaagagaugucaugccucaagaaagccauaaaccugguaggaaca

SEQ ID NO: 340138 - RNA, 65 nt, Homo Sapiens
ucucccugaagcagacugcugaggaauuacauuugcucaagaauuuuuuccgucaaauugugaac

SEQ ID NO: 340139 - RNA, 65 nt, Homo Sapiens
ugccuuaauuauuuaucuuuaguuccuuauuaguucucaagaaacaaaugcuagcuucauaugua

SEQ ID NO: 340140 - RNA, 65 nt, Homo Sapiens
agugggucccuuccuuucuccuuuccucucuacugcucaagaacagauuugaggccaggugcggu

SEQ ID NO: 340141 - RNA, 65 nt, Homo Sapiens
uuuauaagcaauguaauuaugcuauucacaggggccucaagaauugguauguaugaugugaucug

SEQ ID NO: 340142 - RNA, 65 nt, Homo Sapiens
aauccuuauguagaaaggacuuugaaauuuuucuucucaagaaaugguuuguauaagaauaacaa

SEQ ID NO: 340143 - RNA, 65 nt, Homo Sapiens
aaugauacugacugauuaauuauuccugauaacaucucaagaaaaggagaaggaaaguguuucug

SEQ ID NO: 340144 - RNA, 65 nt, Homo Sapiens
ccuauaaaauugucagcguauuuuuacacuauuggcucaagaauguuauaaugcuaagggacaua

SEQ ID NO: 340145 - RNA, 65 nt, Homo Sapiens
agaagaaaagauuaauaccuuaaaagaagaaaacacucaagaagcagcaguccugaaugguguuu

SEQ ID NO: 340146 - RNA, 65 nt, Homo Sapiens
aaaauuuuuuaaauaaguuuacagagcaagacugucucaagaaaaacugcacuccagccugggcc

SEQ ID NO: 340147 - RNA, 65 nt, Homo Sapiens
auaagagaaaugaacucacauugcuuagaaugguucucaagaauuuuauauuuuauacaaauaga

SEQ ID NO: 340148 - RNA, 65 nt, Homo Sapiens
gaauuaacuacauaauggaaaauggcaggcaggcacucaagaaauuagauaagcaccuggcaucu

SEQ ID NO: 340149 - RNA, 65 nt, Homo Sapiens
cucuugagccaguaaucaauaagagcagaacauuucucaagaaucucguuucugugaauuucaug

SEQ ID NO: 340150 - RNA, 65 nt, Homo Sapiens
aaugguguuuuggaaauuuuagccacgucauauaacucaagaauauuuggagaauagaaaugaaa

SEQ ID NO: 340151 - RNA, 65 nt, Homo Sapiens
gccagggccagggcuguaugcacaaaccccacucccucaagaagggaucccugcugggcacaccc

SEQ ID NO: 340152 - RNA, 65 nt, Homo Sapiens
aacugaagaaggagcaagugugaaaaccaaauuuccucaagaaauuugugcaggacaguaaauaa

SEQ ID NO: 340153 - RNA, 65 nt, Homo Sapiens
acugcaacacuacuuuauggagcuccaugcccaagcucaagaacggucagauguggucaguaggg

SEQ ID NO: 340154 - RNA, 65 nt, Homo Sapiens
gauugguacugcaacuguagaugcauuuaaaacuccucaagaaaguacaauuuaauugcucaacc

SEQ ID NO: 340155 - RNA, 65 nt, Homo Sapiens
agcauuaguaauuucuaguacaauuuuuuagguuacucaagaaccauucuaaauuugaguaaaua

SEQ ID NO: 340156 - RNA, 65 nt, Homo Sapiens
ugguacaaaacacaaccgaguuacacaacguuuuccucaagaaaacuaagggaacacacaaagaa

SEQ ID NO: 340157 - RNA, 65 nt, Homo Sapiens
gaugucuauugaguagaaccauaauaauggugaagcucaagaacauucuauaauggguuuggggg

SEQ ID NO: 340158 - RNA, 65 nt, Homo Sapiens
agggauuccuaauaauggcagucauguagcugacacucaagaaaugcaggugaauuguggaaaau

SEQ ID NO: 340159 - RNA, 65 nt, Homo Sapiens
uaggcucauggcaacgugugcauauucacauggcgcucaagaaguucuggcuuuccugcuauaca

SEQ ID NO: 340160 - RNA, 65 nt, Homo Sapiens
uguguuuucuuuagcuucccaacuguccugccugccucaagaauagucuucaucaaguggaagcc

SEQ ID NO: 340161 - RNA, 65 nt, Homo Sapiens
auguaaauuugcucuguuuuaagacuuugaacuaccucaagaagaggaaucuaauacaauauuug

SEQ ID NO: 340162 - RNA, 65 nt, Homo Sapiens
ccacaaguuuucacugaaugagcauggcagugccacucaagaaaaugaaucuccaaaguaucuuc

SEQ ID NO: 340163 - RNA, 65 nt, Homo Sapiens
acagugcuuagaaguaagcaauucccaggucauagcucaagaauuguuagcaaaugacagauuuc

SEQ ID NO: 340164 - RNA, 65 nt, Homo Sapiens
acuagugccaggucacuauuguaagauguuaaaaucucaagaaaauuucacagagcuaaagaaau

SEQ ID NO: 340165 - RNA, 65 nt, Homo Sapiens
uagauaagaaaggacuacagcauuugauguguguccucaagaacuugucuugggucugaaaaagc

SEQ ID NO: 340166 - RNA, 65 nt, Homo Sapiens
acccuauggccuucuugucaaaaccuucacuggagcucaagaaaagcauuucuguuguguuauuu

SEQ ID NO: 340167 - RNA, 65 nt, Homo Sapiens
guugcuuaugggaauccugagcugcuuuucaccaucucaagaagccuaagaaguuauauauuuaa

SEQ ID NO: 340168 - RNA, 65 nt, Homo Sapiens
cuuguagauaaaaguguuccaguaaucagaaaauccucaagaaaauugacuucauuauuuggaag

SEQ ID NO: 340169 - RNA, 65 nt, Homo Sapiens
gugcccauuaccuuuccucugccugaaagacgugucucaagaaaaauaaauucuauuuuagaugc

SEQ ID NO: 340170 - RNA, 65 nt, Homo Sapiens
agaauaaaauugaaaucugcagacaauguuuuugucucaagaacauuaguauaucaucauaaaau

SEQ ID NO: 340171 - RNA, 65 nt, Homo Sapiens
caaauacagcuuuuuuucaacauuuagacuucuuucucaagaaauagaauaaaaagguaaaacua

SEQ ID NO: 340172 - RNA, 65 nt, Homo Sapiens
uuuacguaguuuuucauaggccugucuuccuguuucucaagaauacaaacgaacaagauuaauua

SEQ ID NO: 340173 - RNA, 65 nt, Homo Sapiens
ggccccuuuuuccaacuuauacuuuuauccaugugcucaagaaagaaucuuuagacuacaauaau

SEQ ID NO: 340174 - RNA, 65 nt, Homo Sapiens
aucaagggacuccugugucaaaguguacagaucuccucaagaaaccagauauguauuugcuacuc

SEQ ID NO: 340175 - RNA, 65 nt, Homo Sapiens
uuaaauaaccgauuauugauuacuguauuuuuuuucucaagaacagugauagguagaaacuaauu

SEQ ID NO: 340176 - RNA, 65 nt, Homo Sapiens
aaaagucaucauugcuguuuagcuugacuguuuuccucaagaacaucgaucugaaggauucauaa

SEQ ID NO: 340177 - RNA, 65 nt, Homo Sapiens
aagaugcucuguagagaauuugcuaccgaaguuggcucaagaauuuguuuuuaguguuauuuacc

SEQ ID NO: 340178 - RNA, 65 nt, Homo Sapiens
ucuggcaaaggccuuccugcauuuaugaauucucucucaagaagcaagagaacaccugcaggaag

SEQ ID NO: 340179 - RNA, 65 nt, Homo Sapiens
aaugagaauuaagaauggacaggaccaagacagaacucaagaaagccacuggggaaaacucgaga

SEQ ID NO: 340180 - RNA, 65 nt, Homo Sapiens
aaauauguucaacauuuacuucuauuugauaucugcucaagaagucauagaagucuugggaaacu

SEQ ID NO: 340181 - RNA, 65 nt, Homo Sapiens
ugccacguauguucaaggguaauaaaaccacaagucucaagaauuaaguaacauugucagaaaua

SEQ ID NO: 340182 - RNA, 65 nt, Homo Sapiens
uagucagacugacacuacuaagaguacgugaaaugcucaagaauguuuucuucagguaacacuac

SEQ ID NO: 340183 - RNA, 65 nt, Homo Sapiens
aaaucaucaccaauaccuuuauacucaccaccaagcucaagaaauaaaacaaaacacaguccugc

SEQ ID NO: 340184 - RNA, 65 nt, Homo Sapiens
uuuaauauuuaaauaaaaucagccaaagguucacucucaagaagccagccaacucauuggguugu

SEQ ID NO: 340185 - RNA, 65 nt, Homo Sapiens
aauauccaauguuuaugagugccucacucuuauuccucaagaauuaaauaucaccuagaaaagua

SEQ ID NO: 340186 - RNA, 65 nt, Homo Sapiens
ccaggagguaauuuguugauauauuuucacuuuaacucaagaauuaacaucagcauuguauacac

SEQ ID NO: 340187 - RNA, 65 nt, Homo Sapiens
guguaccacuaaaaguaauaaaaucaagacauuuucucaagaacuuaucacaaauggcaauguaa

SEQ ID NO: 340188 - RNA, 65 nt, Homo Sapiens
augggagcugcaaacgcgguaauugguuuguuggccucaagaagaccaagaagcaugcagagaag

SEQ ID NO: 340189 - RNA, 65 nt, Homo Sapiens
cagcugcacaggccuugacuaggcccccagcaagucucaagaacaaggaaccaugccccuucccc

SEQ ID NO: 340190 - RNA, 65 nt, Homo Sapiens
uuuucaacgacagugauaguuauaaaauaaacuaucucaagaaaguaagaaauacaguuuguuug

SEQ ID NO: 340191 - RNA, 65 nt, Homo Sapiens
uacaguggcuccccaaugccugaagucauugccugcucaagaaugaccuuugagaaauccuuuug

SEQ ID NO: 340192 - RNA, 65 nt, Homo Sapiens
ugauaccuggguugaugugguagccaugggcugggcucaagaaccauacagaguguguucgcacu

SEQ ID NO: 340193 - RNA, 65 nt, Homo Sapiens
agaaaacugccuaacugaagggaaugggggcccugcucaagaagggggccaggcagcuggaauca

SEQ ID NO: 340194 - RNA, 65 nt, Homo Sapiens
cugggguaugagcugccaagucuauuuuaaagacgcucaagaauccucugggguucaucuaggga

SEQ ID NO: 340195 - RNA, 65 nt, Homo Sapiens
gucauucagccaacccagaggauguagacccuguccucaagaagugcagggcgaguucugccgug

SEQ ID NO: 340196 - RNA, 65 nt, Homo Sapiens
agcuguggaacgagacuucugcagagguggcugaccucaagaagcagguacaggcccuucagccc

SEQ ID NO: 340197 - RNA, 65 nt, Homo Sapiens
cagacuagauuauauuuaguaggggaaaaauugggcucaagaaccauucaucaguacgugagaca

SEQ ID NO: 340198 - RNA, 65 nt, Homo Sapiens
cugacuuguaagcaguucauagaagcugcucaauacucaagaaucuugcaagacaguuauuaaac

SEQ ID NO: 340199 - RNA, 65 nt, Homo Sapiens
gcgaaaggacagacuguuggcacugcacauuucuccucaagaaaauaucuuguuuugaucauuuc

SEQ ID NO: 340200 - RNA, 65 nt, Homo Sapiens
acuccgaagucagucugcagccucuccccuccuggcucaagaauucucagcaauuugaacacuaa

SEQ ID NO: 340201 - RNA, 65 nt, Homo Sapiens
cacuucacguauucuuguaugggugcccauuaccacucaagaagaguucugagcaaauaacuaca

SEQ ID NO: 340202 - RNA, 65 nt, Homo Sapiens
gagaugcccuagugguggccguccagcagaaccagcucaagaaaggaccgguagccuucaagcuu

SEQ ID NO: 340203 - RNA, 65 nt, Homo Sapiens
guaauuaugaagaguggagauggauuuggccuguccucaagaauguguuuuacuccgugccuuac

SEQ ID NO: 340204 - RNA, 65 nt, Homo Sapiens
acuuuauucuuguaucucauuauuagagguggaaccucaagaaugaaacagcguccauuuuuuca

SEQ ID NO: 340205 - RNA, 65 nt, Homo Sapiens
agccagcaaguauucucagcacucaggaguugcuucucaagaaagugcauugucuugcccuauag

SEQ ID NO: 340206 - RNA, 65 nt, Homo Sapiens
gauuuggugugauaccuuguaauaggaaugguuuucucaagaauacuuuuaaacauuaaguuuga

SEQ ID NO: 340207 - RNA, 65 nt, Homo Sapiens
uguuauguguguuugcugcguuuaagggucuaagucucaagaaucuugagugaugagcagacaug

SEQ ID NO: 340208 - RNA, 65 nt, Homo Sapiens
acuggcuuuaaaagaagccauucuugcauuuauuucucaagaauuaauauuuaaucuauuuaauc

SEQ ID NO: 340209 - RNA, 65 nt, Homo Sapiens
augugcuaucuggcuuugaaugcuauuuaaagugacucaagaagcuagcccucaauauuugguaa

SEQ ID NO: 340210 - RNA, 65 nt, Homo Sapiens
gaaagaaauauuguugcucaguguuguuaauauagcucaagaauugaguuuauauuugcaguaug

SEQ ID NO: 340211 - RNA, 65 nt, Homo Sapiens
uggacgagaagacucagccugagggccugcggagccucaagaagccagaccgcaagaagcgcuac

SEQ ID NO: 340212 - RNA, 65 nt, Homo Sapiens
uuguggaacuuccucuuucauuggaaacuuucuuacucaagaaugacggcaguauuguuuucuua

SEQ ID NO: 340213 - RNA, 65 nt, Homo Sapiens
ggacugucuucaucaaguauuucccuacagaacuccucaagaaaacagagaucauuuggcuagag

SEQ ID NO: 340214 - RNA, 65 nt, Homo Sapiens
aggacucugggccccuccccagcuccacucccuaccucaagaaugugaccauuuggaaaaggcaa

SEQ ID NO: 340215 - RNA, 65 nt, Homo Sapiens
ugccauguugccaaggcugguuucaaacuccuggacucaagaaauccacccaccucagccuccca

SEQ ID NO: 340216 - RNA, 65 nt, Homo Sapiens
cugugacaguuccaggucuugaagcuaaucagcaucucaagaaaguauccagaaagaacaucugc

SEQ ID NO: 340217 - RNA, 65 nt, Homo Sapiens
gauccuaagcucucaaaauagcauauucccuagagcucaagaaagcugguccaggagguugaaaa

SEQ ID NO: 340218 - RNA, 65 nt, Homo Sapiens
aaacgaacugggaaaauuuccgacagaagucuugucucaagaagaccguugugcuccagccuggg

SEQ ID NO: 340219 - RNA, 65 nt, Homo Sapiens
ugaagauuccaguggucaguucagccuuggaacuccucaagaacccucccaugcccguucugacc

SEQ ID NO: 340220 - RNA, 65 nt, Homo Sapiens
agaauccauuuagcaccuccguuacccaggcaauacucaagaaggggagauugggaaacuuaacc

SEQ ID NO: 340221 - RNA, 65 nt, Homo Sapiens
augcagcuguucugaacuggguuuucauaaguucacucaagaaaaguuuuugcuguuguaaaagu

SEQ ID NO: 340222 - RNA, 65 nt, Homo Sapiens
uuagaauuuaaguaccuuuucuaauucucaaauggcucaagaacaauaugucuguuuaaaaauua

SEQ ID NO: 340223 - RNA, 65 nt, Homo Sapiens
ccuaaaguuucaauacaagccccucagcaccacagcucaagaaaacuguuagugucuucuuccug

SEQ ID NO: 340224 - RNA, 65 nt, Homo Sapiens
ccuacacccacgcacccccccacacacuaugcucucucaagaauguaauuuauuggggccccccc

SEQ ID NO: 340225 - RNA, 65 nt, Homo Sapiens
cuuagaguccugccguggcucagguggaucuaaaacucaagaacaaauucuauuuauuuauuauu

SEQ ID NO: 340226 - RNA, 65 nt, Homo Sapiens
aauauacuaucuaucucaccaguauuugcucucgacucaagaagguuaacauuuucugauucaug

SEQ ID NO: 340227 - RNA, 65 nt, Homo Sapiens
caugacagcugucuguuguuuuaugaaguuuauuucucaagaaaaugggaauaaauuugggauuu

SEQ ID NO: 340228 - RNA, 65 nt, Homo Sapiens
cccacucuagcuugggcaauagagcaaggcuccgucucaagaaaagaaggucauuucccaagacu

SEQ ID NO: 340229 - RNA, 65 nt, Homo Sapiens
caguggaagcauguguguuucuaaaaaguaaaaaucucaagaaaacagaaauggcaugcuuuacc

SEQ ID NO: 340230 - RNA, 65 nt, Homo Sapiens
uaauaaugcagagauaauuagacaugguucccgcccucaagaagcucacaaaaguauucaggaaa

SEQ ID NO: 340231 - RNA, 65 nt, Homo Sapiens
caaguucuuuuggaacuuguuucaagccaaaaacucucaagaaagcaaauugcaccucagcugga

SEQ ID NO: 340232 - RNA, 57 nt, Homo Sapiens; identical to SEQ ID NO: 339173

SEQ ID NO: 340233 - RNA, 65 nt, Homo Sapiens
ucccuaaauuaucccauuauguaauucuuggucagcucaagaacuggguucuuuuucuaauaauu

SEQ ID NO: 340234 - RNA, 65 nt, Homo Sapiens
ugagcuggaacaguaggggcagggagaagacaggucucaagaaaagguuuuuaagaaguuucauc

SEQ ID NO: 340235 - RNA, 65 nt, Homo Sapiens
acuuccucuacucucccgugcacugccggccagagcucaagaagcugcugcacgggcugggccuu

SEQ ID NO: 340236 - RNA, 65 nt, Homo Sapiens
gcauccucugaccuacuucaaauaaugcuggaauacucaagaauuuauuuuacucugaucaaaua

SEQ ID NO: 340237 - RNA, 65 nt, Homo Sapiens
uguuaaccuccggggagagcaacacaaaacccuaucucaagaacugcgggaggaagcacugaaac

SEQ ID NO: 340238 - RNA, 65 nt, Homo Sapiens
ccaugcgcuggcaguacauggucuugcuuuaugggcucaagaaugcuaaccacagggccugagaa

SEQ ID NO: 340239 - RNA, 65 nt, Homo Sapiens
aaaaaaaaguuuguuuuuucuuaauacucuuuucucucaagaaaauucccugauauuauuucuau

SEQ ID NO: 340240 - RNA, 65 nt, Homo Sapiens
guucauauuaauugaggauuucaaauuucccauuucucaagaaauuauggugggagggaauguuu

SEQ ID NO: 340241 - RNA, 65 nt, Homo Sapiens
cagcccugcuucugacauaaagaaacuuguccuuccucaagaacaucauuuugaugauucugaga

SEQ ID NO: 340242 - RNA, 65 nt, Homo Sapiens
aacagaaacgagauuugccaagcuauaauguuucccucaagaacaaaaaauaaccaaaaaaugug

SEQ ID NO: 340243 - RNA, 65 nt, Homo Sapiens
gccuguggaccgaggccccccuggucaacaaggaccucaagaacuugucagccccaguuggcuuc

SEQ ID NO: 340244 - RNA, 65 nt, Homo Sapiens
aaugcagagguaacucucaggcagcuaagcagcaccucaagaaaacauguuaaauuaaugcuucu

SEQ ID NO: 340245 - RNA, 65 nt, Homo Sapiens
ucugagaguagcugcugcuuucccugacuuccuuccucaagaauacagucuauucugggggguug

SEQ ID NO: 340246 - RNA, 65 nt, Homo Sapiens
cagauuuuccucugacaccagagaacaauaguagucucaagaauggaaaccugaaugucugaggg

SEQ ID NO: 340247 - RNA, 65 nt, Homo Sapiens
gaaaaacuucaguuacugaccagucaagagaauuucucaagaaaaaucccagcaacguucccucu

SEQ ID NO: 340248 - RNA, 65 nt, Homo Sapiens
uucaagcacaaagugaugaaugacugccuucaagucucaagaaaacacuuuucccuaacuuuuag

SEQ ID NO: 340249 - RNA, 65 nt, Homo Sapiens
aauuugggugagcugcaccugauuaguugaaaggccucaagaacaaacacugcaguuuccuggaa

SEQ ID NO: 340250 - RNA, 65 nt, Homo Sapiens
acaacuguggaguugguagcugguaacauuguugucucaagaacaacucaccucucucccuagga

SEQ ID NO: 340251 - RNA, 65 nt, Homo Sapiens
cagcccuaaaauucucuccaauccgccacagaaggcucaagaauccacaacuaaaccuucuuaau

SEQ ID NO: 340252 - RNA, 65 nt, Homo Sapiens
guacucgggcgacaccuuacugagccaauggcagucucaagaaaugaacuaccucauaugcagga

SEQ ID NO: 340253 - RNA, 65 nt, Homo Sapiens
gccugaaugacaauguccagcagguucauucuuugcucaagaaagacuuuucugacauuccuaga

SEQ ID NO: 340254 - RNA, 65 nt, Homo Sapiens
aagguaccccaauauaucucgaagaauucaacugucucaagaaucuaauacaacaagaucaacua

SEQ ID NO: 340255 - RNA, 65 nt, Homo Sapiens
ucuuaguucaguggaggaaagaugugcacucuggacucaagaaaccauugaagggagaaaggcaa

SEQ ID NO: 340256 - RNA, 65 nt, Homo Sapiens
agaggggcauaaacuuuccuugcagccagaggcaccucaagaagaagucacugugagcucccagg

SEQ ID NO: 340257 - RNA, 65 nt, Homo Sapiens
uauucuuucacccugucucuuuuuuaucccuuccucucaagaaaaaauucagaugaguuagaagc

SEQ ID NO: 340258 - RNA, 65 nt, Homo Sapiens
aaagugacauaauuuacaugcaauauguuuaucaacucaagaauuuaauauaguugguacacaac

SEQ ID NO: 340259 - RNA, 65 nt, Homo Sapiens
auggauacauuaggagcuucaaacacauauaauuucucaagaaauuuccagaugucucaugcugc

SEQ ID NO: 340260 - RNA, 65 nt, Homo Sapiens
cuauuaaggaagaacaaggaagggaaugaucuuuacucaagaauuucagaaagucagcacugaag

SEQ ID NO: 340261 - RNA, 57 nt, Homo Sapiens; identical to SEQ ID NO: 339202

SEQ ID NO: 340262 - RNA, 65 nt, Homo Sapiens
aagaaggcugcuaauuggauuuugguaguucuuaccucaagaaaacuugaauuauuugggggaaa

SEQ ID NO: 340263 - RNA, 65 nt, Homo Sapiens
cuaagcuuaugaaggaaugccuccuuuguuacacacucaagaauuugucagcacacaauuaauug

SEQ ID NO: 340264 - RNA, 65 nt, Homo Sapiens
uaauaauucagaaauuggguuuugguucagugauucucaagaaaaagaucucuugcccauuaaga

SEQ ID NO: 340265 - RNA, 65 nt, Homo Sapiens
uuuuuuucugaauaacauuucaggaaacaagcacacucaagaaagucacaaaauccaaggugcua

SEQ ID NO: 340266 - RNA, 65 nt, Homo Sapiens
cuacuggaacuggaugaccugaaaaugguguuuuccucaagaagauuaaagaaaacugaacugag

SEQ ID NO: 340267 - RNA, 65 nt, Homo Sapiens
gcccagauguagaaauucauccaggcccucucucccucaagaaaucauuuuccaucuccaaauag

SEQ ID NO: 340268 - RNA, 65 nt, Homo Sapiens
aaacugugcuguuacaacucuagaaaauaugucuucucaagaacaagaaaguucauuucaucacu

SEQ ID NO: 340269 - RNA, 65 nt, Homo Sapiens
ucaguuuauaauuggaagagcucuucauacguuuucucaagaacuccuggcucucucucugcugc

SEQ ID NO: 340270 - RNA, 65 nt, Homo Sapiens
cagcucugcucugagcguccuggagaccccaguuucucaagaauugcuccucuauccgaggccau

SEQ ID NO: 340271 - RNA, 65 nt, Homo Sapiens
augcuuuuugggaaacguugcucaccuucuuucuccucaagaaagcagguugaguccagaugcuu

SEQ ID NO: 340272 - RNA, 65 nt, Homo Sapiens
guuccacagacagaugaggcaggagugauggggcacucaagaaaguucagaggaggcauaagcua

SEQ ID NO: 340273 - RNA, 65 nt, Homo Sapiens
cuuggaucuuggcaugcacccaccuaacccacuuucucaagaacaagaaccuagaaugaauaucc

SEQ ID NO: 340274 - RNA, 65 nt, Homo Sapiens
cacucccagaagaccaaacugccuuccccucagggcucaagaauguguacagucuguggggccgg

SEQ ID NO: 340275 - RNA, 65 nt, Homo Sapiens
uuucuccuuuuguguuuuucccacuuuccaauguacucaagaaaauugaacaaauguaauggauc

SEQ ID NO: 340276 - RNA, 65 nt, Homo Sapiens
uccugacuaaggagcugcagcgauacaucgaagggcucaagaagcgccggagcaagaggcuguac

SEQ ID NO: 340277 - RNA, 65 nt, Homo Sapiens
agccccagagggcuuuguggaggacaggccuugcccucaagaacgucguaccugacgcugagccu

SEQ ID NO: 340278 - RNA, 65 nt, Homo Sapiens
cuugagcuuuuuggaaggauaauucugauaaggcacucaagaaacguacaaccacagugcuuucu

SEQ ID NO: 340279 - RNA, 65 nt, Homo Sapiens
ggagacccgccaccguggaggcagggggcaagaaacucaagaacgcaucaagagcaccagcccug

SEQ ID NO: 340280 - RNA, 54 nt, Homo Sapiens; identical to SEQ ID NO: 339221

SEQ ID NO: 340281 - RNA, 65 nt, Homo Sapiens
gaaccucacgcaccucccauccuaaucauccaaugcucaagaaacaacuucuacuucugcccuug

SEQ ID NO: 340282 - RNA, 65 nt, Homo Sapiens
ccacuuuucagagucaucuacaaaauuuuucuuuccucaagaaaagaguuccuuuugccuuauuc

SEQ ID NO: 340283 - RNA, 65 nt, Homo Sapiens
gucagcaacagaaaaugagaggaaggaagccaagucucaagaacuggcugacuuaggaucaugcu

SEQ ID NO: 340284 - RNA, 65 nt, Homo Sapiens
aaugucuggggacaggccuuuaaaaggaggguggccucaagaaacaagccccuggaucuuugggg

SEQ ID NO: 340285 - RNA, 65 nt, Homo Sapiens
ggccucauuccagggcacaguguuuuuauaugagacucaagaacaccucaugccuaacagugguc

SEQ ID NO: 340286 - RNA, 65 nt, Homo Sapiens
ccuuuguuuugcacugacaaucuucacugccaugccucaagaacaaagaggaggagggauucugg

SEQ ID NO: 340287 - RNA, 65 nt, Homo Sapiens
ucccagucugguaggagagaagauacauucccgcccucaagaaucacugggaaugcugggaaaug

SEQ ID NO: 340288 - RNA, 65 nt, Homo Sapiens
caugugcagucacuggugucccggaggaaaagcagcucaagaacaacaggagacaugagucuuug

SEQ ID NO: 340289 - RNA, 65 nt, Homo Sapiens
uaagucuuagugcacaguauuuuauuuagcaucagcucaagaaacaauauuccuauugaucucau

SEQ ID NO: 340290 - RNA, 65 nt, Homo Sapiens
uggaagaggcagcaggacuuguaggggaaaaguuucucaagaagguccauaaugagauaaugcau

SEQ ID NO: 340291 - RNA, 65 nt, Homo Sapiens
ccauuuauggcaugauuagauugcaaagcaaugaacucaagaaggaauugaaauaaggagggaca

SEQ ID NO: 340292 - RNA, 65 nt, Homo Sapiens
acuaguuuggauaucuuuaggguuuagaaucuaaccucaagaauaagaaauacaaguacaaauug

SEQ ID NO: 340293 - RNA, 65 nt, Homo Sapiens
cacccaucuuuuuucuucccucauuuucugggauucucaagaaagaaaaaguaacccauuaucac

SEQ ID NO: 340294 - RNA, 65 nt, Homo Sapiens
gcccuuuuggacuaauguuacuguccaaguucuuucucaagaaaccacaucugguucagaagagu

SEQ ID NO: 340295 - RNA, 65 nt, Homo Sapiens
uuuuuuaaauuuuuuuauaggcccauaugcucuaucucaagaaacaagaugauuguaacaugucc

SEQ ID NO: 340296 - RNA, 65 nt, Homo Sapiens
auaacuuuccuuuauuucacuuguacccaguuucacucaagaaaucuugaugaauauuuauguug

SEQ ID NO: 340297 - RNA, 65 nt, Homo Sapiens
uagacccucucuauagccaugagacuccuuguggccucaagaaauuuagacgcccacgacagcac

SEQ ID NO: 340298 - RNA, 65 nt, Homo Sapiens
ucagccgcacccgugugcacuguaacuuuugugugcucaagaaauuauacagaaaccuacagcug

SEQ ID NO: 340299 - RNA, 65 nt, Homo Sapiens
aaucaguaaauaccuugaaauccuugcaggagugacucaagaauuaccacuccuggagaaagacu

SEQ ID NO: 340300 - RNA, 51 nt, Homo Sapiens; identical to SEQ ID NO: 339241

SEQ ID NO: 340301 - RNA, 65 nt, Homo Sapiens
uagaccuagaaauaccauuuccacccaucugauuccucaagaaucuauuuccuucauaaagaaug

SEQ ID NO: 340302 - RNA, 65 nt, Homo Sapiens
ugccacauuucaauuacauagaaauguauugaauacucaagaaaaguuaggaaaaaaaaauccaa

SEQ ID NO: 340303 - RNA, 65 nt, Homo Sapiens
cucuagagaagaaaagugaaaagccauuauuuuaacucaagaaaagaucucauaugaucuucuuc

SEQ ID NO: 340304 - RNA, 65 nt, Homo Sapiens
cagcuuggagccucuagguugggacuuaagcuagacucaagaaagggcacuccacugcagcagga

SEQ ID NO: 340305 - RNA, 65 nt, Homo Sapiens
ugccuccuuauuuaucaacacuccucguccccugccucaagaaauauuaaaaauaguaagccucc

SEQ ID NO: 340306 - RNA, 65 nt, Homo Sapiens
agcaugagcuggccacacaucauggacagccccugcucaagaaaaagcaugguaugagcacaggu

SEQ ID NO: 340307 - RNA, 65 nt, Homo Sapiens
gauaauucauuauaucaucaaacuguauauacuuccucaagaacuauuuuugaaaaauagucacc

SEQ ID NO: 340308 - RNA, 65 nt, Homo Sapiens
cccucauuuuuauaaccuggaaacuauaaguaauucucaagaaagcgcucugccauucaacucgg

SEQ ID NO: 340309 - RNA, 65 nt, Homo Sapiens
gguaccuacuacaugcuguaaacacuugaaugugccucaagaaaauacuuuuuacuguuugccaa

SEQ ID NO: 340310 - RNA, 65 nt, Homo Sapiens
ccuuacagguaaguauugcucuuucucuaauaauccucaagaaauaguucuauacuggauccuuu

SEQ ID NO: 340311 - RNA, 65 nt, Homo Sapiens
cugcugggaguccccugagucuucuagauacagggcucaagaaguaguacuggagagaugggauc

SEQ ID NO: 340312 - RNA, 65 nt, Homo Sapiens
caucaggguccucagugcagagcaacuuacgcauccucaagaauccacugcuuuucaggcaagga

SEQ ID NO: 340313 - RNA, 65 nt, Homo Sapiens
ucccacgugggcaauaccagggacccauggggaaacucaagaaugacagcuucuauauuuuguaa

SEQ ID NO: 340314 - RNA, 65 nt, Homo Sapiens
uccacuaagaaggccugucuacacugcaggggaaccucaagaacuuuucauugcacuucuaaaau

SEQ ID NO: 340315 - RNA, 65 nt, Homo Sapiens
ucaaaaggaagagccuuuuaaaaacauuugccaaccucaagaauaaauacugaaagucuugaaag

SEQ ID NO: 340316 - RNA, 65 nt, Homo Sapiens
cuuaggauucugacuaagaggcaaaagagaaaagacucaagaaacugauccuggagaucgagacc

SEQ ID NO: 340317 - RNA, 65 nt, Homo Sapiens
auacucucccagauuuuuacagugggauuuggggccucaagaaauugggagccaggaguaagaca

SEQ ID NO: 340318 - RNA, 65 nt, Homo Sapiens
uuggauguuuucauuggccugcugaagaaguuauucucaagaaaaguuuuguuuuaacaaaauua

SEQ ID NO: 340319 - RNA, 65 nt, Homo Sapiens
uguuauaugacaucauccugaagaacuucgagaagcucaagaagcccaggggagaaacaaaggga

SEQ ID NO: 340320 - RNA, 65 nt, Homo Sapiens
gaaagauuacauacauuugagaauaagaaauuacucucaagaacuucagaaaucugcaacauaau

SEQ ID NO: 340321 - RNA, 65 nt, Homo Sapiens
agauauuucccauaaaugggaaguuugcccauugucucaagaaauguguauuucagugacaauuu

SEQ ID NO: 340322 - RNA, 65 nt, Homo Sapiens
uuaacauuuugggaaguaacugccucugacuucaacucaagaaaacacuuuuuuguugcuaaugu

SEQ ID NO: 340323 - RNA, 65 nt, Homo Sapiens
aaaagaagacugacuggguggaggcucugccuugccucaagaaccauccccugcagagcauccag

SEQ ID NO: 340324 - RNA, 65 nt, Homo Sapiens
cguaggccuugcaucucgccaccuccacuucuguccucaagaacaaguccuaggucaagggaaac

SEQ ID NO: 340325 - RNA, 65 nt, Homo Sapiens
agaaauaaauaaggguggugagccagaggaaaugucucaagaaccuaaaggaagugaaaauagcc

SEQ ID NO: 340326 - RNA, 65 nt, Homo Sapiens
cccuggaauaucccugagaaagcuacgcacucagccucaagaacuggaauuagugcuggauuuga

SEQ ID NO: 340327 - RNA, 65 nt, Homo Sapiens
cugcuucuugcuuugcagaguccucaggaauugcccucaagaacuagauggcccugggaaucaau

SEQ ID NO: 340328 - RNA, 65 nt, Homo Sapiens
cagggaacaauacuguaaacuuuacuugagguugccucaagaacucaaaucuuagaguucauaaa

SEQ ID NO: 340329 - RNA, 65 nt, Homo Sapiens
auaugggagcccaugaggagaaaggguggcugcgacucaagaauagaaugaagaauggaaaugga

SEQ ID NO: 340330 - RNA, 65 nt, Homo Sapiens
agaaggagauaaacaugaccaucgucaaagaccugcucaagaaauuuuuaaaaaagaaacaaagu

SEQ ID NO: 340331 - RNA, 65 nt, Homo Sapiens
aaauuucuuauuugcuagggaacugguaaucuaggcucaagaaguguguggagaagguuuauuuu

SEQ ID NO: 340332 - RNA, 65 nt, Homo Sapiens
ugcaucaguguggacuccuagaacgugcgaccugccucaagaaaaugcaguuuucaaaaacagac

SEQ ID NO: 340333 - RNA, 65 nt, Homo Sapiens
uuccuccucaggacauggagaucugugcagaugagcucaagaagguccuuaacacagucgugaac

SEQ ID NO: 340334 - RNA, 65 nt, Homo Sapiens
caguacaccuguagauauuacuguacuuuuauguucucaagaaauaaguuguugccuauucagug

SEQ ID NO: 340335 - RNA, 65 nt, Homo Sapiens
uuacugauucauacauuaucucacuugugccaacacucaagaagcaggcuacacugacacuggua

SEQ ID NO: 340336 - RNA, 56 nt, Homo Sapiens; identical to SEQ ID NO: 339277

SEQ ID NO: 340337 - RNA, 65 nt, Homo Sapiens
auucacaguugagugcauccgaaggaaaggaagaccucaagaaaagggcuccacuucauccagau

SEQ ID NO: 340338 - RNA, 65 nt, Homo Sapiens
uuuuaaaaacgaaacaaaguaucaucaaagagcugcucaagaaauagaaggagauaaacaccacc

SEQ ID NO: 340339 - RNA, 65 nt, Homo Sapiens
uaugucaagaugagcugaaugguucggaauacuggcucaagaaccaaggaacuuuauaaugaaac

SEQ ID NO: 340340 - RNA, 65 nt, Homo Sapiens
gggcuuccaaugcugugagaacuggccuugcagagcucaagaaggagaugugagcugcuaaauug

SEQ ID NO: 340341 - RNA, 65 nt, Homo Sapiens
gcccggaagcgccaggcuggcauucccaugguggccucaagaaagagccccucucucacacauca

SEQ ID NO: 340342 - RNA, 65 nt, Homo Sapiens
uguguucuuagugauucacauccacgggacaaaaacucaagaagaaauaagagcugacgccacac

SEQ ID NO: 340343 - RNA, 65 nt, Homo Sapiens
cagagggagugugcgaaucuacccugaccaaugggcucaagaauaaaguaugauuuuugagucag

SEQ ID NO: 340344 - RNA, 65 nt, Homo Sapiens
aauugagggcuaaaucccaagugucucuugacuggcucaagaauuagggccccaacuacacaccc

SEQ ID NO: 340345 - RNA, 65 nt, Homo Sapiens
caccuacuuguggcgaucugaguacucuacucuugcucaagaaguaauacgacaaucagaauaca

SEQ ID NO: 340346 - RNA, 65 nt, Homo Sapiens
aaauaugaauugagggcccgaaccugaccaagcggcucaagaauacagagggagugugcgaauca

SEQ ID NO: 340347 - RNA, 65 nt, Homo Sapiens
uagaagauguguaaacagguacugugucuggcguucucaagaaucauacaaauuuggccuuaaga

SEQ ID NO: 340348 - RNA, 65 nt, Homo Sapiens
ggauuagcucugauuuugagcuauacuuacgcuuccucaagaagaugaugaaugcccgcagugag

SEQ ID NO: 340349 - RNA, 65 nt, Homo Sapiens
gucuuaacuaggaaacuaaaaccagugaauccauucucaagaaaauacuacaaaauuaugucugc

SEQ ID NO: 340350 - RNA, 65 nt, Homo Sapiens
gcgaaagucaaauauggagauguggggguaggaaucucaagaauugggaacacaggcaaauuauu

SEQ ID NO: 340351 - RNA, 65 nt, Homo Sapiens
uccucaccaagcucauuacaucugccagggccugccucaagaagcccagcccagccuuuuccugg

SEQ ID NO: 340352 - RNA, 65 nt, Homo Sapiens
uagugguauauuuauguaagaaaaugacuguaaaucucaagaaaaaucucagcagcuaauagcaa

SEQ ID NO: 340353 - RNA, 65 nt, Homo Sapiens
guguaaccauuuguuaacuguacugaagguguguccucaagaagaaaguguucaaauuaaaaaag

SEQ ID NO: 340354 - RNA, 65 nt, Homo Sapiens
gucucuaccaaaaguuaaaaaaaaaaaaaaaaaagcucaagaaccugcacgagggccuaaaacag

SEQ ID NO: 340355 - RNA, 65 nt, Homo Sapiens
ccuucucuguuuaguaguugguuggggaaguggggcucaagaaggauuuugggguucaccagaug

SEQ ID NO: 340356 - RNA, 65 nt, Homo Sapiens
agaaaaggggcuggaaaggggggaauggcccacaucucaagaagcaagauauuguuugugguggu

SEQ ID NO: 340357 - RNA, 65 nt, Homo Sapiens
ggaacagcauggauuccguggauagcuguugcagucucaagaagacugagagcuuccaaaaugcc

SEQ ID NO: 340358 - RNA, 65 nt, Homo Sapiens
cacaccaacauuuugcugccuaccuuguuauccuucucaagaagcugaaguguacgcccucuccc

SEQ ID NO: 340359 - RNA, 65 nt, Homo Sapiens
ugugcccuuccccgccugcgagaugccaccaagcccucaagaaguuguauauaccaccuaggagg

SEQ ID NO: 340360 - RNA, 65 nt, Homo Sapiens
cccgaacgaauguucggaugcguccaguggugccucucaagaaacggccacgugucccagcccag

SEQ ID NO: 340361 - RNA, 65 nt, Homo Sapiens
ugcugagauuucucuggaaaaaaauaacaggcagccucaagaaugcguacaucauuauuaauaua

SEQ ID NO: 340362 - RNA, 65 nt, Homo Sapiens
gggcucccugggaucuccagcauacgauacucuuucucaagaaggucccugaagcuggauucuuu

SEQ ID NO: 340363 - RNA, 65 nt, Homo Sapiens
gaagcgugaaccccagggaagaaggaggacacaaccucaagaaaggcaggccugcaggguguggg

SEQ ID NO: 340364 - RNA, 65 nt, Homo Sapiens
acgggcugcucuacugcuucaaccaugacgcacugcucaagaacuaguuugacacaaacucacac

SEQ ID NO: 340365 - RNA, 65 nt, Homo Sapiens
acgggcugcucuacugcuucaacgaugacgcacugcucaagaacuaguuugacacaaaaucgcac

SEQ ID NO: 340366 - RNA, 65 nt, Homo Sapiens
acgggcugcucuacugcuucaaccaugacgcacugcucaagaacuaguuugacacaaacucgcac

SEQ ID NO: 340367 - RNA, 57 nt, Homo Sapiens; identical to SEQ ID NO: 339308

SEQ ID NO: 340368 - RNA, 65 nt, Homo Sapiens
uuacuuuucuauguugcucauaaaugauuguauaacucaagaagauuugugagugcuuuggaauu

SEQ ID NO: 340369 - RNA, 65 nt, Homo Sapiens
cuccagacgaugcauuucuuggccaaaguggcuuccucaagaaagcagcacuuaccuuugaaaaa

SEQ ID NO: 340370 - RNA, 65 nt, Homo Sapiens
ucaaauggcuucacaguccuuacuucucuaccugccucaagaaggggcucagagcagagacuugu

SEQ ID NO: 340371 - RNA, 65 nt, Homo Sapiens
gggauuaguuggggguauuaggaagacuucauuuucucaagaaauagcaaacauucuuccuaaaa

SEQ ID NO: 340372 - RNA, 65 nt, Homo Sapiens
caauauucguuaauguucaguuuuagcucuaauagcucaagaacauauaacuuuaaaaauaauac

SEQ ID NO: 340373 - RNA, 65 nt, Homo Sapiens
auuauucauucuaucucagaaucuacacuaguaaucucaagaaagagagggcacugaagaccuga

SEQ ID NO: 340374 - RNA, 65 nt, Homo Sapiens
ccaugacgagcucuagcuggaugggcgcagagaaccucaagaaggcaugaagccagccccugcag

SEQ ID NO: 340375 - RNA, 65 nt, Homo Sapiens
agcgcuccagccuggucgacagagugagacuccaucucaagaaaaaauaaaaauaaaguuguucu

SEQ ID NO: 340376 - RNA, 65 nt, Homo Sapiens
ugcuuugggaggcugaggcaggaggaucacucgagcucaagaauucaagaccugggcaagagaga

SEQ ID NO: 340377 - RNA, 65 nt, Homo Sapiens
ugcacuccagccugggcgacagagcaagacucugucucaagaagaaaaaaaaaauacauauacac

SEQ ID NO: 340378 - RNA, 65 nt, Homo Sapiens
gauuuauaugcaugaaguuaaaacaacugacguuacucaagaauuagaaaacuuugcaagauuug

SEQ ID NO: 340379 - RNA, 65 nt, Homo Sapiens
aaaagaaaaagagacaaauuacagcgagacccugucucaagaaagugcacuucagccugggcgac

SEQ ID NO: 340380 - RNA, 65 nt, Homo Sapiens
gggcacugcccggcccggcuucccuugcccccaagcucaagaaggucuucuccagcgcugggccc

SEQ ID NO: 340381 - RNA, 65 nt, Homo Sapiens
agacugugcagagggcauugcacacccaccgcaaccucaagaaccccgaccuacgccacuggaaa

SEQ ID NO: 340382 - RNA, 65 nt, Homo Sapiens
aauaaaagugggaaaaucuuagaaugagacacugucucaagaaaaugcauuccagccugugcgac

SEQ ID NO: 340383 - RNA, 65 nt, Homo Sapiens
ccccagugccuuguaugaagccuacccucugcacccucaagaaacuacaggaccccccaagucuu

SEQ ID NO: 340384 - RNA, 65 nt, Homo Sapiens
aacccaccauaaccagcccacccuuguucuuaucccucaagaagaacuuccuucauuaacaaaga

SEQ ID NO: 340385 - RNA, 65 nt, Homo Sapiens
ucugaagaagguaguaauauuccucaugcauuuuccucaagaauggcauguaccuauugacugua

SEQ ID NO: 340386 - RNA, 65 nt, Homo Sapiens
cccgccgggcuacgaugacauguaccugugaaggccucaagaauguaacaucccaggcuucccuc

SEQ ID NO: 340387 - RNA, 63 nt, Homo Sapiens
ugcacuccagcccgggcaacagaguaagacccugccucaagaaaaaaaaaaaaaaaaaaaauc

SEQ ID NO: 340388 - RNA, 65 nt, Homo Sapiens
guggccaggugccggcacagugccucucccagagccucaagaagggccauuuaggagcuugcuuc

SEQ ID NO: 340389 - RNA, 65 nt, Homo Sapiens
ugcaccgugccugacucauccaguggggaaggugacucaagaaguuguuuaagccuaggccuagg

SEQ ID NO: 340390 - RNA, 65 nt, Homo Sapiens
uaaaagcuguugcuggaaacuugcuuuaggaacagcucaagaaccuuggaguucauauuucacaa

SEQ ID NO: 340391 - RNA, 65 nt, Homo Sapiens
uucaugagggucucuuacuaagccugcggguuugccucaagaaaccgagagaagaggaguggaug

SEQ ID NO: 340392 - RNA, 65 nt, Homo Sapiens
aaagaucucgcuggugcguaaguggaaggaaaugucucaagaaacgucucuauggcgcuuccuug

SEQ ID NO: 340393 - RNA, 52 nt, Homo Sapiens; identical to SEQ ID NO: 339334

SEQ ID NO: 340394 - RNA, 65 nt, Homo Sapiens
agggccuugugcgugggccuucuuccccccucgcccucaagaacaggaaaaucuugcuuuuaugg

SEQ ID NO: 340395 - RNA, 65 nt, Homo Sapiens
gacuuguuuauuuucuaguagcuuuuauaaguacacucaagaauuugucagggagaauaauucug

SEQ ID NO: 340396 - RNA, 65 nt, Homo Sapiens
agauccagguuuacuuucuaucagcugagcaaccucucaagaaaaaauaaauaaauaaauaaacc

SEQ ID NO: 340397 - RNA, 65 nt, Homo Sapiens
aauguguucuguauaaacaaaugcagcuggaaucgcucaagaaucuuauuuuucuaaauccaaca

SEQ ID NO: 340398 - RNA, 65 nt, Homo Sapiens
ugguccugaagacuccggccaagaggcacaagcagcucaagaacaagcuggagaagaacgaggag

SEQ ID NO: 340399 - RNA, 65 nt, Homo Sapiens
cauacuuuccuguauaguucacguuucauguaauccucaagaaauaaaaggaagccaaagagugu

SEQ ID NO: 340400 - RNA, 65 nt, Homo Sapiens
accugauguuuucuuauucuguauuuguaguaguacucaagaaucuuuuacuguaggugaaggcu

SEQ ID NO: 340401 - RNA, 65 nt, Homo Sapiens
gccauaaaaucucacgcugcaaguguuucugaagucucaagaacugggggauuuggcuggugccg

SEQ ID NO: 340402 - RNA, 65 nt, Homo Sapiens
agcacagcugauguaaaauucauagaucccagacacucaagaauuaaggucgggacauauauuua

SEQ ID NO: 340403 - RNA, 65 nt, Homo Sapiens
ggauguccauuucggggagaggagcaggugggacccucaagaaaaugacggagaacaucccagac

SEQ ID NO: 340404 - RNA, 65 nt, Homo Sapiens
uuuuuuuaagagacagauuuuuuuauauuuuuccccucaagaacucggcuuuugaaacuuaggua

SEQ ID NO: 340405 - RNA, 65 nt, Homo Sapiens
aaaagaaggacugaacuccacgucuugcccagcagcucaagaagacuccucccagcggccuccgg

SEQ ID NO: 340406 - RNA, 65 nt, Homo Sapiens
guuucuucuggauuccuuauguguacuuggcuuaacucaagaacaccuuucucgaaauugccagu

SEQ ID NO: 340407 - RNA, 65 nt, Homo Sapiens
gcagguaugugggccagaggccacagacuaccccacucaagaacagccuuucuacaaagcaaggc

SEQ ID NO: 340408 - RNA, 65 nt, Homo Sapiens
aggaggcucccuguacuggagucgucccacuauuccucaagaaaucuuagaaccagcuugugagg

SEQ ID NO: 340409 - RNA, 65 nt, Homo Sapiens
gugaucuguacaaguauguggagcaugaaugcugacucaagaaacuuuuacuccuucugcucaag

SEQ ID NO: 340410 - RNA, 65 nt, Homo Sapiens
uugugagcgaauuagcaauaacauacaugagauaacucaagaaaucaaaagauaguugauucuug

SEQ ID NO: 340411 - RNA, 65 nt, Homo Sapiens
caaagaaacacuugugcaguguauacacagcacuacucaagaagcguuauaaaaauguauaggca

SEQ ID NO: 340412 - RNA, 65 nt, Homo Sapiens
uaaacauuuguuucugugugcuguuguucugcuuccucaagaaaugcucaccccucucugaaggg

SEQ ID NO: 340413 - RNA, 65 nt, Homo Sapiens
aaaaaaaaaaaaaagaauguagagugagacucugucucaagaaggugcacuccagccugggugac

SEQ ID NO: 340414 - RNA, 65 nt, Homo Sapiens
accgccuuccccacccccugaguugcuaaguggggcucaagaagccugccagaggaugagugacc

SEQ ID NO: 340415 - RNA, 65 nt, Homo Sapiens
ucaaauucaggacauaaacuaaagcaccacagcuacucaagaagauucugucacaaauguuccug

SEQ ID NO: 340416 - RNA, 65 nt, Homo Sapiens
gaagcagauucauacagccucaagaaucuuaaaaucucaagaaguagucaaucugaaagauuuuu

SEQ ID NO: 340417 - RNA, 65 nt, Homo Sapiens
agcauuucuuuaaaauguuuucuuuuuaaagcagucucaagaauagagugaugcagacuuguucu

SEQ ID NO: 340418 - RNA, 65 nt, Homo Sapiens
gacagaagagacagugauuuagaaaaagaaaccuacucaagaaaaugagaacacaagaacuuaag

SEQ ID NO: 340419 - RNA, 65 nt, Homo Sapiens
guggaggacccuggaaggaccccuuuucucuggaucucaagaaugagaaugacaaacacaagugc

SEQ ID NO: 340420 - RNA, 65 nt, Homo Sapiens
auguucguauuagagacaaagcuuuuuaguuauuucucaagaagcuuucuugcacuaucacaauu

SEQ ID NO: 340421 - RNA, 65 nt, Homo Sapiens
cugguacaccuguaccagcugcuuuguaaagcaaacucaagaaaacaaaaccuucgucucuuugu

SEQ ID NO: 340422 - RNA, 65 nt, Homo Sapiens
uaaaagauacuuaauucuugacaugagauaaagaccucaagaagugaaagaauuagcaguaaaau

SEQ ID NO: 340423 - RNA, 65 nt, Homo Sapiens
caaaagauaguugauucuugacauacaugagauaacucaagaaauuugugagcgaauuagcaaua

SEQ ID NO: 340424 - RNA, 65 nt, Homo Sapiens
aagcaagcugccuuuguacucuucccccccugcaucucaagaauagcagacagacugcaccaccc

SEQ ID NO: 340425 - RNA, 65 nt, Homo Sapiens
acacagaagcacacaucccugagaaauauuuaaagcucaagaagauuauuuuagguauuaagacu

SEQ ID NO: 340426 - RNA, 65 nt, Homo Sapiens
ugucuaacgagagacaucaguuucucaggaugauccucaagaacguuauggaguccauguugcaa

SEQ ID NO: 340427 - RNA, 65 nt, Homo Sapiens
ugcucugaaaaauuccuuuuaaaguccuucuguuacucaagaaaagccaagagcgucagguggca

SEQ ID NO: 340428 - RNA, 66 nt, Homo Sapiens
caggugugauuugugcaagccagguucaacccuugccucaagaaaucagaugggaccaauuuagug

SEQ ID NO: 340429 - RNA, 66 nt, Homo Sapiens
ugggaagauggcuggugaggagcuuaacagaggaaccucaagaagauucugaaaauccuaccccca

SEQ ID NO: 340430 - RNA, 66 nt, Homo Sapiens
agggcaauacugaagggguuaaacagguuuuugcuccucaagaauuuguuugccugggcccaggau

SEQ ID NO: 340431 - RNA, 66 nt, Homo Sapiens
augauaacacuuaccaaaagaucacugcaaaccugccucaagaagcugaugguggcacuucaauuu

SEQ ID NO: 340432 - RNA, 66 nt, Homo Sapiens
aggaaguccuuuuuuuuuuuuuuuuuuuuuuaauugcucaagaaaugauucucucacaggcuuggg

SEQ ID NO: 340433 - RNA, 66 nt, Homo Sapiens
gugacugaugacaucugacuuuugucgaugggacuucucaagaagccauuccuuggagcuucuguu

SEQ ID NO: 340434 - RNA, 66 nt, Homo Sapiens
cgcauacugccaugaagacggucucuguguccucagcucaagaauccuguagcuugucccaucaua

SEQ ID NO: 340435 - RNA, 58 nt, Homo Sapiens; identical to SEQ ID NO: 339023

SEQ ID NO: 340436 - RNA, 66 nt, Homo Sapiens
aggauuccuccaugguaaagcugaacugaaacaauucucaagaaugcaucagcuguaccuacaaua

SEQ ID NO: 340437 - RNA, 66 nt, Homo Sapiens
uucaaucugaagauguaagacuuccugaaacaaguucucaagaagucuuuacauuauauuuauaac

SEQ ID NO: 340438 - RNA, 66 nt, Homo Sapiens
auuuugaauauuggggaaggaagaugauacuucuuucucaagaaaagaaaauuggauuauuaggaa

SEQ ID NO: 340439 - RNA, 66 nt, Homo Sapiens
gaugucauaagcgaucacuuccuauaugcacuuauucucaagaagaacaucuuuaugguaaagaug

SEQ ID NO: 340440 - RNA, 66 nt, Homo Sapiens
agugugaaugcugaacugaaggcucagauugaggagcucaagaacgagaagcagcauuugauauac

SEQ ID NO: 340441 - RNA, 66 nt, Homo Sapiens
uauuuguauuucaccaccuaaauguaauguugauuccucaagaaugaaaugaaggcacuacauuga

SEQ ID NO: 340442 - RNA, 66 nt, Homo Sapiens
acuuaugaguaagcagucuggcgucgcugacaaguucucaagaagaucuucaagacaaaacagauu

SEQ ID NO: 340443 - RNA, 66 nt, Homo Sapiens
aguuagcaaaccacuccuuuuuagagggauccacuacucaagaaaacuuuccacgugagguuuugu

SEQ ID NO: 340444 - RNA, 65 nt, Homo Sapiens; identical to SEQ ID NO: 340091

SEQ ID NO: 340445 - RNA, 66 nt, Homo Sapiens
agcugagugaacagcaugauagacauguggagucaacucaagaaaacugauccacuggucacaggu

SEQ ID NO: 340446 - RNA, 66 nt, Homo Sapiens
cagcucagcuucuccuucgacaccacguccccagaucucaagaacgugccuugugaccacaucucc

SEQ ID NO: 340447 - RNA, 66 nt, Homo Sapiens
cauggagacuccugcccugugccugcaaacucacugcucaagaagaugagaagagggccuguggga

SEQ ID NO: 340448 - RNA, 66 nt, Homo Sapiens
auuuuucuaaaaauaugaguaaagaaaaaaaauaaacucaagaaugagaaugagauccugucucuu

SEQ ID NO: 340449 - RNA, 66 nt, Homo Sapiens
gagcuuuguauguguccuuuuauugcauaagcacagcucaagaacucagcuuacugaucacuauag

SEQ ID NO: 340450 - RNA, 66 nt, Homo Sapiens
caugccagcucagcccuacaaugagagcccugagcccucaagaacuacagcagugggcuacauaca

SEQ ID NO: 340451 - RNA, 66 nt, Homo Sapiens
aguuccaaaccuagcagaauacaauuaaaggguugacucaagaacuauuauugacaauggcagaga

SEQ ID NO: 340452 - RNA, 66 nt, Homo Sapiens
agaggccuccucuggagugacccaucuccuucccuccucaagaagcucugagggcauccgacaagg

SEQ ID NO: 340453 - RNA, 66 nt, Homo Sapiens
uccuuaaaaacuuugaaguuauauuguguuaaguuccucaagaauccuuuguauggcaguauguau

SEQ ID NO: 340454 - RNA, 66 nt, Homo Sapiens
caggggcauccagggcucccgggggaccaagacauccucaagaaaagcugggauuuaaggacuucu

SEQ ID NO: 340455 - RNA, 66 nt, Homo Sapiens
ugaugggccugaacucggaccagccucaaaaacgcccucaagaacagucaagucccccagcagaac

SEQ ID NO: 340456 - RNA, 51 nt, Homo Sapiens; identical to SEQ ID NO: 339044

SEQ ID NO: 340457 - RNA, 66 nt, Homo Sapiens
ccagagucaccugucucaucucagggcacggcgccccucaagaacucuuccugcucacauccacag

SEQ ID NO: 340458 - RNA, 66 nt, Homo Sapiens
ugggcuguaacaauucagggcucauaccacguuuugcucaagaagcaacgaaggcccucucuuccu

SEQ ID NO: 340459 - RNA, 66 nt, Homo Sapiens
agugcuuuuucuccauggauguuaauuugcuguugccucaagaaaaccauauuuuguaucagugcu

SEQ ID NO: 340460 - RNA, 66 nt, Homo Sapiens
uucacuaugugaaugagauguaauuauaguacaauucucaagaaaaauggaaaaccuuauggaaaa

SEQ ID NO: 340461 - RNA, 66 nt, Homo Sapiens
cauugacccugauuugaccccucuucuuauaaggaucucaagaaucucuucagaagcacugaugac

SEQ ID NO: 340462 - RNA, 66 nt, Homo Sapiens
uauucaaggcaaagcaaggaacaucuugagauaugucucaagaauauaaagauguauuauuuuaag

SEQ ID NO: 340463 - RNA, 66 nt, Homo Sapiens
gaggcucacaugggaguuguccucacccuuguuaaucucaagaaacucuuauuuauaauagguugc

SEQ ID NO: 340464 - RNA, 66 nt, Homo Sapiens
gggaucuguuuggaaacaaccccuugagcugccaggcucaagaaaucauggacucacaggguccug

SEQ ID NO: 340465 - RNA, 66 nt, Homo Sapiens
uccaauggccuguguguuacaaugauaugaucauuucucaagaauaagucccuuuuuguauguguu

SEQ ID NO: 340466 - RNA, 66 nt, Homo Sapiens
ugugucuucugugucacaaacagcacuccaggccagcucaagaagcaaagcaggccaauagaaaug

SEQ ID NO: 340467 - RNA, 66 nt, Homo Sapiens
augccuaugugugcuccauuccucauuucuacuuggcucaagaaaacauuucugcagucaggugag

SEQ ID NO: 340468 - RNA, 66 nt, Homo Sapiens
uuaaaggcagugaaaauggccagccagagaaaagaucucaagaaccagaaauaaauaaggauggug

SEQ ID NO: 340469 - RNA, 66 nt, Homo Sapiens
agguaaagacauacucauuaaguguuauuuauuuuacucaagaacuggaaaccaacuaaaugccuu

SEQ ID NO: 340470 - RNA, 66 nt, Homo Sapiens
cucaguauguucccaggcuaguguugaacuccugagcucaagaaauccuccugccugagucucuga

SEQ ID NO: 340471 - RNA, 66 nt, Homo Sapiens
aauagguuucugauuacauaaaauuugaauagaacacucaagaaguauguagauuuuugaaaaacc

SEQ ID NO: 340472 - RNA, 66 nt, Homo Sapiens
acugugaauguuccaacaccugccuccacuucuccccucaagaaauuuucaacgccaggaaucaug

SEQ ID NO: 340473 - RNA, 66 nt, Homo Sapiens
ucaugaagagacuucugcuuuucaacccccacccuccucaagaaguaauaauuuguuuacuuguaa

SEQ ID NO: 340474 - RNA, 66 nt, Homo Sapiens
acaaguuggaugcggccauucaaggggagccaaaaucucaagaaauucccagcagguuaccuggag

SEQ ID NO: 340475 - RNA, 66 nt, Homo Sapiens
ucccuccccagacaucuggacacugggcauagauuucucaagaaggaagacuccccugccucccca

SEQ ID NO: 340476 - RNA, 66 nt, Homo Sapiens
cauugaaaaauucuaugaaucagugaacuuuugcaucucaagaaaagucauuugaaaacacugcaa

SEQ ID NO: 340477 - RNA, 66 nt, Homo Sapiens
uggcucucauucuaagaggcaagcucccagugaucacucaagaauccccgugucuuucucuaggac

SEQ ID NO: 340478 - RNA, 66 nt, Homo Sapiens
uccuguuggauuuguuuaaauuauaugagaaggugccucaagaauuaauugcauucaucuuguguu

SEQ ID NO: 340479 - RNA, 66 nt, Homo Sapiens
guacagauguguggaauacgacccuaagcgaucauacucaagaauaugccugguucucaauuugac

SEQ ID NO: 340480 - RNA, 66 nt, Homo Sapiens
auaauaaaagaccauaaauauauugaaggaaaaggacucaagaaaaccagaagugacuuauuaaac

SEQ ID NO: 340481 - RNA, 66 nt, Homo Sapiens
cuauugauauuggucauguucaaaacuuauaguagccucaagaaguauuuuuugaaccuuauuucu

SEQ ID NO: 340482 - RNA, 58 nt, Homo Sapiens; identical to SEQ ID NO: 339070

SEQ ID NO: 340483 - RNA, 66 nt, Homo Sapiens
gcuucagauccucuuguguagcuguugaaagucucccucaagaauacauuuugugcucugaguuuu

SEQ ID NO: 340484 - RNA, 66 nt, Homo Sapiens
gucaauaucauuuuaauguaauugauuguauauagucucaagaaugguuggugggcaugaguuccu

SEQ ID NO: 340485 - RNA, 66 nt, Homo Sapiens
gaaacuuuuguagcaaucuggucuauagacuuuuaacucaagaagcuaaggcuagacuuguuaccu

SEQ ID NO: 340486 - RNA, 66 nt, Homo Sapiens
cagaaaugucucuccucuagguaucguauuuuguugcucaagaauccaaaaugggucuguggacau

SEQ ID NO: 340487 - RNA, 66 nt, Homo Sapiens
cugcugcuuaguuuuuggacugaaaagauauuaaaacucaagaaggaccaagaaguuuucauaugu

SEQ ID NO: 340488 - RNA, 66 nt, Homo Sapiens
ucgaggaguaacaauacaaauggauuuugggagugacucaagaagugaagaaugcacaagaaugga

SEQ ID NO: 340489 - RNA, 66 nt, Homo Sapiens
aucaagacacagaacaaggucugucuccuauagucacucaagaagucgaucgagaaguuccacauc

SEQ ID NO: 340490 - RNA, 66 nt, Homo Sapiens
ucaauuaauuagacuuuuguauaagagaugucaugccucaagaaagccauaaaccugguaggaaca

SEQ ID NO: 340491 - RNA, 66 nt, Homo Sapiens
aucucccugaagcagacugcugaggaauuacauuugcucaagaauuuuuuccgucaaauugugaac

SEQ ID NO: 340492 - RNA, 66 nt, Homo Sapiens
cugccuuaauuauuuaucuuuaguuccuuauuaguucucaagaaacaaaugcuagcuucauaugua

SEQ ID NO: 340493 - RNA, 66 nt, Homo Sapiens
cagugggucccuuccuuucuccuuuccucucuacugcucaagaacagauuugaggccaggugcggu

SEQ ID NO: 340494 - RNA, 66 nt, Homo Sapiens
uuuuauaagcaauguaauuaugcuauucacaggggccucaagaauugguauguaugaugugaucug

SEQ ID NO: 340495 - RNA, 66 nt, Homo Sapiens
aaauccuuauguagaaaggacuuugaaauuuuucuucucaagaaaugguuuguauaagaauaacaa

SEQ ID NO: 340496 - RNA, 66 nt, Homo Sapiens
gaaugauacugacugauuaauuauuccugauaacaucucaagaaaaggagaaggaaaguguuucug

SEQ ID NO: 340497 - RNA, 66 nt, Homo Sapiens
gccuauaaaauugucagcguauuuuuacacuauuggcucaagaauguuauaaugcuaagggacaua

SEQ ID NO: 340498 - RNA, 66 nt, Homo Sapiens
gagaagaaaagauuaauaccuuaaaagaagaaaacacucaagaagcagcaguccugaaugguguuu

SEQ ID NO: 340499 - RNA, 66 nt, Homo Sapiens
aaaauuuuuuaaauaaguuucacagagcaagacugucucaagaaaauacugcacuccagccugggc

SEQ ID NO: 340500 - RNA, 66 nt, Homo Sapiens
auaagagaaaugaacucacaauugcuuagaaugguucucaagaauuuuuauauuuuauacaaauag

SEQ ID NO: 340501 - RNA, 66 nt, Homo Sapiens
gaauuaacuacauaauggaauaauggcaggcaggcacucaagaaauuuagauaagcaccuggcauc

SEQ ID NO: 340502 - RNA, 66 nt, Homo Sapiens
cucuugagccaguaaucaaugaagagcagaacauuucucaagaauccucguuucugugaauuucau

SEQ ID NO: 340503 - RNA, 66 nt, Homo Sapiens
aaugguguuuuggaaauuuuaagccacgucauauaacucaagaauaguuuggagaauagaaaugaa

SEQ ID NO: 340504 - RNA, 66 nt, Homo Sapiens
gccagggccagggcuguaugccacaaaccccacucccucaagaaggggaucccugcugggcacacc

SEQ ID NO: 340505 - RNA, 66 nt, Homo Sapiens
aacugaagaaggagcaagugaugaaaaccaaauuuccucaagaaauauugugcaggacaguaaaua

SEQ ID NO: 340506 - RNA, 66 nt, Homo Sapiens
acugcaacacuacuuuaugggagcuccaugcccaagcucaagaacgugucagauguggucaguagg

SEQ ID NO: 340507 - RNA, 66 nt, Homo Sapiens
gauugguacugcaacuguagcaugcauuuaaaacuccucaagaaagauacaauuuaauugcucaac

SEQ ID NO: 340508 - RNA, 66 nt, Homo Sapiens
agcauuaguaauuucuaguaacaauuuuuuagguuacucaagaacccauucuaaauuugaguaaau

SEQ ID NO: 340509 - RNA, 66 nt, Homo Sapiens
ugguacaaaacacaaccgagauuacacaacguuuuccucaagaaaaacuaagggaacacacaaaga

SEQ ID NO: 340510 - RNA, 66 nt, Homo Sapiens
gaugucuauugaguagaaccgauaauaauggugaagcucaagaacauuucuauaauggguuugggg

SEQ ID NO: 340511 - RNA, 66 nt, Homo Sapiens
agggauuccuaauaauggcaugucauguagcugacacucaagaaauugcaggugaauuguggaaaa

SEQ ID NO: 340512 - RNA, 66 nt, Homo Sapiens
uaggcucauggcaacgugugacauauucacauggcgcucaagaagucucuggcuuuccugcuauac

SEQ ID NO: 340513 - RNA, 66 nt, Homo Sapiens
uguguuuucuuuagcuuccccaacuguccugccugccucaagaauaugucuucaucaaguggaagc

SEQ ID NO: 340514 - RNA, 66 nt, Homo Sapiens
uauguaaauuugcucuguuuuaagacuuugaacuaccucaagaagaggaaucuaauacaauauuug

SEQ ID NO: 340515 - RNA, 66 nt, Homo Sapiens
cccacaaguuuucacugaaugagcauggcagugccacucaagaaaaugaaucuccaaaguaucuuc

SEQ ID NO: 340516 - RNA, 66 nt, Homo Sapiens
cacagugcuuagaaguaagcaauucccaggucauagcucaagaauuguuagcaaaugacagauuuc

SEQ ID NO: 340517 - RNA, 66 nt, Homo Sapiens
cacuagugccaggucacuauuguaagauguuaaaaucucaagaaaauuucacagagcuaaagaaau

SEQ ID NO: 340518 - RNA, 66 nt, Homo Sapiens
auagauaagaaaggacuacagcauuugauguguguccucaagaacuugucuugggucugaaaaagc

SEQ ID NO: 340519 - RNA, 66 nt, Homo Sapiens
cacccuauggccuucuugucaaaaccuucacuggagcucaagaaaagcauuucuguuguguuauuu

SEQ ID NO: 340520 - RNA, 66 nt, Homo Sapiens
aguugcuuaugggaauccugagcugcuuuucaccaucucaagaagccuaagaaguuauauauuuaa

SEQ ID NO: 340521 - RNA, 66 nt, Homo Sapiens
acuuguagauaaaaguguuccaguaaucagaaaauccucaagaaaauugacuucauuauuuggaag

SEQ ID NO: 340522 - RNA, 66 nt, Homo Sapiens
ugugcccauuaccuuuccucugccugaaagacgugucucaagaaaaauaaauucuauuuuagaugc

SEQ ID NO: 340523 - RNA, 66 nt, Homo Sapiens
agaauaaaauugaaaucugcuagacaauguuuuugucucaagaacaauuaguauaucaucauaaaa

SEQ ID NO: 340524 - RNA, 66 nt, Homo Sapiens
caaauacagcuuuuuuucaaacauuuagacuucuuucucaagaaauaagaauaaaaagguaaaacu

SEQ ID NO: 340525 - RNA, 66 nt, Homo Sapiens
uuuacguaguuuuucauaggaccugucuuccuguuucucaagaauaucaaacgaacaagauuaauu

SEQ ID NO: 340526 - RNA, 66 nt, Homo Sapiens
ggccccuuuuuccaacuuauuacuuuuauccaugugcucaagaaagcaaucuuuagacuacaauaa

SEQ ID NO: 340527 - RNA, 66 nt, Homo Sapiens
aucaagggacuccugugucacaaguguacagaucuccucaagaaacccagauauguauuugcuacu

SEQ ID NO: 340528 - RNA, 66 nt, Homo Sapiens
uuuaaauaaccgauuauugauuacuguauuuuuuuucucaagaacagugauagguagaaacuaauu

SEQ ID NO: 340529 - RNA, 66 nt, Homo Sapiens
uaaaagucaucauugcuguuuagcuugacuguuuuccucaagaacaucgaucugaaggauucauaa

SEQ ID NO: 340530 - RNA, 66 nt, Homo Sapiens
aaagaugcucuguagagaauuugcuaccgaaguuggcucaagaauuuguuuuuaguguuauuuacc

SEQ ID NO: 340531 - RNA, 66 nt, Homo Sapiens
uucuggcaaaggccuuccugcauuuaugaauucucucucaagaagcaagagaacaccugcaggaag

SEQ ID NO: 340532 - RNA, 66 nt, Homo Sapiens
gaaugagaauuaagaauggacaggaccaagacagaacucaagaaagccacuggggaaaacucgaga

SEQ ID NO: 340533 - RNA, 66 nt, Homo Sapiens
caaauauguucaacauuuacuucuauuugauaucugcucaagaagucauagaagucuugggaaacu

SEQ ID NO: 340534 - RNA, 66 nt, Homo Sapiens
ugccacguauguucaaggguaaauaaaaccacaagucucaagaauuuaaguaacauugucagaaau

SEQ ID NO: 340535 - RNA, 66 nt, Homo Sapiens
uagucagacugacacuacuacagaguacgugaaaugcucaagaauguuuuucuucagguaacacua

SEQ ID NO: 340536 - RNA, 66 nt, Homo Sapiens
aaaucaucaccaauaccuuucauacucaccaccaagcucaagaaaucaaaacaaaacacaguccug

SEQ ID NO: 340537 - RNA, 66 nt, Homo Sapiens
uuuaauauuuaaauaaaaucuagccaaagguucacucucaagaagcccagccaacucauuggguug

SEQ ID NO: 340538 - RNA, 66 nt, Homo Sapiens
aauauccaauguuuaugaguagccucacucuuauuccucaagaauuuaaauaucaccuagaaaagu

SEQ ID NO: 340539 - RNA, 66 nt, Homo Sapiens
ccaggagguaauuuguugaucauauuuucacuuuaacucaagaauuaaacaucagcauuguauaca

SEQ ID NO: 340540 - RNA, 66 nt, Homo Sapiens
guguaccacuaaaaguaauaaaaaucaagacauuuucucaagaacuauaucacaaauggcaaugua

SEQ ID NO: 340541 - RNA, 66 nt, Homo Sapiens
augggagcugcaaacgcggugaauugguuuguuggccucaagaagauccaagaagcaugcagagaa

SEQ ID NO: 340542 - RNA, 66 nt, Homo Sapiens
cagcugcacaggccuugacucaggcccccagcaagucucaagaacacaggaaccaugccccuuccc

SEQ ID NO: 340543 - RNA, 66 nt, Homo Sapiens
uuuucaacgacagugauaguguauaaaauaaacuaucucaagaaagauaagaaauacaguuuguuu

SEQ ID NO: 340544 - RNA, 66 nt, Homo Sapiens
uacaguggcuccccaaugccgugaagucauugccugcucaagaaugaaccuuugagaaauccuuuu

SEQ ID NO: 340545 - RNA, 66 nt, Homo Sapiens
ugauaccuggguugaugugguuagccaugggcugggcucaagaaccaauacagaguguguucgcac

SEQ ID NO: 340546 - RNA, 66 nt, Homo Sapiens
aagaaaacugccuaacugaagggaaugggggcccugcucaagaagggggccaggcagcuggaauca

SEQ ID NO: 340547 - RNA, 66 nt, Homo Sapiens
ccugggguaugagcugccaagucuauuuuaaagacgcucaagaauccucugggguucaucuaggga

SEQ ID NO: 340548 - RNA, 66 nt, Homo Sapiens
ggucauucagccaacccagaggauguagacccuguccucaagaagugcagggcgaguucugccgug

SEQ ID NO: 340549 - RNA, 66 nt, Homo Sapiens
gagcuguggaacgagacuucugcagagguggcugaccucaagaagcagguacaggcccuucagccc

SEQ ID NO: 340550 - RNA, 66 nt, Homo Sapiens
acagacuagauuauauuuaguaggggaaaaauugggcucaagaaccauucaucaguacgugagaca

SEQ ID NO: 340551 - RNA, 66 nt, Homo Sapiens
ucugacuuguaagcaguucauagaagcugcucaauacucaagaaucuugcaagacaguuauuaaac

SEQ ID NO: 340552 - RNA, 66 nt, Homo Sapiens
gcgaaaggacagacuguuggccacugcacauuucuccucaagaaaaguaucuuguuuugaucauuu

SEQ ID NO: 340553 - RNA, 66 nt, Homo Sapiens
acuccgaagucagucugcagaccucuccccuccuggcucaagaauuucucagcaauuugaacacua

SEQ ID NO: 340554 - RNA, 66 nt, Homo Sapiens
cacuucacguauucuuguauagggugcccauuaccacucaagaagagguucugagcaaauaacuac

SEQ ID NO: 340555 - RNA, 66 nt, Homo Sapiens
gagaugcccuagugguggccuguccagcagaaccagcucaagaaagggaccgguagccuucaagcu

SEQ ID NO: 340556 - RNA, 66 nt, Homo Sapiens
guaauuaugaagaguggagacuggauuuggccuguccucaagaaugcuguuuuacuccgugccuua

SEQ ID NO: 340557 - RNA, 66 nt, Homo Sapiens
acuuuauucuuguaucucauauauuagagguggaaccucaagaaugcaaacagcguccauuuuuuc

SEQ ID NO: 340558 - RNA, 66 nt, Homo Sapiens
agccagcaaguauucucagcgacucaggaguugcuucucaagaaagaugcauugucuugcccuaua

SEQ ID NO: 340559 - RNA, 66 nt, Homo Sapiens
gauuuggugugauaccuuguaaauaggaaugguuuucucaagaauaucuuuuaaacauuaaguuug

SEQ ID NO: 340560 - RNA, 66 nt, Homo Sapiens
uguuauguguguuugcugcgguuuaagggucuaagucucaagaaucauugagugaugagcagacau

SEQ ID NO: 340561 - RNA, 66 nt, Homo Sapiens
acuggcuuuaaaagaagccacuucuugcauuuauuucucaagaauugaauauuuaaucuauuuaau

SEQ ID NO: 340562 - RNA, 66 nt, Homo Sapiens
augugcuaucuggcuuugaaaugcuauuuaaagugacucaagaagcguagcccucaauauuuggua

SEQ ID NO: 340563 - RNA, 66 nt, Homo Sapiens
agaaagaaauauuguugcucaguguuguuaauauagcucaagaauugaguuuauauuugcaguaug

SEQ ID NO: 340564 - RNA, 66 nt, Homo Sapiens
guggacgagaagacucagccugagggccugcggagccucaagaagccagaccgcaagaagcgcuac

SEQ ID NO: 340565 - RNA, 66 nt, Homo Sapiens
auuguggaacuuccucuuucauuggaaacuuucuuacucaagaaugacggcaguauuguuuucuua

SEQ ID NO: 340566 - RNA, 66 nt, Homo Sapiens
uggacugucuucaucaaguauuucccuacagaacuccucaagaaaacagagaucauuuggcuagag

SEQ ID NO: 340567 - RNA, 66 nt, Homo Sapiens
caggacucugggccccuccccagcuccacucccuaccucaagaaugugaccauuuggaaaaggcaa

SEQ ID NO: 340568 - RNA, 66 nt, Homo Sapiens
uugccauguugccaaggcugguuucaaacuccuggacucaagaaauccacccaccucagccuccca

SEQ ID NO: 340569 - RNA, 66 nt, Homo Sapiens
ucugugacaguuccaggucuugaagcuaaucagcaucucaagaaaguauccagaaagaacaucugc

SEQ ID NO: 340570 - RNA, 66 nt, Homo Sapiens
agauccuaagcucucaaaauagcauauucccuagagcucaagaaagcugguccaggagguugaaaa

SEQ ID NO: 340571 - RNA, 66 nt, Homo Sapiens
aaacgaacugggaaaauuucgcgacagaagucuugucucaagaagagccguugugcuccagccugg

SEQ ID NO: 340572 - RNA, 66 nt, Homo Sapiens
ugaagauuccaguggucagucucagccuuggaacuccucaagaaccccucccaugcccguucugac

SEQ ID NO: 340573 - RNA, 66 nt, Homo Sapiens
agaauccauuuagcaccucccguuacccaggcaauacucaagaagguggagauugggaaacuuaac

SEQ ID NO: 340574 - RNA, 66 nt, Homo Sapiens
augcagcuguucugaacugguguuuucauaaguucacucaagaaaaaguuuuugcuguuguaaaag

SEQ ID NO: 340575 - RNA, 66 nt, Homo Sapiens
uuagaauuuaaguaccuuuuacuaauucucaaauggcucaagaacaaauaugucuguuuaaaaauu

SEQ ID NO: 340576 - RNA, 66 nt, Homo Sapiens
ccuaaaguuucaauacaagcgcccucagcaccacagcucaagaaaagcuguuagugucuucuuccu

SEQ ID NO: 340577 - RNA, 66 nt, Homo Sapiens
accuacacccacgcacccccccacacacuaugcucucucaagaauguaauuuauuggggccccccc

SEQ ID NO: 340578 - RNA, 66 nt, Homo Sapiens
acuuagaguccugccguggcucagguggaucuaaaacucaagaacaaauucuauuuauuuauuauu

SEQ ID NO: 340579 - RNA, 66 nt, Homo Sapiens
aaauauacuaucuaucucaccaguauuugcucucgacucaagaagguuaacauuuucugauucaug

SEQ ID NO: 340580 - RNA, 66 nt, Homo Sapiens
ucaugacagcugucuguuguuuuaugaaguuuauuucucaagaaaaugggaauaaauuugggauuu

SEQ ID NO: 340581 - RNA, 66 nt, Homo Sapiens
ucccacucuagcuugggcaauagagcaaggcuccgucucaagaaaagaaggucauuucccaagacu

SEQ ID NO: 340582 - RNA, 66 nt, Homo Sapiens
gcaguggaagcauguguguuucuaaaaaguaaaaaucucaagaaaacagaaauggcaugcuuuacc

SEQ ID NO: 340583 - RNA, 66 nt, Homo Sapiens
cuaauaaugcagagauaauuagacaugguucccgcccucaagaagcucacaaaaguauucaggaaa

SEQ ID NO: 340584 - RNA, 66 nt, Homo Sapiens
acaaguucuuuuggaacuuguuucaagccaaaaacucucaagaaagcaaauugcaccucagcugga

SEQ ID NO: 340585 - RNA, 57 nt, Homo Sapiens; identical to SEQ ID NO: 339173

SEQ ID NO: 340586 - RNA, 66 nt, Homo Sapiens
uucccuaaauuaucccauuauguaauucuuggucagcucaagaacuggguucuuuuucuaauaauu

SEQ ID NO: 340587 - RNA, 66 nt, Homo Sapiens
cugagcuggaacaguaggggcagggagaagacaggucucaagaaaagguuuuuaagaaguuucauc

SEQ ID NO: 340588 - RNA, 66 nt, Homo Sapiens
uacuuccucuacucucccgugcacugccggccagagcucaagaagcugcugcacgggcugggccuu

SEQ ID NO: 340589 - RNA, 66 nt, Homo Sapiens
gcauccucugaccuacuucaaaauaaugcuggaauacucaagaauuguauuuuacucugaucaaau

SEQ ID NO: 340590 - RNA, 66 nt, Homo Sapiens
uguuaaccuccggggagagccaacacaaaacccuaucucaagaacuagcgggaggaagcacugaaa

SEQ ID NO: 340591 - RNA, 66 nt, Homo Sapiens
ccaugcgcuggcaguacaugagucuugcuuuaugggcucaagaauggcuaaccacagggccugaga

SEQ ID NO: 340592 - RNA, 66 nt, Homo Sapiens
aaaaaaaaguuuguuuuuucuuuaauacucuuuucucucaagaaaauuucccugauauuauuucua

SEQ ID NO: 340593 - RNA, 66 nt, Homo Sapiens
guucauauuaauugaggauuuucaaauuucccauuucucaagaaauuuauggugggagggaauguu

SEQ ID NO: 340594 - RNA, 66 nt, Homo Sapiens
cagcccugcuucugacauaaaagaaacuuguccuuccucaagaacauucauuuugaugauucugag

SEQ ID NO: 340595 - RNA, 66 nt, Homo Sapiens
aacagaaacgagauuugccagagcuauaauguuucccucaagaacauaaaaauaaccaaaaaaugu

SEQ ID NO: 340596 - RNA, 66 nt, Homo Sapiens
gccuguggaccgaggcccccccuggucaacaaggaccucaagaacucugucagccccaguuggcuu

SEQ ID NO: 340597 - RNA, 66 nt, Homo Sapiens
caaugcagagguaacucucaggcagcuaagcagcaccucaagaaaacauguuaaauuaaugcuucu

SEQ ID NO: 340598 - RNA, 66 nt, Homo Sapiens
uucugagaguagcugcugcuuucccugacuuccuuccucaagaauacagucuauucugggggguug

SEQ ID NO: 340599 - RNA, 66 nt, Homo Sapiens
gcagauuuuccucugacaccagagaacaauaguagucucaagaauggaaaccugaaugucugaggg

SEQ ID NO: 340600 - RNA, 66 nt, Homo Sapiens
ggaaaaacuucaguuacugaccagucaagagaauuucucaagaaaaaucccagcaacguucccucu

SEQ ID NO: 340601 - RNA, 66 nt, Homo Sapiens
cuucaagcacaaagugaugaaugacugccuucaagucucaagaaaacacuuuucccuaacuuuuag

SEQ ID NO: 340602 - RNA, 66 nt, Homo Sapiens
uaauuugggugagcugcaccugauuaguugaaaggccucaagaacaaacacugcaguuuccuggaa

SEQ ID NO: 340603 - RNA, 66 nt, Homo Sapiens
uacaacuguggaguugguagcugguaacauuguugucucaagaacaacucaccucucucccuagga

SEQ ID NO: 340604 - RNA, 66 nt, Homo Sapiens
cagcccuaaaauucucuccauauccgccacagaaggcucaagaaucgcacaacuaaaccuucuuaa

SEQ ID NO: 340605 - RNA, 66 nt, Homo Sapiens
guacucgggcgacaccuuacaugagccaauggcagucucaagaaauagaacuaccucauaugcagg

SEQ ID NO: 340606 - RNA, 66 nt, Homo Sapiens
gccugaaugacaauguccagacagguucauucuuugcucaagaaaggacuuuucugacauuccuag

SEQ ID NO: 340607 - RNA, 66 nt, Homo Sapiens
aagguaccccaauauaucucagaagaauucaacugucucaagaaucuuaauacaacaagaucaacu

SEQ ID NO: 340608 - RNA, 66 nt, Homo Sapiens
ucuuaguucaguggaggaaaagaugugcacucuggacucaagaaacacauugaagggagaaaggca

SEQ ID NO: 340609 - RNA, 66 nt, Homo Sapiens
agaggggcauaaacuuuccugugcagccagaggcaccucaagaagacagucacugugagcucccag

SEQ ID NO: 340610 - RNA, 66 nt, Homo Sapiens
uauucuuucacccugucucucuuuuuaucccuuccucucaagaaaaaaauucagaugaguuagaag

SEQ ID NO: 340611 - RNA, 66 nt, Homo Sapiens
uaaagugacauaauuuacaugcaauauguuuaucaacucaagaauuuaauauaguugguacacaac

SEQ ID NO: 340612 - RNA, 66 nt, Homo Sapiens
aauggauacauuaggagcuucaaacacauauaauuucucaagaaauuuccagaugucucaugcugc

SEQ ID NO: 340613 - RNA, 66 nt, Homo Sapiens
ucuauuaaggaagaacaaggaagggaaugaucuuuacucaagaauuucagaaagucagcacugaag

SEQ ID NO: 340614 - RNA, 57 nt, Homo Sapiens; identical to SEQ ID NO: 339202

SEQ ID NO: 340615 - RNA, 66 nt, Homo Sapiens
aaagaaggcugcuaauuggauuuugguaguucuuaccucaagaaaacuugaauuauuugggggaaa

SEQ ID NO: 340616 - RNA, 66 nt, Homo Sapiens
gcuaagcuuaugaaggaaugccuccuuuguuacacacucaagaauuugucagcacacaauuaauug

SEQ ID NO: 340617 - RNA, 66 nt, Homo Sapiens
auaauaauucagaaauuggguuuugguucagugauucucaagaaaaagaucucuugcccauuaaga

SEQ ID NO: 340618 - RNA, 66 nt, Homo Sapiens
uuuuuuucugaauaacauuuacaggaaacaagcacacucaagaaagaucacaaaauccaaggugcu

SEQ ID NO: 340619 - RNA, 66 nt, Homo Sapiens
cuacuggaacuggaugaccuggaaaaugguguuuuccucaagaagauuuaaagaaaacugaacuga

SEQ ID NO: 340620 - RNA, 66 nt, Homo Sapiens
gcccagauguagaaauucaugccaggcccucucucccucaagaaauacauuuuccaucuccaaaua

SEQ ID NO: 340621 - RNA, 66 nt, Homo Sapiens
aaacugugcuguuacaacucuuagaaaauaugucuucucaagaacauagaaaguucauuucaucac

SEQ ID NO: 340622 - RNA, 66 nt, Homo Sapiens
ucaguuuauaauuggaagagccucuucauacguuuucucaagaacuuccuggcucucucucugcug

SEQ ID NO: 340623 - RNA, 66 nt, Homo Sapiens
cagcucugcucugagcguccuuggagaccccaguuucucaagaauuagcuccucuauccgaggcca

SEQ ID NO: 340624 - RNA, 66 nt, Homo Sapiens
augcuuuuugggaaacguugucucaccuucuuucuccucaagaaaggcagguugaguccagaugcu

SEQ ID NO: 340625 - RNA, 66 nt, Homo Sapiens
uguuccacagacagaugaggcaggagugauggggcacucaagaaaguucagaggaggcauaagcua

SEQ ID NO: 340626 - RNA, 66 nt, Homo Sapiens
acuuggaucuuggcaugcacccaccuaacccacuuucucaagaacaagaaccuagaaugaauaucc

SEQ ID NO: 340627 - RNA, 66 nt, Homo Sapiens
ccacucccagaagaccaaacugccuuccccucagggcucaagaauguguacagucuguggggccgg

SEQ ID NO: 340628 - RNA, 66 nt, Homo Sapiens
uuuucuccuuuuguguuuuucccacuuuccaauguacucaagaaaauugaacaaauguaauggauc

SEQ ID NO: 340629 - RNA, 66 nt, Homo Sapiens
uuccugacuaaggagcugcagcgauacaucgaagggcucaagaagcgccggagcaagaggcuguac

SEQ ID NO: 340630 - RNA, 66 nt, Homo Sapiens
cagccccagagggcuuuguggaggacaggccuugcccucaagaacgucguaccugacgcugagccu

SEQ ID NO: 340631 - RNA, 66 nt, Homo Sapiens
ucuugagcuuuuuggaaggauaauucugauaaggcacucaagaaacguacaaccacagugcuuucu

SEQ ID NO: 340632 - RNA, 66 nt, Homo Sapiens
aggagacccgccaccguggaggcagggggcaagaaacucaagaacgcaucaagagcaccagcccug

SEQ ID NO: 340633 - RNA, 54 nt, Homo Sapiens; identical to SEQ ID NO: 339221

SEQ ID NO: 340634 - RNA, 66 nt, Homo Sapiens
agaaccucacgcaccucccauccuaaucauccaaugcucaagaaacaacuucuacuucugcccuug

SEQ ID NO: 340635 - RNA, 66 nt, Homo Sapiens
accacuuuucagagucaucuacaaaauuuuucuuuccucaagaaaagaguuccuuuugccuuauuc

SEQ ID NO: 340636 - RNA, 66 nt, Homo Sapiens
gucagcaacagaaaaugagauggaaggaagccaagucucaagaacuaggcugacuuaggaucaugc

SEQ ID NO: 340637 - RNA, 66 nt, Homo Sapiens
aaugucuggggacaggccuuguaaaaggaggguggccucaagaaacgaagccccuggaucuuuggg

SEQ ID NO: 340638 - RNA, 66 nt, Homo Sapiens
ggccucauuccagggcacagcuguuuuuauaugagacucaagaacacccucaugccuaacaguggu

SEQ ID NO: 340639 - RNA, 66 nt, Homo Sapiens
ccuuuguuuugcacugacaagucuucacugccaugccucaagaacagaagaggaggagggauucug

SEQ ID NO: 340640 - RNA, 66 nt, Homo Sapiens
ucccagucugguaggagagagagauacauucccgcccucaagaauccacugggaaugcugggaaau

SEQ ID NO: 340641 - RNA, 66 nt, Homo Sapiens
caugugcagucacuggugucgccggaggaaaagcagcucaagaacagacaggagacaugagucuuu

SEQ ID NO: 340642 - RNA, 66 nt, Homo Sapiens
uaagucuuagugcacaguauuuuuauuuagcaucagcucaagaaacgaauauuccuauugaucuca

SEQ ID NO: 340643 - RNA, 66 nt, Homo Sapiens
uggaagaggcagcaggacuuuguaggggaaaaguuucucaagaaggauccauaaugagauaaugca

SEQ ID NO: 340644 - RNA, 66 nt, Homo Sapiens
gccauuuauggcaugauuagauugcaaagcaaugaacucaagaaggaauugaaauaaggagggaca

SEQ ID NO: 340645 - RNA, 66 nt, Homo Sapiens
uacuaguuuggauaucuuuaggguuuagaaucuaaccucaagaauaagaaauacaaguacaaauug

SEQ ID NO: 340646 - RNA, 66 nt, Homo Sapiens
ccacccaucuuuuuucuucccucauuuucugggauucucaagaaagaaaaaguaacccauuaucac

SEQ ID NO: 340647 - RNA, 66 nt, Homo Sapiens
ggcccuuuuggacuaauguuacuguccaaguucuuucucaagaaaccacaucugguucagaagagu

SEQ ID NO: 340648 - RNA, 66 nt, Homo Sapiens
auuuuuuaaauuuuuuuauaggcccauaugcucuaucucaagaaacaagaugauuguaacaugucc

SEQ ID NO: 340649 - RNA, 66 nt, Homo Sapiens
uauaacuuuccuuuauuucacuuguacccaguuucacucaagaaaucuugaugaauauuuauguug

SEQ ID NO: 340650 - RNA, 66 nt, Homo Sapiens
cuagacccucucuauagccaugagacuccuuguggccucaagaaauuuagacgcccacgacagcac

SEQ ID NO: 340651 - RNA, 66 nt, Homo Sapiens
cucagccgcacccgugugcacuguaacuuuugugugcucaagaaauuauacagaaaccuacagcug

SEQ ID NO: 340652 - RNA, 66 nt, Homo Sapiens
aaucaguaaauaccuugaaauuccuugcaggagugacucaagaauuaaccacuccuggagaaagac

SEQ ID NO: 340653 - RNA, 51 nt, Homo Sapiens; identical to SEQ ID NO: 339241

SEQ ID NO: 340654 - RNA, 66 nt, Homo Sapiens
uagaccuagaaauaccauuugccacccaucugauuccucaagaaucuuauuuccuucauaaagaau

SEQ ID NO: 340655 - RNA, 66 nt, Homo Sapiens
ugccacauuucaauuacauaagaaauguauugaauacucaagaaaaaguuaggaaaaaaaaaucca

SEQ ID NO: 340656 - RNA, 66 nt, Homo Sapiens
cucuagagaagaaaagugaacaagccauuauuuuaacucaagaaaaagaucucauaugaucuucuu

SEQ ID NO: 340657 - RNA, 66 nt, Homo Sapiens
cagcuuggagccucuagguuagggacuuaagcuagacucaagaaaggggcacuccacugcagcagg

SEQ ID NO: 340658 - RNA, 66 nt, Homo Sapiens
ugccuccuuauuuaucaacaccuccucguccccugccucaagaaaucauuaaaaauaguaagccuc

SEQ ID NO: 340659 - RNA, 66 nt, Homo Sapiens
agcaugagcuggccacacauucauggacagccccugcucaagaaaaaagcaugguaugagcacagg

SEQ ID NO: 340660 - RNA, 66 nt, Homo Sapiens
gauaauucauuauaucaucacaacuguauauacuuccucaagaacugauuuuugaaaaauagucac

SEQ ID NO: 340661 - RNA, 66 nt, Homo Sapiens
cccucauuuuuauaaccugggaaacuauaaguaauucucaagaaaggcgcucugccauucaacucg

SEQ ID NO: 340662 - RNA, 66 nt, Homo Sapiens
gguaccuacuacaugcuguaaaacacuugaaugugccucaagaaaaauacuuuuuacuguuugcca

SEQ ID NO: 340663 - RNA, 66 nt, Homo Sapiens
ccuuacagguaaguauugcuucuuucucuaauaauccucaagaaauaaguucuauacuggauccuu

SEQ ID NO: 340664 - RNA, 66 nt, Homo Sapiens
cugcugggaguccccugaguccuucuagauacagggcucaagaaguaaguacuggagagaugggau

SEQ ID NO: 340665 - RNA, 66 nt, Homo Sapiens
ucaucaggguccucagugcagagcaacuuacgcauccucaagaauccacugcuuuucaggcaagga

SEQ ID NO: 340666 - RNA, 66 nt, Homo Sapiens
uucccacgugggcaauaccagggacccauggggaaacucaagaaugacagcuucuauauuuuguaa

SEQ ID NO: 340667 - RNA, 66 nt, Homo Sapiens
auccacuaagaaggccugucuacacugcaggggaaccucaagaacuuuucauugcacuucuaaaau

SEQ ID NO: 340668 - RNA, 66 nt, Homo Sapiens
uucaaaaggaagagccuuuuaaaaacauuugccaaccucaagaauaaauacugaaagucuugaaag

SEQ ID NO: 340669 - RNA, 66 nt, Homo Sapiens
ucuuaggauucugacuaagaggcaaaagagaaaagacucaagaaacugauccuggagaucgagacc

SEQ ID NO: 340670 - RNA, 66 nt, Homo Sapiens
auacucucccagauuuuuacaagugggauuuggggccucaagaaauaugggagccaggaguaagac

SEQ ID NO: 340671 - RNA, 66 nt, Homo Sapiens
uuggauguuuucauuggccuagcugaagaaguuauucucaagaaaauguuuuguuuuaacaaaauu

SEQ ID NO: 340672 - RNA, 66 nt, Homo Sapiens
guguuauaugacaucauccugaagaacuucgagaagcucaagaagcccaggggagaaacaaaggga

SEQ ID NO: 340673 - RNA, 66 nt, Homo Sapiens
ggaaagauuacauacauuugagaauaagaaauuacucucaagaacuucagaaaucugcaacauaau

SEQ ID NO: 340674 - RNA, 66 nt, Homo Sapiens
aagauauuucccauaaaugggaaguuugcccauugucucaagaaauguguauuucagugacaauuu

SEQ ID NO: 340675 - RNA, 66 nt, Homo Sapiens
cuuaacauuuugggaaguaacugccucugacuucaacucaagaaaacacuuuuuuguugcuaaugu

SEQ ID NO: 340676 - RNA, 66 nt, Homo Sapiens
caaaagaagacugacuggguggaggcucugccuugccucaagaaccauccccugcagagcauccag

SEQ ID NO: 340677 - RNA, 66 nt, Homo Sapiens
acguaggccuugcaucucgccaccuccacuucuguccucaagaacaaguccuaggucaagggaaac

SEQ ID NO: 340678 - RNA, 66 nt, Homo Sapiens
agaaauaaauaaggguggugcagccagaggaaaugucucaagaaccuuaaaggaagugaaaauagc

SEQ ID NO: 340679 - RNA, 66 nt, Homo Sapiens
cccuggaauaucccugagaaaagcuacgcacucagccucaagaacuaggaauuagugcuggauuug

SEQ ID NO: 340680 - RNA, 66 nt, Homo Sapiens
cugcuucuugcuuugcagaguuccucaggaauugcccucaagaacucagauggcccugggaaucaa

SEQ ID NO: 340681 - RNA, 66 nt, Homo Sapiens
cagggaacaauacuguaaacauuuacuugagguugccucaagaacuucaaaucuuagaguucauaa

SEQ ID NO: 340682 - RNA, 66 nt, Homo Sapiens
auaugggagcccaugaggagaaaaggguggcugcgacucaagaauaagaaugaagaauggaaaugg

SEQ ID NO: 340683 - RNA, 66 nt, Homo Sapiens
aagaaggagauaaacaugaccaucgucaaagaccugcucaagaaauuuuuaaaaaagaaacaaagu

SEQ ID NO: 340684 - RNA, 66 nt, Homo Sapiens
uaaauuucuuauuugcuagggaacugguaaucuaggcucaagaaguguguggagaagguuuauuuu

SEQ ID NO: 340685 - RNA, 66 nt, Homo Sapiens
uugcaucaguguggacuccuagaacgugcgaccugccucaagaaaaugcaguuuucaaaaacagac

SEQ ID NO: 340686 - RNA, 66 nt, Homo Sapiens
cuuccuccucaggacauggagaucugugcagaugagcucaagaagguccuuaacacagucgugaac

SEQ ID NO: 340687 - RNA, 66 nt, Homo Sapiens
ccaguacaccuguagauauuacuguacuuuuauguucucaagaaauaaguuguugccuauucagug

SEQ ID NO: 340688 - RNA, 66 nt, Homo Sapiens
uuuacugauucauacauuaucucacuugugccaacacucaagaagcaggcuacacugacacuggua

SEQ ID NO: 340689 - RNA, 56 nt, Homo Sapiens; identical to SEQ ID NO: 339277

SEQ ID NO: 340690 - RNA, 66 nt, Homo Sapiens
auucacaguugagugcauccugaaggaaaggaagaccucaagaaaaugggcuccacuucauccaga

SEQ ID NO: 340691 - RNA, 66 nt, Homo Sapiens
uuuuaaaaacgaaacaaagucaucaucaaagagcugcucaagaaauaagaaggagauaaacaccac

SEQ ID NO: 340692 - RNA, 66 nt, Homo Sapiens
uaugucaagaugagcugaaucgguucggaauacuggcucaagaaccaaaggaacuuuauaaugaaa

SEQ ID NO: 340693 - RNA, 66 nt, Homo Sapiens
gggcuuccaaugcugugagagacuggccuugcagagcucaagaaggcagaugugagcugcuaaauu

SEQ ID NO: 340694 - RNA, 66 nt, Homo Sapiens
gcccggaagcgccaggcuggacauucccaugguggccucaagaaaguagccccucucucacacauc

SEQ ID NO: 340695 - RNA, 66 nt, Homo Sapiens
auguguucuuagugauucacauccacgggacaaaaacucaagaagaaauaagagcugacgccacac

SEQ ID NO: 340696 - RNA, 66 nt, Homo Sapiens
gcagagggagugugcgaaucuacccugaccaaugggcucaagaauaaaguaugauuuuugagucag

SEQ ID NO: 340697 - RNA, 66 nt, Homo Sapiens
caauugagggcuaaaucccaagugucucuugacuggcucaagaauuagggccccaacuacacaccc

SEQ ID NO: 340698 - RNA, 66 nt, Homo Sapiens
ccaccuacuuguggcgaucugaguacucuacucuugcucaagaaguaauacgacaaucagaauaca

SEQ ID NO: 340699 - RNA, 66 nt, Homo Sapiens
aaauaugaauugagggcccgaaaccugaccaagcggcucaagaauagcagagggagugugcgaauc

SEQ ID NO: 340700 - RNA, 66 nt, Homo Sapiens
uagaagauguguaaacagguaacugugucuggcguucucaagaaucgauacaaauuuggccuuaag

SEQ ID NO: 340701 - RNA, 66 nt, Homo Sapiens
ggauuagcucugauuuugaggcuauacuuacgcuuccucaagaagacugaugaaugcccgcaguga

SEQ ID NO: 340702 - RNA, 66 nt, Homo Sapiens
gucuuaacuaggaaacuaaacaccagugaauccauucucaagaaaaguacuacaaaauuaugucug

SEQ ID NO: 340703 - RNA, 66 nt, Homo Sapiens
gcgaaagucaaauauggagauuguggggguaggaaucucaagaauuagggaacacaggcaaauuau

SEQ ID NO: 340704 - RNA, 66 nt, Homo Sapiens
auccucaccaagcucauuacaucugccagggccugccucaagaagcccagcccagccuuuuccugg

SEQ ID NO: 340705 - RNA, 66 nt, Homo Sapiens
cuagugguauauuuauguaagaaaaugacuguaaaucucaagaaaaaucucagcagcuaauagcaa

SEQ ID NO: 340706 - RNA, 66 nt, Homo Sapiens
gguguaaccauuuguuaacuguacugaagguguguccucaagaagaaaguguucaaauuaaaaaag

SEQ ID NO: 340707 - RNA, 66 nt, Homo Sapiens
ugucucuaccaaaaguuaaaaaaaaaaaaaaaaaagcucaagaaccugcacgagggccuaaaacag

SEQ ID NO: 340708 - RNA, 66 nt, Homo Sapiens
cccuucucuguuuaguaguugguuggggaaguggggcucaagaaggauuuugggguucaccagaug

SEQ ID NO: 340709 - RNA, 66 nt, Homo Sapiens
gagaaaaggggcuggaaaggggggaauggcccacaucucaagaagcaagauauuguuugugguggu

SEQ ID NO: 340710 - RNA, 66 nt, Homo Sapiens
aggaacagcauggauuccguggauagcuguugcagucucaagaagacugagagcuuccaaaaugcc

SEQ ID NO: 340711 - RNA, 66 nt, Homo Sapiens
acacaccaacauuuugcugccuaccuuguuauccuucucaagaagcugaaguguacgcccucuccc

SEQ ID NO: 340712 - RNA, 66 nt, Homo Sapiens
ugugcccuuccccgccugcggagaugccaccaagcccucaagaagucuguauauaccaccuaggag

SEQ ID NO: 340713 - RNA, 66 nt, Homo Sapiens
cccgaacgaauguucggauggcguccaguggugccucucaagaaacaggccacgugucccagccca

SEQ ID NO: 340714 - RNA, 66 nt, Homo Sapiens
ugcugagauuucucuggaaaaaaaauaacaggcagccucaagaaugacguacaucauuauuaauau

SEQ ID NO: 340715 - RNA, 66 nt, Homo Sapiens
gggcucccugggaucuccagucauacgauacucuuucucaagaaggcucccugaagcuggauucuu

SEQ ID NO: 340716 - RNA, 66 nt, Homo Sapiens
gaagcgugaaccccagggaaggaaggaggacacaaccucaagaaagggcaggccugcagggugugg

SEQ ID NO: 340717 - RNA, 66 nt, Homo Sapiens
acgggcugcucuacugcuuccaaccaugacgcacugcucaagaacuaaguuugacacaaacucaca

SEQ ID NO: 340718 - RNA, 66 nt, Homo Sapiens
acgggcugcucuacugcuuccaacgaugacgcacugcucaagaacuaaguuugacacaaaaucgca

SEQ ID NO: 340719 - RNA, 66 nt, Homo Sapiens
acgggcugcucuacugcuuccaaccaugacgcacugcucaagaacuaaguuugacacaaacucgca

SEQ ID NO: 340720 - RNA, 57 nt, Homo Sapiens; identical to SEQ ID NO: 339308

SEQ ID NO: 340721 - RNA, 66 nt, Homo Sapiens
uuacuuuucuauguugcucauuaaaugauuguauaacucaagaagauuuugugagugcuuuggaau

SEQ ID NO: 340722 - RNA, 66 nt, Homo Sapiens
ccuccagacgaugcauuucuuggccaaaguggcuuccucaagaaagcagcacuuaccuuugaaaaa

SEQ ID NO: 340723 - RNA, 66 nt, Homo Sapiens
cucaaauggcuucacaguccuuacuucucuaccugccucaagaaggggcucagagcagagacuugu

SEQ ID NO: 340724 - RNA, 66 nt, Homo Sapiens
gggauuaguuggggguauuaaggaagacuucauuuucucaagaaaucagcaaacauucuuccuaaa

SEQ ID NO: 340725 - RNA, 66 nt, Homo Sapiens
caauauucguuaauguucagcuuuuagcucuaauagcucaagaacaauauaacuuuaaaaauaaua

SEQ ID NO: 340726 - RNA, 66 nt, Homo Sapiens
auuauucauucuaucucagaaaucuacacuaguaaucucaagaaaggagagggcacugaagaccug

SEQ ID NO: 340727 - RNA, 66 nt, Homo Sapiens
accaugacgagcucuagcuggaugggcgcagagaaccucaagaaggcaugaagccagccccugcag

SEQ ID NO: 340728 - RNA, 66 nt, Homo Sapiens
cagcgcuccagccuggucgacagagugagacuccaucucaagaaaaaauaaaaauaaaguuguucu

SEQ ID NO: 340729 - RNA, 66 nt, Homo Sapiens
gugcuuugggaggcugaggcaggaggaucacucgagcucaagaauucaagaccugggcaagagaga

SEQ ID NO: 340730 - RNA, 66 nt, Homo Sapiens
uugcacuccagccugggcgacagagcaagacucugucucaagaagaaaaaaaaaauacauauacac

SEQ ID NO: 340731 - RNA, 66 nt, Homo Sapiens
agauuuauaugcaugaaguuaaaacaacugacguuacucaagaauuagaaaacuuugcaagauuug

SEQ ID NO: 340732 - RNA, 66 nt, Homo Sapiens
aaaagaaaaagagacaaauucacagcgagacccugucucaagaaaguugcacuucagccugggcga

SEQ ID NO: 340733 - RNA, 66 nt, Homo Sapiens
gggcacugcccggcccggcucucccuugcccccaagcucaagaaggaucuucuccagcgcugggcc

SEQ ID NO: 340734 - RNA, 66 nt, Homo Sapiens
agacugugcagagggcauugacacacccaccgcaaccucaagaaccaccgaccuacgccacuggaa

SEQ ID NO: 340735 - RNA, 66 nt, Homo Sapiens
aauaaaagugggaaaaucuucagaaugagacacugucucaagaaaacugcauuccagccugugcga

SEQ ID NO: 340736 - RNA, 66 nt, Homo Sapiens
ccccagugccuuguaugaaguccuacccucugcacccucaagaaacuuacaggaccccccaagucu

SEQ ID NO: 340737 - RNA, 66 nt, Homo Sapiens
aacccaccauaaccagcccaacccuuguucuuaucccucaagaagagacuuccuucauuaacaaag

SEQ ID NO: 340738 - RNA, 66 nt, Homo Sapiens
ucugaagaagguaguaauauauccucaugcauuuuccucaagaaugggcauguaccuauugacugu

SEQ ID NO: 340739 - RNA, 66 nt, Homo Sapiens
ccccgccgggcuacgaugacauguaccugugaaggccucaagaauguaacaucccaggcuucccuc

SEQ ID NO: 340740 - RNA, 64 nt, Homo Sapiens
cugcacuccagcccgggcaacagaguaagacccugccucaagaaaaaaaaaaaaaaaaaaaauc

SEQ ID NO: 340741 - RNA, 66 nt, Homo Sapiens
aguggccaggugccggcacagugccucucccagagccucaagaagggccauuuaggagcuugcuuc

SEQ ID NO: 340742 - RNA, 66 nt, Homo Sapiens
cugcaccgugccugacucauccaguggggaaggugacucaagaaguuguuuaagccuaggccuagg

SEQ ID NO: 340743 - RNA, 66 nt, Homo Sapiens
auaaaagcuguugcuggaaacuugcuuuaggaacagcucaagaaccuuggaguucauauuucacaa

SEQ ID NO: 340744 - RNA, 66 nt, Homo Sapiens
uucaugagggucucuuacuagagccugcggguuugccucaagaaacccgagagaagaggaguggau

SEQ ID NO: 340745 - RNA, 66 nt, Homo Sapiens
aaagaucucgcuggugcguagaguggaaggaaaugucucaagaaacugucucuauggcgcuuccuu

SEQ ID NO: 340746 - RNA, 52 nt, Homo Sapiens; identical to SEQ ID NO: 339334

SEQ ID NO: 340747 - RNA, 66 nt, Homo Sapiens
agggccuugugcgugggccugucuuccccccucgcccucaagaacagggaaaaucuugcuuuuaug

SEQ ID NO: 340748 - RNA, 66 nt, Homo Sapiens
ggacuuguuuauuuucuaguagcuuuuauaaguacacucaagaauuugucagggagaauaauucug

SEQ ID NO: 340749 - RNA, 66 nt, Homo Sapiens
uagauccagguuuacuuucuaucagcugagcaaccucucaagaaaaaauaaauaaauaaauaaacc

SEQ ID NO: 340750 - RNA, 66 nt, Homo Sapiens
aaauguguucuguauaaacaaaugcagcuggaaucgcucaagaaucuuauuuuucuaaauccaaca

SEQ ID NO: 340751 - RNA, 66 nt, Homo Sapiens
gugguccugaagacuccggccaagaggcacaagcagcucaagaacaagcuggagaagaacgaggag

SEQ ID NO: 340752 - RNA, 66 nt, Homo Sapiens
ccauacuuuccuguauaguucacguuucauguaauccucaagaaauaaaaggaagccaaagagugu

SEQ ID NO: 340753 - RNA, 66 nt, Homo Sapiens
accugauguuuucuuauucuuguauuuguaguaguacucaagaaucuuuuuacuguaggugaaggc

SEQ ID NO: 340754 - RNA, 66 nt, Homo Sapiens
gccauaaaaucucacgcugcgaaguguuucugaagucucaagaacuggggggauuuggcuggugcc

SEQ ID NO: 340755 - RNA, 66 nt, Homo Sapiens
agcacagcugauguaaaauuacauagaucccagacacucaagaauuuaaggucgggacauauauuu

SEQ ID NO: 340756 - RNA, 66 nt, Homo Sapiens
aggauguccauuucggggagaggagcaggugggacccucaagaaaaugacggagaacaucccagac

SEQ ID NO: 340757 - RNA, 66 nt, Homo Sapiens
uuuuuuuaagagacagauuuauuuuauauuuuuccccucaagaacuccggcuuuugaaacuuaggu

SEQ ID NO: 340758 - RNA, 66 nt, Homo Sapiens
aaaagaaggacugaacuccagcgucuugcccagcagcucaagaagaucuccucccagcggccuccg

SEQ ID NO: 340759 - RNA, 66 nt, Homo Sapiens
guuucuucuggauuccuuauuguguacuuggcuuaacucaagaacauccuuucucgaaauugccag

SEQ ID NO: 340760 - RNA, 66 nt, Homo Sapiens
gcagguaugugggccagaggcccacagacuaccccacucaagaacaggccuuucuacaaagcaagg

SEQ ID NO: 340761 - RNA, 66 nt, Homo Sapiens
caggaggcucccuguacuggagucgucccacuauuccucaagaaaucuuagaaccagcuugugagg

SEQ ID NO: 340762 - RNA, 66 nt, Homo Sapiens
ugugaucuguacaaguauguggagcaugaaugcugacucaagaaacuuuuacuccuucugcucaag

SEQ ID NO: 340763 - RNA, 66 nt, Homo Sapiens
auugugagcgaauuagcaauaacauacaugagauaacucaagaaaucaaaagauaguugauucuug

SEQ ID NO: 340764 - RNA, 66 nt, Homo Sapiens
caaagaaacacuugugcaguaguauacacagcacuacucaagaagcuguuauaaaaauguauaggc

SEQ ID NO: 340765 - RNA, 66 nt, Homo Sapiens
uaaacauuuguuucuguguggcuguuguucugcuuccucaagaaauggcucaccccucucugaagg

SEQ ID NO: 340766 - RNA, 66 nt, Homo Sapiens
aaaaaaaaaaaaaagaaugucagagugagacucugucucaagaagguugcacuccagccuggguga

SEQ ID NO: 340767 - RNA, 66 nt, Homo Sapiens
accgccuuccccacccccugcaguugcuaaguggggcucaagaagcgcugccagaggaugagugac

SEQ ID NO: 340768 - RNA, 66 nt, Homo Sapiens
ucaaauucaggacauaaacugaaagcaccacagcuacucaagaagaguucugucacaaauguuccu

SEQ ID NO: 340769 - RNA, 66 nt, Homo Sapiens
gaagcagauucauacagccuucaagaaucuuaaaaucucaagaaguaagucaaucugaaagauuuu

SEQ ID NO: 340770 - RNA, 66 nt, Homo Sapiens
agcauuucuuuaaaauguuuuucuuuuuaaagcagucucaagaauaagagugaugcagacuuguuc

SEQ ID NO: 340771 - RNA, 66 nt, Homo Sapiens
gacagaagagacagugauuugagaaaaagaaaccuacucaagaaaaaugagaacacaagaacuuaa

SEQ ID NO: 340772 - RNA, 66 nt, Homo Sapiens
guggaggacccuggaaggacccccuuuucucuggaucucaagaaugaagaaugacaaacacaagug

SEQ ID NO: 340773 - RNA, 66 nt, Homo Sapiens
auguucguauuagagacaaaugcuuuuuaguuauuucucaagaagcuuuucuugcacuaucacaau

SEQ ID NO: 340774 - RNA, 66 nt, Homo Sapiens
cugguacaccuguaccagcuugcuuuguaaagcaaacucaagaaaagcaaaaccuucgucucuuug

SEQ ID NO: 340775 - RNA, 66 nt, Homo Sapiens
uaaaagauacuuaauucuuguacaugagauaaagaccucaagaaguugaaagaauuagcaguaaaa

SEQ ID NO: 340776 - RNA, 66 nt, Homo Sapiens
caaaagauaguugauucuugaacauacaugagauaacucaagaaauauugugagcgaauuagcaau

SEQ ID NO: 340777 - RNA, 66 nt, Homo Sapiens
aagcaagcugccuuuguacuccuucccccccugcaucucaagaauaggcagacagacugcaccacc

SEQ ID NO: 340778 - RNA, 66 nt, Homo Sapiens
acacagaagcacacaucccuugagaaauauuuaaagcucaagaagaauuauuuuagguauuaagac

SEQ ID NO: 340779 - RNA, 66 nt, Homo Sapiens
uugucuaacgagagacaucaguuucucaggaugauccucaagaacguuauggaguccauguugcaa

SEQ ID NO: 340780 - RNA, 66 nt, Homo Sapiens
ugcucugaaaaauuccuuuuaaaaguccuucuguuacucaagaaaaagccaagagcgucagguggc

SEQ ID NO: 340781 - RNA, 64 nt, Homo Sapiens
aaugagaaagguauauauauuacuguaacuguagaagggaaaagggaaaguauuugguucuaaa

SEQ ID NO: 340782 - RNA, 64 nt, Homo Sapiens
aagguauauauauuacuguaacuguagaagggaaaagggaaaguauuugguucuaaaaaauguu

SEQ ID NO: 340783 - RNA, 64 nt, Homo Sapiens
gaagugauaucauaaaaguaaacacuagcuaaggaagggaaaggcuauuaagggaaaggaaaag

SEQ ID NO: 340784 - RNA, 64 nt, Homo Sapiens
aaaagaacacuagcuaaggacauccuuuacuauuaagggaaaggauaggucauuuucuauucac

SEQ ID NO: 340785 - RNA, 64 nt, Homo Sapiens
auuguccccuagcaaggcauaaauuuauuucaaaaagggaaacuaauuauguuacaucuguuuu

SEQ ID NO: 340786 - RNA, 64 nt, Homo Sapiens
auauuuucuuccaagcaaagaguguuggcuaaugaagggaaaggccuacucucaggaucaagaa

SEQ ID NO: 340787 - RNA, 64 nt, Homo Sapiens
auccaugucaguuucuuucacauacaucucuugaaagggaaaaucucacaguggguaaauauau

SEQ ID NO: 340788 - RNA, 64 nt, Homo Sapiens
ucagggaaggggagaagaaaucggggaugggagaaagggaaaaguuccauugugggguaggugg

SEQ ID NO: 340789 - RNA, 64 nt, Homo Sapiens
uccuuguuuguuaaugcuauuaaaacucagauucaagggaaauaccagcuuccacuugagucac

SEQ ID NO: 340790 - RNA, 64 nt, Homo Sapiens
guguuucuuagguaaagucucuuuuugcuacugaaagggaaauggucucuaaacacuggucacu

SEQ ID NO: 340791 - RNA, 64 nt, Homo Sapiens
uuuaacugcugugaaaauguuuccagugcaagagaagggaaauacuaggaacuaagacauuucu

SEQ ID NO: 340792 - RNA, 64 nt, Homo Sapiens
aauuaaaacuuacugauauauuggacuuugagccaagggaaagaaugaguacuaucuuuccaga

SEQ ID NO: 340793 - RNA, 64 nt, Homo Sapiens
uauaaugugugauuaaaugcuuuuuuaaauugcuaagggaaaauaacaaaguguuaguaaucau

SEQ ID NO: 340794 - RNA, 64 nt, Homo Sapiens
uuuucaauagauuauucugccauuuuuuaaaggaaagggaaaaugaaaacagcaugucuuuuua

SEQ ID NO: 340795 - RNA, 64 nt, Homo Sapiens
cacggaaugugugugaagccaagucacaucagaaaagggaaagcaggugugggguaagggaggg

SEQ ID NO: 340796 - RNA, 64 nt, Homo Sapiens
ggagacuaaugaggcuuaacaguucuacacugucaagggaaaagcauuuagugcuacgcugcac

SEQ ID NO: 340797 - RNA, 64 nt, Homo Sapiens
ccaaugaaaaaaggucaguugauuccagugcuaaaagggaaaaaccugugguccgcccagaaga

SEQ ID NO: 340798 - RNA, 64 nt, Homo Sapiens
cgcagaaaagaaaaaaagguuaagcauaaaaagaaagggaaaaagcagaaacacugcagaagac

SEQ ID NO: 340799 - RNA, 64 nt, Homo Sapiens
agagaacacaccaaaaaagugaaagagaaauugaaagggaaaaaagacaaaaagcauaaggcuc

SEQ ID NO: 340800 - RNA, 64 nt, Homo Sapiens
acugaaaaggguucuggaguguucauucagagugaagggaaaacuuuauccuucuauuucuuau

SEQ ID NO: 340801 - RNA, 64 nt, Homo Sapiens
aaggaaugagaacuuugcaguuggaugaauagagaagggaaaaguugcuggagcacggagugaa

SEQ ID NO: 340802 - RNA, 64 nt, Homo Sapiens
uuucuacaugugcauauaguaugcuucuauuuaaaagggaaauaauuuauauguguuauaauga

SEQ ID NO: 340803 - RNA, 64 nt, Homo Sapiens
ggcgucgcccucauuucaacucgcgcuaagaauaaagggaaaacucauugagggccuaaaguaa

SEQ ID NO: 340804 - RNA, 64 nt, Homo Sapiens
aagcagggcaguggugggugcauucugcaagggaaagggaaaggguuugucugcccauuaucuu

SEQ ID NO: 340805 - RNA, 64 nt, Homo Sapiens
gaaaggaagcagggcagugguaucuucauucugcaagggaaagggucacgguuugucugcccau

SEQ ID NO: 340806 - RNA, 64 nt, Homo Sapiens
uccuagguuuucuuugugcucaguuuaaaacaaaaagggaaauguccaaggaguuagaauuucc

SEQ ID NO: 340807 - RNA, 64 nt, Homo Sapiens
aaagucuuuugaagguagcucauaaugaauguaaaagggaaauaaagaauagaagugaaauuug

SEQ ID NO: 340808 - RNA, 64 nt, Homo Sapiens
cuucaaagcauguuucuuuccacauucuguugacaagggaaaacgcaauacacagcuacagaca

SEQ ID NO: 340809 - RNA, 64 nt, Homo Sapiens
uccaaaccaguugggagacugugaaaaaccucagaagggaaaaccagggucuacgaagaauagg

SEQ ID NO: 340810 - RNA, 64 nt, Homo Sapiens
gaacuucacaauuuugcaccgcuucccaaagugaaagggaaacuguuaaagcuuacuuugcaga

SEQ ID NO: 340811 - RNA, 64 nt, Homo Sapiens
auuuaggauuggcaauguaauuagcagauaccagaagggaaauuauuacugauucuuucuguga

SEQ ID NO: 340812 - RNA, 64 nt, Homo Sapiens
ccucugccuggaaccuggcucgugcugugaccagaagggaaaggcggcuguuuggcucuuucuc

SEQ ID NO: 340813 - RNA, 64 nt, Homo Sapiens
uuugauagaacuaaggaaauagugguuuugagugaagggaaaggaaacccagaaacauuuuacg

SEQ ID NO: 340814 - RNA, 64 nt, Homo Sapiens
aaacugacuuuuauaaugaaauacgaaacacagaaagggaaaauuuuacugacaaaaagggaaa

SEQ ID NO: 340815 - RNA, 64 nt, Homo Sapiens
acgaaacacagaaagggaaacauuuacugacaaaaagggaaaauuuuccaaucaguguauugcu

SEQ ID NO: 340816 - RNA, 64 nt, Homo Sapiens
ccuuuucuucuaguaagugucuagaauuagagaaaagggaaagaggaguuaccucagcagaaga

SEQ ID NO: 340817 - RNA, 64 nt, Homo Sapiens
auauuugcaguuggggacagguugaguagaggaaaagggaaagaagggaaagcagaaaacaaau

SEQ ID NO: 340818 - RNA, 64 nt, Homo Sapiens
guuggggacagguugaguagaggaaaagggaaagaagggaaagcagaaaacaaauuuuuagcau

SEQ ID NO: 340819 - RNA, 64 nt, Homo Sapiens
aaaugaguauuuuguccuuuaacuguuuucauuuaagggaaagaucuccuucuaaaaacuucuc

SEQ ID NO: 340820 - RNA, 64 nt, Homo Sapiens
uauacaaaaagaaaauuaauaaacuauuauauguaagggaaauaucaggggagaaaaauuggca

SEQ ID NO: 340821 - RNA, 64 nt, Homo Sapiens
aguaucuuuaacagcucuuuguaauauuaaugagaagggaaaaacauggggauucuuuucuaag

SEQ ID NO: 340822 - RNA, 64 nt, Homo Sapiens
uccucagcauaacugcucagaaaaacuauccaugaagggaaagcuuuaauacuuaaggcuuugu

SEQ ID NO: 340823 - RNA, 64 nt, Homo Sapiens
cugugccucucugggagaaaggagagaggauaagaagggaaaguucacaaccugugaacaggga

SEQ ID NO: 340824 - RNA, 64 nt, Homo Sapiens
gggggacagggcccaucuaccagccuucaucaggaagggaaagggcuuuggggucagguggcag

SEQ ID NO: 340825 - RNA, 64 nt, Homo Sapiens
guagcugaugagguuacaugacaggaaaagucaaaagggaaaaggucagacugaacugugugca

SEQ ID NO: 340826 - RNA, 64 nt, Homo Sapiens
cacauugcgauccauucaguuuuuaugggaaaccaagggaaaagacaagguguuucauuuucgu

SEQ ID NO: 340827 - RNA, 64 nt, Homo Sapiens
ggaacaggaaaagaaaccccugagaacuuuugguaagggaaaagggaaaccaggguuuaucuuu

SEQ ID NO: 340828 - RNA, 64 nt, Homo Sapiens
gucauuugcgcacaacuuaaauguccaugaccagaagggaaacacuacaaucuauuuauuggac

SEQ ID NO: 340829 - RNA, 64 nt, Homo Sapiens
ugauggaugauuauuauuuuaaggucuguuuaggaagggaaauggcuacuuggccagccauugc

SEQ ID NO: 340830 - RNA, 64 nt, Homo Sapiens
ccucaucucauuuggcuguguaaagaaaugggaaaagggaaaaggagagagcaauugaggcagu

SEQ ID NO: 340831 - RNA, 64 nt, Homo Sapiens
auugccguuaggcuucacagacaaaccuccuuugaagggaaauaggccuucucuccagcuggac

SEQ ID NO: 340832 - RNA, 64 nt, Homo Sapiens
auaaaucucgcugaauugaaguugcaguucagggaagggaaacaccccgcauggcaguuccuag

SEQ ID NO: 340833 - RNA, 64 nt, Homo Sapiens
agggacaagcagguuuauguguuuaaacagaaagaagggaaaagguacuaugugauaugguacu

SEQ ID NO: 340834 - RNA, 64 nt, Homo Sapiens
cuuuucaugaauuuugugaacuugccaaaaggggaagggaaaaaucuuuguguuacuucacuca

SEQ ID NO: 340835 - RNA, 64 nt, Homo Sapiens
ggcaauuuugaccuguccugcccuucuuagcuugaagggaaaccccagagacucuucugucagg

SEQ ID NO: 340836 - RNA, 64 nt, Homo Sapiens
ccaauuuuuaaauccauuucauuuuuuaaaaaauaagggaaauaaauguaauugccauuuuuca

SEQ ID NO: 340837 - RNA, 64 nt, Homo Sapiens
aauguaaaaaugcugcaaauuaaaaaccucaaagaagggaaauaauugcaacaaaugggaauug

SEQ ID NO: 340838 - RNA, 64 nt, Homo Sapiens
cuccacuucuguccucaagaacaaguccuaggucaagggaaacagcacagccuguuuauaauua

SEQ ID NO: 340839 - RNA, 64 nt, Homo Sapiens
cuucuuugacuuuuuuucauuaggacugaauucaaagggaaauguuauaaggcauucauauuuu

SEQ ID NO: 340840 - RNA, 64 nt, Homo Sapiens
uugcuuuaaucugugggauuaaacuuugcguauaaagggaaaacuacaauagcuuaccuggcua

SEQ ID NO: 340841 - RNA, 64 nt, Homo Sapiens
auuuauuguuaugaaacuguaaggucuacauauaaagggaaaaaguuaauguggaaagcugauc

SEQ ID NO: 340842 - RNA, 64 nt, Homo Sapiens
cauucccggcauaccuauuagugucuuaaaaaggaagggaaaagucuuuuguugcccucuccua

SEQ ID NO: 340843 - RNA, 64 nt, Homo Sapiens
auugucucuaacugguucugguggagauuaaauaaagggaaauuaagauccaggggacauaaau

SEQ ID NO: 340844 - RNA, 64 nt, Homo Sapiens
gaaagaagaaaagauuuuuguugaguuuuaacagaagggaaaagaaaaaaaaaaagaaaggaca

SEQ ID NO: 340845 - RNA, 64 nt, Homo Sapiens
cucugaacauaaauuuggucaaauaauuggaacaaagggaaacagauacuugauaugaaagcca

SEQ ID NO: 340846 - RNA, 64 nt, Homo Sapiens
auaaggucauuuucucccucuacucacaauacuaaagggaaaaaauggauucaaagcuaggauu

SEQ ID NO: 340847 - RNA, 64 nt, Homo Sapiens
ucacgguaaauagcugccaauuauggcugcacugaagggaaaugaauaauggcuucacugaaug

SEQ ID NO: 340848 - RNA, 64 nt, Homo Sapiens
acagagauuagggggacuuaaaguagguuuuggaaagggaaaccugaaaacuuacauagacaga

SEQ ID NO: 340849 - RNA, 64 nt, Homo Sapiens
aguuuuguaaucaagauuuuauguaacauuuguaaagggaaaauuagcacuuuugugguucuua

SEQ ID NO: 340850 - RNA, 64 nt, Homo Sapiens
uuguaaagggaaaauuagcacuuuugugguucuuaagggaaaagaaacagaccuuguggagauu

SEQ ID NO: 340851 - RNA, 64 nt, Homo Sapiens
gaaguugucaauuccucuuauucuuaaauaucuaaagggaaaggaaaccaacuuuaauuucaga

SEQ ID NO: 340852 - RNA, 64 nt, Homo Sapiens
aaagcugagaugaugucuuaggacuguggccuagaagggaaaggccaccauaccucagaaggua

SEQ ID NO: 340853 - RNA, 64 nt, Homo Sapiens
aaggcugcacaccuagaaccaaaggagaggccaaaagggaaaccuuuggaugaugccuaggccc

SEQ ID NO: 340854 - RNA, 64 nt, Homo Sapiens
caauuagucucaguucucuuaauuuucaggaagaaagggaaauugcagccccucagcccccagg

SEQ ID NO: 340855 - RNA, 64 nt, Homo Sapiens
guucagguguggcagaagcuugcagaugcguccgaagggaaauaaaguguguuggcguuagacu

SEQ ID NO: 340856 - RNA, 64 nt, Homo Sapiens
aaauugcaguuauugauucuuaaauuugauggagaagggaaaauguuaacuuccuauucuuucu

SEQ ID NO: 340857 - RNA, 64 nt, Homo Sapiens
uuuuacuugugggggugggaucaauguguuucaaaagggaaaacuucaguaggauauccaaagu

SEQ ID NO: 340858 - RNA, 64 nt, Homo Sapiens
ccugcuucgauggccccaaagcugggccagaguuaagggaaagaggaggaaguccuaagcagag

SEQ ID NO: 340859 - RNA, 64 nt, Homo Sapiens
gcagagaaguagcaccauuauccccauuuaacagaagggaaacugaggcucggcaagcauaggc

SEQ ID NO: 340860 - RNA, 64 nt, Homo Sapiens
uucaaagcacuguguauaaaacaucuaguuuuagaagggaaacaguugaaacuguuuaaaaaua

SEQ ID NO: 340861 - RNA, 64 nt, Homo Sapiens
auguacauacacauacauacauauuaccauacugaagggaaauggauuuauauuugaauuugau

SEQ ID NO: 340862 - RNA, 64 nt, Homo Sapiens
guauuauaaaaaaagauuuuuuuuuucacuucugaagggaaagucuucaguauuuuaugcaauu

SEQ ID NO: 340863 - RNA, 64 nt, Homo Sapiens
ucuccuggaccaaggcuuggucgucgucaaagucaagggaaaguuuaugcuggugggccacuug

SEQ ID NO: 340864 - RNA, 64 nt, Homo Sapiens
ucaaguauuauaaacaagaauauauggugguaauaagggaaaaagaaaauacuuaaauguuaug

SEQ ID NO: 340865 - RNA, 64 nt, Homo Sapiens
gagcugcuuuuuuugaaacuuaguaauauauuuaaagggaaauuauacaacaccaaaaaauauc

SEQ ID NO: 340866 - RNA, 64 nt, Homo Sapiens; identical to SEQ ID NO: 328787

SEQ ID NO: 340867 - RNA, 64 nt, Homo Sapiens; identical to SEQ ID NO: 328788

SEQ ID NO: 340868 - RNA, 64 nt, Homo Sapiens; identical to SEQ ID NO: 328789

SEQ ID NO: 340869 - RNA, 64 nt, Homo Sapiens; identical to SEQ ID NO: 328790

SEQ ID NO: 340870 - RNA, 64 nt, Homo Sapiens; identical to SEQ ID NO: 328791

SEQ ID NO: 340871 - RNA, 64 nt, Homo Sapiens; identical to SEQ ID NO: 328792

SEQ ID NO: 340872 - RNA, 64 nt, Homo Sapiens; identical to SEQ ID NO: 328793

SEQ ID NO: 340873 - RNA, 64 nt, Homo Sapiens; identical to SEQ ID NO: 328794

SEQ ID NO: 340874 - RNA, 64 nt, Homo Sapiens; identical to SEQ ID NO: 328795

SEQ ID NO: 340875 - RNA, 64 nt, Homo Sapiens; identical to SEQ ID NO: 328796

SEQ ID NO: 340876 - RNA, 64 nt, Homo Sapiens; identical to SEQ ID NO: 328797

SEQ ID NO: 340877 - RNA, 64 nt, Homo Sapiens; identical to SEQ ID NO: 328798

SEQ ID NO: 340878 - RNA, 64 nt, Homo Sapiens; identical to SEQ ID NO: 328799

SEQ ID NO: 340879 - RNA, 64 nt, Homo Sapiens; identical to SEQ ID NO: 328800

SEQ ID NO: 340880 - RNA, 64 nt, Homo Sapiens; identical to SEQ ID NO: 328801

SEQ ID NO: 340881 - RNA, 64 nt, Homo Sapiens; identical to SEQ ID NO: 328802

SEQ ID NO: 340882 - RNA, 64 nt, Homo Sapiens; identical to SEQ ID NO: 328803

SEQ ID NO: 340883 - RNA, 64 nt, Homo Sapiens; identical to SEQ ID NO: 328804

SEQ ID NO: 340884 - RNA, 64 nt, Homo Sapiens
ugaagaaaaaauaaaacugucacauaagacaucaugauaacauuagaauguggaugcaaaauau

SEQ ID NO: 340885 - RNA, 64 nt, Homo Sapiens
gagagaggaauguccaggucagcggcucuagcucugauaacacacugcagaucaacacagucaa

SEQ ID NO: 340886 - RNA, 63 nt, Homo Sapiens
ucauuagaagaacuugauaaaagacucaaauaaauguuagaaagagcccguaauuuuaggacu

SEQ ID NO: 340887 - RNA, 63 nt, Homo Sapiens
gagucacuuugaaauaguuaauucaacagcaccauguuagaaauauauuggcagccaagacuc

SEQ ID NO: 340888 - RNA, 63 nt, Homo Sapiens
uagaauaaaaguaauugagcaaaaugcaauuucauguuagagccagcacuaugaagaguuaau

SEQ ID NO: 340889 - RNA, 63 nt, Homo Sapiens
aggauaaaaauauauuuguguaauggucacuguauguuagauaugcauguaaugcuuauuuag

SEQ ID NO: 340890 - RNA, 63 nt, Homo Sapiens
uguaugggccaucaaccauuuacuuuucccugaauguuagaaacuacaaaaccacuaccuugu

SEQ ID NO: 340891 - RNA, 63 nt, Homo Sapiens
cuucugucacuacuacuuaaaacucugaugauuauguuagauuuuuuugcuaacuaauaaaga

SEQ ID NO: 340892 - RNA, 63 nt, Homo Sapiens
agcaaagaaaaaccaguuugauaaaccucucucauguuagagcuaggcuagucuuuacuuuuc

SEQ ID NO: 340893 - RNA, 63 nt, Homo Sapiens
uacagugggagcaaaaccagugugugccaagccauguuagagauuuauguauggugcaccuac

SEQ ID NO: 340894 - RNA, 63 nt, Homo Sapiens
aaauaaugcggcuaauuaacagaaugauaaaaaauguuagaccuauuacacaaauccaguuuc

SEQ ID NO: 340895 - RNA, 63 nt, Homo Sapiens
uacucaugauuauuuguguuuuacuucauuugaauguuagagcuaaucuccuacacaauucau

SEQ ID NO: 340896 - RNA, 63 nt, Homo Sapiens
aggguugccucuuggcuggguggagucucugaaauguuagaagaagcgcugaagccuugauug

SEQ ID NO: 340897 - RNA, 63 nt, Homo Sapiens
ggaugggcagguggagaaugccuggggguagaaauguuagaucuugcaacaucagauccuugg

SEQ ID NO: 340898 - RNA, 63 nt, Homo Sapiens
gaugcugagugugcguuuucuuuuaaucuaaagauguuagacaaaucaccuuuuaguuuuagu

SEQ ID NO: 340899 - RNA, 63 nt, Homo Sapiens
aaucuuaaguuucguaaguuuugaaaucccacaauguuagacccaaccgacauguucaaaugu

SEQ ID NO: 340900 - RNA, 63 nt, Homo Sapiens
acugcuuaacuaauuuuaaauaaggaaauaaguauguuagaugcaguagacgauacagguugc

SEQ ID NO: 340901 - RNA, 63 nt, Homo Sapiens
aauguucuuacccaaauguaccugaacuaaaaaauguuagauguuggugauaaguugacaguu

SEQ ID NO: 340902 - RNA, 61 nt, Homo Sapiens
gcagccuuggcuccugguaauaggccgcuuuccuucagaaagcccccgguguccagaucgg

SEQ ID NO: 340903 - RNA, 64 nt, Homo Sapiens
uuuaacuuuggaugugaauuuagucacccuuagcccuucagauaagccuagccaguacauauuu

SEQ ID NO: 340904 - RNA, 64 nt, Homo Sapiens
cuacguccugcuucuugguugagacuacugggauccuucagaaaagaaacacugggucccauag

SEQ ID NO: 340905 - RNA, 64 nt, Homo Sapiens
ugggucccauagcuaaauucucaaccgccaggcaccuucagaagaauccagccuaauacuggaa

SEQ ID NO: 340906 - RNA, 64 nt, Homo Sapiens
cuacggaaugacaguauaucagacaaaaacaguuccuucagauuaauuaauaagaacugauaca

SEQ ID NO: 340907 - RNA, 64 nt, Homo Sapiens
gcugauugcuuauacaaauauggaggagagguuuccuucagauuuccaagaguuuagguugugc

SEQ ID NO: 340908 - RNA, 64 nt, Homo Sapiens
cauauuuuucaguagcuccacuuuuguuucucacccuucagaaaucaugccuguagcucucuuc

SEQ ID NO: 340909 - RNA, 64 nt, Homo Sapiens
aggcuaaaauauccagcuuuagaauuuuuagaagccuucagaaguggagaacaacaagguaccc

SEQ ID NO: 340910 - RNA, 64 nt, Homo Sapiens
agauuccaguuccuguugugguacauuauauugcccuucagaauaaaaucuagaauucuuggaa

SEQ ID NO: 340911 - RNA, 64 nt, Homo Sapiens
uaaggaaauaggggaaaaaaaucagggauauauaccuucagaaauuuuuaaaaaggacauuucu

SEQ ID NO: 340912 - RNA, 64 nt, Homo Sapiens
agaugcccggcaggcuggggucugaguugugaccccuucagaguuggugagaugccaaguuugg

SEQ ID NO: 340913 - RNA, 64 nt, Homo Sapiens
ggagaggccacaggagcugccucccagggaggccccuucagagaggagcucauuacugccuucc

SEQ ID NO: 340914 - RNA, 64 nt, Homo Sapiens
uauuuucaccagauauaaaauucuaggaacuuaaccuucagauauuugauccaguaguuuccac

SEQ ID NO: 340915 - RNA, 64 nt, Homo Sapiens
acgauggcaggcauuccucuaccccugcccuuucccuucagaaauuuuuccccuccacucagaa

SEQ ID NO: 340916 - RNA, 64 nt, Homo Sapiens
cuguggagcaagaaaggauuugcccuagggagguccuucagaauacugggacagaggcuacauc

SEQ ID NO: 340917 - RNA, 64 nt, Homo Sapiens
gcuucauggcaagacauaaaaugacacucaaaauccuucagaucuggaaaccggcucaguauua

SEQ ID NO: 340918 - RNA, 64 nt, Homo Sapiens
acagugguuggcuuugaugaacccucaugcugcaccuucagagccaguccucuaguuuggaaua

SEQ ID NO: 340919 - RNA, 64 nt, Homo Sapiens
gagaaccccuaugaguguaagcaauuugggaaagccuucagaucugucaaaaaucuucgauuuc

SEQ ID NO: 340920 - RNA, 64 nt, Homo Sapiens
gagaagcccuaugaauauaagcaaugugggaaagccuucagaucagccucgcaccuucaaaugc

SEQ ID NO: 340921 - RNA, 64 nt, Homo Sapiens
gagaaacccuaugaguguaagcaaugugggaaagccuucagaugugccccacaccuucgaaggc

SEQ ID NO: 340922 - RNA, 64 nt, Homo Sapiens
gagaaacccuaugaguguaaggaaugugggaaagccuucagaucugccucacaccuucaaauuc

SEQ ID NO: 340923 - RNA, 64 nt, Homo Sapiens
gagaaacccuaugaguguaagcaaugugggaaagccuucagaucugccucaauccuucaaaugc

SEQ ID NO: 340924 - RNA, 64 nt, Homo Sapiens
gagaagcccuacgaguguaagcaaugugggaaagccuucagaucugccccacaccuucgaaucc

SEQ ID NO: 340925 - RNA, 64 nt, Homo Sapiens
gagaaacccuaugaguguaaggaaugugggaaagccuucagaucugccaagaaccuucgaauuc

SEQ ID NO: 340926 - RNA, 64 nt, Homo Sapiens
gagaaacccuaugaguguaagcaauguggaaaaaccuucagaucuaccucacaccuucgaaaac

SEQ ID NO: 340927 - RNA, 64 nt, Homo Sapiens
ucagaucuuggggagaguccccucuaguuuguggccuucagaaaauuauuugacugugagacgu

SEQ ID NO: 340928 - RNA, 64 nt, Homo Sapiens
auuacauuccagauaauaugcuauacuugacuugccuucagaauaugccuuuuguuuuucucug

SEQ ID NO: 340929 - RNA, 64 nt, Homo Sapiens; identical to SEQ ID NO: 92137

SEQ ID NO: 340930 - RNA, 64 nt, Homo Sapiens; identical to SEQ ID NO: 92138

SEQ ID NO: 340931 - RNA, 64 nt, Homo Sapiens; identical to SEQ ID NO: 92139

SEQ ID NO: 340932 - RNA, 64 nt, Homo Sapiens; identical to SEQ ID NO: 92140

SEQ ID NO: 340933 - RNA, 64 nt, Homo Sapiens; identical to SEQ ID NO: 92141

SEQ ID NO: 340934 - RNA, 64 nt, Homo Sapiens; identical to SEQ ID NO: 92142

SEQ ID NO: 340935 - RNA, 64 nt, Homo Sapiens; identical to SEQ ID NO: 92143

SEQ ID NO: 340936 - RNA, 64 nt, Homo Sapiens; identical to SEQ ID NO: 92144

SEQ ID NO: 340937 - RNA, 64 nt, Homo Sapiens; identical to SEQ ID NO: 92145

SEQ ID NO: 340938 - RNA, 64 nt, Homo Sapiens; identical to SEQ ID NO: 92146

SEQ ID NO: 340939 - RNA, 64 nt, Homo Sapiens; identical to SEQ ID NO: 92147

SEQ ID NO: 340940 - RNA, 64 nt, Homo Sapiens; identical to SEQ ID NO: 92148

SEQ ID NO: 340941 - RNA, 64 nt, Homo Sapiens; identical to SEQ ID NO: 92149

SEQ ID NO: 340942 - RNA, 64 nt, Homo Sapiens; identical to SEQ ID NO: 92150

SEQ ID NO: 340943 - RNA, 64 nt, Homo Sapiens; identical to SEQ ID NO: 92151

SEQ ID NO: 340944 - RNA, 64 nt, Homo Sapiens; identical to SEQ ID NO: 92152

SEQ ID NO: 340945 - RNA, 64 nt, Homo Sapiens; identical to SEQ ID NO: 92153

SEQ ID NO: 340946 - RNA, 64 nt, Homo Sapiens; identical to SEQ ID NO: 92154

SEQ ID NO: 340947 - RNA, 64 nt, Homo Sapiens; identical to SEQ ID NO: 92155

SEQ ID NO: 340948 - RNA, 64 nt, Homo Sapiens; identical to SEQ ID NO: 92156

SEQ ID NO: 340949 - RNA, 64 nt, Homo Sapiens; identical to SEQ ID NO: 92157

SEQ ID NO: 340950 - RNA, 64 nt, Homo Sapiens; identical to SEQ ID NO: 92158

SEQ ID NO: 340951 - RNA, 64 nt, Homo Sapiens; identical to SEQ ID NO: 92159

SEQ ID NO: 340952 - RNA, 64 nt, Homo Sapiens; identical to SEQ ID NO: 92160

SEQ ID NO: 340953 - RNA, 64 nt, Homo Sapiens; identical to SEQ ID NO: 92161

SEQ ID NO: 340954 - RNA, 64 nt, Homo Sapiens; identical to SEQ ID NO: 92162

SEQ ID NO: 340955 - RNA, 64 nt, Homo Sapiens; identical to SEQ ID NO: 92163

SEQ ID NO: 340956 - RNA, 64 nt, Homo Sapiens; identical to SEQ ID NO: 92164

SEQ ID NO: 340957 - RNA, 64 nt, Homo Sapiens; identical to SEQ ID NO: 92165

SEQ ID NO: 340958 - RNA, 64 nt, Homo Sapiens; identical to SEQ ID NO: 92166

SEQ ID NO: 340959 - RNA, 64 nt, Homo Sapiens; identical to SEQ ID NO: 92167

SEQ ID NO: 340960 - RNA, 64 nt, Homo Sapiens; identical to SEQ ID NO: 92168

SEQ ID NO: 340961 - RNA, 64 nt, Homo Sapiens; identical to SEQ ID NO: 92169

SEQ ID NO: 340962 - RNA, 64 nt, Homo Sapiens; identical to SEQ ID NO: 92170

SEQ ID NO: 340963 - RNA, 64 nt, Homo Sapiens; identical to SEQ ID NO: 92171

SEQ ID NO: 340964 - RNA, 64 nt, Homo Sapiens; identical to SEQ ID NO: 92172

SEQ ID NO: 340965 - RNA, 64 nt, Homo Sapiens; identical to SEQ ID NO: 92173

SEQ ID NO: 340966 - RNA, 64 nt, Homo Sapiens; identical to SEQ ID NO: 92174

SEQ ID NO: 340967 - RNA, 64 nt, Homo Sapiens; identical to SEQ ID NO: 92175

SEQ ID NO: 340968 - RNA, 64 nt, Homo Sapiens; identical to SEQ ID NO: 92176

SEQ ID NO: 340969 - RNA, 64 nt, Homo Sapiens; identical to SEQ ID NO: 92177

SEQ ID NO: 340970 - RNA, 64 nt, Homo Sapiens; identical to SEQ ID NO: 92178

SEQ ID NO: 340971 - RNA, 64 nt, Homo Sapiens; identical to SEQ ID NO: 92179

SEQ ID NO: 340972 - RNA, 64 nt, Homo Sapiens; identical to SEQ ID NO: 92180

SEQ ID NO: 340973 - RNA, 64 nt, Homo Sapiens; identical to SEQ ID NO: 92181

SEQ ID NO: 340974 - RNA, 64 nt, Homo Sapiens; identical to SEQ ID NO: 92182

SEQ ID NO: 340975 - RNA, 64 nt, Homo Sapiens; identical to SEQ ID NO: 92183

SEQ ID NO: 340976 - RNA, 64 nt, Homo Sapiens; identical to SEQ ID NO: 92184

SEQ ID NO: 340977 - RNA, 64 nt, Homo Sapiens; identical to SEQ ID NO: 92185

SEQ ID NO: 340978 - RNA, 64 nt, Homo Sapiens; identical to SEQ ID NO: 92186

SEQ ID NO: 340979 - RNA, 64 nt, Homo Sapiens; identical to SEQ ID NO: 120942

SEQ ID NO: 340980 - RNA, 64 nt, Homo Sapiens; identical to SEQ ID NO: 120943

SEQ ID NO: 340981 - RNA, 64 nt, Homo Sapiens; identical to SEQ ID NO: 120944

SEQ ID NO: 340982 - RNA, 64 nt, Homo Sapiens; identical to SEQ ID NO: 120945

SEQ ID NO: 340983 - RNA, 64 nt, Homo Sapiens; identical to SEQ ID NO: 120946

SEQ ID NO: 340984 - RNA, 64 nt, Homo Sapiens; identical to SEQ ID NO: 120947

SEQ ID NO: 340985 - RNA, 64 nt, Homo Sapiens; identical to SEQ ID NO: 120948

SEQ ID NO: 340986 - RNA, 64 nt, Homo Sapiens; identical to SEQ ID NO: 120949

SEQ ID NO: 340987 - RNA, 64 nt, Homo Sapiens; identical to SEQ ID NO: 120950

SEQ ID NO: 340988 - RNA, 64 nt, Homo Sapiens; identical to SEQ ID NO: 120951

SEQ ID NO: 340989 - RNA, 64 nt, Homo Sapiens; identical to SEQ ID NO: 120952

SEQ ID NO: 340990 - RNA, 64 nt, Homo Sapiens; identical to SEQ ID NO: 120953

SEQ ID NO: 340991 - RNA, 64 nt, Homo Sapiens; identical to SEQ ID NO: 120954

SEQ ID NO: 340992 - RNA, 64 nt, Homo Sapiens; identical to SEQ ID NO: 120955

SEQ ID NO: 340993 - RNA, 64 nt, Homo Sapiens; identical to SEQ ID NO: 120956

SEQ ID NO: 340994 - RNA, 64 nt, Homo Sapiens; identical to SEQ ID NO: 120957

SEQ ID NO: 340995 - RNA, 64 nt, Homo Sapiens; identical to SEQ ID NO: 120958

SEQ ID NO: 340996 - RNA, 64 nt, Homo Sapiens; identical to SEQ ID NO: 120959

SEQ ID NO: 340997 - RNA, 64 nt, Homo Sapiens; identical to SEQ ID NO: 120960

SEQ ID NO: 340998 - RNA, 64 nt, Homo Sapiens; identical to SEQ ID NO: 120961

SEQ ID NO: 340999 - RNA, 64 nt, Homo Sapiens; identical to SEQ ID NO: 120962

SEQ ID NO: 341000 - RNA, 64 nt, Homo Sapiens; identical to SEQ ID NO: 120963

SEQ ID NO: 341001 - RNA, 64 nt, Homo Sapiens; identical to SEQ ID NO: 120964

SEQ ID NO: 341002 - RNA, 62 nt, Homo Sapiens; identical to SEQ ID NO: 120965

SEQ ID NO: 341003 - RNA, 64 nt, Homo Sapiens; identical to SEQ ID NO: 120966

SEQ ID NO: 341004 - RNA, 64 nt, Homo Sapiens; identical to SEQ ID NO: 120967

SEQ ID NO: 341005 - RNA, 64 nt, Homo Sapiens; identical to SEQ ID NO: 120968

SEQ ID NO: 341006 - RNA, 64 nt, Homo Sapiens; identical to SEQ ID NO: 120969

SEQ ID NO: 341007 - RNA, 64 nt, Homo Sapiens; identical to SEQ ID NO: 120970

SEQ ID NO: 341008 - RNA, 64 nt, Homo Sapiens; identical to SEQ ID NO: 120971

SEQ ID NO: 341009 - RNA, 64 nt, Homo Sapiens
cauugugcggauuaaaagaaauaauauauguaaagcacuuuaacacagcaccaggcccacggaa

SEQ ID NO: 341010 - RNA, 64 nt, Homo Sapiens
caaggggaucuuuggggcuaacuucgggaucccugcacuuuauguaagaauguaaaccuggagu

SEQ ID NO: 341011 - RNA, 64 nt, Homo Sapiens
uguuauagggaguaguuuuuucccuuaggacucugcacuuuauagaauguuguaaaacagacaa

SEQ ID NO: 341012 - RNA, 64 nt, Homo Sapiens
ggcugauaguuuuguuuaagguuuuggauaaggagcacuuuaaaacaaacugguguguuguuuu

SEQ ID NO: 341013 - RNA, 64 nt, Homo Sapiens
cuuauucucuagguucugagagugaaugcauugggcacuuuaaguugauauuuucucuucuccg

SEQ ID NO: 341014 - RNA, 64 nt, Homo Sapiens
aaguguccacaacaguuagggaaaugaugcuagagcacuuuaaaaaucagcaggacaacccuga

SEQ ID NO: 341015 - RNA, 64 nt, Homo Sapiens
uuucuaccugcauauggacuaacuugcuucuguugcacuuuaguuaagugaguacacucuaauu

SEQ ID NO: 341016 - RNA, 64 nt, Homo Sapiens
aaaagugaaagcgacaaauuugacauuuuauguagcacuuuauauguuuuuaaauuuggaaaua

SEQ ID NO: 341017 - RNA, 64 nt, Homo Sapiens
gaugcuagucuuugugaccgauugcuaaucuucugcacuuuaauuuauuuuauauaaacuuuac

SEQ ID NO: 341018 - RNA, 64 nt, Homo Sapiens
gacaaucaagaauguuauuaauguguaauacugagcacuuuacuucuuaauaaaaacuugauau

SEQ ID NO: 341019 - RNA, 64 nt, Homo Sapiens
uguaacaaacuuacaaggacaaagaggcuuguuggcacuuuacauauacaguguauacaugugu

SEQ ID NO: 341020 - RNA, 64 nt, Homo Sapiens
ucaaacgaagacauuccaauacugcuuaauuauagcacuuuauuuuuagcugcugaacugccaa

SEQ ID NO: 341021 - RNA, 64 nt, Homo Sapiens
cacaguuaugucuuauaacucuuuaauuugaaaugcacuuuaugaauuucucuccugaugggua

SEQ ID NO: 341022 - RNA, 64 nt, Homo Sapiens
uuucucuccugauggguacuguaccuuauguauugcacuuuaaagcaacuuugcacuauguaaa
